United States Patent 7,250,496 (BIOINFORMATICALLY DETECTABLE GROUP OF NOVEL REGULATORY GENES AND USES THEREOF) - sequence listing, part 10

SEQ ID NO: 377446 - RNA, 19 nt, Human
uggcugaacauauuucuug

SEQ ID NO: 377447 - RNA, 26 nt, Human
ugggauugagugguuaaaaaaaaaaa

SEQ ID NO: 377448 - RNA, 21 nt, Human
ugggccagagaggcuugcuug

SEQ ID NO: 377449 - RNA, 19 nt, Human
uggucugucuuccuauggg

SEQ ID NO: 377450 - RNA, 21 nt, Human
ugguggcucaggcucugggag

SEQ ID NO: 377451 - RNA, 20 nt, Human
ugugaagcugcccgugucgu

SEQ ID NO: 377452 - RNA, 18 nt, Human
ugugaguggcauccuggg

SEQ ID NO: 377453 - RNA, 22 nt, Human
ugugcaugccuuagaaaaagcc

SEQ ID NO: 377454 - RNA, 21 nt, Human
ugugguguauuuuuuguuuuu

SEQ ID NO: 377455 - RNA, 18 nt, Human
uguguccucuuucuugug

SEQ ID NO: 377456 - RNA, 23 nt, Human
ugugugugcaaggcacacacaua

SEQ ID NO: 377457 - RNA, 23 nt, Human
uuaaaagagcuguucauggaaua

SEQ ID NO: 377458 - RNA, 30 nt, Human
uuauuccagaaauuuuguuccaggucuggg

SEQ ID NO: 377459 - RNA, 20 nt, Human
uucauggaauaagaauaaaa

SEQ ID NO: 377460 - RNA, 18 nt, Human
uuccaggucuggacaagc

SEQ ID NO: 377461 - RNA, 24 nt, Human
uuccucagccugcaggcuacaaga

SEQ ID NO: 377462 - RNA, 19 nt, Human
uucuaaggauaagguaacu

SEQ ID NO: 377463 - RNA, 23 nt, Human
uugagugguuaaaaaaaaaaauc

SEQ ID NO: 377464 - RNA, 22 nt, Human
uuggaggacuauuuccaagaag

SEQ ID NO: 377465 - RNA, 20 nt, Human
uuggauggguccagggcuug

SEQ ID NO: 377466 - RNA, 24 nt, Human
uugggaugggggauuggucagcug

SEQ ID NO: 377467 - RNA, 21 nt, Human
uuuggaacuagacuccaauga

SEQ ID NO: 377468 - RNA, 28 nt, Human
uuuuggcugaacauauuucuugcuugag

SEQ ID NO: 377469 - RNA, 21 nt, Human
uuuuguguggacaggcugaag

SEQ ID NO: 377470 - RNA, 22 nt, Human
aaaaaauaacaauccaacaaga

SEQ ID NO: 377471 - RNA, 19 nt, Human
aaaaagaaccuucugaaca

SEQ ID NO: 377472 - RNA, 18 nt, Human
aaaagaacuauaaaccac

SEQ ID NO: 377473 - RNA, 21 nt, Human
aaaagccacccaacaucaaug

SEQ ID NO: 377474 - RNA, 20 nt, Human
aaaauaacuuuaaaguacag

SEQ ID NO: 377475 - RNA, 26 nt, Human
aaacaaaaaauaacaauccaacaaga

SEQ ID NO: 377476 - RNA, 19 nt, Human
aaagacaugaaagacccag

SEQ ID NO: 377477 - RNA, 26 nt, Human
aaagaugagaauguggggaaucugcu

SEQ ID NO: 377478 - RNA, 21 nt, Human
aaauguccuuuuacacuaucc

SEQ ID NO: 377479 - RNA, 21 nt, Human
aacaagagucauguuacccau

SEQ ID NO: 377480 - RNA, 21 nt, Human
aacaauaaaugcaggaagaaa

SEQ ID NO: 377481 - RNA, 24 nt, Human
aagaacaaaagccacccaacauca

SEQ ID NO: 377482 - RNA, 18 nt, Human
aagaaccuucugaacacu

SEQ ID NO: 377483 - RNA, 23 nt, Human
aagaacuauaaaccaccuaacaa

SEQ ID NO: 377484 - RNA, 24 nt, Human
aagcccuaucuuuuauugaaaaug

SEQ ID NO: 377485 - RNA, 19 nt, Human
aagggaaaaauacacucua

SEQ ID NO: 377486 - RNA, 20 nt, Human
acaagggagcaaaagcccua

SEQ ID NO: 377487 - RNA, 20 nt, Human
acaauccaacaagagucauu

SEQ ID NO: 377488 - RNA, 19 nt, Human
acccugggacucaggcaua

SEQ ID NO: 377489 - RNA, 23 nt, Human
acuaagaagagaugggcaaacaa

SEQ ID NO: 377490 - RNA, 23 nt, Human
acuacugggcgaaccacccaucg

SEQ ID NO: 377491 - RNA, 19 nt, Human
agacaugaaagacccagug

SEQ ID NO: 377492 - RNA, 20 nt, Human
aggaagaggcuggcuggagg

SEQ ID NO: 377493 - RNA, 19 nt, Human
agggcgccccacucagccu

SEQ ID NO: 377494 - RNA, 20 nt, Human
agguguaaaaacuagcuacc

SEQ ID NO: 377495 - RNA, 25 nt, Human
aguaauaaggccuauaaaagaagaa

SEQ ID NO: 377496 - RNA, 21 nt, Human
auagucucucuuguguuaaaa

SEQ ID NO: 377497 - RNA, 19 nt, Human
auuuauuuauuuauuuuug

SEQ ID NO: 377498 - RNA, 19 nt, Human
auuucucagugaaagaaca

SEQ ID NO: 377499 - RNA, 26 nt, Human
auuuuguugaaggaaugcauuggggg

SEQ ID NO: 377500 - RNA, 27 nt, Human
caaaagccacccaacaucaaugcuccc

SEQ ID NO: 377501 - RNA, 21 nt, Human
caacaauaaaugcaggaagaa

SEQ ID NO: 377502 - RNA, 21 nt, Human
caagaacaagggagcaaaagc

SEQ ID NO: 377503 - RNA, 25 nt, Human
cagcugaaggugcugcucucacguu

SEQ ID NO: 377504 - RNA, 23 nt, Human
cauacuccucugaacccccaaaa

SEQ ID NO: 377505 - RNA, 20 nt, Human
cauugggcuuuggcuuugau

SEQ ID NO: 377506 - RNA, 22 nt, Human
ccaaaagcaagggaaaaauaca

SEQ ID NO: 377507 - RNA, 22 nt, Human
ccacagcccugguguggagcac

SEQ ID NO: 377508 - RNA, 24 nt, Human
ccacccaacaucaaugcuccucuu

SEQ ID NO: 377509 - RNA, 21 nt, Human
cccaaaagcaagggaaaaaua

SEQ ID NO: 377510 - RNA, 22 nt, Human
cccauaauauuccuuucccuua

SEQ ID NO: 377511 - RNA, 21 nt, Human
ccccaaaagcaagggaaaaau

SEQ ID NO: 377512 - RNA, 21 nt, Human
ccuggccagguggaagcucca

SEQ ID NO: 377513 - RNA, 23 nt, Human
cuccucugaacccccaaaagcaa

SEQ ID NO: 377514 - RNA, 19 nt, Human
cugcaggaagaggcuggcu

SEQ ID NO: 377515 - RNA, 19 nt, Human
cuguggccauuccuaugca

SEQ ID NO: 377516 - RNA, 19 nt, Human
gaaagaacaaaagccaccc

SEQ ID NO: 377517 - RNA, 22 nt, Human
gaacccccaaaagcaagggaaa

SEQ ID NO: 377518 - RNA, 18 nt, Human
gaaggaaugcauuggggg

SEQ ID NO: 377519 - RNA, 19 nt, Human
gaccaaauacaaacaugag

SEQ ID NO: 377520 - RNA, 19 nt, Human
gaccuaaaguuccacuaag

SEQ ID NO: 377521 - RNA, 25 nt, Human
gaugcuucuuauaaauuccccauug

SEQ ID NO: 377522 - RNA, 20 nt, Human
gcaggaagaaaaacugcuga

SEQ ID NO: 377523 - RNA, 20 nt, Human
gcaggaagaggcuggcugga

SEQ ID NO: 377524 - RNA, 22 nt, Human
ggugugcuuauaauugcuggga

SEQ ID NO: 377525 - RNA, 18 nt, Human
gucuagauguguguagga

SEQ ID NO: 377526 - RNA, 23 nt, Human
gugaaagaacaaaagccacccaa

SEQ ID NO: 377527 - RNA, 20 nt, Human
gugcagcccuggggaacucg

SEQ ID NO: 377528 - RNA, 23 nt, Human
uaaacaagcaaauaauccagcca

SEQ ID NO: 377529 - RNA, 20 nt, Human
uaaaccaccuaacaagacuu

SEQ ID NO: 377530 - RNA, 21 nt, Human
uaaaugcaggaagaaaaacug

SEQ ID NO: 377531 - RNA, 21 nt, Human
uaacuuuuucucucugcauau

SEQ ID NO: 377532 - RNA, 22 nt, Human
uaaggaacuuuaucaugggcug

SEQ ID NO: 377533 - RNA, 23 nt, Human
uaccaaaaaguucagaaggcugg

SEQ ID NO: 377534 - RNA, 24 nt, Human
uagaacaacauugcaaaaggucac

SEQ ID NO: 377535 - RNA, 21 nt, Human
uagcuuagaacaacauugcaa

SEQ ID NO: 377536 - RNA, 19 nt, Human
uauaaaagaagaaaugaaa

SEQ ID NO: 377537 - RNA, 20 nt, Human
uccucugaacccccaaaagc

SEQ ID NO: 377538 - RNA, 18 nt, Human
ucuccauguggaguaggu

SEQ ID NO: 377539 - RNA, 20 nt, Human
ucugaacacuuacuuagcuu

SEQ ID NO: 377540 - RNA, 21 nt, Human
ugaaaagagaccuaaaguucc

SEQ ID NO: 377541 - RNA, 23 nt, Human
ugaaaagagaccuaaaguuccac

SEQ ID NO: 377542 - RNA, 24 nt, Human
ugaaaagagaccuaaaguuccacu

SEQ ID NO: 377543 - RNA, 24 nt, Human
ugaacaggccaaagaugagaaugu

SEQ ID NO: 377544 - RNA, 21 nt, Human
ugacagguuugacuuuccacc

SEQ ID NO: 377545 - RNA, 23 nt, Human
ugacuaaaauaacuuuaaaguac

SEQ ID NO: 377546 - RNA, 26 nt, Human
ugaggaccucaucacucuuccacagg

SEQ ID NO: 377547 - RNA, 19 nt, Human
ugaggagacuugaaaagag

SEQ ID NO: 377548 - RNA, 18 nt, Human
ugauuugcaaacuugaac

SEQ ID NO: 377549 - RNA, 18 nt, Human
ugcauugggggggcuuug

SEQ ID NO: 377550 - RNA, 22 nt, Human
ugccgcacccugggacucaggc

SEQ ID NO: 377551 - RNA, 18 nt, Human
ugcuuauaauugcuggga

SEQ ID NO: 377552 - RNA, 23 nt, Human
ugcuugcucagcuuaaucccaua

SEQ ID NO: 377553 - RNA, 19 nt, Human
uggauacaaagguaguuca

SEQ ID NO: 377554 - RNA, 20 nt, Human
uggcuggaggugagggcgcc

SEQ ID NO: 377555 - RNA, 24 nt, Human
ugggaccaaauacaaacaugagac

SEQ ID NO: 377556 - RNA, 19 nt, Human
ugggcgaaccacacugcaa

SEQ ID NO: 377557 - RNA, 23 nt, Human
uggucucuaaagagaccaauuuu

SEQ ID NO: 377558 - RNA, 21 nt, Human
uggugacucuggaaucuagag

SEQ ID NO: 377559 - RNA, 23 nt, Human
uguaauaauggucccuccaagaa

SEQ ID NO: 377560 - RNA, 22 nt, Human
uguacauacuccucugaacccc

SEQ ID NO: 377561 - RNA, 23 nt, Human
uguguaggaagauuuuaaaauuu

SEQ ID NO: 377562 - RNA, 21 nt, Human
uuagaacaacauugcaaaagu

SEQ ID NO: 377563 - RNA, 20 nt, Human
uuaguaccaaaaaguucaga

SEQ ID NO: 377564 - RNA, 22 nt, Human
uucaagucuaccagcucuguuu

SEQ ID NO: 377565 - RNA, 25 nt, Human
uugaugacggugaggaccucaucac

SEQ ID NO: 377566 - RNA, 18 nt, Human
uuucucagugaaagaaca

SEQ ID NO: 377567 - RNA, 27 nt, Human
aagaagcaagguugggaaaggaggagg

SEQ ID NO: 377568 - RNA, 21 nt, Human
accccauggcuccgggggccc

SEQ ID NO: 377569 - RNA, 19 nt, Human
agccagagcccggagcucc

SEQ ID NO: 377570 - RNA, 18 nt, Human
agcuggagccuuggggau

SEQ ID NO: 377571 - RNA, 19 nt, Human
aggagcagcgggagcgcgg

SEQ ID NO: 377572 - RNA, 21 nt, Human
agguugggaaaggaggaggcu

SEQ ID NO: 377573 - RNA, 19 nt, Human
augcugcacggccuggccu

SEQ ID NO: 377574 - RNA, 18 nt, Human
cacccggcaggagcagcg

SEQ ID NO: 377575 - RNA, 19 nt, Human
cacccggcaggagcagcgg

SEQ ID NO: 377576 - RNA, 21 nt, Human
cacugacgcuuccgaaaccgc

SEQ ID NO: 377577 - RNA, 24 nt, Human
cagcaauaacuuauaaggagacca

SEQ ID NO: 377578 - RNA, 20 nt, Human
cagccagagcccggagcucc

SEQ ID NO: 377579 - RNA, 21 nt, Human
caggagcccccgacaccccau

SEQ ID NO: 377580 - RNA, 23 nt, Human
cauggaaacacugacgcuuccga

SEQ ID NO: 377581 - RNA, 18 nt, Human
ccaacucgcccugcccag

SEQ ID NO: 377582 - RNA, 23 nt, Human
ccaaugaggcuccaguuccuccu

SEQ ID NO: 377583 - RNA, 22 nt, Human
cccaaugcccgugccggccacc

SEQ ID NO: 377584 - RNA, 21 nt, Human
ccccaggggcugcggggcucu

SEQ ID NO: 377585 - RNA, 19 nt, Human
ccccauggcuccgggggcc

SEQ ID NO: 377586 - RNA, 19 nt, Human
cccgugccggccaccagag

SEQ ID NO: 377587 - RNA, 27 nt, Human
cccuaagaagcaagguugggaaaggag

SEQ ID NO: 377588 - RNA, 22 nt, Human
cccugcccagcgaccuuccccg

SEQ ID NO: 377589 - RNA, 20 nt, Human
ccggccaccagagggcccuu

SEQ ID NO: 377590 - RNA, 23 nt, Human
ccuggccuccagcgagaggcaga

SEQ ID NO: 377591 - RNA, 22 nt, Human
cgaaacccccugugccucggcc

SEQ ID NO: 377592 - RNA, 23 nt, Human
gagaaggggcugcgggggcggcg

SEQ ID NO: 377593 - RNA, 19 nt, Human
gaggaggcugagagcagac

SEQ ID NO: 377594 - RNA, 22 nt, Human
gaguagcuggagccuuggggau

SEQ ID NO: 377595 - RNA, 20 nt, Human
gccccauuuauucacuucuc

SEQ ID NO: 377596 - RNA, 18 nt, Human
gccucggccgccugcagc

SEQ ID NO: 377597 - RNA, 19 nt, Human
gcggccucaccgcggucag

SEQ ID NO: 377598 - RNA, 18 nt, Human
ggacgugggagaaaggag

SEQ ID NO: 377599 - RNA, 20 nt, Human
ggaggagaaggggcugcggg

SEQ ID NO: 377600 - RNA, 22 nt, Human
ggcagauaggacgugggagaaa

SEQ ID NO: 377601 - RNA, 23 nt, Human
ggccaaugaggcuccaguuccuc

SEQ ID NO: 377602 - RNA, 19 nt, Human
ggcggcgggggcugccgcu

SEQ ID NO: 377603 - RNA, 21 nt, Human
gguugggaaaggaggaggcug

SEQ ID NO: 377604 - RNA, 20 nt, Human
guugggaaaggaggaggcug

SEQ ID NO: 377605 - RNA, 21 nt, Human
uaacauggaaacacugacgcu

SEQ ID NO: 377606 - RNA, 19 nt, Human
uaucugcaaccacguggga

SEQ ID NO: 377607 - RNA, 22 nt, Human
uccaguuccuccugucuucgau

SEQ ID NO: 377608 - RNA, 20 nt, Human
ucccaaugcccgugccggcc

SEQ ID NO: 377609 - RNA, 19 nt, Human
ucccagccagagcccggag

SEQ ID NO: 377610 - RNA, 23 nt, Human
ucggaucacccucuucccucgug

SEQ ID NO: 377611 - RNA, 21 nt, Human
ugcaggaggaggaggcugaga

SEQ ID NO: 377612 - RNA, 24 nt, Human
ugcugcacggccuggccuccagcg

SEQ ID NO: 377613 - RNA, 19 nt, Human
ugggaaaggaggaggcugg

SEQ ID NO: 377614 - RNA, 23 nt, Human
ugggaaaggaggaggcuguuucc

SEQ ID NO: 377615 - RNA, 18 nt, Human
ugggagaaaggaggagaa

SEQ ID NO: 377616 - RNA, 22 nt, Human
ugggagaaaggaggagaagggg

SEQ ID NO: 377617 - RNA, 20 nt, Human
uggggaugacuuuauccugc

SEQ ID NO: 377618 - RNA, 25 nt, Human
aacaaauaagcaauugacaccacca

SEQ ID NO: 377619 - RNA, 18 nt, Human
aacuaauuaucaaacaca

SEQ ID NO: 377620 - RNA, 21 nt, Human
aagcaauugacaccaccaaau

SEQ ID NO: 377621 - RNA, 24 nt, Human
aagcaauugacaccaccaaauucu

SEQ ID NO: 377622 - RNA, 19 nt, Human
aaggcugcaacuggccuga

SEQ ID NO: 377623 - RNA, 19 nt, Human
acaaaaagauaaucacaac

SEQ ID NO: 377624 - RNA, 22 nt, Human
accacaaaaagauaaucacaac

SEQ ID NO: 377625 - RNA, 24 nt, Human
accacaaaaagauaaucacaacaa

SEQ ID NO: 377626 - RNA, 22 nt, Human
caaaauauacacuaacuuaaaa

SEQ ID NO: 377627 - RNA, 22 nt, Human
caaauagauacacauucaacca

SEQ ID NO: 377628 - RNA, 21 nt, Human
caccacaaaaagauaaucaac

SEQ ID NO: 377629 - RNA, 22 nt, Human
cauagacauaacccugaagcuu

SEQ ID NO: 377630 - RNA, 22 nt, Human
cucuuucauuuugcuauaaagc

SEQ ID NO: 377631 - RNA, 23 nt, Human
cuggacaaccgugggaaaacaaa

SEQ ID NO: 377632 - RNA, 22 nt, Human
gaaaacaaauaagcaauugaca

SEQ ID NO: 377633 - RNA, 20 nt, Human
gagaaagaagcauuucaugu

SEQ ID NO: 377634 - RNA, 24 nt, Human
guuugcuucuacauaaauuucuau

SEQ ID NO: 377635 - RNA, 25 nt, Human
uacagugauaguuugcauuucuucu

SEQ ID NO: 377636 - RNA, 20 nt, Human
uauauucucuuuuuaagugg

SEQ ID NO: 377637 - RNA, 28 nt, Human
ucaaauagauacacauucaaccaauaaa

SEQ ID NO: 377638 - RNA, 22 nt, Human
ucaagauaaaagauuuauucac

SEQ ID NO: 377639 - RNA, 24 nt, Human
ucuuucauuuugcuauaaagcauu

SEQ ID NO: 377640 - RNA, 23 nt, Human
ugcuggacaaccgugggaaaaca

SEQ ID NO: 377641 - RNA, 19 nt, Human
uggcugagaaggcugcaac

SEQ ID NO: 377642 - RNA, 23 nt, Human
uucacaccacaaaaagauaauca

SEQ ID NO: 377643 - RNA, 23 nt, Human
uuuuuuuuuuuuuuuuuuuuagg

SEQ ID NO: 377644 - RNA, 26 nt, Human
acaaccuccucucuucuguguuccag

SEQ ID NO: 377645 - RNA, 18 nt, Human
acagacacccaggagccc

SEQ ID NO: 377646 - RNA, 20 nt, Human
acagcuggcugugccugagg

SEQ ID NO: 377647 - RNA, 20 nt, Human
acccaggagccccuucuccc

SEQ ID NO: 377648 - RNA, 23 nt, Human
accuccucucuucuguguuccag

SEQ ID NO: 377649 - RNA, 20 nt, Human
agacaccaauacccauaacc

SEQ ID NO: 377650 - RNA, 21 nt, Human
agagacacaaccuccucucuu

SEQ ID NO: 377651 - RNA, 18 nt, Human
aggaaggagacaucagag

SEQ ID NO: 377652 - RNA, 24 nt, Human
aggaaggagacaucagagugagga

SEQ ID NO: 377653 - RNA, 18 nt, Human
agggcagcaggcaugaau

SEQ ID NO: 377654 - RNA, 21 nt, Human
augagcaagagacacaaccuc

SEQ ID NO: 377655 - RNA, 21 nt, Human
caaaaagguucaggaagccaa

SEQ ID NO: 377656 - RNA, 21 nt, Human
cacagggcucugggguauguc

SEQ ID NO: 377657 - RNA, 21 nt, Human
caccagaucacucuuuccucu

SEQ ID NO: 377658 - RNA, 22 nt, Human
caggagccccuucucccagccu

SEQ ID NO: 377659 - RNA, 26 nt, Human
cccauaaccucucuccuaagccuccu

SEQ ID NO: 377660 - RNA, 19 nt, Human
ccuauggcagggugugggg

SEQ ID NO: 377661 - RNA, 25 nt, Human
ccuuaaguucuauuccuggggauag

SEQ ID NO: 377662 - RNA, 25 nt, Human
cguguauacagacacccaggagccc

SEQ ID NO: 377663 - RNA, 27 nt, Human
cuacccacaggcuugcuaugagcaaga

SEQ ID NO: 377664 - RNA, 20 nt, Human
cuaugugggcugggacaugu

SEQ ID NO: 377665 - RNA, 20 nt, Human
gaaggaaggagacaucagag

SEQ ID NO: 377666 - RNA, 24 nt, Human
ggaggggugguagauucugaagga

SEQ ID NO: 377667 - RNA, 20 nt, Human
uaaccucucuccuaagccuc

SEQ ID NO: 377668 - RNA, 20 nt, Human
uaagccuccuuauaacccag

SEQ ID NO: 377669 - RNA, 24 nt, Human
uaccgucugcccuuccucccaucc

SEQ ID NO: 377670 - RNA, 19 nt, Human
uagagacaccaauacccau

SEQ ID NO: 377671 - RNA, 24 nt, Human
uagagacaccaauacccauaaccu

SEQ ID NO: 377672 - RNA, 24 nt, Human
uauaacccagggugcacagcacag

SEQ ID NO: 377673 - RNA, 21 nt, Human
uccuaagccuccuuauaaccc

SEQ ID NO: 377674 - RNA, 27 nt, Human
ucuccuaagccuccuuauaacccaggg

SEQ ID NO: 377675 - RNA, 19 nt, Human
ucugcccuuccucccaucc

SEQ ID NO: 377676 - RNA, 21 nt, Human
ugaaggaaggagacaucagag

SEQ ID NO: 377677 - RNA, 22 nt, Human
ugaaggaaggagacaucagagu

SEQ ID NO: 377678 - RNA, 20 nt, Human
ugagggcagggcagcaggca

SEQ ID NO: 377679 - RNA, 19 nt, Human
uguauacagacacccagga

SEQ ID NO: 377680 - RNA, 27 nt, Human
uucccaccccuuaaguucuauuccccc

SEQ ID NO: 377681 - RNA, 23 nt, Human
uucuuuuccuguucuucccaccc

SEQ ID NO: 377682 - RNA, 22 nt, Human
uuuuuuuuuuuuaaaggacaau

SEQ ID NO: 377683 - RNA, 21 nt, Human
uuuuuuuuuuuuuaaaggaca

SEQ ID NO: 377684 - RNA, 20 nt, Human
uuuuuuuuuuuuuuaaagga

SEQ ID NO: 377685 - RNA, 23 nt, Human
uuuuuuuuuuuuuuuuuuaaagg

SEQ ID NO: 377686 - RNA, 19 nt, Human
agacagaaugcuaauugca

SEQ ID NO: 377687 - RNA, 22 nt, Human
cucaagggcauggcuguggacc

SEQ ID NO: 377688 - RNA, 23 nt, Human
cucugguacuaagaccuucagcu

SEQ ID NO: 377689 - RNA, 19 nt, Human
cucuucagaugaauucuga

SEQ ID NO: 377690 - RNA, 26 nt, Human
gaccuucagcuucauucagagacucu

SEQ ID NO: 377691 - RNA, 19 nt, Human
gcagaaugggauaggggau

SEQ ID NO: 377692 - RNA, 19 nt, Human
gucucucuucagaugaauu

SEQ ID NO: 377693 - RNA, 22 nt, Human
uaggaaagaaagcuucauagca

SEQ ID NO: 377694 - RNA, 22 nt, Human
ugaaagugaauuuaaugggggu

SEQ ID NO: 377695 - RNA, 23 nt, Human
ugggggagacagaaugcuaauug

SEQ ID NO: 377696 - RNA, 23 nt, Human
uuaagucucucuucagaugaauu

SEQ ID NO: 377697 - RNA, 20 nt, Human
uuuuuugggggagacagaau

SEQ ID NO: 377698 - RNA, 21 nt, Human
acaggcuaaggggaaagaagc

SEQ ID NO: 377699 - RNA, 19 nt, Human
agacagaagacaucaaaau

SEQ ID NO: 377700 - RNA, 24 nt, Human
agacagagacagaagacaucaaaa

SEQ ID NO: 377701 - RNA, 18 nt, Human
agcucugaaaggccggua

SEQ ID NO: 377702 - RNA, 20 nt, Human
agguggagcuguggaacgag

SEQ ID NO: 377703 - RNA, 24 nt, Human
cagcauggcagccucagaaaggaa

SEQ ID NO: 377704 - RNA, 18 nt, Human
caggaguuuaggagucau

SEQ ID NO: 377705 - RNA, 19 nt, Human
cagguucuccgaagcagau

SEQ ID NO: 377706 - RNA, 21 nt, Human
caucaugggcagaucacaggc

SEQ ID NO: 377707 - RNA, 21 nt, Human
gacaguggcagcauggcagcc

SEQ ID NO: 377708 - RNA, 23 nt, Human
uaccaggaguuuaggagucaugg

SEQ ID NO: 377709 - RNA, 21 nt, Human
ucccuggauggcuuugaugag

SEQ ID NO: 377710 - RNA, 19 nt, Human
ucccuguguaucccuggau

SEQ ID NO: 377711 - RNA, 25 nt, Human
ucugaaaggccgguacagcugagga

SEQ ID NO: 377712 - RNA, 21 nt, Human
ugaaagaaaagugacaauugc

SEQ ID NO: 377713 - RNA, 21 nt, Human
ugaaaggccgguacagcugag

SEQ ID NO: 377714 - RNA, 26 nt, Human
ugauggcacccaaagagaagggaguc

SEQ ID NO: 377715 - RNA, 23 nt, Human
uggacaguggcagcauggcagcc

SEQ ID NO: 377716 - RNA, 22 nt, Human
uggcagcauggcagccucagaa

SEQ ID NO: 377717 - RNA, 18 nt, Human
uguggaacgaggugagcc

SEQ ID NO: 377718 - RNA, 19 nt, Human
uucagggagugaaagaaaa

SEQ ID NO: 377719 - RNA, 19 nt, Human
uugauggcacccaaagaga

SEQ ID NO: 377720 - RNA, 22 nt, Human
uuugauggcacccaaagagaag

SEQ ID NO: 377721 - RNA, 23 nt, Human
agccgaagaccagaaaagccaug

SEQ ID NO: 377722 - RNA, 18 nt, Human
aggucgagguguucagcc

SEQ ID NO: 377723 - RNA, 24 nt, Human
agugugugugaacaaaagcuuuau

SEQ ID NO: 377724 - RNA, 19 nt, Human
aucuucagaugaacccuga

SEQ ID NO: 377725 - RNA, 20 nt, Human
cuucaaaggaugcuggaccu

SEQ ID NO: 377726 - RNA, 22 nt, Human
gcagccgaagaccagaaaagcc

SEQ ID NO: 377727 - RNA, 24 nt, Human
ggaaacaugcauuucuuuucauuc

SEQ ID NO: 377728 - RNA, 19 nt, Human
ggaauuaaaagcaauuuaa

SEQ ID NO: 377729 - RNA, 19 nt, Human
ucucaagggcuugucugug

SEQ ID NO: 377730 - RNA, 21 nt, Human
ugaacaaaagcuuuauaguac

SEQ ID NO: 377731 - RNA, 19 nt, Human
ugagcagccgaagaccaga

SEQ ID NO: 377732 - RNA, 23 nt, Human
ugagcagccgaagaccagaaaag

SEQ ID NO: 377733 - RNA, 18 nt, Human
ugggaagaggguguccag

SEQ ID NO: 377734 - RNA, 19 nt, Human
ugugcagagaaggucgagg

SEQ ID NO: 377735 - RNA, 20 nt, Human
ugugcagagaaggucgaggu

SEQ ID NO: 377736 - RNA, 23 nt, Human
ugugcugauuacaaggucuacag

SEQ ID NO: 377737 - RNA, 18 nt, Human
uucagccucugggaucug

SEQ ID NO: 377738 - RNA, 20 nt, Human
uucagccucugggaucuggu

SEQ ID NO: 377739 - RNA, 23 nt, Human
uucuuuucauucgaaucuucaga

SEQ ID NO: 377740 - RNA, 18 nt, Human
aaagagccaguacuucag

SEQ ID NO: 377741 - RNA, 23 nt, Human
aagcaaaagucaaauauuaccug

SEQ ID NO: 377742 - RNA, 24 nt, Human
aauuacucuuuauugaucaaauca

SEQ ID NO: 377743 - RNA, 23 nt, Human
acaauggcucuaagguccaaaca

SEQ ID NO: 377744 - RNA, 19 nt, Human
accugcagggauucucccu

SEQ ID NO: 377745 - RNA, 23 nt, Human
agggaagcgagaggagaagaggg

SEQ ID NO: 377746 - RNA, 19 nt, Human
caaaacucauuugcuucua

SEQ ID NO: 377747 - RNA, 20 nt, Human
caaaucaccaggaaucugcc

SEQ ID NO: 377748 - RNA, 18 nt, Human
caacaagguuucuuuuau

SEQ ID NO: 377749 - RNA, 19 nt, Human
caccuagaaagggcagccg

SEQ ID NO: 377750 - RNA, 22 nt, Human
caccuagaaagggcagccggaa

SEQ ID NO: 377751 - RNA, 22 nt, Human
caccuagaaagggcagccggaa

SEQ ID NO: 377752 - RNA, 21 nt, Human
caggaaagagccaguacuuca

SEQ ID NO: 377753 - RNA, 24 nt, Human
caggaaagagccaguacuucagua

SEQ ID NO: 377754 - RNA, 24 nt, Human
cagguccuccuuucccagucauca

SEQ ID NO: 377755 - RNA, 22 nt, Human
ccaagugaugaacaaauauccc

SEQ ID NO: 377756 - RNA, 22 nt, Human
ccccaaaguucaaaauguuacu

SEQ ID NO: 377757 - RNA, 23 nt, Human
ccccgugcaaagaaaaaucccuc

SEQ ID NO: 377758 - RNA, 21 nt, Human
uaacagagaccaagucagaug

SEQ ID NO: 377759 - RNA, 19 nt, Human
uacuuuggcaagagaaaac

SEQ ID NO: 377760 - RNA, 23 nt, Human
ucagacaaguugcucaauucuug

SEQ ID NO: 377761 - RNA, 19 nt, Human
uccaaaacucauuugcuuc

SEQ ID NO: 377762 - RNA, 20 nt, Human
uccgugauuguggacaaugg

SEQ ID NO: 377763 - RNA, 24 nt, Human
ucuugagaaccauccgugauugug

SEQ ID NO: 377764 - RNA, 24 nt, Human
ugaacaaauauccccccaaaguuc

SEQ ID NO: 377765 - RNA, 22 nt, Human
ugaagcaaaagucaaauauuac

SEQ ID NO: 377766 - RNA, 26 nt, Human
ugaucaaaucaccaggaaucugccgc

SEQ ID NO: 377767 - RNA, 21 nt, Human
ugcaaagaaaaaucccucaac

SEQ ID NO: 377768 - RNA, 23 nt, Human
ugcucugccucucccaguccuua

SEQ ID NO: 377769 - RNA, 21 nt, Human
ugggcucugaggcuugcucug

SEQ ID NO: 377770 - RNA, 19 nt, Human
ugggcugauuccaaucacc

SEQ ID NO: 377771 - RNA, 22 nt, Human
uucccagucaucagacaaguug

SEQ ID NO: 377772 - RNA, 21 nt, Human
uucuuguccagagcaggaaag

SEQ ID NO: 377773 - RNA, 22 nt, Human
uugaucaaaucaccaggaaucu

SEQ ID NO: 377774 - RNA, 24 nt, Human
uuguggacaauggcucuaaggucc

SEQ ID NO: 377775 - RNA, 26 nt, Human
uuuuuuuuuuuuuuuuuuuaguuuuu

SEQ ID NO: 377776 - RNA, 19 nt, Human
aaccuggcaagauaaaaug

SEQ ID NO: 377777 - RNA, 30 nt, Human
acacaagcacacacacacacacacacacag

SEQ ID NO: 377778 - RNA, 23 nt, Human
acacacacacacacacacacaca

SEQ ID NO: 377779 - RNA, 23 nt, Human
acacacacacacacacacacaca

SEQ ID NO: 377780 - RNA, 23 nt, Human
acacacacacacacacacacaca

SEQ ID NO: 377781 - RNA, 23 nt, Human
acacacacacacacacacacaca

SEQ ID NO: 377782 - RNA, 23 nt, Human
acacacacacacacacacacacg

SEQ ID NO: 377783 - RNA, 25 nt, Human
acacacacacacacacacgaggcca

SEQ ID NO: 377784 - RNA, 22 nt, Human
accucuugcuugguccuagaau

SEQ ID NO: 377785 - RNA, 20 nt, Human
agaaacguuaaguauguggg

SEQ ID NO: 377786 - RNA, 21 nt, Human
agaaccuggcaagauaaaaug

SEQ ID NO: 377787 - RNA, 18 nt, Human
agagagaaauaauucaaa

SEQ ID NO: 377788 - RNA, 24 nt, Human
auaaaaauagaaacuuugacaccc

SEQ ID NO: 377789 - RNA, 23 nt, Human
caaacacaagcacacacacacac

SEQ ID NO: 377790 - RNA, 31 nt, Human
caaacacaagcacacacacacacacacacag

SEQ ID NO: 377791 - RNA, 24 nt, Human
cacacaaacacaagcacacacaca

SEQ ID NO: 377792 - RNA, 20 nt, Human
cacacacacacacacacaca

SEQ ID NO: 377793 - RNA, 20 nt, Human
cacacacacacacacacaca

SEQ ID NO: 377794 - RNA, 20 nt, Human
cacacacacacacacacaca

SEQ ID NO: 377795 - RNA, 20 nt, Human
cacacacacacacacacaca

SEQ ID NO: 377796 - RNA, 20 nt, Human
cacacacacacacacacaca

SEQ ID NO: 377797 - RNA, 20 nt, Human
cacacacacacacacacaca

SEQ ID NO: 377798 - RNA, 20 nt, Human
cacacacacacacacacaca

SEQ ID NO: 377799 - RNA, 20 nt, Human
cacacacacacacacacaca

SEQ ID NO: 377800 - RNA, 22 nt, Human
cacacacacacacacacacaca

SEQ ID NO: 377801 - RNA, 22 nt, Human
cacacacacacacacacacaca

SEQ ID NO: 377802 - RNA, 26 nt, Human
cacacacacacacacacacacacaca

SEQ ID NO: 377803 - RNA, 26 nt, Human
cacacacacacacacacacacacaca

SEQ ID NO: 377804 - RNA, 26 nt, Human
cacacacacacacacacacacacaca

SEQ ID NO: 377805 - RNA, 26 nt, Human
cacacacacacacacacacacacaca

SEQ ID NO: 377806 - RNA, 26 nt, Human
cacacacacacacacacacacacaca

SEQ ID NO: 377807 - RNA, 24 nt, Human
cagaaauauagaagcucaacauuu

SEQ ID NO: 377808 - RNA, 24 nt, Human
ccacuccuccaacucuauuaaccu

SEQ ID NO: 377809 - RNA, 22 nt, Human
ccaucagccauacacaaucgac

SEQ ID NO: 377810 - RNA, 19 nt, Human
cccaguaaauuucccacga

SEQ ID NO: 377811 - RNA, 24 nt, Human
ccccaaaaaauauuuuuaaaaaga

SEQ ID NO: 377812 - RNA, 18 nt, Human
cuagaaucccaucagcca

SEQ ID NO: 377813 - RNA, 23 nt, Human
cuggcaagauaaaaugugucaga

SEQ ID NO: 377814 - RNA, 20 nt, Human
gaaccuggcaagauaaaaug

SEQ ID NO: 377815 - RNA, 21 nt, Human
gagaaauaauucaaauggaac

SEQ ID NO: 377816 - RNA, 25 nt, Human
gcacacacacacacacacacacaca

SEQ ID NO: 377817 - RNA, 19 nt, Human
ggaaaaaaaaaaaaccucu

SEQ ID NO: 377818 - RNA, 19 nt, Human
gggaaaaaaaaaaaaccuc

SEQ ID NO: 377819 - RNA, 26 nt, Human
uaaaaauagaaacuuugacaccccuc

SEQ ID NO: 377820 - RNA, 26 nt, Human
uaaauguaauaugcacacaaacacaa

SEQ ID NO: 377821 - RNA, 19 nt, Human
uaauaugcacacaaacaca

SEQ ID NO: 377822 - RNA, 22 nt, Human
uacaguaaaauuagcugcccac

SEQ ID NO: 377823 - RNA, 22 nt, Human
uagcuuccacuccuccaacucu

SEQ ID NO: 377824 - RNA, 24 nt, Human
uaugcacacaaacacaagcacaca

SEQ ID NO: 377825 - RNA, 21 nt, Human
ucccagaaauauagaagcuuc

SEQ ID NO: 377826 - RNA, 18 nt, Human
uccuaaagguuuagaacc

SEQ ID NO: 377827 - RNA, 19 nt, Human
ugcacacaaacacaagcac

SEQ ID NO: 377828 - RNA, 23 nt, Human
ugcacacaaacacaagcacacac

SEQ ID NO: 377829 - RNA, 18 nt, Human
uggcaagauaaaaugugu

SEQ ID NO: 377830 - RNA, 22 nt, Human
uggcaagauaaaaugugucaga

SEQ ID NO: 377831 - RNA, 19 nt, Human
ugugggggaaaaaaaaaaa

SEQ ID NO: 377832 - RNA, 19 nt, Human
ugugggggaaaaaaaaaaa

SEQ ID NO: 377833 - RNA, 24 nt, Human
uugcuugguccuagaaucccauca

SEQ ID NO: 377834 - RNA, 22 nt, Human
uuuaaacacauuccaaaguuua

SEQ ID NO: 377835 - RNA, 18 nt, Human
aagcagcgaggggugggu

SEQ ID NO: 377836 - RNA, 22 nt, Human
agacacagaucugggucccaca

SEQ ID NO: 377837 - RNA, 26 nt, Human
caaggcgacgcagggcaagcagcgag

SEQ ID NO: 377838 - RNA, 21 nt, Human
cagaggagcggacaugcagca

SEQ ID NO: 377839 - RNA, 19 nt, Human
cagggcaagcagcgagggg

SEQ ID NO: 377840 - RNA, 21 nt, Human
cgacgcagggcaagcagcgag

SEQ ID NO: 377841 - RNA, 19 nt, Human
gcaagcagcgagggguggg

SEQ ID NO: 377842 - RNA, 19 nt, Human
gcaaggcgacgcagggcaa

SEQ ID NO: 377843 - RNA, 24 nt, Human
gcgaggggugggugacccagggag

SEQ ID NO: 377844 - RNA, 18 nt, Human
gcgugggugcgucgggcc

SEQ ID NO: 377845 - RNA, 25 nt, Human
ggaaugagggcagcugcuucaagaa

SEQ ID NO: 377846 - RNA, 22 nt, Human
ggagccuccgcggccuccgcuc

SEQ ID NO: 377847 - RNA, 19 nt, Human
gggcaagcagcgaggggug

SEQ ID NO: 377848 - RNA, 25 nt, Human
uccuaagucuuauuccaagcuaagc

SEQ ID NO: 377849 - RNA, 22 nt, Human
ucggcucucggggggugagggg

SEQ ID NO: 377850 - RNA, 19 nt, Human
ucugaagucggaaugaggg

SEQ ID NO: 377851 - RNA, 22 nt, Human
ugaagcaccauuuucuccuaag

SEQ ID NO: 377852 - RNA, 24 nt, Human
ugacuggaccggaagcggguuagu

SEQ ID NO: 377853 - RNA, 24 nt, Human
ugcugaaggaccgaggagccuccg

SEQ ID NO: 377854 - RNA, 24 nt, Human
uuagugaagcaccauuuucuccua

SEQ ID NO: 377855 - RNA, 18 nt, Human
aaaacuaauaacgucaug

SEQ ID NO: 377856 - RNA, 19 nt, Human
aagaacaccucagugagga

SEQ ID NO: 377857 - RNA, 20 nt, Human
agcaggcucuuagcagcucc

SEQ ID NO: 377858 - RNA, 20 nt, Human
agcucaucucgccuccaccu

SEQ ID NO: 377859 - RNA, 24 nt, Human
agguggcugcagggauguggggag

SEQ ID NO: 377860 - RNA, 25 nt, Human
agguggcugcagggauguggggagg

SEQ ID NO: 377861 - RNA, 21 nt, Human
caugucacugggcuggccugu

SEQ ID NO: 377862 - RNA, 21 nt, Human
cccucauguaaauggugauau

SEQ ID NO: 377863 - RNA, 21 nt, Human
cccugggacugaagcggggcc

SEQ ID NO: 377864 - RNA, 18 nt, Human
cuggccuguuuccucugc

SEQ ID NO: 377865 - RNA, 20 nt, Human
gaggacguagccugcucugc

SEQ ID NO: 377866 - RNA, 25 nt, Human
gaggauggagggcggggcugcgcag

SEQ ID NO: 377867 - RNA, 22 nt, Human
gcccugggacugaagcggggcc

SEQ ID NO: 377868 - RNA, 24 nt, Human
ggagguggcugcagggaugugggg

SEQ ID NO: 377869 - RNA, 19 nt, Human
ggauggagggcggggcugc

SEQ ID NO: 377870 - RNA, 21 nt, Human
gggaggauggagggcggggcu

SEQ ID NO: 377871 - RNA, 21 nt, Human
uccucugcgcuguggggagga

SEQ ID NO: 377872 - RNA, 24 nt, Human
ucuggcugcagugacucccaggaa

SEQ ID NO: 377873 - RNA, 19 nt, Human
ugaagcggggccacccgag

SEQ ID NO: 377874 - RNA, 22 nt, Human
ugagagggcucuggcugcagug

SEQ ID NO: 377875 - RNA, 22 nt, Human
ugcgcuguggggaggaguggag

SEQ ID NO: 377876 - RNA, 19 nt, Human
ugcugggagguggcugcag

SEQ ID NO: 377877 - RNA, 21 nt, Human
uggagggcggggcugcgcagc

SEQ ID NO: 377878 - RNA, 19 nt, Human
uggcugcagggaugugggg

SEQ ID NO: 377879 - RNA, 20 nt, Human
uggggaggauggagggcggg

SEQ ID NO: 377880 - RNA, 25 nt, Human
uguaaauggugauauauuuauacaa

SEQ ID NO: 377881 - RNA, 18 nt, Human
aaaagguaagagaagggc

SEQ ID NO: 377882 - RNA, 24 nt, Human
aaaagguaagagaagggcaggagg

SEQ ID NO: 377883 - RNA, 22 nt, Human
aaagguaagagaagggcaggag

SEQ ID NO: 377884 - RNA, 22 nt, Human
aacugucucagcugcuccucca

SEQ ID NO: 377885 - RNA, 20 nt, Human
acaggagagaaucuccuggu

SEQ ID NO: 377886 - RNA, 26 nt, Human
acauugaggaacauuaggcacagaga

SEQ ID NO: 377887 - RNA, 19 nt, Human
aggaggugaaggaaaggag

SEQ ID NO: 377888 - RNA, 29 nt, Human
agggcaggaggugaaggaaaggggacccc

SEQ ID NO: 377889 - RNA, 21 nt, Human
agguaagagaagggcaggagg

SEQ ID NO: 377890 - RNA, 19 nt, Human
cacuggcaguaagcaaggc

SEQ ID NO: 377891 - RNA, 21 nt, Human
cagcugcuccuccacaucagc

SEQ ID NO: 377892 - RNA, 21 nt, Human
ccagguacagucugucaugcc

SEQ ID NO: 377893 - RNA, 22 nt, Human
ccccaaaccccuugcacuuccu

SEQ ID NO: 377894 - RNA, 23 nt, Human
ccccaccccccccgaaaugcucu

SEQ ID NO: 377895 - RNA, 26 nt, Human
ccccccccgaaaugcucuauaaauua

SEQ ID NO: 377896 - RNA, 20 nt, Human
cccggggaugggguguuaau

SEQ ID NO: 377897 - RNA, 18 nt, Human
cccuaugggugugggacc

SEQ ID NO: 377898 - RNA, 18 nt, Human
cuccuccacaucagcucc

SEQ ID NO: 377899 - RNA, 23 nt, Human
cuggaauuucacugaaaagguaa

SEQ ID NO: 377900 - RNA, 21 nt, Human
gagaaucuccuggucugccag

SEQ ID NO: 377901 - RNA, 18 nt, Human
gaguugaugcccugcccu

SEQ ID NO: 377902 - RNA, 28 nt, Human
ggcaggaggugaaggaaagggggacccc

SEQ ID NO: 377903 - RNA, 24 nt, Human
guauuugggcaagaguguccuguu

SEQ ID NO: 377904 - RNA, 18 nt, Human
uaagagaagggcaggagg

SEQ ID NO: 377905 - RNA, 20 nt, Human
uacagucugucaugccuucc

SEQ ID NO: 377906 - RNA, 22 nt, Human
uaggaaaggaaaauccccaaac

SEQ ID NO: 377907 - RNA, 28 nt, Human
ucagcuccuucuuagaguucucccgggg

SEQ ID NO: 377908 - RNA, 21 nt, Human
ucagcugcuccuccacaucag

SEQ ID NO: 377909 - RNA, 21 nt, Human
uccccaaaccccuugcacuuc

SEQ ID NO: 377910 - RNA, 24 nt, Human
ugcaaaaagugcaguauuugggca

SEQ ID NO: 377911 - RNA, 19 nt, Human
ugcccugcccugcuucagc

SEQ ID NO: 377912 - RNA, 22 nt, Human
ugcccugcccugcuucagcuca

SEQ ID NO: 377913 - RNA, 22 nt, Human
ugggugugggacccaaugaauc

SEQ ID NO: 377914 - RNA, 20 nt, Human
uguccuguuuuuccagguaa

SEQ ID NO: 377915 - RNA, 21 nt, Human
uucacugaaaagguaagagaa

SEQ ID NO: 377916 - RNA, 22 nt, Human
uuuccagguacagucugucaug

SEQ ID NO: 377917 - RNA, 18 nt, Human
aaacagcagaagagaagg

SEQ ID NO: 377918 - RNA, 19 nt, Human
aacaacacaccuggaagcc

SEQ ID NO: 377919 - RNA, 29 nt, Human
aaccagaaggcagaaggcgaggggacccc

SEQ ID NO: 377920 - RNA, 21 nt, Human
accguggugagggacagaggc

SEQ ID NO: 377921 - RNA, 21 nt, Human
accugggucccaccaccaguc

SEQ ID NO: 377922 - RNA, 23 nt, Human
agaggcugcgguuggcugcucag

SEQ ID NO: 377923 - RNA, 21 nt, Human
agaggggguuaccuggguccc

SEQ ID NO: 377924 - RNA, 21 nt, Human
cacaccguggugagggacaga

SEQ ID NO: 377925 - RNA, 21 nt, Human
caccuccuuggccagacucaa

SEQ ID NO: 377926 - RNA, 18 nt, Human
cagaaggcgagugcccuc

SEQ ID NO: 377927 - RNA, 18 nt, Human
cagcaggcaguuguccug

SEQ ID NO: 377928 - RNA, 20 nt, Human
cagugacaguuccuggugaa

SEQ ID NO: 377929 - RNA, 21 nt, Human
caguuuccugaacggagggag

SEQ ID NO: 377930 - RNA, 22 nt, Human
ccccagggccugcuucagcucu

SEQ ID NO: 377931 - RNA, 25 nt, Human
ccccgaacaacacaccuggaagcca

SEQ ID NO: 377932 - RNA, 20 nt, Human
cccgaacaacacaccuggaa

SEQ ID NO: 377933 - RNA, 20 nt, Human
ccugggucccaccaccaguc

SEQ ID NO: 377934 - RNA, 19 nt, Human
ccugugcuccgcucuccuu

SEQ ID NO: 377935 - RNA, 21 nt, Human
cgaacaacacaccuggaagcc

SEQ ID NO: 377936 - RNA, 21 nt, Human
cuagcagcaggcaguuguccu

SEQ ID NO: 377937 - RNA, 22 nt, Human
cugcgccucugacugucaucug

SEQ ID NO: 377938 - RNA, 22 nt, Human
cuggaguuacagggugggggug

SEQ ID NO: 377939 - RNA, 21 nt, Human
cuguccccgaacaacacacug

SEQ ID NO: 377940 - RNA, 18 nt, Human
gagauggaguggcagcug

SEQ ID NO: 377941 - RNA, 22 nt, Human
gcaggggcagccacuccccaca

SEQ ID NO: 377942 - RNA, 18 nt, Human
ggagauggaguggcagcu

SEQ ID NO: 377943 - RNA, 23 nt, Human
ggaguuacagggugggggugggg

SEQ ID NO: 377944 - RNA, 28 nt, Human
ggaguuacaggguggggguggggaggga

SEQ ID NO: 377945 - RNA, 22 nt, Human
gggggugggagaggggguuacc

SEQ ID NO: 377946 - RNA, 18 nt, Human
ggggguggggagggaggg

SEQ ID NO: 377947 - RNA, 19 nt, Human
gggguggggagggagggcu

SEQ ID NO: 377948 - RNA, 23 nt, Human
gguggggguggggagggagggcu

SEQ ID NO: 377949 - RNA, 18 nt, Human
gguuaccugggucccacc

SEQ ID NO: 377950 - RNA, 19 nt, Human
gucccuggcaguuuccuga

SEQ ID NO: 377951 - RNA, 20 nt, Human
guggugagggacagaggcac

SEQ ID NO: 377952 - RNA, 18 nt, Human
guuacagggugggggugg

SEQ ID NO: 377953 - RNA, 25 nt, Human
guugaccuuggcaacagacccuagc

SEQ ID NO: 377954 - RNA, 21 nt, Human
uacaggguggggguggggagg

SEQ ID NO: 377955 - RNA, 20 nt, Human
ucaaggcgguggcugucccc

SEQ ID NO: 377956 - RNA, 25 nt, Human
uccacaccguggugagggacagagg

SEQ ID NO: 377957 - RNA, 18 nt, Human
uccccgaacaacacaccu

SEQ ID NO: 377958 - RNA, 23 nt, Human
uccccgaacaacacaccuggaag

SEQ ID NO: 377959 - RNA, 18 nt, Human
ugaacggagggagggagu

SEQ ID NO: 377960 - RNA, 21 nt, Human
ugagagcagcuggagauggag

SEQ ID NO: 377961 - RNA, 22 nt, Human
ugagggacagaggcacgaggcu

SEQ ID NO: 377962 - RNA, 23 nt, Human
ugcuccgcucuccuuguggccaa

SEQ ID NO: 377963 - RNA, 21 nt, Human
uggaauuaaacagcagaagag

SEQ ID NO: 377964 - RNA, 24 nt, Human
uggcaacagacccuagcagcaggc

SEQ ID NO: 377965 - RNA, 23 nt, Human
ugggagaggggguuaccuggguc

SEQ ID NO: 377966 - RNA, 23 nt, Human
ugguaggcggcuuccugcuccug

SEQ ID NO: 377967 - RNA, 22 nt, Human
acccaaucccccgacuccccag

SEQ ID NO: 377968 - RNA, 18 nt, Human
acuggcccccugcccacc

SEQ ID NO: 377969 - RNA, 20 nt, Human
agacgagaugugucaggucc

SEQ ID NO: 377970 - RNA, 25 nt, Human
agacgagaugugucagguccugggg

SEQ ID NO: 377971 - RNA, 25 nt, Human
aggggggaggagagaggaaaacagu

SEQ ID NO: 377972 - RNA, 24 nt, Human
caacccaaucccccgacuccccag

SEQ ID NO: 377973 - RNA, 22 nt, Human
cacaacccaaucccccgacucc

SEQ ID NO: 377974 - RNA, 25 nt, Human
cacaacccaaucccccgacucccca

SEQ ID NO: 377975 - RNA, 24 nt, Human
caccagcgcccccgugcccauccc

SEQ ID NO: 377976 - RNA, 21 nt, Human
caccccagcuucuuggggcag

SEQ ID NO: 377977 - RNA, 22 nt, Human
cacccccgggccccagcggcuu

SEQ ID NO: 377978 - RNA, 21 nt, Human
caccgccccacacccccgggc

SEQ ID NO: 377979 - RNA, 20 nt, Human
cacuccccccucccagacag

SEQ ID NO: 377980 - RNA, 19 nt, Human
cagacagagaucaaggcag

SEQ ID NO: 377981 - RNA, 18 nt, Human
cagccugauccgcaugcg

SEQ ID NO: 377982 - RNA, 22 nt, Human
cagcgucgcugucuccgcugcu

SEQ ID NO: 377983 - RNA, 25 nt, Human
cagcucggccccgccggcccgcggc

SEQ ID NO: 377984 - RNA, 25 nt, Human
caugcaggggugggcuuccccucgc

SEQ ID NO: 377985 - RNA, 20 nt, Human
ccacacccccgggccccagc

SEQ ID NO: 377986 - RNA, 18 nt, Human
ccacaccgccccacaccc

SEQ ID NO: 377987 - RNA, 18 nt, Human
cccacaacccaauccccc

SEQ ID NO: 377988 - RNA, 21 nt, Human
cccacaacccaaucccccgac

SEQ ID NO: 377989 - RNA, 21 nt, Human
cccacacccccgggccccagc

SEQ ID NO: 377990 - RNA, 19 nt, Human
ccccacacccccgggcccc

SEQ ID NO: 377991 - RNA, 21 nt, Human
ccccacacccccgggccccag

SEQ ID NO: 377992 - RNA, 20 nt, Human
ccccaucaagcucaguuauu

SEQ ID NO: 377993 - RNA, 23 nt, Human
cccccagcaccuggggugggggu

SEQ ID NO: 377994 - RNA, 20 nt, Human
ccccgggccccagcggcuuc

SEQ ID NO: 377995 - RNA, 18 nt, Human
ccccucccagacagagau

SEQ ID NO: 377996 - RNA, 24 nt, Human
ccccucccagacagagaucaaggc

SEQ ID NO: 377997 - RNA, 23 nt, Human
ccccucgccccuccccucaugaa

SEQ ID NO: 377998 - RNA, 21 nt, Human
cccggcccagcccggcucagc

SEQ ID NO: 377999 - RNA, 19 nt, Human
cccgugcccaucccuaggg

SEQ ID NO: 378000 - RNA, 22 nt, Human
cccucccugcccccuagcaccc

SEQ ID NO: 378001 - RNA, 24 nt, Human
cccugcccacccccaucaagcuca

SEQ ID NO: 378002 - RNA, 25 nt, Human
ccgccacaccgccccacacccccgg

SEQ ID NO: 378003 - RNA, 18 nt, Human
ccgcggccgccagcgucg

SEQ ID NO: 378004 - RNA, 19 nt, Human
ccggcccgcggcucagccu

SEQ ID NO: 378005 - RNA, 21 nt, Human
ccggugcccaccaugucacgc

SEQ ID NO: 378006 - RNA, 23 nt, Human
ccuagcacccuggaugguccagg

SEQ ID NO: 378007 - RNA, 21 nt, Human
ccucccugcccccuagcaccc

SEQ ID NO: 378008 - RNA, 24 nt, Human
ccugauccgcaugcgccgccgcgc

SEQ ID NO: 378009 - RNA, 18 nt, Human
cgaccgcccucccugucg

SEQ ID NO: 378010 - RNA, 18 nt, Human
cgccgcgaccgaccgccc

SEQ ID NO: 378011 - RNA, 24 nt, Human
cgcgaccgaccgcccucccugucg

SEQ ID NO: 378012 - RNA, 21 nt, Human
cgcugucuccgcugcucgccg

SEQ ID NO: 378013 - RNA, 19 nt, Human
cuagggccccuucacuccc

SEQ ID NO: 378014 - RNA, 26 nt, Human
cucgccgcgaccgaccgcccucccug

SEQ ID NO: 378015 - RNA, 21 nt, Human
cugggggcuuggcucaacugg

SEQ ID NO: 378016 - RNA, 20 nt, Human
cuuuccggugcccaccaugu

SEQ ID NO: 378017 - RNA, 18 nt, Human
gacccccagcaccugggg

SEQ ID NO: 378018 - RNA, 20 nt, Human
gagaucgacguuuugcaaaa

SEQ ID NO: 378019 - RNA, 23 nt, Human
gcagcaaucuccccaccacuucu

SEQ ID NO: 378020 - RNA, 21 nt, Human
gcaggagaaguccccuccuuu

SEQ ID NO: 378021 - RNA, 24 nt, Human
gcccccaccaccccagcuucuugg

SEQ ID NO: 378022 - RNA, 18 nt, Human
gccuucgcggaugcgggg

SEQ ID NO: 378023 - RNA, 22 nt, Human
gcuagggccccuucacuccccc

SEQ ID NO: 378024 - RNA, 19 nt, Human
gcucaacuggcccccugcc

SEQ ID NO: 378025 - RNA, 21 nt, Human
ggaggggggaggagagaggaa

SEQ ID NO: 378026 - RNA, 23 nt, Human
ggccauggggacugcccacaacc

SEQ ID NO: 378027 - RNA, 20 nt, Human
ggcggagugcagggggcuag

SEQ ID NO: 378028 - RNA, 21 nt, Human
ggcugggggcuuggcucaacu

SEQ ID NO: 378029 - RNA, 22 nt, Human
gggaggagagaggaaaacaguu

SEQ ID NO: 378030 - RNA, 22 nt, Human
gguggugagugggaaggggccg

SEQ ID NO: 378031 - RNA, 19 nt, Human
gguguccccucccugcccu

SEQ ID NO: 378032 - RNA, 19 nt, Human
uaaccgcauggcucugagg

SEQ ID NO: 378033 - RNA, 18 nt, Human
uagggcagagaggggggc

SEQ ID NO: 378034 - RNA, 19 nt, Human
uagggcagagaggggggca

SEQ ID NO: 378035 - RNA, 22 nt, Human
ucaccagcgcccccgugcccau

SEQ ID NO: 378036 - RNA, 20 nt, Human
ucagguccugggggugggaa

SEQ ID NO: 378037 - RNA, 18 nt, Human
uccgcaugcgccgccgcg

SEQ ID NO: 378038 - RNA, 20 nt, Human
uccgcugcucgccgcgaccg

SEQ ID NO: 378039 - RNA, 23 nt, Human
ucgccccuccccucaugaaguca

SEQ ID NO: 378040 - RNA, 23 nt, Human
ucgccgcgaccgaccgcccuccc

SEQ ID NO: 378041 - RNA, 18 nt, Human
ucuccaggcggccauggg

SEQ ID NO: 378042 - RNA, 22 nt, Human
ucugcagaucggggcugggggc

SEQ ID NO: 378043 - RNA, 24 nt, Human
ugcaggggugggcuuccccucgcc

SEQ ID NO: 378044 - RNA, 19 nt, Human
uggcccccugcccaccccc

SEQ ID NO: 378045 - RNA, 19 nt, Human
uggcucaacuggcccccug

SEQ ID NO: 378046 - RNA, 24 nt, Human
uggcucaacuggcccccugcccac

SEQ ID NO: 378047 - RNA, 21 nt, Human
ugggaaggggccgagauaugg

SEQ ID NO: 378048 - RNA, 22 nt, Human
uggggacugcccacaacccaau

SEQ ID NO: 378049 - RNA, 24 nt, Human
uuuuuuuuuuuuuuuuuuucaaag

SEQ ID NO: 378050 - RNA, 19 nt, Human
auccucuuccaaaagucuc

SEQ ID NO: 378051 - RNA, 21 nt, Human
augguaacaaucauuucuuuc

SEQ ID NO: 378052 - RNA, 24 nt, Human
auuuauauacaaaaaacuucaaaa

SEQ ID NO: 378053 - RNA, 25 nt, Human
caaaaacaaauuaauccaaaucuug

SEQ ID NO: 378054 - RNA, 23 nt, Human
caaaaugagguaccaagaggagc

SEQ ID NO: 378055 - RNA, 18 nt, Human
caaaaugagguaccaagg

SEQ ID NO: 378056 - RNA, 25 nt, Human
caagaggagcacggagagccggcca

SEQ ID NO: 378057 - RNA, 19 nt, Human
caaggcggagauuaucugc

SEQ ID NO: 378058 - RNA, 22 nt, Human
ccaaaaugagguaccaagagga

SEQ ID NO: 378059 - RNA, 24 nt, Human
ccccaaaaugagguaccaagagga

SEQ ID NO: 378060 - RNA, 18 nt, Human
cuauauauauccucuucc

SEQ ID NO: 378061 - RNA, 21 nt, Human
cuccccaaaaugagguaccaa

SEQ ID NO: 378062 - RNA, 20 nt, Human
uacuaugcuauauauauccu

SEQ ID NO: 378063 - RNA, 22 nt, Human
uaguguaaaaguaugugaagcc

SEQ ID NO: 378064 - RNA, 24 nt, Human
ugucuaacuuauuuaaccccuuca

SEQ ID NO: 378065 - RNA, 19 nt, Human
uuaaauugcaaauuaaagc

SEQ ID NO: 378066 - RNA, 23 nt, Human
aaagagaaagugaaagccauuag

SEQ ID NO: 378067 - RNA, 21 nt, Human
aaccaacauugcggaugcccu

SEQ ID NO: 378068 - RNA, 24 nt, Human
aaccagaggcccagccaaggccca

SEQ ID NO: 378069 - RNA, 21 nt, Human
aacuacaguggugaagagacc

SEQ ID NO: 378070 - RNA, 22 nt, Human
aacuggccuguacagagaccug

SEQ ID NO: 378071 - RNA, 18 nt, Human
aagagaccaggaggcagc

SEQ ID NO: 378072 - RNA, 18 nt, Human
aagcaagggacccccaga

SEQ ID NO: 378073 - RNA, 23 nt, Human
aagcagcugaugguuuggaaaug

SEQ ID NO: 378074 - RNA, 21 nt, Human
aaggucucuucagagggaccc

SEQ ID NO: 378075 - RNA, 24 nt, Human
aaggucucuucagagggaccccag

SEQ ID NO: 378076 - RNA, 18 nt, Human
agaaaaaguucacaugug

SEQ ID NO: 378077 - RNA, 20 nt, Human
agacagaagaggggcacgca

SEQ ID NO: 378078 - RNA, 21 nt, Human
agacagaagaggggcacgcag

SEQ ID NO: 378079 - RNA, 20 nt, Human
agcagccccugccuccagga

SEQ ID NO: 378080 - RNA, 23 nt, Human
agccugacagcuuccagcagaaa

SEQ ID NO: 378081 - RNA, 26 nt, Human
agcuaugugcugggcugcuccaucag

SEQ ID NO: 378082 - RNA, 25 nt, Human
agcuaugugcugggcugcuccaucg

SEQ ID NO: 378083 - RNA, 19 nt, Human
aggagggacaggguucccc

SEQ ID NO: 378084 - RNA, 21 nt, Human
agggcacccaggaaacaucag

SEQ ID NO: 378085 - RNA, 21 nt, Human
aucaacuaaaugucagggacc

SEQ ID NO: 378086 - RNA, 24 nt, Human
augccauuuaauuagauuguuuac

SEQ ID NO: 378087 - RNA, 19 nt, Human
caaaaucaaagccuguccc

SEQ ID NO: 378088 - RNA, 21 nt, Human
cacaggccucaagagaaggcc

SEQ ID NO: 378089 - RNA, 20 nt, Human
cagaaccagaggcccagcca

SEQ ID NO: 378090 - RNA, 20 nt, Human
cagagggugggccccugguc

SEQ ID NO: 378091 - RNA, 22 nt, Human
cagcagaaagugucagaaccag

SEQ ID NO: 378092 - RNA, 24 nt, Human
cagccugacagcuuccagcagaaa

SEQ ID NO: 378093 - RNA, 18 nt, Human
caggagcgcgcugcagug

SEQ ID NO: 378094 - RNA, 20 nt, Human
caggcccagcccugcugcaa

SEQ ID NO: 378095 - RNA, 22 nt, Human
cauuaggcaagcuaugugcugg

SEQ ID NO: 378096 - RNA, 19 nt, Human
ccacacgacuaugugaccu

SEQ ID NO: 378097 - RNA, 20 nt, Human
ccagcagaaagugucagaac

SEQ ID NO: 378098 - RNA, 23 nt, Human
cccacugccgcuguccaggggac

SEQ ID NO: 378099 - RNA, 19 nt, Human
cccagagcacaggccucaa

SEQ ID NO: 378100 - RNA, 18 nt, Human
cccagcaggaagcccaca

SEQ ID NO: 378101 - RNA, 21 nt, Human
ccccugccuccaggagaacuc

SEQ ID NO: 378102 - RNA, 22 nt, Human
cccugggcagagggugggcccc

SEQ ID NO: 378103 - RNA, 22 nt, Human
cccuucgugagccuucucaguc

SEQ ID NO: 378104 - RNA, 19 nt, Human
ccuaaccccugauccugga

SEQ ID NO: 378105 - RNA, 19 nt, Human
ccuaggcuuacuuuaucua

SEQ ID NO: 378106 - RNA, 19 nt, Human
ccucuaaaugggcgcgauu

SEQ ID NO: 378107 - RNA, 18 nt, Human
cgagauacacuuguuagg

SEQ ID NO: 378108 - RNA, 21 nt, Human
cggcgagccucgugccgaauu

SEQ ID NO: 378109 - RNA, 18 nt, Human
cucagucccagcaggaag

SEQ ID NO: 378110 - RNA, 23 nt, Human
cuccugggcccuggcauuguucu

SEQ ID NO: 378111 - RNA, 18 nt, Human
cucucagugaaaccaaca

SEQ ID NO: 378112 - RNA, 18 nt, Human
gaaagugucagaaccaga

SEQ ID NO: 378113 - RNA, 18 nt, Human
gagccagggcacccagga

SEQ ID NO: 378114 - RNA, 23 nt, Human
gaggcagcucucagugaaaccaa

SEQ ID NO: 378115 - RNA, 23 nt, Human
gcaaggacucccugggcagaggg

SEQ ID NO: 378116 - RNA, 20 nt, Human
gcuucuugcacccuaacccc

SEQ ID NO: 378117 - RNA, 20 nt, Human
ggaugcccuucgugagccuu

SEQ ID NO: 378118 - RNA, 22 nt, Human
ggcacagaauccucgacccaca

SEQ ID NO: 378119 - RNA, 18 nt, Human
ggccccugguccuggagg

SEQ ID NO: 378120 - RNA, 22 nt, Human
gggcaggcgguccuccugggcc

SEQ ID NO: 378121 - RNA, 26 nt, Human
gggcccuggcauuguucuuacaaaug

SEQ ID NO: 378122 - RNA, 25 nt, Human
ggucaggagcgcgcugcagugagcc

SEQ ID NO: 378123 - RNA, 18 nt, Human
gguccuggaggcacagaa

SEQ ID NO: 378124 - RNA, 22 nt, Human
gguuacagccacauccucuaaa

SEQ ID NO: 378125 - RNA, 21 nt, Human
gugaaacaaggcagcagcccc

SEQ ID NO: 378126 - RNA, 21 nt, Human
gugagccuucucagucccagc

SEQ ID NO: 378127 - RNA, 22 nt, Human
gugugaucugggacuggcaggu

SEQ ID NO: 378128 - RNA, 23 nt, Human
uaaaacaaaagagaaagugaaag

SEQ ID NO: 378129 - RNA, 19 nt, Human
uaaauggcuucuugcaccc

SEQ ID NO: 378130 - RNA, 20 nt, Human
uaacuggggaagacuucgau

SEQ ID NO: 378131 - RNA, 18 nt, Human
uaggagggacaggguucc

SEQ ID NO: 378132 - RNA, 23 nt, Human
ucagaguguaccaggucuguagc

SEQ ID NO: 378133 - RNA, 20 nt, Human
ucagcacacacacacacaca

SEQ ID NO: 378134 - RNA, 21 nt, Human
ucagcacacacacacacacag

SEQ ID NO: 378135 - RNA, 20 nt, Human
uccagcagguuacagccaca

SEQ ID NO: 378136 - RNA, 23 nt, Human
uccccuaaggcacuuuuaaagau

SEQ ID NO: 378137 - RNA, 20 nt, Human
ucccugggcagagggugggc

SEQ ID NO: 378138 - RNA, 25 nt, Human
ucccugggcagagggugggccccug

SEQ ID NO: 378139 - RNA, 25 nt, Human
ucgacccacacgacuaugugaccuc

SEQ ID NO: 378140 - RNA, 19 nt, Human
ugaaacaaggcagcagccc

SEQ ID NO: 378141 - RNA, 19 nt, Human
ugagagaacuacaguggug

SEQ ID NO: 378142 - RNA, 23 nt, Human
ugaucugggacuggcagguuauu

SEQ ID NO: 378143 - RNA, 20 nt, Human
ugaugugugaucugggacug

SEQ ID NO: 378144 - RNA, 24 nt, Human
ugccaccuagaaaaaguucacaug

SEQ ID NO: 378145 - RNA, 21 nt, Human
ugcccuucgugagccuucuca

SEQ ID NO: 378146 - RNA, 23 nt, Human
ugcugggcugcuaacguagcccc

SEQ ID NO: 378147 - RNA, 22 nt, Human
uggaagaaggcagagaaacugg

SEQ ID NO: 378148 - RNA, 20 nt, Human
uggacagugagcagccaagg

SEQ ID NO: 378149 - RNA, 23 nt, Human
uggacagugagcagccaaggucu

SEQ ID NO: 378150 - RNA, 23 nt, Human
ugggaaggagcuauggaguccca

SEQ ID NO: 378151 - RNA, 25 nt, Human
ugggccccugguccuggaggcacag

SEQ ID NO: 378152 - RNA, 23 nt, Human
uggugaagagaccaggaggcagc

SEQ ID NO: 378153 - RNA, 28 nt, Human
uguccagcuuccucgggccacacacccc

SEQ ID NO: 378154 - RNA, 23 nt, Human
ugucuugcuaacccucaaaauca

SEQ ID NO: 378155 - RNA, 19 nt, Human
uuaggagggacaggguucc

SEQ ID NO: 378156 - RNA, 20 nt, Human
uucacauguggacagugagc

SEQ ID NO: 378157 - RNA, 21 nt, Human
uuccccuaaggcacuuuuaaa

SEQ ID NO: 378158 - RNA, 18 nt, Human
uuccucgggccacacacc

SEQ ID NO: 378159 - RNA, 22 nt, Human
uuuugcugcccuaaauggcuuc

SEQ ID NO: 378160 - RNA, 18 nt, Human
uuuuuuuuuuuuuugcgg

SEQ ID NO: 378161 - RNA, 18 nt, Human
uuuuuuuuuuuuuuuuug

SEQ ID NO: 378162 - RNA, 22 nt, Human
uuuuuuuuuuuuuuuuugcggu

SEQ ID NO: 378163 - RNA, 25 nt, Human
uuuuuuuuuuuuuuuuuugcgguga

SEQ ID NO: 378164 - RNA, 23 nt, Human
uuuuuuuuuuuuuuuuuuugcgg

SEQ ID NO: 378165 - RNA, 20 nt, Human
aaaaaaaaaaaaaggacagu

SEQ ID NO: 378166 - RNA, 24 nt, Human
aaaagggcacccucagccccggcc

SEQ ID NO: 378167 - RNA, 25 nt, Human
aaaucuacaaaacacuguuaaaaaa

SEQ ID NO: 378168 - RNA, 20 nt, Human
acaaaacacuguuaaaaaaa

SEQ ID NO: 378169 - RNA, 25 nt, Human
acacaugcacacacauacacacaca

SEQ ID NO: 378170 - RNA, 26 nt, Human
acagagcuccaggagggagggaacgc

SEQ ID NO: 378171 - RNA, 33 nt, Human
acauggagacacgcacacaugcacacacauagu

SEQ ID NO: 378172 - RNA, 20 nt, Human
acucaucccacccacccacc

SEQ ID NO: 378173 - RNA, 20 nt, Human
agaauggauggcaaggggca

SEQ ID NO: 378174 - RNA, 18 nt, Human
agacaggggccacccagc

SEQ ID NO: 378175 - RNA, 18 nt, Human
agaggaccaacagcaggc

SEQ ID NO: 378176 - RNA, 21 nt, Human
agaugccacaaacugucagcu

SEQ ID NO: 378177 - RNA, 18 nt, Human
agccuggaagcagcggca

SEQ ID NO: 378178 - RNA, 22 nt, Human
agcggcagagggucugucucgg

SEQ ID NO: 378179 - RNA, 20 nt, Human
agcggcagugggaaucugcc

SEQ ID NO: 378180 - RNA, 19 nt, Human
aggcaaggccuugugcugc

SEQ ID NO: 378181 - RNA, 20 nt, Human
aggcaggcggggccaggggc

SEQ ID NO: 378182 - RNA, 24 nt, Human
aggccaggaccagggccuccugga

SEQ ID NO: 378183 - RNA, 21 nt, Human
aggccaggcaaggccuugugc

SEQ ID NO: 378184 - RNA, 18 nt, Human
aggccauggccacaugug

SEQ ID NO: 378185 - RNA, 18 nt, Human
aggccuugugcugcccag

SEQ ID NO: 378186 - RNA, 23 nt, Human
aggcgugcggccacagcgggagc

SEQ ID NO: 378187 - RNA, 23 nt, Human
aggcuggaaaagggcacccucag

SEQ ID NO: 378188 - RNA, 21 nt, Human
agggucccucaggucuaagga

SEQ ID NO: 378189 - RNA, 21 nt, Human
agucaucugaaaucuacaaaa

SEQ ID NO: 378190 - RNA, 24 nt, Human
augcacacacauacacacacacag

SEQ ID NO: 378191 - RNA, 27 nt, Human
auggagacacgcacacaugcacacagu

SEQ ID NO: 378192 - RNA, 19 nt, Human
auggcaguggguaacacgu

SEQ ID NO: 378193 - RNA, 21 nt, Human
caaacaucacccacaagccga

SEQ ID NO: 378194 - RNA, 19 nt, Human
caagucugggccuuggaau

SEQ ID NO: 378195 - RNA, 25 nt, Human
caauucuggauacccccccaccccc

SEQ ID NO: 378196 - RNA, 24 nt, Human
cacacacagggacccuuggcaaga

SEQ ID NO: 378197 - RNA, 22 nt, Human
cacccucagccccggccccagc

SEQ ID NO: 378198 - RNA, 19 nt, Human
caccgcccucucaggccac

SEQ ID NO: 378199 - RNA, 23 nt, Human
cagaauggauggcaaggggcagg

SEQ ID NO: 378200 - RNA, 19 nt, Human
cagagacccacagagcucc

SEQ ID NO: 378201 - RNA, 19 nt, Human
cagcccagagagacagcag

SEQ ID NO: 378202 - RNA, 25 nt, Human
cagcccagagagacagcaggggcca

SEQ ID NO: 378203 - RNA, 22 nt, Human
cagcccaggauccaagccgaga

SEQ ID NO: 378204 - RNA, 20 nt, Human
cagccuggaagcagcggcag

SEQ ID NO: 378205 - RNA, 21 nt, Human
cagcugccccuuuacagaugg

SEQ ID NO: 378206 - RNA, 22 nt, Human
caucccacccacccaccaucau

SEQ ID NO: 378207 - RNA, 24 nt, Human
caugcuguucccaacagcugggcu

SEQ ID NO: 378208 - RNA, 21 nt, Human
cauggccacauguggggcaga

SEQ ID NO: 378209 - RNA, 25 nt, Human
ccacccacccaccaucaucaggccc

SEQ ID NO: 378210 - RNA, 24 nt, Human
ccaggcccggcccagagccagggg

SEQ ID NO: 378211 - RNA, 21 nt, Human
ccagggcuaggcucaccaugu

SEQ ID NO: 378212 - RNA, 22 nt, Human
cccacagagagaggaccaacag

SEQ ID NO: 378213 - RNA, 26 nt, Human
cccacaucugccuccaugcuguuccc

SEQ ID NO: 378214 - RNA, 22 nt, Human
cccacccaccaucaucaggcca

SEQ ID NO: 378215 - RNA, 24 nt, Human
cccaccccccgcaagucggggccg

SEQ ID NO: 378216 - RNA, 23 nt, Human
cccagagagacagcaggggccac

SEQ ID NO: 378217 - RNA, 24 nt, Human
cccagcccuucuccugguuccucu

SEQ ID NO: 378218 - RNA, 20 nt, Human
cccagcucagccccacaucu

SEQ ID NO: 378219 - RNA, 21 nt, Human
cccccaggccucugcauaguc

SEQ ID NO: 378220 - RNA, 23 nt, Human
cccccccaccccccgcaagucug

SEQ ID NO: 378221 - RNA, 19 nt, Human
cccccgcaagucugggccu

SEQ ID NO: 378222 - RNA, 20 nt, Human
cccccgcaagucugggccuu

SEQ ID NO: 378223 - RNA, 23 nt, Human
ccccggccccagcccuucuccug

SEQ ID NO: 378224 - RNA, 19 nt, Human
ccccuggcaauucagcccc

SEQ ID NO: 378225 - RNA, 23 nt, Human
ccccuuguuuccugggcuguccc

SEQ ID NO: 378226 - RNA, 25 nt, Human
cccggcccagagccagggguccccu

SEQ ID NO: 378227 - RNA, 18 nt, Human
cccuagguccagaagccc

SEQ ID NO: 378228 - RNA, 22 nt, Human
cccucagccccggccccagccc

SEQ ID NO: 378229 - RNA, 21 nt, Human
ccucaugaguuaaagggugcc

SEQ ID NO: 378230 - RNA, 20 nt, Human
ccucucaggccacccuaggu

SEQ ID NO: 378231 - RNA, 19 nt, Human
ccugcaccuuuuacccuga

SEQ ID NO: 378232 - RNA, 24 nt, Human
ccuuaggcaguuggagagggauuu

SEQ ID NO: 378233 - RNA, 21 nt, Human
ccuugugcugcccagccugga

SEQ ID NO: 378234 - RNA, 19 nt, Human
cgaaugcauccucagaccc

SEQ ID NO: 378235 - RNA, 23 nt, Human
cgagacaggggccacccagccca

SEQ ID NO: 378236 - RNA, 27 nt, Human
cgcacauggagacacgcacacaugcag

SEQ ID NO: 378237 - RNA, 19 nt, Human
cgcauacccaccgcccucu

SEQ ID NO: 378238 - RNA, 23 nt, Human
cgggagaagacuuggguaauaaa

SEQ ID NO: 378239 - RNA, 23 nt, Human
cucagccccggccccagcccuuc

SEQ ID NO: 378240 - RNA, 24 nt, Human
cucaggccacccuagguccagaag

SEQ ID NO: 378241 - RNA, 20 nt, Human
cucaucccacccacccacca

SEQ ID NO: 378242 - RNA, 19 nt, Human
cuccacucugaacugcucc

SEQ ID NO: 378243 - RNA, 18 nt, Human
cucgcauacccaccgccc

SEQ ID NO: 378244 - RNA, 23 nt, Human
cucgcauacccaccgcccucuca

SEQ ID NO: 378245 - RNA, 21 nt, Human
cucucgacauagaccgggggu

SEQ ID NO: 378246 - RNA, 18 nt, Human
cucugaacugcuccgugg

SEQ ID NO: 378247 - RNA, 22 nt, Human
cucugaacugcuccguggccuu

SEQ ID NO: 378248 - RNA, 21 nt, Human
cucuuuggccagcucucgaca

SEQ ID NO: 378249 - RNA, 19 nt, Human
cugaggaugacagagggag

SEQ ID NO: 378250 - RNA, 21 nt, Human
cugcuccguggccuugggcau

SEQ ID NO: 378251 - RNA, 18 nt, Human
cuggauacccccccaccc

SEQ ID NO: 378252 - RNA, 25 nt, Human
cuuggccuccuuccccacuggcagg

SEQ ID NO: 378253 - RNA, 26 nt, Human
cuuggccuccuuccccacuggcaggg

SEQ ID NO: 378254 - RNA, 18 nt, Human
cuuggcucuucuaugucu

SEQ ID NO: 378255 - RNA, 20 nt, Human
gaagccccuuccaugccacc

SEQ ID NO: 378256 - RNA, 24 nt, Human
gaauccaccacacacccaaaggcc

SEQ ID NO: 378257 - RNA, 22 nt, Human
gagugcagggagaggcgugcgg

SEQ ID NO: 378258 - RNA, 23 nt, Human
gcacacaugcacacacauacaca

SEQ ID NO: 378259 - RNA, 24 nt, Human
gcacacaugcacacacauacacag

SEQ ID NO: 378260 - RNA, 22 nt, Human
gcagcggcagugggaaucugcc

SEQ ID NO: 378261 - RNA, 18 nt, Human
gcaggggccacccaaggu

SEQ ID NO: 378262 - RNA, 22 nt, Human
gccccaggcccggcccagagcc

SEQ ID NO: 378263 - RNA, 19 nt, Human
gcccggcccagagccaggg

SEQ ID NO: 378264 - RNA, 18 nt, Human
gcggaguaggcugaggcu

SEQ ID NO: 378265 - RNA, 20 nt, Human
gcgugcggccacagcgggag

SEQ ID NO: 378266 - RNA, 21 nt, Human
gcucaccauguguguccugcc

SEQ ID NO: 378267 - RNA, 19 nt, Human
gcucucaacugucucccca

SEQ ID NO: 378268 - RNA, 24 nt, Human
ggaccagagcugagcaguugcaga

SEQ ID NO: 378269 - RNA, 23 nt, Human
ggcaggguggcaggcaggcgggg

SEQ ID NO: 378270 - RNA, 19 nt, Human
ggccaggaccagggccucc

SEQ ID NO: 378271 - RNA, 20 nt, Human
ggcucaagaaccccuggcag

SEQ ID NO: 378272 - RNA, 19 nt, Human
gggacaaaguacggggaag

SEQ ID NO: 378273 - RNA, 23 nt, Human
gggcaagccccgagacaggggcc

SEQ ID NO: 378274 - RNA, 25 nt, Human
gggcacccucagccccggccccagc

SEQ ID NO: 378275 - RNA, 24 nt, Human
gggccaggaauugaaaugccacgg

SEQ ID NO: 378276 - RNA, 19 nt, Human
gggcugagcgggcagcggc

SEQ ID NO: 378277 - RNA, 26 nt, Human
ggggcaggguggcaggcaggcggggc

SEQ ID NO: 378278 - RNA, 22 nt, Human
ggggcccaucgcuccucuuugg

SEQ ID NO: 378279 - RNA, 24 nt, Human
gguaauaaagacguaugaaaggaa

SEQ ID NO: 378280 - RNA, 21 nt, Human
uaaauauggacgcacauggag

SEQ ID NO: 378281 - RNA, 22 nt, Human
uacccugauuccccagcucagc

SEQ ID NO: 378282 - RNA, 23 nt, Human
uaggcaggcacugcuuggccucc

SEQ ID NO: 378283 - RNA, 18 nt, Human
ucaaacaucacccacaag

SEQ ID NO: 378284 - RNA, 23 nt, Human
ucagaccccuuguuuccugggcu

SEQ ID NO: 378285 - RNA, 19 nt, Human
ucaggccaggcaaggccuu

SEQ ID NO: 378286 - RNA, 22 nt, Human
ucaggccaggcaaggccuugug

SEQ ID NO: 378287 - RNA, 23 nt, Human
ucagugagcggaguaggcugagg

SEQ ID NO: 378288 - RNA, 27 nt, Human
uccaccacacacccaaaggccgaacag

SEQ ID NO: 378289 - RNA, 19 nt, Human
ucccccaggccucugcaua

SEQ ID NO: 378290 - RNA, 23 nt, Human
uccccgcucucaacugucucccc

SEQ ID NO: 378291 - RNA, 18 nt, Human
uccugguuccucuuccag

SEQ ID NO: 378292 - RNA, 20 nt, Human
ucuccugaugucccagggcu

SEQ ID NO: 378293 - RNA, 23 nt, Human
ucucgaaugcauccucagacccc

SEQ ID NO: 378294 - RNA, 18 nt, Human
ucucgcauacccaccgcc

SEQ ID NO: 378295 - RNA, 19 nt, Human
ugaaaggaaaaguugaaau

SEQ ID NO: 378296 - RNA, 19 nt, Human
ugacagagggagcaccggg

SEQ ID NO: 378297 - RNA, 24 nt, Human
ugacagagggagcaccggguucca

SEQ ID NO: 378298 - RNA, 19 nt, Human
ugagcaguugcagaggcca

SEQ ID NO: 378299 - RNA, 23 nt, Human
ugauuccccagcucagccccaca

SEQ ID NO: 378300 - RNA, 22 nt, Human
ugcacacacauacacacacaca

SEQ ID NO: 378301 - RNA, 19 nt, Human
ugcagggagaggcgugcgg

SEQ ID NO: 378302 - RNA, 23 nt, Human
ugcagggagaggcgugcggccac

SEQ ID NO: 378303 - RNA, 27 nt, Human
uggaauggacgggagaagacuugggua

SEQ ID NO: 378304 - RNA, 21 nt, Human
uggacgggagaagacuugggu

SEQ ID NO: 378305 - RNA, 18 nt, Human
uggcaggcaggcggggcc

SEQ ID NO: 378306 - RNA, 21 nt, Human
uggcaggcaggcggggccagg

SEQ ID NO: 378307 - RNA, 19 nt, Human
uggccuccuuccccacugg

SEQ ID NO: 378308 - RNA, 18 nt, Human
uuagccucucaaaaccuc

SEQ ID NO: 378309 - RNA, 19 nt, Human
uuccaagcccgccuccacc

SEQ ID NO: 378310 - RNA, 18 nt, Human
uuccagagacccacagag

SEQ ID NO: 378311 - RNA, 18 nt, Human
uuccccagcucagccccc

SEQ ID NO: 378312 - RNA, 22 nt, Human
uugauugccuccagagccgagg

SEQ ID NO: 378313 - RNA, 24 nt, Human
uuuacagaugggcacacugaggcc

SEQ ID NO: 378314 - RNA, 19 nt, Human
uuucauaggcaggcacugc

SEQ ID NO: 378315 - RNA, 20 nt, Human
uuuuuuuuuuucugaggucu

SEQ ID NO: 378316 - RNA, 18 nt, Human
uuuuuuuuuuuuuuucug

SEQ ID NO: 378317 - RNA, 21 nt, Human
uuuuuuuuuuuuuuucugagg

SEQ ID NO: 378318 - RNA, 19 nt, Human
aaaaauuccuagaggacau

SEQ ID NO: 378319 - RNA, 19 nt, Human
aaaagaaggcuguagagaa

SEQ ID NO: 378320 - RNA, 19 nt, Human
aaacagaaagcaaaaacua

SEQ ID NO: 378321 - RNA, 23 nt, Human
aacagaacaaaaaaacuaggucu

SEQ ID NO: 378322 - RNA, 24 nt, Human
aacagaacaaaaaaacuaggucua

SEQ ID NO: 378323 - RNA, 20 nt, Human
aagagaaauuucacagacaa

SEQ ID NO: 378324 - RNA, 19 nt, Human
aagcaacaacagcaaaaca

SEQ ID NO: 378325 - RNA, 23 nt, Human
aagcaacacugcaguugaccuug

SEQ ID NO: 378326 - RNA, 23 nt, Human
aauggcuacccccagccucuaug

SEQ ID NO: 378327 - RNA, 25 nt, Human
acaacagcaaaacagaaagcaaaaa

SEQ ID NO: 378328 - RNA, 23 nt, Human
acacacuuggcaagacauagcca

SEQ ID NO: 378329 - RNA, 23 nt, Human
acagaaagcaaaaacuauuagaa

SEQ ID NO: 378330 - RNA, 21 nt, Human
acagaacaaaaaaacuagguc

SEQ ID NO: 378331 - RNA, 21 nt, Human
acagagagaaaccaugucaga

SEQ ID NO: 378332 - RNA, 20 nt, Human
acccauggccuaaaggugcc

SEQ ID NO: 378333 - RNA, 19 nt, Human
acccggugggcugggcugg

SEQ ID NO: 378334 - RNA, 21 nt, Human
acugcacaauggcuaccccca

SEQ ID NO: 378335 - RNA, 19 nt, Human
acugcaguugaccuugaag

SEQ ID NO: 378336 - RNA, 21 nt, Human
agaaaaaaaauuccuagagga

SEQ ID NO: 378337 - RNA, 23 nt, Human
agaaagcaaaaacuauuagaagg

SEQ ID NO: 378338 - RNA, 21 nt, Human
agacuagaagacagagagaaa

SEQ ID NO: 378339 - RNA, 27 nt, Human
agacuagaagacagagagaagggaccc

SEQ ID NO: 378340 - RNA, 19 nt, Human
agagcacauugauggcuca

SEQ ID NO: 378341 - RNA, 22 nt, Human
agcaacaacagcaaaacagaaa

SEQ ID NO: 378342 - RNA, 23 nt, Human
agcaacaacagcaaaacagaaag

SEQ ID NO: 378343 - RNA, 26 nt, Human
aggaggggcggcuaccggaggggcgg

SEQ ID NO: 378344 - RNA, 19 nt, Human
aggcaaagcaaugccagau

SEQ ID NO: 378345 - RNA, 19 nt, Human
aggccgcggcgggcaacau

SEQ ID NO: 378346 - RNA, 22 nt, Human
agggccacgaggagcuuccucc

SEQ ID NO: 378347 - RNA, 25 nt, Human
auaaaguagcaggaaaauuacaaag

SEQ ID NO: 378348 - RNA, 21 nt, Human
auacacagcaccugacacgaa

SEQ ID NO: 378349 - RNA, 23 nt, Human
auggccuccgagagagggcuccu

SEQ ID NO: 378350 - RNA, 21 nt, Human
caaguucuccacuuauacaca

SEQ ID NO: 378351 - RNA, 18 nt, Human
cacagcaccugacacgaa

SEQ ID NO: 378352 - RNA, 23 nt, Human
cacaguaggauauucaaccucca

SEQ ID NO: 378353 - RNA, 24 nt, Human
caccaccagcaccccucccugccc

SEQ ID NO: 378354 - RNA, 19 nt, Human
caccuuggaagggccacga

SEQ ID NO: 378355 - RNA, 24 nt, Human
cagaacaaaaaaacuaggucuaga

SEQ ID NO: 378356 - RNA, 22 nt, Human
cagagagaaaccaugucagacc

SEQ ID NO: 378357 - RNA, 19 nt, Human
cagcaaaacagaaagcaaa

SEQ ID NO: 378358 - RNA, 20 nt, Human
cagcaaaacagaaagcaaaa

SEQ ID NO: 378359 - RNA, 21 nt, Human
cagcaccccucccugcccggu

SEQ ID NO: 378360 - RNA, 26 nt, Human
cagcccuauagggggagggaagcaac

SEQ ID NO: 378361 - RNA, 20 nt, Human
caggagccacucacacaggc

SEQ ID NO: 378362 - RNA, 24 nt, Human
caggagccacucacacaggcagag

SEQ ID NO: 378363 - RNA, 19 nt, Human
ccaccagcaccccucccug

SEQ ID NO: 378364 - RNA, 22 nt, Human
cccccagccucuauggccuccg

SEQ ID NO: 378365 - RNA, 18 nt, Human
cccccgggccaugacugc

SEQ ID NO: 378366 - RNA, 18 nt, Human
ccucccugcccggugaug

SEQ ID NO: 378367 - RNA, 20 nt, Human
ccuccgagagagggcuccua

SEQ ID NO: 378368 - RNA, 23 nt, Human
cggcgcggggggaggaggggcgg

SEQ ID NO: 378369 - RNA, 24 nt, Human
cggugaugucacccggugggcugg

SEQ ID NO: 378370 - RNA, 21 nt, Human
cucuauggccuccgagagagg

SEQ ID NO: 378371 - RNA, 21 nt, Human
gaaaaugccaucaaagacagu

SEQ ID NO: 378372 - RNA, 22 nt, Human
gaagaaaaagaaggcuguagag

SEQ ID NO: 378373 - RNA, 20 nt, Human
gcaaaacagaaagcaaaaac

SEQ ID NO: 378374 - RNA, 25 nt, Human
gcaaagcaacaacagcaaaacagaa

SEQ ID NO: 378375 - RNA, 19 nt, Human
gcagcgugcuccaugcccc

SEQ ID NO: 378376 - RNA, 18 nt, Human
gcgcggggggaggagggg

SEQ ID NO: 378377 - RNA, 23 nt, Human
gcuccuagacagauuccagcccu

SEQ ID NO: 378378 - RNA, 21 nt, Human
gcuguagagaauuuuaacaau

SEQ ID NO: 378379 - RNA, 23 nt, Human
ggaaaacucaaaaucuacaaaag

SEQ ID NO: 378380 - RNA, 23 nt, Human
ggaagaaaaagaaggcuguagag

SEQ ID NO: 378381 - RNA, 18 nt, Human
ggaggaggggcggcuacc

SEQ ID NO: 378382 - RNA, 22 nt, Human
gggaaaacucaaaaucuacaaa

SEQ ID NO: 378383 - RNA, 23 nt, Human
gggcggcggcgcggggggggugc

SEQ ID NO: 378384 - RNA, 26 nt, Human
gggcuggaacaaguccagaugccuuu

SEQ ID NO: 378385 - RNA, 18 nt, Human
ggggggaggaggggcggc

SEQ ID NO: 378386 - RNA, 23 nt, Human
guaugaaccaccaccagcacccc

SEQ ID NO: 378387 - RNA, 22 nt, Human
guuuagggcccaggagccacuc

SEQ ID NO: 378388 - RNA, 24 nt, Human
uaaggcaaagcaaugccagaugaa

SEQ ID NO: 378389 - RNA, 26 nt, Human
uacaaaagagaaauuucacagacaac

SEQ ID NO: 378390 - RNA, 21 nt, Human
uacccccagccucuauggccu

SEQ ID NO: 378391 - RNA, 20 nt, Human
uaccggagucccgcacugcc

SEQ ID NO: 378392 - RNA, 21 nt, Human
uagaaaaaaaauuccuagagg

SEQ ID NO: 378393 - RNA, 19 nt, Human
uagaagacagagagaaacc

SEQ ID NO: 378394 - RNA, 21 nt, Human
uauggaagaaaaagaaggcug

SEQ ID NO: 378395 - RNA, 21 nt, Human
uauggaagaaaaagaaggcuu

SEQ ID NO: 378396 - RNA, 21 nt, Human
ucaacaaagaacaaacaggau

SEQ ID NO: 378397 - RNA, 19 nt, Human
ucaaucaacaaagaacaaa

SEQ ID NO: 378398 - RNA, 28 nt, Human
ucagaccagagcacauugauggcucacg

SEQ ID NO: 378399 - RNA, 20 nt, Human
uccuagacagauuccagccc

SEQ ID NO: 378400 - RNA, 20 nt, Human
ucuauggccuccgagagagg

SEQ ID NO: 378401 - RNA, 19 nt, Human
ugaaaaugccaucaaagac

SEQ ID NO: 378402 - RNA, 25 nt, Human
ugaaaaugccaucaaagacaguugu

SEQ ID NO: 378403 - RNA, 19 nt, Human
ugaccuugaagagaucacu

SEQ ID NO: 378404 - RNA, 24 nt, Human
ugcaaagcaacaacagcaaaacag

SEQ ID NO: 378405 - RNA, 20 nt, Human
ugccuguuuagggcccagga

SEQ ID NO: 378406 - RNA, 21 nt, Human
uggcaagacauagccaaaaga

SEQ ID NO: 378407 - RNA, 19 nt, Human
uggccuccgagagagggcu

SEQ ID NO: 378408 - RNA, 27 nt, Human
uuacacuacaagggaaaacucaaaauc

SEQ ID NO: 378409 - RNA, 21 nt, Human
uuagcuauggaagaaaaagaa

SEQ ID NO: 378410 - RNA, 25 nt, Human
uucaaccuccauuucagcguauuua

SEQ ID NO: 378411 - RNA, 21 nt, Human
uucccccgggccaugacugca

SEQ ID NO: 378412 - RNA, 21 nt, Human
uugaccuugaagagaucacug

SEQ ID NO: 378413 - RNA, 23 nt, Human
uugaccuugaagagaucacuggu

SEQ ID NO: 378414 - RNA, 18 nt, Human
uugauggcucacggugag

SEQ ID NO: 378415 - RNA, 19 nt, Human
uuuuuuuuuuuuaaauggc

SEQ ID NO: 378416 - RNA, 24 nt, Human
uuuuuuuuuuuuuuuuuuaaaugg

SEQ ID NO: 378417 - RNA, 19 nt, Human
aaaaauucuugauuacaga

SEQ ID NO: 378418 - RNA, 19 nt, Human
aaacauaggccugagaaga

SEQ ID NO: 378419 - RNA, 20 nt, Human
aaccuggccuucaagaauag

SEQ ID NO: 378420 - RNA, 18 nt, Human
aacuaagacacugcacaa

SEQ ID NO: 378421 - RNA, 23 nt, Human
aagaaaaaggaagccaugacugg

SEQ ID NO: 378422 - RNA, 18 nt, Human
aagcagcauguaaccuca

SEQ ID NO: 378423 - RNA, 19 nt, Human
aaugaacaacaaaaacacu

SEQ ID NO: 378424 - RNA, 19 nt, Human
accaagaaaaaggaagcca

SEQ ID NO: 378425 - RNA, 22 nt, Human
accaagaaaaaggaagccauga

SEQ ID NO: 378426 - RNA, 24 nt, Human
agccauccagggucauguuguucu

SEQ ID NO: 378427 - RNA, 23 nt, Human
aggaaaguugcuuggggcuucug

SEQ ID NO: 378428 - RNA, 22 nt, Human
augcuggggugaccccuucaca

SEQ ID NO: 378429 - RNA, 25 nt, Human
cagaauccccaggccagcuggcaga

SEQ ID NO: 378430 - RNA, 20 nt, Human
cagacaccacucagaauccc

SEQ ID NO: 378431 - RNA, 22 nt, Human
cagagcaauagcuaagaagcaa

SEQ ID NO: 378432 - RNA, 22 nt, Human
caggauaggggucccuggaagg

SEQ ID NO: 378433 - RNA, 20 nt, Human
cagggaguggguaugaagcc

SEQ ID NO: 378434 - RNA, 24 nt, Human
caguaaucuacaucauccucagac

SEQ ID NO: 378435 - RNA, 18 nt, Human
ccggggauugugaaaucu

SEQ ID NO: 378436 - RNA, 21 nt, Human
ccucaucauuaauucucuuug

SEQ ID NO: 378437 - RNA, 22 nt, Human
ccuuagagaguccauaucucag

SEQ ID NO: 378438 - RNA, 20 nt, Human
ccuucaagaauagccauacc

SEQ ID NO: 378439 - RNA, 26 nt, Human
cucagaauccccaggccagcuggcag

SEQ ID NO: 378440 - RNA, 19 nt, Human
cucagagcaauagcuaaga

SEQ ID NO: 378441 - RNA, 24 nt, Human
cucauaagccacccagguucaugc

SEQ ID NO: 378442 - RNA, 21 nt, Human
cucaugcuggggugaccccuu

SEQ ID NO: 378443 - RNA, 24 nt, Human
cugccuucaagucaaaaaauucuu

SEQ ID NO: 378444 - RNA, 27 nt, Human
cuggaaggguaggaguaaacucuaagc

SEQ ID NO: 378445 - RNA, 19 nt, Human
gagaacuacaaggaagaag

SEQ ID NO: 378446 - RNA, 18 nt, Human
gcaagcagcauguaaccu

SEQ ID NO: 378447 - RNA, 20 nt, Human
ggaaaugugggcucuguaug

SEQ ID NO: 378448 - RNA, 23 nt, Human
ggaggcaagcagcauguaacccc

SEQ ID NO: 378449 - RNA, 19 nt, Human
gguuauuaaaaccuggccu

SEQ ID NO: 378450 - RNA, 23 nt, Human
gugaaaucuucuggaaaacagag

SEQ ID NO: 378451 - RNA, 24 nt, Human
guguggaaaugugggcucuguaug

SEQ ID NO: 378452 - RNA, 21 nt, Human
uaaaacuguucucuauccucu

SEQ ID NO: 378453 - RNA, 19 nt, Human
uaagcagacaccacucaga

SEQ ID NO: 378454 - RNA, 24 nt, Human
uagcuaagaagcaacugucgccau

SEQ ID NO: 378455 - RNA, 25 nt, Human
uccaacuuuuuaaaugaaacuagaa

SEQ ID NO: 378456 - RNA, 24 nt, Human
ucucagagcaauagcuaagaagca

SEQ ID NO: 378457 - RNA, 20 nt, Human
ucuucuggaaaacagaggcu

SEQ ID NO: 378458 - RNA, 18 nt, Human
ucuugauuacagaguugu

SEQ ID NO: 378459 - RNA, 22 nt, Human
ucuuuguuuuacacuacucauu

SEQ ID NO: 378460 - RNA, 18 nt, Human
ugaaagacauaggagaag

SEQ ID NO: 378461 - RNA, 18 nt, Human
ugcucauuugucaaaaca

SEQ ID NO: 378462 - RNA, 22 nt, Human
uggaaaacagaggcacucauca

SEQ ID NO: 378463 - RNA, 19 nt, Human
uggacaucugguggaggca

SEQ ID NO: 378464 - RNA, 22 nt, Human
uggggugaccccuucacaagag

SEQ ID NO: 378465 - RNA, 22 nt, Human
ugguguggaaaugugggcucug

SEQ ID NO: 378466 - RNA, 25 nt, Human
uucucuauccucuuaguagccaucc

SEQ ID NO: 378467 - RNA, 18 nt, Human
uugaaaugaggucaaugc

SEQ ID NO: 378468 - RNA, 22 nt, Human
uuuucagcacuaugaggagagg

SEQ ID NO: 378469 - RNA, 20 nt, Human
agagagaggccucuggggca

SEQ ID NO: 378470 - RNA, 24 nt, Human
agagagaggccucuggggcagagc

SEQ ID NO: 378471 - RNA, 22 nt, Human
agcaaggaggggggccccccaa

SEQ ID NO: 378472 - RNA, 18 nt, Human
aggcccccugcccggccu

SEQ ID NO: 378473 - RNA, 24 nt, Human
auggcucggccccugcagugcccc

SEQ ID NO: 378474 - RNA, 22 nt, Human
caaaguggcuagagacaggggu

SEQ ID NO: 378475 - RNA, 19 nt, Human
caaucuaugaaaauaaagu

SEQ ID NO: 378476 - RNA, 18 nt, Human
cacaggaggaaaaaagcc

SEQ ID NO: 378477 - RNA, 24 nt, Human
cacgcugaccuacacuauguacac

SEQ ID NO: 378478 - RNA, 19 nt, Human
cagccagcggcccacccag

SEQ ID NO: 378479 - RNA, 18 nt, Human
caggcccccugcccggcc

SEQ ID NO: 378480 - RNA, 19 nt, Human
caggcccccugcccggccu

SEQ ID NO: 378481 - RNA, 22 nt, Human
ccacccagagacgcugcagcag

SEQ ID NO: 378482 - RNA, 19 nt, Human
cccacgacggagagagagg

SEQ ID NO: 378483 - RNA, 21 nt, Human
cccccaaaauggcucggcccc

SEQ ID NO: 378484 - RNA, 23 nt, Human
ccccccaaaauggcucggccccc

SEQ ID NO: 378485 - RNA, 24 nt, Human
ccgggaaagccaaguuggcuuccg

SEQ ID NO: 378486 - RNA, 24 nt, Human
ccucaggucaggaggcuaagcacg

SEQ ID NO: 378487 - RNA, 21 nt, Human
ccugcagugccccgaucggcc

SEQ ID NO: 378488 - RNA, 22 nt, Human
ccugccagccagcggcccaccc

SEQ ID NO: 378489 - RNA, 26 nt, Human
cugcaggcccccugcccggccugcca

SEQ ID NO: 378490 - RNA, 19 nt, Human
cugcagugccccgaucggc

SEQ ID NO: 378491 - RNA, 22 nt, Human
cuuccaccgcgaaggcacacag

SEQ ID NO: 378492 - RNA, 20 nt, Human
cuugcacugccuucggccuu

SEQ ID NO: 378493 - RNA, 20 nt, Human
gaaaauaaaguuugcaaaag

SEQ ID NO: 378494 - RNA, 23 nt, Human
gaaggcacacagcagccgcaggu

SEQ ID NO: 378495 - RNA, 21 nt, Human
gagaggccucuggggcagagc

SEQ ID NO: 378496 - RNA, 18 nt, Human
gcaaggaggggggccccc

SEQ ID NO: 378497 - RNA, 22 nt, Human
gcacaguccugcugcaggcccc

SEQ ID NO: 378498 - RNA, 22 nt, Human
gccucuggggcagagcccugcu

SEQ ID NO: 378499 - RNA, 22 nt, Human
gcuaagcacgcugaccuacacu

SEQ ID NO: 378500 - RNA, 21 nt, Human
gcugaccuacacuauguacac

SEQ ID NO: 378501 - RNA, 18 nt, Human
ggaaauguaccccucucu

SEQ ID NO: 378502 - RNA, 23 nt, Human
ggcucggccccugcagugccccg

SEQ ID NO: 378503 - RNA, 19 nt, Human
guacacaggaggaaaaaag

SEQ ID NO: 378504 - RNA, 22 nt, Human
uagggucaagaucgcgccccuc

SEQ ID NO: 378505 - RNA, 23 nt, Human
ucagcaccaucauggccgccggu

SEQ ID NO: 378506 - RNA, 20 nt, Human
uccugcugcaggcccccugc

SEQ ID NO: 378507 - RNA, 21 nt, Human
ugccuucggccuucaaagcuu

SEQ ID NO: 378508 - RNA, 19 nt, Human
uguacacgucucucuccca

SEQ ID NO: 378509 - RNA, 21 nt, Human
uguggaggccagagucucuug

SEQ ID NO: 378510 - RNA, 19 nt, Human
aaaaacaaugagcaggcuc

SEQ ID NO: 378511 - RNA, 23 nt, Human
aaaacauucguauaaaaagggga

SEQ ID NO: 378512 - RNA, 23 nt, Human
aaagccugauaaaaacugaggaa

SEQ ID NO: 378513 - RNA, 22 nt, Human
aagcaaaaaggagagaguaggg

SEQ ID NO: 378514 - RNA, 19 nt, Human
accuauccucucacgccca

SEQ ID NO: 378515 - RNA, 20 nt, Human
agaaaacauucguauaaaaa

SEQ ID NO: 378516 - RNA, 26 nt, Human
agagaaagccugauaaaaacugagga

SEQ ID NO: 378517 - RNA, 20 nt, Human
agguggaggggugggcugag

SEQ ID NO: 378518 - RNA, 21 nt, Human
aucaagacgcuacagcaacuc

SEQ ID NO: 378519 - RNA, 19 nt, Human
aucauggcaaacccaagca

SEQ ID NO: 378520 - RNA, 20 nt, Human
aucauggcaaacccaagcac

SEQ ID NO: 378521 - RNA, 21 nt, Human
auggcaaacccaagcacacug

SEQ ID NO: 378522 - RNA, 24 nt, Human
caacccccgcccggcaccgccuca

SEQ ID NO: 378523 - RNA, 20 nt, Human
cacuggccugaguggcccag

SEQ ID NO: 378524 - RNA, 18 nt, Human
cagcgcagaagccccccc

SEQ ID NO: 378525 - RNA, 19 nt, Human
cagggcugcccaguuucug

SEQ ID NO: 378526 - RNA, 24 nt, Human
caugcauccgcaggccugcccccu

SEQ ID NO: 378527 - RNA, 29 nt, Human
ccagagaaagccugauaaaaacugaggaa

SEQ ID NO: 378528 - RNA, 19 nt, Human
ccagggcugggccccccuc

SEQ ID NO: 378529 - RNA, 19 nt, Human
ccaggggagggaacgcaga

SEQ ID NO: 378530 - RNA, 23 nt, Human
cccaagcacacugguagaaaaca

SEQ ID NO: 378531 - RNA, 20 nt, Human
cccagggagagaaucaagac

SEQ ID NO: 378532 - RNA, 21 nt, Human
cccagggcugggccccccucc

SEQ ID NO: 378533 - RNA, 18 nt, Human
cccaguuucugcccugcc

SEQ ID NO: 378534 - RNA, 23 nt, Human
ccccccuccuccccuggcugucc

SEQ ID NO: 378535 - RNA, 18 nt, Human
cccccugccucccaccag

SEQ ID NO: 378536 - RNA, 22 nt, Human
ccccugccucccaccagccucc

SEQ ID NO: 378537 - RNA, 18 nt, Human
ccgcucagggagacgcgg

SEQ ID NO: 378538 - RNA, 19 nt, Human
ccuggugcucagagacugc

SEQ ID NO: 378539 - RNA, 23 nt, Human
cgcagacccagggagagaaucaa

SEQ ID NO: 378540 - RNA, 21 nt, Human
cgccaccgcccaugacacccg

SEQ ID NO: 378541 - RNA, 18 nt, Human
cgcccaugacacccgaca

SEQ ID NO: 378542 - RNA, 19 nt, Human
cgucgccaccgcccaugac

SEQ ID NO: 378543 - RNA, 24 nt, Human
cucacgcccaccaggcccuggacc

SEQ ID NO: 378544 - RNA, 19 nt, Human
cucagagacugcugucccc

SEQ ID NO: 378545 - RNA, 21 nt, Human
cucccagggcugggccccccu

SEQ ID NO: 378546 - RNA, 23 nt, Human
cucucacgcccaccaggcccugg

SEQ ID NO: 378547 - RNA, 18 nt, Human
cucuuccccaccacucuc

SEQ ID NO: 378548 - RNA, 19 nt, Human
cucuuccccaccacucuca

SEQ ID NO: 378549 - RNA, 24 nt, Human
gaagcccccccugccgucccgcuc

SEQ ID NO: 378550 - RNA, 23 nt, Human
gcaucauggcaaacccaagcaca

SEQ ID NO: 378551 - RNA, 18 nt, Human
gcuggaggcaggggcuug

SEQ ID NO: 378552 - RNA, 18 nt, Human
ggaagcaaaaaggagaga

SEQ ID NO: 378553 - RNA, 20 nt, Human
ggcaggggcuuggcagcuug

SEQ ID NO: 378554 - RNA, 18 nt, Human
ggcccuggaccaugggca

SEQ ID NO: 378555 - RNA, 19 nt, Human
ggccugagggcaacugcuc

SEQ ID NO: 378556 - RNA, 23 nt, Human
ggcugggccccccuccuccccug

SEQ ID NO: 378557 - RNA, 20 nt, Human
gggaagaugcugagggggag

SEQ ID NO: 378558 - RNA, 21 nt, Human
gggagggaacgcagacccagg

SEQ ID NO: 378559 - RNA, 21 nt, Human
gggcaugcugggcacaggccu

SEQ ID NO: 378560 - RNA, 21 nt, Human
gggcuuggcagcuugggagcu

SEQ ID NO: 378561 - RNA, 23 nt, Human
ggugcacuggccugaguggccca

SEQ ID NO: 378562 - RNA, 18 nt, Human
gucgccaccgcccaugac

SEQ ID NO: 378563 - RNA, 18 nt, Human
ucagggagacgcgggggc

SEQ ID NO: 378564 - RNA, 18 nt, Human
uccccuggcuguccugug

SEQ ID NO: 378565 - RNA, 22 nt, Human
uccgcaggccugcccccugccu

SEQ ID NO: 378566 - RNA, 21 nt, Human
ucgagagagagguggaggggu

SEQ ID NO: 378567 - RNA, 22 nt, Human
ugacacccgacaacccccgccc

SEQ ID NO: 378568 - RNA, 27 nt, Human
ugaggaagcaaaaaggagagaguaggg

SEQ ID NO: 378569 - RNA, 19 nt, Human
ugagggcaacugcucccug

SEQ ID NO: 378570 - RNA, 25 nt, Human
ugauaaaaacugaggaagcaaaaag

SEQ ID NO: 378571 - RNA, 18 nt, Human
ugcccugccaccuauccu

SEQ ID NO: 378572 - RNA, 19 nt, Human
ugcccugccaccuauccuc

SEQ ID NO: 378573 - RNA, 22 nt, Human
ugcccugccaccuauccucuca

SEQ ID NO: 378574 - RNA, 24 nt, Human
ugcuaucaagucagggcugcccag

SEQ ID NO: 378575 - RNA, 22 nt, Human
uggaggggugggcugagccugg

SEQ ID NO: 378576 - RNA, 23 nt, Human
uggaggggugggcugagccuggu

SEQ ID NO: 378577 - RNA, 20 nt, Human
uggcccagaagccucggcag

SEQ ID NO: 378578 - RNA, 22 nt, Human
uggccugaguggcccagaagcc

SEQ ID NO: 378579 - RNA, 23 nt, Human
ugggcaucuagugacagcagcuu

SEQ ID NO: 378580 - RNA, 25 nt, Human
uguaauaaagggaaaaacaaugagc

SEQ ID NO: 378581 - RNA, 22 nt, Human
uucaggagagagaaacucagga

SEQ ID NO: 378582 - RNA, 22 nt, Human
aaaaaggccucuucagcuggcc

SEQ ID NO: 378583 - RNA, 21 nt, Human
aaaagcaaaaauguggcaugc

SEQ ID NO: 378584 - RNA, 23 nt, Human
aaaagcaaaaauguggcaugcaa

SEQ ID NO: 378585 - RNA, 21 nt, Human
aaaagccaaaagaucuccagu

SEQ ID NO: 378586 - RNA, 18 nt, Human
aaaagcucaaaagcaaaa

SEQ ID NO: 378587 - RNA, 24 nt, Human
aaaauguugggauuacaggcguga

SEQ ID NO: 378588 - RNA, 19 nt, Human
aaauguugggauuacaggc

SEQ ID NO: 378589 - RNA, 23 nt, Human
aacaagaggagccucaggaaaga

SEQ ID NO: 378590 - RNA, 18 nt, Human
aacaucuuuggguagcug

SEQ ID NO: 378591 - RNA, 23 nt, Human
aagucacgaaauauauauaaaua

SEQ ID NO: 378592 - RNA, 22 nt, Human
aagucuuuugcaugagcuaaac

SEQ ID NO: 378593 - RNA, 20 nt, Human
aagugccacagaccaacacu

SEQ ID NO: 378594 - RNA, 19 nt, Human
acaacaaaaaggccucuuc

SEQ ID NO: 378595 - RNA, 20 nt, Human
acaacaaaaaggccucuuca

SEQ ID NO: 378596 - RNA, 22 nt, Human
acaacaaaaaggccucuucagc

SEQ ID NO: 378597 - RNA, 21 nt, Human
acaagaacaucaugcuggaaa

SEQ ID NO: 378598 - RNA, 18 nt, Human
accaaggccucaggugcu

SEQ ID NO: 378599 - RNA, 24 nt, Human
accagguaauccacccgccuuggc

SEQ ID NO: 378600 - RNA, 23 nt, Human
accccgcuccacauggaaccgaa

SEQ ID NO: 378601 - RNA, 21 nt, Human
acccgccuuggccucccaaaa

SEQ ID NO: 378602 - RNA, 22 nt, Human
acccgccuuggccucccaaaau

SEQ ID NO: 378603 - RNA, 25 nt, Human
acuaugcugcccaggcuggacucga

SEQ ID NO: 378604 - RNA, 20 nt, Human
acuccaaugagguguggcau

SEQ ID NO: 378605 - RNA, 20 nt, Human
agaaaucaauguccaaauaa

SEQ ID NO: 378606 - RNA, 20 nt, Human
agacagggucucacacuaug

SEQ ID NO: 378607 - RNA, 22 nt, Human
agacauuacauucgacaacaua

SEQ ID NO: 378608 - RNA, 18 nt, Human
agacuacaggcaugcacc

SEQ ID NO: 378609 - RNA, 20 nt, Human
agcauccaacccacucgagc

SEQ ID NO: 378610 - RNA, 20 nt, Human
agccuuucagauaacaauuc

SEQ ID NO: 378611 - RNA, 20 nt, Human
agcuucagggcuuauaggga

SEQ ID NO: 378612 - RNA, 20 nt, Human
aggaaagaggcaagcaucca

SEQ ID NO: 378613 - RNA, 23 nt, Human
aggcaugcaccaccagguaaucc

SEQ ID NO: 378614 - RNA, 19 nt, Human
aggcauuuuuguuguucua

SEQ ID NO: 378615 - RNA, 23 nt, Human
aggcgugagucacugugucuggc

SEQ ID NO: 378616 - RNA, 25 nt, Human
aggcuggagugcaguggcgcaaucu

SEQ ID NO: 378617 - RNA, 22 nt, Human
agguaauccacccgccuuggcc

SEQ ID NO: 378618 - RNA, 24 nt, Human
agguaauccacccgccuuggccuc

SEQ ID NO: 378619 - RNA, 18 nt, Human
aguagcugggaguacagg

SEQ ID NO: 378620 - RNA, 21 nt, Human
agucuuuaaaauuaaacccuu

SEQ ID NO: 378621 - RNA, 24 nt, Human
agugauucuccugccucagccucc

SEQ ID NO: 378622 - RNA, 20 nt, Human
agugcaguggcgcaaucucg

SEQ ID NO: 378623 - RNA, 24 nt, Human
agugcaguggcgcaaucucgguuc

SEQ ID NO: 378624 - RNA, 27 nt, Human
auauauacauacauacacuugaccaug

SEQ ID NO: 378625 - RNA, 19 nt, Human
auauauauauauauauaua

SEQ ID NO: 378626 - RNA, 19 nt, Human
auauauauauauauauaua

SEQ ID NO: 378627 - RNA, 19 nt, Human
auauauauauauauauaua

SEQ ID NO: 378628 - RNA, 19 nt, Human
auauauauauauauauaua

SEQ ID NO: 378629 - RNA, 19 nt, Human
auauauauauauauauaua

SEQ ID NO: 378630 - RNA, 19 nt, Human
auauauauauauauauaua

SEQ ID NO: 378631 - RNA, 19 nt, Human
auauauauauauauauaua

SEQ ID NO: 378632 - RNA, 19 nt, Human
auauauauauauauauaua

SEQ ID NO: 378633 - RNA, 19 nt, Human
auauauauauauauauaua

SEQ ID NO: 378634 - RNA, 19 nt, Human
auauauauauauauauaua

SEQ ID NO: 378635 - RNA, 19 nt, Human
auauauauauauauauaua

SEQ ID NO: 378636 - RNA, 19 nt, Human
auauauauauauauauaua

SEQ ID NO: 378637 - RNA, 19 nt, Human
auauauauauauauauaua

SEQ ID NO: 378638 - RNA, 19 nt, Human
auauauauauauauauaua

SEQ ID NO: 378639 - RNA, 19 nt, Human
auauauauauauauauaua

SEQ ID NO: 378640 - RNA, 19 nt, Human
auauauauauauauauaua

SEQ ID NO: 378641 - RNA, 19 nt, Human
auauauauauauauauaua

SEQ ID NO: 378642 - RNA, 19 nt, Human
auauauauauauauauaua

SEQ ID NO: 378643 - RNA, 19 nt, Human
auauauauauauauauaua

SEQ ID NO: 378644 - RNA, 19 nt, Human
auauauauauauauauaua

SEQ ID NO: 378645 - RNA, 19 nt, Human
auauauauauauauauaua

SEQ ID NO: 378646 - RNA, 19 nt, Human
auauauauauauauauaua

SEQ ID NO: 378647 - RNA, 19 nt, Human
auauauauauauauauaua

SEQ ID NO: 378648 - RNA, 19 nt, Human
auauauauauauauauaua

SEQ ID NO: 378649 - RNA, 19 nt, Human
auauauauauauauauaua

SEQ ID NO: 378650 - RNA, 19 nt, Human
auauauauauauauauaua

SEQ ID NO: 378651 - RNA, 19 nt, Human
auauauauauauauauaua

SEQ ID NO: 378652 - RNA, 19 nt, Human
auauauauauauauauaua

SEQ ID NO: 378653 - RNA, 19 nt, Human
auauauauauauauauaua

SEQ ID NO: 378654 - RNA, 19 nt, Human
auauauauauauauauaua

SEQ ID NO: 378655 - RNA, 19 nt, Human
auauauauauauauauaua

SEQ ID NO: 378656 - RNA, 19 nt, Human
auauauauauauauauaua

SEQ ID NO: 378657 - RNA, 19 nt, Human
auauauauauauauauaua

SEQ ID NO: 378658 - RNA, 19 nt, Human
auauauauauauauauaua

SEQ ID NO: 378659 - RNA, 23 nt, Human
aucaccuuucagcccaagugcca

SEQ ID NO: 378660 - RNA, 18 nt, Human
augccacaaacacacaac

SEQ ID NO: 378661 - RNA, 19 nt, Human
auggcaaagaaauaagcau

SEQ ID NO: 378662 - RNA, 20 nt, Human
auggggggacuuggaaaucu

SEQ ID NO: 378663 - RNA, 24 nt, Human
caaaagaucuccaguuauaagcac

SEQ ID NO: 378664 - RNA, 20 nt, Human
caaaaggagugacauuaaua

SEQ ID NO: 378665 - RNA, 20 nt, Human
caaaauaauacccuuacuga

SEQ ID NO: 378666 - RNA, 24 nt, Human
caaaauguugggauuacaggcgug

SEQ ID NO: 378667 - RNA, 18 nt, Human
caaauaauccauucauaa

SEQ ID NO: 378668 - RNA, 23 nt, Human
caacaaaaaggccucuucagcug

SEQ ID NO: 378669 - RNA, 25 nt, Human
caacagcacucuaccucagcuaucc

SEQ ID NO: 378670 - RNA, 20 nt, Human
caagugauucuccugccuca

SEQ ID NO: 378671 - RNA, 22 nt, Human
caagugauucuccugccucagc

SEQ ID NO: 378672 - RNA, 21 nt, Human
caccagguaauccacccgccu

SEQ ID NO: 378673 - RNA, 23 nt, Human
cacccgccuuggccucccaaaau

SEQ ID NO: 378674 - RNA, 26 nt, Human
cacugcaugaaccaaggccucagguu

SEQ ID NO: 378675 - RNA, 19 nt, Human
cacuggcuauacuccaaug

SEQ ID NO: 378676 - RNA, 23 nt, Human
cacuguaaccucugcgucccggg

SEQ ID NO: 378677 - RNA, 19 nt, Human
cagcaaaagcucaaaagca

SEQ ID NO: 378678 - RNA, 22 nt, Human
cagcccaagugccacagaccaa

SEQ ID NO: 378679 - RNA, 20 nt, Human
cagccuccugaguagcugag

SEQ ID NO: 378680 - RNA, 23 nt, Human
caggcuggacucgaacuacuagg

SEQ ID NO: 378681 - RNA, 21 nt, Human
cauaacagugcaguccucaga

SEQ ID NO: 378682 - RNA, 24 nt, Human
cauagaaaagccaaaagaucucca

SEQ ID NO: 378683 - RNA, 23 nt, Human
cauagcuucagggcuuauaggga

SEQ ID NO: 378684 - RNA, 22 nt, Human
caucaugcuggaaaacuucuuc

SEQ ID NO: 378685 - RNA, 21 nt, Human
caugcucgcaaaaggagugac

SEQ ID NO: 378686 - RNA, 18 nt, Human
cauggaaccgaaggugcu

SEQ ID NO: 378687 - RNA, 22 nt, Human
ccaaaauguugggauuacaggc

SEQ ID NO: 378688 - RNA, 22 nt, Human
ccaaaauguugggauuacaggc

SEQ ID NO: 378689 - RNA, 24 nt, Human
ccaaaauguugggauuacaggcgu

SEQ ID NO: 378690 - RNA, 22 nt, Human
ccacaaacacacaacgagccau

SEQ ID NO: 378691 - RNA, 20 nt, Human
ccacagaggagaacacaggg

SEQ ID NO: 378692 - RNA, 21 nt, Human
ccacagaggagaacacaggga

SEQ ID NO: 378693 - RNA, 21 nt, Human
cccaagugccacagaccaaca

SEQ ID NO: 378694 - RNA, 22 nt, Human
cccaggcuggagugcaguggcg

SEQ ID NO: 378695 - RNA, 22 nt, Human
ccccgcuccacauggaaccgaa

SEQ ID NO: 378696 - RNA, 23 nt, Human
cccgaguagcugggaguacaggu

SEQ ID NO: 378697 - RNA, 23 nt, Human
cccggguucaagugauucuccuc

SEQ ID NO: 378698 - RNA, 23 nt, Human
cccggguucaagugauucuccug

SEQ ID NO: 378699 - RNA, 20 nt, Human
ccucaaagaauccucugaua

SEQ ID NO: 378700 - RNA, 19 nt, Human
ccugaguagcugagacuac

SEQ ID NO: 378701 - RNA, 24 nt, Human
ccugaguagcugagacuacaggca

SEQ ID NO: 378702 - RNA, 19 nt, Human
ccuucauuacaaguggugc

SEQ ID NO: 378703 - RNA, 21 nt, Human
cguaacaucuuuggguagcug

SEQ ID NO: 378704 - RNA, 24 nt, Human
cgucccggguucaagugauucucc

SEQ ID NO: 378705 - RNA, 18 nt, Human
cuaggcccaaagccaucc

SEQ ID NO: 378706 - RNA, 18 nt, Human
cuccacauggaaccgaag

SEQ ID NO: 378707 - RNA, 21 nt, Human
cucgcucuguugcccaggcug

SEQ ID NO: 378708 - RNA, 24 nt, Human
cucgcucuguugcccaggcuggag

SEQ ID NO: 378709 - RNA, 20 nt, Human
cucuguugcccaggcuggag

SEQ ID NO: 378710 - RNA, 21 nt, Human
cugaagcucuguacaaugugg

SEQ ID NO: 378711 - RNA, 21 nt, Human
cugacccuuuaaaagaacaag

SEQ ID NO: 378712 - RNA, 23 nt, Human
cugccucagccuccugaguagcu

SEQ ID NO: 378713 - RNA, 21 nt, Human
cuggaaaacuucuucauuuca

SEQ ID NO: 378714 - RNA, 24 nt, Human
gaacuacuaggcccaaagccaucc

SEQ ID NO: 378715 - RNA, 24 nt, Human
gacuuuugucacuaauccauuuuc

SEQ ID NO: 378716 - RNA, 24 nt, Human
gaguacaggugugcaccaccaugc

SEQ ID NO: 378717 - RNA, 24 nt, Human
gaguagcugagacuacaggcaugc

SEQ ID NO: 378718 - RNA, 18 nt, Human
gauuacaggcgugaguca

SEQ ID NO: 378719 - RNA, 21 nt, Human
gauuacaggcgugagucacug

SEQ ID NO: 378720 - RNA, 24 nt, Human
gauuacaggcgugagucacugugu

SEQ ID NO: 378721 - RNA, 20 nt, Human
gccucagccuccugaguagc

SEQ ID NO: 378722 - RNA, 25 nt, Human
gcucuguugcccaggcuggagugca

SEQ ID NO: 378723 - RNA, 19 nt, Human
gcuggagugcaguggcgca

SEQ ID NO: 378724 - RNA, 22 nt, Human
ggaaagaaugaaagccuuucag

SEQ ID NO: 378725 - RNA, 18 nt, Human
gggaugcugugccuaaaa

SEQ ID NO: 378726 - RNA, 22 nt, Human
ggguucaagugauucuccugcc

SEQ ID NO: 378727 - RNA, 23 nt, Human
ggguucaagugauucuccugccu

SEQ ID NO: 378728 - RNA, 24 nt, Human
guaauccacccgccuuggccuccc

SEQ ID NO: 378729 - RNA, 24 nt, Human
gucucgcucuguugcccaggcugg

SEQ ID NO: 378730 - RNA, 24 nt, Human
gugauucuccugccucagccuccu

SEQ ID NO: 378731 - RNA, 23 nt, Human
guuaggaaagaggcaagcaucca

SEQ ID NO: 378732 - RNA, 20 nt, Human
uaaaaaaauuacaaaauaca

SEQ ID NO: 378733 - RNA, 20 nt, Human
uaaaacacauagcuucaggg

SEQ ID NO: 378734 - RNA, 28 nt, Human
uaaaccccgcuccacauggaaccgaagg

SEQ ID NO: 378735 - RNA, 23 nt, Human
uaacagcagagguucuaccuccu

SEQ ID NO: 378736 - RNA, 19 nt, Human
uaaccaaguucauuaacag

SEQ ID NO: 378737 - RNA, 21 nt, Human
uaaguaaggcuaagcuccaaa

SEQ ID NO: 378738 - RNA, 19 nt, Human
uaaguguagauggggggac

SEQ ID NO: 378739 - RNA, 21 nt, Human
uaauacauuaggaacaugaaa

SEQ ID NO: 378740 - RNA, 23 nt, Human
uaauauauacauacauacacuug

SEQ ID NO: 378741 - RNA, 24 nt, Human
uacaaaauacaaaugcccguguua

SEQ ID NO: 378742 - RNA, 23 nt, Human
uaggcccaaagccauccuccugu

SEQ ID NO: 378743 - RNA, 22 nt, Human
uaggugauuuagucaaaagaga

SEQ ID NO: 378744 - RNA, 24 nt, Human
uauaaauauauauauauauauaua

SEQ ID NO: 378745 - RNA, 20 nt, Human
uauauaaauauauauauaua

SEQ ID NO: 378746 - RNA, 20 nt, Human
uauauaaauauauauauaua

SEQ ID NO: 378747 - RNA, 22 nt, Human
uauauauaaauauauauauaua

SEQ ID NO: 378748 - RNA, 25 nt, Human
uauauauaaauauauauauauauau

SEQ ID NO: 378749 - RNA, 24 nt, Human
uauauauaaauauauauauauauu

SEQ ID NO: 378750 - RNA, 19 nt, Human
uauauauauauauauauau

SEQ ID NO: 378751 - RNA, 19 nt, Human
uauauauauauauauauau

SEQ ID NO: 378752 - RNA, 19 nt, Human
uauauauauauauauauau

SEQ ID NO: 378753 - RNA, 19 nt, Human
uauauauauauauauauau

SEQ ID NO: 378754 - RNA, 19 nt, Human
uauauauauauauauauau

SEQ ID NO: 378755 - RNA, 19 nt, Human
uauauauauauauauauau

SEQ ID NO: 378756 - RNA, 19 nt, Human
uauauauauauauauauau

SEQ ID NO: 378757 - RNA, 19 nt, Human
uauauauauauauauauau

SEQ ID NO: 378758 - RNA, 19 nt, Human
uauauauauauauauauau

SEQ ID NO: 378759 - RNA, 19 nt, Human
uauauauauauauauauau

SEQ ID NO: 378760 - RNA, 19 nt, Human
uauauauauauauauauau

SEQ ID NO: 378761 - RNA, 19 nt, Human
uauauauauauauauauau

SEQ ID NO: 378762 - RNA, 19 nt, Human
uauauauauauauauauau

SEQ ID NO: 378763 - RNA, 19 nt, Human
uauauauauauauauauau

SEQ ID NO: 378764 - RNA, 19 nt, Human
uauauauauauauauauau

SEQ ID NO: 378765 - RNA, 19 nt, Human
uauauauauauauauauau

SEQ ID NO: 378766 - RNA, 19 nt, Human
uauauauauauauauauau

SEQ ID NO: 378767 - RNA, 19 nt, Human
uauauauauauauauauau

SEQ ID NO: 378768 - RNA, 18 nt, Human
uaugcugcccaggcugga

SEQ ID NO: 378769 - RNA, 24 nt, Human
uaugcugcccaggcuggacucgaa

SEQ ID NO: 378770 - RNA, 18 nt, Human
uauuggaccuuuguuaga

SEQ ID NO: 378771 - RNA, 22 nt, Human
uauuuauuuauuuauuuuuggu

SEQ ID NO: 378772 - RNA, 21 nt, Human
ucaaaagagaacacugcauga

SEQ ID NO: 378773 - RNA, 20 nt, Human
ucaaaagcaaaaauguggca

SEQ ID NO: 378774 - RNA, 24 nt, Human
ucaaagaauccucugauaauuuua

SEQ ID NO: 378775 - RNA, 21 nt, Human
ucaacagcacucuaccucagc

SEQ ID NO: 378776 - RNA, 19 nt, Human
ucaagugauucuccugccu

SEQ ID NO: 378777 - RNA, 24 nt, Human
ucacacuaugcugcccaggcugga

SEQ ID NO: 378778 - RNA, 19 nt, Human
ucacuguaaccucugcggg

SEQ ID NO: 378779 - RNA, 22 nt, Human
ucacuguaaccucugcgggguc

SEQ ID NO: 378780 - RNA, 23 nt, Human
ucacuguaaccucugcgucccgg

SEQ ID NO: 378781 - RNA, 24 nt, Human
ucacuguaaccucugcgucccggg

SEQ ID NO: 378782 - RNA, 19 nt, Human
uccacauggaaccgaaggu

SEQ ID NO: 378783 - RNA, 18 nt, Human
ucccaaaaagugaaggcu

SEQ ID NO: 378784 - RNA, 24 nt, Human
ucccaaaauguugggauuacaggc

SEQ ID NO: 378785 - RNA, 19 nt, Human
ucccggguucaagugauuc

SEQ ID NO: 378786 - RNA, 21 nt, Human
ucccggguucaagugauucuc

SEQ ID NO: 378787 - RNA, 24 nt, Human
ucccggguucaagugauucuccug

SEQ ID NO: 378788 - RNA, 19 nt, Human
uccggggccuaaucaugcu

SEQ ID NO: 378789 - RNA, 24 nt, Human
uccugaguagcugagacuacaggc

SEQ ID NO: 378790 - RNA, 24 nt, Human
ucgcucuguugcccaggcuggagu

SEQ ID NO: 378791 - RNA, 24 nt, Human
ucucacacuaugcugcccaggcug

SEQ ID NO: 378792 - RNA, 30 nt, Human
ucucacacuaugcugcccaggcuggacucc

SEQ ID NO: 378793 - RNA, 24 nt, Human
ucuccugccucagccuccugagua

SEQ ID NO: 378794 - RNA, 19 nt, Human
ucucgcucuguugcccagg

SEQ ID NO: 378795 - RNA, 23 nt, Human
ucucgcucuguugcccaggcugg

SEQ ID NO: 378796 - RNA, 24 nt, Human
ucucgcucuguugcccaggcugga

SEQ ID NO: 378797 - RNA, 26 nt, Human
ucucgcucuguugcccaggcuggagu

SEQ ID NO: 378798 - RNA, 27 nt, Human
ucucgcucuguugcccaggcuggagug

SEQ ID NO: 378799 - RNA, 18 nt, Human
ucuguugcccaggcugga

SEQ ID NO: 378800 - RNA, 24 nt, Human
ucuguugcccaggcuggagugcag

SEQ ID NO: 378801 - RNA, 23 nt, Human
ugaauaacggaucuuuggaggag

SEQ ID NO: 378802 - RNA, 18 nt, Human
ugacauuaauagcuuugg

SEQ ID NO: 378803 - RNA, 21 nt, Human
ugagacuacaggcaugcacca

SEQ ID NO: 378804 - RNA, 24 nt, Human
ugagacuacaggcaugcaccacca

SEQ ID NO: 378805 - RNA, 23 nt, Human
ugagauagaggucucgcucuguu

SEQ ID NO: 378806 - RNA, 20 nt, Human
ugauucuccugccucagccu

SEQ ID NO: 378807 - RNA, 23 nt, Human
ugcaguggcgcaaucucgguuca

SEQ ID NO: 378808 - RNA, 24 nt, Human
ugcaugaaccaaggccucaggugc

SEQ ID NO: 378809 - RNA, 22 nt, Human
ugccacaaacacacaacgagcc

SEQ ID NO: 378810 - RNA, 22 nt, Human
ugccauuaucaccuuucagccc

SEQ ID NO: 378811 - RNA, 20 nt, Human
ugcccaggcuggacucgaac

SEQ ID NO: 378812 - RNA, 18 nt, Human
ugcccaggcuggagugca

SEQ ID NO: 378813 - RNA, 21 nt, Human
ugcccaggcuggagugcagug

SEQ ID NO: 378814 - RNA, 22 nt, Human
ugcccaggcuggagugcagugg

SEQ ID NO: 378815 - RNA, 24 nt, Human
ugccucagccuccugaguagcuga

SEQ ID NO: 378816 - RNA, 19 nt, Human
uggacucgaacuacuaggc

SEQ ID NO: 378817 - RNA, 23 nt, Human
uggagugcaguggcgcaaucucg

SEQ ID NO: 378818 - RNA, 24 nt, Human
uggagugcaguggcgcaaucucgg

SEQ ID NO: 378819 - RNA, 19 nt, Human
uggcaaagaaauaagcauc

SEQ ID NO: 378820 - RNA, 25 nt, Human
uggcaugcaaaaauauguguaaaug

SEQ ID NO: 378821 - RNA, 18 nt, Human
ugggauuacaggcgugag

SEQ ID NO: 378822 - RNA, 21 nt, Human
ugggauuacaggcgugaguca

SEQ ID NO: 378823 - RNA, 22 nt, Human
ugggauuacaggcgugagucac

SEQ ID NO: 378824 - RNA, 22 nt, Human
ugggauuacaggcgugagucac

SEQ ID NO: 378825 - RNA, 22 nt, Human
ugggauuacaggcgugagucac

SEQ ID NO: 378826 - RNA, 24 nt, Human
ugggauuacaggcgugagucacug

SEQ ID NO: 378827 - RNA, 21 nt, Human
ugggcugacagucccacuggg

SEQ ID NO: 378828 - RNA, 25 nt, Human
uggggggacuuggaaaucuccgggg

SEQ ID NO: 378829 - RNA, 23 nt, Human
uguggcaugcaaaaauaugugua

SEQ ID NO: 378830 - RNA, 26 nt, Human
uguguaaaccacccgaguagcuggga

SEQ ID NO: 378831 - RNA, 19 nt, Human
uuagaauacuguguccagg

SEQ ID NO: 378832 - RNA, 21 nt, Human
uucaagugauucuccugccuc

SEQ ID NO: 378833 - RNA, 23 nt, Human
uucaagugauucuccugccucag

SEQ ID NO: 378834 - RNA, 24 nt, Human
uucaagugauucuccugccucagc

SEQ ID NO: 378835 - RNA, 23 nt, Human
uucacuguaaccucugcggguuc

SEQ ID NO: 378836 - RNA, 18 nt, Human
uuccaguauauuauucug

SEQ ID NO: 378837 - RNA, 21 nt, Human
uucccaguguccgugcauuuc

SEQ ID NO: 378838 - RNA, 24 nt, Human
uugcccaggcuggagugcaguggc

SEQ ID NO: 378839 - RNA, 19 nt, Human
uuggaaaucuccggggccu

SEQ ID NO: 378840 - RNA, 19 nt, Human
uuggagauggugucuuccu

SEQ ID NO: 378841 - RNA, 20 nt, Human
uuggcacauacagagacuga

SEQ ID NO: 378842 - RNA, 22 nt, Human
uuguuagaauacuguguccagg

SEQ ID NO: 378843 - RNA, 18 nt, Human
uuuggaggaguucgugga

SEQ ID NO: 378844 - RNA, 24 nt, Human
aaacaagaugccacugaaagcugg

SEQ ID NO: 378845 - RNA, 18 nt, Human
aaacagcaacaaaaauca

SEQ ID NO: 378846 - RNA, 23 nt, Human
aaagcaucuccaagcauacauac

SEQ ID NO: 378847 - RNA, 20 nt, Human
aacaucuguugagugacagu

SEQ ID NO: 378848 - RNA, 21 nt, Human
aacuaaggcucucuaagcccc

SEQ ID NO: 378849 - RNA, 18 nt, Human
aagccagggcgcccugag

SEQ ID NO: 378850 - RNA, 20 nt, Human
aagcccccaaccccaaacag

SEQ ID NO: 378851 - RNA, 24 nt, Human
aagggcuucauucucaagguuuug

SEQ ID NO: 378852 - RNA, 21 nt, Human
aaggggauggugaacacgagu

SEQ ID NO: 378853 - RNA, 21 nt, Human
aaguagaucugcaccagcccu

SEQ ID NO: 378854 - RNA, 18 nt, Human
aagucagacgccacaaca

SEQ ID NO: 378855 - RNA, 18 nt, Human
acaaagcaucuccaagca

SEQ ID NO: 378856 - RNA, 21 nt, Human
acacaaagcaucuccaagcau

SEQ ID NO: 378857 - RNA, 23 nt, Human
acaccaaugaccaauucacauca

SEQ ID NO: 378858 - RNA, 21 nt, Human
acagcaacaaaaaucaagacu

SEQ ID NO: 378859 - RNA, 22 nt, Human
accagguuuggagacugaauug

SEQ ID NO: 378860 - RNA, 19 nt, Human
accccaccucucuuccccg

SEQ ID NO: 378861 - RNA, 18 nt, Human
accugauaaugaaaaccu

SEQ ID NO: 378862 - RNA, 23 nt, Human
acugccacaauaacuuacaaaga

SEQ ID NO: 378863 - RNA, 21 nt, Human
agaaagcccccaaccccaaac

SEQ ID NO: 378864 - RNA, 24 nt, Human
agaaauaaggcaggagcaacagaa

SEQ ID NO: 378865 - RNA, 18 nt, Human
agaccccugguggcuacu

SEQ ID NO: 378866 - RNA, 23 nt, Human
agaguucuucaguucuccugccu

SEQ ID NO: 378867 - RNA, 25 nt, Human
agcaaacaccaaugaccaauucaca

SEQ ID NO: 378868 - RNA, 19 nt, Human
agcaccucuuuuccuuugc

SEQ ID NO: 378869 - RNA, 18 nt, Human
agcuggguuuaguaggug

SEQ ID NO: 378870 - RNA, 23 nt, Human
aggaaacagcaacaaaaaucaag

SEQ ID NO: 378871 - RNA, 24 nt, Human
aggauuaaaaaaaaaaaauccuac

SEQ ID NO: 378872 - RNA, 23 nt, Human
agggguggagcagggcucuuuga

SEQ ID NO: 378873 - RNA, 29 nt, Human
aggucaggaaacagcaacaaaagggaccc

SEQ ID NO: 378874 - RNA, 21 nt, Human
aguagccccaccccaccucuc

SEQ ID NO: 378875 - RNA, 23 nt, Human
aguguugccauuaagaaagcuuu

SEQ ID NO: 378876 - RNA, 23 nt, Human
auaaaacucucuuaagacucuuu

SEQ ID NO: 378877 - RNA, 24 nt, Human
auaaaacucucuuaagacucuuua

SEQ ID NO: 378878 - RNA, 18 nt, Human
auauguguguguauguaa

SEQ ID NO: 378879 - RNA, 22 nt, Human
augaugcuaggggggccaggag

SEQ ID NO: 378880 - RNA, 27 nt, Human
auguguguguguguaaaauaugugugu

SEQ ID NO: 378881 - RNA, 21 nt, Human
augugugugugugugugugug

SEQ ID NO: 378882 - RNA, 22 nt, Human
augugugugugugugugugugu

SEQ ID NO: 378883 - RNA, 23 nt, Human
auguguguguguguguguguguu

SEQ ID NO: 378884 - RNA, 22 nt, Human
caaaacaagaugccacugaaag

SEQ ID NO: 378885 - RNA, 23 nt, Human
caaaacaagaugccacugaaagc

SEQ ID NO: 378886 - RNA, 20 nt, Human
caaagauaagaaaacucaga

SEQ ID NO: 378887 - RNA, 19 nt, Human
caacagaacaggcccaaag

SEQ ID NO: 378888 - RNA, 20 nt, Human
caauccaacaucuguugagu

SEQ ID NO: 378889 - RNA, 21 nt, Human
caauucacaucaauggaaaga

SEQ ID NO: 378890 - RNA, 19 nt, Human
caccucucuuccccgaagg

SEQ ID NO: 378891 - RNA, 19 nt, Human
cacgagucauguacagggu

SEQ ID NO: 378892 - RNA, 25 nt, Human
cagaauggcaacccaccaucucucc

SEQ ID NO: 378893 - RNA, 20 nt, Human
cagaguagagccagaauauu

SEQ ID NO: 378894 - RNA, 23 nt, Human
caggaaacagcaacaaaaaucaa

SEQ ID NO: 378895 - RNA, 19 nt, Human
cagggcucuuugaagcauc

SEQ ID NO: 378896 - RNA, 19 nt, Human
cauaugugugugugugugu

SEQ ID NO: 378897 - RNA, 19 nt, Human
cauaugugugugugugugu

SEQ ID NO: 378898 - RNA, 21 nt, Human
caucaccgcuccucaucuccu

SEQ ID NO: 378899 - RNA, 19 nt, Human
caugagccuggcuguggau

SEQ ID NO: 378900 - RNA, 22 nt, Human
ccaaccccaaacagguuacggg

SEQ ID NO: 378901 - RNA, 20 nt, Human
ccaggaaaaggauccaugcc

SEQ ID NO: 378902 - RNA, 21 nt, Human
ccaucagagacaaagguagga

SEQ ID NO: 378903 - RNA, 19 nt, Human
cccaggugacaggcaagaa

SEQ ID NO: 378904 - RNA, 27 nt, Human
ccccaccccaccucucuuccccgaaag

SEQ ID NO: 378905 - RNA, 19 nt, Human
cccccaaccccaaacaggu

SEQ ID NO: 378906 - RNA, 18 nt, Human
ccccugguggcuacugug

SEQ ID NO: 378907 - RNA, 25 nt, Human
cccggugcuggcaucaccgcuccuc

SEQ ID NO: 378908 - RNA, 21 nt, Human
cccuaggcccuggauggccag

SEQ ID NO: 378909 - RNA, 18 nt, Human
ccugccuagcacuuggaa

SEQ ID NO: 378910 - RNA, 22 nt, Human
ccugucucuggcuaaccuaaga

SEQ ID NO: 378911 - RNA, 24 nt, Human
cuaguagccccaccccaccucucu

SEQ ID NO: 378912 - RNA, 23 nt, Human
cugacccuucagaguccacacca

SEQ ID NO: 378913 - RNA, 22 nt, Human
cuuccagugcucugcgcauccc

SEQ ID NO: 378914 - RNA, 19 nt, Human
cuugagcccauguccucag

SEQ ID NO: 378915 - RNA, 18 nt, Human
gaagacuggacuauauau

SEQ ID NO: 378916 - RNA, 21 nt, Human
gacaggcaagaacaggucagg

SEQ ID NO: 378917 - RNA, 18 nt, Human
gaccugauaaugaaaacc

SEQ ID NO: 378918 - RNA, 20 nt, Human
gagagauuucaaaggcuagg

SEQ ID NO: 378919 - RNA, 18 nt, Human
gcaacagaacaggcccaa

SEQ ID NO: 378920 - RNA, 25 nt, Human
gccaaccaucuggucaaggcaucac

SEQ ID NO: 378921 - RNA, 26 nt, Human
gcuccuuuuggcuuuucgguguaaaa

SEQ ID NO: 378922 - RNA, 18 nt, Human
ggaaacagauccuugggu

SEQ ID NO: 378923 - RNA, 20 nt, Human
ggaagacagcucugccccca

SEQ ID NO: 378924 - RNA, 21 nt, Human
ggaagacagcucugcccccag

SEQ ID NO: 378925 - RNA, 20 nt, Human
ggaugcuaguagccccaccc

SEQ ID NO: 378926 - RNA, 18 nt, Human
ggcagugggaagggagag

SEQ ID NO: 378927 - RNA, 19 nt, Human
ggcuacugugugaacugcc

SEQ ID NO: 378928 - RNA, 20 nt, Human
gggaagcagagggcaguggg

SEQ ID NO: 378929 - RNA, 18 nt, Human
ggggauggaggagaggca

SEQ ID NO: 378930 - RNA, 20 nt, Human
ggguggacuuaaaacaaguu

SEQ ID NO: 378931 - RNA, 20 nt, Human
ggguggagcagggcucuuug

SEQ ID NO: 378932 - RNA, 21 nt, Human
guaggaacccgagaaaugucu

SEQ ID NO: 378933 - RNA, 22 nt, Human
gucaggguucccuuaauugucc

SEQ ID NO: 378934 - RNA, 21 nt, Human
guggagcagggcucuuugaag

SEQ ID NO: 378935 - RNA, 26 nt, Human
guguguguguguaaaauaugugugug

SEQ ID NO: 378936 - RNA, 24 nt, Human
guguguguguguguguaaaaugug

SEQ ID NO: 378937 - RNA, 21 nt, Human
gugugugugugugugugugug

SEQ ID NO: 378938 - RNA, 26 nt, Human
uaaggcaggagcaacagaacaggccc

SEQ ID NO: 378939 - RNA, 23 nt, Human
uacaaacuccucuguuuucuaaa

SEQ ID NO: 378940 - RNA, 24 nt, Human
uacacaaaugugacauacaaguca

SEQ ID NO: 378941 - RNA, 20 nt, Human
uacagaaaauaauaaggcua

SEQ ID NO: 378942 - RNA, 24 nt, Human
uacaggguugaaagagaaauaagg

SEQ ID NO: 378943 - RNA, 22 nt, Human
uaccaagggcuucauucucaag

SEQ ID NO: 378944 - RNA, 18 nt, Human
uaggaggaaaaaggaccc

SEQ ID NO: 378945 - RNA, 23 nt, Human
uaggcccuggauggccagcuccu

SEQ ID NO: 378946 - RNA, 19 nt, Human
uaggcugacucacuucacu

SEQ ID NO: 378947 - RNA, 24 nt, Human
uaggggauggaggagaggcaagag

SEQ ID NO: 378948 - RNA, 18 nt, Human
uaugugugugugugugug

SEQ ID NO: 378949 - RNA, 23 nt, Human
uaugugugugugugugugugugu

SEQ ID NO: 378950 - RNA, 24 nt, Human
uaugugugugugugugugugugug

SEQ ID NO: 378951 - RNA, 20 nt, Human
ucacugaaagaguucuucag

SEQ ID NO: 378952 - RNA, 23 nt, Human
ucaggaaacagcaacaaaaauca

SEQ ID NO: 378953 - RNA, 19 nt, Human
ucaguucuccugccuagca

SEQ ID NO: 378954 - RNA, 21 nt, Human
ucaguucuccugccuagcaac

SEQ ID NO: 378955 - RNA, 20 nt, Human
ucccugaagagagaccuugu

SEQ ID NO: 378956 - RNA, 20 nt, Human
uccucuguuuucuaaauugg

SEQ ID NO: 378957 - RNA, 19 nt, Human
uccuuggguaugaaagccc

SEQ ID NO: 378958 - RNA, 24 nt, Human
ucuaaauugggaugcuaguagccc

SEQ ID NO: 378959 - RNA, 21 nt, Human
ucuauaaucaguucccaaaac

SEQ ID NO: 378960 - RNA, 23 nt, Human
ugaacugccacaauaacuuacaa

SEQ ID NO: 378961 - RNA, 19 nt, Human
ugaccacucacacacuguu

SEQ ID NO: 378962 - RNA, 22 nt, Human
ugagcucugccgagaaggacuc

SEQ ID NO: 378963 - RNA, 21 nt, Human
ugauaaugaaaaccugucucu

SEQ ID NO: 378964 - RNA, 20 nt, Human
ugauacuccugggauagcau

SEQ ID NO: 378965 - RNA, 21 nt, Human
ugauuucccacaaagcaccuc

SEQ ID NO: 378966 - RNA, 19 nt, Human
ugcagugagcucugccgag

SEQ ID NO: 378967 - RNA, 21 nt, Human
ugccacaauaacuuacaaaga

SEQ ID NO: 378968 - RNA, 24 nt, Human
ugcuaggggggccaggagcacagg

SEQ ID NO: 378969 - RNA, 19 nt, Human
uggaaaaugguccaucaga

SEQ ID NO: 378970 - RNA, 18 nt, Human
uggaaagaacacagagag

SEQ ID NO: 378971 - RNA, 21 nt, Human
uggaaagaacacagagagaaa

SEQ ID NO: 378972 - RNA, 21 nt, Human
uggaagaugugacuucucuuc

SEQ ID NO: 378973 - RNA, 19 nt, Human
uggauggcaguagccaacc

SEQ ID NO: 378974 - RNA, 18 nt, Human
uggauggccagcuccuuu

SEQ ID NO: 378975 - RNA, 22 nt, Human
uggcaguagccaaccaucuggu

SEQ ID NO: 378976 - RNA, 23 nt, Human
uggccagcuccuuuuggcuuuuc

SEQ ID NO: 378977 - RNA, 18 nt, Human
uggcuacaaacuccucug

SEQ ID NO: 378978 - RNA, 22 nt, Human
uggcugaauuacgacgacuggg

SEQ ID NO: 378979 - RNA, 19 nt, Human
uggcuguggaugugucugg

SEQ ID NO: 378980 - RNA, 23 nt, Human
ugggggaagcagagggcaguggg

SEQ ID NO: 378981 - RNA, 20 nt, Human
uguaaaauauguguguguau

SEQ ID NO: 378982 - RNA, 20 nt, Human
uguaaaauauguguguguau

SEQ ID NO: 378983 - RNA, 18 nt, Human
uguaaaaugugugugugu

SEQ ID NO: 378984 - RNA, 21 nt, Human
ugucccaucccguuauguuuc

SEQ ID NO: 378985 - RNA, 22 nt, Human
uguguaaaauauguguguguau

SEQ ID NO: 378986 - RNA, 22 nt, Human
uguguaaaauauguguguguau

SEQ ID NO: 378987 - RNA, 22 nt, Human
uguguguguaaaauaugugugu

SEQ ID NO: 378988 - RNA, 23 nt, Human
uguguguguaaaauauguguguu

SEQ ID NO: 378989 - RNA, 20 nt, Human
uguguguguaaaaugugugu

SEQ ID NO: 378990 - RNA, 20 nt, Human
uguguguguaaaaugugugu

SEQ ID NO: 378991 - RNA, 28 nt, Human
uguguguguaaaauguguguguguguaa

SEQ ID NO: 378992 - RNA, 20 nt, Human
uguguguguguaaaauaugu

SEQ ID NO: 378993 - RNA, 21 nt, Human
uguguguguguaaaauaugug

SEQ ID NO: 378994 - RNA, 24 nt, Human
uguguguguguaaaauaugugugu

SEQ ID NO: 378995 - RNA, 21 nt, Human
uguguguguguaaaaugugug

SEQ ID NO: 378996 - RNA, 22 nt, Human
uguguguguguaaaaugugugu

SEQ ID NO: 378997 - RNA, 26 nt, Human
uguguguguguaaaaugugugugugu

SEQ ID NO: 378998 - RNA, 26 nt, Human
uguguguguguguaaaaugugugugu

SEQ ID NO: 378999 - RNA, 29 nt, Human
uguguguguguguaaaaugugugugugug

SEQ ID NO: 379000 - RNA, 29 nt, Human
uguguguguguguguaaaaugugugugug

SEQ ID NO: 379001 - RNA, 18 nt, Human
ugugugugugugugugug

SEQ ID NO: 379002 - RNA, 18 nt, Human
ugugugugugugugugug

SEQ ID NO: 379003 - RNA, 18 nt, Human
ugugugugugugugugug

SEQ ID NO: 379004 - RNA, 18 nt, Human
ugugugugugugugugug

SEQ ID NO: 379005 - RNA, 21 nt, Human
ugugugugugugugugugugu

SEQ ID NO: 379006 - RNA, 21 nt, Human
ugugugugugugugugugugu

SEQ ID NO: 379007 - RNA, 22 nt, Human
ugugugugugugugugugugua

SEQ ID NO: 379008 - RNA, 20 nt, Human
uguugccauuaagaaagcuu

SEQ ID NO: 379009 - RNA, 19 nt, Human
uguuugcagugagcucugc

SEQ ID NO: 379010 - RNA, 25 nt, Human
uuagaaccuaauuuucaacugaagu

SEQ ID NO: 379011 - RNA, 21 nt, Human
uuccagugcucugcgcauccc

SEQ ID NO: 379012 - RNA, 22 nt, Human
uucucuggcccagacagaacaa

SEQ ID NO: 379013 - RNA, 23 nt, Human
uuggaagggaaccagaaaaaagg

SEQ ID NO: 379014 - RNA, 20 nt, Human
uuuaauuuucuuucgauucc

SEQ ID NO: 379015 - RNA, 22 nt, Human
uuuacaggcugcuggcuacaaa

SEQ ID NO: 379016 - RNA, 18 nt, Human
uuucccacaaagcaccuc

SEQ ID NO: 379017 - RNA, 20 nt, Human
accgaaggcaaagaggacaa

SEQ ID NO: 379018 - RNA, 26 nt, Human
agagcuccaguuggaaugucgacauc

SEQ ID NO: 379019 - RNA, 23 nt, Human
aggcaugacugauaauggcugag

SEQ ID NO: 379020 - RNA, 18 nt, Human
caguuuuuaguaucucac

SEQ ID NO: 379021 - RNA, 25 nt, Human
ccaguuggaauguugauuacauuca

SEQ ID NO: 379022 - RNA, 22 nt, Human
ggcaaagaggacaagcaaagga

SEQ ID NO: 379023 - RNA, 18 nt, Human
uaaauaaugugacuuaaa

SEQ ID NO: 379024 - RNA, 21 nt, Human
uacaacagcuguuaagagaaa

SEQ ID NO: 379025 - RNA, 25 nt, Human
uaccgaaggcaaagaggacaagcaa

SEQ ID NO: 379026 - RNA, 22 nt, Human
uagcaagaaaauaaggcaugac

SEQ ID NO: 379027 - RNA, 24 nt, Human
ugaaaaauaaauaaugugacuuaa

SEQ ID NO: 379028 - RNA, 22 nt, Human
ugaggaaaguucuaaauggugu

SEQ ID NO: 379029 - RNA, 23 nt, Human
agacagacacacagacaguccgc

SEQ ID NO: 379030 - RNA, 23 nt, Human
agcugguauaggcuuggaggugg

SEQ ID NO: 379031 - RNA, 21 nt, Human
agguccgagguccuggguggc

SEQ ID NO: 379032 - RNA, 26 nt, Human
cagcaggagguccggcccggggcugg

SEQ ID NO: 379033 - RNA, 24 nt, Human
cagcauucuggggcuuguaacacu

SEQ ID NO: 379034 - RNA, 23 nt, Human
cccggggcuggaggggccgaggc

SEQ ID NO: 379035 - RNA, 25 nt, Human
ccgcaggcuccaagguccgaggucc

SEQ ID NO: 379036 - RNA, 24 nt, Human
cgagguccuggguggcaucagugg

SEQ ID NO: 379037 - RNA, 20 nt, Human
cgccgcagcacaacgggacc

SEQ ID NO: 379038 - RNA, 23 nt, Human
cgccgcagcacaacgggaccagc

SEQ ID NO: 379039 - RNA, 23 nt, Human
cggcccggggcuggaggggccga

SEQ ID NO: 379040 - RNA, 18 nt, Human
cggcgcggggcgcgggcc

SEQ ID NO: 379041 - RNA, 21 nt, Human
cgggggcaacagaaggcagag

SEQ ID NO: 379042 - RNA, 25 nt, Human
gagacagacacacagacaguccgcc

SEQ ID NO: 379043 - RNA, 23 nt, Human
gcgcuguacacagcugguauagg

SEQ ID NO: 379044 - RNA, 18 nt, Human
gcggggcgcgggcccggg

SEQ ID NO: 379045 - RNA, 21 nt, Human
gggcaggccgggcagcauucu

SEQ ID NO: 379046 - RNA, 22 nt, Human
gggcgggcgggcggcgcggggc

SEQ ID NO: 379047 - RNA, 19 nt, Human
ggggcaacagaaggcagag

SEQ ID NO: 379048 - RNA, 19 nt, Human
gggggcaacagaaggcaga

SEQ ID NO: 379049 - RNA, 22 nt, Human
gguccuggguggcaucaguggu

SEQ ID NO: 379050 - RNA, 19 nt, Human
ucagugguggcgccugggc

SEQ ID NO: 379051 - RNA, 23 nt, Human
uccuggguggcaucagugguggc

SEQ ID NO: 379052 - RNA, 22 nt, Human
uggguggcaucagugguggcgc

SEQ ID NO: 379053 - RNA, 22 nt, Human
agcacagaccaauuagccaaau

SEQ ID NO: 379054 - RNA, 18 nt, Human
agugguuaauuggugaaa

SEQ ID NO: 379055 - RNA, 21 nt, Human
cacagagaugucuacagagac

SEQ ID NO: 379056 - RNA, 21 nt, Human
cagcacagaccaauuagccaa

SEQ ID NO: 379057 - RNA, 18 nt, Human
ccagaaaccuagcuaucu

SEQ ID NO: 379058 - RNA, 22 nt, Human
cuggccaaaaggaaaaaauagc

SEQ ID NO: 379059 - RNA, 28 nt, Human
gaaaacaccuacugugggggaaccagaa

SEQ ID NO: 379060 - RNA, 20 nt, Human
gcagcacagaccaauuagcc

SEQ ID NO: 379061 - RNA, 18 nt, Human
ggaaccagaaaccuagcu

SEQ ID NO: 379062 - RNA, 21 nt, Human
uuuccaaaaggacccuaaucu

SEQ ID NO: 379063 - RNA, 21 nt, Human
aaacccggcagaaacccggga

SEQ ID NO: 379064 - RNA, 24 nt, Human
aaguaacuuauuguacaguccauu

SEQ ID NO: 379065 - RNA, 23 nt, Human
agggagaaacccggcagaaaccc

SEQ ID NO: 379066 - RNA, 21 nt, Human
caaauuagaagucuccauuca

SEQ ID NO: 379067 - RNA, 22 nt, Human
cgaugauaaagaugagaggcac

SEQ ID NO: 379068 - RNA, 19 nt, Human
cuccgaugauaaagaugag

SEQ ID NO: 379069 - RNA, 18 nt, Human
gagaaacccggcagaaac

SEQ ID NO: 379070 - RNA, 24 nt, Human
ggagaaacccggcagaaacccggg

SEQ ID NO: 379071 - RNA, 21 nt, Human
uaauugaaauuuaucugaaac

SEQ ID NO: 379072 - RNA, 19 nt, Human
uacgcgagaugcaaacuuc

SEQ ID NO: 379073 - RNA, 24 nt, Human
uauuuucuuccaaaaaacugcauu

SEQ ID NO: 379074 - RNA, 21 nt, Human
ucaacaacccaggagccgcag

SEQ ID NO: 379075 - RNA, 20 nt, Human
ugauaaagaugagaggcaca

SEQ ID NO: 379076 - RNA, 21 nt, Human
uuaacuuaaaagguggacaua

SEQ ID NO: 379077 - RNA, 23 nt, Human
uucauuaacuuaaaagguggaca

SEQ ID NO: 379078 - RNA, 22 nt, Human
uucugauguaaauuuguuucac

SEQ ID NO: 379079 - RNA, 24 nt, Human
uucugauguaaauuuguuucacug

SEQ ID NO: 379080 - RNA, 23 nt, Human
uuuucaguuucaaauuuuauuuc

SEQ ID NO: 379081 - RNA, 20 nt, Human
aaaaacacaaaagagauuag

SEQ ID NO: 379082 - RNA, 19 nt, Human
aaaaccccaguccuuucac

SEQ ID NO: 379083 - RNA, 18 nt, Human
aaaacggcacauagaaug

SEQ ID NO: 379084 - RNA, 24 nt, Human
aaauauccaaacccaauaacguaa

SEQ ID NO: 379085 - RNA, 19 nt, Human
aacugcuacgcagccgggc

SEQ ID NO: 379086 - RNA, 18 nt, Human
aagugcaguugacaggca

SEQ ID NO: 379087 - RNA, 24 nt, Human
aauaaucaaaaagauaaaccaugu

SEQ ID NO: 379088 - RNA, 19 nt, Human
acaaaagagauuagaccug

SEQ ID NO: 379089 - RNA, 19 nt, Human
acaacaaaacggcacauag

SEQ ID NO: 379090 - RNA, 21 nt, Human
accuccuaaguuacaauaaaa

SEQ ID NO: 379091 - RNA, 18 nt, Human
acgcagccgggccuggug

SEQ ID NO: 379092 - RNA, 22 nt, Human
agaaaagauaacaccaagaaaa

SEQ ID NO: 379093 - RNA, 26 nt, Human
agcuccgcagggagcgcccuggagca

SEQ ID NO: 379094 - RNA, 20 nt, Human
aggcagccucuucuuccagg

SEQ ID NO: 379095 - RNA, 25 nt, Human
auagaaauaaaaauaaauuuuugcc

SEQ ID NO: 379096 - RNA, 19 nt, Human
caacaggccaccuuaauag

SEQ ID NO: 379097 - RNA, 23 nt, Human
cacaugaaaaaucuuuauacaaa

SEQ ID NO: 379098 - RNA, 23 nt, Human
cacguuuccuuaaaagucaggag

SEQ ID NO: 379099 - RNA, 18 nt, Human
cagaagaaaacaggaagc

SEQ ID NO: 379100 - RNA, 21 nt, Human
cagcccgggcccggaaacugg

SEQ ID NO: 379101 - RNA, 20 nt, Human
caggaagcagcucagcacuc

SEQ ID NO: 379102 - RNA, 20 nt, Human
caggaggccacaaauuaggu

SEQ ID NO: 379103 - RNA, 24 nt, Human
caucacuauagaaauaaaaauaaa

SEQ ID NO: 379104 - RNA, 22 nt, Human
caucacucaacugcuacgcagc

SEQ ID NO: 379105 - RNA, 23 nt, Human
ccaaaacagucaucacuauagaa

SEQ ID NO: 379106 - RNA, 18 nt, Human
ccccaaguccuccaucac

SEQ ID NO: 379107 - RNA, 22 nt, Human
ccuggccuuguaccugggcaac

SEQ ID NO: 379108 - RNA, 21 nt, Human
ccuuguaccugggcaacaucc

SEQ ID NO: 379109 - RNA, 21 nt, Human
ccuuuuagaccuggagguaaa

SEQ ID NO: 379110 - RNA, 23 nt, Human
ccuuuuagaccuggagguaaaua

SEQ ID NO: 379111 - RNA, 22 nt, Human
ccuuuugguagcugaacuccaa

SEQ ID NO: 379112 - RNA, 24 nt, Human
cuccgcagggagcgcccuggagca

SEQ ID NO: 379113 - RNA, 26 nt, Human
cugacggugcgaccugcguuucuuuc

SEQ ID NO: 379114 - RNA, 24 nt, Human
cugcaacaggccaccuuaauagcu

SEQ ID NO: 379115 - RNA, 18 nt, Human
cugcaaggccugggugac

SEQ ID NO: 379116 - RNA, 19 nt, Human
cuggcaaaaagguagaaaa

SEQ ID NO: 379117 - RNA, 25 nt, Human
cuggugcacaaaaacacaaaagaga

SEQ ID NO: 379118 - RNA, 20 nt, Human
gaaaggccgggcggagaggc

SEQ ID NO: 379119 - RNA, 22 nt, Human
gaccuguguuugcuaaaacccc

SEQ ID NO: 379120 - RNA, 24 nt, Human
gauaugaucagauuuacaauuuuu

SEQ ID NO: 379121 - RNA, 23 nt, Human
gcaacuuccgaguucccaauuuc

SEQ ID NO: 379122 - RNA, 24 nt, Human
gcagcaacuuccgaguucccaauu

SEQ ID NO: 379123 - RNA, 19 nt, Human
gcgccccgcguggggacgc

SEQ ID NO: 379124 - RNA, 18 nt, Human
ggcggcggagcuccgcag

SEQ ID NO: 379125 - RNA, 18 nt, Human
gggcggagaggcgggcgg

SEQ ID NO: 379126 - RNA, 21 nt, Human
ggucccgaagauccuggccuu

SEQ ID NO: 379127 - RNA, 23 nt, Human
ggugcacaaaaacacaaaagaga

SEQ ID NO: 379128 - RNA, 20 nt, Human
uacaaccuuuucaauaggca

SEQ ID NO: 379129 - RNA, 22 nt, Human
uagcugaacuccaaaugaagcc

SEQ ID NO: 379130 - RNA, 24 nt, Human
uaucugcaaggccugggugacugg

SEQ ID NO: 379131 - RNA, 22 nt, Human
ucaaauauccaaacccaauaac

SEQ ID NO: 379132 - RNA, 27 nt, Human
ucaaauauccaaacccaauaacguaau

SEQ ID NO: 379133 - RNA, 23 nt, Human
ucacacuaccuuuuagaccugga

SEQ ID NO: 379134 - RNA, 20 nt, Human
ucagaagaaaacaggaagca

SEQ ID NO: 379135 - RNA, 20 nt, Human
ucaggccaaauacuccagga

SEQ ID NO: 379136 - RNA, 22 nt, Human
ucaggccaaauacuccaggacc

SEQ ID NO: 379137 - RNA, 19 nt, Human
uccgcagggagcgcccugg

SEQ ID NO: 379138 - RNA, 19 nt, Human
ucuccauauuuuaaguuca

SEQ ID NO: 379139 - RNA, 22 nt, Human
ucugcaaggccugggugacugg

SEQ ID NO: 379140 - RNA, 21 nt, Human
ucuguucauuucaaaccaaaa

SEQ ID NO: 379141 - RNA, 23 nt, Human
ugaacuccaaaugaagccagguc

SEQ ID NO: 379142 - RNA, 19 nt, Human
ugaaggcaauguugaagca

SEQ ID NO: 379143 - RNA, 21 nt, Human
ugaauaacaacaaaacggcac

SEQ ID NO: 379144 - RNA, 22 nt, Human
ugaauaacaacaaaacggcaca

SEQ ID NO: 379145 - RNA, 21 nt, Human
ugagaaaagauaacaccaaga

SEQ ID NO: 379146 - RNA, 24 nt, Human
ugaucagauuuacaauuuuucaga

SEQ ID NO: 379147 - RNA, 21 nt, Human
ugaugcaaagcuucaaacugg

SEQ ID NO: 379148 - RNA, 24 nt, Human
ugggucacacuaccuuuuagaccu

SEQ ID NO: 379149 - RNA, 22 nt, Human
uguguaauggcugcacacggug

SEQ ID NO: 379150 - RNA, 22 nt, Human
uuaucugcaaggccugggugac

SEQ ID NO: 379151 - RNA, 22 nt, Human
uucccccaaguccuccaucacg

SEQ ID NO: 379152 - RNA, 21 nt, Human
uuucccccaaguccuccauca

SEQ ID NO: 379153 - RNA, 24 nt, Human
uuuuaacuacagaaacaaugguua

SEQ ID NO: 379154 - RNA, 18 nt, Human
aaaaaacaaaauagaaaa

SEQ ID NO: 379155 - RNA, 21 nt, Human
aaaauagaaaagaguuaggug

SEQ ID NO: 379156 - RNA, 19 nt, Human
aagagaccaagggacugcg

SEQ ID NO: 379157 - RNA, 23 nt, Human
agagaccaagggacugcgugcuc

SEQ ID NO: 379158 - RNA, 19 nt, Human
augauggaguaaagaaagu

SEQ ID NO: 379159 - RNA, 18 nt, Human
caaaaucaaccagccaug

SEQ ID NO: 379160 - RNA, 20 nt, Human
cgugugcaugucacuaugua

SEQ ID NO: 379161 - RNA, 24 nt, Human
uaaaauagacuuuuaaaauuacaa

SEQ ID NO: 379162 - RNA, 24 nt, Human
uaauaaaauagacuuuuaaaauua

SEQ ID NO: 379163 - RNA, 20 nt, Human
uagaaagaguaaauaugguc

SEQ ID NO: 379164 - RNA, 22 nt, Human
ucggcagcgcagcgcgcuuccc

SEQ ID NO: 379165 - RNA, 22 nt, Human
ugccaagagaggaaccaucaug

SEQ ID NO: 379166 - RNA, 20 nt, Human
uuuuuuuuuuuuuugcucca

SEQ ID NO: 379167 - RNA, 23 nt, Human
uuuuuuuuuuuuuuuugcuccaa

SEQ ID NO: 379168 - RNA, 18 nt, Human
uuuuuuuuuuuuuuuuug

SEQ ID NO: 379169 - RNA, 20 nt, Human
uuuuuuuuuuuuuuuuugcu

SEQ ID NO: 379170 - RNA, 21 nt, Human
aaaaaaaacuauuaaaucuua

SEQ ID NO: 379171 - RNA, 20 nt, Human
aaaccaggcucuugcauggg

SEQ ID NO: 379172 - RNA, 20 nt, Human
aaaugucuucaguaucuaaa

SEQ ID NO: 379173 - RNA, 22 nt, Human
aacugccuuuuguucaacaucc

SEQ ID NO: 379174 - RNA, 22 nt, Human
aaggaaacacgggauuugagac

SEQ ID NO: 379175 - RNA, 21 nt, Human
aaggaaccuuuagguaaggag

SEQ ID NO: 379176 - RNA, 24 nt, Human
acuaggaaacaaaaugucuucagu

SEQ ID NO: 379177 - RNA, 20 nt, Human
agauucugucuuaccggugc

SEQ ID NO: 379178 - RNA, 18 nt, Human
agccuccgcgcgccuccc

SEQ ID NO: 379179 - RNA, 23 nt, Human
agccugucaguccacugccccau

SEQ ID NO: 379180 - RNA, 21 nt, Human
agucauugcuuuaaaauuuuc

SEQ ID NO: 379181 - RNA, 21 nt, Human
augaagacuuuggccuguaaa

SEQ ID NO: 379182 - RNA, 21 nt, Human
caacagugccucaagggggca

SEQ ID NO: 379183 - RNA, 19 nt, Human
caagaaccuauugacaagg

SEQ ID NO: 379184 - RNA, 23 nt, Human
cacaguacugaugaaccuguaua

SEQ ID NO: 379185 - RNA, 21 nt, Human
cacugaauucccaccauuucc

SEQ ID NO: 379186 - RNA, 21 nt, Human
cagaaccaguacccuggcuga

SEQ ID NO: 379187 - RNA, 22 nt, Human
cagcuuugaugggaagcuaaaa

SEQ ID NO: 379188 - RNA, 22 nt, Human
cagugccucaagggggcaugga

SEQ ID NO: 379189 - RNA, 20 nt, Human
cauugcuacaggccaucuua

SEQ ID NO: 379190 - RNA, 19 nt, Human
ccagaaccaguacccuggc

SEQ ID NO: 379191 - RNA, 20 nt, Human
ccggcgccgcgccuccagcu

SEQ ID NO: 379192 - RNA, 18 nt, Human
ccuccccggccgcaccuc

SEQ ID NO: 379193 - RNA, 19 nt, Human
cucaagacacaguacugau

SEQ ID NO: 379194 - RNA, 19 nt, Human
cugggcaauaaaugaagac

SEQ ID NO: 379195 - RNA, 20 nt, Human
cugggcaauaaaugaagacu

SEQ ID NO: 379196 - RNA, 25 nt, Human
cuucuuugcuuuuguccuuuaggaa

SEQ ID NO: 379197 - RNA, 18 nt, Human
gagguggguaugaaggag

SEQ ID NO: 379198 - RNA, 20 nt, Human
gccacucuccauuaagaauc

SEQ ID NO: 379199 - RNA, 22 nt, Human
gccaucuuaugucaguagaucc

SEQ ID NO: 379200 - RNA, 20 nt, Human
gccgcgccuccagcuccagc

SEQ ID NO: 379201 - RNA, 19 nt, Human
gccucaagggggcauggag

SEQ ID NO: 379202 - RNA, 21 nt, Human
gccuccagcuccagccuccgc

SEQ ID NO: 379203 - RNA, 19 nt, Human
gggcaaaguuuauuuucua

SEQ ID NO: 379204 - RNA, 21 nt, Human
uaaaaucucaagacacaguac

SEQ ID NO: 379205 - RNA, 22 nt, Human
uaaagacacugaauucccacca

SEQ ID NO: 379206 - RNA, 23 nt, Human
uaaaugaagacuuuggccuguaa

SEQ ID NO: 379207 - RNA, 22 nt, Human
uacaaguuuucaagaaccuauu

SEQ ID NO: 379208 - RNA, 21 nt, Human
uacccuggcugaaaagugaga

SEQ ID NO: 379209 - RNA, 19 nt, Human
uagaacaaugaaaacucca

SEQ ID NO: 379210 - RNA, 24 nt, Human
uagccaguccucaaauaacugccu

SEQ ID NO: 379211 - RNA, 22 nt, Human
uccccaaauggacuuaugaucc

SEQ ID NO: 379212 - RNA, 20 nt, Human
uccgcgcgccuccccggccg

SEQ ID NO: 379213 - RNA, 21 nt, Human
uccgcgcgccuccccggccgc

SEQ ID NO: 379214 - RNA, 22 nt, Human
uccgcgcgccuccccggccgca

SEQ ID NO: 379215 - RNA, 18 nt, Human
uccuuuccuuguaacaac

SEQ ID NO: 379216 - RNA, 19 nt, Human
ucucuuguuuauuuaaauu

SEQ ID NO: 379217 - RNA, 24 nt, Human
ugaaauagccacucuccauuaaga

SEQ ID NO: 379218 - RNA, 19 nt, Human
ugaccgacuuguucugaug

SEQ ID NO: 379219 - RNA, 19 nt, Human
ugauucuaagaggaugugc

SEQ ID NO: 379220 - RNA, 22 nt, Human
ugcaagacuuuuuuuuagccuu

SEQ ID NO: 379221 - RNA, 24 nt, Human
uguaacaacugaugagaaaaagua

SEQ ID NO: 379222 - RNA, 18 nt, Human
uguugcuaaaugacuguu

SEQ ID NO: 379223 - RNA, 21 nt, Human
uguuuauuuaaauuugggagc

SEQ ID NO: 379224 - RNA, 24 nt, Human
uucuaugucagccugucaguccac

SEQ ID NO: 379225 - RNA, 26 nt, Human
uugcaugggucuuuaaauggacuggu

SEQ ID NO: 379226 - RNA, 25 nt, Human
uugugguauaaagguuggguuuaca

SEQ ID NO: 379227 - RNA, 24 nt, Human
uuuaaaauuuucuacuuuuaauuu

SEQ ID NO: 379228 - RNA, 26 nt, Human
uuucaagaaccuauugacaagguuaa

SEQ ID NO: 379229 - RNA, 19 nt, Human
uuugugguauaaagguugg

SEQ ID NO: 379230 - RNA, 25 nt, Human
aaaaacagugaaaccaagacacuau

SEQ ID NO: 379231 - RNA, 25 nt, Human
aaaaccaaaaaaacaaacaaaaaac

SEQ ID NO: 379232 - RNA, 19 nt, Human
aaaaggggcgaagccagaa

SEQ ID NO: 379233 - RNA, 21 nt, Human
aaacaaaaaaccccucuggga

SEQ ID NO: 379234 - RNA, 22 nt, Human
aaacaaaaacagugaaaccaaa

SEQ ID NO: 379235 - RNA, 24 nt, Human
aaacaaaaacagugaaaccaagac

SEQ ID NO: 379236 - RNA, 22 nt, Human
aaacaaaaagaaaaucaaaacc

SEQ ID NO: 379237 - RNA, 24 nt, Human
aaacaaaaagaaaaucaaaaccaa

SEQ ID NO: 379238 - RNA, 25 nt, Human
aaacaaaaagaaaaucaaaaccaaa

SEQ ID NO: 379239 - RNA, 25 nt, Human
aaacaaacaaaaaaccccucuggga

SEQ ID NO: 379240 - RNA, 23 nt, Human
aaacagugaaaccaagacacuau

SEQ ID NO: 379241 - RNA, 18 nt, Human
aaaccaaauaaaauuuac

SEQ ID NO: 379242 - RNA, 24 nt, Human
aacaaaaagaaaaucaaaaccaaa

SEQ ID NO: 379243 - RNA, 22 nt, Human
aacaagacaaaaauaugaacag

SEQ ID NO: 379244 - RNA, 20 nt, Human
aaccaaaaaaacaaacaaaa

SEQ ID NO: 379245 - RNA, 24 nt, Human
aaccaagacacuauuccaaagucu

SEQ ID NO: 379246 - RNA, 19 nt, Human
aaccuagcaauuauuacaa

SEQ ID NO: 379247 - RNA, 25 nt, Human
aagaaaaacaaaaagaaaaucaaaa

SEQ ID NO: 379248 - RNA, 23 nt, Human
aagaaagaaaaacaaaaagaaaa

SEQ ID NO: 379249 - RNA, 22 nt, Human
aagaagaaagaaaaacaaaaag

SEQ ID NO: 379250 - RNA, 23 nt, Human
aagaagaagaaagaaaaacaaaa

SEQ ID NO: 379251 - RNA, 25 nt, Human
aagaagaagaaagaaaaacaaaaag

SEQ ID NO: 379252 - RNA, 27 nt, Human
aagaagaagaaagaaaaacaaaaagaa

SEQ ID NO: 379253 - RNA, 20 nt, Human
aauacacuguggacaccuuu

SEQ ID NO: 379254 - RNA, 22 nt, Human
aaucaaaaccaaaaaaacaaac

SEQ ID NO: 379255 - RNA, 22 nt, Human
aaugaaaaaaauaagaagaaga

SEQ ID NO: 379256 - RNA, 29 nt, Human
acaaaaaaaaaaucaaaacaaaaacaguu

SEQ ID NO: 379257 - RNA, 19 nt, Human
acaaaaagaaaaucaaaac

SEQ ID NO: 379258 - RNA, 22 nt, Human
acaaacauuucccccuaagacu

SEQ ID NO: 379259 - RNA, 23 nt, Human
acaagacaaaaauaugaacagag

SEQ ID NO: 379260 - RNA, 31 nt, Human
accaaaaaaacaaacaaaaaaccccucuggg

SEQ ID NO: 379261 - RNA, 24 nt, Human
accaaauaaaauuuacaucauaac

SEQ ID NO: 379262 - RNA, 21 nt, Human
agaagaaagaaaaacaaaaag

SEQ ID NO: 379263 - RNA, 19 nt, Human
agacaaaaauaugaacaga

SEQ ID NO: 379264 - RNA, 25 nt, Human
agcugcagcagcugcagccacagcc

SEQ ID NO: 379265 - RNA, 21 nt, Human
aggaaccauaaaaaugccaac

SEQ ID NO: 379266 - RNA, 20 nt, Human
aucaaaacaaaaaaaaaauc

SEQ ID NO: 379267 - RNA, 26 nt, Human
aucaaaacaaaaaaaaaaucaaaaca

SEQ ID NO: 379268 - RNA, 30 nt, Human
aucaaaaccaaaaaaacaaacaaaaaaccc

SEQ ID NO: 379269 - RNA, 24 nt, Human
caaaaacagugaaaccaagacacu

SEQ ID NO: 379270 - RNA, 24 nt, Human
caaaaagaaaaucaaaaccaaaaa

SEQ ID NO: 379271 - RNA, 25 nt, Human
caaaacaaaaaaaaaaucaaaacaa

SEQ ID NO: 379272 - RNA, 18 nt, Human
caagacaaaaauaugaac

SEQ ID NO: 379273 - RNA, 24 nt, Human
caagacaaaaauaugaacagagcc

SEQ ID NO: 379274 - RNA, 23 nt, Human
caauguaaauccaugcccccuuu

SEQ ID NO: 379275 - RNA, 21 nt, Human
cagcugcagccacagccuuuu

SEQ ID NO: 379276 - RNA, 21 nt, Human
cagucuccuucuucggcucug

SEQ ID NO: 379277 - RNA, 26 nt, Human
caucauaacaaacauuucccccuaag

SEQ ID NO: 379278 - RNA, 23 nt, Human
cauuucccccuaagacugugggg

SEQ ID NO: 379279 - RNA, 26 nt, Human
cccacaguguccuggcaaacaacaug

SEQ ID NO: 379280 - RNA, 26 nt, Human
ccccuaagacuguggggacacuuggg

SEQ ID NO: 379281 - RNA, 22 nt, Human
cuagagcucgaauccugauuca

SEQ ID NO: 379282 - RNA, 18 nt, Human
cuccuucuucggcucugg

SEQ ID NO: 379283 - RNA, 21 nt, Human
cugcagccacagccuuuuccu

SEQ ID NO: 379284 - RNA, 18 nt, Human
cuuucauuuucugucuca

SEQ ID NO: 379285 - RNA, 19 nt, Human
gaaaaaaauaagaagaaga

SEQ ID NO: 379286 - RNA, 29 nt, Human
gaccauacaaggucagaagcauaacuuaa

SEQ ID NO: 379287 - RNA, 22 nt, Human
gcagcugcagccacagccuuuu

SEQ ID NO: 379288 - RNA, 21 nt, Human
gcucuggcgcugccacuggcu

SEQ ID NO: 379289 - RNA, 22 nt, Human
gcugcagccacagccuuuuccu

SEQ ID NO: 379290 - RNA, 24 nt, Human
gcugcagccacagccuuuuccuuc

SEQ ID NO: 379291 - RNA, 20 nt, Human
gcugccacuggcucuuccug

SEQ ID NO: 379292 - RNA, 24 nt, Human
ggaacaaaaggggcgaagccagaa

SEQ ID NO: 379293 - RNA, 19 nt, Human
gggaacaaaaggggcgaag

SEQ ID NO: 379294 - RNA, 28 nt, Human
ggucacagcagcugcagcagcugcagcc

SEQ ID NO: 379295 - RNA, 24 nt, Human
uaaaaaaaaucaaaacaaaaaaaa

SEQ ID NO: 379296 - RNA, 22 nt, Human
uaaacccccuuuuuuaaaaagg

SEQ ID NO: 379297 - RNA, 22 nt, Human
uaacaaacauuucccccuaaga

SEQ ID NO: 379298 - RNA, 22 nt, Human
uaacaaacauuucccccuaaga

SEQ ID NO: 379299 - RNA, 22 nt, Human
uaagaagaagaaagaaaaacaa

SEQ ID NO: 379300 - RNA, 28 nt, Human
uaagaagaagaaagaaaaacaaaaagaa

SEQ ID NO: 379301 - RNA, 19 nt, Human
uaauacacuguggacaccu

SEQ ID NO: 379302 - RNA, 20 nt, Human
uaauacacuguggacaccuu

SEQ ID NO: 379303 - RNA, 20 nt, Human
ucagcagagacuccacaggc

SEQ ID NO: 379304 - RNA, 18 nt, Human
ucagucuccuucuucggc

SEQ ID NO: 379305 - RNA, 20 nt, Human
ucccccuaagacugugggga

SEQ ID NO: 379306 - RNA, 23 nt, Human
ucucagggccuuuucacgcaggu

SEQ ID NO: 379307 - RNA, 19 nt, Human
ucuccuucuucggcucugg

SEQ ID NO: 379308 - RNA, 22 nt, Human
ucuuguguuuuuugugcuucuu

SEQ ID NO: 379309 - RNA, 22 nt, Human
ugaaaaaaauaagaagaagaaa

SEQ ID NO: 379310 - RNA, 25 nt, Human
ugaaaaaaauaagaagaagaaagaa

SEQ ID NO: 379311 - RNA, 21 nt, Human
ugaaaccaagacacuauucca

SEQ ID NO: 379312 - RNA, 25 nt, Human
ugaaaccaagacacuauuccaaagu

SEQ ID NO: 379313 - RNA, 19 nt, Human
uggcagcugcaauggcugc

SEQ ID NO: 379314 - RNA, 20 nt, Human
uuccaaagucugggcccuuc

SEQ ID NO: 379315 - RNA, 23 nt, Human
uucuagggcauuuaaaggaaccc

SEQ ID NO: 379316 - RNA, 21 nt, Human
uucuucggcucuggcgcugcc

SEQ ID NO: 379317 - RNA, 21 nt, Human
uuguggcagcugcaauggcug

SEQ ID NO: 379318 - RNA, 18 nt, Human
uuuccuucuuguguuuuu

SEQ ID NO: 379319 - RNA, 25 nt, Human
aaaaaaccaaaaugccuuuaagaaa

SEQ ID NO: 379320 - RNA, 21 nt, Human
aaaaugccuuuaagaaacaug

SEQ ID NO: 379321 - RNA, 18 nt, Human
aaaccccccagaacacau

SEQ ID NO: 379322 - RNA, 22 nt, Human
aaagaaaaaaaaaaggggaggg

SEQ ID NO: 379323 - RNA, 18 nt, Human
aaaguuggggggaggggu

SEQ ID NO: 379324 - RNA, 22 nt, Human
aacaaagaaaaaaaaaagggga

SEQ ID NO: 379325 - RNA, 19 nt, Human
aacucccaucugcauuccc

SEQ ID NO: 379326 - RNA, 21 nt, Human
aacuguauccuccccuccccc

SEQ ID NO: 379327 - RNA, 23 nt, Human
aacuguauccuccccucccccaa

SEQ ID NO: 379328 - RNA, 24 nt, Human
acaaagaaaaaaaaaaggggaggg

SEQ ID NO: 379329 - RNA, 25 nt, Human
acaaagaaaaaaaaaaggggaggga

SEQ ID NO: 379330 - RNA, 26 nt, Human
acaggaacaaagaaaaaaaaaagggg

SEQ ID NO: 379331 - RNA, 19 nt, Human
accaccaucacaaucaccc

SEQ ID NO: 379332 - RNA, 19 nt, Human
acccucccacggcucugcu

SEQ ID NO: 379333 - RNA, 19 nt, Human
agaaaaaaaaaaggggagg

SEQ ID NO: 379334 - RNA, 20 nt, Human
agaaaaaaaaaaggggaggg

SEQ ID NO: 379335 - RNA, 22 nt, Human
agaacacaugaaccaggaagaa

SEQ ID NO: 379336 - RNA, 19 nt, Human
agacaaggacccucccacg

SEQ ID NO: 379337 - RNA, 22 nt, Human
agggaccaacuaauuccaacuc

SEQ ID NO: 379338 - RNA, 25 nt, Human
aggggagggaaagggagcccuccau

SEQ ID NO: 379339 - RNA, 23 nt, Human
aucugcauucccucccaccccaa

SEQ ID NO: 379340 - RNA, 24 nt, Human
caaccaccaucacaaucaccccug

SEQ ID NO: 379341 - RNA, 23 nt, Human
caacuaauuccaacuccugcccc

SEQ ID NO: 379342 - RNA, 21 nt, Human
caagaacaccuuauacaaccu

SEQ ID NO: 379343 - RNA, 28 nt, Human
caagaacaccuuauacaaccuccagucc

SEQ ID NO: 379344 - RNA, 21 nt, Human
caccgcucccgccgccuccgc

SEQ ID NO: 379345 - RNA, 18 nt, Human
caccuuauacaaccucca

SEQ ID NO: 379346 - RNA, 21 nt, Human
caccuuauacaaccuccaguc

SEQ ID NO: 379347 - RNA, 22 nt, Human
caccuuauacaaccuccagucc

SEQ ID NO: 379348 - RNA, 20 nt, Human
cacucgcaccccgccugggc

SEQ ID NO: 379349 - RNA, 18 nt, Human
caucacaaucaccccugg

SEQ ID NO: 379350 - RNA, 23 nt, Human
cauucccucccaccccaaacccc

SEQ ID NO: 379351 - RNA, 24 nt, Human
ccaaaccccccagaacacaugaac

SEQ ID NO: 379352 - RNA, 23 nt, Human
ccaaccaccaucacaaucacccc

SEQ ID NO: 379353 - RNA, 25 nt, Human
ccaacucccaucugcauucccuccc

SEQ ID NO: 379354 - RNA, 18 nt, Human
ccaccccaaaccccccag

SEQ ID NO: 379355 - RNA, 18 nt, Human
ccaugccucccuggcccu

SEQ ID NO: 379356 - RNA, 21 nt, Human
cccaaaccccccagaacacau

SEQ ID NO: 379357 - RNA, 24 nt, Human
cccaccccaaaccccccagaacac

SEQ ID NO: 379358 - RNA, 20 nt, Human
cccaucugcauucccuccca

SEQ ID NO: 379359 - RNA, 21 nt, Human
cccccagaacacaugaaccag

SEQ ID NO: 379360 - RNA, 22 nt, Human
cccucccccaacucccaucugc

SEQ ID NO: 379361 - RNA, 21 nt, Human
ccgccgccuccgcccgccgcc

SEQ ID NO: 379362 - RNA, 22 nt, Human
ccgccgccuccgcccgccgccu

SEQ ID NO: 379363 - RNA, 26 nt, Human
ccgccgccuccgcccgccgccuccga

SEQ ID NO: 379364 - RNA, 24 nt, Human
ccgccuccgcccgccgccuccccc

SEQ ID NO: 379365 - RNA, 22 nt, Human
ccgccuccgcccgccgccuccg

SEQ ID NO: 379366 - RNA, 24 nt, Human
ccgccucgccucgccgguccgccc

SEQ ID NO: 379367 - RNA, 21 nt, Human
ccgcucccgccgccuccgccc

SEQ ID NO: 379368 - RNA, 24 nt, Human
ccgcucccgccgccuccgcccgcc

SEQ ID NO: 379369 - RNA, 19 nt, Human
ccgcucccgccgccuccgg

SEQ ID NO: 379370 - RNA, 23 nt, Human
ccgcugcucgagcucccgagucc

SEQ ID NO: 379371 - RNA, 23 nt, Human
ccucaggggccgcaacgggcucc

SEQ ID NO: 379372 - RNA, 20 nt, Human
ccuccagucccaaccaccau

SEQ ID NO: 379373 - RNA, 27 nt, Human
ccuccagucccaaccaccaucacaauc

SEQ ID NO: 379374 - RNA, 23 nt, Human
ccucccaccccaaaccccccaga

SEQ ID NO: 379375 - RNA, 25 nt, Human
ccucccaccccaaaccccccagaac

SEQ ID NO: 379376 - RNA, 21 nt, Human
ccugaacuguauccuccccuc

SEQ ID NO: 379377 - RNA, 20 nt, Human
ccuggcccugacuccaggcc

SEQ ID NO: 379378 - RNA, 24 nt, Human
cgagcucccgagucccucgggccu

SEQ ID NO: 379379 - RNA, 21 nt, Human
cucccaccccaaaccccccag

SEQ ID NO: 379380 - RNA, 18 nt, Human
cuccccucccccaacucc

SEQ ID NO: 379381 - RNA, 20 nt, Human
cucccuggcccugacuccag

SEQ ID NO: 379382 - RNA, 21 nt, Human
cuucuggauacaaguggggcc

SEQ ID NO: 379383 - RNA, 19 nt, Human
cuuuaagaaacaugaaaag

SEQ ID NO: 379384 - RNA, 22 nt, Human
gagcagacaaggacccucccac

SEQ ID NO: 379385 - RNA, 20 nt, Human
gcaacgggcuccgacugcgc

SEQ ID NO: 379386 - RNA, 18 nt, Human
gccaagguucaaaggaga

SEQ ID NO: 379387 - RNA, 20 nt, Human
gcucuugcuguacagauuuu

SEQ ID NO: 379388 - RNA, 21 nt, Human
ggaagaagggacacuccuugu

SEQ ID NO: 379389 - RNA, 21 nt, Human
ggaccaacuaauuccaacucc

SEQ ID NO: 379390 - RNA, 25 nt, Human
gggagcccuccauccaagggcugcc

SEQ ID NO: 379391 - RNA, 25 nt, Human
gggccaugccucccuggcccugacu

SEQ ID NO: 379392 - RNA, 19 nt, Human
ggggacaguagggaccaac

SEQ ID NO: 379393 - RNA, 20 nt, Human
ggggggagggguucacaacc

SEQ ID NO: 379394 - RNA, 22 nt, Human
uauccuccccucccccaacucc

SEQ ID NO: 379395 - RNA, 21 nt, Human
ucacaggaacaaagaaaaaaa

SEQ ID NO: 379396 - RNA, 20 nt, Human
ucccaccccaaaccccccag

SEQ ID NO: 379397 - RNA, 22 nt, Human
ucccaccccaaaccccccagaa

SEQ ID NO: 379398 - RNA, 24 nt, Human
ucccccaacucccaucugcauucc

SEQ ID NO: 379399 - RNA, 24 nt, Human
ucccucccaccccaaaccccccag

SEQ ID NO: 379400 - RNA, 22 nt, Human
ucccuggcccugacuccaggcu

SEQ ID NO: 379401 - RNA, 23 nt, Human
uccgcccgccucagccgacgccg

SEQ ID NO: 379402 - RNA, 19 nt, Human
uccucaggggccgcaacgg

SEQ ID NO: 379403 - RNA, 21 nt, Human
uccugccccuuccuuccaaga

SEQ ID NO: 379404 - RNA, 19 nt, Human
ucuugccgccgccgcugcu

SEQ ID NO: 379405 - RNA, 23 nt, Human
ucuugccgccgccgcugcucgag

SEQ ID NO: 379406 - RNA, 20 nt, Human
ugaaaaguuggggggagggg

SEQ ID NO: 379407 - RNA, 22 nt, Human
ugaaaaguuggggggagggguu

SEQ ID NO: 379408 - RNA, 23 nt, Human
ugccaagguucaaaggagagcag

SEQ ID NO: 379409 - RNA, 23 nt, Human
ugccccuuccuuccaagaacacc

SEQ ID NO: 379410 - RNA, 22 nt, Human
ugcuggggaagaagggacacuc

SEQ ID NO: 379411 - RNA, 19 nt, Human
uggcuccagagcauugggu

SEQ ID NO: 379412 - RNA, 22 nt, Human
ugggguauccugaacuguaucc

SEQ ID NO: 379413 - RNA, 24 nt, Human
uguacagauuuuaaaaaaccaaaa

SEQ ID NO: 379414 - RNA, 22 nt, Human
uucaaaggagagcagacaagga

SEQ ID NO: 379415 - RNA, 24 nt, Human
uugcuguacagauuuuaaaaaacc

SEQ ID NO: 379416 - RNA, 18 nt, Human
aaaaggagcaucuaggua

SEQ ID NO: 379417 - RNA, 18 nt, Human
aaacaauauugaaacuaa

SEQ ID NO: 379418 - RNA, 21 nt, Human
aaacuuauuuuacuauccaaa

SEQ ID NO: 379419 - RNA, 20 nt, Human
aacuugcauuucuccgcccu

SEQ ID NO: 379420 - RNA, 19 nt, Human
aaggugccagaguucgaaa

SEQ ID NO: 379421 - RNA, 19 nt, Human
aggugccagaguucgaaac

SEQ ID NO: 379422 - RNA, 22 nt, Human
ccgcccucaacacccccucaac

SEQ ID NO: 379423 - RNA, 23 nt, Human
cgacaaaauugaaaggugccaga

SEQ ID NO: 379424 - RNA, 20 nt, Human
cuuuauuagccagagaaaag

SEQ ID NO: 379425 - RNA, 21 nt, Human
uaggucuuuguagccaauguu

SEQ ID NO: 379426 - RNA, 21 nt, Human
ucaaaaacaaggagagugcga

SEQ ID NO: 379427 - RNA, 19 nt, Human
uccaaaacucacuucuacc

SEQ ID NO: 379428 - RNA, 21 nt, Human
uccgcccucaacacccccuca

SEQ ID NO: 379429 - RNA, 21 nt, Human
ucuuuguagccaauguuaccc

SEQ ID NO: 379430 - RNA, 24 nt, Human
uuuacuauccaaaacucacuucua

SEQ ID NO: 379431 - RNA, 20 nt, Human
aaaaaaaaaaacaaagaaca

SEQ ID NO: 379432 - RNA, 20 nt, Human
aaaaaaaaacaaagaacaaa

SEQ ID NO: 379433 - RNA, 26 nt, Human
aaaaaaaaacaaagaacaaaaaacaa

SEQ ID NO: 379434 - RNA, 25 nt, Human
aaaaaaaacaaagaacaaaaaacaa

SEQ ID NO: 379435 - RNA, 20 nt, Human
aaaaaaaccuguucugaccu

SEQ ID NO: 379436 - RNA, 26 nt, Human
aaaaaacaaagaacaaaaaacaaaaa

SEQ ID NO: 379437 - RNA, 22 nt, Human
aaaaacagauagaauaaaccuc

SEQ ID NO: 379438 - RNA, 24 nt, Human
aaaacaaagaacaaaaaacaaaaa

SEQ ID NO: 379439 - RNA, 27 nt, Human
aaaacaaagaacaaaaaacaaaaacaa

SEQ ID NO: 379440 - RNA, 21 nt, Human
aaaacaaucaagcaucuacca

SEQ ID NO: 379441 - RNA, 20 nt, Human
aaacacacaaacacacacuc

SEQ ID NO: 379442 - RNA, 20 nt, Human
aaacagccacuuauccacaa

SEQ ID NO: 379443 - RNA, 20 nt, Human
aaagccuccucagauccaac

SEQ ID NO: 379444 - RNA, 20 nt, Human
aaauaaccgugguuagaaau

SEQ ID NO: 379445 - RNA, 21 nt, Human
aaauaaugauuaaaauaugcc

SEQ ID NO: 379446 - RNA, 24 nt, Human
aacugcuugaaccugggaggcgga

SEQ ID NO: 379447 - RNA, 23 nt, Human
aagagcaagacuccaucucaaaa

SEQ ID NO: 379448 - RNA, 19 nt, Human
acaaaaaacaaaaacaaaa

SEQ ID NO: 379449 - RNA, 20 nt, Human
acaaaaacaaaaaaaccugg

SEQ ID NO: 379450 - RNA, 22 nt, Human
acaaucaagcaucuaccaugcu

SEQ ID NO: 379451 - RNA, 23 nt, Human
acaccauuuugagaccaaaacaa

SEQ ID NO: 379452 - RNA, 23 nt, Human
acagucucaaauaaugauuaaaa

SEQ ID NO: 379453 - RNA, 23 nt, Human
acagugcugaggugacaauaugg

SEQ ID NO: 379454 - RNA, 22 nt, Human
accgccuugcauauucaccaca

SEQ ID NO: 379455 - RNA, 21 nt, Human
accuugaaacacacaaacaca

SEQ ID NO: 379456 - RNA, 25 nt, Human
acuaaaccacaaaggcugcuuacug

SEQ ID NO: 379457 - RNA, 24 nt, Human
acuccaucucaaaaaaaaaaacaa

SEQ ID NO: 379458 - RNA, 18 nt, Human
acugcacuccagccuggg

SEQ ID NO: 379459 - RNA, 19 nt, Human
acugcacuccagccugggc

SEQ ID NO: 379460 - RNA, 25 nt, Human
acugcacuccagccugggcgacaag

SEQ ID NO: 379461 - RNA, 24 nt, Human
agaacaaaaaacaaaaacaaaaaa

SEQ ID NO: 379462 - RNA, 29 nt, Human
agaacaaaaaacaaaaacaaaagggaccc

SEQ ID NO: 379463 - RNA, 25 nt, Human
agccugggcgacaagagcaagacuc

SEQ ID NO: 379464 - RNA, 22 nt, Human
aggcaggagaacugcuugaacc

SEQ ID NO: 379465 - RNA, 24 nt, Human
aggcaggagaacugcuugaaccug

SEQ ID NO: 379466 - RNA, 20 nt, Human
aggcggagguugcagugagc

SEQ ID NO: 379467 - RNA, 24 nt, Human
aggcggagguugcagugagcugag

SEQ ID NO: 379468 - RNA, 24 nt, Human
aggcugaggcaggagaacugcuug

SEQ ID NO: 379469 - RNA, 20 nt, Human
agugcugaggugacaauaug

SEQ ID NO: 379470 - RNA, 19 nt, Human
auaaucaggcacaggacag

SEQ ID NO: 379471 - RNA, 21 nt, Human
aucuagaguagaaaugugaaa

SEQ ID NO: 379472 - RNA, 22 nt, Human
augaaacagccacuuauccaca

SEQ ID NO: 379473 - RNA, 19 nt, Human
augcuguccagugcguagu

SEQ ID NO: 379474 - RNA, 20 nt, Human
auggugugcuuugucuuccc

SEQ ID NO: 379475 - RNA, 24 nt, Human
auugcgccacugcacuccagccug

SEQ ID NO: 379476 - RNA, 26 nt, Human
caaaaaaaaaaacaaagaacaaaaaa

SEQ ID NO: 379477 - RNA, 25 nt, Human
caaaaacaaaaaaaccuguucugac

SEQ ID NO: 379478 - RNA, 23 nt, Human
caaagaacaaaaaacaaaaacaa

SEQ ID NO: 379479 - RNA, 19 nt, Human
caacacaaaguaauucuua

SEQ ID NO: 379480 - RNA, 21 nt, Human
caaccaacauaaaaaagggaa

SEQ ID NO: 379481 - RNA, 23 nt, Human
caaccucggugcuuuaaaaacag

SEQ ID NO: 379482 - RNA, 21 nt, Human
caagacuccaucucaaaaaaa

SEQ ID NO: 379483 - RNA, 24 nt, Human
caauucaauuauaaagaauacauc

SEQ ID NO: 379484 - RNA, 23 nt, Human
cacagugcugaggugacaauaug

SEQ ID NO: 379485 - RNA, 24 nt, Human
cacuccagccugggcgacaagagc

SEQ ID NO: 379486 - RNA, 19 nt, Human
cacugcacuccagccuggg

SEQ ID NO: 379487 - RNA, 21 nt, Human
cacugcacuccagccugggcg

SEQ ID NO: 379488 - RNA, 22 nt, Human
cacugcacuccagccugggcga

SEQ ID NO: 379489 - RNA, 23 nt, Human
cacugcacuccagccugggcgac

SEQ ID NO: 379490 - RNA, 24 nt, Human
cacugcacuccagccugggcgaca

SEQ ID NO: 379491 - RNA, 18 nt, Human
cagauccaacacaaagua

SEQ ID NO: 379492 - RNA, 23 nt, Human
caucucaaaaaaaaaaacaaaga

SEQ ID NO: 379493 - RNA, 20 nt, Human
ccacugcacuccagccuggg

SEQ ID NO: 379494 - RNA, 20 nt, Human
ccacugcacuccagccuggg

SEQ ID NO: 379495 - RNA, 21 nt, Human
ccacugcacuccagccugggc

SEQ ID NO: 379496 - RNA, 21 nt, Human
ccacugcacuccagccugggc

SEQ ID NO: 379497 - RNA, 23 nt, Human
ccacugcacuccagccugggcga

SEQ ID NO: 379498 - RNA, 24 nt, Human
ccacugcacuccagccugggcgac

SEQ ID NO: 379499 - RNA, 23 nt, Human
ccaucucaaaaaaaaaaacaaag

SEQ ID NO: 379500 - RNA, 19 nt, Human
cccacugaaauuccuccuu

SEQ ID NO: 379501 - RNA, 19 nt, Human
ccugggaggcggagguugc

SEQ ID NO: 379502 - RNA, 23 nt, Human
ccugggcgacaagagcaagacuc

SEQ ID NO: 379503 - RNA, 21 nt, Human
cgacaagagcaagacuccauc

SEQ ID NO: 379504 - RNA, 26 nt, Human
cgccacugcacuccagccugggcgac

SEQ ID NO: 379505 - RNA, 25 nt, Human
cuaaaccacaaaggcugcuuacuga

SEQ ID NO: 379506 - RNA, 19 nt, Human
cuccaucucaaaaaaaaaa

SEQ ID NO: 379507 - RNA, 23 nt, Human
cugaccuugaaacacacaaacac

SEQ ID NO: 379508 - RNA, 24 nt, Human
cugaccuugaaacacacaaacaca

SEQ ID NO: 379509 - RNA, 21 nt, Human
cugcuguaaaaaguguacauu

SEQ ID NO: 379510 - RNA, 24 nt, Human
cugcuugaaccugggaggcggagg

SEQ ID NO: 379511 - RNA, 19 nt, Human
cuugaaccugggaggcgga

SEQ ID NO: 379512 - RNA, 21 nt, Human
cuugcauauucaccacaugaa

SEQ ID NO: 379513 - RNA, 20 nt, Human
cuuuuauaacuaaaccacaa

SEQ ID NO: 379514 - RNA, 23 nt, Human
gagauugcgccacugcacuccag

SEQ ID NO: 379515 - RNA, 21 nt, Human
gagguugcagugagcugagau

SEQ ID NO: 379516 - RNA, 23 nt, Human
gagguugcagugagcugagauug

SEQ ID NO: 379517 - RNA, 22 nt, Human
gccacugcacuccagccugggc

SEQ ID NO: 379518 - RNA, 24 nt, Human
gccacugcacuccagccugggcga

SEQ ID NO: 379519 - RNA, 22 nt, Human
ggagguugcagugagcugagau

SEQ ID NO: 379520 - RNA, 24 nt, Human
ggagguugcagugagcugagauug

SEQ ID NO: 379521 - RNA, 24 nt, Human
gggaaaaaccaauucaauuauaaa

SEQ ID NO: 379522 - RNA, 20 nt, Human
gggcuagauguuuucagauu

SEQ ID NO: 379523 - RNA, 19 nt, Human
guugcagugagcugagauu

SEQ ID NO: 379524 - RNA, 21 nt, Human
uaaaauaaucaggcacaggaa

SEQ ID NO: 379525 - RNA, 21 nt, Human
uaaacauacaaagcuguucac

SEQ ID NO: 379526 - RNA, 21 nt, Human
uaccuuugggcuagauguuuu

SEQ ID NO: 379527 - RNA, 26 nt, Human
uacuaaagccuuuuauaacuaaacca

SEQ ID NO: 379528 - RNA, 18 nt, Human
uagaauaaaccucaucaa

SEQ ID NO: 379529 - RNA, 24 nt, Human
uagaguagaaaugugaaaucaaga

SEQ ID NO: 379530 - RNA, 19 nt, Human
uagcuaaaauaaucaggca

SEQ ID NO: 379531 - RNA, 24 nt, Human
uauaacuaaaccacaaaggcugcu

SEQ ID NO: 379532 - RNA, 22 nt, Human
uauagcacaccauuuugagacc

SEQ ID NO: 379533 - RNA, 22 nt, Human
ucaaaaaaaaaaacaaagaaca

SEQ ID NO: 379534 - RNA, 19 nt, Human
uccaaaaacuagauggaau

SEQ ID NO: 379535 - RNA, 27 nt, Human
uccacaaaacuggaaggcuuuuaaaaa

SEQ ID NO: 379536 - RNA, 19 nt, Human
uccagccugggcgacaaga

SEQ ID NO: 379537 - RNA, 21 nt, Human
uccaucucaaaaaaaaaaaca

SEQ ID NO: 379538 - RNA, 19 nt, Human
ucccucuuccccuuacaaa

SEQ ID NO: 379539 - RNA, 23 nt, Human
ucccuuacccuucauaaacauac

SEQ ID NO: 379540 - RNA, 20 nt, Human
uccucuaugagaacagaaca

SEQ ID NO: 379541 - RNA, 23 nt, Human
ucucucucucauacacacacaga

SEQ ID NO: 379542 - RNA, 23 nt, Human
ucuuauugccucacauuuuaaaa

SEQ ID NO: 379543 - RNA, 24 nt, Human
ugaaccugggaggcggagguugca

SEQ ID NO: 379544 - RNA, 20 nt, Human
ugagaacagaacaguggacu

SEQ ID NO: 379545 - RNA, 21 nt, Human
ugagaccaaaacaaucaagcu

SEQ ID NO: 379546 - RNA, 22 nt, Human
ugagcugagauugcgccacugc

SEQ ID NO: 379547 - RNA, 24 nt, Human
ugaggcaggagaacugcuugaacc

SEQ ID NO: 379548 - RNA, 25 nt, Human
ugaggcaggagaacugcuugaaccu

SEQ ID NO: 379549 - RNA, 18 nt, Human
ugcuguccagugcguagu

SEQ ID NO: 379550 - RNA, 20 nt, Human
uggaaggcuuuuaaaaaaug

SEQ ID NO: 379551 - RNA, 21 nt, Human
uggaaggcuuuuaaaaaaugu

SEQ ID NO: 379552 - RNA, 29 nt, Human
ugggaggcggagguugcagugacaacggu

SEQ ID NO: 379553 - RNA, 24 nt, Human
ugggaggcggagguugcagugagc

SEQ ID NO: 379554 - RNA, 23 nt, Human
ugugaaaucaagaguauuuuuga

SEQ ID NO: 379555 - RNA, 22 nt, Human
uguuauaucaaccaacauaaaa

SEQ ID NO: 379556 - RNA, 22 nt, Human
uguugagaacaguauguucugc

SEQ ID NO: 379557 - RNA, 18 nt, Human
uuccaguuagacguggga

SEQ ID NO: 379558 - RNA, 24 nt, Human
uugaaccugggaggcggagguugc

SEQ ID NO: 379559 - RNA, 19 nt, Human
uugcagugagcugagauug

SEQ ID NO: 379560 - RNA, 20 nt, Human
uugcagugagcugagauugc

SEQ ID NO: 379561 - RNA, 22 nt, Human
uugcagugagcugagauugcgc

SEQ ID NO: 379562 - RNA, 23 nt, Human
uugcgccacugcacuccagccug

SEQ ID NO: 379563 - RNA, 24 nt, Human
uuuaccaaagccuccucagaucca

SEQ ID NO: 379564 - RNA, 19 nt, Human
uuucccucuuccccuuaca

SEQ ID NO: 379565 - RNA, 22 nt, Human
aagcggugccaauggggagagu

SEQ ID NO: 379566 - RNA, 31 nt, Human
agaaaaaaaaaacuuaagucccauaaagaag

SEQ ID NO: 379567 - RNA, 18 nt, Human
agacaaaggugguucaga

SEQ ID NO: 379568 - RNA, 22 nt, Human
aggcaggguuuguggcugagaa

SEQ ID NO: 379569 - RNA, 19 nt, Human
cacaaagccaucuggggca

SEQ ID NO: 379570 - RNA, 20 nt, Human
ccauaaagaaggcagaaaca

SEQ ID NO: 379571 - RNA, 19 nt, Human
ccucugcagagacaaaggu

SEQ ID NO: 379572 - RNA, 22 nt, Human
cgacauccuagagauggagagg

SEQ ID NO: 379573 - RNA, 23 nt, Human
gaaaaaaaaaacuuaagucccau

SEQ ID NO: 379574 - RNA, 24 nt, Human
gagaaaaaaaaaacuuaaguccca

SEQ ID NO: 379575 - RNA, 24 nt, Human
gagaagcggugccaauggggagag

SEQ ID NO: 379576 - RNA, 25 nt, Human
gagacaaaggugguucagaguucau

SEQ ID NO: 379577 - RNA, 18 nt, Human
gaguucauggggaaaaga

SEQ ID NO: 379578 - RNA, 22 nt, Human
ggggagaguggcaguguccaga

SEQ ID NO: 379579 - RNA, 22 nt, Human
ggguuuguggcugagaagcggu

SEQ ID NO: 379580 - RNA, 23 nt, Human
ucaacgcugguagccagcucccu

SEQ ID NO: 379581 - RNA, 18 nt, Human
ucucaccaaagacgacau

SEQ ID NO: 379582 - RNA, 24 nt, Human
ugccucugcagagacaaagguggu

SEQ ID NO: 379583 - RNA, 20 nt, Human
ugcuaaagcucgcuugcugg

SEQ ID NO: 379584 - RNA, 21 nt, Human
ugcugggauccggaugccucu

SEQ ID NO: 379585 - RNA, 19 nt, Human
uggagaggagaaaaaaaaa

SEQ ID NO: 379586 - RNA, 19 nt, Human
uggggaaaagaggcagggu

SEQ ID NO: 379587 - RNA, 24 nt, Human
uggggagaguggcaguguccagag

SEQ ID NO: 379588 - RNA, 24 nt, Human
uugauggugaagugacuucccugc

SEQ ID NO: 379589 - RNA, 18 nt, Human
uuuguggcugagaagcgg

SEQ ID NO: 379590 - RNA, 25 nt, Human
uuuuuuuuuuuuuuucacaguuuuu

SEQ ID NO: 379591 - RNA, 22 nt, Human
uuuuuuuuuuuuuuuuucacag

SEQ ID NO: 379592 - RNA, 21 nt, Human
cauuggguggagauuagcugg

SEQ ID NO: 379593 - RNA, 22 nt, Human
ucacugauggcaauggaucucu

SEQ ID NO: 379594 - RNA, 23 nt, Human
ucacugauggcaauggaucucug

SEQ ID NO: 379595 - RNA, 22 nt, Human
ucucuggaucgugcugcugcuu

SEQ ID NO: 379596 - RNA, 23 nt, Human
aaaaaauacaauagaaaccugaa

SEQ ID NO: 379597 - RNA, 20 nt, Human
aaaaauacaauagaaaccug

SEQ ID NO: 379598 - RNA, 23 nt, Human
aaagaagauuauguaaggaaugg

SEQ ID NO: 379599 - RNA, 20 nt, Human
aacaaaacaacuaaaacuac

SEQ ID NO: 379600 - RNA, 20 nt, Human
aagaugccacaaaauuuagc

SEQ ID NO: 379601 - RNA, 21 nt, Human
aaucaucuaaagcauuuggca

SEQ ID NO: 379602 - RNA, 21 nt, Human
accuccugccugucuccaaga

SEQ ID NO: 379603 - RNA, 18 nt, Human
agaagagugacuuuuauu

SEQ ID NO: 379604 - RNA, 21 nt, Human
agaaucuucaggccucugcuc

SEQ ID NO: 379605 - RNA, 21 nt, Human
agcaacugggccugaaauuca

SEQ ID NO: 379606 - RNA, 18 nt, Human
agguccucaucauucugc

SEQ ID NO: 379607 - RNA, 19 nt, Human
agucacuuaaaaacaaaac

SEQ ID NO: 379608 - RNA, 18 nt, Human
auggaacacaucagcauu

SEQ ID NO: 379609 - RNA, 22 nt, Human
caacaauaaucacagagagaag

SEQ ID NO: 379610 - RNA, 26 nt, Human
caacaauaaucacagagagaagucuc

SEQ ID NO: 379611 - RNA, 22 nt, Human
caacugggccugaaauucacca

SEQ ID NO: 379612 - RNA, 22 nt, Human
caagugauccacuuacggagcc

SEQ ID NO: 379613 - RNA, 22 nt, Human
cacagagagaagucuccccacc

SEQ ID NO: 379614 - RNA, 23 nt, Human
cacuuacggagccaagcuaaggg

SEQ ID NO: 379615 - RNA, 19 nt, Human
caugauuaguaaaguguau

SEQ ID NO: 379616 - RNA, 24 nt, Human
cauuacccaaucuuccucaaacau

SEQ ID NO: 379617 - RNA, 24 nt, Human
cauuuagaauacaacuaccaccac

SEQ ID NO: 379618 - RNA, 26 nt, Human
cccaacccagguguuguuaguuaucu

SEQ ID NO: 379619 - RNA, 21 nt, Human
ccgccgccccaacccaggugu

SEQ ID NO: 379620 - RNA, 18 nt, Human
ccuuccuuaaaauaugga

SEQ ID NO: 379621 - RNA, 18 nt, Human
cgcccugggcccuggagc

SEQ ID NO: 379622 - RNA, 18 nt, Human
cgcugcgaggcugggugg

SEQ ID NO: 379623 - RNA, 23 nt, Human
cuacaucauuuagaauacaacua

SEQ ID NO: 379624 - RNA, 31 nt, Human
cucuuuuguuucauaaaaauauaaaaauauu

SEQ ID NO: 379625 - RNA, 22 nt, Human
cugggugggugggugggugcgu

SEQ ID NO: 379626 - RNA, 24 nt, Human
cuuucucugcaagaauguuaaaaa

SEQ ID NO: 379627 - RNA, 21 nt, Human
gagccaagcuaagggagcuga

SEQ ID NO: 379628 - RNA, 19 nt, Human
gagcugaagagaagaggcc

SEQ ID NO: 379629 - RNA, 21 nt, Human
gaucuaugccauucuuuccuu

SEQ ID NO: 379630 - RNA, 21 nt, Human
gaugacuggaggugggaagga

SEQ ID NO: 379631 - RNA, 20 nt, Human
ggaauuaacuccagacugua

SEQ ID NO: 379632 - RNA, 19 nt, Human
ggagcugaagagaagaggc

SEQ ID NO: 379633 - RNA, 19 nt, Human
uaaaaacaaaacaacuaaa

SEQ ID NO: 379634 - RNA, 22 nt, Human
uaaaaacaaaacaacuaaaacu

SEQ ID NO: 379635 - RNA, 24 nt, Human
uaaaaacaaaacaacuaaaacuac

SEQ ID NO: 379636 - RNA, 20 nt, Human
uaaaagguuuaacaucuguu

SEQ ID NO: 379637 - RNA, 19 nt, Human
uaacaggaauuaacuccag

SEQ ID NO: 379638 - RNA, 19 nt, Human
uacaguuucaugaauggaa

SEQ ID NO: 379639 - RNA, 19 nt, Human
uacaucauuuagaauacaa

SEQ ID NO: 379640 - RNA, 26 nt, Human
uaccagggaaaauaaagagauucagc

SEQ ID NO: 379641 - RNA, 21 nt, Human
uacccaaucuuccucaaacau

SEQ ID NO: 379642 - RNA, 20 nt, Human
uagcaacaauaaucacagag

SEQ ID NO: 379643 - RNA, 18 nt, Human
uaucuagaggacauaaaa

SEQ ID NO: 379644 - RNA, 21 nt, Human
uauuuugauuuccuagguuga

SEQ ID NO: 379645 - RNA, 18 nt, Human
ucacuuaaaaacaaaaca

SEQ ID NO: 379646 - RNA, 18 nt, Human
ucagaagaaagaaucuuc

SEQ ID NO: 379647 - RNA, 22 nt, Human
ucagcauuacccaaucuuccuc

SEQ ID NO: 379648 - RNA, 23 nt, Human
ucagcucuucccccaccuccugc

SEQ ID NO: 379649 - RNA, 18 nt, Human
ucaucuaaagcauuuggc

SEQ ID NO: 379650 - RNA, 24 nt, Human
ucccccaccuccugccugucucca

SEQ ID NO: 379651 - RNA, 21 nt, Human
ucuaagacaagcaggaaaaug

SEQ ID NO: 379652 - RNA, 25 nt, Human
ucuccaaugugucuuuuuucccaag

SEQ ID NO: 379653 - RNA, 24 nt, Human
ucucugcaagaauguuaaaaaaaa

SEQ ID NO: 379654 - RNA, 23 nt, Human
ucugcuugguauucuguuggugu

SEQ ID NO: 379655 - RNA, 20 nt, Human
ugacuggaggugggaaggac

SEQ ID NO: 379656 - RNA, 21 nt, Human
ugacuggaggugggaaggacu

SEQ ID NO: 379657 - RNA, 28 nt, Human
ugacuggaggugggaaggacuagaggaa

SEQ ID NO: 379658 - RNA, 21 nt, Human
ugagaggcaaucaucuaaagc

SEQ ID NO: 379659 - RNA, 21 nt, Human
ugagcauaauuauaauuaaca

SEQ ID NO: 379660 - RNA, 20 nt, Human
ugcggcgcccugggcccugg

SEQ ID NO: 379661 - RNA, 25 nt, Human
ugcucuuuuguuucauaaaaauaua

SEQ ID NO: 379662 - RNA, 22 nt, Human
ugggaaggacuagaggaagaug

SEQ ID NO: 379663 - RNA, 23 nt, Human
ugggaaggacuagaggaagaugc

SEQ ID NO: 379664 - RNA, 22 nt, Human
uggggcugaugacuggaggugg

SEQ ID NO: 379665 - RNA, 21 nt, Human
uguguagaaauugaaaccauu

SEQ ID NO: 379666 - RNA, 22 nt, Human
uuccuagguugacuaagcauac

SEQ ID NO: 379667 - RNA, 21 nt, Human
uugcaaagccucuuccauuuc

SEQ ID NO: 379668 - RNA, 22 nt, Human
uuggaucuugcuuucucugcaa

SEQ ID NO: 379669 - RNA, 18 nt, Human
uugguauucuguuggugu

SEQ ID NO: 379670 - RNA, 22 nt, Human
uuuuuuguuuguuuaaccucag

SEQ ID NO: 379671 - RNA, 20 nt, Human
uuuuuuuuuuuuaauagggc

SEQ ID NO: 379672 - RNA, 31 nt, Human
uuuuuuuuuuuuuuuuuuuuuuuaauagggg

SEQ ID NO: 379673 - RNA, 21 nt, Human
aaaaugccccuccuagacccc

SEQ ID NO: 379674 - RNA, 18 nt, Human
aaaugccccuccuagacc

SEQ ID NO: 379675 - RNA, 18 nt, Human
agaggagccuggauuucu

SEQ ID NO: 379676 - RNA, 21 nt, Human
agaggagccuggauuucuugg

SEQ ID NO: 379677 - RNA, 21 nt, Human
agccacaaagacaggaagaga

SEQ ID NO: 379678 - RNA, 21 nt, Human
aggcaggggauagggguggug

SEQ ID NO: 379679 - RNA, 18 nt, Human
aggcagucuccaaaaugc

SEQ ID NO: 379680 - RNA, 20 nt, Human
caacagcaccucaguggggc

SEQ ID NO: 379681 - RNA, 26 nt, Human
ccagcaauaaaccaacaggguacccc

SEQ ID NO: 379682 - RNA, 20 nt, Human
cgauggaaccaaggaggcuc

SEQ ID NO: 379683 - RNA, 19 nt, Human
cggagccacaaagacagga

SEQ ID NO: 379684 - RNA, 20 nt, Human
cggagccacaaagacaggaa

SEQ ID NO: 379685 - RNA, 22 nt, Human
cguugccagcaauaaaccaaca

SEQ ID NO: 379686 - RNA, 25 nt, Human
gaaaaccccuuaguaagcacuucuc

SEQ ID NO: 379687 - RNA, 21 nt, Human
gagagcagggcaggauccagg

SEQ ID NO: 379688 - RNA, 18 nt, Human
gcaucccaaacgccuuuc

SEQ ID NO: 379689 - RNA, 19 nt, Human
gcuucacgauggaaccaag

SEQ ID NO: 379690 - RNA, 21 nt, Human
gggcugguccuucacuauggc

SEQ ID NO: 379691 - RNA, 22 nt, Human
uagaaaaccccuuaguaagcac

SEQ ID NO: 379692 - RNA, 21 nt, Human
uaguaagcacuucucuaaccc

SEQ ID NO: 379693 - RNA, 22 nt, Human
uauccuccaagagucccauagc

SEQ ID NO: 379694 - RNA, 20 nt, Human
uccaaaaugccccuccuaga

SEQ ID NO: 379695 - RNA, 23 nt, Human
uccaaaaugccccuccuagaccc

SEQ ID NO: 379696 - RNA, 22 nt, Human
uccuagaccccugagagaauuc

SEQ ID NO: 379697 - RNA, 18 nt, Human
ugagagggggaggcaggg

SEQ ID NO: 379698 - RNA, 19 nt, Human
uggaaccaaggaggcucuc

SEQ ID NO: 379699 - RNA, 23 nt, Human
uggcuucacgauggaaccaagga

SEQ ID NO: 379700 - RNA, 22 nt, Human
ugggagaggagggcuguggaag

SEQ ID NO: 379701 - RNA, 21 nt, Human
uggguauccuccaagaguccc

SEQ ID NO: 379702 - RNA, 18 nt, Human
uucacgauggaaccaagg

SEQ ID NO: 379703 - RNA, 19 nt, Human
aaggaagcaagggcagggc

SEQ ID NO: 379704 - RNA, 22 nt, Human
aaggaagcaagggcagggcugg

SEQ ID NO: 379705 - RNA, 25 nt, Human
cuagaggaaaagaaaacgagcuccc

SEQ ID NO: 379706 - RNA, 20 nt, Human
gaaggaagcaagggcagggc

SEQ ID NO: 379707 - RNA, 22 nt, Human
ggaaaagaaaacgagcucccau

SEQ ID NO: 379708 - RNA, 19 nt, Human
gggcagggcuggggugccg

SEQ ID NO: 379709 - RNA, 18 nt, Human
ucccagguccugugaugu

SEQ ID NO: 379710 - RNA, 28 nt, Human
ugccuagaggaaaagaaaacgagcuccc

SEQ ID NO: 379711 - RNA, 23 nt, Human
uuuauugaaggaagcaagggcag

SEQ ID NO: 379712 - RNA, 21 nt, Human
aaauuauaaacagccauccuu

SEQ ID NO: 379713 - RNA, 20 nt, Human
accccugcuccagcaacuug

SEQ ID NO: 379714 - RNA, 18 nt, Human
agaaggcaagcgcaaaga

SEQ ID NO: 379715 - RNA, 22 nt, Human
agggggauggggggacaccggg

SEQ ID NO: 379716 - RNA, 19 nt, Human
agguaggagcuacaggccu

SEQ ID NO: 379717 - RNA, 19 nt, Human
agguugggaaucuccucag

SEQ ID NO: 379718 - RNA, 24 nt, Human
caaaaugaaaguagaaauaggccc

SEQ ID NO: 379719 - RNA, 21 nt, Human
caggacaagcagcagcuacau

SEQ ID NO: 379720 - RNA, 23 nt, Human
caggacaagcagcagcuacaucc

SEQ ID NO: 379721 - RNA, 22 nt, Human
caggcugcacaagggaaaccaa

SEQ ID NO: 379722 - RNA, 19 nt, Human
cccacccuaucucucccca

SEQ ID NO: 379723 - RNA, 18 nt, Human
ccccgcgucccgccaccg

SEQ ID NO: 379724 - RNA, 18 nt, Human
cccgcgugcgcggccccg

SEQ ID NO: 379725 - RNA, 23 nt, Human
cccuagugacauacacaccaaca

SEQ ID NO: 379726 - RNA, 24 nt, Human
cccugccucccacccuaucucucc

SEQ ID NO: 379727 - RNA, 23 nt, Human
ccgcgugcgcggccccgcguccc

SEQ ID NO: 379728 - RNA, 20 nt, Human
cugcauugcccugccuccca

SEQ ID NO: 379729 - RNA, 24 nt, Human
cugcggccucgcgagggccccggc

SEQ ID NO: 379730 - RNA, 24 nt, Human
gcagagccccaggcugcacaaggg

SEQ ID NO: 379731 - RNA, 21 nt, Human
ggaagcuuuucccgcgugcgc

SEQ ID NO: 379732 - RNA, 23 nt, Human
ggacaagcagcagcuacauccuu

SEQ ID NO: 379733 - RNA, 22 nt, Human
gggcgcgcuggggggacgcggg

SEQ ID NO: 379734 - RNA, 21 nt, Human
uaaacagccauccuugggaag

SEQ ID NO: 379735 - RNA, 18 nt, Human
uaggccccagguaggagg

SEQ ID NO: 379736 - RNA, 21 nt, Human
ucaugaggagaaacugguacc

SEQ ID NO: 379737 - RNA, 21 nt, Human
ucccacccuaucucuccccaa

SEQ ID NO: 379738 - RNA, 22 nt, Human
ucccacccuaucucuccccaaa

SEQ ID NO: 379739 - RNA, 23 nt, Human
ucccacccuaucucuccccaaaa

SEQ ID NO: 379740 - RNA, 21 nt, Human
ucgggaaaguaagaugaggau

SEQ ID NO: 379741 - RNA, 19 nt, Human
ugaacaggacaagcagcag

SEQ ID NO: 379742 - RNA, 23 nt, Human
ugagaaggcaagcgcaaagagaa

SEQ ID NO: 379743 - RNA, 18 nt, Human
ugccucccacccuaucuc

SEQ ID NO: 379744 - RNA, 23 nt, Human
uggcacagaauccagggacugca

SEQ ID NO: 379745 - RNA, 24 nt, Human
uggcacagaauccagggacugcau

SEQ ID NO: 379746 - RNA, 23 nt, Human
uggguggggagucggggggugug

SEQ ID NO: 379747 - RNA, 20 nt, Human
uucacagaccagaaauacaa

SEQ ID NO: 379748 - RNA, 23 nt, Human
cacguucugcuucucaucaaggg

SEQ ID NO: 379749 - RNA, 18 nt, Human
gaugacgagggagccgca

SEQ ID NO: 379750 - RNA, 27 nt, Human
gcggcagcagugguggcgaguuggcag

SEQ ID NO: 379751 - RNA, 20 nt, Human
gugguggcgaguuggcagca

SEQ ID NO: 379752 - RNA, 21 nt, Human
gugguugcgauugcggcagca

SEQ ID NO: 379753 - RNA, 21 nt, Human
ucucacuucagagacaaagca

SEQ ID NO: 379754 - RNA, 19 nt, Human
ugcuucucaucaagggcau

SEQ ID NO: 379755 - RNA, 21 nt, Human
uggcagcaguuggugacaaag

SEQ ID NO: 379756 - RNA, 18 nt, Human
uugcuaugcaccugauga

SEQ ID NO: 379757 - RNA, 20 nt, Human
aaacacucagaacugcccuc

SEQ ID NO: 379758 - RNA, 23 nt, Human
acuguugugaacacuugcuuuca

SEQ ID NO: 379759 - RNA, 18 nt, Human
agagugaggggagcuuga

SEQ ID NO: 379760 - RNA, 22 nt, Human
aguauggaagaaucgaaagaga

SEQ ID NO: 379761 - RNA, 18 nt, Human
aucuuccucagggucgcu

SEQ ID NO: 379762 - RNA, 23 nt, Human
auggcaaugggaaaagcagaugg

SEQ ID NO: 379763 - RNA, 33 nt, Human
cugguacuugguguguguguguguguguguggu

SEQ ID NO: 379764 - RNA, 24 nt, Human
gaacucuuggcacacuaagaaaaa

SEQ ID NO: 379765 - RNA, 22 nt, Human
gcuaacaucgaacucuuggcac

SEQ ID NO: 379766 - RNA, 18 nt, Human
ggaaacagagugagggga

SEQ ID NO: 379767 - RNA, 23 nt, Human
gggcaugugucguaucccugagg

SEQ ID NO: 379768 - RNA, 21 nt, Human
guggugugguuugugugcgug

SEQ ID NO: 379769 - RNA, 20 nt, Human
gugugugugugugugugugu

SEQ ID NO: 379770 - RNA, 21 nt, Human
gugugugugugugugugugug

SEQ ID NO: 379771 - RNA, 21 nt, Human
gugugugugugugugugugug

SEQ ID NO: 379772 - RNA, 21 nt, Human
gugugugugugugugugugug

SEQ ID NO: 379773 - RNA, 21 nt, Human
gugugugugugugugugugug

SEQ ID NO: 379774 - RNA, 21 nt, Human
gugugugugugugugugugug

SEQ ID NO: 379775 - RNA, 21 nt, Human
gugugugugugugugugugug

SEQ ID NO: 379776 - RNA, 19 nt, Human
uaaacacucagaacugccc

SEQ ID NO: 379777 - RNA, 23 nt, Human
uaacagaaugacacaguguaaga

SEQ ID NO: 379778 - RNA, 22 nt, Human
uacacaaaccaaaauaugcauu

SEQ ID NO: 379779 - RNA, 19 nt, Human
uccaaagagaaaaucagac

SEQ ID NO: 379780 - RNA, 19 nt, Human
ugaccaggacgcauggcaa

SEQ ID NO: 379781 - RNA, 25 nt, Human
uggaagaauccaaagagaaaaucag

SEQ ID NO: 379782 - RNA, 25 nt, Human
uggauacacaaaccaaaauaugcau

SEQ ID NO: 379783 - RNA, 21 nt, Human
uggcaaugggaaaagcagaug

SEQ ID NO: 379784 - RNA, 18 nt, Human
ugggaaaagcagauggca

SEQ ID NO: 379785 - RNA, 23 nt, Human
ugguacuuggugugugugugugu

SEQ ID NO: 379786 - RNA, 22 nt, Human
uggugugugugugugugugugu

SEQ ID NO: 379787 - RNA, 22 nt, Human
ugguuugugugcgugugugugu

SEQ ID NO: 379788 - RNA, 19 nt, Human
ugugugugugugguguggu

SEQ ID NO: 379789 - RNA, 25 nt, Human
uguguguguguggugugguuugugu

SEQ ID NO: 379790 - RNA, 18 nt, Human
ugugugugugugugugug

SEQ ID NO: 379791 - RNA, 18 nt, Human
ugugugugugugugugug

SEQ ID NO: 379792 - RNA, 18 nt, Human
ugugugugugugugugug

SEQ ID NO: 379793 - RNA, 18 nt, Human
ugugugugugugugugug

SEQ ID NO: 379794 - RNA, 18 nt, Human
ugugugugugugugugug

SEQ ID NO: 379795 - RNA, 18 nt, Human
ugugugugugugugugug

SEQ ID NO: 379796 - RNA, 18 nt, Human
ugugugugugugugugug

SEQ ID NO: 379797 - RNA, 18 nt, Human
ugugugugugugugugug

SEQ ID NO: 379798 - RNA, 18 nt, Human
ugugugugugugugugug

SEQ ID NO: 379799 - RNA, 18 nt, Human
ugugugugugugugugug

SEQ ID NO: 379800 - RNA, 18 nt, Human
ugugugugugugugugug

SEQ ID NO: 379801 - RNA, 18 nt, Human
ugugugugugugugugug

SEQ ID NO: 379802 - RNA, 18 nt, Human
ugugugugugugugugug

SEQ ID NO: 379803 - RNA, 18 nt, Human
ugugugugugugugugug

SEQ ID NO: 379804 - RNA, 22 nt, Human
uguguguguguguguguggugu

SEQ ID NO: 379805 - RNA, 20 nt, Human
ugugugugugugugugugug

SEQ ID NO: 379806 - RNA, 21 nt, Human
ugugugugugugugugugugu

SEQ ID NO: 379807 - RNA, 21 nt, Human
ugugugugugugugugugugu

SEQ ID NO: 379808 - RNA, 21 nt, Human
ugugugugugugugugugugu

SEQ ID NO: 379809 - RNA, 21 nt, Human
ugugugugugugugugugugu

SEQ ID NO: 379810 - RNA, 21 nt, Human
ugugugugugugugugugugu

SEQ ID NO: 379811 - RNA, 21 nt, Human
ugugugugugugugugugugu

SEQ ID NO: 379812 - RNA, 21 nt, Human
ugugugugugugugugugugu

SEQ ID NO: 379813 - RNA, 21 nt, Human
ugugugugugugugugugugu

SEQ ID NO: 379814 - RNA, 21 nt, Human
ugugugugugugugugugugu

SEQ ID NO: 379815 - RNA, 21 nt, Human
ugugugugugugugugugugu

SEQ ID NO: 379816 - RNA, 21 nt, Human
ugugugugugugugugugugu

SEQ ID NO: 379817 - RNA, 21 nt, Human
ugugugugugugugugugugu

SEQ ID NO: 379818 - RNA, 21 nt, Human
ugugugugugugugugugugu

SEQ ID NO: 379819 - RNA, 21 nt, Human
ugugugugugugugugugugu

SEQ ID NO: 379820 - RNA, 21 nt, Human
ugugugugugugugugugugu

SEQ ID NO: 379821 - RNA, 21 nt, Human
ugugugugugugugugugugu

SEQ ID NO: 379822 - RNA, 21 nt, Human
ugugugugugugugugugugu

SEQ ID NO: 379823 - RNA, 21 nt, Human
ugugugugugugugugugugu

SEQ ID NO: 379824 - RNA, 21 nt, Human
ugugugugugugugugugugu

SEQ ID NO: 379825 - RNA, 21 nt, Human
ugugugugugugugugugugu

SEQ ID NO: 379826 - RNA, 21 nt, Human
ugugugugugugugugugugu

SEQ ID NO: 379827 - RNA, 21 nt, Human
ugugugugugugugugugugu

SEQ ID NO: 379828 - RNA, 21 nt, Human
ugugugugugugugugugugu

SEQ ID NO: 379829 - RNA, 21 nt, Human
ugugugugugugugugugugu

SEQ ID NO: 379830 - RNA, 21 nt, Human
ugugugugugugugugugugu

SEQ ID NO: 379831 - RNA, 21 nt, Human
ugugugugugugugugugugu

SEQ ID NO: 379832 - RNA, 22 nt, Human
ugugugugugugugugugugug

SEQ ID NO: 379833 - RNA, 22 nt, Human
ugugugugugugugugugugug

SEQ ID NO: 379834 - RNA, 22 nt, Human
ugugugugugugugugugugug

SEQ ID NO: 379835 - RNA, 22 nt, Human
ugugugugugugugugugugug

SEQ ID NO: 379836 - RNA, 22 nt, Human
ugugugugugugugugugugug

SEQ ID NO: 379837 - RNA, 22 nt, Human
ugugugugugugugugugugug

SEQ ID NO: 379838 - RNA, 22 nt, Human
ugugugugugugugugugugug

SEQ ID NO: 379839 - RNA, 18 nt, Human
uugcuaugcaccugauga

SEQ ID NO: 379840 - RNA, 18 nt, Human
uuggugugugugugugug

SEQ ID NO: 379841 - RNA, 23 nt, Human
acuguugugaacacuugcuuuca

SEQ ID NO: 379842 - RNA, 22 nt, Human
auggcaaugggaaaagcagaug

SEQ ID NO: 379843 - RNA, 24 nt, Human
caagaaaauacaauggaaacgcua

SEQ ID NO: 379844 - RNA, 23 nt, Human
cgcuaauaucguacucuuggcac

SEQ ID NO: 379845 - RNA, 33 nt, Human; identical to SEQ ID NO: 379763

SEQ ID NO: 379846 - RNA, 22 nt, Human
ggagaugcuuauacugguacuu

SEQ ID NO: 379847 - RNA, 19 nt, Human
gucauauccccaaggggag

SEQ ID NO: 379848 - RNA, 20 nt, Human
gugugugugugugugugugu

SEQ ID NO: 379849 - RNA, 21 nt, Human
gugugugugugugugugugug

SEQ ID NO: 379850 - RNA, 21 nt, Human
gugugugugugugugugugug

SEQ ID NO: 379851 - RNA, 22 nt, Human
guuugcaaagguuuauuuacug

SEQ ID NO: 379852 - RNA, 19 nt, Human
uaaacacucagaacugccc

SEQ ID NO: 379853 - RNA, 22 nt, Human
uacacaaaccaaaauaugcauu

SEQ ID NO: 379854 - RNA, 18 nt, Human
uacugguacuuggugugu

SEQ ID NO: 379855 - RNA, 21 nt, Human
uccacagccaugcccauguuc

SEQ ID NO: 379856 - RNA, 19 nt, Human
ugaccaggacgcauggcaa

SEQ ID NO: 379857 - RNA, 22 nt, Human
uggaaacgcuaauaucguacuc

SEQ ID NO: 379858 - RNA, 25 nt, Human
uggaagaauccaaagagaaaaucag

SEQ ID NO: 379859 - RNA, 25 nt, Human
uggauacacaaaccaaaauaugcau

SEQ ID NO: 379860 - RNA, 21 nt, Human
uggcaaugggaaaagcagaug

SEQ ID NO: 379861 - RNA, 20 nt, Human
ugggaaaagcagaugggaga

SEQ ID NO: 379862 - RNA, 19 nt, Human
ugggagaugcuuauacugg

SEQ ID NO: 379863 - RNA, 21 nt, Human
ugggagaugcuuauacuggua

SEQ ID NO: 379864 - RNA, 23 nt, Human
ugguacuuggugugugugugugu

SEQ ID NO: 379865 - RNA, 23 nt, Human
uggugugguuugugugugugugu

SEQ ID NO: 379866 - RNA, 22 nt, Human
uggugugugugugugugugugu

SEQ ID NO: 379867 - RNA, 25 nt, Human
uguggugugguuugugugugugugg

SEQ ID NO: 379868 - RNA, 25 nt, Human
uguguguguguggugugguuugugu

SEQ ID NO: 379869 - RNA, 18 nt, Human
ugugugugugugugugug

SEQ ID NO: 379870 - RNA, 18 nt, Human
ugugugugugugugugug

SEQ ID NO: 379871 - RNA, 18 nt, Human
ugugugugugugugugug

SEQ ID NO: 379872 - RNA, 18 nt, Human
ugugugugugugugugug

SEQ ID NO: 379873 - RNA, 18 nt, Human
ugugugugugugugugug

SEQ ID NO: 379874 - RNA, 18 nt, Human
ugugugugugugugugug

SEQ ID NO: 379875 - RNA, 18 nt, Human
ugugugugugugugugug

SEQ ID NO: 379876 - RNA, 22 nt, Human
uguguguguguguguguggugu

SEQ ID NO: 379877 - RNA, 20 nt, Human
ugugugugugugugugugug

SEQ ID NO: 379878 - RNA, 21 nt, Human
ugugugugugugugugugugu

SEQ ID NO: 379879 - RNA, 21 nt, Human
ugugugugugugugugugugu

SEQ ID NO: 379880 - RNA, 21 nt, Human
ugugugugugugugugugugu

SEQ ID NO: 379881 - RNA, 21 nt, Human
ugugugugugugugugugugu

SEQ ID NO: 379882 - RNA, 21 nt, Human
ugugugugugugugugugugu

SEQ ID NO: 379883 - RNA, 21 nt, Human
ugugugugugugugugugugu

SEQ ID NO: 379884 - RNA, 21 nt, Human
ugugugugugugugugugugu

SEQ ID NO: 379885 - RNA, 21 nt, Human
ugugugugugugugugugugu

SEQ ID NO: 379886 - RNA, 21 nt, Human
ugugugugugugugugugugu

SEQ ID NO: 379887 - RNA, 21 nt, Human
ugugugugugugugugugugu

SEQ ID NO: 379888 - RNA, 21 nt, Human
ugugugugugugugugugugu

SEQ ID NO: 379889 - RNA, 21 nt, Human
ugugugugugugugugugugu

SEQ ID NO: 379890 - RNA, 22 nt, Human
ugugugugugugugugugugug

SEQ ID NO: 379891 - RNA, 22 nt, Human
ugugugugugugugugugugug

SEQ ID NO: 379892 - RNA, 22 nt, Human
ugugugugugugugugugugug

SEQ ID NO: 379893 - RNA, 22 nt, Human
ugugugugugugugugugugug

SEQ ID NO: 379894 - RNA, 22 nt, Human
uuaaacacucagaacugcccuc

SEQ ID NO: 379895 - RNA, 20 nt, Human
uugcaaagguuuauuuacug

SEQ ID NO: 379896 - RNA, 18 nt, Human
uugcuaugcaccugauga

SEQ ID NO: 379897 - RNA, 18 nt, Human
uuggugugugugugugug

SEQ ID NO: 379898 - RNA, 21 nt, Human
uuuuuuuuuuuuuuuuuaacg

SEQ ID NO: 379899 - RNA, 22 nt, Human
aaaaaucggaaauuaaacacuu

SEQ ID NO: 379900 - RNA, 22 nt, Human
aaaaucggaaauuaaacacuca

SEQ ID NO: 379901 - RNA, 22 nt, Human
aaaugcagaggaaaaaaucgga

SEQ ID NO: 379902 - RNA, 20 nt, Human
aacaggaaacagagugaggg

SEQ ID NO: 379903 - RNA, 21 nt, Human
aauggagaaaagcagauggga

SEQ ID NO: 379904 - RNA, 23 nt, Human
acagcggaaacgccaacaucgaa

SEQ ID NO: 379905 - RNA, 19 nt, Human
accuccccucaguagucac

SEQ ID NO: 379906 - RNA, 23 nt, Human
acuguugugaacacuugcuuuca

SEQ ID NO: 379907 - RNA, 24 nt, Human
agaaucaaaagggcaaaucggcgg

SEQ ID NO: 379908 - RNA, 18 nt, Human
agaggaaaaaaucggaaa

SEQ ID NO: 379909 - RNA, 21 nt, Human
agcggaaacgccaacaucgaa

SEQ ID NO: 379910 - RNA, 21 nt, Human
aggaaacagagugaggggggc

SEQ ID NO: 379911 - RNA, 19 nt, Human
auggcaauggagaaaagca

SEQ ID NO: 379912 - RNA, 20 nt, Human
auggcaauggagaaaagcag

SEQ ID NO: 379913 - RNA, 23 nt, Human
auggcaauggagaaaagcagaug

SEQ ID NO: 379914 - RNA, 18 nt, Human
caacgaaaacgcuaaugu

SEQ ID NO: 379915 - RNA, 18 nt, Human
cagcgaaaacgcuaaugu

SEQ ID NO: 379916 - RNA, 18 nt, Human
cucaucagcgaaaacgcu

SEQ ID NO: 379917 - RNA, 27 nt, Human
cugguacuuggugugugugugugcgug

SEQ ID NO: 379918 - RNA, 21 nt, Human
gaacaggaaacagagugaggg

SEQ ID NO: 379919 - RNA, 24 nt, Human
gaacaggaaacagagugagggggg

SEQ ID NO: 379920 - RNA, 24 nt, Human
gaacucuuggcacacuaagaaaaa

SEQ ID NO: 379921 - RNA, 24 nt, Human
gacaauacuuguuuucugagguag

SEQ ID NO: 379922 - RNA, 22 nt, Human
ggagaugcuuauacugguacuu

SEQ ID NO: 379923 - RNA, 23 nt, Human
gggagagaggaggguagugcugu

SEQ ID NO: 379924 - RNA, 19 nt, Human
guacuuggugugugugugu

SEQ ID NO: 379925 - RNA, 21 nt, Human
gucgcauggcaauggagaaaa

SEQ ID NO: 379926 - RNA, 20 nt, Human
gugugugugugugcgugugu

SEQ ID NO: 379927 - RNA, 18 nt, Human
uacugguacuuggugugu

SEQ ID NO: 379928 - RNA, 19 nt, Human
ugaccaggacgcauggcaa

SEQ ID NO: 379929 - RNA, 23 nt, Human
ugcaagaaaauacagcggaaacg

SEQ ID NO: 379930 - RNA, 19 nt, Human
ugcagaggaaaaaaucgga

SEQ ID NO: 379931 - RNA, 19 nt, Human
ugcguguguggugugugug

SEQ ID NO: 379932 - RNA, 21 nt, Human
ugggagaugcuuauacuggua

SEQ ID NO: 379933 - RNA, 21 nt, Human
ugguacuuggugugugugugu

SEQ ID NO: 379934 - RNA, 22 nt, Human
uggugugugugugugcgugugu

SEQ ID NO: 379935 - RNA, 23 nt, Human
ugugcguguguggugugugugua

SEQ ID NO: 379936 - RNA, 23 nt, Human
ugugugcguguguggugugugug

SEQ ID NO: 379937 - RNA, 22 nt, Human
ugugugugcguguguggugugu

SEQ ID NO: 379938 - RNA, 18 nt, Human
ugugugugugugcgugug

SEQ ID NO: 379939 - RNA, 20 nt, Human
ugugugugugugcgugugug

SEQ ID NO: 379940 - RNA, 20 nt, Human
ugugugugugugcgugugug

SEQ ID NO: 379941 - RNA, 19 nt, Human
uguugaacguuugcaaagg

SEQ ID NO: 379942 - RNA, 18 nt, Human
uugcuaugcaccugauga

SEQ ID NO: 379943 - RNA, 20 nt, Human
uuguggaagaaucaaaaggg

SEQ ID NO: 379944 - RNA, 21 nt, Human
uuguggaagaaucaaaagggc

SEQ ID NO: 379945 - RNA, 21 nt, Human
uuuuuuuuuuuuuuguugaac

SEQ ID NO: 379946 - RNA, 18 nt, Human
uuuuuuuuuuuuuuuuug

SEQ ID NO: 379947 - RNA, 20 nt, Human
uuuuuuuuuuuuuuuuuguu

SEQ ID NO: 379948 - RNA, 19 nt, Human
aaguccacccugggagcug

SEQ ID NO: 379949 - RNA, 21 nt, Human
acacaaauacacacacugaag

SEQ ID NO: 379950 - RNA, 18 nt, Human
acccugggagcugguaaa

SEQ ID NO: 379951 - RNA, 20 nt, Human
acuuuggaggcugaggaagc

SEQ ID NO: 379952 - RNA, 20 nt, Human
agcccagauccggcagcccc

SEQ ID NO: 379953 - RNA, 21 nt, Human
agccugggcuuccucaagagc

SEQ ID NO: 379954 - RNA, 20 nt, Human
aggaggcuccgaagcuccgu

SEQ ID NO: 379955 - RNA, 24 nt, Human
cacacugaaguccacccugggagc

SEQ ID NO: 379956 - RNA, 22 nt, Human
cacagcccagauccggcagccc

SEQ ID NO: 379957 - RNA, 24 nt, Human
cacagcccagauccggcagcccca

SEQ ID NO: 379958 - RNA, 18 nt, Human
caccuucacugaggaggc

SEQ ID NO: 379959 - RNA, 25 nt, Human
caggguccuccgagccugggcuucc

SEQ ID NO: 379960 - RNA, 23 nt, Human
ccaccaguguccuccccuucuac

SEQ ID NO: 379961 - RNA, 25 nt, Human
ccaguguccuccccuucuaccuccc

SEQ ID NO: 379962 - RNA, 19 nt, Human
cccacagcccagauccggc

SEQ ID NO: 379963 - RNA, 22 nt, Human
cccccaguugggucaguagaac

SEQ ID NO: 379964 - RNA, 19 nt, Human
ccccgaggccgcucgcggg

SEQ ID NO: 379965 - RNA, 19 nt, Human
cccugggagcugguaaaac

SEQ ID NO: 379966 - RNA, 18 nt, Human
ccgaagcuccguucccgc

SEQ ID NO: 379967 - RNA, 19 nt, Human
ccuccccuucuaccuccca

SEQ ID NO: 379968 - RNA, 23 nt, Human
cgcagggcgcggggcgcggggcg

SEQ ID NO: 379969 - RNA, 18 nt, Human
cgcggggcgcaggcggcg

SEQ ID NO: 379970 - RNA, 22 nt, Human
cgcggggcgcggggcgcaggcg

SEQ ID NO: 379971 - RNA, 18 nt, Human
cggccggcucccauggcc

SEQ ID NO: 379972 - RNA, 23 nt, Human
cggggcgcggggcgcaggcggcg

SEQ ID NO: 379973 - RNA, 25 nt, Human
cgugcacacugggguggacgauggg

SEQ ID NO: 379974 - RNA, 20 nt, Human
gcccagauccggcagcccca

SEQ ID NO: 379975 - RNA, 19 nt, Human
gcccgcagggcgcggggcg

SEQ ID NO: 379976 - RNA, 18 nt, Human
gcggggcgcggggcgcag

SEQ ID NO: 379977 - RNA, 20 nt, Human
gcuggugcagucagcggucc

SEQ ID NO: 379978 - RNA, 23 nt, Human
ggcagccccaccaccuucacuga

SEQ ID NO: 379979 - RNA, 20 nt, Human
gggcgcggggcgcaggcggc

SEQ ID NO: 379980 - RNA, 20 nt, Human
guagaaccaccaguguccuc

SEQ ID NO: 379981 - RNA, 22 nt, Human
gucuucaaaccuuugcccccag

SEQ ID NO: 379982 - RNA, 24 nt, Human
guggcccaagggccccacagccca

SEQ ID NO: 379983 - RNA, 18 nt, Human
uaaaauguuuuacucauu

SEQ ID NO: 379984 - RNA, 23 nt, Human
ucacugaggaggcuccgaagcuc

SEQ ID NO: 379985 - RNA, 19 nt, Human
uccccgaggccgcucgcgg

SEQ ID NO: 379986 - RNA, 19 nt, Human
uccuuacagacaggggagg

SEQ ID NO: 379987 - RNA, 22 nt, Human
ucucagacccgucuguuuucca

SEQ ID NO: 379988 - RNA, 19 nt, Human
uggcccaagggccccacag

SEQ ID NO: 379989 - RNA, 18 nt, Human
uggccccgcagguguaca

SEQ ID NO: 379990 - RNA, 18 nt, Human
uggggcuggcgggggagg

SEQ ID NO: 379991 - RNA, 20 nt, Human
uggggcuggcgggggaggcu

SEQ ID NO: 379992 - RNA, 19 nt, Human
ugggguggacgaugggugg

SEQ ID NO: 379993 - RNA, 28 nt, Human
uguccuccccuucuaccucccagcucca

SEQ ID NO: 379994 - RNA, 20 nt, Human
aagcccgaggccggcagaaa

SEQ ID NO: 379995 - RNA, 23 nt, Human
agcccgaggccggcagaaaccaa

SEQ ID NO: 379996 - RNA, 24 nt, Human
caccagcagcaacagacaguauac

SEQ ID NO: 379997 - RNA, 24 nt, Human
caguacaaaaauaaaacuaacacu

SEQ ID NO: 379998 - RNA, 21 nt, Human
cccggagucucaggcucccgc

SEQ ID NO: 379999 - RNA, 19 nt, Human
ccugaggggccgcugcucc

SEQ ID NO: 380000 - RNA, 22 nt, Human
cgccgaggcccaggagcgacga

SEQ ID NO: 380001 - RNA, 25 nt, Human
cggcagaaaccaaaggaagguggcg

SEQ ID NO: 380002 - RNA, 19 nt, Human
cugcugccucucucgcggc

SEQ ID NO: 380003 - RNA, 23 nt, Human
cuguuagcaucaucuucugaguc

SEQ ID NO: 380004 - RNA, 18 nt, Human
cuuuacauuucuugguuu

SEQ ID NO: 380005 - RNA, 25 nt, Human
gaagcccgaggccggcagaaaccaa

SEQ ID NO: 380006 - RNA, 20 nt, Human
gaccgcagaggcgcaccggg

SEQ ID NO: 380007 - RNA, 19 nt, Human
gcagaggagggagcagccc

SEQ ID NO: 380008 - RNA, 27 nt, Human
gcggcgcgggcacgauuccuuccccgc

SEQ ID NO: 380009 - RNA, 23 nt, Human
gcuccgagaccugaggggccgcu

SEQ ID NO: 380010 - RNA, 19 nt, Human
ggagcagcccugcccggag

SEQ ID NO: 380011 - RNA, 24 nt, Human
gggccgcagaagcccgaggccggc

SEQ ID NO: 380012 - RNA, 23 nt, Human
uaaaacuaacacuguuagcauca

SEQ ID NO: 380013 - RNA, 23 nt, Human
uacaguauucacagaaauuaagg

SEQ ID NO: 380014 - RNA, 23 nt, Human
uauacaguauucacagaaauuaa

SEQ ID NO: 380015 - RNA, 18 nt, Human
ugacgagugcauccaaca

SEQ ID NO: 380016 - RNA, 22 nt, Human
ugcccggagucucaggcucccg

SEQ ID NO: 380017 - RNA, 18 nt, Human
uuaaacuaaaaauugcag

SEQ ID NO: 380018 - RNA, 20 nt, Human
uuagcaucaucuucugaguc

SEQ ID NO: 380019 - RNA, 22 nt, Human
aaaaaacaguuaagaaagcuua

SEQ ID NO: 380020 - RNA, 25 nt, Human
aaaaacaguuaagaaagcuuacagc

SEQ ID NO: 380021 - RNA, 26 nt, Human
aagcacccggccccuugggaauauac

SEQ ID NO: 380022 - RNA, 21 nt, Human
acaaauauuugccauauucuc

SEQ ID NO: 380023 - RNA, 18 nt, Human
acccagcgaaacuucauc

SEQ ID NO: 380024 - RNA, 21 nt, Human
agacagucagcugcacaaaac

SEQ ID NO: 380025 - RNA, 26 nt, Human
agagagcacuggcagagcugggggug

SEQ ID NO: 380026 - RNA, 22 nt, Human
agaggagccacagcagcccaga

SEQ ID NO: 380027 - RNA, 18 nt, Human
agcacuggcagagcuggg

SEQ ID NO: 380028 - RNA, 20 nt, Human
aggcagaggugggcuggcuu

SEQ ID NO: 380029 - RNA, 21 nt, Human
aggcagaggugggcuggcuug

SEQ ID NO: 380030 - RNA, 24 nt, Human
aggcaggcaggcaggccgaaggcc

SEQ ID NO: 380031 - RNA, 21 nt, Human
aggccgaaggccuccagggaa

SEQ ID NO: 380032 - RNA, 18 nt, Human
agggucccaggcugggcc

SEQ ID NO: 380033 - RNA, 20 nt, Human
agucagcugcacaaaacugg

SEQ ID NO: 380034 - RNA, 23 nt, Human
auacaaauauuugccauauucuc

SEQ ID NO: 380035 - RNA, 19 nt, Human
cacccagcgaaacuucauc

SEQ ID NO: 380036 - RNA, 19 nt, Human
cacuggcagagcugggggu

SEQ ID NO: 380037 - RNA, 18 nt, Human
cagagagcacuggcagag

SEQ ID NO: 380038 - RNA, 21 nt, Human
cagagggucccaggcugggcc

SEQ ID NO: 380039 - RNA, 21 nt, Human
cagcaaaaaauagaaacuuga

SEQ ID NO: 380040 - RNA, 22 nt, Human
caggcaggcaggcaggcaggcc

SEQ ID NO: 380041 - RNA, 24 nt, Human
caggcaggcaggccgaaggccucc

SEQ ID NO: 380042 - RNA, 24 nt, Human
ccagagagcacuggcagagcuggg

SEQ ID NO: 380043 - RNA, 23 nt, Human
ccccaggcuucaggcucugcaag

SEQ ID NO: 380044 - RNA, 27 nt, Human
ccuaagacccuggugccaugcuacaaa

SEQ ID NO: 380045 - RNA, 19 nt, Human
ccuucuccccaggcuucag

SEQ ID NO: 380046 - RNA, 22 nt, Human
cuagugguggcgccuaagcagu

SEQ ID NO: 380047 - RNA, 23 nt, Human
cuggacucugcuacugagaagga

SEQ ID NO: 380048 - RNA, 19 nt, Human
cugggcccaaacaacugua

SEQ ID NO: 380049 - RNA, 23 nt, Human
gagccaggcccagagagcacugg

SEQ ID NO: 380050 - RNA, 18 nt, Human
gagcugggggugggcuuc

SEQ ID NO: 380051 - RNA, 20 nt, Human
gcugggccuucuccccaggc

SEQ ID NO: 380052 - RNA, 22 nt, Human
gcuucaggcucugcaaggcacu

SEQ ID NO: 380053 - RNA, 19 nt, Human
ggcagaggagccacagcag

SEQ ID NO: 380054 - RNA, 22 nt, Human
ggcaggcaggccgaaggccucc

SEQ ID NO: 380055 - RNA, 22 nt, Human
ggcugggccuucuccccaggcc

SEQ ID NO: 380056 - RNA, 22 nt, Human
ggcugggccuucuccccaggcu

SEQ ID NO: 380057 - RNA, 19 nt, Human
gggaccucaggcaggcagg

SEQ ID NO: 380058 - RNA, 20 nt, Human
gggcccgggacuggcagcgg

SEQ ID NO: 380059 - RNA, 24 nt, Human
uaugaugaaggcagaggugggcug

SEQ ID NO: 380060 - RNA, 20 nt, Human
uccccaggcuucaggcucug

SEQ ID NO: 380061 - RNA, 25 nt, Human
ucuccccaggcuucaggcucugcaa

SEQ ID NO: 380062 - RNA, 23 nt, Human
ucugcaaacccagagcccuugcu

SEQ ID NO: 380063 - RNA, 25 nt, Human
ugaaggcagaggugggcuggcuugg

SEQ ID NO: 380064 - RNA, 19 nt, Human
ugagaacacccguagaugg

SEQ ID NO: 380065 - RNA, 21 nt, Human
ugagacagucagcugcacaaa

SEQ ID NO: 380066 - RNA, 20 nt, Human
uggcagagcugggggugggc

SEQ ID NO: 380067 - RNA, 23 nt, Human
ugggggcagaggagccacagcag

SEQ ID NO: 380068 - RNA, 22 nt, Human
uguuacaaaaaacaguuaagaa

SEQ ID NO: 380069 - RNA, 21 nt, Human
uugcugccuguccagguugug

SEQ ID NO: 380070 - RNA, 24 nt, Human
uuggaggauaggaucugugggggc

SEQ ID NO: 380071 - RNA, 19 nt, Human
aaaaaugucccccgccccc

SEQ ID NO: 380072 - RNA, 23 nt, Human
aaaaguaccucaaggcaauaaaa

SEQ ID NO: 380073 - RNA, 24 nt, Human
aaaaugucccccgcccccagccag

SEQ ID NO: 380074 - RNA, 19 nt, Human
aaacaacaaggaccuagac

SEQ ID NO: 380075 - RNA, 21 nt, Human
aaaccagcaaagcaauuucaa

SEQ ID NO: 380076 - RNA, 18 nt, Human
aaauaaauaugaaaccag

SEQ ID NO: 380077 - RNA, 22 nt, Human
aaaugacaaucaaaugaguuuc

SEQ ID NO: 380078 - RNA, 21 nt, Human
aacaaaccauuuaacauagga

SEQ ID NO: 380079 - RNA, 22 nt, Human
aacaacaaggaccuagacuaag

SEQ ID NO: 380080 - RNA, 24 nt, Human
aacaaucagaaacaaaugaaagga

SEQ ID NO: 380081 - RNA, 21 nt, Human
aacacagacaaauacacaaga

SEQ ID NO: 380082 - RNA, 21 nt, Human
aacuuguauacaaucucccuu

SEQ ID NO: 380083 - RNA, 22 nt, Human
aagagcagugacugugcaagag

SEQ ID NO: 380084 - RNA, 20 nt, Human
aagauguguuggcaaaagca

SEQ ID NO: 380085 - RNA, 23 nt, Human
aagcaagggccagaucauaaaga

SEQ ID NO: 380086 - RNA, 19 nt, Human
aauagagaugaaaaaagaa

SEQ ID NO: 380087 - RNA, 23 nt, Human
aaucauuaaacuacuaaaacaga

SEQ ID NO: 380088 - RNA, 20 nt, Human
aaugaaaggacauuauugaa

SEQ ID NO: 380089 - RNA, 20 nt, Human
aaugaagaggcauuaguaga

SEQ ID NO: 380090 - RNA, 24 nt, Human
acaaauacacaagacuucaaacau

SEQ ID NO: 380091 - RNA, 20 nt, Human
acauuaacaaccuuaacauc

SEQ ID NO: 380092 - RNA, 20 nt, Human
accaugcaggcuaacauaua

SEQ ID NO: 380093 - RNA, 28 nt, Human
acuuuaaagaaagcugaguauaaaagaa

SEQ ID NO: 380094 - RNA, 18 nt, Human
agaaacaaaugaaaggac

SEQ ID NO: 380095 - RNA, 19 nt, Human
agaaacaacaaggaccuag

SEQ ID NO: 380096 - RNA, 22 nt, Human
agaaacaacaaggaccuagacu

SEQ ID NO: 380097 - RNA, 20 nt, Human
agacaaauacacaagacuuu

SEQ ID NO: 380098 - RNA, 19 nt, Human
agacaaaugucaaacaaau

SEQ ID NO: 380099 - RNA, 20 nt, Human
agacaggaagcaaggagacc

SEQ ID NO: 380100 - RNA, 23 nt, Human
agagguaagcaagggccagauca

SEQ ID NO: 380101 - RNA, 18 nt, Human
agaugaaaaaagaaauga

SEQ ID NO: 380102 - RNA, 18 nt, Human
agcaggguggugacagug

SEQ ID NO: 380103 - RNA, 23 nt, Human
aggaauaaaauauauugaaaaaa

SEQ ID NO: 380104 - RNA, 22 nt, Human
aggaauacaggaggaggagccg

SEQ ID NO: 380105 - RNA, 22 nt, Human
aggagaugguggcagcggcggg

SEQ ID NO: 380106 - RNA, 20 nt, Human
aggaugaaaacaaucagaaa

SEQ ID NO: 380107 - RNA, 19 nt, Human
aggcaagaaacaacaagga

SEQ ID NO: 380108 - RNA, 23 nt, Human
aggcaagaaacaacaaggaccua

SEQ ID NO: 380109 - RNA, 24 nt, Human
aggcaagaaacaacaaggaccuag

SEQ ID NO: 380110 - RNA, 19 nt, Human
agugcuugugcacuaagcu

SEQ ID NO: 380111 - RNA, 20 nt, Human
auaugaaaccagcaaagcaa

SEQ ID NO: 380112 - RNA, 24 nt, Human
aucuucauccacuuaauucuguug

SEQ ID NO: 380113 - RNA, 21 nt, Human
augagagagagaggaggagac

SEQ ID NO: 380114 - RNA, 18 nt, Human
augcuuuaaaaugacauu

SEQ ID NO: 380115 - RNA, 19 nt, Human
caaucaaaugaguuucagc

SEQ ID NO: 380116 - RNA, 19 nt, Human
cacaagacuucaaacaugc

SEQ ID NO: 380117 - RNA, 19 nt, Human
cacgcacagcaaacagcac

SEQ ID NO: 380118 - RNA, 24 nt, Human
cacgcacagcaaacagcacgugca

SEQ ID NO: 380119 - RNA, 20 nt, Human
caggaggaggagcaguuuug

SEQ ID NO: 380120 - RNA, 22 nt, Human
caggaggaggagcaguuuuggu

SEQ ID NO: 380121 - RNA, 20 nt, Human
caugcaggcuaacauauaau

SEQ ID NO: 380122 - RNA, 25 nt, Human
cauuaaacuacuaaaacagacaguu

SEQ ID NO: 380123 - RNA, 23 nt, Human
ccacugacaaguucauaugauaa

SEQ ID NO: 380124 - RNA, 24 nt, Human
cccacugacaaguucauaugauaa

SEQ ID NO: 380125 - RNA, 22 nt, Human
cccccggagcccgcccgccgcc

SEQ ID NO: 380126 - RNA, 18 nt, Human
ccccggagcccgcccgcc

SEQ ID NO: 380127 - RNA, 20 nt, Human
ccgccgcgccgccgcggccc

SEQ ID NO: 380128 - RNA, 20 nt, Human
ccgccgcggcccgggcgccc

SEQ ID NO: 380129 - RNA, 24 nt, Human
ccgccggggacgcgggcucggcgg

SEQ ID NO: 380130 - RNA, 19 nt, Human
ccuagacuaagagggaugc

SEQ ID NO: 380131 - RNA, 18 nt, Human
ccuucuccagccuuauug

SEQ ID NO: 380132 - RNA, 19 nt, Human
cgaguuuccggcuugagca

SEQ ID NO: 380133 - RNA, 26 nt, Human
cgcacagcaaacagcacgugcaaagg

SEQ ID NO: 380134 - RNA, 20 nt, Human
cggcuuuuccuucuccagcc

SEQ ID NO: 380135 - RNA, 21 nt, Human
cgggguggauggcggagguca

SEQ ID NO: 380136 - RNA, 25 nt, Human
cgugcaaaggugcagaggugugcga

SEQ ID NO: 380137 - RNA, 18 nt, Human
cucaaggcaauaaaaaaa

SEQ ID NO: 380138 - RNA, 25 nt, Human
cuccugacagcauuaacacagacaa

SEQ ID NO: 380139 - RNA, 23 nt, Human
cucucugcugccgcggcucuugg

SEQ ID NO: 380140 - RNA, 24 nt, Human
cucucugcugccgcggcucuuggu

SEQ ID NO: 380141 - RNA, 21 nt, Human
cugaagucccugggaauccac

SEQ ID NO: 380142 - RNA, 22 nt, Human
gaacaacuaggacuugauccug

SEQ ID NO: 380143 - RNA, 22 nt, Human
gaagaacuuuaaagaaagcuga

SEQ ID NO: 380144 - RNA, 21 nt, Human
gacugugcaagaguugggaga

SEQ ID NO: 380145 - RNA, 19 nt, Human
gagaggaggagacggagga

SEQ ID NO: 380146 - RNA, 23 nt, Human
gagccugguacaucugggaaugg

SEQ ID NO: 380147 - RNA, 22 nt, Human
gauguggggagugagagaggga

SEQ ID NO: 380148 - RNA, 21 nt, Human
gcaagaaacaacaaggaccua

SEQ ID NO: 380149 - RNA, 25 nt, Human
gcccccagccaaaagcuauggaaau

SEQ ID NO: 380150 - RNA, 21 nt, Human
gcccggaggcgcagcucgcgc

SEQ ID NO: 380151 - RNA, 24 nt, Human
gcgccggcuuuuccuucuccagcc

SEQ ID NO: 380152 - RNA, 26 nt, Human
gcgccggcuuuuccuucuccagccuu

SEQ ID NO: 380153 - RNA, 20 nt, Human
ggaaagaagaggugaaucac

SEQ ID NO: 380154 - RNA, 21 nt, Human
ggagagcuaaggcugagaggu

SEQ ID NO: 380155 - RNA, 18 nt, Human
ggaggagacggaggagga

SEQ ID NO: 380156 - RNA, 18 nt, Human
ggaggagacggaggagga

SEQ ID NO: 380157 - RNA, 18 nt, Human
ggccgcgggcgcgccggc

SEQ ID NO: 380158 - RNA, 18 nt, Human
gguggugggggaagaggg

SEQ ID NO: 380159 - RNA, 18 nt, Human
guacaacaacaaaaacag

SEQ ID NO: 380160 - RNA, 20 nt, Human
uaaaaaugucccccgccccc

SEQ ID NO: 380161 - RNA, 18 nt, Human
uaaauaaaccgcaacuga

SEQ ID NO: 380162 - RNA, 23 nt, Human
uaaauacaacaaauaaauaugaa

SEQ ID NO: 380163 - RNA, 22 nt, Human
uaagacaggaagcaaggagacc

SEQ ID NO: 380164 - RNA, 21 nt, Human
uaauaauaagaaaucacccug

SEQ ID NO: 380165 - RNA, 18 nt, Human
uacugaaggccuaguugc

SEQ ID NO: 380166 - RNA, 24 nt, Human
uagaagaacuuuaaagaaagcuga

SEQ ID NO: 380167 - RNA, 21 nt, Human
uagacuaagagggaugcuuug

SEQ ID NO: 380168 - RNA, 18 nt, Human
uagaguauuaaagucaac

SEQ ID NO: 380169 - RNA, 22 nt, Human
uagaguggaugagcaggguggu

SEQ ID NO: 380170 - RNA, 20 nt, Human
uauaaaagaaagacggugga

SEQ ID NO: 380171 - RNA, 18 nt, Human
uauaaaagaaugaagagg

SEQ ID NO: 380172 - RNA, 19 nt, Human
uaucaggaugaaaacaauc

SEQ ID NO: 380173 - RNA, 23 nt, Human
uaugaaaccagcaaagcaauuuc

SEQ ID NO: 380174 - RNA, 19 nt, Human
ucagaaacaaaugaaagga

SEQ ID NO: 380175 - RNA, 21 nt, Human
ucagaaacaaaugaaaggaca

SEQ ID NO: 380176 - RNA, 23 nt, Human
uccacaaggaguuggcacagagg

SEQ ID NO: 380177 - RNA, 21 nt, Human
uccacgcacagcaaacagcac

SEQ ID NO: 380178 - RNA, 23 nt, Human
uccugaagucccugggaauccac

SEQ ID NO: 380179 - RNA, 19 nt, Human
ucgcgccgccgcgccgccg

SEQ ID NO: 380180 - RNA, 19 nt, Human
ucuacagugaacuacagua

SEQ ID NO: 380181 - RNA, 22 nt, Human
ugaaaaaagaaaugacuuggga

SEQ ID NO: 380182 - RNA, 21 nt, Human
ugacagcauuaacacagacaa

SEQ ID NO: 380183 - RNA, 23 nt, Human
ugagagagagaggaggagacgga

SEQ ID NO: 380184 - RNA, 20 nt, Human
ugagagguaagcaagggcca

SEQ ID NO: 380185 - RNA, 21 nt, Human
ugaguggaggacagggcuucu

SEQ ID NO: 380186 - RNA, 19 nt, Human
ugccaguaauuuaucgaac

SEQ ID NO: 380187 - RNA, 18 nt, Human
ugcugaacaacuaggacu

SEQ ID NO: 380188 - RNA, 18 nt, Human
uggaauaguccaugaaca

SEQ ID NO: 380189 - RNA, 23 nt, Human
uggauggcggaggucaggaauac

SEQ ID NO: 380190 - RNA, 19 nt, Human
ugggaaaaggagggaaaga

SEQ ID NO: 380191 - RNA, 18 nt, Human
ugggauuuuaccauuugg

SEQ ID NO: 380192 - RNA, 19 nt, Human
ugggggaagaggggugaug

SEQ ID NO: 380193 - RNA, 19 nt, Human
uggugggggaagaggggug

SEQ ID NO: 380194 - RNA, 21 nt, Human
ugguggugggggaagaggggu

SEQ ID NO: 380195 - RNA, 20 nt, Human
uguacaacaacaaaaacagc

SEQ ID NO: 380196 - RNA, 22 nt, Human
uguauacaaucucccuuaugug

SEQ ID NO: 380197 - RNA, 27 nt, Human
uguugcuaaauagagaugaaaaaagaa

SEQ ID NO: 380198 - RNA, 22 nt, Human
uuaaagaauaaauaaaccgcaa

SEQ ID NO: 380199 - RNA, 21 nt, Human
uucagcgcuccucucugcugc

SEQ ID NO: 380200 - RNA, 22 nt, Human
uucaggcaagaaacaacaagga

SEQ ID NO: 380201 - RNA, 20 nt, Human
uugauccugaagucccuggg

SEQ ID NO: 380202 - RNA, 19 nt, Human
uuggaagggcugccgaguu

SEQ ID NO: 380203 - RNA, 20 nt, Human
uugguuuguaccauguuaga

SEQ ID NO: 380204 - RNA, 24 nt, Human
uuuaaaaugacauucagcaaagua

SEQ ID NO: 380205 - RNA, 20 nt, Human
uuuaaccaugcaggcuaaca

SEQ ID NO: 380206 - RNA, 18 nt, Human
uuugggaaaaggagggaa

SEQ ID NO: 380207 - RNA, 19 nt, Human
uuugguggugggggaagag

SEQ ID NO: 380208 - RNA, 22 nt, Human
uuuuaaaaucucggaauggcuu

SEQ ID NO: 380209 - RNA, 23 nt, Human
uuuugguggugggggaagagggg

SEQ ID NO: 380210 - RNA, 19 nt, Human
uuuuuuuuuuuuguacaac

SEQ ID NO: 380211 - RNA, 26 nt, Human
uuuuuuuuuuuuuaaaaaguaccuca

SEQ ID NO: 380212 - RNA, 19 nt, Human
uuuuuuuuuuuuuuuuugu

SEQ ID NO: 380213 - RNA, 20 nt, Human
uuuuuuuuuuuuuuuuuugg

SEQ ID NO: 380214 - RNA, 24 nt, Human
aaaccagcagccauccccucucag

SEQ ID NO: 380215 - RNA, 19 nt, Human
aagaacucucugcuccacc

SEQ ID NO: 380216 - RNA, 22 nt, Human
aagaagaauggacuccaauuug

SEQ ID NO: 380217 - RNA, 18 nt, Human
aagaagcauuaggauucu

SEQ ID NO: 380218 - RNA, 21 nt, Human
aagcaggucuuucugaugcuu

SEQ ID NO: 380219 - RNA, 18 nt, Human
aagugcugccuccaauag

SEQ ID NO: 380220 - RNA, 20 nt, Human
acaaagagaggaagccugga

SEQ ID NO: 380221 - RNA, 21 nt, Human
accgaaagggcuguauaaucu

SEQ ID NO: 380222 - RNA, 19 nt, Human
accuugcacugggcuaccc

SEQ ID NO: 380223 - RNA, 18 nt, Human
acugcccuaaagaagaau

SEQ ID NO: 380224 - RNA, 20 nt, Human
acuggaaugcugggggcugg

SEQ ID NO: 380225 - RNA, 21 nt, Human
acuucauaaccgaaagggcug

SEQ ID NO: 380226 - RNA, 19 nt, Human
agaacagcaggaaggaugg

SEQ ID NO: 380227 - RNA, 25 nt, Human
agacaggaaaggagugggauccugg

SEQ ID NO: 380228 - RNA, 22 nt, Human
agcagagcuugccuacugcaaa

SEQ ID NO: 380229 - RNA, 27 nt, Human
aggacagcaugagggaaaagugcugcc

SEQ ID NO: 380230 - RNA, 20 nt, Human
aggcaggucaggucuuugga

SEQ ID NO: 380231 - RNA, 19 nt, Human
aggcaucacaguauauugc

SEQ ID NO: 380232 - RNA, 18 nt, Human
auaggacagcaugaggga

SEQ ID NO: 380233 - RNA, 22 nt, Human
augacacugacugauugguacu

SEQ ID NO: 380234 - RNA, 18 nt, Human
augcuuacaugcauagga

SEQ ID NO: 380235 - RNA, 19 nt, Human
auugcuuggggccugaaau

SEQ ID NO: 380236 - RNA, 18 nt, Human
caauaaguaagaacucuc

SEQ ID NO: 380237 - RNA, 19 nt, Human
caccacacagacaggaaag

SEQ ID NO: 380238 - RNA, 21 nt, Human
caccagauguacucagaggac

SEQ ID NO: 380239 - RNA, 27 nt, Human
caccuuuccccacuucuccuccccacu

SEQ ID NO: 380240 - RNA, 20 nt, Human
cagacaggaaaggaguggga

SEQ ID NO: 380241 - RNA, 21 nt, Human
cagcacaaucacaaagagagg

SEQ ID NO: 380242 - RNA, 22 nt, Human
cagcacaaucacaaagagagga

SEQ ID NO: 380243 - RNA, 22 nt, Human
caucacaguauauugcauucuu

SEQ ID NO: 380244 - RNA, 24 nt, Human
ccauccccucucaguucccaacuu

SEQ ID NO: 380245 - RNA, 19 nt, Human
ccaugucaacauagcccuc

SEQ ID NO: 380246 - RNA, 19 nt, Human
ccucucaguucccaacuuc

SEQ ID NO: 380247 - RNA, 23 nt, Human
ccuugcacugggcuacccugcaa

SEQ ID NO: 380248 - RNA, 20 nt, Human
cuagaacagcaggaaggaug

SEQ ID NO: 380249 - RNA, 24 nt, Human
cucagccucguccccaccuguggc

SEQ ID NO: 380250 - RNA, 18 nt, Human
cucugucacccaggccag

SEQ ID NO: 380251 - RNA, 20 nt, Human
cuggaugcuggcuuuaagau

SEQ ID NO: 380252 - RNA, 22 nt, Human
cugguuuugcauguggcaucag

SEQ ID NO: 380253 - RNA, 22 nt, Human
cuguaucuaugucucauguccu

SEQ ID NO: 380254 - RNA, 22 nt, Human
gaacaaaagaaauaaauggaga

SEQ ID NO: 380255 - RNA, 22 nt, Human
gaaugcugggggcugggaagca

SEQ ID NO: 380256 - RNA, 23 nt, Human
gagcauuuguacuaggcauccaa

SEQ ID NO: 380257 - RNA, 21 nt, Human
gaggaaauucuggaugcuggc

SEQ ID NO: 380258 - RNA, 19 nt, Human
gaugcuuugguuugggaaa

SEQ ID NO: 380259 - RNA, 22 nt, Human
gauugcuuggggccugaaaugu

SEQ ID NO: 380260 - RNA, 18 nt, Human
gcacaaucacaaagagag

SEQ ID NO: 380261 - RNA, 21 nt, Human
gcacaaucacaaagagaggaa

SEQ ID NO: 380262 - RNA, 20 nt, Human
gcacaccaccagauguacuc

SEQ ID NO: 380263 - RNA, 20 nt, Human
gccugcugacucucucagcc

SEQ ID NO: 380264 - RNA, 19 nt, Human
gcuacccugcaaacuggag

SEQ ID NO: 380265 - RNA, 22 nt, Human
gcuacccugcaaacuggagcag

SEQ ID NO: 380266 - RNA, 24 nt, Human
gggauccugggggacagcuguggu

SEQ ID NO: 380267 - RNA, 21 nt, Human
gggccccuaguuccucuacuu

SEQ ID NO: 380268 - RNA, 19 nt, Human
gggcugggaagcaggucuu

SEQ ID NO: 380269 - RNA, 19 nt, Human
gguguugggcucccggagg

SEQ ID NO: 380270 - RNA, 20 nt, Human
guuuauaguccuacugcugc

SEQ ID NO: 380271 - RNA, 21 nt, Human
uaacaaaauaaaucaaacuga

SEQ ID NO: 380272 - RNA, 18 nt, Human
uaagaguaaggcauccaa

SEQ ID NO: 380273 - RNA, 21 nt, Human
uaagauaagaguaaggcaucc

SEQ ID NO: 380274 - RNA, 21 nt, Human
uaagaugcuguuguugguucc

SEQ ID NO: 380275 - RNA, 18 nt, Human
uagaacagcaggaaggau

SEQ ID NO: 380276 - RNA, 23 nt, Human
uaggaugcauccacuuaagucuu

SEQ ID NO: 380277 - RNA, 19 nt, Human
uagucucuuccccaggucc

SEQ ID NO: 380278 - RNA, 22 nt, Human
uccauguuccuaguucccugca

SEQ ID NO: 380279 - RNA, 18 nt, Human
uccccacuucuccucccc

SEQ ID NO: 380280 - RNA, 21 nt, Human
ucccugcaacguaggcacaac

SEQ ID NO: 380281 - RNA, 18 nt, Human
uccuacugcugcugccaa

SEQ ID NO: 380282 - RNA, 19 nt, Human
uccugcucugucacccagg

SEQ ID NO: 380283 - RNA, 27 nt, Human
uccugcucugucacccaggccaguacc

SEQ ID NO: 380284 - RNA, 26 nt, Human
ucucacuguuuccuggggggcugggu

SEQ ID NO: 380285 - RNA, 18 nt, Human
ucucagauacuugauucu

SEQ ID NO: 380286 - RNA, 22 nt, Human
ucuggcucugccugcugacucu

SEQ ID NO: 380287 - RNA, 21 nt, Human
ucugucacccaggccaguacc

SEQ ID NO: 380288 - RNA, 23 nt, Human
ucuugacaucguacaccugguuu

SEQ ID NO: 380289 - RNA, 22 nt, Human
ugaugcuccuuuccagccacug

SEQ ID NO: 380290 - RNA, 23 nt, Human
ugcacugggcuacccugcaaacu

SEQ ID NO: 380291 - RNA, 19 nt, Human
ugccaugucaacauagccc

SEQ ID NO: 380292 - RNA, 22 nt, Human
ugcuguuguugguuccccucca

SEQ ID NO: 380293 - RNA, 21 nt, Human
ugcuuacaugcauaggaugca

SEQ ID NO: 380294 - RNA, 18 nt, Human
uggaaugcugggggcugg

SEQ ID NO: 380295 - RNA, 23 nt, Human
uggaaugcugggggcugggaagc

SEQ ID NO: 380296 - RNA, 22 nt, Human
ugggaaauaaugcuuacaugca

SEQ ID NO: 380297 - RNA, 21 nt, Human
ugggauccugggggacagcug

SEQ ID NO: 380298 - RNA, 19 nt, Human
uggggccugaaaugugaug

SEQ ID NO: 380299 - RNA, 23 nt, Human
ugucacccaggccaguaccuaga

SEQ ID NO: 380300 - RNA, 18 nt, Human
aaaaugagaaauaaagaa

SEQ ID NO: 380301 - RNA, 19 nt, Human
aaagguaaaccaacaucau

SEQ ID NO: 380302 - RNA, 18 nt, Human
aaccccaccaaccgcggc

SEQ ID NO: 380303 - RNA, 20 nt, Human
aagaaccucuaaaaagucag

SEQ ID NO: 380304 - RNA, 21 nt, Human
aauguaaaaguucaaaaggga

SEQ ID NO: 380305 - RNA, 19 nt, Human
aauuucuauccauugccuc

SEQ ID NO: 380306 - RNA, 24 nt, Human
acaggguccgcgacagcuccuccu

SEQ ID NO: 380307 - RNA, 21 nt, Human
agcaacagagaccgacucuac

SEQ ID NO: 380308 - RNA, 23 nt, Human
agcaacagagaccgacucuacag

SEQ ID NO: 380309 - RNA, 24 nt, Human
agcaaggagccgaggaagcccccg

SEQ ID NO: 380310 - RNA, 24 nt, Human
aggaaaagguaaaccaacaucauu

SEQ ID NO: 380311 - RNA, 19 nt, Human
aggcaaaaagagcaacaga

SEQ ID NO: 380312 - RNA, 25 nt, Human
aggcaaaaagagcaacagagaccga

SEQ ID NO: 380313 - RNA, 21 nt, Human
auguagauauauauauauaca

SEQ ID NO: 380314 - RNA, 22 nt, Human
auugccucuaucuuugguguca

SEQ ID NO: 380315 - RNA, 27 nt, Human
auuuccauuuuaaugaagaauuaaagg

SEQ ID NO: 380316 - RNA, 21 nt, Human
caacagcaaggagccgaggaa

SEQ ID NO: 380317 - RNA, 20 nt, Human
cacacacauauauauauaua

SEQ ID NO: 380318 - RNA, 21 nt, Human
cacacacauauauauauauau

SEQ ID NO: 380319 - RNA, 22 nt, Human
cauguagauauauauauauaca

SEQ ID NO: 380320 - RNA, 24 nt, Human
ccaacaucauuucuuuaaaaugag

SEQ ID NO: 380321 - RNA, 21 nt, Human
cccaccaaccgcggcagcagc

SEQ ID NO: 380322 - RNA, 18 nt, Human
ccgcgacagcuccuccuc

SEQ ID NO: 380323 - RNA, 19 nt, Human
ccuauaagcugaggauaaa

SEQ ID NO: 380324 - RNA, 18 nt, Human
ccucuaucuuugguguca

SEQ ID NO: 380325 - RNA, 22 nt, Human
cgagacaaauagccuuguauca

SEQ ID NO: 380326 - RNA, 18 nt, Human
cgaggaagcccccgcgcg

SEQ ID NO: 380327 - RNA, 23 nt, Human
cgaucaccacugugauucaaaau

SEQ ID NO: 380328 - RNA, 18 nt, Human
cggcaacagcaaggagcc

SEQ ID NO: 380329 - RNA, 24 nt, Human
cggcggcaacagcaaggagccgag

SEQ ID NO: 380330 - RNA, 26 nt, Human
cggcggcaacagcaaggagccgagga

SEQ ID NO: 380331 - RNA, 18 nt, Human
cuccucucacccaacccc

SEQ ID NO: 380332 - RNA, 18 nt, Human
cugcggcggcggcaacag

SEQ ID NO: 380333 - RNA, 20 nt, Human
cugcgugccgaggugucccc

SEQ ID NO: 380334 - RNA, 24 nt, Human
gagcaacagagaccgacucuacag

SEQ ID NO: 380335 - RNA, 21 nt, Human
gagguguccccggggacuccc

SEQ ID NO: 380336 - RNA, 28 nt, Human
gauauauauauauacacacacauauaua

SEQ ID NO: 380337 - RNA, 20 nt, Human
ggcaaaaagagcaacagaga

SEQ ID NO: 380338 - RNA, 24 nt, Human
guaaaaguucaaaagggaacauua

SEQ ID NO: 380339 - RNA, 25 nt, Human
guuucauuccucugcaggggcggaa

SEQ ID NO: 380340 - RNA, 23 nt, Human
uaauuuugucucauggucccaca

SEQ ID NO: 380341 - RNA, 25 nt, Human
uacaagagacuucgaaaauguagug

SEQ ID NO: 380342 - RNA, 20 nt, Human
uacaauguguuaaagacaua

SEQ ID NO: 380343 - RNA, 20 nt, Human
uacacacacauauauauaua

SEQ ID NO: 380344 - RNA, 23 nt, Human
uacacacacauauauauauauau

SEQ ID NO: 380345 - RNA, 23 nt, Human
uauacacacacauauauauauau

SEQ ID NO: 380346 - RNA, 24 nt, Human
uauacacacacauauauauauaua

SEQ ID NO: 380347 - RNA, 19 nt, Human
uauauacacacacauauau

SEQ ID NO: 380348 - RNA, 24 nt, Human
uauauacacacacauauauauaua

SEQ ID NO: 380349 - RNA, 19 nt, Human
uauauauacacacacauau

SEQ ID NO: 380350 - RNA, 24 nt, Human
uauauauacacacacauauauaua

SEQ ID NO: 380351 - RNA, 23 nt, Human
uauauauauauaucucuuuagcu

SEQ ID NO: 380352 - RNA, 18 nt, Human
uauguacauaacauuugu

SEQ ID NO: 380353 - RNA, 26 nt, Human
ucacacgaucaccacugugauucaaa

SEQ ID NO: 380354 - RNA, 19 nt, Human
ucacccaaccccaccaacc

SEQ ID NO: 380355 - RNA, 22 nt, Human
ucccucucgacagcacgggagu

SEQ ID NO: 380356 - RNA, 23 nt, Human
uccucaggcaaaaagagcaacag

SEQ ID NO: 380357 - RNA, 25 nt, Human
ucucacccaaccccaccaaccgcgg

SEQ ID NO: 380358 - RNA, 20 nt, Human
ucuuuggugucacugccacc

SEQ ID NO: 380359 - RNA, 23 nt, Human
ugaaaggaauuaaauguuguaag

SEQ ID NO: 380360 - RNA, 18 nt, Human
ugaaaugucaugccaaaa

SEQ ID NO: 380361 - RNA, 21 nt, Human
ugucacugccaccaauaaaca

SEQ ID NO: 380362 - RNA, 22 nt, Human
uguccccggggacucccucucg

SEQ ID NO: 380363 - RNA, 23 nt, Human
ugugaaacugaaacacacgacaa

SEQ ID NO: 380364 - RNA, 24 nt, Human
uuaaagacauauuuaaaauacuag

SEQ ID NO: 380365 - RNA, 21 nt, Human
uuaaaggauacaauguguuaa

SEQ ID NO: 380366 - RNA, 21 nt, Human
uucaaaauggccacuaaugca

SEQ ID NO: 380367 - RNA, 21 nt, Human
uuuaaaaauuucuauccauug

SEQ ID NO: 380368 - RNA, 22 nt, Human
uuucauuccucugcaggggcgg

SEQ ID NO: 380369 - RNA, 23 nt, Human
uuugaaacaucuacuuauuucca

SEQ ID NO: 380370 - RNA, 21 nt, Human
aaagcaauagggaaacauguc

SEQ ID NO: 380371 - RNA, 21 nt, Human
aacacgaaccccacccauccc

SEQ ID NO: 380372 - RNA, 21 nt, Human
acccauaucagccacuagcau

SEQ ID NO: 380373 - RNA, 22 nt, Human
agugguggggucgcugccgcug

SEQ ID NO: 380374 - RNA, 24 nt, Human
auaaagcaagacuucucaggcccu

SEQ ID NO: 380375 - RNA, 25 nt, Human
caccaaucugaauccuagugucaua

SEQ ID NO: 380376 - RNA, 23 nt, Human
cacuagcauuuuaaagaugguuu

SEQ ID NO: 380377 - RNA, 21 nt, Human
cccacacccauaucagccacu

SEQ ID NO: 380378 - RNA, 21 nt, Human
cccccacacccauaucagcca

SEQ ID NO: 380379 - RNA, 23 nt, Human
cccucaagcuucgccucugaguc

SEQ ID NO: 380380 - RNA, 24 nt, Human
ccgcugcugcugccgccgcugcug

SEQ ID NO: 380381 - RNA, 26 nt, Human
ccgcugcugcugccgccgcugcugcc

SEQ ID NO: 380382 - RNA, 18 nt, Human
cuaaacacgaaccccacc

SEQ ID NO: 380383 - RNA, 23 nt, Human
cugcaggagacccucugagauuc

SEQ ID NO: 380384 - RNA, 19 nt, Human
cugcugccucuucucucaa

SEQ ID NO: 380385 - RNA, 27 nt, Human
cugcugcugccgccgcugcugcugccu

SEQ ID NO: 380386 - RNA, 21 nt, Human
gaaagcaauagggaaacaugu

SEQ ID NO: 380387 - RNA, 20 nt, Human
gccgcugcugcugccgccgc

SEQ ID NO: 380388 - RNA, 18 nt, Human
gcugccucuucucucaag

SEQ ID NO: 380389 - RNA, 20 nt, Human
gcugcugccgccgcugcugc

SEQ ID NO: 380390 - RNA, 24 nt, Human
gcugcugccgccgcugcugcugcc

SEQ ID NO: 380391 - RNA, 25 nt, Human
gcugcugccgccgcugcugcugccu

SEQ ID NO: 380392 - RNA, 21 nt, Human
gcuuggacuauauuucuggaa

SEQ ID NO: 380393 - RNA, 21 nt, Human
gugguguugcugugcagcggc

SEQ ID NO: 380394 - RNA, 21 nt, Human
uaaacacgaaccccacccauc

SEQ ID NO: 380395 - RNA, 18 nt, Human
uacauaagggcccagaaa

SEQ ID NO: 380396 - RNA, 19 nt, Human
uaggggccugaacccucau

SEQ ID NO: 380397 - RNA, 25 nt, Human
ucaagggugguucuucguccuuccu

SEQ ID NO: 380398 - RNA, 19 nt, Human
uccaagagccucaucccug

SEQ ID NO: 380399 - RNA, 25 nt, Human
uccaagagccucaucccuguuuucu

SEQ ID NO: 380400 - RNA, 19 nt, Human
ucgcugccgcugcugcugc

SEQ ID NO: 380401 - RNA, 19 nt, Human
ucugugguguugcugugca

SEQ ID NO: 380402 - RNA, 22 nt, Human
ugacuggugccuaugaaagcaa

SEQ ID NO: 380403 - RNA, 23 nt, Human
ugaguuuugucuuuuuccacaga

SEQ ID NO: 380404 - RNA, 23 nt, Human
ugcugccucuucucucaagggug

SEQ ID NO: 380405 - RNA, 23 nt, Human
ugcugcugccgccgcugcugcug

SEQ ID NO: 380406 - RNA, 24 nt, Human
ugcugcugccgccgcugcugcugc

SEQ ID NO: 380407 - RNA, 20 nt, Human
uggcagugguggggucgcug

SEQ ID NO: 380408 - RNA, 21 nt, Human
uggggugcugcuuguucugug

SEQ ID NO: 380409 - RNA, 21 nt, Human
ugguggggucgcugccgcugc

SEQ ID NO: 380410 - RNA, 18 nt, Human
uguaccagugcagcuggg

SEQ ID NO: 380411 - RNA, 20 nt, Human
ugugcacauguacugccagc

SEQ ID NO: 380412 - RNA, 25 nt, Human
ugugcacauguacugccagcgcaug

SEQ ID NO: 380413 - RNA, 21 nt, Human
ugugguguugcugugcagcgg

SEQ ID NO: 380414 - RNA, 22 nt, Human
uuaaagaugguuuuaggugggu

SEQ ID NO: 380415 - RNA, 20 nt, Human
uuagacuugcaggcuuccag

SEQ ID NO: 380416 - RNA, 22 nt, Human
uuccaguagggauucuccugau

SEQ ID NO: 380417 - RNA, 25 nt, Human
uucugcuuugugcacauguacugcc

SEQ ID NO: 380418 - RNA, 25 nt, Human
uugagcccauaaagcaagacuucuc

SEQ ID NO: 380419 - RNA, 21 nt, Human
uuuuagguggguacauaaggg

SEQ ID NO: 380420 - RNA, 23 nt, Human
aaaaaaaaagaagaaaccuagua

SEQ ID NO: 380421 - RNA, 25 nt, Human
aaaaaauaaauaaaaacaaaagcaa

SEQ ID NO: 380422 - RNA, 18 nt, Human
aaaacaguagacacagga

SEQ ID NO: 380423 - RNA, 22 nt, Human
aaacaaaagcaaaaaacagcuc

SEQ ID NO: 380424 - RNA, 24 nt, Human
aaacaaaagcaaaaaacagcucca

SEQ ID NO: 380425 - RNA, 27 nt, Human
aaacaacuaacauuaaacacggaaaug

SEQ ID NO: 380426 - RNA, 23 nt, Human
aaacacaauaaaguaaaacacag

SEQ ID NO: 380427 - RNA, 24 nt, Human
aacaaaaaaaaagaagaaaccuag

SEQ ID NO: 380428 - RNA, 22 nt, Human
aacaaaacaguagacacaggaa

SEQ ID NO: 380429 - RNA, 21 nt, Human
aacacagugugaccacaucuc

SEQ ID NO: 380430 - RNA, 22 nt, Human
aacacagugugaccacaucucu

SEQ ID NO: 380431 - RNA, 24 nt, Human
aacacuuugggaggcuaagguggg

SEQ ID NO: 380432 - RNA, 21 nt, Human
aacauugugcugcugccaccu

SEQ ID NO: 380433 - RNA, 24 nt, Human
aagaagaaaccuaguaauucaaaa

SEQ ID NO: 380434 - RNA, 23 nt, Human
aauaaaaaauagaugaagucaaa

SEQ ID NO: 380435 - RNA, 24 nt, Human
aaugacuugaggccaggaguucaa

SEQ ID NO: 380436 - RNA, 20 nt, Human
aaugcccucucuuagauagc

SEQ ID NO: 380437 - RNA, 24 nt, Human
acaaaaaaaaagaagaaaccuagu

SEQ ID NO: 380438 - RNA, 22 nt, Human
acaacaaaacaguagacacagg

SEQ ID NO: 380439 - RNA, 23 nt, Human
acagagugagagccugucucaaa

SEQ ID NO: 380440 - RNA, 24 nt, Human
acagagugagagccugucucaaaa

SEQ ID NO: 380441 - RNA, 23 nt, Human
accaguggcaaaaaauaaauaaa

SEQ ID NO: 380442 - RNA, 22 nt, Human
acucuacgcuaauaaaaacaaa

SEQ ID NO: 380443 - RNA, 24 nt, Human
acugcccuccagcaugggcaacag

SEQ ID NO: 380444 - RNA, 20 nt, Human
acuugaggccaggaguucaa

SEQ ID NO: 380445 - RNA, 22 nt, Human
agaaaacacaauaaaguaaaac

SEQ ID NO: 380446 - RNA, 18 nt, Human
agaaacugaaacuaaacu

SEQ ID NO: 380447 - RNA, 18 nt, Human
agccugggcaacacagug

SEQ ID NO: 380448 - RNA, 19 nt, Human
agccugggcaacacagugu

SEQ ID NO: 380449 - RNA, 18 nt, Human
aggaauaaaaccaaacau

SEQ ID NO: 380450 - RNA, 20 nt, Human
aggaauacuaacacauaaac

SEQ ID NO: 380451 - RNA, 23 nt, Human
aggaguucaagaccagccugggc

SEQ ID NO: 380452 - RNA, 24 nt, Human
aggcaugguggcucacgcuuauaa

SEQ ID NO: 380453 - RNA, 23 nt, Human
aggcuaagguggggaaugacuug

SEQ ID NO: 380454 - RNA, 22 nt, Human
agguggggaaugacuugaggcc

SEQ ID NO: 380455 - RNA, 21 nt, Human
agucucaagauaagucuugga

SEQ ID NO: 380456 - RNA, 18 nt, Human
auaccacugcccuccagc

SEQ ID NO: 380457 - RNA, 20 nt, Human
auauuaacaacaacaaaaca

SEQ ID NO: 380458 - RNA, 22 nt, Human
aucuugucacaaaucccuuacu

SEQ ID NO: 380459 - RNA, 21 nt, Human
auuuaaaaaaaaaaaagugaa

SEQ ID NO: 380460 - RNA, 23 nt, Human
caaaaaacagcuccacuguucca

SEQ ID NO: 380461 - RNA, 20 nt, Human
caaaagcaaaaaacagcucc

SEQ ID NO: 380462 - RNA, 22 nt, Human
caaaagcaaaaaacagcuccac

SEQ ID NO: 380463 - RNA, 24 nt, Human
caaacuaccaugcacuugaaacac

SEQ ID NO: 380464 - RNA, 27 nt, Human
caaauaaaaaauagaugaagucaaaac

SEQ ID NO: 380465 - RNA, 24 nt, Human
caacacuuugggaggcuaaggugg

SEQ ID NO: 380466 - RNA, 21 nt, Human
caaguuaggcaccuuuggaau

SEQ ID NO: 380467 - RNA, 20 nt, Human
cacaucucuacaaaaaauua

SEQ ID NO: 380468 - RNA, 19 nt, Human
caccuguauucccagcuau

SEQ ID NO: 380469 - RNA, 21 nt, Human
caccuguauucccagcuauuc

SEQ ID NO: 380470 - RNA, 24 nt, Human
cacgcuuauaaucccaacacuuug

SEQ ID NO: 380471 - RNA, 24 nt, Human
cacugcccuccagcaugggcaaca

SEQ ID NO: 380472 - RNA, 24 nt, Human
cagcuauucaggaggcugagguag

SEQ ID NO: 380473 - RNA, 22 nt, Human
caguagaauaugagacuuccua

SEQ ID NO: 380474 - RNA, 24 nt, Human
caugagaaacugaaacuaaacuac

SEQ ID NO: 380475 - RNA, 24 nt, Human
cauguacacaaaaaaauauauaca

SEQ ID NO: 380476 - RNA, 21 nt, Human
ccacugcccuccagcaugggc

SEQ ID NO: 380477 - RNA, 24 nt, Human
ccacugcccuccagcaugggcaac

SEQ ID NO: 380478 - RNA, 25 nt, Human
cccacaauacucaauucuaaucauu

SEQ ID NO: 380479 - RNA, 23 nt, Human
cccauauuaacaacaacaaaaca

SEQ ID NO: 380480 - RNA, 20 nt, Human
ccuccagcaugggcaacaga

SEQ ID NO: 380481 - RNA, 21 nt, Human
ccuccagcaugggcaacagag

SEQ ID NO: 380482 - RNA, 21 nt, Human
ccuguauucccagcuauucag

SEQ ID NO: 380483 - RNA, 19 nt, Human
ccugucucaaaauuuaaaa

SEQ ID NO: 380484 - RNA, 20 nt, Human
ccuuuggaauuucaccaucc

SEQ ID NO: 380485 - RNA, 23 nt, Human
cgcuuauaaucccaacacuuugg

SEQ ID NO: 380486 - RNA, 20 nt, Human
cuaacauuaaacacggaaau

SEQ ID NO: 380487 - RNA, 18 nt, Human
cucacaccgcucucaaca

SEQ ID NO: 380488 - RNA, 22 nt, Human
cucacgcuuauaaucccaacac

SEQ ID NO: 380489 - RNA, 24 nt, Human
cucacgcuuauaaucccaacacuu

SEQ ID NO: 380490 - RNA, 19 nt, Human
cugaauugccucaaguucc

SEQ ID NO: 380491 - RNA, 21 nt, Human
cuguauucccagcuauucagg

SEQ ID NO: 380492 - RNA, 21 nt, Human
cuuugggaggcuaaggugggg

SEQ ID NO: 380493 - RNA, 18 nt, Human
gaaugacuugaggccagg

SEQ ID NO: 380494 - RNA, 19 nt, Human
gaggugaagcaaggacgug

SEQ ID NO: 380495 - RNA, 20 nt, Human
gaugugugcauguacacagu

SEQ ID NO: 380496 - RNA, 27 nt, Human
gcaaaaaauaaauaaaaacaaaagcaa

SEQ ID NO: 380497 - RNA, 18 nt, Human
gcggucagaucaaagcug

SEQ ID NO: 380498 - RNA, 22 nt, Human
gcgugcaccuguauucccagcu

SEQ ID NO: 380499 - RNA, 24 nt, Human
ggaaugacuugaggccaggaguuc

SEQ ID NO: 380500 - RNA, 21 nt, Human
ggccaggcaugguggcucacg

SEQ ID NO: 380501 - RNA, 23 nt, Human
gguggcucacgcuuauaauccca

SEQ ID NO: 380502 - RNA, 20 nt, Human
gugcauuccuucugucagau

SEQ ID NO: 380503 - RNA, 23 nt, Human
uaaaaaaaaaaaagugaaaaugc

SEQ ID NO: 380504 - RNA, 19 nt, Human
uaaaaaauagaugaaguca

SEQ ID NO: 380505 - RNA, 21 nt, Human
uaaaaaauagaugaagucaaa

SEQ ID NO: 380506 - RNA, 26 nt, Human
uaaaaacaaaagcaaaaaacagcucc

SEQ ID NO: 380507 - RNA, 22 nt, Human
uaaggcacccacagaauuaggg

SEQ ID NO: 380508 - RNA, 23 nt, Human
uaagguggggaaugacuugaggc

SEQ ID NO: 380509 - RNA, 25 nt, Human
uaagguggggaaugacuugaggcca

SEQ ID NO: 380510 - RNA, 23 nt, Human
uaagucuuggacaccaacugaau

SEQ ID NO: 380511 - RNA, 23 nt, Human
uaccaagcaccucacaccgcucu

SEQ ID NO: 380512 - RNA, 20 nt, Human
uaccaagcaccucacaccgg

SEQ ID NO: 380513 - RNA, 19 nt, Human
uaccugaggugaagcaagg

SEQ ID NO: 380514 - RNA, 18 nt, Human
uagaauaaccccuugagc

SEQ ID NO: 380515 - RNA, 30 nt, Human
uagaauaaccccuugagcggucagaucaaa

SEQ ID NO: 380516 - RNA, 22 nt, Human
uagaaugugaaaaucauuuaga

SEQ ID NO: 380517 - RNA, 20 nt, Human
uauaaucccaacacuuuggg

SEQ ID NO: 380518 - RNA, 22 nt, Human
uauucuuucuuuacacucaaga

SEQ ID NO: 380519 - RNA, 21 nt, Human
uauugcagaacaaaaaaaaag

SEQ ID NO: 380520 - RNA, 24 nt, Human
ucaaaauuuaaaaaaaaaaaagug

SEQ ID NO: 380521 - RNA, 20 nt, Human
ucauaccacugcccuccagc

SEQ ID NO: 380522 - RNA, 20 nt, Human
uccagcaugggcaacagagu

SEQ ID NO: 380523 - RNA, 24 nt, Human
uccagcaugggcaacagagugaga

SEQ ID NO: 380524 - RNA, 18 nt, Human
ugaaaaugcccucucuua

SEQ ID NO: 380525 - RNA, 24 nt, Human
ugaccacaucucuacaaaaaauua

SEQ ID NO: 380526 - RNA, 21 nt, Human
ugagaaacugaaacuaaacua

SEQ ID NO: 380527 - RNA, 23 nt, Human
ugagacuuccuacucuacgcuaa

SEQ ID NO: 380528 - RNA, 18 nt, Human
ugagauaauucaccauga

SEQ ID NO: 380529 - RNA, 20 nt, Human
ugagguagaauaaccccuug

SEQ ID NO: 380530 - RNA, 20 nt, Human
ugcagaacaaaaaaaaagaa

SEQ ID NO: 380531 - RNA, 23 nt, Human
ugcagaacaaaaaaaaagaagaa

SEQ ID NO: 380532 - RNA, 23 nt, Human
ugcagaacaaaaaaaaagaagaa

SEQ ID NO: 380533 - RNA, 23 nt, Human
uggcaaaaaauaaauaaaaacaa

SEQ ID NO: 380534 - RNA, 26 nt, Human
uggcaaaaaauaaauaaaagggaccc

SEQ ID NO: 380535 - RNA, 22 nt, Human
uggcgugcaccuguauucccag

SEQ ID NO: 380536 - RNA, 21 nt, Human
uggcucacgcuuauaauccca

SEQ ID NO: 380537 - RNA, 21 nt, Human
ugggaggcuaagguggggaau

SEQ ID NO: 380538 - RNA, 24 nt, Human
uggggccaggcaugguggcucacg

SEQ ID NO: 380539 - RNA, 24 nt, Human
ugguggcucacgcuuauaauccca

SEQ ID NO: 380540 - RNA, 19 nt, Human
ugucaaaauggguaugaag

SEQ ID NO: 380541 - RNA, 27 nt, Human
ugucuuguuuagcauguauuucagggg

SEQ ID NO: 380542 - RNA, 23 nt, Human
uuagaaugugaaaaucauuuaga

SEQ ID NO: 380543 - RNA, 18 nt, Human
uucaggaggcugagguag

SEQ ID NO: 380544 - RNA, 22 nt, Human
uugaggccaggaguucaagacc

SEQ ID NO: 380545 - RNA, 23 nt, Human
uuuaaaaaaaaaaaagugaaaau

SEQ ID NO: 380546 - RNA, 18 nt, Human
uuuuacaggccauguagc

SEQ ID NO: 380547 - RNA, 22 nt, Human
aaaccggucacauucucauccc

SEQ ID NO: 380548 - RNA, 23 nt, Human
aaaccggucacauucucauccca

SEQ ID NO: 380549 - RNA, 18 nt, Human
aacacaggccucugcgug

SEQ ID NO: 380550 - RNA, 21 nt, Human
aacacaugaauggcucaucac

SEQ ID NO: 380551 - RNA, 20 nt, Human
acccugaguggggcaggagg

SEQ ID NO: 380552 - RNA, 22 nt, Human
acccugaguggggcaggaggca

SEQ ID NO: 380553 - RNA, 21 nt, Human
agcggcggcgcuggaucccgg

SEQ ID NO: 380554 - RNA, 20 nt, Human
aggccucugcgugcucccag

SEQ ID NO: 380555 - RNA, 26 nt, Human
aucccacuucacucguaggccuccaa

SEQ ID NO: 380556 - RNA, 18 nt, Human
cacacagucccacaccuc

SEQ ID NO: 380557 - RNA, 23 nt, Human
caggagaggcguguuuggguaac

SEQ ID NO: 380558 - RNA, 24 nt, Human
cagugaugcuuuggauaauuucaa

SEQ ID NO: 380559 - RNA, 22 nt, Human
cauauacaaugccuucuccucg

SEQ ID NO: 380560 - RNA, 19 nt, Human
ccaacccugaguggggcag

SEQ ID NO: 380561 - RNA, 22 nt, Human
ccagcgccggguccauugcguc

SEQ ID NO: 380562 - RNA, 18 nt, Human
cccacaccuccucuagug

SEQ ID NO: 380563 - RNA, 23 nt, Human
cccacaccuccucuaguguccca

SEQ ID NO: 380564 - RNA, 23 nt, Human
cccacuucacucguaggccucca

SEQ ID NO: 380565 - RNA, 22 nt, Human
ccugggucuacccugccaggag

SEQ ID NO: 380566 - RNA, 18 nt, Human
cgcuggaucccgggugcc

SEQ ID NO: 380567 - RNA, 26 nt, Human
cuagugucccauauacaaugccuucu

SEQ ID NO: 380568 - RNA, 20 nt, Human
cuccuuggugucccaacagc

SEQ ID NO: 380569 - RNA, 19 nt, Human
cucguaggccuccaacagc

SEQ ID NO: 380570 - RNA, 19 nt, Human
cuucacacagucccacacc

SEQ ID NO: 380571 - RNA, 18 nt, Human
cuucacucguaggccucc

SEQ ID NO: 380572 - RNA, 20 nt, Human
cuucccggcaaaucuuccag

SEQ ID NO: 380573 - RNA, 21 nt, Human
cuucucggccacagccucgcu

SEQ ID NO: 380574 - RNA, 21 nt, Human
gcaacagggccugguuuucag

SEQ ID NO: 380575 - RNA, 23 nt, Human
gcacaggacugagggagcgguac

SEQ ID NO: 380576 - RNA, 20 nt, Human
gcugccagcgccggguccau

SEQ ID NO: 380577 - RNA, 24 nt, Human
gggcaggaggcaggaagggugggc

SEQ ID NO: 380578 - RNA, 23 nt, Human
gguacgccuucccggcaaaucuu

SEQ ID NO: 380579 - RNA, 23 nt, Human
guacuggagcaucuucucggcca

SEQ ID NO: 380580 - RNA, 23 nt, Human
gugaacacaggccucugcgugcu

SEQ ID NO: 380581 - RNA, 18 nt, Human
gugggcugccgccucugg

SEQ ID NO: 380582 - RNA, 20 nt, Human
guggucucugagagugaugg

SEQ ID NO: 380583 - RNA, 19 nt, Human
uaggccuccaacagcuggc

SEQ ID NO: 380584 - RNA, 23 nt, Human
uauuuggggggcugcagcacagg

SEQ ID NO: 380585 - RNA, 20 nt, Human
ucagaaaaauauauuugggg

SEQ ID NO: 380586 - RNA, 23 nt, Human
ucaguggcgaugaugauucucua

SEQ ID NO: 380587 - RNA, 24 nt, Human
ucaguggcgaugaugauucucuau

SEQ ID NO: 380588 - RNA, 26 nt, Human
ucaguggcgaugaugauucucuauga

SEQ ID NO: 380589 - RNA, 19 nt, Human
ucccaacagcuggagcucc

SEQ ID NO: 380590 - RNA, 21 nt, Human
ucccacuucacucguaggccu

SEQ ID NO: 380591 - RNA, 19 nt, Human
ucccauauacaaugccuuc

SEQ ID NO: 380592 - RNA, 21 nt, Human
ucgaugagucacgggaguucu

SEQ ID NO: 380593 - RNA, 23 nt, Human
ucgcaugguguccaggccgaguc

SEQ ID NO: 380594 - RNA, 22 nt, Human
ucucugucagaugguuagaggc

SEQ ID NO: 380595 - RNA, 20 nt, Human
ugaauggcucaucacacgcc

SEQ ID NO: 380596 - RNA, 20 nt, Human
ugagggagcgguacaugcuu

SEQ ID NO: 380597 - RNA, 22 nt, Human
ugaguggggcaggaggcaggaa

SEQ ID NO: 380598 - RNA, 24 nt, Human
ugcggggucgcggguguuaugagc

SEQ ID NO: 380599 - RNA, 19 nt, Human
ugcgugcucccaggcuccu

SEQ ID NO: 380600 - RNA, 22 nt, Human
ugcugugucccgccgguacugg

SEQ ID NO: 380601 - RNA, 23 nt, Human
ugcugugucccgccgguacugga

SEQ ID NO: 380602 - RNA, 25 nt, Human
uggcauucucagagaugcgcagucc

SEQ ID NO: 380603 - RNA, 25 nt, Human
uuuuuuuuuuuuuuuuuuauaucag

SEQ ID NO: 380604 - RNA, 19 nt, Human
aaaaggacaaaguagccca

SEQ ID NO: 380605 - RNA, 24 nt, Human
aaaaggacaaaguagcccauuuaa

SEQ ID NO: 380606 - RNA, 23 nt, Human
aaacauaugcaguucucaaugca

SEQ ID NO: 380607 - RNA, 26 nt, Human
aaacaucauccacucaaaaaaguguc

SEQ ID NO: 380608 - RNA, 20 nt, Human
aaaccaauggaaaacugcca

SEQ ID NO: 380609 - RNA, 19 nt, Human
aaagcagaauguauucagc

SEQ ID NO: 380610 - RNA, 23 nt, Human
aaauacaguauacuucacgaaac

SEQ ID NO: 380611 - RNA, 19 nt, Human
aaauuugguuuuuggcuuu

SEQ ID NO: 380612 - RNA, 18 nt, Human
aacaggccccagccagga

SEQ ID NO: 380613 - RNA, 23 nt, Human
aacaucauccacucaaaaaagug

SEQ ID NO: 380614 - RNA, 18 nt, Human
aacccacucuucagagaa

SEQ ID NO: 380615 - RNA, 20 nt, Human
aaccuugucaaacccaucuc

SEQ ID NO: 380616 - RNA, 18 nt, Human
aagcaaagaaaacaugua

SEQ ID NO: 380617 - RNA, 22 nt, Human
acagcaaaugaaacuuuucugc

SEQ ID NO: 380618 - RNA, 23 nt, Human
accacccuaauaacaaaaaggac

SEQ ID NO: 380619 - RNA, 21 nt, Human
acccuaauaacaaaaaggaca

SEQ ID NO: 380620 - RNA, 24 nt, Human
accuugugccccaacaagggccug

SEQ ID NO: 380621 - RNA, 19 nt, Human
agcaguaguggaaaaacaa

SEQ ID NO: 380622 - RNA, 19 nt, Human
agcaguaguggaaaaacaa

SEQ ID NO: 380623 - RNA, 21 nt, Human
aggaaaaagguaaaaauacag

SEQ ID NO: 380624 - RNA, 22 nt, Human
aggaacagaguagcaggaggga

SEQ ID NO: 380625 - RNA, 18 nt, Human
aggaaggaaaaagguaaa

SEQ ID NO: 380626 - RNA, 18 nt, Human
agguuuguaaacauguca

SEQ ID NO: 380627 - RNA, 21 nt, Human
aguagcaggagggaaucacag

SEQ ID NO: 380628 - RNA, 21 nt, Human
auagcaauuacaauggaaaag

SEQ ID NO: 380629 - RNA, 19 nt, Human
augcccuucagaguaacug

SEQ ID NO: 380630 - RNA, 20 nt, Human
auggaaaacugccaguuaca

SEQ ID NO: 380631 - RNA, 28 nt, Human
caaccaaaggagcagcuacgcacagcac

SEQ ID NO: 380632 - RNA, 19 nt, Human
caacugaaacuuagguucu

SEQ ID NO: 380633 - RNA, 24 nt, Human
caagaugaaagcagaauguauuca

SEQ ID NO: 380634 - RNA, 21 nt, Human
cacaggaugugaaggaacaga

SEQ ID NO: 380635 - RNA, 23 nt, Human
caccuugugccccaacaagggcc

SEQ ID NO: 380636 - RNA, 19 nt, Human
cacuuaaagcaaagaaaac

SEQ ID NO: 380637 - RNA, 21 nt, Human
cagcaaaugaaacuuuucugc

SEQ ID NO: 380638 - RNA, 18 nt, Human
cagccgagccccuccgca

SEQ ID NO: 380639 - RNA, 20 nt, Human
cagccgagccccuccgcaga

SEQ ID NO: 380640 - RNA, 21 nt, Human
cagccgagccccuccgcagac

SEQ ID NO: 380641 - RNA, 21 nt, Human
cagcgcuggcgccccgccccg

SEQ ID NO: 380642 - RNA, 19 nt, Human
caggagggaaucacagaug

SEQ ID NO: 380643 - RNA, 21 nt, Human
caggccccagccaggagcaag

SEQ ID NO: 380644 - RNA, 21 nt, Human
cauaacaaacaguaaagcuaa

SEQ ID NO: 380645 - RNA, 24 nt, Human
ccuaccagauccaugauggcuacc

SEQ ID NO: 380646 - RNA, 22 nt, Human
ccuagaaacacaggaugugaag

SEQ ID NO: 380647 - RNA, 22 nt, Human
ccuugugccccaacaagggcug

SEQ ID NO: 380648 - RNA, 24 nt, Human
cgaaacaucauccacucaaaaaag

SEQ ID NO: 380649 - RNA, 21 nt, Human
cgcggcggugcagccucuccc

SEQ ID NO: 380650 - RNA, 20 nt, Human
cucaagaaacagaauuuguc

SEQ ID NO: 380651 - RNA, 28 nt, Human
cugauaggcaguaacacggggaucucuu

SEQ ID NO: 380652 - RNA, 25 nt, Human
cugccaggcgcgauccccccggugc

SEQ ID NO: 380653 - RNA, 19 nt, Human
cugggucgccucugcucgg

SEQ ID NO: 380654 - RNA, 19 nt, Human
cuugugaaacccacucuuc

SEQ ID NO: 380655 - RNA, 25 nt, Human
cuuuuucuacuccuuucccaauuuu

SEQ ID NO: 380656 - RNA, 22 nt, Human
gaaaaacaagauacagccacau

SEQ ID NO: 380657 - RNA, 23 nt, Human
gaaacauaugcaguucucaaugc

SEQ ID NO: 380658 - RNA, 22 nt, Human
gaaacaucauccacucaaaaaa

SEQ ID NO: 380659 - RNA, 23 nt, Human
gagaaaaggcagcgcuggcgccc

SEQ ID NO: 380660 - RNA, 20 nt, Human
gcggcggugcagccucuccc

SEQ ID NO: 380661 - RNA, 21 nt, Human
ggaaagcacugugugcauauu

SEQ ID NO: 380662 - RNA, 20 nt, Human
ggauccggaagggcuaggcg

SEQ ID NO: 380663 - RNA, 18 nt, Human
gggcgcggcggugcagcc

SEQ ID NO: 380664 - RNA, 24 nt, Human
gugcagccgagccccuccgcagac

SEQ ID NO: 380665 - RNA, 25 nt, Human
gugguagcaguaguggaaaaacaag

SEQ ID NO: 380666 - RNA, 27 nt, Human
uaaaacaaaacucaagaaaucuuuauc

SEQ ID NO: 380667 - RNA, 25 nt, Human
uaaaauacacauuuucccccuacca

SEQ ID NO: 380668 - RNA, 25 nt, Human
uaacaguugggcacugacuuuaugc

SEQ ID NO: 380669 - RNA, 20 nt, Human
uaaugcaauacagauacuuu

SEQ ID NO: 380670 - RNA, 20 nt, Human
uaauguugucuucuuuguuu

SEQ ID NO: 380671 - RNA, 19 nt, Human
uacagcaaaugaaacuuuu

SEQ ID NO: 380672 - RNA, 18 nt, Human
uacugcuuuuucuacucc

SEQ ID NO: 380673 - RNA, 22 nt, Human
uagcaguaguggaaaaacaaga

SEQ ID NO: 380674 - RNA, 18 nt, Human
uccaccaaagaagaauac

SEQ ID NO: 380675 - RNA, 23 nt, Human
ucccuugggagaacuguaaaaau

SEQ ID NO: 380676 - RNA, 20 nt, Human
ucucccacagaaauuuaccg

SEQ ID NO: 380677 - RNA, 22 nt, Human
ucugcgcaggaaagcgaaacua

SEQ ID NO: 380678 - RNA, 18 nt, Human
ugaaggaacagaguagca

SEQ ID NO: 380679 - RNA, 20 nt, Human
ugcaauacagauacuuuagc

SEQ ID NO: 380680 - RNA, 20 nt, Human
ugccaagacugucgagguua

SEQ ID NO: 380681 - RNA, 19 nt, Human
ugccacggaaagcacugug

SEQ ID NO: 380682 - RNA, 22 nt, Human
ugccacggaaagcacugugugc

SEQ ID NO: 380683 - RNA, 19 nt, Human
ugccccaacaagggccugg

SEQ ID NO: 380684 - RNA, 22 nt, Human
ugcgcaggaaagcgaaacuacc

SEQ ID NO: 380685 - RNA, 23 nt, Human
uggaaaaacaagauacagccaca

SEQ ID NO: 380686 - RNA, 20 nt, Human
uguaaacaugucacucuucu

SEQ ID NO: 380687 - RNA, 24 nt, Human
ugucgccagagaagaugaaaaaaa

SEQ ID NO: 380688 - RNA, 18 nt, Human
ugucuggaaaaaguacag

SEQ ID NO: 380689 - RNA, 20 nt, Human
ugucuggaaaaaguacagga

SEQ ID NO: 380690 - RNA, 18 nt, Human
ugugaauagccuaacucc

SEQ ID NO: 380691 - RNA, 21 nt, Human
ugugauggcgauagcaauuac

SEQ ID NO: 380692 - RNA, 18 nt, Human
ugugguagcaguagugga

SEQ ID NO: 380693 - RNA, 18 nt, Human
uguugucuucuuuguuuu

SEQ ID NO: 380694 - RNA, 21 nt, Human
uuacacuuaaagcaaagaaaa

SEQ ID NO: 380695 - RNA, 20 nt, Human
uuuuuggcuuuuuuuuuuuu

SEQ ID NO: 380696 - RNA, 27 nt, Human
uuuuuggcuuuuuuuuuuuuuuuuaaa

SEQ ID NO: 380697 - RNA, 21 nt, Human
aaaaagaaaccuagggcuuag

SEQ ID NO: 380698 - RNA, 18 nt, Human
aaaagcagaucacccaca

SEQ ID NO: 380699 - RNA, 24 nt, Human
aaagugcugggauuacaggcguga

SEQ ID NO: 380700 - RNA, 22 nt, Human
aacaacaauaacaaaaagcugc

SEQ ID NO: 380701 - RNA, 25 nt, Human
aacccccggcucccccucccagucu

SEQ ID NO: 380702 - RNA, 18 nt, Human
aagaaaccuagggcuuag

SEQ ID NO: 380703 - RNA, 19 nt, Human
aagaaaccuagggcuuaga

SEQ ID NO: 380704 - RNA, 20 nt, Human
aagaaaccuagggcuuagau

SEQ ID NO: 380705 - RNA, 21 nt, Human
aagaaaccuagggcuuagaua

SEQ ID NO: 380706 - RNA, 20 nt, Human
aagggccucuccgagccgag

SEQ ID NO: 380707 - RNA, 19 nt, Human
aagugcugggauuacaggc

SEQ ID NO: 380708 - RNA, 19 nt, Human
aagugcugggauuacaggc

SEQ ID NO: 380709 - RNA, 26 nt, Human
aagugcugggauuacaggcgugagcc

SEQ ID NO: 380710 - RNA, 26 nt, Human
aauaacaaaaagcugcugagaaagga

SEQ ID NO: 380711 - RNA, 18 nt, Human
aauuuuggcucacugcaa

SEQ ID NO: 380712 - RNA, 21 nt, Human
acaacaacaacaauaacaaaa

SEQ ID NO: 380713 - RNA, 20 nt, Human
acaacaacaauaacaaaaag

SEQ ID NO: 380714 - RNA, 22 nt, Human
acaagacauuuccuuuuucucc

SEQ ID NO: 380715 - RNA, 18 nt, Human
acgggguuucaccguguu

SEQ ID NO: 380716 - RNA, 19 nt, Human
acgggguuucaccguguua

SEQ ID NO: 380717 - RNA, 20 nt, Human
acgggguuucaccguguuag

SEQ ID NO: 380718 - RNA, 24 nt, Human
acgggguuucaccguguuagccag

SEQ ID NO: 380719 - RNA, 22 nt, Human
agaaacaggcagaaggaugccg

SEQ ID NO: 380720 - RNA, 28 nt, Human
agaaacaggcagaaggaugccgguaccc

SEQ ID NO: 380721 - RNA, 19 nt, Human
agaaaggagggcaggggaa

SEQ ID NO: 380722 - RNA, 22 nt, Human
agaaaggagggcaggggaacaa

SEQ ID NO: 380723 - RNA, 23 nt, Human
agaaaggcuaugcugauacagug

SEQ ID NO: 380724 - RNA, 20 nt, Human
agaacacauccuuauuugca

SEQ ID NO: 380725 - RNA, 19 nt, Human
agaaugcagguaggcgccu

SEQ ID NO: 380726 - RNA, 19 nt, Human
agagacgggguuucaccgu

SEQ ID NO: 380727 - RNA, 26 nt, Human
agauuaaaaaaaaucuggaaccacaa

SEQ ID NO: 380728 - RNA, 24 nt, Human
agcgauucuccugccucagccucc

SEQ ID NO: 380729 - RNA, 24 nt, Human
aggagauuaaaaaaaaucuggaac

SEQ ID NO: 380730 - RNA, 26 nt, Human
aggccggggcugcgcgugucguggac

SEQ ID NO: 380731 - RNA, 27 nt, Human
aggccggggcugcgcgugucguggacc

SEQ ID NO: 380732 - RNA, 24 nt, Human
aggcgccucagucguaucuuucug

SEQ ID NO: 380733 - RNA, 20 nt, Human
aguagagacgggguuucacc

SEQ ID NO: 380734 - RNA, 21 nt, Human
aguagagacgggguuucaccg

SEQ ID NO: 380735 - RNA, 18 nt, Human
aguagcugggacuacagg

SEQ ID NO: 380736 - RNA, 19 nt, Human
aguagcugggacuacaggc

SEQ ID NO: 380737 - RNA, 23 nt, Human
aguagcugggacuacaggcgccc

SEQ ID NO: 380738 - RNA, 19 nt, Human
aguauguagcuauaggugg

SEQ ID NO: 380739 - RNA, 18 nt, Human
agugcagugugcaguggu

SEQ ID NO: 380740 - RNA, 24 nt, Human
agugcagugugcaguggugcaauu

SEQ ID NO: 380741 - RNA, 18 nt, Human
agugcugggauuacaggc

SEQ ID NO: 380742 - RNA, 24 nt, Human
caaagugcugggauuacaggcgug

SEQ ID NO: 380743 - RNA, 24 nt, Human
caacaacaauaacaaaaagcugcu

SEQ ID NO: 380744 - RNA, 25 nt, Human
caacaacaauaacaaaaagcugcug

SEQ ID NO: 380745 - RNA, 29 nt, Human
caacaacaauaacaaaaagcugcugagaa

SEQ ID NO: 380746 - RNA, 20 nt, Human
caagcgauucuccugccuca

SEQ ID NO: 380747 - RNA, 22 nt, Human
caagcgauucuccugccucagc

SEQ ID NO: 380748 - RNA, 20 nt, Human
caccccccgccacauccccu

SEQ ID NO: 380749 - RNA, 18 nt, Human
caccguguuagccaggau

SEQ ID NO: 380750 - RNA, 23 nt, Human
caccguguuagccaggauggucu

SEQ ID NO: 380751 - RNA, 24 nt, Human
caccguguuagccaggauggucuu

SEQ ID NO: 380752 - RNA, 19 nt, Human
cagaaacaggcagaaggau

SEQ ID NO: 380753 - RNA, 24 nt, Human
cagaaaggcuaugcugauacagug

SEQ ID NO: 380754 - RNA, 19 nt, Human
cagaaggaugccgcaggca

SEQ ID NO: 380755 - RNA, 19 nt, Human
cagaaggaugccgcaggca

SEQ ID NO: 380756 - RNA, 23 nt, Human
cagagaacacauccuuauuugca

SEQ ID NO: 380757 - RNA, 21 nt, Human
caggcgcccaccaccacaccc

SEQ ID NO: 380758 - RNA, 23 nt, Human
caggcgcccaccaccacacccag

SEQ ID NO: 380759 - RNA, 19 nt, Human
caggggaacaaaacaacac

SEQ ID NO: 380760 - RNA, 21 nt, Human
cagguucaagcgauucuccug

SEQ ID NO: 380761 - RNA, 22 nt, Human
ccaaagugcugggauuacaggc

SEQ ID NO: 380762 - RNA, 22 nt, Human
ccaaagugcugggauuacaggc

SEQ ID NO: 380763 - RNA, 24 nt, Human
ccaaagugcugggauuacaggcgu

SEQ ID NO: 380764 - RNA, 21 nt, Human
cccaccaccacacccagcuaa

SEQ ID NO: 380765 - RNA, 22 nt, Human
ccccccgccacauccccugauc

SEQ ID NO: 380766 - RNA, 21 nt, Human
ccccugaucaugggucucaga

SEQ ID NO: 380767 - RNA, 23 nt, Human
cccgaguagcugggacuacaggc

SEQ ID NO: 380768 - RNA, 24 nt, Human
cccgaguagcugggacuacaggcg

SEQ ID NO: 380769 - RNA, 18 nt, Human
cccggcucccccucccag

SEQ ID NO: 380770 - RNA, 20 nt, Human
cccugaucaugggucucaga

SEQ ID NO: 380771 - RNA, 24 nt, Human
ccucucagguucaagcgauucucc

SEQ ID NO: 380772 - RNA, 24 nt, Human
ccugaccuuaugauccgccucggc

SEQ ID NO: 380773 - RNA, 23 nt, Human
ccugccucagccucccgaguagc

SEQ ID NO: 380774 - RNA, 24 nt, Human
ccuuuaauuguuauuauuucuuaa

SEQ ID NO: 380775 - RNA, 23 nt, Human
ccuuuuucucccucuagccaccc

SEQ ID NO: 380776 - RNA, 21 nt, Human
cgcccaccaccacacccagcu

SEQ ID NO: 380777 - RNA, 24 nt, Human
cgccucggccucccaaagugcugg

SEQ ID NO: 380778 - RNA, 24 nt, Human
cggcucccccucccagucugcgcc

SEQ ID NO: 380779 - RNA, 21 nt, Human
cggggcugcgcgugugccggg

SEQ ID NO: 380780 - RNA, 24 nt, Human
cgggguuucaccguguuagccagg

SEQ ID NO: 380781 - RNA, 22 nt, Human
cgguuggggcuuguucccucgg

SEQ ID NO: 380782 - RNA, 24 nt, Human
cgguuggggcuuguucccucggcu

SEQ ID NO: 380783 - RNA, 25 nt, Human
cuagccaccccccgccacauccccu

SEQ ID NO: 380784 - RNA, 24 nt, Human
cucagccucccgaguagcugggac

SEQ ID NO: 380785 - RNA, 20 nt, Human
cuccugaccuuaugauccgc

SEQ ID NO: 380786 - RNA, 23 nt, Human
cucuauuuuuaaaagugcccaga

SEQ ID NO: 380787 - RNA, 24 nt, Human
cugcaaccuccgccucucagguuc

SEQ ID NO: 380788 - RNA, 23 nt, Human
cugccucagccucccgaguagcu

SEQ ID NO: 380789 - RNA, 24 nt, Human
cuuuuaguagagacgggguuucac

SEQ ID NO: 380790 - RNA, 18 nt, Human
gaaaggagggcaggggaa

SEQ ID NO: 380791 - RNA, 19 nt, Human
gacauuuccuuuuucuccc

SEQ ID NO: 380792 - RNA, 18 nt, Human
gaccuuaugauccgccuc

SEQ ID NO: 380793 - RNA, 24 nt, Human
gagacgggguuucaccguguuagc

SEQ ID NO: 380794 - RNA, 25 nt, Human
gaguagcugggacuacaggcgccca

SEQ ID NO: 380795 - RNA, 18 nt, Human
gauuacaggcgugagcca

SEQ ID NO: 380796 - RNA, 21 nt, Human
gauuacaggcgugagccacca

SEQ ID NO: 380797 - RNA, 22 nt, Human
gauuacaggcgugagccaccau

SEQ ID NO: 380798 - RNA, 24 nt, Human
gauuacaggcgugagccaccaugc

SEQ ID NO: 380799 - RNA, 21 nt, Human
gauucuccugccucagccucc

SEQ ID NO: 380800 - RNA, 18 nt, Human
gcccaccaccacacccag

SEQ ID NO: 380801 - RNA, 18 nt, Human
gcccaccaccacacccag

SEQ ID NO: 380802 - RNA, 23 nt, Human
gccucggccucccaaagugcugg

SEQ ID NO: 380803 - RNA, 24 nt, Human
gcgauucuccugccucagccuccc

SEQ ID NO: 380804 - RNA, 18 nt, Human
gcgccgccgcagcuccgg

SEQ ID NO: 380805 - RNA, 19 nt, Human
gcgugagccaccaugcccg

SEQ ID NO: 380806 - RNA, 19 nt, Human
gcuaaaaucagggguccca

SEQ ID NO: 380807 - RNA, 21 nt, Human
ggaacaaaacaacacaagaca

SEQ ID NO: 380808 - RNA, 24 nt, Human
ggauggucuugaucuccugaccuu

SEQ ID NO: 380809 - RNA, 24 nt, Human
ggauuacaggcgugagccaccaug

SEQ ID NO: 380810 - RNA, 23 nt, Human
ggcucccccucccagucugcgcc

SEQ ID NO: 380811 - RNA, 18 nt, Human
gggagagacagcgccaag

SEQ ID NO: 380812 - RNA, 19 nt, Human
ggggagagacagcgccaag

SEQ ID NO: 380813 - RNA, 23 nt, Human
gggguuucaccguguuagccagg

SEQ ID NO: 380814 - RNA, 22 nt, Human
ggguuucaccguguuagccagg

SEQ ID NO: 380815 - RNA, 22 nt, Human
ggucuugaucuccugaccuuau

SEQ ID NO: 380816 - RNA, 20 nt, Human
gguggcagaaugcagguagg

SEQ ID NO: 380817 - RNA, 23 nt, Human
guagagacgggguuucaccgugu

SEQ ID NO: 380818 - RNA, 21 nt, Human
gugagggguggcagaaugcag

SEQ ID NO: 380819 - RNA, 22 nt, Human
gugcaguggugcaauuuuggcu

SEQ ID NO: 380820 - RNA, 25 nt, Human
gugugcaguggugcaauuuuggcuc

SEQ ID NO: 380821 - RNA, 23 nt, Human
uaaaaagaaaccuagggcuuagu

SEQ ID NO: 380822 - RNA, 23 nt, Human
uaaaaagugcaaugccaggagua

SEQ ID NO: 380823 - RNA, 26 nt, Human
uaagaacaacaacaacaauaacaaaa

SEQ ID NO: 380824 - RNA, 27 nt, Human
uaagaacaacaacaacaauuggagacc

SEQ ID NO: 380825 - RNA, 24 nt, Human
uaauuuuuuguacuuuuaguagag

SEQ ID NO: 380826 - RNA, 25 nt, Human
uaauuuuuuguacuuuuaguagaga

SEQ ID NO: 380827 - RNA, 21 nt, Human
uacagaaaggcuaugcugaua

SEQ ID NO: 380828 - RNA, 23 nt, Human
uacaggcgugagccaccaugccc

SEQ ID NO: 380829 - RNA, 21 nt, Human
uagcagaaguaggagauuaaa

SEQ ID NO: 380830 - RNA, 21 nt, Human
uaguagagacgggguuucacc

SEQ ID NO: 380831 - RNA, 24 nt, Human
uaguagagacgggguuucaccgug

SEQ ID NO: 380832 - RNA, 26 nt, Human
uaguagagacgggguuucaccguguu

SEQ ID NO: 380833 - RNA, 26 nt, Human
uaguagagacgggguuucaccguugg

SEQ ID NO: 380834 - RNA, 24 nt, Human
ucaccguguuagccaggauggucu

SEQ ID NO: 380835 - RNA, 19 nt, Human
ucacugcaaccuccgccuc

SEQ ID NO: 380836 - RNA, 24 nt, Human
ucacugcaaccuccgccucucagg

SEQ ID NO: 380837 - RNA, 24 nt, Human
ucacugcaaccuccgccucucagg

SEQ ID NO: 380838 - RNA, 25 nt, Human
ucacugcaaccuccgccucucaggu

SEQ ID NO: 380839 - RNA, 27 nt, Human
ucacugcaaccuccgccucucagguuc

SEQ ID NO: 380840 - RNA, 23 nt, Human
ucagccucccgaguagcugggac

SEQ ID NO: 380841 - RNA, 24 nt, Human
ucagucguaucuuucugcagcuuc

SEQ ID NO: 380842 - RNA, 19 nt, Human
uccaggauccgguuggggc

SEQ ID NO: 380843 - RNA, 24 nt, Human
ucccaaagugcugggauuacaggc

SEQ ID NO: 380844 - RNA, 24 nt, Human
ucccgaguagcugggacuacaggc

SEQ ID NO: 380845 - RNA, 21 nt, Human
uccgagccgagggggagagac

SEQ ID NO: 380846 - RNA, 24 nt, Human
uccuuuuucucccucuagccaccc

SEQ ID NO: 380847 - RNA, 18 nt, Human
ucgcccaggauggagugc

SEQ ID NO: 380848 - RNA, 21 nt, Human
ucggaacccccggcucccccu

SEQ ID NO: 380849 - RNA, 18 nt, Human
ucggccucccaaagugcu

SEQ ID NO: 380850 - RNA, 25 nt, Human
ucuaagaacaacaacaacaauaaca

SEQ ID NO: 380851 - RNA, 24 nt, Human
ucucagacugucgcccaggaugga

SEQ ID NO: 380852 - RNA, 21 nt, Human
ucucagguucaagcgauucuc

SEQ ID NO: 380853 - RNA, 24 nt, Human
ucucagguucaagcgauucuccug

SEQ ID NO: 380854 - RNA, 24 nt, Human
ucuccugccucagccucccgagua

SEQ ID NO: 380855 - RNA, 18 nt, Human
ucugcagcuuccguucuc

SEQ ID NO: 380856 - RNA, 21 nt, Human
ucugcagcuuccguucucagc

SEQ ID NO: 380857 - RNA, 23 nt, Human
ucugcagcuuccguucucagcuc

SEQ ID NO: 380858 - RNA, 21 nt, Human
ucugcgccgccgcagcuccgg

SEQ ID NO: 380859 - RNA, 22 nt, Human
ugagacagagucucagacuguc

SEQ ID NO: 380860 - RNA, 22 nt, Human
ugcaguggugcaauuuuggcuc

SEQ ID NO: 380861 - RNA, 24 nt, Human
ugccucagccucccgaguagcugg

SEQ ID NO: 380862 - RNA, 24 nt, Human
ugcugggauuacaggcgugagcca

SEQ ID NO: 380863 - RNA, 19 nt, Human
uggagugcagugugcagug

SEQ ID NO: 380864 - RNA, 33 nt, Human
uggagugcagugugcaguggugcaauuuugggg

SEQ ID NO: 380865 - RNA, 21 nt, Human
ugggacuacaggcgcccacca

SEQ ID NO: 380866 - RNA, 24 nt, Human
ugggacuacaggcgcccaccacca

SEQ ID NO: 380867 - RNA, 18 nt, Human
ugggauuacaggcgugag

SEQ ID NO: 380868 - RNA, 22 nt, Human
ugggauuacaggcgugagccac

SEQ ID NO: 380869 - RNA, 23 nt, Human
ugggauuacaggcgugagccacc

SEQ ID NO: 380870 - RNA, 24 nt, Human
ugggauuacaggcgugagccacca

SEQ ID NO: 380871 - RNA, 25 nt, Human
ugggauuacaggcgugagccaccau

SEQ ID NO: 380872 - RNA, 21 nt, Human
uguagcuauagguggccugug

SEQ ID NO: 380873 - RNA, 24 nt, Human
ugugcaguggugcaauuuuggcuc

SEQ ID NO: 380874 - RNA, 18 nt, Human
uuagauaguccuaucuuc

SEQ ID NO: 380875 - RNA, 18 nt, Human
uuaguagagacgggguuu

SEQ ID NO: 380876 - RNA, 22 nt, Human
uuaguagagacgggguuucacc

SEQ ID NO: 380877 - RNA, 24 nt, Human
uuaguagagacgggguuucaccgu

SEQ ID NO: 380878 - RNA, 21 nt, Human
uucaagcgauucuccugccuc

SEQ ID NO: 380879 - RNA, 23 nt, Human
uucaagcgauucuccugccucag

SEQ ID NO: 380880 - RNA, 24 nt, Human
uucaagcgauucuccugccucagc

SEQ ID NO: 380881 - RNA, 21 nt, Human
uuuaaaaagaaaccuagggcu

SEQ ID NO: 380882 - RNA, 19 nt, Human
uuucaccguguuagccagg

SEQ ID NO: 380883 - RNA, 21 nt, Human
uuuuuguacuuuuaguagaga

SEQ ID NO: 380884 - RNA, 24 nt, Human
uuuuuuguacuuuuaguagagacg

SEQ ID NO: 380885 - RNA, 20 nt, Human
uuuuuuuuuuugagacagag

SEQ ID NO: 380886 - RNA, 26 nt, Human
uuuuuuuuuuuugagacagagucuca

SEQ ID NO: 380887 - RNA, 18 nt, Human
uuuuuuuuuuuuuuuuug

SEQ ID NO: 380888 - RNA, 19 nt, Human
aagcgccccucacaguccc

SEQ ID NO: 380889 - RNA, 19 nt, Human
agaagcgccccucacaguc

SEQ ID NO: 380890 - RNA, 21 nt, Human
agagagcuucagaugucaaac

SEQ ID NO: 380891 - RNA, 24 nt, Human
agaugucaaacauuuccuagaacc

SEQ ID NO: 380892 - RNA, 20 nt, Human
auuuccuagaaccugguauu

SEQ ID NO: 380893 - RNA, 20 nt, Human
caaagucagaagcgccccuc

SEQ ID NO: 380894 - RNA, 21 nt, Human
cacagucccuaggagaaagcc

SEQ ID NO: 380895 - RNA, 24 nt, Human
cagugcucaaguccaaagucagaa

SEQ ID NO: 380896 - RNA, 22 nt, Human
cccacccacucuauucuagaaa

SEQ ID NO: 380897 - RNA, 24 nt, Human
cccaggcagugcucaaguccaaag

SEQ ID NO: 380898 - RNA, 19 nt, Human
cccuucaccgggcguccuc

SEQ ID NO: 380899 - RNA, 18 nt, Human
cuaacacgcagaaacugc

SEQ ID NO: 380900 - RNA, 25 nt, Human
cuugcaaguuuaucugaagcuuugg

SEQ ID NO: 380901 - RNA, 22 nt, Human
gugaagagagcuucagauguca

SEQ ID NO: 380902 - RNA, 19 nt, Human
uauucuagaaaugcuaaca

SEQ ID NO: 380903 - RNA, 19 nt, Human
uauugggcaaagaacaguc

SEQ ID NO: 380904 - RNA, 22 nt, Human
ucaaacauuuccuagaaccugg

SEQ ID NO: 380905 - RNA, 19 nt, Human
uccaaagucagaagcgccc

SEQ ID NO: 380906 - RNA, 25 nt, Human
ucccuaggagaaagccgcugacgcc

SEQ ID NO: 380907 - RNA, 22 nt, Human
ucuuuaaacuuuuucauuugcu

SEQ ID NO: 380908 - RNA, 18 nt, Human
ugccacgggagugugaag

SEQ ID NO: 380909 - RNA, 18 nt, Human
ugccaggcuggagccccu

SEQ ID NO: 380910 - RNA, 21 nt, Human
ugggacuuuacuugggucagu

SEQ ID NO: 380911 - RNA, 21 nt, Human
uugcaaguuuaucugaagcuu

SEQ ID NO: 380912 - RNA, 24 nt, Human
uugcaaguuuaucugaagcuuugg

SEQ ID NO: 380913 - RNA, 18 nt, Human
uugcauuucuccucccac

SEQ ID NO: 380914 - RNA, 21 nt, Human
uugguuucaagcauuucaguc

SEQ ID NO: 380915 - RNA, 21 nt, Human
uuugcauuucuccucccacuu

SEQ ID NO: 380916 - RNA, 22 nt, Human
aaacaccauaacgugcaccaac

SEQ ID NO: 380917 - RNA, 18 nt, Human
aacuaaacucucagacag

SEQ ID NO: 380918 - RNA, 21 nt, Human
acacaaacacauacucgcacu

SEQ ID NO: 380919 - RNA, 23 nt, Human
acacacacacacacaaacacaua

SEQ ID NO: 380920 - RNA, 25 nt, Human
acacacacacacacacacacaaaca

SEQ ID NO: 380921 - RNA, 23 nt, Human
acacacacacacacacacacaca

SEQ ID NO: 380922 - RNA, 23 nt, Human
acacacacacacacacacacaca

SEQ ID NO: 380923 - RNA, 23 nt, Human
acacacacacacacacacacaca

SEQ ID NO: 380924 - RNA, 21 nt, Human
accaacgcacacacacacaca

SEQ ID NO: 380925 - RNA, 23 nt, Human
acgcacacacacacacacacaca

SEQ ID NO: 380926 - RNA, 31 nt, Human
acgugcaccaacgcacacacacacacacaca

SEQ ID NO: 380927 - RNA, 22 nt, Human
cacaaacacauacucgcacucc

SEQ ID NO: 380928 - RNA, 24 nt, Human
cacacacacacacaaacacauacu

SEQ ID NO: 380929 - RNA, 20 nt, Human
cacacacacacacacacaca

SEQ ID NO: 380930 - RNA, 20 nt, Human
cacacacacacacacacaca

SEQ ID NO: 380931 - RNA, 20 nt, Human
cacacacacacacacacaca

SEQ ID NO: 380932 - RNA, 20 nt, Human
cacacacacacacacacaca

SEQ ID NO: 380933 - RNA, 20 nt, Human
cacacacacacacacacaca

SEQ ID NO: 380934 - RNA, 20 nt, Human
cacacacacacacacacaca

SEQ ID NO: 380935 - RNA, 22 nt, Human
cacacacacacacacacacaca

SEQ ID NO: 380936 - RNA, 26 nt, Human
cacacacacacacacacacacacaaa

SEQ ID NO: 380937 - RNA, 26 nt, Human
cacacacacacacacacacacacaca

SEQ ID NO: 380938 - RNA, 26 nt, Human
cacacacacacacacacacacacaca

SEQ ID NO: 380939 - RNA, 31 nt, Human
caccaacgcacacacacacacacacacacag

SEQ ID NO: 380940 - RNA, 23 nt, Human
cagaaacacuaaggucacaacua

SEQ ID NO: 380941 - RNA, 22 nt, Human
cauggaauuaaaacauccacaa

SEQ ID NO: 380942 - RNA, 26 nt, Human
ccaacgcacacacacacacacacaca

SEQ ID NO: 380943 - RNA, 19 nt, Human
cccgcucgcucccucccuc

SEQ ID NO: 380944 - RNA, 26 nt, Human
ccgcccggggugacggcuccggccgc

SEQ ID NO: 380945 - RNA, 24 nt, Human
ccucccgccggggcccgcgggggc

SEQ ID NO: 380946 - RNA, 23 nt, Human
cgacucuccucccgccggggccc

SEQ ID NO: 380947 - RNA, 20 nt, Human
cgcacacacacacacacaca

SEQ ID NO: 380948 - RNA, 25 nt, Human
cgcacacacacacacacacacacac

SEQ ID NO: 380949 - RNA, 21 nt, Human
cgcacucccuucgcuggugcc

SEQ ID NO: 380950 - RNA, 24 nt, Human
cgcccgcccgcucgcucccucccu

SEQ ID NO: 380951 - RNA, 21 nt, Human
cugucuggcuugcccgcccgc

SEQ ID NO: 380952 - RNA, 20 nt, Human
gaagaugaagaagcugaaga

SEQ ID NO: 380953 - RNA, 26 nt, Human
gaagcgauucauggaauuaaaacauc

SEQ ID NO: 380954 - RNA, 18 nt, Human
gcgcgccgcucacgcgcg

SEQ ID NO: 380955 - RNA, 21 nt, Human
gcgcgccgcucacgcgcggag

SEQ ID NO: 380956 - RNA, 23 nt, Human
gcgcuggguccccgcccgggguc

SEQ ID NO: 380957 - RNA, 21 nt, Human
ggggcccgcgggggcgcgcgc

SEQ ID NO: 380958 - RNA, 26 nt, Human
gugcaccaacgcacacacacacacag

SEQ ID NO: 380959 - RNA, 27 nt, Human
uaaaacauccacaagagugauuccucc

SEQ ID NO: 380960 - RNA, 20 nt, Human
ucaaaagagaagcgauucau

SEQ ID NO: 380961 - RNA, 22 nt, Human
uccucuggugaagaugaagaag

SEQ ID NO: 380962 - RNA, 18 nt, Human
ucgcucccucccucggcc

SEQ ID NO: 380963 - RNA, 23 nt, Human
ugaagaagcugaagauggagagg

SEQ ID NO: 380964 - RNA, 24 nt, Human
ugcgcuggguccccgcccggggug

SEQ ID NO: 380965 - RNA, 19 nt, Human
aaaagaaaaauaagauaaa

SEQ ID NO: 380966 - RNA, 24 nt, Human
aaaagaaaaauaagauaaagcaca

SEQ ID NO: 380967 - RNA, 20 nt, Human
aaccuguacuaguaaccaca

SEQ ID NO: 380968 - RNA, 24 nt, Human
aacgcugucacuggcuggcucagg

SEQ ID NO: 380969 - RNA, 18 nt, Human
aauauccucuaucccugg

SEQ ID NO: 380970 - RNA, 23 nt, Human
acacacacacacacacacacaca

SEQ ID NO: 380971 - RNA, 21 nt, Human
acacacauacauacacacaca

SEQ ID NO: 380972 - RNA, 20 nt, Human
acacuccucucccguccucc

SEQ ID NO: 380973 - RNA, 23 nt, Human
acauacauacacacacacacaca

SEQ ID NO: 380974 - RNA, 19 nt, Human
accuccccccuuccaccac

SEQ ID NO: 380975 - RNA, 21 nt, Human
acuggcuggcucaggcagcug

SEQ ID NO: 380976 - RNA, 18 nt, Human
acuugcugcugucuucug

SEQ ID NO: 380977 - RNA, 26 nt, Human
agaccccuccuaugcucccacccagg

SEQ ID NO: 380978 - RNA, 20 nt, Human
agcacacuugcugcugucuu

SEQ ID NO: 380979 - RNA, 21 nt, Human
aggaggggcugugcccccaag

SEQ ID NO: 380980 - RNA, 18 nt, Human
aggaguagguggggauag

SEQ ID NO: 380981 - RNA, 23 nt, Human
aggcaaaagcagauagacacaug

SEQ ID NO: 380982 - RNA, 24 nt, Human
aggcaaaagcagauagacacaugg

SEQ ID NO: 380983 - RNA, 26 nt, Human
aggcauguuggggcgugucucagagc

SEQ ID NO: 380984 - RNA, 20 nt, Human
agggccacauggccaggccu

SEQ ID NO: 380985 - RNA, 29 nt, Human
auaaagcacacacauacauacacacacac

SEQ ID NO: 380986 - RNA, 23 nt, Human
auagucucauacacguaucagaa

SEQ ID NO: 380987 - RNA, 18 nt, Human
auggggcaacagaaaagg

SEQ ID NO: 380988 - RNA, 20 nt, Human
cacacacacacacacacaca

SEQ ID NO: 380989 - RNA, 20 nt, Human
cacacacacacacacacaca

SEQ ID NO: 380990 - RNA, 20 nt, Human
cacacacacacacacacaca

SEQ ID NO: 380991 - RNA, 20 nt, Human
cacacacacacacacacaca

SEQ ID NO: 380992 - RNA, 20 nt, Human
cacacacacacacacacaca

SEQ ID NO: 380993 - RNA, 22 nt, Human
cacacacacacacacacacaca

SEQ ID NO: 380994 - RNA, 22 nt, Human
cacacacacacacacacacaca

SEQ ID NO: 380995 - RNA, 22 nt, Human
cacacacacacacacacacaca

SEQ ID NO: 380996 - RNA, 26 nt, Human
cacacacacacacacacacacacaca

SEQ ID NO: 380997 - RNA, 26 nt, Human
cacacacacacacacacacacacaca

SEQ ID NO: 380998 - RNA, 24 nt, Human
cacacacacacacacacacacacu

SEQ ID NO: 380999 - RNA, 22 nt, Human
cacacacauacauacacacaca

SEQ ID NO: 381000 - RNA, 24 nt, Human
cacacacauacauacacacacaca

SEQ ID NO: 381001 - RNA, 21 nt, Human
cacacuccucucccguccucc

SEQ ID NO: 381002 - RNA, 18 nt, Human
cacagccacuuggaccca

SEQ ID NO: 381003 - RNA, 22 nt, Human
caccaccaccaaaaagaaaaau

SEQ ID NO: 381004 - RNA, 19 nt, Human
cacccagggucccuugagc

SEQ ID NO: 381005 - RNA, 25 nt, Human
cacccagggucccuugagcugcuuc

SEQ ID NO: 381006 - RNA, 20 nt, Human
cacccuggcucccaggcagc

SEQ ID NO: 381007 - RNA, 18 nt, Human
caccuccccccuuccacc

SEQ ID NO: 381008 - RNA, 19 nt, Human
caccuggcuaacaggaauu

SEQ ID NO: 381009 - RNA, 22 nt, Human
cacguucacacagcuauacacg

SEQ ID NO: 381010 - RNA, 20 nt, Human
cagaccccuccuaugcuccc

SEQ ID NO: 381011 - RNA, 21 nt, Human
cagcauuggagguguggagcc

SEQ ID NO: 381012 - RNA, 22 nt, Human
cagcauuggagguguggagcca

SEQ ID NO: 381013 - RNA, 22 nt, Human
cagcuauacacgaagaaucuca

SEQ ID NO: 381014 - RNA, 21 nt, Human
caggugcaggcauguuggggc

SEQ ID NO: 381015 - RNA, 20 nt, Human
caguggcugccccagcccgc

SEQ ID NO: 381016 - RNA, 25 nt, Human
cauacacacacacacacacacacac

SEQ ID NO: 381017 - RNA, 24 nt, Human
ccaccaccaccaaaaagaaaaaua

SEQ ID NO: 381018 - RNA, 28 nt, Human
ccaccaccaccaccaaaaaggccucggc

SEQ ID NO: 381019 - RNA, 21 nt, Human
ccacccagggucccuugagcu

SEQ ID NO: 381020 - RNA, 24 nt, Human
ccagggucccuugagcugcuuccc

SEQ ID NO: 381021 - RNA, 19 nt, Human
ccccaaggacccucccccc

SEQ ID NO: 381022 - RNA, 24 nt, Human
ccccaucacccucagagagcucug

SEQ ID NO: 381023 - RNA, 25 nt, Human
cccccaaggacccuccccccgacuc

SEQ ID NO: 381024 - RNA, 20 nt, Human
cccccgacuccccuugcccc

SEQ ID NO: 381025 - RNA, 20 nt, Human
cccccuuccaccaccaccac

SEQ ID NO: 381026 - RNA, 21 nt, Human
ccccgacuccccuugccccuc

SEQ ID NO: 381027 - RNA, 18 nt, Human
ccccuccugcucagcccc

SEQ ID NO: 381028 - RNA, 21 nt, Human
cccugcuagcaccuccccccu

SEQ ID NO: 381029 - RNA, 20 nt, Human
ccgacuccccuugccccucc

SEQ ID NO: 381030 - RNA, 18 nt, Human
ccuaugcucccacccagg

SEQ ID NO: 381031 - RNA, 18 nt, Human
ccuccuaugcucccaccc

SEQ ID NO: 381032 - RNA, 20 nt, Human
ccuccuaugcucccacccag

SEQ ID NO: 381033 - RNA, 19 nt, Human
ccugccuauccguccuagg

SEQ ID NO: 381034 - RNA, 23 nt, Human
ccugcuagcaccuccccccuucc

SEQ ID NO: 381035 - RNA, 20 nt, Human
ccugugcucuuacccagccc

SEQ ID NO: 381036 - RNA, 24 nt, Human
ccuuccaccaccaccaccaaaaag

SEQ ID NO: 381037 - RNA, 19 nt, Human
cgacuccccuugccccucc

SEQ ID NO: 381038 - RNA, 23 nt, Human
cuagcaccuccccccuuccacca

SEQ ID NO: 381039 - RNA, 20 nt, Human
cuggacccagacucucaccc

SEQ ID NO: 381040 - RNA, 20 nt, Human
cuggggggcaucugcaggug

SEQ ID NO: 381041 - RNA, 25 nt, Human
cugggggugaggcuggucaaagggc

SEQ ID NO: 381042 - RNA, 20 nt, Human
cugucucuuuggguucuccc

SEQ ID NO: 381043 - RNA, 18 nt, Human
cuugcugcugucuucugu

SEQ ID NO: 381044 - RNA, 25 nt, Human
cuuuggguucucccuccccuaaggg

SEQ ID NO: 381045 - RNA, 29 nt, Human
gaagccuuccaugcccuaaccugugcucu

SEQ ID NO: 381046 - RNA, 23 nt, Human
gacccacuugggcacagucagac

SEQ ID NO: 381047 - RNA, 25 nt, Human
gagcugucucuuugggucggguucc

SEQ ID NO: 381048 - RNA, 21 nt, Human
gaguucaaggcuggcccugcu

SEQ ID NO: 381049 - RNA, 21 nt, Human
gcaaaagcagauagacacaug

SEQ ID NO: 381050 - RNA, 21 nt, Human
gcaaccccucugcugucuucu

SEQ ID NO: 381051 - RNA, 18 nt, Human
gcaggucuguggggguag

SEQ ID NO: 381052 - RNA, 24 nt, Human
gcccccaaggacccuccccccgac

SEQ ID NO: 381053 - RNA, 18 nt, Human
gcucagccccaucacccu

SEQ ID NO: 381054 - RNA, 20 nt, Human
gcucaucuggcccaggcugg

SEQ ID NO: 381055 - RNA, 22 nt, Human
gcugcaggugcaggcauguugg

SEQ ID NO: 381056 - RNA, 18 nt, Human
gcuggggggcaucugcag

SEQ ID NO: 381057 - RNA, 22 nt, Human
gcugucuucucccuuucucagc

SEQ ID NO: 381058 - RNA, 19 nt, Human
ggaauaugucuucaccaag

SEQ ID NO: 381059 - RNA, 22 nt, Human
ggaaugauagaaaggaaggagu

SEQ ID NO: 381060 - RNA, 18 nt, Human
ggcuccacccacugugca

SEQ ID NO: 381061 - RNA, 19 nt, Human
ggcugcaggaggggcugug

SEQ ID NO: 381062 - RNA, 18 nt, Human
ggcuuaggaucuaugacc

SEQ ID NO: 381063 - RNA, 19 nt, Human
gggauaggggagugaaggg

SEQ ID NO: 381064 - RNA, 21 nt, Human
ggggauggagugagagugugg

SEQ ID NO: 381065 - RNA, 21 nt, Human
ggggauggagugagagugugg

SEQ ID NO: 381066 - RNA, 22 nt, Human
ggggugaggcuggucaaagggc

SEQ ID NO: 381067 - RNA, 20 nt, Human
gggucagaaugggcggagaa

SEQ ID NO: 381068 - RNA, 19 nt, Human
gguggauggggcaacagaa

SEQ ID NO: 381069 - RNA, 21 nt, Human
gugugugcgugcgugugcgcg

SEQ ID NO: 381070 - RNA, 31 nt, Human
uaagauaaagcacacacauacauacacacag

SEQ ID NO: 381071 - RNA, 20 nt, Human
uacacacacacacacacaca

SEQ ID NO: 381072 - RNA, 25 nt, Human
uacacacacacacacacacacacac

SEQ ID NO: 381073 - RNA, 24 nt, Human
uacauacacacacacacacacaca

SEQ ID NO: 381074 - RNA, 26 nt, Human
uacauacacacacacacacacacaca

SEQ ID NO: 381075 - RNA, 19 nt, Human
uacuaguaaccacaugucc

SEQ ID NO: 381076 - RNA, 21 nt, Human
uaguagaagagcugucucuuu

SEQ ID NO: 381077 - RNA, 19 nt, Human
uagugagguccuguucagu

SEQ ID NO: 381078 - RNA, 20 nt, Human
uaucagaagccuccaccugg

SEQ ID NO: 381079 - RNA, 19 nt, Human
uaugcucccacccaggguc

SEQ ID NO: 381080 - RNA, 23 nt, Human
uauguggucaugcaacuaaggug

SEQ ID NO: 381081 - RNA, 22 nt, Human
uaugugugugugcgugcgugug

SEQ ID NO: 381082 - RNA, 19 nt, Human
ucagggcaaaaccuguacu

SEQ ID NO: 381083 - RNA, 20 nt, Human
uccaccaccaccaccaaaaa

SEQ ID NO: 381084 - RNA, 22 nt, Human
uccccccgacuccccuugcccc

SEQ ID NO: 381085 - RNA, 18 nt, Human
uccucucccguccucccu

SEQ ID NO: 381086 - RNA, 24 nt, Human
ucuaugaccccugccuugagaggg

SEQ ID NO: 381087 - RNA, 24 nt, Human
ucucccguccucccucuucagugu

SEQ ID NO: 381088 - RNA, 22 nt, Human
ucugcugucuucucccuuucuc

SEQ ID NO: 381089 - RNA, 22 nt, Human
ucuucaccaauccaagugcccu

SEQ ID NO: 381090 - RNA, 18 nt, Human
ugaggcuggucaaagggc

SEQ ID NO: 381091 - RNA, 20 nt, Human
ugauacggggggauggaguu

SEQ ID NO: 381092 - RNA, 19 nt, Human
ugcaggugaggcuccugga

SEQ ID NO: 381093 - RNA, 24 nt, Human
ugcaggugcaggcauguuggggcg

SEQ ID NO: 381094 - RNA, 22 nt, Human
ugccccagcccgcuguuuccgg

SEQ ID NO: 381095 - RNA, 18 nt, Human
ugcgugugcgcgcugcag

SEQ ID NO: 381096 - RNA, 24 nt, Human
uggagguugccucggcaaccccuc

SEQ ID NO: 381097 - RNA, 21 nt, Human
uggcgguggauggggcaacag

SEQ ID NO: 381098 - RNA, 21 nt, Human
uggcucaggcagcugucuucc

SEQ ID NO: 381099 - RNA, 18 nt, Human
uggcugccccagcccgcu

SEQ ID NO: 381100 - RNA, 19 nt, Human
ugggacauugagaucccag

SEQ ID NO: 381101 - RNA, 21 nt, Human
ugggauaggggagugaaggga

SEQ ID NO: 381102 - RNA, 20 nt, Human
uggggcgugucucagagccu

SEQ ID NO: 381103 - RNA, 21 nt, Human
ugggguuggcccuuaggucca

SEQ ID NO: 381104 - RNA, 22 nt, Human
ugucacagccacuuggacccac

SEQ ID NO: 381105 - RNA, 20 nt, Human
ugucacuggcuggcucaggc

SEQ ID NO: 381106 - RNA, 19 nt, Human
uguccagagcaggucugug

SEQ ID NO: 381107 - RNA, 21 nt, Human
ugugcucuuacccagcccccc

SEQ ID NO: 381108 - RNA, 19 nt, Human
ugugguggguacaccuggg

SEQ ID NO: 381109 - RNA, 23 nt, Human
ugugugcgugcgugugcgcgcug

SEQ ID NO: 381110 - RNA, 20 nt, Human
uguucagugggaggcagcag

SEQ ID NO: 381111 - RNA, 19 nt, Human
uuccagucagugcuggaag

SEQ ID NO: 381112 - RNA, 24 nt, Human
uuggguucucccuccagcugggau

SEQ ID NO: 381113 - RNA, 20 nt, Human
uuuauggcuuaggaucuaug

SEQ ID NO: 381114 - RNA, 18 nt, Human
uuucagauuguguacagu

SEQ ID NO: 381115 - RNA, 21 nt, Human
uuuuuuuuuuuuuuuuuucag

SEQ ID NO: 381116 - RNA, 26 nt, Human
auugcaauuauaucaucaagugacaa

SEQ ID NO: 381117 - RNA, 23 nt, Human
caucaagugacaauugaaaaggg

SEQ ID NO: 381118 - RNA, 20 nt, Human
cauuugcauugcucuuugau

SEQ ID NO: 381119 - RNA, 26 nt, Human
cucaauaaucauguccugcaguuacu

SEQ ID NO: 381120 - RNA, 19 nt, Human
gagacuacagaaguaguga

SEQ ID NO: 381121 - RNA, 25 nt, Human
ucaagugacaauugaaaaggcaagu

SEQ ID NO: 381122 - RNA, 27 nt, Human
aaaaagaccaaacacggaggugcccag

SEQ ID NO: 381123 - RNA, 28 nt, Human
aaaaagaccaaacacggaggugcccagg

SEQ ID NO: 381124 - RNA, 18 nt, Human
aaaagaccaaacacggag

SEQ ID NO: 381125 - RNA, 20 nt, Human
aaagcaguuucaguauuuuc

SEQ ID NO: 381126 - RNA, 18 nt, Human
aaauaaaaauggaaccaa

SEQ ID NO: 381127 - RNA, 21 nt, Human
aaaugaucaucuaaaguuuaa

SEQ ID NO: 381128 - RNA, 22 nt, Human
aagaaggaaaaaagggagagga

SEQ ID NO: 381129 - RNA, 18 nt, Human
aaggaagaaggaaaaaag

SEQ ID NO: 381130 - RNA, 25 nt, Human
aagucagucucagacaaguuuccaa

SEQ ID NO: 381131 - RNA, 22 nt, Human
aaucgcugaccugggaggugga

SEQ ID NO: 381132 - RNA, 19 nt, Human
aauggaaccaaaugaucau

SEQ ID NO: 381133 - RNA, 20 nt, Human
acaagagcaaaacuccaccu

SEQ ID NO: 381134 - RNA, 25 nt, Human
acacaacaucaaaagcaagggaacc

SEQ ID NO: 381135 - RNA, 26 nt, Human
acacaacaucaaaagcaagggaacgc

SEQ ID NO: 381136 - RNA, 18 nt, Human
acaguaacacaacaucaa

SEQ ID NO: 381137 - RNA, 18 nt, Human
acaguagggguuaugcuu

SEQ ID NO: 381138 - RNA, 18 nt, Human
accacauacacauggaua

SEQ ID NO: 381139 - RNA, 18 nt, Human
accccagcacaguccagc

SEQ ID NO: 381140 - RNA, 23 nt, Human
accuuuuuuaaaaagagggcguu

SEQ ID NO: 381141 - RNA, 22 nt, Human
acgccacugcacuccagccugg

SEQ ID NO: 381142 - RNA, 24 nt, Human
acgccacugcacuccagccugggc

SEQ ID NO: 381143 - RNA, 19 nt, Human
acgcugaagagcgcucagg

SEQ ID NO: 381144 - RNA, 18 nt, Human
acugcacuccagccuggg

SEQ ID NO: 381145 - RNA, 19 nt, Human
acugcacuccagccugggc

SEQ ID NO: 381146 - RNA, 25 nt, Human
acugcacuccagccugggcgacaag

SEQ ID NO: 381147 - RNA, 22 nt, Human
agaaaaauuccagcguaaacaa

SEQ ID NO: 381148 - RNA, 19 nt, Human
agaggaagaagggacgaag

SEQ ID NO: 381149 - RNA, 21 nt, Human
aggaagcgggagccgagagag

SEQ ID NO: 381150 - RNA, 25 nt, Human
agggagaggaagaagggacgaaggg

SEQ ID NO: 381151 - RNA, 18 nt, Human
agguggagguugcaguga

SEQ ID NO: 381152 - RNA, 24 nt, Human
agguggagguugcagugagccgag

SEQ ID NO: 381153 - RNA, 23 nt, Human
aguccagccggccacagccgccu

SEQ ID NO: 381154 - RNA, 24 nt, Human
aucacgccacugcacuccagccug

SEQ ID NO: 381155 - RNA, 19 nt, Human
aucacugaaacuguccugg

SEQ ID NO: 381156 - RNA, 21 nt, Human
caaagcaguuucaguauuuuc

SEQ ID NO: 381157 - RNA, 23 nt, Human
caaaugaucaucuaaaguuuaaa

SEQ ID NO: 381158 - RNA, 22 nt, Human
caacacagcuguauacagaaac

SEQ ID NO: 381159 - RNA, 24 nt, Human
cacaacaucaaaagcaacacagcu

SEQ ID NO: 381160 - RNA, 26 nt, Human
cacaguccagccggccacagccgccu

SEQ ID NO: 381161 - RNA, 24 nt, Human
cacuccagccugggcgacaagagc

SEQ ID NO: 381162 - RNA, 22 nt, Human
cacucuggaaaaucacucugca

SEQ ID NO: 381163 - RNA, 19 nt, Human
cacugcacuccagccuggg

SEQ ID NO: 381164 - RNA, 21 nt, Human
cacugcacuccagccugggcg

SEQ ID NO: 381165 - RNA, 22 nt, Human
cacugcacuccagccugggcga

SEQ ID NO: 381166 - RNA, 23 nt, Human
cacugcacuccagccugggcgac

SEQ ID NO: 381167 - RNA, 24 nt, Human
cacugcacuccagccugggcgaca

SEQ ID NO: 381168 - RNA, 23 nt, Human
cagcacaguccagccggccacag

SEQ ID NO: 381169 - RNA, 21 nt, Human
cagcccuaauggagauguaau

SEQ ID NO: 381170 - RNA, 21 nt, Human
cagccggccacagccgccucc

SEQ ID NO: 381171 - RNA, 24 nt, Human
cagccggccacagccgccuccuug

SEQ ID NO: 381172 - RNA, 24 nt, Human
cagguuuauauggacuacauggag

SEQ ID NO: 381173 - RNA, 21 nt, Human
cagugcacacacuucugugua

SEQ ID NO: 381174 - RNA, 23 nt, Human
cagugcacacacuucuguguaca

SEQ ID NO: 381175 - RNA, 25 nt, Human
caguucugagagguuaagugguuaa

SEQ ID NO: 381176 - RNA, 25 nt, Human
caguucugagagguuaagugguuaa

SEQ ID NO: 381177 - RNA, 20 nt, Human
ccacugcacuccagccuggg

SEQ ID NO: 381178 - RNA, 21 nt, Human
ccacugcacuccagccugggc

SEQ ID NO: 381179 - RNA, 21 nt, Human
ccacugcacuccagccugggc

SEQ ID NO: 381180 - RNA, 23 nt, Human
ccacugcacuccagccugggcga

SEQ ID NO: 381181 - RNA, 23 nt, Human
ccacugcacuccagccugggcga

SEQ ID NO: 381182 - RNA, 24 nt, Human
ccacugcacuccagccugggcgac

SEQ ID NO: 381183 - RNA, 24 nt, Human
ccagcacaguccagccggccacag

SEQ ID NO: 381184 - RNA, 18 nt, Human
ccaggacuguuucagcug

SEQ ID NO: 381185 - RNA, 20 nt, Human
ccauggggagaaaaauucca

SEQ ID NO: 381186 - RNA, 19 nt, Human
ccgccgggccggggggggg

SEQ ID NO: 381187 - RNA, 21 nt, Human
ccugggagguggagguugcag

SEQ ID NO: 381188 - RNA, 22 nt, Human
ccuguuugcauuaacaaaaaua

SEQ ID NO: 381189 - RNA, 23 nt, Human
ccuguuugcauuaacaaaaauaa

SEQ ID NO: 381190 - RNA, 21 nt, Human
cgacaagagcaaaacuccacc

SEQ ID NO: 381191 - RNA, 19 nt, Human
cgcgcaaacgcugaagagc

SEQ ID NO: 381192 - RNA, 24 nt, Human
cuccuguaaucucagcuuaucggg

SEQ ID NO: 381193 - RNA, 20 nt, Human
cucgcagggcuaccagguuu

SEQ ID NO: 381194 - RNA, 21 nt, Human
cucucuggcauggcuguccag

SEQ ID NO: 381195 - RNA, 23 nt, Human
cugaccugggagguggagguugc

SEQ ID NO: 381196 - RNA, 21 nt, Human
cuuuaaaacagagaucaaagu

SEQ ID NO: 381197 - RNA, 20 nt, Human
cuuucuggcugcugcuccgg

SEQ ID NO: 381198 - RNA, 23 nt, Human
cuuucuuuuuuaaaaagagggcg

SEQ ID NO: 381199 - RNA, 25 nt, Human
cuuucuuuuuuaaaaagagggcguu

SEQ ID NO: 381200 - RNA, 25 nt, Human
cuuucuuuuuuaaaaagagggcguu

SEQ ID NO: 381201 - RNA, 22 nt, Human
gaagagaaagcaguggugaugg

SEQ ID NO: 381202 - RNA, 19 nt, Human
gaaggaagaaggaaaaaag

SEQ ID NO: 381203 - RNA, 20 nt, Human
gaaggaagaaggaaaaaagg

SEQ ID NO: 381204 - RNA, 18 nt, Human
gaagggagggaagaggcg

SEQ ID NO: 381205 - RNA, 21 nt, Human
gaagggagggaagaggcggag

SEQ ID NO: 381206 - RNA, 22 nt, Human
gacaagagcaaaacuccaccug

SEQ ID NO: 381207 - RNA, 24 nt, Human
gaccgccaggucaccgaguggcca

SEQ ID NO: 381208 - RNA, 24 nt, Human
gagaggaagaagggacgaagggag

SEQ ID NO: 381209 - RNA, 23 nt, Human
gagaucacgccacugcacuccag

SEQ ID NO: 381210 - RNA, 19 nt, Human
gaggugcccagggugugga

SEQ ID NO: 381211 - RNA, 22 nt, Human
gagguugcagugagccgagauc

SEQ ID NO: 381212 - RNA, 20 nt, Human
gaguggccguggaggaggcc

SEQ ID NO: 381213 - RNA, 22 nt, Human
gccacugcacuccagccugggc

SEQ ID NO: 381214 - RNA, 24 nt, Human
gccacugcacuccagccugggcga

SEQ ID NO: 381215 - RNA, 20 nt, Human
gccaucacaacaaaccccag

SEQ ID NO: 381216 - RNA, 20 nt, Human
gccgagaucacgccacugca

SEQ ID NO: 381217 - RNA, 19 nt, Human
gcugcugcuccggacucgu

SEQ ID NO: 381218 - RNA, 24 nt, Human
ggagaaaaauuccagcguaaacaa

SEQ ID NO: 381219 - RNA, 20 nt, Human
ggaggggaaggaagaaggaa

SEQ ID NO: 381220 - RNA, 20 nt, Human
ggagguugcagugagccgag

SEQ ID NO: 381221 - RNA, 22 nt, Human
ggagguugcagugagccgagau

SEQ ID NO: 381222 - RNA, 23 nt, Human
ggagguugcagugagccgagauc

SEQ ID NO: 381223 - RNA, 24 nt, Human
ggagguugcagugagccgagauca

SEQ ID NO: 381224 - RNA, 21 nt, Human
ggccgggggggggaggcgguc

SEQ ID NO: 381225 - RNA, 19 nt, Human
ggccggucaaaggccucuc

SEQ ID NO: 381226 - RNA, 18 nt, Human
ggcgguggcggcgaggag

SEQ ID NO: 381227 - RNA, 19 nt, Human
ggcgguggcggcgaggagg

SEQ ID NO: 381228 - RNA, 22 nt, Human
gggaggcugaagugggaaaauc

SEQ ID NO: 381229 - RNA, 24 nt, Human
gggccgggggggggaggcgguccu

SEQ ID NO: 381230 - RNA, 24 nt, Human
ggggaaaaaaaagaccaaacacgg

SEQ ID NO: 381231 - RNA, 25 nt, Human
ggggaaggaagaaggaaaaaaggga

SEQ ID NO: 381232 - RNA, 21 nt, Human
guccaauuuauacaacugugg

SEQ ID NO: 381233 - RNA, 23 nt, Human
guccaauuuauacaacuguggga

SEQ ID NO: 381234 - RNA, 20 nt, Human
gugcacacacuucuguguac

SEQ ID NO: 381235 - RNA, 19 nt, Human
guugcagugagccgagauc

SEQ ID NO: 381236 - RNA, 24 nt, Human
uaacacaacaucaaaagcaacaca

SEQ ID NO: 381237 - RNA, 18 nt, Human
uaacucgcagggcuacca

SEQ ID NO: 381238 - RNA, 22 nt, Human
uaauaaacucuggcugcugcuc

SEQ ID NO: 381239 - RNA, 23 nt, Human
uacaguagggguuaugcuuucug

SEQ ID NO: 381240 - RNA, 22 nt, Human
uauauggacuacauggagauca

SEQ ID NO: 381241 - RNA, 22 nt, Human
uauccuguaguguagugaaagc

SEQ ID NO: 381242 - RNA, 22 nt, Human
ucaaaggccucucucuggcaug

SEQ ID NO: 381243 - RNA, 21 nt, Human
ucaaaguucauuuaaguccug

SEQ ID NO: 381244 - RNA, 18 nt, Human
ucacaacaaaccccagca

SEQ ID NO: 381245 - RNA, 22 nt, Human
ucacaacaaaccccagcacagu

SEQ ID NO: 381246 - RNA, 23 nt, Human
ucacacaggggaaaaaaaagacc

SEQ ID NO: 381247 - RNA, 23 nt, Human
ucacgccacugcacuccagccug

SEQ ID NO: 381248 - RNA, 19 nt, Human
ucacugaaacuguccuggg

SEQ ID NO: 381249 - RNA, 28 nt, Human
ucacugaaacuguccuggguuggacccc

SEQ ID NO: 381250 - RNA, 18 nt, Human
ucagcccuaauggagaug

SEQ ID NO: 381251 - RNA, 21 nt, Human
ucagcccuaauggagauguaa

SEQ ID NO: 381252 - RNA, 25 nt, Human
ucagugcacacacuucuguguacag

SEQ ID NO: 381253 - RNA, 19 nt, Human
uccaaauuuucaaagcagu

SEQ ID NO: 381254 - RNA, 19 nt, Human
uccagccugggcgacaaga

SEQ ID NO: 381255 - RNA, 19 nt, Human
uccaggacuguuucagcug

SEQ ID NO: 381256 - RNA, 19 nt, Human
uccauggggagaaaaauuc

SEQ ID NO: 381257 - RNA, 21 nt, Human
ucccccggccggcgguccugg

SEQ ID NO: 381258 - RNA, 20 nt, Human
uccuguaguguagugaaagc

SEQ ID NO: 381259 - RNA, 22 nt, Human
ucgcugaccugggagguggagg

SEQ ID NO: 381260 - RNA, 21 nt, Human
ucucuggcauggcuguccagg

SEQ ID NO: 381261 - RNA, 18 nt, Human
ucuuccccacaggcagcu

SEQ ID NO: 381262 - RNA, 19 nt, Human
ucuuuuuuaaaaagagggc

SEQ ID NO: 381263 - RNA, 19 nt, Human
ugaaacuaagaauacagau

SEQ ID NO: 381264 - RNA, 23 nt, Human
ugaccugggagguggagguugca

SEQ ID NO: 381265 - RNA, 20 nt, Human
ugagaaauucucaaaugaaa

SEQ ID NO: 381266 - RNA, 22 nt, Human
ugagccgagaucacgccacugc

SEQ ID NO: 381267 - RNA, 28 nt, Human
ugcauuaacaaaaauaaaaaugaaauaa

SEQ ID NO: 381268 - RNA, 22 nt, Human
ugcuaugaagucuaaaguucua

SEQ ID NO: 381269 - RNA, 23 nt, Human
ugcugcccacauccuuuacccac

SEQ ID NO: 381270 - RNA, 22 nt, Human
ugcugcuggcugcugcuccgga

SEQ ID NO: 381271 - RNA, 19 nt, Human
uggaagcaguacuuaacuc

SEQ ID NO: 381272 - RNA, 20 nt, Human
uggagguugcagugagccga

SEQ ID NO: 381273 - RNA, 20 nt, Human
uggagguugcagugagccgg

SEQ ID NO: 381274 - RNA, 19 nt, Human
uggcauggcuguccagggu

SEQ ID NO: 381275 - RNA, 22 nt, Human
uggcauggcuguccaggguucu

SEQ ID NO: 381276 - RNA, 22 nt, Human
uggccaucacaacaaaccccag

SEQ ID NO: 381277 - RNA, 18 nt, Human
uggcggcgaggaggggaa

SEQ ID NO: 381278 - RNA, 20 nt, Human
ugggaaaaucgcugaccugg

SEQ ID NO: 381279 - RNA, 18 nt, Human
ugggagguggagguugca

SEQ ID NO: 381280 - RNA, 29 nt, Human
ugggagguggagguugcagugacaacggu

SEQ ID NO: 381281 - RNA, 24 nt, Human
ugggagguggagguugcagugagc

SEQ ID NO: 381282 - RNA, 21 nt, Human
ugggcgguggcggcgaggagg

SEQ ID NO: 381283 - RNA, 19 nt, Human
ugucccgggagaaccagcu

SEQ ID NO: 381284 - RNA, 21 nt, Human
uguccuggguuagucaaugaa

SEQ ID NO: 381285 - RNA, 20 nt, Human
ugucuaaccacauacacaug

SEQ ID NO: 381286 - RNA, 19 nt, Human
uuaauaaacuccuguaauc

SEQ ID NO: 381287 - RNA, 18 nt, Human
uuacuuacauuccauggg

SEQ ID NO: 381288 - RNA, 23 nt, Human
uuagcucuggggccggucaaagg

SEQ ID NO: 381289 - RNA, 24 nt, Human
uuccaggaacaauguugucuuugu

SEQ ID NO: 381290 - RNA, 24 nt, Human
uuccaggaacaauguugucuuugu

SEQ ID NO: 381291 - RNA, 22 nt, Human
uuccauggggagaaaaauucca

SEQ ID NO: 381292 - RNA, 18 nt, Human
uucuucuuucacacaggg

SEQ ID NO: 381293 - RNA, 18 nt, Human
uugcagugagccgagauc

SEQ ID NO: 381294 - RNA, 20 nt, Human
uugcagugagccgagaucac

SEQ ID NO: 381295 - RNA, 21 nt, Human
uugcagugagccgagaucacg

SEQ ID NO: 381296 - RNA, 18 nt, Human
uuuauacaacugugggag

SEQ ID NO: 381297 - RNA, 22 nt, Human
uuugauuuucucuggugcuuuu

SEQ ID NO: 381298 - RNA, 19 nt, Human
aaaaaaauccgaacaugca

SEQ ID NO: 381299 - RNA, 23 nt, Human
aaaaaaauccgaacaugcaaaau

SEQ ID NO: 381300 - RNA, 18 nt, Human
aaaaaaucaauucagagc

SEQ ID NO: 381301 - RNA, 23 nt, Human
aaaaaaucaauucagagcuugaa

SEQ ID NO: 381302 - RNA, 23 nt, Human
aaaaagaagaaggaaaauggaga

SEQ ID NO: 381303 - RNA, 19 nt, Human
aaaagaagaaggaaaaugg

SEQ ID NO: 381304 - RNA, 22 nt, Human
aaaagaagaaggaaaauggagg

SEQ ID NO: 381305 - RNA, 18 nt, Human
aaaaguucuaaccuagaa

SEQ ID NO: 381306 - RNA, 23 nt, Human
aaacauauaacguguccauaaaa

SEQ ID NO: 381307 - RNA, 23 nt, Human
aaacaugauccaguaaaacaaau

SEQ ID NO: 381308 - RNA, 27 nt, Human
aaagaagaaggaaaauggagaagagac

SEQ ID NO: 381309 - RNA, 23 nt, Human
aacaaaaacaaauucuaaaauug

SEQ ID NO: 381310 - RNA, 19 nt, Human
aacagaaugcaaaauucaa

SEQ ID NO: 381311 - RNA, 21 nt, Human
aacuaagaaaucaagacacag

SEQ ID NO: 381312 - RNA, 25 nt, Human
aacuauaagcuaguuuuagacuacc

SEQ ID NO: 381313 - RNA, 23 nt, Human
aagaagaaggaaaauggagaaga

SEQ ID NO: 381314 - RNA, 23 nt, Human
aagaagaaggaaaauggagaaga

SEQ ID NO: 381315 - RNA, 19 nt, Human
aagaaggaaaauggagaag

SEQ ID NO: 381316 - RNA, 24 nt, Human
aagagauagaugcaccuaaucaag

SEQ ID NO: 381317 - RNA, 19 nt, Human
aagcaaaaaaucaauucag

SEQ ID NO: 381318 - RNA, 21 nt, Human
aagcaaaaaaucaauucagag

SEQ ID NO: 381319 - RNA, 21 nt, Human
aaggcaacuaagaaaucaaga

SEQ ID NO: 381320 - RNA, 18 nt, Human
aauaaauaggggaaaaaa

SEQ ID NO: 381321 - RNA, 18 nt, Human
acacuaacaacuaccugg

SEQ ID NO: 381322 - RNA, 18 nt, Human
accuauaaagaaauaggc

SEQ ID NO: 381323 - RNA, 22 nt, Human
accuguuuauauucauuaguau

SEQ ID NO: 381324 - RNA, 22 nt, Human
acuacaguccaauuaaaacauu

SEQ ID NO: 381325 - RNA, 20 nt, Human
acugcuguaucccucacggc

SEQ ID NO: 381326 - RNA, 22 nt, Human
acuuuguaauacaauauagcug

SEQ ID NO: 381327 - RNA, 23 nt, Human
agaagaaggaaaauggagaagag

SEQ ID NO: 381328 - RNA, 27 nt, Human
agcuacuguaacaacagcuccaagcaa

SEQ ID NO: 381329 - RNA, 18 nt, Human
aggcaacuaagaaaucaa

SEQ ID NO: 381330 - RNA, 21 nt, Human
aggcagcaaaagaauuacuag

SEQ ID NO: 381331 - RNA, 21 nt, Human
aggcagccucuucuugccggg

SEQ ID NO: 381332 - RNA, 23 nt, Human
agucaguucaaaacaugauccag

SEQ ID NO: 381333 - RNA, 23 nt, Human
aguggcauguaggccauacuagc

SEQ ID NO: 381334 - RNA, 23 nt, Human
auaccccccaaaacacaugaccc

SEQ ID NO: 381335 - RNA, 18 nt, Human
auguaaaaaaagggagaa

SEQ ID NO: 381336 - RNA, 23 nt, Human
caaccaaagaagcacaguaauau

SEQ ID NO: 381337 - RNA, 26 nt, Human
caacuaagaaaucaagacacagauau

SEQ ID NO: 381338 - RNA, 24 nt, Human
caagacacagauauuuccccuucc

SEQ ID NO: 381339 - RNA, 20 nt, Human
caauacacucucuacacaca

SEQ ID NO: 381340 - RNA, 18 nt, Human
cagaucuucuagagcauu

SEQ ID NO: 381341 - RNA, 19 nt, Human
caucaaugacagaguauuu

SEQ ID NO: 381342 - RNA, 18 nt, Human
caucacaauuuauuucua

SEQ ID NO: 381343 - RNA, 19 nt, Human
cauguaggccauacuagca

SEQ ID NO: 381344 - RNA, 18 nt, Human
ccaaauagaagacaguga

SEQ ID NO: 381345 - RNA, 19 nt, Human
ccccccaaaacacaugacc

SEQ ID NO: 381346 - RNA, 21 nt, Human
ccccccaaaacacaugaccuu

SEQ ID NO: 381347 - RNA, 21 nt, Human
ccugaaucaauacuagcaacc

SEQ ID NO: 381348 - RNA, 21 nt, Human
cuacuguaacaacagcuccaa

SEQ ID NO: 381349 - RNA, 23 nt, Human
cuacuguaacaacagcuccaagc

SEQ ID NO: 381350 - RNA, 20 nt, Human
cuccaaaaacuucugagccu

SEQ ID NO: 381351 - RNA, 22 nt, Human
cuccuaagguaauagacuucua

SEQ ID NO: 381352 - RNA, 23 nt, Human
cugcuuagcugcagguagugguc

SEQ ID NO: 381353 - RNA, 23 nt, Human
cuuccuagaguuuacaauucuuu

SEQ ID NO: 381354 - RNA, 19 nt, Human
gaacaugcaaaauaccccc

SEQ ID NO: 381355 - RNA, 21 nt, Human
gaacaugcaaaauacccccca

SEQ ID NO: 381356 - RNA, 22 nt, Human
gaacaugcaaaauaccccccaa

SEQ ID NO: 381357 - RNA, 22 nt, Human
gaagacagugaagaauaugaaa

SEQ ID NO: 381358 - RNA, 23 nt, Human
gaagagauagaugcaccuaauca

SEQ ID NO: 381359 - RNA, 20 nt, Human
gcaaaauaccccccaaaaca

SEQ ID NO: 381360 - RNA, 18 nt, Human
gcaaaauuacagcuacug

SEQ ID NO: 381361 - RNA, 20 nt, Human
gcagcaaaagaauuacuaga

SEQ ID NO: 381362 - RNA, 18 nt, Human
ggaagacagagcgaagag

SEQ ID NO: 381363 - RNA, 18 nt, Human
gggcaaggaaagccaaag

SEQ ID NO: 381364 - RNA, 24 nt, Human
guaaaaaucacaauacacagauuu

SEQ ID NO: 381365 - RNA, 28 nt, Human
guaaaacaaauacacauuguuaugccuc

SEQ ID NO: 381366 - RNA, 26 nt, Human
guaaaacaacaaaaacaaauucuaaa

SEQ ID NO: 381367 - RNA, 21 nt, Human
guaucccucacggcuccaaaa

SEQ ID NO: 381368 - RNA, 22 nt, Human
guccuguaauuucuaaacuaca

SEQ ID NO: 381369 - RNA, 20 nt, Human
gugaagggaaaaaaaaaucc

SEQ ID NO: 381370 - RNA, 19 nt, Human
gugguaggcagccucuucu

SEQ ID NO: 381371 - RNA, 21 nt, Human
gugguuaaaauuucagaugac

SEQ ID NO: 381372 - RNA, 23 nt, Human
uaaagaaauaggcuuuaaaacuu

SEQ ID NO: 381373 - RNA, 21 nt, Human
uaacaacagcuccaagcaaaa

SEQ ID NO: 381374 - RNA, 19 nt, Human
uaacagcuucuugaaguuc

SEQ ID NO: 381375 - RNA, 21 nt, Human
uaacuuuaaauuaagugguua

SEQ ID NO: 381376 - RNA, 19 nt, Human
uaagaaaucaagacacaga

SEQ ID NO: 381377 - RNA, 23 nt, Human
uaagaguccaauuagaaacacua

SEQ ID NO: 381378 - RNA, 20 nt, Human
uaaggaauaaagacuaagau

SEQ ID NO: 381379 - RNA, 23 nt, Human
uaagguaaaacaacaaaaacaaa

SEQ ID NO: 381380 - RNA, 22 nt, Human
uaaguuaaacuauaagcuaguu

SEQ ID NO: 381381 - RNA, 20 nt, Human
uaauagaaacaaucuacaug

SEQ ID NO: 381382 - RNA, 22 nt, Human
uacacaauacagaucuucuaga

SEQ ID NO: 381383 - RNA, 21 nt, Human
uacacaauauucaauaagcaa

SEQ ID NO: 381384 - RNA, 18 nt, Human
uacccagugaaacagaau

SEQ ID NO: 381385 - RNA, 20 nt, Human
uaccccccaaaacacaugac

SEQ ID NO: 381386 - RNA, 23 nt, Human
uacccucccuagucaguucaaaa

SEQ ID NO: 381387 - RNA, 23 nt, Human
uagaugcaccuaaucaagaccaa

SEQ ID NO: 381388 - RNA, 21 nt, Human
uauguaaaaaaagggagaacu

SEQ ID NO: 381389 - RNA, 24 nt, Human
uauuaagaguccaauuagaaacac

SEQ ID NO: 381390 - RNA, 21 nt, Human
ucaauaccagcucauucaacc

SEQ ID NO: 381391 - RNA, 25 nt, Human
ucaauacuagcaacagaaugcaaaa

SEQ ID NO: 381392 - RNA, 20 nt, Human
ucccucacggcuccaaaaac

SEQ ID NO: 381393 - RNA, 20 nt, Human
uccuagaguuuacaauucuu

SEQ ID NO: 381394 - RNA, 18 nt, Human
ucuaaccuagaaacacag

SEQ ID NO: 381395 - RNA, 19 nt, Human
ucuaaccuagaaacacaga

SEQ ID NO: 381396 - RNA, 20 nt, Human
ugaaucaauacuagcaacag

SEQ ID NO: 381397 - RNA, 18 nt, Human
ugaaugcaauuugugcuu

SEQ ID NO: 381398 - RNA, 22 nt, Human
ugauuuuugugggguuuuuucc

SEQ ID NO: 381399 - RNA, 18 nt, Human
ugcaccuaaucaagacca

SEQ ID NO: 381400 - RNA, 22 nt, Human
ugcuguaucccucacggcucca

SEQ ID NO: 381401 - RNA, 24 nt, Human
ugugcaauaaaauaaaaaaguucu

SEQ ID NO: 381402 - RNA, 23 nt, Human
uguuuuguuuuuuguuuuugcuu

SEQ ID NO: 381403 - RNA, 19 nt, Human
uuagaaauaaaaacaaauu

SEQ ID NO: 381404 - RNA, 23 nt, Human
uucaaaacaugauccaguaaaac

SEQ ID NO: 381405 - RNA, 20 nt, Human
uucagaaauaaaaguaacag

SEQ ID NO: 381406 - RNA, 18 nt, Human
uuggucuuaaggaauaaa

SEQ ID NO: 381407 - RNA, 20 nt, Human
uuggucuuaaggaauaaaga

SEQ ID NO: 381408 - RNA, 24 nt, Human
uuguuuuguuuuuuguuuuugcuu

SEQ ID NO: 381409 - RNA, 23 nt, Human
uuuguguaucuuugaguucuucu

SEQ ID NO: 381410 - RNA, 23 nt, Human
uuuuguuuuuuguuuuugcuuuu

SEQ ID NO: 381411 - RNA, 19 nt, Human
aaaaaaaaaaaaaaaaaga

SEQ ID NO: 381412 - RNA, 24 nt, Human
aaaaaaaaaaaaaaaagaaaagaa

SEQ ID NO: 381413 - RNA, 23 nt, Human
aaaaaaaagaaaagaaaaaagga

SEQ ID NO: 381414 - RNA, 21 nt, Human
aaaauggacacaacacacaaa

SEQ ID NO: 381415 - RNA, 22 nt, Human
aaacuaaaucuauaugcaauaa

SEQ ID NO: 381416 - RNA, 22 nt, Human
aaagaaaauuagacauuggagg

SEQ ID NO: 381417 - RNA, 23 nt, Human
aaagagaagcaaaaaacuagcaa

SEQ ID NO: 381418 - RNA, 19 nt, Human
aaagucucccaccccauca

SEQ ID NO: 381419 - RNA, 19 nt, Human
aaauggacacaacacacaa

SEQ ID NO: 381420 - RNA, 19 nt, Human
aacuggucuaggucagccc

SEQ ID NO: 381421 - RNA, 22 nt, Human
aagaaaaaaggaaaucuacuga

SEQ ID NO: 381422 - RNA, 19 nt, Human
aagaagaugcaggcucaaa

SEQ ID NO: 381423 - RNA, 18 nt, Human
aagcaaaaaacuagcaac

SEQ ID NO: 381424 - RNA, 22 nt, Human
aaggaaaucuacugaacugaag

SEQ ID NO: 381425 - RNA, 23 nt, Human
aaggggggguaccacgguuugaa

SEQ ID NO: 381426 - RNA, 26 nt, Human
aaguuguuggguuuuuuuuuuuuccu

SEQ ID NO: 381427 - RNA, 19 nt, Human
acaaaggcagcaauguuug

SEQ ID NO: 381428 - RNA, 22 nt, Human
accaaaggcuucauauuaugcu

SEQ ID NO: 381429 - RNA, 26 nt, Human
accagcucuuuuucccucuuucuuuc

SEQ ID NO: 381430 - RNA, 18 nt, Human
accugauuuccaagaggc

SEQ ID NO: 381431 - RNA, 20 nt, Human
acuguuguucauagauaggu

SEQ ID NO: 381432 - RNA, 23 nt, Human
agaaaaaaggaaaucuacugaac

SEQ ID NO: 381433 - RNA, 24 nt, Human
agaaagagagaaauuugcuaggaa

SEQ ID NO: 381434 - RNA, 24 nt, Human
agauacuuuuaaagcucugagcag

SEQ ID NO: 381435 - RNA, 21 nt, Human
agauaucaucguggggagaaa

SEQ ID NO: 381436 - RNA, 20 nt, Human
agccucuggguugagguggg

SEQ ID NO: 381437 - RNA, 19 nt, Human
agcgaguuuggaguggccc

SEQ ID NO: 381438 - RNA, 19 nt, Human
aggcaccgaugaaagggga

SEQ ID NO: 381439 - RNA, 18 nt, Human
aggcagaaugaucacaug

SEQ ID NO: 381440 - RNA, 30 nt, Human
aggucacagccaaaaaaaaaaaaaaaaaaa

SEQ ID NO: 381441 - RNA, 24 nt, Human
aguagccucuggguugaggugggc

SEQ ID NO: 381442 - RNA, 20 nt, Human
agugaagauguggaucugga

SEQ ID NO: 381443 - RNA, 18 nt, Human
auugauuacagaagccua

SEQ ID NO: 381444 - RNA, 18 nt, Human
auuggaggaucaagacca

SEQ ID NO: 381445 - RNA, 22 nt, Human
caaaauggacacaacacacaaa

SEQ ID NO: 381446 - RNA, 24 nt, Human
caaacuggucuaggucagcccccg

SEQ ID NO: 381447 - RNA, 18 nt, Human
caauaaaacguaacacuu

SEQ ID NO: 381448 - RNA, 23 nt, Human
caccgccgcugcugcugcugcug

SEQ ID NO: 381449 - RNA, 21 nt, Human
cagccaaaaaccuaaauauca

SEQ ID NO: 381450 - RNA, 25 nt, Human
cagccccaagucccccggacuaaag

SEQ ID NO: 381451 - RNA, 18 nt, Human
cagcccccgaaucacucu

SEQ ID NO: 381452 - RNA, 18 nt, Human
cagcugccaggacuacuu

SEQ ID NO: 381453 - RNA, 22 nt, Human
cagcugccaggacuacuuuggc

SEQ ID NO: 381454 - RNA, 19 nt, Human
caucauggcagaaaugauc

SEQ ID NO: 381455 - RNA, 24 nt, Human
caugaauguuuuguguuugggggu

SEQ ID NO: 381456 - RNA, 23 nt, Human
ccaaaaaaaaaaaaaaaaaaaaa

SEQ ID NO: 381457 - RNA, 22 nt, Human
ccagcacagauucauaacacga

SEQ ID NO: 381458 - RNA, 20 nt, Human
ccaggaucccuaucacucga

SEQ ID NO: 381459 - RNA, 21 nt, Human
ccaugauauguuucauaaccu

SEQ ID NO: 381460 - RNA, 24 nt, Human
cccaagucccccggacuaaagacc

SEQ ID NO: 381461 - RNA, 21 nt, Human
ccccaagucccccggacuaaa

SEQ ID NO: 381462 - RNA, 19 nt, Human
ccccccuuuccucuuuccc

SEQ ID NO: 381463 - RNA, 20 nt, Human
cccccgaaucacucugcagc

SEQ ID NO: 381464 - RNA, 21 nt, Human
cccccgaaucacucugcagca

SEQ ID NO: 381465 - RNA, 24 nt, Human
cccccggacuaaagaccuaaaggc

SEQ ID NO: 381466 - RNA, 20 nt, Human
ccccugcaguccuaccccuc

SEQ ID NO: 381467 - RNA, 27 nt, Human
ccccugcaguccuaccccuccucccuc

SEQ ID NO: 381468 - RNA, 22 nt, Human
cccggacuaaagaccuaaaggc

SEQ ID NO: 381469 - RNA, 18 nt, Human
cccuccucccucucuucc

SEQ ID NO: 381470 - RNA, 23 nt, Human
ccgccgcugcugcugcugcugcc

SEQ ID NO: 381471 - RNA, 23 nt, Human
ccgccgcugcugcugcugcugcc

SEQ ID NO: 381472 - RNA, 25 nt, Human
ccgccgcugcugcugcugcugcugc

SEQ ID NO: 381473 - RNA, 28 nt, Human
ccgcugcugcugcugcugccaccgguuc

SEQ ID NO: 381474 - RNA, 20 nt, Human
ccgcugcugcugcugcugcu

SEQ ID NO: 381475 - RNA, 23 nt, Human
ccggugccuccgcugcugcugcu

SEQ ID NO: 381476 - RNA, 20 nt, Human
ccucccucucuuccucucuu

SEQ ID NO: 381477 - RNA, 23 nt, Human
ccucuccuggcuugagugaagau

SEQ ID NO: 381478 - RNA, 18 nt, Human
ccugcaguccuaccccuc

SEQ ID NO: 381479 - RNA, 20 nt, Human
ccugcaguccuaccccuccu

SEQ ID NO: 381480 - RNA, 20 nt, Human
ccuugagcagcacguuacug

SEQ ID NO: 381481 - RNA, 20 nt, Human
ccuuuccucuuucccucucc

SEQ ID NO: 381482 - RNA, 23 nt, Human
cgcugcugcugcugcugccaccg

SEQ ID NO: 381483 - RNA, 25 nt, Human
cggaaagaaaauuagacauuggagg

SEQ ID NO: 381484 - RNA, 18 nt, Human
cgugcuacaggacgaaaa

SEQ ID NO: 381485 - RNA, 21 nt, Human
cuccgcugcugcugcugcugc

SEQ ID NO: 381486 - RNA, 19 nt, Human
cuccugaggagaggcagaa

SEQ ID NO: 381487 - RNA, 22 nt, Human
cuccuggcuugagugaagaugu

SEQ ID NO: 381488 - RNA, 25 nt, Human
cucucagccccaagucccccggacu

SEQ ID NO: 381489 - RNA, 23 nt, Human
cugcugccaccgccgcugcugcu

SEQ ID NO: 381490 - RNA, 22 nt, Human
cugcugcugcugcagucgcugc

SEQ ID NO: 381491 - RNA, 22 nt, Human
cugcugcugcugccaccgccgc

SEQ ID NO: 381492 - RNA, 18 nt, Human
cugcugcugcugcugcag

SEQ ID NO: 381493 - RNA, 19 nt, Human
cugcugcugggucugcugc

SEQ ID NO: 381494 - RNA, 19 nt, Human
cuucaaauuacaauggcug

SEQ ID NO: 381495 - RNA, 23 nt, Human
cuuuuucccucuuucuuucuuuu

SEQ ID NO: 381496 - RNA, 20 nt, Human
gaaaaauaaagcuaaguuac

SEQ ID NO: 381497 - RNA, 23 nt, Human
gacuaaagaccuaaaggcugauu

SEQ ID NO: 381498 - RNA, 23 nt, Human
gagcauuuaagacaugcauuuaa

SEQ ID NO: 381499 - RNA, 22 nt, Human
gcaaauauaauggcacaaaaau

SEQ ID NO: 381500 - RNA, 18 nt, Human
gcauuuaagacaugcauu

SEQ ID NO: 381501 - RNA, 21 nt, Human
gccaaaaaaaaaaaaaaaaaa

SEQ ID NO: 381502 - RNA, 20 nt, Human
gccaccgccgcugcugcugc

SEQ ID NO: 381503 - RNA, 19 nt, Human
gccccccuuuccucuuucc

SEQ ID NO: 381504 - RNA, 19 nt, Human
gcucuuuuucccucuuucu

SEQ ID NO: 381505 - RNA, 20 nt, Human
gcugcagucgcugcuucuug

SEQ ID NO: 381506 - RNA, 20 nt, Human
gcugccaccgccgcugcugc

SEQ ID NO: 381507 - RNA, 20 nt, Human
gcugccgccgcugcugcugc

SEQ ID NO: 381508 - RNA, 20 nt, Human
gcugcugccgccgcugcugc

SEQ ID NO: 381509 - RNA, 23 nt, Human
gcugcugccgccgcugcugcugc

SEQ ID NO: 381510 - RNA, 23 nt, Human
gcuuuguuuaagcagaguccucu

SEQ ID NO: 381511 - RNA, 19 nt, Human
ggacagccaggcucaagca

SEQ ID NO: 381512 - RNA, 22 nt, Human
ggagaugugcccucucuccucc

SEQ ID NO: 381513 - RNA, 21 nt, Human
gggaauuggagggaguagggu

SEQ ID NO: 381514 - RNA, 18 nt, Human
ggggauagaaaauaggaa

SEQ ID NO: 381515 - RNA, 23 nt, Human
gggggugggaagugugggaggga

SEQ ID NO: 381516 - RNA, 21 nt, Human
gggugggaagugugggaggga

SEQ ID NO: 381517 - RNA, 20 nt, Human
ggugggaagugugggaggga

SEQ ID NO: 381518 - RNA, 19 nt, Human
guacuuucuccugaggaga

SEQ ID NO: 381519 - RNA, 20 nt, Human
guccaagcccauagggaugc

SEQ ID NO: 381520 - RNA, 20 nt, Human
guccuggcuuaguuggguuu

SEQ ID NO: 381521 - RNA, 20 nt, Human
gugaugcugcugcugccacc

SEQ ID NO: 381522 - RNA, 22 nt, Human
gugaugcugcugcugccaccgg

SEQ ID NO: 381523 - RNA, 25 nt, Human
gugccuccgcugcugcugcugcugc

SEQ ID NO: 381524 - RNA, 20 nt, Human
gugcugcugcugcugcugcu

SEQ ID NO: 381525 - RNA, 25 nt, Human
guuuuuuuuuuuuccugccccccuu

SEQ ID NO: 381526 - RNA, 23 nt, Human
uaaaaaaaucaaaccaggcacag

SEQ ID NO: 381527 - RNA, 19 nt, Human
uaaaaaaggccacaaggag

SEQ ID NO: 381528 - RNA, 18 nt, Human
uaaaaaauaagcaaauaa

SEQ ID NO: 381529 - RNA, 18 nt, Human
uaaauaaaguuuccuuau

SEQ ID NO: 381530 - RNA, 22 nt, Human
uaaauaaugacauauaccagau

SEQ ID NO: 381531 - RNA, 22 nt, Human
uaacaaucugaugucagcacgc

SEQ ID NO: 381532 - RNA, 19 nt, Human
uaaggggggaauuggaggg

SEQ ID NO: 381533 - RNA, 24 nt, Human
uaagucaagaguagccucuggggg

SEQ ID NO: 381534 - RNA, 26 nt, Human
uacacucaaaauuggugugucaacac

SEQ ID NO: 381535 - RNA, 21 nt, Human
uagcucauuagagaucaagaa

SEQ ID NO: 381536 - RNA, 24 nt, Human
uagcucauuagagaucaagaauuc

SEQ ID NO: 381537 - RNA, 24 nt, Human
uaggaacuacuuuaaaaaaaucaa

SEQ ID NO: 381538 - RNA, 25 nt, Human
uauacugcuuuguuuaagcagaguc

SEQ ID NO: 381539 - RNA, 21 nt, Human
uaucuuagaaggaauucacca

SEQ ID NO: 381540 - RNA, 18 nt, Human
uauguguagauauaugua

SEQ ID NO: 381541 - RNA, 19 nt, Human
uauguguagauauauguau

SEQ ID NO: 381542 - RNA, 19 nt, Human
uauuccacaguuagaccuu

SEQ ID NO: 381543 - RNA, 21 nt, Human
ucaaaccaggcacaguacacu

SEQ ID NO: 381544 - RNA, 27 nt, Human
ucaaaccaggcacaguacacucaaaau

SEQ ID NO: 381545 - RNA, 18 nt, Human
ucacauggauuuuguugg

SEQ ID NO: 381546 - RNA, 20 nt, Human
ucagagaagucagccuugcc

SEQ ID NO: 381547 - RNA, 20 nt, Human
ucagccuugccugggggugg

SEQ ID NO: 381548 - RNA, 18 nt, Human
ucauacaggcccaucuua

SEQ ID NO: 381549 - RNA, 22 nt, Human
ucauggcagaaaugaucaaacc

SEQ ID NO: 381550 - RNA, 25 nt, Human
ucccaccccaucaucauuugccaga

SEQ ID NO: 381551 - RNA, 20 nt, Human
uccgcugcugcugcugcugc

SEQ ID NO: 381552 - RNA, 23 nt, Human
uccuaauguauaguaggccuuau

SEQ ID NO: 381553 - RNA, 24 nt, Human
uccugccccccuuuccucuuuccc

SEQ ID NO: 381554 - RNA, 22 nt, Human
uccuggaauuuccaguuggaug

SEQ ID NO: 381555 - RNA, 25 nt, Human
uccuugagcagcacguuacugguuu

SEQ ID NO: 381556 - RNA, 19 nt, Human
ucucucagccccaaguccc

SEQ ID NO: 381557 - RNA, 21 nt, Human
ucucuugacauugaccuuugg

SEQ ID NO: 381558 - RNA, 18 nt, Human
ucugguuggacagccagg

SEQ ID NO: 381559 - RNA, 23 nt, Human
ucuuuuuuucuauuuuuuuacga

SEQ ID NO: 381560 - RNA, 21 nt, Human
ugaagaaagagagaaauuugc

SEQ ID NO: 381561 - RNA, 18 nt, Human
ugaauguuuuguguuugg

SEQ ID NO: 381562 - RNA, 21 nt, Human
ugacauauaccagauaugcuu

SEQ ID NO: 381563 - RNA, 21 nt, Human
ugagcaguuacaguacguaaa

SEQ ID NO: 381564 - RNA, 24 nt, Human
ugaggugggcugggagauuaacau

SEQ ID NO: 381565 - RNA, 20 nt, Human
ugccugggggugggaagugu

SEQ ID NO: 381566 - RNA, 21 nt, Human
ugccugggggugggaagugug

SEQ ID NO: 381567 - RNA, 27 nt, Human
ugcugcugccgccgcugcugcugcugc

SEQ ID NO: 381568 - RNA, 21 nt, Human
ugcugcugcugcagucgcugc

SEQ ID NO: 381569 - RNA, 27 nt, Human
ugcugcugcugccgccgcugcugcugc

SEQ ID NO: 381570 - RNA, 20 nt, Human
ugcugcugcugcugccaccg

SEQ ID NO: 381571 - RNA, 18 nt, Human
ugcugcugcugcugcugc

SEQ ID NO: 381572 - RNA, 24 nt, Human
ugcugcugcugcugggucugcugc

SEQ ID NO: 381573 - RNA, 22 nt, Human
uggccccugcaguccuaccccu

SEQ ID NO: 381574 - RNA, 24 nt, Human
uggccccugcaguccuaccccucc

SEQ ID NO: 381575 - RNA, 19 nt, Human
uggggaccuggggauggga

SEQ ID NO: 381576 - RNA, 18 nt, Human
ugggguccuggcuuaguu

SEQ ID NO: 381577 - RNA, 20 nt, Human
ugguaaaagaggguacuuuc

SEQ ID NO: 381578 - RNA, 21 nt, Human
ugucagcacgcuuagaggcug

SEQ ID NO: 381579 - RNA, 23 nt, Human
ugugcugcugcugcugcugcugg

SEQ ID NO: 381580 - RNA, 21 nt, Human
uguguagauauauguauugua

SEQ ID NO: 381581 - RNA, 22 nt, Human
ugugucaacaccccuaaaauga

SEQ ID NO: 381582 - RNA, 24 nt, Human
uguugcuggugaugcugcugcugc

SEQ ID NO: 381583 - RNA, 23 nt, Human
uguuguugcuggugaugcugcug

SEQ ID NO: 381584 - RNA, 23 nt, Human
uuccaguuggaugugacagagau

SEQ ID NO: 381585 - RNA, 22 nt, Human
uucccucuuucuuucuuuuuuu

SEQ ID NO: 381586 - RNA, 20 nt, Human
uuccugucucauacaggccc

SEQ ID NO: 381587 - RNA, 19 nt, Human
uugcaccucuggcuuuugc

SEQ ID NO: 381588 - RNA, 20 nt, Human
uuggagggaguagggugggg

SEQ ID NO: 381589 - RNA, 19 nt, Human
uuggaugugacagagaucu

SEQ ID NO: 381590 - RNA, 20 nt, Human
uugguuccuggaauuuccag

SEQ ID NO: 381591 - RNA, 21 nt, Human
uugguuccuggaauuuccagu

SEQ ID NO: 381592 - RNA, 18 nt, Human
uuuggaaguuuaaggggg

SEQ ID NO: 381593 - RNA, 19 nt, Human
uuuuuuccugccccccuuu

SEQ ID NO: 381594 - RNA, 27 nt, Human
uuuuuuuuuguuguuguugcuggugau

SEQ ID NO: 381595 - RNA, 23 nt, Human
uuuuuuuuuuccugccccccuuu

SEQ ID NO: 381596 - RNA, 19 nt, Human
uuuuuuuuuuuccugcccc

SEQ ID NO: 381597 - RNA, 21 nt, Human
aaacagaauaauggaaaucca

SEQ ID NO: 381598 - RNA, 26 nt, Human
aaacagaauaauggaaauccaagcag

SEQ ID NO: 381599 - RNA, 25 nt, Human
aaacauuugaauaccuuuagaaaua

SEQ ID NO: 381600 - RNA, 19 nt, Human
aaccaaacagaauaaugga

SEQ ID NO: 381601 - RNA, 21 nt, Human
caaccuccagaauccagaaaa

SEQ ID NO: 381602 - RNA, 24 nt, Human
caauuaccaauuuuauucucuaac

SEQ ID NO: 381603 - RNA, 25 nt, Human
cagaauccagaaaauauaguuaucc

SEQ ID NO: 381604 - RNA, 24 nt, Human
cagauuacaagaauaugacacuua

SEQ ID NO: 381605 - RNA, 19 nt, Human
caggaucaaucuggucacg

SEQ ID NO: 381606 - RNA, 18 nt, Human
ccuccagaauccagaaaa

SEQ ID NO: 381607 - RNA, 23 nt, Human
cuaauccuaagacaaaacacuau

SEQ ID NO: 381608 - RNA, 24 nt, Human
cuuccaaccacuguaaauaccuga

SEQ ID NO: 381609 - RNA, 23 nt, Human
uaaaacuccuggagaaugcagau

SEQ ID NO: 381610 - RNA, 22 nt, Human
uaguaagaacugggaaucucau

SEQ ID NO: 381611 - RNA, 21 nt, Human
uauggcaguuacugaauauua

SEQ ID NO: 381612 - RNA, 23 nt, Human
ucacaaauaaccauuauuucugc

SEQ ID NO: 381613 - RNA, 20 nt, Human
uccuaagacaaaacacuaug

SEQ ID NO: 381614 - RNA, 23 nt, Human
ucuuccaaccacuguaaauaccu

SEQ ID NO: 381615 - RNA, 19 nt, Human
uggaaaagguaaucugaua

SEQ ID NO: 381616 - RNA, 19 nt, Human
caaaaaaagaugagaacca

SEQ ID NO: 381617 - RNA, 23 nt, Human
caaauaccaaggcagaucuuaag

SEQ ID NO: 381618 - RNA, 20 nt, Human
uaagcugcaaaaaaagauga

SEQ ID NO: 381619 - RNA, 23 nt, Human
uaagcugcaaaaaaagaugagaa

SEQ ID NO: 381620 - RNA, 18 nt, Human
aaacuugaaauguuggug

SEQ ID NO: 381621 - RNA, 20 nt, Human
agagcgcggagccuccaagc

SEQ ID NO: 381622 - RNA, 22 nt, Human
cagccacccacucuucgccuua

SEQ ID NO: 381623 - RNA, 21 nt, Human
cagcugcaggccccgccuccu

SEQ ID NO: 381624 - RNA, 22 nt, Human
ccaccugcuggcgccccgcguc

SEQ ID NO: 381625 - RNA, 22 nt, Human
ccagaggugcgggccccacgcg

SEQ ID NO: 381626 - RNA, 20 nt, Human
ccgugagucucggcugccga

SEQ ID NO: 381627 - RNA, 18 nt, Human
ccuccaagccagcugcag

SEQ ID NO: 381628 - RNA, 23 nt, Human
ccuccaagccagcugcaggcccc

SEQ ID NO: 381629 - RNA, 25 nt, Human
cgcggagccuccaagccagcugcag

SEQ ID NO: 381630 - RNA, 24 nt, Human
cuccaagccagcugcaggccccgc

SEQ ID NO: 381631 - RNA, 19 nt, Human
cuucagccacccacucuuc

SEQ ID NO: 381632 - RNA, 21 nt, Human
gccgcugcugcccagaggugc

SEQ ID NO: 381633 - RNA, 21 nt, Human
ucagccacccacucuucgccu

SEQ ID NO: 381634 - RNA, 23 nt, Human
uccaagccagcugcaggccccgc

SEQ ID NO: 381635 - RNA, 23 nt, Human
uccagcgccaccugcuggcgccc

SEQ ID NO: 381636 - RNA, 21 nt, Human
ucggcugccgcugcugcccag

SEQ ID NO: 381637 - RNA, 24 nt, Human
ucucggcugccgcugcugcccaga

SEQ ID NO: 381638 - RNA, 28 nt, Human
ugcgcguccagcgccaccugcuggcgcc

SEQ ID NO: 381639 - RNA, 24 nt, Human
uucgccuuagcuugaccgugaguc

SEQ ID NO: 381640 - RNA, 18 nt, Human
uuuuuuuuuuuuuccuug

SEQ ID NO: 381641 - RNA, 22 nt, Human
uuuuuuuuuuuuuuuuuuccuu

SEQ ID NO: 381642 - RNA, 21 nt, Human
aaaauaccuuuacagccauag

SEQ ID NO: 381643 - RNA, 23 nt, Human
aaacaagaaaccaaaccucaaaa

SEQ ID NO: 381644 - RNA, 22 nt, Human
aaagaacaaacuucaaagauua

SEQ ID NO: 381645 - RNA, 18 nt, Human
aacacagaaaaccccauu

SEQ ID NO: 381646 - RNA, 27 nt, Human
aagagaagagaagagaagagaggcgag

SEQ ID NO: 381647 - RNA, 23 nt, Human
aagagaagagaagagaggcgaga

SEQ ID NO: 381648 - RNA, 24 nt, Human
aagagacagaaacaagaaaccaaa

SEQ ID NO: 381649 - RNA, 19 nt, Human
aagcaagagacagaaacaa

SEQ ID NO: 381650 - RNA, 27 nt, Human
aagcaagagacagaaacaagaaaccaa

SEQ ID NO: 381651 - RNA, 28 nt, Human
aagcaagagacagaaacaagagggaccc

SEQ ID NO: 381652 - RNA, 20 nt, Human
aaguaacaugaaaaugggau

SEQ ID NO: 381653 - RNA, 20 nt, Human
aaguggaggaggaagagaag

SEQ ID NO: 381654 - RNA, 21 nt, Human
aauaauaaugaaggacccaag

SEQ ID NO: 381655 - RNA, 20 nt, Human
aauaaugaaggacccaagga

SEQ ID NO: 381656 - RNA, 21 nt, Human
aaugccuucuuggccagggca

SEQ ID NO: 381657 - RNA, 21 nt, Human
acagcagagacagaagcugaa

SEQ ID NO: 381658 - RNA, 21 nt, Human
accaaaccucaaaacugggac

SEQ ID NO: 381659 - RNA, 19 nt, Human
accaaagaacaaacuucaa

SEQ ID NO: 381660 - RNA, 20 nt, Human
accaaagaacaaacuucaaa

SEQ ID NO: 381661 - RNA, 18 nt, Human
accuauaccaucuuccuu

SEQ ID NO: 381662 - RNA, 19 nt, Human
accucaaaacugggacagc

SEQ ID NO: 381663 - RNA, 20 nt, Human
acuugggaaauucagauuac

SEQ ID NO: 381664 - RNA, 22 nt, Human
agaacacccagggaaggacaag

SEQ ID NO: 381665 - RNA, 24 nt, Human
agaagagaagagaagagaggcgag

SEQ ID NO: 381666 - RNA, 18 nt, Human
agacagaaacaagaaacc

SEQ ID NO: 381667 - RNA, 23 nt, Human
agacagaaacaagaaaccaaacc

SEQ ID NO: 381668 - RNA, 25 nt, Human
agacagaaacaagaaaccaaaccuc

SEQ ID NO: 381669 - RNA, 21 nt, Human
agccauagcaaaaacagguaa

SEQ ID NO: 381670 - RNA, 20 nt, Human
agccugcccccuccaacagc

SEQ ID NO: 381671 - RNA, 19 nt, Human
aggaagagaagagaagaga

SEQ ID NO: 381672 - RNA, 20 nt, Human
aggagggcuggcuccucagg

SEQ ID NO: 381673 - RNA, 21 nt, Human
aggagggcuggcuccucaggu

SEQ ID NO: 381674 - RNA, 18 nt, Human
aggcagguguggguggga

SEQ ID NO: 381675 - RNA, 19 nt, Human
aggcaggugugggugggag

SEQ ID NO: 381676 - RNA, 19 nt, Human
agggaggagcccgaaagca

SEQ ID NO: 381677 - RNA, 21 nt, Human
agggaggcagguguggguggg

SEQ ID NO: 381678 - RNA, 18 nt, Human
aggguguccagggaguac

SEQ ID NO: 381679 - RNA, 18 nt, Human
agguaagggagagaguug

SEQ ID NO: 381680 - RNA, 20 nt, Human
aguggagagggagugacagc

SEQ ID NO: 381681 - RNA, 19 nt, Human
agugggguggaacagaucu

SEQ ID NO: 381682 - RNA, 18 nt, Human
aguggugggagggaggag

SEQ ID NO: 381683 - RNA, 19 nt, Human
aucauggcuguggcucucc

SEQ ID NO: 381684 - RNA, 24 nt, Human
augaaauaacacagaaaaccccau

SEQ ID NO: 381685 - RNA, 20 nt, Human
caaaacugggacagcagaga

SEQ ID NO: 381686 - RNA, 20 nt, Human
caaaauaggaucccaggauu

SEQ ID NO: 381687 - RNA, 27 nt, Human
caacuccagggcuccauaagagcccuu

SEQ ID NO: 381688 - RNA, 23 nt, Human
caagaaaccaaaccucaaaacug

SEQ ID NO: 381689 - RNA, 23 nt, Human
caagagacagaaacaagaaacca

SEQ ID NO: 381690 - RNA, 22 nt, Human
caaugaacagaugccucucccc

SEQ ID NO: 381691 - RNA, 22 nt, Human
caccccugcggaagggggccgg

SEQ ID NO: 381692 - RNA, 23 nt, Human
caccccuuccccaaacugguugu

SEQ ID NO: 381693 - RNA, 19 nt, Human
caccucgggaucccagagg

SEQ ID NO: 381694 - RNA, 22 nt, Human
cacgcuggcggucacucaugug

SEQ ID NO: 381695 - RNA, 18 nt, Human
cacggcucaucugaggag

SEQ ID NO: 381696 - RNA, 19 nt, Human
cagaaacaagaaaccaaac

SEQ ID NO: 381697 - RNA, 19 nt, Human
cagaagcugaaccccagag

SEQ ID NO: 381698 - RNA, 19 nt, Human
cagaaguggaggaggaaga

SEQ ID NO: 381699 - RNA, 20 nt, Human
cagaccccuggaccagcccu

SEQ ID NO: 381700 - RNA, 24 nt, Human
cagaugccucucccaacccauucc

SEQ ID NO: 381701 - RNA, 19 nt, Human
cagcagagacagaagcugg

SEQ ID NO: 381702 - RNA, 21 nt, Human
cagcagcagcccaugguuggg

SEQ ID NO: 381703 - RNA, 27 nt, Human
cagcauccuugcccaacaacuccaggg

SEQ ID NO: 381704 - RNA, 24 nt, Human
cagccacccgcgagccugcccccu

SEQ ID NO: 381705 - RNA, 24 nt, Human
cagguggggcugaggggcucagcu

SEQ ID NO: 381706 - RNA, 22 nt, Human
ccaaaccucaaaacugggacag

SEQ ID NO: 381707 - RNA, 22 nt, Human
ccaaugaacagaugccucuccc

SEQ ID NO: 381708 - RNA, 25 nt, Human
ccagaccccuggaccagcccuuccc

SEQ ID NO: 381709 - RNA, 18 nt, Human
ccagaggcaaagccagga

SEQ ID NO: 381710 - RNA, 22 nt, Human
ccagaggcaaagccaggagccc

SEQ ID NO: 381711 - RNA, 20 nt, Human
ccagccccagguauacccac

SEQ ID NO: 381712 - RNA, 19 nt, Human
ccaggagcccgggagugca

SEQ ID NO: 381713 - RNA, 23 nt, Human
ccaguuaucuugaaggaagggag

SEQ ID NO: 381714 - RNA, 20 nt, Human
cccaggcccaaaauaggauc

SEQ ID NO: 381715 - RNA, 20 nt, Human
cccaugguugggacggaggc

SEQ ID NO: 381716 - RNA, 25 nt, Human
cccaugguugggacggaggcagggc

SEQ ID NO: 381717 - RNA, 20 nt, Human
ccccaggcccaaaauaggau

SEQ ID NO: 381718 - RNA, 25 nt, Human
ccccauccugccuacuucuuaagag

SEQ ID NO: 381719 - RNA, 19 nt, Human
ccccuggaccagcccuucc

SEQ ID NO: 381720 - RNA, 21 nt, Human
ccccuggaccagcccuuccca

SEQ ID NO: 381721 - RNA, 25 nt, Human
ccccuggaccagcccuucccaugcc

SEQ ID NO: 381722 - RNA, 18 nt, Human
cccgaaagcaagagacag

SEQ ID NO: 381723 - RNA, 21 nt, Human
cccgcgagccugcccccucca

SEQ ID NO: 381724 - RNA, 21 nt, Human
cccuccuaagaccagccccag

SEQ ID NO: 381725 - RNA, 21 nt, Human
ccuaagaccagccccagguau

SEQ ID NO: 381726 - RNA, 22 nt, Human
ccuagccccagucuggagcaaa

SEQ ID NO: 381727 - RNA, 19 nt, Human
ccuccuaagaccagcccca

SEQ ID NO: 381728 - RNA, 21 nt, Human
ccucgggaucccagaggcaaa

SEQ ID NO: 381729 - RNA, 24 nt, Human
ccugaccucgcccugccgaagagc

SEQ ID NO: 381730 - RNA, 19 nt, Human
ccugcccccuccaacagcc

SEQ ID NO: 381731 - RNA, 18 nt, Human
ccugccuacuucuuaaga

SEQ ID NO: 381732 - RNA, 19 nt, Human
ccuuagccaccccuucccc

SEQ ID NO: 381733 - RNA, 25 nt, Human
ccuuuacugccaccccauccugccc

SEQ ID NO: 381734 - RNA, 22 nt, Human
cgacccgcaggguccugagggc

SEQ ID NO: 381735 - RNA, 19 nt, Human
cgccaauagagccauuauc

SEQ ID NO: 381736 - RNA, 22 nt, Human
cgccaguaaugccuucuuggcc

SEQ ID NO: 381737 - RNA, 22 nt, Human
cggaaugggucaaaucccucug

SEQ ID NO: 381738 - RNA, 27 nt, Human
cggaggcagggcaggcaggccauggug

SEQ ID NO: 381739 - RNA, 25 nt, Human
cgggaagaauccaaauguggagagc

SEQ ID NO: 381740 - RNA, 19 nt, Human
cgggcaggguggcugcggg

SEQ ID NO: 381741 - RNA, 24 nt, Human
cucagccacagccuucuugccagc

SEQ ID NO: 381742 - RNA, 23 nt, Human
cuccaaguuugggugcgggagga

SEQ ID NO: 381743 - RNA, 23 nt, Human
cuccaaugaacagaugccucucc

SEQ ID NO: 381744 - RNA, 23 nt, Human
cucccaacccauucccaagccug

SEQ ID NO: 381745 - RNA, 19 nt, Human
cucccccauggaucccugg

SEQ ID NO: 381746 - RNA, 21 nt, Human
cuccucagccacagccuucuu

SEQ ID NO: 381747 - RNA, 18 nt, Human
cucgugccgcuuccggag

SEQ ID NO: 381748 - RNA, 19 nt, Human
cucgugccgcuuccggaga

SEQ ID NO: 381749 - RNA, 23 nt, Human
cugacccacaucaauaccaaaga

SEQ ID NO: 381750 - RNA, 26 nt, Human
cugccgaagagcggcgagcagcagaa

SEQ ID NO: 381751 - RNA, 18 nt, Human
cuggggagcuggggcugu

SEQ ID NO: 381752 - RNA, 19 nt, Human
cuugcagggcucggcuguc

SEQ ID NO: 381753 - RNA, 21 nt, Human
cuugcagggcucggcuguccc

SEQ ID NO: 381754 - RNA, 18 nt, Human
cuuggccagggcagggcu

SEQ ID NO: 381755 - RNA, 20 nt, Human
gaaacaagaaaccaaaccuc

SEQ ID NO: 381756 - RNA, 23 nt, Human
gagacagaagcugaaccccagag

SEQ ID NO: 381757 - RNA, 20 nt, Human
gagcagcagaagcuggggag

SEQ ID NO: 381758 - RNA, 18 nt, Human
gaggaagagaagagaaga

SEQ ID NO: 381759 - RNA, 21 nt, Human
gcgagcagcagaagcugggga

SEQ ID NO: 381760 - RNA, 22 nt, Human
gcgagcagcagaagcuggggag

SEQ ID NO: 381761 - RNA, 23 nt, Human
gcucaucugaggagguuuggggg

SEQ ID NO: 381762 - RNA, 19 nt, Human
ggacagcagagacagaagc

SEQ ID NO: 381763 - RNA, 20 nt, Human
ggagccacuuguccugagcc

SEQ ID NO: 381764 - RNA, 21 nt, Human
ggagggcgugcgacccgcagg

SEQ ID NO: 381765 - RNA, 21 nt, Human
ggcagggaguggggcagagga

SEQ ID NO: 381766 - RNA, 18 nt, Human
gggaucccagaggcaaag

SEQ ID NO: 381767 - RNA, 21 nt, Human
gggggaaaguggucacacagc

SEQ ID NO: 381768 - RNA, 21 nt, Human
gggguggaacagaucugaggc

SEQ ID NO: 381769 - RNA, 21 nt, Human
gguaagagggaggcaggugug

SEQ ID NO: 381770 - RNA, 18 nt, Human
gguggggcugaggggcuc

SEQ ID NO: 381771 - RNA, 19 nt, Human
gguuguucucugagaauug

SEQ ID NO: 381772 - RNA, 23 nt, Human
guauacccaccccaggcccaaaa

SEQ ID NO: 381773 - RNA, 22 nt, Human
gucuagagggugggaagggugg

SEQ ID NO: 381774 - RNA, 23 nt, Human
gugggguggaacagaucugaggc

SEQ ID NO: 381775 - RNA, 19 nt, Human
uaacacagaaaaccccauu

SEQ ID NO: 381776 - RNA, 18 nt, Human
uacaaaguaacaugaaaa

SEQ ID NO: 381777 - RNA, 21 nt, Human
uacagccauagcaaaaacagg

SEQ ID NO: 381778 - RNA, 21 nt, Human
uacccaccccaggcccaaaau

SEQ ID NO: 381779 - RNA, 25 nt, Human
uacucguccuaucuucccugcaacu

SEQ ID NO: 381780 - RNA, 23 nt, Human
uagcacccuccuaagaccagccc

SEQ ID NO: 381781 - RNA, 24 nt, Human
uagcacccuccuaagaccagcccc

SEQ ID NO: 381782 - RNA, 22 nt, Human
uagccaccccuuccccaaacug

SEQ ID NO: 381783 - RNA, 18 nt, Human
uaggaucccaggauaaag

SEQ ID NO: 381784 - RNA, 23 nt, Human
ucaaaacugggacagcagagaca

SEQ ID NO: 381785 - RNA, 21 nt, Human
ucagcgccaguaaugccuucu

SEQ ID NO: 381786 - RNA, 23 nt, Human
uccagcccaugguucagcgccag

SEQ ID NO: 381787 - RNA, 20 nt, Human
ucccaacccauucccaagcc

SEQ ID NO: 381788 - RNA, 22 nt, Human
ucccaagccuggccucucuuua

SEQ ID NO: 381789 - RNA, 23 nt, Human
ucccagaggcaaagccaggagcc

SEQ ID NO: 381790 - RNA, 22 nt, Human
uccucagccacagccuucuugc

SEQ ID NO: 381791 - RNA, 22 nt, Human
uccugcagugugggggagcagg

SEQ ID NO: 381792 - RNA, 22 nt, Human
uccugggccuccuaggccgagg

SEQ ID NO: 381793 - RNA, 24 nt, Human
uccuuagccaccccuuccccaaac

SEQ ID NO: 381794 - RNA, 24 nt, Human
ucucccaacccauucccaagccug

SEQ ID NO: 381795 - RNA, 19 nt, Human
ucuccgcgggcacagaagu

SEQ ID NO: 381796 - RNA, 26 nt, Human
ucugcagccuagcacccuccuaagac

SEQ ID NO: 381797 - RNA, 20 nt, Human
ucuuccggccugggcuggag

SEQ ID NO: 381798 - RNA, 21 nt, Human
ucuuccggccugggcuggagu

SEQ ID NO: 381799 - RNA, 20 nt, Human
ugaaauaacacagaaaaccc

SEQ ID NO: 381800 - RNA, 24 nt, Human
ugaaauaacacagaaaagggaggc

SEQ ID NO: 381801 - RNA, 19 nt, Human
ugaacagaugccucuccca

SEQ ID NO: 381802 - RNA, 22 nt, Human
ugaacagaugccucucccaacc

SEQ ID NO: 381803 - RNA, 22 nt, Human
ugaaccccagagguggagcugg

SEQ ID NO: 381804 - RNA, 20 nt, Human
ugaaggaagggagggaagga

SEQ ID NO: 381805 - RNA, 22 nt, Human
ugaaggaagggagggaaggagg

SEQ ID NO: 381806 - RNA, 21 nt, Human
ugaaggacccaaggaugaggg

SEQ ID NO: 381807 - RNA, 20 nt, Human
ugacagcauccuugcccaac

SEQ ID NO: 381808 - RNA, 21 nt, Human
ugagugggguggaacagaucu

SEQ ID NO: 381809 - RNA, 23 nt, Human
ugagugggguggaacagaucuga

SEQ ID NO: 381810 - RNA, 22 nt, Human
ugcacugaaguggagagggagu

SEQ ID NO: 381811 - RNA, 22 nt, Human
ugcagccuagcacccuccuaag

SEQ ID NO: 381812 - RNA, 21 nt, Human
ugcccagaccccuggaccagc

SEQ ID NO: 381813 - RNA, 19 nt, Human
uggagcaaacagaaccacu

SEQ ID NO: 381814 - RNA, 22 nt, Human
uggcagggaguggggcagagga

SEQ ID NO: 381815 - RNA, 18 nt, Human
uggcuccucagguccaac

SEQ ID NO: 381816 - RNA, 23 nt, Human
uggcugcggggcugcugucagcu

SEQ ID NO: 381817 - RNA, 20 nt, Human
ugggaagggugggggaaagu

SEQ ID NO: 381818 - RNA, 22 nt, Human
ugggaagggugggggaaagugg

SEQ ID NO: 381819 - RNA, 18 nt, Human
ugggacagcagagacaga

SEQ ID NO: 381820 - RNA, 20 nt, Human
uguccccaacuggagauggu

SEQ ID NO: 381821 - RNA, 19 nt, Human
ugugagaacgggaagaauc

SEQ ID NO: 381822 - RNA, 20 nt, Human
uucaaaaaaugacagcaucc

SEQ ID NO: 381823 - RNA, 21 nt, Human
uucccaagccuggccucucuu

SEQ ID NO: 381824 - RNA, 19 nt, Human
uuccuuagccaccccuucc

SEQ ID NO: 381825 - RNA, 23 nt, Human
uugaugcuuggggagcuuugggg

SEQ ID NO: 381826 - RNA, 20 nt, Human
uuggggccaguuaucuugaa

SEQ ID NO: 381827 - RNA, 19 nt, Human
uugucuagagggugggaag

SEQ ID NO: 381828 - RNA, 18 nt, Human
aaaaaaaccaacuauggg

SEQ ID NO: 381829 - RNA, 23 nt, Human
aacccccuccccuccccauaaca

SEQ ID NO: 381830 - RNA, 19 nt, Human
aacuaggggcaggggaaag

SEQ ID NO: 381831 - RNA, 19 nt, Human
acagcaacuaggggcaggg

SEQ ID NO: 381832 - RNA, 20 nt, Human
accugaggcuggaagaaccc

SEQ ID NO: 381833 - RNA, 22 nt, Human
agacagcugggaccugaggcug

SEQ ID NO: 381834 - RNA, 19 nt, Human
aggcuggaagaacccccuc

SEQ ID NO: 381835 - RNA, 22 nt, Human
caacgugagacagcugggaccu

SEQ ID NO: 381836 - RNA, 18 nt, Human
caugcccacugccccaaa

SEQ ID NO: 381837 - RNA, 27 nt, Human
ccacugccccaaauaaaaaaaaaacca

SEQ ID NO: 381838 - RNA, 21 nt, Human
ccccaaauaaaaaaaaaacca

SEQ ID NO: 381839 - RNA, 22 nt, Human
ccccugcucucccuuccgcucc

SEQ ID NO: 381840 - RNA, 24 nt, Human
ccgagacagcaacuaggggcaggg

SEQ ID NO: 381841 - RNA, 19 nt, Human
ccgcggucccagcuccucu

SEQ ID NO: 381842 - RNA, 20 nt, Human
ccuucucuccccugcucucc

SEQ ID NO: 381843 - RNA, 19 nt, Human
cgagacagcaacuaggggc

SEQ ID NO: 381844 - RNA, 20 nt, Human
cgagggcagcggugaagaga

SEQ ID NO: 381845 - RNA, 19 nt, Human
cgugugcugggagggccca

SEQ ID NO: 381846 - RNA, 22 nt, Human
cuccccuccccauaacaugccc

SEQ ID NO: 381847 - RNA, 23 nt, Human
cugccccaaauaaaaaaaaaacc

SEQ ID NO: 381848 - RNA, 25 nt, Human
cuggaagaacccccuccccucccca

SEQ ID NO: 381849 - RNA, 18 nt, Human
gaagaacccccuccccuc

SEQ ID NO: 381850 - RNA, 20 nt, Human
gacagcugggaccugaggcu

SEQ ID NO: 381851 - RNA, 18 nt, Human
gcgaagggaaggggggau

SEQ ID NO: 381852 - RNA, 22 nt, Human
ggaaagagacauggaacucgag

SEQ ID NO: 381853 - RNA, 20 nt, Human
gggcccagaggcagcggcgg

SEQ ID NO: 381854 - RNA, 23 nt, Human
uaaaaaaaaaaccaacuauggga

SEQ ID NO: 381855 - RNA, 25 nt, Human
uaaaaaaaaaaccaacuaugggaga

SEQ ID NO: 381856 - RNA, 19 nt, Human
uaacaugcccacugcccca

SEQ ID NO: 381857 - RNA, 18 nt, Human
ucccagcuccucuuucca

SEQ ID NO: 381858 - RNA, 23 nt, Human
uccccauaacaugcccacugccc

SEQ ID NO: 381859 - RNA, 18 nt, Human
uccccugcucucccuucc

SEQ ID NO: 381860 - RNA, 20 nt, Human
uccccugcucucccuuccga

SEQ ID NO: 381861 - RNA, 20 nt, Human
uccgugcugcucgccgcggu

SEQ ID NO: 381862 - RNA, 22 nt, Human
ucgccgcggucccagcuccucu

SEQ ID NO: 381863 - RNA, 20 nt, Human
ucucugugucuuccccggga

SEQ ID NO: 381864 - RNA, 18 nt, Human
ugccccaaauaaaaaaaa

SEQ ID NO: 381865 - RNA, 23 nt, Human
ugcugggagggcccagaggcagc

SEQ ID NO: 381866 - RNA, 21 nt, Human
uggaagaacccccuccccucc

SEQ ID NO: 381867 - RNA, 26 nt, Human
uggaagaacccccuccccuccccaua

SEQ ID NO: 381868 - RNA, 18 nt, Human
ugggagggcccagaggca

SEQ ID NO: 381869 - RNA, 19 nt, Human
ugggagggcccagaggcag

SEQ ID NO: 381870 - RNA, 21 nt, Human
ugggagggcccagaggcagcg

SEQ ID NO: 381871 - RNA, 23 nt, Human
uuccccgggguuauguauaaaua

SEQ ID NO: 381872 - RNA, 20 nt, Human
aaaaaccaagaauuccagcc

SEQ ID NO: 381873 - RNA, 18 nt, Human
aaacaggagaggacucga

SEQ ID NO: 381874 - RNA, 26 nt, Human
aacacccauuccucuuggacccugac

SEQ ID NO: 381875 - RNA, 21 nt, Human
aacugcuccaccuaacaugcu

SEQ ID NO: 381876 - RNA, 25 nt, Human
aagagaaguccaacagacugccagc

SEQ ID NO: 381877 - RNA, 22 nt, Human
aagcugccagccacagccccgg

SEQ ID NO: 381878 - RNA, 26 nt, Human
aagucaggaacgcuggggcaggucua

SEQ ID NO: 381879 - RNA, 23 nt, Human
aauauacauuagguucaggugac

SEQ ID NO: 381880 - RNA, 18 nt, Human
acacaggagccugugcgg

SEQ ID NO: 381881 - RNA, 20 nt, Human
acaccaacugcuccaccuaa

SEQ ID NO: 381882 - RNA, 18 nt, Human
acagacgcaagagggaaa

SEQ ID NO: 381883 - RNA, 21 nt, Human
acaggagccugugcgggggcc

SEQ ID NO: 381884 - RNA, 23 nt, Human
acaggccagcaagaagucaggaa

SEQ ID NO: 381885 - RNA, 19 nt, Human
acccauuccucuuggaccc

SEQ ID NO: 381886 - RNA, 25 nt, Human
accccgaaggcccagcaggagucca

SEQ ID NO: 381887 - RNA, 21 nt, Human
accucacccuccacaggccag

SEQ ID NO: 381888 - RNA, 21 nt, Human
acgcaagagggaaaagggguc

SEQ ID NO: 381889 - RNA, 21 nt, Human
agagcaaaacugguauuuucg

SEQ ID NO: 381890 - RNA, 18 nt, Human
aggccagcaagaagucag

SEQ ID NO: 381891 - RNA, 18 nt, Human
aggccaucuccugagcag

SEQ ID NO: 381892 - RNA, 18 nt, Human
cacaguugggguggcaca

SEQ ID NO: 381893 - RNA, 22 nt, Human
caccuaacaugcucaguggcac

SEQ ID NO: 381894 - RNA, 23 nt, Human
caccucacccuccacaggccagc

SEQ ID NO: 381895 - RNA, 18 nt, Human
caccugggcagaagaggc

SEQ ID NO: 381896 - RNA, 22 nt, Human
cacgugccacaccaacugcucc

SEQ ID NO: 381897 - RNA, 23 nt, Human
cagcacgcaucgcagccuggcag

SEQ ID NO: 381898 - RNA, 21 nt, Human
cagcagugcuuugucccacag

SEQ ID NO: 381899 - RNA, 22 nt, Human
cauagacaaggcuuugucuuaa

SEQ ID NO: 381900 - RNA, 23 nt, Human
ccaacugagaccccgaaggccca

SEQ ID NO: 381901 - RNA, 25 nt, Human
ccaccaagcugccagccacagcccc

SEQ ID NO: 381902 - RNA, 21 nt, Human
ccaucuccugagcagccagcu

SEQ ID NO: 381903 - RNA, 22 nt, Human
cccaccaagcugccagccacag

SEQ ID NO: 381904 - RNA, 21 nt, Human
cccgcacgugccacaccaagg

SEQ ID NO: 381905 - RNA, 18 nt, Human
cccuggggcccaccaagc

SEQ ID NO: 381906 - RNA, 23 nt, Human
ccggugccaacaccccgcacgug

SEQ ID NO: 381907 - RNA, 21 nt, Human
ccucccucuuuccccgguccc

SEQ ID NO: 381908 - RNA, 21 nt, Human
ccuggcuccucugggaacaga

SEQ ID NO: 381909 - RNA, 21 nt, Human
ccugggcagaagaggccaggc

SEQ ID NO: 381910 - RNA, 21 nt, Human
cuauggagcagacuggguugu

SEQ ID NO: 381911 - RNA, 19 nt, Human
cugaccccaccaacagccc

SEQ ID NO: 381912 - RNA, 23 nt, Human
cugagaccccgaaggcccagcag

SEQ ID NO: 381913 - RNA, 20 nt, Human
cugcaggccuggcuccucug

SEQ ID NO: 381914 - RNA, 18 nt, Human
cugccauguuccuggggc

SEQ ID NO: 381915 - RNA, 20 nt, Human
cuggggcaggucuaucaggc

SEQ ID NO: 381916 - RNA, 19 nt, Human
cuuggacccugaccccacc

SEQ ID NO: 381917 - RNA, 23 nt, Human
gaaaugcaaggugggacuccuga

SEQ ID NO: 381918 - RNA, 18 nt, Human
gaagccaacugagacccc

SEQ ID NO: 381919 - RNA, 24 nt, Human
gaagccaacugagaccccgaaggc

SEQ ID NO: 381920 - RNA, 20 nt, Human
gaagggaucuggggcucaag

SEQ ID NO: 381921 - RNA, 20 nt, Human
gaaguccaacagacugccag

SEQ ID NO: 381922 - RNA, 23 nt, Human
gaccccaccaacagccccauccc

SEQ ID NO: 381923 - RNA, 22 nt, Human
gagaacaggaggaaugaggccg

SEQ ID NO: 381924 - RNA, 23 nt, Human
gagaaggcccuggggcccaccaa

SEQ ID NO: 381925 - RNA, 18 nt, Human
gagggacuugaugauuga

SEQ ID NO: 381926 - RNA, 19 nt, Human
gaguccaucugagguacag

SEQ ID NO: 381927 - RNA, 19 nt, Human
gccagccacagccccgggc

SEQ ID NO: 381928 - RNA, 20 nt, Human
gcgcgguggcgccggcucgg

SEQ ID NO: 381929 - RNA, 24 nt, Human
ggacccugaccccaccaacagccc

SEQ ID NO: 381930 - RNA, 22 nt, Human
ggcgcgguggcgccggcucggg

SEQ ID NO: 381931 - RNA, 22 nt, Human
gggaacagaaauggcugugagg

SEQ ID NO: 381932 - RNA, 19 nt, Human
ggggauggggcagaggcaa

SEQ ID NO: 381933 - RNA, 22 nt, Human
gguggcacagggcgaggggcug

SEQ ID NO: 381934 - RNA, 18 nt, Human
uagaaucagaaucugggg

SEQ ID NO: 381935 - RNA, 25 nt, Human
ucaccugcagacagggugggccaga

SEQ ID NO: 381936 - RNA, 20 nt, Human
uccugaacacagucgggggg

SEQ ID NO: 381937 - RNA, 24 nt, Human
uccugagcagccagcugcaggccu

SEQ ID NO: 381938 - RNA, 20 nt, Human
ucuuggacccugaccccacc

SEQ ID NO: 381939 - RNA, 20 nt, Human
ugaaaaaccaagaauuccag

SEQ ID NO: 381940 - RNA, 24 nt, Human
ugaaaaaccaagaauuccagcccg

SEQ ID NO: 381941 - RNA, 24 nt, Human
ugaagagaaguccaacagacugcc

SEQ ID NO: 381942 - RNA, 26 nt, Human
ugacaaauaauuacaccucacccucc

SEQ ID NO: 381943 - RNA, 24 nt, Human
ugaccccaccaacagccccauccc

SEQ ID NO: 381944 - RNA, 21 nt, Human
ugaguuacauguucacagaga

SEQ ID NO: 381945 - RNA, 19 nt, Human
ugcaaggugggacuccuga

SEQ ID NO: 381946 - RNA, 21 nt, Human
ugcaggaagggggacgcgaga

SEQ ID NO: 381947 - RNA, 21 nt, Human
ugccaacaccccgcacgugcc

SEQ ID NO: 381948 - RNA, 20 nt, Human
ugcucaguggcacaggcuca

SEQ ID NO: 381949 - RNA, 22 nt, Human
uggacccugaccccaccaacag

SEQ ID NO: 381950 - RNA, 23 nt, Human
uggagcagacuggguuguggaag

SEQ ID NO: 381951 - RNA, 18 nt, Human
uggcacaggcucaggcag

SEQ ID NO: 381952 - RNA, 21 nt, Human
uggcugaaaaaccaagaauuc

SEQ ID NO: 381953 - RNA, 21 nt, Human
uggggcagaggcaaacagccc

SEQ ID NO: 381954 - RNA, 21 nt, Human
uggggcccaccaagcugccag

SEQ ID NO: 381955 - RNA, 23 nt, Human
ugggguggcacagggcgaggggc

SEQ ID NO: 381956 - RNA, 21 nt, Human
ugucccacagagagcaaaacu

SEQ ID NO: 381957 - RNA, 19 nt, Human
uguguacgcguaugugugu

SEQ ID NO: 381958 - RNA, 22 nt, Human
ugugugcauucacacccaugug

SEQ ID NO: 381959 - RNA, 24 nt, Human
ugugugcauucacacccaugugca

SEQ ID NO: 381960 - RNA, 26 nt, Human
ugugugcauucacacccaugugcagg

SEQ ID NO: 381961 - RNA, 20 nt, Human
uguguguacgcguaugugug

SEQ ID NO: 381962 - RNA, 23 nt, Human
uucaccugcagacagggugggcc

SEQ ID NO: 381963 - RNA, 25 nt, Human
uucaucagcagugcuuugucccaca

SEQ ID NO: 381964 - RNA, 26 nt, Human
uucaucagcagugcuuugucccacag

SEQ ID NO: 381965 - RNA, 22 nt, Human
uuucgcaaacaggagaggacuc

SEQ ID NO: 381966 - RNA, 27 nt, Human
aaaaaaaaaggcaacaaaaaccccaaa

SEQ ID NO: 381967 - RNA, 22 nt, Human
aaaaaaccaaagcggccgcgcg

SEQ ID NO: 381968 - RNA, 21 nt, Human
aaaaaccaaagcggccgcgcg

SEQ ID NO: 381969 - RNA, 24 nt, Human
aaaaagaaaaaaaaaaggcaacaa

SEQ ID NO: 381970 - RNA, 22 nt, Human
aaaagaaaaaaaaaaggcaaca

SEQ ID NO: 381971 - RNA, 25 nt, Human
aaaagaaaaaaaaaaggcaacaaaa

SEQ ID NO: 381972 - RNA, 28 nt, Human
aaaagaaaauggaaccaaccaaacaaaa

SEQ ID NO: 381973 - RNA, 23 nt, Human
aaaaggcaacaaaaaccccaaaa

SEQ ID NO: 381974 - RNA, 21 nt, Human
aagggaaaaacccuucuucca

SEQ ID NO: 381975 - RNA, 19 nt, Human
acaaaaaaccaaagcggcc

SEQ ID NO: 381976 - RNA, 20 nt, Human
accaaacaaaaaaccaaagc

SEQ ID NO: 381977 - RNA, 21 nt, Human
accccaaaaggaagggaaaaa

SEQ ID NO: 381978 - RNA, 23 nt, Human
accccacagccccccugccaccc

SEQ ID NO: 381979 - RNA, 23 nt, Human
agaaaaaaaaaaggcaacaaaaa

SEQ ID NO: 381980 - RNA, 26 nt, Human
agaaaaaaaaaaggcaacaaaaaccc

SEQ ID NO: 381981 - RNA, 19 nt, Human
agaaaaaaagaaaauggaa

SEQ ID NO: 381982 - RNA, 22 nt, Human
agcagcucccaaacaccccuca

SEQ ID NO: 381983 - RNA, 18 nt, Human
agccccccugccacccag

SEQ ID NO: 381984 - RNA, 20 nt, Human
agccuggucuccacacccgc

SEQ ID NO: 381985 - RNA, 24 nt, Human
agcgcaguggccuugggggagagg

SEQ ID NO: 381986 - RNA, 18 nt, Human
aggcaacaaaaaccccaa

SEQ ID NO: 381987 - RNA, 24 nt, Human
aggcaacaaaaaccccaaaaggaa

SEQ ID NO: 381988 - RNA, 19 nt, Human
caaccaaacaaaaaaccaa

SEQ ID NO: 381989 - RNA, 21 nt, Human
cacccagcagcucccaaacac

SEQ ID NO: 381990 - RNA, 19 nt, Human
caccccucacagccacagc

SEQ ID NO: 381991 - RNA, 21 nt, Human
cacggcacccuccgagucccc

SEQ ID NO: 381992 - RNA, 22 nt, Human
cagcagcucccaaacaccccuc

SEQ ID NO: 381993 - RNA, 22 nt, Human
caggaagacugagggccuggcg

SEQ ID NO: 381994 - RNA, 22 nt, Human
ccaaaaggaagggaaaaacccu

SEQ ID NO: 381995 - RNA, 23 nt, Human
ccaaccaaacaaaaaaccaaagc

SEQ ID NO: 381996 - RNA, 20 nt, Human
ccacccagcagcucccaaac

SEQ ID NO: 381997 - RNA, 25 nt, Human
ccacccagcagcucccaaacacccc

SEQ ID NO: 381998 - RNA, 21 nt, Human
cccaaacaccccucacagcca

SEQ ID NO: 381999 - RNA, 23 nt, Human
cccaaacaccccucacagccaca

SEQ ID NO: 382000 - RNA, 20 nt, Human
cccagcagcucccaaacacc

SEQ ID NO: 382001 - RNA, 22 nt, Human
ccccacagccccccugccaccc

SEQ ID NO: 382002 - RNA, 19 nt, Human
cccccugccacccagcagc

SEQ ID NO: 382003 - RNA, 27 nt, Human
cccccugccacccagcagcucccaaac

SEQ ID NO: 382004 - RNA, 21 nt, Human
ccccugccacccagcagcucc

SEQ ID NO: 382005 - RNA, 18 nt, Human
cccgccgccagcccugag

SEQ ID NO: 382006 - RNA, 21 nt, Human
cccugccacccagcagcuccc

SEQ ID NO: 382007 - RNA, 19 nt, Human
cccugcugucccccugccc

SEQ ID NO: 382008 - RNA, 22 nt, Human
ccuccggccgggccgccaaagc

SEQ ID NO: 382009 - RNA, 22 nt, Human
ccucgcccgcacggcacccucc

SEQ ID NO: 382010 - RNA, 18 nt, Human
ccugcccuccggccgggc

SEQ ID NO: 382011 - RNA, 23 nt, Human
cgcacggcacccuccgagucccc

SEQ ID NO: 382012 - RNA, 21 nt, Human
cggcucagacgcgaguuccag

SEQ ID NO: 382013 - RNA, 23 nt, Human
cggggcuccuggacacgggcugc

SEQ ID NO: 382014 - RNA, 25 nt, Human
cucacagccacagcucaaauccacc

SEQ ID NO: 382015 - RNA, 22 nt, Human
cucccaaacaccccucacagcc

SEQ ID NO: 382016 - RNA, 22 nt, Human
cugcgaagucaacaagccgcgu

SEQ ID NO: 382017 - RNA, 21 nt, Human
cugcggcggggccgccggacg

SEQ ID NO: 382018 - RNA, 21 nt, Human
cuggcggggcuccuggacacg

SEQ ID NO: 382019 - RNA, 20 nt, Human
cuggucugcggcggggccgc

SEQ ID NO: 382020 - RNA, 19 nt, Human
cugucccccugcccggccc

SEQ ID NO: 382021 - RNA, 19 nt, Human
cuucuccaaaauuuuacaa

SEQ ID NO: 382022 - RNA, 20 nt, Human
gaggguccugcccuccggcc

SEQ ID NO: 382023 - RNA, 18 nt, Human
gagucccgccgccagccc

SEQ ID NO: 382024 - RNA, 19 nt, Human
gcagcucccaaacaccccu

SEQ ID NO: 382025 - RNA, 18 nt, Human
gccaguagucuccacaua

SEQ ID NO: 382026 - RNA, 23 nt, Human
ggaaggcuccgcccggggcugcg

SEQ ID NO: 382027 - RNA, 21 nt, Human
ggcaacaaaaaccccaaaagg

SEQ ID NO: 382028 - RNA, 18 nt, Human
ggcacagaagcauggcgg

SEQ ID NO: 382029 - RNA, 19 nt, Human
ggcaggaagacugagggcc

SEQ ID NO: 382030 - RNA, 21 nt, Human
ggccuggcgcgggcaccuggc

SEQ ID NO: 382031 - RNA, 24 nt, Human
ggccuugggggagaggugaggguc

SEQ ID NO: 382032 - RNA, 24 nt, Human
gggaaaaacccuucuuccaacaga

SEQ ID NO: 382033 - RNA, 20 nt, Human
gggaaggcuccgcccggggc

SEQ ID NO: 382034 - RNA, 19 nt, Human
gggcaccuggcggggcucc

SEQ ID NO: 382035 - RNA, 19 nt, Human
ggggucccaagagcgcagu

SEQ ID NO: 382036 - RNA, 18 nt, Human
gggucaggagccuggucu

SEQ ID NO: 382037 - RNA, 22 nt, Human
uacaaagaaaaaagaaaaaaaa

SEQ ID NO: 382038 - RNA, 24 nt, Human
uauugaccgcacacuccugcuugc

SEQ ID NO: 382039 - RNA, 22 nt, Human
uccacauaaagugcauggaggc

SEQ ID NO: 382040 - RNA, 20 nt, Human
uccagguggcgcugcaugcc

SEQ ID NO: 382041 - RNA, 24 nt, Human
ucccaagcuuuauuuauugccaaa

SEQ ID NO: 382042 - RNA, 24 nt, Human
uccccgccgcgucugcaccauccc

SEQ ID NO: 382043 - RNA, 20 nt, Human
ucccugcugucccccugccc

SEQ ID NO: 382044 - RNA, 18 nt, Human
uccgacuucccuucucca

SEQ ID NO: 382045 - RNA, 23 nt, Human
uccgcgggugagcgguccuuccu

SEQ ID NO: 382046 - RNA, 24 nt, Human
uccggccgggccgccaaagcgggg

SEQ ID NO: 382047 - RNA, 23 nt, Human
uccuggacacgggcugcaggcgg

SEQ ID NO: 382048 - RNA, 23 nt, Human
uccuggagucccgccgccagccc

SEQ ID NO: 382049 - RNA, 22 nt, Human
ucugcggaccggcgggcaccgg

SEQ ID NO: 382050 - RNA, 22 nt, Human
ugacccgagagcgcaaaggcgg

SEQ ID NO: 382051 - RNA, 23 nt, Human
ugagcgguccuuccuuguguucc

SEQ ID NO: 382052 - RNA, 21 nt, Human
ugagggccuggcgcgggcacc

SEQ ID NO: 382053 - RNA, 18 nt, Human
ugcauggaggccgccucc

SEQ ID NO: 382054 - RNA, 21 nt, Human
ugccacccagcagcucccaaa

SEQ ID NO: 382055 - RNA, 24 nt, Human
uggaaccaaccaaacaaaaaacca

SEQ ID NO: 382056 - RNA, 25 nt, Human
uggaaccaaccaaacaaaaaaccaa

SEQ ID NO: 382057 - RNA, 25 nt, Human
uggaaccaaccaaacaaaaaaccag

SEQ ID NO: 382058 - RNA, 22 nt, Human
uggggcguggucggcacagaag

SEQ ID NO: 382059 - RNA, 21 nt, Human
uucccaagcuuuauuuauugc

SEQ ID NO: 382060 - RNA, 22 nt, Human
uugcuccggguuuucucugggg

SEQ ID NO: 382061 - RNA, 19 nt, Human
uugggcggccucgcccgca

SEQ ID NO: 382062 - RNA, 22 nt, Human
uuuuuuuuuuucaagcuuccca

SEQ ID NO: 382063 - RNA, 22 nt, Human
uuuuuuuuuuuuuuucaagcuu

SEQ ID NO: 382064 - RNA, 24 nt, Human
uuuuuuuuuuuuuuuuuuuucaag

SEQ ID NO: 382065 - RNA, 24 nt, Human
aaaagagaaaaaaauaaagacaaa

SEQ ID NO: 382066 - RNA, 18 nt, Human
aaagacaaaugagguggc

SEQ ID NO: 382067 - RNA, 25 nt, Human
aagagaaaaaaauaaagacaaauga

SEQ ID NO: 382068 - RNA, 22 nt, Human
aagcgagggccaggggugaggc

SEQ ID NO: 382069 - RNA, 20 nt, Human
agaaggaaggagacagaggg

SEQ ID NO: 382070 - RNA, 21 nt, Human
agcagccgugcuggccuucuu

SEQ ID NO: 382071 - RNA, 20 nt, Human
ccaauagaaaggacagaaac

SEQ ID NO: 382072 - RNA, 18 nt, Human
ccgagaaggaaggagaca

SEQ ID NO: 382073 - RNA, 19 nt, Human
cggguuggggcggaacugg

SEQ ID NO: 382074 - RNA, 22 nt, Human
cgugggcugcugggcugcuggg

SEQ ID NO: 382075 - RNA, 20 nt, Human
gagaaggaaggagacagagg

SEQ ID NO: 382076 - RNA, 20 nt, Human
gagcagccgugcuggccuuc

SEQ ID NO: 382077 - RNA, 21 nt, Human
gcggcgucgugagcagccgug

SEQ ID NO: 382078 - RNA, 19 nt, Human
gcugcugggcugcugggcu

SEQ ID NO: 382079 - RNA, 22 nt, Human
ggcugcugggcugcugggcugu

SEQ ID NO: 382080 - RNA, 20 nt, Human
gggcugcugggcugcugggc

SEQ ID NO: 382081 - RNA, 25 nt, Human
gggcugcugggcuguuuggucugcu

SEQ ID NO: 382082 - RNA, 21 nt, Human
guccaggguucccggguuggg

SEQ ID NO: 382083 - RNA, 22 nt, Human
uccaggguucccggguuggggc

SEQ ID NO: 382084 - RNA, 25 nt, Human
ucccugaacacacacaaagggaaca

SEQ ID NO: 382085 - RNA, 20 nt, Human
ugaacacacacaaagggaac

SEQ ID NO: 382086 - RNA, 24 nt, Human
ugagcagccgugcuggccuucuuu

SEQ ID NO: 382087 - RNA, 22 nt, Human
ugagguggcagagcaggagagc

SEQ ID NO: 382088 - RNA, 18 nt, Human
ugaugucucagugcuaca

SEQ ID NO: 382089 - RNA, 18 nt, Human
ugcggagagguggugaug

SEQ ID NO: 382090 - RNA, 19 nt, Human
uggcagagcaggagagcuc

SEQ ID NO: 382091 - RNA, 25 nt, Human
uggcuggcuccuauuggcugaaauu

SEQ ID NO: 382092 - RNA, 18 nt, Human
uuuuuuuuuuuuuuuuug

SEQ ID NO: 382093 - RNA, 18 nt, Human
uuuuuuuuuuuuuuuuug

SEQ ID NO: 382094 - RNA, 18 nt, Human
uuuuuuuuuuuuuuuuug

SEQ ID NO: 382095 - RNA, 23 nt, Human
aaaauucuuucauagaaaggcuu

SEQ ID NO: 382096 - RNA, 22 nt, Human
aaaguucucccugacaccuucc

SEQ ID NO: 382097 - RNA, 18 nt, Human
acgcugaaaccacggaaa

SEQ ID NO: 382098 - RNA, 21 nt, Human
cugaaaccacggaaaguucuc

SEQ ID NO: 382099 - RNA, 22 nt, Human
cugaaaccacggaaaguucucc

SEQ ID NO: 382100 - RNA, 21 nt, Human
uaagagcaaagucagguguuc

SEQ ID NO: 382101 - RNA, 21 nt, Human
uacaugguuuacauuauaggu

SEQ ID NO: 382102 - RNA, 19 nt, Human
uaucucagauacaugguuu

SEQ ID NO: 382103 - RNA, 21 nt, Human
uauggucuaagagcaaaguca

SEQ ID NO: 382104 - RNA, 23 nt, Human
ucaggcucggcucucuaaaccgc

SEQ ID NO: 382105 - RNA, 22 nt, Human
uucaggcucuggccuggguucu

SEQ ID NO: 382106 - RNA, 23 nt, Human
uuccgaggccugggcggugcccu

SEQ ID NO: 382107 - RNA, 21 nt, Human
uuucaggcucuggccuggguu

SEQ ID NO: 382108 - RNA, 22 nt, Human
aaaccccaccacugggucagaa

SEQ ID NO: 382109 - RNA, 23 nt, Human
aaaccccaccacugggucagaaa

SEQ ID NO: 382110 - RNA, 20 nt, Human
aacccugcccuccuucacca

SEQ ID NO: 382111 - RNA, 22 nt, Human
aacccugcccuccuucaccagc

SEQ ID NO: 382112 - RNA, 22 nt, Human
acucauccuggcucccaagccu

SEQ ID NO: 382113 - RNA, 19 nt, Human
agaaaagaacccugcccuc

SEQ ID NO: 382114 - RNA, 20 nt, Human
agaaaccaggcaaacagcag

SEQ ID NO: 382115 - RNA, 20 nt, Human
agaacccugcccuccuucac

SEQ ID NO: 382116 - RNA, 19 nt, Human
agccacagccuuggcacca

SEQ ID NO: 382117 - RNA, 19 nt, Human
agggcagagaagcauugcu

SEQ ID NO: 382118 - RNA, 18 nt, Human
cacguagagaaaagaacc

SEQ ID NO: 382119 - RNA, 20 nt, Human
cacguagagaaaagaacccu

SEQ ID NO: 382120 - RNA, 27 nt, Human
cagagguacuuuauuuggcaauuuuaa

SEQ ID NO: 382121 - RNA, 18 nt, Human
cagccuuggcaccauuuc

SEQ ID NO: 382122 - RNA, 19 nt, Human
cauuuuacacgaaagggaa

SEQ ID NO: 382123 - RNA, 20 nt, Human
cauuuuacacgaaagggaac

SEQ ID NO: 382124 - RNA, 19 nt, Human
ccccagaaaucccaccuuc

SEQ ID NO: 382125 - RNA, 19 nt, Human
cccucccggcccacucuga

SEQ ID NO: 382126 - RNA, 22 nt, Human
cccuccuucaccagccucccca

SEQ ID NO: 382127 - RNA, 25 nt, Human
ccugcccuccuucaccaaucgguug

SEQ ID NO: 382128 - RNA, 19 nt, Human
cuccccagaaaucccaccu

SEQ ID NO: 382129 - RNA, 29 nt, Human
cuucaccagccuccccagaaaucccaccu

SEQ ID NO: 382130 - RNA, 18 nt, Human
gagguggaaguuggggag

SEQ ID NO: 382131 - RNA, 20 nt, Human
gcauugcucaaaccccacca

SEQ ID NO: 382132 - RNA, 18 nt, Human
gccaccaucaugcagcuc

SEQ ID NO: 382133 - RNA, 22 nt, Human
gcucugcggagguggaaguugg

SEQ ID NO: 382134 - RNA, 21 nt, Human
uaacaugacacguagagaaaa

SEQ ID NO: 382135 - RNA, 24 nt, Human
uaacaugacacguagagaaaagaa

SEQ ID NO: 382136 - RNA, 24 nt, Human
uccuggcucccaagccuucccaag

SEQ ID NO: 382137 - RNA, 22 nt, Human
ugacacguagagaaaagaaccc

SEQ ID NO: 382138 - RNA, 19 nt, Human
ugagcgcagacguccuucc

SEQ ID NO: 382139 - RNA, 24 nt, Human
ugagcgcagacguccuuccuaacc

SEQ ID NO: 382140 - RNA, 18 nt, Human
uggaaguuggggagcuuu

SEQ ID NO: 382141 - RNA, 18 nt, Human
uggcgugccugccaugac

SEQ ID NO: 382142 - RNA, 18 nt, Human
uggcucccaagccuuccc

SEQ ID NO: 382143 - RNA, 24 nt, Human
uggcucccaagccuucccaaggug

SEQ ID NO: 382144 - RNA, 21 nt, Human
uucaagacagaguaauaacag

SEQ ID NO: 382145 - RNA, 23 nt, Human
aaaacaaacgaaagcacucuccc

SEQ ID NO: 382146 - RNA, 19 nt, Human
aaaaggaggaggaugaaga

SEQ ID NO: 382147 - RNA, 18 nt, Human
aaacaaaaccccaaaugc

SEQ ID NO: 382148 - RNA, 19 nt, Human
aaaccccaaaugccaaagg

SEQ ID NO: 382149 - RNA, 23 nt, Human
aaagaugauaugcagaauccacu

SEQ ID NO: 382150 - RNA, 26 nt, Human
aacccccuucucgcuccuucuuccau

SEQ ID NO: 382151 - RNA, 22 nt, Human
aauuauuaaugacaaacccugc

SEQ ID NO: 382152 - RNA, 22 nt, Human
acaaaaccccaaaugccaaagg

SEQ ID NO: 382153 - RNA, 20 nt, Human
acacuaagaaauaguaccau

SEQ ID NO: 382154 - RNA, 18 nt, Human
acauguaauaaaggcaag

SEQ ID NO: 382155 - RNA, 19 nt, Human
accccaaaugccaaaggaa

SEQ ID NO: 382156 - RNA, 23 nt, Human
acccugcaaauacaaaauaaaac

SEQ ID NO: 382157 - RNA, 24 nt, Human
agaaggaaaaaaggaaaaacaaaa

SEQ ID NO: 382158 - RNA, 21 nt, Human
agcacagugaagacugugugu

SEQ ID NO: 382159 - RNA, 23 nt, Human
aggaaaaaaggaaaaacaaaacc

SEQ ID NO: 382160 - RNA, 22 nt, Human
aggaugaagaaggaaaaaagga

SEQ ID NO: 382161 - RNA, 23 nt, Human
aguaauaaaauaaaauaaaauga

SEQ ID NO: 382162 - RNA, 20 nt, Human
caaaaccccaaaugccaaag

SEQ ID NO: 382163 - RNA, 22 nt, Human
caaaucacuggucacagaauuc

SEQ ID NO: 382164 - RNA, 22 nt, Human
caccccucucugcuggcucucu

SEQ ID NO: 382165 - RNA, 18 nt, Human
caguggcacgauuccaaa

SEQ ID NO: 382166 - RNA, 23 nt, Human
ccaguuucucccauuuaaaacaa

SEQ ID NO: 382167 - RNA, 26 nt, Human
ccaucugagagacuucaucuggcugc

SEQ ID NO: 382168 - RNA, 28 nt, Human
cccaaaucacuggucacagaauucaaaa

SEQ ID NO: 382169 - RNA, 22 nt, Human
cccccuucucgcuccuucuucc

SEQ ID NO: 382170 - RNA, 25 nt, Human
ccccuucucgcuccuucuuccauuc

SEQ ID NO: 382171 - RNA, 18 nt, Human
cccuccccacccaucuga

SEQ ID NO: 382172 - RNA, 21 nt, Human
cccuccccacccaucugagag

SEQ ID NO: 382173 - RNA, 18 nt, Human
ccuccaggauaaggcuuc

SEQ ID NO: 382174 - RNA, 18 nt, Human
ccucucugcuggcucucu

SEQ ID NO: 382175 - RNA, 20 nt, Human
ccuggcgcugggguggcucc

SEQ ID NO: 382176 - RNA, 18 nt, Human
ccuucucgcuccuucuuc

SEQ ID NO: 382177 - RNA, 19 nt, Human
ccuucucgcuccuucuucc

SEQ ID NO: 382178 - RNA, 20 nt, Human
ccuuggcaacaugcuccagu

SEQ ID NO: 382179 - RNA, 19 nt, Human
cgaaagcacucucccuaac

SEQ ID NO: 382180 - RNA, 21 nt, Human
cgaaagcacucucccuaaccc

SEQ ID NO: 382181 - RNA, 22 nt, Human
cgaaagcacucucccuaaccca

SEQ ID NO: 382182 - RNA, 21 nt, Human
cuccuccaggauaaggcuucg

SEQ ID NO: 382183 - RNA, 26 nt, Human
cucuccuccaggauaaggcuucguca

SEQ ID NO: 382184 - RNA, 22 nt, Human
cuggaaggagcugacccucccc

SEQ ID NO: 382185 - RNA, 20 nt, Human
cuggcgcagaccagcagugg

SEQ ID NO: 382186 - RNA, 19 nt, Human
cuucucgcuccuucuucca

SEQ ID NO: 382187 - RNA, 26 nt, Human
cuuggcaacaugcuccaguuucuccc

SEQ ID NO: 382188 - RNA, 19 nt, Human
gaaagcacucucccuaacc

SEQ ID NO: 382189 - RNA, 24 nt, Human
gagcgcuucauggggagaaacuga

SEQ ID NO: 382190 - RNA, 19 nt, Human
gagcugacccuccccaccc

SEQ ID NO: 382191 - RNA, 20 nt, Human
gaggaugaagaaggaaaaaa

SEQ ID NO: 382192 - RNA, 19 nt, Human
gaugaagaaggaaaaaagg

SEQ ID NO: 382193 - RNA, 19 nt, Human
ggcgccuggcgcuggggug

SEQ ID NO: 382194 - RNA, 21 nt, Human
ggcugcagcacagugaagacu

SEQ ID NO: 382195 - RNA, 22 nt, Human
ggggcguagggcaaacggggaa

SEQ ID NO: 382196 - RNA, 18 nt, Human
uaaaacccaaaucacugg

SEQ ID NO: 382197 - RNA, 27 nt, Human
uaaaaugaucgcuggaaggagcugaag

SEQ ID NO: 382198 - RNA, 21 nt, Human
uaaaauuaaaaacaaaaguaa

SEQ ID NO: 382199 - RNA, 19 nt, Human
uaaagcaggauaccugagg

SEQ ID NO: 382200 - RNA, 22 nt, Human
uaccaucgaugaaaaaggaaau

SEQ ID NO: 382201 - RNA, 21 nt, Human
uauauacaaaucuguacaccc

SEQ ID NO: 382202 - RNA, 20 nt, Human
uaucauaaucccaaauauac

SEQ ID NO: 382203 - RNA, 25 nt, Human
ucaguaacccccuucucgcuccuuc

SEQ ID NO: 382204 - RNA, 22 nt, Human
uccaaacaaaugucagacgaga

SEQ ID NO: 382205 - RNA, 23 nt, Human
uccacugacguuaucuacagaag

SEQ ID NO: 382206 - RNA, 21 nt, Human
ucccuggacgggcgccuggcg

SEQ ID NO: 382207 - RNA, 23 nt, Human
ucccuggacgggcgccuggcgcu

SEQ ID NO: 382208 - RNA, 18 nt, Human
uccuucuuccauucaccc

SEQ ID NO: 382209 - RNA, 23 nt, Human
ucgguggagucagcgaaggcucu

SEQ ID NO: 382210 - RNA, 19 nt, Human
ucucugccuuggcaacaug

SEQ ID NO: 382211 - RNA, 19 nt, Human
ugacaaacccugcaaauac

SEQ ID NO: 382212 - RNA, 18 nt, Human
ugagagacuucaucuggc

SEQ ID NO: 382213 - RNA, 21 nt, Human
ugauaugcagaauccacuaca

SEQ ID NO: 382214 - RNA, 19 nt, Human
ugaucgcuggaaggagcug

SEQ ID NO: 382215 - RNA, 24 nt, Human
ugcaaauacaaaauaaaacccaaa

SEQ ID NO: 382216 - RNA, 21 nt, Human
ugccuuggcaacaugcuccag

SEQ ID NO: 382217 - RNA, 23 nt, Human
uggaaaggacgguacaucuggcg

SEQ ID NO: 382218 - RNA, 19 nt, Human
uggcaacaugcuccaguuu

SEQ ID NO: 382219 - RNA, 21 nt, Human
uggcaacaugcuccaguuucu

SEQ ID NO: 382220 - RNA, 18 nt, Human
uuccauucaccccucucu

SEQ ID NO: 382221 - RNA, 24 nt, Human
uucucgcuccuucuuccauucacc

SEQ ID NO: 382222 - RNA, 25 nt, Human
uuuguacacagugauuccuuaugca

SEQ ID NO: 382223 - RNA, 22 nt, Human
aacuagucccagaacauuucua

SEQ ID NO: 382224 - RNA, 21 nt, Human
aagaaccucugcaacaacaac

SEQ ID NO: 382225 - RNA, 28 nt, Human
aagcagcgacgaaaauaguccuugaagc

SEQ ID NO: 382226 - RNA, 18 nt, Human
agaucauucaggccggag

SEQ ID NO: 382227 - RNA, 21 nt, Human
aggggaagagaguguggaggc

SEQ ID NO: 382228 - RNA, 23 nt, Human
caacuagucccagaacauuucua

SEQ ID NO: 382229 - RNA, 19 nt, Human
cacguaccacaaaaacuac

SEQ ID NO: 382230 - RNA, 20 nt, Human
cacugcacguaccacaaaaa

SEQ ID NO: 382231 - RNA, 20 nt, Human
cauggagaucauucaggccg

SEQ ID NO: 382232 - RNA, 22 nt, Human
ccacaaaaacuacuacugaccu

SEQ ID NO: 382233 - RNA, 18 nt, Human
ccagaacauuucuagaua

SEQ ID NO: 382234 - RNA, 20 nt, Human
ccaggauuggagacuuaaaa

SEQ ID NO: 382235 - RNA, 21 nt, Human
cccaggauuggagacuuaaaa

SEQ ID NO: 382236 - RNA, 22 nt, Human
cccaggauuggagacuuaaaac

SEQ ID NO: 382237 - RNA, 22 nt, Human
ccugccugcaugcacucaaaaa

SEQ ID NO: 382238 - RNA, 19 nt, Human
cgcaagcagcgacgaaaau

SEQ ID NO: 382239 - RNA, 21 nt, Human
cuaaagauacaacucaacuag

SEQ ID NO: 382240 - RNA, 25 nt, Human
cugaacaauuccugaaaaaccugaa

SEQ ID NO: 382241 - RNA, 18 nt, Human
gaagagaguguggaggcu

SEQ ID NO: 382242 - RNA, 24 nt, Human
gggcggcuagaaggugacagaaaa

SEQ ID NO: 382243 - RNA, 18 nt, Human
gugaccgcgucuucaugg

SEQ ID NO: 382244 - RNA, 24 nt, Human
guguauuaaccaaaccaaacaaag

SEQ ID NO: 382245 - RNA, 18 nt, Human
uaaaacgcaagcagcgac

SEQ ID NO: 382246 - RNA, 22 nt, Human
uaccacaaaaacuacuacugac

SEQ ID NO: 382247 - RNA, 18 nt, Human
uacuaaagauacaacuca

SEQ ID NO: 382248 - RNA, 20 nt, Human
uacuaaagauacaacucaac

SEQ ID NO: 382249 - RNA, 21 nt, Human
uccaaaucuccacuucgugau

SEQ ID NO: 382250 - RNA, 18 nt, Human
ucugcaaacagagaucac

SEQ ID NO: 382251 - RNA, 23 nt, Human
ucuguguauuaaccaaaccaaac

SEQ ID NO: 382252 - RNA, 21 nt, Human
ugaaaaaccugauuaugaagg

SEQ ID NO: 382253 - RNA, 23 nt, Human
ugaaaaaccugauuaugaaggca

SEQ ID NO: 382254 - RNA, 22 nt, Human
ugaaggcacugaugccguaccc

SEQ ID NO: 382255 - RNA, 26 nt, Human
ugccguacccacuuucugcaaacaga

SEQ ID NO: 382256 - RNA, 21 nt, Human
uggaggcugcgugaccgcguc

SEQ ID NO: 382257 - RNA, 21 nt, Human
uuuuuugcauagccaaacauc

SEQ ID NO: 382258 - RNA, 18 nt, Human
uuuuuuuuuuuuuuuuug

SEQ ID NO: 382259 - RNA, 21 nt, Human
uuuuuuuuuuuuuuuuugcau

SEQ ID NO: 382260 - RNA, 24 nt, Human
uuuuuuuuuuuuuuuuuugcauag

SEQ ID NO: 382261 - RNA, 28 nt, Human
aaacagguaauauguaacaaaagccaga

SEQ ID NO: 382262 - RNA, 19 nt, Human
aacagcaccuuagccaaga

SEQ ID NO: 382263 - RNA, 18 nt, Human
aacagguaauauguaaca

SEQ ID NO: 382264 - RNA, 19 nt, Human
aaccagaaaaccagaagca

SEQ ID NO: 382265 - RNA, 21 nt, Human
aagaaaauaaagaccuguggc

SEQ ID NO: 382266 - RNA, 25 nt, Human
aagaaaccgucacacaggcuucuga

SEQ ID NO: 382267 - RNA, 22 nt, Human
aagcaggauagcuguuuauggc

SEQ ID NO: 382268 - RNA, 24 nt, Human
acaaagaaaagaagagguguuaga

SEQ ID NO: 382269 - RNA, 22 nt, Human
acaaccagaaaaccagaagcaa

SEQ ID NO: 382270 - RNA, 24 nt, Human
accgcaaccuccacuuccagguuc

SEQ ID NO: 382271 - RNA, 22 nt, Human
accucaguuucccgaguagcug

SEQ ID NO: 382272 - RNA, 23 nt, Human
accucaguuucccgaguagcugg

SEQ ID NO: 382273 - RNA, 24 nt, Human
accucaguuucccgaguagcuggg

SEQ ID NO: 382274 - RNA, 18 nt, Human
accuguggcugcauagga

SEQ ID NO: 382275 - RNA, 20 nt, Human
agaaaauccucuuacuacca

SEQ ID NO: 382276 - RNA, 18 nt, Human
agaaacaaagaaaagaag

SEQ ID NO: 382277 - RNA, 21 nt, Human
agacuaaagaaaccgucacac

SEQ ID NO: 382278 - RNA, 21 nt, Human
agacuuucugggccuucuaag

SEQ ID NO: 382279 - RNA, 18 nt, Human
agccaagaggguuccagc

SEQ ID NO: 382280 - RNA, 21 nt, Human
agccgugaagagaaagugagg

SEQ ID NO: 382281 - RNA, 22 nt, Human
aguagaaaugguugucuuuguu

SEQ ID NO: 382282 - RNA, 23 nt, Human
aguuauuuuuaaaacaccuauca

SEQ ID NO: 382283 - RNA, 23 nt, Human
aguuuucuggaggacaaacaggu

SEQ ID NO: 382284 - RNA, 23 nt, Human
auguaacaaaagccagagaaaga

SEQ ID NO: 382285 - RNA, 19 nt, Human
auuccgucagcuggcucug

SEQ ID NO: 382286 - RNA, 24 nt, Human
caagcugguaacccccaucaacac

SEQ ID NO: 382287 - RNA, 21 nt, Human
cacacaggcuucugaagugac

SEQ ID NO: 382288 - RNA, 20 nt, Human
caccgcaaccuccacuucca

SEQ ID NO: 382289 - RNA, 21 nt, Human
cacucagaaaagcagcauggg

SEQ ID NO: 382290 - RNA, 19 nt, Human
caggaggagauaaaucaau

SEQ ID NO: 382291 - RNA, 25 nt, Human
caguuuuucagaugcauuauggaag

SEQ ID NO: 382292 - RNA, 18 nt, Human
caugccuuaauuuguguu

SEQ ID NO: 382293 - RNA, 21 nt, Human
cauucugaugaacuuaggaaa

SEQ ID NO: 382294 - RNA, 18 nt, Human
ccagaaaaccagaagcaa

SEQ ID NO: 382295 - RNA, 19 nt, Human
ccagguucaaucgauucuc

SEQ ID NO: 382296 - RNA, 22 nt, Human
ccauaaauaaagugcaccauga

SEQ ID NO: 382297 - RNA, 21 nt, Human
ccauuggcagcacuugcaggu

SEQ ID NO: 382298 - RNA, 24 nt, Human
cccaccucaguuucccgaguagcu

SEQ ID NO: 382299 - RNA, 19 nt, Human
cccaggcuggagugcgaca

SEQ ID NO: 382300 - RNA, 23 nt, Human
cccauuggcagcacuugcaggua

SEQ ID NO: 382301 - RNA, 18 nt, Human
ccccaucaacacucagaa

SEQ ID NO: 382302 - RNA, 23 nt, Human
ccccaucaacacucagaaaagca

SEQ ID NO: 382303 - RNA, 19 nt, Human
cccgaguagcugggauuac

SEQ ID NO: 382304 - RNA, 23 nt, Human
ccgcaaccuccacuuccagguuc

SEQ ID NO: 382305 - RNA, 18 nt, Human
ccuccugccuaggccugg

SEQ ID NO: 382306 - RNA, 19 nt, Human
ccuccugccuaggccuggg

SEQ ID NO: 382307 - RNA, 21 nt, Human
ccuguaagucacacauauaua

SEQ ID NO: 382308 - RNA, 18 nt, Human
ccuucagccagaauccug

SEQ ID NO: 382309 - RNA, 24 nt, Human
ccuucauucugaugaacuuaggaa

SEQ ID NO: 382310 - RNA, 21 nt, Human
cgacaggaugaucuuggcuca

SEQ ID NO: 382311 - RNA, 24 nt, Human
cgcucuuguugcccaggcuggagu

SEQ ID NO: 382312 - RNA, 22 nt, Human
cuagguauaaagacuaaagaaa

SEQ ID NO: 382313 - RNA, 21 nt, Human
cucaaguuauuuuuaaaacac

SEQ ID NO: 382314 - RNA, 23 nt, Human
cucaccgcaaccuccacuuccag

SEQ ID NO: 382315 - RNA, 23 nt, Human
cucaguuucccgaguagcuggga

SEQ ID NO: 382316 - RNA, 19 nt, Human
cuguaccuguaagucacac

SEQ ID NO: 382317 - RNA, 23 nt, Human
cuuccagguucaaucgauucucc

SEQ ID NO: 382318 - RNA, 24 nt, Human
cuuguugcccaggcuggagugcga

SEQ ID NO: 382319 - RNA, 25 nt, Human
cuuucugggccuucuaagagcaaca

SEQ ID NO: 382320 - RNA, 24 nt, Human
gaguagcugggauuacagcgaugc

SEQ ID NO: 382321 - RNA, 22 nt, Human
gaugcauuauggaagaaaaucc

SEQ ID NO: 382322 - RNA, 24 nt, Human
gccugaggcugagguauggguaga

SEQ ID NO: 382323 - RNA, 21 nt, Human
gcucaugaugcuucucuucca

SEQ ID NO: 382324 - RNA, 24 nt, Human
gcucuuguugcccaggcuggagug

SEQ ID NO: 382325 - RNA, 22 nt, Human
ggcugcuagaaacaaagaaaag

SEQ ID NO: 382326 - RNA, 24 nt, Human
ggcugcuagaaacaaagaaaagaa

SEQ ID NO: 382327 - RNA, 23 nt, Human
guguuaugggaaguuggaggcac

SEQ ID NO: 382328 - RNA, 24 nt, Human
uaaaacaccuaucaaauuggcuca

SEQ ID NO: 382329 - RNA, 21 nt, Human
uaaagaaaccgucacacaggc

SEQ ID NO: 382330 - RNA, 22 nt, Human
uaacaaaagccagagaaagaga

SEQ ID NO: 382331 - RNA, 19 nt, Human
uaagagcaacaguggauca

SEQ ID NO: 382332 - RNA, 22 nt, Human
uaaguaagaaaauaaagaccug

SEQ ID NO: 382333 - RNA, 19 nt, Human
uaagucacacauauauauc

SEQ ID NO: 382334 - RNA, 20 nt, Human
uaccacauuucaggagacuu

SEQ ID NO: 382335 - RNA, 19 nt, Human
uaccauaaauaaagugcac

SEQ ID NO: 382336 - RNA, 25 nt, Human
uacuuggugggcuuggcagagagcg

SEQ ID NO: 382337 - RNA, 26 nt, Human
uagaauccacccauugugcacucucc

SEQ ID NO: 382338 - RNA, 21 nt, Human
uaggaaauaccaugcaacaac

SEQ ID NO: 382339 - RNA, 23 nt, Human
uagguauaaagacuaaagaaacc

SEQ ID NO: 382340 - RNA, 23 nt, Human
uaguaccauaaauaaagugcacc

SEQ ID NO: 382341 - RNA, 31 nt, Human
uaucuuuuuuuuucuuuuugagauggaguuu

SEQ ID NO: 382342 - RNA, 19 nt, Human
ucaagagugugagaggaaa

SEQ ID NO: 382343 - RNA, 19 nt, Human
ucacacaggcuucugaagu

SEQ ID NO: 382344 - RNA, 23 nt, Human
ucaccgcaaccuccacuuccagg

SEQ ID NO: 382345 - RNA, 19 nt, Human
ucagccagaauccuggcug

SEQ ID NO: 382346 - RNA, 23 nt, Human
ucaguuucccgaguagcugggau

SEQ ID NO: 382347 - RNA, 22 nt, Human
ucccgaguagcugggauuacag

SEQ ID NO: 382348 - RNA, 23 nt, Human
ucccgaguagcugggauuacagc

SEQ ID NO: 382349 - RNA, 18 nt, Human
uccuggcugcugagacug

SEQ ID NO: 382350 - RNA, 20 nt, Human
uccuucagccagaauccugg

SEQ ID NO: 382351 - RNA, 23 nt, Human
ucgcucuuguugcccaggcugga

SEQ ID NO: 382352 - RNA, 21 nt, Human
ucugucuuagggauuuucugg

SEQ ID NO: 382353 - RNA, 22 nt, Human
ucuuguugcccaggcuggagug

SEQ ID NO: 382354 - RNA, 22 nt, Human
ucuuuuuuuuucuuuuugagau

SEQ ID NO: 382355 - RNA, 21 nt, Human
ugacccagaaaucccaccccu

SEQ ID NO: 382356 - RNA, 22 nt, Human
ugcaacaaccagaaaaccagaa

SEQ ID NO: 382357 - RNA, 20 nt, Human
ugcaaugcccaaagacuuuc

SEQ ID NO: 382358 - RNA, 18 nt, Human
ugcccaggcuggagugcg

SEQ ID NO: 382359 - RNA, 20 nt, Human
ugcccaggcuggagugcgac

SEQ ID NO: 382360 - RNA, 18 nt, Human
ugcuuuauuuccuuagua

SEQ ID NO: 382361 - RNA, 24 nt, Human
uggagugcgacaggaugaucuugg

SEQ ID NO: 382362 - RNA, 23 nt, Human
uggcucuguacuucuauugggcu

SEQ ID NO: 382363 - RNA, 22 nt, Human
ugggauuacagcgaugcgcuac

SEQ ID NO: 382364 - RNA, 24 nt, Human
ugggauuacagcgaugcgcuacca

SEQ ID NO: 382365 - RNA, 25 nt, Human
ugggauuacagcgaugcgcuaccau

SEQ ID NO: 382366 - RNA, 21 nt, Human
ugggcuuggcagagagcgugu

SEQ ID NO: 382367 - RNA, 21 nt, Human
uggugggcuuggcagagagcg

SEQ ID NO: 382368 - RNA, 21 nt, Human
ugguggguuccaucaacuucu

SEQ ID NO: 382369 - RNA, 25 nt, Human
uucaaucgauucucccaccucaguu

SEQ ID NO: 382370 - RNA, 18 nt, Human
uuccaaagggguucugga

SEQ ID NO: 382371 - RNA, 22 nt, Human
uuccaggccuccugccuaggcc

SEQ ID NO: 382372 - RNA, 24 nt, Human
uucgcucuuguugcccaggcugga

SEQ ID NO: 382373 - RNA, 18 nt, Human
uugcccaggcuggagugc

SEQ ID NO: 382374 - RNA, 22 nt, Human
uugguggguuccaucaacuucu

SEQ ID NO: 382375 - RNA, 26 nt, Human
uuuaaaacaccuaucaaauuggcuca

SEQ ID NO: 382376 - RNA, 20 nt, Human
uuuccccuucauucugauga

SEQ ID NO: 382377 - RNA, 24 nt, Human
uuucgcucuuguugcccaggcugg

SEQ ID NO: 382378 - RNA, 21 nt, Human
uuuuccccuucauucugauga

SEQ ID NO: 382379 - RNA, 21 nt, Human
uuuucuggaggacaaacaggu

SEQ ID NO: 382380 - RNA, 25 nt, Human
uuuuuucuuuuugagauggaguuuc

SEQ ID NO: 382381 - RNA, 25 nt, Human
aaaaacagacaauguaaaacuuucc

SEQ ID NO: 382382 - RNA, 19 nt, Human
accaauguacauacacaca

SEQ ID NO: 382383 - RNA, 21 nt, Human
acuaggagucucuguuccugg

SEQ ID NO: 382384 - RNA, 20 nt, Human
agaaaaacagacaauguaaa

SEQ ID NO: 382385 - RNA, 21 nt, Human
agaauucacccaaagccuggg

SEQ ID NO: 382386 - RNA, 22 nt, Human
agagcccuucccacuggcgcac

SEQ ID NO: 382387 - RNA, 19 nt, Human
agauaauauaccugacccc

SEQ ID NO: 382388 - RNA, 24 nt, Human
auauaccugaccaauguacauaca

SEQ ID NO: 382389 - RNA, 20 nt, Human
auccagaauucacccaaagc

SEQ ID NO: 382390 - RNA, 22 nt, Human
caagagagcccuucccacuggc

SEQ ID NO: 382391 - RNA, 25 nt, Human
caauguacauacacacaucaagaug

SEQ ID NO: 382392 - RNA, 18 nt, Human
cagaauucacccaaagcc

SEQ ID NO: 382393 - RNA, 21 nt, Human
cuaggagucucuguuccuggg

SEQ ID NO: 382394 - RNA, 19 nt, Human
cugacugucaagagagccc

SEQ ID NO: 382395 - RNA, 18 nt, Human
cuggcgcacauuccugag

SEQ ID NO: 382396 - RNA, 19 nt, Human
cuguggagagacgacagag

SEQ ID NO: 382397 - RNA, 23 nt, Human
gagaagaaaaacagacaauguaa

SEQ ID NO: 382398 - RNA, 19 nt, Human
gagaugccaccaccugcgu

SEQ ID NO: 382399 - RNA, 18 nt, Human
gccauccagaauucaccc

SEQ ID NO: 382400 - RNA, 19 nt, Human
gcuguggagagacgacaga

SEQ ID NO: 382401 - RNA, 23 nt, Human
ggugcuguggagagacgacagag

SEQ ID NO: 382402 - RNA, 24 nt, Human
uaaaacucugaguuaaaagcgcca

SEQ ID NO: 382403 - RNA, 21 nt, Human
uaaaagcgccaauauaaaucc

SEQ ID NO: 382404 - RNA, 20 nt, Human
ucuuccagaaagaacaauug

SEQ ID NO: 382405 - RNA, 21 nt, Human
uggagcuggggcccucacagc

SEQ ID NO: 382406 - RNA, 24 nt, Human
ugggagaagaaaaacagacaaugu

SEQ ID NO: 382407 - RNA, 20 nt, Human
uggguggagcuggggcccuc

SEQ ID NO: 382408 - RNA, 24 nt, Human
aaaggaaugccaccagagaaaaaa

SEQ ID NO: 382409 - RNA, 19 nt, Human
aaccaguauaaguagcaca

SEQ ID NO: 382410 - RNA, 18 nt, Human
aaggcagcgccaaggaca

SEQ ID NO: 382411 - RNA, 18 nt, Human
acaaggcagcgccaagga

SEQ ID NO: 382412 - RNA, 22 nt, Human
acagccaggcucuggauuugcc

SEQ ID NO: 382413 - RNA, 18 nt, Human
accagagaaaaaauacaa

SEQ ID NO: 382414 - RNA, 19 nt, Human
acuccgaccagccgccccu

SEQ ID NO: 382415 - RNA, 20 nt, Human
agaaaaaauacaagucugua

SEQ ID NO: 382416 - RNA, 21 nt, Human
agacacauggccucuucugua

SEQ ID NO: 382417 - RNA, 21 nt, Human
agcacaauucucguggcuacu

SEQ ID NO: 382418 - RNA, 21 nt, Human
agcgccaaggacacucaggga

SEQ ID NO: 382419 - RNA, 23 nt, Human
agcgccaaggacacucagggacg

SEQ ID NO: 382420 - RNA, 23 nt, Human
aggcagcgccaaggacacucagg

SEQ ID NO: 382421 - RNA, 24 nt, Human
agugucauguuuauugauguggag

SEQ ID NO: 382422 - RNA, 24 nt, Human
auaucuuuauuuucauacuuaaaa

SEQ ID NO: 382423 - RNA, 24 nt, Human
auauggcagcccuggcucaaggau

SEQ ID NO: 382424 - RNA, 23 nt, Human
caaaucccuaaauggagguagag

SEQ ID NO: 382425 - RNA, 19 nt, Human
caagcaaaucccuaaaugg

SEQ ID NO: 382426 - RNA, 26 nt, Human
caaggauuucucccccugcacgauuc

SEQ ID NO: 382427 - RNA, 19 nt, Human
cacagccaggcucuggauu

SEQ ID NO: 382428 - RNA, 23 nt, Human
cacagccaggcucuggauuugcc

SEQ ID NO: 382429 - RNA, 18 nt, Human
cagcccuggcucaaggau

SEQ ID NO: 382430 - RNA, 21 nt, Human
caggcucuggauuugccuccu

SEQ ID NO: 382431 - RNA, 23 nt, Human
ccagagaaaaaauacaagucugu

SEQ ID NO: 382432 - RNA, 25 nt, Human
cccacagccaggcucuggauuugcc

SEQ ID NO: 382433 - RNA, 18 nt, Human
cccacggucuacccaccc

SEQ ID NO: 382434 - RNA, 23 nt, Human
cccaggagcggaugcaaaggcgc

SEQ ID NO: 382435 - RNA, 22 nt, Human
cccccacggucuacccaccucg

SEQ ID NO: 382436 - RNA, 26 nt, Human
ccccuuguccccgccguccucguccg

SEQ ID NO: 382437 - RNA, 27 nt, Human
ccccuuguccccgccguccucguccgc

SEQ ID NO: 382438 - RNA, 23 nt, Human
ccuacagggcgccucggugccca

SEQ ID NO: 382439 - RNA, 18 nt, Human
ccugcgacccaaggaccu

SEQ ID NO: 382440 - RNA, 21 nt, Human
cgaccagccgccccuuguccc

SEQ ID NO: 382441 - RNA, 21 nt, Human
cgccaacccaauaaguuacac

SEQ ID NO: 382442 - RNA, 23 nt, Human
cuaaaggaaugccaccagagaaa

SEQ ID NO: 382443 - RNA, 18 nt, Human
cucagggacggaggaacc

SEQ ID NO: 382444 - RNA, 20 nt, Human
cugcagucgaaccuugccuc

SEQ ID NO: 382445 - RNA, 24 nt, Human
gcagaguggucacuuuccccacag

SEQ ID NO: 382446 - RNA, 19 nt, Human
gccacugagauauccccca

SEQ ID NO: 382447 - RNA, 22 nt, Human
gcgggcacaaggcagcgccaag

SEQ ID NO: 382448 - RNA, 18 nt, Human
ggaaugccaccagagaaa

SEQ ID NO: 382449 - RNA, 23 nt, Human
ggcacaaggcagcgccaaggaca

SEQ ID NO: 382450 - RNA, 23 nt, Human
gggacggaggaaccgacagggga

SEQ ID NO: 382451 - RNA, 20 nt, Human
uaaggaggacuagaaaccca

SEQ ID NO: 382452 - RNA, 23 nt, Human
uacacacaugcuaugacuccaau

SEQ ID NO: 382453 - RNA, 25 nt, Human
uacagggcgccucggugcccaggag

SEQ ID NO: 382454 - RNA, 21 nt, Human
uaucccaagcaaaucccuaaa

SEQ ID NO: 382455 - RNA, 21 nt, Human
ucacucagguacuaggaaggu

SEQ ID NO: 382456 - RNA, 26 nt, Human
ucagagugucauguuuauugaugugg

SEQ ID NO: 382457 - RNA, 18 nt, Human
uccgccacugagauaucc

SEQ ID NO: 382458 - RNA, 18 nt, Human
ugaagacaccaugccuag

SEQ ID NO: 382459 - RNA, 22 nt, Human
ugcaaaggcgcugggcgggcac

SEQ ID NO: 382460 - RNA, 18 nt, Human
ugcccaggagcggaugca

SEQ ID NO: 382461 - RNA, 21 nt, Human
uguuccuauuuuucacacucu

SEQ ID NO: 382462 - RNA, 18 nt, Human
uuacacacucacucaggu

SEQ ID NO: 382463 - RNA, 20 nt, Human
uuucucccccugcacgauuc

SEQ ID NO: 382464 - RNA, 25 nt, Human
aaagaacuucucagaaagcugugca

SEQ ID NO: 382465 - RNA, 23 nt, Human
aagauccaaaaccgucugaagga

SEQ ID NO: 382466 - RNA, 24 nt, Human
aagcugugcaguaagauccaaaac

SEQ ID NO: 382467 - RNA, 18 nt, Human
agaaauucucacugguug

SEQ ID NO: 382468 - RNA, 21 nt, Human
augcaagccacaaaacauggc

SEQ ID NO: 382469 - RNA, 21 nt, Human
caguaagauccaaaaccgucu

SEQ ID NO: 382470 - RNA, 22 nt, Human
cauauuuguucuaaucaugaag

SEQ ID NO: 382471 - RNA, 23 nt, Human
cauggcaccaaaagaacuucuca

SEQ ID NO: 382472 - RNA, 19 nt, Human
ccacaaaacauggcaccaa

SEQ ID NO: 382473 - RNA, 20 nt, Human
gaaagcugugcaguaagauc

SEQ ID NO: 382474 - RNA, 21 nt, Human
gauccaaaaccgucugaagga

SEQ ID NO: 382475 - RNA, 27 nt, Human
uaaaugacucccccgccgaguccccca

SEQ ID NO: 382476 - RNA, 20 nt, Human
uauuuguucuaaucaugaag

SEQ ID NO: 382477 - RNA, 23 nt, Human
uccaaaaccgucugaaggaagaa

SEQ ID NO: 382478 - RNA, 19 nt, Human
ugaaggaagaaauucucac

SEQ ID NO: 382479 - RNA, 22 nt, Human
ugacucccccgccgaguccccc

SEQ ID NO: 382480 - RNA, 21 nt, Human
ugcaagccacaaaacauggca

SEQ ID NO: 382481 - RNA, 26 nt, Human
ugcaagccacaaaacauggcaccaaa

SEQ ID NO: 382482 - RNA, 20 nt, Human
uuaaaugacucccccgccga

SEQ ID NO: 382483 - RNA, 21 nt, Human
uugguguuaauugguucuucc

SEQ ID NO: 382484 - RNA, 22 nt, Human
aaaaauagcuacauuagaaaga

SEQ ID NO: 382485 - RNA, 19 nt, Human
aaaagggacacagaacaaa

SEQ ID NO: 382486 - RNA, 23 nt, Human
aacucaaaagaagucacugccac

SEQ ID NO: 382487 - RNA, 20 nt, Human
aagaagucacugccaccaac

SEQ ID NO: 382488 - RNA, 25 nt, Human
acauuagaaagaccaacacuuuaga

SEQ ID NO: 382489 - RNA, 25 nt, Human
accagccccaaaggccccaucugga

SEQ ID NO: 382490 - RNA, 19 nt, Human
agagcaagcaaaccaccaa

SEQ ID NO: 382491 - RNA, 23 nt, Human
agauauucagcaucuaacaguuc

SEQ ID NO: 382492 - RNA, 18 nt, Human
agcaagcaaaccaccaag

SEQ ID NO: 382493 - RNA, 21 nt, Human
aguagcaucugguaagauugg

SEQ ID NO: 382494 - RNA, 23 nt, Human
auaaaguuuuauuaauauucuga

SEQ ID NO: 382495 - RNA, 25 nt, Human
aucuggaacaaguaucaaccaggag

SEQ ID NO: 382496 - RNA, 18 nt, Human
caacacuuuagaaaaaga

SEQ ID NO: 382497 - RNA, 23 nt, Human
cagucauuguggaaggagacaau

SEQ ID NO: 382498 - RNA, 22 nt, Human
caguccuacauuagcuucuaaa

SEQ ID NO: 382499 - RNA, 22 nt, Human
cauuagaaagaccaacacuuua

SEQ ID NO: 382500 - RNA, 26 nt, Human
ccugggcugaggcauccaaacaaagc

SEQ ID NO: 382501 - RNA, 22 nt, Human
cuagaaacacgcuugugcuuuu

SEQ ID NO: 382502 - RNA, 20 nt, Human
cuagccauuaacccaguaca

SEQ ID NO: 382503 - RNA, 22 nt, Human
cucaaaagaagucacugccacc

SEQ ID NO: 382504 - RNA, 24 nt, Human
cuggggcaagaaacggggcagaga

SEQ ID NO: 382505 - RNA, 23 nt, Human
gaccugggcugaggcauccaaac

SEQ ID NO: 382506 - RNA, 19 nt, Human
gcaagaaacggggcagaga

SEQ ID NO: 382507 - RNA, 20 nt, Human
gcuacauuagaaagaccaaa

SEQ ID NO: 382508 - RNA, 19 nt, Human
ggacagaauugggauugaa

SEQ ID NO: 382509 - RNA, 26 nt, Human
ggacaugccccaccuguaacguagag

SEQ ID NO: 382510 - RNA, 19 nt, Human
gggauggggagaaagucag

SEQ ID NO: 382511 - RNA, 20 nt, Human
ggggauggggagaaagucag

SEQ ID NO: 382512 - RNA, 18 nt, Human
uaaaagggacacagaaca

SEQ ID NO: 382513 - RNA, 19 nt, Human
uaaaagggacacagaacag

SEQ ID NO: 382514 - RNA, 22 nt, Human
uaacagcugaccugggcugagg

SEQ ID NO: 382515 - RNA, 21 nt, Human
uaacucaaaagaagucacugc

SEQ ID NO: 382516 - RNA, 23 nt, Human
uacaccaaguguacugaaguaga

SEQ ID NO: 382517 - RNA, 24 nt, Human
uacauacucuuuucacaaauaugu

SEQ ID NO: 382518 - RNA, 20 nt, Human
uacauuagaaagaccaacac

SEQ ID NO: 382519 - RNA, 24 nt, Human
uacauuagaaagaccaacacuuua

SEQ ID NO: 382520 - RNA, 19 nt, Human
uagaaaaagaguaaaacac

SEQ ID NO: 382521 - RNA, 20 nt, Human
uagaaaaagaguaaaacacu

SEQ ID NO: 382522 - RNA, 23 nt, Human
ucuaaaauauuugucaggaggga

SEQ ID NO: 382523 - RNA, 20 nt, Human
ucuaacaguucaaaagaagc

SEQ ID NO: 382524 - RNA, 19 nt, Human
ucucuagaaacacgcuugu

SEQ ID NO: 382525 - RNA, 19 nt, Human
ugcaaaccacacuggggca

SEQ ID NO: 382526 - RNA, 22 nt, Human
ugcaacaagaaaaauagcuaca

SEQ ID NO: 382527 - RNA, 24 nt, Human
uggaaggagacaaugcaaaccaca

SEQ ID NO: 382528 - RNA, 20 nt, Human
ugggacagaauugggauuga

SEQ ID NO: 382529 - RNA, 18 nt, Human
uggggagaaagucaguuc

SEQ ID NO: 382530 - RNA, 18 nt, Human
aggcagggggauuuacua

SEQ ID NO: 382531 - RNA, 18 nt, Human
agggaugugcagacgcug

SEQ ID NO: 382532 - RNA, 18 nt, Human
guggggcgugccagaccc

SEQ ID NO: 382533 - RNA, 18 nt, Human
guggggcgugccagaccc

SEQ ID NO: 382534 - RNA, 19 nt, Human
guggggcgugccagacccu

SEQ ID NO: 382535 - RNA, 19 nt, Human
uaggcagggggauuuacua

SEQ ID NO: 382536 - RNA, 28 nt, Human
caaucacugcaaccucacuacagcuggg

SEQ ID NO: 382537 - RNA, 19 nt, Human
ccucuguucaugguuucug

SEQ ID NO: 382538 - RNA, 19 nt, Human
cuuguucauccucuguuca

SEQ ID NO: 382539 - RNA, 20 nt, Human
uaauaagcauauucccauga

SEQ ID NO: 382540 - RNA, 20 nt, Human
ucacugcaaccucacuacag

SEQ ID NO: 382541 - RNA, 20 nt, Human
ucacugcaaccucacuacag

SEQ ID NO: 382542 - RNA, 25 nt, Human
ucacugcaaccucacuacagcuggg

SEQ ID NO: 382543 - RNA, 26 nt, Human
ugaagcaggccaauccuacucaauca

SEQ ID NO: 382544 - RNA, 21 nt, Human
uggggaacugagcugugaugg

SEQ ID NO: 382545 - RNA, 19 nt, Human
uucaugguuucugcaccag

SEQ ID NO: 382546 - RNA, 21 nt, Human
aagcggucgggguggccagga

SEQ ID NO: 382547 - RNA, 23 nt, Human
acgccagguagggcagggaaccc

SEQ ID NO: 382548 - RNA, 25 nt, Human
auaguggcggcaauggccucagccc

SEQ ID NO: 382549 - RNA, 18 nt, Human
caccugcuuuuccagccc

SEQ ID NO: 382550 - RNA, 18 nt, Human
caccugcuuuuccagccc

SEQ ID NO: 382551 - RNA, 18 nt, Human
cagcccacccucaccugc

SEQ ID NO: 382552 - RNA, 19 nt, Human
ccucaccugcuuuuccagc

SEQ ID NO: 382553 - RNA, 25 nt, Human
ccuggaccaggacgccagguagggc

SEQ ID NO: 382554 - RNA, 19 nt, Human
cucagcccagcccacccuc

SEQ ID NO: 382555 - RNA, 21 nt, Human
cucccaagcuccgcgccucgc

SEQ ID NO: 382556 - RNA, 20 nt, Human
gcccagggcuccccuggacc

SEQ ID NO: 382557 - RNA, 19 nt, Human
uaguggcggcaauggccuc

SEQ ID NO: 382558 - RNA, 22 nt, Human
uauuacacagauaguggcggca

SEQ ID NO: 382559 - RNA, 19 nt, Human
ugagaggggaaacagucca

SEQ ID NO: 382560 - RNA, 21 nt, Human
ugagaggggaaacaguccaga

SEQ ID NO: 382561 - RNA, 19 nt, Human
uggccaggaacauaaacua

SEQ ID NO: 382562 - RNA, 20 nt, Human
uuccagcccacaaaggggga

SEQ ID NO: 382563 - RNA, 21 nt, Human
aaagccgagggaggguggggc

SEQ ID NO: 382564 - RNA, 21 nt, Human
aacgcuuuuuuuuuuuuuuuu

SEQ ID NO: 382565 - RNA, 21 nt, Human
aacgcuuuuuuuuuuuuuuuu

SEQ ID NO: 382566 - RNA, 21 nt, Human
acccuggcggcccugccuggg

SEQ ID NO: 382567 - RNA, 24 nt, Human
accgaguuacugaaggcaaggaag

SEQ ID NO: 382568 - RNA, 18 nt, Human
acucgcaugcaucucccu

SEQ ID NO: 382569 - RNA, 22 nt, Human
acugcaggccugaaaugacauc

SEQ ID NO: 382570 - RNA, 25 nt, Human
agaaggcaacacggacaguggucac

SEQ ID NO: 382571 - RNA, 22 nt, Human
agacugcaggccugaaaugaca

SEQ ID NO: 382572 - RNA, 22 nt, Human
agaggacagggcaggucagcug

SEQ ID NO: 382573 - RNA, 23 nt, Human
agaggacagggcaggucagcugg

SEQ ID NO: 382574 - RNA, 26 nt, Human
agaggcggggguugggagggcagccc

SEQ ID NO: 382575 - RNA, 19 nt, Human
aggaaugugggaagggaag

SEQ ID NO: 382576 - RNA, 24 nt, Human
agggaagagcagaaccugggccca

SEQ ID NO: 382577 - RNA, 24 nt, Human
aguggaguggcaguuuggguggcu

SEQ ID NO: 382578 - RNA, 19 nt, Human
caacaggagccaccauccc

SEQ ID NO: 382579 - RNA, 21 nt, Human
cacacggacacggccccaucc

SEQ ID NO: 382580 - RNA, 21 nt, Human
cacacucacagagaucaugca

SEQ ID NO: 382581 - RNA, 22 nt, Human
caccauguggccagcugguccc

SEQ ID NO: 382582 - RNA, 20 nt, Human
cacccuggcggcccugccug

SEQ ID NO: 382583 - RNA, 22 nt, Human
cacggacacggccccauccccu

SEQ ID NO: 382584 - RNA, 19 nt, Human
cagagcugggcugucccuc

SEQ ID NO: 382585 - RNA, 18 nt, Human
cagcugguuguaccaaga

SEQ ID NO: 382586 - RNA, 20 nt, Human
caugcacacgacacggggcg

SEQ ID NO: 382587 - RNA, 23 nt, Human
ccacaagggagaggguccugggg

SEQ ID NO: 382588 - RNA, 22 nt, Human
ccaccgaguuacugaaggcaag

SEQ ID NO: 382589 - RNA, 24 nt, Human
ccagaggcggggguugggagggca

SEQ ID NO: 382590 - RNA, 20 nt, Human
ccagguggcagcagccaggg

SEQ ID NO: 382591 - RNA, 20 nt, Human
ccccagggaagagcagaacc

SEQ ID NO: 382592 - RNA, 25 nt, Human
ccccuaaccugaaaagcagcaccau

SEQ ID NO: 382593 - RNA, 19 nt, Human
ccccuaggcaggggaggga

SEQ ID NO: 382594 - RNA, 21 nt, Human
cccugccugggucugcuccuc

SEQ ID NO: 382595 - RNA, 20 nt, Human
cccuggcggcccugccuggg

SEQ ID NO: 382596 - RNA, 19 nt, Human
ccuuuggugaagggguugg

SEQ ID NO: 382597 - RNA, 21 nt, Human
cgagggaggguggggcacacg

SEQ ID NO: 382598 - RNA, 27 nt, Human
cgcacacucacagagaucaugcacacg

SEQ ID NO: 382599 - RNA, 19 nt, Human
cgcaugcaucucccugccu

SEQ ID NO: 382600 - RNA, 27 nt, Human
cggcuggcugccgaauacugcaucugg

SEQ ID NO: 382601 - RNA, 23 nt, Human
cuccuggggccggaggaaugugg

SEQ ID NO: 382602 - RNA, 18 nt, Human
cucugagccagaggcggg

SEQ ID NO: 382603 - RNA, 21 nt, Human
cugggcccaccgaguuacuga

SEQ ID NO: 382604 - RNA, 18 nt, Human
cugguccccaccccucag

SEQ ID NO: 382605 - RNA, 23 nt, Human
cuuuuuuuuuuuuuuuuuuacag

SEQ ID NO: 382606 - RNA, 21 nt, Human
gaagccccaagguggugagga

SEQ ID NO: 382607 - RNA, 19 nt, Human
gaagggguuggggggaauc

SEQ ID NO: 382608 - RNA, 23 nt, Human
gagcaugggggccgggagggagg

SEQ ID NO: 382609 - RNA, 22 nt, Human
gagccagaggcggggguuggga

SEQ ID NO: 382610 - RNA, 19 nt, Human
gaggguccuggggcggggg

SEQ ID NO: 382611 - RNA, 21 nt, Human
gauggcaagggcaggaugaga

SEQ ID NO: 382612 - RNA, 26 nt, Human
gcaagacaacaggagccaccauccca

SEQ ID NO: 382613 - RNA, 25 nt, Human
gcagcagccagggccuccuuggagu

SEQ ID NO: 382614 - RNA, 21 nt, Human
gccagggccuccuuggagugg

SEQ ID NO: 382615 - RNA, 18 nt, Human
gcucugagccagaggcgg

SEQ ID NO: 382616 - RNA, 22 nt, Human
gcucugcuuguggggacagcug

SEQ ID NO: 382617 - RNA, 21 nt, Human
gcuggcuugagggacugacug

SEQ ID NO: 382618 - RNA, 18 nt, Human
ggaggaggagguagcccu

SEQ ID NO: 382619 - RNA, 19 nt, Human
ggaggguggggcacacgga

SEQ ID NO: 382620 - RNA, 23 nt, Human
ggaguaaagccgagggagggugg

SEQ ID NO: 382621 - RNA, 21 nt, Human
gggagaggguccuggggcggg

SEQ ID NO: 382622 - RNA, 23 nt, Human
gggcaggaugagacugcaggccu

SEQ ID NO: 382623 - RNA, 18 nt, Human
gggccgggagggagggug

SEQ ID NO: 382624 - RNA, 19 nt, Human
ggggacggagggcccaugg

SEQ ID NO: 382625 - RNA, 21 nt, Human
ggggagggagccuggagccau

SEQ ID NO: 382626 - RNA, 18 nt, Human
uagcugcugggguggcug

SEQ ID NO: 382627 - RNA, 21 nt, Human
ucaccucuccccuaaccugaa

SEQ ID NO: 382628 - RNA, 23 nt, Human
ucacgccccgcuggcugccuccc

SEQ ID NO: 382629 - RNA, 18 nt, Human
ucagaccuagcccaaggg

SEQ ID NO: 382630 - RNA, 21 nt, Human
ucagcgacugagacucagagc

SEQ ID NO: 382631 - RNA, 22 nt, Human
ucagggcucugcuuguggggac

SEQ ID NO: 382632 - RNA, 18 nt, Human
uccccaccccucagggcu

SEQ ID NO: 382633 - RNA, 18 nt, Human
uccccggcuggcugccga

SEQ ID NO: 382634 - RNA, 20 nt, Human
ucccuagcugcugggguggc

SEQ ID NO: 382635 - RNA, 24 nt, Human
ucccugccuguccacaagggagag

SEQ ID NO: 382636 - RNA, 21 nt, Human
ucucccugccuguccacaagg

SEQ ID NO: 382637 - RNA, 20 nt, Human
ugaaggcaaggaagcguggc

SEQ ID NO: 382638 - RNA, 23 nt, Human
ugagaagccccaagguggugagg

SEQ ID NO: 382639 - RNA, 19 nt, Human
ugagacugcaggccugaaa

SEQ ID NO: 382640 - RNA, 21 nt, Human
ugaggaggaggagguagcccu

SEQ ID NO: 382641 - RNA, 19 nt, Human
ugcagccugcuuugccucc

SEQ ID NO: 382642 - RNA, 18 nt, Human
ugcaucucccugccuguc

SEQ ID NO: 382643 - RNA, 19 nt, Human
ugccugggucugcuccucg

SEQ ID NO: 382644 - RNA, 21 nt, Human
ugcugcaugcacucgcaugca

SEQ ID NO: 382645 - RNA, 19 nt, Human
uggagaggacagggcaggu

SEQ ID NO: 382646 - RNA, 23 nt, Human
uggcaagggcaggaugagacugc

SEQ ID NO: 382647 - RNA, 21 nt, Human
uggcagagaagggagcauggg

SEQ ID NO: 382648 - RNA, 24 nt, Human
uggcagagaagggagcauggggga

SEQ ID NO: 382649 - RNA, 25 nt, Human
uggcagagaagggagcaugggggcc

SEQ ID NO: 382650 - RNA, 21 nt, Human
uggcagcagccagggccuccu

SEQ ID NO: 382651 - RNA, 20 nt, Human
uggcagccugagccucccug

SEQ ID NO: 382652 - RNA, 23 nt, Human
uggcagccugagccucccuggca

SEQ ID NO: 382653 - RNA, 20 nt, Human
uggcagccugagccucccuu

SEQ ID NO: 382654 - RNA, 18 nt, Human
uggcugccucccucugcc

SEQ ID NO: 382655 - RNA, 19 nt, Human
uggcugccucccucugccu

SEQ ID NO: 382656 - RNA, 21 nt, Human
ugggaagggaagcugaggccc

SEQ ID NO: 382657 - RNA, 23 nt, Human
ugggaagggaagcugaggcccag

SEQ ID NO: 382658 - RNA, 22 nt, Human
ugggagggcagcccagccaggu

SEQ ID NO: 382659 - RNA, 22 nt, Human
ugggcaggaguaaagccgaggg

SEQ ID NO: 382660 - RNA, 28 nt, Human
ugggcaggaguaaagccgagggagggug

SEQ ID NO: 382661 - RNA, 21 nt, Human
ugggggccgggagggagggug

SEQ ID NO: 382662 - RNA, 22 nt, Human
ugugcacacugcaucacgcccc

SEQ ID NO: 382663 - RNA, 18 nt, Human
ugugggaagggaagcuga

SEQ ID NO: 382664 - RNA, 18 nt, Human
uucaagaaggcaacacgg

SEQ ID NO: 382665 - RNA, 18 nt, Human
uugggagggcagcccagc

SEQ ID NO: 382666 - RNA, 26 nt, Human
aaacaugauuacaggaaucuuccuac

SEQ ID NO: 382667 - RNA, 18 nt, Human
aacccgcccaaccccccc

SEQ ID NO: 382668 - RNA, 22 nt, Human
aauccaacaaaaaaaugaaaga

SEQ ID NO: 382669 - RNA, 22 nt, Human
aauuaaaaaaacaugauuacag

SEQ ID NO: 382670 - RNA, 18 nt, Human
acacuuugugcuguugug

SEQ ID NO: 382671 - RNA, 18 nt, Human
accauccuuuauacaaua

SEQ ID NO: 382672 - RNA, 18 nt, Human
acuucaggguaaaaaaga

SEQ ID NO: 382673 - RNA, 18 nt, Human
aggaacccgcccaacccc

SEQ ID NO: 382674 - RNA, 18 nt, Human
aggaacccgcccaacccc

SEQ ID NO: 382675 - RNA, 20 nt, Human
aucagacuuaaauagaccag

SEQ ID NO: 382676 - RNA, 25 nt, Human
caaaggaacccgcccaaccccccca

SEQ ID NO: 382677 - RNA, 20 nt, Human
caacaaaaaaaugaaagaca

SEQ ID NO: 382678 - RNA, 27 nt, Human
cagaaagaguaucaaauuaacuagaaa

SEQ ID NO: 382679 - RNA, 19 nt, Human
caggguaaaaaagaucuua

SEQ ID NO: 382680 - RNA, 20 nt, Human
ccaacaaaaaaaugaaagac

SEQ ID NO: 382681 - RNA, 25 nt, Human
ccaacccccccaauaaaaauaacaa

SEQ ID NO: 382682 - RNA, 19 nt, Human
cccguaaacaucagacuua

SEQ ID NO: 382683 - RNA, 24 nt, Human
cuuaaaggaaauccaacaaaaaaa

SEQ ID NO: 382684 - RNA, 19 nt, Human
gcagggagaucccaacaga

SEQ ID NO: 382685 - RNA, 22 nt, Human
gguaaaaaagaucuuaaaggaa

SEQ ID NO: 382686 - RNA, 19 nt, Human
uaaaaaaacaugauuacag

SEQ ID NO: 382687 - RNA, 18 nt, Human
uacaacccauguauugga

SEQ ID NO: 382688 - RNA, 20 nt, Human
uauauacacagaaagaguag

SEQ ID NO: 382689 - RNA, 25 nt, Human
uauuaaauugaagaccaagggaguu

SEQ ID NO: 382690 - RNA, 21 nt, Human
uccaacaaaaaaaugaaagac

SEQ ID NO: 382691 - RNA, 19 nt, Human
uccgaauuccccaaacuaa

SEQ ID NO: 382692 - RNA, 21 nt, Human
uccuuuauacaauagcuuuaa

SEQ ID NO: 382693 - RNA, 21 nt, Human
ucuaagcagucaccuggaccu

SEQ ID NO: 382694 - RNA, 18 nt, Human
uggcccaaaacuuaacaa

SEQ ID NO: 382695 - RNA, 18 nt, Human
ugugaaccagaaaaauac

SEQ ID NO: 382696 - RNA, 21 nt, Human
uguucuuauucgcuaauuuca

SEQ ID NO: 382697 - RNA, 21 nt, Human
uuaauccaaaggaacccgccc

SEQ ID NO: 382698 - RNA, 20 nt, Human
uuauuggagaauauuuuccc

SEQ ID NO: 382699 - RNA, 26 nt, Human
uucaggguaaaaaagaucuuaaagga

SEQ ID NO: 382700 - RNA, 21 nt, Human
agagcagguuuugcguaccaa

SEQ ID NO: 382701 - RNA, 21 nt, Human
ccaggugucacugcugguggu

SEQ ID NO: 382702 - RNA, 22 nt, Human
cccgccgcucggacucuuccug

SEQ ID NO: 382703 - RNA, 20 nt, Human
cgcucggacucuuccugcuc

SEQ ID NO: 382704 - RNA, 23 nt, Human
cuccgcccgccgcucggacucuu

SEQ ID NO: 382705 - RNA, 19 nt, Human
gcgcgaccggagccuggag

SEQ ID NO: 382706 - RNA, 19 nt, Human
ucccgugcgcgaccggagc

SEQ ID NO: 382707 - RNA, 23 nt, Human
aaacaagaagagggcaucacuga

SEQ ID NO: 382708 - RNA, 22 nt, Human
aaacaagguuuuaaaaacaccc

SEQ ID NO: 382709 - RNA, 25 nt, Human
aaacaagguuuuaaaaacacccaaa

SEQ ID NO: 382710 - RNA, 20 nt, Human
aaacaaguuucaagacagac

SEQ ID NO: 382711 - RNA, 26 nt, Human
aaacacgaugauguaugaccccacac

SEQ ID NO: 382712 - RNA, 24 nt, Human
aacaagguuuuaaaaacacccaaa

SEQ ID NO: 382713 - RNA, 21 nt, Human
aacacgaugauguaugacccc

SEQ ID NO: 382714 - RNA, 20 nt, Human
aacugcuuauuucuucaucu

SEQ ID NO: 382715 - RNA, 18 nt, Human
aagagggcaucacugaac

SEQ ID NO: 382716 - RNA, 18 nt, Human
aaggaacugaggcgggcg

SEQ ID NO: 382717 - RNA, 18 nt, Human
acaaacaagguccugaag

SEQ ID NO: 382718 - RNA, 18 nt, Human
acaacagcagcagcacaa

SEQ ID NO: 382719 - RNA, 19 nt, Human
acaacagcagcagcacaaa

SEQ ID NO: 382720 - RNA, 18 nt, Human
acaaugcagcgagcagag

SEQ ID NO: 382721 - RNA, 24 nt, Human
acagccuuccugcauuugcugcuu

SEQ ID NO: 382722 - RNA, 25 nt, Human
accacaaugcagcgagcagagaggg

SEQ ID NO: 382723 - RNA, 21 nt, Human
acccaagcaaugugcacguca

SEQ ID NO: 382724 - RNA, 20 nt, Human
accccgccgccuccucaggu

SEQ ID NO: 382725 - RNA, 24 nt, Human
acgggccaagaaccuucuccacag

SEQ ID NO: 382726 - RNA, 18 nt, Human
agcaaugugcacgucacc

SEQ ID NO: 382727 - RNA, 21 nt, Human
aggaacugaggcgggcggugg

SEQ ID NO: 382728 - RNA, 21 nt, Human
aggacaggaacaaccccaaac

SEQ ID NO: 382729 - RNA, 19 nt, Human
aggcuggggagggggcagu

SEQ ID NO: 382730 - RNA, 24 nt, Human
agguauuaugaaguaucugaaacu

SEQ ID NO: 382731 - RNA, 24 nt, Human
aguaauacacacauggccugcagg

SEQ ID NO: 382732 - RNA, 21 nt, Human
auaacagagaaagggaaacca

SEQ ID NO: 382733 - RNA, 21 nt, Human
caacaaggacaggaacaaccc

SEQ ID NO: 382734 - RNA, 20 nt, Human
cacacauggccugcaggagg

SEQ ID NO: 382735 - RNA, 21 nt, Human
cacagccauagcccucuguuc

SEQ ID NO: 382736 - RNA, 21 nt, Human
caccccagccuccacccacag

SEQ ID NO: 382737 - RNA, 23 nt, Human
caccgggaaggggugcugauuuc

SEQ ID NO: 382738 - RNA, 22 nt, Human
cacuguggacacaggcugggga

SEQ ID NO: 382739 - RNA, 18 nt, Human
cacuguuugguccgaggg

SEQ ID NO: 382740 - RNA, 23 nt, Human
cagagaaagggaaaccaacaucu

SEQ ID NO: 382741 - RNA, 19 nt, Human
cagccagggcgugcagggc

SEQ ID NO: 382742 - RNA, 22 nt, Human
cagccauagcccucuguucagg

SEQ ID NO: 382743 - RNA, 18 nt, Human
cagccuccacccacagcu

SEQ ID NO: 382744 - RNA, 19 nt, Human
caggcuccagacuaacugu

SEQ ID NO: 382745 - RNA, 20 nt, Human
cauccuaacaguccagaaau

SEQ ID NO: 382746 - RNA, 18 nt, Human
ccaacaucuucgacaaac

SEQ ID NO: 382747 - RNA, 28 nt, Human
ccaacgggccaagaaccuucuccacagc

SEQ ID NO: 382748 - RNA, 25 nt, Human
ccacaaugcagcgagcagugggaac

SEQ ID NO: 382749 - RNA, 24 nt, Human
ccacacaacacaagguauuaugaa

SEQ ID NO: 382750 - RNA, 20 nt, Human
cccagccuccacccacagcc

SEQ ID NO: 382751 - RNA, 21 nt, Human
ccccagccuccacccacagcu

SEQ ID NO: 382752 - RNA, 20 nt, Human
ccccgccgccuccucaggug

SEQ ID NO: 382753 - RNA, 21 nt, Human
cccucuguucaggggccucca

SEQ ID NO: 382754 - RNA, 22 nt, Human
cccuggacaccgggaaggggug

SEQ ID NO: 382755 - RNA, 19 nt, Human
ccucaggugggcgcgcugg

SEQ ID NO: 382756 - RNA, 19 nt, Human
ccugcggaccccgccgccu

SEQ ID NO: 382757 - RNA, 24 nt, Human
ccugcggaccccgccgccuccuca

SEQ ID NO: 382758 - RNA, 26 nt, Human
ccugcggaccccgccgccuccucagg

SEQ ID NO: 382759 - RNA, 21 nt, Human
cgagcagagagggcggggagc

SEQ ID NO: 382760 - RNA, 19 nt, Human
cgcaaaggaacugaggcgg

SEQ ID NO: 382761 - RNA, 21 nt, Human
cgccugcggaccccgccgccu

SEQ ID NO: 382762 - RNA, 27 nt, Human
cucaacaaggacaggaacaaccccaaa

SEQ ID NO: 382763 - RNA, 18 nt, Human
cugcugugcaccaauugc

SEQ ID NO: 382764 - RNA, 22 nt, Human
cuguucaggggccuccagaacc

SEQ ID NO: 382765 - RNA, 21 nt, Human
gaacaccacaaugcagcgagc

SEQ ID NO: 382766 - RNA, 25 nt, Human
gaagaugcuugccgagaggguacag

SEQ ID NO: 382767 - RNA, 20 nt, Human
gacaacagcagcagcacaaa

SEQ ID NO: 382768 - RNA, 21 nt, Human
gagaagagaacaccacaaugc

SEQ ID NO: 382769 - RNA, 21 nt, Human
gagacagccuuccugcauuug

SEQ ID NO: 382770 - RNA, 18 nt, Human
gagcgcugugggaugggg

SEQ ID NO: 382771 - RNA, 19 nt, Human
gaggauguguguggaucuu

SEQ ID NO: 382772 - RNA, 23 nt, Human
gaggguacagggucugugugagu

SEQ ID NO: 382773 - RNA, 19 nt, Human
gcagacaccccagccucca

SEQ ID NO: 382774 - RNA, 19 nt, Human
gcgccgagcucgcguacag

SEQ ID NO: 382775 - RNA, 26 nt, Human
gcgcugugggaugggggcguguuuug

SEQ ID NO: 382776 - RNA, 20 nt, Human
gcugggaaaggcaaagaggu

SEQ ID NO: 382777 - RNA, 19 nt, Human
ggcaacagacgcaaaggaa

SEQ ID NO: 382778 - RNA, 21 nt, Human
ggccaagaaccuucuccacag

SEQ ID NO: 382779 - RNA, 23 nt, Human
ggcgcaggugccugcgguuccgu

SEQ ID NO: 382780 - RNA, 24 nt, Human
ggcggcgagggggcugggcagggg

SEQ ID NO: 382781 - RNA, 18 nt, Human
gggacagaagggccuggg

SEQ ID NO: 382782 - RNA, 18 nt, Human
gggccacaggcuccagac

SEQ ID NO: 382783 - RNA, 20 nt, Human
ggggacagaacaagcagcgg

SEQ ID NO: 382784 - RNA, 20 nt, Human
ggggagggggcagugacagg

SEQ ID NO: 382785 - RNA, 21 nt, Human
ggggagggggcagugacaggc

SEQ ID NO: 382786 - RNA, 21 nt, Human
ggguaugagacgcugggaaag

SEQ ID NO: 382787 - RNA, 21 nt, Human
ggucguauaaguugggaggga

SEQ ID NO: 382788 - RNA, 21 nt, Human
gucacaaaucuuaaauaacgg

SEQ ID NO: 382789 - RNA, 22 nt, Human
guggaggaggacgcuggccuga

SEQ ID NO: 382790 - RNA, 18 nt, Human
gugggcgcgcugggccag

SEQ ID NO: 382791 - RNA, 19 nt, Human
guuauguacaaggucacaa

SEQ ID NO: 382792 - RNA, 20 nt, Human
uaaaaugaccaucuucucuu

SEQ ID NO: 382793 - RNA, 22 nt, Human
uaacagagaaagggaaaccaac

SEQ ID NO: 382794 - RNA, 23 nt, Human
uaagacgcccggcgcaggugccu

SEQ ID NO: 382795 - RNA, 20 nt, Human
uaauacacacauggccugca

SEQ ID NO: 382796 - RNA, 22 nt, Human
uacaaggucacaaaucuuaaau

SEQ ID NO: 382797 - RNA, 20 nt, Human
uaccggggguaugagacgcu

SEQ ID NO: 382798 - RNA, 23 nt, Human
uagcccucuguucaggggccucc

SEQ ID NO: 382799 - RNA, 23 nt, Human
uauauuucacgacaacagcagca

SEQ ID NO: 382800 - RNA, 21 nt, Human
uaucugaaacugaggauaauc

SEQ ID NO: 382801 - RNA, 22 nt, Human
ucaguguguccagcaguuucug

SEQ ID NO: 382802 - RNA, 22 nt, Human
uccacagccauagcccucuguu

SEQ ID NO: 382803 - RNA, 19 nt, Human
uccagaacccaucuguucu

SEQ ID NO: 382804 - RNA, 21 nt, Human
uccugauugucaccucccagg

SEQ ID NO: 382805 - RNA, 20 nt, Human
uccugcugugcaccaauugc

SEQ ID NO: 382806 - RNA, 19 nt, Human
ugaaauacuccaagaacac

SEQ ID NO: 382807 - RNA, 23 nt, Human
ugaguccaacgggccaagaaccu

SEQ ID NO: 382808 - RNA, 19 nt, Human
ugagucuugaggauggcga

SEQ ID NO: 382809 - RNA, 18 nt, Human
ugcacgucacccaggguu

SEQ ID NO: 382810 - RNA, 19 nt, Human
ugcauuugcugcuuuaguu

SEQ ID NO: 382811 - RNA, 18 nt, Human
ugccgagaggguacaggg

SEQ ID NO: 382812 - RNA, 19 nt, Human
ugccuggggacagaagggc

SEQ ID NO: 382813 - RNA, 22 nt, Human
ugccuggggacagaagggccug

SEQ ID NO: 382814 - RNA, 24 nt, Human
ugcuuauuucuucaucuguuuuau

SEQ ID NO: 382815 - RNA, 18 nt, Human
uggaggaggacgcuggcc

SEQ ID NO: 382816 - RNA, 21 nt, Human
uggcgccgagcucgcguacag

SEQ ID NO: 382817 - RNA, 20 nt, Human
ugggaagcugcggagcgcug

SEQ ID NO: 382818 - RNA, 25 nt, Human
uggggacagaagggccugggccaca

SEQ ID NO: 382819 - RNA, 21 nt, Human
uggugggaagcugcggagcgc

SEQ ID NO: 382820 - RNA, 19 nt, Human
ugugcaccaauugcacaug

SEQ ID NO: 382821 - RNA, 27 nt, Human
uguucaggggccuccagaacccaucug

SEQ ID NO: 382822 - RNA, 20 nt, Human
uuaaaaaacacaaugcauua

SEQ ID NO: 382823 - RNA, 22 nt, Human
uuaaaaacacccaaauuucuac

SEQ ID NO: 382824 - RNA, 22 nt, Human
uuauucaguuucuucagugugu

SEQ ID NO: 382825 - RNA, 21 nt, Human
uuccugacccuugaacgaagg

SEQ ID NO: 382826 - RNA, 20 nt, Human
uucucaacaaggacaggaac

SEQ ID NO: 382827 - RNA, 18 nt, Human
uugccgagaggguacagg

SEQ ID NO: 382828 - RNA, 22 nt, Human
uuuggaggggcgacuuauuuuu

SEQ ID NO: 382829 - RNA, 18 nt, Human
uuugguccgagggagggg

SEQ ID NO: 382830 - RNA, 24 nt, Human
aaagugcugggauuacagguuuga

SEQ ID NO: 382831 - RNA, 24 nt, Human
aagugauccacccgccuuggucuc

SEQ ID NO: 382832 - RNA, 18 nt, Human
aagugcugggauuacagg

SEQ ID NO: 382833 - RNA, 19 nt, Human
aagugcugggauuacaggu

SEQ ID NO: 382834 - RNA, 26 nt, Human
aagugcugggauuacagguuugagcc

SEQ ID NO: 382835 - RNA, 21 nt, Human
aauaaaauauucaaggaaaga

SEQ ID NO: 382836 - RNA, 18 nt, Human
aaucacggccacagucug

SEQ ID NO: 382837 - RNA, 24 nt, Human
acaaaacagggaggugaauaaagc

SEQ ID NO: 382838 - RNA, 29 nt, Human
acaagggggaaaagcacagaagcaccauu

SEQ ID NO: 382839 - RNA, 19 nt, Human
acagggaggugaauaaagc

SEQ ID NO: 382840 - RNA, 18 nt, Human
acaggguuucgccauguu

SEQ ID NO: 382841 - RNA, 19 nt, Human
acaggguuucgccauguug

SEQ ID NO: 382842 - RNA, 24 nt, Human
acaggguuucgccauguugcccag

SEQ ID NO: 382843 - RNA, 25 nt, Human
acccgccuuggucucccaaagugcu

SEQ ID NO: 382844 - RNA, 18 nt, Human
agacaagaacagagcaga

SEQ ID NO: 382845 - RNA, 25 nt, Human
agacaagaacagagcagaggggacc

SEQ ID NO: 382846 - RNA, 18 nt, Human
agacaggguuucgccaug

SEQ ID NO: 382847 - RNA, 18 nt, Human
agacaggguuucgccaug

SEQ ID NO: 382848 - RNA, 23 nt, Human
agacaggguuucgccauguugcc

SEQ ID NO: 382849 - RNA, 22 nt, Human
agagacaagaacagagcagaga

SEQ ID NO: 382850 - RNA, 24 nt, Human
agcgauucuccugucucagccucc

SEQ ID NO: 382851 - RNA, 24 nt, Human
agggaggugaauaaagcaaguaug

SEQ ID NO: 382852 - RNA, 22 nt, Human
aggucuacuucagccagauaac

SEQ ID NO: 382853 - RNA, 23 nt, Human
agguuugagccaucgugccuggc

SEQ ID NO: 382854 - RNA, 21 nt, Human
agucacccauaacuucauuug

SEQ ID NO: 382855 - RNA, 21 nt, Human
auaauugagaaaggcuaacuc

SEQ ID NO: 382856 - RNA, 24 nt, Human
augcugagcuaaaaauuccacacu

SEQ ID NO: 382857 - RNA, 24 nt, Human
auuuuuguauuuuuaguagagaca

SEQ ID NO: 382858 - RNA, 24 nt, Human
caaagugcugggauuacagguuug

SEQ ID NO: 382859 - RNA, 22 nt, Human
caagcgauucuccugucucagc

SEQ ID NO: 382860 - RNA, 24 nt, Human
caccacacccggcuaauuuuugua

SEQ ID NO: 382861 - RNA, 23 nt, Human
cacccgccuuggucucccaaagu

SEQ ID NO: 382862 - RNA, 24 nt, Human
cacccgccuuggucucccaaagug

SEQ ID NO: 382863 - RNA, 21 nt, Human
cacugcaaccucugccucccg

SEQ ID NO: 382864 - RNA, 23 nt, Human
cacugcaaccucugccucccggg

SEQ ID NO: 382865 - RNA, 23 nt, Human
cagagacaagaacagagcagaga

SEQ ID NO: 382866 - RNA, 19 nt, Human
cagccuccugagaagcuga

SEQ ID NO: 382867 - RNA, 24 nt, Human
caggguuucgccauguugcccagg

SEQ ID NO: 382868 - RNA, 19 nt, Human
caguucuagugaaauauaa

SEQ ID NO: 382869 - RNA, 20 nt, Human
cauguugcccaggcuggucu

SEQ ID NO: 382870 - RNA, 23 nt, Human
cauguugcccaggcuggucuuga

SEQ ID NO: 382871 - RNA, 24 nt, Human
cauguugcccaggcuggucuugaa

SEQ ID NO: 382872 - RNA, 24 nt, Human
cauuuuauucucucaaugcugagc

SEQ ID NO: 382873 - RNA, 21 nt, Human
ccaaagugcugggauuacagg

SEQ ID NO: 382874 - RNA, 22 nt, Human
ccaaagugcugggauuacaggu

SEQ ID NO: 382875 - RNA, 21 nt, Human
ccauguugcccaggcuggucu

SEQ ID NO: 382876 - RNA, 24 nt, Human
cccaaagugcugggauuacagguu

SEQ ID NO: 382877 - RNA, 20 nt, Human
cccggguucaagcgauucuc

SEQ ID NO: 382878 - RNA, 23 nt, Human
cccggguucaagcgauucuccug

SEQ ID NO: 382879 - RNA, 24 nt, Human
ccgccuuggucucccaaagugcug

SEQ ID NO: 382880 - RNA, 24 nt, Human
ccucccggguucaagcgauucucc

SEQ ID NO: 382881 - RNA, 22 nt, Human
ccugaccucaagugauccaccc

SEQ ID NO: 382882 - RNA, 23 nt, Human
ccugaccucaagugauccacccg

SEQ ID NO: 382883 - RNA, 24 nt, Human
ccugucucagccuccugagaagcu

SEQ ID NO: 382884 - RNA, 19 nt, Human
cgcaacacaaaacagggag

SEQ ID NO: 382885 - RNA, 24 nt, Human
cgccauguugcccaggcuggucuu

SEQ ID NO: 382886 - RNA, 27 nt, Human
cgccauguugcccaggcuggucuugaa

SEQ ID NO: 382887 - RNA, 19 nt, Human
cuaaccauuuuaccuaaau

SEQ ID NO: 382888 - RNA, 23 nt, Human
cuaauuuuuguauuuuuaguaga

SEQ ID NO: 382889 - RNA, 24 nt, Human
cucaagugauccacccgccuuggu

SEQ ID NO: 382890 - RNA, 24 nt, Human
cucacugcaaccucugccucccgg

SEQ ID NO: 382891 - RNA, 23 nt, Human
cugcaaccucugccucccggguu

SEQ ID NO: 382892 - RNA, 24 nt, Human
cugcaaccucugccucccggguuc

SEQ ID NO: 382893 - RNA, 19 nt, Human
gaaaagcacagaagcacca

SEQ ID NO: 382894 - RNA, 19 nt, Human
gaaucacggccacagucug

SEQ ID NO: 382895 - RNA, 23 nt, Human
gaccucaagugauccacccgccu

SEQ ID NO: 382896 - RNA, 20 nt, Human
gagagguggcaggacgggca

SEQ ID NO: 382897 - RNA, 18 nt, Human
gagguggcaggacgggca

SEQ ID NO: 382898 - RNA, 18 nt, Human
gauuacagguuugagcca

SEQ ID NO: 382899 - RNA, 21 nt, Human
gauuacagguuugagccaucg

SEQ ID NO: 382900 - RNA, 24 nt, Human
gauuacagguuugagccaucgugc

SEQ ID NO: 382901 - RNA, 23 nt, Human
gauuagccacaccaugaguuaua

SEQ ID NO: 382902 - RNA, 24 nt, Human
gcagagacaagaacagagcagaga

SEQ ID NO: 382903 - RNA, 19 nt, Human
gccgcgcaugaucucagcu

SEQ ID NO: 382904 - RNA, 22 nt, Human
gccuuggucucccaaagugcug

SEQ ID NO: 382905 - RNA, 24 nt, Human
gccuuggucucccaaagugcuggg

SEQ ID NO: 382906 - RNA, 24 nt, Human
gcgauucuccugucucagccuccu

SEQ ID NO: 382907 - RNA, 24 nt, Human
gcgcaugaucucagcucacugcaa

SEQ ID NO: 382908 - RNA, 21 nt, Human
gcugggauuacagguuugagc

SEQ ID NO: 382909 - RNA, 23 nt, Human
gcuggucuugaacuccugaccuc

SEQ ID NO: 382910 - RNA, 23 nt, Human
ggaaagacgcaacacaaaacagg

SEQ ID NO: 382911 - RNA, 22 nt, Human
ggaggugaauaaagcaaguaug

SEQ ID NO: 382912 - RNA, 24 nt, Human
ggcuggucuugaacuccugaccuc

SEQ ID NO: 382913 - RNA, 23 nt, Human
gggaaugaaggcagagacaagaa

SEQ ID NO: 382914 - RNA, 19 nt, Human
ggucuugaacuccugaccu

SEQ ID NO: 382915 - RNA, 24 nt, Human
gugauccacccgccuuggucuccc

SEQ ID NO: 382916 - RNA, 24 nt, Human
guuucgccauguugcccaggcugg

SEQ ID NO: 382917 - RNA, 23 nt, Human
uaaagcaaguauguuguaaaauc

SEQ ID NO: 382918 - RNA, 24 nt, Human
uaauuuuuguauuuuuaguagaga

SEQ ID NO: 382919 - RNA, 23 nt, Human
uacagagaagugccaccacaccc

SEQ ID NO: 382920 - RNA, 22 nt, Human
uagagacaggguuucgccaugu

SEQ ID NO: 382921 - RNA, 24 nt, Human
uaguagagacaggguuucgccaug

SEQ ID NO: 382922 - RNA, 20 nt, Human
uauucaaggaaagacgcaac

SEQ ID NO: 382923 - RNA, 22 nt, Human
uauucaaggaaagacgcaacag

SEQ ID NO: 382924 - RNA, 29 nt, Human
uauucuguccuuucagauaauuuacauuu

SEQ ID NO: 382925 - RNA, 20 nt, Human
ucacauaaaauuaggucuac

SEQ ID NO: 382926 - RNA, 24 nt, Human
ucacugcaaccucugccucccggg

SEQ ID NO: 382927 - RNA, 25 nt, Human
ucacugcaaccucugccucccgggu

SEQ ID NO: 382928 - RNA, 23 nt, Human
ucccaaagugcugggauuacagg

SEQ ID NO: 382929 - RNA, 21 nt, Human
ucccggguucaagcgauucuc

SEQ ID NO: 382930 - RNA, 24 nt, Human
ucccggguucaagcgauucuccug

SEQ ID NO: 382931 - RNA, 21 nt, Human
ucgccauguugcccaggcugg

SEQ ID NO: 382932 - RNA, 22 nt, Human
ucgccauguugcccaggcuggu

SEQ ID NO: 382933 - RNA, 24 nt, Human
ucuccugucucagccuccugagaa

SEQ ID NO: 382934 - RNA, 21 nt, Human
ucuugaacuccugaccucaag

SEQ ID NO: 382935 - RNA, 20 nt, Human
ugaagcaguggguauuagug

SEQ ID NO: 382936 - RNA, 24 nt, Human
ugaccucaagugauccacccgccu

SEQ ID NO: 382937 - RNA, 24 nt, Human
ugagaaaggcuaacucugggccaa

SEQ ID NO: 382938 - RNA, 24 nt, Human
ugagauuacagagaagugccacca

SEQ ID NO: 382939 - RNA, 21 nt, Human
ugagcuaaaaauuccacacau

SEQ ID NO: 382940 - RNA, 24 nt, Human
ugcccaggcuggucuugaacuccu

SEQ ID NO: 382941 - RNA, 21 nt, Human
uggaaaaagaauucuguucau

SEQ ID NO: 382942 - RNA, 20 nt, Human
uggcaggacgggcagcaggc

SEQ ID NO: 382943 - RNA, 18 nt, Human
ugggauuacagguuugag

SEQ ID NO: 382944 - RNA, 19 nt, Human
ugggauuacagguuugagc

SEQ ID NO: 382945 - RNA, 21 nt, Human
ugggauuacagguuugagcca

SEQ ID NO: 382946 - RNA, 21 nt, Human
ugggauuacagguuugagcca

SEQ ID NO: 382947 - RNA, 21 nt, Human
ugggauuacagguuugagcca

SEQ ID NO: 382948 - RNA, 22 nt, Human
ugggauuacagguuugagccau

SEQ ID NO: 382949 - RNA, 24 nt, Human
ugggauuacagguuugagccaucg

SEQ ID NO: 382950 - RNA, 18 nt, Human
uguagaaaagcugaaagu

SEQ ID NO: 382951 - RNA, 24 nt, Human
uguagaaaagcugaaaguugacug

SEQ ID NO: 382952 - RNA, 24 nt, Human
ugucucagccuccugagaagcuga

SEQ ID NO: 382953 - RNA, 20 nt, Human
uguuguaaaauccucccuug

SEQ ID NO: 382954 - RNA, 24 nt, Human
uuaguagagacaggguuucgccau

SEQ ID NO: 382955 - RNA, 19 nt, Human
uuauauauaccuuucaucc

SEQ ID NO: 382956 - RNA, 23 nt, Human
uucaagcgauucuccugucucag

SEQ ID NO: 382957 - RNA, 23 nt, Human
uuucgccauguugcccaggcugg

SEQ ID NO: 382958 - RNA, 24 nt, Human
uuucgccauguugcccaggcuggu

SEQ ID NO: 382959 - RNA, 23 nt, Human
uuuuuaguagagacaggguuucg

SEQ ID NO: 382960 - RNA, 24 nt, Human
uuuuuaguagagacaggguuucgc

SEQ ID NO: 382961 - RNA, 20 nt, Human
uuuuuguauuuuuaguagag

SEQ ID NO: 382962 - RNA, 23 nt, Human
aaaaggaggggucucccuacagg

SEQ ID NO: 382963 - RNA, 23 nt, Human
aaaauaccacccgguuucuacaa

SEQ ID NO: 382964 - RNA, 25 nt, Human
aaaaugccccauccccacccaacca

SEQ ID NO: 382965 - RNA, 20 nt, Human
aaaccccagucccaagaccc

SEQ ID NO: 382966 - RNA, 20 nt, Human
aaaccucugggaggcaccaa

SEQ ID NO: 382967 - RNA, 21 nt, Human
aaagcuuagcucagaaaaugc

SEQ ID NO: 382968 - RNA, 24 nt, Human
aacucaauccgaaaccccaguccc

SEQ ID NO: 382969 - RNA, 23 nt, Human
aacuccugcucccuggagaaccc

SEQ ID NO: 382970 - RNA, 20 nt, Human
aagaaaaccaaacaugauca

SEQ ID NO: 382971 - RNA, 25 nt, Human
aagaaaggguacauucaccaagcau

SEQ ID NO: 382972 - RNA, 20 nt, Human
aagaagaaaaccaaacauga

SEQ ID NO: 382973 - RNA, 21 nt, Human
aagaagaaaaccaaacaugau

SEQ ID NO: 382974 - RNA, 23 nt, Human
aagcaccuucucugguggcagcc

SEQ ID NO: 382975 - RNA, 20 nt, Human
acaggcagggcugcuguggu

SEQ ID NO: 382976 - RNA, 24 nt, Human
accagccagcagcccaagaaaccu

SEQ ID NO: 382977 - RNA, 19 nt, Human
acccaggcaccucaccugg

SEQ ID NO: 382978 - RNA, 23 nt, Human
acccauucacuuggaaaacagua

SEQ ID NO: 382979 - RNA, 18 nt, Human
accccucccuggccccag

SEQ ID NO: 382980 - RNA, 19 nt, Human
acccugcucccccagaaca

SEQ ID NO: 382981 - RNA, 24 nt, Human
acucggugggugagacuccccgag

SEQ ID NO: 382982 - RNA, 22 nt, Human
acucuccccuuggcuucuccag

SEQ ID NO: 382983 - RNA, 18 nt, Human
agaaaaccaaacaugauc

SEQ ID NO: 382984 - RNA, 18 nt, Human
agaaaaugccccaucccc

SEQ ID NO: 382985 - RNA, 20 nt, Human
agaggaagagggggcaagaa

SEQ ID NO: 382986 - RNA, 23 nt, Human
agauaggcuggcuucuggaaggc

SEQ ID NO: 382987 - RNA, 20 nt, Human
agccagaaagggaagaccag

SEQ ID NO: 382988 - RNA, 24 nt, Human
agccagcagagccacaggagccug

SEQ ID NO: 382989 - RNA, 22 nt, Human
agccagcagcccaagaaaccuc

SEQ ID NO: 382990 - RNA, 19 nt, Human
agcccagggagagauacag

SEQ ID NO: 382991 - RNA, 24 nt, Human
agcccucaggcaggucccgagcaa

SEQ ID NO: 382992 - RNA, 22 nt, Human
aggaaauucucuacuggucagc

SEQ ID NO: 382993 - RNA, 22 nt, Human
aggaagaggcaccagcuccagu

SEQ ID NO: 382994 - RNA, 20 nt, Human
aggagagggauuaggagugg

SEQ ID NO: 382995 - RNA, 20 nt, Human
aggcagauuuagggagggag

SEQ ID NO: 382996 - RNA, 18 nt, Human
aggcaggaaaggggcuug

SEQ ID NO: 382997 - RNA, 23 nt, Human
aggcuggcuucuggaaggcaaac

SEQ ID NO: 382998 - RNA, 19 nt, Human
agggacccaggcaccucac

SEQ ID NO: 382999 - RNA, 19 nt, Human
agggagcccucaggcaggu

SEQ ID NO: 383000 - RNA, 18 nt, Human
agggcugcuguggugggg

SEQ ID NO: 383001 - RNA, 19 nt, Human
aguagcaccccucccuggc

SEQ ID NO: 383002 - RNA, 22 nt, Human
aguguuagcaaaaccaaaguga

SEQ ID NO: 383003 - RNA, 18 nt, Human
caaaaccaaagugaaaga

SEQ ID NO: 383004 - RNA, 18 nt, Human
caaagacccuccaggucu

SEQ ID NO: 383005 - RNA, 21 nt, Human
caagcauccugugccagaagc

SEQ ID NO: 383006 - RNA, 21 nt, Human
cacccaaaaauucuuacaaaa

SEQ ID NO: 383007 - RNA, 23 nt, Human
cacccaaaaauucuuacaaaagu

SEQ ID NO: 383008 - RNA, 25 nt, Human
caccuggcauggauguccuagaagc

SEQ ID NO: 383009 - RNA, 18 nt, Human
cacuggggagcagcuggg

SEQ ID NO: 383010 - RNA, 19 nt, Human
cagaaaaugccccaucccc

SEQ ID NO: 383011 - RNA, 21 nt, Human
cagaaaaugccccauccccac

SEQ ID NO: 383012 - RNA, 18 nt, Human
cagaacagggccaccaug

SEQ ID NO: 383013 - RNA, 19 nt, Human
cagagccagugagauggag

SEQ ID NO: 383014 - RNA, 20 nt, Human
cagagcugcagggagggaaa

SEQ ID NO: 383015 - RNA, 20 nt, Human
cagagcuggagacccaggcc

SEQ ID NO: 383016 - RNA, 22 nt, Human
cagauggaaguacggcgaacug

SEQ ID NO: 383017 - RNA, 21 nt, Human
cagcuggugcccucauacccc

SEQ ID NO: 383018 - RNA, 23 nt, Human
caggcgaacaccaagcaccuucu

SEQ ID NO: 383019 - RNA, 25 nt, Human
cagggagaggcuggucaugguggca

SEQ ID NO: 383020 - RNA, 19 nt, Human
caggucccgagcaagagag

SEQ ID NO: 383021 - RNA, 18 nt, Human
caguccuccugcagccca

SEQ ID NO: 383022 - RNA, 22 nt, Human
caguguuagcaaaaccaaagug

SEQ ID NO: 383023 - RNA, 20 nt, Human
cauccccacccaaccaacga

SEQ ID NO: 383024 - RNA, 23 nt, Human
cauccugugccagaagcugugcu

SEQ ID NO: 383025 - RNA, 18 nt, Human
ccaagcauccugugccag

SEQ ID NO: 383026 - RNA, 22 nt, Human
ccaaguagcuugcagaagaggc

SEQ ID NO: 383027 - RNA, 22 nt, Human
ccagcuggugcccucauacccc

SEQ ID NO: 383028 - RNA, 21 nt, Human
ccaggucaggcgugggagaua

SEQ ID NO: 383029 - RNA, 20 nt, Human
ccaggugcuucacaaacuaa

SEQ ID NO: 383030 - RNA, 23 nt, Human
cccaagaaaccucugggaggcac

SEQ ID NO: 383031 - RNA, 19 nt, Human
cccagaacagggccaccau

SEQ ID NO: 383032 - RNA, 20 nt, Human
ccccacacaggccugagacc

SEQ ID NO: 383033 - RNA, 22 nt, Human
ccccacacaggccugagaccuc

SEQ ID NO: 383034 - RNA, 21 nt, Human
cccccagaacagggccaccau

SEQ ID NO: 383035 - RNA, 22 nt, Human
ccccccucagaauugcagcuga

SEQ ID NO: 383036 - RNA, 19 nt, Human
ccccgggcuccaucaggcc

SEQ ID NO: 383037 - RNA, 20 nt, Human
ccccgggcuccaucaggccc

SEQ ID NO: 383038 - RNA, 18 nt, Human
ccccugagcuggagguga

SEQ ID NO: 383039 - RNA, 23 nt, Human
ccccugagcuggaggugaggugg

SEQ ID NO: 383040 - RNA, 26 nt, Human
ccccuuaccuccuccacccacuacaa

SEQ ID NO: 383041 - RNA, 20 nt, Human
cccgaguggcuugcaucuug

SEQ ID NO: 383042 - RNA, 19 nt, Human
cccucagagccagugagau

SEQ ID NO: 383043 - RNA, 26 nt, Human
ccgaccuucagguuuucucccugacg

SEQ ID NO: 383044 - RNA, 21 nt, Human
ccgaguggcuugcaucuuggc

SEQ ID NO: 383045 - RNA, 23 nt, Human
ccuagaguuggggguaagaaggc

SEQ ID NO: 383046 - RNA, 20 nt, Human
ccuaguggcuccauggaggu

SEQ ID NO: 383047 - RNA, 22 nt, Human
ccuccugcagcccacacugagc

SEQ ID NO: 383048 - RNA, 18 nt, Human
ccuccugccuuacccugc

SEQ ID NO: 383049 - RNA, 21 nt, Human
ccucgcacaagccucccaaac

SEQ ID NO: 383050 - RNA, 22 nt, Human
ccucgcacaagccucccaaacc

SEQ ID NO: 383051 - RNA, 26 nt, Human
ccucgcacaagccucccaaacccccc

SEQ ID NO: 383052 - RNA, 22 nt, Human
ccugagaccucgcacaagccuc

SEQ ID NO: 383053 - RNA, 27 nt, Human
ccugagaccucgcacaagccucccaaa

SEQ ID NO: 383054 - RNA, 20 nt, Human
ccugcugggcugugcggcag

SEQ ID NO: 383055 - RNA, 20 nt, Human
cgaaaccccagucccaagac

SEQ ID NO: 383056 - RNA, 24 nt, Human
cgcacaagccucccaaaccccccu

SEQ ID NO: 383057 - RNA, 18 nt, Human
cgccucccuccugcuggg

SEQ ID NO: 383058 - RNA, 19 nt, Human
cgcucugcaucuggcuguc

SEQ ID NO: 383059 - RNA, 22 nt, Human
cuacaaaauaaaauaaggaaga

SEQ ID NO: 383060 - RNA, 24 nt, Human
cucccaaaccccccucagaauugc

SEQ ID NO: 383061 - RNA, 27 nt, Human
cucccaaaccccccucagaauugcagc

SEQ ID NO: 383062 - RNA, 18 nt, Human
cuccugacauauugcagg

SEQ ID NO: 383063 - RNA, 24 nt, Human
cucgcacaagccucccaaaccccc

SEQ ID NO: 383064 - RNA, 18 nt, Human
cucucccaaauacuccag

SEQ ID NO: 383065 - RNA, 21 nt, Human
cucucccaaauacuccaggcu

SEQ ID NO: 383066 - RNA, 20 nt, Human
cucugugcagccggcuccuc

SEQ ID NO: 383067 - RNA, 27 nt, Human
cucugugcagccggcuccuccagggcu

SEQ ID NO: 383068 - RNA, 23 nt, Human
cugcagcccacacugagccagca

SEQ ID NO: 383069 - RNA, 22 nt, Human
cugcagccccaggaaccgaguc

SEQ ID NO: 383070 - RNA, 20 nt, Human
cuggaggugagguggagggc

SEQ ID NO: 383071 - RNA, 22 nt, Human
cuggccccugcaggaucuuggg

SEQ ID NO: 383072 - RNA, 23 nt, Human
cugggggcagcucuuuggcugga

SEQ ID NO: 383073 - RNA, 20 nt, Human
cugguggcagcccagggaga

SEQ ID NO: 383074 - RNA, 25 nt, Human
cugucuccaccuaggggcacagcca

SEQ ID NO: 383075 - RNA, 18 nt, Human
cugugcaggcugcaggca

SEQ ID NO: 383076 - RNA, 20 nt, Human
gaagaccagacacaaaaaua

SEQ ID NO: 383077 - RNA, 20 nt, Human
gaccaggugcuucacaaacu

SEQ ID NO: 383078 - RNA, 23 nt, Human
gacccaggcaccucaccuggcau

SEQ ID NO: 383079 - RNA, 22 nt, Human
gaccucgcacaagccucccaaa

SEQ ID NO: 383080 - RNA, 20 nt, Human
gaccuucagguuuucucccu

SEQ ID NO: 383081 - RNA, 20 nt, Human
gagacuccccgaggcgaugg

SEQ ID NO: 383082 - RNA, 18 nt, Human
gagccuggccccugcagg

SEQ ID NO: 383083 - RNA, 18 nt, Human
gagcugcagggagggaaa

SEQ ID NO: 383084 - RNA, 22 nt, Human
gaggugagguggagggccugug

SEQ ID NO: 383085 - RNA, 20 nt, Human
gaguagcaaaggcuuccaga

SEQ ID NO: 383086 - RNA, 21 nt, Human
gagucgccacugacauuaaaa

SEQ ID NO: 383087 - RNA, 18 nt, Human
gcacccagcagauggaag

SEQ ID NO: 383088 - RNA, 24 nt, Human
gcagccccaggaaccgagucgcca

SEQ ID NO: 383089 - RNA, 21 nt, Human
gcagcccuacagccugaaggc

SEQ ID NO: 383090 - RNA, 18 nt, Human
gcagccggcuccuccagg

SEQ ID NO: 383091 - RNA, 22 nt, Human
gcaggcacugggggaacuggag

SEQ ID NO: 383092 - RNA, 20 nt, Human
gcaguacugggggugagggg

SEQ ID NO: 383093 - RNA, 24 nt, Human
gccaggaugccagaaaggagaggg

SEQ ID NO: 383094 - RNA, 19 nt, Human
gcuggacaggguccaaggu

SEQ ID NO: 383095 - RNA, 22 nt, Human
gcuggcugcagccccaggaacc

SEQ ID NO: 383096 - RNA, 22 nt, Human
ggacaggacugguuacagagcu

SEQ ID NO: 383097 - RNA, 24 nt, Human
ggaggccccuuaccuccuccaccc

SEQ ID NO: 383098 - RNA, 26 nt, Human
ggagugucucuacucucccccugccc

SEQ ID NO: 383099 - RNA, 23 nt, Human
ggcacagccaggguccagaguca

SEQ ID NO: 383100 - RNA, 19 nt, Human
ggcaguagaggcacagcug

SEQ ID NO: 383101 - RNA, 20 nt, Human
ggcaucccugcuggugccug

SEQ ID NO: 383102 - RNA, 23 nt, Human
gggcacuccuguggcaucccugc

SEQ ID NO: 383103 - RNA, 19 nt, Human
gggcaggcacugggggaac

SEQ ID NO: 383104 - RNA, 21 nt, Human
gggcaguagaggcacagcugc

SEQ ID NO: 383105 - RNA, 20 nt, Human
ggggaacuggagagggcaaa

SEQ ID NO: 383106 - RNA, 21 nt, Human
gggggaacuggagagggcaaa

SEQ ID NO: 383107 - RNA, 24 nt, Human
ggggguaggugagaaagagggcug

SEQ ID NO: 383108 - RNA, 20 nt, Human
ggggugcguagggcaggcac

SEQ ID NO: 383109 - RNA, 21 nt, Human
ggucagcuuggcuugaucuuc

SEQ ID NO: 383110 - RNA, 21 nt, Human
ggucaggggcucccucagagc

SEQ ID NO: 383111 - RNA, 23 nt, Human
ggugagaaagagggcugucucca

SEQ ID NO: 383112 - RNA, 24 nt, Human
ggugggggaaggccaguagggcuc

SEQ ID NO: 383113 - RNA, 20 nt, Human
gucagaaacaagagcuucac

SEQ ID NO: 383114 - RNA, 18 nt, Human
guccagagucaaaccuca

SEQ ID NO: 383115 - RNA, 20 nt, Human
gugauacccuguccugcccu

SEQ ID NO: 383116 - RNA, 24 nt, Human
uaaaauaccacccgguuucuacaa

SEQ ID NO: 383117 - RNA, 27 nt, Human
uaaaauaccacccgguuucuacaaaau

SEQ ID NO: 383118 - RNA, 20 nt, Human
uaacccgagaggaacuccaa

SEQ ID NO: 383119 - RNA, 24 nt, Human
uaaggcagcccuacagccugaagg

SEQ ID NO: 383120 - RNA, 22 nt, Human
uaagugagucacccaaaaauuc

SEQ ID NO: 383121 - RNA, 18 nt, Human
uacccugcucccccagaa

SEQ ID NO: 383122 - RNA, 19 nt, Human
uacccugcucccccagaac

SEQ ID NO: 383123 - RNA, 19 nt, Human
uacugggggugaggggcug

SEQ ID NO: 383124 - RNA, 18 nt, Human
uagaagaugaggcugggg

SEQ ID NO: 383125 - RNA, 23 nt, Human
uagaguuggggguaagaaggcag

SEQ ID NO: 383126 - RNA, 19 nt, Human
uagcuugcagaagaggcag

SEQ ID NO: 383127 - RNA, 23 nt, Human
uaggcuggcuucuggaaggcaaa

SEQ ID NO: 383128 - RNA, 19 nt, Human
ucaaagcugcacaagggag

SEQ ID NO: 383129 - RNA, 21 nt, Human
ucacuggggagcagcugggcu

SEQ ID NO: 383130 - RNA, 23 nt, Human
ucacuggggagcagcugggcucc

SEQ ID NO: 383131 - RNA, 18 nt, Human
ucagggagaggcugguca

SEQ ID NO: 383132 - RNA, 20 nt, Human
ucaugacuuugcuuugaaga

SEQ ID NO: 383133 - RNA, 22 nt, Human
uccacaaagacccuccaggucu

SEQ ID NO: 383134 - RNA, 21 nt, Human
ucccaggcuggcugcagcccc

SEQ ID NO: 383135 - RNA, 27 nt, Human
ucccaggcuggcugcagccccaggaac

SEQ ID NO: 383136 - RNA, 19 nt, Human
ucccccugccccgggcucc

SEQ ID NO: 383137 - RNA, 21 nt, Human
ucccccugccccgggcuccau

SEQ ID NO: 383138 - RNA, 22 nt, Human
uccccuuggcuucuccaguccc

SEQ ID NO: 383139 - RNA, 19 nt, Human
ucccugcuggccccugcag

SEQ ID NO: 383140 - RNA, 19 nt, Human
ucccugcuggugccugugu

SEQ ID NO: 383141 - RNA, 19 nt, Human
ucccuggagaacccagcug

SEQ ID NO: 383142 - RNA, 23 nt, Human
ucccuggagaacccagcuggugc

SEQ ID NO: 383143 - RNA, 20 nt, Human
uccgccucccuccugcuggg

SEQ ID NO: 383144 - RNA, 21 nt, Human
uccugccuuacccugcucccc

SEQ ID NO: 383145 - RNA, 19 nt, Human
ucucggagcucacccacuu

SEQ ID NO: 383146 - RNA, 22 nt, Human
ucugcaguacugggggugaggg

SEQ ID NO: 383147 - RNA, 21 nt, Human
ucuggcuguccgccucccucc

SEQ ID NO: 383148 - RNA, 18 nt, Human
ucugguggcagcccaggg

SEQ ID NO: 383149 - RNA, 21 nt, Human
ugaaccucacccucucccagg

SEQ ID NO: 383150 - RNA, 19 nt, Human
ugacuuugcuuugaagagg

SEQ ID NO: 383151 - RNA, 23 nt, Human
ugagauggagccuggccccugca

SEQ ID NO: 383152 - RNA, 26 nt, Human
ugagucacccaaaaauucuuacaaaa

SEQ ID NO: 383153 - RNA, 18 nt, Human
ugcaaagauguuuaaugc

SEQ ID NO: 383154 - RNA, 24 nt, Human
ugcagaagaggcagauuuagggag

SEQ ID NO: 383155 - RNA, 21 nt, Human
ugcagcagaggcagaugggag

SEQ ID NO: 383156 - RNA, 20 nt, Human
ugccagaagcugugcuggac

SEQ ID NO: 383157 - RNA, 20 nt, Human
ugccuuacccugcuccccca

SEQ ID NO: 383158 - RNA, 18 nt, Human
ugcugggcugugcggcag

SEQ ID NO: 383159 - RNA, 22 nt, Human
uggaaaacaguagcaccccucc

SEQ ID NO: 383160 - RNA, 19 nt, Human
uggagagggcaaacgacgg

SEQ ID NO: 383161 - RNA, 24 nt, Human
uggauguccuagaagccagaaagg

SEQ ID NO: 383162 - RNA, 24 nt, Human
uggcacugcgcagucuuccucaca

SEQ ID NO: 383163 - RNA, 21 nt, Human
uggcagcccagggagagauac

SEQ ID NO: 383164 - RNA, 26 nt, Human
uggcaggcgaacaccaagcaccuucu

SEQ ID NO: 383165 - RNA, 22 nt, Human
uggcauggauguccuagaagcc

SEQ ID NO: 383166 - RNA, 18 nt, Human
uggccugaugggucacaa

SEQ ID NO: 383167 - RNA, 19 nt, Human
uggccugaugggucacaag

SEQ ID NO: 383168 - RNA, 20 nt, Human
uggccugaugggucacaagg

SEQ ID NO: 383169 - RNA, 26 nt, Human
uggcuggaucucucaucaguggaguc

SEQ ID NO: 383170 - RNA, 24 nt, Human
ugggaggcaccaaugcccauagga

SEQ ID NO: 383171 - RNA, 21 nt, Human
ugggggcagcucuuuggcugg

SEQ ID NO: 383172 - RNA, 22 nt, Human
ugggggcugcagcgaggucuag

SEQ ID NO: 383173 - RNA, 20 nt, Human
uguacaaaaggaggggucuc

SEQ ID NO: 383174 - RNA, 19 nt, Human
ugucagaaacaagagcuuc

SEQ ID NO: 383175 - RNA, 21 nt, Human
uguggcaucccugcuggugcc

SEQ ID NO: 383176 - RNA, 18 nt, Human
uugcagaagaggcagauu

SEQ ID NO: 383177 - RNA, 19 nt, Human
uugcugguuccaggucagg

SEQ ID NO: 383178 - RNA, 20 nt, Human
acaugagccacugugccuga

SEQ ID NO: 383179 - RNA, 24 nt, Human
caaaucgcugggauugcagacaug

SEQ ID NO: 383180 - RNA, 20 nt, Human
cagcucaaccucccaaaucg

SEQ ID NO: 383181 - RNA, 24 nt, Human
cagcucaaccucccaaaucgcugg

SEQ ID NO: 383182 - RNA, 23 nt, Human
ccagcucaaccucccaaaucgcu

SEQ ID NO: 383183 - RNA, 22 nt, Human
ccuaccagcucaaccucccaaa

SEQ ID NO: 383184 - RNA, 18 nt, Human
gauugcagacaugagcca

SEQ ID NO: 383185 - RNA, 19 nt, Human
gauugcagacaugagccac

SEQ ID NO: 383186 - RNA, 21 nt, Human
gauugcagacaugagccacug

SEQ ID NO: 383187 - RNA, 18 nt, Human
gcacacucccucugcagu

SEQ ID NO: 383188 - RNA, 23 nt, Human
ugcagugacuccaggagccccuc

SEQ ID NO: 383189 - RNA, 18 nt, Human
ugggauugcagacaugag

SEQ ID NO: 383190 - RNA, 21 nt, Human
ugggauugcagacaugagcca

SEQ ID NO: 383191 - RNA, 22 nt, Human
ugggauugcagacaugagccac

SEQ ID NO: 383192 - RNA, 23 nt, Human
ugggauugcagacaugagccacu

SEQ ID NO: 383193 - RNA, 24 nt, Human
ugggauugcagacaugagccacug

SEQ ID NO: 383194 - RNA, 22 nt, Human
aacucacuguauccacaaccuc

SEQ ID NO: 383195 - RNA, 19 nt, Human
aaguagcugggacuacagg

SEQ ID NO: 383196 - RNA, 20 nt, Human
aaguagcugggacuacaggu

SEQ ID NO: 383197 - RNA, 26 nt, Human
aaguagcugggacuacagguaagugc

SEQ ID NO: 383198 - RNA, 20 nt, Human
acaugagccacugugccuga

SEQ ID NO: 383199 - RNA, 21 nt, Human
agccucugcuucccaaguagc

SEQ ID NO: 383200 - RNA, 23 nt, Human
agccucugcuucccaaguagcug

SEQ ID NO: 383201 - RNA, 24 nt, Human
caaaucgcugggauugcagacaug

SEQ ID NO: 383202 - RNA, 22 nt, Human
caaccuccugggcugaaaugau

SEQ ID NO: 383203 - RNA, 24 nt, Human
cacagccagaucaggucuccccaa

SEQ ID NO: 383204 - RNA, 22 nt, Human
cagccagaucaggucuccccaa

SEQ ID NO: 383205 - RNA, 20 nt, Human
cagcucaaccucccaaaucg

SEQ ID NO: 383206 - RNA, 21 nt, Human
ccacaaccuccugggcugaaa

SEQ ID NO: 383207 - RNA, 23 nt, Human
ccagcucaaccucccaaaucgcu

SEQ ID NO: 383208 - RNA, 22 nt, Human
cccaaguagcugggacuacagg

SEQ ID NO: 383209 - RNA, 23 nt, Human
cccaaguagcugggacuacaggu

SEQ ID NO: 383210 - RNA, 20 nt, Human
cccgggcaccgccuccccgu

SEQ ID NO: 383211 - RNA, 22 nt, Human
ccuaccagcucaaccucccaaa

SEQ ID NO: 383212 - RNA, 18 nt, Human
ccuccagccucugcuucc

SEQ ID NO: 383213 - RNA, 24 nt, Human
cucacuguauccacaaccuccugg

SEQ ID NO: 383214 - RNA, 24 nt, Human
cugaaaugauccuccagccucugc

SEQ ID NO: 383215 - RNA, 19 nt, Human
cuggcacagccagaucagg

SEQ ID NO: 383216 - RNA, 18 nt, Human
gauugcagacaugagcca

SEQ ID NO: 383217 - RNA, 19 nt, Human
gauugcagacaugagccac

SEQ ID NO: 383218 - RNA, 21 nt, Human
gauugcagacaugagccacug

SEQ ID NO: 383219 - RNA, 18 nt, Human
gcacacucccucugcagu

SEQ ID NO: 383220 - RNA, 22 nt, Human
gcucaaccucccaaaucgcugg

SEQ ID NO: 383221 - RNA, 18 nt, Human
uauuuucuuuggagggag

SEQ ID NO: 383222 - RNA, 24 nt, Human
ucacuauuuuaccaggcuggucuc

SEQ ID NO: 383223 - RNA, 24 nt, Human
ucacuguauccacaaccuccuggg

SEQ ID NO: 383224 - RNA, 24 nt, Human
ucccaaguagcugggacuacaggu

SEQ ID NO: 383225 - RNA, 21 nt, Human
ucuugcuugucauccaggcug

SEQ ID NO: 383226 - RNA, 23 nt, Human
ugaggucucacuauuuuaccagg

SEQ ID NO: 383227 - RNA, 23 nt, Human
ugcagugacuccaggagccccuc

SEQ ID NO: 383228 - RNA, 19 nt, Human
ugggacuacagguaagugc

SEQ ID NO: 383229 - RNA, 21 nt, Human
ugggacuacagguaagugcca

SEQ ID NO: 383230 - RNA, 18 nt, Human
ugggauugcagacaugag

SEQ ID NO: 383231 - RNA, 21 nt, Human
ugggauugcagacaugagcca

SEQ ID NO: 383232 - RNA, 22 nt, Human
ugggauugcagacaugagccac

SEQ ID NO: 383233 - RNA, 23 nt, Human
ugggauugcagacaugagccacu

SEQ ID NO: 383234 - RNA, 24 nt, Human
ugggauugcagacaugagccacug

SEQ ID NO: 383235 - RNA, 24 nt, Human
ugugauccuaccagcucaaccucc

SEQ ID NO: 383236 - RNA, 26 nt, Human
uuguagagaugaggucucacuauuuu

SEQ ID NO: 383237 - RNA, 18 nt, Human
uuucucaguguccaucug

SEQ ID NO: 383238 - RNA, 22 nt, Human
aaaaaauacccuacgaaaucca

SEQ ID NO: 383239 - RNA, 22 nt, Human
aagaauaguugggaaaaugggc

SEQ ID NO: 383240 - RNA, 21 nt, Human
aagcaagggaaaagaacaccu

SEQ ID NO: 383241 - RNA, 21 nt, Human
aagcagucaguuaagaccagc

SEQ ID NO: 383242 - RNA, 20 nt, Human
aagcauucagaauuuuaguu

SEQ ID NO: 383243 - RNA, 18 nt, Human
aagcauuuuaacacugac

SEQ ID NO: 383244 - RNA, 20 nt, Human
aagcuaccuuauaucuuacu

SEQ ID NO: 383245 - RNA, 24 nt, Human
acauagcaagacccuauuuuaaaa

SEQ ID NO: 383246 - RNA, 24 nt, Human
acauuguuuggaauugccagugca

SEQ ID NO: 383247 - RNA, 22 nt, Human
acugcauuagguacuaggagua

SEQ ID NO: 383248 - RNA, 25 nt, Human
agacagaacuccaggauugagccca

SEQ ID NO: 383249 - RNA, 23 nt, Human
agccauccugucuccuccuuucu

SEQ ID NO: 383250 - RNA, 24 nt, Human
agccugggcaacauagcaagaccc

SEQ ID NO: 383251 - RNA, 24 nt, Human
aggccauguuuccucagggcuggc

SEQ ID NO: 383252 - RNA, 20 nt, Human
aguugccugaauggccagga

SEQ ID NO: 383253 - RNA, 26 nt, Human
auccugucuccuccuuucugcuuuca

SEQ ID NO: 383254 - RNA, 20 nt, Human
augggaagcaagggaaaaga

SEQ ID NO: 383255 - RNA, 18 nt, Human
caagggcacuugcugugu

SEQ ID NO: 383256 - RNA, 23 nt, Human
caaguuccagcugaaagucagca

SEQ ID NO: 383257 - RNA, 20 nt, Human
cagcagcucaaaggcccacu

SEQ ID NO: 383258 - RNA, 20 nt, Human
cagcucaaaggcccacucaa

SEQ ID NO: 383259 - RNA, 24 nt, Human
caggauugagcccaggcuggaguu

SEQ ID NO: 383260 - RNA, 19 nt, Human
caggcacugcauuagguac

SEQ ID NO: 383261 - RNA, 24 nt, Human
caguuaagaccagccugggcaaca

SEQ ID NO: 383262 - RNA, 26 nt, Human
cauagcaagacccuauuuuaaaaaaa

SEQ ID NO: 383263 - RNA, 19 nt, Human
caugcuuucuguuuccuau

SEQ ID NO: 383264 - RNA, 21 nt, Human
ccaccagugaggcacucaggc

SEQ ID NO: 383265 - RNA, 22 nt, Human
ccagaauaauggggauuaaaac

SEQ ID NO: 383266 - RNA, 21 nt, Human
ccaggcacugcauuagguacu

SEQ ID NO: 383267 - RNA, 19 nt, Human
cccaauuaccuccaugccu

SEQ ID NO: 383268 - RNA, 19 nt, Human
cccucuacaaguucucaag

SEQ ID NO: 383269 - RNA, 22 nt, Human
ccugggcaacauagcaagaccc

SEQ ID NO: 383270 - RNA, 24 nt, Human
ccugucuccuccuuucugcuuucc

SEQ ID NO: 383271 - RNA, 21 nt, Human
cguuguugacagccauccugu

SEQ ID NO: 383272 - RNA, 23 nt, Human
cucauauacauauaguuaaaacu

SEQ ID NO: 383273 - RNA, 25 nt, Human
cugcaacugggacaaauaugggaag

SEQ ID NO: 383274 - RNA, 21 nt, Human
gaagaguaaauacauaagaag

SEQ ID NO: 383275 - RNA, 23 nt, Human
gacccaauuaccuccaugccugg

SEQ ID NO: 383276 - RNA, 18 nt, Human
gacuaaaagaaaaggguc

SEQ ID NO: 383277 - RNA, 20 nt, Human
gauccuuuuuaaaaaaugaa

SEQ ID NO: 383278 - RNA, 18 nt, Human
gccauguuuccucagggc

SEQ ID NO: 383279 - RNA, 20 nt, Human
gcugcagucauuuauccaug

SEQ ID NO: 383280 - RNA, 23 nt, Human
gguauagauaagaaauugaagag

SEQ ID NO: 383281 - RNA, 19 nt, Human
guauagauaagaaauugaa

SEQ ID NO: 383282 - RNA, 22 nt, Human
uaaaaaaaauacccuacgaaau

SEQ ID NO: 383283 - RNA, 20 nt, Human
uaaaaaaugaaguggugaca

SEQ ID NO: 383284 - RNA, 28 nt, Human
uaaaaagcagucaguuaagaccagccug

SEQ ID NO: 383285 - RNA, 18 nt, Human
uaaaaaggugcuuauuug

SEQ ID NO: 383286 - RNA, 19 nt, Human
uacccucagcuauggaaug

SEQ ID NO: 383287 - RNA, 24 nt, Human
uagaacuuaggccaauaagaguuu

SEQ ID NO: 383288 - RNA, 19 nt, Human
uagcacugggacuauucac

SEQ ID NO: 383289 - RNA, 26 nt, Human
uauaaccuaauauuuggacuuauacc

SEQ ID NO: 383290 - RNA, 22 nt, Human
uauggcaugagacugaacccaa

SEQ ID NO: 383291 - RNA, 19 nt, Human
ucaagggcacuugcugugu

SEQ ID NO: 383292 - RNA, 26 nt, Human
ucagagauucuucuggcugggacuga

SEQ ID NO: 383293 - RNA, 27 nt, Human
ucauuuauccaugcacuuuuuuacucc

SEQ ID NO: 383294 - RNA, 20 nt, Human
uccaugcacuuuuuuacucc

SEQ ID NO: 383295 - RNA, 19 nt, Human
ucccaaaaggccacuguca

SEQ ID NO: 383296 - RNA, 19 nt, Human
ucccacccaccagugaggc

SEQ ID NO: 383297 - RNA, 19 nt, Human
ucccagggugaacugcucc

SEQ ID NO: 383298 - RNA, 23 nt, Human
uccuucugauagugaccagacag

SEQ ID NO: 383299 - RNA, 18 nt, Human
ucuucuggcugggacuga

SEQ ID NO: 383300 - RNA, 22 nt, Human
ugaagaguaaauacauaagaag

SEQ ID NO: 383301 - RNA, 20 nt, Human
ugacagccauccugucuccu

SEQ ID NO: 383302 - RNA, 21 nt, Human
ugacauuguuuggaauugcca

SEQ ID NO: 383303 - RNA, 19 nt, Human
ugaccagacagaacuccag

SEQ ID NO: 383304 - RNA, 21 nt, Human
ugacguuguugacagccaucc

SEQ ID NO: 383305 - RNA, 26 nt, Human
ugagacugaacccaagaauuaacaau

SEQ ID NO: 383306 - RNA, 18 nt, Human
ugagcccaggcuggaguu

SEQ ID NO: 383307 - RNA, 23 nt, Human
ugccugaauggccaggacagaug

SEQ ID NO: 383308 - RNA, 21 nt, Human
ugccugggagccaugcccaug

SEQ ID NO: 383309 - RNA, 19 nt, Human
uggccaggacagaugacag

SEQ ID NO: 383310 - RNA, 21 nt, Human
ugggaagcaagggaaaagaac

SEQ ID NO: 383311 - RNA, 19 nt, Human
ugggacaaauaugggaagc

SEQ ID NO: 383312 - RNA, 21 nt, Human
ugggacuaaaagaaaaggguc

SEQ ID NO: 383313 - RNA, 19 nt, Human
uguauacauucacaauaug

SEQ ID NO: 383314 - RNA, 22 nt, Human
ugucuccuccuuucugcuuuca

SEQ ID NO: 383315 - RNA, 19 nt, Human
uguugacagccauccuguc

SEQ ID NO: 383316 - RNA, 19 nt, Human
uuagggcuuccaaaagggu

SEQ ID NO: 383317 - RNA, 21 nt, Human
uuaguuuauuaagcuaccuua

SEQ ID NO: 383318 - RNA, 21 nt, Human
uucuucuggcugggacugaag

SEQ ID NO: 383319 - RNA, 30 nt, Human
uucuuuuuuuccuuuuuuuuuucucuuuuu

SEQ ID NO: 383320 - RNA, 27 nt, Human
uugggacuaaaagaaaagggucaaagu

SEQ ID NO: 383321 - RNA, 21 nt, Human
uuuuuuccuuuuuuuuuucuc

SEQ ID NO: 383322 - RNA, 18 nt, Human
aaagucugggaucccaug

SEQ ID NO: 383323 - RNA, 19 nt, Human
aaagugcugggauuacaga

SEQ ID NO: 383324 - RNA, 24 nt, Human
aaagugcugggauuacagacauga

SEQ ID NO: 383325 - RNA, 20 nt, Human
aaccucugccuccugaguuc

SEQ ID NO: 383326 - RNA, 24 nt, Human
aacgauucuccuaccucagccucc

SEQ ID NO: 383327 - RNA, 21 nt, Human
aagugcugggauuacagacau

SEQ ID NO: 383328 - RNA, 26 nt, Human
aagugcugggauuacagacaugagcc

SEQ ID NO: 383329 - RNA, 19 nt, Human
acaaggaagggaucagaga

SEQ ID NO: 383330 - RNA, 21 nt, Human
acaugagccaaugcgccuggc

SEQ ID NO: 383331 - RNA, 19 nt, Human
acccaggcuggagugcagu

SEQ ID NO: 383332 - RNA, 19 nt, Human
agagaugggguuucaccgu

SEQ ID NO: 383333 - RNA, 22 nt, Human
agcaaggauaaaacgaucuuua

SEQ ID NO: 383334 - RNA, 18 nt, Human
agccaaugcgccuggcua

SEQ ID NO: 383335 - RNA, 19 nt, Human
aggcaugaaccaccgcgcc

SEQ ID NO: 383336 - RNA, 25 nt, Human
aggcuggagugcaguggcgcgaucu

SEQ ID NO: 383337 - RNA, 22 nt, Human
aggguuucaucauguuggccag

SEQ ID NO: 383338 - RNA, 23 nt, Human
aggguuucaucauguuggccagg

SEQ ID NO: 383339 - RNA, 19 nt, Human
aguagcugggacuauaggc

SEQ ID NO: 383340 - RNA, 23 nt, Human
agugcaguggcgcgaucuuggcu

SEQ ID NO: 383341 - RNA, 24 nt, Human
agugcaguggcgcgaucuuggcuc

SEQ ID NO: 383342 - RNA, 24 nt, Human
agugcugggauuacagacaugagc

SEQ ID NO: 383343 - RNA, 18 nt, Human
agugcugggauuacaggc

SEQ ID NO: 383344 - RNA, 22 nt, Human
agugcugggauuacaggcauga

SEQ ID NO: 383345 - RNA, 18 nt, Human
auaggguuucaucauguu

SEQ ID NO: 383346 - RNA, 23 nt, Human
auaggguuucaucauguuggcca

SEQ ID NO: 383347 - RNA, 24 nt, Human
auaggguuucaucauguuggccag

SEQ ID NO: 383348 - RNA, 24 nt, Human
auagugcugggauuacaggcauga

SEQ ID NO: 383349 - RNA, 24 nt, Human
aucauguuggccaggauggucucg

SEQ ID NO: 383350 - RNA, 18 nt, Human
augaccucuuccugcgug

SEQ ID NO: 383351 - RNA, 18 nt, Human
augggguuucaccguguu

SEQ ID NO: 383352 - RNA, 20 nt, Human
augggguuucaccguguuag

SEQ ID NO: 383353 - RNA, 24 nt, Human
augggguuucaccguguuagccag

SEQ ID NO: 383354 - RNA, 24 nt, Human
auuuuuguauuuuuaguagagaua

SEQ ID NO: 383355 - RNA, 20 nt, Human
caaacgauucuccuaccuca

SEQ ID NO: 383356 - RNA, 24 nt, Human
caaagugcugggauuacagacaug

SEQ ID NO: 383357 - RNA, 19 nt, Human
cacaaugaccccagucagg

SEQ ID NO: 383358 - RNA, 22 nt, Human
caccaccaugcccggcuaauuu

SEQ ID NO: 383359 - RNA, 24 nt, Human
caccaugcccggcuaauuuuugua

SEQ ID NO: 383360 - RNA, 24 nt, Human
cacccaggcuggagugcaguggcg

SEQ ID NO: 383361 - RNA, 22 nt, Human
cacccccccgaccucccaaagu

SEQ ID NO: 383362 - RNA, 18 nt, Human
caccgcuggaggcugugg

SEQ ID NO: 383363 - RNA, 18 nt, Human
caccguguuagccaggau

SEQ ID NO: 383364 - RNA, 24 nt, Human
caccguguuagccaggauggucuc

SEQ ID NO: 383365 - RNA, 24 nt, Human
cacugcaaccuuugcaucccuggg

SEQ ID NO: 383366 - RNA, 21 nt, Human
cagcaaggauaaaacgaucuu

SEQ ID NO: 383367 - RNA, 22 nt, Human
caggauaaaauaauaagucuua

SEQ ID NO: 383368 - RNA, 19 nt, Human
caguggcgcgaucuuggcu

SEQ ID NO: 383369 - RNA, 24 nt, Human
cauagugcugggauuacaggcaug

SEQ ID NO: 383370 - RNA, 22 nt, Human
caucauguuggccaggaugguc

SEQ ID NO: 383371 - RNA, 24 nt, Human
caucauguuggccaggauggucuc

SEQ ID NO: 383372 - RNA, 21 nt, Human
cauguuggccaggauggucuc

SEQ ID NO: 383373 - RNA, 18 nt, Human
cauugcaaacauuuaaaa

SEQ ID NO: 383374 - RNA, 21 nt, Human
cauugcaaccucugccuccug

SEQ ID NO: 383375 - RNA, 19 nt, Human
ccaaagugcugggauuaca

SEQ ID NO: 383376 - RNA, 24 nt, Human
ccaaagugcugggauuacagacau

SEQ ID NO: 383377 - RNA, 21 nt, Human
ccacccccccgaccucccaaa

SEQ ID NO: 383378 - RNA, 23 nt, Human
ccauagugcugggauuacaggca

SEQ ID NO: 383379 - RNA, 24 nt, Human
ccauagugcugggauuacaggcau

SEQ ID NO: 383380 - RNA, 19 nt, Human
cccccacccccccgaccuc

SEQ ID NO: 383381 - RNA, 21 nt, Human
cccccacccccccgaccuccc

SEQ ID NO: 383382 - RNA, 19 nt, Human
cccgaguagcugggacuau

SEQ ID NO: 383383 - RNA, 24 nt, Human
cccgaguagcugggacuauaggcg

SEQ ID NO: 383384 - RNA, 23 nt, Human
cccgugauccucccccacccccc

SEQ ID NO: 383385 - RNA, 23 nt, Human
ccuaccucagccucccgaguagc

SEQ ID NO: 383386 - RNA, 24 nt, Human
ccuaccucagccucccgaguagcu

SEQ ID NO: 383387 - RNA, 24 nt, Human
ccuccugaguucaaacgauucucc

SEQ ID NO: 383388 - RNA, 18 nt, Human
ccuggccaaccgugguaa

SEQ ID NO: 383389 - RNA, 24 nt, Human
ccuggccaaccgugguaacuuuua

SEQ ID NO: 383390 - RNA, 26 nt, Human
ccuggcuaauuuuuuuuguuuuuugu

SEQ ID NO: 383391 - RNA, 24 nt, Human
cgcucugucacccaggcuggagug

SEQ ID NO: 383392 - RNA, 21 nt, Human
cgugauccucccccacccccc

SEQ ID NO: 383393 - RNA, 22 nt, Human
cgugauccucccccaccccccc

SEQ ID NO: 383394 - RNA, 23 nt, Human
cgugcaccaccaugcccggcuaa

SEQ ID NO: 383395 - RNA, 25 nt, Human
cucacugcaaccuuugcaucccugg

SEQ ID NO: 383396 - RNA, 24 nt, Human
cucagccucccgaguagcugggac

SEQ ID NO: 383397 - RNA, 19 nt, Human
cucauugcaaccucugccu

SEQ ID NO: 383398 - RNA, 23 nt, Human
cucauugcaaccucugccuccug

SEQ ID NO: 383399 - RNA, 22 nt, Human
cucccccacccccccgaccucc

SEQ ID NO: 383400 - RNA, 18 nt, Human
cuccugaccccgugaucc

SEQ ID NO: 383401 - RNA, 24 nt, Human
cuccugaccucgugauccgcccgu

SEQ ID NO: 383402 - RNA, 24 nt, Human
cucgcucugucacccaggcuggag

SEQ ID NO: 383403 - RNA, 19 nt, Human
cugucacccaggcuggagu

SEQ ID NO: 383404 - RNA, 24 nt, Human
gaccccgugauccucccccacccc

SEQ ID NO: 383405 - RNA, 22 nt, Human
gaccucgugauccgcccgucuc

SEQ ID NO: 383406 - RNA, 22 nt, Human
gaccucgugauccgcccgucuc

SEQ ID NO: 383407 - RNA, 24 nt, Human
gaccucgugauccgcccgucucgg

SEQ ID NO: 383408 - RNA, 22 nt, Human
gacuauaggcgugcaccaccau

SEQ ID NO: 383409 - RNA, 23 nt, Human
gagauaggguuucaucauguugg

SEQ ID NO: 383410 - RNA, 18 nt, Human
gagaugggguuucaccgu

SEQ ID NO: 383411 - RNA, 24 nt, Human
gagaugggguuucaccguguuagc

SEQ ID NO: 383412 - RNA, 18 nt, Human
gauuacagacaugagcca

SEQ ID NO: 383413 - RNA, 22 nt, Human
gauuacagacaugagccaaugc

SEQ ID NO: 383414 - RNA, 22 nt, Human
gauuacagacaugagccaaugc

SEQ ID NO: 383415 - RNA, 22 nt, Human
gauuacaggcaugaaccaccgc

SEQ ID NO: 383416 - RNA, 20 nt, Human
gcagcuacaggcagaucagc

SEQ ID NO: 383417 - RNA, 22 nt, Human
gcccggcuaauuuuuguauuuu

SEQ ID NO: 383418 - RNA, 22 nt, Human
gccuccugaguucaaacgauuc

SEQ ID NO: 383419 - RNA, 21 nt, Human
gcucauugcaaccucugccuc

SEQ ID NO: 383420 - RNA, 25 nt, Human
gcucugucacccaggcuggagugca

SEQ ID NO: 383421 - RNA, 19 nt, Human
gcuggagugcaguggcgcg

SEQ ID NO: 383422 - RNA, 24 nt, Human
ggacuauaggcgugcaccaccaug

SEQ ID NO: 383423 - RNA, 24 nt, Human
ggauggucucagucuccugaccuc

SEQ ID NO: 383424 - RNA, 22 nt, Human
ggauuacagacaugagccaaug

SEQ ID NO: 383425 - RNA, 22 nt, Human
ggauuacaggcaugaaccaccg

SEQ ID NO: 383426 - RNA, 22 nt, Human
gggguuucaccguguuagccag

SEQ ID NO: 383427 - RNA, 21 nt, Human
ggguuucaucauguuggccag

SEQ ID NO: 383428 - RNA, 22 nt, Human
ggguuucaucauguuggccagg

SEQ ID NO: 383429 - RNA, 24 nt, Human
gucucgcucugucacccaggcugg

SEQ ID NO: 383430 - RNA, 22 nt, Human
gucugggaucccaugacucaac

SEQ ID NO: 383431 - RNA, 23 nt, Human
gugauccucccccacccccccga

SEQ ID NO: 383432 - RNA, 21 nt, Human
uaaaaaagucugggaucccau

SEQ ID NO: 383433 - RNA, 24 nt, Human
uaauuuuuguauuuuuaguagaga

SEQ ID NO: 383434 - RNA, 20 nt, Human
uacacaaugaccccagucag

SEQ ID NO: 383435 - RNA, 22 nt, Human
uacaggcaugaaccaccgcgcc

SEQ ID NO: 383436 - RNA, 24 nt, Human
uaccucagccucccgaguagcugg

SEQ ID NO: 383437 - RNA, 24 nt, Human
uaguagagauaggguuucaucaug

SEQ ID NO: 383438 - RNA, 21 nt, Human
uaguagagaugggguuucacc

SEQ ID NO: 383439 - RNA, 24 nt, Human
uaguagagaugggguuucaccgug

SEQ ID NO: 383440 - RNA, 26 nt, Human
uaguagagaugggguuucaccguguu

SEQ ID NO: 383441 - RNA, 25 nt, Human
uagugcugggauuacaggcaugaac

SEQ ID NO: 383442 - RNA, 18 nt, Human
ucaaugucauucuccaua

SEQ ID NO: 383443 - RNA, 24 nt, Human
ucacccaggcuggagugcaguggc

SEQ ID NO: 383444 - RNA, 24 nt, Human
ucaccguguuagccaggauggucu

SEQ ID NO: 383445 - RNA, 21 nt, Human
ucacugcaaccuuugcauccc

SEQ ID NO: 383446 - RNA, 25 nt, Human
ucacugcaaccuuugcaucccuggg

SEQ ID NO: 383447 - RNA, 24 nt, Human
ucacuguagcuauuucuuauuuuu

SEQ ID NO: 383448 - RNA, 23 nt, Human
ucagccucccgaguagcugggac

SEQ ID NO: 383449 - RNA, 19 nt, Human
ucauugcaaccucugccuc

SEQ ID NO: 383450 - RNA, 22 nt, Human
ucauugcaaccucugccuccug

SEQ ID NO: 383451 - RNA, 25 nt, Human
ucauugcaaccucugccuccugagu

SEQ ID NO: 383452 - RNA, 18 nt, Human
ucccaaagugcugggauu

SEQ ID NO: 383453 - RNA, 24 nt, Human
ucccaaagugcugggauuacagac

SEQ ID NO: 383454 - RNA, 24 nt, Human
ucccauagugcugggauuacaggc

SEQ ID NO: 383455 - RNA, 25 nt, Human
ucccccacccccccgaccucccaaa

SEQ ID NO: 383456 - RNA, 24 nt, Human
ucccgaguagcugggacuauaggc

SEQ ID NO: 383457 - RNA, 21 nt, Human
ucccugggcuuugaacccugg

SEQ ID NO: 383458 - RNA, 23 nt, Human
ucccugggcuuugaacccugguu

SEQ ID NO: 383459 - RNA, 21 nt, Human
uccugaguucaaacgauucuc

SEQ ID NO: 383460 - RNA, 27 nt, Human
ucuaaaaucugucacuguagcuauuuc

SEQ ID NO: 383461 - RNA, 22 nt, Human
ucuccauauaagauccagagug

SEQ ID NO: 383462 - RNA, 24 nt, Human
ucuccuaccucagccucccgagua

SEQ ID NO: 383463 - RNA, 19 nt, Human
ucucgcucugucacccagg

SEQ ID NO: 383464 - RNA, 23 nt, Human
ucucgcucugucacccaggcugg

SEQ ID NO: 383465 - RNA, 24 nt, Human
ucucgcucugucacccaggcugga

SEQ ID NO: 383466 - RNA, 26 nt, Human
ucucgcucugucacccaggcuggagu

SEQ ID NO: 383467 - RNA, 27 nt, Human
ucucgcucugucacccaggcuggagug

SEQ ID NO: 383468 - RNA, 24 nt, Human
ucugucacccaggcuggagugcag

SEQ ID NO: 383469 - RNA, 19 nt, Human
ugaccccgugauccucccc

SEQ ID NO: 383470 - RNA, 21 nt, Human
ugaccccgugauccuccccca

SEQ ID NO: 383471 - RNA, 22 nt, Human
ugacucaacucacugcaaccuu

SEQ ID NO: 383472 - RNA, 22 nt, Human
ugcaguggcgcgaucuuggcuc

SEQ ID NO: 383473 - RNA, 24 nt, Human
ugcccggcuaauuuuuguauuuuu

SEQ ID NO: 383474 - RNA, 24 nt, Human
ugcugggauuacagacaugagcca

SEQ ID NO: 383475 - RNA, 23 nt, Human
ugcugggauuacaggcaugaacc

SEQ ID NO: 383476 - RNA, 23 nt, Human
uggagugcaguggcgcgaucuug

SEQ ID NO: 383477 - RNA, 24 nt, Human
uggagugcaguggcgcgaucuugg

SEQ ID NO: 383478 - RNA, 24 nt, Human
uggccaggauggucucgaucuccu

SEQ ID NO: 383479 - RNA, 21 nt, Human
ugggacuauaggcgugcacca

SEQ ID NO: 383480 - RNA, 24 nt, Human
ugggacuauaggcgugcaccacca

SEQ ID NO: 383481 - RNA, 25 nt, Human
ugggacuauaggcgugcaccaccau

SEQ ID NO: 383482 - RNA, 18 nt, Human
ugggauuacagacaugag

SEQ ID NO: 383483 - RNA, 21 nt, Human
ugggauuacagacaugagcca

SEQ ID NO: 383484 - RNA, 21 nt, Human
ugggauuacagacaugagcca

SEQ ID NO: 383485 - RNA, 24 nt, Human
ugggauuacagacaugagccaaug

SEQ ID NO: 383486 - RNA, 27 nt, Human
ugggauuacagacaugagccaaugcgc

SEQ ID NO: 383487 - RNA, 21 nt, Human
ugggauuacaggcaugaacca

SEQ ID NO: 383488 - RNA, 23 nt, Human
ugggauuacaggcaugaaccacc

SEQ ID NO: 383489 - RNA, 24 nt, Human
ugggauuacaggcaugaaccaccg

SEQ ID NO: 383490 - RNA, 24 nt, Human
ugggauuacaggcaugaaccaccg

SEQ ID NO: 383491 - RNA, 24 nt, Human
ugggguuucaccguguuagccagg

SEQ ID NO: 383492 - RNA, 19 nt, Human
uguaaacgggaaacauugc

SEQ ID NO: 383493 - RNA, 18 nt, Human
uuaguagagauaggguuu

SEQ ID NO: 383494 - RNA, 20 nt, Human
uuaguagagauaggguuuca

SEQ ID NO: 383495 - RNA, 24 nt, Human
uuaguagagauaggguuucaucau

SEQ ID NO: 383496 - RNA, 18 nt, Human
uuaguagagaugggguuu

SEQ ID NO: 383497 - RNA, 22 nt, Human
uuaguagagaugggguuucacc

SEQ ID NO: 383498 - RNA, 24 nt, Human
uuaguagagaugggguuucaccgu

SEQ ID NO: 383499 - RNA, 24 nt, Human
uucaaacgauucuccuaccucagc

SEQ ID NO: 383500 - RNA, 23 nt, Human
uugagacggucucgcucugucac

SEQ ID NO: 383501 - RNA, 19 nt, Human
uugcaaccucugccuccug

SEQ ID NO: 383502 - RNA, 23 nt, Human
uugcaaccucugccuccugaguu

SEQ ID NO: 383503 - RNA, 24 nt, Human
uugcaaccucugccuccugaguuc

SEQ ID NO: 383504 - RNA, 18 nt, Human
uugcaucccugggcuuug

SEQ ID NO: 383505 - RNA, 23 nt, Human
uuguauuuuuaguagagaugggg

SEQ ID NO: 383506 - RNA, 21 nt, Human
uuuaacaaggaagggaucaga

SEQ ID NO: 383507 - RNA, 19 nt, Human
uuucaccguguuagccagg

SEQ ID NO: 383508 - RNA, 19 nt, Human
uuucaucauguuggccagg

SEQ ID NO: 383509 - RNA, 28 nt, Human
uuugcaucccugggcuuugaacccuggu

SEQ ID NO: 383510 - RNA, 20 nt, Human
uuuuguauuuuuaguagaga

SEQ ID NO: 383511 - RNA, 23 nt, Human
uuuuuaguagagauaggguuuca

SEQ ID NO: 383512 - RNA, 24 nt, Human
uuuuuaguagagaugggguuucac

SEQ ID NO: 383513 - RNA, 20 nt, Human
uuuuuguauuuuuaguagag

SEQ ID NO: 383514 - RNA, 22 nt, Human
uuuuuguauuuuuaguagagaa

SEQ ID NO: 383515 - RNA, 22 nt, Human
uuuuuuguauuuuuaguagagg

SEQ ID NO: 383516 - RNA, 22 nt, Human
aaaccccgccccuacuaaaaag

SEQ ID NO: 383517 - RNA, 18 nt, Human
aacauggugaaaccccgc

SEQ ID NO: 383518 - RNA, 20 nt, Human
aacauggugaaaccccgccc

SEQ ID NO: 383519 - RNA, 20 nt, Human
aagacaaaaaucagccaagc

SEQ ID NO: 383520 - RNA, 24 nt, Human
aaucgcuugaacccaggaggcgga

SEQ ID NO: 383521 - RNA, 24 nt, Human
accugaggucaggaguuugagacc

SEQ ID NO: 383522 - RNA, 22 nt, Human
agaaucgcuugaacccaggagg

SEQ ID NO: 383523 - RNA, 24 nt, Human
agcacuuugggagacagagguggg

SEQ ID NO: 383524 - RNA, 23 nt, Human
agccaagcgugguggcgcaugcc

SEQ ID NO: 383525 - RNA, 22 nt, Human
agccuggccaacauggugaaac

SEQ ID NO: 383526 - RNA, 24 nt, Human
agccuggccaacauggugaaaccc

SEQ ID NO: 383527 - RNA, 20 nt, Human
aggaguuugagaccagccug

SEQ ID NO: 383528 - RNA, 23 nt, Human
aggcaggagaaucgcuugaaccc

SEQ ID NO: 383529 - RNA, 24 nt, Human
aggcaggagaaucgcuugaaccca

SEQ ID NO: 383530 - RNA, 24 nt, Human
aggcggagguugcagugagccgag

SEQ ID NO: 383531 - RNA, 20 nt, Human
aggcugaggcaggagaaucg

SEQ ID NO: 383532 - RNA, 24 nt, Human
aggcugaggcaggagaaucgcuug

SEQ ID NO: 383533 - RNA, 22 nt, Human
agguggguggaucaccugaggu

SEQ ID NO: 383534 - RNA, 24 nt, Human
aguggcacacuccuguaaucccag

SEQ ID NO: 383535 - RNA, 24 nt, Human
caacauggugaaaccccgccccua

SEQ ID NO: 383536 - RNA, 24 nt, Human
caaggaacuuccuccucagagccu

SEQ ID NO: 383537 - RNA, 23 nt, Human
caccugaggucaggaguuugaga

SEQ ID NO: 383538 - RNA, 22 nt, Human
cacuccuguaaucccagcacuu

SEQ ID NO: 383539 - RNA, 24 nt, Human
cacuccuguaaucccagcacuuug

SEQ ID NO: 383540 - RNA, 25 nt, Human
cagagguggguggaucaccugaggu

SEQ ID NO: 383541 - RNA, 24 nt, Human
cagcacuuugggagacagaggugg

SEQ ID NO: 383542 - RNA, 19 nt, Human
caggcgcaguggcacacuc

SEQ ID NO: 383543 - RNA, 22 nt, Human
ccaggaggcggagguugcagug

SEQ ID NO: 383544 - RNA, 21 nt, Human
ccccuacuaaaaagacaaaaa

SEQ ID NO: 383545 - RNA, 22 nt, Human
cccuacuaaaaagacaaaaauc

SEQ ID NO: 383546 - RNA, 22 nt, Human
ccugaggucaggaguuugagac

SEQ ID NO: 383547 - RNA, 23 nt, Human
ccuggccaacauggugaaacccc

SEQ ID NO: 383548 - RNA, 24 nt, Human
ccuggccaacauggugaaaccccg

SEQ ID NO: 383549 - RNA, 22 nt, Human
ccuguaaucccagcacuuuggg

SEQ ID NO: 383550 - RNA, 25 nt, Human
cuaaaaagacaaaaaucagccaagc

SEQ ID NO: 383551 - RNA, 23 nt, Human
cuccuguaaucccagcacuuugg

SEQ ID NO: 383552 - RNA, 30 nt, Human
gagacagagguggguggaucaccugagguu

SEQ ID NO: 383553 - RNA, 25 nt, Human
gagguggguggaucaccugagguca

SEQ ID NO: 383554 - RNA, 22 nt, Human
gagguugcagugagccgagauc

SEQ ID NO: 383555 - RNA, 24 nt, Human
gaucaccugaggucaggaguuuga

SEQ ID NO: 383556 - RNA, 22 nt, Human
gcaggagaaucgcuugaaccca

SEQ ID NO: 383557 - RNA, 18 nt, Human
gccaacauggugaaaccc

SEQ ID NO: 383558 - RNA, 22 nt, Human
ggagaguagggaggugggugcu

SEQ ID NO: 383559 - RNA, 22 nt, Human
ggaggcggagguugcagugagc

SEQ ID NO: 383560 - RNA, 18 nt, Human
ggagguugcagugagccg

SEQ ID NO: 383561 - RNA, 20 nt, Human
ggagguugcagugagccgag

SEQ ID NO: 383562 - RNA, 22 nt, Human
ggagguugcagugagccgagau

SEQ ID NO: 383563 - RNA, 23 nt, Human
ggagguugcagugagccgagauc

SEQ ID NO: 383564 - RNA, 24 nt, Human
ggagguugcagugagccgagauca

SEQ ID NO: 383565 - RNA, 22 nt, Human
ggaucaccugaggucaggaguu

SEQ ID NO: 383566 - RNA, 21 nt, Human
gggaggugggugcuggaguuc

SEQ ID NO: 383567 - RNA, 19 nt, Human
ggucaggaguuugagacca

SEQ ID NO: 383568 - RNA, 24 nt, Human
ggucaggcgcaguggcacacuccu

SEQ ID NO: 383569 - RNA, 22 nt, Human
ggugaaaccccgccccuacuaa

SEQ ID NO: 383570 - RNA, 21 nt, Human
gguggaucaccugaggucagg

SEQ ID NO: 383571 - RNA, 19 nt, Human
guugcagugagccgagauc

SEQ ID NO: 383572 - RNA, 20 nt, Human
uaaaguggugacacuguccc

SEQ ID NO: 383573 - RNA, 19 nt, Human
uacuccggaggcugaggca

SEQ ID NO: 383574 - RNA, 19 nt, Human
ucaccugaggucaggaguu

SEQ ID NO: 383575 - RNA, 24 nt, Human
ucagagccucagucccucuucugu

SEQ ID NO: 383576 - RNA, 23 nt, Human
ucagccaagcgugguggcgcaug

SEQ ID NO: 383577 - RNA, 24 nt, Human
ucgcuugaacccaggaggcggagg

SEQ ID NO: 383578 - RNA, 19 nt, Human
ucucaggguggcgacacuc

SEQ ID NO: 383579 - RNA, 23 nt, Human
ugagaccagccuggccaacaugg

SEQ ID NO: 383580 - RNA, 24 nt, Human
ugagaccagccuggccaacauggu

SEQ ID NO: 383581 - RNA, 20 nt, Human
ugaggcaggagaaucgcuug

SEQ ID NO: 383582 - RNA, 24 nt, Human
ugaggcaggagaaucgcuugaacc

SEQ ID NO: 383583 - RNA, 25 nt, Human
ugaggcaggagaaucgcuugaaccc

SEQ ID NO: 383584 - RNA, 18 nt, Human
ugaggucaggaguuugag

SEQ ID NO: 383585 - RNA, 19 nt, Human
ugccuguacucccaguuac

SEQ ID NO: 383586 - RNA, 23 nt, Human
uggaucaccugaggucaggaguu

SEQ ID NO: 383587 - RNA, 24 nt, Human
uggaucaccugaggucaggaguuu

SEQ ID NO: 383588 - RNA, 27 nt, Human
uggaucaccugaggucaggaguuugag

SEQ ID NO: 383589 - RNA, 22 nt, Human
uggcacacuccuguaaucccag

SEQ ID NO: 383590 - RNA, 24 nt, Human
uggcacacuccuguaaucccagca

SEQ ID NO: 383591 - RNA, 18 nt, Human
uggccaacauggugaaac

SEQ ID NO: 383592 - RNA, 21 nt, Human
uggcgacacucggacccuggc

SEQ ID NO: 383593 - RNA, 19 nt, Human
ugggagacagaggugggug

SEQ ID NO: 383594 - RNA, 24 nt, Human
ugggagacagagguggguggauca

SEQ ID NO: 383595 - RNA, 24 nt, Human
uggguggaucaccugaggucagga

SEQ ID NO: 383596 - RNA, 20 nt, Human
uggugaaaccccgccccuaa

SEQ ID NO: 383597 - RNA, 24 nt, Human
ugguggcgcaugccuguacuccca

SEQ ID NO: 383598 - RNA, 18 nt, Human
uuccuccucagagccuca

SEQ ID NO: 383599 - RNA, 24 nt, Human
uugaacccaggaggcggagguugc

SEQ ID NO: 383600 - RNA, 18 nt, Human
uugcagugagccgagauc

SEQ ID NO: 383601 - RNA, 20 nt, Human
uugcagugagccgagaucac

SEQ ID NO: 383602 - RNA, 21 nt, Human
uugcagugagccgagaucacg

SEQ ID NO: 383603 - RNA, 19 nt, Human
uugggagacagaggugggu

SEQ ID NO: 383604 - RNA, 20 nt, Human
aaaugggcccuuagagaaaa

SEQ ID NO: 383605 - RNA, 21 nt, Human
aacaaguacaguaguaccccc

SEQ ID NO: 383606 - RNA, 24 nt, Human
aacaaguacaguaguacccccuua

SEQ ID NO: 383607 - RNA, 20 nt, Human
aacccuauauuacccggaau

SEQ ID NO: 383608 - RNA, 20 nt, Human
aacuugcuuccucuucucug

SEQ ID NO: 383609 - RNA, 18 nt, Human
aagaagcccagauucugg

SEQ ID NO: 383610 - RNA, 23 nt, Human
aagaagcccagauucugggggca

SEQ ID NO: 383611 - RNA, 21 nt, Human
aauuccggaaagggguggagg

SEQ ID NO: 383612 - RNA, 19 nt, Human
accacagcucugugcagca

SEQ ID NO: 383613 - RNA, 22 nt, Human
acugugcugacaggauggcagg

SEQ ID NO: 383614 - RNA, 21 nt, Human
acuugagucugcaggccuguu

SEQ ID NO: 383615 - RNA, 33 nt, Human
agauguuugaaaccacagauugcaccaaaccuc

SEQ ID NO: 383616 - RNA, 25 nt, Human
aggaccgaaaccaaaugucuacugg

SEQ ID NO: 383617 - RNA, 21 nt, Human
agggaggccuaagggaauggg

SEQ ID NO: 383618 - RNA, 21 nt, Human
aucagaaucaccuuucuccca

SEQ ID NO: 383619 - RNA, 19 nt, Human
augcggguggggaaugggg

SEQ ID NO: 383620 - RNA, 22 nt, Human
caacaaguacaguaguaccccc

SEQ ID NO: 383621 - RNA, 22 nt, Human
caccaaacccuauauuacccgg

SEQ ID NO: 383622 - RNA, 23 nt, Human
cagcagcauuguagcagaccugu

SEQ ID NO: 383623 - RNA, 19 nt, Human
cagcucugugcagcagcag

SEQ ID NO: 383624 - RNA, 18 nt, Human
caucugccuagcagagcu

SEQ ID NO: 383625 - RNA, 21 nt, Human
cccugggaggggauauuaggg

SEQ ID NO: 383626 - RNA, 21 nt, Human
ccuugaggggauugacuugag

SEQ ID NO: 383627 - RNA, 22 nt, Human
cgaaaccaaaugucuacuggcc

SEQ ID NO: 383628 - RNA, 24 nt, Human
cggaaagggguggagguggcuccu

SEQ ID NO: 383629 - RNA, 21 nt, Human
cugacuuaaacagggauaaaa

SEQ ID NO: 383630 - RNA, 18 nt, Human
gagaaaacuuggagcacu

SEQ ID NO: 383631 - RNA, 20 nt, Human
gcccagauucugggggcaaa

SEQ ID NO: 383632 - RNA, 21 nt, Human
ggaaugggguaggagggaugg

SEQ ID NO: 383633 - RNA, 18 nt, Human
gggaaugggguaggaggg

SEQ ID NO: 383634 - RNA, 19 nt, Human
ggguggggaaugggguagg

SEQ ID NO: 383635 - RNA, 19 nt, Human
gguaggagggaugggugcu

SEQ ID NO: 383636 - RNA, 20 nt, Human
uagcagagcuaacaugaaga

SEQ ID NO: 383637 - RNA, 23 nt, Human
ucagaaucaccuuucucccaucu

SEQ ID NO: 383638 - RNA, 19 nt, Human
ucagcagaggacaacugug

SEQ ID NO: 383639 - RNA, 23 nt, Human
ucauuuguggagcaggccugaau

SEQ ID NO: 383640 - RNA, 22 nt, Human
ucugggaucaagauagggagac

SEQ ID NO: 383641 - RNA, 24 nt, Human
ucuugagagugggaguccaaaugg

SEQ ID NO: 383642 - RNA, 21 nt, Human
ugaaaaaaaguagugacagcc

SEQ ID NO: 383643 - RNA, 20 nt, Human
ugaaaccacagauugcacca

SEQ ID NO: 383644 - RNA, 22 nt, Human
ugagaggaagacacagagaagg

SEQ ID NO: 383645 - RNA, 24 nt, Human
ugcugacaggauggcagguaaugc

SEQ ID NO: 383646 - RNA, 18 nt, Human
uggcagguaaugcgggug

SEQ ID NO: 383647 - RNA, 18 nt, Human
uggggaaugggguaggag

SEQ ID NO: 383648 - RNA, 20 nt, Human
uggggauauguucuacgacc

SEQ ID NO: 383649 - RNA, 21 nt, Human
uggggcgcuggggcugaaaug

SEQ ID NO: 383650 - RNA, 24 nt, Human
uggggcugaaaugaaucauuugug

SEQ ID NO: 383651 - RNA, 20 nt, Human
ugggguaggagggaugggug

SEQ ID NO: 383652 - RNA, 24 nt, Human
ugggucagacugacuuaaacaggg

SEQ ID NO: 383653 - RNA, 18 nt, Human
uguagaaggaagauucug

SEQ ID NO: 383654 - RNA, 22 nt, Human
uuccaagccguucugaacuugc

SEQ ID NO: 383655 - RNA, 22 nt, Human
uucucugaaaugacaucugccu

SEQ ID NO: 383656 - RNA, 22 nt, Human
aaaaggaaaaacaaaaggaaau

SEQ ID NO: 383657 - RNA, 20 nt, Human
aaaaggaaauccagaacaau

SEQ ID NO: 383658 - RNA, 19 nt, Human
aaacaaaaggaaauccaga

SEQ ID NO: 383659 - RNA, 22 nt, Human
aaagauggaaaacuaaaaggaa

SEQ ID NO: 383660 - RNA, 23 nt, Human
agacgguacaacaaaagcaagcu

SEQ ID NO: 383661 - RNA, 23 nt, Human
aggaaaaacaaaaggaaauccag

SEQ ID NO: 383662 - RNA, 18 nt, Human
caaaaggaaauccagaac

SEQ ID NO: 383663 - RNA, 26 nt, Human
caaaaggaaauccagaacaauccgcc

SEQ ID NO: 383664 - RNA, 18 nt, Human
caggaagguggggacccu

SEQ ID NO: 383665 - RNA, 18 nt, Human
ccaaugagcaccagggag

SEQ ID NO: 383666 - RNA, 23 nt, Human
cccacaauccugcgcuccacccc

SEQ ID NO: 383667 - RNA, 29 nt, Human
cccccagacucuacucagauuccaaugag

SEQ ID NO: 383668 - RNA, 25 nt, Human
cccuccuacgccacaugcuagaccu

SEQ ID NO: 383669 - RNA, 19 nt, Human
cccugggagaagaaaaccc

SEQ ID NO: 383670 - RNA, 25 nt, Human
ccuagcccugcaggaggaucuugug

SEQ ID NO: 383671 - RNA, 18 nt, Human
ccuccuacgccacaugcu

SEQ ID NO: 383672 - RNA, 22 nt, Human
ccuccuacgccacaugcuagac

SEQ ID NO: 383673 - RNA, 23 nt, Human
cuaaaaggaaaaacaaaaggaaa

SEQ ID NO: 383674 - RNA, 23 nt, Human
cuuccgcugcugcugggaaagac

SEQ ID NO: 383675 - RNA, 21 nt, Human
gaagguggggacccuccccca

SEQ ID NO: 383676 - RNA, 19 nt, Human
gaaguccaccggcccugcc

SEQ ID NO: 383677 - RNA, 20 nt, Human
gagccucaguuuccccgcug

SEQ ID NO: 383678 - RNA, 23 nt, Human
ggacccucccccagacucuacuc

SEQ ID NO: 383679 - RNA, 21 nt, Human
gggagaagaaaaccccuuagg

SEQ ID NO: 383680 - RNA, 22 nt, Human
uacaacaaaagcaagcuguggg

SEQ ID NO: 383681 - RNA, 19 nt, Human
uccccaguuuccgaaucug

SEQ ID NO: 383682 - RNA, 23 nt, Human
ucccccagacucuacucagauuc

SEQ ID NO: 383683 - RNA, 21 nt, Human
ucccugggagaagaaaacccc

SEQ ID NO: 383684 - RNA, 23 nt, Human
uccuacgccacaugcuagaccuc

SEQ ID NO: 383685 - RNA, 20 nt, Human
uccugcgcuccaccccgagc

SEQ ID NO: 383686 - RNA, 19 nt, Human
uggaaaacuaaaaggaaaa

SEQ ID NO: 383687 - RNA, 22 nt, Human
ugggaaagacagcagucuuggc

SEQ ID NO: 383688 - RNA, 25 nt, Human
ugggagaagaaaaccccuuagggaa

SEQ ID NO: 383689 - RNA, 20 nt, Human
uggggaggagguacaggaag

SEQ ID NO: 383690 - RNA, 26 nt, Human
uggggaggagguacaggaaggugggg

SEQ ID NO: 383691 - RNA, 21 nt, Human
ugucacagccaagggccaggg

SEQ ID NO: 383692 - RNA, 21 nt, Human
aagcgguggcagcagcagggg

SEQ ID NO: 383693 - RNA, 24 nt, Human
acucauucucaccuuccucuuccu

SEQ ID NO: 383694 - RNA, 21 nt, Human
acuuuauggacauaaaaggag

SEQ ID NO: 383695 - RNA, 21 nt, Human
agccaggccuuucccagccuc

SEQ ID NO: 383696 - RNA, 22 nt, Human
aggaagcgguggcagcagcagg

SEQ ID NO: 383697 - RNA, 23 nt, Human
aggcaggaagcgguggcagcagc

SEQ ID NO: 383698 - RNA, 20 nt, Human
aggcggucaucaaaagaggu

SEQ ID NO: 383699 - RNA, 18 nt, Human
agggagggaggcaguggg

SEQ ID NO: 383700 - RNA, 21 nt, Human
aggggcugggcagugcuuccc

SEQ ID NO: 383701 - RNA, 24 nt, Human
agguggucggugagggucuggagc

SEQ ID NO: 383702 - RNA, 19 nt, Human
auacuuucccuccucuccc

SEQ ID NO: 383703 - RNA, 18 nt, Human
caaguucacaaggccauc

SEQ ID NO: 383704 - RNA, 24 nt, Human
caccaaagagaacgucucacuuca

SEQ ID NO: 383705 - RNA, 23 nt, Human
caccuuccucuuccuccucccug

SEQ ID NO: 383706 - RNA, 25 nt, Human
caccuuccucuuccuccucccugcc

SEQ ID NO: 383707 - RNA, 18 nt, Human
caggcaggggcugggcag

SEQ ID NO: 383708 - RNA, 19 nt, Human
caggggcugggcagugcuu

SEQ ID NO: 383709 - RNA, 20 nt, Human
cagugggcagccaggccuuu

SEQ ID NO: 383710 - RNA, 20 nt, Human
cauccggguugaccaccaaa

SEQ ID NO: 383711 - RNA, 21 nt, Human
ccaaacugaauaaauagcauc

SEQ ID NO: 383712 - RNA, 23 nt, Human
ccacccggcuguuggcaucaggg

SEQ ID NO: 383713 - RNA, 20 nt, Human
cccugccacacuccccuccc

SEQ ID NO: 383714 - RNA, 21 nt, Human
cccugccacacuccccuccca

SEQ ID NO: 383715 - RNA, 24 nt, Human
ccuccucucccuccugccccaaac

SEQ ID NO: 383716 - RNA, 18 nt, Human
ccuuccucuuccuccucc

SEQ ID NO: 383717 - RNA, 21 nt, Human
cggguugaccaccaaagagaa

SEQ ID NO: 383718 - RNA, 19 nt, Human
cuccccacgagagcuaggg

SEQ ID NO: 383719 - RNA, 20 nt, Human
cuccucucccuccugcccca

SEQ ID NO: 383720 - RNA, 18 nt, Human
cuccugccccaaacugaa

SEQ ID NO: 383721 - RNA, 18 nt, Human
cuuggacagccacccggc

SEQ ID NO: 383722 - RNA, 23 nt, Human
cuuuugacuuugacacccaaauu

SEQ ID NO: 383723 - RNA, 21 nt, Human
gcagugcuucccugugucccc

SEQ ID NO: 383724 - RNA, 19 nt, Human
gcaucagggucagaaauac

SEQ ID NO: 383725 - RNA, 19 nt, Human
gcuuggacagccacccggc

SEQ ID NO: 383726 - RNA, 20 nt, Human
ggcagggagggaggcagugg

SEQ ID NO: 383727 - RNA, 22 nt, Human
ggcagggagggaggcagugggc

SEQ ID NO: 383728 - RNA, 25 nt, Human
gggggaaagggcagccaggcagggg

SEQ ID NO: 383729 - RNA, 23 nt, Human
uaaaaggaggggcagggagggag

SEQ ID NO: 383730 - RNA, 21 nt, Human
uaaauagcaucccucucccca

SEQ ID NO: 383731 - RNA, 24 nt, Human
uaaauagcaucccucuccccacga

SEQ ID NO: 383732 - RNA, 26 nt, Human
uaaauagcaucccucuccccacgaga

SEQ ID NO: 383733 - RNA, 19 nt, Human
uacuuucccuccucucccu

SEQ ID NO: 383734 - RNA, 20 nt, Human
uagaauacaaaacuguucua

SEQ ID NO: 383735 - RNA, 26 nt, Human
ucacaaggccauccagccugucaccc

SEQ ID NO: 383736 - RNA, 19 nt, Human
ucaccuuccucuuccuccu

SEQ ID NO: 383737 - RNA, 22 nt, Human
ucaccuuccucuuccuccuccc

SEQ ID NO: 383738 - RNA, 21 nt, Human
ucagaaauacuuucccuccuc

SEQ ID NO: 383739 - RNA, 25 nt, Human
ucagaaauacuuucccuccucuccc

SEQ ID NO: 383740 - RNA, 21 nt, Human
ucagggucagaaauacuuucc

SEQ ID NO: 383741 - RNA, 21 nt, Human
ucccuguguccccugcaaucc

SEQ ID NO: 383742 - RNA, 21 nt, Human
ucccuguguccccugcaaucc

SEQ ID NO: 383743 - RNA, 21 nt, Human
uccucuuccuccucccugcca

SEQ ID NO: 383744 - RNA, 23 nt, Human
uccugccccaaacugaauaaaua

SEQ ID NO: 383745 - RNA, 23 nt, Human
ucucccuccugccccaaacugaa

SEQ ID NO: 383746 - RNA, 19 nt, Human
ucuucugaaucaccagagu

SEQ ID NO: 383747 - RNA, 18 nt, Human
ugaaucaccagagucacu

SEQ ID NO: 383748 - RNA, 23 nt, Human
ugaaucaccagagucacugcccu

SEQ ID NO: 383749 - RNA, 18 nt, Human
ugacacccaaauucuccu

SEQ ID NO: 383750 - RNA, 20 nt, Human
ugacaggcaggaagcggugg

SEQ ID NO: 383751 - RNA, 18 nt, Human
uggacagccacccggcug

SEQ ID NO: 383752 - RNA, 21 nt, Human
uggcaucagggucagaaauac

SEQ ID NO: 383753 - RNA, 18 nt, Human
uugaccaccaaagagaac

SEQ ID NO: 383754 - RNA, 22 nt, Human
uugaccaccaaagagaacgucu

SEQ ID NO: 383755 - RNA, 20 nt, Human
uuugacuuugacacccaaau

SEQ ID NO: 383756 - RNA, 21 nt, Human
ccggccccgcgggcgcuuccg

SEQ ID NO: 383757 - RNA, 21 nt, Human
cgcacccggccccgcgggcgc

SEQ ID NO: 383758 - RNA, 23 nt, Human
uuuuuuuuuuuuuuuuuucacgg

SEQ ID NO: 383759 - RNA, 23 nt, Human
aaaaaaacucaaaaauaggacug

SEQ ID NO: 383760 - RNA, 23 nt, Human
aaaaaacucaaaaauaggacuga

SEQ ID NO: 383761 - RNA, 18 nt, Human
aaaaagagaaacacagua

SEQ ID NO: 383762 - RNA, 21 nt, Human
aaaaagagaaacacaguauaa

SEQ ID NO: 383763 - RNA, 18 nt, Human
aaaauacagcauaaaaug

SEQ ID NO: 383764 - RNA, 22 nt, Human
aaaauacagcauaaaaugagau

SEQ ID NO: 383765 - RNA, 22 nt, Human
aaacguuuucaaacacaacuaa

SEQ ID NO: 383766 - RNA, 21 nt, Human
aaagcaaaaaaaucuuagaaa

SEQ ID NO: 383767 - RNA, 18 nt, Human
aaccgugacuuggccaag

SEQ ID NO: 383768 - RNA, 22 nt, Human
aaccugccucaccccugcccug

SEQ ID NO: 383769 - RNA, 26 nt, Human
aagagggaggcaggcucggggcuggg

SEQ ID NO: 383770 - RNA, 27 nt, Human
aagcacuuaugagcagaaaccugccuc

SEQ ID NO: 383771 - RNA, 24 nt, Human
aagcaguuaagcucccccaaaaag

SEQ ID NO: 383772 - RNA, 19 nt, Human
aagcgggcuguucacucca

SEQ ID NO: 383773 - RNA, 24 nt, Human
aaggacuucuugccccuccaccuu

SEQ ID NO: 383774 - RNA, 25 nt, Human
aaggcccccuccuguacccccacaa

SEQ ID NO: 383775 - RNA, 28 nt, Human
aaggcccccuccuguacccccacaaaaa

SEQ ID NO: 383776 - RNA, 22 nt, Human
aagggaggggaagggaagagga

SEQ ID NO: 383777 - RNA, 23 nt, Human
aagggaggggaagggaagaggau

SEQ ID NO: 383778 - RNA, 18 nt, Human
aaguggugugucggggcu

SEQ ID NO: 383779 - RNA, 20 nt, Human
aaugagauuuagaucuguuu

SEQ ID NO: 383780 - RNA, 22 nt, Human
acaguauaaggcaguguuagaa

SEQ ID NO: 383781 - RNA, 19 nt, Human
accacagagaaaccgugac

SEQ ID NO: 383782 - RNA, 19 nt, Human
acccgcugcggccuccaca

SEQ ID NO: 383783 - RNA, 22 nt, Human
acccuacuuuccaccaaucagc

SEQ ID NO: 383784 - RNA, 19 nt, Human
accugccucaccccugccc

SEQ ID NO: 383785 - RNA, 20 nt, Human
agaggauacauaaaagcugg

SEQ ID NO: 383786 - RNA, 19 nt, Human
agagggaggcaggcucggg

SEQ ID NO: 383787 - RNA, 22 nt, Human
agcagcccuggagacaggcuga

SEQ ID NO: 383788 - RNA, 22 nt, Human
agccaaccaaccuugaccacag

SEQ ID NO: 383789 - RNA, 18 nt, Human
agccagccuguccccaga

SEQ ID NO: 383790 - RNA, 19 nt, Human
agccaggcagguagggauc

SEQ ID NO: 383791 - RNA, 20 nt, Human
agcccuucccacugccagcu

SEQ ID NO: 383792 - RNA, 26 nt, Human
agcggcugcggcucugcaagcugguc

SEQ ID NO: 383793 - RNA, 24 nt, Human
aggcucggggcugggccgcagcag

SEQ ID NO: 383794 - RNA, 21 nt, Human
agggaggggaagggaagagga

SEQ ID NO: 383795 - RNA, 22 nt, Human
agggaggggaagggaagaggau

SEQ ID NO: 383796 - RNA, 19 nt, Human
agggccaggagaaacagga

SEQ ID NO: 383797 - RNA, 20 nt, Human
aggucuaggggccagagaga

SEQ ID NO: 383798 - RNA, 18 nt, Human
auaaacagcagcuucuac

SEQ ID NO: 383799 - RNA, 23 nt, Human
auaaagcaaaaaaaucuuagaaa

SEQ ID NO: 383800 - RNA, 24 nt, Human
aucccacuuauccuccccucccug

SEQ ID NO: 383801 - RNA, 27 nt, Human
aucccacuuauccuccccucccugcaa

SEQ ID NO: 383802 - RNA, 18 nt, Human
augauaauaccaaugcgu

SEQ ID NO: 383803 - RNA, 21 nt, Human
caaaacaucugugccuuuacc

SEQ ID NO: 383804 - RNA, 20 nt, Human
caaacggacaaucugaguga

SEQ ID NO: 383805 - RNA, 22 nt, Human
caacaagcaguuaagcuccccc

SEQ ID NO: 383806 - RNA, 23 nt, Human
caacaagcaguuaagcuccccca

SEQ ID NO: 383807 - RNA, 26 nt, Human
caacaagcaguuaagcucccccaaaa

SEQ ID NO: 383808 - RNA, 24 nt, Human
cacacccccugcccacagcggcug

SEQ ID NO: 383809 - RNA, 18 nt, Human
caccaaucagccaaccaa

SEQ ID NO: 383810 - RNA, 28 nt, Human
cacccagaccagcagcuuccccaaggac

SEQ ID NO: 383811 - RNA, 21 nt, Human
cagaaacaacaucaaagccac

SEQ ID NO: 383812 - RNA, 21 nt, Human
cagaacuggugcugacugcuc

SEQ ID NO: 383813 - RNA, 18 nt, Human
cagcagcacccagaccag

SEQ ID NO: 383814 - RNA, 23 nt, Human
cagcauaaaaugagauuuagauc

SEQ ID NO: 383815 - RNA, 19 nt, Human
cagcuuggaggccagcagc

SEQ ID NO: 383816 - RNA, 21 nt, Human
caggauuaagaucaaaucggu

SEQ ID NO: 383817 - RNA, 25 nt, Human
caggugucucugcaaauaaaguucu

SEQ ID NO: 383818 - RNA, 20 nt, Human
caguccuugacggccacggg

SEQ ID NO: 383819 - RNA, 20 nt, Human
cauacggcacuaacagggag

SEQ ID NO: 383820 - RNA, 23 nt, Human
ccaaggacuucuugccccuccac

SEQ ID NO: 383821 - RNA, 21 nt, Human
ccaauggaugagaggccaaga

SEQ ID NO: 383822 - RNA, 20 nt, Human
ccacauaaagcaaaaaaauc

SEQ ID NO: 383823 - RNA, 24 nt, Human
ccagcagcuuccccaaggacuucu

SEQ ID NO: 383824 - RNA, 19 nt, Human
ccagcugccaggcuggccu

SEQ ID NO: 383825 - RNA, 25 nt, Human
cccaugugagguaacuggguugagu

SEQ ID NO: 383826 - RNA, 18 nt, Human
ccccaaaaagagaaacac

SEQ ID NO: 383827 - RNA, 23 nt, Human
ccccaaggacuucuugccccucc

SEQ ID NO: 383828 - RNA, 18 nt, Human
cccgcacccgcugcggcc

SEQ ID NO: 383829 - RNA, 20 nt, Human
cccgcacccgcugcggccuc

SEQ ID NO: 383830 - RNA, 21 nt, Human
cccgcacccgcugcggccucc

SEQ ID NO: 383831 - RNA, 21 nt, Human
cccugcccacagcggcugcgg

SEQ ID NO: 383832 - RNA, 20 nt, Human
ccgcacccgcugcggccucc

SEQ ID NO: 383833 - RNA, 23 nt, Human
ccuagcccacccagggccaggag

SEQ ID NO: 383834 - RNA, 21 nt, Human
ccucaagcuacuaaaacuccc

SEQ ID NO: 383835 - RNA, 18 nt, Human
ccucaccccugcccugca

SEQ ID NO: 383836 - RNA, 26 nt, Human
ccucaggaaaguggugugucggggcu

SEQ ID NO: 383837 - RNA, 24 nt, Human
ccucccugcaaaggcaucuucccg

SEQ ID NO: 383838 - RNA, 19 nt, Human
ccuccuguacccccacaaa

SEQ ID NO: 383839 - RNA, 21 nt, Human
ccuccuguacccccacaaaaa

SEQ ID NO: 383840 - RNA, 21 nt, Human
ccugaagccauugcucgaucu

SEQ ID NO: 383841 - RNA, 20 nt, Human
ccuguacccccacaaaaaaa

SEQ ID NO: 383842 - RNA, 27 nt, Human
cgcuaaaaauguaaacuuacaaauaag

SEQ ID NO: 383843 - RNA, 21 nt, Human
cggcgugggggaggcuuccag

SEQ ID NO: 383844 - RNA, 20 nt, Human
cugcgcuuucgagaccuugc

SEQ ID NO: 383845 - RNA, 22 nt, Human
cugcugcuggggcuaccccugu

SEQ ID NO: 383846 - RNA, 21 nt, Human
cuugcagggugcugcugcugg

SEQ ID NO: 383847 - RNA, 23 nt, Human
gagaggccaagagggaggcaggc

SEQ ID NO: 383848 - RNA, 19 nt, Human
gagcuccugccacaccccc

SEQ ID NO: 383849 - RNA, 23 nt, Human
gcacugaagggucagacgccaga

SEQ ID NO: 383850 - RNA, 21 nt, Human
gcaucuucccgaaucaggccc

SEQ ID NO: 383851 - RNA, 18 nt, Human
gccacacccccugcccac

SEQ ID NO: 383852 - RNA, 19 nt, Human
gcgugggggaggcuuccag

SEQ ID NO: 383853 - RNA, 24 nt, Human
gcucccccaaaaagagaaacacag

SEQ ID NO: 383854 - RNA, 18 nt, Human
gcugcuggggcuaccccu

SEQ ID NO: 383855 - RNA, 21 nt, Human
ggacuucuugccccuccaccu

SEQ ID NO: 383856 - RNA, 26 nt, Human
ggagaagagaacccaugucccgucgg

SEQ ID NO: 383857 - RNA, 21 nt, Human
ggagcgagguguggaccaaga

SEQ ID NO: 383858 - RNA, 25 nt, Human
ggagcuccugccacacccccugccc

SEQ ID NO: 383859 - RNA, 22 nt, Human
ggggguaaggaaguaggcuacc

SEQ ID NO: 383860 - RNA, 21 nt, Human
gggguaaggaaguaggcuacc

SEQ ID NO: 383861 - RNA, 23 nt, Human
gugcugcucagccagggcggccu

SEQ ID NO: 383862 - RNA, 21 nt, Human
uaaaacacuuggcaccaaucc

SEQ ID NO: 383863 - RNA, 22 nt, Human
uaaaaugagauuuagaucuguu

SEQ ID NO: 383864 - RNA, 20 nt, Human
uaaaguucucaaaacaucug

SEQ ID NO: 383865 - RNA, 21 nt, Human
uaacuggguugaguccguggg

SEQ ID NO: 383866 - RNA, 22 nt, Human
uaacuggguugaguccguggga

SEQ ID NO: 383867 - RNA, 20 nt, Human
uaaggcaucacaaauuguaa

SEQ ID NO: 383868 - RNA, 19 nt, Human
uaccccuguguggucucac

SEQ ID NO: 383869 - RNA, 24 nt, Human
uauaaaauacagcauaaaaugaga

SEQ ID NO: 383870 - RNA, 18 nt, Human
uaugagcagaaaccugcc

SEQ ID NO: 383871 - RNA, 18 nt, Human
ucaaaacaucugugccuu

SEQ ID NO: 383872 - RNA, 20 nt, Human
ucaaaacaucugugccuuua

SEQ ID NO: 383873 - RNA, 25 nt, Human
ucaaaacguuuucaaacacaacuaa

SEQ ID NO: 383874 - RNA, 18 nt, Human
ucacaggagaagagaacc

SEQ ID NO: 383875 - RNA, 19 nt, Human
ucacaggagaagagaaccc

SEQ ID NO: 383876 - RNA, 21 nt, Human
ucagccagggcggccugcgcu

SEQ ID NO: 383877 - RNA, 23 nt, Human
ucgcuccgcgucggcugcggcuc

SEQ ID NO: 383878 - RNA, 22 nt, Human
ucuugccccuccaccuugccuc

SEQ ID NO: 383879 - RNA, 28 nt, Human
ugaaccacccaaaauaauuuaguaguuu

SEQ ID NO: 383880 - RNA, 18 nt, Human
ugacuuggccaaggucau

SEQ ID NO: 383881 - RNA, 18 nt, Human
ugacuuggccaaggucau

SEQ ID NO: 383882 - RNA, 21 nt, Human
ugagaugccacagccaagcgg

SEQ ID NO: 383883 - RNA, 19 nt, Human
ugagcagaaaccugccuca

SEQ ID NO: 383884 - RNA, 20 nt, Human
ugagcagcuggccaggcugg

SEQ ID NO: 383885 - RNA, 21 nt, Human
ugcugcuggggcuaccccugu

SEQ ID NO: 383886 - RNA, 22 nt, Human
uggccaaggucauuugaugggg

SEQ ID NO: 383887 - RNA, 23 nt, Human
uggccaaggucauuugauggggg

SEQ ID NO: 383888 - RNA, 21 nt, Human
uggccaggcuggcuugcaggg

SEQ ID NO: 383889 - RNA, 21 nt, Human
uggcugaaccacccaaaauaa

SEQ ID NO: 383890 - RNA, 18 nt, Human
ugggacuaguucggcugu

SEQ ID NO: 383891 - RNA, 21 nt, Human
ugggggaggcuuccagcugcc

SEQ ID NO: 383892 - RNA, 24 nt, Human
ugggucuccagugcugggagcucc

SEQ ID NO: 383893 - RNA, 19 nt, Human
ugggugucccuaaauguuu

SEQ ID NO: 383894 - RNA, 18 nt, Human
ugugccuuuaccaaggga

SEQ ID NO: 383895 - RNA, 23 nt, Human
uucaaacacaacuaagauauaaa

SEQ ID NO: 383896 - RNA, 21 nt, Human
uucccacauaaagcaaaaaaa

SEQ ID NO: 383897 - RNA, 19 nt, Human
uugaugggggcugucauac

SEQ ID NO: 383898 - RNA, 22 nt, Human
aaaaagcagaaggcagcccugc

SEQ ID NO: 383899 - RNA, 23 nt, Human
aaaaaggcuggcccagccuuggc

SEQ ID NO: 383900 - RNA, 23 nt, Human
aaacagagaugaugacucggaau

SEQ ID NO: 383901 - RNA, 23 nt, Human
aaacagagaugaugacucggaau

SEQ ID NO: 383902 - RNA, 22 nt, Human
aaccaguggauggggcucugca

SEQ ID NO: 383903 - RNA, 22 nt, Human
aaccaguggauggggcucugca

SEQ ID NO: 383904 - RNA, 19 nt, Human
aaccuagucagccgccgca

SEQ ID NO: 383905 - RNA, 21 nt, Human
aacuguuucccuacuguccug

SEQ ID NO: 383906 - RNA, 21 nt, Human
aacuguuucccuacuguccug

SEQ ID NO: 383907 - RNA, 22 nt, Human
aagaccagcaagaauuugaaaa

SEQ ID NO: 383908 - RNA, 24 nt, Human
aauuaggaaugagucccaccuagc

SEQ ID NO: 383909 - RNA, 20 nt, Human
acaggaggccugcgggaggg

SEQ ID NO: 383910 - RNA, 23 nt, Human
acccuaggaccccucucagccac

SEQ ID NO: 383911 - RNA, 24 nt, Human
acccuaggaccccucucagccacc

SEQ ID NO: 383912 - RNA, 23 nt, Human
accgacaaacugaacagcugugg

SEQ ID NO: 383913 - RNA, 24 nt, Human
acugcugagauccccaacgggcca

SEQ ID NO: 383914 - RNA, 24 nt, Human
acugcugagauccccaacgggcca

SEQ ID NO: 383915 - RNA, 19 nt, Human
acuuucuuccaccuggcug

SEQ ID NO: 383916 - RNA, 19 nt, Human
acuuucuuccaccuggcug

SEQ ID NO: 383917 - RNA, 22 nt, Human
agaaaggaguauuuuaaaucca

SEQ ID NO: 383918 - RNA, 21 nt, Human
agagccccucccaacucugac

SEQ ID NO: 383919 - RNA, 23 nt, Human
agaugcccagaagggucugaaac

SEQ ID NO: 383920 - RNA, 25 nt, Human
agcacagccccagaacgcacugccc

SEQ ID NO: 383921 - RNA, 23 nt, Human
agccgccgcagccucucggcccc

SEQ ID NO: 383922 - RNA, 22 nt, Human
aggcccacagcugcucugugca

SEQ ID NO: 383923 - RNA, 19 nt, Human
aggcgccucccuucuccag

SEQ ID NO: 383924 - RNA, 18 nt, Human
agggcaugggaagccugg

SEQ ID NO: 383925 - RNA, 23 nt, Human
aggggcugccaccuguagggggc

SEQ ID NO: 383926 - RNA, 20 nt, Human
agguucccucucucccugcc

SEQ ID NO: 383927 - RNA, 21 nt, Human
agguucccucucucccugccc

SEQ ID NO: 383928 - RNA, 23 nt, Human
auuaggaaugagucccaccuagc

SEQ ID NO: 383929 - RNA, 23 nt, Human
auuaggaaugagucccaccuagc

SEQ ID NO: 383930 - RNA, 22 nt, Human
caaacgcucuggccaggagcuc

SEQ ID NO: 383931 - RNA, 20 nt, Human
caccaggaaggaaagguuug

SEQ ID NO: 383932 - RNA, 21 nt, Human
cacccuaggaccccucucagc

SEQ ID NO: 383933 - RNA, 19 nt, Human
cacccuccugccccacugc

SEQ ID NO: 383934 - RNA, 23 nt, Human
cacccuccugccccacugcugag

SEQ ID NO: 383935 - RNA, 25 nt, Human
cacggccuggcccucccgccgcagu

SEQ ID NO: 383936 - RNA, 25 nt, Human
cagaaaggaguauuuuaaauccacc

SEQ ID NO: 383937 - RNA, 18 nt, Human
cagaaggcagcccugccu

SEQ ID NO: 383938 - RNA, 21 nt, Human
cagauguccuggguuugcgcc

SEQ ID NO: 383939 - RNA, 20 nt, Human
cagcaaacagagaugaugac

SEQ ID NO: 383940 - RNA, 20 nt, Human
cagcaaacagagaugaugac

SEQ ID NO: 383941 - RNA, 21 nt, Human
cagcacagccccagaacgcaa

SEQ ID NO: 383942 - RNA, 18 nt, Human
cagcaugggagugggcag

SEQ ID NO: 383943 - RNA, 19 nt, Human
cagccucucggccccgccu

SEQ ID NO: 383944 - RNA, 21 nt, Human
cagccucucggccccgccucg

SEQ ID NO: 383945 - RNA, 19 nt, Human
cagcggggagaccugggac

SEQ ID NO: 383946 - RNA, 29 nt, Human
caggacuccccgaaaucaggcacccuccc

SEQ ID NO: 383947 - RNA, 29 nt, Human
caggacuccccgaaaucaggcacccuccc

SEQ ID NO: 383948 - RNA, 20 nt, Human
cagggaaaccaagccccagg

SEQ ID NO: 383949 - RNA, 21 nt, Human
cagggcagggaaaccaagccc

SEQ ID NO: 383950 - RNA, 22 nt, Human
cagguucccucucucccugccc

SEQ ID NO: 383951 - RNA, 21 nt, Human
caucccccacauucccaugac

SEQ ID NO: 383952 - RNA, 19 nt, Human
cauggcacagacauaugug

SEQ ID NO: 383953 - RNA, 19 nt, Human
cauggcacagacauaugug

SEQ ID NO: 383954 - RNA, 25 nt, Human
ccaauggcuuucaaggccauucccu

SEQ ID NO: 383955 - RNA, 18 nt, Human
ccagcgcccgcacaccag

SEQ ID NO: 383956 - RNA, 18 nt, Human
cccaggucaugcuggcuu

SEQ ID NO: 383957 - RNA, 25 nt, Human
cccccacauucccaugacugucccu

SEQ ID NO: 383958 - RNA, 22 nt, Human
ccccgccgcgccgcgguccgaa

SEQ ID NO: 383959 - RNA, 19 nt, Human
cccgccgcgccgcgguccg

SEQ ID NO: 383960 - RNA, 23 nt, Human
cccgccgcgccgcgguccgaaaa

SEQ ID NO: 383961 - RNA, 26 nt, Human
cccggccugcccaacacugcucagag

SEQ ID NO: 383962 - RNA, 26 nt, Human
cccggccugcccaacacugcucagag

SEQ ID NO: 383963 - RNA, 18 nt, Human
cccucucucccugcccca

SEQ ID NO: 383964 - RNA, 24 nt, Human
ccgccgcagccucucggccccgcc

SEQ ID NO: 383965 - RNA, 25 nt, Human
ccgccgcagccucucggccccgccu

SEQ ID NO: 383966 - RNA, 18 nt, Human
ccgccgcagucucucuuc

SEQ ID NO: 383967 - RNA, 19 nt, Human
ccgcgucucucccacggcc

SEQ ID NO: 383968 - RNA, 22 nt, Human
ccuaaguuucccccuaaguaaa

SEQ ID NO: 383969 - RNA, 22 nt, Human
ccuaggcugagagaagcaaggc

SEQ ID NO: 383970 - RNA, 22 nt, Human
ccuaggcugagagaagcaaggc

SEQ ID NO: 383971 - RNA, 23 nt, Human
ccucgggaugggagacccggccu

SEQ ID NO: 383972 - RNA, 23 nt, Human
ccucgggaugggagacccggccu

SEQ ID NO: 383973 - RNA, 20 nt, Human
ccuggaaaacucuaggacug

SEQ ID NO: 383974 - RNA, 22 nt, Human
cgaaaucaggcacccuccugcc

SEQ ID NO: 383975 - RNA, 18 nt, Human
cgagccucaagcagcgca

SEQ ID NO: 383976 - RNA, 22 nt, Human
cgccccagcgcccgcacaccag

SEQ ID NO: 383977 - RNA, 19 nt, Human
cggaagagggccugcgggg

SEQ ID NO: 383978 - RNA, 24 nt, Human
cgguccgaaaaccuagucagccgc

SEQ ID NO: 383979 - RNA, 25 nt, Human
cgugggcagcagcugucacacgggc

SEQ ID NO: 383980 - RNA, 25 nt, Human
cgugggcagcagcugucacacgggc

SEQ ID NO: 383981 - RNA, 23 nt, Human
cuccacugcugagauccccaacu

SEQ ID NO: 383982 - RNA, 22 nt, Human
cucccaacucugacaacaggcu

SEQ ID NO: 383983 - RNA, 22 nt, Human
cucccaacucugacaacaggcu

SEQ ID NO: 383984 - RNA, 24 nt, Human
cucccaacucugacaacaggcucg

SEQ ID NO: 383985 - RNA, 24 nt, Human
cucccaacucugacaacaggcucg

SEQ ID NO: 383986 - RNA, 18 nt, Human
cucugugcaggggcccuc

SEQ ID NO: 383987 - RNA, 24 nt, Human
cugaaacacccuaggaccccucuc

SEQ ID NO: 383988 - RNA, 18 nt, Human
cugaaucuugauuuucua

SEQ ID NO: 383989 - RNA, 23 nt, Human
cugccuccacacugggguuuggu

SEQ ID NO: 383990 - RNA, 19 nt, Human
cugcugaguuaaugaguac

SEQ ID NO: 383991 - RNA, 21 nt, Human
cuggcuggccaggaaggcagc

SEQ ID NO: 383992 - RNA, 21 nt, Human
cuggcuggccaggaaggcagc

SEQ ID NO: 383993 - RNA, 21 nt, Human
cuuggaaacuuucuuccaccu

SEQ ID NO: 383994 - RNA, 24 nt, Human
cuuggaaacuuucuuccaccugga

SEQ ID NO: 383995 - RNA, 24 nt, Human
cuuggaaacuuucuuccaccugga

SEQ ID NO: 383996 - RNA, 20 nt, Human
gaaggcagcccugccugcug

SEQ ID NO: 383997 - RNA, 21 nt, Human
gacaacaggcucgggucagga

SEQ ID NO: 383998 - RNA, 18 nt, Human
gaccugggacccgcccca

SEQ ID NO: 383999 - RNA, 18 nt, Human
gagccucaagcagcgcag

SEQ ID NO: 384000 - RNA, 24 nt, Human
gcagaaggcagcccugccugcugg

SEQ ID NO: 384001 - RNA, 21 nt, Human
gcagcagcugucacacgggcc

SEQ ID NO: 384002 - RNA, 23 nt, Human
gcaggggcugccaccuguagggg

SEQ ID NO: 384003 - RNA, 19 nt, Human
gcccaaaaaaggcuggccc

SEQ ID NO: 384004 - RNA, 18 nt, Human
gccccggaggcucaggcg

SEQ ID NO: 384005 - RNA, 23 nt, Human
gcuguggaaggagaugcccagaa

SEQ ID NO: 384006 - RNA, 18 nt, Human
gcuucaucccccacauuc

SEQ ID NO: 384007 - RNA, 19 nt, Human
ggaaggcagcaaacagaga

SEQ ID NO: 384008 - RNA, 24 nt, Human
ggaaugagucccaccuagcuucca

SEQ ID NO: 384009 - RNA, 24 nt, Human
ggaaugagucccaccuagcuucca

SEQ ID NO: 384010 - RNA, 22 nt, Human
ggacauggacucugcaucugcu

SEQ ID NO: 384011 - RNA, 19 nt, Human
ggaccccucucagccaccc

SEQ ID NO: 384012 - RNA, 22 nt, Human
ggcagaauuaggaaugaguccc

SEQ ID NO: 384013 - RNA, 22 nt, Human
ggcagaauuaggaaugaguccc

SEQ ID NO: 384014 - RNA, 18 nt, Human
ggcaggggcugccaccug

SEQ ID NO: 384015 - RNA, 23 nt, Human
gggcagcagcugucacacgggcc

SEQ ID NO: 384016 - RNA, 24 nt, Human
gggcaggggcugccaccuguaggg

SEQ ID NO: 384017 - RNA, 21 nt, Human
gggcugccaccuguagggggc

SEQ ID NO: 384018 - RNA, 27 nt, Human
gguaacaggagcagcacagccccagaa

SEQ ID NO: 384019 - RNA, 23 nt, Human
gguggucaagugccucugcgacc

SEQ ID NO: 384020 - RNA, 22 nt, Human
guccgaaaaccuagucagccgc

SEQ ID NO: 384021 - RNA, 23 nt, Human
gugaagcugagggacuguugggg

SEQ ID NO: 384022 - RNA, 23 nt, Human
uaacgggcuucccaaggaagucc

SEQ ID NO: 384023 - RNA, 24 nt, Human
uacagccaggcgccucccuucucc

SEQ ID NO: 384024 - RNA, 20 nt, Human
uagcuuggaaacuuucuucc

SEQ ID NO: 384025 - RNA, 20 nt, Human
uagcuuggaaacuuucuucc

SEQ ID NO: 384026 - RNA, 25 nt, Human
uaggcugagagaagcaaggcuguga

SEQ ID NO: 384027 - RNA, 25 nt, Human
uaggcugagagaagcaaggcuguga

SEQ ID NO: 384028 - RNA, 22 nt, Human
ucaaagagaccgacaaacugaa

SEQ ID NO: 384029 - RNA, 19 nt, Human
ucagaagguaacaggagca

SEQ ID NO: 384030 - RNA, 23 nt, Human
ucagcuucuuacggagccccaca

SEQ ID NO: 384031 - RNA, 24 nt, Human
uccccaacgggccagaccuagcuu

SEQ ID NO: 384032 - RNA, 24 nt, Human
uccccaacgggccagaccuagcuu

SEQ ID NO: 384033 - RNA, 22 nt, Human
ucggaagagggccugcggggga

SEQ ID NO: 384034 - RNA, 19 nt, Human
ucggucaaacgcucuggcc

SEQ ID NO: 384035 - RNA, 22 nt, Human
ucuacauauggauucagaaggu

SEQ ID NO: 384036 - RNA, 19 nt, Human
ucugaaacccaggcauggc

SEQ ID NO: 384037 - RNA, 24 nt, Human
ucugacaacaggcucgggucagga

SEQ ID NO: 384038 - RNA, 19 nt, Human
ucugcugaguuaaugagua

SEQ ID NO: 384039 - RNA, 19 nt, Human
ucuuacggagccccacaag

SEQ ID NO: 384040 - RNA, 18 nt, Human
ugaaacacccuaggaccc

SEQ ID NO: 384041 - RNA, 20 nt, Human
ugaaacacccuaggaccccu

SEQ ID NO: 384042 - RNA, 21 nt, Human
ugaaacccaggcauggcucca

SEQ ID NO: 384043 - RNA, 24 nt, Human
ugaaacccaggcauggcuccacug

SEQ ID NO: 384044 - RNA, 19 nt, Human
ugcagggccgugagcaggu

SEQ ID NO: 384045 - RNA, 22 nt, Human
ugccccaaggcaaggcaggcag

SEQ ID NO: 384046 - RNA, 24 nt, Human
ugccccacugcugagauccccaac

SEQ ID NO: 384047 - RNA, 19 nt, Human
ugcccgaggaggaaggcuc

SEQ ID NO: 384048 - RNA, 22 nt, Human
ugccugggcuucaucccccaca

SEQ ID NO: 384049 - RNA, 20 nt, Human
ugcugcagcucagcagugcc

SEQ ID NO: 384050 - RNA, 19 nt, Human
uggaaacuuucuuccaccu

SEQ ID NO: 384051 - RNA, 19 nt, Human
uggaaacuuucuuccaccu

SEQ ID NO: 384052 - RNA, 21 nt, Human
uggaaacuuucuuccaccugg

SEQ ID NO: 384053 - RNA, 21 nt, Human
uggaaacuuucuuccaccugg

SEQ ID NO: 384054 - RNA, 19 nt, Human
uggaaggagaugcccagaa

SEQ ID NO: 384055 - RNA, 19 nt, Human
uggaaggccucccugucuc

SEQ ID NO: 384056 - RNA, 19 nt, Human
uggaggaaaugcugccuca

SEQ ID NO: 384057 - RNA, 19 nt, Human
uggauggggcucugcacag

SEQ ID NO: 384058 - RNA, 19 nt, Human
uggauggggcucugcacag

SEQ ID NO: 384059 - RNA, 18 nt, Human
uggcucagggcaagaacc

SEQ ID NO: 384060 - RNA, 18 nt, Human
uggcucagggcaagaacc

SEQ ID NO: 384061 - RNA, 18 nt, Human
uggcucagggcaagaacc

SEQ ID NO: 384062 - RNA, 19 nt, Human
uggcucagggcaagaacca

SEQ ID NO: 384063 - RNA, 19 nt, Human
ugggacccagcacggggcc

SEQ ID NO: 384064 - RNA, 18 nt, Human
ugggcagaaaggaguauu

SEQ ID NO: 384065 - RNA, 21 nt, Human
uggggcagaguggaaggccuc

SEQ ID NO: 384066 - RNA, 22 nt, Human
ugggggagggcaugggaagccu

SEQ ID NO: 384067 - RNA, 22 nt, Human
ugggugaagcugagggacuguu

SEQ ID NO: 384068 - RNA, 20 nt, Human
uguggaaggagaugcccaga

SEQ ID NO: 384069 - RNA, 21 nt, Human
uguggaggaaaugcugccuca

SEQ ID NO: 384070 - RNA, 21 nt, Human
uucccucagaacccccuggaa

SEQ ID NO: 384071 - RNA, 18 nt, Human
uucccugccugggcuuca

SEQ ID NO: 384072 - RNA, 19 nt, Human
uugcgcccugcucugcugc

SEQ ID NO: 384073 - RNA, 22 nt, Human
uuggaaacuuucuuccaccugg

SEQ ID NO: 384074 - RNA, 22 nt, Human
uuggaaacuuucuuccaccugg

SEQ ID NO: 384075 - RNA, 19 nt, Human
uuggcuccagcuccgugga

SEQ ID NO: 384076 - RNA, 24 nt, Human
acuguugugucugucucucagcuc

SEQ ID NO: 384077 - RNA, 19 nt, Human
agagcaccacugugucccc

SEQ ID NO: 384078 - RNA, 22 nt, Human
agguggucaguuuccauccaug

SEQ ID NO: 384079 - RNA, 22 nt, Human
auucacuucacucucucuccag

SEQ ID NO: 384080 - RNA, 21 nt, Human
caagcucaugcucaccucaca

SEQ ID NO: 384081 - RNA, 18 nt, Human
cacaccagcuccuguuca

SEQ ID NO: 384082 - RNA, 21 nt, Human
cacaccucaggguuguccucu

SEQ ID NO: 384083 - RNA, 18 nt, Human
cagaaaggaaugagaccc

SEQ ID NO: 384084 - RNA, 20 nt, Human
cagaagccaagagagcgggg

SEQ ID NO: 384085 - RNA, 19 nt, Human
cagaccaggccccagucuc

SEQ ID NO: 384086 - RNA, 26 nt, Human
cagcagagcaccacugugucccccuc

SEQ ID NO: 384087 - RNA, 26 nt, Human
caggaugcaccacgccuggacgugcu

SEQ ID NO: 384088 - RNA, 26 nt, Human
caggcaguggggaacaggcagugacc

SEQ ID NO: 384089 - RNA, 24 nt, Human
cagucuuugucucauaaccggaga

SEQ ID NO: 384090 - RNA, 20 nt, Human
caucccacuuuguaucuugc

SEQ ID NO: 384091 - RNA, 23 nt, Human
ccaccguuccuccucccugaccc

SEQ ID NO: 384092 - RNA, 18 nt, Human
cccaggaugcaccacgcc

SEQ ID NO: 384093 - RNA, 26 nt, Human
cccauaugccacaccucaggguuguc

SEQ ID NO: 384094 - RNA, 21 nt, Human
ccgggccguucacgacucaca

SEQ ID NO: 384095 - RNA, 23 nt, Human
ccuaggacggaagacggcggccc

SEQ ID NO: 384096 - RNA, 22 nt, Human
ccuccaaauucugagcaguaaa

SEQ ID NO: 384097 - RNA, 20 nt, Human
ccugcaaaccucggggaagc

SEQ ID NO: 384098 - RNA, 20 nt, Human
cgccccggggcacuggggaa

SEQ ID NO: 384099 - RNA, 23 nt, Human
cgccccggggcacuggggaacag

SEQ ID NO: 384100 - RNA, 24 nt, Human
cggcagcagaggccaccgucuucu

SEQ ID NO: 384101 - RNA, 22 nt, Human
cucucucuuucucacaugggau

SEQ ID NO: 384102 - RNA, 25 nt, Human
cugggucugaaggucccggauccug

SEQ ID NO: 384103 - RNA, 19 nt, Human
cuuuguaucuugcauucac

SEQ ID NO: 384104 - RNA, 19 nt, Human
gaacagaaaggaaugagac

SEQ ID NO: 384105 - RNA, 23 nt, Human
gaacagaaaggaaugagacccca

SEQ ID NO: 384106 - RNA, 22 nt, Human
gacggaagacggcggccccagg

SEQ ID NO: 384107 - RNA, 27 nt, Human
gagaccccaacaggcagaagccaagag

SEQ ID NO: 384108 - RNA, 19 nt, Human
gcagcagaggccaccgucu

SEQ ID NO: 384109 - RNA, 21 nt, Human
ggcacuggggaacagaaagga

SEQ ID NO: 384110 - RNA, 20 nt, Human
gggaacaggcagugacugcc

SEQ ID NO: 384111 - RNA, 22 nt, Human
gggacagagccagcgucaagga

SEQ ID NO: 384112 - RNA, 19 nt, Human
gggaucugugaucugggcc

SEQ ID NO: 384113 - RNA, 18 nt, Human
ggugagcugcggacuaac

SEQ ID NO: 384114 - RNA, 23 nt, Human
guccuggagucuccuaggacgga

SEQ ID NO: 384115 - RNA, 18 nt, Human
gucugguaacagucacac

SEQ ID NO: 384116 - RNA, 20 nt, Human
gucuucugucccguggcucc

SEQ ID NO: 384117 - RNA, 18 nt, Human
uacugcucccucccucca

SEQ ID NO: 384118 - RNA, 20 nt, Human
uagguggucaguuuccaucc

SEQ ID NO: 384119 - RNA, 23 nt, Human
uauaugcauggaaagaguaugua

SEQ ID NO: 384120 - RNA, 22 nt, Human
ucacaacucagcagagcaccac

SEQ ID NO: 384121 - RNA, 26 nt, Human
ucacuucacucucucuccagcuuuua

SEQ ID NO: 384122 - RNA, 18 nt, Human
ucagaggguguccuggag

SEQ ID NO: 384123 - RNA, 21 nt, Human
uccauaugccacuaaaauuca

SEQ ID NO: 384124 - RNA, 22 nt, Human
ucccccucacauggagaggccg

SEQ ID NO: 384125 - RNA, 25 nt, Human
ucccuagguccaaugcacuugaccc

SEQ ID NO: 384126 - RNA, 23 nt, Human
ucccugacccugcaaaccucggg

SEQ ID NO: 384127 - RNA, 27 nt, Human
ucuccagcuuuuauucuuugggccgcc

SEQ ID NO: 384128 - RNA, 18 nt, Human
ucuccuaggacggaagac

SEQ ID NO: 384129 - RNA, 18 nt, Human
ucucucagcucaagcuca

SEQ ID NO: 384130 - RNA, 19 nt, Human
ugccacuaaaauucaccug

SEQ ID NO: 384131 - RNA, 22 nt, Human
ugccaggugcccauaugccaca

SEQ ID NO: 384132 - RNA, 24 nt, Human
ugcgaacacaggcaguggggaaca

SEQ ID NO: 384133 - RNA, 24 nt, Human
ugcucccucccuccaaauucugag

SEQ ID NO: 384134 - RNA, 18 nt, Human
uggaaagaguauguauuc

SEQ ID NO: 384135 - RNA, 20 nt, Human
uggagaggccgaggucugug

SEQ ID NO: 384136 - RNA, 18 nt, Human
ugggacagagccagcguc

SEQ ID NO: 384137 - RNA, 21 nt, Human
uguccuggagucuccuaggac

SEQ ID NO: 384138 - RNA, 25 nt, Human
uguccuggagucuccuaggacggaa

SEQ ID NO: 384139 - RNA, 24 nt, Human
ugucucauaaccggagaguuucau

SEQ ID NO: 384140 - RNA, 22 nt, Human
uucacgacucacaccuuccccg

SEQ ID NO: 384141 - RNA, 22 nt, Human
aagaugcuuaguucaaaauauc

SEQ ID NO: 384142 - RNA, 24 nt, Human
aagguuacuuuuuuugaauugcuc

SEQ ID NO: 384143 - RNA, 24 nt, Human
acuuuaagcuguaauagagaaagg

SEQ ID NO: 384144 - RNA, 21 nt, Human
agucauuuaguuucugaaagu

SEQ ID NO: 384145 - RNA, 19 nt, Human
caucaaaauuuccaaauca

SEQ ID NO: 384146 - RNA, 20 nt, Human
cccacugaggaauuaaacaa

SEQ ID NO: 384147 - RNA, 23 nt, Human
guucaaaauaucuuagauuuaau

SEQ ID NO: 384148 - RNA, 21 nt, Human
guuuagaaguugcaauuuuag

SEQ ID NO: 384149 - RNA, 24 nt, Human
uaaaaaugcuuaucaauuaacuau

SEQ ID NO: 384150 - RNA, 20 nt, Human
uaauagagaaagguaacacg

SEQ ID NO: 384151 - RNA, 21 nt, Human
uagugagcacuucaguucuuu

SEQ ID NO: 384152 - RNA, 24 nt, Human
uauuuuagaacaaauauaaagggu

SEQ ID NO: 384153 - RNA, 19 nt, Human
ucauuaacauauuuacaga

SEQ ID NO: 384154 - RNA, 26 nt, Human
uccuccuauaaauauuuucuuuuuau

SEQ ID NO: 384155 - RNA, 28 nt, Human
ugaaaaaaauaauuauaaaugcuggaaa

SEQ ID NO: 384156 - RNA, 18 nt, Human
ugaaaggcuguuacuuug

SEQ ID NO: 384157 - RNA, 21 nt, Human
ugaguagugagcacuucaguu

SEQ ID NO: 384158 - RNA, 18 nt, Human
uggaaaaauuggccucau

SEQ ID NO: 384159 - RNA, 24 nt, Human
uguaaaauuacaaauauuuauuac

SEQ ID NO: 384160 - RNA, 21 nt, Human
uuuaauauuauuuucacauuu

SEQ ID NO: 384161 - RNA, 20 nt, Human
uuuagaacaaauauaaaggg

SEQ ID NO: 384162 - RNA, 25 nt, Human
uuucuuggguucacugaacacaagg

SEQ ID NO: 384163 - RNA, 25 nt, Human
aaaccagccucagcccguaggccag

SEQ ID NO: 384164 - RNA, 21 nt, Human
aagcaggugcaaaaacaaaua

SEQ ID NO: 384165 - RNA, 20 nt, Human
aagccaucucccccaccccc

SEQ ID NO: 384166 - RNA, 21 nt, Human
aaggagcaaggcagccaucag

SEQ ID NO: 384167 - RNA, 18 nt, Human
agaccccucaaucuccag

SEQ ID NO: 384168 - RNA, 24 nt, Human
agagacccuacagcucuuagggcc

SEQ ID NO: 384169 - RNA, 19 nt, Human
agagcagguaggagcaggu

SEQ ID NO: 384170 - RNA, 18 nt, Human
agcaagggcuucccucuc

SEQ ID NO: 384171 - RNA, 19 nt, Human
agcaggugggggcaggugg

SEQ ID NO: 384172 - RNA, 20 nt, Human
agcaggugggggcaggugga

SEQ ID NO: 384173 - RNA, 21 nt, Human
aggaggccugcagcagacccc

SEQ ID NO: 384174 - RNA, 19 nt, Human
aggagggcagcaguggggg

SEQ ID NO: 384175 - RNA, 26 nt, Human
aggcagaagcaggugcaaaagggacc

SEQ ID NO: 384176 - RNA, 23 nt, Human
aggguugagggguguacaagagg

SEQ ID NO: 384177 - RNA, 18 nt, Human
agguaggagcaggugggg

SEQ ID NO: 384178 - RNA, 19 nt, Human
aguacaaaguuucuguggu

SEQ ID NO: 384179 - RNA, 19 nt, Human
auaccuuuggggcagcagg

SEQ ID NO: 384180 - RNA, 19 nt, Human
aucaccaccccaucaaugc

SEQ ID NO: 384181 - RNA, 25 nt, Human
aucaccaccccaucaaugcacauuc

SEQ ID NO: 384182 - RNA, 24 nt, Human
caaucuccaggcagaagcaggugc

SEQ ID NO: 384183 - RNA, 21 nt, Human
cacagacagacacauagaucu

SEQ ID NO: 384184 - RNA, 19 nt, Human
cacagauggggcugggaca

SEQ ID NO: 384185 - RNA, 19 nt, Human
cacagcccugaacguagag

SEQ ID NO: 384186 - RNA, 23 nt, Human
cacagcccugaacguagagcagg

SEQ ID NO: 384187 - RNA, 24 nt, Human
cacccccaauucuuggccuguacu

SEQ ID NO: 384188 - RNA, 22 nt, Human
cacugcacugugaaggcagagc

SEQ ID NO: 384189 - RNA, 24 nt, Human
cacugugaaggcagagcuuggucc

SEQ ID NO: 384190 - RNA, 18 nt, Human
cagagcucccaagagccc

SEQ ID NO: 384191 - RNA, 21 nt, Human
caggagggcagcaguggggga

SEQ ID NO: 384192 - RNA, 21 nt, Human
caucaccaccccaucaaugca

SEQ ID NO: 384193 - RNA, 26 nt, Human
cauucuuguccuaagugcuaucuacg

SEQ ID NO: 384194 - RNA, 23 nt, Human
ccacccccaauucuuggccugua

SEQ ID NO: 384195 - RNA, 23 nt, Human
ccagcacuguaagcacgagcaga

SEQ ID NO: 384196 - RNA, 28 nt, Human
ccagcacuguaagcacgagcagaaacca

SEQ ID NO: 384197 - RNA, 24 nt, Human
cccacagauggggcugggacaggg

SEQ ID NO: 384198 - RNA, 23 nt, Human
cccacggcuaacgacauucgggc

SEQ ID NO: 384199 - RNA, 21 nt, Human
cccauggacacccacuucccu

SEQ ID NO: 384200 - RNA, 25 nt, Human
cccauggacacccacuucccuucca

SEQ ID NO: 384201 - RNA, 21 nt, Human
ccccacccccaauucuuggcc

SEQ ID NO: 384202 - RNA, 21 nt, Human
ccccuagcaaccgcagagcuc

SEQ ID NO: 384203 - RNA, 23 nt, Human
ccccuuucuuucacuaguacaaa

SEQ ID NO: 384204 - RNA, 19 nt, Human
cccucagucagucuggccu

SEQ ID NO: 384205 - RNA, 21 nt, Human
ccuggagguuagucugggggg

SEQ ID NO: 384206 - RNA, 22 nt, Human
ccuggagguuagucuggggggc

SEQ ID NO: 384207 - RNA, 24 nt, Human
cgagcagaaaccagccucagcccg

SEQ ID NO: 384208 - RNA, 21 nt, Human
cgaggcccuggcagucauucu

SEQ ID NO: 384209 - RNA, 21 nt, Human
cgaggcccuggcagucauucu

SEQ ID NO: 384210 - RNA, 20 nt, Human
cuagguaccuucacugcacu

SEQ ID NO: 384211 - RNA, 19 nt, Human
cucccccacccccaauucu

SEQ ID NO: 384212 - RNA, 24 nt, Human
cugaguggugucagcggucaugac

SEQ ID NO: 384213 - RNA, 19 nt, Human
cugcacugccuuccucuca

SEQ ID NO: 384214 - RNA, 19 nt, Human
cugcucaguggcccaugga

SEQ ID NO: 384215 - RNA, 18 nt, Human
cuuagggccaacacuacc

SEQ ID NO: 384216 - RNA, 22 nt, Human
cuuggccuguacuuugccuucu

SEQ ID NO: 384217 - RNA, 21 nt, Human
gaaccagauucaguccaugcc

SEQ ID NO: 384218 - RNA, 18 nt, Human
gaagccaucucccccacc

SEQ ID NO: 384219 - RNA, 19 nt, Human
gaagguggguggggguuug

SEQ ID NO: 384220 - RNA, 23 nt, Human
gacauucgggccuagccggccuc

SEQ ID NO: 384221 - RNA, 19 nt, Human
gagcacaaagggcuggggu

SEQ ID NO: 384222 - RNA, 21 nt, Human
gagcaggugggggcaggugga

SEQ ID NO: 384223 - RNA, 23 nt, Human
gaggccugcagcagaccccucaa

SEQ ID NO: 384224 - RNA, 22 nt, Human
gcagaagcaggugcaaaaacaa

SEQ ID NO: 384225 - RNA, 18 nt, Human
gcagcagggaggaggccu

SEQ ID NO: 384226 - RNA, 24 nt, Human
gccaucucccccacccccaauucu

SEQ ID NO: 384227 - RNA, 19 nt, Human
gcugggacagggaaagggg

SEQ ID NO: 384228 - RNA, 19 nt, Human
gcuucaggcccccucaguc

SEQ ID NO: 384229 - RNA, 18 nt, Human
ggaauggcaggcagcaag

SEQ ID NO: 384230 - RNA, 21 nt, Human
ggcacagguagucaggaagga

SEQ ID NO: 384231 - RNA, 20 nt, Human
ggcuggggucugggaauggc

SEQ ID NO: 384232 - RNA, 18 nt, Human
gggaggaggccugcagca

SEQ ID NO: 384233 - RNA, 21 nt, Human
gggcuggggucugggaauggc

SEQ ID NO: 384234 - RNA, 19 nt, Human
gguggguggggguuuguaa

SEQ ID NO: 384235 - RNA, 19 nt, Human
guaggagcaggugggggca

SEQ ID NO: 384236 - RNA, 19 nt, Human
gugggggcagguggaggca

SEQ ID NO: 384237 - RNA, 22 nt, Human
guuucugugguuggggaaccag

SEQ ID NO: 384238 - RNA, 24 nt, Human
uacaagaggagaaccagauucagu

SEQ ID NO: 384239 - RNA, 21 nt, Human
uacagucucauguaggggcac

SEQ ID NO: 384240 - RNA, 22 nt, Human
uagaucuugguuccagcucuga

SEQ ID NO: 384241 - RNA, 22 nt, Human
ucaccacggccacagcccugaa

SEQ ID NO: 384242 - RNA, 18 nt, Human
ucagucuggccucagacu

SEQ ID NO: 384243 - RNA, 20 nt, Human
ucaugucgggcuaggcacuc

SEQ ID NO: 384244 - RNA, 23 nt, Human
uccagcucugaguggugucagcg

SEQ ID NO: 384245 - RNA, 24 nt, Human
uccaugccuggagguuagucuggg

SEQ ID NO: 384246 - RNA, 21 nt, Human
uccccauaccuuuggggcagc

SEQ ID NO: 384247 - RNA, 23 nt, Human
uccgugguuuucaaggcuucccu

SEQ ID NO: 384248 - RNA, 18 nt, Human
uccuggcauccaccuccg

SEQ ID NO: 384249 - RNA, 21 nt, Human
ucuaccuagugccuggcaccu

SEQ ID NO: 384250 - RNA, 23 nt, Human
ucucauguaggggcacucugggc

SEQ ID NO: 384251 - RNA, 20 nt, Human
ucugccugcucugggguugc

SEQ ID NO: 384252 - RNA, 20 nt, Human
ucuggccucugaugucugcc

SEQ ID NO: 384253 - RNA, 23 nt, Human
ucuggccucugaugucugccugc

SEQ ID NO: 384254 - RNA, 22 nt, Human
ugauagcagggcauacagucuc

SEQ ID NO: 384255 - RNA, 21 nt, Human
ugcaaaaacaaauauauucug

SEQ ID NO: 384256 - RNA, 20 nt, Human
ugcauaggguugaggggugu

SEQ ID NO: 384257 - RNA, 21 nt, Human
ugccuggagguuagucugggg

SEQ ID NO: 384258 - RNA, 22 nt, Human
ugccuggagguuagucuggggg

SEQ ID NO: 384259 - RNA, 25 nt, Human
uggaccaggugcucuaccuagugcc

SEQ ID NO: 384260 - RNA, 22 nt, Human
uggcaggcagcaagggcuuccc

SEQ ID NO: 384261 - RNA, 18 nt, Human
uggccagcucugcacugc

SEQ ID NO: 384262 - RNA, 25 nt, Human
uggcccauggacacccacuucccuu

SEQ ID NO: 384263 - RNA, 20 nt, Human
uggccucugaugucugccuu

SEQ ID NO: 384264 - RNA, 25 nt, Human
uggggaaccagcuucaugucgggcu

SEQ ID NO: 384265 - RNA, 21 nt, Human
uggggcugggacagggaaagg

SEQ ID NO: 384266 - RNA, 19 nt, Human
uguaagcacgagcagaaac

SEQ ID NO: 384267 - RNA, 21 nt, Human
uucccuuccaguggcaugugg

SEQ ID NO: 384268 - RNA, 22 nt, Human
aaagcuagauuugcugcauuua

SEQ ID NO: 384269 - RNA, 24 nt, Human
aaagugcugggaucacagguguga

SEQ ID NO: 384270 - RNA, 20 nt, Human
aaccuccgccuccugaauuc

SEQ ID NO: 384271 - RNA, 21 nt, Human
aaccugcaggaaguauaaaaa

SEQ ID NO: 384272 - RNA, 26 nt, Human
aagugcugggaucacaggugugagcc

SEQ ID NO: 384273 - RNA, 26 nt, Human
aauggaaaaguagaaaacaguauaaa

SEQ ID NO: 384274 - RNA, 19 nt, Human
acaggguuucaccaugaug

SEQ ID NO: 384275 - RNA, 20 nt, Human
acaggguuucaccaugaugg

SEQ ID NO: 384276 - RNA, 24 nt, Human
acaggguuucaccaugauggccag

SEQ ID NO: 384277 - RNA, 20 nt, Human
acagugaguauuaaacagga

SEQ ID NO: 384278 - RNA, 24 nt, Human
accaugauggccaggcuggucuug

SEQ ID NO: 384279 - RNA, 19 nt, Human
acuacaggcgugugccacc

SEQ ID NO: 384280 - RNA, 27 nt, Human
agaaaacaguauaaaauucaguaucac

SEQ ID NO: 384281 - RNA, 21 nt, Human
agacauacacucaucacaaca

SEQ ID NO: 384282 - RNA, 25 nt, Human
agagcucuucggagauuuuucuucu

SEQ ID NO: 384283 - RNA, 20 nt, Human
agccggccgggcagggaggc

SEQ ID NO: 384284 - RNA, 18 nt, Human
aggaaaaaaauauuauaa

SEQ ID NO: 384285 - RNA, 21 nt, Human
aggaaaaaaauauuauaauca

SEQ ID NO: 384286 - RNA, 24 nt, Human
aggcgugugccaccacgcccggcu

SEQ ID NO: 384287 - RNA, 23 nt, Human
aguagcugggacuacaggcgugu

SEQ ID NO: 384288 - RNA, 26 nt, Human
aguauuguuagguacagcugcucucc

SEQ ID NO: 384289 - RNA, 24 nt, Human
agugauucuccugccucagccucc

SEQ ID NO: 384290 - RNA, 20 nt, Human
agugcagugguaugaucuug

SEQ ID NO: 384291 - RNA, 23 nt, Human
agugcagugguaugaucuuggcu

SEQ ID NO: 384292 - RNA, 24 nt, Human
agugcagugguaugaucuuggcuc

SEQ ID NO: 384293 - RNA, 24 nt, Human
agugguaugaucuuggcucacugc

SEQ ID NO: 384294 - RNA, 23 nt, Human
auaauucaggcacacacuuuggc

SEQ ID NO: 384295 - RNA, 22 nt, Human
auguuaacauuaggaaaaaaau

SEQ ID NO: 384296 - RNA, 20 nt, Human
auucauguuacuaacaggcg

SEQ ID NO: 384297 - RNA, 18 nt, Human
auucuccugccucagccu

SEQ ID NO: 384298 - RNA, 22 nt, Human
caaaaaaccauccuggucccau

SEQ ID NO: 384299 - RNA, 24 nt, Human
caaagugcugggaucacaggugug

SEQ ID NO: 384300 - RNA, 20 nt, Human
caagugauucuccugccuca

SEQ ID NO: 384301 - RNA, 22 nt, Human
caagugauucuccugccucagc

SEQ ID NO: 384302 - RNA, 20 nt, Human
cacaacacaauuagaaaucu

SEQ ID NO: 384303 - RNA, 24 nt, Human
cacaacacaauuagaaaucucaga

SEQ ID NO: 384304 - RNA, 21 nt, Human
cacaggugugagccaccacac

SEQ ID NO: 384305 - RNA, 18 nt, Human
caccacacaggccuggcc

SEQ ID NO: 384306 - RNA, 24 nt, Human
caccacgcccggcuaauuuuugua

SEQ ID NO: 384307 - RNA, 21 nt, Human
caccaugauggccaggcuggu

SEQ ID NO: 384308 - RNA, 22 nt, Human
caccaugauggccaggcugguc

SEQ ID NO: 384309 - RNA, 23 nt, Human
caccaugauggccaggcuggucu

SEQ ID NO: 384310 - RNA, 19 nt, Human
caccuccucgcgccucggc

SEQ ID NO: 384311 - RNA, 21 nt, Human
cacugcaaccuccgccuccug

SEQ ID NO: 384312 - RNA, 20 nt, Human
cagccuccugaguagcuggg

SEQ ID NO: 384313 - RNA, 18 nt, Human
caggcgcccuuaaagugc

SEQ ID NO: 384314 - RNA, 24 nt, Human
caggguuucaccaugauggccagg

SEQ ID NO: 384315 - RNA, 24 nt, Human
caguagagacaggguuucaccaug

SEQ ID NO: 384316 - RNA, 26 nt, Human
caguagagacaggguuucaccaugau

SEQ ID NO: 384317 - RNA, 24 nt, Human
caugauggccaggcuggucuugaa

SEQ ID NO: 384318 - RNA, 19 nt, Human
cauuuucacaacacaauua

SEQ ID NO: 384319 - RNA, 21 nt, Human
ccaaagugcugggaucacagg

SEQ ID NO: 384320 - RNA, 24 nt, Human
ccaaagugcugggaucacaggugu

SEQ ID NO: 384321 - RNA, 20 nt, Human
ccaccacgcccggcuaauuu

SEQ ID NO: 384322 - RNA, 21 nt, Human
ccccgccgcccgggccuuggg

SEQ ID NO: 384323 - RNA, 24 nt, Human
ccgccuccugaauucaagugauuc

SEQ ID NO: 384324 - RNA, 26 nt, Human
ccggccgggcagggaggcgggucagc

SEQ ID NO: 384325 - RNA, 23 nt, Human
ccugaauucaagugauucuccug

SEQ ID NO: 384326 - RNA, 23 nt, Human
ccugaguagcugggacuacaggc

SEQ ID NO: 384327 - RNA, 24 nt, Human
ccugaguagcugggacuacaggcg

SEQ ID NO: 384328 - RNA, 23 nt, Human
ccugccucagccuccugaguagc

SEQ ID NO: 384329 - RNA, 22 nt, Human
ccuggucccauuaucauguccu

SEQ ID NO: 384330 - RNA, 21 nt, Human
cgaaauacgaaaugaagcuga

SEQ ID NO: 384331 - RNA, 24 nt, Human
cgacacagauuuccaauucauguu

SEQ ID NO: 384332 - RNA, 22 nt, Human
cgcgcuccagccucaccuccuc

SEQ ID NO: 384333 - RNA, 20 nt, Human
cggccgggcagggaggcggg

SEQ ID NO: 384334 - RNA, 21 nt, Human
cggccgggcagggaggcgggu

SEQ ID NO: 384335 - RNA, 19 nt, Human
cgggagccggccgggcagg

SEQ ID NO: 384336 - RNA, 24 nt, Human
cgugauccuccuaccucagccucc

SEQ ID NO: 384337 - RNA, 24 nt, Human
cucacgugauccuccuaccucagc

SEQ ID NO: 384338 - RNA, 24 nt, Human
cucagccuccugaguagcugggac

SEQ ID NO: 384339 - RNA, 21 nt, Human
cucccaagaaagagcuaaaga

SEQ ID NO: 384340 - RNA, 23 nt, Human
cucccuugaaaacuaauauauuc

SEQ ID NO: 384341 - RNA, 20 nt, Human
cuccucgcgccucggccccc

SEQ ID NO: 384342 - RNA, 19 nt, Human
cuccugaauucaagugauu

SEQ ID NO: 384343 - RNA, 22 nt, Human
cuccugccucagccuccugagu

SEQ ID NO: 384344 - RNA, 23 nt, Human
cucggccccgccucgugccgguu

SEQ ID NO: 384345 - RNA, 23 nt, Human
cugcaaccuccgccuccugaauu

SEQ ID NO: 384346 - RNA, 24 nt, Human
cugcaaccuccgccuccugaauuc

SEQ ID NO: 384347 - RNA, 23 nt, Human
cugccucagccuccugaguagcu

SEQ ID NO: 384348 - RNA, 18 nt, Human
cugccugaaauugagagg

SEQ ID NO: 384349 - RNA, 24 nt, Human
cuuacugugucacucaggcugcag

SEQ ID NO: 384350 - RNA, 20 nt, Human
gaaauacgaaaugaagcuga

SEQ ID NO: 384351 - RNA, 21 nt, Human
gaaccgccacgucgccaucug

SEQ ID NO: 384352 - RNA, 26 nt, Human
gaagcugaaauuaauuuuuacauuua

SEQ ID NO: 384353 - RNA, 20 nt, Human
gaguagcugggacuacaggc

SEQ ID NO: 384354 - RNA, 25 nt, Human
gaguagcugggacuacaggcgugug

SEQ ID NO: 384355 - RNA, 20 nt, Human
gaguuggggucgcggcgggc

SEQ ID NO: 384356 - RNA, 18 nt, Human
gaucacaggugugagcca

SEQ ID NO: 384357 - RNA, 20 nt, Human
gauuacuuuuuaagaagaac

SEQ ID NO: 384358 - RNA, 19 nt, Human
gcccgcgggacggccccgc

SEQ ID NO: 384359 - RNA, 22 nt, Human
gcccggcuaauuuuuguauuuu

SEQ ID NO: 384360 - RNA, 18 nt, Human
gcccuuaaagugcuccau

SEQ ID NO: 384361 - RNA, 23 nt, Human
gcgucccggaguuggggucgcgg

SEQ ID NO: 384362 - RNA, 18 nt, Human
gcucuccaggcagcuugu

SEQ ID NO: 384363 - RNA, 23 nt, Human
gcuggucuugaacucccgaccuc

SEQ ID NO: 384364 - RNA, 19 nt, Human
ggacuacaggcgugugcca

SEQ ID NO: 384365 - RNA, 24 nt, Human
ggaguuggggucgcggcgggcggg

SEQ ID NO: 384366 - RNA, 20 nt, Human
ggccgggcagggaggcgggu

SEQ ID NO: 384367 - RNA, 24 nt, Human
ggcuggucuugaacucccgaccuc

SEQ ID NO: 384368 - RNA, 27 nt, Human
gggaacagggaaggcgagggggccggu

SEQ ID NO: 384369 - RNA, 20 nt, Human
gucagcggccugggggagga

SEQ ID NO: 384370 - RNA, 24 nt, Human
gugauccuccuaccucagccuccc

SEQ ID NO: 384371 - RNA, 24 nt, Human
gugauucuccugccucagccuccu

SEQ ID NO: 384372 - RNA, 25 nt, Human
uaaaacaaguaucaguucaaaaaua

SEQ ID NO: 384373 - RNA, 19 nt, Human
uaaagucuagcuucuccca

SEQ ID NO: 384374 - RNA, 21 nt, Human
uaaagucuagcuucucccaag

SEQ ID NO: 384375 - RNA, 20 nt, Human
uaaagugcuccauuccccuu

SEQ ID NO: 384376 - RNA, 19 nt, Human
uaagaagaaccugcaggaa

SEQ ID NO: 384377 - RNA, 24 nt, Human
uaauuuuuguauuuucaguagaga

SEQ ID NO: 384378 - RNA, 23 nt, Human
uacaggcgugugccaccacgccc

SEQ ID NO: 384379 - RNA, 24 nt, Human
uaccucagccucccaaagugcugg

SEQ ID NO: 384380 - RNA, 23 nt, Human
uacucgacacagauuuccaauuc

SEQ ID NO: 384381 - RNA, 20 nt, Human
uacugugucacucaggcugc

SEQ ID NO: 384382 - RNA, 26 nt, Human
uagaaaacaguauaaaauucaguauc

SEQ ID NO: 384383 - RNA, 20 nt, Human
uagagacaggguuucaccau

SEQ ID NO: 384384 - RNA, 21 nt, Human
uagagacaggguuucaccaug

SEQ ID NO: 384385 - RNA, 19 nt, Human
ucacugcaaccuccgccuc

SEQ ID NO: 384386 - RNA, 20 nt, Human
ucacugcaaccuccgccucc

SEQ ID NO: 384387 - RNA, 22 nt, Human
ucacugcaaccuccgccuccug

SEQ ID NO: 384388 - RNA, 23 nt, Human
ucacugcaaccuccgccuccuga

SEQ ID NO: 384389 - RNA, 26 nt, Human
ucacugcaaccuccgccuccugaauu

SEQ ID NO: 384390 - RNA, 18 nt, Human
ucagccucccaaagugcu

SEQ ID NO: 384391 - RNA, 23 nt, Human
ucagccuccugaguagcugggac

SEQ ID NO: 384392 - RNA, 19 nt, Human
ucagcggccugggggagga

SEQ ID NO: 384393 - RNA, 24 nt, Human
ucaguagagacaggguuucaccau

SEQ ID NO: 384394 - RNA, 21 nt, Human
ucaguaucaccuauuugucuc

SEQ ID NO: 384395 - RNA, 23 nt, Human
ucagucuaugagacccagugacc

SEQ ID NO: 384396 - RNA, 23 nt, Human
ucccaaagugcugggaucacagg

SEQ ID NO: 384397 - RNA, 27 nt, Human
uccuccuaccucagccucccaaagugc

SEQ ID NO: 384398 - RNA, 21 nt, Human
uccugaauucaagugauucuc

SEQ ID NO: 384399 - RNA, 24 nt, Human
uccugaauucaagugauucuccug

SEQ ID NO: 384400 - RNA, 24 nt, Human
uccugaguagcugggacuacaggc

SEQ ID NO: 384401 - RNA, 18 nt, Human
ugaauucaagugauucuc

SEQ ID NO: 384402 - RNA, 23 nt, Human
ugaauucaagugauucuccugcc

SEQ ID NO: 384403 - RNA, 24 nt, Human
ugaauucaagugauucuccugccu

SEQ ID NO: 384404 - RNA, 19 nt, Human
ugaggugccaauguuuuaa

SEQ ID NO: 384405 - RNA, 19 nt, Human
ugcagugcagugguaugau

SEQ ID NO: 384406 - RNA, 24 nt, Human
ugcagugcagugguaugaucuugg

SEQ ID NO: 384407 - RNA, 22 nt, Human
ugcagugguaugaucuuggcuc

SEQ ID NO: 384408 - RNA, 25 nt, Human
ugcagugguaugaucuuuggaaggc

SEQ ID NO: 384409 - RNA, 24 nt, Human
ugccucagccuccugaguagcugg

SEQ ID NO: 384410 - RNA, 19 nt, Human
ugccugaaauugagaggcu

SEQ ID NO: 384411 - RNA, 19 nt, Human
ugcuccauuccccuugcuu

SEQ ID NO: 384412 - RNA, 24 nt, Human
ugcugggaucacaggugugagcca

SEQ ID NO: 384413 - RNA, 18 nt, Human
uggaagccucccacuccc

SEQ ID NO: 384414 - RNA, 21 nt, Human
uggagcaaugagcuuagguaa

SEQ ID NO: 384415 - RNA, 23 nt, Human
uggccaggcuggucuugaacucc

SEQ ID NO: 384416 - RNA, 24 nt, Human
ugggaacagggaaggcgagggggc

SEQ ID NO: 384417 - RNA, 18 nt, Human
ugggacuacaggcgugug

SEQ ID NO: 384418 - RNA, 21 nt, Human
ugggacuacaggcgugugcca

SEQ ID NO: 384419 - RNA, 22 nt, Human
ugggacuacaggcgugugccac

SEQ ID NO: 384420 - RNA, 24 nt, Human
ugggacuacaggcgugugccacca

SEQ ID NO: 384421 - RNA, 18 nt, Human
ugggaucacaggugugag

SEQ ID NO: 384422 - RNA, 19 nt, Human
ugggaucacaggugugagc

SEQ ID NO: 384423 - RNA, 22 nt, Human
ugggaucacaggugugagccac

SEQ ID NO: 384424 - RNA, 23 nt, Human
ugggaucacaggugugagccacc

SEQ ID NO: 384425 - RNA, 24 nt, Human
ugggaucacaggugugagccacca

SEQ ID NO: 384426 - RNA, 24 nt, Human
ugggggaggauaggcguccgcagc

SEQ ID NO: 384427 - RNA, 19 nt, Human
uguaaauagucugccuucc

SEQ ID NO: 384428 - RNA, 24 nt, Human
uuaggaaaaaaauauuauaaucau

SEQ ID NO: 384429 - RNA, 28 nt, Human
uuauuuuagguaaucaaagccuggagca

SEQ ID NO: 384430 - RNA, 21 nt, Human
uucaagugauucuccugccuc

SEQ ID NO: 384431 - RNA, 23 nt, Human
uucaagugauucuccugccucag

SEQ ID NO: 384432 - RNA, 24 nt, Human
uucaagugauucuccugccucagc

SEQ ID NO: 384433 - RNA, 23 nt, Human
uucauguuacuaacaggcgcccu

SEQ ID NO: 384434 - RNA, 18 nt, Human
uucucccaagaaagagcu

SEQ ID NO: 384435 - RNA, 31 nt, Human
uuggaagccucccacucccuugaaaacuaag

SEQ ID NO: 384436 - RNA, 21 nt, Human
uuggucucuaagcacuauaaa

SEQ ID NO: 384437 - RNA, 22 nt, Human
uuguuagguacagcugcucucc

SEQ ID NO: 384438 - RNA, 19 nt, Human
uuuagguaaucaaagccug

SEQ ID NO: 384439 - RNA, 21 nt, Human
uuucaccaugauggccaggcu

SEQ ID NO: 384440 - RNA, 19 nt, Human
uuuuaagaagaaccugcag

SEQ ID NO: 384441 - RNA, 24 nt, Human
uuuucaguagagacaggguuucac

SEQ ID NO: 384442 - RNA, 20 nt, Human
uuuuuguauuuucaguagag

SEQ ID NO: 384443 - RNA, 23 nt, Human
uuuuuguauuuucaguagagaca

SEQ ID NO: 384444 - RNA, 23 nt, Human
uuuuuuuuuuuuggagacagucu

SEQ ID NO: 384445 - RNA, 20 nt, Human
uuuuuuuuuuuuuuuuuugg

SEQ ID NO: 384446 - RNA, 26 nt, Human
aaaaaaaaaaaaaaaggcauugccua

SEQ ID NO: 384447 - RNA, 25 nt, Human
aaaaaaaaaaaaaggcauugccuag

SEQ ID NO: 384448 - RNA, 20 nt, Human
aaaaaaaaggcauugccuag

SEQ ID NO: 384449 - RNA, 18 nt, Human
aaaaacaccaguccaaaa

SEQ ID NO: 384450 - RNA, 19 nt, Human
aaaaacaccaguccaaaaa

SEQ ID NO: 384451 - RNA, 18 nt, Human
aaaaaggcauugccuagc

SEQ ID NO: 384452 - RNA, 21 nt, Human
aaaaauauauauccauuuccc

SEQ ID NO: 384453 - RNA, 26 nt, Human
aaaacaaaacaaaacacguuauaccc

SEQ ID NO: 384454 - RNA, 19 nt, Human
aaaacucagugagaaucca

SEQ ID NO: 384455 - RNA, 20 nt, Human
aaaauacacaacuccgggac

SEQ ID NO: 384456 - RNA, 21 nt, Human
aaaauacacaacuccgggaca

SEQ ID NO: 384457 - RNA, 22 nt, Human
aaaaucccaaaaguuagcccaa

SEQ ID NO: 384458 - RNA, 19 nt, Human
aaaccaucaucaaaaaugc

SEQ ID NO: 384459 - RNA, 21 nt, Human
aaaccaucaucaaaaaugcag

SEQ ID NO: 384460 - RNA, 22 nt, Human
aaagaucacgaugucagcaagc

SEQ ID NO: 384461 - RNA, 28 nt, Human
aacaaaacaaaacacguuauacccucga

SEQ ID NO: 384462 - RNA, 19 nt, Human
aacagaagcaacuccaucu

SEQ ID NO: 384463 - RNA, 18 nt, Human
aacuaaaagcugagcauc

SEQ ID NO: 384464 - RNA, 18 nt, Human
aacuaaaagcugagcauc

SEQ ID NO: 384465 - RNA, 22 nt, Human
aacucucucuuuucuuccgcua

SEQ ID NO: 384466 - RNA, 23 nt, Human
aagcaacugcaucuaucagaagc

SEQ ID NO: 384467 - RNA, 23 nt, Human
aagcacaaaguaaaaucccaaaa

SEQ ID NO: 384468 - RNA, 25 nt, Human
aauccucguuccucuaaguuaaagg

SEQ ID NO: 384469 - RNA, 24 nt, Human
acaaaacaaaacacguuauacccu

SEQ ID NO: 384470 - RNA, 24 nt, Human
acagaagcaacuccaucuaccuuu

SEQ ID NO: 384471 - RNA, 24 nt, Human
agaaugguguuuuccaaaaggcuu

SEQ ID NO: 384472 - RNA, 22 nt, Human
agagcaaacuuuucuguauaua

SEQ ID NO: 384473 - RNA, 24 nt, Human
agcaccggaagcaguacucagaaa

SEQ ID NO: 384474 - RNA, 24 nt, Human
aucuuuaacaaugucagguucuga

SEQ ID NO: 384475 - RNA, 20 nt, Human
caaaaaaaaaaaaaaaggca

SEQ ID NO: 384476 - RNA, 22 nt, Human
caaaacaaaacacguuauaccc

SEQ ID NO: 384477 - RNA, 23 nt, Human
caacugcaucuaucagaagcgau

SEQ ID NO: 384478 - RNA, 24 nt, Human
caaggccauccacuugaacucucu

SEQ ID NO: 384479 - RNA, 23 nt, Human
cacaugaaaccugaggacacuuc

SEQ ID NO: 384480 - RNA, 22 nt, Human
cagaacaggauaaauuuagaau

SEQ ID NO: 384481 - RNA, 23 nt, Human
cagaacaggauaaauuuagaaug

SEQ ID NO: 384482 - RNA, 20 nt, Human
cagauacuuuuauuaauucu

SEQ ID NO: 384483 - RNA, 20 nt, Human
caggaaacagguaaaggcua

SEQ ID NO: 384484 - RNA, 22 nt, Human
cagugcuaucuauagcagcugc

SEQ ID NO: 384485 - RNA, 19 nt, Human
cauccauuacugggcaaau

SEQ ID NO: 384486 - RNA, 21 nt, Human
ccacaugaaaccugaggacac

SEQ ID NO: 384487 - RNA, 23 nt, Human
ccaguccaaaaauauauaucccc

SEQ ID NO: 384488 - RNA, 19 nt, Human
cccaaccuggccucggugg

SEQ ID NO: 384489 - RNA, 21 nt, Human
ccccuaguguccucgaggcug

SEQ ID NO: 384490 - RNA, 23 nt, Human
ccgguggcaggaucgccgcuucc

SEQ ID NO: 384491 - RNA, 23 nt, Human
cgguggcaggaucgccgcuuccc

SEQ ID NO: 384492 - RNA, 22 nt, Human
cucaaggccauccacuugaacu

SEQ ID NO: 384493 - RNA, 21 nt, Human
cugaaaacucugauugaaaaa

SEQ ID NO: 384494 - RNA, 22 nt, Human
cugcuucaaaaaaaaaaaaaaa

SEQ ID NO: 384495 - RNA, 23 nt, Human
cuucaaaaaaaaaaaaaaaggca

SEQ ID NO: 384496 - RNA, 22 nt, Human
cuucuuugguucaaagauuugu

SEQ ID NO: 384497 - RNA, 22 nt, Human
cuucuuugguucaaagauuugu

SEQ ID NO: 384498 - RNA, 19 nt, Human
gaagcgaugaugauucaga

SEQ ID NO: 384499 - RNA, 20 nt, Human
gacuauuugagaguaaaauu

SEQ ID NO: 384500 - RNA, 19 nt, Human
gagcaucgauuccucuuuc

SEQ ID NO: 384501 - RNA, 19 nt, Human
gagcaucgauuccucuuuc

SEQ ID NO: 384502 - RNA, 19 nt, Human
gaugauucagaacaggaua

SEQ ID NO: 384503 - RNA, 20 nt, Human
gauguuuuuauuuugacuau

SEQ ID NO: 384504 - RNA, 23 nt, Human
gcaguacucagaacaagucauac

SEQ ID NO: 384505 - RNA, 23 nt, Human
gcagugcuaucuauagcagcugc

SEQ ID NO: 384506 - RNA, 18 nt, Human
gcugaacuuccccaaccu

SEQ ID NO: 384507 - RNA, 20 nt, Human
gcuugaaacuuuccuuugac

SEQ ID NO: 384508 - RNA, 20 nt, Human
gcuugaaacuuuccuuugac

SEQ ID NO: 384509 - RNA, 21 nt, Human
gggagauauuaagguagaaag

SEQ ID NO: 384510 - RNA, 20 nt, Human
gguaaaggcuacaucccaaa

SEQ ID NO: 384511 - RNA, 21 nt, Human
uaaaggcuacaucccaaaagu

SEQ ID NO: 384512 - RNA, 18 nt, Human
uaacaaugucagguucug

SEQ ID NO: 384513 - RNA, 23 nt, Human
uaacagauacuuuuauuaauucu

SEQ ID NO: 384514 - RNA, 24 nt, Human
uaagaauucuuucuucuuugguuc

SEQ ID NO: 384515 - RNA, 24 nt, Human
uaagaauucuuucuucuuugguuc

SEQ ID NO: 384516 - RNA, 26 nt, Human
uacauaaaaacaaggcacuauacauu

SEQ ID NO: 384517 - RNA, 22 nt, Human
uacuuugugaaaaacaccaguc

SEQ ID NO: 384518 - RNA, 22 nt, Human
uagaaugguguuuuccaaaagg

SEQ ID NO: 384519 - RNA, 20 nt, Human
uagcuggaacaagaaggcag

SEQ ID NO: 384520 - RNA, 18 nt, Human
uaggaagugcaacuaaaa

SEQ ID NO: 384521 - RNA, 18 nt, Human
uaggaagugcaacuaaaa

SEQ ID NO: 384522 - RNA, 21 nt, Human
ucaaaaaaaaaaaaaaaggca

SEQ ID NO: 384523 - RNA, 22 nt, Human
ucaaaacucagugagaauccac

SEQ ID NO: 384524 - RNA, 28 nt, Human
ucaaaaucaucauaucucagcuuuucaa

SEQ ID NO: 384525 - RNA, 22 nt, Human
ucaugggcuucuccuucaguuu

SEQ ID NO: 384526 - RNA, 19 nt, Human
uccacaugaaaccugagga

SEQ ID NO: 384527 - RNA, 23 nt, Human
ucccgguggcaggaucgccgcuu

SEQ ID NO: 384528 - RNA, 19 nt, Human
uccucguuccucuaaguua

SEQ ID NO: 384529 - RNA, 22 nt, Human
ucuaauuuaaaaaacaaaacaa

SEQ ID NO: 384530 - RNA, 23 nt, Human
ucuccaauguagccagaaucuac

SEQ ID NO: 384531 - RNA, 22 nt, Human
ucuccagaguccaugccauuaa

SEQ ID NO: 384532 - RNA, 23 nt, Human
ucucuucaugggcuucuccuuca

SEQ ID NO: 384533 - RNA, 23 nt, Human
ucuuuaacaaugucagguucuga

SEQ ID NO: 384534 - RNA, 22 nt, Human
ugaaaaacaccaguccaaaaau

SEQ ID NO: 384535 - RNA, 24 nt, Human
ugaaaaauacuuugugaaaaacac

SEQ ID NO: 384536 - RNA, 25 nt, Human
ugaaaaauacuuugugaaaaacacc

SEQ ID NO: 384537 - RNA, 18 nt, Human
ugauugaaaaauacuuug

SEQ ID NO: 384538 - RNA, 18 nt, Human
uguacaaaaucaaagauc

SEQ ID NO: 384539 - RNA, 23 nt, Human
ugugaaaaacaccaguccaaaaa

SEQ ID NO: 384540 - RNA, 20 nt, Human
uguuggacgugaccgugagg

SEQ ID NO: 384541 - RNA, 20 nt, Human
uucaaaaaaaaaaaaaaagg

SEQ ID NO: 384542 - RNA, 23 nt, Human
uucaaaaaaaaaaaaaaaggcau

SEQ ID NO: 384543 - RNA, 21 nt, Human
uucagaacaggauaaauuuag

SEQ ID NO: 384544 - RNA, 23 nt, Human
uucagaacaggauaaauuuagaa

SEQ ID NO: 384545 - RNA, 26 nt, Human
uuccucuccaaaaagaacgccaaaaa

SEQ ID NO: 384546 - RNA, 20 nt, Human
uugacuuauaugguguuuau

SEQ ID NO: 384547 - RNA, 19 nt, Human
uuuagaauccacaaacuau

SEQ ID NO: 384548 - RNA, 20 nt, Human
uuuagaauccacaaacuauc

SEQ ID NO: 384549 - RNA, 23 nt, Human
aaaaauuagcaaaaaauugagaa

SEQ ID NO: 384550 - RNA, 19 nt, Human
aaaacaccugaugacaagc

SEQ ID NO: 384551 - RNA, 21 nt, Human
aaaaggaaacacgcugccaaa

SEQ ID NO: 384552 - RNA, 24 nt, Human
aaaaggaaacacgcugccaaagga

SEQ ID NO: 384553 - RNA, 24 nt, Human
aaacagccaaaaaucuuaagacaa

SEQ ID NO: 384554 - RNA, 24 nt, Human
aaagugcugggauuacaggcguga

SEQ ID NO: 384555 - RNA, 23 nt, Human
aaccggccaaucuaguuuaacag

SEQ ID NO: 384556 - RNA, 18 nt, Human
aagcuagaaaaccucuac

SEQ ID NO: 384557 - RNA, 20 nt, Human
aaggauauugccuccuagac

SEQ ID NO: 384558 - RNA, 19 nt, Human
aaguagcugggauuacagg

SEQ ID NO: 384559 - RNA, 25 nt, Human
aaguagcugggauuacaggcgcccg

SEQ ID NO: 384560 - RNA, 19 nt, Human
aagugcugggauuacaggc

SEQ ID NO: 384561 - RNA, 19 nt, Human
aagugcugggauuacaggc

SEQ ID NO: 384562 - RNA, 24 nt, Human
aaugugcagucaaaccacaggaaa

SEQ ID NO: 384563 - RNA, 19 nt, Human
acagaccauuucuucauug

SEQ ID NO: 384564 - RNA, 19 nt, Human
acagaggaagggaaaaagc

SEQ ID NO: 384565 - RNA, 20 nt, Human
acaggguuucaccagguugg

SEQ ID NO: 384566 - RNA, 24 nt, Human
acaggguuucaccagguuggccag

SEQ ID NO: 384567 - RNA, 23 nt, Human
accacgcccggcccccaaagcug

SEQ ID NO: 384568 - RNA, 18 nt, Human
accugaugacaagcacuc

SEQ ID NO: 384569 - RNA, 30 nt, Human
acucuguugcccaagcuggaguacaacggg

SEQ ID NO: 384570 - RNA, 19 nt, Human
agacaggguuucaccaggu

SEQ ID NO: 384571 - RNA, 19 nt, Human
agagaggcacagaaggaag

SEQ ID NO: 384572 - RNA, 21 nt, Human
agaggugauuagguucuuugu

SEQ ID NO: 384573 - RNA, 21 nt, Human
agauaaauaagaaggcuuccu

SEQ ID NO: 384574 - RNA, 19 nt, Human
agaugcauauaaacuauga

SEQ ID NO: 384575 - RNA, 22 nt, Human
agcaaaaaauugagaaaguuga

SEQ ID NO: 384576 - RNA, 23 nt, Human
agcagacauacagucaacuuccu

SEQ ID NO: 384577 - RNA, 24 nt, Human
agcuacugaauaaaaugauaauac

SEQ ID NO: 384578 - RNA, 21 nt, Human
aggaaauggcaaugacuccau

SEQ ID NO: 384579 - RNA, 24 nt, Human
aggugauccacccgccucggccuc

SEQ ID NO: 384580 - RNA, 24 nt, Human
agugauucuccugccucagccucc

SEQ ID NO: 384581 - RNA, 18 nt, Human
agugcugggauuacaggc

SEQ ID NO: 384582 - RNA, 18 nt, Human
auaauccucucacagccu

SEQ ID NO: 384583 - RNA, 21 nt, Human
auacuggagucuucuggugua

SEQ ID NO: 384584 - RNA, 20 nt, Human
aucagaugcauauaaacuau

SEQ ID NO: 384585 - RNA, 23 nt, Human
auuccaucaugauccuccccacc

SEQ ID NO: 384586 - RNA, 24 nt, Human
caaagugcugggauuacaggcgug

SEQ ID NO: 384587 - RNA, 22 nt, Human
caagugauucuccugccucagc

SEQ ID NO: 384588 - RNA, 27 nt, Human
caagugauucuccugccucagccuccc

SEQ ID NO: 384589 - RNA, 24 nt, Human
cacaacuucuagaaguagaaauuc

SEQ ID NO: 384590 - RNA, 20 nt, Human
cacauauguaaccgcuuagu

SEQ ID NO: 384591 - RNA, 22 nt, Human
caccacgcccggcccccaaagc

SEQ ID NO: 384592 - RNA, 22 nt, Human
caccagguuggccaggcugcuc

SEQ ID NO: 384593 - RNA, 23 nt, Human
cacccgccucggccucccaaagu

SEQ ID NO: 384594 - RNA, 21 nt, Human
caccugaugacaagcacucaa

SEQ ID NO: 384595 - RNA, 19 nt, Human
cacucuguugcccaagcug

SEQ ID NO: 384596 - RNA, 23 nt, Human
cacuuuauaaaggcaacuauaag

SEQ ID NO: 384597 - RNA, 19 nt, Human
caggaccuauuucacaacu

SEQ ID NO: 384598 - RNA, 21 nt, Human
caggcgcccgccaccacgcuc

SEQ ID NO: 384599 - RNA, 24 nt, Human
caggguuucaccagguuggccagg

SEQ ID NO: 384600 - RNA, 20 nt, Human
ccaaagugcugggauuacag

SEQ ID NO: 384601 - RNA, 22 nt, Human
ccaaagugcugggauuacaggc

SEQ ID NO: 384602 - RNA, 22 nt, Human
ccaaagugcugggauuacaggc

SEQ ID NO: 384603 - RNA, 24 nt, Human
ccaaagugcugggauuacaggcgu

SEQ ID NO: 384604 - RNA, 24 nt, Human
ccaaaugggauauacuuaguucau

SEQ ID NO: 384605 - RNA, 18 nt, Human
ccaacacccaaaucagcu

SEQ ID NO: 384606 - RNA, 22 nt, Human
ccaaguagcugggauuacaggc

SEQ ID NO: 384607 - RNA, 18 nt, Human
ccaggcagugugaggucu

SEQ ID NO: 384608 - RNA, 23 nt, Human
cccaaguagcugggauuacaggc

SEQ ID NO: 384609 - RNA, 23 nt, Human
cccaaguagcugggauuacaggc

SEQ ID NO: 384610 - RNA, 22 nt, Human
cccagggcuagagcagcuaagc

SEQ ID NO: 384611 - RNA, 19 nt, Human
cccauagauuucacagagg

SEQ ID NO: 384612 - RNA, 19 nt, Human
ccccgccaaccccuccugc

SEQ ID NO: 384613 - RNA, 22 nt, Human
ccccgccaaccccuccugccca

SEQ ID NO: 384614 - RNA, 18 nt, Human
ccccucaacauagcacau

SEQ ID NO: 384615 - RNA, 21 nt, Human
cccgccaccacgcucagcuaa

SEQ ID NO: 384616 - RNA, 18 nt, Human
cccucaacauagcacauc

SEQ ID NO: 384617 - RNA, 24 nt, Human
ccgccucccacguucaagugauuc

SEQ ID NO: 384618 - RNA, 23 nt, Human
ccuaaggccacacuguuuccauc

SEQ ID NO: 384619 - RNA, 24 nt, Human
ccucccacguucaagugauucucc

SEQ ID NO: 384620 - RNA, 22 nt, Human
ccugaccucaggugauccaccc

SEQ ID NO: 384621 - RNA, 23 nt, Human
ccugaccucaggugauccacccg

SEQ ID NO: 384622 - RNA, 20 nt, Human
ccugcugccccgccaacccc

SEQ ID NO: 384623 - RNA, 24 nt, Human
cgccucggccucccaaagugcugg

SEQ ID NO: 384624 - RNA, 22 nt, Human
cgugagccaccacgcccggccc

SEQ ID NO: 384625 - RNA, 24 nt, Human
cucacucuguugcccaagcuggag

SEQ ID NO: 384626 - RNA, 23 nt, Human
cucagccucccaaguagcuggga

SEQ ID NO: 384627 - RNA, 23 nt, Human
cucucauguaaauaaauacauac

SEQ ID NO: 384628 - RNA, 18 nt, Human
cugagguucucuguccuc

SEQ ID NO: 384629 - RNA, 24 nt, Human
cugcaaccuccgccucccacguuc

SEQ ID NO: 384630 - RNA, 23 nt, Human
cugccucagccucccaaguagcu

SEQ ID NO: 384631 - RNA, 24 nt, Human
cugcugccccgccaaccccuccug

SEQ ID NO: 384632 - RNA, 23 nt, Human
cuuaagacaaauaccuacagacc

SEQ ID NO: 384633 - RNA, 20 nt, Human
cuugaacuccugaccucagg

SEQ ID NO: 384634 - RNA, 30 nt, Human
cuuuucagguaacccuuguuugcaggaagg

SEQ ID NO: 384635 - RNA, 19 nt, Human
gaacccagggcuagagcag

SEQ ID NO: 384636 - RNA, 20 nt, Human
gaccaugugcaucuaaucug

SEQ ID NO: 384637 - RNA, 24 nt, Human
gaccucaggugauccacccgccuc

SEQ ID NO: 384638 - RNA, 18 nt, Human
gauuacaggcgcccgcca

SEQ ID NO: 384639 - RNA, 18 nt, Human
gauuacaggcgugagcca

SEQ ID NO: 384640 - RNA, 21 nt, Human
gauuacaggcgugagccacca

SEQ ID NO: 384641 - RNA, 22 nt, Human
gauuacaggcgugagccaccac

SEQ ID NO: 384642 - RNA, 22 nt, Human
gcaaccuccgccucccacguuc

SEQ ID NO: 384643 - RNA, 23 nt, Human
gcaagcacuagcauaagaacacc

SEQ ID NO: 384644 - RNA, 21 nt, Human
gccacacuguuuccaucccau

SEQ ID NO: 384645 - RNA, 20 nt, Human
gccucagccucccaaguagc

SEQ ID NO: 384646 - RNA, 24 nt, Human
gcuacagcuguggaauaagccagg

SEQ ID NO: 384647 - RNA, 20 nt, Human
gcucuugaacuccugaccuc

SEQ ID NO: 384648 - RNA, 19 nt, Human
gcuggaguacaacggcaug

SEQ ID NO: 384649 - RNA, 18 nt, Human
ggaaagguuccauuccuu

SEQ ID NO: 384650 - RNA, 19 nt, Human
ggauuacaggcgugagcca

SEQ ID NO: 384651 - RNA, 21 nt, Human
ggcagaaauccaacacccaaa

SEQ ID NO: 384652 - RNA, 23 nt, Human
ggcaugaucucagcucgcugcaa

SEQ ID NO: 384653 - RNA, 22 nt, Human
ggccaaucuaguuuaacagcac

SEQ ID NO: 384654 - RNA, 20 nt, Human
ggcuagagcagcuaagcccc

SEQ ID NO: 384655 - RNA, 24 nt, Human
ggcugcucuugaacuccugaccuc

SEQ ID NO: 384656 - RNA, 22 nt, Human
gggcaaagggguagucuccuuu

SEQ ID NO: 384657 - RNA, 18 nt, Human
guagcugggauuacaggc

SEQ ID NO: 384658 - RNA, 24 nt, Human
gugauccacccgccucggccuccc

SEQ ID NO: 384659 - RNA, 24 nt, Human
gugauucuccugccucagccuccc

SEQ ID NO: 384660 - RNA, 24 nt, Human
uaaacagaaagcuuuugcacaacc

SEQ ID NO: 384661 - RNA, 25 nt, Human
uaaacagaaagcuuuugcacaacca

SEQ ID NO: 384662 - RNA, 23 nt, Human
uaacagcacauacucggaaaagg

SEQ ID NO: 384663 - RNA, 20 nt, Human
uaagacaaauaccuacagac

SEQ ID NO: 384664 - RNA, 22 nt, Human
uaagacaaauaccuacagacca

SEQ ID NO: 384665 - RNA, 20 nt, Human
uaaggaaaacaccugaugac

SEQ ID NO: 384666 - RNA, 21 nt, Human
uaauuacaaaaguaaaaccaa

SEQ ID NO: 384667 - RNA, 27 nt, Human
uaauuuuuuuuguauuuuuaguagaga

SEQ ID NO: 384668 - RNA, 24 nt, Human
uacaccugccagcuacugaauaaa

SEQ ID NO: 384669 - RNA, 19 nt, Human
uacaggcgcccgccaccac

SEQ ID NO: 384670 - RNA, 23 nt, Human
uacaggcgugagccaccacgccc

SEQ ID NO: 384671 - RNA, 20 nt, Human
uagaagcuagaaaaccucua

SEQ ID NO: 384672 - RNA, 20 nt, Human
uagagacaggguuucaccag

SEQ ID NO: 384673 - RNA, 22 nt, Human
uagagacaggguuucaccaggu

SEQ ID NO: 384674 - RNA, 18 nt, Human
uagaucauauaugaaaac

SEQ ID NO: 384675 - RNA, 23 nt, Human
uagcacaucacaaaaauacauuu

SEQ ID NO: 384676 - RNA, 24 nt, Human
uagcagacauacagucaacuuccu

SEQ ID NO: 384677 - RNA, 25 nt, Human
uagggaaagaaauaucuuaguagaa

SEQ ID NO: 384678 - RNA, 19 nt, Human
uaguagagacaggguuuca

SEQ ID NO: 384679 - RNA, 18 nt, Human
uaucaagguccacaugug

SEQ ID NO: 384680 - RNA, 21 nt, Human
uauuaaggaaaacaccugaug

SEQ ID NO: 384681 - RNA, 21 nt, Human
uauuugacuccuaaggccaca

SEQ ID NO: 384682 - RNA, 24 nt, Human
ucaaaggcacaugauacaaaaaua

SEQ ID NO: 384683 - RNA, 18 nt, Human
ucaagugauucuccugcc

SEQ ID NO: 384684 - RNA, 22 nt, Human
ucagagcaccaauggucaaagg

SEQ ID NO: 384685 - RNA, 23 nt, Human
ucagagcaccaauggucaaaggc

SEQ ID NO: 384686 - RNA, 20 nt, Human
ucagccucccaaguagcugg

SEQ ID NO: 384687 - RNA, 23 nt, Human
uccaaaugggauauacuuaguuc

SEQ ID NO: 384688 - RNA, 22 nt, Human
uccaacacccaaaucagcuguc

SEQ ID NO: 384689 - RNA, 25 nt, Human
uccaacacccaaaucagcugucaaa

SEQ ID NO: 384690 - RNA, 26 nt, Human
uccaacacccaaaucagcugucaaau

SEQ ID NO: 384691 - RNA, 23 nt, Human
uccaagaacccagggcuagagca

SEQ ID NO: 384692 - RNA, 19 nt, Human
uccacagagguucugagua

SEQ ID NO: 384693 - RNA, 20 nt, Human
uccacaugugaccagaaagc

SEQ ID NO: 384694 - RNA, 24 nt, Human
ucccaaagugcugggauuacaggc

SEQ ID NO: 384695 - RNA, 24 nt, Human
ucccaaguagcugggauuacaggc

SEQ ID NO: 384696 - RNA, 24 nt, Human
ucccacguucaagugauucuccug

SEQ ID NO: 384697 - RNA, 21 nt, Human
uccuccccaccaugcagagac

SEQ ID NO: 384698 - RNA, 18 nt, Human
ucgcugcaaccuccgccu

SEQ ID NO: 384699 - RNA, 19 nt, Human
ucgcugcaaccuccgccuc

SEQ ID NO: 384700 - RNA, 24 nt, Human
ucgcugcaaccuccgccucccacg

SEQ ID NO: 384701 - RNA, 27 nt, Human
ucgcugcaaccuccgccucccacguuc

SEQ ID NO: 384702 - RNA, 18 nt, Human
ucggccucccaaagugcu

SEQ ID NO: 384703 - RNA, 18 nt, Human
ucuaauacaccugccagc

SEQ ID NO: 384704 - RNA, 27 nt, Human
ucuaauacaccugccagcuacugaaua

SEQ ID NO: 384705 - RNA, 23 nt, Human
ucucacucuguugcccaagcugg

SEQ ID NO: 384706 - RNA, 24 nt, Human
ucucacucuguugcccaagcugga

SEQ ID NO: 384707 - RNA, 25 nt, Human
ucucacucuguugcccaagcuggag

SEQ ID NO: 384708 - RNA, 26 nt, Human
ucucacucuguugcccaagcuggagu

SEQ ID NO: 384709 - RNA, 26 nt, Human
ucuccugccucagccucccaaguagc

SEQ ID NO: 384710 - RNA, 22 nt, Human
ucuggaaugagggauacuggag

SEQ ID NO: 384711 - RNA, 23 nt, Human
ucuugaacuccugaccucaggug

SEQ ID NO: 384712 - RNA, 21 nt, Human
ugacaagcacucaaacacucu

SEQ ID NO: 384713 - RNA, 26 nt, Human
ugacaagcacucaaacacucuugaaa

SEQ ID NO: 384714 - RNA, 19 nt, Human
ugacaugcuaucaucuuua

SEQ ID NO: 384715 - RNA, 21 nt, Human
ugaccucaggugauccacccg

SEQ ID NO: 384716 - RNA, 24 nt, Human
ugaccucaggugauccacccgccu

SEQ ID NO: 384717 - RNA, 19 nt, Human
ugacuccuaaggccacacu

SEQ ID NO: 384718 - RNA, 22 nt, Human
ugagauggagucucacucuguu

SEQ ID NO: 384719 - RNA, 18 nt, Human
ugagccccuccaaacucu

SEQ ID NO: 384720 - RNA, 20 nt, Human
ugauaauuuaugggauuaua

SEQ ID NO: 384721 - RNA, 20 nt, Human
ugauucuccugccucagccu

SEQ ID NO: 384722 - RNA, 25 nt, Human
ugcaggaagauaaauaagaaggcuu

SEQ ID NO: 384723 - RNA, 19 nt, Human
ugcaucuaaucugcuuucu

SEQ ID NO: 384724 - RNA, 19 nt, Human
ugcccaccuaacaaaggcu

SEQ ID NO: 384725 - RNA, 25 nt, Human
ugcccaccuaacaaaggcuaacaua

SEQ ID NO: 384726 - RNA, 24 nt, Human
ugccccgccaaccccuccugccca

SEQ ID NO: 384727 - RNA, 26 nt, Human
ugccccgccaaccccuccugcccagc

SEQ ID NO: 384728 - RNA, 24 nt, Human
ugccucagccucccaaguagcugg

SEQ ID NO: 384729 - RNA, 24 nt, Human
ugcucuugaacuccugaccucagg

SEQ ID NO: 384730 - RNA, 24 nt, Human
ugcugggauuacaggcgugagcca

SEQ ID NO: 384731 - RNA, 20 nt, Human
uggaaugagggauacuggag

SEQ ID NO: 384732 - RNA, 19 nt, Human
uggaguacaacggcaugau

SEQ ID NO: 384733 - RNA, 24 nt, Human
uggcagugagccccuccaaacucu

SEQ ID NO: 384734 - RNA, 24 nt, Human
uggccaggcugcucuugaacuccu

SEQ ID NO: 384735 - RNA, 21 nt, Human
ugggauuacaggcgcccgcca

SEQ ID NO: 384736 - RNA, 22 nt, Human
ugggauuacaggcgcccgccac

SEQ ID NO: 384737 - RNA, 24 nt, Human
ugggauuacaggcgcccgccacca

SEQ ID NO: 384738 - RNA, 18 nt, Human
ugggauuacaggcgugag

SEQ ID NO: 384739 - RNA, 19 nt, Human
ugggauuacaggcgugagc

SEQ ID NO: 384740 - RNA, 22 nt, Human
ugggauuacaggcgugagccac

SEQ ID NO: 384741 - RNA, 23 nt, Human
ugggauuacaggcgugagccacc

SEQ ID NO: 384742 - RNA, 24 nt, Human
ugggauuacaggcgugagccacca

SEQ ID NO: 384743 - RNA, 21 nt, Human
ugggauuauauuccaguuucc

SEQ ID NO: 384744 - RNA, 24 nt, Human
uguaugaugguuagggaaagaaau

SEQ ID NO: 384745 - RNA, 26 nt, Human
ugucaggaaauggaaagcgaaccggc

SEQ ID NO: 384746 - RNA, 18 nt, Human
ugugcagucaaaccacag

SEQ ID NO: 384747 - RNA, 22 nt, Human
uguuuuguuuuguuuugagaug

SEQ ID NO: 384748 - RNA, 25 nt, Human
uguuuuguuuuguuuuguuuugauu

SEQ ID NO: 384749 - RNA, 25 nt, Human
uguuuuguuuuguuuuguuuugauu

SEQ ID NO: 384750 - RNA, 20 nt, Human
uuacuguugcuucucaauua

SEQ ID NO: 384751 - RNA, 23 nt, Human
uuagaaaaauuagcaaaaaauug

SEQ ID NO: 384752 - RNA, 23 nt, Human
uuaggauacugacccacuuagag

SEQ ID NO: 384753 - RNA, 18 nt, Human
uuaguagagacaggguuu

SEQ ID NO: 384754 - RNA, 22 nt, Human
uucaaagaaagaguaaacaaac

SEQ ID NO: 384755 - RNA, 21 nt, Human
uucaagugauucuccugccuc

SEQ ID NO: 384756 - RNA, 23 nt, Human
uucaagugauucuccugccucag

SEQ ID NO: 384757 - RNA, 24 nt, Human
uucaagugauucuccugccucagc

SEQ ID NO: 384758 - RNA, 28 nt, Human
uucauuggcaaauauuuuccagucauaa

SEQ ID NO: 384759 - RNA, 24 nt, Human
uucuuuguagaauacuuuuuccuc

SEQ ID NO: 384760 - RNA, 23 nt, Human
uuguagaauacuuuuuccucauu

SEQ ID NO: 384761 - RNA, 21 nt, Human
uuucaccagguuggccaggcu

SEQ ID NO: 384762 - RNA, 23 nt, Human
uuugcacaaccacauauguaacc

SEQ ID NO: 384763 - RNA, 19 nt, Human
uuuguuuuguuuuguuuug

SEQ ID NO: 384764 - RNA, 24 nt, Human
uuuuuaguagagacaggguuucac

SEQ ID NO: 384765 - RNA, 21 nt, Human
uuuuuguauuuuuaguagaga

SEQ ID NO: 384766 - RNA, 21 nt, Human
uuuuuuguauuuuuaguagag

SEQ ID NO: 384767 - RNA, 24 nt, Human
uuuuuuguauuuuuaguagagaca

SEQ ID NO: 384768 - RNA, 25 nt, Human
aaacaagaaaagaguucaagugggc

SEQ ID NO: 384769 - RNA, 19 nt, Human
aaagaaauaaacaaaagcc

SEQ ID NO: 384770 - RNA, 23 nt, Human
aaauaacaacuauuauccauuua

SEQ ID NO: 384771 - RNA, 20 nt, Human
aaaugcuagcauauccacug

SEQ ID NO: 384772 - RNA, 19 nt, Human
aacaaaccaaagaaauaaa

SEQ ID NO: 384773 - RNA, 18 nt, Human
aacaggaaucaagcccaa

SEQ ID NO: 384774 - RNA, 21 nt, Human
aacuauuauucaacaggaauc

SEQ ID NO: 384775 - RNA, 23 nt, Human
aauuuaccuccccacccccucua

SEQ ID NO: 384776 - RNA, 25 nt, Human
acaaaccaaagaaauaaacaaaagc

SEQ ID NO: 384777 - RNA, 19 nt, Human
acaaagauaaaccuggagg

SEQ ID NO: 384778 - RNA, 25 nt, Human
acagacuaauuuguucauucauuga

SEQ ID NO: 384779 - RNA, 18 nt, Human
acuggcagauaccaucug

SEQ ID NO: 384780 - RNA, 24 nt, Human
acugugguucccuucuuuuucuuu

SEQ ID NO: 384781 - RNA, 25 nt, Human
agaagaaaaaggaacacauuuaaaa

SEQ ID NO: 384782 - RNA, 24 nt, Human
agcaccaacaucauuacaauuccc

SEQ ID NO: 384783 - RNA, 23 nt, Human
agcuaaaaugcuagcauauccac

SEQ ID NO: 384784 - RNA, 21 nt, Human
aggaagcagcaccaacaucau

SEQ ID NO: 384785 - RNA, 19 nt, Human
aggaggacaaggauaauuc

SEQ ID NO: 384786 - RNA, 19 nt, Human
agguaauugaucccuaaaa

SEQ ID NO: 384787 - RNA, 18 nt, Human
augacacuaguuaacaaa

SEQ ID NO: 384788 - RNA, 19 nt, Human
auugcuuuuaacuccuugu

SEQ ID NO: 384789 - RNA, 20 nt, Human
auuguuuugaagcaccuaaa

SEQ ID NO: 384790 - RNA, 23 nt, Human
caaaauguuccccaucuaacuga

SEQ ID NO: 384791 - RNA, 21 nt, Human
caaaucaacugcaaugggaaa

SEQ ID NO: 384792 - RNA, 23 nt, Human
caacaucauuacaauuccccaaa

SEQ ID NO: 384793 - RNA, 18 nt, Human
caagcccaaacccuggag

SEQ ID NO: 384794 - RNA, 25 nt, Human
caccuaaaacuucucaauaacaaaa

SEQ ID NO: 384795 - RNA, 24 nt, Human
cacugaacuuuauuccugaaaguc

SEQ ID NO: 384796 - RNA, 20 nt, Human
cagaagauaucaagcuaucc

SEQ ID NO: 384797 - RNA, 20 nt, Human
cagcacacugaacuuuauuc

SEQ ID NO: 384798 - RNA, 26 nt, Human
ccacacuaccucccuuugcacagcua

SEQ ID NO: 384799 - RNA, 25 nt, Human
cccacccccucuacuacauauucua

SEQ ID NO: 384800 - RNA, 19 nt, Human
ccccaaauaacaacuauua

SEQ ID NO: 384801 - RNA, 21 nt, Human
cccgcucccagaggaggcugg

SEQ ID NO: 384802 - RNA, 24 nt, Human
cccucuacuacauauucuauuagc

SEQ ID NO: 384803 - RNA, 25 nt, Human
cuaaugggcuagcaaaauguucccc

SEQ ID NO: 384804 - RNA, 21 nt, Human
cuaggguagaaaaugucuucc

SEQ ID NO: 384805 - RNA, 23 nt, Human
cucccagaggaggcuggaccggc

SEQ ID NO: 384806 - RNA, 21 nt, Human
cugugguucccuucuuuuucu

SEQ ID NO: 384807 - RNA, 27 nt, Human
gaaaaaggaacacauuuaaaaaacugc

SEQ ID NO: 384808 - RNA, 21 nt, Human
gaaguucacaggaauaaacug

SEQ ID NO: 384809 - RNA, 20 nt, Human
gauaaagaagacuggaaaaa

SEQ ID NO: 384810 - RNA, 22 nt, Human
gcaaugaaugguucaaucugaa

SEQ ID NO: 384811 - RNA, 20 nt, Human
gcagauaccaucugucagua

SEQ ID NO: 384812 - RNA, 21 nt, Human
gcuaaaaugcuagcauaucca

SEQ ID NO: 384813 - RNA, 21 nt, Human
gcugcaaugaaugguucaauc

SEQ ID NO: 384814 - RNA, 19 nt, Human
ggaaauuauucaggaaugc

SEQ ID NO: 384815 - RNA, 20 nt, Human
ggaggacaaggauaauucug

SEQ ID NO: 384816 - RNA, 20 nt, Human
gggaaaacagaagauaucaa

SEQ ID NO: 384817 - RNA, 21 nt, Human
guagaaaaugucuuccuuuca

SEQ ID NO: 384818 - RNA, 22 nt, Human
gucacauggauugcuuuuaacu

SEQ ID NO: 384819 - RNA, 22 nt, Human
uaaaaugagacaugugcuuuaa

SEQ ID NO: 384820 - RNA, 19 nt, Human
uaaacugguagauaagaca

SEQ ID NO: 384821 - RNA, 23 nt, Human
uaacaaaccaaagaaauaaacaa

SEQ ID NO: 384822 - RNA, 19 nt, Human
uacaaaguuucuccauagu

SEQ ID NO: 384823 - RNA, 18 nt, Human
uaccucccuuugcacagc

SEQ ID NO: 384824 - RNA, 18 nt, Human
uacugcugcaaugaaugg

SEQ ID NO: 384825 - RNA, 19 nt, Human
uagaagaacagguaccaug

SEQ ID NO: 384826 - RNA, 24 nt, Human
uaugcuagauaaacaagaaaagag

SEQ ID NO: 384827 - RNA, 22 nt, Human
uccaauuuucuuacacugcagu

SEQ ID NO: 384828 - RNA, 23 nt, Human
uccccaaauaacaacuauuaucc

SEQ ID NO: 384829 - RNA, 23 nt, Human
ugagaagaggguugaagagacug

SEQ ID NO: 384830 - RNA, 20 nt, Human
ugcaaugggaaaacagaaga

SEQ ID NO: 384831 - RNA, 22 nt, Human
ugcaaugggaaaacagaagaua

SEQ ID NO: 384832 - RNA, 21 nt, Human
uggaacaagauuuuaaaaagu

SEQ ID NO: 384833 - RNA, 21 nt, Human
ugggcuagcaaaauguucccc

SEQ ID NO: 384834 - RNA, 22 nt, Human
ugucaaauaaaugaaucaggua

SEQ ID NO: 384835 - RNA, 18 nt, Human
ugugaaaggcuugaguca

SEQ ID NO: 384836 - RNA, 24 nt, Human
ugugcacauacaaaguuucuccau

SEQ ID NO: 384837 - RNA, 21 nt, Human
ugugguucccuucuuuuucuu

SEQ ID NO: 384838 - RNA, 18 nt, Human
uucacagaagaaaaagga

SEQ ID NO: 384839 - RNA, 25 nt, Human
uucuuacacugcaguuaaaugguug

SEQ ID NO: 384840 - RNA, 22 nt, Human
uucuuuggcaagucagaggaau

SEQ ID NO: 384841 - RNA, 21 nt, Human
uugaucccuaaaacaugcaca

SEQ ID NO: 384842 - RNA, 20 nt, Human
uuucauacuuuacuugucug

SEQ ID NO: 384843 - RNA, 18 nt, Human
aaacacaaaucauucaug

SEQ ID NO: 384844 - RNA, 25 nt, Human
aaguauuuuuuaagucucaacuucc

SEQ ID NO: 384845 - RNA, 24 nt, Human
acaagaaaaaguaacaacaauaua

SEQ ID NO: 384846 - RNA, 21 nt, Human
agaauaaagaaugacccucaa

SEQ ID NO: 384847 - RNA, 19 nt, Human
aguaaagaauaaagaauga

SEQ ID NO: 384848 - RNA, 24 nt, Human
auaaugcauucuuagcauucaaag

SEQ ID NO: 384849 - RNA, 19 nt, Human
aucacaucgccaggaggaa

SEQ ID NO: 384850 - RNA, 20 nt, Human
augcauucuuagcauucaaa

SEQ ID NO: 384851 - RNA, 22 nt, Human
caagaaaaaguaacaacaauau

SEQ ID NO: 384852 - RNA, 22 nt, Human
cccucguuuccuucucccuuuc

SEQ ID NO: 384853 - RNA, 22 nt, Human
cguuuccuucucccuuucgccc

SEQ ID NO: 384854 - RNA, 21 nt, Human
guuuccuucucccuuucgccc

SEQ ID NO: 384855 - RNA, 25 nt, Human
uaaagaaacacaaaucauucaugca

SEQ ID NO: 384856 - RNA, 24 nt, Human
uaaauuccaucacaucgccaggag

SEQ ID NO: 384857 - RNA, 18 nt, Human
uaacuacacugauucucu

SEQ ID NO: 384858 - RNA, 18 nt, Human
uacaaauuugaaaacuua

SEQ ID NO: 384859 - RNA, 19 nt, Human
uacaagaaaaaguaacaac

SEQ ID NO: 384860 - RNA, 24 nt, Human
uaguaaagaauaaagaaugacccu

SEQ ID NO: 384861 - RNA, 22 nt, Human
ucgcccuaccgcccgcugccac

SEQ ID NO: 384862 - RNA, 21 nt, Human
ugacagguuuccagacaauau

SEQ ID NO: 384863 - RNA, 21 nt, Human
ugacccucaauaaugcauucu

SEQ ID NO: 384864 - RNA, 27 nt, Human
ugacccucaauaaugcauucuuagcau

SEQ ID NO: 384865 - RNA, 21 nt, Human
uucaaaggcuaacuuuacaaa

SEQ ID NO: 384866 - RNA, 21 nt, Human
uucucuguuacgguuguaaau

SEQ ID NO: 384867 - RNA, 18 nt, Human
uuggcucuggcaaauaag

SEQ ID NO: 384868 - RNA, 24 nt, Human
aaaaaaaauauuguauagacagaa

SEQ ID NO: 384869 - RNA, 21 nt, Human
aacugcauugauucaaaaaca

SEQ ID NO: 384870 - RNA, 18 nt, Human
acagagaauaauaauuag

SEQ ID NO: 384871 - RNA, 19 nt, Human
agacagaagucuucugggc

SEQ ID NO: 384872 - RNA, 23 nt, Human
cucauguuauagugguucccucu

SEQ ID NO: 384873 - RNA, 20 nt, Human
cuccaaaauuaaaaaaaaau

SEQ ID NO: 384874 - RNA, 19 nt, Human
cugcauugauucaaaaaca

SEQ ID NO: 384875 - RNA, 19 nt, Human
gaguauaauuaacucaaaa

SEQ ID NO: 384876 - RNA, 23 nt, Human
uaauuuauuaaagaaacucauuu

SEQ ID NO: 384877 - RNA, 18 nt, Human
uccaaaauuaaaaaaaaa

SEQ ID NO: 384878 - RNA, 23 nt, Human
ucggugacauguauauuuuucuc

SEQ ID NO: 384879 - RNA, 23 nt, Human
uuaaagcuuuuaucuccaaaauu

SEQ ID NO: 384880 - RNA, 23 nt, Human
uuggacucauguuauagugguuc

SEQ ID NO: 384881 - RNA, 19 nt, Human
uuuccucaguuauauacag

SEQ ID NO: 384882 - RNA, 24 nt, Human
aaaacaaacaaauccagcuagccc

SEQ ID NO: 384883 - RNA, 20 nt, Human
aagaaaacaaacaaauccag

SEQ ID NO: 384884 - RNA, 23 nt, Human
aaucacacagacaagaaaacaaa

SEQ ID NO: 384885 - RNA, 24 nt, Human
aaucacacagacaagaaaacaaac

SEQ ID NO: 384886 - RNA, 26 nt, Human
acacagacaagaaaacaaacaaaucc

SEQ ID NO: 384887 - RNA, 24 nt, Human
acagacaagaaaacaaacaaaucc

SEQ ID NO: 384888 - RNA, 26 nt, Human
acagacaagaaaacaaacaaauccag

SEQ ID NO: 384889 - RNA, 23 nt, Human
agacaagaaaacaaacaaaucca

SEQ ID NO: 384890 - RNA, 24 nt, Human
agacaagaaaacaaacaaauccag

SEQ ID NO: 384891 - RNA, 19 nt, Human
agacaugaaagggauuugg

SEQ ID NO: 384892 - RNA, 22 nt, Human
agggcgggcgcagcgcggggcc

SEQ ID NO: 384893 - RNA, 23 nt, Human
auaaccuguaugaaaaucacaca

SEQ ID NO: 384894 - RNA, 19 nt, Human
augucccugggcccgauga

SEQ ID NO: 384895 - RNA, 19 nt, Human
cacagacaagaaaacaaac

SEQ ID NO: 384896 - RNA, 21 nt, Human
cacccgcuccuccucgcucuc

SEQ ID NO: 384897 - RNA, 25 nt, Human
ccagcuagccccuuggauccugcca

SEQ ID NO: 384898 - RNA, 23 nt, Human
ccgccgggcccgcggcucuuccu

SEQ ID NO: 384899 - RNA, 22 nt, Human
ccgccgggguggccucagccgc

SEQ ID NO: 384900 - RNA, 20 nt, Human
ccucuggauacauuuuccug

SEQ ID NO: 384901 - RNA, 21 nt, Human
ccugcgccaggugaggcgagg

SEQ ID NO: 384902 - RNA, 25 nt, Human
ccugugaucaaaggcagccaccgac

SEQ ID NO: 384903 - RNA, 22 nt, Human
cgaugaguaacaaaugcacccc

SEQ ID NO: 384904 - RNA, 18 nt, Human
cggggccacccgcuccuc

SEQ ID NO: 384905 - RNA, 20 nt, Human
cuagccccuuggauccugcc

SEQ ID NO: 384906 - RNA, 20 nt, Human
cucccgggacugccuuugcu

SEQ ID NO: 384907 - RNA, 21 nt, Human
cugugaucaaaggcagccacc

SEQ ID NO: 384908 - RNA, 19 nt, Human
gccaccgacaggugcggga

SEQ ID NO: 384909 - RNA, 21 nt, Human
ggcauuuggaaaaggccgcuu

SEQ ID NO: 384910 - RNA, 20 nt, Human
gggcgggcgcagcgcggggc

SEQ ID NO: 384911 - RNA, 22 nt, Human
uaacaaaugcaccccgggaccc

SEQ ID NO: 384912 - RNA, 18 nt, Human
uaaggcauccuugggcau

SEQ ID NO: 384913 - RNA, 19 nt, Human
uagccccuuggauccugcc

SEQ ID NO: 384914 - RNA, 22 nt, Human
uauugucaggaaagcuuuucag

SEQ ID NO: 384915 - RNA, 22 nt, Human
ucaaaggcagccaccgacaggu

SEQ ID NO: 384916 - RNA, 27 nt, Human
uccaccugcgccaggugaggcgagggc

SEQ ID NO: 384917 - RNA, 21 nt, Human
ucccugggcccgaugaguaac

SEQ ID NO: 384918 - RNA, 20 nt, Human
ucgcucuccagccgccgccg

SEQ ID NO: 384919 - RNA, 22 nt, Human
ucucauggccguagaagcagcc

SEQ ID NO: 384920 - RNA, 23 nt, Human
ugccauccgucuuuucucccggg

SEQ ID NO: 384921 - RNA, 21 nt, Human
uggaaaaggccgcuuggggug

SEQ ID NO: 384922 - RNA, 18 nt, Human
uggaaagacaugaaaggg

SEQ ID NO: 384923 - RNA, 18 nt, Human
uggcagagggagguggcu

SEQ ID NO: 384924 - RNA, 25 nt, Human
ugggcauguuccauccaagccuggc

SEQ ID NO: 384925 - RNA, 26 nt, Human
uggggugagagugcucuaggccacuc

SEQ ID NO: 384926 - RNA, 18 nt, Human
ugugggcauguuccaucc

SEQ ID NO: 384927 - RNA, 21 nt, Human
uuccucugccuuugccuuccc

SEQ ID NO: 384928 - RNA, 23 nt, Human
uuuggaaaaggccgcuuggggug

SEQ ID NO: 384929 - RNA, 18 nt, Human
acugcgcggugcccagga

SEQ ID NO: 384930 - RNA, 18 nt, Human
aggagccgcgggggcgga

SEQ ID NO: 384931 - RNA, 20 nt, Human
cugcgacuuggggcaggggg

SEQ ID NO: 384932 - RNA, 18 nt, Human
ugcccaggagcacagcug

SEQ ID NO: 384933 - RNA, 25 nt, Human
aaacagcccuggaaucacaaguuau

SEQ ID NO: 384934 - RNA, 21 nt, Human
aaccagacagaggagcugaca

SEQ ID NO: 384935 - RNA, 26 nt, Human
aagcacgaacaggaacagguaaacaa

SEQ ID NO: 384936 - RNA, 18 nt, Human
acacugcauaggaaaaac

SEQ ID NO: 384937 - RNA, 22 nt, Human
accccggcgccagaccccgcag

SEQ ID NO: 384938 - RNA, 20 nt, Human
agaagauaaagucacacugg

SEQ ID NO: 384939 - RNA, 20 nt, Human
agcacaguucauugaagauc

SEQ ID NO: 384940 - RNA, 21 nt, Human
agcauugaaagaacgcagcaa

SEQ ID NO: 384941 - RNA, 23 nt, Human
agcuuggggggaggagaggaguu

SEQ ID NO: 384942 - RNA, 21 nt, Human
caaaccacccagaagauaaag

SEQ ID NO: 384943 - RNA, 18 nt, Human
cacaauucuuuuguauac

SEQ ID NO: 384944 - RNA, 19 nt, Human
cacugguggagggaaaguu

SEQ ID NO: 384945 - RNA, 20 nt, Human
cagaaagaaagcgaaaagca

SEQ ID NO: 384946 - RNA, 18 nt, Human
cagacagaggagcugaca

SEQ ID NO: 384947 - RNA, 19 nt, Human
cagacagaggagcugacac

SEQ ID NO: 384948 - RNA, 24 nt, Human
ccagugggagggucuguuuucccc

SEQ ID NO: 384949 - RNA, 20 nt, Human
cccccuacucccauuucacc

SEQ ID NO: 384950 - RNA, 21 nt, Human
ccccgcuuuccuuucguuugu

SEQ ID NO: 384951 - RNA, 21 nt, Human
ccccuacucccauuucacccc

SEQ ID NO: 384952 - RNA, 18 nt, Human
cccuguccaccccccuac

SEQ ID NO: 384953 - RNA, 23 nt, Human
cccuguccaccccccuacuccca

SEQ ID NO: 384954 - RNA, 19 nt, Human
ccggcgccagaccccgcag

SEQ ID NO: 384955 - RNA, 20 nt, Human
ccuccccgcuuuccuuucgu

SEQ ID NO: 384956 - RNA, 21 nt, Human
ccuguccaccccccuacuccc

SEQ ID NO: 384957 - RNA, 22 nt, Human
cgcggagggagagcgagggcgg

SEQ ID NO: 384958 - RNA, 25 nt, Human
cggcgccagaccccgcagacagcag

SEQ ID NO: 384959 - RNA, 21 nt, Human
cucuuaauguucuaucuaguu

SEQ ID NO: 384960 - RNA, 21 nt, Human
cucuuaauguucuaucuaguu

SEQ ID NO: 384961 - RNA, 19 nt, Human
cugagcuuggggggaggag

SEQ ID NO: 384962 - RNA, 20 nt, Human
cuggaaucacaaguuauaca

SEQ ID NO: 384963 - RNA, 19 nt, Human
gaacagguaaacaaccaga

SEQ ID NO: 384964 - RNA, 22 nt, Human
gauaaagucacacuggacuugg

SEQ ID NO: 384965 - RNA, 18 nt, Human
gccagaccccgcagacag

SEQ ID NO: 384966 - RNA, 28 nt, Human
ggaaaaacacaguccagucagcauugaa

SEQ ID NO: 384967 - RNA, 23 nt, Human
ggagaggaguuggguuuucuuuu

SEQ ID NO: 384968 - RNA, 24 nt, Human
ggcgccagaccccgcagacagcag

SEQ ID NO: 384969 - RNA, 19 nt, Human
ggcugggggcgcgcggggc

SEQ ID NO: 384970 - RNA, 25 nt, Human
gggcgcgcggggcuacggggucugg

SEQ ID NO: 384971 - RNA, 19 nt, Human
ggggaggagaggaguuggg

SEQ ID NO: 384972 - RNA, 20 nt, Human
gggggaggagaggaguuggg

SEQ ID NO: 384973 - RNA, 22 nt, Human
gucuguuuuccccuccccgcuu

SEQ ID NO: 384974 - RNA, 21 nt, Human
guuuucguuucuccccugucc

SEQ ID NO: 384975 - RNA, 21 nt, Human
uaaacaaccagacagaggagc

SEQ ID NO: 384976 - RNA, 24 nt, Human
uaaacaaccagacagaggagcuga

SEQ ID NO: 384977 - RNA, 23 nt, Human
uaggaaaaacacaguccagucag

SEQ ID NO: 384978 - RNA, 21 nt, Human
ucaaaccacccagaagauaaa

SEQ ID NO: 384979 - RNA, 24 nt, Human
uccagucagcauugaaagaacgca

SEQ ID NO: 384980 - RNA, 25 nt, Human
uccccgcuuuccuuucguuuguuuu

SEQ ID NO: 384981 - RNA, 19 nt, Human
uccuuucguuuguuuuugg

SEQ ID NO: 384982 - RNA, 24 nt, Human
ucuguuuuccccuccccgcuuucc

SEQ ID NO: 384983 - RNA, 26 nt, Human
ugaaagaacgcagcaacggcgucgac

SEQ ID NO: 384984 - RNA, 20 nt, Human
ugagcauuacaagcacgaac

SEQ ID NO: 384985 - RNA, 27 nt, Human
ugagcauuacaagcacgaacaggaaca

SEQ ID NO: 384986 - RNA, 19 nt, Human
uggugaaugucuuagaugc

SEQ ID NO: 384987 - RNA, 24 nt, Human
ugucuuagaugccuuucccgguug

SEQ ID NO: 384988 - RNA, 30 nt, Human
uguuuuccccuccccgcuuuccuuucguuu

SEQ ID NO: 384989 - RNA, 21 nt, Human
uuaaaaacacuaucaaaccac

SEQ ID NO: 384990 - RNA, 18 nt, Human
uuugugguuuucguuucu

SEQ ID NO: 384991 - RNA, 19 nt, Human
aaaaaggaaacggcauucc

SEQ ID NO: 384992 - RNA, 21 nt, Human
aaacacuaguaagaaugugaa

SEQ ID NO: 384993 - RNA, 21 nt, Human
aaacacuaguaagaaugugaa

SEQ ID NO: 384994 - RNA, 21 nt, Human
aaacacuaguaagaaugugaa

SEQ ID NO: 384995 - RNA, 18 nt, Human
aaacagcgguuccuaaac

SEQ ID NO: 384996 - RNA, 18 nt, Human
aaacagcgguuccuaaac

SEQ ID NO: 384997 - RNA, 18 nt, Human
aaacagcgguuccuaaac

SEQ ID NO: 384998 - RNA, 21 nt, Human
aaccuggaggcucucaaaggc

SEQ ID NO: 384999 - RNA, 21 nt, Human
aaccuggaggcucucaaaggc

SEQ ID NO: 385000 - RNA, 21 nt, Human
aaccuggaggcucucaaaggc

SEQ ID NO: 385001 - RNA, 22 nt, Human
aagaaauacaaacagcgguucc

SEQ ID NO: 385002 - RNA, 22 nt, Human
aagaaauacaaacagcgguucc

SEQ ID NO: 385003 - RNA, 22 nt, Human
aagaaauacaaacagcgguucc

SEQ ID NO: 385004 - RNA, 18 nt, Human
aagaugaggcaggagggg

SEQ ID NO: 385005 - RNA, 18 nt, Human
aagaugaggcaggagggg

SEQ ID NO: 385006 - RNA, 18 nt, Human
aagaugaggcaggagggg

SEQ ID NO: 385007 - RNA, 19 nt, Human
aagcugauuucuuuccugc

SEQ ID NO: 385008 - RNA, 19 nt, Human
aagcugauuucuuuccugc

SEQ ID NO: 385009 - RNA, 19 nt, Human
aagcugauuucuuuccugc

SEQ ID NO: 385010 - RNA, 21 nt, Human
aaguauguucucaggcccucc

SEQ ID NO: 385011 - RNA, 21 nt, Human
aaguauguucucaggcccucc

SEQ ID NO: 385012 - RNA, 21 nt, Human
aaguauguucucaggcccucc

SEQ ID NO: 385013 - RNA, 19 nt, Human
acagggucugguuucuuuc

SEQ ID NO: 385014 - RNA, 19 nt, Human
acagggucugguuucuuuc

SEQ ID NO: 385015 - RNA, 19 nt, Human
acagggucugguuucuuuc

SEQ ID NO: 385016 - RNA, 24 nt, Human
acagugguggaacagaauggguac

SEQ ID NO: 385017 - RNA, 19 nt, Human
acagugucugcguuugaug

SEQ ID NO: 385018 - RNA, 19 nt, Human
acagugucugcguuugaug

SEQ ID NO: 385019 - RNA, 19 nt, Human
acagugucugcguuugaug

SEQ ID NO: 385020 - RNA, 19 nt, Human
acucgcagacaucucacuu

SEQ ID NO: 385021 - RNA, 19 nt, Human
acucgcagacaucucacuu

SEQ ID NO: 385022 - RNA, 19 nt, Human
acucgcagacaucucacuu

SEQ ID NO: 385023 - RNA, 21 nt, Human
aggagggggacgaguguagca

SEQ ID NO: 385024 - RNA, 18 nt, Human
aggcaggagggggacgag

SEQ ID NO: 385025 - RNA, 18 nt, Human
aggcaggagggggacgag

SEQ ID NO: 385026 - RNA, 18 nt, Human
aggcaggagggggacgag

SEQ ID NO: 385027 - RNA, 29 nt, Human
aggccuguuuugaggaaccuggaggcucu

SEQ ID NO: 385028 - RNA, 29 nt, Human
aggccuguuuugaggaaccuggaggcucu

SEQ ID NO: 385029 - RNA, 29 nt, Human
aggccuguuuugaggaaccuggaggcucu

SEQ ID NO: 385030 - RNA, 27 nt, Human
agggggccggggcugugaggcgagggu

SEQ ID NO: 385031 - RNA, 21 nt, Human
agggucugguuucuuucuugg

SEQ ID NO: 385032 - RNA, 21 nt, Human
agggucugguuucuuucuugg

SEQ ID NO: 385033 - RNA, 21 nt, Human
agggucugguuucuuucuugg

SEQ ID NO: 385034 - RNA, 19 nt, Human
auguucucaggcccuccau

SEQ ID NO: 385035 - RNA, 22 nt, Human
caaaaaaagaaauacaaacagc

SEQ ID NO: 385036 - RNA, 22 nt, Human
caaaaaaagaaauacaaacagc

SEQ ID NO: 385037 - RNA, 22 nt, Human
caaaaaaagaaauacaaacagc

SEQ ID NO: 385038 - RNA, 18 nt, Human
caaaggcccaccucacag

SEQ ID NO: 385039 - RNA, 18 nt, Human
caaaggcccaccucacag

SEQ ID NO: 385040 - RNA, 18 nt, Human
caaaggcccaccucacag

SEQ ID NO: 385041 - RNA, 22 nt, Human
caacagauccauaaaaaggaaa

SEQ ID NO: 385042 - RNA, 22 nt, Human
caacagauccauaaaaaggaaa

SEQ ID NO: 385043 - RNA, 22 nt, Human
caacagauccauaaaaaggaaa

SEQ ID NO: 385044 - RNA, 21 nt, Human
cacuuggggucccacgcuggg

SEQ ID NO: 385045 - RNA, 21 nt, Human
cacuuggggucccacgcuggg

SEQ ID NO: 385046 - RNA, 22 nt, Human
caggagggggacgaguguagca

SEQ ID NO: 385047 - RNA, 22 nt, Human
caggagggggacgaguguagca

SEQ ID NO: 385048 - RNA, 18 nt, Human
caggcacguggguaggca

SEQ ID NO: 385049 - RNA, 18 nt, Human
caggcacguggguaggca

SEQ ID NO: 385050 - RNA, 18 nt, Human
caggcacguggguaggca

SEQ ID NO: 385051 - RNA, 21 nt, Human
caggcccuccauucuguuccc

SEQ ID NO: 385052 - RNA, 21 nt, Human
caggcccuccauucuguuccc

SEQ ID NO: 385053 - RNA, 21 nt, Human
caggcccuccauucuguuccc

SEQ ID NO: 385054 - RNA, 22 nt, Human
cauaaaaaggaaacggcauucc

SEQ ID NO: 385055 - RNA, 22 nt, Human
cauaaaaaggaaacggcauucc

SEQ ID NO: 385056 - RNA, 19 nt, Human
cauugcacuucggauccua

SEQ ID NO: 385057 - RNA, 19 nt, Human
cauugcacuucggauccua

SEQ ID NO: 385058 - RNA, 20 nt, Human
cauugcacuucggauccuau

SEQ ID NO: 385059 - RNA, 22 nt, Human
ccaccucacagucagacaaugc

SEQ ID NO: 385060 - RNA, 23 nt, Human
cccaaaggugagccaaacacuag

SEQ ID NO: 385061 - RNA, 23 nt, Human
cccaaaggugagccaaacacuag

SEQ ID NO: 385062 - RNA, 23 nt, Human
cccaaaggugagccaaacacuag

SEQ ID NO: 385063 - RNA, 21 nt, Human
cccaacagauccauaaaaagg

SEQ ID NO: 385064 - RNA, 21 nt, Human
cccaacagauccauaaaaagg

SEQ ID NO: 385065 - RNA, 21 nt, Human
cccaacagauccauaaaaagg

SEQ ID NO: 385066 - RNA, 23 nt, Human
cccaccucacagucagacaaugc

SEQ ID NO: 385067 - RNA, 23 nt, Human
cccaccucacagucagacaaugc

SEQ ID NO: 385068 - RNA, 20 nt, Human
ccccuguuucugucguguuc

SEQ ID NO: 385069 - RNA, 20 nt, Human
ccccuguuucugucguguuc

SEQ ID NO: 385070 - RNA, 20 nt, Human
ccccuguuucugucguguuc

SEQ ID NO: 385071 - RNA, 20 nt, Human
ccugcacagggggccggggc

SEQ ID NO: 385072 - RNA, 21 nt, Human
ccugccuggucuaagggcggg

SEQ ID NO: 385073 - RNA, 21 nt, Human
ccugccuggucuaagggcggg

SEQ ID NO: 385074 - RNA, 19 nt, Human
cuccaaaaaaagaaauaca

SEQ ID NO: 385075 - RNA, 24 nt, Human
cugucguguucugaaagaccccac

SEQ ID NO: 385076 - RNA, 24 nt, Human
cugucguguucugaaagaccccac

SEQ ID NO: 385077 - RNA, 24 nt, Human
cugucguguucugaaagaccccac

SEQ ID NO: 385078 - RNA, 19 nt, Human
cuguuuugaggaaccugga

SEQ ID NO: 385079 - RNA, 19 nt, Human
cuguuuugaggaaccugga

SEQ ID NO: 385080 - RNA, 19 nt, Human
cuguuuugaggaaccugga

SEQ ID NO: 385081 - RNA, 19 nt, Human
cuuggccucgucuucacuu

SEQ ID NO: 385082 - RNA, 20 nt, Human
cuuggccucgucuucacuug

SEQ ID NO: 385083 - RNA, 20 nt, Human
cuuuccugcaggaauuccga

SEQ ID NO: 385084 - RNA, 20 nt, Human
cuuuccugcaggaauuccga

SEQ ID NO: 385085 - RNA, 20 nt, Human
cuuuccugcaggaauuccga

SEQ ID NO: 385086 - RNA, 21 nt, Human
cuuugcugcuguggagauccg

SEQ ID NO: 385087 - RNA, 20 nt, Human
cuuuguaaacuagucuuuau

SEQ ID NO: 385088 - RNA, 20 nt, Human
cuuuguaaacuagucuuuau

SEQ ID NO: 385089 - RNA, 20 nt, Human
cuuuguaaacuagucuuuau

SEQ ID NO: 385090 - RNA, 19 nt, Human
gaaccaaggcugagaagga

SEQ ID NO: 385091 - RNA, 19 nt, Human
gaaccaaggcugagaagga

SEQ ID NO: 385092 - RNA, 19 nt, Human
gaaccaaggcugagaagga

SEQ ID NO: 385093 - RNA, 19 nt, Human
gaggcaggagggggacgag

SEQ ID NO: 385094 - RNA, 19 nt, Human
gaggcgaggguggcaccug

SEQ ID NO: 385095 - RNA, 22 nt, Human
gaugaggcaggagggggacgag

SEQ ID NO: 385096 - RNA, 22 nt, Human
gaugaggcaggagggggacgag

SEQ ID NO: 385097 - RNA, 21 nt, Human
gauuucuuuccugcaggaauu

SEQ ID NO: 385098 - RNA, 22 nt, Human
gcaaaacacuguuaaaagauua

SEQ ID NO: 385099 - RNA, 22 nt, Human
gcaaaacacuguuaaaagauua

SEQ ID NO: 385100 - RNA, 22 nt, Human
gcaaaacacuguuaaaagauua

SEQ ID NO: 385101 - RNA, 21 nt, Human
gcccaccucacagucagacaa

SEQ ID NO: 385102 - RNA, 21 nt, Human
gcccaccucacagucagacaa

SEQ ID NO: 385103 - RNA, 21 nt, Human
gcccaccucacagucagacaa

SEQ ID NO: 385104 - RNA, 20 nt, Human
gccuuugcccaaaggugagc

SEQ ID NO: 385105 - RNA, 20 nt, Human
gccuuugcccaaaggugagc

SEQ ID NO: 385106 - RNA, 20 nt, Human
gccuuugcccaaaggugagc

SEQ ID NO: 385107 - RNA, 23 nt, Human
gcggaugguuucagccuuggccu

SEQ ID NO: 385108 - RNA, 23 nt, Human
gcggaugguuucagccuuggccu

SEQ ID NO: 385109 - RNA, 19 nt, Human
gcuuggaggccugguuugg

SEQ ID NO: 385110 - RNA, 23 nt, Human
ggcgaggguggcaccuggcuugg

SEQ ID NO: 385111 - RNA, 18 nt, Human
gggauuuuucucuuuuug

SEQ ID NO: 385112 - RNA, 18 nt, Human
gggauuuuucucuuuuug

SEQ ID NO: 385113 - RNA, 18 nt, Human
gggauuuuucucuuuuug

SEQ ID NO: 385114 - RNA, 25 nt, Human
ggguggcaccuggcuuggaggccug

SEQ ID NO: 385115 - RNA, 23 nt, Human
gguggcaccuggcuuggaggccu

SEQ ID NO: 385116 - RNA, 23 nt, Human
guauguucucaggcccuccauuc

SEQ ID NO: 385117 - RNA, 23 nt, Human
guauguucucaggcccuccauuc

SEQ ID NO: 385118 - RNA, 20 nt, Human
guccaaauaagaauaaugcu

SEQ ID NO: 385119 - RNA, 20 nt, Human
guccaaauaagaauaaugcu

SEQ ID NO: 385120 - RNA, 20 nt, Human
guccaaauaagaauaaugcu

SEQ ID NO: 385121 - RNA, 22 nt, Human
uaaaaaggaaacggcauuccug

SEQ ID NO: 385122 - RNA, 22 nt, Human
uaaaaaggaaacggcauuccug

SEQ ID NO: 385123 - RNA, 22 nt, Human
uaaaaaggaaacggcauuccug

SEQ ID NO: 385124 - RNA, 21 nt, Human
uacggcccugcacagggggcc

SEQ ID NO: 385125 - RNA, 23 nt, Human
ucaggaccccacuaguggccgag

SEQ ID NO: 385126 - RNA, 23 nt, Human
ucaggaccccacuaguggccgag

SEQ ID NO: 385127 - RNA, 23 nt, Human
ucaggaccccacuaguggccgag

SEQ ID NO: 385128 - RNA, 27 nt, Human
uccaaaaaaagaaauacaaacagcggu

SEQ ID NO: 385129 - RNA, 27 nt, Human
uccaaaaaaagaaauacaaacagcggu

SEQ ID NO: 385130 - RNA, 27 nt, Human
uccaaaaaaagaaauacaaacagcggu

SEQ ID NO: 385131 - RNA, 19 nt, Human
uccuggugggaggccagag

SEQ ID NO: 385132 - RNA, 19 nt, Human
uccuggugggaggccagag

SEQ ID NO: 385133 - RNA, 19 nt, Human
uccuggugggaggccagag

SEQ ID NO: 385134 - RNA, 18 nt, Human
ucuccaaaaaaagaaaua

SEQ ID NO: 385135 - RNA, 20 nt, Human
ucuccaaaaaaagaaauaca

SEQ ID NO: 385136 - RNA, 20 nt, Human
ucuccaaaaaaagaaauaca

SEQ ID NO: 385137 - RNA, 19 nt, Human
ucuuucuuggccucaggac

SEQ ID NO: 385138 - RNA, 19 nt, Human
ucuuucuuggccucaggac

SEQ ID NO: 385139 - RNA, 19 nt, Human
ucuuucuuggccucaggac

SEQ ID NO: 385140 - RNA, 22 nt, Human
ugaaaugccaaacuagaaguga

SEQ ID NO: 385141 - RNA, 22 nt, Human
ugaaaugccaaacuagaaguga

SEQ ID NO: 385142 - RNA, 22 nt, Human
ugaaaugccaaacuagaaguga

SEQ ID NO: 385143 - RNA, 18 nt, Human
ugagaaggaagaugaggc

SEQ ID NO: 385144 - RNA, 18 nt, Human
ugagaaggaagaugaggc

SEQ ID NO: 385145 - RNA, 18 nt, Human
ugagaaggaagaugaggc

SEQ ID NO: 385146 - RNA, 18 nt, Human
ugagcguggauggaacua

SEQ ID NO: 385147 - RNA, 18 nt, Human
ugagcguggauggaacua

SEQ ID NO: 385148 - RNA, 18 nt, Human
ugagcguggauggaacua

SEQ ID NO: 385149 - RNA, 23 nt, Human
ugaggaaccuggaggcucucaaa

SEQ ID NO: 385150 - RNA, 23 nt, Human
ugaggaaccuggaggcucucaaa

SEQ ID NO: 385151 - RNA, 23 nt, Human
ugaggaaccuggaggcucucaaa

SEQ ID NO: 385152 - RNA, 21 nt, Human
ugaggcaggagggggacgagu

SEQ ID NO: 385153 - RNA, 19 nt, Human
ugaggcgaggguggcaccu

SEQ ID NO: 385154 - RNA, 21 nt, Human
ugaggcgaggguggcaccugg

SEQ ID NO: 385155 - RNA, 19 nt, Human
ugccuggucuaagggcggg

SEQ ID NO: 385156 - RNA, 19 nt, Human
ugccuggucuaagggcggg

SEQ ID NO: 385157 - RNA, 19 nt, Human
ugccuggucuaagggcggg

SEQ ID NO: 385158 - RNA, 22 nt, Human
ugcuggaaugucacggugaagg

SEQ ID NO: 385159 - RNA, 22 nt, Human
ugcuggaaugucacggugaagg

SEQ ID NO: 385160 - RNA, 22 nt, Human
ugcuggaaugucacggugaagg

SEQ ID NO: 385161 - RNA, 18 nt, Human
uggaaugucacggugaag

SEQ ID NO: 385162 - RNA, 18 nt, Human
uggaaugucacggugaag

SEQ ID NO: 385163 - RNA, 18 nt, Human
uggaaugucacggugaag

SEQ ID NO: 385164 - RNA, 21 nt, Human
uggaggccugguuuggggagc

SEQ ID NO: 385165 - RNA, 23 nt, Human
uggccucaggaccccacuagugg

SEQ ID NO: 385166 - RNA, 23 nt, Human
uggccucaggaccccacuagugg

SEQ ID NO: 385167 - RNA, 23 nt, Human
uggccucaggaccccacuagugg

SEQ ID NO: 385168 - RNA, 21 nt, Human
uggcguuagucagagaacagg

SEQ ID NO: 385169 - RNA, 21 nt, Human
uggcguuagucagagaacagg

SEQ ID NO: 385170 - RNA, 21 nt, Human
uggcugggauuuuucucuuuu

SEQ ID NO: 385171 - RNA, 21 nt, Human
uggcugggauuuuucucuuuu

SEQ ID NO: 385172 - RNA, 23 nt, Human
uggcuucuuggacucuucacccu

SEQ ID NO: 385173 - RNA, 23 nt, Human
ugggggccuuugccugccugguc

SEQ ID NO: 385174 - RNA, 23 nt, Human
ugggggccuuugccugccugguc

SEQ ID NO: 385175 - RNA, 23 nt, Human
ugggggccuuugccugccugguc

SEQ ID NO: 385176 - RNA, 20 nt, Human
uggggucccacgcugggagg

SEQ ID NO: 385177 - RNA, 20 nt, Human
uggggucccacgcugggagg

SEQ ID NO: 385178 - RNA, 24 nt, Human
uggggucccacgcugggagguguc

SEQ ID NO: 385179 - RNA, 24 nt, Human
uggggucccacgcugggagguguc

SEQ ID NO: 385180 - RNA, 22 nt, Human
uggguacaggagcccuaaccug

SEQ ID NO: 385181 - RNA, 22 nt, Human
uggguacaggagcccuaaccug

SEQ ID NO: 385182 - RNA, 22 nt, Human
uggguacaggagcccuaaccug

SEQ ID NO: 385183 - RNA, 25 nt, Human
ugugaggcgaggguggcaccuggcu

SEQ ID NO: 385184 - RNA, 19 nt, Human
uuccucagguugcggaugg

SEQ ID NO: 385185 - RNA, 19 nt, Human
uuccucagguugcggaugg

SEQ ID NO: 385186 - RNA, 24 nt, Human
uuccucagguugcggaugguuuca

SEQ ID NO: 385187 - RNA, 24 nt, Human
uuccucagguugcggaugguuuca

SEQ ID NO: 385188 - RNA, 22 nt, Human
uucuuggccucaggaccccacu

SEQ ID NO: 385189 - RNA, 22 nt, Human
uucuuggccucaggaccccacu

SEQ ID NO: 385190 - RNA, 22 nt, Human
uucuuggccucaggaccccacu

SEQ ID NO: 385191 - RNA, 18 nt, Human
uugcuguacagaguuugu

SEQ ID NO: 385192 - RNA, 18 nt, Human
uugcuguacagaguuugu

SEQ ID NO: 385193 - RNA, 19 nt, Human
uuugcugcuguggagaucc

SEQ ID NO: 385194 - RNA, 20 nt, Human
aaacacccaagauggaguua

SEQ ID NO: 385195 - RNA, 23 nt, Human
aaauaccccuggcccccacccuc

SEQ ID NO: 385196 - RNA, 20 nt, Human
aacacuggacugccccaccc

SEQ ID NO: 385197 - RNA, 18 nt, Human
aacagauaaccugccccc

SEQ ID NO: 385198 - RNA, 21 nt, Human
aacagauaaccugcccccaug

SEQ ID NO: 385199 - RNA, 22 nt, Human
aaccagguggugggggggucua

SEQ ID NO: 385200 - RNA, 23 nt, Human
aaggacaggccaguggacacugg

SEQ ID NO: 385201 - RNA, 21 nt, Human
aaggccaaggaaacaccucuc

SEQ ID NO: 385202 - RNA, 23 nt, Human
acacacacgcacacacacacaca

SEQ ID NO: 385203 - RNA, 24 nt, Human
acagcccaggagccgaccuggcug

SEQ ID NO: 385204 - RNA, 23 nt, Human
acagggggaugggcccccagcgc

SEQ ID NO: 385205 - RNA, 24 nt, Human
accgcacacacacgcacacacaca

SEQ ID NO: 385206 - RNA, 21 nt, Human
accgcccuucaccgcacacac

SEQ ID NO: 385207 - RNA, 19 nt, Human
accugcucugcucugcucc

SEQ ID NO: 385208 - RNA, 24 nt, Human
acgcagagcacagagcagcacccg

SEQ ID NO: 385209 - RNA, 18 nt, Human
acggggccacuggauuca

SEQ ID NO: 385210 - RNA, 20 nt, Human
acuugguucaccacagaugg

SEQ ID NO: 385211 - RNA, 22 nt, Human
agaaacccaggcgucagggcca

SEQ ID NO: 385212 - RNA, 22 nt, Human
agaaugacaguaacacugagca

SEQ ID NO: 385213 - RNA, 26 nt, Human
agacaguccccaacacuggacugccc

SEQ ID NO: 385214 - RNA, 23 nt, Human
agagaggggacagauggggaggg

SEQ ID NO: 385215 - RNA, 22 nt, Human
agagauuaugaccuccucaggc

SEQ ID NO: 385216 - RNA, 19 nt, Human
agcaccccccauuccuggc

SEQ ID NO: 385217 - RNA, 20 nt, Human
agcgcucucccauaccuccc

SEQ ID NO: 385218 - RNA, 19 nt, Human
aggacagucugugacugcc

SEQ ID NO: 385219 - RNA, 18 nt, Human
aggagguggguggccagg

SEQ ID NO: 385220 - RNA, 24 nt, Human
aggcagaagaccugacuccugaac

SEQ ID NO: 385221 - RNA, 21 nt, Human
aggcagggccugucacaaaca

SEQ ID NO: 385222 - RNA, 20 nt, Human
agggcagcugggaggaaaag

SEQ ID NO: 385223 - RNA, 20 nt, Human
aggggacagauggggagggg

SEQ ID NO: 385224 - RNA, 24 nt, Human
aggggcuggguguggagagagggg

SEQ ID NO: 385225 - RNA, 24 nt, Human
agucgggcagccugggcuuggccc

SEQ ID NO: 385226 - RNA, 24 nt, Human
agugaucaguccuuugagagacca

SEQ ID NO: 385227 - RNA, 22 nt, Human
augaccuccucaggccccacgg

SEQ ID NO: 385228 - RNA, 20 nt, Human
caaagcccuguccuugccgc

SEQ ID NO: 385229 - RNA, 22 nt, Human
caaauaccccuggcccccaccc

SEQ ID NO: 385230 - RNA, 18 nt, Human
cacaaacacccaagaugg

SEQ ID NO: 385231 - RNA, 21 nt, Human
cacagaacuucacucugccau

SEQ ID NO: 385232 - RNA, 19 nt, Human
cacagcucaucgcuccccu

SEQ ID NO: 385233 - RNA, 24 nt, Human
cacagugggccuucuggaaggcca

SEQ ID NO: 385234 - RNA, 25 nt, Human
caccagggcuuccuccacagcucau

SEQ ID NO: 385235 - RNA, 19 nt, Human
caccccugccccgagcuac

SEQ ID NO: 385236 - RNA, 19 nt, Human
cacccgcgcggugcccccc

SEQ ID NO: 385237 - RNA, 24 nt, Human
cacccggggugagcccucuuggag

SEQ ID NO: 385238 - RNA, 22 nt, Human
cacccuaugaccaagccacggu

SEQ ID NO: 385239 - RNA, 19 nt, Human
cacucugccauaaacacuc

SEQ ID NO: 385240 - RNA, 20 nt, Human
cacuggacugccccaccccu

SEQ ID NO: 385241 - RNA, 20 nt, Human
cacugggcccguccaccacc

SEQ ID NO: 385242 - RNA, 19 nt, Human
cagaacaucucacagccuc

SEQ ID NO: 385243 - RNA, 25 nt, Human
cagaggcugaugaggcgcugggcag

SEQ ID NO: 385244 - RNA, 22 nt, Human
cagcccauggucuucccugggc

SEQ ID NO: 385245 - RNA, 24 nt, Human
cagccugggcuuggccccaccucu

SEQ ID NO: 385246 - RNA, 21 nt, Human
cagcgcucucccauaccuccc

SEQ ID NO: 385247 - RNA, 26 nt, Human
cagcgcucucccauaccucccugucc

SEQ ID NO: 385248 - RNA, 21 nt, Human
caggagcaggggcugggugug

SEQ ID NO: 385249 - RNA, 24 nt, Human
caggagcccugggucccauccaaa

SEQ ID NO: 385250 - RNA, 20 nt, Human
caggagccgaccuggcugau

SEQ ID NO: 385251 - RNA, 25 nt, Human
cagggaccacccaugcccuuggucg

SEQ ID NO: 385252 - RNA, 20 nt, Human
cagggccugucacaaacacc

SEQ ID NO: 385253 - RNA, 23 nt, Human
cagggugacagcccccagugucc

SEQ ID NO: 385254 - RNA, 24 nt, Human
caggugagggaucgccugccucuu

SEQ ID NO: 385255 - RNA, 24 nt, Human
cagugggugagggucagaacaucu

SEQ ID NO: 385256 - RNA, 22 nt, Human
cauaaaauggagacggcccuga

SEQ ID NO: 385257 - RNA, 23 nt, Human
ccaaaucucgcccuccaucucuc

SEQ ID NO: 385258 - RNA, 24 nt, Human
ccaacagauaaccugcccccaugc

SEQ ID NO: 385259 - RNA, 20 nt, Human
ccaagccacgguguagccac

SEQ ID NO: 385260 - RNA, 21 nt, Human
ccaagccacgguguagccacc

SEQ ID NO: 385261 - RNA, 19 nt, Human
ccaccaccugcucugcucu

SEQ ID NO: 385262 - RNA, 18 nt, Human
ccacccaugcccuuggua

SEQ ID NO: 385263 - RNA, 21 nt, Human
ccagggcagagucaggagccc

SEQ ID NO: 385264 - RNA, 19 nt, Human
cccaacacuggacugcccc

SEQ ID NO: 385265 - RNA, 23 nt, Human
cccaggaugagccaacucagaag

SEQ ID NO: 385266 - RNA, 21 nt, Human
cccauccaaaucucgcccucc

SEQ ID NO: 385267 - RNA, 22 nt, Human
cccaugcccagcacaggccgga

SEQ ID NO: 385268 - RNA, 19 nt, Human
ccccaccccugccccgagc

SEQ ID NO: 385269 - RNA, 20 nt, Human
ccccagcgcucucccauacc

SEQ ID NO: 385270 - RNA, 18 nt, Human
ccccaggggcuguccucu

SEQ ID NO: 385271 - RNA, 20 nt, Human
cccccgaacccugacugacc

SEQ ID NO: 385272 - RNA, 20 nt, Human
ccccgaacccugacugaccc

SEQ ID NO: 385273 - RNA, 24 nt, Human
ccccgaacccugacugaccccaga

SEQ ID NO: 385274 - RNA, 20 nt, Human
cccguccaccaccugcucug

SEQ ID NO: 385275 - RNA, 23 nt, Human
cccuccggcugaggaucaccagc

SEQ ID NO: 385276 - RNA, 18 nt, Human
cccugccccgagcuaccc

SEQ ID NO: 385277 - RNA, 21 nt, Human
cccuguccuugccgcucugcc

SEQ ID NO: 385278 - RNA, 23 nt, Human
ccgcacacacacgcacacacaca

SEQ ID NO: 385279 - RNA, 19 nt, Human
ccggggcaccgacaagggc

SEQ ID NO: 385280 - RNA, 18 nt, Human
ccucaggccccacggccc

SEQ ID NO: 385281 - RNA, 18 nt, Human
ccucaggccccacggccc

SEQ ID NO: 385282 - RNA, 19 nt, Human
ccucaggggcucuugccug

SEQ ID NO: 385283 - RNA, 21 nt, Human
ccuggcccccacccucuaggc

SEQ ID NO: 385284 - RNA, 23 nt, Human
ccugggaggggcauucccccuuu

SEQ ID NO: 385285 - RNA, 20 nt, Human
ccugggucccauccaaaucu

SEQ ID NO: 385286 - RNA, 19 nt, Human
cgaggagaaacagaugggc

SEQ ID NO: 385287 - RNA, 25 nt, Human
cggggcaccgacaagggcuggagac

SEQ ID NO: 385288 - RNA, 24 nt, Human
cuagaccucaguuuccucaaccau

SEQ ID NO: 385289 - RNA, 21 nt, Human
cucacccuaugaccaagccac

SEQ ID NO: 385290 - RNA, 18 nt, Human
cucagcaccccccauucc

SEQ ID NO: 385291 - RNA, 21 nt, Human
cuccacagcucaucgcucccc

SEQ ID NO: 385292 - RNA, 20 nt, Human
cuccugcccucacucacgcc

SEQ ID NO: 385293 - RNA, 21 nt, Human
cugcacccgcgcggugccccc

SEQ ID NO: 385294 - RNA, 21 nt, Human
cugcagcccccgaacccugac

SEQ ID NO: 385295 - RNA, 27 nt, Human
cugcaggagggcccuucuuccucccag

SEQ ID NO: 385296 - RNA, 22 nt, Human
cugcagucgggcagccugggcu

SEQ ID NO: 385297 - RNA, 22 nt, Human
cuggcuccacagugggccuucu

SEQ ID NO: 385298 - RNA, 20 nt, Human
cugggcaggucccugccaga

SEQ ID NO: 385299 - RNA, 19 nt, Human
cugggcccucucuugugcu

SEQ ID NO: 385300 - RNA, 22 nt, Human
cuuagugaccccuccuagaggc

SEQ ID NO: 385301 - RNA, 21 nt, Human
cuucccagcauuaucuggauc

SEQ ID NO: 385302 - RNA, 20 nt, Human
cuucugggcugaacccggga

SEQ ID NO: 385303 - RNA, 24 nt, Human
cuuggccccaccucuaucacuagc

SEQ ID NO: 385304 - RNA, 21 nt, Human
cuugggccaagguuagggguc

SEQ ID NO: 385305 - RNA, 19 nt, Human
gaacccugacugaccccag

SEQ ID NO: 385306 - RNA, 18 nt, Human
gaagagcacguggucugc

SEQ ID NO: 385307 - RNA, 22 nt, Human
gaagagcacguggucugcaguc

SEQ ID NO: 385308 - RNA, 19 nt, Human
gaagccccaagcgugggga

SEQ ID NO: 385309 - RNA, 24 nt, Human
gacauggggagugucaggucaagu

SEQ ID NO: 385310 - RNA, 21 nt, Human
gagaggcuuuugguggacagu

SEQ ID NO: 385311 - RNA, 24 nt, Human
gagaggcuuuugguggacaguggg

SEQ ID NO: 385312 - RNA, 19 nt, Human
gagaggggacagaugggga

SEQ ID NO: 385313 - RNA, 21 nt, Human
gagcagcacccggggugagcc

SEQ ID NO: 385314 - RNA, 20 nt, Human
gagccucaguuucccuucug

SEQ ID NO: 385315 - RNA, 21 nt, Human
gagccucaguuucccuucugg

SEQ ID NO: 385316 - RNA, 20 nt, Human
gaggggcgggggcaggcggu

SEQ ID NO: 385317 - RNA, 21 nt, Human
gaguugggccugggguucccc

SEQ ID NO: 385318 - RNA, 21 nt, Human
gaucugucuuucccaccauuc

SEQ ID NO: 385319 - RNA, 19 nt, Human
gauucugggcaaguaaucu

SEQ ID NO: 385320 - RNA, 20 nt, Human
gcagcugggaggaaaaggga

SEQ ID NO: 385321 - RNA, 20 nt, Human
gcaggguccagcugcaggag

SEQ ID NO: 385322 - RNA, 20 nt, Human
gcaguaacgcugcgggaggg

SEQ ID NO: 385323 - RNA, 19 nt, Human
gcaguacccugaggucucc

SEQ ID NO: 385324 - RNA, 24 nt, Human
gccacacuucccagcauuaucugg

SEQ ID NO: 385325 - RNA, 18 nt, Human
gcccaggagccgaccugg

SEQ ID NO: 385326 - RNA, 21 nt, Human
gcccauggucuucccugggcc

SEQ ID NO: 385327 - RNA, 22 nt, Human
gccccgagcuacccuggaccuc

SEQ ID NO: 385328 - RNA, 19 nt, Human
gcugcagcccccgaacccu

SEQ ID NO: 385329 - RNA, 21 nt, Human
gcuggcuggcacccgaggaga

SEQ ID NO: 385330 - RNA, 23 nt, Human
ggaaagcuuugggagcaagggag

SEQ ID NO: 385331 - RNA, 18 nt, Human
ggaagagugagggauucu

SEQ ID NO: 385332 - RNA, 19 nt, Human
ggaagggcuucugggcuga

SEQ ID NO: 385333 - RNA, 18 nt, Human
ggaccacccaugcccuug

SEQ ID NO: 385334 - RNA, 23 nt, Human
ggagccacccugcaggguccagc

SEQ ID NO: 385335 - RNA, 19 nt, Human
ggaggccaagggccagggg

SEQ ID NO: 385336 - RNA, 20 nt, Human
ggagguggguggccagggaa

SEQ ID NO: 385337 - RNA, 20 nt, Human
ggauguggguggagggaccc

SEQ ID NO: 385338 - RNA, 25 nt, Human
ggcaggagcaggggcugggugugga

SEQ ID NO: 385339 - RNA, 24 nt, Human
ggcaguacccugaggucuccuagu

SEQ ID NO: 385340 - RNA, 23 nt, Human
ggccaagguuaggggucucccag

SEQ ID NO: 385341 - RNA, 21 nt, Human
ggccccacggcccucuuuggg

SEQ ID NO: 385342 - RNA, 21 nt, Human
ggcuuugaagaucaagaauca

SEQ ID NO: 385343 - RNA, 23 nt, Human
gggaagccccaagcguggggaug

SEQ ID NO: 385344 - RNA, 19 nt, Human
gggaggucacaagggcagg

SEQ ID NO: 385345 - RNA, 23 nt, Human
gggccagggguaggaccaggggg

SEQ ID NO: 385346 - RNA, 19 nt, Human
gggcuucugggcugaaccc

SEQ ID NO: 385347 - RNA, 24 nt, Human
gggcuucugggcugaacccgggaa

SEQ ID NO: 385348 - RNA, 18 nt, Human
ggggagggcagcugggag

SEQ ID NO: 385349 - RNA, 18 nt, Human
ggggauggggggauggug

SEQ ID NO: 385350 - RNA, 19 nt, Human
ggggauggggggauggugg

SEQ ID NO: 385351 - RNA, 21 nt, Human
ggggcuguccccaggggagga

SEQ ID NO: 385352 - RNA, 27 nt, Human
ggggcuguccucugccaacagaaggag

SEQ ID NO: 385353 - RNA, 22 nt, Human
gguaggagguggguggccaggg

SEQ ID NO: 385354 - RNA, 24 nt, Human
guaggaccagggggaugugggugg

SEQ ID NO: 385355 - RNA, 19 nt, Human
gucccuucucccauaaacu

SEQ ID NO: 385356 - RNA, 25 nt, Human
gucugugggacacgcagagcacaga

SEQ ID NO: 385357 - RNA, 20 nt, Human
gugaaaccuuuuuuccuggg

SEQ ID NO: 385358 - RNA, 23 nt, Human
uaacugcugagugaguaagcagg

SEQ ID NO: 385359 - RNA, 21 nt, Human
uaccaccagggcuuccuccac

SEQ ID NO: 385360 - RNA, 18 nt, Human
uaccccagacucugccga

SEQ ID NO: 385361 - RNA, 21 nt, Human
uaccccuggcccccacccucu

SEQ ID NO: 385362 - RNA, 21 nt, Human
uacccugaggucuccuagugc

SEQ ID NO: 385363 - RNA, 22 nt, Human
uaccggacagaguugggccugg

SEQ ID NO: 385364 - RNA, 22 nt, Human
uacguagacaguccccaacacu

SEQ ID NO: 385365 - RNA, 23 nt, Human
uagaugggggauggggggauggu

SEQ ID NO: 385366 - RNA, 24 nt, Human
uagccccucaacugcgacaccccc

SEQ ID NO: 385367 - RNA, 18 nt, Human
uagggaggcuggcuccac

SEQ ID NO: 385368 - RNA, 21 nt, Human
ucaccacccaugcccagcaca

SEQ ID NO: 385369 - RNA, 22 nt, Human
ucacccucucucaucuccaucc

SEQ ID NO: 385370 - RNA, 22 nt, Human
uccaaaucucgcccuccaucuc

SEQ ID NO: 385371 - RNA, 21 nt, Human
uccacggccacagcccaggag

SEQ ID NO: 385372 - RNA, 22 nt, Human
uccacggccacagcccaggagc

SEQ ID NO: 385373 - RNA, 19 nt, Human
uccagcugcaggagggccc

SEQ ID NO: 385374 - RNA, 21 nt, Human
uccagggcagagucaggagcc

SEQ ID NO: 385375 - RNA, 19 nt, Human
ucccauaccucccuguccc

SEQ ID NO: 385376 - RNA, 18 nt, Human
ucccugggccucccaugc

SEQ ID NO: 385377 - RNA, 23 nt, Human
uccuccucuuucccuuaacucug

SEQ ID NO: 385378 - RNA, 22 nt, Human
ucgagacuuaaccagguggugg

SEQ ID NO: 385379 - RNA, 24 nt, Human
ucgaggcaccugcugggcagcugg

SEQ ID NO: 385380 - RNA, 22 nt, Human
ucuccacggccacagcccagga

SEQ ID NO: 385381 - RNA, 21 nt, Human
ucucccauaaacuccugggag

SEQ ID NO: 385382 - RNA, 25 nt, Human
ucugcagucgggcagccugggcuug

SEQ ID NO: 385383 - RNA, 18 nt, Human
ucugggcugaacccggga

SEQ ID NO: 385384 - RNA, 22 nt, Human
ucuuagaugggggaugggggga

SEQ ID NO: 385385 - RNA, 20 nt, Human
ugaagagcccaccuugugca

SEQ ID NO: 385386 - RNA, 21 nt, Human
ugaaugcaaauaccccuggcc

SEQ ID NO: 385387 - RNA, 18 nt, Human
ugacaguaacacugagca

SEQ ID NO: 385388 - RNA, 19 nt, Human
ugaccuccucaggccccac

SEQ ID NO: 385389 - RNA, 21 nt, Human
ugacucagcaccccccauucc

SEQ ID NO: 385390 - RNA, 19 nt, Human
ugacuccugaaccucuccc

SEQ ID NO: 385391 - RNA, 20 nt, Human
ugacuccugaaccucucccu

SEQ ID NO: 385392 - RNA, 18 nt, Human
ugacugaccccagaugag

SEQ ID NO: 385393 - RNA, 19 nt, Human
ugagagaccacgaaggggu

SEQ ID NO: 385394 - RNA, 23 nt, Human
ugagaggagaggugacauagugu

SEQ ID NO: 385395 - RNA, 20 nt, Human
ugagaugacucagcaccccc

SEQ ID NO: 385396 - RNA, 20 nt, Human
ugagcccucuuggaggaggc

SEQ ID NO: 385397 - RNA, 22 nt, Human
ugagggccccaaggccucccag

SEQ ID NO: 385398 - RNA, 20 nt, Human
ugaguaagcaggugagggaa

SEQ ID NO: 385399 - RNA, 18 nt, Human
ugcagcagaaucagggug

SEQ ID NO: 385400 - RNA, 19 nt, Human
ugcagcagaaucagggugu

SEQ ID NO: 385401 - RNA, 26 nt, Human
ugcagucgggcagccugggcuuggcc

SEQ ID NO: 385402 - RNA, 18 nt, Human
ugccacacucuccccuac

SEQ ID NO: 385403 - RNA, 18 nt, Human
ugccacggggccacugga

SEQ ID NO: 385404 - RNA, 21 nt, Human
ugcccaggaugagccaacuca

SEQ ID NO: 385405 - RNA, 21 nt, Human
ugcccugggauauacuugcac

SEQ ID NO: 385406 - RNA, 21 nt, Human
ugccgcucugccucccauagg

SEQ ID NO: 385407 - RNA, 23 nt, Human
ugccuaggguggcaggcagggcc

SEQ ID NO: 385408 - RNA, 18 nt, Human
ugccucaggggcucuugc

SEQ ID NO: 385409 - RNA, 18 nt, Human
ugccucaggggcucuugc

SEQ ID NO: 385410 - RNA, 20 nt, Human
ugcugagugaguaagcaggu

SEQ ID NO: 385411 - RNA, 20 nt, Human
ugcugagugaguaagcaggu

SEQ ID NO: 385412 - RNA, 22 nt, Human
ugcugggcagcuggggccaaga

SEQ ID NO: 385413 - RNA, 20 nt, Human
uggaagggcuucugggcuga

SEQ ID NO: 385414 - RNA, 21 nt, Human
uggagagaggggacagauggg

SEQ ID NO: 385415 - RNA, 23 nt, Human
uggaggaggccaagggccagggg

SEQ ID NO: 385416 - RNA, 19 nt, Human
uggccagggaagagcacgu

SEQ ID NO: 385417 - RNA, 20 nt, Human
ugggcagcuggggccaagaa

SEQ ID NO: 385418 - RNA, 20 nt, Human
ugggcaguacccugaggucu

SEQ ID NO: 385419 - RNA, 19 nt, Human
ugggcugaacccgggaaga

SEQ ID NO: 385420 - RNA, 20 nt, Human
uggggaggggcgggggcagg

SEQ ID NO: 385421 - RNA, 20 nt, Human
ugggggcccaggauggggac

SEQ ID NO: 385422 - RNA, 19 nt, Human
uggguucugagucuucacu

SEQ ID NO: 385423 - RNA, 29 nt, Human
uggguucugagucuucacuuuauuacuau

SEQ ID NO: 385424 - RNA, 19 nt, Human
ugucaccagaagucaccac

SEQ ID NO: 385425 - RNA, 20 nt, Human
ugucauaaaggagggugcca

SEQ ID NO: 385426 - RNA, 19 nt, Human
ugugaaaccuuuuuuccug

SEQ ID NO: 385427 - RNA, 22 nt, Human
uguggacagagccccuucuccg

SEQ ID NO: 385428 - RNA, 19 nt, Human
uguggagagaggggacaga

SEQ ID NO: 385429 - RNA, 25 nt, Human
uucacuuuauuacuaugucaccgcu

SEQ ID NO: 385430 - RNA, 21 nt, Human
uucuccggauuggaaaaugaa

SEQ ID NO: 385431 - RNA, 19 nt, Human
uugccugugucauccuggg

SEQ ID NO: 385432 - RNA, 23 nt, Human
uuuccugggaggucacaagggca

SEQ ID NO: 385433 - RNA, 18 nt, Human
uuugccacucacucaccg

SEQ ID NO: 385434 - RNA, 24 nt, Human
aaagcgaggaaaaacacuagcuaa

SEQ ID NO: 385435 - RNA, 20 nt, Human
aacaggugaaagagaggggc

SEQ ID NO: 385436 - RNA, 21 nt, Human
aaccugagugaggacacaaga

SEQ ID NO: 385437 - RNA, 22 nt, Human
agauaauagcggcucccacggc

SEQ ID NO: 385438 - RNA, 22 nt, Human
aggauggaacaggugaaagaga

SEQ ID NO: 385439 - RNA, 21 nt, Human
aggggaagcaaaccugaguga

SEQ ID NO: 385440 - RNA, 22 nt, Human
aggggcuggcaguuccaggagg

SEQ ID NO: 385441 - RNA, 19 nt, Human
aguuccaggaggcucaugg

SEQ ID NO: 385442 - RNA, 24 nt, Human
caaggaggaagugccaugagcacc

SEQ ID NO: 385443 - RNA, 18 nt, Human
caccagccccgcccucac

SEQ ID NO: 385444 - RNA, 19 nt, Human
caccccugcccuccccagg

SEQ ID NO: 385445 - RNA, 22 nt, Human
caccccugcccuccccaggcuu

SEQ ID NO: 385446 - RNA, 24 nt, Human
caccccugcccuccccaggcuucc

SEQ ID NO: 385447 - RNA, 21 nt, Human
cacgggaggcagcccagaggc

SEQ ID NO: 385448 - RNA, 19 nt, Human
cacucggcacagacagagu

SEQ ID NO: 385449 - RNA, 25 nt, Human
cagcaucccaggccgggcaucuccc

SEQ ID NO: 385450 - RNA, 18 nt, Human
cagccccgcccucacacc

SEQ ID NO: 385451 - RNA, 20 nt, Human
cagccccgcccucacaccac

SEQ ID NO: 385452 - RNA, 21 nt, Human
cagggugguggcccccagauc

SEQ ID NO: 385453 - RNA, 22 nt, Human
caugagcaccagccccgcccuc

SEQ ID NO: 385454 - RNA, 23 nt, Human
ccaggccgggcaucucccccacg

SEQ ID NO: 385455 - RNA, 22 nt, Human
ccauggggcaccccugcccucc

SEQ ID NO: 385456 - RNA, 18 nt, Human
cccacggccugacccggg

SEQ ID NO: 385457 - RNA, 22 nt, Human
ccccugcccuccccaggcuucc

SEQ ID NO: 385458 - RNA, 24 nt, Human
cccgggccggggggaagcugaggc

SEQ ID NO: 385459 - RNA, 24 nt, Human
cccugcccuccccaggcuuccuaa

SEQ ID NO: 385460 - RNA, 18 nt, Human
ccgccgcugccgccgccg

SEQ ID NO: 385461 - RNA, 24 nt, Human
ccgucgccgccgcugccgccgccg

SEQ ID NO: 385462 - RNA, 18 nt, Human
ccucucugucccccuucc

SEQ ID NO: 385463 - RNA, 18 nt, Human
ccugcugccagggguggg

SEQ ID NO: 385464 - RNA, 20 nt, Human
cggcucccacggccugaccc

SEQ ID NO: 385465 - RNA, 21 nt, Human
cucacaccacgggaggcagcc

SEQ ID NO: 385466 - RNA, 27 nt, Human
cucacaccacgggaggcagcccagagg

SEQ ID NO: 385467 - RNA, 26 nt, Human
cuccccaggcuuccuaaguaacaacu

SEQ ID NO: 385468 - RNA, 19 nt, Human
gacugaagcccucugggca

SEQ ID NO: 385469 - RNA, 21 nt, Human
gagaacgcagauaauagcggc

SEQ ID NO: 385470 - RNA, 22 nt, Human
gaggggcuggcaguuccaggag

SEQ ID NO: 385471 - RNA, 23 nt, Human
gcagcccagaggccaccggcaca

SEQ ID NO: 385472 - RNA, 21 nt, Human
gcaguuccaggaggcucaugg

SEQ ID NO: 385473 - RNA, 21 nt, Human
gccccgcccucacaccacggg

SEQ ID NO: 385474 - RNA, 23 nt, Human
ggaaaguccagggcagaggggag

SEQ ID NO: 385475 - RNA, 18 nt, Human
ggcagaggggagggcccu

SEQ ID NO: 385476 - RNA, 18 nt, Human
gggaaaguccagggcaga

SEQ ID NO: 385477 - RNA, 21 nt, Human
gggcacaggcacuuggggugu

SEQ ID NO: 385478 - RNA, 22 nt, Human
gggcaggugugauggcccccac

SEQ ID NO: 385479 - RNA, 22 nt, Human
ggggaagcugaggcacuuguca

SEQ ID NO: 385480 - RNA, 22 nt, Human
ucaggcaaagcccuucccugcu

SEQ ID NO: 385481 - RNA, 21 nt, Human
ucccacggccugacccgggcc

SEQ ID NO: 385482 - RNA, 23 nt, Human
uccccaggcuuccuaaguaacaa

SEQ ID NO: 385483 - RNA, 23 nt, Human
ucccugcugccaggggugggagc

SEQ ID NO: 385484 - RNA, 22 nt, Human
ucgccgccgcugccgccgccgc

SEQ ID NO: 385485 - RNA, 24 nt, Human
ucgccgucgccgccgcugccgccg

SEQ ID NO: 385486 - RNA, 20 nt, Human
ucugccagcccccgccaggc

SEQ ID NO: 385487 - RNA, 23 nt, Human
ugaggacacaagagccugguccg

SEQ ID NO: 385488 - RNA, 19 nt, Human
ugcaggcggggcugagguc

SEQ ID NO: 385489 - RNA, 19 nt, Human
ugccaugagcaccagcccc

SEQ ID NO: 385490 - RNA, 20 nt, Human
ugcccuggaggagugagcgg

SEQ ID NO: 385491 - RNA, 22 nt, Human
ugcccuggaggagugagcggcu

SEQ ID NO: 385492 - RNA, 26 nt, Human
uggaacaggugaaagagaggggcugg

SEQ ID NO: 385493 - RNA, 19 nt, Human
uggcccccacgagucuuug

SEQ ID NO: 385494 - RNA, 21 nt, Human
ugggcaccugcuggcuucuag

SEQ ID NO: 385495 - RNA, 22 nt, Human
ugggcaccugcuggcuucuagc

SEQ ID NO: 385496 - RNA, 22 nt, Human
ugucaggcaaagcccuucccug

SEQ ID NO: 385497 - RNA, 19 nt, Human
ugucaguagcacaugggca

SEQ ID NO: 385498 - RNA, 22 nt, Human
ugugauggcccccacgagucuu

SEQ ID NO: 385499 - RNA, 23 nt, Human
uuuauaauacacucggcacagac

SEQ ID NO: 385500 - RNA, 21 nt, Human
acccccucuuggccccggaug

SEQ ID NO: 385501 - RNA, 21 nt, Human
accuugugccuuccuggccag

SEQ ID NO: 385502 - RNA, 21 nt, Human
agaaacgagacagucacuacc

SEQ ID NO: 385503 - RNA, 20 nt, Human
agagagaggagcagcuugug

SEQ ID NO: 385504 - RNA, 21 nt, Human
agcagccugugagagaaagug

SEQ ID NO: 385505 - RNA, 25 nt, Human
agcggccaccuacucuguccgcggc

SEQ ID NO: 385506 - RNA, 20 nt, Human
agcuaugcagagggacucca

SEQ ID NO: 385507 - RNA, 27 nt, Human
aggagcagcuuguggaguacuaggagg

SEQ ID NO: 385508 - RNA, 19 nt, Human
aggcagggacugggccagg

SEQ ID NO: 385509 - RNA, 18 nt, Human
agggacugggccaggaag

SEQ ID NO: 385510 - RNA, 26 nt, Human
agggacugggggaacuuggcaggggc

SEQ ID NO: 385511 - RNA, 22 nt, Human
agguggagaggcagggacuggg

SEQ ID NO: 385512 - RNA, 19 nt, Human
agucggaacaugggacacu

SEQ ID NO: 385513 - RNA, 19 nt, Human
aguggagaguggcuccgga

SEQ ID NO: 385514 - RNA, 19 nt, Human
aucacaacacugacagggc

SEQ ID NO: 385515 - RNA, 19 nt, Human
cacugagcuggaaggaccc

SEQ ID NO: 385516 - RNA, 25 nt, Human
caggaagccaagguaaagggaacca

SEQ ID NO: 385517 - RNA, 19 nt, Human
caggugcugagggacuggg

SEQ ID NO: 385518 - RNA, 21 nt, Human
caucuuguggggcacgguggc

SEQ ID NO: 385519 - RNA, 23 nt, Human
ccagaaccacccacaccugggca

SEQ ID NO: 385520 - RNA, 19 nt, Human
ccaggcauccuucuccucu

SEQ ID NO: 385521 - RNA, 24 nt, Human
cccagacacgcggguccacccccu

SEQ ID NO: 385522 - RNA, 19 nt, Human
cccccaaccccagagugag

SEQ ID NO: 385523 - RNA, 25 nt, Human
ccccgcuuuguccugggcagccccu

SEQ ID NO: 385524 - RNA, 20 nt, Human
ccccugcccccgcuuugucc

SEQ ID NO: 385525 - RNA, 20 nt, Human
ccccugcccccgcuuugucc

SEQ ID NO: 385526 - RNA, 20 nt, Human
ccgaggccgcugccucgugc

SEQ ID NO: 385527 - RNA, 19 nt, Human
ccguccggccggccccgcc

SEQ ID NO: 385528 - RNA, 18 nt, Human
ccugcugaggggcuuguc

SEQ ID NO: 385529 - RNA, 19 nt, Human
ccuggcacccaggcauccu

SEQ ID NO: 385530 - RNA, 20 nt, Human
ccuggcgccuucuguccgcc

SEQ ID NO: 385531 - RNA, 23 nt, Human
cguagagggcagcuggaccccca

SEQ ID NO: 385532 - RNA, 19 nt, Human
cucuccuggcaaggucuua

SEQ ID NO: 385533 - RNA, 19 nt, Human
cugaagggcuaggacaggg

SEQ ID NO: 385534 - RNA, 23 nt, Human
cuggaccaugaucacaacacuga

SEQ ID NO: 385535 - RNA, 23 nt, Human
cuggagccucugggccucucucc

SEQ ID NO: 385536 - RNA, 25 nt, Human
cuggagccucugggccucucuccug

SEQ ID NO: 385537 - RNA, 21 nt, Human
cuggggccugcguuggugggg

SEQ ID NO: 385538 - RNA, 25 nt, Human
gaaaauacacaaucucuggucuuuc

SEQ ID NO: 385539 - RNA, 21 nt, Human
gaacaugggacacugaaaaua

SEQ ID NO: 385540 - RNA, 23 nt, Human
gaccaugaucacaacacugaccg

SEQ ID NO: 385541 - RNA, 20 nt, Human
gaccaugaucacaacacugg

SEQ ID NO: 385542 - RNA, 23 nt, Human
gacccaagggaggucccggagac

SEQ ID NO: 385543 - RNA, 21 nt, Human
gagccucugggccucucuccu

SEQ ID NO: 385544 - RNA, 20 nt, Human
gaugggaacaguggccagga

SEQ ID NO: 385545 - RNA, 22 nt, Human
gcccgaggccgcugccucgugc

SEQ ID NO: 385546 - RNA, 19 nt, Human
gcccuggucugugccugcc

SEQ ID NO: 385547 - RNA, 20 nt, Human
gccuuggagcccuggucugu

SEQ ID NO: 385548 - RNA, 24 nt, Human
gcuggugucuuggcccacagcuac

SEQ ID NO: 385549 - RNA, 21 nt, Human
ggaaagccuuccccaggccag

SEQ ID NO: 385550 - RNA, 24 nt, Human
ggacugggccaggaagccaaggua

SEQ ID NO: 385551 - RNA, 19 nt, Human
ggagagggagagagugaua

SEQ ID NO: 385552 - RNA, 19 nt, Human
ggcaaggucuuacugaagg

SEQ ID NO: 385553 - RNA, 19 nt, Human
ggccucucuccugcugagg

SEQ ID NO: 385554 - RNA, 24 nt, Human
ggccuuggagcccuggucugugcc

SEQ ID NO: 385555 - RNA, 24 nt, Human
gggaggucccggagacccuggggc

SEQ ID NO: 385556 - RNA, 26 nt, Human
gggcaggggccggggccacagagaga

SEQ ID NO: 385557 - RNA, 23 nt, Human
gggccggggccacagagagagga

SEQ ID NO: 385558 - RNA, 19 nt, Human
ggggaacuuggcaggggca

SEQ ID NO: 385559 - RNA, 20 nt, Human
ggguggccuuggagcccugg

SEQ ID NO: 385560 - RNA, 22 nt, Human
gguggagaggcagggacugggc

SEQ ID NO: 385561 - RNA, 19 nt, Human
gucagcucaguuacagucu

SEQ ID NO: 385562 - RNA, 26 nt, Human
guggccuuggagcccuggucugugcc

SEQ ID NO: 385563 - RNA, 18 nt, Human
uauccccuucucaggacc

SEQ ID NO: 385564 - RNA, 21 nt, Human
ucaggaccucaguccuggggc

SEQ ID NO: 385565 - RNA, 19 nt, Human
ucaggagagggagagagug

SEQ ID NO: 385566 - RNA, 21 nt, Human
ucaguccuggggccaggugcu

SEQ ID NO: 385567 - RNA, 21 nt, Human
uccccaggccaguccauucca

SEQ ID NO: 385568 - RNA, 22 nt, Human
uccccagucuuggggcgagggu

SEQ ID NO: 385569 - RNA, 22 nt, Human
ucuaggcuacaauguaacaagg

SEQ ID NO: 385570 - RNA, 22 nt, Human
ucuccuggcaaggucuuacuga

SEQ ID NO: 385571 - RNA, 23 nt, Human
ucuguccgcggcacugagcugga

SEQ ID NO: 385572 - RNA, 18 nt, Human
ugagagaaaguggagagu

SEQ ID NO: 385573 - RNA, 18 nt, Human
ugagcuggaaggacccaa

SEQ ID NO: 385574 - RNA, 20 nt, Human
ugaguagucagcuaugcaga

SEQ ID NO: 385575 - RNA, 22 nt, Human
ugcagagggacuccaaccuggg

SEQ ID NO: 385576 - RNA, 18 nt, Human
uggagaguggcuccggac

SEQ ID NO: 385577 - RNA, 19 nt, Human
uggagcccuggucugugcc

SEQ ID NO: 385578 - RNA, 20 nt, Human
uggagcccuggucugugccu

SEQ ID NO: 385579 - RNA, 21 nt, Human
uggagcccuggucugugccug

SEQ ID NO: 385580 - RNA, 20 nt, Human
ugggaugggaacaguggcca

SEQ ID NO: 385581 - RNA, 18 nt, Human
ugggcuguucuagcagcc

SEQ ID NO: 385582 - RNA, 19 nt, Human
uguggcaaccacguuuggu

SEQ ID NO: 385583 - RNA, 22 nt, Human
uguucacuuaaauauccacaca

SEQ ID NO: 385584 - RNA, 23 nt, Human
uuccccugcccccgcuuuguccu

SEQ ID NO: 385585 - RNA, 21 nt, Human
uuggagcccuggucugugccu

SEQ ID NO: 385586 - RNA, 22 nt, Human
uuggagcccuggucugugccug

SEQ ID NO: 385587 - RNA, 22 nt, Human
uuuuuuuuuuuuuuuuucacag

SEQ ID NO: 385588 - RNA, 23 nt, Human
uuuuuuuuuuuuuuuuucacagu

SEQ ID NO: 385589 - RNA, 20 nt, Human
aggcagcccucuuccuccgg

SEQ ID NO: 385590 - RNA, 22 nt, Human
aaaacuuaaguaaaaagagcau

SEQ ID NO: 385591 - RNA, 18 nt, Human
aaaaggcuagaugcagug

SEQ ID NO: 385592 - RNA, 31 nt, Human
aacaaaugugcacacacacacacacacacag

SEQ ID NO: 385593 - RNA, 21 nt, Human
aacuagaaauaaaucuuuagc

SEQ ID NO: 385594 - RNA, 18 nt, Human
aagggaauggcaguauug

SEQ ID NO: 385595 - RNA, 22 nt, Human
aauauaagagugaagccauuau

SEQ ID NO: 385596 - RNA, 22 nt, Human
acaaaaugcuguguuccacccc

SEQ ID NO: 385597 - RNA, 23 nt, Human
acacacacacacacacacacaca

SEQ ID NO: 385598 - RNA, 23 nt, Human
acacacacacacacacacacaca

SEQ ID NO: 385599 - RNA, 23 nt, Human
acacacacacacacacacacaca

SEQ ID NO: 385600 - RNA, 23 nt, Human
acacacacacacacacacacaca

SEQ ID NO: 385601 - RNA, 23 nt, Human
acacacacacacacacacacaca

SEQ ID NO: 385602 - RNA, 23 nt, Human
acacacacacacacacacacaca

SEQ ID NO: 385603 - RNA, 23 nt, Human
acacacacacacacacacacaca

SEQ ID NO: 385604 - RNA, 23 nt, Human
acacacacacacacacacacaca

SEQ ID NO: 385605 - RNA, 20 nt, Human
acuagaaauaaaucuuuagc

SEQ ID NO: 385606 - RNA, 22 nt, Human
acuauaugggcaaaugcagaaa

SEQ ID NO: 385607 - RNA, 21 nt, Human
agacugaacaugaggccaaug

SEQ ID NO: 385608 - RNA, 25 nt, Human
agcacacacggcagucacaguguac

SEQ ID NO: 385609 - RNA, 18 nt, Human
agcuucuucucccccauc

SEQ ID NO: 385610 - RNA, 21 nt, Human
aggaaacuacgggucuaagca

SEQ ID NO: 385611 - RNA, 23 nt, Human
agugucauuuacuacauaauaac

SEQ ID NO: 385612 - RNA, 18 nt, Human
aucagcucuccuauaucu

SEQ ID NO: 385613 - RNA, 21 nt, Human
augggcaaaugcagaaaggcu

SEQ ID NO: 385614 - RNA, 25 nt, Human
augugcacacacacacacacacagu

SEQ ID NO: 385615 - RNA, 20 nt, Human
auuacugagguauuuacaga

SEQ ID NO: 385616 - RNA, 25 nt, Human
caaauacacaaacuagaaauaaauc

SEQ ID NO: 385617 - RNA, 20 nt, Human
caaaugugcacacacacaca

SEQ ID NO: 385618 - RNA, 20 nt, Human
caauauuucauaaauguuga

SEQ ID NO: 385619 - RNA, 20 nt, Human
cacacacacacacacacaca

SEQ ID NO: 385620 - RNA, 20 nt, Human
cacacacacacacacacaca

SEQ ID NO: 385621 - RNA, 20 nt, Human
cacacacacacacacacaca

SEQ ID NO: 385622 - RNA, 20 nt, Human
cacacacacacacacacaca

SEQ ID NO: 385623 - RNA, 20 nt, Human
cacacacacacacacacaca

SEQ ID NO: 385624 - RNA, 20 nt, Human
cacacacacacacacacaca

SEQ ID NO: 385625 - RNA, 20 nt, Human
cacacacacacacacacaca

SEQ ID NO: 385626 - RNA, 20 nt, Human
cacacacacacacacacaca

SEQ ID NO: 385627 - RNA, 20 nt, Human
cacacacacacacacacaca

SEQ ID NO: 385628 - RNA, 20 nt, Human
cacacacacacacacacaca

SEQ ID NO: 385629 - RNA, 20 nt, Human
cacacacacacacacacaca

SEQ ID NO: 385630 - RNA, 20 nt, Human
cacacacacacacacacaca

SEQ ID NO: 385631 - RNA, 20 nt, Human
cacacacacacacacacaca

SEQ ID NO: 385632 - RNA, 22 nt, Human
cacacacacacacacacacaca

SEQ ID NO: 385633 - RNA, 22 nt, Human
cacacacacacacacacacaca

SEQ ID NO: 385634 - RNA, 22 nt, Human
cacacacacacacacacacaca

SEQ ID NO: 385635 - RNA, 22 nt, Human
cacacacacacacacacacaca

SEQ ID NO: 385636 - RNA, 22 nt, Human
cacacacacacacacacacaca

SEQ ID NO: 385637 - RNA, 22 nt, Human
cacacacacacacacacacaca

SEQ ID NO: 385638 - RNA, 26 nt, Human
cacacacacacacacacacacacaca

SEQ ID NO: 385639 - RNA, 26 nt, Human
cacacacacacacacacacacacaca

SEQ ID NO: 385640 - RNA, 26 nt, Human
cacacacacacacacacacacacaca

SEQ ID NO: 385641 - RNA, 26 nt, Human
cacacacacacacacacacacacaca

SEQ ID NO: 385642 - RNA, 26 nt, Human
cacacacacacacacacacacacaca

SEQ ID NO: 385643 - RNA, 26 nt, Human
cacacacacacacacacacacacaca

SEQ ID NO: 385644 - RNA, 26 nt, Human
cacacacacacacacacacacacaca

SEQ ID NO: 385645 - RNA, 26 nt, Human
cacacacacacacacacacacacacg

SEQ ID NO: 385646 - RNA, 27 nt, Human
cacacacacacacacacacacacggaa

SEQ ID NO: 385647 - RNA, 24 nt, Human
cacacacacacacacggaacaccu

SEQ ID NO: 385648 - RNA, 21 nt, Human
cacagauuguuguguuaaaaa

SEQ ID NO: 385649 - RNA, 18 nt, Human
cacagugcuugacaaaau

SEQ ID NO: 385650 - RNA, 21 nt, Human
cacggcagucacaguguacac

SEQ ID NO: 385651 - RNA, 21 nt, Human
caguagaagggaauggcagua

SEQ ID NO: 385652 - RNA, 26 nt, Human
cauaauaacauugaaaacguuuaaaa

SEQ ID NO: 385653 - RNA, 18 nt, Human
cauacaaauacacaaacu

SEQ ID NO: 385654 - RNA, 19 nt, Human
ccacugaggaaacuacggg

SEQ ID NO: 385655 - RNA, 24 nt, Human
cccaaacaaaugugcacacacaca

SEQ ID NO: 385656 - RNA, 19 nt, Human
cccuuagcuucuucucccc

SEQ ID NO: 385657 - RNA, 21 nt, Human
cucagaucaugcuauuuugcc

SEQ ID NO: 385658 - RNA, 18 nt, Human
cucccccauccccaaaca

SEQ ID NO: 385659 - RNA, 21 nt, Human
cugaauugguccuuuguaaug

SEQ ID NO: 385660 - RNA, 22 nt, Human
cuucauaauagugucauuuacu

SEQ ID NO: 385661 - RNA, 26 nt, Human
cuuccacgaaaugguugucuaccaua

SEQ ID NO: 385662 - RNA, 19 nt, Human
gaagggaauggcaguauug

SEQ ID NO: 385663 - RNA, 24 nt, Human
ggaaaaaugaaaggacccauauua

SEQ ID NO: 385664 - RNA, 22 nt, Human
ggccuggaaauuaaaauggauc

SEQ ID NO: 385665 - RNA, 24 nt, Human
ggcuaaagagcacuauaugggcaa

SEQ ID NO: 385666 - RNA, 21 nt, Human
uaaaaagagcauauaaaaaga

SEQ ID NO: 385667 - RNA, 24 nt, Human
uaaaacaggauuccaaguaccacu

SEQ ID NO: 385668 - RNA, 25 nt, Human
uaaaagaagaguagauuuggagggc

SEQ ID NO: 385669 - RNA, 23 nt, Human
uaaaauagaacaucuuauuaaaa

SEQ ID NO: 385670 - RNA, 23 nt, Human
uaaaucuuuagcauacugguaua

SEQ ID NO: 385671 - RNA, 19 nt, Human
uacaaauacacaaacuaga

SEQ ID NO: 385672 - RNA, 18 nt, Human
uacaauaucacuacggaa

SEQ ID NO: 385673 - RNA, 21 nt, Human
uacacaaacuagaaauaaauc

SEQ ID NO: 385674 - RNA, 19 nt, Human
uagcuucuucucccccauc

SEQ ID NO: 385675 - RNA, 22 nt, Human
uagcuucuucucccccaucccc

SEQ ID NO: 385676 - RNA, 20 nt, Human
uagcuuuguaaauauguaca

SEQ ID NO: 385677 - RNA, 19 nt, Human
uaggugugaaaucuggaac

SEQ ID NO: 385678 - RNA, 19 nt, Human
uauaugggcaaaugcagaa

SEQ ID NO: 385679 - RNA, 18 nt, Human
uauugcacagugcuugac

SEQ ID NO: 385680 - RNA, 23 nt, Human
uccuugaggucagccuggaugcu

SEQ ID NO: 385681 - RNA, 22 nt, Human
ugaaaacguuuaaaaacuccuc

SEQ ID NO: 385682 - RNA, 20 nt, Human
ugacuucuccccuuagcuuc

SEQ ID NO: 385683 - RNA, 20 nt, Human
ugcacacacacacacacaca

SEQ ID NO: 385684 - RNA, 25 nt, Human
ugcacacacacacacacacacacac

SEQ ID NO: 385685 - RNA, 21 nt, Human
uggaaaaaugaaaggacccau

SEQ ID NO: 385686 - RNA, 22 nt, Human
uggaacagaauucacaggaugu

SEQ ID NO: 385687 - RNA, 22 nt, Human
uggaauauugcacagugcuuga

SEQ ID NO: 385688 - RNA, 22 nt, Human
uggaaugcagacgauacuauau

SEQ ID NO: 385689 - RNA, 18 nt, Human
uggcuaaagagcacuaua

SEQ ID NO: 385690 - RNA, 22 nt, Human
uggcuaaagagcacuauauggg

SEQ ID NO: 385691 - RNA, 23 nt, Human
uggcuggaaaaaugaaaggaccc

SEQ ID NO: 385692 - RNA, 20 nt, Human
ugggauuacaauacugucug

SEQ ID NO: 385693 - RNA, 25 nt, Human
ugugcacacacacacacacacacac

SEQ ID NO: 385694 - RNA, 19 nt, Human
uguguuaaaaauauccugc

SEQ ID NO: 385695 - RNA, 19 nt, Human
uugauauuuuugcuggaau

SEQ ID NO: 385696 - RNA, 21 nt, Human
uuguuguugguuuuuguuuuu

SEQ ID NO: 385697 - RNA, 22 nt, Human
uuuaguuuuugaaaagacgugg

SEQ ID NO: 385698 - RNA, 23 nt, Human
uuucaguucugaauugguccuuu

SEQ ID NO: 385699 - RNA, 25 nt, Human
uuuggaauuauuguaggugugaaau

SEQ ID NO: 385700 - RNA, 20 nt, Human
uuuuuucuuuuuaaauaguc

SEQ ID NO: 385701 - RNA, 18 nt, Human
aaaaaaaaaaaaaucggc

SEQ ID NO: 385702 - RNA, 19 nt, Human
aaaagaacagacacugucu

SEQ ID NO: 385703 - RNA, 18 nt, Human
aaacugccuggcuggauu

SEQ ID NO: 385704 - RNA, 23 nt, Human
aaagaaagaaaauuucuccuugc

SEQ ID NO: 385705 - RNA, 19 nt, Human
aacaaaucaauuacugagu

SEQ ID NO: 385706 - RNA, 22 nt, Human
aacaacaacaacaaaaagguag

SEQ ID NO: 385707 - RNA, 21 nt, Human
aacaacaacaacaacaaaaag

SEQ ID NO: 385708 - RNA, 20 nt, Human
aacacugugauaucaaacac

SEQ ID NO: 385709 - RNA, 20 nt, Human
aaguuccacucauacuucuc

SEQ ID NO: 385710 - RNA, 19 nt, Human
acaacaacaacaacaaaaa

SEQ ID NO: 385711 - RNA, 19 nt, Human
accucgguuccuguuuugg

SEQ ID NO: 385712 - RNA, 25 nt, Human
acuguccuuuugaaaugaaucugag

SEQ ID NO: 385713 - RNA, 25 nt, Human
agaaaagauagugaaacacauucuu

SEQ ID NO: 385714 - RNA, 22 nt, Human
agaacagacacugucucacaca

SEQ ID NO: 385715 - RNA, 20 nt, Human
agcaacaacaacaacaacaa

SEQ ID NO: 385716 - RNA, 20 nt, Human
agcgcagagcccagggcacc

SEQ ID NO: 385717 - RNA, 20 nt, Human
agcgcugaaaacaacagcgc

SEQ ID NO: 385718 - RNA, 22 nt, Human
agcuccuggaacagggaggagg

SEQ ID NO: 385719 - RNA, 21 nt, Human
aggcauagucauaaaaagcau

SEQ ID NO: 385720 - RNA, 18 nt, Human
agggaggaggcaaagagg

SEQ ID NO: 385721 - RNA, 21 nt, Human
aucggccucguccaacaacca

SEQ ID NO: 385722 - RNA, 19 nt, Human
augcuuuuuuaaucccaaa

SEQ ID NO: 385723 - RNA, 25 nt, Human
auguugcuuucacagagaugccgag

SEQ ID NO: 385724 - RNA, 21 nt, Human
auugcucuugaacgauuuugu

SEQ ID NO: 385725 - RNA, 22 nt, Human
caaaagaacagacacugucuca

SEQ ID NO: 385726 - RNA, 23 nt, Human
caaaagaacagacacugucucac

SEQ ID NO: 385727 - RNA, 23 nt, Human
caaaccaaacugaaaugaccaga

SEQ ID NO: 385728 - RNA, 20 nt, Human
caacaacaacaacaacaaaa

SEQ ID NO: 385729 - RNA, 24 nt, Human
caacuuuucacacucaaaaacacu

SEQ ID NO: 385730 - RNA, 21 nt, Human
cacaccaugcuuccuuccaaa

SEQ ID NO: 385731 - RNA, 21 nt, Human
cagcucaagacaaauuagccu

SEQ ID NO: 385732 - RNA, 21 nt, Human
ccaccauuaacuucuggcugc

SEQ ID NO: 385733 - RNA, 20 nt, Human
ccauguuaaaaaaaaaaaaa

SEQ ID NO: 385734 - RNA, 22 nt, Human
ccucgcacagugauuugccacc

SEQ ID NO: 385735 - RNA, 23 nt, Human
ccucgcacagugauuugccaccu

SEQ ID NO: 385736 - RNA, 18 nt, Human
cgaguggagcaagaugcu

SEQ ID NO: 385737 - RNA, 19 nt, Human
cgcccucgcacagugauuu

SEQ ID NO: 385738 - RNA, 22 nt, Human
cuaauuugacagccuaagcaua

SEQ ID NO: 385739 - RNA, 23 nt, Human
cuagcaacaacaacaacaacaaa

SEQ ID NO: 385740 - RNA, 18 nt, Human
cucacacaccaugcuucc

SEQ ID NO: 385741 - RNA, 22 nt, Human
cucagcuuguucacuguccuuu

SEQ ID NO: 385742 - RNA, 19 nt, Human
cugaaaacaacagcgcaga

SEQ ID NO: 385743 - RNA, 18 nt, Human
cugacacaaaaccugacu

SEQ ID NO: 385744 - RNA, 22 nt, Human
cuggcaauguaaaaaaucuuca

SEQ ID NO: 385745 - RNA, 24 nt, Human
gaaaacaacagcgcagagcccagg

SEQ ID NO: 385746 - RNA, 24 nt, Human
gaaaagauagugaaacacauucuu

SEQ ID NO: 385747 - RNA, 24 nt, Human
gaaagaaagaaaauuucuccuugc

SEQ ID NO: 385748 - RNA, 21 nt, Human
gaacagggaggaggcaaagag

SEQ ID NO: 385749 - RNA, 19 nt, Human
gaacauauguaaauuauau

SEQ ID NO: 385750 - RNA, 20 nt, Human
gacagaauuaauaaauacaa

SEQ ID NO: 385751 - RNA, 23 nt, Human
gauacaagacacaagucuguaaa

SEQ ID NO: 385752 - RNA, 21 nt, Human
gcaacaacaacaacaacaaaa

SEQ ID NO: 385753 - RNA, 23 nt, Human
gcacuggaaaaugauacaagaca

SEQ ID NO: 385754 - RNA, 24 nt, Human
gcuaaaguacugacacaaaaccug

SEQ ID NO: 385755 - RNA, 22 nt, Human
ggaacagggaggaggcaaagag

SEQ ID NO: 385756 - RNA, 18 nt, Human
gugaauaauccaaggcca

SEQ ID NO: 385757 - RNA, 18 nt, Human
guguucuguccgaggugc

SEQ ID NO: 385758 - RNA, 26 nt, Human
guuaaaaaaaaaaaaaucggccucgu

SEQ ID NO: 385759 - RNA, 23 nt, Human
uaaauuaaaugaagacuuaggug

SEQ ID NO: 385760 - RNA, 24 nt, Human
uaaucuuuguacauacagaaugua

SEQ ID NO: 385761 - RNA, 19 nt, Human
uaauuacaaaccaaacuga

SEQ ID NO: 385762 - RNA, 27 nt, Human
uaauucaacuguacucaaguuccacuc

SEQ ID NO: 385763 - RNA, 19 nt, Human
uaccucagcugcuaccacc

SEQ ID NO: 385764 - RNA, 23 nt, Human
uagcaacaacaacaacaacaaaa

SEQ ID NO: 385765 - RNA, 19 nt, Human
ucagaaaugaugaaauuag

SEQ ID NO: 385766 - RNA, 22 nt, Human
ucaggccacacugaggcuugug

SEQ ID NO: 385767 - RNA, 24 nt, Human
ucauaaaaugucugacuauuccua

SEQ ID NO: 385768 - RNA, 21 nt, Human
ucauuguuccauguuaaaaaa

SEQ ID NO: 385769 - RNA, 25 nt, Human
uccaacucuucuaauaaauagggaa

SEQ ID NO: 385770 - RNA, 20 nt, Human
uccaauauagaaagaaagaa

SEQ ID NO: 385771 - RNA, 23 nt, Human
uccauguuaaaaaaaaaaaaauc

SEQ ID NO: 385772 - RNA, 20 nt, Human
uccgaggugcugaagggaaa

SEQ ID NO: 385773 - RNA, 18 nt, Human
uccuggaacagggaggag

SEQ ID NO: 385774 - RNA, 26 nt, Human
ucguccaacaaccauaccucagcugc

SEQ ID NO: 385775 - RNA, 24 nt, Human
ucuaaaacaguacauuuucagaaa

SEQ ID NO: 385776 - RNA, 20 nt, Human
ucucaggccacacugaggcu

SEQ ID NO: 385777 - RNA, 22 nt, Human
ugaaguuacuuucuggucuacu

SEQ ID NO: 385778 - RNA, 21 nt, Human
ugaauuucagaacccuggcac

SEQ ID NO: 385779 - RNA, 23 nt, Human
ugacacaaaaccugacucaaaau

SEQ ID NO: 385780 - RNA, 21 nt, Human
ugacuuccccaaacuacacac

SEQ ID NO: 385781 - RNA, 19 nt, Human
ugaggcuugugacaggcag

SEQ ID NO: 385782 - RNA, 22 nt, Human
ugauuugccaccucgguuccug

SEQ ID NO: 385783 - RNA, 19 nt, Human
ugccuggaucucaagcgcc

SEQ ID NO: 385784 - RNA, 18 nt, Human
uggcacaaaagaacagac

SEQ ID NO: 385785 - RNA, 18 nt, Human
uggcuggauucacuugcc

SEQ ID NO: 385786 - RNA, 18 nt, Human
uggguacaaacgauggcc

SEQ ID NO: 385787 - RNA, 24 nt, Human
uguacauacagaauguaauacauu

SEQ ID NO: 385788 - RNA, 28 nt, Human
ugucucacacaccaugcuuccuuccaaa

SEQ ID NO: 385789 - RNA, 21 nt, Human
ugucugacuauuccuaguuau

SEQ ID NO: 385790 - RNA, 19 nt, Human
ugugcuaauuugacagccu

SEQ ID NO: 385791 - RNA, 21 nt, Human
uucaauccauuucuagcaaca

SEQ ID NO: 385792 - RNA, 25 nt, Human
uucacagucuuuucaaguagcaucu

SEQ ID NO: 385793 - RNA, 23 nt, Human
uucucaggccacacugaggcuug

SEQ ID NO: 385794 - RNA, 22 nt, Human
uuggguggugagauuggcuaau

SEQ ID NO: 385795 - RNA, 25 nt, Human
uuucucaggccacacugaggcuugu

SEQ ID NO: 385796 - RNA, 26 nt, Human
uuugcacaugacagaauuaauaaaua

SEQ ID NO: 385797 - RNA, 23 nt, Human
uuugccaccucgguuccuguuuu

SEQ ID NO: 385798 - RNA, 22 nt, Human
uuuguaguggaaugaagacaau

SEQ ID NO: 385799 - RNA, 22 nt, Human
aaagcagggggcaggacccggg

SEQ ID NO: 385800 - RNA, 20 nt, Human
aacaaagaacuccaacuccc

SEQ ID NO: 385801 - RNA, 19 nt, Human
aaggguggggcuggcuugg

SEQ ID NO: 385802 - RNA, 22 nt, Human
acccucuuccuccacggcccca

SEQ ID NO: 385803 - RNA, 20 nt, Human
accgcguugcccagagcaac

SEQ ID NO: 385804 - RNA, 22 nt, Human
accgcguugcccagagcaacag

SEQ ID NO: 385805 - RNA, 26 nt, Human
acucaagcacccuagucccccauucc

SEQ ID NO: 385806 - RNA, 23 nt, Human
agaggaagcuuaaggguggggcc

SEQ ID NO: 385807 - RNA, 19 nt, Human
aggacccgggggcaggaga

SEQ ID NO: 385808 - RNA, 20 nt, Human
aggggguguccaggaccuag

SEQ ID NO: 385809 - RNA, 19 nt, Human
agucuggggucaggggcua

SEQ ID NO: 385810 - RNA, 19 nt, Human
caacaaagaacuccaacuc

SEQ ID NO: 385811 - RNA, 25 nt, Human
ccagagcaacagccgggcuccucuc

SEQ ID NO: 385812 - RNA, 20 nt, Human
cccacaggcaucccgcugaa

SEQ ID NO: 385813 - RNA, 22 nt, Human
ccccacgcacaacaaagaacuc

SEQ ID NO: 385814 - RNA, 22 nt, Human
ccccagacguccuuugagcccc

SEQ ID NO: 385815 - RNA, 18 nt, Human
cccggcggggcaggcucg

SEQ ID NO: 385816 - RNA, 23 nt, Human
cccuagucccccauucccacccc

SEQ ID NO: 385817 - RNA, 18 nt, Human
cccuggggcaucugggug

SEQ ID NO: 385818 - RNA, 23 nt, Human
ccggcggggcaggcuccugucgg

SEQ ID NO: 385819 - RNA, 24 nt, Human
ccucgccccuccgcagggucugaa

SEQ ID NO: 385820 - RNA, 19 nt, Human
ccucucaagcgggguaaga

SEQ ID NO: 385821 - RNA, 23 nt, Human
cgcagaaaccggacagccaccgc

SEQ ID NO: 385822 - RNA, 21 nt, Human
cgggcggggcugacgcacaga

SEQ ID NO: 385823 - RNA, 26 nt, Human
cuccacggccccacaggcaucccgcu

SEQ ID NO: 385824 - RNA, 23 nt, Human
cucuuccuccacggccccacagg

SEQ ID NO: 385825 - RNA, 24 nt, Human
gaaccggaagcgggcgaaggcaga

SEQ ID NO: 385826 - RNA, 19 nt, Human
gcacaacaaagaacuccaa

SEQ ID NO: 385827 - RNA, 20 nt, Human
gcaggacccgggggcaggag

SEQ ID NO: 385828 - RNA, 21 nt, Human
gccuucccuucccgggguccc

SEQ ID NO: 385829 - RNA, 25 nt, Human
gcuccggggcccaccggugccuggg

SEQ ID NO: 385830 - RNA, 18 nt, Human
ggagagcagacgaggaug

SEQ ID NO: 385831 - RNA, 19 nt, Human
ggaggguaaccgucagagg

SEQ ID NO: 385832 - RNA, 21 nt, Human
ggggcaggacccgggggcagg

SEQ ID NO: 385833 - RNA, 24 nt, Human
ggggcaggacccgggggcaggaga

SEQ ID NO: 385834 - RNA, 20 nt, Human
ggggguguccaggaccuagu

SEQ ID NO: 385835 - RNA, 20 nt, Human
gggguggaagguggggggag

SEQ ID NO: 385836 - RNA, 21 nt, Human
guaguaucagccuccccgcac

SEQ ID NO: 385837 - RNA, 24 nt, Human
guggggcuggcuuggcuuuggccg

SEQ ID NO: 385838 - RNA, 22 nt, Human
uaucagccuccccgcacuugag

SEQ ID NO: 385839 - RNA, 21 nt, Human
uccccgcacuugagagggggu

SEQ ID NO: 385840 - RNA, 24 nt, Human
uccgcagggucugaaccggaagcg

SEQ ID NO: 385841 - RNA, 18 nt, Human
uccggggcccaccggugc

SEQ ID NO: 385842 - RNA, 19 nt, Human
uccggggcccaccggugcc

SEQ ID NO: 385843 - RNA, 25 nt, Human
ucucgggagucuggggucaggggcu

SEQ ID NO: 385844 - RNA, 23 nt, Human
ucugcagagacacucaagcaccc

SEQ ID NO: 385845 - RNA, 22 nt, Human
ugacgcacagacgcggaguccc

SEQ ID NO: 385846 - RNA, 24 nt, Human
ugacuucugccucguccucgcccc

SEQ ID NO: 385847 - RNA, 18 nt, Human
ugagaagacaggaauggu

SEQ ID NO: 385848 - RNA, 19 nt, Human
ugcccagagcaacagccgg

SEQ ID NO: 385849 - RNA, 24 nt, Human
ugccuucccuucccggggucccug

SEQ ID NO: 385850 - RNA, 22 nt, Human
uggcgggguccuggagucuuuu

SEQ ID NO: 385851 - RNA, 20 nt, Human
uggggcaucugggugugucc

SEQ ID NO: 385852 - RNA, 18 nt, Human
ugggguggaagguggggg

SEQ ID NO: 385853 - RNA, 18 nt, Human
ugugcuggaaaguugucg

SEQ ID NO: 385854 - RNA, 22 nt, Human
uguugccaggacaacgggcggg

SEQ ID NO: 385855 - RNA, 22 nt, Human
uuaaggguggggcuggcuuggc

SEQ ID NO: 385856 - RNA, 22 nt, Human
uuccuccacggccccacaggca

SEQ ID NO: 385857 - RNA, 22 nt, Human
uuggccgggggcuugggguggg

SEQ ID NO: 385858 - RNA, 20 nt, Human
uugggguggaaggugggggg

SEQ ID NO: 385859 - RNA, 19 nt, Human
aaccugcuguccucaacua

SEQ ID NO: 385860 - RNA, 21 nt, Human
aacucuccagucuggcaguuu

SEQ ID NO: 385861 - RNA, 18 nt, Human
aagccaccugggacagca

SEQ ID NO: 385862 - RNA, 18 nt, Human
aaggaagguccgcgcgca

SEQ ID NO: 385863 - RNA, 20 nt, Human
aaggaggggcuucacuaaua

SEQ ID NO: 385864 - RNA, 18 nt, Human
acgacaaaaagucacugc

SEQ ID NO: 385865 - RNA, 28 nt, Human
agacccgggaggagggcgcggaccaaga

SEQ ID NO: 385866 - RNA, 18 nt, Human
agggaugcuggggcucug

SEQ ID NO: 385867 - RNA, 25 nt, Human
caacuaaaaccugcuguccucaacu

SEQ ID NO: 385868 - RNA, 18 nt, Human
caccacuggcugccacga

SEQ ID NO: 385869 - RNA, 24 nt, Human
cacuguaugagaaauaaaccaaaa

SEQ ID NO: 385870 - RNA, 20 nt, Human
ccacgacaaaaagucacugc

SEQ ID NO: 385871 - RNA, 21 nt, Human
ccccgccguccccgaagccca

SEQ ID NO: 385872 - RNA, 24 nt, Human
ccccgccguccccgaagcccagac

SEQ ID NO: 385873 - RNA, 23 nt, Human
ccccgcuccaggcgcgccucccu

SEQ ID NO: 385874 - RNA, 21 nt, Human
ccccuccccgccguccccgaa

SEQ ID NO: 385875 - RNA, 24 nt, Human
cccugcucuuggccgccgcccuuc

SEQ ID NO: 385876 - RNA, 22 nt, Human
ccgcaguaguagugcuguucuc

SEQ ID NO: 385877 - RNA, 24 nt, Human
ccggcuccccuccccgccgucccc

SEQ ID NO: 385878 - RNA, 24 nt, Human
ccuccccgccguccccgaagccca

SEQ ID NO: 385879 - RNA, 21 nt, Human
ccuccccucccagggacgagc

SEQ ID NO: 385880 - RNA, 23 nt, Human
ccucgcccacggagccccaggcg

SEQ ID NO: 385881 - RNA, 22 nt, Human
cgccgcccuuccgagaaaaggg

SEQ ID NO: 385882 - RNA, 22 nt, Human
cgcgccuccgaugccucaacuc

SEQ ID NO: 385883 - RNA, 23 nt, Human
cgcuaccugagauccaccuuccc

SEQ ID NO: 385884 - RNA, 19 nt, Human
cgcuacugcaggugugagc

SEQ ID NO: 385885 - RNA, 21 nt, Human
cggcacagacccgggaggagg

SEQ ID NO: 385886 - RNA, 22 nt, Human
cggcucccgggucccggguccc

SEQ ID NO: 385887 - RNA, 22 nt, Human
cguccccgaagcccagacucgc

SEQ ID NO: 385888 - RNA, 25 nt, Human
cuaaaguaggacugguggaguuuac

SEQ ID NO: 385889 - RNA, 26 nt, Human
cuccacaguuggguucaucuguaagc

SEQ ID NO: 385890 - RNA, 22 nt, Human
cuccccgccguccccgaagccc

SEQ ID NO: 385891 - RNA, 24 nt, Human
cuccccuccccgccguccccgaag

SEQ ID NO: 385892 - RNA, 20 nt, Human
cuccgaugccucaacucucc

SEQ ID NO: 385893 - RNA, 18 nt, Human
cuggaaaaggaagguccg

SEQ ID NO: 385894 - RNA, 22 nt, Human
cugggacagcaccgcuacugca

SEQ ID NO: 385895 - RNA, 22 nt, Human
gcuuugggaugcgccgcgcucc

SEQ ID NO: 385896 - RNA, 22 nt, Human
ggacggaaauaagcaaaagcaa

SEQ ID NO: 385897 - RNA, 25 nt, Human
ggaugcuggggcucuggggaaaggu

SEQ ID NO: 385898 - RNA, 20 nt, Human
gggcucuggggaaaggugcc

SEQ ID NO: 385899 - RNA, 23 nt, Human
gucccgggucccggcacagaccc

SEQ ID NO: 385900 - RNA, 18 nt, Human
gugcaccuguccccacaa

SEQ ID NO: 385901 - RNA, 18 nt, Human
guucaucuguaagccacc

SEQ ID NO: 385902 - RNA, 24 nt, Human
uacacacauucuagggggcagagc

SEQ ID NO: 385903 - RNA, 23 nt, Human
uaugcuuaaaauacacacauucu

SEQ ID NO: 385904 - RNA, 19 nt, Human
ucaaaagaaaaauaugaaa

SEQ ID NO: 385905 - RNA, 24 nt, Human
ucacugcaucuuucgggaccuggg

SEQ ID NO: 385906 - RNA, 22 nt, Human
uccccacacgucccucgcccac

SEQ ID NO: 385907 - RNA, 19 nt, Human
ucccguccggcuccccucc

SEQ ID NO: 385908 - RNA, 19 nt, Human
uccggugcaccugucccca

SEQ ID NO: 385909 - RNA, 18 nt, Human
ucuccacaguuggguuca

SEQ ID NO: 385910 - RNA, 18 nt, Human
ucuguaagccaccuggga

SEQ ID NO: 385911 - RNA, 19 nt, Human
ucuguaagccaccugggac

SEQ ID NO: 385912 - RNA, 23 nt, Human
ugcaucuuucgggaccugggccu

SEQ ID NO: 385913 - RNA, 21 nt, Human
ugccaaaguugccaauacacu

SEQ ID NO: 385914 - RNA, 21 nt, Human
ugccucaacucuccagucugg

SEQ ID NO: 385915 - RNA, 18 nt, Human
ugcucuuggccgccgccc

SEQ ID NO: 385916 - RNA, 22 nt, Human
uguccucaacuaugauuuuauu

SEQ ID NO: 385917 - RNA, 18 nt, Human
uguccuuaacagcucaac

SEQ ID NO: 385918 - RNA, 20 nt, Human
ugugagcaagggaugcuggg

SEQ ID NO: 385919 - RNA, 20 nt, Human
uuaagagugugcuuuuuauc

SEQ ID NO: 385920 - RNA, 21 nt, Human
uuggguucaucuguaagccac

SEQ ID NO: 385921 - RNA, 20 nt, Human
uuucuggacccuggcaaaca

SEQ ID NO: 385922 - RNA, 24 nt, Human
uuugaaaaggaaguuacugaggcu

SEQ ID NO: 385923 - RNA, 21 nt, Human
uuuugcauauugcguuuauuu

SEQ ID NO: 385924 - RNA, 21 nt, Human
aaugauuuuuuuucuuuaggg

SEQ ID NO: 385925 - RNA, 24 nt, Human
acaaauacaguguaauaccaaaau

SEQ ID NO: 385926 - RNA, 24 nt, Human
accaugaaaacaaauaggaaaagc

SEQ ID NO: 385927 - RNA, 24 nt, Human
agacauuagaaucacauugaaacu

SEQ ID NO: 385928 - RNA, 20 nt, Human
aggaaaagcacaagacuguc

SEQ ID NO: 385929 - RNA, 26 nt, Human
auacaaauacaguguaauaccaaaau

SEQ ID NO: 385930 - RNA, 21 nt, Human
aucacauugaaacuuuuaaaa

SEQ ID NO: 385931 - RNA, 18 nt, Human
augcuucagagauacaaa

SEQ ID NO: 385932 - RNA, 19 nt, Human
augcuucagagauacaaau

SEQ ID NO: 385933 - RNA, 23 nt, Human
caaaugaagcugaauaaauaaug

SEQ ID NO: 385934 - RNA, 24 nt, Human
caauacauauuggcacaauaugaa

SEQ ID NO: 385935 - RNA, 22 nt, Human
caauaugaaaaauaaacacuuu

SEQ ID NO: 385936 - RNA, 21 nt, Human
cacaaaugaagcugaauaaau

SEQ ID NO: 385937 - RNA, 22 nt, Human
cacaacacaucauacaaugaaa

SEQ ID NO: 385938 - RNA, 19 nt, Human
caggaguuuccuuccuuuu

SEQ ID NO: 385939 - RNA, 22 nt, Human
cgcuccgcacucucgguagcug

SEQ ID NO: 385940 - RNA, 22 nt, Human
cuauauagucacaaaacaugaa

SEQ ID NO: 385941 - RNA, 25 nt, Human
cucauagugcaugucuuaauuuacc

SEQ ID NO: 385942 - RNA, 21 nt, Human
cugaauaaauaauguuaggua

SEQ ID NO: 385943 - RNA, 18 nt, Human
cugcucagugccuugcgg

SEQ ID NO: 385944 - RNA, 21 nt, Human
gcuaucacaacacaucauaca

SEQ ID NO: 385945 - RNA, 19 nt, Human
uacaguguaauaccaaaau

SEQ ID NO: 385946 - RNA, 19 nt, Human
uaucacaacacaucauaca

SEQ ID NO: 385947 - RNA, 25 nt, Human
ucaaccccaaacaauuguuauuaaa

SEQ ID NO: 385948 - RNA, 19 nt, Human
uccgagcgcacgcuggucg

SEQ ID NO: 385949 - RNA, 21 nt, Human
uccuuccuuuuccgcaguagc

SEQ ID NO: 385950 - RNA, 20 nt, Human
ugaauaaauaauguuaggua

SEQ ID NO: 385951 - RNA, 24 nt, Human
ugcuucaaagcaaugauuuuuuuu

SEQ ID NO: 385952 - RNA, 22 nt, Human
uggauuuugcgacggacagucc

SEQ ID NO: 385953 - RNA, 19 nt, Human
uuaaaacacauguuuacaa

SEQ ID NO: 385954 - RNA, 18 nt, Human
uuaacacugugcuuuguu

SEQ ID NO: 385955 - RNA, 22 nt, Human
uuggcacaauaugaaaaauaaa

SEQ ID NO: 385956 - RNA, 23 nt, Human
uuuaccugucauugcccauugac

SEQ ID NO: 385957 - RNA, 24 nt, Human
uuuuccgcaguagcugacacaacu

SEQ ID NO: 385958 - RNA, 29 nt, Human
uuuugcgacggacagucccgcgggguuga

SEQ ID NO: 385959 - RNA, 19 nt, Human
uuuuuuuucuuuagggacu

SEQ ID NO: 385960 - RNA, 21 nt, Human
uuuuuuuuuuuuuuuuucaag

SEQ ID NO: 385961 - RNA, 22 nt, Human
aacagggaagagaaaggguaac

SEQ ID NO: 385962 - RNA, 21 nt, Human
aagaggucuuccuaaugcagu

SEQ ID NO: 385963 - RNA, 19 nt, Human
aaugcaguccaggaguccg

SEQ ID NO: 385964 - RNA, 23 nt, Human
agcacaagaauguuacaagaaca

SEQ ID NO: 385965 - RNA, 23 nt, Human
cacuaugcaguuuccacaccagg

SEQ ID NO: 385966 - RNA, 19 nt, Human
cagggucagguagaaaaga

SEQ ID NO: 385967 - RNA, 18 nt, Human
caguccaggaguccggaa

SEQ ID NO: 385968 - RNA, 22 nt, Human
cccucacacacuggugcugccg

SEQ ID NO: 385969 - RNA, 20 nt, Human
cggugcuccugcaaagagag

SEQ ID NO: 385970 - RNA, 21 nt, Human
cggugcuccugcaaagagaga

SEQ ID NO: 385971 - RNA, 23 nt, Human
cugccugcuccccucacacacug

SEQ ID NO: 385972 - RNA, 26 nt, Human
cugccugcuccccucacacacuggug

SEQ ID NO: 385973 - RNA, 21 nt, Human
gcgcaccuggggauugggaca

SEQ ID NO: 385974 - RNA, 22 nt, Human
gggacagggaaagaggucuucc

SEQ ID NO: 385975 - RNA, 18 nt, Human
gggauauucacuaugcag

SEQ ID NO: 385976 - RNA, 18 nt, Human
ggggauugggacagggaa

SEQ ID NO: 385977 - RNA, 20 nt, Human
uaaugcaguccaggaguccg

SEQ ID NO: 385978 - RNA, 18 nt, Human
ucagguagaaaagaugga

SEQ ID NO: 385979 - RNA, 19 nt, Human
ucagguagaaaagauggag

SEQ ID NO: 385980 - RNA, 22 nt, Human
uggagcagcucugugccggggg

SEQ ID NO: 385981 - RNA, 21 nt, Human
uggcaggaucaaggaacuggc

SEQ ID NO: 385982 - RNA, 21 nt, Human
uggggauauucacuaugcagu

SEQ ID NO: 385983 - RNA, 22 nt, Human
aaaacaccaaaacacagcagca

SEQ ID NO: 385984 - RNA, 21 nt, Human
aaaaugugacuucuggcuuua

SEQ ID NO: 385985 - RNA, 24 nt, Human
aaacaccaaaacacagcagcaaaa

SEQ ID NO: 385986 - RNA, 23 nt, Human
aaacagaucacaaaaaaaucaga

SEQ ID NO: 385987 - RNA, 18 nt, Human
aaacaugaaaacaccaaa

SEQ ID NO: 385988 - RNA, 27 nt, Human
aagcaagcucacaaucacaugaccaca

SEQ ID NO: 385989 - RNA, 21 nt, Human
aagcagaugugcaaugaacua

SEQ ID NO: 385990 - RNA, 22 nt, Human
aaggggauccagagccccuucu

SEQ ID NO: 385991 - RNA, 24 nt, Human
aaguaaacaugaaaacaccaaaac

SEQ ID NO: 385992 - RNA, 21 nt, Human
aauagaucgaaacucugucuc

SEQ ID NO: 385993 - RNA, 23 nt, Human
acacaacaucuccauauuagaac

SEQ ID NO: 385994 - RNA, 19 nt, Human
acaguguugggauuacagg

SEQ ID NO: 385995 - RNA, 23 nt, Human
acauaaaucuucccucagauucc

SEQ ID NO: 385996 - RNA, 21 nt, Human
acuaacccuaaaggggccaca

SEQ ID NO: 385997 - RNA, 26 nt, Human
acuguuacucuauggagacucaagga

SEQ ID NO: 385998 - RNA, 22 nt, Human
acuuuggcaaagucaaaagcua

SEQ ID NO: 385999 - RNA, 27 nt, Human
agaaagcagacacuaucauuccagucg

SEQ ID NO: 386000 - RNA, 27 nt, Human
agacaggugguggagaagaccccaaag

SEQ ID NO: 386001 - RNA, 21 nt, Human
agaggacuaaaaaggaaauca

SEQ ID NO: 386002 - RNA, 19 nt, Human
agauaugaaaacccaagac

SEQ ID NO: 386003 - RNA, 21 nt, Human
agauaugaaaacccaagacug

SEQ ID NO: 386004 - RNA, 21 nt, Human
agaucgaaacucugucucaaa

SEQ ID NO: 386005 - RNA, 21 nt, Human
agcugaggaguguccaaauac

SEQ ID NO: 386006 - RNA, 22 nt, Human
aggaaguuaaaagggggcuuca

SEQ ID NO: 386007 - RNA, 20 nt, Human
aggaauuuggcuuuguuagu

SEQ ID NO: 386008 - RNA, 19 nt, Human
aggcagagggggagaaagu

SEQ ID NO: 386009 - RNA, 22 nt, Human
aggcccccggcccgcggcgccc

SEQ ID NO: 386010 - RNA, 21 nt, Human
agggcagacuugccaaacccu

SEQ ID NO: 386011 - RNA, 21 nt, Human
agguucuuaaggggucucuuc

SEQ ID NO: 386012 - RNA, 22 nt, Human
agguuucaccauguugccuagg

SEQ ID NO: 386013 - RNA, 20 nt, Human
agugcaguggcaugaucaug

SEQ ID NO: 386014 - RNA, 23 nt, Human
agugcaguggcaugaucauggcu

SEQ ID NO: 386015 - RNA, 24 nt, Human
agugcaguggcaugaucauggcuc

SEQ ID NO: 386016 - RNA, 20 nt, Human
auaaaucuucccucagauuc

SEQ ID NO: 386017 - RNA, 22 nt, Human
auaaaucuucccucagauucca

SEQ ID NO: 386018 - RNA, 24 nt, Human
auagaucgaaacucugucucaaaa

SEQ ID NO: 386019 - RNA, 19 nt, Human
auauuguucuuucauaagc

SEQ ID NO: 386020 - RNA, 20 nt, Human
augugugugagagugugugu

SEQ ID NO: 386021 - RNA, 21 nt, Human
caaaaaacuacaaaaaagugc

SEQ ID NO: 386022 - RNA, 23 nt, Human
caaaacgaaacauaaaucuuccc

SEQ ID NO: 386023 - RNA, 21 nt, Human
caacaggcuugaauauacagc

SEQ ID NO: 386024 - RNA, 20 nt, Human
caacgcagcacucaucccuc

SEQ ID NO: 386025 - RNA, 18 nt, Human
caacuugagcuauccucc

SEQ ID NO: 386026 - RNA, 22 nt, Human
caagaucuugcugucacccagg

SEQ ID NO: 386027 - RNA, 24 nt, Human
caagguuucaccauguugccuagg

SEQ ID NO: 386028 - RNA, 22 nt, Human
caagugauccuccugccucggc

SEQ ID NO: 386029 - RNA, 19 nt, Human
cacacacuucauggcaccc

SEQ ID NO: 386030 - RNA, 24 nt, Human
cacaggcacgugccaccaugccca

SEQ ID NO: 386031 - RNA, 19 nt, Human
caccaaaacacagcagcaa

SEQ ID NO: 386032 - RNA, 19 nt, Human
caccauguugccuagguag

SEQ ID NO: 386033 - RNA, 24 nt, Human
caccauguugccuagguagguuuc

SEQ ID NO: 386034 - RNA, 24 nt, Human
caccucagccucccaaguagcugg

SEQ ID NO: 386035 - RNA, 22 nt, Human
cacgcugcccuguaucuggacu

SEQ ID NO: 386036 - RNA, 21 nt, Human
cacggugcggccgcagcgggc

SEQ ID NO: 386037 - RNA, 18 nt, Human
cacuccagcugcuuuuac

SEQ ID NO: 386038 - RNA, 22 nt, Human
cacugcagccuugaccucccag

SEQ ID NO: 386039 - RNA, 23 nt, Human
cagaacuuucacucccacuaaaa

SEQ ID NO: 386040 - RNA, 20 nt, Human
cagauaccacuaaaaggcag

SEQ ID NO: 386041 - RNA, 22 nt, Human
cagaucaauauaaaacaaguaa

SEQ ID NO: 386042 - RNA, 24 nt, Human
cagcagcaaaaagauuuagcaauc

SEQ ID NO: 386043 - RNA, 21 nt, Human
cagcccaggaacaucuggggg

SEQ ID NO: 386044 - RNA, 23 nt, Human
cagccuugaccucccaggcuccc

SEQ ID NO: 386045 - RNA, 19 nt, Human
caggaauaagccacugugc

SEQ ID NO: 386046 - RNA, 21 nt, Human
caggcucccaccucagccucc

SEQ ID NO: 386047 - RNA, 21 nt, Human
caguggcaugaucauggcuca

SEQ ID NO: 386048 - RNA, 22 nt, Human
caucuauaaacauacauguaug

SEQ ID NO: 386049 - RNA, 27 nt, Human
caucugaaaauucuuuauaaauacaga

SEQ ID NO: 386050 - RNA, 22 nt, Human
caugcagaaagcagacacuauc

SEQ ID NO: 386051 - RNA, 20 nt, Human
cauggcucacugcagccuug

SEQ ID NO: 386052 - RNA, 24 nt, Human
cauguugccuagguagguuucaaa

SEQ ID NO: 386053 - RNA, 22 nt, Human
ccaaaacacagcagcaaaaaga

SEQ ID NO: 386054 - RNA, 21 nt, Human
ccaacaucuaggccagcagcu

SEQ ID NO: 386055 - RNA, 22 nt, Human
ccacacccauuaaagcugagga

SEQ ID NO: 386056 - RNA, 19 nt, Human
ccacaggccagcauugcac

SEQ ID NO: 386057 - RNA, 21 nt, Human
ccacaguguugggauuacagg

SEQ ID NO: 386058 - RNA, 24 nt, Human
ccacaguguugggauuacaggaau

SEQ ID NO: 386059 - RNA, 22 nt, Human
ccagcagcugccuucuacuuuc

SEQ ID NO: 386060 - RNA, 20 nt, Human
cccaccucagccucccaagu

SEQ ID NO: 386061 - RNA, 23 nt, Human
ccccgcgccgggcuccacuagcc

SEQ ID NO: 386062 - RNA, 21 nt, Human
cccggcccgcggcgcccggcc

SEQ ID NO: 386063 - RNA, 18 nt, Human
cccguccuguggccuccu

SEQ ID NO: 386064 - RNA, 22 nt, Human
cccuguaucuggacuggggaug

SEQ ID NO: 386065 - RNA, 19 nt, Human
ccggcgccgcguccuccuc

SEQ ID NO: 386066 - RNA, 19 nt, Human
ccuccaaaacgaaacauaa

SEQ ID NO: 386067 - RNA, 23 nt, Human
ccucccaggcucccaccucagcc

SEQ ID NO: 386068 - RNA, 20 nt, Human
ccuccccucacggugcggcc

SEQ ID NO: 386069 - RNA, 18 nt, Human
ccucccuggggcuaaaga

SEQ ID NO: 386070 - RNA, 18 nt, Human
ccucccuggggcuaaaga

SEQ ID NO: 386071 - RNA, 19 nt, Human
ccucuguuuaacacauagc

SEQ ID NO: 386072 - RNA, 22 nt, Human
ccuggacucaagugauccuccu

SEQ ID NO: 386073 - RNA, 23 nt, Human
ccuggacucaagugauccuccug

SEQ ID NO: 386074 - RNA, 20 nt, Human
ccuguggccuccucaggccc

SEQ ID NO: 386075 - RNA, 22 nt, Human
ccuguggccuccucaggccccc

SEQ ID NO: 386076 - RNA, 25 nt, Human
cggcagccggcgccgcguccuccuc

SEQ ID NO: 386077 - RNA, 18 nt, Human
cuaauuuuuauuuuggua

SEQ ID NO: 386078 - RNA, 23 nt, Human
cuaggacagcauucauauuacac

SEQ ID NO: 386079 - RNA, 18 nt, Human
cuaggccagcagcugccu

SEQ ID NO: 386080 - RNA, 21 nt, Human
cucaaggauuuagugguaagu

SEQ ID NO: 386081 - RNA, 24 nt, Human
cucaagugauccuccugccucggc

SEQ ID NO: 386082 - RNA, 21 nt, Human
cucacugcagccuugaccucc

SEQ ID NO: 386083 - RNA, 24 nt, Human
cucagccucccaaguagcugggac

SEQ ID NO: 386084 - RNA, 24 nt, Human
cucccaaguagcugggaccacagg

SEQ ID NO: 386085 - RNA, 22 nt, Human
cucccaggcucccaccucagcc

SEQ ID NO: 386086 - RNA, 19 nt, Human
cuccuccggcuccagcucc

SEQ ID NO: 386087 - RNA, 24 nt, Human
cucuauacuauauucuuacucucc

SEQ ID NO: 386088 - RNA, 19 nt, Human
cucugucucaaaaaaaaaa

SEQ ID NO: 386089 - RNA, 23 nt, Human
cugcagccuugaccucccaggcu

SEQ ID NO: 386090 - RNA, 18 nt, Human
cuggaggccagucaaacc

SEQ ID NO: 386091 - RNA, 19 nt, Human
cuggauaaaggcuaucuac

SEQ ID NO: 386092 - RNA, 19 nt, Human
cugguggagcgcuuccucc

SEQ ID NO: 386093 - RNA, 22 nt, Human
cuucauagggggaaacuaggag

SEQ ID NO: 386094 - RNA, 19 nt, Human
cuucauucacuggggucag

SEQ ID NO: 386095 - RNA, 22 nt, Human
cuuccaacucaguauacacaga

SEQ ID NO: 386096 - RNA, 24 nt, Human
cuuuccuuuuucacuccugguuuu

SEQ ID NO: 386097 - RNA, 22 nt, Human
gaauucauugagauuuauaugg

SEQ ID NO: 386098 - RNA, 20 nt, Human
gacauucugggauucccaga

SEQ ID NO: 386099 - RNA, 20 nt, Human
gagagucuguuacaucaguu

SEQ ID NO: 386100 - RNA, 18 nt, Human
gagauccuuugagaggag

SEQ ID NO: 386101 - RNA, 19 nt, Human
gaucauggcucacugcagc

SEQ ID NO: 386102 - RNA, 20 nt, Human
gaugacuuuaaaacaaacuu

SEQ ID NO: 386103 - RNA, 18 nt, Human
gauuacaggaauaagcca

SEQ ID NO: 386104 - RNA, 19 nt, Human
gauuacaggaauaagccac

SEQ ID NO: 386105 - RNA, 21 nt, Human
gauuacaggaauaagccacug

SEQ ID NO: 386106 - RNA, 24 nt, Human
gauuuagcaaucaauguuucuuuc

SEQ ID NO: 386107 - RNA, 21 nt, Human
gcagcaguaggcaugugcuuu

SEQ ID NO: 386108 - RNA, 23 nt, Human
gccaaacugucuccuuaaauaaa

SEQ ID NO: 386109 - RNA, 18 nt, Human
gccccgcgccgggcucca

SEQ ID NO: 386110 - RNA, 18 nt, Human
gcccuuuuucucuucugu

SEQ ID NO: 386111 - RNA, 21 nt, Human
gcucacugcagccuugaccuc

SEQ ID NO: 386112 - RNA, 21 nt, Human
gcuccagcuccuaggggcagg

SEQ ID NO: 386113 - RNA, 23 nt, Human
gcucccaccucagccucccaagu

SEQ ID NO: 386114 - RNA, 20 nt, Human
gcuucauucacuggggucag

SEQ ID NO: 386115 - RNA, 22 nt, Human
ggacucaagugauccuccugcc

SEQ ID NO: 386116 - RNA, 24 nt, Human
ggauuacaggaauaagccacugug

SEQ ID NO: 386117 - RNA, 19 nt, Human
ggcaaacacacacuugcua

SEQ ID NO: 386118 - RNA, 21 nt, Human
guagagacaagguuucaccau

SEQ ID NO: 386119 - RNA, 22 nt, Human
guagagacaagguuucaccaug

SEQ ID NO: 386120 - RNA, 25 nt, Human
guagauuuucuucacauacuuaaaa

SEQ ID NO: 386121 - RNA, 21 nt, Human
gucucaaaaaaaaaaaaaaag

SEQ ID NO: 386122 - RNA, 20 nt, Human
gucugaggacuaacccuaaa

SEQ ID NO: 386123 - RNA, 22 nt, Human
uaaaacaaguaaacaugaaaac

SEQ ID NO: 386124 - RNA, 23 nt, Human
uaaaacaaguaaacaugaaaaca

SEQ ID NO: 386125 - RNA, 20 nt, Human
uaaacagaucacaaaaaaau

SEQ ID NO: 386126 - RNA, 22 nt, Human
uaaagcauuacacagaccacca

SEQ ID NO: 386127 - RNA, 21 nt, Human
uaagacaacaggcuugaauau

SEQ ID NO: 386128 - RNA, 22 nt, Human
uaagacaggacagugcuuuaaa

SEQ ID NO: 386129 - RNA, 23 nt, Human
uaaguuuuuuuuuuuucucugca

SEQ ID NO: 386130 - RNA, 18 nt, Human
uaauacacugcuaaagaa

SEQ ID NO: 386131 - RNA, 21 nt, Human
uaauuuuuauuuugguagaga

SEQ ID NO: 386132 - RNA, 22 nt, Human
uacaaaauguuaagacaacagg

SEQ ID NO: 386133 - RNA, 19 nt, Human
uacaaguuaaagcauuaca

SEQ ID NO: 386134 - RNA, 19 nt, Human
uacacagaccaccacaggc

SEQ ID NO: 386135 - RNA, 23 nt, Human
uacacagaccaccacaggccagc

SEQ ID NO: 386136 - RNA, 23 nt, Human
uacaggaauaagccacugugccc

SEQ ID NO: 386137 - RNA, 18 nt, Human
uaccuuuauggaaaauga

SEQ ID NO: 386138 - RNA, 22 nt, Human
uagagacaagguuucaccaugu

SEQ ID NO: 386139 - RNA, 21 nt, Human
uaggguuucuuccagggcugu

SEQ ID NO: 386140 - RNA, 22 nt, Human
uauaaauacagaauuagcaguu

SEQ ID NO: 386141 - RNA, 23 nt, Human
uauguagaugaauauuccacaca

SEQ ID NO: 386142 - RNA, 20 nt, Human
ucaaaaaaaaaaaaaaagau

SEQ ID NO: 386143 - RNA, 24 nt, Human
ucaaaauggagggaaccggugaca

SEQ ID NO: 386144 - RNA, 23 nt, Human
ucaauguuucuuucugcaaaaug

SEQ ID NO: 386145 - RNA, 19 nt, Human
ucacugcagccuugaccuc

SEQ ID NO: 386146 - RNA, 23 nt, Human
ucacugcagccuugaccucccag

SEQ ID NO: 386147 - RNA, 24 nt, Human
ucacugcagccuugaccucccagg

SEQ ID NO: 386148 - RNA, 21 nt, Human
ucacuuccaacucaguauaca

SEQ ID NO: 386149 - RNA, 20 nt, Human
ucagccucccaaguagcugg

SEQ ID NO: 386150 - RNA, 22 nt, Human
uccacaguguugggauuacagg

SEQ ID NO: 386151 - RNA, 18 nt, Human
uccagaguuccaaaaucc

SEQ ID NO: 386152 - RNA, 24 nt, Human
uccauaccauucuggaaggcugcc

SEQ ID NO: 386153 - RNA, 25 nt, Human
ucccaaaccaacaucuaggccagca

SEQ ID NO: 386154 - RNA, 24 nt, Human
ucccaaguagcugggaccacaggc

SEQ ID NO: 386155 - RNA, 19 nt, Human
ucccagacuauauuguucu

SEQ ID NO: 386156 - RNA, 21 nt, Human
ucuacuuuccuuuuucacucc

SEQ ID NO: 386157 - RNA, 21 nt, Human
ucuggauccagaaucucaaca

SEQ ID NO: 386158 - RNA, 18 nt, Human
ucuggcacuaggggaugg

SEQ ID NO: 386159 - RNA, 20 nt, Human
ucuggcacuaggggauggga

SEQ ID NO: 386160 - RNA, 25 nt, Human
ucuguauuaacaaauggaggcagag

SEQ ID NO: 386161 - RNA, 23 nt, Human
ucugucucaaaaaaaaaaaaaaa

SEQ ID NO: 386162 - RNA, 25 nt, Human
ucuguuaucuuuuagauucuucaga

SEQ ID NO: 386163 - RNA, 23 nt, Human
ucuuacucuccagaguuccaaaa

SEQ ID NO: 386164 - RNA, 24 nt, Human
ucuucacaucuuuaaucccccaaa

SEQ ID NO: 386165 - RNA, 20 nt, Human
ucuuccaccagugugcuagg

SEQ ID NO: 386166 - RNA, 22 nt, Human
ucuugcugucacccaggaugga

SEQ ID NO: 386167 - RNA, 24 nt, Human
ucuugcugucacccaggauggagu

SEQ ID NO: 386168 - RNA, 21 nt, Human
ucuuuauuaaaguauuugaag

SEQ ID NO: 386169 - RNA, 28 nt, Human
ugaaaacaccaaaacacagcuggagacc

SEQ ID NO: 386170 - RNA, 20 nt, Human
ugaagacuuucagcauguaa

SEQ ID NO: 386171 - RNA, 20 nt, Human
ugaauauacagccuaagcac

SEQ ID NO: 386172 - RNA, 20 nt, Human
ugacaggcgccagcaagcgu

SEQ ID NO: 386173 - RNA, 20 nt, Human
ugacuucuuagaccuuuggc

SEQ ID NO: 386174 - RNA, 21 nt, Human
ugagaaaacugggcuucccgg

SEQ ID NO: 386175 - RNA, 18 nt, Human
ugagaaggaccgaggcug

SEQ ID NO: 386176 - RNA, 22 nt, Human
ugagaggccaggacaauuauca

SEQ ID NO: 386177 - RNA, 21 nt, Human
ugaguauaugucagauaccac

SEQ ID NO: 386178 - RNA, 19 nt, Human
ugaucuguacaagcuacga

SEQ ID NO: 386179 - RNA, 21 nt, Human
ugccucggccuuccacagugu

SEQ ID NO: 386180 - RNA, 18 nt, Human
ugcuagggaagggcugcc

SEQ ID NO: 386181 - RNA, 21 nt, Human
uggacaaaaaacuacaaaaaa

SEQ ID NO: 386182 - RNA, 24 nt, Human
uggacaaaaaacuacaaaaaagug

SEQ ID NO: 386183 - RNA, 24 nt, Human
uggacucaagugauccuccugccu

SEQ ID NO: 386184 - RNA, 18 nt, Human
uggagaagaccccaaaga

SEQ ID NO: 386185 - RNA, 22 nt, Human
uggaggccagucaaaccuuuuu

SEQ ID NO: 386186 - RNA, 19 nt, Human
uggagugcaguggcaugau

SEQ ID NO: 386187 - RNA, 21 nt, Human
uggagugcaguggcaugauca

SEQ ID NO: 386188 - RNA, 24 nt, Human
uggagugcaguggcaugaucaugg

SEQ ID NO: 386189 - RNA, 18 nt, Human
uggcaaagucaaaagcua

SEQ ID NO: 386190 - RNA, 18 nt, Human
uggcaugaucauggcuca

SEQ ID NO: 386191 - RNA, 20 nt, Human
uggccuccuccauacaaguu

SEQ ID NO: 386192 - RNA, 24 nt, Human
uggcucacugcagccuugaccucc

SEQ ID NO: 386193 - RNA, 24 nt, Human
ugggaccacaggcacgugccacca

SEQ ID NO: 386194 - RNA, 19 nt, Human
ugggauuacaggaauaagc

SEQ ID NO: 386195 - RNA, 22 nt, Human
ugggauuacaggaauaagccac

SEQ ID NO: 386196 - RNA, 22 nt, Human
ugggauuacaggaauaagccac

SEQ ID NO: 386197 - RNA, 24 nt, Human
ugggauuacaggaauaagccacug

SEQ ID NO: 386198 - RNA, 26 nt, Human
ugggauuacaggaauaagccacugug

SEQ ID NO: 386199 - RNA, 22 nt, Human
ugggggauauuuccucauaacg

SEQ ID NO: 386200 - RNA, 23 nt, Human
ugguagagacaagguuucaccau

SEQ ID NO: 386201 - RNA, 24 nt, Human
ugguagagacaagguuucaccaug

SEQ ID NO: 386202 - RNA, 19 nt, Human
uggucaccuacacgcugcc

SEQ ID NO: 386203 - RNA, 18 nt, Human
ugugcuacaauuaccuuu

SEQ ID NO: 386204 - RNA, 21 nt, Human
uguuuugaguauaugucagau

SEQ ID NO: 386205 - RNA, 23 nt, Human
uucaaaauggagggaaccgguga

SEQ ID NO: 386206 - RNA, 26 nt, Human
uucacucccacuaaaaaaaccccuag

SEQ ID NO: 386207 - RNA, 21 nt, Human
uucagaauaaauacaucuuua

SEQ ID NO: 386208 - RNA, 23 nt, Human
uucauauuacaccacagugacug

SEQ ID NO: 386209 - RNA, 18 nt, Human
uucaugugacuuuuacug

SEQ ID NO: 386210 - RNA, 25 nt, Human
uuccaaaauccuuuauuuuuaaaga

SEQ ID NO: 386211 - RNA, 22 nt, Human
uucugagucaggacucuauuuc

SEQ ID NO: 386212 - RNA, 18 nt, Human
uugaguucaaauuuguac

SEQ ID NO: 386213 - RNA, 20 nt, Human
uugcucuggauccagaaucu

SEQ ID NO: 386214 - RNA, 23 nt, Human
uugcucuuaaaaaaacccuuuug

SEQ ID NO: 386215 - RNA, 23 nt, Human
uuggagugguucaugugacuuuu

SEQ ID NO: 386216 - RNA, 24 nt, Human
uugguagagacaagguuucaccau

SEQ ID NO: 386217 - RNA, 21 nt, Human
uuuacagaacaaaagguuugg

SEQ ID NO: 386218 - RNA, 19 nt, Human
uuucaccauguugccuagg

SEQ ID NO: 386219 - RNA, 23 nt, Human
uuuuacagaacaaaagguuuggg

SEQ ID NO: 386220 - RNA, 23 nt, Human
uuuugguagagacaagguuucac

SEQ ID NO: 386221 - RNA, 22 nt, Human
aaaagugaaaacagaaccuguc

SEQ ID NO: 386222 - RNA, 23 nt, Human
aagcugcucacccugggaacuug

SEQ ID NO: 386223 - RNA, 22 nt, Human
agaaaggaaauacaguagugca

SEQ ID NO: 386224 - RNA, 21 nt, Human
agccgggagccggggcggccg

SEQ ID NO: 386225 - RNA, 23 nt, Human
ccuuaguacugcauacaaucaaa

SEQ ID NO: 386226 - RNA, 22 nt, Human
cucccugauacaggaacucuga

SEQ ID NO: 386227 - RNA, 25 nt, Human
cucgcugugcccuggcgugcaagcu

SEQ ID NO: 386228 - RNA, 19 nt, Human
gaaccuguccauggaacug

SEQ ID NO: 386229 - RNA, 18 nt, Human
gaucaaguuuacacuccu

SEQ ID NO: 386230 - RNA, 18 nt, Human
gcagccgggagccggggc

SEQ ID NO: 386231 - RNA, 19 nt, Human
gcagccgggagccggggcg

SEQ ID NO: 386232 - RNA, 19 nt, Human
gggcaaggccaaggucagc

SEQ ID NO: 386233 - RNA, 23 nt, Human
ggucauauugccgcaacaguuaa

SEQ ID NO: 386234 - RNA, 20 nt, Human
uaaggcaagagucccuaugc

SEQ ID NO: 386235 - RNA, 18 nt, Human
uauuagagaaucagacaa

SEQ ID NO: 386236 - RNA, 18 nt, Human
uccaaaagcugcucaccc

SEQ ID NO: 386237 - RNA, 21 nt, Human
uccuuaaggcaagagucccua

SEQ ID NO: 386238 - RNA, 25 nt, Human
ugaaaacagaaccuguccauggaac

SEQ ID NO: 386239 - RNA, 23 nt, Human
ugcucacccugggaacuugugua

SEQ ID NO: 386240 - RNA, 22 nt, Human
uggaacuggaggaacagcagug

SEQ ID NO: 386241 - RNA, 24 nt, Human
uggaggaacagcagugugccgacg

SEQ ID NO: 386242 - RNA, 19 nt, Human
uuagaaaggaaauacagua

SEQ ID NO: 386243 - RNA, 22 nt, Human
uugaaacaugcauuucuuguuu

SEQ ID NO: 386244 - RNA, 19 nt, Human
uuuuuuuuuuucaagaucc

SEQ ID NO: 386245 - RNA, 24 nt, Human
uuuuuuuuuuuuuuuuuuuucaag

SEQ ID NO: 386246 - RNA, 20 nt, Human
acaagacagaaaaaagaaca

SEQ ID NO: 386247 - RNA, 24 nt, Human
agaaaaaagaacaugacaccuaag

SEQ ID NO: 386248 - RNA, 22 nt, Human
agacaagacagaaaaaagaaca

SEQ ID NO: 386249 - RNA, 26 nt, Human
agacagaaaaaagaacaugacaccua

SEQ ID NO: 386250 - RNA, 22 nt, Human
cagaaaaaagaacaugacaccu

SEQ ID NO: 386251 - RNA, 19 nt, Human
caugacaccuaagagaauc

SEQ ID NO: 386252 - RNA, 18 nt, Human
cccgcgccgccgccgcca

SEQ ID NO: 386253 - RNA, 22 nt, Human
cccgcgccgccgccgccaggaa

SEQ ID NO: 386254 - RNA, 19 nt, Human
ccgcgccgccgccgccagg

SEQ ID NO: 386255 - RNA, 20 nt, Human
cguugccgggcucugagccc

SEQ ID NO: 386256 - RNA, 18 nt, Human
gaagacaagacagaaaaa

SEQ ID NO: 386257 - RNA, 19 nt, Human
gacaagacagaaaaaagaa

SEQ ID NO: 386258 - RNA, 18 nt, Human
gccaggaaggaggggucc

SEQ ID NO: 386259 - RNA, 21 nt, Human
ggacagacagacgggagcagg

SEQ ID NO: 386260 - RNA, 23 nt, Human
ggacagacagacgggagcagggg

SEQ ID NO: 386261 - RNA, 20 nt, Human
ggagcaggggggcggggaca

SEQ ID NO: 386262 - RNA, 22 nt, Human
gggggcggggacagcggcuccg

SEQ ID NO: 386263 - RNA, 19 nt, Human
ugaagacaagacagaaaaa

SEQ ID NO: 386264 - RNA, 23 nt, Human
ugagucauguuuucaaagcaauc

SEQ ID NO: 386265 - RNA, 28 nt, Human
acacaaccccccucugcagcagaguccu

SEQ ID NO: 386266 - RNA, 28 nt, Human
acacaaccccccucugcagcagaguccu

SEQ ID NO: 386267 - RNA, 22 nt, Human
agaaaaucagucuacuccgggc

SEQ ID NO: 386268 - RNA, 18 nt, Human
agacaggaggguggaagg

SEQ ID NO: 386269 - RNA, 19 nt, Human
agauggucuuguggccccu

SEQ ID NO: 386270 - RNA, 23 nt, Human
aggcaggucaaaggcaguggggg

SEQ ID NO: 386271 - RNA, 18 nt, Human
aggcgguaaagcccuacu

SEQ ID NO: 386272 - RNA, 19 nt, Human
aucuguacacaaccccccu

SEQ ID NO: 386273 - RNA, 19 nt, Human
aucuguacacaaccccccu

SEQ ID NO: 386274 - RNA, 23 nt, Human
caaccccccucugcagcagaguc

SEQ ID NO: 386275 - RNA, 23 nt, Human
caaccccccucugcagcagaguc

SEQ ID NO: 386276 - RNA, 21 nt, Human
cacuguguauguagauggucu

SEQ ID NO: 386277 - RNA, 20 nt, Human
ccaaagucacuuccagaaau

SEQ ID NO: 386278 - RNA, 26 nt, Human
ccauacugacccuuuuugcaaguccc

SEQ ID NO: 386279 - RNA, 18 nt, Human
ccucuugucucacagcug

SEQ ID NO: 386280 - RNA, 21 nt, Human
ccuguggcuggcgccuggggc

SEQ ID NO: 386281 - RNA, 21 nt, Human
cucgcaugcagccaaagucac

SEQ ID NO: 386282 - RNA, 21 nt, Human
cugcaccugccaaaggcccug

SEQ ID NO: 386283 - RNA, 21 nt, Human
cugcaguccccacuugucccu

SEQ ID NO: 386284 - RNA, 23 nt, Human
cuuuuugcaagucccagugugag

SEQ ID NO: 386285 - RNA, 22 nt, Human
gacccuuuuugcaagucccagu

SEQ ID NO: 386286 - RNA, 22 nt, Human
ggcucaggguccuucuaaagcc

SEQ ID NO: 386287 - RNA, 20 nt, Human
ggucuuguggccccuggaga

SEQ ID NO: 386288 - RNA, 21 nt, Human
ggucuuguggccccuggagag

SEQ ID NO: 386289 - RNA, 24 nt, Human
ggucuuguggccccuggagagcuc

SEQ ID NO: 386290 - RNA, 20 nt, Human
gucacuuccagaaauggaau

SEQ ID NO: 386291 - RNA, 18 nt, Human
uaaagcagacaggagggu

SEQ ID NO: 386292 - RNA, 19 nt, Human
ucaggguccuucuaaagcc

SEQ ID NO: 386293 - RNA, 18 nt, Human
ucagugauuugguuugag

SEQ ID NO: 386294 - RNA, 20 nt, Human
ucccuaacccauacugaccc

SEQ ID NO: 386295 - RNA, 22 nt, Human
ucccucuugucucacagcuggg

SEQ ID NO: 386296 - RNA, 21 nt, Human
uccugucguggcgccuggggc

SEQ ID NO: 386297 - RNA, 22 nt, Human
uccuguggcuggcgccuggggc

SEQ ID NO: 386298 - RNA, 23 nt, Human
ucgaagcuaggcguaaagccuac

SEQ ID NO: 386299 - RNA, 21 nt, Human
ugaggaaaagcugguccgacc

SEQ ID NO: 386300 - RNA, 19 nt, Human
ugcaugaagggaggcaggu

SEQ ID NO: 386301 - RNA, 24 nt, Human
uggaaaagaaaaaaagaaaaucag

SEQ ID NO: 386302 - RNA, 24 nt, Human
ugucguggcgccuggggcucaggg

SEQ ID NO: 386303 - RNA, 24 nt, Human
ugugaugauaaguuagcugcaguc

SEQ ID NO: 386304 - RNA, 19 nt, Human
uguggcuggcgccuggggc

SEQ ID NO: 386305 - RNA, 22 nt, Human
uuucccuaacccauacugaccc

SEQ ID NO: 386306 - RNA, 23 nt, Human
aacaaacucaugaccuucaaaga

SEQ ID NO: 386307 - RNA, 24 nt, Human
agaaaggcagcuuucaaucacaaa

SEQ ID NO: 386308 - RNA, 19 nt, Human
agaagaggggcgcgggagg

SEQ ID NO: 386309 - RNA, 21 nt, Human
aggggcccgggacucgcggga

SEQ ID NO: 386310 - RNA, 18 nt, Human
cauauuuaaugcacacau

SEQ ID NO: 386311 - RNA, 23 nt, Human
cgcgaggccuggggcacgcgggu

SEQ ID NO: 386312 - RNA, 21 nt, Human
gaaaggcagcuuucaaucaca

SEQ ID NO: 386313 - RNA, 24 nt, Human
gaagcauauuuaaugcacacauuu

SEQ ID NO: 386314 - RNA, 21 nt, Human
gacagcgacgagggggucccc

SEQ ID NO: 386315 - RNA, 21 nt, Human
ggcgcgggaggggcccgggac

SEQ ID NO: 386316 - RNA, 18 nt, Human
ggcgugcgccgggagucg

SEQ ID NO: 386317 - RNA, 20 nt, Human
gggcgcgggaggggcccggg

SEQ ID NO: 386318 - RNA, 21 nt, Human
uaaugcacacauuugaauguu

SEQ ID NO: 386319 - RNA, 20 nt, Human
uggaguccaaguucuggauu

SEQ ID NO: 386320 - RNA, 19 nt, Human
uucaaagaugucuucgucc

SEQ ID NO: 386321 - RNA, 19 nt, Human
aaacccaaggcgauaacaa

SEQ ID NO: 386322 - RNA, 18 nt, Human
acacaucccgccccccuc

SEQ ID NO: 386323 - RNA, 21 nt, Human
acaccagaguagcaacaugaa

SEQ ID NO: 386324 - RNA, 22 nt, Human
accccaccccauccccugcccc

SEQ ID NO: 386325 - RNA, 24 nt, Human
acccgcccucgcggccuccugcua

SEQ ID NO: 386326 - RNA, 19 nt, Human
acgcggaccggacgcgggc

SEQ ID NO: 386327 - RNA, 24 nt, Human
acugcguucaggcagcugaaacag

SEQ ID NO: 386328 - RNA, 19 nt, Human
agaaagaaaggagacccug

SEQ ID NO: 386329 - RNA, 22 nt, Human
agaugaccaaagacuggcacuu

SEQ ID NO: 386330 - RNA, 18 nt, Human
agcaacauuaucaaagac

SEQ ID NO: 386331 - RNA, 20 nt, Human
aggccaggaucuauuaaacc

SEQ ID NO: 386332 - RNA, 20 nt, Human
aggccaggaucuauuaaacc

SEQ ID NO: 386333 - RNA, 22 nt, Human
aggccaggaucuauuaaaccug

SEQ ID NO: 386334 - RNA, 20 nt, Human
aggcgcggggacucgucggg

SEQ ID NO: 386335 - RNA, 20 nt, Human
agggcugggauucaaaggag

SEQ ID NO: 386336 - RNA, 26 nt, Human
agguuuccuguuguuggaccgaaagg

SEQ ID NO: 386337 - RNA, 21 nt, Human
agugauagaaaucuggaggga

SEQ ID NO: 386338 - RNA, 23 nt, Human
aucccgccccccuccccguccca

SEQ ID NO: 386339 - RNA, 18 nt, Human
caaacuccucuucuccuc

SEQ ID NO: 386340 - RNA, 22 nt, Human
caaacugcguucaggcagcuga

SEQ ID NO: 386341 - RNA, 21 nt, Human
caaaggagguacagcucuuga

SEQ ID NO: 386342 - RNA, 20 nt, Human
caacauuaucaaagacaaca

SEQ ID NO: 386343 - RNA, 23 nt, Human
caagcauauguggucaguaauac

SEQ ID NO: 386344 - RNA, 23 nt, Human
cagccccagcccucccuugauuu

SEQ ID NO: 386345 - RNA, 18 nt, Human
cagcccucccuugauuuc

SEQ ID NO: 386346 - RNA, 20 nt, Human
caggcgucugcgccccggcc

SEQ ID NO: 386347 - RNA, 21 nt, Human
cauccaaacugcguucaggcu

SEQ ID NO: 386348 - RNA, 24 nt, Human
caucccgccccccuccccguccca

SEQ ID NO: 386349 - RNA, 25 nt, Human
caucccgccccccuccccgucccac

SEQ ID NO: 386350 - RNA, 21 nt, Human
cauuuuacaaaaaagaacauu

SEQ ID NO: 386351 - RNA, 23 nt, Human
cccagugacaagcauaugugguc

SEQ ID NO: 386352 - RNA, 21 nt, Human
cccgccccccuccccguccca

SEQ ID NO: 386353 - RNA, 27 nt, Human
cccgcgauaggaucagaaccggggucc

SEQ ID NO: 386354 - RNA, 22 nt, Human
cccggccgcucccuccggcucu

SEQ ID NO: 386355 - RNA, 23 nt, Human
cccucaagacagaagugagaaag

SEQ ID NO: 386356 - RNA, 18 nt, Human
cccucucuucuuuguucc

SEQ ID NO: 386357 - RNA, 19 nt, Human
ccgcccucgcggccuccug

SEQ ID NO: 386358 - RNA, 21 nt, Human
ccucaagacagaagugagaaa

SEQ ID NO: 386359 - RNA, 19 nt, Human
ccuccuccggaccgaaagc

SEQ ID NO: 386360 - RNA, 19 nt, Human
ccuggcgcgucugggccgc

SEQ ID NO: 386361 - RNA, 23 nt, Human
cgccccggccgcucccuccggcu

SEQ ID NO: 386362 - RNA, 20 nt, Human
cgcgacugucgccucuccuc

SEQ ID NO: 386363 - RNA, 22 nt, Human
cgcgacugucgccucuccucua

SEQ ID NO: 386364 - RNA, 18 nt, Human
cggguaggccaugauaca

SEQ ID NO: 386365 - RNA, 23 nt, Human
cuagaguuuucugucuccauugg

SEQ ID NO: 386366 - RNA, 21 nt, Human
cucccuuuucguucuuuccca

SEQ ID NO: 386367 - RNA, 19 nt, Human
cuccugcuacagaccuggc

SEQ ID NO: 386368 - RNA, 23 nt, Human
cuuuucguucuuucccagcccca

SEQ ID NO: 386369 - RNA, 22 nt, Human
gaacuagaguuuucugucucca

SEQ ID NO: 386370 - RNA, 18 nt, Human
gacacaccagaguagcaa

SEQ ID NO: 386371 - RNA, 18 nt, Human
gacugucgccucuccucu

SEQ ID NO: 386372 - RNA, 19 nt, Human
gcaggcgucugcgccccgg

SEQ ID NO: 386373 - RNA, 21 nt, Human
gccacaacgccuuugaguuaa

SEQ ID NO: 386374 - RNA, 21 nt, Human
gcccucagagcucgcccuccu

SEQ ID NO: 386375 - RNA, 24 nt, Human
gcccucccuugauuucucucacuc

SEQ ID NO: 386376 - RNA, 21 nt, Human
gcgggcggaugaggcgcgggg

SEQ ID NO: 386377 - RNA, 23 nt, Human
gcggggacucgucggggcucggg

SEQ ID NO: 386378 - RNA, 21 nt, Human
gcugugccaucccuuccuuca

SEQ ID NO: 386379 - RNA, 22 nt, Human
ggaccgaaagccgggaagggga

SEQ ID NO: 386380 - RNA, 22 nt, Human
ggcaggaauuugaaaggauaaa

SEQ ID NO: 386381 - RNA, 23 nt, Human
ggcaguaagggcaagcugaagaa

SEQ ID NO: 386382 - RNA, 24 nt, Human
gguaccccaccccauccccugccc

SEQ ID NO: 386383 - RNA, 22 nt, Human
uaaaaaaaaaauacaagucuug

SEQ ID NO: 386384 - RNA, 23 nt, Human
uaaaaaaaaaauacaagucuugg

SEQ ID NO: 386385 - RNA, 25 nt, Human
uaaaaaaaaaauacaagucuuggga

SEQ ID NO: 386386 - RNA, 20 nt, Human
uaagugauuugcucaaaggc

SEQ ID NO: 386387 - RNA, 22 nt, Human
uacucaccuguaggcuucuggg

SEQ ID NO: 386388 - RNA, 21 nt, Human
uaggcccaguuaacaaacucc

SEQ ID NO: 386389 - RNA, 25 nt, Human
uaucaaagacaacauauguacaaac

SEQ ID NO: 386390 - RNA, 26 nt, Human
uaucaaagacaacauauguacaaaca

SEQ ID NO: 386391 - RNA, 24 nt, Human
ucaaagacaacauauguacaaaca

SEQ ID NO: 386392 - RNA, 24 nt, Human
ucaaagacauccaaacugcguuca

SEQ ID NO: 386393 - RNA, 22 nt, Human
ucaaauaauuuaaacccaaggc

SEQ ID NO: 386394 - RNA, 21 nt, Human
ucaccuguaggcuucugggga

SEQ ID NO: 386395 - RNA, 24 nt, Human
ucacucccucucuucuuuguucca

SEQ ID NO: 386396 - RNA, 19 nt, Human
ucagagcucgcccuccugc

SEQ ID NO: 386397 - RNA, 21 nt, Human
ucccgccccccuccccguccc

SEQ ID NO: 386398 - RNA, 25 nt, Human
ucccgccccccuccccgucccacgg

SEQ ID NO: 386399 - RNA, 23 nt, Human
ucccucaagacagaagugagaaa

SEQ ID NO: 386400 - RNA, 21 nt, Human
ucccuugauuucucucacucc

SEQ ID NO: 386401 - RNA, 24 nt, Human
uccgggcaaugucuguccucaaag

SEQ ID NO: 386402 - RNA, 18 nt, Human
uccucuauacgcgacucc

SEQ ID NO: 386403 - RNA, 21 nt, Human
uccugacagguagggacuauc

SEQ ID NO: 386404 - RNA, 19 nt, Human
ucucacaguagcacacguu

SEQ ID NO: 386405 - RNA, 20 nt, Human
ucucccggcagaaagucuaa

SEQ ID NO: 386406 - RNA, 20 nt, Human
ugagaaagaaaggagacccc

SEQ ID NO: 386407 - RNA, 23 nt, Human
ugaggccaggaucuauuaaaccu

SEQ ID NO: 386408 - RNA, 19 nt, Human
ugguaaaugaggcuacuac

SEQ ID NO: 386409 - RNA, 18 nt, Human
ugucauacagauacuugu

SEQ ID NO: 386410 - RNA, 23 nt, Human
uucaggcagcugaaacaggcuuc

SEQ ID NO: 386411 - RNA, 20 nt, Human
uucauugcaaaguguggcuc

SEQ ID NO: 386412 - RNA, 26 nt, Human
uucccagccccagcccucccuugauu

SEQ ID NO: 386413 - RNA, 22 nt, Human
uuccuguuguuggaccgaaagg

SEQ ID NO: 386414 - RNA, 21 nt, Human
uucugguuugugccuuuccca

SEQ ID NO: 386415 - RNA, 21 nt, Human
uuucccagccccagcccuccc

SEQ ID NO: 386416 - RNA, 24 nt, Human
aaaauaacagagacauguuauauc

SEQ ID NO: 386417 - RNA, 24 nt, Human
aaaguacaaagccagacauuaaag

SEQ ID NO: 386418 - RNA, 21 nt, Human
aacacauacaccaaagcuuga

SEQ ID NO: 386419 - RNA, 26 nt, Human
aaugcccacucacauuuaauaauagc

SEQ ID NO: 386420 - RNA, 21 nt, Human
acaguggcgugaucucagcuc

SEQ ID NO: 386421 - RNA, 24 nt, Human
accaugagaauucagcugaaaaac

SEQ ID NO: 386422 - RNA, 25 nt, Human
acuuuguugcccaggcuggagcaca

SEQ ID NO: 386423 - RNA, 22 nt, Human
agcugaaaaacaacucuccaga

SEQ ID NO: 386424 - RNA, 27 nt, Human
aggcagacugcaaaguacaaagccaga

SEQ ID NO: 386425 - RNA, 18 nt, Human
aguggcgugaucucagcu

SEQ ID NO: 386426 - RNA, 18 nt, Human
caaaagacuacugcagau

SEQ ID NO: 386427 - RNA, 20 nt, Human
caacaggaguguuuuaaagc

SEQ ID NO: 386428 - RNA, 22 nt, Human
caacucuccagaaugcccaccc

SEQ ID NO: 386429 - RNA, 24 nt, Human
cacacaacucugcagcauaauacc

SEQ ID NO: 386430 - RNA, 19 nt, Human
cacuuuguugcccaggcug

SEQ ID NO: 386431 - RNA, 22 nt, Human
cacuuuguugcccaggcuggag

SEQ ID NO: 386432 - RNA, 24 nt, Human
cagaaccggccaacacauacacca

SEQ ID NO: 386433 - RNA, 24 nt, Human
cagagucucacuuuguugcccagg

SEQ ID NO: 386434 - RNA, 22 nt, Human
cagauuagacaggcagacugca

SEQ ID NO: 386435 - RNA, 20 nt, Human
cagcacugugaugugaggua

SEQ ID NO: 386436 - RNA, 22 nt, Human
cagcagagcuucuucaagacuu

SEQ ID NO: 386437 - RNA, 19 nt, Human
cauaauaccaacaacagga

SEQ ID NO: 386438 - RNA, 22 nt, Human
ccacauuccaaacuucugacuu

SEQ ID NO: 386439 - RNA, 25 nt, Human
ccauauuguccuuugacccaccaca

SEQ ID NO: 386440 - RNA, 21 nt, Human
cccaggcuggagcacaguggc

SEQ ID NO: 386441 - RNA, 21 nt, Human
cccaggcuggagcacaguggc

SEQ ID NO: 386442 - RNA, 18 nt, Human
ccucaaaagacuacugca

SEQ ID NO: 386443 - RNA, 24 nt, Human
ccuccuguguucaagcaauucucc

SEQ ID NO: 386444 - RNA, 23 nt, Human
ccuguguucaagcaauucuccug

SEQ ID NO: 386445 - RNA, 24 nt, Human
cucacuuuguugcccaggcuggag

SEQ ID NO: 386446 - RNA, 23 nt, Human
cucgcugcaaccucugccuccug

SEQ ID NO: 386447 - RNA, 20 nt, Human
cugaaaaacaacucuccagg

SEQ ID NO: 386448 - RNA, 24 nt, Human
cugcaaccucugccuccuguguuc

SEQ ID NO: 386449 - RNA, 25 nt, Human
cugcagauuagacaggcagacugca

SEQ ID NO: 386450 - RNA, 24 nt, Human
cuggagcacaguggcgugaucuca

SEQ ID NO: 386451 - RNA, 20 nt, Human
cuggcacaguggccauucuu

SEQ ID NO: 386452 - RNA, 22 nt, Human
gacccaccacauuccaaacuuc

SEQ ID NO: 386453 - RNA, 22 nt, Human
gcaaccucugccuccuguguuc

SEQ ID NO: 386454 - RNA, 21 nt, Human
gcugcuuuggucuuccucagc

SEQ ID NO: 386455 - RNA, 18 nt, Human
ggcaggaguccacguugg

SEQ ID NO: 386456 - RNA, 23 nt, Human
ggcaggaguccacguugggagga

SEQ ID NO: 386457 - RNA, 22 nt, Human
ggcuggagcacaguggcgugau

SEQ ID NO: 386458 - RNA, 24 nt, Human
gggcaggaguccacguugggagga

SEQ ID NO: 386459 - RNA, 18 nt, Human
gggcaucuggcacagugg

SEQ ID NO: 386460 - RNA, 18 nt, Human
gucuuccucagcagagcu

SEQ ID NO: 386461 - RNA, 20 nt, Human
uacaacuuaagguuuccuuu

SEQ ID NO: 386462 - RNA, 24 nt, Human
uagacaauacaacuuaagguuucc

SEQ ID NO: 386463 - RNA, 23 nt, Human
uaggaaauucaaaugggcaacgc

SEQ ID NO: 386464 - RNA, 21 nt, Human
uccuguguucaagcaauucuc

SEQ ID NO: 386465 - RNA, 24 nt, Human
uccuguguucaagcaauucuccug

SEQ ID NO: 386466 - RNA, 22 nt, Human
ucgcugcaaccucugccuccug

SEQ ID NO: 386467 - RNA, 23 nt, Human
ucgcugcaaccucugccuccugu

SEQ ID NO: 386468 - RNA, 22 nt, Human
ucucacuuuguugcccaggcug

SEQ ID NO: 386469 - RNA, 23 nt, Human
ucucacuuuguugcccaggcugg

SEQ ID NO: 386470 - RNA, 24 nt, Human
ucucacuuuguugcccaggcugga

SEQ ID NO: 386471 - RNA, 19 nt, Human
ucuccagaaugcccaccca

SEQ ID NO: 386472 - RNA, 24 nt, Human
ucugccuccuguguucaagcaauu

SEQ ID NO: 386473 - RNA, 19 nt, Human
ugaaaaacaacucuccaga

SEQ ID NO: 386474 - RNA, 24 nt, Human
ugaaaaacaacucuccagaaugcc

SEQ ID NO: 386475 - RNA, 19 nt, Human
ugacuucugaucccaagcu

SEQ ID NO: 386476 - RNA, 20 nt, Human
ugacuucugaucccaagcuc

SEQ ID NO: 386477 - RNA, 22 nt, Human
ugagacagagucucacuuuguu

SEQ ID NO: 386478 - RNA, 21 nt, Human
ugcccaggcuggagcacagug

SEQ ID NO: 386479 - RNA, 24 nt, Human
ugcccaggcuggagcacaguggcg

SEQ ID NO: 386480 - RNA, 22 nt, Human
ugcugcuuuggucuuccucagc

SEQ ID NO: 386481 - RNA, 19 nt, Human
ugcuuuggucuuccucagc

SEQ ID NO: 386482 - RNA, 24 nt, Human
uggcgugaucucagcucgcugcaa

SEQ ID NO: 386483 - RNA, 22 nt, Human
ugggaggaggaaaggcgcaggc

SEQ ID NO: 386484 - RNA, 24 nt, Human
uuaaagguuuuuuguuuuuuuuuu

SEQ ID NO: 386485 - RNA, 31 nt, Human
uuggcaacgagugcugcuuuggucuuccucu

SEQ ID NO: 386486 - RNA, 18 nt, Human
uuuguugcccaggcugga

SEQ ID NO: 386487 - RNA, 20 nt, Human
uuuuuuuuuuugagacagag

SEQ ID NO: 386488 - RNA, 26 nt, Human
uuuuuuuuuuuugagacagagucuca

SEQ ID NO: 386489 - RNA, 18 nt, Human
uuuuuuuuuuuuuuuuug

SEQ ID NO: 386490 - RNA, 21 nt, Human
aaaaugagcuugcucuuuucc

SEQ ID NO: 386491 - RNA, 21 nt, Human
aagguguuaguuaauuucaug

SEQ ID NO: 386492 - RNA, 22 nt, Human
aauaaaggaggacacggaaaaa

SEQ ID NO: 386493 - RNA, 25 nt, Human
accuaggcuggagaacagggaaggc

SEQ ID NO: 386494 - RNA, 18 nt, Human
agggaaggcugaccaagg

SEQ ID NO: 386495 - RNA, 22 nt, Human
auaaaacaacagucgcccagaa

SEQ ID NO: 386496 - RNA, 24 nt, Human
caaaagcaauaaauggaguuaaau

SEQ ID NO: 386497 - RNA, 26 nt, Human
caccuaggcuggagaacagggaaggc

SEQ ID NO: 386498 - RNA, 22 nt, Human
cagggaaaaauuauaccaaaag

SEQ ID NO: 386499 - RNA, 20 nt, Human
cuggagaacagggaaggcug

SEQ ID NO: 386500 - RNA, 20 nt, Human
gagaacagggaaggcugacc

SEQ ID NO: 386501 - RNA, 22 nt, Human
gagaacagggaaggcugaccaa

SEQ ID NO: 386502 - RNA, 19 nt, Human
gcuggagaacagggaaggc

SEQ ID NO: 386503 - RNA, 22 nt, Human
uacaggugugagccaccacgcc

SEQ ID NO: 386504 - RNA, 23 nt, Human
uacaggugugagccaccacgccu

SEQ ID NO: 386505 - RNA, 25 nt, Human
uguacaaauaugaacaaauugggga

SEQ ID NO: 386506 - RNA, 18 nt, Human
uuacaggugugagccacc

SEQ ID NO: 386507 - RNA, 18 nt, Human
acaggcugguguggggac

SEQ ID NO: 386508 - RNA, 19 nt, Human
ugguguggggacaugggga

SEQ ID NO: 386509 - RNA, 20 nt, Human
aaacaaaacgaaaccaaaac

SEQ ID NO: 386510 - RNA, 20 nt, Human
aaaccaaaacaaaacaaaaa

SEQ ID NO: 386511 - RNA, 24 nt, Human
aaacccgagcugcacaggccagga

SEQ ID NO: 386512 - RNA, 21 nt, Human
aacaaaacgaaaccaaaacaa

SEQ ID NO: 386513 - RNA, 18 nt, Human
aacaaagcaagaccccau

SEQ ID NO: 386514 - RNA, 19 nt, Human
aacaaagcaagaccccauc

SEQ ID NO: 386515 - RNA, 20 nt, Human
aacaaagcaagaccccaucu

SEQ ID NO: 386516 - RNA, 21 nt, Human
aacaaagcaagaccccaucuc

SEQ ID NO: 386517 - RNA, 19 nt, Human
aacgaaaccaaaacaaaac

SEQ ID NO: 386518 - RNA, 21 nt, Human
aagcccaggaguucaaggcug

SEQ ID NO: 386519 - RNA, 24 nt, Human
aagucuggaaccaauacuucuucc

SEQ ID NO: 386520 - RNA, 20 nt, Human
aaugccccaagaggucccaa

SEQ ID NO: 386521 - RNA, 21 nt, Human
accaaaauccacaggagaauc

SEQ ID NO: 386522 - RNA, 26 nt, Human
accaauuauucugcuauuccugccau

SEQ ID NO: 386523 - RNA, 19 nt, Human
accagauauaagaaacaac

SEQ ID NO: 386524 - RNA, 22 nt, Human
accccaucuccauaaaaaauaa

SEQ ID NO: 386525 - RNA, 21 nt, Human
acccuaucucaaacaaaacga

SEQ ID NO: 386526 - RNA, 18 nt, Human
acuuaaaaccagauauaa

SEQ ID NO: 386527 - RNA, 21 nt, Human
acuucaaaaugccccaagagg

SEQ ID NO: 386528 - RNA, 20 nt, Human
acuuuaggaggcugaggcag

SEQ ID NO: 386529 - RNA, 19 nt, Human
agacugaggugggaggguc

SEQ ID NO: 386530 - RNA, 19 nt, Human
agaugccugaggcagaagc

SEQ ID NO: 386531 - RNA, 20 nt, Human
agcaacuucaggcuucaaug

SEQ ID NO: 386532 - RNA, 23 nt, Human
agcugggcacaguagugugugcc

SEQ ID NO: 386533 - RNA, 24 nt, Human
aggacugcuugaagccaggaguuc

SEQ ID NO: 386534 - RNA, 19 nt, Human
aggauuggaggggagagga

SEQ ID NO: 386535 - RNA, 18 nt, Human
aggcaggaggacugcuug

SEQ ID NO: 386536 - RNA, 24 nt, Human
aggcugaggcaggaggacugcuug

SEQ ID NO: 386537 - RNA, 18 nt, Human
agggucacuuaagcccag

SEQ ID NO: 386538 - RNA, 24 nt, Human
agggucacuuaagcccaggaguuc

SEQ ID NO: 386539 - RNA, 20 nt, Human
aggugggagggucacuuaag

SEQ ID NO: 386540 - RNA, 21 nt, Human
aguagugugugccuguagucc

SEQ ID NO: 386541 - RNA, 22 nt, Human
aucacucaccaaaauccacagg

SEQ ID NO: 386542 - RNA, 25 nt, Human
aucacucaccaaaauccacaggaga

SEQ ID NO: 386543 - RNA, 22 nt, Human
augccgcugcacuccagccuag

SEQ ID NO: 386544 - RNA, 28 nt, Human
caaaacgaaaccaaaacaaaacaaaacu

SEQ ID NO: 386545 - RNA, 21 nt, Human
caaaauccacaggagaaucuu

SEQ ID NO: 386546 - RNA, 21 nt, Human
caaaaugccccaagagguccc

SEQ ID NO: 386547 - RNA, 30 nt, Human
caaacaaaacgaaaccaaaacaaaacaaag

SEQ ID NO: 386548 - RNA, 22 nt, Human
caagaggucccaaaauuuaguc

SEQ ID NO: 386549 - RNA, 31 nt, Human
caaguuggaaaacaguuuaaugaucacucaa

SEQ ID NO: 386550 - RNA, 23 nt, Human
cacuccagccuaggugauagagc

SEQ ID NO: 386551 - RNA, 21 nt, Human
cagaagaugcuuauggcccac

SEQ ID NO: 386552 - RNA, 24 nt, Human
caggaguucaaggcugcagucaug

SEQ ID NO: 386553 - RNA, 19 nt, Human
ccaaaacaaaacaaaacuc

SEQ ID NO: 386554 - RNA, 19 nt, Human
ccgcugcacuccagccuag

SEQ ID NO: 386555 - RNA, 20 nt, Human
ccgcugcacuccagccuagg

SEQ ID NO: 386556 - RNA, 21 nt, Human
ccgcugcacuccagccuaggu

SEQ ID NO: 386557 - RNA, 24 nt, Human
ccgcugcacuccagccuaggugau

SEQ ID NO: 386558 - RNA, 19 nt, Human
cgaaaccaaaacaaaacaa

SEQ ID NO: 386559 - RNA, 22 nt, Human
cgaaaccaaaacaaaacaaaac

SEQ ID NO: 386560 - RNA, 23 nt, Human
cgcugcacuccagccuaggugau

SEQ ID NO: 386561 - RNA, 25 nt, Human
cgcugcacuccagccuaggugauag

SEQ ID NO: 386562 - RNA, 23 nt, Human
cuaagucuuagcaacuucaggcu

SEQ ID NO: 386563 - RNA, 18 nt, Human
cucaggagacugaggugg

SEQ ID NO: 386564 - RNA, 25 nt, Human
cugaggcagaagcucggaaacccga

SEQ ID NO: 386565 - RNA, 20 nt, Human
cugcacuccagccuagguga

SEQ ID NO: 386566 - RNA, 25 nt, Human
cugcacuccagccuaggugauagag

SEQ ID NO: 386567 - RNA, 21 nt, Human
cuuauggcccacguaucuucu

SEQ ID NO: 386568 - RNA, 24 nt, Human
gcacuccagccuaggugauagagc

SEQ ID NO: 386569 - RNA, 19 nt, Human
gcacuuuaggaggcugagg

SEQ ID NO: 386570 - RNA, 22 nt, Human
gcacuuuaggaggcugaggcag

SEQ ID NO: 386571 - RNA, 23 nt, Human
gcagucaugccgcugcacuccag

SEQ ID NO: 386572 - RNA, 22 nt, Human
ggcagaagcucggaaacccgag

SEQ ID NO: 386573 - RNA, 24 nt, Human
gggcacaguagugugugccuguag

SEQ ID NO: 386574 - RNA, 23 nt, Human
gggucacuuaagcccaggaguuc

SEQ ID NO: 386575 - RNA, 24 nt, Human
ggucacuuaagcccaggaguucaa

SEQ ID NO: 386576 - RNA, 23 nt, Human
gucaugccgcugcacuccagccu

SEQ ID NO: 386577 - RNA, 21 nt, Human
uaaaaccagauauaagaaaca

SEQ ID NO: 386578 - RNA, 22 nt, Human
uaaaaccagauauaagaaacaa

SEQ ID NO: 386579 - RNA, 30 nt, Human
uaaaaccagauauaagaaacaaccuaaguu

SEQ ID NO: 386580 - RNA, 21 nt, Human
uaagaaacaaccuaagucuua

SEQ ID NO: 386581 - RNA, 22 nt, Human
uagagcaagacccuaucucaaa

SEQ ID NO: 386582 - RNA, 23 nt, Human
uagagcaagacccuaucucaaac

SEQ ID NO: 386583 - RNA, 22 nt, Human
uagcaacuucaggcuucaaugu

SEQ ID NO: 386584 - RNA, 23 nt, Human
uagcugggcacaguagugugugc

SEQ ID NO: 386585 - RNA, 19 nt, Human
uagugugugccuguagucc

SEQ ID NO: 386586 - RNA, 24 nt, Human
uagugugugccuguaguccuagcu

SEQ ID NO: 386587 - RNA, 27 nt, Human
ucaaacaaaacgaaaccaaaacaaaac

SEQ ID NO: 386588 - RNA, 21 nt, Human
ucacgaccagccugggcaaca

SEQ ID NO: 386589 - RNA, 21 nt, Human
ucacucaccaaaauccacagg

SEQ ID NO: 386590 - RNA, 23 nt, Human
ucacuuaagcccaggaguucaag

SEQ ID NO: 386591 - RNA, 21 nt, Human
ucccaaaauuuagucaaggca

SEQ ID NO: 386592 - RNA, 20 nt, Human
uccccuguccagaagaugcu

SEQ ID NO: 386593 - RNA, 26 nt, Human
ucuuaaauguuuacaagcaccaauua

SEQ ID NO: 386594 - RNA, 21 nt, Human
ugaaagcaguuccccugucca

SEQ ID NO: 386595 - RNA, 23 nt, Human
ugacaaauaucagaguuuugaga

SEQ ID NO: 386596 - RNA, 18 nt, Human
ugagauacuaaagcacca

SEQ ID NO: 386597 - RNA, 25 nt, Human
ugaggcaggaggacugcuugaagcc

SEQ ID NO: 386598 - RNA, 26 nt, Human
ugaggcaggaggacugcuugaagcca

SEQ ID NO: 386599 - RNA, 18 nt, Human
ugaggugggagggucacu

SEQ ID NO: 386600 - RNA, 23 nt, Human
ugaucacucaccaaaauccacag

SEQ ID NO: 386601 - RNA, 18 nt, Human
ugccgcugcacuccagcc

SEQ ID NO: 386602 - RNA, 24 nt, Human
ugccugaggcagaagcucggaaac

SEQ ID NO: 386603 - RNA, 24 nt, Human
ugccuguaguccuagcuacucagg

SEQ ID NO: 386604 - RNA, 22 nt, Human
ugggcaacaaagcaagacccca

SEQ ID NO: 386605 - RNA, 21 nt, Human
ugugccuguaguccuagcuac

SEQ ID NO: 386606 - RNA, 21 nt, Human
uuaagcccaggaguucaaggc

SEQ ID NO: 386607 - RNA, 24 nt, Human
uuagcugggcacaguagugugugc

SEQ ID NO: 386608 - RNA, 18 nt, Human
uucaucuacuuaaaacca

SEQ ID NO: 386609 - RNA, 18 nt, Human
uuuuuuuuuuuuuuuuug

SEQ ID NO: 386610 - RNA, 19 nt, Human
uuuuuuuuuuuuuuuuugc

SEQ ID NO: 386611 - RNA, 26 nt, Human
uuuuuuuuuuuuuuuuugcaaguugg

SEQ ID NO: 386612 - RNA, 23 nt, Human
aaaaaaaaaauccaaggaugaga

SEQ ID NO: 386613 - RNA, 21 nt, Human
aaaagggggaagggagaagga

SEQ ID NO: 386614 - RNA, 22 nt, Human
aaagcaaaugaaaugaaaguca

SEQ ID NO: 386615 - RNA, 21 nt, Human
aacccuuuacaaauccugcua

SEQ ID NO: 386616 - RNA, 25 nt, Human
agaaggaaacaaaacccuuuacaaa

SEQ ID NO: 386617 - RNA, 21 nt, Human
agcucaaguaucuccaaauac

SEQ ID NO: 386618 - RNA, 19 nt, Human
aggaggcuuuauucuuuug

SEQ ID NO: 386619 - RNA, 20 nt, Human
aggccaauuaaaggcagcag

SEQ ID NO: 386620 - RNA, 19 nt, Human
agggaaaagggggaaggga

SEQ ID NO: 386621 - RNA, 19 nt, Human
auaaaaucuucucuggaag

SEQ ID NO: 386622 - RNA, 24 nt, Human
auaaugcuuugucccauauucagu

SEQ ID NO: 386623 - RNA, 20 nt, Human
cacugacauuacaaaguaca

SEQ ID NO: 386624 - RNA, 20 nt, Human
cagcagcgucuaucucccca

SEQ ID NO: 386625 - RNA, 21 nt, Human
cagcagcgucuaucuccccau

SEQ ID NO: 386626 - RNA, 19 nt, Human
caugauaugcagagacugc

SEQ ID NO: 386627 - RNA, 24 nt, Human
cauuacaaaguacagggaaaaggg

SEQ ID NO: 386628 - RNA, 19 nt, Human
cccaaaaagaccauaaugc

SEQ ID NO: 386629 - RNA, 23 nt, Human
ccccaugauaugcagagacugcc

SEQ ID NO: 386630 - RNA, 24 nt, Human
cucucagucauuauagauauugcu

SEQ ID NO: 386631 - RNA, 23 nt, Human
cucuguaaagcauuaaaaaaaaa

SEQ ID NO: 386632 - RNA, 20 nt, Human
ggaaaagcaaaugaaaugaa

SEQ ID NO: 386633 - RNA, 18 nt, Human
ggaaguugggguaggagg

SEQ ID NO: 386634 - RNA, 23 nt, Human
ggagcugugaggaccaaggccaa

SEQ ID NO: 386635 - RNA, 27 nt, Human
ggcuuuauucuuuuggcagauccucuc

SEQ ID NO: 386636 - RNA, 18 nt, Human
gggaaaagggggaaggga

SEQ ID NO: 386637 - RNA, 20 nt, Human
guccauucccugaccuuucc

SEQ ID NO: 386638 - RNA, 18 nt, Human
uacaaaguacagggaaaa

SEQ ID NO: 386639 - RNA, 19 nt, Human
uacaaaguacagggaaaag

SEQ ID NO: 386640 - RNA, 23 nt, Human
uacagggaaaagggggaagggag

SEQ ID NO: 386641 - RNA, 18 nt, Human
uauucuggaaaagcaaau

SEQ ID NO: 386642 - RNA, 22 nt, Human
ucagcucaaguaucuccaaaua

SEQ ID NO: 386643 - RNA, 23 nt, Human
ucuccaaauacauugcuguccau

SEQ ID NO: 386644 - RNA, 26 nt, Human
ucucuguaaagcauuaaaaaaaaaaa

SEQ ID NO: 386645 - RNA, 19 nt, Human
ugagauggcugaguucuca

SEQ ID NO: 386646 - RNA, 18 nt, Human
ugccccagugaagcguuc

SEQ ID NO: 386647 - RNA, 22 nt, Human
ugccccagugaagcguucgucu

SEQ ID NO: 386648 - RNA, 19 nt, Human
uguuucuuuuuggagcugu

SEQ ID NO: 386649 - RNA, 19 nt, Human
uuaaaggcagcagcgucua

SEQ ID NO: 386650 - RNA, 24 nt, Human
uuacccaaaaagaccauaaugcuu

SEQ ID NO: 386651 - RNA, 18 nt, Human
uucucagcucaaguaucu

SEQ ID NO: 386652 - RNA, 18 nt, Human
uuuggagcugugaggacc

SEQ ID NO: 386653 - RNA, 19 nt, Human
aaacugucccagcccuccc

SEQ ID NO: 386654 - RNA, 22 nt, Human
aacagacauuucuagaagaaaa

SEQ ID NO: 386655 - RNA, 22 nt, Human
aaggaacauucaaaacagggaa

SEQ ID NO: 386656 - RNA, 18 nt, Human
aaucucaacagacauuuc

SEQ ID NO: 386657 - RNA, 24 nt, Human
agacaaaggaacauucaaaacagu

SEQ ID NO: 386658 - RNA, 19 nt, Human
agcccgccgagaacaacga

SEQ ID NO: 386659 - RNA, 21 nt, Human
aggcggcgcggcggccggagc

SEQ ID NO: 386660 - RNA, 20 nt, Human
augucagagacaaaggaaca

SEQ ID NO: 386661 - RNA, 23 nt, Human
caacagacauuucuagaagaaaa

SEQ ID NO: 386662 - RNA, 20 nt, Human
cagcccgccgagaacaacga

SEQ ID NO: 386663 - RNA, 24 nt, Human
cagcccgccgagaacaacgaauac

SEQ ID NO: 386664 - RNA, 19 nt, Human
ccacaaaaacaagcagccu

SEQ ID NO: 386665 - RNA, 20 nt, Human
ccacaaaaacaagcagccuu

SEQ ID NO: 386666 - RNA, 23 nt, Human
cccaagaagaggccacgaggaaa

SEQ ID NO: 386667 - RNA, 21 nt, Human
ccucccacccaaauaaaaauc

SEQ ID NO: 386668 - RNA, 19 nt, Human
cgagaacaacgaauacgaa

SEQ ID NO: 386669 - RNA, 22 nt, Human
cgagaacaacgaauacgaaagc

SEQ ID NO: 386670 - RNA, 24 nt, Human
cgagaacaacgaauacgaaagcca

SEQ ID NO: 386671 - RNA, 27 nt, Human
cuaacggccgcggcgcggaggccccuu

SEQ ID NO: 386672 - RNA, 27 nt, Human
cucccacccaaauaaaaauccaaaugu

SEQ ID NO: 386673 - RNA, 20 nt, Human
gaaaaacugucccagcccuc

SEQ ID NO: 386674 - RNA, 19 nt, Human
gcggcgcggcggccggagc

SEQ ID NO: 386675 - RNA, 26 nt, Human
ggccgcggcgcggaggccccacagcc

SEQ ID NO: 386676 - RNA, 19 nt, Human
ggcggcgcggcggccggag

SEQ ID NO: 386677 - RNA, 18 nt, Human
guuggaaacuaaaggggg

SEQ ID NO: 386678 - RNA, 20 nt, Human
uagaagaaaaacugucccag

SEQ ID NO: 386679 - RNA, 19 nt, Human
uagcuccaaggguugggga

SEQ ID NO: 386680 - RNA, 18 nt, Human
uauuacaaaacacuuuuc

SEQ ID NO: 386681 - RNA, 21 nt, Human
uggaaacuaaagggggaaauc

SEQ ID NO: 386682 - RNA, 26 nt, Human
uggcaauauuuuacaacgcauuuagc

SEQ ID NO: 386683 - RNA, 23 nt, Human
uuagcuccaaggguuggggagaa

SEQ ID NO: 386684 - RNA, 24 nt, Human
uuagcuccaaggguuggggagaag

SEQ ID NO: 386685 - RNA, 29 nt, Human
uuuuuuuuuuuuuuuuuuuuccacaaaaa

SEQ ID NO: 386686 - RNA, 19 nt, Human
aaaaaagaaaacagacaua

SEQ ID NO: 386687 - RNA, 25 nt, Human
aaaagaaaacagacauaguuacaaa

SEQ ID NO: 386688 - RNA, 23 nt, Human
aacauuacaaaaaagaaaacaga

SEQ ID NO: 386689 - RNA, 25 nt, Human
aacauuuaacauuacaaaaaagaaa

SEQ ID NO: 386690 - RNA, 22 nt, Human
aagaaaacagacauaguuacaa

SEQ ID NO: 386691 - RNA, 25 nt, Human
aagaaaacagacauaguuacaaaga

SEQ ID NO: 386692 - RNA, 24 nt, Human
agaaaacagacauaguuacaaaga

SEQ ID NO: 386693 - RNA, 18 nt, Human
aggcagcgcgcggcccgg

SEQ ID NO: 386694 - RNA, 18 nt, Human
aguaaagcuaaacucagu

SEQ ID NO: 386695 - RNA, 23 nt, Human
auaaaauagaauuucacuuccga

SEQ ID NO: 386696 - RNA, 23 nt, Human
auaacuaucuaccaagcuacuua

SEQ ID NO: 386697 - RNA, 20 nt, Human
cacugagcacagauguuucc

SEQ ID NO: 386698 - RNA, 22 nt, Human
cagacauaguuacaaagagcaa

SEQ ID NO: 386699 - RNA, 26 nt, Human
cauucaauaacuaucuaccaagcuac

SEQ ID NO: 386700 - RNA, 21 nt, Human
cauuccugcaccacugagcac

SEQ ID NO: 386701 - RNA, 20 nt, Human
cccggcucguaacuccuccu

SEQ ID NO: 386702 - RNA, 21 nt, Human
cuaccaagcuacuuacugugu

SEQ ID NO: 386703 - RNA, 19 nt, Human
cucguaacuccuccugcug

SEQ ID NO: 386704 - RNA, 21 nt, Human
cucguaacuccuccugcugca

SEQ ID NO: 386705 - RNA, 20 nt, Human
cugcagcaggcguaucguug

SEQ ID NO: 386706 - RNA, 18 nt, Human
cuuccgagcuuccaaaua

SEQ ID NO: 386707 - RNA, 24 nt, Human
gagcuuccaaauaauccacaguuu

SEQ ID NO: 386708 - RNA, 25 nt, Human
gagcuuccaaauaauccacaguuuc

SEQ ID NO: 386709 - RNA, 20 nt, Human
gcccggcucguaacuccucc

SEQ ID NO: 386710 - RNA, 21 nt, Human
gcccggcucguaacuccuccu

SEQ ID NO: 386711 - RNA, 20 nt, Human
ggaaaaugcauuccugcacc

SEQ ID NO: 386712 - RNA, 22 nt, Human
uaacuaucuaccaagcuacuua

SEQ ID NO: 386713 - RNA, 19 nt, Human
uacaaaaaagaaaacagac

SEQ ID NO: 386714 - RNA, 18 nt, Human
uacaaagagcaaaggcag

SEQ ID NO: 386715 - RNA, 19 nt, Human
uacccgccuaaauuuagag

SEQ ID NO: 386716 - RNA, 19 nt, Human
uacuguguagcuacaacug

SEQ ID NO: 386717 - RNA, 20 nt, Human
uacuguguagcuacaacugu

SEQ ID NO: 386718 - RNA, 22 nt, Human
uacuguguagcuacaacuguga

SEQ ID NO: 386719 - RNA, 20 nt, Human
uccaaauaauccacaguuuc

SEQ ID NO: 386720 - RNA, 25 nt, Human
uccaaauaauccacaguuucuaccg

SEQ ID NO: 386721 - RNA, 23 nt, Human
uccacuucuucaucaucugucac

SEQ ID NO: 386722 - RNA, 19 nt, Human
ucuaccaagcuacuuacug

SEQ ID NO: 386723 - RNA, 24 nt, Human
uuaauucuucacugaaaucacuca

SEQ ID NO: 386724 - RNA, 21 nt, Human
uuccaaauaauccacaguuuc

SEQ ID NO: 386725 - RNA, 18 nt, Human
uuguaguaauauaagcuu

SEQ ID NO: 386726 - RNA, 26 nt, Human
uuuaacauuacaaaaaagaaaacaga

SEQ ID NO: 386727 - RNA, 22 nt, Human
uuuguaguaauauaagcuucuu

SEQ ID NO: 386728 - RNA, 18 nt, Human
aaaaucccagcaacacag

SEQ ID NO: 386729 - RNA, 18 nt, Human
aaaaugagaaggggaggg

SEQ ID NO: 386730 - RNA, 27 nt, Human
aaaccagacagacccgggucccugcaa

SEQ ID NO: 386731 - RNA, 20 nt, Human
aacagagaauucccccaaac

SEQ ID NO: 386732 - RNA, 20 nt, Human
aaccuggauccaaggcaucu

SEQ ID NO: 386733 - RNA, 19 nt, Human
aagcaacccacaacagcag

SEQ ID NO: 386734 - RNA, 21 nt, Human
aaugagaaggggagggaggaa

SEQ ID NO: 386735 - RNA, 21 nt, Human
acaggaaaacagaaucuucca

SEQ ID NO: 386736 - RNA, 21 nt, Human
agaauucccccaaacugacau

SEQ ID NO: 386737 - RNA, 19 nt, Human
agacuaaaaucccagcaac

SEQ ID NO: 386738 - RNA, 18 nt, Human
agaggaaggaugaggggc

SEQ ID NO: 386739 - RNA, 23 nt, Human
agcaacacaggcccaccggcacc

SEQ ID NO: 386740 - RNA, 21 nt, Human
agcaccacacuggccaccucg

SEQ ID NO: 386741 - RNA, 18 nt, Human
agccagcacuccuggccc

SEQ ID NO: 386742 - RNA, 22 nt, Human
aggaaagaaaggggggagucug

SEQ ID NO: 386743 - RNA, 24 nt, Human
aggaugaggggcucucuggggcuu

SEQ ID NO: 386744 - RNA, 23 nt, Human
aggcccaccggcaccuccagccu

SEQ ID NO: 386745 - RNA, 23 nt, Human
aggcgugagaacugagggaccug

SEQ ID NO: 386746 - RNA, 19 nt, Human
caaagcaacccacaacagc

SEQ ID NO: 386747 - RNA, 23 nt, Human
caacacaggcccaccggcaccuc

SEQ ID NO: 386748 - RNA, 19 nt, Human
caacagagaauucccccaa

SEQ ID NO: 386749 - RNA, 22 nt, Human
caaccugaaaaaagaccuuucu

SEQ ID NO: 386750 - RNA, 23 nt, Human
caccaaacacgaggagccagcac

SEQ ID NO: 386751 - RNA, 19 nt, Human
caccacgagggaaaucuca

SEQ ID NO: 386752 - RNA, 22 nt, Human
caccagccaaccugaaaaaaga

SEQ ID NO: 386753 - RNA, 19 nt, Human
cacgcgagucaguguauga

SEQ ID NO: 386754 - RNA, 24 nt, Human
cacuggacaggaaggcgugagaac

SEQ ID NO: 386755 - RNA, 22 nt, Human
cagaaucuuccacugcagcuag

SEQ ID NO: 386756 - RNA, 18 nt, Human
cagcaacacaggcccacc

SEQ ID NO: 386757 - RNA, 24 nt, Human
cagcaacacaggcccaccggcacc

SEQ ID NO: 386758 - RNA, 19 nt, Human
cagcacagacuaaaauccc

SEQ ID NO: 386759 - RNA, 18 nt, Human
cagcggagcccugccucc

SEQ ID NO: 386760 - RNA, 21 nt, Human
cagcugccaaguguauuuagu

SEQ ID NO: 386761 - RNA, 21 nt, Human
caucagaaaccagacagaccc

SEQ ID NO: 386762 - RNA, 18 nt, Human
ccacaacagcagcugcca

SEQ ID NO: 386763 - RNA, 23 nt, Human
ccacagcugaggcgcagcggagc

SEQ ID NO: 386764 - RNA, 24 nt, Human
cccacagcugaggcgcagcggagc

SEQ ID NO: 386765 - RNA, 18 nt, Human
cccacaggaaaacagaau

SEQ ID NO: 386766 - RNA, 18 nt, Human
ccccagcuuuggcacucg

SEQ ID NO: 386767 - RNA, 21 nt, Human
ccucacuccacccucaccaaa

SEQ ID NO: 386768 - RNA, 27 nt, Human
ccucccagcacagacuaaaaucccagg

SEQ ID NO: 386769 - RNA, 22 nt, Human
cgccagaguucgugaccccggc

SEQ ID NO: 386770 - RNA, 23 nt, Human
cgggacgcuguccagccuaaaaa

SEQ ID NO: 386771 - RNA, 20 nt, Human
cucgccggacccuggcacca

SEQ ID NO: 386772 - RNA, 20 nt, Human
cuggacaggaaggcgugaga

SEQ ID NO: 386773 - RNA, 20 nt, Human
cuuccacugcagcuagagaa

SEQ ID NO: 386774 - RNA, 20 nt, Human
gacagcccacaggugccaga

SEQ ID NO: 386775 - RNA, 19 nt, Human
gagcauuuuccccacagga

SEQ ID NO: 386776 - RNA, 19 nt, Human
gaggggcucucuggggcuu

SEQ ID NO: 386777 - RNA, 21 nt, Human
gaggggcucucuggggcuuga

SEQ ID NO: 386778 - RNA, 22 nt, Human
gcaacacaggcccaccggcacc

SEQ ID NO: 386779 - RNA, 19 nt, Human
gcagcuagagaaacuccga

SEQ ID NO: 386780 - RNA, 22 nt, Human
gccucggcgugaugcucgccgg

SEQ ID NO: 386781 - RNA, 23 nt, Human
gcucucuggggcuugagggcagc

SEQ ID NO: 386782 - RNA, 19 nt, Human
ggaaaacagaaucuuccac

SEQ ID NO: 386783 - RNA, 22 nt, Human
ggaaggaugaggggcucucugg

SEQ ID NO: 386784 - RNA, 21 nt, Human
ggggagggaggaaagaaaggg

SEQ ID NO: 386785 - RNA, 21 nt, Human
ggggagggaggaaagaaaggg

SEQ ID NO: 386786 - RNA, 18 nt, Human
guauuuagucccugaacc

SEQ ID NO: 386787 - RNA, 18 nt, Human
guauuuuguugcccuguc

SEQ ID NO: 386788 - RNA, 24 nt, Human
uagacaucaaaaugagaaggggag

SEQ ID NO: 386789 - RNA, 24 nt, Human
uauuuuguugcccugucccuucaa

SEQ ID NO: 386790 - RNA, 18 nt, Human
ucaaaaugagaaggggag

SEQ ID NO: 386791 - RNA, 18 nt, Human
ucagagggcacuaucgac

SEQ ID NO: 386792 - RNA, 18 nt, Human
ucccagcaacacaggccc

SEQ ID NO: 386793 - RNA, 18 nt, Human
ucccagcaacacaggccc

SEQ ID NO: 386794 - RNA, 20 nt, Human
ucccuuaggcaugauaaaca

SEQ ID NO: 386795 - RNA, 22 nt, Human
ucucaaguagaaccccagcuuu

SEQ ID NO: 386796 - RNA, 24 nt, Human
ucucaaguagaaccccagcuuugg

SEQ ID NO: 386797 - RNA, 22 nt, Human
ucucuggggcuugagggcagcc

SEQ ID NO: 386798 - RNA, 18 nt, Human
ugagaaggggagggagga

SEQ ID NO: 386799 - RNA, 26 nt, Human
ugagaaggggagggaggaaagaaagg

SEQ ID NO: 386800 - RNA, 18 nt, Human
ugagucacaugcaauucc

SEQ ID NO: 386801 - RNA, 22 nt, Human
ugauaaacauuuuaacacccac

SEQ ID NO: 386802 - RNA, 24 nt, Human
ugcaugagcucagugucagguagu

SEQ ID NO: 386803 - RNA, 19 nt, Human
ugcccugucccuucaacuu

SEQ ID NO: 386804 - RNA, 19 nt, Human
ugccugaggcccccacagc

SEQ ID NO: 386805 - RNA, 23 nt, Human
ugcuuggcucaucaucacagugg

SEQ ID NO: 386806 - RNA, 24 nt, Human
uggaaacaaggaccaagcaccaca

SEQ ID NO: 386807 - RNA, 27 nt, Human
uugcccugucccuucaacuuggcucca

SEQ ID NO: 386808 - RNA, 21 nt, Human
uuuggcacucgggacggguca

SEQ ID NO: 386809 - RNA, 22 nt, Human
aaaaaguccccaggcguccucc

SEQ ID NO: 386810 - RNA, 24 nt, Human
aaacaggaauauaaaacuguucca

SEQ ID NO: 386811 - RNA, 23 nt, Human
aacaauagcaauuaaaaacuuca

SEQ ID NO: 386812 - RNA, 18 nt, Human
aacaggaauauaaaacug

SEQ ID NO: 386813 - RNA, 21 nt, Human
aaguuagguagaacuaaacca

SEQ ID NO: 386814 - RNA, 26 nt, Human
aauagguacaaagaaggggcuuugcu

SEQ ID NO: 386815 - RNA, 18 nt, Human
aaugcacaaauaaugcag

SEQ ID NO: 386816 - RNA, 22 nt, Human
acaaaaaggcguaaucugcaaa

SEQ ID NO: 386817 - RNA, 24 nt, Human
acaaagaaggggcuuugcucugga

SEQ ID NO: 386818 - RNA, 24 nt, Human
agaacuaaaccaaaaugcacaaau

SEQ ID NO: 386819 - RNA, 23 nt, Human
aggaagauaaauagucuaaaaaa

SEQ ID NO: 386820 - RNA, 18 nt, Human
agggaggggaggggaggg

SEQ ID NO: 386821 - RNA, 19 nt, Human
agggaggggaggggagggc

SEQ ID NO: 386822 - RNA, 22 nt, Human
agggaggggaggggagggcagg

SEQ ID NO: 386823 - RNA, 23 nt, Human
agggaggggaggggagggcaggg

SEQ ID NO: 386824 - RNA, 19 nt, Human
aggggaagggaggggaggg

SEQ ID NO: 386825 - RNA, 19 nt, Human
aggggaggggagggcaggg

SEQ ID NO: 386826 - RNA, 23 nt, Human
aguaacugugcaaaauuuacaug

SEQ ID NO: 386827 - RNA, 23 nt, Human
auaaaauaaacgaaaugagguca

SEQ ID NO: 386828 - RNA, 20 nt, Human
auucucagcggaguggaggg

SEQ ID NO: 386829 - RNA, 23 nt, Human
auuuccuaaaagacaaaauaaaa

SEQ ID NO: 386830 - RNA, 22 nt, Human
caacugacuauuacaaaaauaa

SEQ ID NO: 386831 - RNA, 21 nt, Human
cacaaauaaugcagaaacugc

SEQ ID NO: 386832 - RNA, 23 nt, Human
cacacauucagaaggagccaccu

SEQ ID NO: 386833 - RNA, 18 nt, Human
caccuacauaguaaguua

SEQ ID NO: 386834 - RNA, 20 nt, Human
cagaaggagccaccuuugcu

SEQ ID NO: 386835 - RNA, 22 nt, Human
ccaaaaugcacaaauaaugcag

SEQ ID NO: 386836 - RNA, 24 nt, Human
ccaacugacuauuacaaaaauaaa

SEQ ID NO: 386837 - RNA, 25 nt, Human
ccuccaggauucucagcggagugga

SEQ ID NO: 386838 - RNA, 22 nt, Human
cuaaaaaacacagugcaaguaa

SEQ ID NO: 386839 - RNA, 21 nt, Human
gaagggaggggaggggagggc

SEQ ID NO: 386840 - RNA, 19 nt, Human
gaggggaagggaaggaaga

SEQ ID NO: 386841 - RNA, 21 nt, Human
ggaagggaggggaggggaggg

SEQ ID NO: 386842 - RNA, 21 nt, Human
ggaguggaggggaagggaggg

SEQ ID NO: 386843 - RNA, 20 nt, Human
ggcagagaggagagcggggu

SEQ ID NO: 386844 - RNA, 20 nt, Human
ggcccaaggcuugcauacag

SEQ ID NO: 386845 - RNA, 19 nt, Human
gggcagagaggagagcggg

SEQ ID NO: 386846 - RNA, 26 nt, Human
gggcagagaggagagcggggugggag

SEQ ID NO: 386847 - RNA, 18 nt, Human
gggcagggggcagagagg

SEQ ID NO: 386848 - RNA, 23 nt, Human
ggggaagggaggggaggggaggg

SEQ ID NO: 386849 - RNA, 18 nt, Human
ggggaggggagggcaggg

SEQ ID NO: 386850 - RNA, 19 nt, Human
ggggaggggagggcagggg

SEQ ID NO: 386851 - RNA, 21 nt, Human
ggggaggggagggcagggggc

SEQ ID NO: 386852 - RNA, 23 nt, Human
ggggaggggagggcagggggcag

SEQ ID NO: 386853 - RNA, 22 nt, Human
uaaccucugaaaauagaaagaa

SEQ ID NO: 386854 - RNA, 22 nt, Human
uaaguuagguagaacuaaacca

SEQ ID NO: 386855 - RNA, 24 nt, Human
uacugaucagcguucaguucacac

SEQ ID NO: 386856 - RNA, 19 nt, Human
uagaaagaaccaauuagua

SEQ ID NO: 386857 - RNA, 22 nt, Human
uagguagaacuaaaccaaaaug

SEQ ID NO: 386858 - RNA, 22 nt, Human
uauguacaauuacugacaaaau

SEQ ID NO: 386859 - RNA, 22 nt, Human
ugaaaaaauggaaagacaggga

SEQ ID NO: 386860 - RNA, 18 nt, Human
uggaaagacagggauuuc

SEQ ID NO: 386861 - RNA, 23 nt, Human
uggacgucuguaaagucggccca

SEQ ID NO: 386862 - RNA, 22 nt, Human
uggaggggaagggaggggaggg

SEQ ID NO: 386863 - RNA, 18 nt, Human
uguaaagagguggcuguu

SEQ ID NO: 386864 - RNA, 21 nt, Human
uguacagaugcugaccacaca

SEQ ID NO: 386865 - RNA, 21 nt, Human
uguagacauacaccuacauag

SEQ ID NO: 386866 - RNA, 20 nt, Human
uucaacacuugauucacacc

SEQ ID NO: 386867 - RNA, 22 nt, Human
uuuuuuuuuuuuuuuuuuacag

SEQ ID NO: 386868 - RNA, 25 nt, Human
aaaaaauaacauuuuccuuuugaaa

SEQ ID NO: 386869 - RNA, 25 nt, Human
aaaacaauacaaaacaaaaaauaac

SEQ ID NO: 386870 - RNA, 20 nt, Human
aacaugcuuaaaaauuagga

SEQ ID NO: 386871 - RNA, 26 nt, Human
aagcaacgcccuaacguuccuucuaa

SEQ ID NO: 386872 - RNA, 18 nt, Human
acaaaaaauaaagguaag

SEQ ID NO: 386873 - RNA, 21 nt, Human
acacuggaacucagccgacca

SEQ ID NO: 386874 - RNA, 23 nt, Human
agacaaagaugaaucugagucug

SEQ ID NO: 386875 - RNA, 18 nt, Human
agagcucauauccccaag

SEQ ID NO: 386876 - RNA, 22 nt, Human
agccgaccaaagucaccacagu

SEQ ID NO: 386877 - RNA, 20 nt, Human
aggagcaggcagccuagggc

SEQ ID NO: 386878 - RNA, 24 nt, Human
auaaaaacuauccuugggauuuaa

SEQ ID NO: 386879 - RNA, 24 nt, Human
aucuauccccauuugucuuguuuu

SEQ ID NO: 386880 - RNA, 19 nt, Human
augaagaauaacauacgug

SEQ ID NO: 386881 - RNA, 24 nt, Human
augaagcagagaauuagcaacccc

SEQ ID NO: 386882 - RNA, 21 nt, Human
auuccaccucuuccccucuug

SEQ ID NO: 386883 - RNA, 26 nt, Human
caaaacaaaaaauaacauuuuccuuu

SEQ ID NO: 386884 - RNA, 19 nt, Human
caacggaccacuguuacuu

SEQ ID NO: 386885 - RNA, 19 nt, Human
caacuucugauuccagccc

SEQ ID NO: 386886 - RNA, 24 nt, Human
cagagaauuagcaaccccaggcac

SEQ ID NO: 386887 - RNA, 26 nt, Human
caggacagugcaacaaugcuuugugu

SEQ ID NO: 386888 - RNA, 24 nt, Human
cauaacugauuuucagaagacaaa

SEQ ID NO: 386889 - RNA, 19 nt, Human
ccagcccagaaaaccuacc

SEQ ID NO: 386890 - RNA, 21 nt, Human
cccaggcacaaucuaucccca

SEQ ID NO: 386891 - RNA, 19 nt, Human
ccgaccaaagucaccacag

SEQ ID NO: 386892 - RNA, 19 nt, Human
ccgauuccaccucuucccc

SEQ ID NO: 386893 - RNA, 22 nt, Human
ccuuuuaaguacagaauccaac

SEQ ID NO: 386894 - RNA, 20 nt, Human
cucagccgaccaaagucacc

SEQ ID NO: 386895 - RNA, 22 nt, Human
cucagccgaccaaagucaccac

SEQ ID NO: 386896 - RNA, 19 nt, Human
cugagucuguaagaguccc

SEQ ID NO: 386897 - RNA, 19 nt, Human
cuggauugucgugguguug

SEQ ID NO: 386898 - RNA, 21 nt, Human
gaaauacucuaauuugaaaac

SEQ ID NO: 386899 - RNA, 22 nt, Human
gagaauuagcaaccccaggcac

SEQ ID NO: 386900 - RNA, 21 nt, Human
gagguguuuuuuuuuuuuucc

SEQ ID NO: 386901 - RNA, 23 nt, Human
gcaguaaauagcaaggaucugga

SEQ ID NO: 386902 - RNA, 18 nt, Human
ggaagaacaggaugaaga

SEQ ID NO: 386903 - RNA, 20 nt, Human
ggugacugucauaguuagcu

SEQ ID NO: 386904 - RNA, 24 nt, Human
guccccucacuugguaccagaaac

SEQ ID NO: 386905 - RNA, 19 nt, Human
gucgugguguugggggcuu

SEQ ID NO: 386906 - RNA, 22 nt, Human
uaacuugcugaaacaaaaaaaa

SEQ ID NO: 386907 - RNA, 24 nt, Human
uaagcaacuucugauuccagccca

SEQ ID NO: 386908 - RNA, 20 nt, Human
uaccacuuugggacagguuc

SEQ ID NO: 386909 - RNA, 18 nt, Human
uagaauauggccauaaca

SEQ ID NO: 386910 - RNA, 20 nt, Human
uaguaacaaauagggccuua

SEQ ID NO: 386911 - RNA, 20 nt, Human
uaucugaggagcaggcagcc

SEQ ID NO: 386912 - RNA, 18 nt, Human
uccagcccagaaaaccua

SEQ ID NO: 386913 - RNA, 25 nt, Human
uccgauuccaccucuuccccucuug

SEQ ID NO: 386914 - RNA, 24 nt, Human
ucugaggagcaggcagccuagggc

SEQ ID NO: 386915 - RNA, 22 nt, Human
ugaaauuucaggacagugcaac

SEQ ID NO: 386916 - RNA, 21 nt, Human
ugaagcagagaauuagcaacc

SEQ ID NO: 386917 - RNA, 22 nt, Human
ugaagcagagaauuagcaaccc

SEQ ID NO: 386918 - RNA, 24 nt, Human
ugacaguaccuuuuaaguacagaa

SEQ ID NO: 386919 - RNA, 22 nt, Human
ugagauggauagguaagaguua

SEQ ID NO: 386920 - RNA, 18 nt, Human
ugcaugcuguauuaggga

SEQ ID NO: 386921 - RNA, 22 nt, Human
uggccugucacguacagagggu

SEQ ID NO: 386922 - RNA, 26 nt, Human
uguagaauauggccauaacaguccca

SEQ ID NO: 386923 - RNA, 23 nt, Human
ugugccaacaugcuuaaaaauua

SEQ ID NO: 386924 - RNA, 20 nt, Human
uguuacuuuuaaucaaaacg

SEQ ID NO: 386925 - RNA, 23 nt, Human
uuaaaauuuacuauacuguagaa

SEQ ID NO: 386926 - RNA, 19 nt, Human
uuaaauauacaaaaacaac

SEQ ID NO: 386927 - RNA, 20 nt, Human
uuaugccucuuccuuucucc

SEQ ID NO: 386928 - RNA, 25 nt, Human
uucuuuuuuuuuuuuuuaaagaggg

SEQ ID NO: 386929 - RNA, 23 nt, Human
uugcugaaacaaaaaaaaaugug

SEQ ID NO: 386930 - RNA, 24 nt, Human
uugcugaaacaaaaaaaaaugugg

SEQ ID NO: 386931 - RNA, 21 nt, Human
uuuuuuuuuuuuaaagagggu

SEQ ID NO: 386932 - RNA, 21 nt, Human
uuuuuuuuuuuuuuaaagagg

SEQ ID NO: 386933 - RNA, 19 nt, Human
aaaaacauucucuguagcu

SEQ ID NO: 386934 - RNA, 19 nt, Human
aaaauagcauuugaacaga

SEQ ID NO: 386935 - RNA, 23 nt, Human
aagcaccauaaauguccccucca

SEQ ID NO: 386936 - RNA, 22 nt, Human
aagcaggaugaauuauugaaau

SEQ ID NO: 386937 - RNA, 24 nt, Human
aaguagaacauggaagcuaaauuu

SEQ ID NO: 386938 - RNA, 20 nt, Human
agacaaaaacauucucugua

SEQ ID NO: 386939 - RNA, 21 nt, Human
agauuuuuccaagcagcauac

SEQ ID NO: 386940 - RNA, 19 nt, Human
auguagcuguuuuagcuga

SEQ ID NO: 386941 - RNA, 25 nt, Human
auuccauuaaucaugggccaagaaa

SEQ ID NO: 386942 - RNA, 20 nt, Human
auuugcuuuuagucucccuu

SEQ ID NO: 386943 - RNA, 21 nt, Human
caaagcaccauaaaugucccc

SEQ ID NO: 386944 - RNA, 21 nt, Human
cagaaaaugcauaguuuccac

SEQ ID NO: 386945 - RNA, 19 nt, Human
caguagcuuccaaaagguc

SEQ ID NO: 386946 - RNA, 18 nt, Human
caugggccaagaaaaaaa

SEQ ID NO: 386947 - RNA, 21 nt, Human
ccaaagcaccauaaauguccc

SEQ ID NO: 386948 - RNA, 22 nt, Human
ccacacaauccaaagcaccaua

SEQ ID NO: 386949 - RNA, 20 nt, Human
gaucauuuaacauaguuuuu

SEQ ID NO: 386950 - RNA, 22 nt, Human
gaucauuuaacauaguuuuuga

SEQ ID NO: 386951 - RNA, 23 nt, Human
uaaaauagcauuugaacagaaaa

SEQ ID NO: 386952 - RNA, 27 nt, Human
uaagaaaggaacccuaccuaguuacau

SEQ ID NO: 386953 - RNA, 21 nt, Human
uagaacauggaagcuaaauuu

SEQ ID NO: 386954 - RNA, 19 nt, Human
ucaaaacucaacagguaua

SEQ ID NO: 386955 - RNA, 22 nt, Human
uccaaagcaccauaaauguccc

SEQ ID NO: 386956 - RNA, 20 nt, Human
uccacacaauccaaagcacc

SEQ ID NO: 386957 - RNA, 22 nt, Human
uccaugaucauaauaccucuua

SEQ ID NO: 386958 - RNA, 18 nt, Human
uccuguucagauuuuucc

SEQ ID NO: 386959 - RNA, 26 nt, Human
ugaagcaggaugaauuauugaaauca

SEQ ID NO: 386960 - RNA, 18 nt, Human
uggaacuguccuguucag

SEQ ID NO: 386961 - RNA, 23 nt, Human
ugggugcacucaaaacucaacag

SEQ ID NO: 386962 - RNA, 21 nt, Human
uuccacacaauccaaagcacc

SEQ ID NO: 386963 - RNA, 20 nt, Human
uuucuaaauguaauaaauua

SEQ ID NO: 386964 - RNA, 20 nt, Human
aacacgcuacagucacagga

SEQ ID NO: 386965 - RNA, 19 nt, Human
aagaaagugacaugaagga

SEQ ID NO: 386966 - RNA, 21 nt, Human
aagcgagaucccagcagagaa

SEQ ID NO: 386967 - RNA, 20 nt, Human
aaggaugaagcccccggugg

SEQ ID NO: 386968 - RNA, 23 nt, Human
acaauaucuaaaaagaaagugac

SEQ ID NO: 386969 - RNA, 23 nt, Human
acacacacgggguccccacgagc

SEQ ID NO: 386970 - RNA, 20 nt, Human
acacgggguccccacgagca

SEQ ID NO: 386971 - RNA, 24 nt, Human
accaaccguccucuuuccaguccc

SEQ ID NO: 386972 - RNA, 27 nt, Human
accccaucuccugcaacaucucuccaa

SEQ ID NO: 386973 - RNA, 19 nt, Human
acgcuacagucacaggauc

SEQ ID NO: 386974 - RNA, 23 nt, Human
acgcuacagucacaggaucuccu

SEQ ID NO: 386975 - RNA, 27 nt, Human
agcacagacacacaaccaaccguccuc

SEQ ID NO: 386976 - RNA, 22 nt, Human
aggaaaacucuagcggcagccg

SEQ ID NO: 386977 - RNA, 21 nt, Human
aggcacacacacggggucccc

SEQ ID NO: 386978 - RNA, 23 nt, Human
agggaccuucaaagggucuccuc

SEQ ID NO: 386979 - RNA, 22 nt, Human
aggucgaagauccccgggcagc

SEQ ID NO: 386980 - RNA, 19 nt, Human
augaaggaagcaaucuaca

SEQ ID NO: 386981 - RNA, 19 nt, Human
caaugcaggcacacacacg

SEQ ID NO: 386982 - RNA, 21 nt, Human
cacacaaccaaccguccucuu

SEQ ID NO: 386983 - RNA, 23 nt, Human
caccccaucuccugcaacaucuc

SEQ ID NO: 386984 - RNA, 22 nt, Human
cagcagagaagcaggucgaaga

SEQ ID NO: 386985 - RNA, 19 nt, Human
caggaaaacucuagcggca

SEQ ID NO: 386986 - RNA, 24 nt, Human
ccaaccguccucuuuccagucccc

SEQ ID NO: 386987 - RNA, 31 nt, Human
ccaaugcaggcacacacacgggguccccacc

SEQ ID NO: 386988 - RNA, 22 nt, Human
ccacccgagcgcggggagcagg

SEQ ID NO: 386989 - RNA, 21 nt, Human
cccccgguggagagacggaga

SEQ ID NO: 386990 - RNA, 19 nt, Human
ccccgccacccgagcgcgg

SEQ ID NO: 386991 - RNA, 21 nt, Human
ccuggaaggaugaagcccccg

SEQ ID NO: 386992 - RNA, 25 nt, Human
cgcuuagcgagcaugcaugugugua

SEQ ID NO: 386993 - RNA, 23 nt, Human
cugcaugugugggaauccggggg

SEQ ID NO: 386994 - RNA, 21 nt, Human
cuggagucccucuucuccucc

SEQ ID NO: 386995 - RNA, 21 nt, Human
gaauccgggggcuggcaggug

SEQ ID NO: 386996 - RNA, 26 nt, Human
gcacagacacacaaccaaccguccuc

SEQ ID NO: 386997 - RNA, 19 nt, Human
gcacguguguacaugucug

SEQ ID NO: 386998 - RNA, 19 nt, Human
uaaaacacgcuacagucac

SEQ ID NO: 386999 - RNA, 22 nt, Human
uaaaacacgcuacagucacagg

SEQ ID NO: 387000 - RNA, 18 nt, Human
uccccgggcagcgcgaaa

SEQ ID NO: 387001 - RNA, 23 nt, Human
ucccuggaaggaugaagcccccg

SEQ ID NO: 387002 - RNA, 20 nt, Human
uccucuuuccaguccccaca

SEQ ID NO: 387003 - RNA, 20 nt, Human
ucuccucagaucaguggagg

SEQ ID NO: 387004 - RNA, 21 nt, Human
ucuccucagaucaguggaggc

SEQ ID NO: 387005 - RNA, 19 nt, Human
uguguacaugucugcaugu

SEQ ID NO: 387006 - RNA, 22 nt, Human
uguguacaugucugcaugugug

SEQ ID NO: 387007 - RNA, 20 nt, Human
uguguacgugcacgugugua

SEQ ID NO: 387008 - RNA, 24 nt, Human
uguguacgugcacguguguacaug

SEQ ID NO: 387009 - RNA, 21 nt, Human
aaauggcggcucccccggaac

SEQ ID NO: 387010 - RNA, 19 nt, Human
aacucacaaacucucccgg

SEQ ID NO: 387011 - RNA, 18 nt, Human
aagcuccaagucuuuucu

SEQ ID NO: 387012 - RNA, 19 nt, Human
agaaguucucuguagauca

SEQ ID NO: 387013 - RNA, 23 nt, Human
caaacaaaugaaagaacuuaaca

SEQ ID NO: 387014 - RNA, 18 nt, Human
caaagcagcaacagcagc

SEQ ID NO: 387015 - RNA, 21 nt, Human
caagaauuuucuaaugcugac

SEQ ID NO: 387016 - RNA, 22 nt, Human
cacaaacucucccggaacaaag

SEQ ID NO: 387017 - RNA, 18 nt, Human
cacaaagcagcaacagca

SEQ ID NO: 387018 - RNA, 22 nt, Human
cacacagcauuaaaaggacuag

SEQ ID NO: 387019 - RNA, 21 nt, Human
caccucgccggcccuccgucc

SEQ ID NO: 387020 - RNA, 25 nt, Human
cacuaaaaaguuccagcuacugcaa

SEQ ID NO: 387021 - RNA, 21 nt, Human
cagaugcaaugccaaguccca

SEQ ID NO: 387022 - RNA, 23 nt, Human
cagcaacagcagcuucuagaaaa

SEQ ID NO: 387023 - RNA, 21 nt, Human
cagcagcuucuagaaaaugga

SEQ ID NO: 387024 - RNA, 27 nt, Human
cagcgagcucucuucgccucggguacu

SEQ ID NO: 387025 - RNA, 23 nt, Human
ccagaccccgcaccucgccggcc

SEQ ID NO: 387026 - RNA, 21 nt, Human
ccaguacaauaaagccaagaa

SEQ ID NO: 387027 - RNA, 24 nt, Human
ccaguacaauaaagccaagaauuu

SEQ ID NO: 387028 - RNA, 24 nt, Human
cccccggaacgguuuucggcccag

SEQ ID NO: 387029 - RNA, 23 nt, Human
cgaauaccagucguuaacacaaa

SEQ ID NO: 387030 - RNA, 20 nt, Human
cggcccagaaagcccagcag

SEQ ID NO: 387031 - RNA, 23 nt, Human
cgggagagagccgagcgucuccu

SEQ ID NO: 387032 - RNA, 18 nt, Human
cgggccggagcgaaggga

SEQ ID NO: 387033 - RNA, 20 nt, Human
cuagacuagguucuucuuau

SEQ ID NO: 387034 - RNA, 18 nt, Human
cuagcaaaacaauauaaa

SEQ ID NO: 387035 - RNA, 20 nt, Human
cucccggaacaaagacacuc

SEQ ID NO: 387036 - RNA, 25 nt, Human
cucuacauauagaaagcugcuuuga

SEQ ID NO: 387037 - RNA, 24 nt, Human
gaaccauacauuccgcuaauccug

SEQ ID NO: 387038 - RNA, 21 nt, Human
ggaacaaagacacucaaaaaa

SEQ ID NO: 387039 - RNA, 21 nt, Human
ggcccuccguccgggucgccu

SEQ ID NO: 387040 - RNA, 21 nt, Human
gggaacaggaaagcaaauggc

SEQ ID NO: 387041 - RNA, 18 nt, Human
gggccggagcgaagggaa

SEQ ID NO: 387042 - RNA, 21 nt, Human
uaaaacaccaguuugcuauga

SEQ ID NO: 387043 - RNA, 18 nt, Human
uaacagaacacacagcau

SEQ ID NO: 387044 - RNA, 26 nt, Human
uaacagaacacacagcauuaaaagga

SEQ ID NO: 387045 - RNA, 25 nt, Human
uagcaaaacaauauaaauuugcuga

SEQ ID NO: 387046 - RNA, 28 nt, Human
uagcaaaacaauauaaauuugcugaaaa

SEQ ID NO: 387047 - RNA, 23 nt, Human
uauugcauaggaaaacauaugca

SEQ ID NO: 387048 - RNA, 20 nt, Human
ucagcgagcucucuucgccu

SEQ ID NO: 387049 - RNA, 22 nt, Human
ucgcaucaccagaccccgcacc

SEQ ID NO: 387050 - RNA, 25 nt, Human
ucgccuacccagcaaaaacggaagu

SEQ ID NO: 387051 - RNA, 19 nt, Human
ucucacgucaucacaaagc

SEQ ID NO: 387052 - RNA, 25 nt, Human
ucucccggaacaaagacacucaaaa

SEQ ID NO: 387053 - RNA, 23 nt, Human
ugaaaaacaaaauuacaaacaaa

SEQ ID NO: 387054 - RNA, 22 nt, Human
ugcuucuuauaggaugaacacc

SEQ ID NO: 387055 - RNA, 21 nt, Human
uguauuggaaacaacuuaaua

SEQ ID NO: 387056 - RNA, 23 nt, Human
uuccuuaauucuuccugccgcuu

SEQ ID NO: 387057 - RNA, 20 nt, Human
uugcugaaaaacaaaauuac

SEQ ID NO: 387058 - RNA, 18 nt, Human
uuuaaagugaaaaacaga

SEQ ID NO: 387059 - RNA, 24 nt, Human
uuuuuuuuuaaagugaaaaacaga

SEQ ID NO: 387060 - RNA, 25 nt, Human
aaaaaccaaaagaaaagcuaaaaca

SEQ ID NO: 387061 - RNA, 18 nt, Human
aaaagaaaagcuaaaaca

SEQ ID NO: 387062 - RNA, 18 nt, Human
aaacaacagaacauaagc

SEQ ID NO: 387063 - RNA, 18 nt, Human
aaacagcuguacggccuc

SEQ ID NO: 387064 - RNA, 23 nt, Human
aacagagacagaacacaaucuag

SEQ ID NO: 387065 - RNA, 21 nt, Human
aacauaacaagaccccauuuc

SEQ ID NO: 387066 - RNA, 19 nt, Human
aagcaaaaagaaaaccauc

SEQ ID NO: 387067 - RNA, 22 nt, Human
aagcaaaaagaaaaccaucacu

SEQ ID NO: 387068 - RNA, 23 nt, Human
aagcaaaaagaaaaccaucacua

SEQ ID NO: 387069 - RNA, 23 nt, Human
aauaauauaccuagaaaaaaacc

SEQ ID NO: 387070 - RNA, 19 nt, Human
aauucccaaauugacaaag

SEQ ID NO: 387071 - RNA, 22 nt, Human
acagaacacaaucuaguauuaa

SEQ ID NO: 387072 - RNA, 21 nt, Human
acagaacauaagcagcagcaa

SEQ ID NO: 387073 - RNA, 18 nt, Human
accucguuuuuuccccua

SEQ ID NO: 387074 - RNA, 24 nt, Human
acuaauaauauaccuagaaaaaaa

SEQ ID NO: 387075 - RNA, 18 nt, Human
agaaaaaaacccaaacaa

SEQ ID NO: 387076 - RNA, 26 nt, Human
agaaaagcuaaaacauaugcaaacca

SEQ ID NO: 387077 - RNA, 20 nt, Human
agacaauaccuuauuugacu

SEQ ID NO: 387078 - RNA, 24 nt, Human
agccugggcaacauaacaagaccc

SEQ ID NO: 387079 - RNA, 19 nt, Human
agcuguacggccucuaggc

SEQ ID NO: 387080 - RNA, 18 nt, Human
aggaaaaggcucaaaaua

SEQ ID NO: 387081 - RNA, 22 nt, Human
aggaggaaaaggcucaaaauaa

SEQ ID NO: 387082 - RNA, 19 nt, Human
aggcugaggcggaaggauc

SEQ ID NO: 387083 - RNA, 19 nt, Human
auaaaacacuaauaauaua

SEQ ID NO: 387084 - RNA, 23 nt, Human
auaaggcaacugaagggacaaaa

SEQ ID NO: 387085 - RNA, 21 nt, Human
auaauauaccuagaaaaaaac

SEQ ID NO: 387086 - RNA, 22 nt, Human
auagcacagaagcaauauaauc

SEQ ID NO: 387087 - RNA, 21 nt, Human
caaauugacaaagagaaaguc

SEQ ID NO: 387088 - RNA, 21 nt, Human
caacagaacauaagcagcagc

SEQ ID NO: 387089 - RNA, 22 nt, Human
caaccagcuccauccuaaaaac

SEQ ID NO: 387090 - RNA, 24 nt, Human
caacuguagucccagcuacucagg

SEQ ID NO: 387091 - RNA, 19 nt, Human
cacaguuucauccaaucug

SEQ ID NO: 387092 - RNA, 24 nt, Human
cagcuacucaggaggcugaggcgg

SEQ ID NO: 387093 - RNA, 23 nt, Human
cauaacaagaccccauuucuaaa

SEQ ID NO: 387094 - RNA, 21 nt, Human
cauccuaaaaacaacagaacc

SEQ ID NO: 387095 - RNA, 18 nt, Human
caucuuguucuuccuaac

SEQ ID NO: 387096 - RNA, 21 nt, Human
ccaaaagaaaagcuaaaacau

SEQ ID NO: 387097 - RNA, 22 nt, Human
ccaucacuaaaaacuccucuug

SEQ ID NO: 387098 - RNA, 19 nt, Human
ccuagaaaaaaacccaaac

SEQ ID NO: 387099 - RNA, 24 nt, Human
ccugggcaacauaacaagacccca

SEQ ID NO: 387100 - RNA, 22 nt, Human
cggccucuaggcuagacugccu

SEQ ID NO: 387101 - RNA, 21 nt, Human
cguuaccuuagcuccucucca

SEQ ID NO: 387102 - RNA, 25 nt, Human
cuaaaaacuccucuugcucccucuc

SEQ ID NO: 387103 - RNA, 23 nt, Human
cuccucuugcucccucuccugac

SEQ ID NO: 387104 - RNA, 19 nt, Human
cugaauaaucugcugguac

SEQ ID NO: 387105 - RNA, 21 nt, Human
cuguagucccagcuacucagg

SEQ ID NO: 387106 - RNA, 23 nt, Human
gaacacaaucuaguauuaacugc

SEQ ID NO: 387107 - RNA, 23 nt, Human
gcaucuuguucuuccuaaccuua

SEQ ID NO: 387108 - RNA, 22 nt, Human
ggagucugaauucagccugggc

SEQ ID NO: 387109 - RNA, 21 nt, Human
guacggccucuaggcuagacu

SEQ ID NO: 387110 - RNA, 22 nt, Human
uaaaaaccaaaagaaaagcuaa

SEQ ID NO: 387111 - RNA, 24 nt, Human
uaaaaggaacaauuuauuuauugc

SEQ ID NO: 387112 - RNA, 20 nt, Human
uaacaaccagcuccauccua

SEQ ID NO: 387113 - RNA, 23 nt, Human
uaagcccaggagucugaauucag

SEQ ID NO: 387114 - RNA, 18 nt, Human
uaaguagcaaagaaggua

SEQ ID NO: 387115 - RNA, 20 nt, Human
uaauaauaauaauucccaaa

SEQ ID NO: 387116 - RNA, 23 nt, Human
uaccauagcacagaagcaauaua

SEQ ID NO: 387117 - RNA, 21 nt, Human
uauaacugauucaacauaagg

SEQ ID NO: 387118 - RNA, 25 nt, Human
uaugcaaaccaaacagcuguacggc

SEQ ID NO: 387119 - RNA, 23 nt, Human
ucaaaauaaggauaacaguucau

SEQ ID NO: 387120 - RNA, 20 nt, Human
ucauccaaucugcagucugg

SEQ ID NO: 387121 - RNA, 21 nt, Human
uccaaagucaauccaaauuac

SEQ ID NO: 387122 - RNA, 25 nt, Human
uccauccuaaaaacaacagaacaua

SEQ ID NO: 387123 - RNA, 18 nt, Human
ucuccugaccacuucugg

SEQ ID NO: 387124 - RNA, 18 nt, Human
ugaacagagacagaacac

SEQ ID NO: 387125 - RNA, 18 nt, Human
ugacaaagagaaagucuc

SEQ ID NO: 387126 - RNA, 24 nt, Human
ugaccucguuuuuuccccuauguu

SEQ ID NO: 387127 - RNA, 19 nt, Human
ugaugaggguuaggaggaa

SEQ ID NO: 387128 - RNA, 20 nt, Human
ugccuuuagaagcauggcug

SEQ ID NO: 387129 - RNA, 21 nt, Human
ugggcaacauaacaagacccc

SEQ ID NO: 387130 - RNA, 22 nt, Human
ugggcaacauaacaagacccca

SEQ ID NO: 387131 - RNA, 18 nt, Human
uggugcacaacuguaguc

SEQ ID NO: 387132 - RNA, 21 nt, Human
uggugcacaacuguaguccca

SEQ ID NO: 387133 - RNA, 24 nt, Human
ugguggugcacaacuguaguccca

SEQ ID NO: 387134 - RNA, 20 nt, Human
uguagauuuuccaaagucaa

SEQ ID NO: 387135 - RNA, 19 nt, Human
uuaaagaacauagaccaua

SEQ ID NO: 387136 - RNA, 21 nt, Human
uuaauaauaauaauucccaaa

SEQ ID NO: 387137 - RNA, 21 nt, Human
uuauacuggccuuuucuacau

SEQ ID NO: 387138 - RNA, 19 nt, Human
uuuuuuuuuuuuaaaagga

SEQ ID NO: 387139 - RNA, 21 nt, Human
uuuuuuuuuuuuuuaaaagga

SEQ ID NO: 387140 - RNA, 24 nt, Human
uuuuuuuuuuuuuuuuuuaaaagg

SEQ ID NO: 387141 - RNA, 25 nt, Human
aaacauccagcaugcauguuuaaua

SEQ ID NO: 387142 - RNA, 19 nt, Human
aacuuuauuuuucuuacac

SEQ ID NO: 387143 - RNA, 18 nt, Human
aagcaacaugguccccgc

SEQ ID NO: 387144 - RNA, 24 nt, Human
acacuuuuaaggcugaugaaaaac

SEQ ID NO: 387145 - RNA, 19 nt, Human
acgcaaguucuuugccuag

SEQ ID NO: 387146 - RNA, 27 nt, Human
agaaaaagaaacacaggcauaaaggac

SEQ ID NO: 387147 - RNA, 19 nt, Human
agaaacacaggcauaaacc

SEQ ID NO: 387148 - RNA, 18 nt, Human
caaguucuuugccuagug

SEQ ID NO: 387149 - RNA, 19 nt, Human
cauggagaaaaagaaacac

SEQ ID NO: 387150 - RNA, 20 nt, Human
cauguuacauucagcaaggc

SEQ ID NO: 387151 - RNA, 25 nt, Human
cauguuuagcuuucucauggagaaa

SEQ ID NO: 387152 - RNA, 23 nt, Human
cuagugugguuuuuccaaccccu

SEQ ID NO: 387153 - RNA, 23 nt, Human
gagaaaaagaaacacaggcauaa

SEQ ID NO: 387154 - RNA, 24 nt, Human
gccuagugugguuuuuccaacccc

SEQ ID NO: 387155 - RNA, 22 nt, Human
ggaagcaacaugguccccgccg

SEQ ID NO: 387156 - RNA, 22 nt, Human
uaaaguguuacugacacuugaa

SEQ ID NO: 387157 - RNA, 18 nt, Human
uaaguagcuagccuuaua

SEQ ID NO: 387158 - RNA, 19 nt, Human
uagugugguuuuuccaacc

SEQ ID NO: 387159 - RNA, 19 nt, Human
ucaagaccaaguauacaug

SEQ ID NO: 387160 - RNA, 22 nt, Human
ucuaaaacacaacuugaaaaca

SEQ ID NO: 387161 - RNA, 18 nt, Human
ucuuuaguuuuauuuuaa

SEQ ID NO: 387162 - RNA, 24 nt, Human
ugaaugacaacuuuauuuuucuua

SEQ ID NO: 387163 - RNA, 24 nt, Human
ugaaugacaacuuuauuuuucuua

SEQ ID NO: 387164 - RNA, 23 nt, Human
uucauguuuagcuuucucaugga

SEQ ID NO: 387165 - RNA, 24 nt, Human
uuuauuuuucuuacacuuuuaagg

SEQ ID NO: 387166 - RNA, 20 nt, Human
uuuuucuguaauaaacuuaa

SEQ ID NO: 387167 - RNA, 23 nt, Human
aaccccaaaaauauuccaggaca

SEQ ID NO: 387168 - RNA, 19 nt, Human
aagaaggcuuccucagggc

SEQ ID NO: 387169 - RNA, 24 nt, Human
aagcgggauggcugcagccaagga

SEQ ID NO: 387170 - RNA, 24 nt, Human
aaguugggcugaggcugggggcac

SEQ ID NO: 387171 - RNA, 19 nt, Human
acaguggacuuggcccaca

SEQ ID NO: 387172 - RNA, 21 nt, Human
agaaguugggcugaggcuggg

SEQ ID NO: 387173 - RNA, 24 nt, Human
aggagacaguagaggugauggggg

SEQ ID NO: 387174 - RNA, 21 nt, Human
aggagcugggggagggccggg

SEQ ID NO: 387175 - RNA, 22 nt, Human
aggcaggcuaagcgggauggcu

SEQ ID NO: 387176 - RNA, 20 nt, Human
agggaggagcugcccaggug

SEQ ID NO: 387177 - RNA, 24 nt, Human
agggcugaagguaccacacgggug

SEQ ID NO: 387178 - RNA, 18 nt, Human
agggggcaggcugggcug

SEQ ID NO: 387179 - RNA, 18 nt, Human
aggugaugggggcagccg

SEQ ID NO: 387180 - RNA, 23 nt, Human
aggugaugggggcagccgggagg

SEQ ID NO: 387181 - RNA, 18 nt, Human
auccaggcuacccccagc

SEQ ID NO: 387182 - RNA, 24 nt, Human
caaggaggacaguggacuuggccc

SEQ ID NO: 387183 - RNA, 23 nt, Human
cacauccaggcuacccccagccc

SEQ ID NO: 387184 - RNA, 28 nt, Human
cacgggugugggugaggcaggcuaagcg

SEQ ID NO: 387185 - RNA, 19 nt, Human
caggaaggagugaagacuu

SEQ ID NO: 387186 - RNA, 23 nt, Human
caggaaggagugaagacuugugg

SEQ ID NO: 387187 - RNA, 18 nt, Human
ccaaggaggacaguggac

SEQ ID NO: 387188 - RNA, 18 nt, Human
ccaggacaagauaggggg

SEQ ID NO: 387189 - RNA, 22 nt, Human
cccaaaaauauuccaggacaag

SEQ ID NO: 387190 - RNA, 21 nt, Human
cccacauccaggcuaccccca

SEQ ID NO: 387191 - RNA, 18 nt, Human
ccccugcuuagcccaggg

SEQ ID NO: 387192 - RNA, 20 nt, Human
ccccugcuuagcccagggag

SEQ ID NO: 387193 - RNA, 22 nt, Human
ccgccaaggaggacaguggacu

SEQ ID NO: 387194 - RNA, 23 nt, Human
ccucagggcucgcaggaaggagu

SEQ ID NO: 387195 - RNA, 18 nt, Human
gcagccgggagggagggg

SEQ ID NO: 387196 - RNA, 24 nt, Human
ggagacaguagaggugaugggggc

SEQ ID NO: 387197 - RNA, 22 nt, Human
ggcacagggaggagcugcccag

SEQ ID NO: 387198 - RNA, 20 nt, Human
ggggagggccgggcucaggg

SEQ ID NO: 387199 - RNA, 18 nt, Human
gggggagggccgggcuca

SEQ ID NO: 387200 - RNA, 20 nt, Human
gggggcacagggaggagcug

SEQ ID NO: 387201 - RNA, 24 nt, Human
ggugaugggggcagccgggaggga

SEQ ID NO: 387202 - RNA, 24 nt, Human
uaccacacgggugugggugaggca

SEQ ID NO: 387203 - RNA, 19 nt, Human
uagcccagggaggagacag

SEQ ID NO: 387204 - RNA, 19 nt, Human
uagggggcaggcugggcug

SEQ ID NO: 387205 - RNA, 20 nt, Human
ugaggcugggggcacaggga

SEQ ID NO: 387206 - RNA, 21 nt, Human
ugaggcugggggcacagggag

SEQ ID NO: 387207 - RNA, 18 nt, Human
ugcagccaaggagcuggg

SEQ ID NO: 387208 - RNA, 26 nt, Human
uggcugcagccaaggagcugggggag

SEQ ID NO: 387209 - RNA, 25 nt, Human
uggcugcagccaaggagcugggggg

SEQ ID NO: 387210 - RNA, 21 nt, Human
ugggggagggccgggcucagg

SEQ ID NO: 387211 - RNA, 21 nt, Human
ugggggcagccgggagggagg

SEQ ID NO: 387212 - RNA, 21 nt, Human
uugcucagugacagagccuca

SEQ ID NO: 387213 - RNA, 21 nt, Human
aacucaucuuccucaagcccc

SEQ ID NO: 387214 - RNA, 23 nt, Human
aacucaucuuccucaagccccag

SEQ ID NO: 387215 - RNA, 27 nt, Human
aacucaucuuccucaagccccagacca

SEQ ID NO: 387216 - RNA, 24 nt, Human
aaggaagaggccaguugguccagu

SEQ ID NO: 387217 - RNA, 20 nt, Human
acaaauucuuuauuuaaauc

SEQ ID NO: 387218 - RNA, 20 nt, Human
acucaucuuccucaagcccc

SEQ ID NO: 387219 - RNA, 20 nt, Human
agaaggcagaggcagcauca

SEQ ID NO: 387220 - RNA, 18 nt, Human
agaggaugccagcaggca

SEQ ID NO: 387221 - RNA, 22 nt, Human
aggccagggcauggcgguggga

SEQ ID NO: 387222 - RNA, 22 nt, Human
aucuuccucaagccccagacca

SEQ ID NO: 387223 - RNA, 20 nt, Human
caacaaacucaucuuccuca

SEQ ID NO: 387224 - RNA, 21 nt, Human
caacaaacucaucuuccucaa

SEQ ID NO: 387225 - RNA, 23 nt, Human
cacagcugugggagaagcauacu

SEQ ID NO: 387226 - RNA, 18 nt, Human
cagcaucagugacuccca

SEQ ID NO: 387227 - RNA, 22 nt, Human
cagccacagcugugggagaagc

SEQ ID NO: 387228 - RNA, 21 nt, Human
cagcccucccucuccaucccc

SEQ ID NO: 387229 - RNA, 23 nt, Human
cagcccucccucuccauccccuc

SEQ ID NO: 387230 - RNA, 23 nt, Human
cagcuguggcuggggcagcagcu

SEQ ID NO: 387231 - RNA, 22 nt, Human
caggacaggcugaaccccccac

SEQ ID NO: 387232 - RNA, 21 nt, Human
cagggaaggcugccccagaug

SEQ ID NO: 387233 - RNA, 23 nt, Human
cagggaaggcugccccagaugug

SEQ ID NO: 387234 - RNA, 23 nt, Human
caucuuccucaagccccagacca

SEQ ID NO: 387235 - RNA, 21 nt, Human
ccaauggguggcgguggcugc

SEQ ID NO: 387236 - RNA, 26 nt, Human
cccccacccugacagaaaggagcuug

SEQ ID NO: 387237 - RNA, 22 nt, Human
ccccucaccccaccccuuagcc

SEQ ID NO: 387238 - RNA, 24 nt, Human
ccucaccccaccccuuagccacag

SEQ ID NO: 387239 - RNA, 19 nt, Human
ccucuccauccccucaccc

SEQ ID NO: 387240 - RNA, 23 nt, Human
ccugcagccacagcugugggaga

SEQ ID NO: 387241 - RNA, 24 nt, Human
ccugccagggaaggcugccccaga

SEQ ID NO: 387242 - RNA, 19 nt, Human
cucagagacagaacaggcc

SEQ ID NO: 387243 - RNA, 21 nt, Human
cucagagacagaacaggccag

SEQ ID NO: 387244 - RNA, 18 nt, Human
gaauguauuaguaagcau

SEQ ID NO: 387245 - RNA, 24 nt, Human
gagcacagucagugcagcuguggc

SEQ ID NO: 387246 - RNA, 19 nt, Human
gagcucagagacagaacag

SEQ ID NO: 387247 - RNA, 18 nt, Human
gcagcagcugccacaggc

SEQ ID NO: 387248 - RNA, 18 nt, Human
ggaaugucacugcuaaaa

SEQ ID NO: 387249 - RNA, 18 nt, Human
ggacaggcugaacccccc

SEQ ID NO: 387250 - RNA, 20 nt, Human
ggcaggggcaaggccugggg

SEQ ID NO: 387251 - RNA, 20 nt, Human
ggcugccccagauguguggg

SEQ ID NO: 387252 - RNA, 18 nt, Human
ggcuggggcagcagcugc

SEQ ID NO: 387253 - RNA, 19 nt, Human
gggcaaggccugggguggg

SEQ ID NO: 387254 - RNA, 19 nt, Human
ggggagcguucaagcgggc

SEQ ID NO: 387255 - RNA, 18 nt, Human
uaggccagggcauggcgg

SEQ ID NO: 387256 - RNA, 21 nt, Human
ucaacaaacucaucuuccuca

SEQ ID NO: 387257 - RNA, 21 nt, Human
ucagagacagaacaggccagg

SEQ ID NO: 387258 - RNA, 23 nt, Human
uccaauggguggcgguggcugcg

SEQ ID NO: 387259 - RNA, 23 nt, Human
uccagcaucagaaggcagaggca

SEQ ID NO: 387260 - RNA, 21 nt, Human
ucccuauaaauuaaguuccug

SEQ ID NO: 387261 - RNA, 24 nt, Human
uccugcagccacagcugugggaga

SEQ ID NO: 387262 - RNA, 24 nt, Human
ucuacauauauauuaaccauucgu

SEQ ID NO: 387263 - RNA, 20 nt, Human
ugaaccccccacccugacag

SEQ ID NO: 387264 - RNA, 20 nt, Human
ugacagaaaggagcuugaga

SEQ ID NO: 387265 - RNA, 19 nt, Human
ugagggacugaggccccua

SEQ ID NO: 387266 - RNA, 22 nt, Human
uggagagcagcgcacugacuca

SEQ ID NO: 387267 - RNA, 21 nt, Human
uggcggugagggacugaggcc

SEQ ID NO: 387268 - RNA, 19 nt, Human
ugggagaagcauacuugua

SEQ ID NO: 387269 - RNA, 23 nt, Human
uggggcagcagcugccacaggcc

SEQ ID NO: 387270 - RNA, 24 nt, Human
uggggcagcagcugccacaggcuu

SEQ ID NO: 387271 - RNA, 22 nt, Human
uggguggcgguggcugcgggga

SEQ ID NO: 387272 - RNA, 20 nt, Human
ugguaggcagcccucccucu

SEQ ID NO: 387273 - RNA, 19 nt, Human
uguauuaguaagcaugggg

SEQ ID NO: 387274 - RNA, 22 nt, Human
uguggugagcacagucagugca

SEQ ID NO: 387275 - RNA, 18 nt, Human
uuagccacagugaaggga

SEQ ID NO: 387276 - RNA, 21 nt, Human
aaaaaacccuauacaugacca

SEQ ID NO: 387277 - RNA, 22 nt, Human
aaaaaacccuauacaugaccaa

SEQ ID NO: 387278 - RNA, 21 nt, Human
aaaaaguaaaaauuagccagg

SEQ ID NO: 387279 - RNA, 19 nt, Human
aaacagaaaagccagcccc

SEQ ID NO: 387280 - RNA, 23 nt, Human
aaacagaaaagccagccccaggg

SEQ ID NO: 387281 - RNA, 22 nt, Human
aaacagccuuagauccuacagc

SEQ ID NO: 387282 - RNA, 20 nt, Human
aaaggugaacaauguugccc

SEQ ID NO: 387283 - RNA, 25 nt, Human
aaagugcugggcccgcccacagaag

SEQ ID NO: 387284 - RNA, 18 nt, Human
aaaguucuuuacguucuc

SEQ ID NO: 387285 - RNA, 20 nt, Human
aaauuccaaaugcaaagcau

SEQ ID NO: 387286 - RNA, 21 nt, Human
aacagaaaagccagccccagg

SEQ ID NO: 387287 - RNA, 18 nt, Human
aagaaggcaccucgaggc

SEQ ID NO: 387288 - RNA, 19 nt, Human
aagagucacacacccacag

SEQ ID NO: 387289 - RNA, 19 nt, Human
aagcaaaaauuccaaaugc

SEQ ID NO: 387290 - RNA, 21 nt, Human
aagcagaacuuugauccccag

SEQ ID NO: 387291 - RNA, 20 nt, Human
aaggcaggagaauugccugg

SEQ ID NO: 387292 - RNA, 22 nt, Human
aagggggggcuuuccagacagc

SEQ ID NO: 387293 - RNA, 21 nt, Human
aaguggccacacaggccaccc

SEQ ID NO: 387294 - RNA, 24 nt, Human
aauggcugacaccugugaucccag

SEQ ID NO: 387295 - RNA, 22 nt, Human
acacaucaucaccacauggguu

SEQ ID NO: 387296 - RNA, 21 nt, Human
acaccgucucucacacacaca

SEQ ID NO: 387297 - RNA, 22 nt, Human
acaccugugaucccagugcuuc

SEQ ID NO: 387298 - RNA, 20 nt, Human
acacgggcagggggcaaguc

SEQ ID NO: 387299 - RNA, 19 nt, Human
acaguguuggccucugggc

SEQ ID NO: 387300 - RNA, 21 nt, Human
acaguguuggccucugggcug

SEQ ID NO: 387301 - RNA, 21 nt, Human
accacuguacuccagccugag

SEQ ID NO: 387302 - RNA, 24 nt, Human
accacuguacuccagccugaguga

SEQ ID NO: 387303 - RNA, 19 nt, Human
accccaccugcccugaagc

SEQ ID NO: 387304 - RNA, 22 nt, Human
acgcugcggugugguccugggc

SEQ ID NO: 387305 - RNA, 19 nt, Human
acuccagccugagugacag

SEQ ID NO: 387306 - RNA, 20 nt, Human
acuccaucucuaccaaaaaa

SEQ ID NO: 387307 - RNA, 18 nt, Human
acuguacuccagccugag

SEQ ID NO: 387308 - RNA, 24 nt, Human
acuguacuccagccugagugacag

SEQ ID NO: 387309 - RNA, 18 nt, Human
agaaaaccacaucccacc

SEQ ID NO: 387310 - RNA, 23 nt, Human
agaaaagccagccccagggucag

SEQ ID NO: 387311 - RNA, 26 nt, Human
agaaaagccagccccagggucaguaa

SEQ ID NO: 387312 - RNA, 19 nt, Human
agaauugccugaagccagg

SEQ ID NO: 387313 - RNA, 24 nt, Human
agacccacccccaaaaggccgaaa

SEQ ID NO: 387314 - RNA, 22 nt, Human
agagaccaacgcaauucaucac

SEQ ID NO: 387315 - RNA, 25 nt, Human
agaggaaggauaaggucauggggga

SEQ ID NO: 387316 - RNA, 18 nt, Human
agaguucaaggcugcaga

SEQ ID NO: 387317 - RNA, 19 nt, Human
agaugugauucccuucagu

SEQ ID NO: 387318 - RNA, 26 nt, Human
agccacaggcuuaggaaggcaagucu

SEQ ID NO: 387319 - RNA, 21 nt, Human
agccaggacuucaagaccagc

SEQ ID NO: 387320 - RNA, 24 nt, Human
agccugggcaauauagcaagacuc

SEQ ID NO: 387321 - RNA, 18 nt, Human
agccuuagauccuacagc

SEQ ID NO: 387322 - RNA, 27 nt, Human
agccuuuccucuacccccuccuccccc

SEQ ID NO: 387323 - RNA, 25 nt, Human
agcuauuuaguccaacagcaacaac

SEQ ID NO: 387324 - RNA, 22 nt, Human
aggaaacagaaaagccagcccc

SEQ ID NO: 387325 - RNA, 23 nt, Human
aggacuucaagaccagccugggc

SEQ ID NO: 387326 - RNA, 19 nt, Human
aggagauaggccaagccag

SEQ ID NO: 387327 - RNA, 19 nt, Human
aggcaagucucauugggga

SEQ ID NO: 387328 - RNA, 20 nt, Human
aggcaagucucauuggggag

SEQ ID NO: 387329 - RNA, 18 nt, Human
aggcaggagaauugccug

SEQ ID NO: 387330 - RNA, 19 nt, Human
aggcagggcaagagggagg

SEQ ID NO: 387331 - RNA, 21 nt, Human
aggccaaagcgguuuacaauc

SEQ ID NO: 387332 - RNA, 18 nt, Human
aggccugcaguuacgcug

SEQ ID NO: 387333 - RNA, 24 nt, Human
aggcugaggugagaggauugcuug

SEQ ID NO: 387334 - RNA, 18 nt, Human
agggagagagagaaaugg

SEQ ID NO: 387335 - RNA, 24 nt, Human
aggugugguggcucacaccugugg

SEQ ID NO: 387336 - RNA, 23 nt, Human
auagggguggagagaaagaggca

SEQ ID NO: 387337 - RNA, 19 nt, Human
aucccauucaguccacacc

SEQ ID NO: 387338 - RNA, 23 nt, Human
aucgcaaacagcuuuccgccccc

SEQ ID NO: 387339 - RNA, 22 nt, Human
aucuagagcagacuguccacug

SEQ ID NO: 387340 - RNA, 21 nt, Human
aucucuuuuccauucuuauua

SEQ ID NO: 387341 - RNA, 24 nt, Human
auggcaccacuguacuccagccug

SEQ ID NO: 387342 - RNA, 24 nt, Human
auuagccaggugugguggcucaca

SEQ ID NO: 387343 - RNA, 20 nt, Human
auugucccuuucucugccuu

SEQ ID NO: 387344 - RNA, 24 nt, Human
caaaaggauucuucacuuuacaaa

SEQ ID NO: 387345 - RNA, 20 nt, Human
caaauagauaaucuggagaa

SEQ ID NO: 387346 - RNA, 20 nt, Human
caaccucccagacgcacccu

SEQ ID NO: 387347 - RNA, 20 nt, Human
caagcuggauggaucaacaa

SEQ ID NO: 387348 - RNA, 20 nt, Human
cacacaaagcccgacagggc

SEQ ID NO: 387349 - RNA, 20 nt, Human
cacacacacacacacacaca

SEQ ID NO: 387350 - RNA, 20 nt, Human
cacacacacacacacacaca

SEQ ID NO: 387351 - RNA, 22 nt, Human
cacacacacacacacacacaca

SEQ ID NO: 387352 - RNA, 22 nt, Human
cacacccacaguguuggccucu

SEQ ID NO: 387353 - RNA, 25 nt, Human
caccccaccugcccugaagcccacc

SEQ ID NO: 387354 - RNA, 20 nt, Human
cacucuacuaucauuguccc

SEQ ID NO: 387355 - RNA, 19 nt, Human
cacuguacuccagccugag

SEQ ID NO: 387356 - RNA, 19 nt, Human
cacuguacuccagccugag

SEQ ID NO: 387357 - RNA, 24 nt, Human
cacuguacuccagccugagugaca

SEQ ID NO: 387358 - RNA, 25 nt, Human
cacuguacuccagccugagugacag

SEQ ID NO: 387359 - RNA, 21 nt, Human
cagaacaagacaccgucucuc

SEQ ID NO: 387360 - RNA, 24 nt, Human
cagacccacccccaaaaggccgaa

SEQ ID NO: 387361 - RNA, 24 nt, Human
cagagccuagagggagagggcuag

SEQ ID NO: 387362 - RNA, 24 nt, Human
cagcaaagaaaucccucuaagcau

SEQ ID NO: 387363 - RNA, 22 nt, Human
cagcagccuaagaacgcccucc

SEQ ID NO: 387364 - RNA, 18 nt, Human
cagcaucuggcaagcugg

SEQ ID NO: 387365 - RNA, 18 nt, Human
caggccaaaagcagugac

SEQ ID NO: 387366 - RNA, 25 nt, Human
caggcuaucucuccucugaccuccu

SEQ ID NO: 387367 - RNA, 25 nt, Human
caggucuuaggaaagacagggaucc

SEQ ID NO: 387368 - RNA, 21 nt, Human
cagugaugaguucuugcaugg

SEQ ID NO: 387369 - RNA, 21 nt, Human
cauacaggacuucugugcaau

SEQ ID NO: 387370 - RNA, 20 nt, Human
caucuggauugacacaggaa

SEQ ID NO: 387371 - RNA, 20 nt, Human
ccaaaauaucucuugcucca

SEQ ID NO: 387372 - RNA, 21 nt, Human
ccaaacguuggaaaggaacca

SEQ ID NO: 387373 - RNA, 28 nt, Human
ccaaccaguccagggaaucgcaaacagc

SEQ ID NO: 387374 - RNA, 20 nt, Human
ccacaccauagcccuaggag

SEQ ID NO: 387375 - RNA, 26 nt, Human
ccaccugcccugaagcccaccauccc

SEQ ID NO: 387376 - RNA, 20 nt, Human
ccacuguacuccagccugag

SEQ ID NO: 387377 - RNA, 20 nt, Human
ccacuguacuccagccugag

SEQ ID NO: 387378 - RNA, 21 nt, Human
ccacuguacuccagccugagu

SEQ ID NO: 387379 - RNA, 24 nt, Human
ccacuguacuccagccugagugac

SEQ ID NO: 387380 - RNA, 22 nt, Human
ccagacccacccccaaaaggcc

SEQ ID NO: 387381 - RNA, 26 nt, Human
ccaggccaaaagcagugacaacucca

SEQ ID NO: 387382 - RNA, 20 nt, Human
ccauacccuagaagugaggc

SEQ ID NO: 387383 - RNA, 23 nt, Human
cccaccaucccagcagccuaaga

SEQ ID NO: 387384 - RNA, 20 nt, Human
cccacccccaaaaggccgaa

SEQ ID NO: 387385 - RNA, 19 nt, Human
cccaugggcuuagaugcag

SEQ ID NO: 387386 - RNA, 20 nt, Human
cccaugggcuuagaugcagg

SEQ ID NO: 387387 - RNA, 20 nt, Human
ccccagccagcuugggaggg

SEQ ID NO: 387388 - RNA, 24 nt, Human
ccccuccuccccccacccgccuua

SEQ ID NO: 387389 - RNA, 21 nt, Human
cccgaccaaccaguccaggga

SEQ ID NO: 387390 - RNA, 23 nt, Human
cccuaggagauaggccaagccag

SEQ ID NO: 387391 - RNA, 20 nt, Human
cccucugaauaggaucucca

SEQ ID NO: 387392 - RNA, 21 nt, Human
cccuggccuuggaacaagaua

SEQ ID NO: 387393 - RNA, 22 nt, Human
ccgccuugcuucagagccgccc

SEQ ID NO: 387394 - RNA, 22 nt, Human
ccugaagccaggacuucaagac

SEQ ID NO: 387395 - RNA, 20 nt, Human
ccugggugaagauggggcuc

SEQ ID NO: 387396 - RNA, 18 nt, Human
ccugugguccucccuacu

SEQ ID NO: 387397 - RNA, 22 nt, Human
cgaaaugggcagcuauugggua

SEQ ID NO: 387398 - RNA, 21 nt, Human
cgacagggcuuucucagggcu

SEQ ID NO: 387399 - RNA, 22 nt, Human
cgcccccaaccugcagguguuu

SEQ ID NO: 387400 - RNA, 19 nt, Human
cggcugacuacagaugcug

SEQ ID NO: 387401 - RNA, 22 nt, Human
cgggaggcugaggugagaggau

SEQ ID NO: 387402 - RNA, 21 nt, Human
cuaacucaagcgaauccacgg

SEQ ID NO: 387403 - RNA, 21 nt, Human
cuacccccuccuccccccacc

SEQ ID NO: 387404 - RNA, 21 nt, Human
cucacacacacacacacacac

SEQ ID NO: 387405 - RNA, 20 nt, Human
cucacaccugugguccuccc

SEQ ID NO: 387406 - RNA, 19 nt, Human
cucauaaaacccauccacc

SEQ ID NO: 387407 - RNA, 21 nt, Human
cuccacuccgccggaaagggg

SEQ ID NO: 387408 - RNA, 21 nt, Human
cuccccccacccgccuuaaaa

SEQ ID NO: 387409 - RNA, 26 nt, Human
cuccccccacccgccuuaaaaaaccc

SEQ ID NO: 387410 - RNA, 22 nt, Human
cugaagcccaccaucccagcag

SEQ ID NO: 387411 - RNA, 24 nt, Human
cugacaccugugaucccagugcuu

SEQ ID NO: 387412 - RNA, 19 nt, Human
cugcagcaucuggcaagcu

SEQ ID NO: 387413 - RNA, 20 nt, Human
cuggaggcaaaggcaggaga

SEQ ID NO: 387414 - RNA, 19 nt, Human
cuucaagaccagccugggc

SEQ ID NO: 387415 - RNA, 20 nt, Human
gaaacagaaaagccagcccc

SEQ ID NO: 387416 - RNA, 19 nt, Human
gaaaucacaaguacggcca

SEQ ID NO: 387417 - RNA, 22 nt, Human
gaaaucacaaguacggccagac

SEQ ID NO: 387418 - RNA, 27 nt, Human
gaaaucuucccgauacauccucacauu

SEQ ID NO: 387419 - RNA, 24 nt, Human
gaacauagaccagaccaucagcaa

SEQ ID NO: 387420 - RNA, 26 nt, Human
gagccgcccaauucucaccccaccug

SEQ ID NO: 387421 - RNA, 19 nt, Human
gagcugacaaccccagguc

SEQ ID NO: 387422 - RNA, 24 nt, Human
gaggugagaggauugcuugagccc

SEQ ID NO: 387423 - RNA, 22 nt, Human
gaguugaagcccacaugcccaa

SEQ ID NO: 387424 - RNA, 23 nt, Human
gauugcuugagcccagaguucaa

SEQ ID NO: 387425 - RNA, 22 nt, Human
gcagucaggcacaccggccuac

SEQ ID NO: 387426 - RNA, 20 nt, Human
gcauuaaaccaaccucccag

SEQ ID NO: 387427 - RNA, 18 nt, Human
gccagaaguuugaguucu

SEQ ID NO: 387428 - RNA, 22 nt, Human
gccagacccacccccaaaaggc

SEQ ID NO: 387429 - RNA, 19 nt, Human
gccaguguucccauaucuc

SEQ ID NO: 387430 - RNA, 21 nt, Human
gcuaagugaaugugcauaugu

SEQ ID NO: 387431 - RNA, 18 nt, Human
gcugacaccugugauccc

SEQ ID NO: 387432 - RNA, 18 nt, Human
gcugacuacagaugcugu

SEQ ID NO: 387433 - RNA, 22 nt, Human
ggaaaggagcagacauauucuc

SEQ ID NO: 387434 - RNA, 22 nt, Human
ggaaaggggcggaagccgagga

SEQ ID NO: 387435 - RNA, 25 nt, Human
ggacugagggaagagggaagaccgu

SEQ ID NO: 387436 - RNA, 18 nt, Human
ggagagagagaaaugggg

SEQ ID NO: 387437 - RNA, 23 nt, Human
ggaggcugaggugagaggauugc

SEQ ID NO: 387438 - RNA, 18 nt, Human
ggcaagagggagggagag

SEQ ID NO: 387439 - RNA, 22 nt, Human
ggccugggugaagauggggcuc

SEQ ID NO: 387440 - RNA, 22 nt, Human
ggcggaagccgaggaagaggau

SEQ ID NO: 387441 - RNA, 21 nt, Human
gggaggcugaggugagaggau

SEQ ID NO: 387442 - RNA, 23 nt, Human
gggaggcugaggugagaggauug

SEQ ID NO: 387443 - RNA, 21 nt, Human
gggcaagucuucagcagaggg

SEQ ID NO: 387444 - RNA, 21 nt, Human
gggggcuuuccagacagccac

SEQ ID NO: 387445 - RNA, 24 nt, Human
gggugcaauggcugacaccuguga

SEQ ID NO: 387446 - RNA, 24 nt, Human
gguaccuauaaauauggacagaag

SEQ ID NO: 387447 - RNA, 23 nt, Human
gguggcucacaccugugguccuc

SEQ ID NO: 387448 - RNA, 19 nt, Human
guacuccagccugagugac

SEQ ID NO: 387449 - RNA, 18 nt, Human
gugugguggcucacaccu

SEQ ID NO: 387450 - RNA, 23 nt, Human
uaaagagucacacacccacagug

SEQ ID NO: 387451 - RNA, 18 nt, Human
uaacucaggccaaagcgg

SEQ ID NO: 387452 - RNA, 19 nt, Human
uaagaaaaccacaucccac

SEQ ID NO: 387453 - RNA, 26 nt, Human
uacagaucuucuuuaguucuuacaaa

SEQ ID NO: 387454 - RNA, 21 nt, Human
uacggccagacccacccccaa

SEQ ID NO: 387455 - RNA, 20 nt, Human
uacuccagccugagugacag

SEQ ID NO: 387456 - RNA, 19 nt, Human
uacugguacaggaaacaga

SEQ ID NO: 387457 - RNA, 23 nt, Human
uagaagugaggcuggauccuggu

SEQ ID NO: 387458 - RNA, 19 nt, Human
uagaccagaccaucagcaa

SEQ ID NO: 387459 - RNA, 24 nt, Human
uaggaaggcaagucucauugggga

SEQ ID NO: 387460 - RNA, 22 nt, Human
uaggcugaagcccaaacuauaa

SEQ ID NO: 387461 - RNA, 25 nt, Human
uauagcaagacuccaucucuaccaa

SEQ ID NO: 387462 - RNA, 21 nt, Human
ucacacacacacacacacaca

SEQ ID NO: 387463 - RNA, 18 nt, Human
ucacucgccagcaugaac

SEQ ID NO: 387464 - RNA, 19 nt, Human
ucagccaggucuccggcug

SEQ ID NO: 387465 - RNA, 20 nt, Human
ucaggccaaagcgguuuaca

SEQ ID NO: 387466 - RNA, 19 nt, Human
ucauaaaacccauccaccc

SEQ ID NO: 387467 - RNA, 21 nt, Human
uccacaccauagcccuaggag

SEQ ID NO: 387468 - RNA, 25 nt, Human
uccacagccacaggcuuaggaaggc

SEQ ID NO: 387469 - RNA, 25 nt, Human
uccagacagccacagugaugaguuc

SEQ ID NO: 387470 - RNA, 18 nt, Human
uccagccugagugacaga

SEQ ID NO: 387471 - RNA, 22 nt, Human
uccaggccaaaagcagugacaa

SEQ ID NO: 387472 - RNA, 18 nt, Human
ucccaaacuccaggccaa

SEQ ID NO: 387473 - RNA, 18 nt, Human
ucccaaaguucagacauc

SEQ ID NO: 387474 - RNA, 20 nt, Human
ucccaaaguucagacaucca

SEQ ID NO: 387475 - RNA, 18 nt, Human
ucccauucaguccacacc

SEQ ID NO: 387476 - RNA, 20 nt, Human
ucccuuucucugccuucaca

SEQ ID NO: 387477 - RNA, 22 nt, Human
uccgccggaaaggggcggaagc

SEQ ID NO: 387478 - RNA, 19 nt, Human
uccucuacccccuccuccc

SEQ ID NO: 387479 - RNA, 23 nt, Human
uccucuacccccuccucccccca

SEQ ID NO: 387480 - RNA, 26 nt, Human
uccucuacccccuccuccccccaccc

SEQ ID NO: 387481 - RNA, 22 nt, Human
uccucuucugcagaaaaaugca

SEQ ID NO: 387482 - RNA, 19 nt, Human
ucgggaggcugaggugaga

SEQ ID NO: 387483 - RNA, 22 nt, Human
ucuagccagggccuggucucug

SEQ ID NO: 387484 - RNA, 21 nt, Human
ucucacacacacacacacaca

SEQ ID NO: 387485 - RNA, 28 nt, Human
ucucacacacacacacacacacacacaa

SEQ ID NO: 387486 - RNA, 22 nt, Human
ucucauaaaacccauccaccca

SEQ ID NO: 387487 - RNA, 22 nt, Human
ucucuaccaaaaaaaaaaaaaa

SEQ ID NO: 387488 - RNA, 19 nt, Human
ucugcagcaucuggcaagc

SEQ ID NO: 387489 - RNA, 21 nt, Human
ugaaagaagagggagccagaa

SEQ ID NO: 387490 - RNA, 22 nt, Human
ugaaagaagagggagccagaag

SEQ ID NO: 387491 - RNA, 22 nt, Human
ugaagcaaacagccuuagaucc

SEQ ID NO: 387492 - RNA, 20 nt, Human
ugaagcccacaugcccaaaa

SEQ ID NO: 387493 - RNA, 18 nt, Human
ugaauggagagccugagu

SEQ ID NO: 387494 - RNA, 22 nt, Human
ugacaaccccaggucuuaggaa

SEQ ID NO: 387495 - RNA, 24 nt, Human
ugagaggccugcaguuacgcugcg

SEQ ID NO: 387496 - RNA, 19 nt, Human
ugagauugagggaaaagaa

SEQ ID NO: 387497 - RNA, 22 nt, Human
ugagggaagagggaagaccgug

SEQ ID NO: 387498 - RNA, 21 nt, Human
ugaggugagaggauugcuuga

SEQ ID NO: 387499 - RNA, 22 nt, Human
ugaggugagaggauugcuugag

SEQ ID NO: 387500 - RNA, 24 nt, Human
ugaggugagaggauugcuugagcc

SEQ ID NO: 387501 - RNA, 19 nt, Human
ugauccccagggcaagaag

SEQ ID NO: 387502 - RNA, 24 nt, Human
ugaugucgaggaguugaagcccac

SEQ ID NO: 387503 - RNA, 21 nt, Human
ugauucccuucagugguuaug

SEQ ID NO: 387504 - RNA, 21 nt, Human
ugcagugguuauuucuuuaaa

SEQ ID NO: 387505 - RNA, 28 nt, Human
ugcccugaagcccaccaucccagcagcc

SEQ ID NO: 387506 - RNA, 22 nt, Human
ugccgcgcccaaagcgaguuuc

SEQ ID NO: 387507 - RNA, 24 nt, Human
ugcgcaucuacucagcaccagcgu

SEQ ID NO: 387508 - RNA, 24 nt, Human
ugcuuucccccuuuuucgcugaga

SEQ ID NO: 387509 - RNA, 20 nt, Human
uggaaaggaaccaacccuaa

SEQ ID NO: 387510 - RNA, 20 nt, Human
uggcaccacuguacuccagc

SEQ ID NO: 387511 - RNA, 23 nt, Human
uggcaggacagggccacaggcua

SEQ ID NO: 387512 - RNA, 22 nt, Human
uggccacacaggccaccccagc

SEQ ID NO: 387513 - RNA, 19 nt, Human
uggcucacaccuguggucc

SEQ ID NO: 387514 - RNA, 24 nt, Human
uggcugacaccugugaucccagug

SEQ ID NO: 387515 - RNA, 23 nt, Human
ugggaaggauuugggacugaggg

SEQ ID NO: 387516 - RNA, 18 nt, Human
ugggaggggcuaaaggca

SEQ ID NO: 387517 - RNA, 23 nt, Human
ugugguggcucacaccugugguc

SEQ ID NO: 387518 - RNA, 18 nt, Human
uguuuguuuucuaagcag

SEQ ID NO: 387519 - RNA, 23 nt, Human
uguuuuguuuuguuuuaccuuua

SEQ ID NO: 387520 - RNA, 23 nt, Human
uuacgcugcggugugguccuggg

SEQ ID NO: 387521 - RNA, 25 nt, Human
uucagagccgcccaauucucacccc

SEQ ID NO: 387522 - RNA, 24 nt, Human
uucaguguuuguuuucuaagcagg

SEQ ID NO: 387523 - RNA, 21 nt, Human
uucauggguaacaaggaagga

SEQ ID NO: 387524 - RNA, 22 nt, Human
uuccauucuuauuacugucccu

SEQ ID NO: 387525 - RNA, 21 nt, Human
uucccaaaguucagacaucca

SEQ ID NO: 387526 - RNA, 22 nt, Human
uugcuugagcccagaguucaag

SEQ ID NO: 387527 - RNA, 23 nt, Human
uugcuugagcccagaguucaagg

SEQ ID NO: 387528 - RNA, 25 nt, Human
uuggccucugggcuguacaaagguc

SEQ ID NO: 387529 - RNA, 18 nt, Human
uugggaaggauuugggac

SEQ ID NO: 387530 - RNA, 19 nt, Human
uugucccuuucucugccuu

SEQ ID NO: 387531 - RNA, 18 nt, Human
uuucugaucuccuacugg

SEQ ID NO: 387532 - RNA, 22 nt, Human
aaaauagcagacacugguagga

SEQ ID NO: 387533 - RNA, 19 nt, Human
aaacaacagauaaacgacu

SEQ ID NO: 387534 - RNA, 18 nt, Human
aaaggaucucugcagcag

SEQ ID NO: 387535 - RNA, 24 nt, Human
aaaggauguaagaaacaaaagaaa

SEQ ID NO: 387536 - RNA, 19 nt, Human
aacaacgggacuggagaga

SEQ ID NO: 387537 - RNA, 24 nt, Human
aacaugaggggaaggggcugggga

SEQ ID NO: 387538 - RNA, 20 nt, Human
aaccaaaggcuuugggcucc

SEQ ID NO: 387539 - RNA, 18 nt, Human
aacucaaagcaggaacag

SEQ ID NO: 387540 - RNA, 23 nt, Human
aacuccaccacuacgaccaccuu

SEQ ID NO: 387541 - RNA, 21 nt, Human
aagaaggaaaauauuuuaaaa

SEQ ID NO: 387542 - RNA, 24 nt, Human
aagaaggaaaauauuuuaaaauau

SEQ ID NO: 387543 - RNA, 21 nt, Human
aagaauuuugccagcucaaaa

SEQ ID NO: 387544 - RNA, 21 nt, Human
acaaaauacuccucaucacca

SEQ ID NO: 387545 - RNA, 23 nt, Human
acaacagauaaacgacugauggg

SEQ ID NO: 387546 - RNA, 26 nt, Human
acaccccaccccaccccaccucucca

SEQ ID NO: 387547 - RNA, 24 nt, Human
acagugugugcucugaaaaggauc

SEQ ID NO: 387548 - RNA, 23 nt, Human
accccaccucuccaccccaccaa

SEQ ID NO: 387549 - RNA, 23 nt, Human
agaaacaaaagaaauaguuagaa

SEQ ID NO: 387550 - RNA, 20 nt, Human
agaauuuugccagcucaaaa

SEQ ID NO: 387551 - RNA, 24 nt, Human
agacagaugggcuggaacagugug

SEQ ID NO: 387552 - RNA, 19 nt, Human
agagcagcagagcuuuucu

SEQ ID NO: 387553 - RNA, 20 nt, Human
agcagacacugguaggaaca

SEQ ID NO: 387554 - RNA, 24 nt, Human
aggcagaaaguuugucguggagcu

SEQ ID NO: 387555 - RNA, 25 nt, Human
aggugggaaagggaagauagaacuu

SEQ ID NO: 387556 - RNA, 20 nt, Human
agguguuggggaaggcagaa

SEQ ID NO: 387557 - RNA, 21 nt, Human
agugauagaagcacauggaga

SEQ ID NO: 387558 - RNA, 21 nt, Human
auccugaaaaaauaaauguug

SEQ ID NO: 387559 - RNA, 21 nt, Human
auuuugccagcucaaaauacu

SEQ ID NO: 387560 - RNA, 19 nt, Human
caacagauaaacgacugau

SEQ ID NO: 387561 - RNA, 24 nt, Human
caaccucauaggguuggggauaau

SEQ ID NO: 387562 - RNA, 23 nt, Human
caagaaaacaccauaugcaaagg

SEQ ID NO: 387563 - RNA, 25 nt, Human
caagaaaacaccauaugcaaaggca

SEQ ID NO: 387564 - RNA, 20 nt, Human
cacacaguguccaaaucucc

SEQ ID NO: 387565 - RNA, 20 nt, Human
cacaccccaccccaccccag

SEQ ID NO: 387566 - RNA, 22 nt, Human
caccacaccccaccccacccca

SEQ ID NO: 387567 - RNA, 23 nt, Human
caccacuacgaccaccuugggaa

SEQ ID NO: 387568 - RNA, 18 nt, Human
caccccaccacaccccac

SEQ ID NO: 387569 - RNA, 22 nt, Human
caccccaccacaccccacccca

SEQ ID NO: 387570 - RNA, 23 nt, Human
caccccaccacaccccaccccac

SEQ ID NO: 387571 - RNA, 24 nt, Human
caccccaccacaccccaccccacc

SEQ ID NO: 387572 - RNA, 26 nt, Human
caccccaccacaccccaccccacccc

SEQ ID NO: 387573 - RNA, 21 nt, Human
caccccaccccaccccaccuc

SEQ ID NO: 387574 - RNA, 28 nt, Human
caccccaccccaccccaccucuccaccu

SEQ ID NO: 387575 - RNA, 24 nt, Human
caccccaccucuccaccccaccaa

SEQ ID NO: 387576 - RNA, 18 nt, Human
caccugaaggaauuucca

SEQ ID NO: 387577 - RNA, 19 nt, Human
caccugaaggaauuuccag

SEQ ID NO: 387578 - RNA, 19 nt, Human
ccacaaaauacuccucauc

SEQ ID NO: 387579 - RNA, 23 nt, Human
ccaccaaaagcacacagugucca

SEQ ID NO: 387580 - RNA, 19 nt, Human
ccaccacaccccaccccag

SEQ ID NO: 387581 - RNA, 20 nt, Human
ccaccacuacgaccaccuug

SEQ ID NO: 387582 - RNA, 22 nt, Human
ccaccccaccacaccccacccc

SEQ ID NO: 387583 - RNA, 26 nt, Human
ccaccccaccucuccaccccaccaaa

SEQ ID NO: 387584 - RNA, 25 nt, Human
cccaccccaccacaccccaccccac

SEQ ID NO: 387585 - RNA, 22 nt, Human
cccaccccaccccaccucucca

SEQ ID NO: 387586 - RNA, 23 nt, Human
cccaccccaccucuccaccccac

SEQ ID NO: 387587 - RNA, 19 nt, Human
cccaccucuccaccccacc

SEQ ID NO: 387588 - RNA, 25 nt, Human
ccccaccacaccccaccccacccca

SEQ ID NO: 387589 - RNA, 24 nt, Human
ccccaccccaccccaccucuccac

SEQ ID NO: 387590 - RNA, 26 nt, Human
ccgcggcggggagaccgcagcuccgg

SEQ ID NO: 387591 - RNA, 26 nt, Human
ccgcggcggggagaccgcagcuccgg

SEQ ID NO: 387592 - RNA, 22 nt, Human
ccucccaccccaccacacccca

SEQ ID NO: 387593 - RNA, 24 nt, Human
cgcuccgucucucccaaccucgcu

SEQ ID NO: 387594 - RNA, 25 nt, Human
cgcuccgucucucccaaccucgcua

SEQ ID NO: 387595 - RNA, 23 nt, Human
cuccacuaugaauuagcccucgg

SEQ ID NO: 387596 - RNA, 19 nt, Human
cucccaccccaccacaccc

SEQ ID NO: 387597 - RNA, 23 nt, Human
cuccuggaagaccugaacccuga

SEQ ID NO: 387598 - RNA, 23 nt, Human
cucuauaaaugguagcuguuacc

SEQ ID NO: 387599 - RNA, 18 nt, Human
cucuccaccccaccaaaa

SEQ ID NO: 387600 - RNA, 21 nt, Human
gaaaacaccauaugcaaaggc

SEQ ID NO: 387601 - RNA, 23 nt, Human
gaaacucaaagcaggaacagcuc

SEQ ID NO: 387602 - RNA, 20 nt, Human
gaacagcucuggguccugga

SEQ ID NO: 387603 - RNA, 20 nt, Human
gaacuugaaaaucaggggcg

SEQ ID NO: 387604 - RNA, 23 nt, Human
gacagccucccaccccaccacac

SEQ ID NO: 387605 - RNA, 19 nt, Human
gacgccccugagaagaggg

SEQ ID NO: 387606 - RNA, 20 nt, Human
gagacagaugggcuggaaca

SEQ ID NO: 387607 - RNA, 21 nt, Human
gagaccgcagcuccggggacu

SEQ ID NO: 387608 - RNA, 21 nt, Human
gagaccgcagcuccggggacu

SEQ ID NO: 387609 - RNA, 26 nt, Human
gagcagaaaaugggcaagagggaccc

SEQ ID NO: 387610 - RNA, 23 nt, Human
gagcagcagagcuuuucuugaug

SEQ ID NO: 387611 - RNA, 19 nt, Human
gagcuggauacaacaggag

SEQ ID NO: 387612 - RNA, 24 nt, Human
gcacagcucuagggaaacucaaag

SEQ ID NO: 387613 - RNA, 20 nt, Human
gcucaaaauacugguuuaau

SEQ ID NO: 387614 - RNA, 19 nt, Human
ggaagauagaacuuuaaaa

SEQ ID NO: 387615 - RNA, 20 nt, Human
ggaaggggcuggggaagagg

SEQ ID NO: 387616 - RNA, 20 nt, Human
gggcuggggaagagggaaag

SEQ ID NO: 387617 - RNA, 18 nt, Human
ggggaaggggcuggggaa

SEQ ID NO: 387618 - RNA, 19 nt, Human
gugcuugcaacucaggaac

SEQ ID NO: 387619 - RNA, 21 nt, Human
guguaacaugaggggaagggg

SEQ ID NO: 387620 - RNA, 22 nt, Human
uaagucuugaacuugaaaauca

SEQ ID NO: 387621 - RNA, 25 nt, Human
uaaguuuccuggacacagacagccu

SEQ ID NO: 387622 - RNA, 27 nt, Human
uaauacaugaaaaacacuuagcauagc

SEQ ID NO: 387623 - RNA, 22 nt, Human
uacugguuuaauucuuucucag

SEQ ID NO: 387624 - RNA, 22 nt, Human
uagaaaaaugacuuugugaaga

SEQ ID NO: 387625 - RNA, 19 nt, Human
uagagcuaagagcagcaga

SEQ ID NO: 387626 - RNA, 21 nt, Human
uagcagauauaaagcuuaaua

SEQ ID NO: 387627 - RNA, 21 nt, Human
uauuaugccacaaaauacucc

SEQ ID NO: 387628 - RNA, 23 nt, Human
ucaguggugauugacgucucaaa

SEQ ID NO: 387629 - RNA, 23 nt, Human
ucaucaccaggcaaagcucuagu

SEQ ID NO: 387630 - RNA, 19 nt, Human
ucauugagccucuuugagc

SEQ ID NO: 387631 - RNA, 19 nt, Human
uccaacuccaccacuacga

SEQ ID NO: 387632 - RNA, 22 nt, Human
uccaacuccaccacuacgacca

SEQ ID NO: 387633 - RNA, 24 nt, Human
uccaacuccaccacuacgaccacc

SEQ ID NO: 387634 - RNA, 19 nt, Human
uccaccacuacgaccaccu

SEQ ID NO: 387635 - RNA, 20 nt, Human
uccaccacuacgaccaccuu

SEQ ID NO: 387636 - RNA, 20 nt, Human
uccaccccaccaaaagcaca

SEQ ID NO: 387637 - RNA, 20 nt, Human
uccaccccaccaaaagcaca

SEQ ID NO: 387638 - RNA, 19 nt, Human
uccuggacacagacagccu

SEQ ID NO: 387639 - RNA, 19 nt, Human
ucuaucucaaacaacagau

SEQ ID NO: 387640 - RNA, 26 nt, Human
ucucugcagcagggcuugagagcacc

SEQ ID NO: 387641 - RNA, 21 nt, Human
ucugcagcagggcuugagagc

SEQ ID NO: 387642 - RNA, 22 nt, Human
ugaaagagguaaccgcacagug

SEQ ID NO: 387643 - RNA, 26 nt, Human
ugaauauuuaugucauuuuugguuaa

SEQ ID NO: 387644 - RNA, 18 nt, Human
ugacacagaauuuagaaa

SEQ ID NO: 387645 - RNA, 25 nt, Human
ugagacagaugggcuggaacagugu

SEQ ID NO: 387646 - RNA, 21 nt, Human
ugauacgacuuugggauaggu

SEQ ID NO: 387647 - RNA, 19 nt, Human
ugcaaaggcacaaaggugu

SEQ ID NO: 387648 - RNA, 18 nt, Human
ugccaucaucguauguga

SEQ ID NO: 387649 - RNA, 22 nt, Human
uggaaggucaaaaaagguggga

SEQ ID NO: 387650 - RNA, 22 nt, Human
uggacacagacagccucccacc

SEQ ID NO: 387651 - RNA, 18 nt, Human
ugggaaagucauugagcc

SEQ ID NO: 387652 - RNA, 24 nt, Human
ugggucaggguguggacucuaggg

SEQ ID NO: 387653 - RNA, 20 nt, Human
uggguccuggagacgccccu

SEQ ID NO: 387654 - RNA, 21 nt, Human
ugguagagaaaccucucuggu

SEQ ID NO: 387655 - RNA, 23 nt, Human
uguaaaauggggauaauaaccaa

SEQ ID NO: 387656 - RNA, 18 nt, Human
uguccaaaucuccaucgu

SEQ ID NO: 387657 - RNA, 22 nt, Human
uguucucugucccuccagaccc

SEQ ID NO: 387658 - RNA, 22 nt, Human
uuaauugaaggaauuguacuag

SEQ ID NO: 387659 - RNA, 19 nt, Human
uuccgcccaggugcucaug

SEQ ID NO: 387660 - RNA, 23 nt, Human
uugagcuucaguuuccucaucug

SEQ ID NO: 387661 - RNA, 21 nt, Human
uuguacuuuuuuauauugucu

SEQ ID NO: 387662 - RNA, 26 nt, Human
uuuacuuuucuucuuuguacuuuuuu

SEQ ID NO: 387663 - RNA, 21 nt, Human
uuuccgcccaggugcucaugg

SEQ ID NO: 387664 - RNA, 28 nt, Human
uuugccagcucaaaauacugguuuaauu

SEQ ID NO: 387665 - RNA, 23 nt, Human
aaaaaaaaaaaaaaaggaaaaaa

SEQ ID NO: 387666 - RNA, 19 nt, Human
aaaaaagcauuucucgggc

SEQ ID NO: 387667 - RNA, 19 nt, Human
aaaaaaguuuuuugccuuc

SEQ ID NO: 387668 - RNA, 18 nt, Human
aaaaaggcauuccagcac

SEQ ID NO: 387669 - RNA, 22 nt, Human
aaaccccgucucuacuaaaaaa

SEQ ID NO: 387670 - RNA, 19 nt, Human
aacacggugaaaccccguc

SEQ ID NO: 387671 - RNA, 19 nt, Human
aacacggugaaaccccguc

SEQ ID NO: 387672 - RNA, 20 nt, Human
aacacggugaaaccccgucu

SEQ ID NO: 387673 - RNA, 20 nt, Human
aacacggugaaaccccgucu

SEQ ID NO: 387674 - RNA, 21 nt, Human
aacacggugaaaccccgucuc

SEQ ID NO: 387675 - RNA, 21 nt, Human
aacacggugaaaccccgucuc

SEQ ID NO: 387676 - RNA, 24 nt, Human
aacagagcgagacucugucucaga

SEQ ID NO: 387677 - RNA, 19 nt, Human
aacauggugaaaccccguc

SEQ ID NO: 387678 - RNA, 20 nt, Human
aacauggugaaaccccgucu

SEQ ID NO: 387679 - RNA, 21 nt, Human
aacauggugaaaccccgucuc

SEQ ID NO: 387680 - RNA, 25 nt, Human
aagaaaaaaaaaaaaggcauuccag

SEQ ID NO: 387681 - RNA, 24 nt, Human
aagaggugagcuccgucucaaaaa

SEQ ID NO: 387682 - RNA, 24 nt, Human
aauacuuuugggaggccgaggcgg

SEQ ID NO: 387683 - RNA, 20 nt, Human
aauugcuugaacccaggagg

SEQ ID NO: 387684 - RNA, 24 nt, Human
aauugcuugaacccaggaggcgga

SEQ ID NO: 387685 - RNA, 24 nt, Human
acagagcgagacucagucucaaaa

SEQ ID NO: 387686 - RNA, 21 nt, Human
acagagcgagacucugucuca

SEQ ID NO: 387687 - RNA, 24 nt, Human
acagagcgagacucugucucagaa

SEQ ID NO: 387688 - RNA, 24 nt, Human
acaggcauuuaacgacgacucaca

SEQ ID NO: 387689 - RNA, 24 nt, Human
acccacauacccaaaagcuuuuug

SEQ ID NO: 387690 - RNA, 25 nt, Human
accccgucucuacuaaaaaauacaa

SEQ ID NO: 387691 - RNA, 24 nt, Human
accccgucucuacuaaaaacacaa

SEQ ID NO: 387692 - RNA, 24 nt, Human
accccgucucuacuaaaaauacaa

SEQ ID NO: 387693 - RNA, 21 nt, Human
accuugaugauuuuuaagagu

SEQ ID NO: 387694 - RNA, 24 nt, Human
acuaaaaauacaaaaauucacugg

SEQ ID NO: 387695 - RNA, 24 nt, Human
acugcacuccagccugggcaacag

SEQ ID NO: 387696 - RNA, 24 nt, Human
acugcacuccagccugggcaacag

SEQ ID NO: 387697 - RNA, 24 nt, Human
acugcacuccagccugggcgacag

SEQ ID NO: 387698 - RNA, 26 nt, Human
acugcacuccagccugggcgacagag

SEQ ID NO: 387699 - RNA, 18 nt, Human
acugcacugcagccuggg

SEQ ID NO: 387700 - RNA, 19 nt, Human
acugcacugcagccugggc

SEQ ID NO: 387701 - RNA, 21 nt, Human
acugcacugcagccugggcgg

SEQ ID NO: 387702 - RNA, 26 nt, Human
acugcacugcagccugggcggaagag

SEQ ID NO: 387703 - RNA, 25 nt, Human
acugcagccugggcggaagagguga

SEQ ID NO: 387704 - RNA, 22 nt, Human
acugggugugguggcaugugcc

SEQ ID NO: 387705 - RNA, 21 nt, Human
acuuuugggaggccgaggcgg

SEQ ID NO: 387706 - RNA, 23 nt, Human
agaaaaaaaaaaaaggcauucca

SEQ ID NO: 387707 - RNA, 19 nt, Human
agaaagauuauuugcagcc

SEQ ID NO: 387708 - RNA, 22 nt, Human
agacaggccagucccuguccuc

SEQ ID NO: 387709 - RNA, 24 nt, Human
agagaugaugguggcuuccacagg

SEQ ID NO: 387710 - RNA, 24 nt, Human
agcacuuugggaggccgaggcggg

SEQ ID NO: 387711 - RNA, 24 nt, Human
agcacuuugggaggcugagguggg

SEQ ID NO: 387712 - RNA, 22 nt, Human
agccacagaauugcuugaaccc

SEQ ID NO: 387713 - RNA, 21 nt, Human
agccgggcgugguggcgggcc

SEQ ID NO: 387714 - RNA, 22 nt, Human
agccuggccaacauggugaaac

SEQ ID NO: 387715 - RNA, 24 nt, Human
agccuggccaacauggugaaaccc

SEQ ID NO: 387716 - RNA, 24 nt, Human
agccugggcaacagagcgagacuc

SEQ ID NO: 387717 - RNA, 24 nt, Human
agccugggcgacagagcgagacuc

SEQ ID NO: 387718 - RNA, 26 nt, Human
agcuugggccagagaugaugguggcu

SEQ ID NO: 387719 - RNA, 18 nt, Human
aggaggucuggcgagcac

SEQ ID NO: 387720 - RNA, 21 nt, Human
aggcaggagaauggcgugaac

SEQ ID NO: 387721 - RNA, 21 nt, Human
aggcaggagaauggcgugaac

SEQ ID NO: 387722 - RNA, 24 nt, Human
aggcaggagaauggcgugaacccg

SEQ ID NO: 387723 - RNA, 24 nt, Human
aggcaggagaauggcgugaacccg

SEQ ID NO: 387724 - RNA, 23 nt, Human
aggcaguggcuccagcgcggggc

SEQ ID NO: 387725 - RNA, 23 nt, Human
aggccgaggcgggcagaucacaa

SEQ ID NO: 387726 - RNA, 21 nt, Human
aggccgaggcgggcggaucac

SEQ ID NO: 387727 - RNA, 24 nt, Human
aggcggacggugccgugagccgag

SEQ ID NO: 387728 - RNA, 21 nt, Human
aggcggagcuugcagugagcc

SEQ ID NO: 387729 - RNA, 24 nt, Human
aggcggagcuugcagugagccgag

SEQ ID NO: 387730 - RNA, 19 nt, Human
aggcggagguugcaguaag

SEQ ID NO: 387731 - RNA, 24 nt, Human
aggcggagguugcaguaagccaag

SEQ ID NO: 387732 - RNA, 24 nt, Human
aggcgggcagaucacaaggucagg

SEQ ID NO: 387733 - RNA, 19 nt, Human
aggcgggcggaucaccagg

SEQ ID NO: 387734 - RNA, 19 nt, Human
aggcugaggcaggagaaug

SEQ ID NO: 387735 - RNA, 21 nt, Human
aggcugaggugggcagaucac

SEQ ID NO: 387736 - RNA, 22 nt, Human
aggguauuauuuuagggagcua

SEQ ID NO: 387737 - RNA, 22 nt, Human
aggugggcagaucaccugaggu

SEQ ID NO: 387738 - RNA, 26 nt, Human
aggugggcagaucaccugaggucagg

SEQ ID NO: 387739 - RNA, 24 nt, Human
aucaugccacugcacugcagccug

SEQ ID NO: 387740 - RNA, 24 nt, Human
aucgcgccacugcacuccagccug

SEQ ID NO: 387741 - RNA, 24 nt, Human
aucgugccacugcacuccagccug

SEQ ID NO: 387742 - RNA, 26 nt, Human
auuauuugcagccgggcgcgguggcu

SEQ ID NO: 387743 - RNA, 25 nt, Human
auuuaacgacgacucacacgaucac

SEQ ID NO: 387744 - RNA, 24 nt, Human
caacauggugaaaccccgucucua

SEQ ID NO: 387745 - RNA, 24 nt, Human
caagaccagccuggccaacauggu

SEQ ID NO: 387746 - RNA, 24 nt, Human
cacgccuguaaucccagcacuuug

SEQ ID NO: 387747 - RNA, 24 nt, Human
cacgccuguaaucccagcacuuug

SEQ ID NO: 387748 - RNA, 23 nt, Human
cacuccagccugggcaacagagc

SEQ ID NO: 387749 - RNA, 24 nt, Human
cacuccagccugggcaacagagcg

SEQ ID NO: 387750 - RNA, 23 nt, Human
cacuccagccugggcgacagagc

SEQ ID NO: 387751 - RNA, 24 nt, Human
cacuccagccugggcgacagagcg

SEQ ID NO: 387752 - RNA, 18 nt, Human
cacugcacuccagccugg

SEQ ID NO: 387753 - RNA, 19 nt, Human
cacugcacuccagccuggg

SEQ ID NO: 387754 - RNA, 19 nt, Human
cacugcacuccagccuggg

SEQ ID NO: 387755 - RNA, 20 nt, Human
cacugcacuccagccugggc

SEQ ID NO: 387756 - RNA, 21 nt, Human
cacugcacuccagccugggca

SEQ ID NO: 387757 - RNA, 23 nt, Human
cacugcacuccagccugggcaac

SEQ ID NO: 387758 - RNA, 24 nt, Human
cacugcacuccagccugggcaaca

SEQ ID NO: 387759 - RNA, 22 nt, Human
cacugcacuccagccugggcga

SEQ ID NO: 387760 - RNA, 23 nt, Human
cacugcacuccagccugggcgac

SEQ ID NO: 387761 - RNA, 24 nt, Human
cacugcacuccagccugggcgaca

SEQ ID NO: 387762 - RNA, 20 nt, Human
cacugcacugcagccugggc

SEQ ID NO: 387763 - RNA, 23 nt, Human
cacugcacugcagccugggcgga

SEQ ID NO: 387764 - RNA, 27 nt, Human
cagaucaccugaggucaggaauucaag

SEQ ID NO: 387765 - RNA, 20 nt, Human
cagcacucaguggagagaga

SEQ ID NO: 387766 - RNA, 24 nt, Human
cagcacuuugggaggccgaggcgg

SEQ ID NO: 387767 - RNA, 24 nt, Human
cagcacuuugggaggcugaggugg

SEQ ID NO: 387768 - RNA, 21 nt, Human
caggcauuuaacgacgacuca

SEQ ID NO: 387769 - RNA, 21 nt, Human
caguggacagacaggccaguc

SEQ ID NO: 387770 - RNA, 18 nt, Human
ccacugcacuccagccug

SEQ ID NO: 387771 - RNA, 20 nt, Human
ccacugcacuccagccuggg

SEQ ID NO: 387772 - RNA, 20 nt, Human
ccacugcacuccagccuggg

SEQ ID NO: 387773 - RNA, 20 nt, Human
ccacugcacuccagccuggg

SEQ ID NO: 387774 - RNA, 20 nt, Human
ccacugcacuccagccuggg

SEQ ID NO: 387775 - RNA, 21 nt, Human
ccacugcacuccagccugggc

SEQ ID NO: 387776 - RNA, 21 nt, Human
ccacugcacuccagccugggc

SEQ ID NO: 387777 - RNA, 21 nt, Human
ccacugcacuccagccugggc

SEQ ID NO: 387778 - RNA, 23 nt, Human
ccacugcacuccagccugggcaa

SEQ ID NO: 387779 - RNA, 24 nt, Human
ccacugcacuccagccugggcaac

SEQ ID NO: 387780 - RNA, 24 nt, Human
ccacugcacuccagccugggcgac

SEQ ID NO: 387781 - RNA, 20 nt, Human
ccacugcacugcagccuggg

SEQ ID NO: 387782 - RNA, 20 nt, Human
ccacugcacugcagccuggg

SEQ ID NO: 387783 - RNA, 21 nt, Human
ccacugcacugcagccugggc

SEQ ID NO: 387784 - RNA, 22 nt, Human
ccacugcacugcagccugggcg

SEQ ID NO: 387785 - RNA, 20 nt, Human
ccagcgcggggcgguggggg

SEQ ID NO: 387786 - RNA, 23 nt, Human
ccccuguagucccagcuacucgg

SEQ ID NO: 387787 - RNA, 24 nt, Human
ccccuguagucccagcuacucggg

SEQ ID NO: 387788 - RNA, 20 nt, Human
cccuguagucccagcuacuc

SEQ ID NO: 387789 - RNA, 23 nt, Human
cccuguaguccgagcuacuuggg

SEQ ID NO: 387790 - RNA, 18 nt, Human
ccgugagccgagaucgug

SEQ ID NO: 387791 - RNA, 23 nt, Human
ccuggccaacauggugaaacccc

SEQ ID NO: 387792 - RNA, 24 nt, Human
ccuggccaacauggugaaaccccg

SEQ ID NO: 387793 - RNA, 23 nt, Human
ccuggcuaacacggugaaacccc

SEQ ID NO: 387794 - RNA, 23 nt, Human
ccuggcuaacacggugaaacccc

SEQ ID NO: 387795 - RNA, 24 nt, Human
ccuggcuaacacggugaaaccccg

SEQ ID NO: 387796 - RNA, 24 nt, Human
ccuggcuaacacggugaaaccccg

SEQ ID NO: 387797 - RNA, 22 nt, Human
ccugggcaacagagcgagacuc

SEQ ID NO: 387798 - RNA, 22 nt, Human
ccugggcgacagagcgagacuc

SEQ ID NO: 387799 - RNA, 22 nt, Human
ccuguaaucccagcacuuuggg

SEQ ID NO: 387800 - RNA, 22 nt, Human
ccuguaaucccagcuacuccgg

SEQ ID NO: 387801 - RNA, 23 nt, Human
ccuguaaucccagcuacuccgga

SEQ ID NO: 387802 - RNA, 21 nt, Human
ccuguagucccagcuacucgg

SEQ ID NO: 387803 - RNA, 22 nt, Human
ccuguagucccagcuacucggg

SEQ ID NO: 387804 - RNA, 18 nt, Human
cgacccagggagggcaag

SEQ ID NO: 387805 - RNA, 24 nt, Human
cgagaccauccuggcuaacacggu

SEQ ID NO: 387806 - RNA, 24 nt, Human
cgagaccauccuggcuaacacggu

SEQ ID NO: 387807 - RNA, 23 nt, Human
cgagacucugucucagaaaaaaa

SEQ ID NO: 387808 - RNA, 24 nt, Human
cgagaucgcgccacugcacuccag

SEQ ID NO: 387809 - RNA, 24 nt, Human
cgagaucgugccacugcacuccag

SEQ ID NO: 387810 - RNA, 19 nt, Human
cgagcaccaucuagggcug

SEQ ID NO: 387811 - RNA, 26 nt, Human
cgccacugcacuccagccugggcgac

SEQ ID NO: 387812 - RNA, 23 nt, Human
cgccuguaaucccagcacuuugg

SEQ ID NO: 387813 - RNA, 24 nt, Human
cgccuguaaucccagcacuuuggg

SEQ ID NO: 387814 - RNA, 22 nt, Human
cgggcagaucacaaggucagga

SEQ ID NO: 387815 - RNA, 24 nt, Human
cggucgucacgccuguaaucccag

SEQ ID NO: 387816 - RNA, 22 nt, Human
cgucacgccuguaaucccagca

SEQ ID NO: 387817 - RNA, 22 nt, Human
cgucacgccuguaaucccagca

SEQ ID NO: 387818 - RNA, 23 nt, Human
cgugguggcgggccccuguaguc

SEQ ID NO: 387819 - RNA, 19 nt, Human
cuaaaaacacaaaaaguua

SEQ ID NO: 387820 - RNA, 18 nt, Human
cucaaaaaaaaaaaaaaa

SEQ ID NO: 387821 - RNA, 18 nt, Human
cucaaaaaaaaaaaaaaa

SEQ ID NO: 387822 - RNA, 24 nt, Human
cucagucucaaaaaaaaaaaaaaa

SEQ ID NO: 387823 - RNA, 19 nt, Human
cuccgucucaaaaaaaaaa

SEQ ID NO: 387824 - RNA, 20 nt, Human
cucuacuaaaaaauacaaaa

SEQ ID NO: 387825 - RNA, 18 nt, Human
cuggcuaacacggugaaa

SEQ ID NO: 387826 - RNA, 18 nt, Human
cuggcuaacacggugaaa

SEQ ID NO: 387827 - RNA, 19 nt, Human
cuugcagugagccgagauc

SEQ ID NO: 387828 - RNA, 21 nt, Human
cuugcagugagccgagaucgc

SEQ ID NO: 387829 - RNA, 23 nt, Human
cuuugggaggcugaggugggcag

SEQ ID NO: 387830 - RNA, 21 nt, Human
gaacccgggaggcggacggug

SEQ ID NO: 387831 - RNA, 19 nt, Human
gacucggagaucccugagc

SEQ ID NO: 387832 - RNA, 18 nt, Human
gacucugucucagaaaaa

SEQ ID NO: 387833 - RNA, 20 nt, Human
gacugggaccuggagguggg

SEQ ID NO: 387834 - RNA, 18 nt, Human
gagccagggcaagaagaa

SEQ ID NO: 387835 - RNA, 24 nt, Human
gagcuacuugggaggcugaggcag

SEQ ID NO: 387836 - RNA, 18 nt, Human
gagcuugcagugagccga

SEQ ID NO: 387837 - RNA, 23 nt, Human
gagcuugcagugagccgagaucg

SEQ ID NO: 387838 - RNA, 24 nt, Human
gaggcgggcagaucacaaggucag

SEQ ID NO: 387839 - RNA, 24 nt, Human
gaggcgggcggaucaccagguuag

SEQ ID NO: 387840 - RNA, 20 nt, Human
gagggcaaggguggaccagg

SEQ ID NO: 387841 - RNA, 18 nt, Human
gagguugcaguaagccaa

SEQ ID NO: 387842 - RNA, 22 nt, Human
gagguugcaguaagccaagauc

SEQ ID NO: 387843 - RNA, 24 nt, Human
gaucaccagguuaggagaucgaga

SEQ ID NO: 387844 - RNA, 18 nt, Human
gaucaccugaggucagga

SEQ ID NO: 387845 - RNA, 24 nt, Human
gaucaccugaggucaggaauucaa

SEQ ID NO: 387846 - RNA, 24 nt, Human
gcacuccagccugggcaacagagc

SEQ ID NO: 387847 - RNA, 24 nt, Human
gcacuccagccugggcgacagagc

SEQ ID NO: 387848 - RNA, 22 nt, Human
gcaugugccuguaaucccagcu

SEQ ID NO: 387849 - RNA, 24 nt, Human
gccaacauggugaaaccccgucuc

SEQ ID NO: 387850 - RNA, 20 nt, Human
gccaagaucaugccacugca

SEQ ID NO: 387851 - RNA, 22 nt, Human
gccacugcacuccagccugggc

SEQ ID NO: 387852 - RNA, 22 nt, Human
gccacugcacuccagccugggc

SEQ ID NO: 387853 - RNA, 24 nt, Human
gccacugcacuccagccugggcaa

SEQ ID NO: 387854 - RNA, 24 nt, Human
gccacugcacuccagccugggcga

SEQ ID NO: 387855 - RNA, 24 nt, Human
gccacugcacugcagccugggcgg

SEQ ID NO: 387856 - RNA, 18 nt, Human
gccaugaagccuccucuu

SEQ ID NO: 387857 - RNA, 20 nt, Human
gccgagaucgcgccacugca

SEQ ID NO: 387858 - RNA, 20 nt, Human
gccgagaucgugccacugca

SEQ ID NO: 387859 - RNA, 24 nt, Human
gcuaacacggugaaaccccgucuc

SEQ ID NO: 387860 - RNA, 24 nt, Human
gcuaacacggugaaaccccgucuc

SEQ ID NO: 387861 - RNA, 22 nt, Human
gcugaggcaggagaauggcgug

SEQ ID NO: 387862 - RNA, 22 nt, Human
gcugaggcaggagaauggcgug

SEQ ID NO: 387863 - RNA, 23 nt, Human
ggaacagaggacugggaccugga

SEQ ID NO: 387864 - RNA, 24 nt, Human
ggacggugccgugagccgagaucg

SEQ ID NO: 387865 - RNA, 24 nt, Human
ggagcuugcagugagccgagaucg

SEQ ID NO: 387866 - RNA, 21 nt, Human
ggagggcaaggguggaccagg

SEQ ID NO: 387867 - RNA, 20 nt, Human
ggagguugcaguaagccaag

SEQ ID NO: 387868 - RNA, 24 nt, Human
ggagguugcaguaagccaagauca

SEQ ID NO: 387869 - RNA, 22 nt, Human
ggaguuuuucagaagcuacauu

SEQ ID NO: 387870 - RNA, 21 nt, Human
ggcagaucacaaggucaggag

SEQ ID NO: 387871 - RNA, 24 nt, Human
ggccagagaugaugguggcuucca

SEQ ID NO: 387872 - RNA, 18 nt, Human
ggcgcgggguuacagcag

SEQ ID NO: 387873 - RNA, 22 nt, Human
ggcgcggucgucacgccuguaa

SEQ ID NO: 387874 - RNA, 23 nt, Human
ggcgcgguggcucacgcggguaa

SEQ ID NO: 387875 - RNA, 19 nt, Human
ggcugaagaacuaggcagu

SEQ ID NO: 387876 - RNA, 19 nt, Human
gggggggacaagugagcca

SEQ ID NO: 387877 - RNA, 23 nt, Human
ggucgucacgccuguaaucccag

SEQ ID NO: 387878 - RNA, 23 nt, Human
ggucgucacgccuguaaucccag

SEQ ID NO: 387879 - RNA, 24 nt, Human
gguggcaugugccuguaaucccag

SEQ ID NO: 387880 - RNA, 23 nt, Human
gguggcucacgcggguaauccca

SEQ ID NO: 387881 - RNA, 22 nt, Human
gguguggucgucacgccuguaa

SEQ ID NO: 387882 - RNA, 23 nt, Human
ggugugguggcaugugccuguaa

SEQ ID NO: 387883 - RNA, 24 nt, Human
gucgucacgccuguaaucccagca

SEQ ID NO: 387884 - RNA, 24 nt, Human
gucgucacgccuguaaucccagca

SEQ ID NO: 387885 - RNA, 21 nt, Human
gucucaaaaaaaaaaaaaaag

SEQ ID NO: 387886 - RNA, 23 nt, Human
guggcaugugccuguaaucccag

SEQ ID NO: 387887 - RNA, 25 nt, Human
gugggccuuaggucccuaugccggc

SEQ ID NO: 387888 - RNA, 21 nt, Human
uaaaaaagcauuucucgggcc

SEQ ID NO: 387889 - RNA, 22 nt, Human
uaacacggugaaaccccgucuc

SEQ ID NO: 387890 - RNA, 22 nt, Human
uaacacggugaaaccccgucuc

SEQ ID NO: 387891 - RNA, 24 nt, Human
uaacacggugaaaccccgucucua

SEQ ID NO: 387892 - RNA, 24 nt, Human
uaacacggugaaaccccgucucua

SEQ ID NO: 387893 - RNA, 21 nt, Human
uaacccacauacccaaaagcu

SEQ ID NO: 387894 - RNA, 23 nt, Human
uaaguguacaguggaguuuuuca

SEQ ID NO: 387895 - RNA, 21 nt, Human
uaccuugaugauuuuuaagag

SEQ ID NO: 387896 - RNA, 24 nt, Human
uaccuugaugauuuuuaagagucc

SEQ ID NO: 387897 - RNA, 18 nt, Human
uagagcuccaagaaggug

SEQ ID NO: 387898 - RNA, 18 nt, Human
uagccgggcgugguggcg

SEQ ID NO: 387899 - RNA, 21 nt, Human
uagcuauaacccacauaccca

SEQ ID NO: 387900 - RNA, 23 nt, Human
uaggcaguggcuccagcgcgggg

SEQ ID NO: 387901 - RNA, 24 nt, Human
uauaacccacauacccaaaagcuu

SEQ ID NO: 387902 - RNA, 19 nt, Human
ucaaaaaaaaaaaaaaagg

SEQ ID NO: 387903 - RNA, 18 nt, Human
ucacaaggucaggagauc

SEQ ID NO: 387904 - RNA, 24 nt, Human
ucacaaggucaggagaucgagacc

SEQ ID NO: 387905 - RNA, 24 nt, Human
ucaccagguuaggagaucgagacc

SEQ ID NO: 387906 - RNA, 23 nt, Human
ucacgccuguaaucccagcacuu

SEQ ID NO: 387907 - RNA, 23 nt, Human
ucacgccuguaaucccagcacuu

SEQ ID NO: 387908 - RNA, 25 nt, Human
ucagucucaaaaaaaaaaaaaaaaa

SEQ ID NO: 387909 - RNA, 20 nt, Human
ucaguggagagagauuggag

SEQ ID NO: 387910 - RNA, 20 nt, Human
uccacaggauggcagugagu

SEQ ID NO: 387911 - RNA, 23 nt, Human
uccagccugggcaacagagcgag

SEQ ID NO: 387912 - RNA, 24 nt, Human
uccagccugggcaacagagcgaga

SEQ ID NO: 387913 - RNA, 23 nt, Human
uccagccugggcgacagagcgag

SEQ ID NO: 387914 - RNA, 24 nt, Human
uccagccugggcgacagagcgaga

SEQ ID NO: 387915 - RNA, 22 nt, Human
ucccugagcugcgccgccgcuu

SEQ ID NO: 387916 - RNA, 23 nt, Human
uccgucucaaaaaaaaaaaaaaa

SEQ ID NO: 387917 - RNA, 22 nt, Human
uccucagccaugaagccuccuc

SEQ ID NO: 387918 - RNA, 23 nt, Human
ucgugccacugcacuccagccug

SEQ ID NO: 387919 - RNA, 22 nt, Human
ucuccaaauguaaccucggccc

SEQ ID NO: 387920 - RNA, 21 nt, Human
ucucuacuaaaaacacaaaaa

SEQ ID NO: 387921 - RNA, 21 nt, Human
ucucuacuaaaaauacaaaaa

SEQ ID NO: 387922 - RNA, 25 nt, Human
ucugucucagaaaaaaagaaaaaaa

SEQ ID NO: 387923 - RNA, 26 nt, Human
ucugucucagaaaaaaagaaaaaaag

SEQ ID NO: 387924 - RNA, 19 nt, Human
ugagagaaaaauugagaac

SEQ ID NO: 387925 - RNA, 24 nt, Human
ugagagaaaaauugagaaccacgu

SEQ ID NO: 387926 - RNA, 22 nt, Human
ugagccgagaucgcgccacugc

SEQ ID NO: 387927 - RNA, 22 nt, Human
ugagccgagaucgugccacugc

SEQ ID NO: 387928 - RNA, 24 nt, Human
ugaggcaggagaauggcgugaacc

SEQ ID NO: 387929 - RNA, 24 nt, Human
ugaggcaggagaauggcgugaacc

SEQ ID NO: 387930 - RNA, 25 nt, Human
ugaggcaggagaauggcgugaaccc

SEQ ID NO: 387931 - RNA, 25 nt, Human
ugaggcaggagaauggcgugaaccc

SEQ ID NO: 387932 - RNA, 20 nt, Human
ugaggugggcagaucaccug

SEQ ID NO: 387933 - RNA, 24 nt, Human
ugaggugggcagaucaccugaggu

SEQ ID NO: 387934 - RNA, 26 nt, Human
ugaggugggcagaucaccugagguca

SEQ ID NO: 387935 - RNA, 19 nt, Human
ugaugauuuuuaagagucc

SEQ ID NO: 387936 - RNA, 24 nt, Human
ugcagccgggcgcgguggcucacg

SEQ ID NO: 387937 - RNA, 24 nt, Human
ugccacugcacuccagccugggca

SEQ ID NO: 387938 - RNA, 23 nt, Human
ugccgugagccgagaucgugcca

SEQ ID NO: 387939 - RNA, 19 nt, Human
ugccuguaaucccagcuac

SEQ ID NO: 387940 - RNA, 24 nt, Human
ugccuguaaucccagcuacuccgg

SEQ ID NO: 387941 - RNA, 20 nt, Human
uggagagagauuggagggau

SEQ ID NO: 387942 - RNA, 19 nt, Human
uggaggugggcgggaggcg

SEQ ID NO: 387943 - RNA, 21 nt, Human
uggcaugugccuguaauccca

SEQ ID NO: 387944 - RNA, 24 nt, Human
uggccaacauggugaaaccccguc

SEQ ID NO: 387945 - RNA, 24 nt, Human
uggcuccagcgcggggcggugggg

SEQ ID NO: 387946 - RNA, 20 nt, Human
ugggaggccgaggcgggcag

SEQ ID NO: 387947 - RNA, 24 nt, Human
ugggaggccgaggcgggcagauca

SEQ ID NO: 387948 - RNA, 19 nt, Human
ugggaggccgaggcgggcg

SEQ ID NO: 387949 - RNA, 24 nt, Human
ugggaggccgaggcgggcggauca

SEQ ID NO: 387950 - RNA, 18 nt, Human
ugggaggcugaggcagga

SEQ ID NO: 387951 - RNA, 24 nt, Human
ugggaggcugaggcaggagaaugg

SEQ ID NO: 387952 - RNA, 20 nt, Human
ugggaggcugaggugggcag

SEQ ID NO: 387953 - RNA, 24 nt, Human
ugggaggcugaggugggcagauca

SEQ ID NO: 387954 - RNA, 24 nt, Human
ugggcagaucaccugaggucagga

SEQ ID NO: 387955 - RNA, 19 nt, Human
ugggccagagaugauggug

SEQ ID NO: 387956 - RNA, 18 nt, Human
ugggugugguggcaugug

SEQ ID NO: 387957 - RNA, 23 nt, Human
uggucgucacgccuguaauccca

SEQ ID NO: 387958 - RNA, 24 nt, Human
uggucgucacgccuguaaucccag

SEQ ID NO: 387959 - RNA, 24 nt, Human
ugguggcaugugccuguaauccca

SEQ ID NO: 387960 - RNA, 23 nt, Human
ugguggcgggccccuguaguccc

SEQ ID NO: 387961 - RNA, 24 nt, Human
ugguggcgggccccuguaguccca

SEQ ID NO: 387962 - RNA, 18 nt, Human
uuagccgggcgugguggc

SEQ ID NO: 387963 - RNA, 24 nt, Human
uugaacccaggaggcggagguugc

SEQ ID NO: 387964 - RNA, 18 nt, Human
uugcagugagccgagauc

SEQ ID NO: 387965 - RNA, 19 nt, Human
uugcagugagccgagaucg

SEQ ID NO: 387966 - RNA, 22 nt, Human
uugcagugagccgagaucgcgc

SEQ ID NO: 387967 - RNA, 24 nt, Human
uugcuugaacccaggaggcggagg

SEQ ID NO: 387968 - RNA, 24 nt, Human
uuggagggauuaggagcagaugau

SEQ ID NO: 387969 - RNA, 25 nt, Human
uugggaggccgaggcgggcagauca

SEQ ID NO: 387970 - RNA, 25 nt, Human
uugggaggccgaggcgggcggauca

SEQ ID NO: 387971 - RNA, 25 nt, Human
uugggaggcugaggugggcagauca

SEQ ID NO: 387972 - RNA, 25 nt, Human
uuuuuuuuuuuuuggaagcacugga

SEQ ID NO: 387973 - RNA, 18 nt, Human
uuuuuuuuuuuuuuuuug

SEQ ID NO: 387974 - RNA, 21 nt, Human
aaaagucugaacagcagcagc

SEQ ID NO: 387975 - RNA, 21 nt, Human
aauauguuuaaggcacauggc

SEQ ID NO: 387976 - RNA, 23 nt, Human
aggaagaauacaauuuaacaaaa

SEQ ID NO: 387977 - RNA, 24 nt, Human
caaauuaucacaauaaauuucaga

SEQ ID NO: 387978 - RNA, 20 nt, Human
caguucacuaaggaaggcac

SEQ ID NO: 387979 - RNA, 23 nt, Human
guccaaauaguuuuuuuuaaaaa

SEQ ID NO: 387980 - RNA, 22 nt, Human
uaaaaaagucugaacagcagca

SEQ ID NO: 387981 - RNA, 21 nt, Human
uaaaggggaaaauauauagua

SEQ ID NO: 387982 - RNA, 26 nt, Human
uaacaaaaaguguuuauuaaagggga

SEQ ID NO: 387983 - RNA, 23 nt, Human
uaaggcacauggcaaacuuuugg

SEQ ID NO: 387984 - RNA, 22 nt, Human
uauaguaauauguuuaaggcac

SEQ ID NO: 387985 - RNA, 24 nt, Human
ugcaagaaaaaagaaauacaaauu

SEQ ID NO: 387986 - RNA, 20 nt, Human
aagcccggagucgcggccgg

SEQ ID NO: 387987 - RNA, 19 nt, Human
acccagggagcccagggag

SEQ ID NO: 387988 - RNA, 19 nt, Human
accgucccgccuccuuccu

SEQ ID NO: 387989 - RNA, 18 nt, Human
acuccggcaaccgccagc

SEQ ID NO: 387990 - RNA, 21 nt, Human
acugggguagcagcugcugca

SEQ ID NO: 387991 - RNA, 18 nt, Human
agaaaacuacagaaccca

SEQ ID NO: 387992 - RNA, 18 nt, Human
agaaaacuacagaaccca

SEQ ID NO: 387993 - RNA, 18 nt, Human
agacagggggcugcaguu

SEQ ID NO: 387994 - RNA, 20 nt, Human
agcccggagucgcggcccca

SEQ ID NO: 387995 - RNA, 21 nt, Human
aggcaggcagucugugucaga

SEQ ID NO: 387996 - RNA, 21 nt, Human
aggcaggcagucugugucaga

SEQ ID NO: 387997 - RNA, 22 nt, Human
aggcagucugugucagagguag

SEQ ID NO: 387998 - RNA, 22 nt, Human
aggcagucugugucagagguag

SEQ ID NO: 387999 - RNA, 24 nt, Human
agggcccagggcacccagggagcc

SEQ ID NO: 388000 - RNA, 21 nt, Human
agggccggggccaagcccgga

SEQ ID NO: 388001 - RNA, 23 nt, Human
aucaccaauaaaaugaggacgga

SEQ ID NO: 388002 - RNA, 22 nt, Human
auggugaauucuuugcgguggg

SEQ ID NO: 388003 - RNA, 20 nt, Human
caacugcggagggacaggau

SEQ ID NO: 388004 - RNA, 21 nt, Human
caagcccggagucgcggccgg

SEQ ID NO: 388005 - RNA, 26 nt, Human
caauacacagccgacgagcuagggcu

SEQ ID NO: 388006 - RNA, 18 nt, Human
caccaauggagaaguggu

SEQ ID NO: 388007 - RNA, 19 nt, Human
caccaggcacuggcagagu

SEQ ID NO: 388008 - RNA, 22 nt, Human
cacccuacuucgugagccucca

SEQ ID NO: 388009 - RNA, 19 nt, Human
caccgugugcacucgaagc

SEQ ID NO: 388010 - RNA, 22 nt, Human
cacgcgccccaauacacagccg

SEQ ID NO: 388011 - RNA, 18 nt, Human
cagaaagagcagggagca

SEQ ID NO: 388012 - RNA, 18 nt, Human
cagaaagagcagggagca

SEQ ID NO: 388013 - RNA, 18 nt, Human
cagaggcagaaagagcag

SEQ ID NO: 388014 - RNA, 18 nt, Human
cagaggcagaaagagcag

SEQ ID NO: 388015 - RNA, 21 nt, Human
cagaggcagaaagagcaggga

SEQ ID NO: 388016 - RNA, 21 nt, Human
cagaggcagaaagagcaggga

SEQ ID NO: 388017 - RNA, 20 nt, Human
cagcaguaaaaaccggaaug

SEQ ID NO: 388018 - RNA, 21 nt, Human
cagcccccugauuucauuccc

SEQ ID NO: 388019 - RNA, 21 nt, Human
cagcccccugauuucauuccc

SEQ ID NO: 388020 - RNA, 21 nt, Human
cagcuggggcuucacuugcug

SEQ ID NO: 388021 - RNA, 20 nt, Human
caggcagggcccagggcacc

SEQ ID NO: 388022 - RNA, 23 nt, Human
cagggcacccagggagcccaggg

SEQ ID NO: 388023 - RNA, 24 nt, Human
caucaccaauaaaaugaggacgga

SEQ ID NO: 388024 - RNA, 24 nt, Human
caucaccaauaaaaugaggacgga

SEQ ID NO: 388025 - RNA, 21 nt, Human
caucugugucgcagcuggaga

SEQ ID NO: 388026 - RNA, 25 nt, Human
ccaauacacagccgacgagcuaggg

SEQ ID NO: 388027 - RNA, 24 nt, Human
ccauccaggcgggagcccacacca

SEQ ID NO: 388028 - RNA, 18 nt, Human
ccaucugugucgcagcug

SEQ ID NO: 388029 - RNA, 26 nt, Human
cccacaccaauggagaaguggucauc

SEQ ID NO: 388030 - RNA, 20 nt, Human
cccagaggcagaaagagcag

SEQ ID NO: 388031 - RNA, 20 nt, Human
cccagaggcagaaagagcag

SEQ ID NO: 388032 - RNA, 21 nt, Human
cccagggcacccagggagccc

SEQ ID NO: 388033 - RNA, 23 nt, Human
cccccgcccacccuacuucguga

SEQ ID NO: 388034 - RNA, 24 nt, Human
ccccugauuucauucccauucauc

SEQ ID NO: 388035 - RNA, 24 nt, Human
ccccugauuucauucccauucauc

SEQ ID NO: 388036 - RNA, 21 nt, Human
cccgccuccuuccuuccgcgc

SEQ ID NO: 388037 - RNA, 22 nt, Human
cccgcgggcgccaccgugacug

SEQ ID NO: 388038 - RNA, 20 nt, Human
cccuacuucgugagccucca

SEQ ID NO: 388039 - RNA, 23 nt, Human
ccgccuccuuccuuccgcgcccc

SEQ ID NO: 388040 - RNA, 20 nt, Human
ccgcgcccccucucucccgg

SEQ ID NO: 388041 - RNA, 18 nt, Human
ccgucccgccuccuuccu

SEQ ID NO: 388042 - RNA, 22 nt, Human
ccucaccacgggcugccucccu

SEQ ID NO: 388043 - RNA, 18 nt, Human
ccucccuggugguugcag

SEQ ID NO: 388044 - RNA, 23 nt, Human
ccucccuggugguugcagagcca

SEQ ID NO: 388045 - RNA, 18 nt, Human
ccugggccccgguuucga

SEQ ID NO: 388046 - RNA, 22 nt, Human
cgccccaauacacagccgacga

SEQ ID NO: 388047 - RNA, 18 nt, Human
cgcccccucucucccggu

SEQ ID NO: 388048 - RNA, 20 nt, Human
cgcccccucucucccggucc

SEQ ID NO: 388049 - RNA, 25 nt, Human
cggcagcaggcagggcccagggcac

SEQ ID NO: 388050 - RNA, 20 nt, Human
cgggcugccucccuggugga

SEQ ID NO: 388051 - RNA, 19 nt, Human
cucaaugaaacgcuccacu

SEQ ID NO: 388052 - RNA, 19 nt, Human
cucagagagcucacugagg

SEQ ID NO: 388053 - RNA, 26 nt, Human
cucccaaucucaaugaaacgcuccac

SEQ ID NO: 388054 - RNA, 20 nt, Human
cuccugggucacuguguacu

SEQ ID NO: 388055 - RNA, 22 nt, Human
cugcagggcacggcgggcagcc

SEQ ID NO: 388056 - RNA, 19 nt, Human
cugcgugcguggcucgccc

SEQ ID NO: 388057 - RNA, 20 nt, Human
cugcugcagcaguaaaaacc

SEQ ID NO: 388058 - RNA, 25 nt, Human
cuuccgcgcccccucucucccgguc

SEQ ID NO: 388059 - RNA, 20 nt, Human
cuucucgagaaggccguauu

SEQ ID NO: 388060 - RNA, 19 nt, Human
gacgugaaaggccugcucc

SEQ ID NO: 388061 - RNA, 20 nt, Human
gacugcagccuccacgcgcc

SEQ ID NO: 388062 - RNA, 24 nt, Human
gagaaaacuacagaacccaagagc

SEQ ID NO: 388063 - RNA, 24 nt, Human
gagaaaacuacagaacccaagagc

SEQ ID NO: 388064 - RNA, 20 nt, Human
gagguagagauggcacccac

SEQ ID NO: 388065 - RNA, 23 nt, Human
gcacggagccuuuuggaucgcga

SEQ ID NO: 388066 - RNA, 23 nt, Human
gcacggagccuuuuggaucgcga

SEQ ID NO: 388067 - RNA, 18 nt, Human
gcccagggagcaacugcg

SEQ ID NO: 388068 - RNA, 19 nt, Human
gcccagggagcaacugcgg

SEQ ID NO: 388069 - RNA, 21 nt, Human
gcccagggcacccagggagcc

SEQ ID NO: 388070 - RNA, 21 nt, Human
gccccaauacacagccgacga

SEQ ID NO: 388071 - RNA, 21 nt, Human
gccccgguuucgaagaccauc

SEQ ID NO: 388072 - RNA, 18 nt, Human
gcuggcugaggcucugug

SEQ ID NO: 388073 - RNA, 23 nt, Human
gcuguggacaugcguacuagcgg

SEQ ID NO: 388074 - RNA, 23 nt, Human
ggagucccccgcccacccuacuu

SEQ ID NO: 388075 - RNA, 19 nt, Human
ggcuggcugaggcucugug

SEQ ID NO: 388076 - RNA, 20 nt, Human
gucgcuucucgagaaggccg

SEQ ID NO: 388077 - RNA, 18 nt, Human
gugaaaggccugcuccuc

SEQ ID NO: 388078 - RNA, 22 nt, Human
gugcaaccugggccccgguuuc

SEQ ID NO: 388079 - RNA, 23 nt, Human
uacagaacccaagagcccgcgcg

SEQ ID NO: 388080 - RNA, 18 nt, Human
uagcggaggggaagccgc

SEQ ID NO: 388081 - RNA, 24 nt, Human
uccacgcgccccaauacacagccg

SEQ ID NO: 388082 - RNA, 24 nt, Human
uccaugggggggcuccugguuagg

SEQ ID NO: 388083 - RNA, 22 nt, Human
ucccaggugcaaccugggcccc

SEQ ID NO: 388084 - RNA, 24 nt, Human
ucccccgcccacccuacuucguga

SEQ ID NO: 388085 - RNA, 18 nt, Human
uccgcgcccccucucucc

SEQ ID NO: 388086 - RNA, 25 nt, Human
uccugguuaggacuacagauggaac

SEQ ID NO: 388087 - RNA, 18 nt, Human
ucugcaccaccagcuccu

SEQ ID NO: 388088 - RNA, 19 nt, Human
ucugugucagagguagaga

SEQ ID NO: 388089 - RNA, 19 nt, Human
ucugugucagagguagaga

SEQ ID NO: 388090 - RNA, 19 nt, Human
ugacugcagccuccacgcg

SEQ ID NO: 388091 - RNA, 21 nt, Human
ugccaauuuuuuggaagugcc

SEQ ID NO: 388092 - RNA, 23 nt, Human
ugcccugugccuucucagcuuca

SEQ ID NO: 388093 - RNA, 23 nt, Human
ugcccugugccuucucagcuuca

SEQ ID NO: 388094 - RNA, 18 nt, Human
ugcguggcucgcccgggc

SEQ ID NO: 388095 - RNA, 18 nt, Human
uggccggcuggguggaca

SEQ ID NO: 388096 - RNA, 19 nt, Human
uggccggcuggguggacag

SEQ ID NO: 388097 - RNA, 23 nt, Human
uggcugaggcucugugguccuug

SEQ ID NO: 388098 - RNA, 23 nt, Human
uggcugaggcucugugguccuug

SEQ ID NO: 388099 - RNA, 22 nt, Human
ugggcacggagccuuuuggauc

SEQ ID NO: 388100 - RNA, 22 nt, Human
ugggcacggagccuuuuggauc

SEQ ID NO: 388101 - RNA, 22 nt, Human
ugggcuggcccagacuccuggg

SEQ ID NO: 388102 - RNA, 24 nt, Human
uggguagggaggcgguaaggacuc

SEQ ID NO: 388103 - RNA, 24 nt, Human
ugugccuucucagcuucaaggcag

SEQ ID NO: 388104 - RNA, 24 nt, Human
ugugccuucucagcuucaaggcag

SEQ ID NO: 388105 - RNA, 18 nt, Human
uucugcaccaccagcucc

SEQ ID NO: 388106 - RNA, 21 nt, Human
aaaaacaaaacaaaagaacca

SEQ ID NO: 388107 - RNA, 19 nt, Human
aaaacaaaacaaaagaacc

SEQ ID NO: 388108 - RNA, 22 nt, Human
aaaagaaccaaacacugugaca

SEQ ID NO: 388109 - RNA, 19 nt, Human
aaaagcauccaagcacagg

SEQ ID NO: 388110 - RNA, 21 nt, Human
aaaagucuuccaacagaugug

SEQ ID NO: 388111 - RNA, 21 nt, Human
aaaauauccauuaugcaccac

SEQ ID NO: 388112 - RNA, 18 nt, Human
aaacaaaagaaccaaaca

SEQ ID NO: 388113 - RNA, 18 nt, Human
aaacauucguacauuauu

SEQ ID NO: 388114 - RNA, 18 nt, Human
aacagauguggauguccu

SEQ ID NO: 388115 - RNA, 19 nt, Human
aagcgcagcccagccaccg

SEQ ID NO: 388116 - RNA, 22 nt, Human
aaggaaaaaaauccauauggug

SEQ ID NO: 388117 - RNA, 19 nt, Human
acaaaacaaaagaaccaaa

SEQ ID NO: 388118 - RNA, 23 nt, Human
acagaagagaacacacaccauac

SEQ ID NO: 388119 - RNA, 22 nt, Human
acaggacacagaacugcagcaa

SEQ ID NO: 388120 - RNA, 19 nt, Human
accaagucucugcacgcgc

SEQ ID NO: 388121 - RNA, 20 nt, Human
accaagucucugcacgcgcu

SEQ ID NO: 388122 - RNA, 24 nt, Human
acggacccaagcgcagcccagcca

SEQ ID NO: 388123 - RNA, 27 nt, Human
aggggagacaaguguuaaaaaacaaaa

SEQ ID NO: 388124 - RNA, 23 nt, Human
agguuucaaaaguucagacagcc

SEQ ID NO: 388125 - RNA, 19 nt, Human
augaaggcuucauauugua

SEQ ID NO: 388126 - RNA, 24 nt, Human
auggcagaauauuuacagcacuac

SEQ ID NO: 388127 - RNA, 24 nt, Human
caaacagcauucuuauggguagcu

SEQ ID NO: 388128 - RNA, 19 nt, Human
caacagauguggauguccu

SEQ ID NO: 388129 - RNA, 23 nt, Human
caacagauguggauguccuuuga

SEQ ID NO: 388130 - RNA, 26 nt, Human
caaguaucauuucacuuaacacauuc

SEQ ID NO: 388131 - RNA, 20 nt, Human
cacaccacaagcucagucca

SEQ ID NO: 388132 - RNA, 18 nt, Human
cacagaacugcagcaaac

SEQ ID NO: 388133 - RNA, 23 nt, Human
caccaagucucugcacgcgcucu

SEQ ID NO: 388134 - RNA, 19 nt, Human
caccgcuucgcucccacaa

SEQ ID NO: 388135 - RNA, 23 nt, Human
cacugugacaccaugaucuccua

SEQ ID NO: 388136 - RNA, 21 nt, Human
cagaacugcagcaaacagcag

SEQ ID NO: 388137 - RNA, 21 nt, Human
cagcccagccaccgcuucgcu

SEQ ID NO: 388138 - RNA, 21 nt, Human
cagccuucugguuccauauca

SEQ ID NO: 388139 - RNA, 24 nt, Human
cagggauaaaauauuacaggagaa

SEQ ID NO: 388140 - RNA, 24 nt, Human
cauucguacauuauuugcuaucau

SEQ ID NO: 388141 - RNA, 22 nt, Human
ccaccgcuucgcucccacaaaa

SEQ ID NO: 388142 - RNA, 20 nt, Human
ccaugaguuuagaaaaauuu

SEQ ID NO: 388143 - RNA, 18 nt, Human
ccuccugcaaagcacacc

SEQ ID NO: 388144 - RNA, 22 nt, Human
cgcucucuccuuuucucgcuca

SEQ ID NO: 388145 - RNA, 18 nt, Human
cggacccaagcgcagccc

SEQ ID NO: 388146 - RNA, 18 nt, Human
cguacauuauuugcuauc

SEQ ID NO: 388147 - RNA, 19 nt, Human
cuaagaacaaaaacucacu

SEQ ID NO: 388148 - RNA, 19 nt, Human
cucugcacgcgcucucucc

SEQ ID NO: 388149 - RNA, 23 nt, Human
cugcacgcgcucucuccuuuucu

SEQ ID NO: 388150 - RNA, 22 nt, Human
gaauuuccaacaaugacaacuc

SEQ ID NO: 388151 - RNA, 21 nt, Human
gcaccaccaucaaucccacac

SEQ ID NO: 388152 - RNA, 18 nt, Human
gcuagggccgccuccucc

SEQ ID NO: 388153 - RNA, 23 nt, Human
gggauaaaauauuacaggagaaa

SEQ ID NO: 388154 - RNA, 24 nt, Human
gugggguucaaauuaaaacaaggg

SEQ ID NO: 388155 - RNA, 22 nt, Human
uaaaaaacaaaacaaaagaacc

SEQ ID NO: 388156 - RNA, 23 nt, Human
uaaaaaacaaaacaaaagaacca

SEQ ID NO: 388157 - RNA, 24 nt, Human
uaaaaaacaaaacaaaagaaccaa

SEQ ID NO: 388158 - RNA, 24 nt, Human
uaaaaaauauccauuaugcaccac

SEQ ID NO: 388159 - RNA, 18 nt, Human
uaaaaagcauccaagcac

SEQ ID NO: 388160 - RNA, 19 nt, Human
uaaaaagcauccaagcaca

SEQ ID NO: 388161 - RNA, 20 nt, Human
uaaaauuccuuuagcucuuc

SEQ ID NO: 388162 - RNA, 22 nt, Human
uacagcauucacagcaguugac

SEQ ID NO: 388163 - RNA, 25 nt, Human
uacagcauucacagcaguugacaaa

SEQ ID NO: 388164 - RNA, 21 nt, Human
uaccaaccaaccacaacccca

SEQ ID NO: 388165 - RNA, 21 nt, Human
uauaaaaagcauccaagcaca

SEQ ID NO: 388166 - RNA, 24 nt, Human
uauacuuaccaugaguuuagaaaa

SEQ ID NO: 388167 - RNA, 18 nt, Human
uaucauugcucucugcac

SEQ ID NO: 388168 - RNA, 18 nt, Human
uaucuaagaacaaaaacu

SEQ ID NO: 388169 - RNA, 19 nt, Human
uccagggauaaaauauuac

SEQ ID NO: 388170 - RNA, 22 nt, Human
uccuauggcagaauauuuacag

SEQ ID NO: 388171 - RNA, 20 nt, Human
ucuuugagacaccugagcuc

SEQ ID NO: 388172 - RNA, 18 nt, Human
ugcuucaaguccuccugc

SEQ ID NO: 388173 - RNA, 21 nt, Human
ugggacacccaccgucaaaga

SEQ ID NO: 388174 - RNA, 23 nt, Human
ugggacacccaccgucaaagacg

SEQ ID NO: 388175 - RNA, 21 nt, Human
uguuaaaaaacaaaacaaaag

SEQ ID NO: 388176 - RNA, 23 nt, Human
uguuaaaaaacaaaacaaaagaa

SEQ ID NO: 388177 - RNA, 26 nt, Human
uguuaaaaaacaaaacaaaagaacca

SEQ ID NO: 388178 - RNA, 24 nt, Human
uuaaaagucuuccaacagaugugg

SEQ ID NO: 388179 - RNA, 24 nt, Human
uuaccaugaguuuagaaaaauuug

SEQ ID NO: 388180 - RNA, 22 nt, Human
uucauguaacaaaacuuauaaa

SEQ ID NO: 388181 - RNA, 22 nt, Human
uuccaacagauguggauguccu

SEQ ID NO: 388182 - RNA, 21 nt, Human
uucucagcccaucagcuucag

SEQ ID NO: 388183 - RNA, 27 nt, Human
uugccacacuuacauaucaguaacaga

SEQ ID NO: 388184 - RNA, 26 nt, Human
uuuaagaauuuccaacaaugacaacu

SEQ ID NO: 388185 - RNA, 25 nt, Human
uuucacuuaacacauucaucuaaug

SEQ ID NO: 388186 - RNA, 23 nt, Human
uuugaauucccaccauucuauac

SEQ ID NO: 388187 - RNA, 19 nt, Human
aaaaaaaaaagaaaaacaa

SEQ ID NO: 388188 - RNA, 22 nt, Human
aaaaaaaaaagaaaaacaauaa

SEQ ID NO: 388189 - RNA, 21 nt, Human
aaaaaaagaaaaaaaagaaag

SEQ ID NO: 388190 - RNA, 19 nt, Human
aaaaaagaaaaacaauaau

SEQ ID NO: 388191 - RNA, 21 nt, Human
aaaaaagaaagccugaugcac

SEQ ID NO: 388192 - RNA, 26 nt, Human
aaaaaucaauaaaaaguucaaauagc

SEQ ID NO: 388193 - RNA, 23 nt, Human
aaaagcaggaacaaucuugaacc

SEQ ID NO: 388194 - RNA, 23 nt, Human
aaagaaagaaacaaagaaaagaa

SEQ ID NO: 388195 - RNA, 22 nt, Human
aaagaaagaaagaaacaaagaa

SEQ ID NO: 388196 - RNA, 19 nt, Human
aaagcucccuuagcucuuc

SEQ ID NO: 388197 - RNA, 28 nt, Human
aaauaaagaaagaaagaaacaaagaaaa

SEQ ID NO: 388198 - RNA, 22 nt, Human
aaauaauucuuuacucccccca

SEQ ID NO: 388199 - RNA, 19 nt, Human
aacauggugaaacccuguc

SEQ ID NO: 388200 - RNA, 20 nt, Human
aacauggugaaacccugucu

SEQ ID NO: 388201 - RNA, 21 nt, Human
aacauggugaaacccugucuc

SEQ ID NO: 388202 - RNA, 21 nt, Human
aagaaaaacaauaauuuaugc

SEQ ID NO: 388203 - RNA, 24 nt, Human
aagaaaagaaaagcuuauauugaa

SEQ ID NO: 388204 - RNA, 22 nt, Human
aagaaagaaacaaagaaaagaa

SEQ ID NO: 388205 - RNA, 23 nt, Human
aagaaagaaagaaacaaagaaaa

SEQ ID NO: 388206 - RNA, 20 nt, Human
aagaagccaaccccgaaagc

SEQ ID NO: 388207 - RNA, 20 nt, Human
aagcagccuccaagaagcca

SEQ ID NO: 388208 - RNA, 22 nt, Human
aaggagaaagcagccuccaaga

SEQ ID NO: 388209 - RNA, 20 nt, Human
aaguaaaggagaaagcagcc

SEQ ID NO: 388210 - RNA, 24 nt, Human
aaucgcuugaacccaggaggugga

SEQ ID NO: 388211 - RNA, 21 nt, Human
acacaguaguauuucuggaag

SEQ ID NO: 388212 - RNA, 24 nt, Human
acagagcaagacuccaucucaaaa

SEQ ID NO: 388213 - RNA, 24 nt, Human
acccaggagguggagguugcagug

SEQ ID NO: 388214 - RNA, 24 nt, Human
accccgaaagcucccuuagcucuu

SEQ ID NO: 388215 - RNA, 24 nt, Human
acccugucucuacuaaaaauacaa

SEQ ID NO: 388216 - RNA, 18 nt, Human
acugcacuccagcauggg

SEQ ID NO: 388217 - RNA, 24 nt, Human
acugcacuccagcaugggcgacag

SEQ ID NO: 388218 - RNA, 23 nt, Human
agaaaagaaaagcuuauauugaa

SEQ ID NO: 388219 - RNA, 19 nt, Human
agaccugccuggagagagc

SEQ ID NO: 388220 - RNA, 21 nt, Human
agagggaggcagauuaaugaa

SEQ ID NO: 388221 - RNA, 22 nt, Human
agauugccugaggucaggaguu

SEQ ID NO: 388222 - RNA, 23 nt, Human
agcaacuuuuccuaauguguuua

SEQ ID NO: 388223 - RNA, 24 nt, Human
agcaugggcgacagagcaagacuc

SEQ ID NO: 388224 - RNA, 21 nt, Human
agccgggcaugguggcucacg

SEQ ID NO: 388225 - RNA, 22 nt, Human
agccuggcuaacauggugaaac

SEQ ID NO: 388226 - RNA, 24 nt, Human
agccuggcuaacauggugaaaccc

SEQ ID NO: 388227 - RNA, 18 nt, Human
aggaaaugguugggggca

SEQ ID NO: 388228 - RNA, 22 nt, Human
aggagaaagcagccuccaagaa

SEQ ID NO: 388229 - RNA, 20 nt, Human
aggaguuugagaccagccug

SEQ ID NO: 388230 - RNA, 18 nt, Human
aggcaagagaaucgcuug

SEQ ID NO: 388231 - RNA, 24 nt, Human
aggcaagagaaucgcuugaaccca

SEQ ID NO: 388232 - RNA, 22 nt, Human
aggcgggcagauugccugaggu

SEQ ID NO: 388233 - RNA, 24 nt, Human
aggcgggcagauugccugagguca

SEQ ID NO: 388234 - RNA, 24 nt, Human
agguggagguugcagugagccgag

SEQ ID NO: 388235 - RNA, 24 nt, Human
agguugaggcaagagaaucgcuug

SEQ ID NO: 388236 - RNA, 23 nt, Human
aguaaaggagaaagcagccucca

SEQ ID NO: 388237 - RNA, 24 nt, Human
aucgcgccacugcacuccagcaug

SEQ ID NO: 388238 - RNA, 22 nt, Human
aucuuuuucuuuucccucaucc

SEQ ID NO: 388239 - RNA, 22 nt, Human
auuaaaaaaaaaaaaagaaaaa

SEQ ID NO: 388240 - RNA, 24 nt, Human
auugccugaggucaggaguuugag

SEQ ID NO: 388241 - RNA, 24 nt, Human
caaaauaauucuuuacucccccca

SEQ ID NO: 388242 - RNA, 18 nt, Human
caacuuuuccuaaugugu

SEQ ID NO: 388243 - RNA, 20 nt, Human
caccaaauacaugugucccc

SEQ ID NO: 388244 - RNA, 20 nt, Human
caccugagucccugaggagc

SEQ ID NO: 388245 - RNA, 23 nt, Human
cacgccuguaaucccaguacuuu

SEQ ID NO: 388246 - RNA, 23 nt, Human
cacuccagcaugggcgacagagc

SEQ ID NO: 388247 - RNA, 19 nt, Human
cacugcacuccagcauggg

SEQ ID NO: 388248 - RNA, 21 nt, Human
cacugcacuccagcaugggcg

SEQ ID NO: 388249 - RNA, 22 nt, Human
cacugcacuccagcaugggcga

SEQ ID NO: 388250 - RNA, 23 nt, Human
cacugcacuccagcaugggcgac

SEQ ID NO: 388251 - RNA, 24 nt, Human
cacugcacuccagcaugggcgaca

SEQ ID NO: 388252 - RNA, 24 nt, Human
cagauugccugaggucaggaguuu

SEQ ID NO: 388253 - RNA, 18 nt, Human
cagcaugggcgacagagc

SEQ ID NO: 388254 - RNA, 29 nt, Human
caggagguggagguugcagugacaacggu

SEQ ID NO: 388255 - RNA, 24 nt, Human
caggagguggagguugcagugagc

SEQ ID NO: 388256 - RNA, 24 nt, Human
caguacuuuaggagacccaggcgg

SEQ ID NO: 388257 - RNA, 23 nt, Human
ccaaccccgaaagcucccuuagc

SEQ ID NO: 388258 - RNA, 20 nt, Human
ccacugcacuccagcauggg

SEQ ID NO: 388259 - RNA, 20 nt, Human
ccacugcacuccagcauggg

SEQ ID NO: 388260 - RNA, 21 nt, Human
ccacugcacuccagcaugggc

SEQ ID NO: 388261 - RNA, 23 nt, Human
ccacugcacuccagcaugggcga

SEQ ID NO: 388262 - RNA, 24 nt, Human
ccacugcacuccagcaugggcgac

SEQ ID NO: 388263 - RNA, 21 nt, Human
cccaggagguggagguugcag

SEQ ID NO: 388264 - RNA, 21 nt, Human
ccccccaaaaaucaauaaaaa

SEQ ID NO: 388265 - RNA, 21 nt, Human
cccugaggagccgcaaggccu

SEQ ID NO: 388266 - RNA, 23 nt, Human
cccugaggagccgcaaggccuag

SEQ ID NO: 388267 - RNA, 18 nt, Human
ccuccaagaagccaaccc

SEQ ID NO: 388268 - RNA, 22 nt, Human
ccugaggucaggaguuugagac

SEQ ID NO: 388269 - RNA, 19 nt, Human
ccuggagagagcguguucu

SEQ ID NO: 388270 - RNA, 22 nt, Human
ccuggcuaacauggugaaaccc

SEQ ID NO: 388271 - RNA, 24 nt, Human
ccuggcuaacauggugaaacccug

SEQ ID NO: 388272 - RNA, 21 nt, Human
ccuguagucccaacugcuugg

SEQ ID NO: 388273 - RNA, 24 nt, Human
cgagaucgcgccacugcacuccag

SEQ ID NO: 388274 - RNA, 24 nt, Human
cgccuguaaucccaguacuuuagg

SEQ ID NO: 388275 - RNA, 23 nt, Human
cgccuguagucccaacugcuugg

SEQ ID NO: 388276 - RNA, 24 nt, Human
cgccuguagucccaacugcuuggg

SEQ ID NO: 388277 - RNA, 24 nt, Human
cgggcagauugccugaggucagga

SEQ ID NO: 388278 - RNA, 20 nt, Human
cucaaaauaaagaaagaaag

SEQ ID NO: 388279 - RNA, 22 nt, Human
cucaaaauaaagaaagaaagaa

SEQ ID NO: 388280 - RNA, 24 nt, Human
cucaaaauaaagaaagaaagaaac

SEQ ID NO: 388281 - RNA, 22 nt, Human
cucacgccuguaaucccaguac

SEQ ID NO: 388282 - RNA, 24 nt, Human
cucacgccuguaaucccaguacuu

SEQ ID NO: 388283 - RNA, 20 nt, Human
cucacgccuguagucccaac

SEQ ID NO: 388284 - RNA, 24 nt, Human
cucacgccuguagucccaacugcu

SEQ ID NO: 388285 - RNA, 24 nt, Human
cuggcuaacauggugaaacccugu

SEQ ID NO: 388286 - RNA, 21 nt, Human
cuuauauugaacuucucuaaa

SEQ ID NO: 388287 - RNA, 22 nt, Human
cuuuguucaccugguacuuuca

SEQ ID NO: 388288 - RNA, 20 nt, Human
gaaagcagccuccaagaagc

SEQ ID NO: 388289 - RNA, 23 nt, Human
gagaaucgcuugaacccaggagg

SEQ ID NO: 388290 - RNA, 18 nt, Human
gaggaucugagugugggu

SEQ ID NO: 388291 - RNA, 23 nt, Human
gagguugcagugagccgagaucg

SEQ ID NO: 388292 - RNA, 24 nt, Human
gauugccugaggucaggaguuuga

SEQ ID NO: 388293 - RNA, 22 nt, Human
gcaagagaaucgcuugaaccca

SEQ ID NO: 388294 - RNA, 23 nt, Human
gcagccuccaagaagccaacccc

SEQ ID NO: 388295 - RNA, 24 nt, Human
gccacugcacuccagcaugggcga

SEQ ID NO: 388296 - RNA, 20 nt, Human
gccgagaucgcgccacugca

SEQ ID NO: 388297 - RNA, 24 nt, Human
gccugaggucaggaguuugagacc

SEQ ID NO: 388298 - RNA, 23 nt, Human
gccuguagucccaacugcuuggg

SEQ ID NO: 388299 - RNA, 21 nt, Human
gcgcagagcaagggaguaauc

SEQ ID NO: 388300 - RNA, 24 nt, Human
gcuaacauggugaaacccugucuc

SEQ ID NO: 388301 - RNA, 23 nt, Human
ggaggaucugagugugggugugg

SEQ ID NO: 388302 - RNA, 20 nt, Human
ggagguugcagugagccgag

SEQ ID NO: 388303 - RNA, 22 nt, Human
ggagguugcagugagccgagau

SEQ ID NO: 388304 - RNA, 24 nt, Human
ggagguugcagugagccgagaucg

SEQ ID NO: 388305 - RNA, 21 nt, Human
ggcagauugccugaggucagg

SEQ ID NO: 388306 - RNA, 22 nt, Human
ggcaugguggcucacgccugua

SEQ ID NO: 388307 - RNA, 23 nt, Human
ggcgagguggcucacgccuguaa

SEQ ID NO: 388308 - RNA, 19 nt, Human
ggucaggaguuugagacca

SEQ ID NO: 388309 - RNA, 23 nt, Human
gguggcucacgccuguaauccca

SEQ ID NO: 388310 - RNA, 24 nt, Human
gguggcucacgccuguaaucccag

SEQ ID NO: 388311 - RNA, 18 nt, Human
gguggcucacgccuguag

SEQ ID NO: 388312 - RNA, 23 nt, Human
gguggcucacgccuguaguccca

SEQ ID NO: 388313 - RNA, 19 nt, Human
guaaaggagaaagcagccu

SEQ ID NO: 388314 - RNA, 21 nt, Human
gugaaacccugucucuacuaa

SEQ ID NO: 388315 - RNA, 22 nt, Human
gugaggcaauaagagaguugag

SEQ ID NO: 388316 - RNA, 22 nt, Human
uaacauggugaaacccugucuc

SEQ ID NO: 388317 - RNA, 24 nt, Human
uaacauggugaaacccugucucua

SEQ ID NO: 388318 - RNA, 18 nt, Human
uaagaaagccugaugccg

SEQ ID NO: 388319 - RNA, 22 nt, Human
uaggagacccaggcgggcagau

SEQ ID NO: 388320 - RNA, 23 nt, Human
uauaacaaugacaagugaagaua

SEQ ID NO: 388321 - RNA, 20 nt, Human
ucaagaaaaaaaagaaggaa

SEQ ID NO: 388322 - RNA, 24 nt, Human
ucaaucuuuuucuuuucccucauc

SEQ ID NO: 388323 - RNA, 22 nt, Human
ucacgccuguaaucccaguacu

SEQ ID NO: 388324 - RNA, 24 nt, Human
uccagcaugggcgacagagcaaga

SEQ ID NO: 388325 - RNA, 22 nt, Human
uccccccaaaaaucaauaaaaa

SEQ ID NO: 388326 - RNA, 27 nt, Human
ucccugaggagccgcaaggccuagucc

SEQ ID NO: 388327 - RNA, 21 nt, Human
ucccuuagcucuucuuugaca

SEQ ID NO: 388328 - RNA, 24 nt, Human
ucgcuugaacccaggagguggagg

SEQ ID NO: 388329 - RNA, 25 nt, Human
ucucuaaaaaaagaaaaaaaagaaa

SEQ ID NO: 388330 - RNA, 21 nt, Human
ucucuacuaaaaauacaaaaa

SEQ ID NO: 388331 - RNA, 22 nt, Human
ucuuuccaguuauaauucuauu

SEQ ID NO: 388332 - RNA, 19 nt, Human
ugaaaagauaauauauauu

SEQ ID NO: 388333 - RNA, 23 nt, Human
ugaacccuugacauggugcauuu

SEQ ID NO: 388334 - RNA, 26 nt, Human
ugaacuucucuaaaaaaagaaaaaaa

SEQ ID NO: 388335 - RNA, 23 nt, Human
ugagaccagccuggcuaacaugg

SEQ ID NO: 388336 - RNA, 22 nt, Human
ugagccgagaucgcgccacugc

SEQ ID NO: 388337 - RNA, 20 nt, Human
ugaggaaaugguugggggca

SEQ ID NO: 388338 - RNA, 18 nt, Human
ugaggaggaucugagugu

SEQ ID NO: 388339 - RNA, 20 nt, Human
ugaggcaagagaaucgcuug

SEQ ID NO: 388340 - RNA, 24 nt, Human
ugaggcaagagaaucgcuugaacc

SEQ ID NO: 388341 - RNA, 25 nt, Human
ugaggcaagagaaucgcuugaaccc

SEQ ID NO: 388342 - RNA, 18 nt, Human
ugaggucaggaguuugag

SEQ ID NO: 388343 - RNA, 22 nt, Human
ugcauuugaggccccucuccca

SEQ ID NO: 388344 - RNA, 23 nt, Human
ugccugaggucaggaguuugaga

SEQ ID NO: 388345 - RNA, 19 nt, Human
ugccuggagagagcguguu

SEQ ID NO: 388346 - RNA, 22 nt, Human
uggcucacgccuguaaucccag

SEQ ID NO: 388347 - RNA, 22 nt, Human
uggcucacgccuguaaucccag

SEQ ID NO: 388348 - RNA, 24 nt, Human
uggcucacgccuguaaucccagua

SEQ ID NO: 388349 - RNA, 21 nt, Human
uggcucacgccuguaguccca

SEQ ID NO: 388350 - RNA, 22 nt, Human
uggcucacgccuguagucccaa

SEQ ID NO: 388351 - RNA, 20 nt, Human
ugggagguugaggcaagaga

SEQ ID NO: 388352 - RNA, 24 nt, Human
ugguggcucacgccuguaguccca

SEQ ID NO: 388353 - RNA, 22 nt, Human
uguaaagugagguauaccugaa

SEQ ID NO: 388354 - RNA, 22 nt, Human
uuagaaaauguaugaaaagaua

SEQ ID NO: 388355 - RNA, 19 nt, Human
uuagagucugaggaaaugg

SEQ ID NO: 388356 - RNA, 18 nt, Human
uuagccgggcaugguggc

SEQ ID NO: 388357 - RNA, 22 nt, Human
uucaagaaaaaaaagaaggaaa

SEQ ID NO: 388358 - RNA, 18 nt, Human
uuccaaguaaaggagaaa

SEQ ID NO: 388359 - RNA, 21 nt, Human
uucuugucucaacugcuuucu

SEQ ID NO: 388360 - RNA, 24 nt, Human
uugaacccaggagguggagguugc

SEQ ID NO: 388361 - RNA, 20 nt, Human
uugaacccuugacauggugc

SEQ ID NO: 388362 - RNA, 18 nt, Human
uugcagugagccgagauc

SEQ ID NO: 388363 - RNA, 19 nt, Human
uugcagugagccgagaucg

SEQ ID NO: 388364 - RNA, 20 nt, Human
uugcagugagccgagaucgc

SEQ ID NO: 388365 - RNA, 22 nt, Human
uugcagugagccgagaucgcgc

SEQ ID NO: 388366 - RNA, 19 nt, Human
uuguacuuggggaaaagca

SEQ ID NO: 388367 - RNA, 23 nt, Human
uuuaagaaagccugaugccgcug

SEQ ID NO: 388368 - RNA, 23 nt, Human
uuuauuugcauccaaaauaauuc

SEQ ID NO: 388369 - RNA, 24 nt, Human
uuucaagaaaaaaaagaaggaaau

SEQ ID NO: 388370 - RNA, 23 nt, Human
uuucuggaaggucucugauuccu

SEQ ID NO: 388371 - RNA, 24 nt, Human
acaaggucaacagaaacuugugaa

SEQ ID NO: 388372 - RNA, 20 nt, Human
agacaguucugcaaacuagg

SEQ ID NO: 388373 - RNA, 18 nt, Human
auccgccaucagccgccg

SEQ ID NO: 388374 - RNA, 20 nt, Human
cagaaacuugugaauauucu

SEQ ID NO: 388375 - RNA, 19 nt, Human
caguggaaagacucccgga

SEQ ID NO: 388376 - RNA, 25 nt, Human
ccggaucaagggagaaaguuacgca

SEQ ID NO: 388377 - RNA, 20 nt, Human
cucccggaucaagggagaaa

SEQ ID NO: 388378 - RNA, 22 nt, Human
cuuccgauccugauccgccauc

SEQ ID NO: 388379 - RNA, 22 nt, Human
guuuuuuuuuuuuuuuuuuacu

SEQ ID NO: 388380 - RNA, 18 nt, Human
ucagacaguucugcaaac

SEQ ID NO: 388381 - RNA, 19 nt, Human
ucuauggucuccucagugg

SEQ ID NO: 388382 - RNA, 22 nt, Human
ucuauggucuccucaguggucu

SEQ ID NO: 388383 - RNA, 23 nt, Human
ugacaaaugcuuuuuauuacaua

SEQ ID NO: 388384 - RNA, 24 nt, Human
ugugguuuuuuuuuuuuuuuuuua

SEQ ID NO: 388385 - RNA, 25 nt, Human
uuuuuuuuuuuuuuuuuacugcuaa

SEQ ID NO: 388386 - RNA, 18 nt, Human
uuuuuuuuuuuuuuuuug

SEQ ID NO: 388387 - RNA, 23 nt, Human
uuuuuuuuuuuuuuuuuuguuau

SEQ ID NO: 388388 - RNA, 19 nt, Human
aaacaugaaaacccaggcc

SEQ ID NO: 388389 - RNA, 18 nt, Human
aagaauccagaaggcagc

SEQ ID NO: 388390 - RNA, 27 nt, Human
aagcauuugguacuacugucaucaaua

SEQ ID NO: 388391 - RNA, 19 nt, Human
aaguaacugccugugguca

SEQ ID NO: 388392 - RNA, 24 nt, Human
acagcucuggugggcccccugcuc

SEQ ID NO: 388393 - RNA, 19 nt, Human
acaucugaaggcaagaagg

SEQ ID NO: 388394 - RNA, 19 nt, Human
agaaggaagacguggccaa

SEQ ID NO: 388395 - RNA, 20 nt, Human
agagaacaucugaaggcaag

SEQ ID NO: 388396 - RNA, 23 nt, Human
agccauggggcagcagagaagaa

SEQ ID NO: 388397 - RNA, 19 nt, Human
aggaagcacggaggagcug

SEQ ID NO: 388398 - RNA, 26 nt, Human
aggcaagaaggaaagagaggggaccc

SEQ ID NO: 388399 - RNA, 19 nt, Human
aggcagaaggaagacgugg

SEQ ID NO: 388400 - RNA, 23 nt, Human
aggcgggcgcuggcaccccggcc

SEQ ID NO: 388401 - RNA, 22 nt, Human
auggaggcgggaaguggugcac

SEQ ID NO: 388402 - RNA, 21 nt, Human
caaaaccaggcaaugauuaaa

SEQ ID NO: 388403 - RNA, 26 nt, Human
cacaggccgugggcgcgcugcggaac

SEQ ID NO: 388404 - RNA, 22 nt, Human
cacucuaggcuccacguggcug

SEQ ID NO: 388405 - RNA, 20 nt, Human
cacuuuuuccaagaggccca

SEQ ID NO: 388406 - RNA, 21 nt, Human
cagcaugggggcaagcagcca

SEQ ID NO: 388407 - RNA, 21 nt, Human
cagccagaccucaggcccuca

SEQ ID NO: 388408 - RNA, 24 nt, Human
cagcgccccgggccggccuguggg

SEQ ID NO: 388409 - RNA, 20 nt, Human
caggccggagcagcgcccgg

SEQ ID NO: 388410 - RNA, 21 nt, Human
caggggacuggaccgaggucc

SEQ ID NO: 388411 - RNA, 22 nt, Human
caggucaggccggagcagcgcc

SEQ ID NO: 388412 - RNA, 24 nt, Human
caugaaaacccaggccgucagaga

SEQ ID NO: 388413 - RNA, 25 nt, Human
ccaccugaggccagaccuugccuga

SEQ ID NO: 388414 - RNA, 21 nt, Human
ccaggaaauguaaggucaugg

SEQ ID NO: 388415 - RNA, 18 nt, Human
cccacccggcccgcggcc

SEQ ID NO: 388416 - RNA, 19 nt, Human
cccaggcccuaggauucaa

SEQ ID NO: 388417 - RNA, 22 nt, Human
cccauaaagcuuagccaugggg

SEQ ID NO: 388418 - RNA, 20 nt, Human
ccccacccggcccgcggccg

SEQ ID NO: 388419 - RNA, 19 nt, Human
cccccugcuccccuagcca

SEQ ID NO: 388420 - RNA, 24 nt, Human
ccccgcucucucgucacuggggag

SEQ ID NO: 388421 - RNA, 26 nt, Human
cccggcccgcggccggcgcucccagc

SEQ ID NO: 388422 - RNA, 26 nt, Human
cccucagccccagcucugugcgggcc

SEQ ID NO: 388423 - RNA, 18 nt, Human
ccgacucugugccuggca

SEQ ID NO: 388424 - RNA, 20 nt, Human
ccugaggccagaccuugccu

SEQ ID NO: 388425 - RNA, 24 nt, Human
ccugcagacuugcucugcuccauc

SEQ ID NO: 388426 - RNA, 21 nt, Human
ccugccuaagcuucuuccucc

SEQ ID NO: 388427 - RNA, 21 nt, Human
ccugccuucuaugcucccucc

SEQ ID NO: 388428 - RNA, 19 nt, Human
cgagacacuggccccugac

SEQ ID NO: 388429 - RNA, 21 nt, Human
cgcacggacggacgggggcgc

SEQ ID NO: 388430 - RNA, 19 nt, Human
cgcaggagaagcccucgug

SEQ ID NO: 388431 - RNA, 19 nt, Human
cgcaggucaggccggagca

SEQ ID NO: 388432 - RNA, 20 nt, Human
cgccucuaggucugcgaccu

SEQ ID NO: 388433 - RNA, 22 nt, Human
cgcggccggcgcucccagcgcc

SEQ ID NO: 388434 - RNA, 18 nt, Human
cgcugcggaacgggagga

SEQ ID NO: 388435 - RNA, 26 nt, Human
cggcccaccugaggccagaccuugcc

SEQ ID NO: 388436 - RNA, 20 nt, Human
cuaaaagccacguuugagcu

SEQ ID NO: 388437 - RNA, 19 nt, Human
cuacugucaucaauacagu

SEQ ID NO: 388438 - RNA, 20 nt, Human
cuagugcugggcgaaaagga

SEQ ID NO: 388439 - RNA, 20 nt, Human
cuagugcugggcgaaaagga

SEQ ID NO: 388440 - RNA, 23 nt, Human
cucagccccagcucugugcgggc

SEQ ID NO: 388441 - RNA, 18 nt, Human
cucccagcgccccgggcc

SEQ ID NO: 388442 - RNA, 25 nt, Human
cucccagcgccccgggccggccugu

SEQ ID NO: 388443 - RNA, 18 nt, Human
cugcggcccaccugaggc

SEQ ID NO: 388444 - RNA, 20 nt, Human
cuucuaugcucccuccugaa

SEQ ID NO: 388445 - RNA, 20 nt, Human
gaacaaaucugucuaaaagc

SEQ ID NO: 388446 - RNA, 23 nt, Human
gacacaauucuguauaaucuguu

SEQ ID NO: 388447 - RNA, 24 nt, Human
gagaagcagcugagguccuuugug

SEQ ID NO: 388448 - RNA, 20 nt, Human
gaggaaacgggaaggcgggc

SEQ ID NO: 388449 - RNA, 21 nt, Human
gagggagcacgagucauggag

SEQ ID NO: 388450 - RNA, 21 nt, Human
gauguugagaggcagaaagga

SEQ ID NO: 388451 - RNA, 26 nt, Human
gcaacauaaaaaggagggagcacgag

SEQ ID NO: 388452 - RNA, 22 nt, Human
gcaagaaggaaagagagcccug

SEQ ID NO: 388453 - RNA, 19 nt, Human
gccugcggcccaccugagg

SEQ ID NO: 388454 - RNA, 24 nt, Human
gccuguggugggggggaagcucag

SEQ ID NO: 388455 - RNA, 18 nt, Human
gcgaaaaggaggcgcagg

SEQ ID NO: 388456 - RNA, 22 nt, Human
gcgcgcggcggccgccgucccg

SEQ ID NO: 388457 - RNA, 21 nt, Human
gcggccggcgcucccagcgcc

SEQ ID NO: 388458 - RNA, 19 nt, Human
gcugggcuugacuucuggc

SEQ ID NO: 388459 - RNA, 20 nt, Human
gcuuggcugacaaaucccga

SEQ ID NO: 388460 - RNA, 18 nt, Human
ggaaauguaaggucaugg

SEQ ID NO: 388461 - RNA, 21 nt, Human
ggaaguggugcaccugcagac

SEQ ID NO: 388462 - RNA, 26 nt, Human
ggacgggggcgcggcgcaacagggga

SEQ ID NO: 388463 - RNA, 21 nt, Human
ggagcagcgcccggccccgcu

SEQ ID NO: 388464 - RNA, 19 nt, Human
ggccaagggcugcuuuucc

SEQ ID NO: 388465 - RNA, 19 nt, Human
ggccuaaggcgcuagugcu

SEQ ID NO: 388466 - RNA, 18 nt, Human
gggcagcagagaagaaag

SEQ ID NO: 388467 - RNA, 19 nt, Human
gggcgaaaaggaggcgcag

SEQ ID NO: 388468 - RNA, 23 nt, Human
ggguaggagccaggccgaggagu

SEQ ID NO: 388469 - RNA, 20 nt, Human
ggucaggccggagcagcgcc

SEQ ID NO: 388470 - RNA, 19 nt, Human
ggucccuucgcaggucagg

SEQ ID NO: 388471 - RNA, 21 nt, Human
uagccauggggcagcagagaa

SEQ ID NO: 388472 - RNA, 21 nt, Human
uaugaacaaaucugucuaaaa

SEQ ID NO: 388473 - RNA, 24 nt, Human
ucaaaaacaugaaaacccaggccc

SEQ ID NO: 388474 - RNA, 19 nt, Human
ucaggccggagcagcgccc

SEQ ID NO: 388475 - RNA, 23 nt, Human
ucccucagccccagcucugugcg

SEQ ID NO: 388476 - RNA, 18 nt, Human
ucccugaggagguaguga

SEQ ID NO: 388477 - RNA, 20 nt, Human
ucccugaggagguagugagc

SEQ ID NO: 388478 - RNA, 21 nt, Human
ucgggugagucccgagauugc

SEQ ID NO: 388479 - RNA, 18 nt, Human
ugacuggcccgcgcacgg

SEQ ID NO: 388480 - RNA, 25 nt, Human
ugagagggucuaugaacaaaucugu

SEQ ID NO: 388481 - RNA, 19 nt, Human
ugagcgcgcggcggccgcc

SEQ ID NO: 388482 - RNA, 23 nt, Human
ugagcuaaaagcaucaguccaau

SEQ ID NO: 388483 - RNA, 18 nt, Human
ugaggaaagggccugugg

SEQ ID NO: 388484 - RNA, 20 nt, Human
ugccuucuaugcucccuccu

SEQ ID NO: 388485 - RNA, 21 nt, Human
ugcucugcuccaucacuuuuu

SEQ ID NO: 388486 - RNA, 21 nt, Human
uggaaugccuaccagcucgga

SEQ ID NO: 388487 - RNA, 21 nt, Human
uggccaagggcugcuuuuccc

SEQ ID NO: 388488 - RNA, 19 nt, Human
ugggagaagcagcugaggu

SEQ ID NO: 388489 - RNA, 23 nt, Human
ugggagaagcagcugagguccuu

SEQ ID NO: 388490 - RNA, 18 nt, Human
ugggggggaagcucaggc

SEQ ID NO: 388491 - RNA, 28 nt, Human
uggguaggagccaggccgaggagucuua

SEQ ID NO: 388492 - RNA, 23 nt, Human
ugucaucaauacaguuuuugaaa

SEQ ID NO: 388493 - RNA, 19 nt, Human
uguuggcgccagcaugggg

SEQ ID NO: 388494 - RNA, 18 nt, Human
uuaaagcauuugguacua

SEQ ID NO: 388495 - RNA, 21 nt, Human
uucccgccugcggcccaccug

SEQ ID NO: 388496 - RNA, 23 nt, Human
uucuguauaaucugucacaagaa

SEQ ID NO: 388497 - RNA, 23 nt, Human
uugagcuaaaagcaucaguccau

SEQ ID NO: 388498 - RNA, 21 nt, Human
uuguuggcgccagcauggggg

SEQ ID NO: 388499 - RNA, 24 nt, Human
uuuaugguuuaaaaucaauuggug

SEQ ID NO: 388500 - RNA, 18 nt, Human
uuuuuuuuuuuuuuuuug

SEQ ID NO: 388501 - RNA, 22 nt, Human
uuuuuuuuuuuuuuuuuggauu

SEQ ID NO: 388502 - RNA, 18 nt, Human
accccaagucaccagagc

SEQ ID NO: 388503 - RNA, 21 nt, Human
agacauccucaccaggcaggg

SEQ ID NO: 388504 - RNA, 21 nt, Human
aggaacaagacauccucacca

SEQ ID NO: 388505 - RNA, 20 nt, Human
aggaugagggaugaaaagga

SEQ ID NO: 388506 - RNA, 24 nt, Human
augaaggaugagggaugaaaagga

SEQ ID NO: 388507 - RNA, 18 nt, Human
caaggcuuuccacaccgg

SEQ ID NO: 388508 - RNA, 20 nt, Human
caaggcuuuccacaccggcc

SEQ ID NO: 388509 - RNA, 19 nt, Human
caccccaagucaccagagc

SEQ ID NO: 388510 - RNA, 20 nt, Human
cagcgcuacccuucaacagc

SEQ ID NO: 388511 - RNA, 21 nt, Human
cagcuagugccagccuccaag

SEQ ID NO: 388512 - RNA, 18 nt, Human
cccacuccgcuagagcgc

SEQ ID NO: 388513 - RNA, 23 nt, Human
ccgcgcccccgccucacguguuc

SEQ ID NO: 388514 - RNA, 19 nt, Human
cgcccccgccucacguguu

SEQ ID NO: 388515 - RNA, 22 nt, Human
cuccaagggccagcgcuacccu

SEQ ID NO: 388516 - RNA, 18 nt, Human
gaaaaggaggcgcccgcu

SEQ ID NO: 388517 - RNA, 22 nt, Human
gaaggaugagggaugaaaagga

SEQ ID NO: 388518 - RNA, 22 nt, Human
gaggaaaagcugucagcuagug

SEQ ID NO: 388519 - RNA, 24 nt, Human
gccucacguguucgcagaucccac

SEQ ID NO: 388520 - RNA, 24 nt, Human
gcuagagcgcgaaagccagggaug

SEQ ID NO: 388521 - RNA, 18 nt, Human
gggccagcgcuacccuuc

SEQ ID NO: 388522 - RNA, 21 nt, Human
uacccuucaacagcuggaggc

SEQ ID NO: 388523 - RNA, 18 nt, Human
ucaccagagcgcaggugc

SEQ ID NO: 388524 - RNA, 18 nt, Human
uguucaagugaaggcaga

SEQ ID NO: 388525 - RNA, 23 nt, Human
aaaaacagaaaagcaacaagaac

SEQ ID NO: 388526 - RNA, 19 nt, Human
aaaaaggccccccugcccu

SEQ ID NO: 388527 - RNA, 22 nt, Human
aaaacaugaaucacacaaagcu

SEQ ID NO: 388528 - RNA, 24 nt, Human
aaaauacucaucucagaaccagag

SEQ ID NO: 388529 - RNA, 21 nt, Human
aaacaaaaaaaaaaaaauccc

SEQ ID NO: 388530 - RNA, 25 nt, Human
aaacaaaaaaaaaaaaaucccaagg

SEQ ID NO: 388531 - RNA, 19 nt, Human
aaaccaauccacacgccuc

SEQ ID NO: 388532 - RNA, 21 nt, Human
aaaccacccaaugaacaaaga

SEQ ID NO: 388533 - RNA, 21 nt, Human
aaagcacuuacuacgcgccaa

SEQ ID NO: 388534 - RNA, 20 nt, Human
aaagccaggggcucccucag

SEQ ID NO: 388535 - RNA, 21 nt, Human
aaaggccccccugcccugccu

SEQ ID NO: 388536 - RNA, 18 nt, Human
aaaguguugggauuacaa

SEQ ID NO: 388537 - RNA, 18 nt, Human
aacaaacuguacucuaaa

SEQ ID NO: 388538 - RNA, 21 nt, Human
aaccacccaaugaacaaagaa

SEQ ID NO: 388539 - RNA, 24 nt, Human
aacuucagugaguggcggaaggaa

SEQ ID NO: 388540 - RNA, 21 nt, Human
aagagacaacaagcccaagac

SEQ ID NO: 388541 - RNA, 18 nt, Human
aagaggcccuuguccuuu

SEQ ID NO: 388542 - RNA, 19 nt, Human
aagaggcccuuguccuuug

SEQ ID NO: 388543 - RNA, 19 nt, Human
aaggccccccugcccugcc

SEQ ID NO: 388544 - RNA, 20 nt, Human
aaguguugggauuacaaagu

SEQ ID NO: 388545 - RNA, 18 nt, Human
aaucaucaccucauccag

SEQ ID NO: 388546 - RNA, 20 nt, Human
acacagacaauaaaaacugc

SEQ ID NO: 388547 - RNA, 20 nt, Human
acagaaaagcaacaagaaca

SEQ ID NO: 388548 - RNA, 22 nt, Human
acagaacacgaauaaaauacuc

SEQ ID NO: 388549 - RNA, 21 nt, Human
acagacaauaaaaacugcaca

SEQ ID NO: 388550 - RNA, 18 nt, Human
acaggcuggccuuugaca

SEQ ID NO: 388551 - RNA, 19 nt, Human
acauacccaaguggaggcc

SEQ ID NO: 388552 - RNA, 23 nt, Human
accuaacaauuccgacaugguuc

SEQ ID NO: 388553 - RNA, 21 nt, Human
acuucacuuggcuccaugauc

SEQ ID NO: 388554 - RNA, 21 nt, Human
agaaagcgagcgcgagcgcga

SEQ ID NO: 388555 - RNA, 18 nt, Human
agaaggaagagacaacaa

SEQ ID NO: 388556 - RNA, 21 nt, Human
agaaucggaaaaaugccaaua

SEQ ID NO: 388557 - RNA, 19 nt, Human
agacaacaagcccaagaca

SEQ ID NO: 388558 - RNA, 21 nt, Human
agacaacaagcccaagacagc

SEQ ID NO: 388559 - RNA, 19 nt, Human
agacaauaaaaacugcaca

SEQ ID NO: 388560 - RNA, 18 nt, Human
agacagggggaggggcag

SEQ ID NO: 388561 - RNA, 18 nt, Human
agagagggugaguagugg

SEQ ID NO: 388562 - RNA, 24 nt, Human
agagggcggaagggggaaagcugu

SEQ ID NO: 388563 - RNA, 21 nt, Human
agcagcagagagggugaguag

SEQ ID NO: 388564 - RNA, 18 nt, Human
agcagcgcaacuuguggc

SEQ ID NO: 388565 - RNA, 20 nt, Human
agcaucccuuucccaggugu

SEQ ID NO: 388566 - RNA, 20 nt, Human
agcauccggucauaaaaaug

SEQ ID NO: 388567 - RNA, 19 nt, Human
agccagggauggagccugg

SEQ ID NO: 388568 - RNA, 22 nt, Human
agccagggauggagccuggggu

SEQ ID NO: 388569 - RNA, 20 nt, Human
agccgacugaaaaaccaccc

SEQ ID NO: 388570 - RNA, 22 nt, Human
agcgcgcggaccccagccagga

SEQ ID NO: 388571 - RNA, 23 nt, Human
aggaagagacaacaagcccaaga

SEQ ID NO: 388572 - RNA, 23 nt, Human
aggaggaggguuuuucccccuuc

SEQ ID NO: 388573 - RNA, 23 nt, Human
aggccucccagcccagguuucua

SEQ ID NO: 388574 - RNA, 19 nt, Human
aggcuggggaagccaggga

SEQ ID NO: 388575 - RNA, 20 nt, Human
aggggucagaggguuucacc

SEQ ID NO: 388576 - RNA, 24 nt, Human
aguuguuacugguuugucaagcau

SEQ ID NO: 388577 - RNA, 20 nt, Human
augccaauagagaacauguc

SEQ ID NO: 388578 - RNA, 22 nt, Human
auggagccugggguccgaggcc

SEQ ID NO: 388579 - RNA, 23 nt, Human
auggagccugggguccgaggccu

SEQ ID NO: 388580 - RNA, 18 nt, Human
caacaagaacaaagcaga

SEQ ID NO: 388581 - RNA, 20 nt, Human
caacaagaacaaagcagacc

SEQ ID NO: 388582 - RNA, 23 nt, Human
caagcauaagccaugcccuaacg

SEQ ID NO: 388583 - RNA, 25 nt, Human
caagccagaaugcaaaacuucagug

SEQ ID NO: 388584 - RNA, 27 nt, Human
cacaauaacaccgucucacugcuggaa

SEQ ID NO: 388585 - RNA, 23 nt, Human
cacagaagcccugacccuucccc

SEQ ID NO: 388586 - RNA, 19 nt, Human
cagaaaagcaacaagaaca

SEQ ID NO: 388587 - RNA, 21 nt, Human
cagccgcgcgccgcccccggg

SEQ ID NO: 388588 - RNA, 20 nt, Human
cagccggcagccuccgaguc

SEQ ID NO: 388589 - RNA, 19 nt, Human
cagccuccgagucccggcc

SEQ ID NO: 388590 - RNA, 22 nt, Human
caucucagaaccagagcacuuu

SEQ ID NO: 388591 - RNA, 23 nt, Human
caucuuccucagcccuucugccc

SEQ ID NO: 388592 - RNA, 21 nt, Human
caugaaucacacaaagcucuc

SEQ ID NO: 388593 - RNA, 20 nt, Human
cauguuuuaagagcuguaaa

SEQ ID NO: 388594 - RNA, 21 nt, Human
cauuucuugauuacagggaug

SEQ ID NO: 388595 - RNA, 18 nt, Human
ccaaaaauacuccaggcu

SEQ ID NO: 388596 - RNA, 24 nt, Human
ccagccgacugaaaaaccacccaa

SEQ ID NO: 388597 - RNA, 19 nt, Human
cccaccaucgccaucccac

SEQ ID NO: 388598 - RNA, 25 nt, Human
cccagcauccggucauaaaaauggg

SEQ ID NO: 388599 - RNA, 24 nt, Human
ccccacgggcugggccaucuuccu

SEQ ID NO: 388600 - RNA, 24 nt, Human
ccccagaagauagaauuccagccu

SEQ ID NO: 388601 - RNA, 18 nt, Human
cccccgggccgcccccgc

SEQ ID NO: 388602 - RNA, 21 nt, Human
cccccugcccugccuucuuac

SEQ ID NO: 388603 - RNA, 28 nt, Human
ccccgccccgccgccgccgagucccgga

SEQ ID NO: 388604 - RNA, 19 nt, Human
ccccgccgccgccgagucc

SEQ ID NO: 388605 - RNA, 21 nt, Human
ccccgccgccggcccuccuca

SEQ ID NO: 388606 - RNA, 19 nt, Human
ccccggagcagccgcgcgc

SEQ ID NO: 388607 - RNA, 23 nt, Human
ccccggagcagccgcgcgccgcc

SEQ ID NO: 388608 - RNA, 20 nt, Human
cccuuggggcagcaucccuu

SEQ ID NO: 388609 - RNA, 23 nt, Human
ccgaggccucccagcccagguuu

SEQ ID NO: 388610 - RNA, 24 nt, Human
ccgaggccucccagcccagguuuc

SEQ ID NO: 388611 - RNA, 18 nt, Human
ccgccccgccgccggccc

SEQ ID NO: 388612 - RNA, 18 nt, Human
ccgccgccggcccuccuc

SEQ ID NO: 388613 - RNA, 22 nt, Human
ccuccgagucccggccgugcgg

SEQ ID NO: 388614 - RNA, 22 nt, Human
ccugaggcugaggggaaagccg

SEQ ID NO: 388615 - RNA, 22 nt, Human
ccuuauggugacuucauguaug

SEQ ID NO: 388616 - RNA, 21 nt, Human
ccuucugcccacaggaaaacc

SEQ ID NO: 388617 - RNA, 21 nt, Human
cgaauggcggccugagggcgc

SEQ ID NO: 388618 - RNA, 20 nt, Human
cgacugaaaaaccacccaau

SEQ ID NO: 388619 - RNA, 24 nt, Human
cgccaaagugcccuugagaccuaa

SEQ ID NO: 388620 - RNA, 21 nt, Human
cgcgcuccgaaccucccucca

SEQ ID NO: 388621 - RNA, 24 nt, Human
cggagagagcgcgggcgcuggaaa

SEQ ID NO: 388622 - RNA, 22 nt, Human
cggcauggcggggaccucccuc

SEQ ID NO: 388623 - RNA, 24 nt, Human
cgggagggacuggcacggacagug

SEQ ID NO: 388624 - RNA, 19 nt, Human
cguuauacgguugugggaa

SEQ ID NO: 388625 - RNA, 21 nt, Human
cucuaaacuucacagaguccu

SEQ ID NO: 388626 - RNA, 20 nt, Human
cugcacaagccagaaugcaa

SEQ ID NO: 388627 - RNA, 25 nt, Human
cugcaguaccuuaugguucugccaa

SEQ ID NO: 388628 - RNA, 19 nt, Human
cugcccugccuucuuacau

SEQ ID NO: 388629 - RNA, 19 nt, Human
cugcuggugacccagcagc

SEQ ID NO: 388630 - RNA, 24 nt, Human
cugcuggugacccagcagccccca

SEQ ID NO: 388631 - RNA, 23 nt, Human
gaacacacaccagauugcacccc

SEQ ID NO: 388632 - RNA, 24 nt, Human
gaauaaaauacucaucucagaacc

SEQ ID NO: 388633 - RNA, 21 nt, Human
gacagaguggaaagacagggg

SEQ ID NO: 388634 - RNA, 20 nt, Human
gagagagagagaaagagagc

SEQ ID NO: 388635 - RNA, 20 nt, Human
gagagagagagagaaagaga

SEQ ID NO: 388636 - RNA, 23 nt, Human
gagcaaucucgcugcugaccccg

SEQ ID NO: 388637 - RNA, 22 nt, Human
gagcuguaaacaacguugaaca

SEQ ID NO: 388638 - RNA, 19 nt, Human
gaggccucccagcccaggu

SEQ ID NO: 388639 - RNA, 24 nt, Human
gaggcgggcgcggcggcggcggcg

SEQ ID NO: 388640 - RNA, 22 nt, Human
gagggcgcugcggcggcggcgg

SEQ ID NO: 388641 - RNA, 21 nt, Human
gaggggaaagccaggggcucc

SEQ ID NO: 388642 - RNA, 24 nt, Human
gaggggcagggagcaacagaagga

SEQ ID NO: 388643 - RNA, 19 nt, Human
gccagaaugcaaaacuuca

SEQ ID NO: 388644 - RNA, 20 nt, Human
gcccugccuguggcuucuuc

SEQ ID NO: 388645 - RNA, 24 nt, Human
gccgacugaaaaaccacccaauga

SEQ ID NO: 388646 - RNA, 23 nt, Human
gccuggugcucugcgaggcaucu

SEQ ID NO: 388647 - RNA, 22 nt, Human
gcgcgagcgcgagcgcaagggg

SEQ ID NO: 388648 - RNA, 21 nt, Human
gcgcggagugggggcgcugag

SEQ ID NO: 388649 - RNA, 26 nt, Human
gcggaacaaaagguuaaaaaacagaa

SEQ ID NO: 388650 - RNA, 19 nt, Human
gcggcggcggcagcgggag

SEQ ID NO: 388651 - RNA, 24 nt, Human
gcggcggcggcggcggcggcaaca

SEQ ID NO: 388652 - RNA, 23 nt, Human
gcggcggcggcggcggcggcagc

SEQ ID NO: 388653 - RNA, 20 nt, Human
ggaacaaaagguuaaaaaac

SEQ ID NO: 388654 - RNA, 19 nt, Human
ggacagcgggagggacugg

SEQ ID NO: 388655 - RNA, 19 nt, Human
ggaccuguggaccagcagg

SEQ ID NO: 388656 - RNA, 21 nt, Human
ggaggagagggugggagaggg

SEQ ID NO: 388657 - RNA, 18 nt, Human
ggagugggggcgcugagg

SEQ ID NO: 388658 - RNA, 20 nt, Human
ggcgcggcggcggcggcggc

SEQ ID NO: 388659 - RNA, 20 nt, Human
ggcgcugcggcggcggcggg

SEQ ID NO: 388660 - RNA, 21 nt, Human
ggcugggccaucuuccucagc

SEQ ID NO: 388661 - RNA, 24 nt, Human
gggaagccagggauggagccuggg

SEQ ID NO: 388662 - RNA, 21 nt, Human
gggacagcgggagggacuggc

SEQ ID NO: 388663 - RNA, 27 nt, Human
gggauggagccugggguccgaggccuc

SEQ ID NO: 388664 - RNA, 24 nt, Human
gggcagcaucccuuucccaggugu

SEQ ID NO: 388665 - RNA, 23 nt, Human
gggcgcggcggcggcggcggcgg

SEQ ID NO: 388666 - RNA, 20 nt, Human
gggcgcugcggcggcggcga

SEQ ID NO: 388667 - RNA, 20 nt, Human
gggcucccucaggcccugcc

SEQ ID NO: 388668 - RNA, 20 nt, Human
gggcucccucaggcccugcc

SEQ ID NO: 388669 - RNA, 21 nt, Human
gggcucccucaggcccugccu

SEQ ID NO: 388670 - RNA, 24 nt, Human
ggggcgcuggcggcuccucgcucc

SEQ ID NO: 388671 - RNA, 22 nt, Human
gugagacaaagaaauuaugaag

SEQ ID NO: 388672 - RNA, 19 nt, Human
guggcggggggaaugaaaa

SEQ ID NO: 388673 - RNA, 25 nt, Human
uaaaaacagcaaaaagauuauuuaa

SEQ ID NO: 388674 - RNA, 23 nt, Human
uaaaaaugggaagccgucugcag

SEQ ID NO: 388675 - RNA, 24 nt, Human
uaauuuuuuaaaaacagcaaaaag

SEQ ID NO: 388676 - RNA, 22 nt, Human
uaccaacaugccagcagcagag

SEQ ID NO: 388677 - RNA, 25 nt, Human
uaccaacaugccagcagcagagagg

SEQ ID NO: 388678 - RNA, 19 nt, Human
uacuacgcgccaaagugcc

SEQ ID NO: 388679 - RNA, 28 nt, Human
uagccaacacgccuaauccccugaaagg

SEQ ID NO: 388680 - RNA, 23 nt, Human
uagggaaaacaaaaaaaaaaaaa

SEQ ID NO: 388681 - RNA, 21 nt, Human
uaucaaaauagagcaauuuau

SEQ ID NO: 388682 - RNA, 21 nt, Human
uaugagaaagguacagaggga

SEQ ID NO: 388683 - RNA, 22 nt, Human
uauggaccuguggaccagcagg

SEQ ID NO: 388684 - RNA, 22 nt, Human
uauucaagacacugaauaugau

SEQ ID NO: 388685 - RNA, 21 nt, Human
uccaaaaauacuccaggcucu

SEQ ID NO: 388686 - RNA, 20 nt, Human
uccacagaagcccugacccu

SEQ ID NO: 388687 - RNA, 22 nt, Human
uccacagaagcccugacccuuc

SEQ ID NO: 388688 - RNA, 19 nt, Human
uccagccagaguuuuccug

SEQ ID NO: 388689 - RNA, 22 nt, Human
uccagccgacugaaaaaccacc

SEQ ID NO: 388690 - RNA, 23 nt, Human
uccauucagccaucacagagccu

SEQ ID NO: 388691 - RNA, 24 nt, Human
uccccgauggcugggagugcguca

SEQ ID NO: 388692 - RNA, 20 nt, Human
ucccucaggcccugccuguc

SEQ ID NO: 388693 - RNA, 21 nt, Human
uccugcuggcugccaaggugc

SEQ ID NO: 388694 - RNA, 21 nt, Human
uccuugggacgggaaaucauc

SEQ ID NO: 388695 - RNA, 24 nt, Human
ucuccuagucuucugugagacaaa

SEQ ID NO: 388696 - RNA, 21 nt, Human
ucuccuguaaaaaggcccccc

SEQ ID NO: 388697 - RNA, 23 nt, Human
ucuuuuggaccccaacaaacugu

SEQ ID NO: 388698 - RNA, 21 nt, Human
ugaaaaaccacccaaugaaca

SEQ ID NO: 388699 - RNA, 22 nt, Human
ugaacccgaccaaacacucuag

SEQ ID NO: 388700 - RNA, 25 nt, Human
ugaauaauucacauacccaagugga

SEQ ID NO: 388701 - RNA, 32 nt, Human
ugacacagacaauaaaaacugcacaagccagg

SEQ ID NO: 388702 - RNA, 20 nt, Human
ugacccagcagcccccacgg

SEQ ID NO: 388703 - RNA, 20 nt, Human
ugacccagcagcccccacgg

SEQ ID NO: 388704 - RNA, 21 nt, Human
ugaggcugaggggaaagccag

SEQ ID NO: 388705 - RNA, 24 nt, Human
ugagggcgcugcggcggcggcggg

SEQ ID NO: 388706 - RNA, 21 nt, Human
ugauuugcuucuguuuuugcu

SEQ ID NO: 388707 - RNA, 22 nt, Human
ugcauacacaccaaaagaugcg

SEQ ID NO: 388708 - RNA, 21 nt, Human
ugcccugccuucuuacauaaa

SEQ ID NO: 388709 - RNA, 19 nt, Human
ugcggcggccgaagagggc

SEQ ID NO: 388710 - RNA, 19 nt, Human
uggaaaccauucuaucccc

SEQ ID NO: 388711 - RNA, 22 nt, Human
uggaaagacagggggaggggca

SEQ ID NO: 388712 - RNA, 22 nt, Human
uggaccccaacaaacuguacuc

SEQ ID NO: 388713 - RNA, 24 nt, Human
uggaggucaccagauucacugaaa

SEQ ID NO: 388714 - RNA, 24 nt, Human
uggcagaaauuauuagcgacguuc

SEQ ID NO: 388715 - RNA, 21 nt, Human
uggcggaaggaacauuucugc

SEQ ID NO: 388716 - RNA, 23 nt, Human
uggcggcgccgcgcgcccggccg

SEQ ID NO: 388717 - RNA, 21 nt, Human
uggcuccgcagaugaaugcca

SEQ ID NO: 388718 - RNA, 19 nt, Human
uggcugcagagcaaucucg

SEQ ID NO: 388719 - RNA, 22 nt, Human
uggcugcagagcaaucucgcug

SEQ ID NO: 388720 - RNA, 24 nt, Human
uggcuguacgucugacacagacaa

SEQ ID NO: 388721 - RNA, 18 nt, Human
ugggaagccgucugcagg

SEQ ID NO: 388722 - RNA, 20 nt, Human
ugggagagggcggaaggggg

SEQ ID NO: 388723 - RNA, 20 nt, Human
ugguuuugcuugcggccgca

SEQ ID NO: 388724 - RNA, 25 nt, Human
uguagccaacacgccuaauccagcc

SEQ ID NO: 388725 - RNA, 21 nt, Human
uguauggaccuguggaccagc

SEQ ID NO: 388726 - RNA, 23 nt, Human
uuaauuuuuuaaaaacagcaaaa

SEQ ID NO: 388727 - RNA, 18 nt, Human
uucacagaguccuuggga

SEQ ID NO: 388728 - RNA, 23 nt, Human
uuccagccgacugaaaaaccacc

SEQ ID NO: 388729 - RNA, 24 nt, Human
uugcuucuguuuuugcuugccuuu

SEQ ID NO: 388730 - RNA, 23 nt, Human
uuggucccccuuggggcagcauc

SEQ ID NO: 388731 - RNA, 27 nt, Human
uuuaaaaacuucuugaugaagauuacc

SEQ ID NO: 388732 - RNA, 23 nt, Human
uuuggucuucugggacaugaaua

SEQ ID NO: 388733 - RNA, 18 nt, Human
uuuuccaaaaauacucca

SEQ ID NO: 388734 - RNA, 18 nt, Human
uuuuccaaaaauacucca

SEQ ID NO: 388735 - RNA, 24 nt, Human
aaagauggcagcagcgccaugagg

SEQ ID NO: 388736 - RNA, 24 nt, Human
aaagauggcagcagcgccaugagg

SEQ ID NO: 388737 - RNA, 19 nt, Human
aaaggcuuccaccugggag

SEQ ID NO: 388738 - RNA, 24 nt, Human
aacagccgcaccgcccgguccccc

SEQ ID NO: 388739 - RNA, 22 nt, Human
aacugcugcuuaguacucaggu

SEQ ID NO: 388740 - RNA, 22 nt, Human
aacugcugcuuaguacucaggu

SEQ ID NO: 388741 - RNA, 23 nt, Human
aagaaaagcaccuuggccacuag

SEQ ID NO: 388742 - RNA, 23 nt, Human
aagaaaagcaccuuggccacuag

SEQ ID NO: 388743 - RNA, 26 nt, Human
aagaagagagagaccuaaguagacaa

SEQ ID NO: 388744 - RNA, 26 nt, Human
aagaagagagagaccuaaguagacaa

SEQ ID NO: 388745 - RNA, 25 nt, Human
aaggaaaucccuuagugucuuuuug

SEQ ID NO: 388746 - RNA, 25 nt, Human
aaggaaaucccuuagugucuuuuug

SEQ ID NO: 388747 - RNA, 25 nt, Human
acagccagcaagaagagagagaccu

SEQ ID NO: 388748 - RNA, 25 nt, Human
acagccagcaagaagagagagaccu

SEQ ID NO: 388749 - RNA, 19 nt, Human
acugggccugggaggaaga

SEQ ID NO: 388750 - RNA, 19 nt, Human
acugggccugggaggaaga

SEQ ID NO: 388751 - RNA, 21 nt, Human
agaagccauccuccgugaguc

SEQ ID NO: 388752 - RNA, 19 nt, Human
agacagcacuugacccuuc

SEQ ID NO: 388753 - RNA, 21 nt, Human
agcaagaagagagagaccuaa

SEQ ID NO: 388754 - RNA, 21 nt, Human
agcaagaagagagagaccuaa

SEQ ID NO: 388755 - RNA, 18 nt, Human
agccaggaggcggugggu

SEQ ID NO: 388756 - RNA, 24 nt, Human
aggaggccagaucccuccuccuca

SEQ ID NO: 388757 - RNA, 24 nt, Human
aggaggccagaucccuccuccuca

SEQ ID NO: 388758 - RNA, 25 nt, Human
aggccaagaccugggcguuggggga

SEQ ID NO: 388759 - RNA, 22 nt, Human
aggccagaucccuccuccucaa

SEQ ID NO: 388760 - RNA, 22 nt, Human
aggccagaucccuccuccucaa

SEQ ID NO: 388761 - RNA, 20 nt, Human
aggcccgcuucagguggccc

SEQ ID NO: 388762 - RNA, 23 nt, Human
aggcggugggugaaguuguguug

SEQ ID NO: 388763 - RNA, 19 nt, Human
auggaacacaguucuguga

SEQ ID NO: 388764 - RNA, 19 nt, Human
auggaacacaguucuguga

SEQ ID NO: 388765 - RNA, 19 nt, Human
auggaacacaguucuguga

SEQ ID NO: 388766 - RNA, 19 nt, Human
auggaacacaguucuguga

SEQ ID NO: 388767 - RNA, 18 nt, Human
auuugucagguggaaauc

SEQ ID NO: 388768 - RNA, 19 nt, Human
caaagcacuccuccuucuc

SEQ ID NO: 388769 - RNA, 19 nt, Human
cacauucucucucucucuc

SEQ ID NO: 388770 - RNA, 19 nt, Human
cacauucucucucucucuc

SEQ ID NO: 388771 - RNA, 21 nt, Human
cacccgccgccucuucaaagc

SEQ ID NO: 388772 - RNA, 25 nt, Human
cacccgccgccucuucaaagcggcc

SEQ ID NO: 388773 - RNA, 22 nt, Human
caccgcccgguccccacaggag

SEQ ID NO: 388774 - RNA, 22 nt, Human
caccuuggccacuagucaggga

SEQ ID NO: 388775 - RNA, 19 nt, Human
cacuccuccuucucgcccc

SEQ ID NO: 388776 - RNA, 18 nt, Human
cacuuuuaccacuuucau

SEQ ID NO: 388777 - RNA, 21 nt, Human
cagaucccuccuccucaaucc

SEQ ID NO: 388778 - RNA, 21 nt, Human
cagaucccuccuccucaaucc

SEQ ID NO: 388779 - RNA, 19 nt, Human
cagcaaguagggguccugc

SEQ ID NO: 388780 - RNA, 18 nt, Human
cagcagcgccaugaggag

SEQ ID NO: 388781 - RNA, 18 nt, Human
cagcagcgccaugaggag

SEQ ID NO: 388782 - RNA, 24 nt, Human
cagccagacgaugaaggcucugca

SEQ ID NO: 388783 - RNA, 21 nt, Human
cagcgccaugaggaggccaga

SEQ ID NO: 388784 - RNA, 21 nt, Human
cagcgccaugaggaggccaga

SEQ ID NO: 388785 - RNA, 24 nt, Human
caggagacuccuucugaaaggcuu

SEQ ID NO: 388786 - RNA, 20 nt, Human
ccacugggccugggaggaag

SEQ ID NO: 388787 - RNA, 20 nt, Human
ccacugggccugggaggaag

SEQ ID NO: 388788 - RNA, 21 nt, Human
ccagccagacgaugaaggcuc

SEQ ID NO: 388789 - RNA, 18 nt, Human
cccacuuuuaccacuuuc

SEQ ID NO: 388790 - RNA, 21 nt, Human
cccacuuuuaccacuuucaug

SEQ ID NO: 388791 - RNA, 22 nt, Human
cccgcacggcucugccgggccg

SEQ ID NO: 388792 - RNA, 24 nt, Human
cccgcacggcucugccgggccgcg

SEQ ID NO: 388793 - RNA, 20 nt, Human
cccucccagagucacuucuu

SEQ ID NO: 388794 - RNA, 23 nt, Human
ccgcgcacgcacgcgggggcgcg

SEQ ID NO: 388795 - RNA, 19 nt, Human
ccuccuggaacucccccuu

SEQ ID NO: 388796 - RNA, 20 nt, Human
cgccauggacccgcucaaag

SEQ ID NO: 388797 - RNA, 21 nt, Human
cgccauggacccgcucaaagc

SEQ ID NO: 388798 - RNA, 23 nt, Human
cgccgccucuucaaagcggccug

SEQ ID NO: 388799 - RNA, 22 nt, Human
cgcgcacgcacgcgggggcgcg

SEQ ID NO: 388800 - RNA, 19 nt, Human
cgcuuggucaucuugaaga

SEQ ID NO: 388801 - RNA, 19 nt, Human
cgcuuggucaucuugaaga

SEQ ID NO: 388802 - RNA, 20 nt, Human
cguuggaggcccgcuucagg

SEQ ID NO: 388803 - RNA, 22 nt, Human
cguugggggagagggccaggcg

SEQ ID NO: 388804 - RNA, 27 nt, Human
cuccucucuaccauucuccucagugcc

SEQ ID NO: 388805 - RNA, 27 nt, Human
cuccucucuaccauucuccucagugcc

SEQ ID NO: 388806 - RNA, 18 nt, Human
cucuccucuccucucuac

SEQ ID NO: 388807 - RNA, 21 nt, Human
cucuccucuccucucuaccau

SEQ ID NO: 388808 - RNA, 22 nt, Human
cucugcgccgggcccucccaga

SEQ ID NO: 388809 - RNA, 22 nt, Human
cucugcgccgggcccucccaga

SEQ ID NO: 388810 - RNA, 23 nt, Human
cucugcgccgggcccucccagag

SEQ ID NO: 388811 - RNA, 24 nt, Human
cucuucagagcugcagccaggagg

SEQ ID NO: 388812 - RNA, 24 nt, Human
cuuacaaauagaacugaggcccag

SEQ ID NO: 388813 - RNA, 24 nt, Human
cuuacaaauagaacugaggcccag

SEQ ID NO: 388814 - RNA, 20 nt, Human
cuugaugaacugaaaagagg

SEQ ID NO: 388815 - RNA, 22 nt, Human
gaaaggcuuccaccugggagga

SEQ ID NO: 388816 - RNA, 22 nt, Human
gaagguguagcccccauccucc

SEQ ID NO: 388817 - RNA, 24 nt, Human
gaccugggcguugggggagagggc

SEQ ID NO: 388818 - RNA, 21 nt, Human
gaggaggccagaucccuccuc

SEQ ID NO: 388819 - RNA, 21 nt, Human
gaggaggccagaucccuccuc

SEQ ID NO: 388820 - RNA, 22 nt, Human
gccagaucccuccuccucaauc

SEQ ID NO: 388821 - RNA, 22 nt, Human
gccgcaccgcccgguccccaca

SEQ ID NO: 388822 - RNA, 21 nt, Human
gccugggucagcugcugcugc

SEQ ID NO: 388823 - RNA, 24 nt, Human
gcgcggcacccgccgccucuucaa

SEQ ID NO: 388824 - RNA, 21 nt, Human
gcggaguggcccuuuaguucg

SEQ ID NO: 388825 - RNA, 21 nt, Human
gggcgcccgcacggcucugcc

SEQ ID NO: 388826 - RNA, 23 nt, Human
gguagccagguauuugccauugc

SEQ ID NO: 388827 - RNA, 20 nt, Human
ggugcucucgcugcaggaag

SEQ ID NO: 388828 - RNA, 22 nt, Human
guagccagguauuugccauugc

SEQ ID NO: 388829 - RNA, 20 nt, Human
guugggggagagggccaggc

SEQ ID NO: 388830 - RNA, 20 nt, Human
uaccacuuucaugacauugg

SEQ ID NO: 388831 - RNA, 20 nt, Human
uaccacuuucaugacauugg

SEQ ID NO: 388832 - RNA, 25 nt, Human
uagaacugaggcccagaaggaaauc

SEQ ID NO: 388833 - RNA, 25 nt, Human
uagaacugaggcccagaaggaaauc

SEQ ID NO: 388834 - RNA, 19 nt, Human
uauuccacaucuguguccc

SEQ ID NO: 388835 - RNA, 22 nt, Human
uauuugccauugcugcuaaagu

SEQ ID NO: 388836 - RNA, 18 nt, Human
ucaaagcacacugguucc

SEQ ID NO: 388837 - RNA, 18 nt, Human
ucaaagcacacugguucc

SEQ ID NO: 388838 - RNA, 22 nt, Human
ucaaauaucugaugaacuugau

SEQ ID NO: 388839 - RNA, 22 nt, Human
ucaaauaucugaugaacuugau

SEQ ID NO: 388840 - RNA, 26 nt, Human
ucaauccucugcgccgggcccuccca

SEQ ID NO: 388841 - RNA, 19 nt, Human
ucagagcugcagccaggag

SEQ ID NO: 388842 - RNA, 23 nt, Human
ucagggucucuugggccuggguc

SEQ ID NO: 388843 - RNA, 21 nt, Human
ucagguggcccugcaucuccu

SEQ ID NO: 388844 - RNA, 21 nt, Human
uccaaagcagacuucccaaac

SEQ ID NO: 388845 - RNA, 20 nt, Human
ucccagaaaacuuugccuuc

SEQ ID NO: 388846 - RNA, 20 nt, Human
ucccagaaaacuuugccuuc

SEQ ID NO: 388847 - RNA, 23 nt, Human
uccccagcucauauuuauuuggg

SEQ ID NO: 388848 - RNA, 23 nt, Human
uccccagcucauauuuauuuggg

SEQ ID NO: 388849 - RNA, 21 nt, Human
ucccgcuuggucaucuugaag

SEQ ID NO: 388850 - RNA, 22 nt, Human
uccuccgugagucguuggagaa

SEQ ID NO: 388851 - RNA, 18 nt, Human
uccuucugaaaggcuucc

SEQ ID NO: 388852 - RNA, 19 nt, Human
uccuucugaaaggcuucca

SEQ ID NO: 388853 - RNA, 19 nt, Human
uccuugcaaaacugcugcu

SEQ ID NO: 388854 - RNA, 19 nt, Human
uccuugcaaaacugcugcu

SEQ ID NO: 388855 - RNA, 22 nt, Human
ucuccucagugccaggugggga

SEQ ID NO: 388856 - RNA, 20 nt, Human
ucuccucucuaccauucucc

SEQ ID NO: 388857 - RNA, 20 nt, Human
ucuccucucuaccauucucc

SEQ ID NO: 388858 - RNA, 18 nt, Human
ucuccuuaaacaagauau

SEQ ID NO: 388859 - RNA, 22 nt, Human
ucucuccucuccucucuaccau

SEQ ID NO: 388860 - RNA, 19 nt, Human
ucugcagucagggcugaag

SEQ ID NO: 388861 - RNA, 18 nt, Human
ucugguugguguugaugg

SEQ ID NO: 388862 - RNA, 24 nt, Human
ucuucagagcugcagccaggaggc

SEQ ID NO: 388863 - RNA, 23 nt, Human
ucuucagggcacccaggcucuuc

SEQ ID NO: 388864 - RNA, 24 nt, Human
ucuucagggcacccaggcucuuca

SEQ ID NO: 388865 - RNA, 21 nt, Human
ucuuggaucccgaagauuugu

SEQ ID NO: 388866 - RNA, 18 nt, Human
ugaaacagccgcaccgcc

SEQ ID NO: 388867 - RNA, 18 nt, Human
ugacaggcgccuugugcu

SEQ ID NO: 388868 - RNA, 19 nt, Human
ugagaagucaacaucuguu

SEQ ID NO: 388869 - RNA, 24 nt, Human
ugaggaugugcugccacaaggcca

SEQ ID NO: 388870 - RNA, 24 nt, Human
ugaggaugugcugccacaaggcca

SEQ ID NO: 388871 - RNA, 21 nt, Human
ugauggaacacaguucuguga

SEQ ID NO: 388872 - RNA, 21 nt, Human
ugauggaacacaguucuguga

SEQ ID NO: 388873 - RNA, 19 nt, Human
ugaugggaagcuaucccag

SEQ ID NO: 388874 - RNA, 21 nt, Human
ugcaggaaguccuuggugcuc

SEQ ID NO: 388875 - RNA, 21 nt, Human
ugcagucagggcugaagcgca

SEQ ID NO: 388876 - RNA, 18 nt, Human
ugcaucuccuccaccaug

SEQ ID NO: 388877 - RNA, 21 nt, Human
ugccacagggagauacagcag

SEQ ID NO: 388878 - RNA, 20 nt, Human
ugcuuuuuagggaaguccuc

SEQ ID NO: 388879 - RNA, 18 nt, Human
uggaacucccccuucuuu

SEQ ID NO: 388880 - RNA, 21 nt, Human
uggaggcccgcuucagguggc

SEQ ID NO: 388881 - RNA, 21 nt, Human
uggcagcagcgccaugaggag

SEQ ID NO: 388882 - RNA, 21 nt, Human
uggcagcagcgccaugaggag

SEQ ID NO: 388883 - RNA, 24 nt, Human
uggccaggaguguugugaaacagc

SEQ ID NO: 388884 - RNA, 20 nt, Human
ugggaggaagaaaagcaccu

SEQ ID NO: 388885 - RNA, 20 nt, Human
ugggaggaagaaaagcaccu

SEQ ID NO: 388886 - RNA, 22 nt, Human
ugggaggaagaaaagcaccuug

SEQ ID NO: 388887 - RNA, 22 nt, Human
ugggaggaagaaaagcaccuug

SEQ ID NO: 388888 - RNA, 18 nt, Human
uggggacagauuccaccc

SEQ ID NO: 388889 - RNA, 18 nt, Human
uggggacagauuccaccc

SEQ ID NO: 388890 - RNA, 23 nt, Human
ugucaaaggacaaguuggcgaua

SEQ ID NO: 388891 - RNA, 18 nt, Human
ugugaagguguagccccc

SEQ ID NO: 388892 - RNA, 21 nt, Human
ugugaugggaagcuaucccag

SEQ ID NO: 388893 - RNA, 21 nt, Human
uguugaggcuucuccuuccga

SEQ ID NO: 388894 - RNA, 22 nt, Human
uucagagcugcagccaggaggc

SEQ ID NO: 388895 - RNA, 19 nt, Human
uucccaaggaauguguuuc

SEQ ID NO: 388896 - RNA, 19 nt, Human
uucccaaggaauguguuuc

SEQ ID NO: 388897 - RNA, 19 nt, Human
uucccgcuguggcucuuca

SEQ ID NO: 388898 - RNA, 25 nt, Human
uucuuuccaaagcagacuucccaaa

SEQ ID NO: 388899 - RNA, 25 nt, Human
uuugauggaacacaguucugugaug

SEQ ID NO: 388900 - RNA, 25 nt, Human
uuugauggaacacaguucugugaug

SEQ ID NO: 388901 - RNA, 19 nt, Human
uuugcuuuuuggccugaaa

SEQ ID NO: 388902 - RNA, 18 nt, Human
uuugucagguggaaaucc

SEQ ID NO: 388903 - RNA, 20 nt, Human
uuuuuuuuuaauccccagcu

SEQ ID NO: 388904 - RNA, 22 nt, Human
uuuuuuuuuuuaauccccagcu

SEQ ID NO: 388905 - RNA, 22 nt, Human
uuuuuuuuuuuaauccccagcu

SEQ ID NO: 388906 - RNA, 22 nt, Human
cagcugaaaccugcuagggucc

SEQ ID NO: 388907 - RNA, 19 nt, Human
ccgcuccagcugaaaccug

SEQ ID NO: 388908 - RNA, 22 nt, Human
ccugcuagggucccggcagcca

SEQ ID NO: 388909 - RNA, 20 nt, Human
gccgccgccgccgcuccagc

SEQ ID NO: 388910 - RNA, 21 nt, Human
ggguucaggauggacuggaga

SEQ ID NO: 388911 - RNA, 23 nt, Human
uagcaccgaacucuucacagaac

SEQ ID NO: 388912 - RNA, 19 nt, Human
ucacagaacgccacacucc

SEQ ID NO: 388913 - RNA, 21 nt, Human
uuauggguuuuccagggguuc

SEQ ID NO: 388914 - RNA, 19 nt, Human
uuuuuuuuuuuuuugccag

SEQ ID NO: 388915 - RNA, 22 nt, Human
uuuuuuuuuuuuuuuugccagg

SEQ ID NO: 388916 - RNA, 18 nt, Human
uuuuuuuuuuuuuuuuug

SEQ ID NO: 388917 - RNA, 22 nt, Human
uuuuuuuuuuuuuuuuugccag

SEQ ID NO: 388918 - RNA, 21 nt, Human
aaagaucacuaugggccagcg

SEQ ID NO: 388919 - RNA, 23 nt, Human
aacucaacauccaucuucucaca

SEQ ID NO: 388920 - RNA, 23 nt, Human
aagaaagaaaaaaauauguacag

SEQ ID NO: 388921 - RNA, 23 nt, Human
aagaagggggugggggaggcaag

SEQ ID NO: 388922 - RNA, 20 nt, Human
aagggggugggggaggcaag

SEQ ID NO: 388923 - RNA, 21 nt, Human
aagggggugggggaggcaagg

SEQ ID NO: 388924 - RNA, 19 nt, Human
acccugcaacucaacaucc

SEQ ID NO: 388925 - RNA, 25 nt, Human
agaagggggugggggaggcaagggu

SEQ ID NO: 388926 - RNA, 18 nt, Human
agcacacucuucucagca

SEQ ID NO: 388927 - RNA, 31 nt, Human
agggggugggggaggcaaggguacaugagaa

SEQ ID NO: 388928 - RNA, 23 nt, Human
auuaaaaaguccaaucaauuaua

SEQ ID NO: 388929 - RNA, 21 nt, Human
caacaccaccauuuaaaggua

SEQ ID NO: 388930 - RNA, 21 nt, Human
caaggguacaugagagccagu

SEQ ID NO: 388931 - RNA, 19 nt, Human
cacccugcaacucaacauc

SEQ ID NO: 388932 - RNA, 25 nt, Human
cacccugcaacucaacauccaucuu

SEQ ID NO: 388933 - RNA, 18 nt, Human
cacgccaagaaacaguga

SEQ ID NO: 388934 - RNA, 21 nt, Human
ccuugcgcuggaacucgucuc

SEQ ID NO: 388935 - RNA, 23 nt, Human
cgaaguuaaacagccggcggccc

SEQ ID NO: 388936 - RNA, 22 nt, Human
cgccaagaaacagugaugcugc

SEQ ID NO: 388937 - RNA, 23 nt, Human
cggcccaggcgcccgccacagcg

SEQ ID NO: 388938 - RNA, 22 nt, Human
cucaaaccaacuugucaacagc

SEQ ID NO: 388939 - RNA, 24 nt, Human
cucacagucacgcugcgcgguguu

SEQ ID NO: 388940 - RNA, 22 nt, Human
cugaagaaagaaaaaaauaugu

SEQ ID NO: 388941 - RNA, 28 nt, Human
cuuaaaguuuucucccucaaaccaacuu

SEQ ID NO: 388942 - RNA, 18 nt, Human
gaaauauaaaaacugugg

SEQ ID NO: 388943 - RNA, 18 nt, Human
gaagggggugggggaggc

SEQ ID NO: 388944 - RNA, 18 nt, Human
gaaguuaaacagccggcg

SEQ ID NO: 388945 - RNA, 22 nt, Human
gauuuguuuaaaaaaaaaaaaa

SEQ ID NO: 388946 - RNA, 24 nt, Human
ggggaaaaacauuaaaauuaaaaa

SEQ ID NO: 388947 - RNA, 20 nt, Human
uaaaaaaaaaaaaagaaggg

SEQ ID NO: 388948 - RNA, 23 nt, Human
uaaaaucuacauauaaauaaaug

SEQ ID NO: 388949 - RNA, 21 nt, Human
uaaagguaccaaaacaaacug

SEQ ID NO: 388950 - RNA, 19 nt, Human
uaaaugggcagcgcugccc

SEQ ID NO: 388951 - RNA, 24 nt, Human
uacagaguacucugaagaaagaaa

SEQ ID NO: 388952 - RNA, 19 nt, Human
ucccucaaaccaacuuguc

SEQ ID NO: 388953 - RNA, 25 nt, Human
ucccucaaaccaacuugucaacagc

SEQ ID NO: 388954 - RNA, 18 nt, Human
ucuggcacagaaauaacc

SEQ ID NO: 388955 - RNA, 20 nt, Human
ucuggcacagaaauaacccc

SEQ ID NO: 388956 - RNA, 22 nt, Human
ucuggcacagaaauaaccccua

SEQ ID NO: 388957 - RNA, 23 nt, Human
ucuguccugcaauacuggagagg

SEQ ID NO: 388958 - RNA, 21 nt, Human
ugagcaacucacagucacgcu

SEQ ID NO: 388959 - RNA, 18 nt, Human
ugaugcugcugggucacu

SEQ ID NO: 388960 - RNA, 19 nt, Human
ugcaaagaucacuaugggc

SEQ ID NO: 388961 - RNA, 21 nt, Human
ugccacacccugcaacucaac

SEQ ID NO: 388962 - RNA, 22 nt, Human
uggaaugugucuggcacagaaa

SEQ ID NO: 388963 - RNA, 23 nt, Human
uggagagguggaaugugucuggc

SEQ ID NO: 388964 - RNA, 22 nt, Human
uggcuuuaacacuuaaaguuuu

SEQ ID NO: 388965 - RNA, 19 nt, Human
ugggcagcgcugcccagau

SEQ ID NO: 388966 - RNA, 24 nt, Human
uggggaaaaacauuaaaauuaaaa

SEQ ID NO: 388967 - RNA, 23 nt, Human
uggugccacacccugcaacucaa

SEQ ID NO: 388968 - RNA, 22 nt, Human
uuaaacagccggcggcccaggc

SEQ ID NO: 388969 - RNA, 22 nt, Human
uucauggggaaaaacauuaaaa

SEQ ID NO: 388970 - RNA, 23 nt, Human
uucucccucaaaccaacuuguca

SEQ ID NO: 388971 - RNA, 21 nt, Human
uuuaaaaaaaaaaaaagaagg

SEQ ID NO: 388972 - RNA, 25 nt, Human
uuuaaaaaaaaaaaaagaagggggu

SEQ ID NO: 388973 - RNA, 20 nt, Human
aaagagagagaagagaaagu

SEQ ID NO: 388974 - RNA, 21 nt, Human
aaaguugaaggucggugagcu

SEQ ID NO: 388975 - RNA, 20 nt, Human
aagagaagacgagggggagg

SEQ ID NO: 388976 - RNA, 19 nt, Human
acuccacagaagaagagua

SEQ ID NO: 388977 - RNA, 19 nt, Human
agaaagaaaagcaaagaaa

SEQ ID NO: 388978 - RNA, 22 nt, Human
agaaagaaaagcaaagaaagga

SEQ ID NO: 388979 - RNA, 18 nt, Human
agacggccaucgaggguc

SEQ ID NO: 388980 - RNA, 23 nt, Human
agagaagacgagggggaggggaa

SEQ ID NO: 388981 - RNA, 23 nt, Human
agagaagagaaaguaugagagga

SEQ ID NO: 388982 - RNA, 21 nt, Human
agagagagaagagaaaguaug

SEQ ID NO: 388983 - RNA, 19 nt, Human
agcugugaggggcuggcug

SEQ ID NO: 388984 - RNA, 21 nt, Human
aggagagaaagaaaagcaaag

SEQ ID NO: 388985 - RNA, 22 nt, Human
aggagagaaagaaaagcaaaga

SEQ ID NO: 388986 - RNA, 22 nt, Human
agggccgagacuuggcggagga

SEQ ID NO: 388987 - RNA, 22 nt, Human
aggggcuggcuggggguccggg

SEQ ID NO: 388988 - RNA, 18 nt, Human
caaaguugaaggucggug

SEQ ID NO: 388989 - RNA, 22 nt, Human
ccauccauccauccauccacuc

SEQ ID NO: 388990 - RNA, 21 nt, Human
cccaggucuccuaaaggugaa

SEQ ID NO: 388991 - RNA, 21 nt, Human
cccaucacuacugaguauuuc

SEQ ID NO: 388992 - RNA, 21 nt, Human
ccuaugguuaauguggagggc

SEQ ID NO: 388993 - RNA, 23 nt, Human
cgcucggagaccugcacuuauuc

SEQ ID NO: 388994 - RNA, 18 nt, Human
cugcccaggucuccuaaa

SEQ ID NO: 388995 - RNA, 22 nt, Human
cugugcaaaaaagguuaaaauc

SEQ ID NO: 388996 - RNA, 23 nt, Human
cuugacgagaauaaaacaugcca

SEQ ID NO: 388997 - RNA, 20 nt, Human
gacgagaauaaaacaugcca

SEQ ID NO: 388998 - RNA, 25 nt, Human
gacgagggggaggggaauguaggag

SEQ ID NO: 388999 - RNA, 25 nt, Human
gagaaguaggagguaagagaagacg

SEQ ID NO: 389000 - RNA, 18 nt, Human
gaggagaagugggaaacc

SEQ ID NO: 389001 - RNA, 19 nt, Human
gaguguggggaggcggagc

SEQ ID NO: 389002 - RNA, 18 nt, Human
gcaaggaggagugugggg

SEQ ID NO: 389003 - RNA, 22 nt, Human
gcggaggaaucgcugcugccug

SEQ ID NO: 389004 - RNA, 19 nt, Human
gcucggagaccugcacuua

SEQ ID NO: 389005 - RNA, 18 nt, Human
ggcuggggguccgggccg

SEQ ID NO: 389006 - RNA, 19 nt, Human
gggaaacccaucacuacug

SEQ ID NO: 389007 - RNA, 21 nt, Human
gggccgcggcggggccgggcg

SEQ ID NO: 389008 - RNA, 19 nt, Human
ggggaggggaauguaggag

SEQ ID NO: 389009 - RNA, 21 nt, Human
ggggaggggaauguaggagga

SEQ ID NO: 389010 - RNA, 18 nt, Human
uaacuccacagaagaaga

SEQ ID NO: 389011 - RNA, 20 nt, Human
uaacuccacagaagaagagu

SEQ ID NO: 389012 - RNA, 21 nt, Human
uaagaaaggacgcgcugggug

SEQ ID NO: 389013 - RNA, 19 nt, Human
uaagagaagacgaggggga

SEQ ID NO: 389014 - RNA, 21 nt, Human
uaagagaagacgagggggagg

SEQ ID NO: 389015 - RNA, 23 nt, Human
uaggagguaagagaagacgaggg

SEQ ID NO: 389016 - RNA, 23 nt, Human
ugaggagaagugggaaacccauc

SEQ ID NO: 389017 - RNA, 19 nt, Human
ugagugggugcgcaaggag

SEQ ID NO: 389018 - RNA, 23 nt, Human
ugugaggggcuggcugggggucc

SEQ ID NO: 389019 - RNA, 21 nt, Human
uguggagggccgagacuuggc

SEQ ID NO: 389020 - RNA, 19 nt, Human
uguggggaggcggagcugg

SEQ ID NO: 389021 - RNA, 25 nt, Human
uuaaagguguuuggguggauucucc

SEQ ID NO: 389022 - RNA, 24 nt, Human
uuaagcaugaacugguuuugugcc

SEQ ID NO: 389023 - RNA, 23 nt, Human
uugaggagaagugggaaacccau

SEQ ID NO: 389024 - RNA, 21 nt, Human
aaggggagagccgcgguggcc

SEQ ID NO: 389025 - RNA, 24 nt, Human
acccaggcuggagugcaguggcau

SEQ ID NO: 389026 - RNA, 18 nt, Human
acucugucacccaggcug

SEQ ID NO: 389027 - RNA, 25 nt, Human
acucugucacccaggcuggagugca

SEQ ID NO: 389028 - RNA, 18 nt, Human
agaccagggacagugggg

SEQ ID NO: 389029 - RNA, 22 nt, Human
aggacccugagcccuggugggc

SEQ ID NO: 389030 - RNA, 23 nt, Human
aggacccugagcccuggugggcc

SEQ ID NO: 389031 - RNA, 22 nt, Human
aggcucaagugauccuccugcc

SEQ ID NO: 389032 - RNA, 19 nt, Human
aggcuggagugcaguggca

SEQ ID NO: 389033 - RNA, 25 nt, Human
agugauccuccugccucagccuccc

SEQ ID NO: 389034 - RNA, 21 nt, Human
agugcaguggcaugaucauag

SEQ ID NO: 389035 - RNA, 23 nt, Human
agugcaguggcaugaucauagcu

SEQ ID NO: 389036 - RNA, 24 nt, Human
agugcaguggcaugaucauagcuu

SEQ ID NO: 389037 - RNA, 21 nt, Human
auaaauaucacuuccuuccgc

SEQ ID NO: 389038 - RNA, 18 nt, Human
auagcuuacugcagccuc

SEQ ID NO: 389039 - RNA, 20 nt, Human
auggcuucgaggcuggggaa

SEQ ID NO: 389040 - RNA, 20 nt, Human
caagugauccuccugccuca

SEQ ID NO: 389041 - RNA, 22 nt, Human
caagugauccuccugccucagc

SEQ ID NO: 389042 - RNA, 18 nt, Human
cacccggucggaggaccc

SEQ ID NO: 389043 - RNA, 23 nt, Human
cacucugucacccaggcuggagu

SEQ ID NO: 389044 - RNA, 24 nt, Human
cacucugucacccaggcuggagug

SEQ ID NO: 389045 - RNA, 22 nt, Human
cacuuccuuccgccuccgaccc

SEQ ID NO: 389046 - RNA, 19 nt, Human
cagcagcacaucugucccc

SEQ ID NO: 389047 - RNA, 20 nt, Human
cagcagcacaucuguccccu

SEQ ID NO: 389048 - RNA, 23 nt, Human
cagccuccaacuaauaggcucaa

SEQ ID NO: 389049 - RNA, 19 nt, Human
caugugcccauggcccggc

SEQ ID NO: 389050 - RNA, 19 nt, Human
ccaugugcccauggcccgg

SEQ ID NO: 389051 - RNA, 18 nt, Human
cccuuccuccucgcuccc

SEQ ID NO: 389052 - RNA, 25 nt, Human
cccuuccuccucgcucccccugccg

SEQ ID NO: 389053 - RNA, 21 nt, Human
ccgccgccuccgcuggcccgg

SEQ ID NO: 389054 - RNA, 23 nt, Human
ccgggcgcuuuggcacuggcggg

SEQ ID NO: 389055 - RNA, 23 nt, Human
ccucuugcaugcacacuugaccu

SEQ ID NO: 389056 - RNA, 23 nt, Human
ccugccggggauccuggcagcca

SEQ ID NO: 389057 - RNA, 21 nt, Human
ccuuccuccucgcucccccug

SEQ ID NO: 389058 - RNA, 24 nt, Human
ccuuccuccucgcucccccugccg

SEQ ID NO: 389059 - RNA, 20 nt, Human
cgaggcuggggaaggggaga

SEQ ID NO: 389060 - RNA, 20 nt, Human
cggggcucucgggcugucua

SEQ ID NO: 389061 - RNA, 20 nt, Human
cucaagugauccuccugccu

SEQ ID NO: 389062 - RNA, 24 nt, Human
cucaagugauccuccugccucagc

SEQ ID NO: 389063 - RNA, 24 nt, Human
cucacucugucacccaggcuggag

SEQ ID NO: 389064 - RNA, 23 nt, Human
cugccucagccucccgaguaacu

SEQ ID NO: 389065 - RNA, 18 nt, Human
gacccugagcccuggugg

SEQ ID NO: 389066 - RNA, 19 nt, Human
gaucauagcuuacugcagc

SEQ ID NO: 389067 - RNA, 21 nt, Human
gcccaaggggcuggggguggc

SEQ ID NO: 389068 - RNA, 19 nt, Human
gccuuuaagugaacugcuu

SEQ ID NO: 389069 - RNA, 19 nt, Human
gcucaagugauccuccugc

SEQ ID NO: 389070 - RNA, 22 nt, Human
gcuccgccgccuccgcuggccc

SEQ ID NO: 389071 - RNA, 27 nt, Human
gcuccgccgccuccgcuggggccgcuc

SEQ ID NO: 389072 - RNA, 19 nt, Human
gcuggagugcaguggcaug

SEQ ID NO: 389073 - RNA, 21 nt, Human
gcuggcccggccgcgguuccc

SEQ ID NO: 389074 - RNA, 23 nt, Human
gcuggcccggccgcgguucccuu

SEQ ID NO: 389075 - RNA, 21 nt, Human
gggaaggggagagccgcggug

SEQ ID NO: 389076 - RNA, 22 nt, Human
gggccggggaaggacccgcggu

SEQ ID NO: 389077 - RNA, 18 nt, Human
ggggcaggguggccgggc

SEQ ID NO: 389078 - RNA, 24 nt, Human
gugauccuccugccucagccuccc

SEQ ID NO: 389079 - RNA, 21 nt, Human
guucccuuccuccucgcuccc

SEQ ID NO: 389080 - RNA, 18 nt, Human
uagcccaaggggcugggg

SEQ ID NO: 389081 - RNA, 24 nt, Human
uaggcucaagugauccuccugccu

SEQ ID NO: 389082 - RNA, 22 nt, Human
ucacccaggcuggagugcagug

SEQ ID NO: 389083 - RNA, 24 nt, Human
ucacucugucacccaggcuggagu

SEQ ID NO: 389084 - RNA, 22 nt, Human
ucagccucccgaguaacucaug

SEQ ID NO: 389085 - RNA, 21 nt, Human
uccaccauccagcugugcagg

SEQ ID NO: 389086 - RNA, 20 nt, Human
ucccgaguaacucauggccu

SEQ ID NO: 389087 - RNA, 18 nt, Human
uccgcuggcccggccgcg

SEQ ID NO: 389088 - RNA, 26 nt, Human
uccuccugccucagccucccgaguaa

SEQ ID NO: 389089 - RNA, 22 nt, Human
ucuacacugcaacugccggccg

SEQ ID NO: 389090 - RNA, 24 nt, Human
ucuacacugcaacugccggccggg

SEQ ID NO: 389091 - RNA, 19 nt, Human
ucuacaguaucuacaugua

SEQ ID NO: 389092 - RNA, 23 nt, Human
ucucacucugucacccaggcugg

SEQ ID NO: 389093 - RNA, 24 nt, Human
ucucacucugucacccaggcugga

SEQ ID NO: 389094 - RNA, 26 nt, Human
ucucacucugucacccaggcuggagu

SEQ ID NO: 389095 - RNA, 27 nt, Human
ucucacucugucacccaggcuggagug

SEQ ID NO: 389096 - RNA, 24 nt, Human
ucugucacccaggcuggagugcag

SEQ ID NO: 389097 - RNA, 19 nt, Human
ucuguccccugccaccucu

SEQ ID NO: 389098 - RNA, 22 nt, Human
ugcccuuggggcaggguggccg

SEQ ID NO: 389099 - RNA, 18 nt, Human
ugccggggauccuggcag

SEQ ID NO: 389100 - RNA, 19 nt, Human
ugccggggauccuggcagc

SEQ ID NO: 389101 - RNA, 23 nt, Human
ugccucagccucccgaguaacuc

SEQ ID NO: 389102 - RNA, 24 nt, Human
ugccucagccucccgaguaacuca

SEQ ID NO: 389103 - RNA, 25 nt, Human
ugccucagccucccgaguaacucau

SEQ ID NO: 389104 - RNA, 22 nt, Human
ugcuugcccuuggggcagggug

SEQ ID NO: 389105 - RNA, 19 nt, Human
uggagugcaguggcaugau

SEQ ID NO: 389106 - RNA, 19 nt, Human
uggagugcaguggcaugau

SEQ ID NO: 389107 - RNA, 21 nt, Human
uggagugcaguggcaugauca

SEQ ID NO: 389108 - RNA, 18 nt, Human
uggcaugaucauagcuua

SEQ ID NO: 389109 - RNA, 22 nt, Human
uggcuucgaggcuggggaaggg

SEQ ID NO: 389110 - RNA, 21 nt, Human
ugugcaggaccggggcgggag

SEQ ID NO: 389111 - RNA, 26 nt, Human
ugugcaggaccggggcgggggaacgc

SEQ ID NO: 389112 - RNA, 25 nt, Human
uguuuguuuuuucuuuuaagagacc

SEQ ID NO: 389113 - RNA, 22 nt, Human
uucaaacaugaaccaaagugaa

SEQ ID NO: 389114 - RNA, 22 nt, Human
uugcaugcacacuugaccuccu

SEQ ID NO: 389115 - RNA, 23 nt, Human
uugcuugcccuuggggcagggug

SEQ ID NO: 389116 - RNA, 18 nt, Human
uuggggcaggguggccgg

SEQ ID NO: 389117 - RNA, 23 nt, Human
uuuguuuguuuguuuuuucuuuu

SEQ ID NO: 389118 - RNA, 20 nt, Human
accccuggccccugcaccuu

SEQ ID NO: 389119 - RNA, 18 nt, Human
agggaagugucccaggcc

SEQ ID NO: 389120 - RNA, 20 nt, Human
auaaauacucauucugugcu

SEQ ID NO: 389121 - RNA, 18 nt, Human
caaggcagaagugccacu

SEQ ID NO: 389122 - RNA, 19 nt, Human
caaggcagaagugccacuc

SEQ ID NO: 389123 - RNA, 20 nt, Human
caccuucuggcuucugcagg

SEQ ID NO: 389124 - RNA, 25 nt, Human
cagcucaggucuacacugacuucag

SEQ ID NO: 389125 - RNA, 23 nt, Human
ccagcaucccucaacccaguuuu

SEQ ID NO: 389126 - RNA, 24 nt, Human
cccaagcagcaggggcaggcagcc

SEQ ID NO: 389127 - RNA, 21 nt, Human
cccagcagcucccaagugacu

SEQ ID NO: 389128 - RNA, 21 nt, Human
cccaggccccgacuugccaga

SEQ ID NO: 389129 - RNA, 22 nt, Human
ccccugcaccuucuggcuucug

SEQ ID NO: 389130 - RNA, 18 nt, Human
ccugcguggcaggggagc

SEQ ID NO: 389131 - RNA, 22 nt, Human
cucccaccucgcuggaagacca

SEQ ID NO: 389132 - RNA, 21 nt, Human
cucucaucgggacauccggcc

SEQ ID NO: 389133 - RNA, 20 nt, Human
cugcaccuucuggcuucugc

SEQ ID NO: 389134 - RNA, 21 nt, Human
cugcagggaccgcugggcccu

SEQ ID NO: 389135 - RNA, 23 nt, Human
cugcagggaccgcugggcccugg

SEQ ID NO: 389136 - RNA, 24 nt, Human
gacucccuccgaugcucccacccc

SEQ ID NO: 389137 - RNA, 19 nt, Human
gacuugccagacgaggcuc

SEQ ID NO: 389138 - RNA, 22 nt, Human
gaggggugccugucucuucagg

SEQ ID NO: 389139 - RNA, 24 nt, Human
ggcugggaggggugccugucucuu

SEQ ID NO: 389140 - RNA, 21 nt, Human
gggcaggcagcccggguggcc

SEQ ID NO: 389141 - RNA, 22 nt, Human
guggcaggggagcagcugggca

SEQ ID NO: 389142 - RNA, 27 nt, Human
uaacagguucccucccagcucaggucu

SEQ ID NO: 389143 - RNA, 21 nt, Human
uccagggcucugggacucccu

SEQ ID NO: 389144 - RNA, 24 nt, Human
ucccaagugacuguguuuccagca

SEQ ID NO: 389145 - RNA, 23 nt, Human
ucccaccucgcuggaagaccaga

SEQ ID NO: 389146 - RNA, 25 nt, Human
ucugcagggaccgcugggcccugga

SEQ ID NO: 389147 - RNA, 22 nt, Human
ucuggcuucugcagggaccgcu

SEQ ID NO: 389148 - RNA, 23 nt, Human
ugaggcccagggaagugucccag

SEQ ID NO: 389149 - RNA, 19 nt, Human
ugcucccaccccuggcccc

SEQ ID NO: 389150 - RNA, 22 nt, Human
caaagaaauacuguauuguaau

SEQ ID NO: 389151 - RNA, 19 nt, Human
cccuggagggggugaaggg

SEQ ID NO: 389152 - RNA, 18 nt, Human
cuucaagauuaaaugguc

SEQ ID NO: 389153 - RNA, 19 nt, Human
cuucacugcuuucaugaga

SEQ ID NO: 389154 - RNA, 22 nt, Human
gaaaaucccaucacuuagcauc

SEQ ID NO: 389155 - RNA, 21 nt, Human
uaaaaugcaguuaacguggug

SEQ ID NO: 389156 - RNA, 18 nt, Human
uaacaaagaaauacugua

SEQ ID NO: 389157 - RNA, 21 nt, Human
ucauuuuuaaaacugaaauug

SEQ ID NO: 389158 - RNA, 23 nt, Human
ucuuuaggcuacaaagauaaaua

SEQ ID NO: 389159 - RNA, 24 nt, Human
uguaaugaugcuuuuuaagcccaa

SEQ ID NO: 389160 - RNA, 22 nt, Human
ugucauugucaauguguaaaau

SEQ ID NO: 389161 - RNA, 25 nt, Human
uuaaaucuuuaaauguauaacaaag

SEQ ID NO: 389162 - RNA, 22 nt, Human
uuacauguaauuguucuagaaa

SEQ ID NO: 389163 - RNA, 20 nt, Human
uuaguaguuucuucaacagc

SEQ ID NO: 389164 - RNA, 18 nt, Human
uucaugagaauuacaucc

SEQ ID NO: 389165 - RNA, 23 nt, Human
uuguguuccuucaagauuaaaug

SEQ ID NO: 389166 - RNA, 21 nt, Human
uuuaaauguauaacaaagaaa

SEQ ID NO: 389167 - RNA, 22 nt, Human
aaaaagacacagauuuucuuaa

SEQ ID NO: 389168 - RNA, 18 nt, Human
aaaaagcaaaacaaaaaa

SEQ ID NO: 389169 - RNA, 19 nt, Human
aaaaagcaaaacaaaaaag

SEQ ID NO: 389170 - RNA, 18 nt, Human
aaaacaaaaauguugcag

SEQ ID NO: 389171 - RNA, 23 nt, Human
aaaagaaaacaaaaauguugcag

SEQ ID NO: 389172 - RNA, 31 nt, Human
aaaagaaagaaaaaagaaaaggaggcagaag

SEQ ID NO: 389173 - RNA, 23 nt, Human
aaaagcaaaacaaaaaagaaaga

SEQ ID NO: 389174 - RNA, 22 nt, Human
aaacaagaacacaaaaccugaa

SEQ ID NO: 389175 - RNA, 21 nt, Human
aaacagaaucauguuaaugug

SEQ ID NO: 389176 - RNA, 26 nt, Human
aaagaaaaaagaaaaggaggcagaag

SEQ ID NO: 389177 - RNA, 22 nt, Human
aacacaaaaccugacaguugca

SEQ ID NO: 389178 - RNA, 19 nt, Human
aaccgauaaugcaaguccc

SEQ ID NO: 389179 - RNA, 21 nt, Human
aacuccuacccccaguagcuc

SEQ ID NO: 389180 - RNA, 19 nt, Human
aagaaagaaaaaagaaaag

SEQ ID NO: 389181 - RNA, 20 nt, Human
aagaaagaaaaaagaaaaga

SEQ ID NO: 389182 - RNA, 21 nt, Human
aagaaagaaaaaagaaaagga

SEQ ID NO: 389183 - RNA, 18 nt, Human
aagaacacaaaaccugac

SEQ ID NO: 389184 - RNA, 23 nt, Human
aagcaaaacaaaaaagaaagaaa

SEQ ID NO: 389185 - RNA, 23 nt, Human
aaggaagggcuaacgccauggcg

SEQ ID NO: 389186 - RNA, 21 nt, Human
accacaaauacauuacugugg

SEQ ID NO: 389187 - RNA, 21 nt, Human
acgcaacugcaaaaggaaggg

SEQ ID NO: 389188 - RNA, 20 nt, Human
acgccauggcgggcccgugg

SEQ ID NO: 389189 - RNA, 23 nt, Human
acuggaaugaaaagacgugucug

SEQ ID NO: 389190 - RNA, 21 nt, Human
agagacccagaccagccuuuu

SEQ ID NO: 389191 - RNA, 19 nt, Human
agcaaaacaaaaaagaaag

SEQ ID NO: 389192 - RNA, 22 nt, Human
agcaaucucaguuauauuuuaa

SEQ ID NO: 389193 - RNA, 24 nt, Human
aggaaagagaaagaacugucaaag

SEQ ID NO: 389194 - RNA, 24 nt, Human
aggcggggcgcugggcuccagccg

SEQ ID NO: 389195 - RNA, 19 nt, Human
agggaggaggggaaguguc

SEQ ID NO: 389196 - RNA, 26 nt, Human
agggaggaggggaagugucuuuugga

SEQ ID NO: 389197 - RNA, 22 nt, Human
caacugcaaaaggaagggcuaa

SEQ ID NO: 389198 - RNA, 24 nt, Human
caagcguucaaaauaaaaaccaca

SEQ ID NO: 389199 - RNA, 18 nt, Human
caaggcgaaaaaucagca

SEQ ID NO: 389200 - RNA, 18 nt, Human
cagccugaacuggacugg

SEQ ID NO: 389201 - RNA, 19 nt, Human
caguaauuuauugagaacc

SEQ ID NO: 389202 - RNA, 18 nt, Human
cauuacuguggacaugca

SEQ ID NO: 389203 - RNA, 22 nt, Human
ccacuccuucccuuuaaauccc

SEQ ID NO: 389204 - RNA, 22 nt, Human
ccagacgcaacugcaaaaggaa

SEQ ID NO: 389205 - RNA, 24 nt, Human
ccagccggggacaaguccgcagcu

SEQ ID NO: 389206 - RNA, 18 nt, Human
ccaggcggggcgcugggc

SEQ ID NO: 389207 - RNA, 19 nt, Human
ccaggcggggcgcugggcu

SEQ ID NO: 389208 - RNA, 19 nt, Human
cccagacgcaacugcaaaa

SEQ ID NO: 389209 - RNA, 21 nt, Human
ccccaguagcucaaugcaacc

SEQ ID NO: 389210 - RNA, 20 nt, Human
cccccccucccuugggucac

SEQ ID NO: 389211 - RNA, 18 nt, Human
cccuuuaaaucccccccu

SEQ ID NO: 389212 - RNA, 23 nt, Human
ccuccccaaacaaagcugcucag

SEQ ID NO: 389213 - RNA, 27 nt, Human
ccuccccgccuggugggcagagacugg

SEQ ID NO: 389214 - RNA, 19 nt, Human
ccugacaguugcaauucua

SEQ ID NO: 389215 - RNA, 19 nt, Human
ccuugcuggaaguugcucu

SEQ ID NO: 389216 - RNA, 24 nt, Human
cgccaagaagacaggggcugucuc

SEQ ID NO: 389217 - RNA, 21 nt, Human
cgcugggcuccagccggggac

SEQ ID NO: 389218 - RNA, 20 nt, Human
cuaaugcacuucaaagggag

SEQ ID NO: 389219 - RNA, 21 nt, Human
cugauccagaucccggacaua

SEQ ID NO: 389220 - RNA, 19 nt, Human
cuggaaauaaacccaacua

SEQ ID NO: 389221 - RNA, 20 nt, Human
gaaaacaagaacacaaaacc

SEQ ID NO: 389222 - RNA, 19 nt, Human
gaaguggagcuggaaagug

SEQ ID NO: 389223 - RNA, 23 nt, Human
gaagugucuuuuggagaauggga

SEQ ID NO: 389224 - RNA, 20 nt, Human
gacaugaauccugcuacaga

SEQ ID NO: 389225 - RNA, 19 nt, Human
gcaaaacaaaaaagaaaga

SEQ ID NO: 389226 - RNA, 20 nt, Human
gcaaaacaaaaaagaaagaa

SEQ ID NO: 389227 - RNA, 20 nt, Human
gcaaggcgaaaaaucagcaa

SEQ ID NO: 389228 - RNA, 19 nt, Human
gcccacuccuucccuuuaa

SEQ ID NO: 389229 - RNA, 18 nt, Human
gccuugcuggaaguugcu

SEQ ID NO: 389230 - RNA, 20 nt, Human
gcugggcuccagccggggac

SEQ ID NO: 389231 - RNA, 22 nt, Human
ggaaaaagcaaaacaaaaaaga

SEQ ID NO: 389232 - RNA, 19 nt, Human
ggacauauaaaccacgcca

SEQ ID NO: 389233 - RNA, 19 nt, Human
gggaaaaagcaaaacaaaa

SEQ ID NO: 389234 - RNA, 23 nt, Human
gggaaaaagcaaaacaaaaaaga

SEQ ID NO: 389235 - RNA, 23 nt, Human
uaacagcagcacauaauucaaaa

SEQ ID NO: 389236 - RNA, 19 nt, Human
uaauauagacuaaacaagg

SEQ ID NO: 389237 - RNA, 18 nt, Human
uacacagagcuauguaca

SEQ ID NO: 389238 - RNA, 22 nt, Human
uacuuugucuaauagucucacu

SEQ ID NO: 389239 - RNA, 21 nt, Human
uauacaggaaagagaaagaac

SEQ ID NO: 389240 - RNA, 24 nt, Human
ucaaaaggggggaaaaagcaaaac

SEQ ID NO: 389241 - RNA, 18 nt, Human
ucaaagggaggaggggaa

SEQ ID NO: 389242 - RNA, 19 nt, Human
uccccgccuggugggcaga

SEQ ID NO: 389243 - RNA, 21 nt, Human
ucccuugggucacugauuuga

SEQ ID NO: 389244 - RNA, 20 nt, Human
ucccuuuaaaucccccccuc

SEQ ID NO: 389245 - RNA, 25 nt, Human
ucucuagcacauucucucggguucc

SEQ ID NO: 389246 - RNA, 21 nt, Human
ugaaaacaucacaagaauauu

SEQ ID NO: 389247 - RNA, 26 nt, Human
ugaaaacaucacaagaauauuaaaaa

SEQ ID NO: 389248 - RNA, 24 nt, Human
ugaaaauaggaaauagcacuuucc

SEQ ID NO: 389249 - RNA, 23 nt, Human
ugaauccugcuacagagcuuaga

SEQ ID NO: 389250 - RNA, 22 nt, Human
ugagaaccgauaaugcaagucc

SEQ ID NO: 389251 - RNA, 19 nt, Human
ugcaagaagagaccuacag

SEQ ID NO: 389252 - RNA, 19 nt, Human
ugcagacaacucuuuugaa

SEQ ID NO: 389253 - RNA, 22 nt, Human
uggaaauaaacccaacuaaagg

SEQ ID NO: 389254 - RNA, 24 nt, Human
uggagaaugggaggccgcuuuuaa

SEQ ID NO: 389255 - RNA, 21 nt, Human
uggcacuccuuccccaauuuu

SEQ ID NO: 389256 - RNA, 21 nt, Human
uguuuugcccacuccuucccu

SEQ ID NO: 389257 - RNA, 24 nt, Human
uguuuugcccacuccuucccuuua

SEQ ID NO: 389258 - RNA, 21 nt, Human
uucaaagggaggaggggaagu

SEQ ID NO: 389259 - RNA, 19 nt, Human
uuugaacaccuccccgccu

SEQ ID NO: 389260 - RNA, 23 nt, Human
uuuuguuguuguuuaacagcagc

SEQ ID NO: 389261 - RNA, 22 nt, Human
aagagaccucuuuaggccaggu

SEQ ID NO: 389262 - RNA, 21 nt, Human
aauaaagaggcaaccaggcga

SEQ ID NO: 389263 - RNA, 23 nt, Human
accccaguaaaauaaagaggcaa

SEQ ID NO: 389264 - RNA, 26 nt, Human
acuuugaaaaggaccaccaaaagaga

SEQ ID NO: 389265 - RNA, 23 nt, Human
agagcacguaccucccagcucaa

SEQ ID NO: 389266 - RNA, 21 nt, Human
agccacagguuccggacgucu

SEQ ID NO: 389267 - RNA, 20 nt, Human
agccaggagugcgccucgcu

SEQ ID NO: 389268 - RNA, 20 nt, Human
auuaccaggcauaccccagu

SEQ ID NO: 389269 - RNA, 19 nt, Human
caaccaggcgauagcgacu

SEQ ID NO: 389270 - RNA, 23 nt, Human
caagaagagcacguaccucccag

SEQ ID NO: 389271 - RNA, 21 nt, Human
cacaaauagagccaagaucga

SEQ ID NO: 389272 - RNA, 19 nt, Human
cacgcaaccggcccgcgcg

SEQ ID NO: 389273 - RNA, 20 nt, Human
cagcauccagcgaccuugag

SEQ ID NO: 389274 - RNA, 21 nt, Human
ccgggucugcgcagccacagg

SEQ ID NO: 389275 - RNA, 18 nt, Human
ccucucucucucucuuuc

SEQ ID NO: 389276 - RNA, 20 nt, Human
cgcaagguucugcucuccaa

SEQ ID NO: 389277 - RNA, 21 nt, Human
cgucuuggccccgggaauaaa

SEQ ID NO: 389278 - RNA, 21 nt, Human
cucaggugaagacuuugaaaa

SEQ ID NO: 389279 - RNA, 19 nt, Human
cuccuucucucucuuucuc

SEQ ID NO: 389280 - RNA, 26 nt, Human
cucucucucucucuuucucuaggaaa

SEQ ID NO: 389281 - RNA, 20 nt, Human
cucucucuuucuccucucuc

SEQ ID NO: 389282 - RNA, 21 nt, Human
cuguugugaagcaggccucac

SEQ ID NO: 389283 - RNA, 26 nt, Human
cuucuuuggagcgcaaaagccaggag

SEQ ID NO: 389284 - RNA, 20 nt, Human
cuuuaggccaggucuucuuc

SEQ ID NO: 389285 - RNA, 20 nt, Human
gaagagcacguaccucccag

SEQ ID NO: 389286 - RNA, 21 nt, Human
gaccucuuuaggccaggucuu

SEQ ID NO: 389287 - RNA, 22 nt, Human
gacuuugaaaaggaccaccaaa

SEQ ID NO: 389288 - RNA, 24 nt, Human
gaguccaccucagaccucuauugg

SEQ ID NO: 389289 - RNA, 18 nt, Human
ggaagggggagaggaggg

SEQ ID NO: 389290 - RNA, 22 nt, Human
ggggagaggagggaacucuuca

SEQ ID NO: 389291 - RNA, 23 nt, Human
gguucugcucuccaacuauccca

SEQ ID NO: 389292 - RNA, 21 nt, Human
uaaagacauaaaccaacccgg

SEQ ID NO: 389293 - RNA, 22 nt, Human
uaggaaaugucuguugugaagc

SEQ ID NO: 389294 - RNA, 19 nt, Human
ucagugccgggucugcgca

SEQ ID NO: 389295 - RNA, 18 nt, Human
uccgugggguucucuugg

SEQ ID NO: 389296 - RNA, 24 nt, Human
uccucucucucucucuuucucuaa

SEQ ID NO: 389297 - RNA, 26 nt, Human
ucucucuccuucucucucuuucuccu

SEQ ID NO: 389298 - RNA, 21 nt, Human
ucucucucuuucuccucucuc

SEQ ID NO: 389299 - RNA, 23 nt, Human
ucuucacgaagggaggugggagu

SEQ ID NO: 389300 - RNA, 19 nt, Human
ucuuggccccgggaauaaa

SEQ ID NO: 389301 - RNA, 23 nt, Human
ucuuuaggccaggucuucuucca

SEQ ID NO: 389302 - RNA, 18 nt, Human
ucuuucuccucucucucu

SEQ ID NO: 389303 - RNA, 24 nt, Human
ucuuuggagcgcaaaagccaggag

SEQ ID NO: 389304 - RNA, 22 nt, Human
ugagacaaaacaagaaagucaa

SEQ ID NO: 389305 - RNA, 27 nt, Human
ugcaccuauaggacuuggagacgucac

SEQ ID NO: 389306 - RNA, 22 nt, Human
ugcccgcgcaagguucugcucu

SEQ ID NO: 389307 - RNA, 20 nt, Human
uggcuggggggcagcggcgg

SEQ ID NO: 389308 - RNA, 22 nt, Human
ugucaagaagagcacguaccuc

SEQ ID NO: 389309 - RNA, 22 nt, Human
ugucuguugugaagcaggccuc

SEQ ID NO: 389310 - RNA, 22 nt, Human
uuauuaccaggcauaccccagu

SEQ ID NO: 389311 - RNA, 24 nt, Human
aagcagcgugaacagagggaaagu

SEQ ID NO: 389312 - RNA, 20 nt, Human
aaguaguugggauuacaggc

SEQ ID NO: 389313 - RNA, 26 nt, Human
aaguaguugggauuacaggcguuugc

SEQ ID NO: 389314 - RNA, 23 nt, Human
aauggcuuccuaacagaugacau

SEQ ID NO: 389315 - RNA, 20 nt, Human
acagcucagccccuuccaga

SEQ ID NO: 389316 - RNA, 21 nt, Human
acaggguuucaccauguuggc

SEQ ID NO: 389317 - RNA, 22 nt, Human
acaggguuucaccauguuggca

SEQ ID NO: 389318 - RNA, 23 nt, Human
acaggguuucaccauguuggcag

SEQ ID NO: 389319 - RNA, 23 nt, Human
accauguuggcaggcuggucucg

SEQ ID NO: 389320 - RNA, 26 nt, Human
accuggguacgguccccuccuccccu

SEQ ID NO: 389321 - RNA, 20 nt, Human
accuuggcgccccagaccuu

SEQ ID NO: 389322 - RNA, 24 nt, Human
acucuggucccagaacaacagacu

SEQ ID NO: 389323 - RNA, 24 nt, Human
agagauucuccugccucagccucc

SEQ ID NO: 389324 - RNA, 22 nt, Human
agcagagacaggguuucaccau

SEQ ID NO: 389325 - RNA, 24 nt, Human
agccccggcuagggauaagcuggg

SEQ ID NO: 389326 - RNA, 22 nt, Human
agcugauuucacagggcacucg

SEQ ID NO: 389327 - RNA, 18 nt, Human
agcuggacucccagcagc

SEQ ID NO: 389328 - RNA, 20 nt, Human
agcuggacucccagcagccu

SEQ ID NO: 389329 - RNA, 19 nt, Human
aggaggccgcagcccaguc

SEQ ID NO: 389330 - RNA, 18 nt, Human
agggauaagcuggggggc

SEQ ID NO: 389331 - RNA, 23 nt, Human
aggugagggggcuccagggcugg

SEQ ID NO: 389332 - RNA, 24 nt, Human
aggugaucugcccgccucagccuc

SEQ ID NO: 389333 - RNA, 18 nt, Human
agugcugggauuacaugc

SEQ ID NO: 389334 - RNA, 22 nt, Human
agugcugggauuacaugcguga

SEQ ID NO: 389335 - RNA, 22 nt, Human
aguuuucuuuucuuucuuuuuu

SEQ ID NO: 389336 - RNA, 24 nt, Human
auggggccgguggaggugaggggg

SEQ ID NO: 389337 - RNA, 20 nt, Human
caaccuccaccuccuggguu

SEQ ID NO: 389338 - RNA, 23 nt, Human
caaccuccaccuccuggguucaa

SEQ ID NO: 389339 - RNA, 22 nt, Human
caagagauucuccugccucagc

SEQ ID NO: 389340 - RNA, 18 nt, Human
cacagcucagccccuucc

SEQ ID NO: 389341 - RNA, 21 nt, Human
cacagcucagccccuuccaga

SEQ ID NO: 389342 - RNA, 21 nt, Human
cacagcucagccccuuccaga

SEQ ID NO: 389343 - RNA, 24 nt, Human
cacagcucagccccuuccagaucc

SEQ ID NO: 389344 - RNA, 24 nt, Human
caccaugccuggcuaauuuuugua

SEQ ID NO: 389345 - RNA, 23 nt, Human
caccauguuggcaggcuggucuc

SEQ ID NO: 389346 - RNA, 23 nt, Human
caccuggucucucuucucuuuag

SEQ ID NO: 389347 - RNA, 21 nt, Human
cacugcaaccuccaccuccug

SEQ ID NO: 389348 - RNA, 23 nt, Human
cacugcaaccuccaccuccuggg

SEQ ID NO: 389349 - RNA, 22 nt, Human
cagagacaggguuucaccaugu

SEQ ID NO: 389350 - RNA, 24 nt, Human
cagagugcugggauuacaugcgug

SEQ ID NO: 389351 - RNA, 18 nt, Human
cagcgugaacagagggaa

SEQ ID NO: 389352 - RNA, 23 nt, Human
caggguuucaccauguuggcagg

SEQ ID NO: 389353 - RNA, 19 nt, Human
caggugaccgcccuccgcc

SEQ ID NO: 389354 - RNA, 23 nt, Human
caggugaccgcccuccgcccccc

SEQ ID NO: 389355 - RNA, 21 nt, Human
caucacgagccaagccuccaa

SEQ ID NO: 389356 - RNA, 24 nt, Human
ccaaguaguugggauuacaggcgu

SEQ ID NO: 389357 - RNA, 20 nt, Human
ccagagugcugggauuacau

SEQ ID NO: 389358 - RNA, 22 nt, Human
ccagagugcugggauuacaugc

SEQ ID NO: 389359 - RNA, 24 nt, Human
ccagagugcugggauuacaugcgu

SEQ ID NO: 389360 - RNA, 18 nt, Human
ccagggccaaacacagga

SEQ ID NO: 389361 - RNA, 24 nt, Human
cccaaguaguugggauuacaggcg

SEQ ID NO: 389362 - RNA, 25 nt, Human
cccaaguaguugggauuacaggcgu

SEQ ID NO: 389363 - RNA, 21 nt, Human
ccccaugcuaaaaaaaccucc

SEQ ID NO: 389364 - RNA, 20 nt, Human
ccccauuuggccagcagagc

SEQ ID NO: 389365 - RNA, 22 nt, Human
cccccugcccccucauuacaua

SEQ ID NO: 389366 - RNA, 18 nt, Human
ccccucccuccccacccc

SEQ ID NO: 389367 - RNA, 19 nt, Human
ccccuggggccucgaaggg

SEQ ID NO: 389368 - RNA, 19 nt, Human
cccgagcaccguaguccuc

SEQ ID NO: 389369 - RNA, 18 nt, Human
cccuccccaccccgggag

SEQ ID NO: 389370 - RNA, 23 nt, Human
cccuccccucuuuggggcccugg

SEQ ID NO: 389371 - RNA, 24 nt, Human
ccgccucagccucccagagugcug

SEQ ID NO: 389372 - RNA, 19 nt, Human
ccgggaggcuucauuagcc

SEQ ID NO: 389373 - RNA, 21 nt, Human
ccguaguccucccuggucccc

SEQ ID NO: 389374 - RNA, 23 nt, Human
ccuaggcuggaaugcaauggcau

SEQ ID NO: 389375 - RNA, 22 nt, Human
ccucaggugaucugcccgccuc

SEQ ID NO: 389376 - RNA, 19 nt, Human
ccuccaccuccuggguuca

SEQ ID NO: 389377 - RNA, 22 nt, Human
ccuccuccccucccuccccacc

SEQ ID NO: 389378 - RNA, 24 nt, Human
ccuccuggguucaagagauucucc

SEQ ID NO: 389379 - RNA, 22 nt, Human
ccucgaagggguccgagagggg

SEQ ID NO: 389380 - RNA, 23 nt, Human
ccuggaaccuggacggagccaag

SEQ ID NO: 389381 - RNA, 18 nt, Human
ccuggaguugggcugggg

SEQ ID NO: 389382 - RNA, 20 nt, Human
ccuggaguugggcuggggug

SEQ ID NO: 389383 - RNA, 22 nt, Human
ccuggccucaggugaucugccc

SEQ ID NO: 389384 - RNA, 23 nt, Human
ccuggguucaagagauucuccug

SEQ ID NO: 389385 - RNA, 19 nt, Human
ccuugguuaggcuuugaag

SEQ ID NO: 389386 - RNA, 23 nt, Human
cgcccagggccaaacacaggagc

SEQ ID NO: 389387 - RNA, 21 nt, Human
cgcccuccgccccccuucacu

SEQ ID NO: 389388 - RNA, 19 nt, Human
cgguccccuccuccccucc

SEQ ID NO: 389389 - RNA, 24 nt, Human
cguguugccuaggcuggaaugcaa

SEQ ID NO: 389390 - RNA, 23 nt, Human
cucacagcucagccccuuccaga

SEQ ID NO: 389391 - RNA, 24 nt, Human
cucacugcaaccuccaccuccugg

SEQ ID NO: 389392 - RNA, 26 nt, Human
cucacugcaaccuccaccuccugggu

SEQ ID NO: 389393 - RNA, 23 nt, Human
cucagccucccaaguaguuggga

SEQ ID NO: 389394 - RNA, 21 nt, Human
cucccuccccaccccgggagg

SEQ ID NO: 389395 - RNA, 18 nt, Human
cuccgccccccuucacuu

SEQ ID NO: 389396 - RNA, 21 nt, Human
cuccuggguucaagagauucu

SEQ ID NO: 389397 - RNA, 20 nt, Human
cucguguugccuaggcugga

SEQ ID NO: 389398 - RNA, 18 nt, Human
cugcaaccuccaccuccu

SEQ ID NO: 389399 - RNA, 24 nt, Human
cugcaaccuccaccuccuggguuc

SEQ ID NO: 389400 - RNA, 21 nt, Human
cugcccgccucagccucccag

SEQ ID NO: 389401 - RNA, 21 nt, Human
cugccucagccucccaaguag

SEQ ID NO: 389402 - RNA, 24 nt, Human
cuggaaugcaauggcaugaucucg

SEQ ID NO: 389403 - RNA, 18 nt, Human
cugguccccaugcuaaaa

SEQ ID NO: 389404 - RNA, 20 nt, Human
cuuggaggccgggcccugga

SEQ ID NO: 389405 - RNA, 21 nt, Human
cuuggaggccgggcccuggag

SEQ ID NO: 389406 - RNA, 20 nt, Human
cuuuggggcccuggaguugg

SEQ ID NO: 389407 - RNA, 21 nt, Human
cuuuggggcccuggaguuggg

SEQ ID NO: 389408 - RNA, 19 nt, Human
gacccccugcccccucauu

SEQ ID NO: 389409 - RNA, 24 nt, Human
gagauucuccugccucagccuccc

SEQ ID NO: 389410 - RNA, 21 nt, Human
gagccccuuccauucacacgg

SEQ ID NO: 389411 - RNA, 20 nt, Human
gaggcagaggggcccagcag

SEQ ID NO: 389412 - RNA, 18 nt, Human
gauuacaggcguuugcca

SEQ ID NO: 389413 - RNA, 24 nt, Human
gauuacaggcguuugccaccaugc

SEQ ID NO: 389414 - RNA, 18 nt, Human
gauuacaugcgugagcca

SEQ ID NO: 389415 - RNA, 20 nt, Human
gcaggcuggucucgaacucc

SEQ ID NO: 389416 - RNA, 25 nt, Human
gccaaacacaggagcccaauguuuc

SEQ ID NO: 389417 - RNA, 23 nt, Human
gccucagccucccagagugcugg

SEQ ID NO: 389418 - RNA, 21 nt, Human
gcucguguugccuaggcugga

SEQ ID NO: 389419 - RNA, 19 nt, Human
gcuggaaugcaauggcaug

SEQ ID NO: 389420 - RNA, 21 nt, Human
gcugggauuacaugcgugagc

SEQ ID NO: 389421 - RNA, 23 nt, Human
gcuggucucgaacuccuggccuc

SEQ ID NO: 389422 - RNA, 21 nt, Human
gcuuuguuuguuuuaucucca

SEQ ID NO: 389423 - RNA, 23 nt, Human
ggaggcagaggggcccagcagug

SEQ ID NO: 389424 - RNA, 18 nt, Human
ggaggccgggcccuggag

SEQ ID NO: 389425 - RNA, 24 nt, Human
ggcccuggaguugggcuggggugg

SEQ ID NO: 389426 - RNA, 21 nt, Human
ggccgcgaggaggccgcagcc

SEQ ID NO: 389427 - RNA, 24 nt, Human
ggcuggucucgaacuccuggccuc

SEQ ID NO: 389428 - RNA, 20 nt, Human
gggacgcggccugagcugau

SEQ ID NO: 389429 - RNA, 19 nt, Human
gggcacucggggccgcgag

SEQ ID NO: 389430 - RNA, 22 nt, Human
gggcugggggaagggagcggga

SEQ ID NO: 389431 - RNA, 29 nt, Human
gggcugggguggagaccccuggggccucc

SEQ ID NO: 389432 - RNA, 18 nt, Human
ggggaugcuggucugugg

SEQ ID NO: 389433 - RNA, 22 nt, Human
ggggauggggccgguggaggug

SEQ ID NO: 389434 - RNA, 23 nt, Human
gggggcggggccuggaaccugga

SEQ ID NO: 389435 - RNA, 18 nt, Human
ggggggguggggauugag

SEQ ID NO: 389436 - RNA, 21 nt, Human
gggggugggagugaaaucaag

SEQ ID NO: 389437 - RNA, 19 nt, Human
gguggagaccccuggggcc

SEQ ID NO: 389438 - RNA, 18 nt, Human
guaaguggggaugcuggu

SEQ ID NO: 389439 - RNA, 19 nt, Human
guaguccucccuggucccc

SEQ ID NO: 389440 - RNA, 18 nt, Human
guaguugggauuacaggc

SEQ ID NO: 389441 - RNA, 20 nt, Human
guccucccugguccccaugc

SEQ ID NO: 389442 - RNA, 24 nt, Human
gugaaguugagggggugggugggc

SEQ ID NO: 389443 - RNA, 24 nt, Human
gugaucugcccgccucagccuccc

SEQ ID NO: 389444 - RNA, 24 nt, Human
gugggugggcaggcccaaggcggc

SEQ ID NO: 389445 - RNA, 27 nt, Human
uaaaaaaaccuccaucacgagccaagc

SEQ ID NO: 389446 - RNA, 18 nt, Human
uaacuccucggcuugacu

SEQ ID NO: 389447 - RNA, 20 nt, Human
uaacuccucggcuugacuga

SEQ ID NO: 389448 - RNA, 18 nt, Human
uaagcuggggggcggggc

SEQ ID NO: 389449 - RNA, 24 nt, Human
uaauuuuuguauuuuuagcagaga

SEQ ID NO: 389450 - RNA, 24 nt, Human
uacaugcgugagccaccacaccug

SEQ ID NO: 389451 - RNA, 23 nt, Human
uagaauggcuuccuaacagauga

SEQ ID NO: 389452 - RNA, 24 nt, Human
uagcagagacaggguuucaccaug

SEQ ID NO: 389453 - RNA, 26 nt, Human
uagcagagacaggguuucaccauguu

SEQ ID NO: 389454 - RNA, 18 nt, Human
uaggcuuugaagccagag

SEQ ID NO: 389455 - RNA, 24 nt, Human
ucacgagccaagccuccaaaguuc

SEQ ID NO: 389456 - RNA, 23 nt, Human
ucacugcaaccuccaccuccugg

SEQ ID NO: 389457 - RNA, 24 nt, Human
ucacugcaaccuccaccuccuggg

SEQ ID NO: 389458 - RNA, 25 nt, Human
ucacugcaaccuccaccuccugggu

SEQ ID NO: 389459 - RNA, 27 nt, Human
ucacugcaaccuccaccuccuggguuc

SEQ ID NO: 389460 - RNA, 20 nt, Human
ucagccccuuccagauccag

SEQ ID NO: 389461 - RNA, 19 nt, Human
uccagagcccauggggagg

SEQ ID NO: 389462 - RNA, 18 nt, Human
uccagcacggugccuggc

SEQ ID NO: 389463 - RNA, 22 nt, Human
uccagggcugggggaagggagc

SEQ ID NO: 389464 - RNA, 24 nt, Human
ucccaaguaguugggauuacaggc

SEQ ID NO: 389465 - RNA, 18 nt, Human
ucccagagugcugggauu

SEQ ID NO: 389466 - RNA, 24 nt, Human
ucccagagugcugggauuacaugc

SEQ ID NO: 389467 - RNA, 28 nt, Human
uccccaugcuaaaaaaaccuccaucacg

SEQ ID NO: 389468 - RNA, 23 nt, Human
uccccucccuccccaccccggga

SEQ ID NO: 389469 - RNA, 27 nt, Human
uccccuccuccccucccuccccacccc

SEQ ID NO: 389470 - RNA, 21 nt, Human
uccuggguucaagagauucuc

SEQ ID NO: 389471 - RNA, 24 nt, Human
uccuggguucaagagauucuccug

SEQ ID NO: 389472 - RNA, 23 nt, Human
ucgaagggguccgagaggggguc

SEQ ID NO: 389473 - RNA, 19 nt, Human
ucuccugccucagccuccc

SEQ ID NO: 389474 - RNA, 20 nt, Human
ucucgaacuccuggccucag

SEQ ID NO: 389475 - RNA, 21 nt, Human
ucugcccgccucagccuccca

SEQ ID NO: 389476 - RNA, 22 nt, Human
ucugcccgccucagccucccag

SEQ ID NO: 389477 - RNA, 19 nt, Human
ucugcuugucuacucuccc

SEQ ID NO: 389478 - RNA, 21 nt, Human
ucuuuggggcccuggaguugg

SEQ ID NO: 389479 - RNA, 18 nt, Human
ucuuuuuuuuuuuuuuuu

SEQ ID NO: 389480 - RNA, 18 nt, Human
ugaauguuuucacuuacc

SEQ ID NO: 389481 - RNA, 21 nt, Human
ugaccgcccuccgccccccuu

SEQ ID NO: 389482 - RNA, 20 nt, Human
ugagggggcuccagggcugg

SEQ ID NO: 389483 - RNA, 18 nt, Human
ugauggaggcagaggggc

SEQ ID NO: 389484 - RNA, 21 nt, Human
ugcaccagugugugugggggg

SEQ ID NO: 389485 - RNA, 22 nt, Human
ugcaccaguguguguggggggg

SEQ ID NO: 389486 - RNA, 21 nt, Human
ugccuaggcuggaaugcaaug

SEQ ID NO: 389487 - RNA, 24 nt, Human
ugccuaggcuggaaugcaauggca

SEQ ID NO: 389488 - RNA, 24 nt, Human
ugccucagccucccaaguaguugg

SEQ ID NO: 389489 - RNA, 20 nt, Human
ugcugagucagugaaugaaa

SEQ ID NO: 389490 - RNA, 24 nt, Human
ugcugggauuacaugcgugagcca

SEQ ID NO: 389491 - RNA, 24 nt, Human
ugcuggucuguggccccauuuggc

SEQ ID NO: 389492 - RNA, 21 nt, Human
ugcuuagggcccccggugcug

SEQ ID NO: 389493 - RNA, 24 nt, Human
ugcuuuguuuguuuuaucuccagu

SEQ ID NO: 389494 - RNA, 18 nt, Human
uggaaccuggacggagcc

SEQ ID NO: 389495 - RNA, 19 nt, Human
uggaaugcaauggcaugau

SEQ ID NO: 389496 - RNA, 23 nt, Human
uggaaugcaauggcaugaucucg

SEQ ID NO: 389497 - RNA, 18 nt, Human
uggacggagccaagaguc

SEQ ID NO: 389498 - RNA, 18 nt, Human
uggagaccccuggggccu

SEQ ID NO: 389499 - RNA, 22 nt, Human
uggaggcagaggggcccagcag

SEQ ID NO: 389500 - RNA, 18 nt, Human
uggaggccgggcccugga

SEQ ID NO: 389501 - RNA, 23 nt, Human
uggcacauagcagguacuauaua

SEQ ID NO: 389502 - RNA, 23 nt, Human
uggcaggcuggucucgaacuccu

SEQ ID NO: 389503 - RNA, 26 nt, Human
uggcaggugaccgcccuccgcccccc

SEQ ID NO: 389504 - RNA, 24 nt, Human
uggccagcagagccccuuccauuc

SEQ ID NO: 389505 - RNA, 20 nt, Human
uggccucaggugaucugccc

SEQ ID NO: 389506 - RNA, 24 nt, Human
uggccucaggugaucugcccgccu

SEQ ID NO: 389507 - RNA, 18 nt, Human
ugggauuacaggcguuug

SEQ ID NO: 389508 - RNA, 19 nt, Human
ugggauuacaggcguuugc

SEQ ID NO: 389509 - RNA, 21 nt, Human
ugggauuacaggcguuugcca

SEQ ID NO: 389510 - RNA, 22 nt, Human
ugggauuacaggcguuugccac

SEQ ID NO: 389511 - RNA, 24 nt, Human
ugggauuacaggcguuugccacca

SEQ ID NO: 389512 - RNA, 25 nt, Human
ugggauuacaggcguuugccaccau

SEQ ID NO: 389513 - RNA, 18 nt, Human
ugggauuacaugcgugag

SEQ ID NO: 389514 - RNA, 19 nt, Human
ugggauuacaugcgugagc

SEQ ID NO: 389515 - RNA, 22 nt, Human
ugggauuacaugcgugagccac

SEQ ID NO: 389516 - RNA, 23 nt, Human
ugggauuacaugcgugagccacc

SEQ ID NO: 389517 - RNA, 24 nt, Human
ugggauuacaugcgugagccacca

SEQ ID NO: 389518 - RNA, 18 nt, Human
uggggccucgaagggguc

SEQ ID NO: 389519 - RNA, 23 nt, Human
ugggggaagggagcgggagguuu

SEQ ID NO: 389520 - RNA, 24 nt, Human
ugggggauggggccgguggaggug

SEQ ID NO: 389521 - RNA, 19 nt, Human
ugggguggagaccccuggg

SEQ ID NO: 389522 - RNA, 19 nt, Human
ugggugggcaggcccaagg

SEQ ID NO: 389523 - RNA, 19 nt, Human
ugguaaguggggaugcugg

SEQ ID NO: 389524 - RNA, 18 nt, Human
ugugggggauggggccgg

SEQ ID NO: 389525 - RNA, 24 nt, Human
uuagcagagacaggguuucaccau

SEQ ID NO: 389526 - RNA, 18 nt, Human
uucaagagauucuccugc

SEQ ID NO: 389527 - RNA, 23 nt, Human
uucaagagauucuccugccucag

SEQ ID NO: 389528 - RNA, 21 nt, Human
uucaccauguuggcaggcugg

SEQ ID NO: 389529 - RNA, 29 nt, Human
uucuuucuuuuuuuuuuuuuuuuugagaa

SEQ ID NO: 389530 - RNA, 23 nt, Human
uugcucguguugccuaggcugga

SEQ ID NO: 389531 - RNA, 20 nt, Human
uuggaggccgggcccuggag

SEQ ID NO: 389532 - RNA, 21 nt, Human
uuggccagcagagccccuucc

SEQ ID NO: 389533 - RNA, 20 nt, Human
uuggugugggggauggggcc

SEQ ID NO: 389534 - RNA, 20 nt, Human
uuucaccauguuggcaggcu

SEQ ID NO: 389535 - RNA, 24 nt, Human
uuucuuuuuuuuuuuuuuuuuggg

SEQ ID NO: 389536 - RNA, 24 nt, Human
uuugcucguguugccuaggcugga

SEQ ID NO: 389537 - RNA, 24 nt, Human
uuuugcucguguugccuaggcugg

SEQ ID NO: 389538 - RNA, 22 nt, Human
uuuuguauuuuuagcagagaca

SEQ ID NO: 389539 - RNA, 24 nt, Human
uuuuuagcagagacaggguuucac

SEQ ID NO: 389540 - RNA, 20 nt, Human
uuuuuguauuuuuagcagag

SEQ ID NO: 389541 - RNA, 19 nt, Human
uuuuuuuuuuuuugagagg

SEQ ID NO: 389542 - RNA, 22 nt, Human
uuuuuuuuuuuuuuuugagagg

SEQ ID NO: 389543 - RNA, 21 nt, Human
aaaaaaaaaaaaaauggccag

SEQ ID NO: 389544 - RNA, 18 nt, Human
aaacaggagacuuuucca

SEQ ID NO: 389545 - RNA, 19 nt, Human
aacacggugaaaccccguc

SEQ ID NO: 389546 - RNA, 20 nt, Human
aacacggugaaaccccgucu

SEQ ID NO: 389547 - RNA, 21 nt, Human
aacacggugaaaccccgucuc

SEQ ID NO: 389548 - RNA, 19 nt, Human
aacuguaccccagcaagua

SEQ ID NO: 389549 - RNA, 18 nt, Human
aaucaccugaggucagga

SEQ ID NO: 389550 - RNA, 24 nt, Human
aaucaccugaggucaggaguucaa

SEQ ID NO: 389551 - RNA, 24 nt, Human
aaucgcuugaacccgggaggcgga

SEQ ID NO: 389552 - RNA, 24 nt, Human
aaucgcuugaacccgggaggugga

SEQ ID NO: 389553 - RNA, 22 nt, Human
acaaaauggaaauacacgcauc

SEQ ID NO: 389554 - RNA, 23 nt, Human
acagagcaagacuccgucuaaaa

SEQ ID NO: 389555 - RNA, 19 nt, Human
acagagugagacuccgucu

SEQ ID NO: 389556 - RNA, 23 nt, Human
acagagugagacuccgucuaaaa

SEQ ID NO: 389557 - RNA, 21 nt, Human
acaguaacuguggauccuucu

SEQ ID NO: 389558 - RNA, 24 nt, Human
accccgucucuacuaaaaauacaa

SEQ ID NO: 389559 - RNA, 24 nt, Human
accugaggucaggaguucaagacc

SEQ ID NO: 389560 - RNA, 23 nt, Human
acuccagccugggggacagagca

SEQ ID NO: 389561 - RNA, 24 nt, Human
acuccaggcugggccacagaguga

SEQ ID NO: 389562 - RNA, 18 nt, Human
acugcacuccagccuggg

SEQ ID NO: 389563 - RNA, 24 nt, Human
acugcacuccagccugggggacag

SEQ ID NO: 389564 - RNA, 24 nt, Human
acuguacuccaggcugggccacag

SEQ ID NO: 389565 - RNA, 22 nt, Human
agaaucgcuugaacccgggagg

SEQ ID NO: 389566 - RNA, 21 nt, Human
agagcaagacuccgucuaaaa

SEQ ID NO: 389567 - RNA, 21 nt, Human
agaugugcgggcgccgagggu

SEQ ID NO: 389568 - RNA, 24 nt, Human
agcacuuugggaggcugaggcugg

SEQ ID NO: 389569 - RNA, 23 nt, Human
agccgggcgugguggcgcgcgcc

SEQ ID NO: 389570 - RNA, 24 nt, Human
agccuggccaacacggugaaaccc

SEQ ID NO: 389571 - RNA, 24 nt, Human
agccugggggacagagcaagacuc

SEQ ID NO: 389572 - RNA, 18 nt, Human
agccuucccuguuggagg

SEQ ID NO: 389573 - RNA, 18 nt, Human
aggcacgagaaucgcuug

SEQ ID NO: 389574 - RNA, 24 nt, Human
aggcacgagaaucgcuugaacccg

SEQ ID NO: 389575 - RNA, 24 nt, Human
aggcaggagaaucgcuugaacccg

SEQ ID NO: 389576 - RNA, 21 nt, Human
aggcggagguugcagugagcc

SEQ ID NO: 389577 - RNA, 24 nt, Human
aggcggagguugcagugagccgag

SEQ ID NO: 389578 - RNA, 24 nt, Human
aggcugaggcacgagaaucgcuug

SEQ ID NO: 389579 - RNA, 20 nt, Human
aggcugaggcaggagaaucg

SEQ ID NO: 389580 - RNA, 24 nt, Human
aggcugaggcaggagaaucgcuug

SEQ ID NO: 389581 - RNA, 24 nt, Human
aggcugggccacagagugagacuc

SEQ ID NO: 389582 - RNA, 22 nt, Human
aggcuggugaaucaccugaggu

SEQ ID NO: 389583 - RNA, 26 nt, Human
aggcuggugaaucaccugaggucagg

SEQ ID NO: 389584 - RNA, 18 nt, Human
aggggccgaggaagggag

SEQ ID NO: 389585 - RNA, 25 nt, Human
agguggagguugcagugacaacggu

SEQ ID NO: 389586 - RNA, 24 nt, Human
agguggagguugcagugagcugag

SEQ ID NO: 389587 - RNA, 22 nt, Human
agucaccaccccaucaggccga

SEQ ID NO: 389588 - RNA, 24 nt, Human
aguggcuuacgccuguaaucccag

SEQ ID NO: 389589 - RNA, 19 nt, Human
auacacgcaucacagugac

SEQ ID NO: 389590 - RNA, 24 nt, Human
auugcgccacugcacuccagccug

SEQ ID NO: 389591 - RNA, 18 nt, Human
auuuacugugcugucugc

SEQ ID NO: 389592 - RNA, 21 nt, Human
caaaacaggagacuuuuccaa

SEQ ID NO: 389593 - RNA, 22 nt, Human
caaaacccugcugcugaugccc

SEQ ID NO: 389594 - RNA, 24 nt, Human
caacacggugaaaccccgucucua

SEQ ID NO: 389595 - RNA, 20 nt, Human
caacccaaaacccugcugcu

SEQ ID NO: 389596 - RNA, 18 nt, Human
caacuguaccccagcaag

SEQ ID NO: 389597 - RNA, 24 nt, Human
caaggccgggcgcaguggcuuacg

SEQ ID NO: 389598 - RNA, 23 nt, Human
cacagagugagacuccgucuaaa

SEQ ID NO: 389599 - RNA, 19 nt, Human
cacccccagccccugaauc

SEQ ID NO: 389600 - RNA, 23 nt, Human
caccugaggucaggaguucaaga

SEQ ID NO: 389601 - RNA, 18 nt, Human
cacugcacuccagccugg

SEQ ID NO: 389602 - RNA, 19 nt, Human
cacugcacuccagccuggg

SEQ ID NO: 389603 - RNA, 22 nt, Human
cacugcacuccagccuggggga

SEQ ID NO: 389604 - RNA, 24 nt, Human
cacugcacuccagccugggggaca

SEQ ID NO: 389605 - RNA, 25 nt, Human
cacugcacuccagccugggggacag

SEQ ID NO: 389606 - RNA, 20 nt, Human
cacuguacuccaggcugggc

SEQ ID NO: 389607 - RNA, 20 nt, Human
cagagaccucaucugcgggg

SEQ ID NO: 389608 - RNA, 23 nt, Human
cagcacuuugggaggcugaggcu

SEQ ID NO: 389609 - RNA, 25 nt, Human
cagcacuuugggaggcugaggcugg

SEQ ID NO: 389610 - RNA, 21 nt, Human
cagccccugaauccucagaac

SEQ ID NO: 389611 - RNA, 24 nt, Human
cagcuacucaggaggcugaggcag

SEQ ID NO: 389612 - RNA, 21 nt, Human
caggcuggcacugguucaggc

SEQ ID NO: 389613 - RNA, 22 nt, Human
caucaaagcaauaaaaucuaac

SEQ ID NO: 389614 - RNA, 18 nt, Human
caugcaaggccgggcgca

SEQ ID NO: 389615 - RNA, 24 nt, Human
caugccugugaucccagcacuuug

SEQ ID NO: 389616 - RNA, 24 nt, Human
ccaaaacccugcugcugaugccca

SEQ ID NO: 389617 - RNA, 22 nt, Human
ccaccagagaucaugcuuuaca

SEQ ID NO: 389618 - RNA, 19 nt, Human
ccacugcacuccagccugg

SEQ ID NO: 389619 - RNA, 20 nt, Human
ccacugcacuccagccuggg

SEQ ID NO: 389620 - RNA, 22 nt, Human
ccacugcacuccagccuggggg

SEQ ID NO: 389621 - RNA, 24 nt, Human
ccacugcacuccagccugggggac

SEQ ID NO: 389622 - RNA, 19 nt, Human
ccacuguacuccaggcugg

SEQ ID NO: 389623 - RNA, 23 nt, Human
ccagguacuaguuaauuauaguc

SEQ ID NO: 389624 - RNA, 19 nt, Human
ccaguccacgggaaaagga

SEQ ID NO: 389625 - RNA, 21 nt, Human
cccagccccugaauccucaga

SEQ ID NO: 389626 - RNA, 19 nt, Human
ccccagcaaguaggucaaa

SEQ ID NO: 389627 - RNA, 21 nt, Human
ccccugaauccucagaacagg

SEQ ID NO: 389628 - RNA, 26 nt, Human
ccccugggcacauuucuguauuucua

SEQ ID NO: 389629 - RNA, 21 nt, Human
cccgggagguggagguugcag

SEQ ID NO: 389630 - RNA, 19 nt, Human
cccugagggaucagucacc

SEQ ID NO: 389631 - RNA, 24 nt, Human
ccgcggaaaggcgcgggaggggcg

SEQ ID NO: 389632 - RNA, 21 nt, Human
ccuauagucccagcuacucag

SEQ ID NO: 389633 - RNA, 22 nt, Human
ccuauagucccagcuacucagg

SEQ ID NO: 389634 - RNA, 23 nt, Human
ccuggccaacacggugaaacccc

SEQ ID NO: 389635 - RNA, 24 nt, Human
ccuggccaacacggugaaaccccg

SEQ ID NO: 389636 - RNA, 22 nt, Human
ccugggggacagagcaagacuc

SEQ ID NO: 389637 - RNA, 19 nt, Human
ccuguaaucccagcugcuc

SEQ ID NO: 389638 - RNA, 21 nt, Human
ccuguaaucccagcugcucgg

SEQ ID NO: 389639 - RNA, 22 nt, Human
ccugugaucccagcacuuuggg

SEQ ID NO: 389640 - RNA, 19 nt, Human
ccuguuggagguucaaaag

SEQ ID NO: 389641 - RNA, 25 nt, Human
ccuugcuacagacucuccauuccua

SEQ ID NO: 389642 - RNA, 22 nt, Human
cgaggaagggagagugcuuggu

SEQ ID NO: 389643 - RNA, 26 nt, Human
cgccacugcacuccagccugggggac

SEQ ID NO: 389644 - RNA, 20 nt, Human
cgccgucuggagcugagcag

SEQ ID NO: 389645 - RNA, 18 nt, Human
cgccuauagucccagcua

SEQ ID NO: 389646 - RNA, 24 nt, Human
cgccuauagucccagcuacucagg

SEQ ID NO: 389647 - RNA, 24 nt, Human
cgccuguaaucccagcugcucggg

SEQ ID NO: 389648 - RNA, 24 nt, Human
cgggaggcggagguugcagugagc

SEQ ID NO: 389649 - RNA, 24 nt, Human
cgggagguggagguugcagugagc

SEQ ID NO: 389650 - RNA, 23 nt, Human
cgucuaaaaaaaaaaaaaaaaug

SEQ ID NO: 389651 - RNA, 21 nt, Human
cucgagcgggaccucccaggg

SEQ ID NO: 389652 - RNA, 23 nt, Human
cugaugcccacuguccauccagc

SEQ ID NO: 389653 - RNA, 24 nt, Human
cuggaucccgcgcccggggguccg

SEQ ID NO: 389654 - RNA, 18 nt, Human
cuggccaacacggugaaa

SEQ ID NO: 389655 - RNA, 18 nt, Human
cuguguugaccuucacau

SEQ ID NO: 389656 - RNA, 23 nt, Human
cuuacgccuguaaucccagcugc

SEQ ID NO: 389657 - RNA, 25 nt, Human
gaaucaccugaggucaggaguucaa

SEQ ID NO: 389658 - RNA, 20 nt, Human
gagaugaaccccugggcaca

SEQ ID NO: 389659 - RNA, 23 nt, Human
gagauugcgccacugcacuccag

SEQ ID NO: 389660 - RNA, 23 nt, Human
gagguugcagugagccgagaucg

SEQ ID NO: 389661 - RNA, 23 nt, Human
gagguugcagugagcugagauug

SEQ ID NO: 389662 - RNA, 20 nt, Human
gcacaccuucagagaccuca

SEQ ID NO: 389663 - RNA, 24 nt, Human
gcacuccagccugggggacagagc

SEQ ID NO: 389664 - RNA, 18 nt, Human
gcaguggcuuacgccugu

SEQ ID NO: 389665 - RNA, 24 nt, Human
gccaacacggugaaaccccgucuc

SEQ ID NO: 389666 - RNA, 20 nt, Human
gccacuguacuccaggcugg

SEQ ID NO: 389667 - RNA, 23 nt, Human
gccuguaaucccagcugcucggg

SEQ ID NO: 389668 - RNA, 20 nt, Human
gcgcaguggcuuacgccugu

SEQ ID NO: 389669 - RNA, 19 nt, Human
gcgccgucuggagcugagc

SEQ ID NO: 389670 - RNA, 19 nt, Human
gcugggggcgggcagaggg

SEQ ID NO: 389671 - RNA, 23 nt, Human
ggaaggacgggcucgagcgggga

SEQ ID NO: 389672 - RNA, 19 nt, Human
ggaggcugaggcuggugaa

SEQ ID NO: 389673 - RNA, 20 nt, Human
ggagguugcagugagccgag

SEQ ID NO: 389674 - RNA, 22 nt, Human
ggagguugcagugagccgagau

SEQ ID NO: 389675 - RNA, 24 nt, Human
ggagguugcagugagccgagaucg

SEQ ID NO: 389676 - RNA, 22 nt, Human
ggagguugcagugagcugagau

SEQ ID NO: 389677 - RNA, 24 nt, Human
ggagguugcagugagcugagauug

SEQ ID NO: 389678 - RNA, 23 nt, Human
ggaugggaaaaaggggccgagga

SEQ ID NO: 389679 - RNA, 24 nt, Human
ggcagagggaggggaaggacgggc

SEQ ID NO: 389680 - RNA, 18 nt, Human
ggcgcaguggcuuacgcc

SEQ ID NO: 389681 - RNA, 23 nt, Human
ggcgcaguggcuuacgccuguaa

SEQ ID NO: 389682 - RNA, 21 nt, Human
ggcgcgcgccuauagucccag

SEQ ID NO: 389683 - RNA, 22 nt, Human
ggcgugguggcgcgcgccuaua

SEQ ID NO: 389684 - RNA, 22 nt, Human
gggaggcugaggcacgagaauc

SEQ ID NO: 389685 - RNA, 22 nt, Human
gggcagagggaggggaaggacg

SEQ ID NO: 389686 - RNA, 24 nt, Human
gggcaggcuggcacugguucaggc

SEQ ID NO: 389687 - RNA, 21 nt, Human
gggcugggggcgggcagaggg

SEQ ID NO: 389688 - RNA, 24 nt, Human
ggggcgagggcugggugcuggagc

SEQ ID NO: 389689 - RNA, 22 nt, Human
ggguggggcgagggcugggggc

SEQ ID NO: 389690 - RNA, 19 nt, Human
gguggagguugcagugagc

SEQ ID NO: 389691 - RNA, 24 nt, Human
ggugguucaugccugugaucccag

SEQ ID NO: 389692 - RNA, 24 nt, Human
guacuccaggcugggccacagagu

SEQ ID NO: 389693 - RNA, 20 nt, Human
guggagguugcagugagcug

SEQ ID NO: 389694 - RNA, 19 nt, Human
guggauccuucucacaugg

SEQ ID NO: 389695 - RNA, 23 nt, Human
guggauccuucucacaugguggc

SEQ ID NO: 389696 - RNA, 22 nt, Human
guugcaaccaacuccacugacc

SEQ ID NO: 389697 - RNA, 21 nt, Human
guugcagugagcugagauugc

SEQ ID NO: 389698 - RNA, 23 nt, Human
uaaaaaaaaaaaaaaaauggcca

SEQ ID NO: 389699 - RNA, 21 nt, Human
uaaaaccaaaggcagagauau

SEQ ID NO: 389700 - RNA, 21 nt, Human
uacaaaauggaaauacacgca

SEQ ID NO: 389701 - RNA, 22 nt, Human
uacacgcaucacagugacugug

SEQ ID NO: 389702 - RNA, 20 nt, Human
uacgccuguaaucccagcug

SEQ ID NO: 389703 - RNA, 20 nt, Human
uacuccaggcugggccacag

SEQ ID NO: 389704 - RNA, 22 nt, Human
uacuccaggcugggccacagag

SEQ ID NO: 389705 - RNA, 24 nt, Human
uacuccaggcugggccacagagug

SEQ ID NO: 389706 - RNA, 21 nt, Human
uaggaagauaaaaaugaccac

SEQ ID NO: 389707 - RNA, 21 nt, Human
uagggagaugaaccccugggc

SEQ ID NO: 389708 - RNA, 21 nt, Human
uauauaccauugauacauaug

SEQ ID NO: 389709 - RNA, 23 nt, Human
ucaccugaggucaggaguucaag

SEQ ID NO: 389710 - RNA, 23 nt, Human
ucaugccugugaucccagcacuu

SEQ ID NO: 389711 - RNA, 19 nt, Human
uccgaggggccaagggcuc

SEQ ID NO: 389712 - RNA, 22 nt, Human
uccgucuaaaaaaaaaaaaaaa

SEQ ID NO: 389713 - RNA, 23 nt, Human
uccgucuaaaaaaaaaaaaaaaa

SEQ ID NO: 389714 - RNA, 24 nt, Human
ucgcuugaacccgggaggcggagg

SEQ ID NO: 389715 - RNA, 24 nt, Human
ucgcuugaacccgggagguggagg

SEQ ID NO: 389716 - RNA, 24 nt, Human
ucgggaggcugaggcacgagaauc

SEQ ID NO: 389717 - RNA, 20 nt, Human
ucuaaaaaaaaaaauagcaa

SEQ ID NO: 389718 - RNA, 23 nt, Human
ucucuacuaaaaauacaaaaauu

SEQ ID NO: 389719 - RNA, 24 nt, Human
ugaaucaccugaggucaggaguuc

SEQ ID NO: 389720 - RNA, 26 nt, Human
ugaaucaccugaggucaggaguucaa

SEQ ID NO: 389721 - RNA, 22 nt, Human
ugagccgagaucgugccacugu

SEQ ID NO: 389722 - RNA, 22 nt, Human
ugagcugagauugcgccacugc

SEQ ID NO: 389723 - RNA, 24 nt, Human
ugaggcacgagaaucgcuugaacc

SEQ ID NO: 389724 - RNA, 20 nt, Human
ugaggcaggagaaucgcuug

SEQ ID NO: 389725 - RNA, 24 nt, Human
ugaggcaggagaaucgcuugaacc

SEQ ID NO: 389726 - RNA, 25 nt, Human
ugaggcaggagaaucgcuugaaccc

SEQ ID NO: 389727 - RNA, 20 nt, Human
ugaggcuggugaaucaccug

SEQ ID NO: 389728 - RNA, 24 nt, Human
ugaggcuggugaaucaccugaggu

SEQ ID NO: 389729 - RNA, 26 nt, Human
ugaggcuggugaaucaccugagguca

SEQ ID NO: 389730 - RNA, 22 nt, Human
ugagucagucuggcugugacca

SEQ ID NO: 389731 - RNA, 23 nt, Human
ugccugugaucccagcacuuugg

SEQ ID NO: 389732 - RNA, 23 nt, Human
ugccugugaucccagcacuuugg

SEQ ID NO: 389733 - RNA, 22 nt, Human
ugcggggcucccaccuggcugg

SEQ ID NO: 389734 - RNA, 25 nt, Human
ugcuacagacucuccauuccuagga

SEQ ID NO: 389735 - RNA, 18 nt, Human
ugcugcagacagggcagg

SEQ ID NO: 389736 - RNA, 20 nt, Human
ugcugcugaugcccacuguc

SEQ ID NO: 389737 - RNA, 18 nt, Human
uggagcugagcaggcaga

SEQ ID NO: 389738 - RNA, 18 nt, Human
uggagguugcagugagcu

SEQ ID NO: 389739 - RNA, 19 nt, Human
uggcaagaaaagggggugc

SEQ ID NO: 389740 - RNA, 24 nt, Human
uggccagguguggugguucaugcc

SEQ ID NO: 389741 - RNA, 25 nt, Human
uggcugggaacagaggccgagacaa

SEQ ID NO: 389742 - RNA, 18 nt, Human
uggcugguuauuagggag

SEQ ID NO: 389743 - RNA, 20 nt, Human
uggcugugaccaggggcggg

SEQ ID NO: 389744 - RNA, 21 nt, Human
uggcuuacgccuguaauccca

SEQ ID NO: 389745 - RNA, 22 nt, Human
uggcuuacgccuguaaucccag

SEQ ID NO: 389746 - RNA, 19 nt, Human
ugggaacagaggccgagac

SEQ ID NO: 389747 - RNA, 19 nt, Human
ugggaggcugaggcuggug

SEQ ID NO: 389748 - RNA, 24 nt, Human
ugggaggcugaggcuggugaauca

SEQ ID NO: 389749 - RNA, 19 nt, Human
uggggucaacccaaaaccc

SEQ ID NO: 389750 - RNA, 24 nt, Human
uggggucaacccaaaacccugcug

SEQ ID NO: 389751 - RNA, 23 nt, Human
uggugaaucaccugaggucagga

SEQ ID NO: 389752 - RNA, 24 nt, Human
uggugguucaugccugugauccca

SEQ ID NO: 389753 - RNA, 24 nt, Human
ugguucaugccugugaucccagca

SEQ ID NO: 389754 - RNA, 21 nt, Human
ugucauaaucagcugaccaag

SEQ ID NO: 389755 - RNA, 18 nt, Human
uuaaagccacucaucaaa

SEQ ID NO: 389756 - RNA, 18 nt, Human
uuagccgggcgugguggc

SEQ ID NO: 389757 - RNA, 20 nt, Human
uuagccgggcgugguggcgc

SEQ ID NO: 389758 - RNA, 20 nt, Human
uuagccgggcgugguggcgc

SEQ ID NO: 389759 - RNA, 18 nt, Human
uucacauuggaggcccuu

SEQ ID NO: 389760 - RNA, 23 nt, Human
uucaugccugugaucccagcacu

SEQ ID NO: 389761 - RNA, 18 nt, Human
uuccuaggaugcuguugg

SEQ ID NO: 389762 - RNA, 24 nt, Human
uugaacccgggaggcggagguugc

SEQ ID NO: 389763 - RNA, 24 nt, Human
uugaacccgggagguggagguugc

SEQ ID NO: 389764 - RNA, 22 nt, Human
uugcagugagccgagaucgugc

SEQ ID NO: 389765 - RNA, 23 nt, Human
uugcagugagccgagaucgugcc

SEQ ID NO: 389766 - RNA, 19 nt, Human
uugcagugagcugagauug

SEQ ID NO: 389767 - RNA, 22 nt, Human
uugcagugagcugagauugcgc

SEQ ID NO: 389768 - RNA, 23 nt, Human
uugcgccacugcacuccagccug

SEQ ID NO: 389769 - RNA, 18 nt, Human
uuggaggcccuugcuaca

SEQ ID NO: 389770 - RNA, 20 nt, Human
uugggaggcugaggcuggug

SEQ ID NO: 389771 - RNA, 25 nt, Human
uugggaggcugaggcuggugaauca

SEQ ID NO: 389772 - RNA, 24 nt, Human
aacaggcaaccaagcaaacaucac

SEQ ID NO: 389773 - RNA, 22 nt, Human
aaccaagcaaacaucacaugga

SEQ ID NO: 389774 - RNA, 24 nt, Human
aaggaagaggagggcacaacaaag

SEQ ID NO: 389775 - RNA, 19 nt, Human
agaggaaggaagaggaggg

SEQ ID NO: 389776 - RNA, 21 nt, Human
agaggagggcacaacaaaggg

SEQ ID NO: 389777 - RNA, 25 nt, Human
caaugugcucuuucucagagugucu

SEQ ID NO: 389778 - RNA, 22 nt, Human
cagugacauuuuuccaaaauuc

SEQ ID NO: 389779 - RNA, 22 nt, Human
cagugacauuuuuccaaaauuc

SEQ ID NO: 389780 - RNA, 19 nt, Human
ccaagcaaacaucacaugg

SEQ ID NO: 389781 - RNA, 22 nt, Human
ccacccggcagccuucuguguc

SEQ ID NO: 389782 - RNA, 18 nt, Human
ccagagugguggucuucc

SEQ ID NO: 389783 - RNA, 21 nt, Human
cccuccccccacccggcagcc

SEQ ID NO: 389784 - RNA, 20 nt, Human
cccuuaugggaaccgugcuc

SEQ ID NO: 389785 - RNA, 20 nt, Human
ccuccccccacccggcagcc

SEQ ID NO: 389786 - RNA, 20 nt, Human
ccuccccccacccggcagcc

SEQ ID NO: 389787 - RNA, 20 nt, Human
ccuccccccacccggcagcc

SEQ ID NO: 389788 - RNA, 20 nt, Human
ccucugagaccccagagugg

SEQ ID NO: 389789 - RNA, 23 nt, Human
ccucugagaccccagaguggugg

SEQ ID NO: 389790 - RNA, 18 nt, Human
cggcagccuucuguguca

SEQ ID NO: 389791 - RNA, 21 nt, Human
cugcagguagaaaagggaaca

SEQ ID NO: 389792 - RNA, 23 nt, Human
gcccuuaugggaaccgugcucug

SEQ ID NO: 389793 - RNA, 28 nt, Human
ggaaggaagaggagggcacaacaaaggg

SEQ ID NO: 389794 - RNA, 18 nt, Human
gggaacaggcaaccaagc

SEQ ID NO: 389795 - RNA, 20 nt, Human
ggguuucaguguaaaggaau

SEQ ID NO: 389796 - RNA, 19 nt, Human
gguuucaguguaaaggaau

SEQ ID NO: 389797 - RNA, 18 nt, Human
uaaaggaaugaaucagca

SEQ ID NO: 389798 - RNA, 22 nt, Human
ucccuauaaagaggaaggaaga

SEQ ID NO: 389799 - RNA, 24 nt, Human
uccucugagaccccagaguggugg

SEQ ID NO: 389800 - RNA, 23 nt, Human
ucugcagguagaaaagggaacag

SEQ ID NO: 389801 - RNA, 18 nt, Human
ugagacaggaggcugauc

SEQ ID NO: 389802 - RNA, 22 nt, Human
ugauauagacaccauuuuuugg

SEQ ID NO: 389803 - RNA, 19 nt, Human
aacucugggcaaacuacaa

SEQ ID NO: 389804 - RNA, 18 nt, Human
aagggcccagcccagggc

SEQ ID NO: 389805 - RNA, 21 nt, Human
agauuccccucacauuuuccu

SEQ ID NO: 389806 - RNA, 25 nt, Human
agccaggaagggcccagcccagggc

SEQ ID NO: 389807 - RNA, 21 nt, Human
auccuugccucugcccuuuuc

SEQ ID NO: 389808 - RNA, 22 nt, Human
caaagcagccauggccagcagc

SEQ ID NO: 389809 - RNA, 24 nt, Human
cacagcggagcccaagucacaguc

SEQ ID NO: 389810 - RNA, 18 nt, Human
caccaguaccuuuugucc

SEQ ID NO: 389811 - RNA, 18 nt, Human
caccauccuugccucugc

SEQ ID NO: 389812 - RNA, 19 nt, Human
caccucccccucccuccca

SEQ ID NO: 389813 - RNA, 22 nt, Human
cagcagcuccccuccacagucc

SEQ ID NO: 389814 - RNA, 22 nt, Human
cagcccagggcgggcacagcgg

SEQ ID NO: 389815 - RNA, 20 nt, Human
cauccuugccucugcccuuu

SEQ ID NO: 389816 - RNA, 24 nt, Human
ccaacucugggcaaacuacaaagc

SEQ ID NO: 389817 - RNA, 24 nt, Human
ccagggcgggcacagcggagccca

SEQ ID NO: 389818 - RNA, 21 nt, Human
ccauggccagcagcuccccuc

SEQ ID NO: 389819 - RNA, 22 nt, Human
cccaccauccuugccucugccc

SEQ ID NO: 389820 - RNA, 19 nt, Human
ccccaccauccuugccucu

SEQ ID NO: 389821 - RNA, 24 nt, Human
ccccccuccccuagcccccaacuc

SEQ ID NO: 389822 - RNA, 23 nt, Human
cccccuccccuagcccccaacuc

SEQ ID NO: 389823 - RNA, 28 nt, Human
cccccuccccuagcccccaacucugggc

SEQ ID NO: 389824 - RNA, 18 nt, Human
ccccucccucccagcuuc

SEQ ID NO: 389825 - RNA, 19 nt, Human
ccucccagcuucuucugcc

SEQ ID NO: 389826 - RNA, 22 nt, Human
gccacccucccuuugggaacuc

SEQ ID NO: 389827 - RNA, 21 nt, Human
gcccacugucucugccacccu

SEQ ID NO: 389828 - RNA, 19 nt, Human
gcccuuuucaccucccccu

SEQ ID NO: 389829 - RNA, 28 nt, Human
gccucuggcuccccccuccccuagcccc

SEQ ID NO: 389830 - RNA, 21 nt, Human
ggaacucagggggcucaggca

SEQ ID NO: 389831 - RNA, 22 nt, Human
ggcuccccccuccccuagcccc

SEQ ID NO: 389832 - RNA, 19 nt, Human
gggccccaccauccuugcc

SEQ ID NO: 389833 - RNA, 21 nt, Human
ggugcugggggccccaccauc

SEQ ID NO: 389834 - RNA, 20 nt, Human
guccuagccaggaagggccc

SEQ ID NO: 389835 - RNA, 19 nt, Human
uccccccuccccuagcccc

SEQ ID NO: 389836 - RNA, 21 nt, Human
uccccuagcccccaacucugg

SEQ ID NO: 389837 - RNA, 22 nt, Human
ucccucccagcuucuucugccc

SEQ ID NO: 389838 - RNA, 30 nt, Human
uccuagccaggaagggcccagcccagggcc

SEQ ID NO: 389839 - RNA, 24 nt, Human
uccucagcugugcuggcccccaac

SEQ ID NO: 389840 - RNA, 25 nt, Human
ugcccuuuucaccucccccucccuc

SEQ ID NO: 389841 - RNA, 21 nt, Human
ugccucugcccuuuucaccuc

SEQ ID NO: 389842 - RNA, 21 nt, Human
uggcccccaacucuccacccu

SEQ ID NO: 389843 - RNA, 24 nt, Human
uggcuccccccuccccuagccccc

SEQ ID NO: 389844 - RNA, 27 nt, Human
uggcuccccccuccccuagcccccaac

SEQ ID NO: 389845 - RNA, 23 nt, Human
ugggaacucagggggcucaggca

SEQ ID NO: 389846 - RNA, 22 nt, Human
ugggcaaacuacaaagcagcca

SEQ ID NO: 389847 - RNA, 23 nt, Human
ugggggccccaccauccuugccu

SEQ ID NO: 389848 - RNA, 24 nt, Human
uuccuggaucagggccacuccucc

SEQ ID NO: 389849 - RNA, 18 nt, Human
aaaaacaaagucuaacuc

SEQ ID NO: 389850 - RNA, 19 nt, Human
aaacaaagucuaacucaag

SEQ ID NO: 389851 - RNA, 18 nt, Human
aaacagaaaaaaugguac

SEQ ID NO: 389852 - RNA, 26 nt, Human
aaacagaaaaaaugguacacacuuua

SEQ ID NO: 389853 - RNA, 26 nt, Human
aaacagguaaauuaacaggaaaacca

SEQ ID NO: 389854 - RNA, 20 nt, Human
aacaaaaucuucaacuauga

SEQ ID NO: 389855 - RNA, 21 nt, Human
aacuuacuuauaaaaacagaa

SEQ ID NO: 389856 - RNA, 23 nt, Human
aagaacaaguaauauacauguac

SEQ ID NO: 389857 - RNA, 21 nt, Human
aagacacagcaggagcgaccg

SEQ ID NO: 389858 - RNA, 19 nt, Human
aauagcuauacuacacuaa

SEQ ID NO: 389859 - RNA, 21 nt, Human
acacauuauaaagucaaacag

SEQ ID NO: 389860 - RNA, 22 nt, Human
acuaaaacacauuauaaaguca

SEQ ID NO: 389861 - RNA, 21 nt, Human
acuacacuaagaugcuaaaca

SEQ ID NO: 389862 - RNA, 18 nt, Human
agaaaaagucagcaaaua

SEQ ID NO: 389863 - RNA, 23 nt, Human
agaaagaagaaauauugccaaga

SEQ ID NO: 389864 - RNA, 21 nt, Human
aggucuuucuacgggugccug

SEQ ID NO: 389865 - RNA, 19 nt, Human
auauuugguaaaccuaaaa

SEQ ID NO: 389866 - RNA, 26 nt, Human
augcaauaagaaauuggaaaaaggga

SEQ ID NO: 389867 - RNA, 20 nt, Human
caacuaugaacugacaaaau

SEQ ID NO: 389868 - RNA, 20 nt, Human
caaguaauauacauguacaa

SEQ ID NO: 389869 - RNA, 19 nt, Human
cacagcaggagcgaccccc

SEQ ID NO: 389870 - RNA, 19 nt, Human
caccaccgcaggcccgggc

SEQ ID NO: 389871 - RNA, 18 nt, Human
caccgcaggcccgggccu

SEQ ID NO: 389872 - RNA, 24 nt, Human
cacuuuaacaaaagcaaaacuuaa

SEQ ID NO: 389873 - RNA, 21 nt, Human
caggaaaaccaaacugaucuc

SEQ ID NO: 389874 - RNA, 21 nt, Human
cauauuugguaaaccuaaaau

SEQ ID NO: 389875 - RNA, 20 nt, Human
cauuuuagauaagcugguca

SEQ ID NO: 389876 - RNA, 21 nt, Human
cccccaccaccgcaggcccgg

SEQ ID NO: 389877 - RNA, 22 nt, Human
ccgcgcccaccccgcuggcaag

SEQ ID NO: 389878 - RNA, 22 nt, Human
ccgcgcccaccccgcuggcaag

SEQ ID NO: 389879 - RNA, 22 nt, Human
cgaaucaaaaucuagucaugaa

SEQ ID NO: 389880 - RNA, 21 nt, Human
cggcaggucuucuccgcgccc

SEQ ID NO: 389881 - RNA, 18 nt, Human
cucaaguugcuuuaaaaa

SEQ ID NO: 389882 - RNA, 20 nt, Human
cucacaaacgaagcccgcgg

SEQ ID NO: 389883 - RNA, 19 nt, Human
cuccaaacagaaaaaaugg

SEQ ID NO: 389884 - RNA, 18 nt, Human
cuccggcaggucuucucc

SEQ ID NO: 389885 - RNA, 19 nt, Human
cuuaacauggacauuuaaa

SEQ ID NO: 389886 - RNA, 24 nt, Human
gaagacacagcaggagcgaccccc

SEQ ID NO: 389887 - RNA, 22 nt, Human
gacccccggcgcgcagcaaccc

SEQ ID NO: 389888 - RNA, 24 nt, Human
gacccccggcgcgcagcaaccccc

SEQ ID NO: 389889 - RNA, 18 nt, Human
ggaagacacagcaggagc

SEQ ID NO: 389890 - RNA, 21 nt, Human
ggcgcgcagcaacccccacca

SEQ ID NO: 389891 - RNA, 21 nt, Human
gggcgaagcuggagcggaaga

SEQ ID NO: 389892 - RNA, 21 nt, Human
guccuuaagauuaauccuugg

SEQ ID NO: 389893 - RNA, 23 nt, Human
uaaagcuaguuacaaaauccguu

SEQ ID NO: 389894 - RNA, 26 nt, Human
uaaagucuuguuuccaaaaaucuauu

SEQ ID NO: 389895 - RNA, 18 nt, Human
uaacagagaguaacagaa

SEQ ID NO: 389896 - RNA, 22 nt, Human
uaacauggacauuuaaaaaugc

SEQ ID NO: 389897 - RNA, 20 nt, Human
uaagaaagaagaaauauugc

SEQ ID NO: 389898 - RNA, 18 nt, Human
uaagaaauuggaaaaagg

SEQ ID NO: 389899 - RNA, 23 nt, Human
uacaugccaauauggaaaaaaaa

SEQ ID NO: 389900 - RNA, 19 nt, Human
uacauguacaagaaauuac

SEQ ID NO: 389901 - RNA, 23 nt, Human
uacauguacaagaaauuacaaga

SEQ ID NO: 389902 - RNA, 22 nt, Human
uaggucaaaaacaaagucuaac

SEQ ID NO: 389903 - RNA, 23 nt, Human
uagugggaaguucucaucuuugc

SEQ ID NO: 389904 - RNA, 24 nt, Human
ucaaaaacaaagucuaacucaagu

SEQ ID NO: 389905 - RNA, 21 nt, Human
ucacaguguaaaagaaaaaaa

SEQ ID NO: 389906 - RNA, 24 nt, Human
uccaaacagaaaaaaugguacaca

SEQ ID NO: 389907 - RNA, 21 nt, Human
ucccuacugaucugaaacuac

SEQ ID NO: 389908 - RNA, 23 nt, Human
ucccuacugaucugaaacuacag

SEQ ID NO: 389909 - RNA, 23 nt, Human
uccuuggucaguauagauuuccg

SEQ ID NO: 389910 - RNA, 20 nt, Human
ugcaaaacuaaaacacauua

SEQ ID NO: 389911 - RNA, 25 nt, Human
uggaaaaagggagcaaaggagagug

SEQ ID NO: 389912 - RNA, 22 nt, Human
uggaaagaccaccgcuuuaaug

SEQ ID NO: 389913 - RNA, 18 nt, Human
uggcaaggggaagugggc

SEQ ID NO: 389914 - RNA, 24 nt, Human
uguucaacaaucucacucauugac

SEQ ID NO: 389915 - RNA, 21 nt, Human
uuuaaaauggaucacuuaauu

SEQ ID NO: 389916 - RNA, 24 nt, Human
uuuccaaaaaucuauuaagaacaa

SEQ ID NO: 389917 - RNA, 20 nt, Human
aagagaaaaaccgaagacga

SEQ ID NO: 389918 - RNA, 23 nt, Human
aagaggauuaaaaauaaagaaaa

SEQ ID NO: 389919 - RNA, 18 nt, Human
agagaaaaaccgaagacg

SEQ ID NO: 389920 - RNA, 20 nt, Human
agagcaaagaaaaaagaaac

SEQ ID NO: 389921 - RNA, 25 nt, Human
caaaaaaccacaaacuggguaguaa

SEQ ID NO: 389922 - RNA, 20 nt, Human
caacucaugauaaagauaau

SEQ ID NO: 389923 - RNA, 22 nt, Human
cauacaggcuaaucaauacagu

SEQ ID NO: 389924 - RNA, 25 nt, Human
cgggaggcugacgagagccgggagg

SEQ ID NO: 389925 - RNA, 26 nt, Human
cucgagcuacaacuacacaugcaaug

SEQ ID NO: 389926 - RNA, 21 nt, Human
cuuucuggguuuuaccacaua

SEQ ID NO: 389927 - RNA, 20 nt, Human
gcgaaggaagagaaaaaccg

SEQ ID NO: 389928 - RNA, 23 nt, Human
guuacauuucucccaaaaaacca

SEQ ID NO: 389929 - RNA, 19 nt, Human
uaaaaagaugacaucccac

SEQ ID NO: 389930 - RNA, 19 nt, Human
uaaacagagcagugcaacu

SEQ ID NO: 389931 - RNA, 22 nt, Human
uaacugagucucuaggcaauau

SEQ ID NO: 389932 - RNA, 19 nt, Human
uaggcaauauauuuaaaac

SEQ ID NO: 389933 - RNA, 24 nt, Human
ucauacuagaagaaacuuggccgu

SEQ ID NO: 389934 - RNA, 20 nt, Human
ucucccaaaaaaccacaaac

SEQ ID NO: 389935 - RNA, 23 nt, Human
ugaaaguaucuugcauucaugau

SEQ ID NO: 389936 - RNA, 23 nt, Human
ugacugcaggaggcuggaagaca

SEQ ID NO: 389937 - RNA, 19 nt, Human
ugauggaugcuuucugggu

SEQ ID NO: 389938 - RNA, 22 nt, Human
ugcaaugaagggagcccugcua

SEQ ID NO: 389939 - RNA, 18 nt, Human
ugcuuuacaaaaaaggga

SEQ ID NO: 389940 - RNA, 24 nt, Human
uuagcgaaggaagagaaaaaccga

SEQ ID NO: 389941 - RNA, 21 nt, Human
uucagagcaaagaaaaaagaa

SEQ ID NO: 389942 - RNA, 22 nt, Human
uucagagcaaagaaaaaagaaa

SEQ ID NO: 389943 - RNA, 25 nt, Human
uucagagcaaagaaaaaagaaacuu

SEQ ID NO: 389944 - RNA, 20 nt, Human
uucuccacaugggaacacua

SEQ ID NO: 389945 - RNA, 27 nt, Human
uuuuuugcaaguuguuuuauuuucaau

SEQ ID NO: 389946 - RNA, 21 nt, Human
aaaauccucagugagacagag

SEQ ID NO: 389947 - RNA, 19 nt, Human
aaagugugcuccaggcagg

SEQ ID NO: 389948 - RNA, 20 nt, Human
aagaugcuaaugaacaacaa

SEQ ID NO: 389949 - RNA, 19 nt, Human
aaugaacaacaaaaguaua

SEQ ID NO: 389950 - RNA, 22 nt, Human
aauuccauuccccaacccccac

SEQ ID NO: 389951 - RNA, 18 nt, Human
agacucggagaccaaaag

SEQ ID NO: 389952 - RNA, 20 nt, Human
aggcagggaggcggggcugu

SEQ ID NO: 389953 - RNA, 19 nt, Human
aggcggggcuguggcacgc

SEQ ID NO: 389954 - RNA, 18 nt, Human
ccccaacccccacugucc

SEQ ID NO: 389955 - RNA, 22 nt, Human
ccccacuguccuuguauuccug

SEQ ID NO: 389956 - RNA, 24 nt, Human
ccccacuguccuuguauuccugcc

SEQ ID NO: 389957 - RNA, 24 nt, Human
cccccacuguccuuguauuccugc

SEQ ID NO: 389958 - RNA, 22 nt, Human
ccuuuaaaauccucagugagac

SEQ ID NO: 389959 - RNA, 23 nt, Human
cgucuuauaguuuacaaagauug

SEQ ID NO: 389960 - RNA, 23 nt, Human
cuaaugaacaacaaaaguauaaa

SEQ ID NO: 389961 - RNA, 24 nt, Human
gcuucacaucuucagaauucuaaa

SEQ ID NO: 389962 - RNA, 24 nt, Human
guagaauuccauuccccaaccccc

SEQ ID NO: 389963 - RNA, 24 nt, Human
uaauugaccuuuaaaauccucagu

SEQ ID NO: 389964 - RNA, 22 nt, Human
uagaauuccauuccccaacccc

SEQ ID NO: 389965 - RNA, 23 nt, Human
uagaauuccauuccccaaccccc

SEQ ID NO: 389966 - RNA, 22 nt, Human
ucacaucuucagaauucuaaag

SEQ ID NO: 389967 - RNA, 28 nt, Human
uccccaacccccacuguccuuguauucc

SEQ ID NO: 389968 - RNA, 20 nt, Human
uccucagugagacagaggcu

SEQ ID NO: 389969 - RNA, 24 nt, Human
uccucagugagacagaggcuucac

SEQ ID NO: 389970 - RNA, 20 nt, Human
ugaccuuuaaaauccucagu

SEQ ID NO: 389971 - RNA, 19 nt, Human
uuccugccuccccagauuc

SEQ ID NO: 389972 - RNA, 21 nt, Human
aaaaaccugaaaauuggcuca

SEQ ID NO: 389973 - RNA, 24 nt, Human
aaaaaucaaaacaaaacaaacccc

SEQ ID NO: 389974 - RNA, 19 nt, Human
aaacaaaacaaaccccaac

SEQ ID NO: 389975 - RNA, 23 nt, Human
aaacaggaguauaguuuacaaga

SEQ ID NO: 389976 - RNA, 20 nt, Human
aagguaaaaguauuguccau

SEQ ID NO: 389977 - RNA, 25 nt, Human
acaaagaaaagcauaaauauuucca

SEQ ID NO: 389978 - RNA, 20 nt, Human
acauaaaucuucucuuaggc

SEQ ID NO: 389979 - RNA, 27 nt, Human
agaaacacccagaaagguaagggaguc

SEQ ID NO: 389980 - RNA, 18 nt, Human
agaauauugauaaagauc

SEQ ID NO: 389981 - RNA, 20 nt, Human
aggaguauaguuuacaagaa

SEQ ID NO: 389982 - RNA, 18 nt, Human
agugaacaaauaaaacua

SEQ ID NO: 389983 - RNA, 21 nt, Human
aguuuacaagaaacacccaga

SEQ ID NO: 389984 - RNA, 24 nt, Human
aucuuuagagacaaagguaaaagu

SEQ ID NO: 389985 - RNA, 20 nt, Human
caaaacaaaacaaaccccaa

SEQ ID NO: 389986 - RNA, 22 nt, Human
caaaugcuucuccuucuguuug

SEQ ID NO: 389987 - RNA, 24 nt, Human
cacauauauguaaaaaccugaaaa

SEQ ID NO: 389988 - RNA, 20 nt, Human
ccacaccucauaaaaggaug

SEQ ID NO: 389989 - RNA, 21 nt, Human
cuaaacaacaagacucggucu

SEQ ID NO: 389990 - RNA, 18 nt, Human
cuuccacaccucauaaaa

SEQ ID NO: 389991 - RNA, 18 nt, Human
cuuccacaccucauaaaa

SEQ ID NO: 389992 - RNA, 28 nt, Human
uaaaaaaaaaaaaucaaaacaaaacaaa

SEQ ID NO: 389993 - RNA, 19 nt, Human
uacaagaaacacccagaaa

SEQ ID NO: 389994 - RNA, 23 nt, Human
uacaagaaacacccagaaaggua

SEQ ID NO: 389995 - RNA, 22 nt, Human
uauuaacacugcuaggaagaac

SEQ ID NO: 389996 - RNA, 21 nt, Human
ucaccaagucacugacuucca

SEQ ID NO: 389997 - RNA, 21 nt, Human
ugcacauauauguaaaaaccu

SEQ ID NO: 389998 - RNA, 21 nt, Human
ugcaucuggcaaguucaagcc

SEQ ID NO: 389999 - RNA, 19 nt, Human
uguaaaaaccugaaaauug

SEQ ID NO: 390000 - RNA, 23 nt, Human
uguuuucucuuuuacccgcuuua

SEQ ID NO: 390001 - RNA, 21 nt, Human
uugaauagaugccccuaugga

SEQ ID NO: 390002 - RNA, 21 nt, Human
aaagcuggaggucauggggcc

SEQ ID NO: 390003 - RNA, 24 nt, Human
aagcaggcaguacaggccccaggg

SEQ ID NO: 390004 - RNA, 24 nt, Human
accccaggccuuuuccugaauccc

SEQ ID NO: 390005 - RNA, 21 nt, Human
acgaagcagcgacagucccuc

SEQ ID NO: 390006 - RNA, 19 nt, Human
agagcccugccugccuucc

SEQ ID NO: 390007 - RNA, 18 nt, Human
agccccgaaguagccuuc

SEQ ID NO: 390008 - RNA, 21 nt, Human
agcuacuccugccccaaacaa

SEQ ID NO: 390009 - RNA, 18 nt, Human
agcugccccaccaggacc

SEQ ID NO: 390010 - RNA, 19 nt, Human
aggcaguacaggccccagg

SEQ ID NO: 390011 - RNA, 22 nt, Human
agggcagggucugcagggcgcu

SEQ ID NO: 390012 - RNA, 18 nt, Human
agguucucagcagcaggc

SEQ ID NO: 390013 - RNA, 20 nt, Human
auaaacgugccacucgcccc

SEQ ID NO: 390014 - RNA, 19 nt, Human
cacaggccuguguccugag

SEQ ID NO: 390015 - RNA, 20 nt, Human
cacaggcuccuuugucccuc

SEQ ID NO: 390016 - RNA, 21 nt, Human
caccccaggccuuuuccugaa

SEQ ID NO: 390017 - RNA, 25 nt, Human
cacgacccccuccugugcaccccga

SEQ ID NO: 390018 - RNA, 21 nt, Human
cagccccgaaguagccuuccc

SEQ ID NO: 390019 - RNA, 18 nt, Human
cagcuuggccaguucccc

SEQ ID NO: 390020 - RNA, 20 nt, Human
caggaaggaguggcccggug

SEQ ID NO: 390021 - RNA, 22 nt, Human
caggaguaaggacgacuuccca

SEQ ID NO: 390022 - RNA, 22 nt, Human
caggcuucugaguguuaguccu

SEQ ID NO: 390023 - RNA, 23 nt, Human
caguagaggcaggaggccaggcu

SEQ ID NO: 390024 - RNA, 18 nt, Human
caucagagcagagugggg

SEQ ID NO: 390025 - RNA, 23 nt, Human
ccaccaggaccuggacuuggcac

SEQ ID NO: 390026 - RNA, 21 nt, Human
ccaggaagggccacgguugcu

SEQ ID NO: 390027 - RNA, 22 nt, Human
ccagggcucuccauaggcccag

SEQ ID NO: 390028 - RNA, 21 nt, Human
ccaguuccccggcccugcuca

SEQ ID NO: 390029 - RNA, 25 nt, Human
ccaguuccccggcccugcucagcug

SEQ ID NO: 390030 - RNA, 23 nt, Human
ccccaaacaagggcagggucugc

SEQ ID NO: 390031 - RNA, 24 nt, Human
ccccaagcaggcaguacaggcccc

SEQ ID NO: 390032 - RNA, 21 nt, Human
ccccagggcccaggugccgug

SEQ ID NO: 390033 - RNA, 24 nt, Human
cccccaagcaggcaguacaggccc

SEQ ID NO: 390034 - RNA, 23 nt, Human
ccuccuggcagugcucaggaccu

SEQ ID NO: 390035 - RNA, 18 nt, Human
ccuccugugcaccccgag

SEQ ID NO: 390036 - RNA, 21 nt, Human
ccugugcaccccgagcagccu

SEQ ID NO: 390037 - RNA, 24 nt, Human
cgccccggcuggcuacaagcugca

SEQ ID NO: 390038 - RNA, 21 nt, Human
cgccucagagcccucccuuuc

SEQ ID NO: 390039 - RNA, 23 nt, Human
cucagcuuggccaguuccccggc

SEQ ID NO: 390040 - RNA, 23 nt, Human
cucaggaccucagacuccucagg

SEQ ID NO: 390041 - RNA, 21 nt, Human
cuccacggguuggggcgccuc

SEQ ID NO: 390042 - RNA, 19 nt, Human
cuccauaggcccaggcugg

SEQ ID NO: 390043 - RNA, 27 nt, Human
cuccuugacuuuacuaaaaguuaaaua

SEQ ID NO: 390044 - RNA, 21 nt, Human
cuuggcacggguugcgaggcu

SEQ ID NO: 390045 - RNA, 20 nt, Human
gacccccuccugugcacccc

SEQ ID NO: 390046 - RNA, 23 nt, Human
gaguguuaguccuguccacacag

SEQ ID NO: 390047 - RNA, 19 nt, Human
gauccagggccucucagag

SEQ ID NO: 390048 - RNA, 19 nt, Human
gaugcaucagagcagagug

SEQ ID NO: 390049 - RNA, 18 nt, Human
gcucccacaggaguaagg

SEQ ID NO: 390050 - RNA, 23 nt, Human
ggaguuggggcaggaaggagugg

SEQ ID NO: 390051 - RNA, 20 nt, Human
ggcaggaaggaguggcccgg

SEQ ID NO: 390052 - RNA, 19 nt, Human
ggcaggcucagguccucca

SEQ ID NO: 390053 - RNA, 18 nt, Human
gggaagaaauacaggaaa

SEQ ID NO: 390054 - RNA, 25 nt, Human
gggagagggaaucgcuggggauggg

SEQ ID NO: 390055 - RNA, 19 nt, Human
gggcucuccauaggcccag

SEQ ID NO: 390056 - RNA, 23 nt, Human
ggucauggggccugggagaggga

SEQ ID NO: 390057 - RNA, 21 nt, Human
guagcggucccagggcucucc

SEQ ID NO: 390058 - RNA, 21 nt, Human
guguagcggucccagggcucu

SEQ ID NO: 390059 - RNA, 21 nt, Human
uacuccugccccaaacaaggg

SEQ ID NO: 390060 - RNA, 24 nt, Human
uacuccugccccaaacaagggcug

SEQ ID NO: 390061 - RNA, 22 nt, Human
uagcuucggccucccugggcuc

SEQ ID NO: 390062 - RNA, 18 nt, Human
ucacagcuacacaggccu

SEQ ID NO: 390063 - RNA, 19 nt, Human
ucacagcuacacaggccug

SEQ ID NO: 390064 - RNA, 18 nt, Human
ucauaggccgcccccuuc

SEQ ID NO: 390065 - RNA, 21 nt, Human
uccacggguuggggcgccuca

SEQ ID NO: 390066 - RNA, 19 nt, Human
ucccagccccgaaguagcc

SEQ ID NO: 390067 - RNA, 20 nt, Human
uccugaaucccaggguagac

SEQ ID NO: 390068 - RNA, 22 nt, Human
uccugagaaguguggcugccag

SEQ ID NO: 390069 - RNA, 21 nt, Human
uccuggguucacaggcuccuu

SEQ ID NO: 390070 - RNA, 20 nt, Human
ucgcuggggaugggaagacc

SEQ ID NO: 390071 - RNA, 20 nt, Human
ucuccauaggcccaggcugg

SEQ ID NO: 390072 - RNA, 20 nt, Human
ucuccugggcaccucagcuu

SEQ ID NO: 390073 - RNA, 18 nt, Human
uggaaggaguuggggcag

SEQ ID NO: 390074 - RNA, 18 nt, Human
uggcaugugggucacuag

SEQ ID NO: 390075 - RNA, 20 nt, Human
uggcaugugggucacuagcu

SEQ ID NO: 390076 - RNA, 21 nt, Human
ugggaagaaauacaggaaagc

SEQ ID NO: 390077 - RNA, 25 nt, Human
uggggucaccucuuucuucuccugg

SEQ ID NO: 390078 - RNA, 19 nt, Human
uggguacauuggugacaga

SEQ ID NO: 390079 - RNA, 21 nt, Human
uguccacacagguagcuccug

SEQ ID NO: 390080 - RNA, 18 nt, Human
uguccuggguucacaggc

SEQ ID NO: 390081 - RNA, 24 nt, Human
uguguccugagaaguguggcugcc

SEQ ID NO: 390082 - RNA, 22 nt, Human
uuagagccccaggcucuggcac

SEQ ID NO: 390083 - RNA, 26 nt, Human
aaaaagacaacaagcucugaagaaaa

SEQ ID NO: 390084 - RNA, 18 nt, Human
aaaaagggccaggcagug

SEQ ID NO: 390085 - RNA, 23 nt, Human
aaaagacaacaagcucugaagaa

SEQ ID NO: 390086 - RNA, 23 nt, Human
aaagucuaauauagcgaaaaaga

SEQ ID NO: 390087 - RNA, 21 nt, Human
aacaucucaugggcugauguu

SEQ ID NO: 390088 - RNA, 18 nt, Human
aagaacaaggccacagau

SEQ ID NO: 390089 - RNA, 23 nt, Human
aagacuuuucccuuccuuuuuaa

SEQ ID NO: 390090 - RNA, 25 nt, Human
aauaaaaauaaaucaaaaaaugaga

SEQ ID NO: 390091 - RNA, 21 nt, Human
acaaagagaaaauaaaaauaa

SEQ ID NO: 390092 - RNA, 18 nt, Human
acagugaaaaauaagcca

SEQ ID NO: 390093 - RNA, 26 nt, Human
accaaaaaguccacuaaguucacaaa

SEQ ID NO: 390094 - RNA, 24 nt, Human
acugaaaugaagaacaaggccagu

SEQ ID NO: 390095 - RNA, 24 nt, Human
acuggguuuuguuauguucaccau

SEQ ID NO: 390096 - RNA, 22 nt, Human
agaauauaugcaaauuaaagua

SEQ ID NO: 390097 - RNA, 24 nt, Human
agagaucaaauauaacacccacaa

SEQ ID NO: 390098 - RNA, 23 nt, Human
agcauguuuuucucucccagggu

SEQ ID NO: 390099 - RNA, 19 nt, Human
aggaaauacgggugaccau

SEQ ID NO: 390100 - RNA, 24 nt, Human
aggauuacauuugaguuucuuggu

SEQ ID NO: 390101 - RNA, 18 nt, Human
agguaauuagccucagag

SEQ ID NO: 390102 - RNA, 21 nt, Human
agguaugccgggaaugcuaag

SEQ ID NO: 390103 - RNA, 18 nt, Human
aguuucuugguucaagug

SEQ ID NO: 390104 - RNA, 24 nt, Human
auuaacacugaaaugaagaacaag

SEQ ID NO: 390105 - RNA, 19 nt, Human
caaagcacacagggcugca

SEQ ID NO: 390106 - RNA, 24 nt, Human
caaagucuaauauagcgaaaaaga

SEQ ID NO: 390107 - RNA, 19 nt, Human
caagcucugaagaaaaaag

SEQ ID NO: 390108 - RNA, 21 nt, Human
cacagccugaaaaaaucgucu

SEQ ID NO: 390109 - RNA, 18 nt, Human
caccauaaucacagccug

SEQ ID NO: 390110 - RNA, 18 nt, Human
cacuaaguucacaaauga

SEQ ID NO: 390111 - RNA, 24 nt, Human
caggguuguugugguggaagacag

SEQ ID NO: 390112 - RNA, 21 nt, Human
cccacaaagagaaaauaaaaa

SEQ ID NO: 390113 - RNA, 20 nt, Human
ccgggaaugcuaagggccaa

SEQ ID NO: 390114 - RNA, 18 nt, Human
ccugccgccccgucuccg

SEQ ID NO: 390115 - RNA, 18 nt, Human
cggaggaggcuggacugu

SEQ ID NO: 390116 - RNA, 21 nt, Human
cucacacaucauaagcaacaa

SEQ ID NO: 390117 - RNA, 18 nt, Human
cucuggaacuggcugaug

SEQ ID NO: 390118 - RNA, 18 nt, Human
cugcuuuguucucugcac

SEQ ID NO: 390119 - RNA, 20 nt, Human
cuguugauauuggcuauaag

SEQ ID NO: 390120 - RNA, 23 nt, Human
cuucggccacuucuagcaggucc

SEQ ID NO: 390121 - RNA, 19 nt, Human
gaaguucaaagugauuaug

SEQ ID NO: 390122 - RNA, 22 nt, Human
gauuacauuugaguuucuuggu

SEQ ID NO: 390123 - RNA, 18 nt, Human
gcaaacaucucaugggcu

SEQ ID NO: 390124 - RNA, 25 nt, Human
gcaaagcacacagggcugcacggag

SEQ ID NO: 390125 - RNA, 18 nt, Human
gccaggcaguggcauaug

SEQ ID NO: 390126 - RNA, 21 nt, Human
gggcaacaaaagacuuuuccc

SEQ ID NO: 390127 - RNA, 21 nt, Human
gguccugccgccccgucuccg

SEQ ID NO: 390128 - RNA, 20 nt, Human
ggucugggagggggaggcgg

SEQ ID NO: 390129 - RNA, 18 nt, Human
gucaccuucuaucuagcc

SEQ ID NO: 390130 - RNA, 19 nt, Human
guucagauuuagagaucaa

SEQ ID NO: 390131 - RNA, 22 nt, Human
uaaaaugcuagcuaggcuaugg

SEQ ID NO: 390132 - RNA, 22 nt, Human
uaagauggacugacaaguacug

SEQ ID NO: 390133 - RNA, 23 nt, Human
uaagccaaauguuuuuuucuuuc

SEQ ID NO: 390134 - RNA, 21 nt, Human
uaaucuggcucaucauuuugg

SEQ ID NO: 390135 - RNA, 24 nt, Human
uaccagaaguucugucuuguuuuu

SEQ ID NO: 390136 - RNA, 21 nt, Human
uagaagcuugaaaagucuugg

SEQ ID NO: 390137 - RNA, 22 nt, Human
uagaguaccagaaguucugucu

SEQ ID NO: 390138 - RNA, 19 nt, Human
uagcauguuuuucucuccc

SEQ ID NO: 390139 - RNA, 25 nt, Human
uagccuacugauaacucuggaacug

SEQ ID NO: 390140 - RNA, 24 nt, Human
uaggauuacauuugaguuucuugg

SEQ ID NO: 390141 - RNA, 20 nt, Human
uauggcaagaggauaggaga

SEQ ID NO: 390142 - RNA, 21 nt, Human
uauggcaagaggauaggagag

SEQ ID NO: 390143 - RNA, 21 nt, Human
uaugucuuuuaaaacaacuuu

SEQ ID NO: 390144 - RNA, 22 nt, Human
uauguucaccauaaucacagcc

SEQ ID NO: 390145 - RNA, 22 nt, Human
uauuacaagcuuuccuaugaga

SEQ ID NO: 390146 - RNA, 18 nt, Human
ucaguuuaggcacaaggc

SEQ ID NO: 390147 - RNA, 18 nt, Human
uccacggugaguggagag

SEQ ID NO: 390148 - RNA, 24 nt, Human
ucccaggguuguugugguggaagg

SEQ ID NO: 390149 - RNA, 24 nt, Human
ugaaaugaagaacaaggccacaga

SEQ ID NO: 390150 - RNA, 23 nt, Human
ugacagagaaauaaaggcuagga

SEQ ID NO: 390151 - RNA, 18 nt, Human
ugagagcaagagaaaugc

SEQ ID NO: 390152 - RNA, 20 nt, Human
ugagaucuagaagcuugaaa

SEQ ID NO: 390153 - RNA, 19 nt, Human
ugauguucuaucugaugag

SEQ ID NO: 390154 - RNA, 19 nt, Human
ugauuuggguccuuuccuc

SEQ ID NO: 390155 - RNA, 23 nt, Human
ugauuuggguccuuuccucugug

SEQ ID NO: 390156 - RNA, 19 nt, Human
ugcaaagucuaauauagcg

SEQ ID NO: 390157 - RNA, 23 nt, Human
ugcaaagucuaauauagcgaaaa

SEQ ID NO: 390158 - RNA, 18 nt, Human
ugcuuggaaaacaaagcg

SEQ ID NO: 390159 - RNA, 19 nt, Human
ugcuuggaaaacaaagcga

SEQ ID NO: 390160 - RNA, 18 nt, Human
ugggagggggaggcggcu

SEQ ID NO: 390161 - RNA, 22 nt, Human
uguaguacuuacugcuuggaaa

SEQ ID NO: 390162 - RNA, 21 nt, Human
ugucuuguuuuuguucuuuca

SEQ ID NO: 390163 - RNA, 19 nt, Human
ugugcaaagcacacagggc

SEQ ID NO: 390164 - RNA, 22 nt, Human
uguuauguucaccauaaucaca

SEQ ID NO: 390165 - RNA, 24 nt, Human
uuagagacagagagugccuuaaug

SEQ ID NO: 390166 - RNA, 19 nt, Human
uuggguccuuuccucugug

SEQ ID NO: 390167 - RNA, 20 nt, Human
uuuauauguagaccuuacag

SEQ ID NO: 390168 - RNA, 19 nt, Human
uuugaucguaggauuacau

SEQ ID NO: 390169 - RNA, 20 nt, Human
uuuggccgggagaacgggcu

SEQ ID NO: 390170 - RNA, 24 nt, Human
uuuguuuuuucuucucccuccugu

SEQ ID NO: 390171 - RNA, 20 nt, Human
uuuuucuuucuauuuuauga

SEQ ID NO: 390172 - RNA, 22 nt, Human
acacacacacccugucaccaac

SEQ ID NO: 390173 - RNA, 19 nt, Human
acacacccugucaccaaca

SEQ ID NO: 390174 - RNA, 18 nt, Human
acccugucaccaacaguc

SEQ ID NO: 390175 - RNA, 20 nt, Human
agaugucccgagggcccugc

SEQ ID NO: 390176 - RNA, 20 nt, Human
agccaguggcuggcuccugg

SEQ ID NO: 390177 - RNA, 24 nt, Human
agccaguggcuggcuccuggccuc

SEQ ID NO: 390178 - RNA, 21 nt, Human
aggggugggcuuggcuccugg

SEQ ID NO: 390179 - RNA, 19 nt, Human
cacacacccugucaccaac

SEQ ID NO: 390180 - RNA, 19 nt, Human
cacccugucaccaacaguc

SEQ ID NO: 390181 - RNA, 21 nt, Human
cacccugucaccaacagucuu

SEQ ID NO: 390182 - RNA, 23 nt, Human
cacgcacagauacacacacaccc

SEQ ID NO: 390183 - RNA, 18 nt, Human
cagauacacacacacccu

SEQ ID NO: 390184 - RNA, 21 nt, Human
ccaauucucucucacacacac

SEQ ID NO: 390185 - RNA, 26 nt, Human
ccaguggcuggcuccuggccuccuuc

SEQ ID NO: 390186 - RNA, 19 nt, Human
cccgagggcccugcccaga

SEQ ID NO: 390187 - RNA, 19 nt, Human
ccuugucucugaccagcca

SEQ ID NO: 390188 - RNA, 20 nt, Human
cgagggcccugcccagagug

SEQ ID NO: 390189 - RNA, 24 nt, Human
cgccggccgcgucccuccgugcgc

SEQ ID NO: 390190 - RNA, 20 nt, Human
gcacagauacacacacaccc

SEQ ID NO: 390191 - RNA, 23 nt, Human
uccuggccuccuucuccaggguc

SEQ ID NO: 390192 - RNA, 23 nt, Human
ugaccagccagagcuggcaggcu

SEQ ID NO: 390193 - RNA, 18 nt, Human
uggcuccuggggucuucu

SEQ ID NO: 390194 - RNA, 22 nt, Human
uggcuccuggggucuucuuccc

SEQ ID NO: 390195 - RNA, 22 nt, Human
uggucccccggucccuacacaa

SEQ ID NO: 390196 - RNA, 24 nt, Human
aacacguccuauggcaccucacuu

SEQ ID NO: 390197 - RNA, 22 nt, Human
aaccuuaauuaccuguauuccu

SEQ ID NO: 390198 - RNA, 19 nt, Human
aacuuccagcucacuggca

SEQ ID NO: 390199 - RNA, 20 nt, Human
aagaacucccucuuacauuu

SEQ ID NO: 390200 - RNA, 24 nt, Human
aagaagaguaaaugcccaggagug

SEQ ID NO: 390201 - RNA, 19 nt, Human
aagaagccggggccaggag

SEQ ID NO: 390202 - RNA, 23 nt, Human
aagcaaagcugugaaaagccagg

SEQ ID NO: 390203 - RNA, 23 nt, Human
aagcaaggaauaucacagaccca

SEQ ID NO: 390204 - RNA, 21 nt, Human
aagcagccuaggacucaaugc

SEQ ID NO: 390205 - RNA, 20 nt, Human
aaucccaguuaccuuauuua

SEQ ID NO: 390206 - RNA, 19 nt, Human
acacuaccugaauagccca

SEQ ID NO: 390207 - RNA, 19 nt, Human
acacuaccugaauagccca

SEQ ID NO: 390208 - RNA, 23 nt, Human
acacugaaccaggccagcccagu

SEQ ID NO: 390209 - RNA, 24 nt, Human
agcacacuaccugaauagcccaaa

SEQ ID NO: 390210 - RNA, 21 nt, Human
agcagugccagccugugcggc

SEQ ID NO: 390211 - RNA, 20 nt, Human
agcccaaauucagagugcaa

SEQ ID NO: 390212 - RNA, 25 nt, Human
agguuuucccagaaugccuugggug

SEQ ID NO: 390213 - RNA, 18 nt, Human
aguaagcagguuuguauu

SEQ ID NO: 390214 - RNA, 21 nt, Human
auaaaucuucugcuaucuuug

SEQ ID NO: 390215 - RNA, 18 nt, Human
auagaacaggucaagaua

SEQ ID NO: 390216 - RNA, 20 nt, Human
auagaacaggucaagauaaa

SEQ ID NO: 390217 - RNA, 20 nt, Human
caagcacauucucccuggaa

SEQ ID NO: 390218 - RNA, 26 nt, Human
caauacgaacacaucaccucugugua

SEQ ID NO: 390219 - RNA, 20 nt, Human
caauagaucuguuuucccuu

SEQ ID NO: 390220 - RNA, 22 nt, Human
cacaucaauccauccuucuucc

SEQ ID NO: 390221 - RNA, 19 nt, Human
caccagggucugcuccagg

SEQ ID NO: 390222 - RNA, 19 nt, Human
cacccguggaguggagcug

SEQ ID NO: 390223 - RNA, 20 nt, Human
caccgcgcggcgcagucucc

SEQ ID NO: 390224 - RNA, 19 nt, Human
cacugaaccaggccagccc

SEQ ID NO: 390225 - RNA, 21 nt, Human
cacugaaccaggccagcccag

SEQ ID NO: 390226 - RNA, 20 nt, Human
cacuggcaauuuccuggagg

SEQ ID NO: 390227 - RNA, 21 nt, Human
cagcucacuggcaauuuccug

SEQ ID NO: 390228 - RNA, 24 nt, Human
caggcauggcuuuugcaacugaua

SEQ ID NO: 390229 - RNA, 18 nt, Human
caggcccuagguuuuccc

SEQ ID NO: 390230 - RNA, 19 nt, Human
caguaagcagguuuguauu

SEQ ID NO: 390231 - RNA, 20 nt, Human
caucacacugguaaacugcu

SEQ ID NO: 390232 - RNA, 18 nt, Human
ccacagaguagggaaguu

SEQ ID NO: 390233 - RNA, 20 nt, Human
ccagaaugccuugggugaug

SEQ ID NO: 390234 - RNA, 26 nt, Human
ccaucucuccccuuccccuaagauuc

SEQ ID NO: 390235 - RNA, 24 nt, Human
cccaguugcccucugcugugucca

SEQ ID NO: 390236 - RNA, 22 nt, Human
cccccucugcaccaccucuucc

SEQ ID NO: 390237 - RNA, 24 nt, Human
ccccuugggcuccucggcaggagc

SEQ ID NO: 390238 - RNA, 19 nt, Human
cccucugcaccaccucuuc

SEQ ID NO: 390239 - RNA, 18 nt, Human
ccuccaaucugcaaggca

SEQ ID NO: 390240 - RNA, 23 nt, Human
ccuccaaucugcaaggcaaggau

SEQ ID NO: 390241 - RNA, 26 nt, Human
ccuccagcucaacccauauauuugca

SEQ ID NO: 390242 - RNA, 21 nt, Human
ccuguagucauucccuccugg

SEQ ID NO: 390243 - RNA, 27 nt, Human
cgccccgaucuucuggccaaucccuca

SEQ ID NO: 390244 - RNA, 18 nt, Human
cgcugcugugucuacuca

SEQ ID NO: 390245 - RNA, 20 nt, Human
cucacuggcaauuuccugga

SEQ ID NO: 390246 - RNA, 24 nt, Human
cuccagcucaacccauauauuugc

SEQ ID NO: 390247 - RNA, 24 nt, Human
cuccagcucaacccauauauuugc

SEQ ID NO: 390248 - RNA, 18 nt, Human
cucccucuuacauuuucc

SEQ ID NO: 390249 - RNA, 19 nt, Human
cuccugggccacgcaccgc

SEQ ID NO: 390250 - RNA, 23 nt, Human
cucugcaccaccucuuccacuuc

SEQ ID NO: 390251 - RNA, 24 nt, Human
cugcaccaccucuuccacuucagg

SEQ ID NO: 390252 - RNA, 18 nt, Human
cuguuugacagccaagaa

SEQ ID NO: 390253 - RNA, 23 nt, Human
cuuaagaacucccucuuacauuu

SEQ ID NO: 390254 - RNA, 24 nt, Human
cuucugucuuggccaccagggucu

SEQ ID NO: 390255 - RNA, 19 nt, Human
cuugaguugugcuguaugc

SEQ ID NO: 390256 - RNA, 23 nt, Human
cuuggggagggaagggaaggggg

SEQ ID NO: 390257 - RNA, 18 nt, Human
gaacuuaaccaaauccca

SEQ ID NO: 390258 - RNA, 20 nt, Human
gaacuuccagcucacuggca

SEQ ID NO: 390259 - RNA, 23 nt, Human
gaagaguaaaugcccaggaguga

SEQ ID NO: 390260 - RNA, 18 nt, Human
gauuuuguuggcagcagg

SEQ ID NO: 390261 - RNA, 19 nt, Human
gcaauacgaacacaucacc

SEQ ID NO: 390262 - RNA, 21 nt, Human
gcauggcuuuugcaacugaua

SEQ ID NO: 390263 - RNA, 25 nt, Human
gcccaaauucagagugcaagcagcc

SEQ ID NO: 390264 - RNA, 20 nt, Human
gcccaguugcccucugcugu

SEQ ID NO: 390265 - RNA, 19 nt, Human
gcggggcgcggggaaggag

SEQ ID NO: 390266 - RNA, 18 nt, Human
gcgguuucaacuuugagc

SEQ ID NO: 390267 - RNA, 23 nt, Human
ggagugaaugaagcggcuugucc

SEQ ID NO: 390268 - RNA, 18 nt, Human
gggaagggaaggggggua

SEQ ID NO: 390269 - RNA, 22 nt, Human
ggggagggaagggaaggggggu

SEQ ID NO: 390270 - RNA, 22 nt, Human
gguggcggggcgcggggaagga

SEQ ID NO: 390271 - RNA, 22 nt, Human
gguguaaggcucacaaaagaaa

SEQ ID NO: 390272 - RNA, 20 nt, Human
gguuugauucacacugaacc

SEQ ID NO: 390273 - RNA, 26 nt, Human
gucuacgugcaauacgaacacaucac

SEQ ID NO: 390274 - RNA, 20 nt, Human
gugcccccucugcaccaccu

SEQ ID NO: 390275 - RNA, 19 nt, Human
guggagcugugucacagcc

SEQ ID NO: 390276 - RNA, 18 nt, Human
guguccacccguggagug

SEQ ID NO: 390277 - RNA, 19 nt, Human
guugcccucugcugugucc

SEQ ID NO: 390278 - RNA, 21 nt, Human
guuugauucacacugaaccag

SEQ ID NO: 390279 - RNA, 19 nt, Human
uacacacgucuacgugcaa

SEQ ID NO: 390280 - RNA, 20 nt, Human
uaccaggcuuucucuugccc

SEQ ID NO: 390281 - RNA, 21 nt, Human
uagucauucccuccuggggag

SEQ ID NO: 390282 - RNA, 21 nt, Human
uaguuuggcuugguguaaggc

SEQ ID NO: 390283 - RNA, 20 nt, Human
uauacacacgucuacgugca

SEQ ID NO: 390284 - RNA, 22 nt, Human
uauacacacgucuacgugcaau

SEQ ID NO: 390285 - RNA, 23 nt, Human
uaucacagacccacaagaagagu

SEQ ID NO: 390286 - RNA, 20 nt, Human
uauuuggggagccuccaauc

SEQ ID NO: 390287 - RNA, 19 nt, Human
ucaauccauccuucuuccc

SEQ ID NO: 390288 - RNA, 19 nt, Human
ucauucccucuuggggagg

SEQ ID NO: 390289 - RNA, 22 nt, Human
uccacaucaauccauccuucuu

SEQ ID NO: 390290 - RNA, 19 nt, Human
uccaucucuccccuucccc

SEQ ID NO: 390291 - RNA, 20 nt, Human
ucccagucugaugcaaacuu

SEQ ID NO: 390292 - RNA, 21 nt, Human
uccccuaagauucugaauuag

SEQ ID NO: 390293 - RNA, 20 nt, Human
ucccgggaccccuugggcuc

SEQ ID NO: 390294 - RNA, 24 nt, Human
ucccuguagucauucccuccuggg

SEQ ID NO: 390295 - RNA, 20 nt, Human
ucccuguagucauucccucu

SEQ ID NO: 390296 - RNA, 19 nt, Human
ucgggguggcggggcgcgg

SEQ ID NO: 390297 - RNA, 19 nt, Human
ucuccgugcaaugcaaacu

SEQ ID NO: 390298 - RNA, 25 nt, Human
ucuuacauuuuccaucgguugcagg

SEQ ID NO: 390299 - RNA, 20 nt, Human
ucuucaagcagugccagccu

SEQ ID NO: 390300 - RNA, 21 nt, Human
ugcaauacgaacacaucaccu

SEQ ID NO: 390301 - RNA, 22 nt, Human
ugcaaugcaaacucaggaacac

SEQ ID NO: 390302 - RNA, 19 nt, Human
ugccaagcacauucucccu

SEQ ID NO: 390303 - RNA, 19 nt, Human
ugccaagcacauucucccu

SEQ ID NO: 390304 - RNA, 23 nt, Human
ugccaagcacauucucccuggaa

SEQ ID NO: 390305 - RNA, 22 nt, Human
ugccaccaagaaccuuaagaac

SEQ ID NO: 390306 - RNA, 22 nt, Human
ugccaccaagaaccuuaagaag

SEQ ID NO: 390307 - RNA, 18 nt, Human
ugcccaggagugaaugaa

SEQ ID NO: 390308 - RNA, 18 nt, Human
ugcccccucugcaccacc

SEQ ID NO: 390309 - RNA, 18 nt, Human
ugcccccucugcaccacc

SEQ ID NO: 390310 - RNA, 21 nt, Human
ugcuccaggcccugaaugagu

SEQ ID NO: 390311 - RNA, 28 nt, Human
ugcuugccugcgccccgaucuucuggcc

SEQ ID NO: 390312 - RNA, 20 nt, Human
uggcaauuuccuggaggugg

SEQ ID NO: 390313 - RNA, 23 nt, Human
uggcagcaggacuagccacagag

SEQ ID NO: 390314 - RNA, 20 nt, Human
uggcaggaaaccaucucuuc

SEQ ID NO: 390315 - RNA, 21 nt, Human
uggggagggaagggaaggggg

SEQ ID NO: 390316 - RNA, 21 nt, Human
uggggagggaagggaaggggg

SEQ ID NO: 390317 - RNA, 21 nt, Human
uggggagggaagggaaggggg

SEQ ID NO: 390318 - RNA, 21 nt, Human
ugugaacuuaaccaaauccca

SEQ ID NO: 390319 - RNA, 18 nt, Human
uucuggccaaucccucac

SEQ ID NO: 390320 - RNA, 24 nt, Human
uugcaacugauaggugcucugacu

SEQ ID NO: 390321 - RNA, 21 nt, Human
uuggaaauaaaagcaaagcug

SEQ ID NO: 390322 - RNA, 18 nt, Human
uuggggagggaagggaag

SEQ ID NO: 390323 - RNA, 24 nt, Human
uuucccagaaugccuugggugaug

SEQ ID NO: 390324 - RNA, 25 nt, Human
uuugcaacugauaggugcucugacu

SEQ ID NO: 390325 - RNA, 19 nt, Human
uuugcaccuuuccaguaag

SEQ ID NO: 390326 - RNA, 24 nt, Human
aaaaaaaaaaaaaaaaagacagaa

SEQ ID NO: 390327 - RNA, 25 nt, Human
aaaaaaaaaaaaaaagacagaagaa

SEQ ID NO: 390328 - RNA, 20 nt, Human
aaaaaaaaaaagacagaaga

SEQ ID NO: 390329 - RNA, 23 nt, Human
aaaaaaaaaaagacagaagaaag

SEQ ID NO: 390330 - RNA, 20 nt, Human
aaaaagaagggggugagggg

SEQ ID NO: 390331 - RNA, 22 nt, Human
aaaacccaaauccaggaacccc

SEQ ID NO: 390332 - RNA, 26 nt, Human
aaaccaacgaccccguggugaccuca

SEQ ID NO: 390333 - RNA, 20 nt, Human
aaacccaaagcccacagcag

SEQ ID NO: 390334 - RNA, 20 nt, Human
aaacccccagcacuggcccc

SEQ ID NO: 390335 - RNA, 22 nt, Human
aaacccccagcacuggccccac

SEQ ID NO: 390336 - RNA, 25 nt, Human
aaagauccacaaagcccccaaacaa

SEQ ID NO: 390337 - RNA, 23 nt, Human
aaccacgcccccuguagcuccca

SEQ ID NO: 390338 - RNA, 24 nt, Human
aagaagagggaaggagacaaauag

SEQ ID NO: 390339 - RNA, 18 nt, Human
aagcacaaagggaggcua

SEQ ID NO: 390340 - RNA, 22 nt, Human
aagcagaagggcgggcacaauc

SEQ ID NO: 390341 - RNA, 21 nt, Human
aagcccccaaacaaaaccucc

SEQ ID NO: 390342 - RNA, 19 nt, Human
aaggacggaaaaagaaggg

SEQ ID NO: 390343 - RNA, 25 nt, Human
aagggcucccuggaagccgagugag

SEQ ID NO: 390344 - RNA, 25 nt, Human
aagugacugacccccaccaacccug

SEQ ID NO: 390345 - RNA, 18 nt, Human
acaaaaccuccaucugca

SEQ ID NO: 390346 - RNA, 21 nt, Human
acaaacccaaagcccacagca

SEQ ID NO: 390347 - RNA, 23 nt, Human
acaagcagaggccaccaacagag

SEQ ID NO: 390348 - RNA, 21 nt, Human
acaccgccauccuggcagccu

SEQ ID NO: 390349 - RNA, 22 nt, Human
acacucagagaaagagaagcca

SEQ ID NO: 390350 - RNA, 25 nt, Human
accaacgaccccguggugaccucag

SEQ ID NO: 390351 - RNA, 22 nt, Human
accacugcacuccagcucgggu

SEQ ID NO: 390352 - RNA, 22 nt, Human
acccaaagcccacagcagaggc

SEQ ID NO: 390353 - RNA, 18 nt, Human
acccaaauccaggaaccc

SEQ ID NO: 390354 - RNA, 22 nt, Human
acccaaauccaggaaccccucc

SEQ ID NO: 390355 - RNA, 20 nt, Human
accgcagaaagauccacaaa

SEQ ID NO: 390356 - RNA, 22 nt, Human
acggggaaugcccuggugugug

SEQ ID NO: 390357 - RNA, 18 nt, Human
acugcacuccagcucggg

SEQ ID NO: 390358 - RNA, 24 nt, Human
acugcacuccagcucgggugacag

SEQ ID NO: 390359 - RNA, 18 nt, Human
acugguacugcucagugc

SEQ ID NO: 390360 - RNA, 19 nt, Human
agaaagauccacaaagccc

SEQ ID NO: 390361 - RNA, 18 nt, Human
agaagaagagggaaggag

SEQ ID NO: 390362 - RNA, 24 nt, Human
agaagggcgggcacaaucucacaa

SEQ ID NO: 390363 - RNA, 24 nt, Human
agacagaagaaaggcagccacuga

SEQ ID NO: 390364 - RNA, 25 nt, Human
agaccaggaguucgaggcuguagug

SEQ ID NO: 390365 - RNA, 25 nt, Human
agagaagccagucccugggcuuggg

SEQ ID NO: 390366 - RNA, 20 nt, Human
agagaccaggaguucgaggc

SEQ ID NO: 390367 - RNA, 20 nt, Human
agagaggaggguggagggga

SEQ ID NO: 390368 - RNA, 21 nt, Human
agagaggaggguggaggggag

SEQ ID NO: 390369 - RNA, 19 nt, Human
agagggaaggagacaaaua

SEQ ID NO: 390370 - RNA, 20 nt, Human
agagguagaccugucucuca

SEQ ID NO: 390371 - RNA, 22 nt, Human
agccaguuucccugcccugggg

SEQ ID NO: 390372 - RNA, 23 nt, Human
agccaguuucccugcccuggggu

SEQ ID NO: 390373 - RNA, 24 nt, Human
agccuccagacaccuguuacuccc

SEQ ID NO: 390374 - RNA, 24 nt, Human
aggaaccccuccacccuucagccc

SEQ ID NO: 390375 - RNA, 25 nt, Human
aggaaccccuccacccuucagcccu

SEQ ID NO: 390376 - RNA, 18 nt, Human
aggaccgcaagagaccag

SEQ ID NO: 390377 - RNA, 24 nt, Human
aggaccgcaagagaccaggaguuc

SEQ ID NO: 390378 - RNA, 20 nt, Human
aggacggaaaaagaaggggg

SEQ ID NO: 390379 - RNA, 24 nt, Human
aggagcccagagugaaaauuaaag

SEQ ID NO: 390380 - RNA, 19 nt, Human
aggaggucguaggauucca

SEQ ID NO: 390381 - RNA, 22 nt, Human
aggaggucguaggauuccaucc

SEQ ID NO: 390382 - RNA, 27 nt, Human
aggaguucgaggcuguagugagccaag

SEQ ID NO: 390383 - RNA, 22 nt, Human
aggccagggccagcacacagga

SEQ ID NO: 390384 - RNA, 19 nt, Human
agggggugagggggugggu

SEQ ID NO: 390385 - RNA, 22 nt, Human
agggggugaggggguggguggg

SEQ ID NO: 390386 - RNA, 21 nt, Human
agggggugggugggugcgaga

SEQ ID NO: 390387 - RNA, 18 nt, Human
auacagggcagaggggag

SEQ ID NO: 390388 - RNA, 19 nt, Human
aucauuugggaugggggca

SEQ ID NO: 390389 - RNA, 25 nt, Human
auccugacaaacccaaagcccacag

SEQ ID NO: 390390 - RNA, 23 nt, Human
augccccuugccccaaccacgcc

SEQ ID NO: 390391 - RNA, 19 nt, Human
augugccauuugccucaga

SEQ ID NO: 390392 - RNA, 21 nt, Human
auugcugcaaagauuucaagu

SEQ ID NO: 390393 - RNA, 22 nt, Human
caaaacccaaauccaggaaccc

SEQ ID NO: 390394 - RNA, 29 nt, Human
caaaacccaaauccaggaaccccuccacc

SEQ ID NO: 390395 - RNA, 20 nt, Human
caaagcccccaaacaaaacc

SEQ ID NO: 390396 - RNA, 23 nt, Human
caaagcccccaaacaaaaccucc

SEQ ID NO: 390397 - RNA, 23 nt, Human
caaauuccuccaaauucuaacau

SEQ ID NO: 390398 - RNA, 18 nt, Human
caacaagcagaggccacc

SEQ ID NO: 390399 - RNA, 21 nt, Human
caagcagaggccaccaacaga

SEQ ID NO: 390400 - RNA, 20 nt, Human
caaggacggaaaaagaaggg

SEQ ID NO: 390401 - RNA, 22 nt, Human
cacaaagcccccaaacaaaacc

SEQ ID NO: 390402 - RNA, 24 nt, Human
cacaaagcccccaaacaaaaccuc

SEQ ID NO: 390403 - RNA, 22 nt, Human
cacaaagggaggcuaagacagg

SEQ ID NO: 390404 - RNA, 21 nt, Human
cacaagcaaaacccaaaucca

SEQ ID NO: 390405 - RNA, 22 nt, Human
cacaccgccauccuggcagccu

SEQ ID NO: 390406 - RNA, 21 nt, Human
cacagcccuugcuugucagaa

SEQ ID NO: 390407 - RNA, 27 nt, Human
caccacccagcugauggcuccgagccc

SEQ ID NO: 390408 - RNA, 26 nt, Human
caccacugcacuccagcucgggugac

SEQ ID NO: 390409 - RNA, 22 nt, Human
cacccuucagccuccagacacc

SEQ ID NO: 390410 - RNA, 19 nt, Human
cacggaagccaacaagcag

SEQ ID NO: 390411 - RNA, 22 nt, Human
cacuccagcucgggugacagag

SEQ ID NO: 390412 - RNA, 19 nt, Human
cacugcacuccagcucggg

SEQ ID NO: 390413 - RNA, 19 nt, Human
cacugcacuccagcucggg

SEQ ID NO: 390414 - RNA, 23 nt, Human
cacugcacuccagcucgggugac

SEQ ID NO: 390415 - RNA, 24 nt, Human
cacugcacuccagcucgggugaca

SEQ ID NO: 390416 - RNA, 24 nt, Human
cacugcacuccagcucgggugaca

SEQ ID NO: 390417 - RNA, 19 nt, Human
cacuuuggcaaaucacugc

SEQ ID NO: 390418 - RNA, 21 nt, Human
cagaaacccccagcacuggcc

SEQ ID NO: 390419 - RNA, 18 nt, Human
cagaagaaaggcagccac

SEQ ID NO: 390420 - RNA, 19 nt, Human
cagaagaaugaaggaccag

SEQ ID NO: 390421 - RNA, 18 nt, Human
cagaggccaccaacagag

SEQ ID NO: 390422 - RNA, 19 nt, Human
cagagguagaccugucucu

SEQ ID NO: 390423 - RNA, 21 nt, Human
cagcacagcagccaccucugu

SEQ ID NO: 390424 - RNA, 22 nt, Human
cagccacacagggagaagaaga

SEQ ID NO: 390425 - RNA, 18 nt, Human
cagccacugauaauauca

SEQ ID NO: 390426 - RNA, 20 nt, Human
cagcccucaggccuuucuca

SEQ ID NO: 390427 - RNA, 21 nt, Human
cagccggaccgagcgaggggc

SEQ ID NO: 390428 - RNA, 25 nt, Human
cagccuccagacaccuguuacuccc

SEQ ID NO: 390429 - RNA, 22 nt, Human
caggacguccgucagguaagca

SEQ ID NO: 390430 - RNA, 18 nt, Human
caggagcacucaaucaag

SEQ ID NO: 390431 - RNA, 20 nt, Human
cagggagaagaagagggaag

SEQ ID NO: 390432 - RNA, 19 nt, Human
cagggcagaggggagagga

SEQ ID NO: 390433 - RNA, 24 nt, Human
cagggccagcacacaggagcacuc

SEQ ID NO: 390434 - RNA, 21 nt, Human
caguccaagguaugcuguccc

SEQ ID NO: 390435 - RNA, 21 nt, Human
cagugcuaugggagggcacag

SEQ ID NO: 390436 - RNA, 23 nt, Human
cauaacuguugcuccagaaacag

SEQ ID NO: 390437 - RNA, 23 nt, Human
caucugcagcugguucuggggac

SEQ ID NO: 390438 - RNA, 23 nt, Human
caugcacccuguguggaaggucc

SEQ ID NO: 390439 - RNA, 22 nt, Human
caugugccauuugccucagaac

SEQ ID NO: 390440 - RNA, 23 nt, Human
cauucagccccuccagggaucca

SEQ ID NO: 390441 - RNA, 19 nt, Human
cauuugggaugggggcagg

SEQ ID NO: 390442 - RNA, 21 nt, Human
ccaaagcccacagcagaggca

SEQ ID NO: 390443 - RNA, 24 nt, Human
ccaagacuuucuuccuguguggcu

SEQ ID NO: 390444 - RNA, 18 nt, Human
ccaaggacggaaaaagaa

SEQ ID NO: 390445 - RNA, 20 nt, Human
ccacugcacuccagcucggg

SEQ ID NO: 390446 - RNA, 20 nt, Human
ccacugcacuccagcucggg

SEQ ID NO: 390447 - RNA, 20 nt, Human
ccacugcacuccagcucggg

SEQ ID NO: 390448 - RNA, 21 nt, Human
ccacugcacuccagcucgggu

SEQ ID NO: 390449 - RNA, 24 nt, Human
ccacugcacuccagcucgggugac

SEQ ID NO: 390450 - RNA, 20 nt, Human
ccagaagaaugaaggaccag

SEQ ID NO: 390451 - RNA, 21 nt, Human
ccagcccuagcucucuggguc

SEQ ID NO: 390452 - RNA, 23 nt, Human
ccagucuuugccuagggcuucuc

SEQ ID NO: 390453 - RNA, 18 nt, Human
ccauuuuguaggcaggaa

SEQ ID NO: 390454 - RNA, 22 nt, Human
cccagcaucgugcaucuaggca

SEQ ID NO: 390455 - RNA, 19 nt, Human
cccauaacuguugcuccag

SEQ ID NO: 390456 - RNA, 18 nt, Human
ccccaaaggcuacugagc

SEQ ID NO: 390457 - RNA, 24 nt, Human
ccccaaaggcuacugagcuucucc

SEQ ID NO: 390458 - RNA, 18 nt, Human
ccccagcaucgugcaucu

SEQ ID NO: 390459 - RNA, 18 nt, Human
ccccagcaucgugcaucu

SEQ ID NO: 390460 - RNA, 25 nt, Human
cccccaaacaaaaccuccaucugca

SEQ ID NO: 390461 - RNA, 19 nt, Human
cccggggucccggaggcuc

SEQ ID NO: 390462 - RNA, 21 nt, Human
cccucucuaauguuaagaguc

SEQ ID NO: 390463 - RNA, 21 nt, Human
cccuguagcucccagcuucag

SEQ ID NO: 390464 - RNA, 20 nt, Human
ccgcugagucagcagccacc

SEQ ID NO: 390465 - RNA, 23 nt, Human
ccuacagaaacccccagcacugg

SEQ ID NO: 390466 - RNA, 28 nt, Human
ccuacagaaacccccagcacuggccccc

SEQ ID NO: 390467 - RNA, 18 nt, Human
ccuggaagccgagugagc

SEQ ID NO: 390468 - RNA, 21 nt, Human
ccugucccuccagcccuagcc

SEQ ID NO: 390469 - RNA, 28 nt, Human
ccugucccuccagcccuagcucucuggg

SEQ ID NO: 390470 - RNA, 24 nt, Human
cgcagaaagauccacaaagccccc

SEQ ID NO: 390471 - RNA, 25 nt, Human
cgcagaaagauccacaaagccccca

SEQ ID NO: 390472 - RNA, 21 nt, Human
cggcucuacagacagaagcca

SEQ ID NO: 390473 - RNA, 22 nt, Human
cuaccagacaguaaccucccag

SEQ ID NO: 390474 - RNA, 20 nt, Human
cuaggcacagcacagcagcc

SEQ ID NO: 390475 - RNA, 23 nt, Human
cuccagcccuagcucucuggguc

SEQ ID NO: 390476 - RNA, 21 nt, Human
cuccagcucgggugacagagg

SEQ ID NO: 390477 - RNA, 18 nt, Human
cuccguggaucgcugugg

SEQ ID NO: 390478 - RNA, 23 nt, Human
cucguacaucacuagcauauccc

SEQ ID NO: 390479 - RNA, 23 nt, Human
cugacaaacccaaagcccacagc

SEQ ID NO: 390480 - RNA, 22 nt, Human
cugagaguggauugucugaggu

SEQ ID NO: 390481 - RNA, 19 nt, Human
cugaggugccagcaggacg

SEQ ID NO: 390482 - RNA, 19 nt, Human
cugcucagugccagccaug

SEQ ID NO: 390483 - RNA, 24 nt, Human
cugcugccugccagucuucucacu

SEQ ID NO: 390484 - RNA, 18 nt, Human
cuggccccaccuucaugc

SEQ ID NO: 390485 - RNA, 18 nt, Human
cugggcacugucaggcuc

SEQ ID NO: 390486 - RNA, 21 nt, Human
cugggcuucgggcugcgcucc

SEQ ID NO: 390487 - RNA, 22 nt, Human
cuguagugagccaagacugcac

SEQ ID NO: 390488 - RNA, 27 nt, Human
cuucaugcugggcacugucaggcuccc

SEQ ID NO: 390489 - RNA, 23 nt, Human
cuuccuaccagacaguaaccucc

SEQ ID NO: 390490 - RNA, 20 nt, Human
cuuuugaaauuuugacucug

SEQ ID NO: 390491 - RNA, 18 nt, Human
gaaaaagaagggggugag

SEQ ID NO: 390492 - RNA, 22 nt, Human
gaccccguggugaccucagcac

SEQ ID NO: 390493 - RNA, 29 nt, Human
gacggaaaaagaagggggugagggggugg

SEQ ID NO: 390494 - RNA, 18 nt, Human
gagaagaagagggaagga

SEQ ID NO: 390495 - RNA, 19 nt, Human
gagaggaggguggagggga

SEQ ID NO: 390496 - RNA, 19 nt, Human
gaggaccgcaagagaccag

SEQ ID NO: 390497 - RNA, 18 nt, Human
gaggcuguagugagccaa

SEQ ID NO: 390498 - RNA, 27 nt, Human
gaguauccgcuucccaugacacgcccu

SEQ ID NO: 390499 - RNA, 21 nt, Human
gaucaaaaagaaaaugauuuc

SEQ ID NO: 390500 - RNA, 26 nt, Human
gcagccacacagggagaagaagaggg

SEQ ID NO: 390501 - RNA, 18 nt, Human
gcagccaccucuguuucu

SEQ ID NO: 390502 - RNA, 21 nt, Human
gccauccuggcagccugaggc

SEQ ID NO: 390503 - RNA, 20 nt, Human
gcccccaaacaaaaccucca

SEQ ID NO: 390504 - RNA, 22 nt, Human
gcccuagcucucugggucuccu

SEQ ID NO: 390505 - RNA, 20 nt, Human
gcugcgcuccugagagugga

SEQ ID NO: 390506 - RNA, 18 nt, Human
ggaaccagcaggccagag

SEQ ID NO: 390507 - RNA, 23 nt, Human
ggaaccagcaggccagagcucua

SEQ ID NO: 390508 - RNA, 23 nt, Human
ggaaccccuccacccuucagccu

SEQ ID NO: 390509 - RNA, 20 nt, Human
ggagaagaagagggaaggag

SEQ ID NO: 390510 - RNA, 21 nt, Human
ggagcacucaaucaagcauga

SEQ ID NO: 390511 - RNA, 18 nt, Human
ggaggaaacugaucagag

SEQ ID NO: 390512 - RNA, 20 nt, Human
ggaugggggcaggggaggga

SEQ ID NO: 390513 - RNA, 20 nt, Human
ggcacugaggugggaagagu

SEQ ID NO: 390514 - RNA, 19 nt, Human
gggaaggagacaaauaggg

SEQ ID NO: 390515 - RNA, 21 nt, Human
gggagaagaagagggaaggag

SEQ ID NO: 390516 - RNA, 19 nt, Human
ggggugagggggugggugg

SEQ ID NO: 390517 - RNA, 20 nt, Human
ggguaaagggcucccuggaa

SEQ ID NO: 390518 - RNA, 20 nt, Human
ggugagggggugggugggug

SEQ ID NO: 390519 - RNA, 19 nt, Human
ggugggugcgagagaggag

SEQ ID NO: 390520 - RNA, 22 nt, Human
gguguggaaaacaggguccuug

SEQ ID NO: 390521 - RNA, 21 nt, Human
guaggcaggaaauucagacuc

SEQ ID NO: 390522 - RNA, 20 nt, Human
guccuuguuuucguaccauu

SEQ ID NO: 390523 - RNA, 21 nt, Human
gugccagcaggacguccguca

SEQ ID NO: 390524 - RNA, 22 nt, Human
gugcuggucaggucacugggcu

SEQ ID NO: 390525 - RNA, 21 nt, Human
guggaagguccuauuucucca

SEQ ID NO: 390526 - RNA, 23 nt, Human
gugggcaagcacacugguacugc

SEQ ID NO: 390527 - RNA, 28 nt, Human
uaaccucccagaggcaggacgcgcagcu

SEQ ID NO: 390528 - RNA, 25 nt, Human
uaagacaggaggaccgcaagagacc

SEQ ID NO: 390529 - RNA, 18 nt, Human
uaagcagggaccucucgc

SEQ ID NO: 390530 - RNA, 22 nt, Human
uacaaagaaaacuaauagacac

SEQ ID NO: 390531 - RNA, 22 nt, Human
uacagacagaagccaccccuga

SEQ ID NO: 390532 - RNA, 21 nt, Human
uagaaagaucagacuugagca

SEQ ID NO: 390533 - RNA, 21 nt, Human
uagcauaucccaggacuuggu

SEQ ID NO: 390534 - RNA, 20 nt, Human
uagugacccuaccuuggcug

SEQ ID NO: 390535 - RNA, 22 nt, Human
ucaaaaaaaaaaaaaaaaaaaa

SEQ ID NO: 390536 - RNA, 23 nt, Human
ucaaaaaaaaaaaaaaaaaaaaa

SEQ ID NO: 390537 - RNA, 28 nt, Human
ucaaucaagcaugauggagcagguacuc

SEQ ID NO: 390538 - RNA, 21 nt, Human
ucacagggcaauggcugaacc

SEQ ID NO: 390539 - RNA, 23 nt, Human
ucacagggcaauggcugaaccag

SEQ ID NO: 390540 - RNA, 20 nt, Human
ucagagaaagagaagccagu

SEQ ID NO: 390541 - RNA, 24 nt, Human
ucagagaaagagaagccagucccu

SEQ ID NO: 390542 - RNA, 19 nt, Human
uccaaggacggaaaaagaa

SEQ ID NO: 390543 - RNA, 23 nt, Human
uccaaggacggaaaaagaagggg

SEQ ID NO: 390544 - RNA, 23 nt, Human
uccaaggacggaaaaagaagggg

SEQ ID NO: 390545 - RNA, 21 nt, Human
uccacaaagcccccaaacaaa

SEQ ID NO: 390546 - RNA, 23 nt, Human
uccacaaagcccccaaacaaaac

SEQ ID NO: 390547 - RNA, 24 nt, Human
uccagcucgggugacagagguaga

SEQ ID NO: 390548 - RNA, 19 nt, Human
uccaggccagggccagcac

SEQ ID NO: 390549 - RNA, 25 nt, Human
uccaucugcagcugguucuggggac

SEQ ID NO: 390550 - RNA, 19 nt, Human
uccaugacagcugcccaga

SEQ ID NO: 390551 - RNA, 22 nt, Human
ucccaacucauugcugcaaaga

SEQ ID NO: 390552 - RNA, 23 nt, Human
ucccagaggcaggacgcgcagcu

SEQ ID NO: 390553 - RNA, 21 nt, Human
ucccauaacuguugcuccaga

SEQ ID NO: 390554 - RNA, 23 nt, Human
ucccaugacacgcccuuccuaga

SEQ ID NO: 390555 - RNA, 19 nt, Human
ucccugacuuuggugugga

SEQ ID NO: 390556 - RNA, 18 nt, Human
uccuuguuguugcgcacg

SEQ ID NO: 390557 - RNA, 25 nt, Human
ucggagguuccuugucucccaccuc

SEQ ID NO: 390558 - RNA, 21 nt, Human
ucucucaaaaaaaaaaaaaaa

SEQ ID NO: 390559 - RNA, 25 nt, Human
ucucucaaaaaaaaaaaaaaaaaaa

SEQ ID NO: 390560 - RNA, 23 nt, Human
ucugaggugccagcaggacgucc

SEQ ID NO: 390561 - RNA, 31 nt, Human
ucugcaaucaggccagucuuugccuagggcc

SEQ ID NO: 390562 - RNA, 19 nt, Human
ucuuaaguaaccaagacuu

SEQ ID NO: 390563 - RNA, 20 nt, Human
ugaaugcugggcuccagccu

SEQ ID NO: 390564 - RNA, 20 nt, Human
ugacaaacccaaagcccacc

SEQ ID NO: 390565 - RNA, 18 nt, Human
ugacaucgugggagaggc

SEQ ID NO: 390566 - RNA, 22 nt, Human
ugaccuuuacaaagaaaacuaa

SEQ ID NO: 390567 - RNA, 20 nt, Human
ugacucgggagcccugucac

SEQ ID NO: 390568 - RNA, 23 nt, Human
ugacucgggagcccugucacggg

SEQ ID NO: 390569 - RNA, 24 nt, Human
ugagaucaaaaagaaaaugauuuc

SEQ ID NO: 390570 - RNA, 20 nt, Human
ugagcuccuggcccacagga

SEQ ID NO: 390571 - RNA, 19 nt, Human
ugaggggagaggggacaga

SEQ ID NO: 390572 - RNA, 28 nt, Human
ugaggggagaggggacagaucacuuuug

SEQ ID NO: 390573 - RNA, 21 nt, Human
ugagggggugggugggugcga

SEQ ID NO: 390574 - RNA, 21 nt, Human
ugaggguaguauggguuaucg

SEQ ID NO: 390575 - RNA, 24 nt, Human
ugaggguaguauggguuaucggga

SEQ ID NO: 390576 - RNA, 24 nt, Human
ugccccaaccacgcccccuguagc

SEQ ID NO: 390577 - RNA, 21 nt, Human
ugcccugcucccugucccucc

SEQ ID NO: 390578 - RNA, 24 nt, Human
ugcccugcucccugucccuccagc

SEQ ID NO: 390579 - RNA, 27 nt, Human
ugcccugggguuucuuagggagugcac

SEQ ID NO: 390580 - RNA, 27 nt, Human
ugccuaaaccaacgaccccguggugac

SEQ ID NO: 390581 - RNA, 24 nt, Human
ugccugagucgaugacucgggagc

SEQ ID NO: 390582 - RNA, 23 nt, Human
ugcgagagaggaggguggagggg

SEQ ID NO: 390583 - RNA, 21 nt, Human
ugcucccugucccuccagccc

SEQ ID NO: 390584 - RNA, 21 nt, Human
uggagcaggcaggaggcugcu

SEQ ID NO: 390585 - RNA, 23 nt, Human
uggagcagguacucggucaguuu

SEQ ID NO: 390586 - RNA, 19 nt, Human
uggaggagguggccggagu

SEQ ID NO: 390587 - RNA, 19 nt, Human
uggcuuccaggcucccuga

SEQ ID NO: 390588 - RNA, 19 nt, Human
ugggagaggcauuguggca

SEQ ID NO: 390589 - RNA, 23 nt, Human
ugggugggugcgagagaggaggg

SEQ ID NO: 390590 - RNA, 25 nt, Human
ugggugggugcgagagaggagggug

SEQ ID NO: 390591 - RNA, 23 nt, Human
ugguagucaguccaagguaugcu

SEQ ID NO: 390592 - RNA, 18 nt, Human
ugguguggagaucacagg

SEQ ID NO: 390593 - RNA, 20 nt, Human
ugucacggcacaccgccauc

SEQ ID NO: 390594 - RNA, 19 nt, Human
uguccaggccucgcgggag

SEQ ID NO: 390595 - RNA, 24 nt, Human
ugugggcacugaggugggaagagu

SEQ ID NO: 390596 - RNA, 19 nt, Human
uuagaacccagauacauaa

SEQ ID NO: 390597 - RNA, 22 nt, Human
uuagaacccagauacauaacua

SEQ ID NO: 390598 - RNA, 24 nt, Human
uuauacauucacuccuuucauccu

SEQ ID NO: 390599 - RNA, 19 nt, Human
uucaagugacugacccccc

SEQ ID NO: 390600 - RNA, 22 nt, Human
uucacuucccacuuaggauguu

SEQ ID NO: 390601 - RNA, 18 nt, Human
uuccuccaaauucuaaca

SEQ ID NO: 390602 - RNA, 19 nt, Human
uuccuguguggcugagccu

SEQ ID NO: 390603 - RNA, 21 nt, Human
uucuugcuuccucuucggagg

SEQ ID NO: 390604 - RNA, 21 nt, Human
uuggagcaggcaggaggcugc

SEQ ID NO: 390605 - RNA, 21 nt, Human
uuggcugugggcacugaggug

SEQ ID NO: 390606 - RNA, 24 nt, Human
uugguuagugacccuaccuuggcu

SEQ ID NO: 390607 - RNA, 25 nt, Human
uuuacuucuuuaaaagaaaucucaa

SEQ ID NO: 390608 - RNA, 24 nt, Human
uuucacaagcccuuuucuuggagc

SEQ ID NO: 390609 - RNA, 20 nt, Human
uuucuaguuccagggccagg

SEQ ID NO: 390610 - RNA, 24 nt, Human
uuuggcuuuccuuucacaagcccu

SEQ ID NO: 390611 - RNA, 23 nt, Human
aaaaaugaaagcaaaaagaaaaa

SEQ ID NO: 390612 - RNA, 20 nt, Human
aaagggguuaaauggguguu

SEQ ID NO: 390613 - RNA, 23 nt, Human
aaauuaaaaaaaaaaaaccauaa

SEQ ID NO: 390614 - RNA, 21 nt, Human
aacaaaacaacacaacauaaa

SEQ ID NO: 390615 - RNA, 25 nt, Human
aagcaaaaagaaaaagggguuaagg

SEQ ID NO: 390616 - RNA, 24 nt, Human
aaugaaagcaaaaagaaaaagggg

SEQ ID NO: 390617 - RNA, 22 nt, Human
acaaagucuuuccagacuaaaa

SEQ ID NO: 390618 - RNA, 25 nt, Human
acaauuuacaaaacaaaacaacaca

SEQ ID NO: 390619 - RNA, 18 nt, Human
acuuuuuucuuuuuuuaa

SEQ ID NO: 390620 - RNA, 18 nt, Human
aggcacgcgggcggggcg

SEQ ID NO: 390621 - RNA, 19 nt, Human
auaaaaaugaaagcaaaaa

SEQ ID NO: 390622 - RNA, 23 nt, Human
aucaacgccacacacacaccccg

SEQ ID NO: 390623 - RNA, 26 nt, Human
aucaacgccacacacacaccccgguu

SEQ ID NO: 390624 - RNA, 18 nt, Human
aucccaccccuccccccu

SEQ ID NO: 390625 - RNA, 24 nt, Human
aucccaccccuccccccucccccc

SEQ ID NO: 390626 - RNA, 25 nt, Human
aucccuguauuucccccucccccaa

SEQ ID NO: 390627 - RNA, 22 nt, Human
auuccccccacccuuuccccau

SEQ ID NO: 390628 - RNA, 24 nt, Human
auuucacccccaaaaagaaaaaau

SEQ ID NO: 390629 - RNA, 21 nt, Human
caacacaggccuggaccuccu

SEQ ID NO: 390630 - RNA, 24 nt, Human
caacauaaagaaucacguagcaug

SEQ ID NO: 390631 - RNA, 21 nt, Human
cacacacacaccccguccuuc

SEQ ID NO: 390632 - RNA, 20 nt, Human
caccccuccccccucccccc

SEQ ID NO: 390633 - RNA, 21 nt, Human
cacccuuuccccaucauccca

SEQ ID NO: 390634 - RNA, 25 nt, Human
cagagugaccccugaaagaugcacu

SEQ ID NO: 390635 - RNA, 18 nt, Human
cagcuaugaccucaggca

SEQ ID NO: 390636 - RNA, 28 nt, Human
cagcucacacugccagcucuggcaacac

SEQ ID NO: 390637 - RNA, 21 nt, Human
cagucccuccccgucccugcc

SEQ ID NO: 390638 - RNA, 21 nt, Human
ccacagugacccaggacacag

SEQ ID NO: 390639 - RNA, 21 nt, Human
ccaccccuccccccucccccc

SEQ ID NO: 390640 - RNA, 20 nt, Human
ccauggaaacagccauucca

SEQ ID NO: 390641 - RNA, 22 nt, Human
cccaccccuccccccucccccc

SEQ ID NO: 390642 - RNA, 21 nt, Human
cccacucugaucacagcgaca

SEQ ID NO: 390643 - RNA, 27 nt, Human
ccccaaaaccuucccacuuugagacaa

SEQ ID NO: 390644 - RNA, 24 nt, Human
cccccaaaaagaaaaaauuaaaaa

SEQ ID NO: 390645 - RNA, 19 nt, Human
cccccaaaaccuucccacu

SEQ ID NO: 390646 - RNA, 20 nt, Human
cccccaaaaccuucccacuu

SEQ ID NO: 390647 - RNA, 18 nt, Human
ccccccacccuuucccca

SEQ ID NO: 390648 - RNA, 21 nt, Human
ccccccacccuuuccccauca

SEQ ID NO: 390649 - RNA, 22 nt, Human
cccuguauuucccccuccccca

SEQ ID NO: 390650 - RNA, 22 nt, Human
ccuacagcucacacugccagcu

SEQ ID NO: 390651 - RNA, 21 nt, Human
ccucaccagccacagugaccc

SEQ ID NO: 390652 - RNA, 22 nt, Human
cgcgggcggggcggggcggggc

SEQ ID NO: 390653 - RNA, 24 nt, Human
cguagcauggggcugccuaucuga

SEQ ID NO: 390654 - RNA, 23 nt, Human
cuauggagauuguguccauggaa

SEQ ID NO: 390655 - RNA, 25 nt, Human
cuccacagucucaccugugcuugcu

SEQ ID NO: 390656 - RNA, 24 nt, Human
gacagucccuccccgucccugccu

SEQ ID NO: 390657 - RNA, 24 nt, Human
gaguguccaccaccuucucaucuc

SEQ ID NO: 390658 - RNA, 20 nt, Human
gccugugcauuagaacccac

SEQ ID NO: 390659 - RNA, 21 nt, Human
gcgggcggggcggggcggggc

SEQ ID NO: 390660 - RNA, 18 nt, Human
gcggggcggggcggggca

SEQ ID NO: 390661 - RNA, 19 nt, Human
gcuguaauuggauuguguu

SEQ ID NO: 390662 - RNA, 22 nt, Human
ggaccuccucccauccccacgg

SEQ ID NO: 390663 - RNA, 23 nt, Human
ggauuguguuccauaagccugug

SEQ ID NO: 390664 - RNA, 18 nt, Human
ggcaggcacgcgggcggg

SEQ ID NO: 390665 - RNA, 20 nt, Human
ggcaggcacgcgggcggggc

SEQ ID NO: 390666 - RNA, 23 nt, Human
ggcaugggcaggcacgcgggcgg

SEQ ID NO: 390667 - RNA, 21 nt, Human
ggguuaaauggguguuccugg

SEQ ID NO: 390668 - RNA, 21 nt, Human
uaaaacucagauauuuaaaaa

SEQ ID NO: 390669 - RNA, 24 nt, Human
uaaacaaagucuuuccagacuaaa

SEQ ID NO: 390670 - RNA, 27 nt, Human
uaacugccaucauagcucuguccagac

SEQ ID NO: 390671 - RNA, 23 nt, Human
uaagccugugcauuagaacccac

SEQ ID NO: 390672 - RNA, 20 nt, Human
uacaaaacaaaacaacacaa

SEQ ID NO: 390673 - RNA, 24 nt, Human
uauauuuaucccucccuuuuaauu

SEQ ID NO: 390674 - RNA, 20 nt, Human
uauuuuauccccauggcaga

SEQ ID NO: 390675 - RNA, 18 nt, Human
ucaaucucacauuuaaau

SEQ ID NO: 390676 - RNA, 24 nt, Human
ucagauauuuaaaaauuauacaau

SEQ ID NO: 390677 - RNA, 23 nt, Human
uccaccaccuucucaucuccaca

SEQ ID NO: 390678 - RNA, 19 nt, Human
uccagacuaaaaauagauu

SEQ ID NO: 390679 - RNA, 23 nt, Human
uccagacuaaaaauagauuuaua

SEQ ID NO: 390680 - RNA, 19 nt, Human
uccccauggcagagugacc

SEQ ID NO: 390681 - RNA, 23 nt, Human
uccccauggcagagugaccccug

SEQ ID NO: 390682 - RNA, 23 nt, Human
ucccugccuacagcucacacugc

SEQ ID NO: 390683 - RNA, 20 nt, Human
ucccuguauuucccccuccc

SEQ ID NO: 390684 - RNA, 22 nt, Human
ucccuguauuucccccuccccc

SEQ ID NO: 390685 - RNA, 24 nt, Human
ucccuguauuucccccucccccaa

SEQ ID NO: 390686 - RNA, 23 nt, Human
ucccugugggucagggcacagcu

SEQ ID NO: 390687 - RNA, 23 nt, Human
ucccuugauuuugcugcugcugu

SEQ ID NO: 390688 - RNA, 20 nt, Human
uccuugagguccucaccagc

SEQ ID NO: 390689 - RNA, 19 nt, Human
ugacccaggacacagcuau

SEQ ID NO: 390690 - RNA, 22 nt, Human
ugagacaggcuaaagaucaacg

SEQ ID NO: 390691 - RNA, 20 nt, Human
ugccaucauagcucugucca

SEQ ID NO: 390692 - RNA, 19 nt, Human
ugccuggaaugugcugagg

SEQ ID NO: 390693 - RNA, 21 nt, Human
ugccuggaaugugcugaggac

SEQ ID NO: 390694 - RNA, 22 nt, Human
uggaaugugcugaggacagggg

SEQ ID NO: 390695 - RNA, 24 nt, Human
uggaaugugcugaggacagggggc

SEQ ID NO: 390696 - RNA, 24 nt, Human
uggagauuguguccauggaaacag

SEQ ID NO: 390697 - RNA, 23 nt, Human
uggauuguguuccauaagccugu

SEQ ID NO: 390698 - RNA, 19 nt, Human
uggcuaaaacgcuguggug

SEQ ID NO: 390699 - RNA, 25 nt, Human
ugugguuugcuuuuucaauccuggg

SEQ ID NO: 390700 - RNA, 24 nt, Human
uguguacacuugaugggguccuug

SEQ ID NO: 390701 - RNA, 21 nt, Human
uguguuccauaagccugugca

SEQ ID NO: 390702 - RNA, 24 nt, Human
uuaaaacagaaucaaaagggauag

SEQ ID NO: 390703 - RNA, 20 nt, Human
uuagaacccacauugugucc

SEQ ID NO: 390704 - RNA, 18 nt, Human
uucauacugagauccagc

SEQ ID NO: 390705 - RNA, 19 nt, Human
uuccccccacccuuucccc

SEQ ID NO: 390706 - RNA, 21 nt, Human
uuucccccucccccaaaaccu

SEQ ID NO: 390707 - RNA, 22 nt, Human
uuuuuugauuuuuuuuguuuuu

SEQ ID NO: 390708 - RNA, 21 nt, Human
uuuuuuuuguuuuuuguuuuu

SEQ ID NO: 390709 - RNA, 27 nt, Human
agacagagagacagagaaaggggaccc

SEQ ID NO: 390710 - RNA, 24 nt, Human
agacagagagacccugaaaccaag

SEQ ID NO: 390711 - RNA, 19 nt, Human
agacagagagcacugaggg

SEQ ID NO: 390712 - RNA, 23 nt, Human
agcgaggaagagggugagagaga

SEQ ID NO: 390713 - RNA, 21 nt, Human
aguggacgagggagagagaga

SEQ ID NO: 390714 - RNA, 21 nt, Human
auugcgagggggaagcagaga

SEQ ID NO: 390715 - RNA, 23 nt, Human
caagaggccucccgaauguugcg

SEQ ID NO: 390716 - RNA, 21 nt, Human
cagagagcacugagggcaggg

SEQ ID NO: 390717 - RNA, 21 nt, Human
cccagacucgcaccuccaagg

SEQ ID NO: 390718 - RNA, 22 nt, Human
ccccgggagcgcgccuuuccca

SEQ ID NO: 390719 - RNA, 21 nt, Human
cccgcuccccccgggagcgcg

SEQ ID NO: 390720 - RNA, 22 nt, Human
cccggggcccgcuccccccggg

SEQ ID NO: 390721 - RNA, 24 nt, Human
ccuucccggggcccgcuccccccg

SEQ ID NO: 390722 - RNA, 22 nt, Human
cgaggacuucugcagcagagga

SEQ ID NO: 390723 - RNA, 23 nt, Human
cuccugcugggagcuggaguugg

SEQ ID NO: 390724 - RNA, 19 nt, Human
cugaaaccaagaggccucc

SEQ ID NO: 390725 - RNA, 20 nt, Human
cugaaaccaagaggccuccc

SEQ ID NO: 390726 - RNA, 18 nt, Human
gacgagggagagagagag

SEQ ID NO: 390727 - RNA, 19 nt, Human
gagacagagaaagcgagga

SEQ ID NO: 390728 - RNA, 18 nt, Human
gagacagagagacagaga

SEQ ID NO: 390729 - RNA, 23 nt, Human
gagcauugcgagggggaagcaga

SEQ ID NO: 390730 - RNA, 19 nt, Human
gcagccaccuccugcuggg

SEQ ID NO: 390731 - RNA, 22 nt, Human
gccuucccggggcccgcucccc

SEQ ID NO: 390732 - RNA, 18 nt, Human
gcgagggggaagcagaga

SEQ ID NO: 390733 - RNA, 26 nt, Human
gggaagcagagacagagaagaaagau

SEQ ID NO: 390734 - RNA, 18 nt, Human
ggggaguggacgagggag

SEQ ID NO: 390735 - RNA, 21 nt, Human
ggugagagagagacagagaga

SEQ ID NO: 390736 - RNA, 18 nt, Human
ucccggggcccgcucccc

SEQ ID NO: 390737 - RNA, 19 nt, Human
ugagaaggaaccccgagga

SEQ ID NO: 390738 - RNA, 19 nt, Human
ugauaggcucuuaucuauu

SEQ ID NO: 390739 - RNA, 20 nt, Human
ugcgagggggaagcagagac

SEQ ID NO: 390740 - RNA, 19 nt, Human
ugucaaagucagcuauccu

SEQ ID NO: 390741 - RNA, 19 nt, Human
ugugacugucaaagucagc

SEQ ID NO: 390742 - RNA, 19 nt, Human
aaaaaaacaaaagacccgc

SEQ ID NO: 390743 - RNA, 22 nt, Human
aaaaaaccagagaccaaaggca

SEQ ID NO: 390744 - RNA, 23 nt, Human
aaaaaaccagagaccaaaggcag

SEQ ID NO: 390745 - RNA, 21 nt, Human
aaaacaagagggagaggcaag

SEQ ID NO: 390746 - RNA, 21 nt, Human
aaaagcuuaaaaaaaccagag

SEQ ID NO: 390747 - RNA, 20 nt, Human
aaaaugcuccugucagccca

SEQ ID NO: 390748 - RNA, 18 nt, Human
aaacccaagacagucccc

SEQ ID NO: 390749 - RNA, 24 nt, Human
aaggccucaaugcagggaggggca

SEQ ID NO: 390750 - RNA, 21 nt, Human
acagccagcccaggggucccc

SEQ ID NO: 390751 - RNA, 24 nt, Human
agaccuggagagaggccugggugg

SEQ ID NO: 390752 - RNA, 23 nt, Human
agagcagcuuaggggggccuggg

SEQ ID NO: 390753 - RNA, 20 nt, Human
agaggcuauggggccacugc

SEQ ID NO: 390754 - RNA, 21 nt, Human
agcagguguggccccaggccc

SEQ ID NO: 390755 - RNA, 27 nt, Human
agccaccuugcugacgucccuuccccc

SEQ ID NO: 390756 - RNA, 19 nt, Human
agcccaggcaacagggcca

SEQ ID NO: 390757 - RNA, 21 nt, Human
agcggguggcucgucccacgg

SEQ ID NO: 390758 - RNA, 21 nt, Human
aggcaacagggccaagaugca

SEQ ID NO: 390759 - RNA, 23 nt, Human
aggccagugagugguaggccagg

SEQ ID NO: 390760 - RNA, 24 nt, Human
agggcagcagguguggccccaggc

SEQ ID NO: 390761 - RNA, 21 nt, Human
aggggucacuggucccaacaa

SEQ ID NO: 390762 - RNA, 19 nt, Human
agggucagagccaccuugc

SEQ ID NO: 390763 - RNA, 21 nt, Human
agggugugguccccaugccag

SEQ ID NO: 390764 - RNA, 20 nt, Human
agguuuacacggggucuuuu

SEQ ID NO: 390765 - RNA, 22 nt, Human
agucucaggaguggcacggggg

SEQ ID NO: 390766 - RNA, 24 nt, Human
agugaaggacaggguguccaggag

SEQ ID NO: 390767 - RNA, 21 nt, Human
aguucagagcaugagccuggg

SEQ ID NO: 390768 - RNA, 18 nt, Human
aguucguguggaacugga

SEQ ID NO: 390769 - RNA, 20 nt, Human
auaaaaugucacguuuauug

SEQ ID NO: 390770 - RNA, 23 nt, Human
aucacaccccccaccccccauaa

SEQ ID NO: 390771 - RNA, 26 nt, Human
caaaaaaagcuuaaaaaaaccagaga

SEQ ID NO: 390772 - RNA, 19 nt, Human
caaaacaagagggagaggc

SEQ ID NO: 390773 - RNA, 19 nt, Human
caaaaccaagagaaccccc

SEQ ID NO: 390774 - RNA, 25 nt, Human
caagacaguccccagccagcuggga

SEQ ID NO: 390775 - RNA, 25 nt, Human
cacagcccaaggccuucguggggcu

SEQ ID NO: 390776 - RNA, 24 nt, Human
cacagcugcuuggcagagucaccu

SEQ ID NO: 390777 - RNA, 23 nt, Human
cacaugaaggcccccagcuagcc

SEQ ID NO: 390778 - RNA, 22 nt, Human
cacccagaccuaggggcagggc

SEQ ID NO: 390779 - RNA, 21 nt, Human
caccgggcuccaggguguggu

SEQ ID NO: 390780 - RNA, 20 nt, Human
cacgcaucacuuuccacaug

SEQ ID NO: 390781 - RNA, 26 nt, Human
cacgcaucacuuuccacaugacaaaa

SEQ ID NO: 390782 - RNA, 21 nt, Human
cacucagaucacaccccccac

SEQ ID NO: 390783 - RNA, 22 nt, Human
cagaucacaccccccacccccc

SEQ ID NO: 390784 - RNA, 20 nt, Human
cagcagaaauagcgagagaa

SEQ ID NO: 390785 - RNA, 21 nt, Human
cagcagaaauagcgagagaca

SEQ ID NO: 390786 - RNA, 23 nt, Human
cagcagaaauagcgagagacacg

SEQ ID NO: 390787 - RNA, 22 nt, Human
cagcagggucggacgcacagcc

SEQ ID NO: 390788 - RNA, 20 nt, Human
cagccagcugggaagagcug

SEQ ID NO: 390789 - RNA, 23 nt, Human
cagcccaaggccuucguggggcu

SEQ ID NO: 390790 - RNA, 23 nt, Human
cagcugggaagagcugguuaccc

SEQ ID NO: 390791 - RNA, 18 nt, Human
cagcuuaggggggccugg

SEQ ID NO: 390792 - RNA, 23 nt, Human
caggacaggucucugaauccacc

SEQ ID NO: 390793 - RNA, 22 nt, Human
caggauccaugggacaggucac

SEQ ID NO: 390794 - RNA, 21 nt, Human
caggguaggagacuugcaguu

SEQ ID NO: 390795 - RNA, 19 nt, Human
caucaaaaaaacaaaagac

SEQ ID NO: 390796 - RNA, 25 nt, Human
caugaagggcacaugaaggccccca

SEQ ID NO: 390797 - RNA, 19 nt, Human
ccacagugaccacugcccu

SEQ ID NO: 390798 - RNA, 23 nt, Human
ccaccgagaagggagaggcagcc

SEQ ID NO: 390799 - RNA, 19 nt, Human
ccaggcccacaccugggug

SEQ ID NO: 390800 - RNA, 20 nt, Human
ccauaauugugguucccagg

SEQ ID NO: 390801 - RNA, 19 nt, Human
cccaacaucaaaaaaacaa

SEQ ID NO: 390802 - RNA, 20 nt, Human
cccacgcaucacuuuccaca

SEQ ID NO: 390803 - RNA, 25 nt, Human
cccaggaacugcuguuucuuccucc

SEQ ID NO: 390804 - RNA, 21 nt, Human
ccccaagcccaggucaguccc

SEQ ID NO: 390805 - RNA, 18 nt, Human
ccccagcuagccaggccc

SEQ ID NO: 390806 - RNA, 20 nt, Human
ccccaggcccagggaugcuc

SEQ ID NO: 390807 - RNA, 20 nt, Human
ccccauaauugugguuccca

SEQ ID NO: 390808 - RNA, 20 nt, Human
cccccagcuagccaggcccc

SEQ ID NO: 390809 - RNA, 18 nt, Human
cccugggggccacagcug

SEQ ID NO: 390810 - RNA, 18 nt, Human
cccuuggaccacacagag

SEQ ID NO: 390811 - RNA, 19 nt, Human
ccgccgccuguccccguuc

SEQ ID NO: 390812 - RNA, 22 nt, Human
ccggggucucgaguggccguuc

SEQ ID NO: 390813 - RNA, 19 nt, Human
ccuaggggcagggccagga

SEQ ID NO: 390814 - RNA, 19 nt, Human
ccugaggggagaggaugcg

SEQ ID NO: 390815 - RNA, 23 nt, Human
ccuggacccagugucaccuuggc

SEQ ID NO: 390816 - RNA, 20 nt, Human
ccuugcugacgucccuuccc

SEQ ID NO: 390817 - RNA, 24 nt, Human
cgcccacgcaucacuuuccacaug

SEQ ID NO: 390818 - RNA, 18 nt, Human
cgucacgauggcccucug

SEQ ID NO: 390819 - RNA, 22 nt, Human
cguuuuaaagucccaaucaucc

SEQ ID NO: 390820 - RNA, 18 nt, Human
cuaccauggggcccaggc

SEQ ID NO: 390821 - RNA, 24 nt, Human
cucagaucacaccccccacccccc

SEQ ID NO: 390822 - RNA, 21 nt, Human
cuccugagcagcauccucuca

SEQ ID NO: 390823 - RNA, 18 nt, Human
cugcagcagggucggacg

SEQ ID NO: 390824 - RNA, 20 nt, Human
cuggggguaacggugggagu

SEQ ID NO: 390825 - RNA, 24 nt, Human
cugggugaaucucguuugaauucu

SEQ ID NO: 390826 - RNA, 20 nt, Human
cugggugccacagugaccac

SEQ ID NO: 390827 - RNA, 24 nt, Human
cuggucccaacaaaaugccccauu

SEQ ID NO: 390828 - RNA, 27 nt, Human
gaagccccaaggugccuucaucaggga

SEQ ID NO: 390829 - RNA, 23 nt, Human
gacaaaaccaagagaacccccaa

SEQ ID NO: 390830 - RNA, 18 nt, Human
gacccgccgccugucccc

SEQ ID NO: 390831 - RNA, 24 nt, Human
gaccuggagagaggccugggugcu

SEQ ID NO: 390832 - RNA, 25 nt, Human
gagcacagggcugaaagcggguggc

SEQ ID NO: 390833 - RNA, 19 nt, Human
gagcagcauccucucagcc

SEQ ID NO: 390834 - RNA, 23 nt, Human
gagcaugagccugggucccuggg

SEQ ID NO: 390835 - RNA, 21 nt, Human
gagggucagagccaccuugcu

SEQ ID NO: 390836 - RNA, 24 nt, Human
gcaaaaaaagcuuaaaaaaaccag

SEQ ID NO: 390837 - RNA, 20 nt, Human
gcaaaacaagagggagaggc

SEQ ID NO: 390838 - RNA, 22 nt, Human
gcacaguuccagaggcuauggg

SEQ ID NO: 390839 - RNA, 21 nt, Human
gcagcagaaauagcgagagac

SEQ ID NO: 390840 - RNA, 26 nt, Human
gcagcagaaauagcgagagacacggg

SEQ ID NO: 390841 - RNA, 19 nt, Human
gcagcuuaggggggccugg

SEQ ID NO: 390842 - RNA, 19 nt, Human
gcccggggucucgaguggc

SEQ ID NO: 390843 - RNA, 18 nt, Human
ggacugggggcagauacc

SEQ ID NO: 390844 - RNA, 19 nt, Human
ggagagaggccugggugcu

SEQ ID NO: 390845 - RNA, 18 nt, Human
ggagagcagcuuaggggg

SEQ ID NO: 390846 - RNA, 18 nt, Human
ggcagcagguguggcccc

SEQ ID NO: 390847 - RNA, 22 nt, Human
ggcagcagguguggccccaggc

SEQ ID NO: 390848 - RNA, 20 nt, Human
ggcauugagcuggccuugag

SEQ ID NO: 390849 - RNA, 25 nt, Human
ggccagagcacagggcugaaagcgg

SEQ ID NO: 390850 - RNA, 24 nt, Human
ggccagugagugguaggccagggc

SEQ ID NO: 390851 - RNA, 22 nt, Human
gggagagcagcuuaggggggcc

SEQ ID NO: 390852 - RNA, 18 nt, Human
gggccacugcccacccag

SEQ ID NO: 390853 - RNA, 22 nt, Human
gggccagagcacagggcugaaa

SEQ ID NO: 390854 - RNA, 24 nt, Human
gggccaggagcaaaacaagaggga

SEQ ID NO: 390855 - RNA, 22 nt, Human
ggggcucagaccagcacagucc

SEQ ID NO: 390856 - RNA, 22 nt, Human
ggggcucagguuuacacggggu

SEQ ID NO: 390857 - RNA, 21 nt, Human
ggggggacgggggggcucagg

SEQ ID NO: 390858 - RNA, 24 nt, Human
ggggggggggggggacgggggggc

SEQ ID NO: 390859 - RNA, 20 nt, Human
gggggguguccugugcuggc

SEQ ID NO: 390860 - RNA, 21 nt, Human
gggugugguccccaugccagg

SEQ ID NO: 390861 - RNA, 19 nt, Human
gguaggccagggccccagg

SEQ ID NO: 390862 - RNA, 24 nt, Human
ggucacagagugacacgguggcug

SEQ ID NO: 390863 - RNA, 18 nt, Human
gguuuccacagcaucccc

SEQ ID NO: 390864 - RNA, 24 nt, Human
guagcccugggggccacagcugcu

SEQ ID NO: 390865 - RNA, 19 nt, Human
gucucgaguggccguucug

SEQ ID NO: 390866 - RNA, 25 nt, Human
gucucgaguggccguucuggggcca

SEQ ID NO: 390867 - RNA, 21 nt, Human
gucuggggaggggagucaggc

SEQ ID NO: 390868 - RNA, 21 nt, Human
gugccuucaucagggaacgcc

SEQ ID NO: 390869 - RNA, 24 nt, Human
guucccaggaacugcuguuucuuc

SEQ ID NO: 390870 - RNA, 23 nt, Human
uaaaaaaaccagagaccaaaggc

SEQ ID NO: 390871 - RNA, 24 nt, Human
uaaaaaaaccagagaccaaaggca

SEQ ID NO: 390872 - RNA, 25 nt, Human
uaaaaaaaccagagaccaaaggcag

SEQ ID NO: 390873 - RNA, 25 nt, Human
uaaacccaagacaguccccagccag

SEQ ID NO: 390874 - RNA, 22 nt, Human
uaagagaucaaacucccagggc

SEQ ID NO: 390875 - RNA, 20 nt, Human
uaccaggcauugagcuggcc

SEQ ID NO: 390876 - RNA, 24 nt, Human
uagccaggcccacaccugggugcc

SEQ ID NO: 390877 - RNA, 19 nt, Human
uaggcacaauuugcuggug

SEQ ID NO: 390878 - RNA, 19 nt, Human
ucaagaaaugcaaugcuca

SEQ ID NO: 390879 - RNA, 19 nt, Human
ucacaccccccacccccca

SEQ ID NO: 390880 - RNA, 19 nt, Human
ucacuggucccaacaaaau

SEQ ID NO: 390881 - RNA, 19 nt, Human
ucagagccaccuugcugac

SEQ ID NO: 390882 - RNA, 23 nt, Human
uccacaugacaaaaccaagagaa

SEQ ID NO: 390883 - RNA, 25 nt, Human
ucccccaagcccaggucaguccccc

SEQ ID NO: 390884 - RNA, 22 nt, Human
ucccuggggcaaaggagugaag

SEQ ID NO: 390885 - RNA, 18 nt, Human
ucccuuaagagaucaaac

SEQ ID NO: 390886 - RNA, 19 nt, Human
uccugaggggagaggaugc

SEQ ID NO: 390887 - RNA, 18 nt, Human
uccuggacccagugucac

SEQ ID NO: 390888 - RNA, 20 nt, Human
ucuccuggggccagggcggg

SEQ ID NO: 390889 - RNA, 21 nt, Human
ucuggggccagagcacagggc

SEQ ID NO: 390890 - RNA, 21 nt, Human
ugaaggacaggguguccagga

SEQ ID NO: 390891 - RNA, 18 nt, Human
ugacaaaaccaagagaac

SEQ ID NO: 390892 - RNA, 19 nt, Human
ugcuccugucagcccaggc

SEQ ID NO: 390893 - RNA, 21 nt, Human
uggaacuggaugggaucccag

SEQ ID NO: 390894 - RNA, 20 nt, Human
uggcuccugagcagcauccu

SEQ ID NO: 390895 - RNA, 20 nt, Human
uggcucgaugcugacaacag

SEQ ID NO: 390896 - RNA, 20 nt, Human
uggggaggggagucaggcag

SEQ ID NO: 390897 - RNA, 23 nt, Human
uggggaggggagucaggcagucc

SEQ ID NO: 390898 - RNA, 19 nt, Human
uggggccagggcgggcacc

SEQ ID NO: 390899 - RNA, 19 nt, Human
uggggugggggguguccug

SEQ ID NO: 390900 - RNA, 20 nt, Human
uggugggguggggugggggg

SEQ ID NO: 390901 - RNA, 20 nt, Human
uggugggguggggugggggg

SEQ ID NO: 390902 - RNA, 21 nt, Human
uguccaggagguccccagcac

SEQ ID NO: 390903 - RNA, 23 nt, Human
uguccugugcuggcuccugagca

SEQ ID NO: 390904 - RNA, 24 nt, Human
uguggaugaagcccggggucucga

SEQ ID NO: 390905 - RNA, 18 nt, Human
uguguaggguagcccugg

SEQ ID NO: 390906 - RNA, 25 nt, Human
uguugcuugcuuucagguuuuguuu

SEQ ID NO: 390907 - RNA, 22 nt, Human
uuaaaaaaaauauuucgcuuag

SEQ ID NO: 390908 - RNA, 21 nt, Human
uuaaagucccaaucauccagc

SEQ ID NO: 390909 - RNA, 23 nt, Human
uucccaggaacugcuguuucuuc

SEQ ID NO: 390910 - RNA, 22 nt, Human
uuccugaggggagaggaugcgg

SEQ ID NO: 390911 - RNA, 19 nt, Human
uugguguuggcucgaugcu

SEQ ID NO: 390912 - RNA, 18 nt, Human
uuuaaacccaagacaguc

SEQ ID NO: 390913 - RNA, 23 nt, Human
uuuaaacccaagacaguccccag

SEQ ID NO: 390914 - RNA, 21 nt, Human
aagcaauguggcaacuuggac

SEQ ID NO: 390915 - RNA, 18 nt, Human
acacaaaccgcccgcgcg

SEQ ID NO: 390916 - RNA, 25 nt, Human
accgccgccgccaccgccgccgccu

SEQ ID NO: 390917 - RNA, 23 nt, Human
agacacacagccaagaucccccc

SEQ ID NO: 390918 - RNA, 23 nt, Human
aguugcacuuuuuucuuucuuuu

SEQ ID NO: 390919 - RNA, 18 nt, Human
cacagccaagaucccccc

SEQ ID NO: 390920 - RNA, 19 nt, Human
cacuuuuuucuuucuuuuu

SEQ ID NO: 390921 - RNA, 23 nt, Human
cagauccgcagacacacagccaa

SEQ ID NO: 390922 - RNA, 18 nt, Human
cagucucugggcuguguc

SEQ ID NO: 390923 - RNA, 19 nt, Human
ccccgccgccgccgccgcc

SEQ ID NO: 390924 - RNA, 22 nt, Human
cccgcgccugcugccuccccgc

SEQ ID NO: 390925 - RNA, 22 nt, Human
cccgcucccgcgccugcugccu

SEQ ID NO: 390926 - RNA, 20 nt, Human
ccgccgccaccgccgccgcc

SEQ ID NO: 390927 - RNA, 21 nt, Human
ccgccgccaccgccgccgccu

SEQ ID NO: 390928 - RNA, 22 nt, Human
ccgccgccaccgccgccgccug

SEQ ID NO: 390929 - RNA, 21 nt, Human
ccgccgccgccaccgccgccg

SEQ ID NO: 390930 - RNA, 23 nt, Human
ccgccgccgccaccgccgccgcc

SEQ ID NO: 390931 - RNA, 23 nt, Human
ccgccgccgccaccgccgccgcc

SEQ ID NO: 390932 - RNA, 18 nt, Human
ccgccgccgccgccgcca

SEQ ID NO: 390933 - RNA, 24 nt, Human
ccgccgccgccgccgccacuacag

SEQ ID NO: 390934 - RNA, 18 nt, Human
ccgccgccgccgccgccg

SEQ ID NO: 390935 - RNA, 18 nt, Human
ccgccgccgccgccgccg

SEQ ID NO: 390936 - RNA, 22 nt, Human
ccgccgccgccugcuccugcgc

SEQ ID NO: 390937 - RNA, 25 nt, Human
ccgccgccgccugcuccugcgcccg

SEQ ID NO: 390938 - RNA, 20 nt, Human
ccgccugcuccugcgcccgc

SEQ ID NO: 390939 - RNA, 22 nt, Human
ccgccugcuccugcgcccgcuc

SEQ ID NO: 390940 - RNA, 18 nt, Human
ccggcgccgaggcggcgu

SEQ ID NO: 390941 - RNA, 20 nt, Human
ccgugcaccgccggcgccga

SEQ ID NO: 390942 - RNA, 21 nt, Human
ccuccccgccgccgccgccgc

SEQ ID NO: 390943 - RNA, 24 nt, Human
cgcagacacacagccaagaucccc

SEQ ID NO: 390944 - RNA, 25 nt, Human
cgcagacacacagccaagauccccc

SEQ ID NO: 390945 - RNA, 21 nt, Human
cgccacuacagauccgcagac

SEQ ID NO: 390946 - RNA, 22 nt, Human
cgucugcgauucauaacuacuc

SEQ ID NO: 390947 - RNA, 27 nt, Human
cuccccgccgccgccgccgccgccgcc

SEQ ID NO: 390948 - RNA, 18 nt, Human
cuccgugcaccgccggcg

SEQ ID NO: 390949 - RNA, 22 nt, Human
cugcugccuccccgccgccgcc

SEQ ID NO: 390950 - RNA, 23 nt, Human
gacacacagccaagauccccccg

SEQ ID NO: 390951 - RNA, 19 nt, Human
gcacuuuuuucuuucuuuu

SEQ ID NO: 390952 - RNA, 20 nt, Human
gccgccacuacagauccgca

SEQ ID NO: 390953 - RNA, 21 nt, Human
gccuccccgccgccgccgccg

SEQ ID NO: 390954 - RNA, 20 nt, Human
gcugccuccccgccgccgcc

SEQ ID NO: 390955 - RNA, 18 nt, Human
uagcaaaaucacacaaac

SEQ ID NO: 390956 - RNA, 25 nt, Human
uccccgccgccgccgccgccgccgg

SEQ ID NO: 390957 - RNA, 24 nt, Human
uccgcagacacacagccaagaucc

SEQ ID NO: 390958 - RNA, 20 nt, Human
uccgugcaccgccggcgccg

SEQ ID NO: 390959 - RNA, 22 nt, Human
ucuaaccgccgccgccaccgcc

SEQ ID NO: 390960 - RNA, 19 nt, Human
ucucugggcugugucucag

SEQ ID NO: 390961 - RNA, 22 nt, Human
ucucugggcugugucucagccu

SEQ ID NO: 390962 - RNA, 25 nt, Human
ugucuuauauuacaaaaaugggggu

SEQ ID NO: 390963 - RNA, 24 nt, Human
uuuuucuuucuuuuuuuuguuuuu

SEQ ID NO: 390964 - RNA, 24 nt, Human
uuuuuuguuuuucuguuuuuugau

SEQ ID NO: 390965 - RNA, 22 nt, Human
uuuuuuuuguuuuucuguuuuu

SEQ ID NO: 390966 - RNA, 18 nt, Human
aaagacaggcucuggcug

SEQ ID NO: 390967 - RNA, 24 nt, Human
aaagugcugggauuacaggcguga

SEQ ID NO: 390968 - RNA, 18 nt, Human
aaauggaauugugaaaaa

SEQ ID NO: 390969 - RNA, 21 nt, Human
aacagagcuucuccauuuccu

SEQ ID NO: 390970 - RNA, 22 nt, Human
aaccuauuccauuccccuuccu

SEQ ID NO: 390971 - RNA, 19 nt, Human
aagugcugggauuacaggc

SEQ ID NO: 390972 - RNA, 19 nt, Human
aagugcugggauuacaggc

SEQ ID NO: 390973 - RNA, 24 nt, Human
acagcccuuuuuuuuuuuuuuuuu

SEQ ID NO: 390974 - RNA, 18 nt, Human
acaggguuucaccauguu

SEQ ID NO: 390975 - RNA, 21 nt, Human
acaggguuucaccauguuggc

SEQ ID NO: 390976 - RNA, 24 nt, Human
acaggguuucaccauguuggccag

SEQ ID NO: 390977 - RNA, 18 nt, Human
accauguuggccaggcug

SEQ ID NO: 390978 - RNA, 20 nt, Human
acuggagugcaauagcgcca

SEQ ID NO: 390979 - RNA, 24 nt, Human
acuuaaccuauuccauuccccuuc

SEQ ID NO: 390980 - RNA, 18 nt, Human
agagcacugucaucggaa

SEQ ID NO: 390981 - RNA, 24 nt, Human
agaucauaguaaggggcuuccucu

SEQ ID NO: 390982 - RNA, 21 nt, Human
agaugcagucucccuguuacc

SEQ ID NO: 390983 - RNA, 21 nt, Human
agcaguuugaaucgaugaccc

SEQ ID NO: 390984 - RNA, 22 nt, Human
agcaguuugaaucgaugacccc

SEQ ID NO: 390985 - RNA, 22 nt, Human
agcccuuuuuuuuuuuuuuuuu

SEQ ID NO: 390986 - RNA, 18 nt, Human
agccuggggccagagcuu

SEQ ID NO: 390987 - RNA, 20 nt, Human
agcggccuucuccggguaag

SEQ ID NO: 390988 - RNA, 21 nt, Human
agcuagggaggcagaggcuuc

SEQ ID NO: 390989 - RNA, 19 nt, Human
agcuggggacccggggcag

SEQ ID NO: 390990 - RNA, 18 nt, Human
aggaccccugccaguuuc

SEQ ID NO: 390991 - RNA, 24 nt, Human
aggcaaaaaacaaaaauuaaauua

SEQ ID NO: 390992 - RNA, 25 nt, Human
aggcagaggcuucuggcuggcaaga

SEQ ID NO: 390993 - RNA, 19 nt, Human
aggcggccagguguccugu

SEQ ID NO: 390994 - RNA, 23 nt, Human
agggaggcagaggcuucuggcug

SEQ ID NO: 390995 - RNA, 21 nt, Human
agggugaguccuggggagcug

SEQ ID NO: 390996 - RNA, 18 nt, Human
aggugauccaccugccuc

SEQ ID NO: 390997 - RNA, 22 nt, Human
aguagauacaggguuucaccau

SEQ ID NO: 390998 - RNA, 24 nt, Human
agucucccuguuacccagacugga

SEQ ID NO: 390999 - RNA, 24 nt, Human
agugauucuuccgccucagccucc

SEQ ID NO: 391000 - RNA, 22 nt, Human
aucuuuggauucugagaaacca

SEQ ID NO: 391001 - RNA, 27 nt, Human
auggacagcccuuuuuuuuuuuuuuuu

SEQ ID NO: 391002 - RNA, 24 nt, Human
caaagugcugggauuacaggcgug

SEQ ID NO: 391003 - RNA, 18 nt, Human
caagcugcccagaagcug

SEQ ID NO: 391004 - RNA, 20 nt, Human
caagugauucuuccgccuca

SEQ ID NO: 391005 - RNA, 22 nt, Human
caagugauucuuccgccucagc

SEQ ID NO: 391006 - RNA, 22 nt, Human
caccaccacguccggcuaauuu

SEQ ID NO: 391007 - RNA, 24 nt, Human
caccacguccggcuaauuuuugua

SEQ ID NO: 391008 - RNA, 21 nt, Human
caccauguuggccaggcuggu

SEQ ID NO: 391009 - RNA, 24 nt, Human
caccauguuggccaggcuggucuc

SEQ ID NO: 391010 - RNA, 20 nt, Human
cacccuccccuccccaauuu

SEQ ID NO: 391011 - RNA, 20 nt, Human
cacuacuggagguuuucugg

SEQ ID NO: 391012 - RNA, 22 nt, Human
cagccccauggggaaacuggag

SEQ ID NO: 391013 - RNA, 24 nt, Human
caggguuucaccauguuggccagg

SEQ ID NO: 391014 - RNA, 22 nt, Human
caggugauccaccugccucggc

SEQ ID NO: 391015 - RNA, 21 nt, Human
caucaagacagaucugauucc

SEQ ID NO: 391016 - RNA, 24 nt, Human
cauguuggccaggcuggucucaaa

SEQ ID NO: 391017 - RNA, 22 nt, Human
ccaaagugcugggauuacaggc

SEQ ID NO: 391018 - RNA, 22 nt, Human
ccaaagugcugggauuacaggc

SEQ ID NO: 391019 - RNA, 22 nt, Human
ccaaagugcugggauuacaggc

SEQ ID NO: 391020 - RNA, 24 nt, Human
ccaaagugcugggauuacaggcgu

SEQ ID NO: 391021 - RNA, 20 nt, Human
ccagguguccugugccugcu

SEQ ID NO: 391022 - RNA, 22 nt, Human
ccaugagaucugggucucuguc

SEQ ID NO: 391023 - RNA, 24 nt, Human
ccccagguucaggcagaaguucug

SEQ ID NO: 391024 - RNA, 21 nt, Human
cccgaguagcugggauuacau

SEQ ID NO: 391025 - RNA, 24 nt, Human
cccggguucaagugauucuucccc

SEQ ID NO: 391026 - RNA, 23 nt, Human
ccgccucagccucccgaguagcu

SEQ ID NO: 391027 - RNA, 24 nt, Human
ccgccucccggguucaagugauuc

SEQ ID NO: 391028 - RNA, 20 nt, Human
ccggcagcccuuuuucuuug

SEQ ID NO: 391029 - RNA, 23 nt, Human
ccugggguugggaggcugagagc

SEQ ID NO: 391030 - RNA, 24 nt, Human
ccuguuacccagacuggagugcaa

SEQ ID NO: 391031 - RNA, 25 nt, Human
ccuuuuuuuuuuuuuuuuuuuuuga

SEQ ID NO: 391032 - RNA, 24 nt, Human
cgccucagccucccgaguagcugg

SEQ ID NO: 391033 - RNA, 23 nt, Human
cgcgcaccaccacguccggcuaa

SEQ ID NO: 391034 - RNA, 24 nt, Human
cgucaggugauccaccugccucgg

SEQ ID NO: 391035 - RNA, 20 nt, Human
cuaaaguaggaacuaaaggc

SEQ ID NO: 391036 - RNA, 22 nt, Human
cucacuggaaccuccgccuccc

SEQ ID NO: 391037 - RNA, 24 nt, Human
cucacuggaaccuccgccucccgg

SEQ ID NO: 391038 - RNA, 23 nt, Human
cucagccucccgaguagcuggga

SEQ ID NO: 391039 - RNA, 20 nt, Human
cucccggguucaagugauuc

SEQ ID NO: 391040 - RNA, 23 nt, Human
cucccuguuacccagacuggagu

SEQ ID NO: 391041 - RNA, 20 nt, Human
cugaauggggaggguguggc

SEQ ID NO: 391042 - RNA, 20 nt, Human
cugacgucaggugauccacc

SEQ ID NO: 391043 - RNA, 24 nt, Human
cugcggggggccugugggggcccu

SEQ ID NO: 391044 - RNA, 22 nt, Human
cuggagcuucccaggcgacuga

SEQ ID NO: 391045 - RNA, 25 nt, Human
cuggggacccggggcagccuagagc

SEQ ID NO: 391046 - RNA, 19 nt, Human
cugggucucugucauuuuc

SEQ ID NO: 391047 - RNA, 21 nt, Human
cugugaauggggaggggugca

SEQ ID NO: 391048 - RNA, 19 nt, Human
cugugccugcuaggccacc

SEQ ID NO: 391049 - RNA, 21 nt, Human
cugugccugcuaggccaccug

SEQ ID NO: 391050 - RNA, 21 nt, Human
cugugggggcccugggguugg

SEQ ID NO: 391051 - RNA, 21 nt, Human
cuugcaagcuccugagaucau

SEQ ID NO: 391052 - RNA, 25 nt, Human
cuugugaccaugcucacauguuguu

SEQ ID NO: 391053 - RNA, 18 nt, Human
gaacuguugacugcagcu

SEQ ID NO: 391054 - RNA, 19 nt, Human
gaaggaacggggcuggggc

SEQ ID NO: 391055 - RNA, 24 nt, Human
gacgucaggugauccaccugccuc

SEQ ID NO: 391056 - RNA, 22 nt, Human
gagcaguuugaaucgaugaccc

SEQ ID NO: 391057 - RNA, 20 nt, Human
gaguagcugggauuacaugc

SEQ ID NO: 391058 - RNA, 21 nt, Human
gauuacaggcgugacgaccgc

SEQ ID NO: 391059 - RNA, 21 nt, Human
gccagguguccugugccugcu

SEQ ID NO: 391060 - RNA, 19 nt, Human
gccugugggggcccugggg

SEQ ID NO: 391061 - RNA, 22 nt, Human
gcggggcagcagaugguaugag

SEQ ID NO: 391062 - RNA, 18 nt, Human
gcuggggacccggggcag

SEQ ID NO: 391063 - RNA, 21 nt, Human
gcuggggcagcggccuucucc

SEQ ID NO: 391064 - RNA, 22 nt, Human
gcugguuuuguuuuuguuuuua

SEQ ID NO: 391065 - RNA, 22 nt, Human
gcuuuuuuugagggguguguga

SEQ ID NO: 391066 - RNA, 19 nt, Human
ggaaacuggagcuucccag

SEQ ID NO: 391067 - RNA, 18 nt, Human
ggagauggguagagaagg

SEQ ID NO: 391068 - RNA, 18 nt, Human
ggcagcagaugguaugag

SEQ ID NO: 391069 - RNA, 20 nt, Human
ggccugugggggcccugggg

SEQ ID NO: 391070 - RNA, 18 nt, Human
gggagauggguagagaag

SEQ ID NO: 391071 - RNA, 18 nt, Human
gggaggggugcacacugg

SEQ ID NO: 391072 - RNA, 20 nt, Human
gggcuggggcagcggccuuc

SEQ ID NO: 391073 - RNA, 21 nt, Human
ggggaugggggagauggguag

SEQ ID NO: 391074 - RNA, 22 nt, Human
ggguuucaccauguuggccagg

SEQ ID NO: 391075 - RNA, 22 nt, Human
gguagugucagauuauuucugu

SEQ ID NO: 391076 - RNA, 19 nt, Human
gguuuuguuuuuguuuuua

SEQ ID NO: 391077 - RNA, 21 nt, Human
guaggaacuaaaggcuuuuuu

SEQ ID NO: 391078 - RNA, 26 nt, Human
guccugugccugcuaggccaccuggu

SEQ ID NO: 391079 - RNA, 24 nt, Human
gugauccaccugccucggccugcc

SEQ ID NO: 391080 - RNA, 24 nt, Human
gugauucuuccgccucagccuccc

SEQ ID NO: 391081 - RNA, 19 nt, Human
uaaauuaaagacuuguuuu

SEQ ID NO: 391082 - RNA, 20 nt, Human
uaaccuauuccauuccccuu

SEQ ID NO: 391083 - RNA, 22 nt, Human
uaauuuuuguauuuuuaguaga

SEQ ID NO: 391084 - RNA, 18 nt, Human
uacaaagaauagaucgac

SEQ ID NO: 391085 - RNA, 27 nt, Human
uacacccuccccuccccaauuugcccc

SEQ ID NO: 391086 - RNA, 22 nt, Human
uagauacaggguuucaccaugu

SEQ ID NO: 391087 - RNA, 21 nt, Human
uagggaggcagaggcuucugg

SEQ ID NO: 391088 - RNA, 22 nt, Human
uagggaggcagaggcuucuggc

SEQ ID NO: 391089 - RNA, 25 nt, Human
uaguaagcaguucuguggggaagcg

SEQ ID NO: 391090 - RNA, 24 nt, Human
uaguagauacaggguuucaccaug

SEQ ID NO: 391091 - RNA, 19 nt, Human
uaugagggugaguccuggg

SEQ ID NO: 391092 - RNA, 19 nt, Human
ucaagugauucuuccgccu

SEQ ID NO: 391093 - RNA, 24 nt, Human
ucacuggaaccuccgccucccggg

SEQ ID NO: 391094 - RNA, 25 nt, Human
ucacuggaaccuccgccucccgggu

SEQ ID NO: 391095 - RNA, 19 nt, Human
ucagauuauuucuguugcu

SEQ ID NO: 391096 - RNA, 20 nt, Human
ucagccucccgaguagcugg

SEQ ID NO: 391097 - RNA, 20 nt, Human
uccaugagaucugggucucu

SEQ ID NO: 391098 - RNA, 21 nt, Human
uccaugagaucugggucucug

SEQ ID NO: 391099 - RNA, 18 nt, Human
ucccgaguagcugggauu

SEQ ID NO: 391100 - RNA, 20 nt, Human
ucccggguucaagugauucu

SEQ ID NO: 391101 - RNA, 24 nt, Human
ucccggguucaagugauucuuccg

SEQ ID NO: 391102 - RNA, 27 nt, Human
ucccuguuacccagacuggagugcaau

SEQ ID NO: 391103 - RNA, 20 nt, Human
ucucaagcugcccagaagcu

SEQ ID NO: 391104 - RNA, 21 nt, Human
ucuccauuuccuuagaagagc

SEQ ID NO: 391105 - RNA, 20 nt, Human
ucucccuguuacccagacug

SEQ ID NO: 391106 - RNA, 22 nt, Human
ucucccuguuacccagacugga

SEQ ID NO: 391107 - RNA, 24 nt, Human
ucucccuguuacccagacuggagu

SEQ ID NO: 391108 - RNA, 23 nt, Human
ucuccggguaaguaccgaaugca

SEQ ID NO: 391109 - RNA, 25 nt, Human
ucugaaaucuucagggucuggaccc

SEQ ID NO: 391110 - RNA, 20 nt, Human
ucugcagccucugaaaucuu

SEQ ID NO: 391111 - RNA, 18 nt, Human
ugaaagacaggcucuggc

SEQ ID NO: 391112 - RNA, 21 nt, Human
ugaaagacaggcucuggcugu

SEQ ID NO: 391113 - RNA, 22 nt, Human
ugaauacauggacagcccuuuu

SEQ ID NO: 391114 - RNA, 24 nt, Human
ugacgucaggugauccaccugccu

SEQ ID NO: 391115 - RNA, 19 nt, Human
ugacugcagcugcuaguga

SEQ ID NO: 391116 - RNA, 27 nt, Human
ugagagcaguggagagaccuggggaug

SEQ ID NO: 391117 - RNA, 28 nt, Human
ugagagcaguggagagaccuggggaugu

SEQ ID NO: 391118 - RNA, 21 nt, Human
ugagaucauaguaaggggcuu

SEQ ID NO: 391119 - RNA, 20 nt, Human
ugcacuccggggccuucagg

SEQ ID NO: 391120 - RNA, 23 nt, Human
ugcaguguuacacuagaauaugu

SEQ ID NO: 391121 - RNA, 18 nt, Human
ugccauagaugaacugga

SEQ ID NO: 391122 - RNA, 18 nt, Human
ugccucggccugccaaag

SEQ ID NO: 391123 - RNA, 23 nt, Human
ugcuagugacaagccuggggcca

SEQ ID NO: 391124 - RNA, 18 nt, Human
ugcugcggggggccugug

SEQ ID NO: 391125 - RNA, 20 nt, Human
ugcugggauuacaggcguga

SEQ ID NO: 391126 - RNA, 25 nt, Human
ugcuuagguugauaggccuaaacuu

SEQ ID NO: 391127 - RNA, 20 nt, Human
uggaauugugaaaaaggcuc

SEQ ID NO: 391128 - RNA, 21 nt, Human
uggaauugugaaaaaggcucu

SEQ ID NO: 391129 - RNA, 21 nt, Human
uggccaggcuggucucaaacu

SEQ ID NO: 391130 - RNA, 19 nt, Human
uggcuggacugccauagau

SEQ ID NO: 391131 - RNA, 24 nt, Human
uggcuggacugccauagaugaacu

SEQ ID NO: 391132 - RNA, 18 nt, Human
ugggauuacaggcgugac

SEQ ID NO: 391133 - RNA, 19 nt, Human
ugggauuacaggcgugacg

SEQ ID NO: 391134 - RNA, 20 nt, Human
ugggauuacaggcgugacga

SEQ ID NO: 391135 - RNA, 21 nt, Human
ugggauuacaggcgugacgac

SEQ ID NO: 391136 - RNA, 22 nt, Human
ugggauuacaggcgugacgacc

SEQ ID NO: 391137 - RNA, 23 nt, Human
ugggauuacaggcgugacgaccg

SEQ ID NO: 391138 - RNA, 24 nt, Human
ugggauuacaugcgcgcaccacca

SEQ ID NO: 391139 - RNA, 18 nt, Human
uggggaaacuggagcuuc

SEQ ID NO: 391140 - RNA, 21 nt, Human
uggggagcuggggacccgggg

SEQ ID NO: 391141 - RNA, 21 nt, Human
uggggaggggugcacacugga

SEQ ID NO: 391142 - RNA, 24 nt, Human
uggggaggggugcacacuggauuu

SEQ ID NO: 391143 - RNA, 26 nt, Human
ugggggaugggggagauggguagaga

SEQ ID NO: 391144 - RNA, 19 nt, Human
ugugaauggggaggggugc

SEQ ID NO: 391145 - RNA, 21 nt, Human
uguggggaagcggggcagcag

SEQ ID NO: 391146 - RNA, 20 nt, Human
uguuacccagacuggagugc

SEQ ID NO: 391147 - RNA, 21 nt, Human
uuaggcugguggguuucucag

SEQ ID NO: 391148 - RNA, 24 nt, Human
uuaguagauacaggguuucaccau

SEQ ID NO: 391149 - RNA, 23 nt, Human
uucaagugauucuuccgccucag

SEQ ID NO: 391150 - RNA, 24 nt, Human
uucaagugauucuuccgccucagc

SEQ ID NO: 391151 - RNA, 22 nt, Human
uucuuaggcugguggguuucuc

SEQ ID NO: 391152 - RNA, 23 nt, Human
uugaacacuacaauaaucuuuuu

SEQ ID NO: 391153 - RNA, 24 nt, Human
uuucaccauguuggccaggcuggu

SEQ ID NO: 391154 - RNA, 23 nt, Human
uuuggauuuaggcaaaaaacaaa

SEQ ID NO: 391155 - RNA, 19 nt, Human
uuuuggguuugcccucuca

SEQ ID NO: 391156 - RNA, 24 nt, Human
uuuuuaguagauacaggguuucac

SEQ ID NO: 391157 - RNA, 18 nt, Human
uuuuuguauuuuuaguag

SEQ ID NO: 391158 - RNA, 21 nt, Human
uuuuuguauuuuuaguagaua

SEQ ID NO: 391159 - RNA, 18 nt, Human
uuuuuuuuuuuuuuuuug

SEQ ID NO: 391160 - RNA, 22 nt, Human
aaaaccuuucaaggugggggug

SEQ ID NO: 391161 - RNA, 21 nt, Human
aaacaaaaccauaaacaaagc

SEQ ID NO: 391162 - RNA, 23 nt, Human
aaacagcuguugauaaaaauuuu

SEQ ID NO: 391163 - RNA, 31 nt, Human
aaaucacccccucaaaguuuugcccccccag

SEQ ID NO: 391164 - RNA, 21 nt, Human
aagaaaaagacgaguccaagg

SEQ ID NO: 391165 - RNA, 25 nt, Human
aagaaaaagacgaguccaaggugaa

SEQ ID NO: 391166 - RNA, 19 nt, Human
aagaaaagccaaaaaaaau

SEQ ID NO: 391167 - RNA, 19 nt, Human
aagggggguaaaaaaaaaa

SEQ ID NO: 391168 - RNA, 30 nt, Human
aaugaaggaggaagaaaagccaaaaaaaaa

SEQ ID NO: 391169 - RNA, 19 nt, Human
acaguuauguauauauaua

SEQ ID NO: 391170 - RNA, 19 nt, Human
agagggaggaggggagggg

SEQ ID NO: 391171 - RNA, 25 nt, Human
aggaagaaaagccaaaaaaaaucac

SEQ ID NO: 391172 - RNA, 23 nt, Human
aggaggaagaaaagccaaaaaaa

SEQ ID NO: 391173 - RNA, 20 nt, Human
aggaggggaggggaaggggg

SEQ ID NO: 391174 - RNA, 19 nt, Human
agggaggaggggaggggaa

SEQ ID NO: 391175 - RNA, 21 nt, Human
agggaggaggggaggggaagg

SEQ ID NO: 391176 - RNA, 18 nt, Human
aggggaaggggggggaga

SEQ ID NO: 391177 - RNA, 22 nt, Human
aggggaggggaaggggggggag

SEQ ID NO: 391178 - RNA, 20 nt, Human
agggggguaaaaaaaaaaaa

SEQ ID NO: 391179 - RNA, 22 nt, Human
agguggggguggggggcaaauu

SEQ ID NO: 391180 - RNA, 20 nt, Human
aguuauguauauauauauau

SEQ ID NO: 391181 - RNA, 21 nt, Human
caaaguuuugcccccccaaaa

SEQ ID NO: 391182 - RNA, 31 nt, Human
caaauuaagaaaagugaaacaaaaccauaaa

SEQ ID NO: 391183 - RNA, 24 nt, Human
caauuuuggaagaaaaaugaagga

SEQ ID NO: 391184 - RNA, 23 nt, Human
ccaaaaaaaaucacccccucaaa

SEQ ID NO: 391185 - RNA, 19 nt, Human
ccaaucaugagguucuucu

SEQ ID NO: 391186 - RNA, 20 nt, Human
ccacauggcacaaaauuaag

SEQ ID NO: 391187 - RNA, 20 nt, Human
ccaccagcagcaauuuugga

SEQ ID NO: 391188 - RNA, 21 nt, Human
cccaccagcagcaauuuugga

SEQ ID NO: 391189 - RNA, 23 nt, Human
ccccaaaaaauauugcaagaaaa

SEQ ID NO: 391190 - RNA, 26 nt, Human
ccccaaaaaauauugcaagaaaaaga

SEQ ID NO: 391191 - RNA, 26 nt, Human
cccccccaaaaaauauugcaagaaaa

SEQ ID NO: 391192 - RNA, 23 nt, Human
cccccucaaaguuuugccccccc

SEQ ID NO: 391193 - RNA, 26 nt, Human
cccccucaaaguuuugcccccccaaa

SEQ ID NO: 391194 - RNA, 23 nt, Human
ccucaaaguuuugcccccccaaa

SEQ ID NO: 391195 - RNA, 21 nt, Human
ccuggggaggggaaaagaggg

SEQ ID NO: 391196 - RNA, 26 nt, Human
cuauccgaacuacauaacaguuaugu

SEQ ID NO: 391197 - RNA, 28 nt, Human
cuggggaggggaaaagagggaggagggg

SEQ ID NO: 391198 - RNA, 23 nt, Human
cuuucaagguggggguggggggc

SEQ ID NO: 391199 - RNA, 20 nt, Human
gaggggaaaagagggaggag

SEQ ID NO: 391200 - RNA, 20 nt, Human
ggaggaggggaggggaaggg

SEQ ID NO: 391201 - RNA, 22 nt, Human
ggaggaggggaggggaaggggg

SEQ ID NO: 391202 - RNA, 23 nt, Human
ggaggaggggaggggaagggggg

SEQ ID NO: 391203 - RNA, 19 nt, Human
ggaggggaaaagagggagg

SEQ ID NO: 391204 - RNA, 29 nt, Human
ggaggggaaaagagggaggaggggagggg

SEQ ID NO: 391205 - RNA, 23 nt, Human
gggaaaagagggaggaggggagg

SEQ ID NO: 391206 - RNA, 22 nt, Human
ggggguggggggcaaauuaaga

SEQ ID NO: 391207 - RNA, 23 nt, Human
gugaaacaaaaccauaaacaaag

SEQ ID NO: 391208 - RNA, 21 nt, Human
uaagaaaagugaaacaaaacc

SEQ ID NO: 391209 - RNA, 22 nt, Human
uaagaaaagugaaacaaaacca

SEQ ID NO: 391210 - RNA, 23 nt, Human
uauguauauauauauauuuuuua

SEQ ID NO: 391211 - RNA, 21 nt, Human
ucaagguggggguggggggca

SEQ ID NO: 391212 - RNA, 21 nt, Human
ucugcuugggggucuuuuucu

SEQ ID NO: 391213 - RNA, 23 nt, Human
ugaaacaaaaccauaaacaaagc

SEQ ID NO: 391214 - RNA, 24 nt, Human
ugaaacaaaaccauaaacaaagca

SEQ ID NO: 391215 - RNA, 26 nt, Human
ugcaagaaaaagacgaguccaagguu

SEQ ID NO: 391216 - RNA, 18 nt, Human
ugcacgcgugaguuuggg

SEQ ID NO: 391217 - RNA, 19 nt, Human
uggaagaaaaaugaaggag

SEQ ID NO: 391218 - RNA, 23 nt, Human
uggcacaaaauuaagagaguaca

SEQ ID NO: 391219 - RNA, 21 nt, Human
uggggaggggaaaagagggag

SEQ ID NO: 391220 - RNA, 27 nt, Human
uggggaggggaaaagagggaggagggg

SEQ ID NO: 391221 - RNA, 25 nt, Human
uuaaacgcuacaaagacuuuaaaca

SEQ ID NO: 391222 - RNA, 18 nt, Human
uuucugcuugggggucuu

SEQ ID NO: 391223 - RNA, 23 nt, Human
aaaaaacaaguaaaacacgccuu

SEQ ID NO: 391224 - RNA, 21 nt, Human
aaaaagccuagguggggggug

SEQ ID NO: 391225 - RNA, 25 nt, Human
aaaacaaaaaccaccgugaaaguaa

SEQ ID NO: 391226 - RNA, 23 nt, Human
aaacaaguaaaacacgccuuuaa

SEQ ID NO: 391227 - RNA, 21 nt, Human
aaacacacaucacacacucuu

SEQ ID NO: 391228 - RNA, 20 nt, Human
aaacccaaaaagccuaggug

SEQ ID NO: 391229 - RNA, 23 nt, Human
aaagcagaaaucaggaaguggag

SEQ ID NO: 391230 - RNA, 24 nt, Human
aaagcagaaaucaggaaguggaga

SEQ ID NO: 391231 - RNA, 26 nt, Human
aagaaaaaacaaaaaccaccgugaaa

SEQ ID NO: 391232 - RNA, 24 nt, Human
aagaagccgaaguagcugaaggca

SEQ ID NO: 391233 - RNA, 21 nt, Human
aagggccgccccuuccugccg

SEQ ID NO: 391234 - RNA, 21 nt, Human
aagucaccucugcccucucug

SEQ ID NO: 391235 - RNA, 19 nt, Human
accaccgugaaaguaaagu

SEQ ID NO: 391236 - RNA, 18 nt, Human
agcaauaagaaaaaacaa

SEQ ID NO: 391237 - RNA, 21 nt, Human
agcaauaagaaaaaacaaaaa

SEQ ID NO: 391238 - RNA, 21 nt, Human
agcacugucaagaaaucuaca

SEQ ID NO: 391239 - RNA, 20 nt, Human
agcagcagcagcagcaggaa

SEQ ID NO: 391240 - RNA, 23 nt, Human
agcagcagcaggaaugggggcag

SEQ ID NO: 391241 - RNA, 18 nt, Human
agcaggaagaagcuucug

SEQ ID NO: 391242 - RNA, 20 nt, Human
agcaggaaugggggcagcca

SEQ ID NO: 391243 - RNA, 19 nt, Human
agcccccggugggcaccag

SEQ ID NO: 391244 - RNA, 23 nt, Human
agccuccaauauugcacaacuuc

SEQ ID NO: 391245 - RNA, 22 nt, Human
agcugaaaccuggaacacaaac

SEQ ID NO: 391246 - RNA, 19 nt, Human
aggaaugggggcagccagc

SEQ ID NO: 391247 - RNA, 18 nt, Human
aggcaagggccuggcugc

SEQ ID NO: 391248 - RNA, 23 nt, Human
agggguuuuguguuggaaucagu

SEQ ID NO: 391249 - RNA, 18 nt, Human
aggugggggguggggagg

SEQ ID NO: 391250 - RNA, 19 nt, Human
aggugggggguggggaggg

SEQ ID NO: 391251 - RNA, 19 nt, Human
aucuacaaaacacacauca

SEQ ID NO: 391252 - RNA, 23 nt, Human
augguaaaaaaaaaaacuaugua

SEQ ID NO: 391253 - RNA, 21 nt, Human
auugcacaacuucacccaagu

SEQ ID NO: 391254 - RNA, 22 nt, Human
cacacacucuuaaaaaaacaag

SEQ ID NO: 391255 - RNA, 22 nt, Human
cacacaguagugaacaggaauc

SEQ ID NO: 391256 - RNA, 19 nt, Human
cacagcaauaagaaaaaac

SEQ ID NO: 391257 - RNA, 20 nt, Human
cacaucacacacucuuaaaa

SEQ ID NO: 391258 - RNA, 24 nt, Human
caccagcaggccagggaugcagcc

SEQ ID NO: 391259 - RNA, 23 nt, Human
caccucugcccucucugagguuc

SEQ ID NO: 391260 - RNA, 25 nt, Human
caccugggcuggguuugggggcggg

SEQ ID NO: 391261 - RNA, 24 nt, Human
cagcaauaagaaaaaacaaaaacc

SEQ ID NO: 391262 - RNA, 23 nt, Human
cagcagcagcagcagcagcagga

SEQ ID NO: 391263 - RNA, 21 nt, Human
cagcagcagcggaaacgggag

SEQ ID NO: 391264 - RNA, 19 nt, Human
cagcagcaggaaugggggc

SEQ ID NO: 391265 - RNA, 25 nt, Human
cagcagcaggaaugggggcagccag

SEQ ID NO: 391266 - RNA, 18 nt, Human
cagcagcggaaacgggag

SEQ ID NO: 391267 - RNA, 22 nt, Human
cagcagcggaaacgggaggugc

SEQ ID NO: 391268 - RNA, 25 nt, Human
cagcaggaagaagcuucugggcuuc

SEQ ID NO: 391269 - RNA, 22 nt, Human
cagccacagagcagcagcagca

SEQ ID NO: 391270 - RNA, 23 nt, Human
caugagccaugagccugucuccc

SEQ ID NO: 391271 - RNA, 24 nt, Human
ccacagcaauaagaaaaaacaaaa

SEQ ID NO: 391272 - RNA, 21 nt, Human
ccagcaggccagggaugcagc

SEQ ID NO: 391273 - RNA, 21 nt, Human
ccccagcacuuugaagucacc

SEQ ID NO: 391274 - RNA, 18 nt, Human
ccccuuccugccgccucc

SEQ ID NO: 391275 - RNA, 19 nt, Human
cccgccuuuccccuuucuc

SEQ ID NO: 391276 - RNA, 20 nt, Human
cccucaggacggagucccca

SEQ ID NO: 391277 - RNA, 21 nt, Human
cccucaggacggaguccccag

SEQ ID NO: 391278 - RNA, 19 nt, Human
ccuacagucagccuccaau

SEQ ID NO: 391279 - RNA, 21 nt, Human
ccuccaccccagugcugaggg

SEQ ID NO: 391280 - RNA, 26 nt, Human
ccuccggacagccuuucgcccagucu

SEQ ID NO: 391281 - RNA, 19 nt, Human
ccucuguuuaacacugcag

SEQ ID NO: 391282 - RNA, 24 nt, Human
cgagggaagcugaaaccuggaaca

SEQ ID NO: 391283 - RNA, 19 nt, Human
cggcccagggcaggcaccg

SEQ ID NO: 391284 - RNA, 22 nt, Human
cuaggugggggguggggagggg

SEQ ID NO: 391285 - RNA, 25 nt, Human
cucaugauaacauaagagauaaagg

SEQ ID NO: 391286 - RNA, 20 nt, Human
cucugcggcaaggcaccugg

SEQ ID NO: 391287 - RNA, 18 nt, Human
cugaaaccuggaacacaa

SEQ ID NO: 391288 - RNA, 23 nt, Human
cuuaaaaacacugaccuaaaccu

SEQ ID NO: 391289 - RNA, 23 nt, Human
gaacaaaacccaaaaagccuagg

SEQ ID NO: 391290 - RNA, 18 nt, Human
gaagucaccucugcccuc

SEQ ID NO: 391291 - RNA, 21 nt, Human
gaugcagccuccugcacuggg

SEQ ID NO: 391292 - RNA, 25 nt, Human
gcagcagcagcaggaaugggggcag

SEQ ID NO: 391293 - RNA, 24 nt, Human
gccagcuuccugcggcccggcaca

SEQ ID NO: 391294 - RNA, 18 nt, Human
gcccuggggccccuuccu

SEQ ID NO: 391295 - RNA, 21 nt, Human
gccucccuacccucaaguaac

SEQ ID NO: 391296 - RNA, 20 nt, Human
gcuucugggcuuccgcaagg

SEQ ID NO: 391297 - RNA, 18 nt, Human
ggacucagggagcagcau

SEQ ID NO: 391298 - RNA, 25 nt, Human
ggagagaauuccuagaaucuguaga

SEQ ID NO: 391299 - RNA, 18 nt, Human
ggcccggcacaggcacag

SEQ ID NO: 391300 - RNA, 21 nt, Human
gggcaggcaccgcccugagcc

SEQ ID NO: 391301 - RNA, 19 nt, Human
gggcggggacuggacucag

SEQ ID NO: 391302 - RNA, 20 nt, Human
gggcggggacuggacucagg

SEQ ID NO: 391303 - RNA, 20 nt, Human
ggggcggggacuggacucag

SEQ ID NO: 391304 - RNA, 23 nt, Human
ggggguggggaggggggucccgg

SEQ ID NO: 391305 - RNA, 22 nt, Human
gguuacuguguuuccaugaaaa

SEQ ID NO: 391306 - RNA, 20 nt, Human
gugcgcccagaccugccagg

SEQ ID NO: 391307 - RNA, 25 nt, Human
uaaaaauacccgccuuuccccuuuc

SEQ ID NO: 391308 - RNA, 23 nt, Human
uaaaacacgccuuuaacguccuc

SEQ ID NO: 391309 - RNA, 22 nt, Human
uaaaccucucacuuuaccuucc

SEQ ID NO: 391310 - RNA, 25 nt, Human
uaaagaaauggauaguaaucaacug

SEQ ID NO: 391311 - RNA, 20 nt, Human
uaacaacaggagcgagggaa

SEQ ID NO: 391312 - RNA, 23 nt, Human
uaacuugggucaaucuuuggcuu

SEQ ID NO: 391313 - RNA, 20 nt, Human
uaagaaaaaaaagucuccag

SEQ ID NO: 391314 - RNA, 22 nt, Human
uaagaaaaaaaagucuccaggu

SEQ ID NO: 391315 - RNA, 23 nt, Human
uaaguagugucuaccuaucuccc

SEQ ID NO: 391316 - RNA, 20 nt, Human
uaccucuguaaaaaugaagg

SEQ ID NO: 391317 - RNA, 24 nt, Human
uaccuuccuugaacaaaacccaaa

SEQ ID NO: 391318 - RNA, 21 nt, Human
uagcugaaggcaccugggcug

SEQ ID NO: 391319 - RNA, 18 nt, Human
uaggugggggguggggag

SEQ ID NO: 391320 - RNA, 19 nt, Human
uaggugggggguggggagg

SEQ ID NO: 391321 - RNA, 26 nt, Human
uaguaaucaaugcacgcgcacacaca

SEQ ID NO: 391322 - RNA, 28 nt, Human
uaugguaaaaaaaaaaacuauguacauc

SEQ ID NO: 391323 - RNA, 22 nt, Human
ucaacuaaaauaagaaaaaaaa

SEQ ID NO: 391324 - RNA, 28 nt, Human
ucaacuaaaauaagaaaaaaaagucucc

SEQ ID NO: 391325 - RNA, 21 nt, Human
ucacaguuuuccuuaaagcag

SEQ ID NO: 391326 - RNA, 27 nt, Human
uccccagcacuuugaagucaccucugc

SEQ ID NO: 391327 - RNA, 21 nt, Human
uccgcaagggcacgcaggggc

SEQ ID NO: 391328 - RNA, 22 nt, Human
uccuccgcagaguccuggaaaa

SEQ ID NO: 391329 - RNA, 19 nt, Human
ucucccagcugcccagccc

SEQ ID NO: 391330 - RNA, 22 nt, Human
ucucccaucccaaaaacuucuu

SEQ ID NO: 391331 - RNA, 19 nt, Human
ucucugcggcaaggcaccu

SEQ ID NO: 391332 - RNA, 24 nt, Human
ucuguauuacagcacugucaagaa

SEQ ID NO: 391333 - RNA, 18 nt, Human
ugaaaugcauaaacguca

SEQ ID NO: 391334 - RNA, 22 nt, Human
ugaacaaaacccaaaaagccua

SEQ ID NO: 391335 - RNA, 20 nt, Human
ugccagguaagggccgcccc

SEQ ID NO: 391336 - RNA, 19 nt, Human
ugccgucuguauuacagca

SEQ ID NO: 391337 - RNA, 19 nt, Human
ugcgcccagaccugccagg

SEQ ID NO: 391338 - RNA, 23 nt, Human
ugcggcaaggcaccuggucugcc

SEQ ID NO: 391339 - RNA, 22 nt, Human
uggauucucucccaucccaaaa

SEQ ID NO: 391340 - RNA, 21 nt, Human
uggggaggggggucccggccc

SEQ ID NO: 391341 - RNA, 23 nt, Human
ugggggcagccagcuuccugcgg

SEQ ID NO: 391342 - RNA, 19 nt, Human
ugggggguggggagggggg

SEQ ID NO: 391343 - RNA, 21 nt, Human
ugucaagaaaucuacaaaaca

SEQ ID NO: 391344 - RNA, 24 nt, Human
ugucaagaaaucuacaaaacacac

SEQ ID NO: 391345 - RNA, 20 nt, Human
uuaaaaaggggaagggguuu

SEQ ID NO: 391346 - RNA, 26 nt, Human
uuaaagcagaaaucaggaaguggaga

SEQ ID NO: 391347 - RNA, 24 nt, Human
uuccacagcaauaagaaaaaacaa

SEQ ID NO: 391348 - RNA, 21 nt, Human
uuccucaaugcacaccugugc

SEQ ID NO: 391349 - RNA, 25 nt, Human
uuccugccguuccuccgcagagucc

SEQ ID NO: 391350 - RNA, 23 nt, Human
uucucaaugccucuguuuaacac

SEQ ID NO: 391351 - RNA, 20 nt, Human
uugaacaaaacccaaaaagc

SEQ ID NO: 391352 - RNA, 19 nt, Human
uugaucuauggcauuagaa

SEQ ID NO: 391353 - RNA, 18 nt, Human
uugggggcggggacugga

SEQ ID NO: 391354 - RNA, 26 nt, Human
uuuaaaaauacccgccuuuccccuuu

SEQ ID NO: 391355 - RNA, 19 nt, Human
uuugaaacagccacagagc

SEQ ID NO: 391356 - RNA, 19 nt, Human
uuugaagucaccucugccc

SEQ ID NO: 391357 - RNA, 24 nt, Human
aaaaacacaacgaaaccuguaaga

SEQ ID NO: 391358 - RNA, 21 nt, Human
aaaaagaaacagauuaggcaa

SEQ ID NO: 391359 - RNA, 27 nt, Human
aaagaaacagauuaggcaaagaucaga

SEQ ID NO: 391360 - RNA, 18 nt, Human
aagaacuaggggaaaagg

SEQ ID NO: 391361 - RNA, 20 nt, Human
acaaaggggagaagcaggga

SEQ ID NO: 391362 - RNA, 19 nt, Human
acgaaaccuguaagaacuu

SEQ ID NO: 391363 - RNA, 21 nt, Human
acggaacagcaagagccccaa

SEQ ID NO: 391364 - RNA, 18 nt, Human
agaagaaacggaacagca

SEQ ID NO: 391365 - RNA, 19 nt, Human
agcagggagaagaaacgga

SEQ ID NO: 391366 - RNA, 23 nt, Human
gaaaaagaaacagauuaggcaaa

SEQ ID NO: 391367 - RNA, 19 nt, Human
gaaaaggaaaaagaaacag

SEQ ID NO: 391368 - RNA, 21 nt, Human
gaaacggaacagcaagagccc

SEQ ID NO: 391369 - RNA, 23 nt, Human
gaugacaaaggggagaagcaggg

SEQ ID NO: 391370 - RNA, 24 nt, Human
gaugacaaaggggagaagcaggga

SEQ ID NO: 391371 - RNA, 21 nt, Human
gggcaggaaagaaguuucuga

SEQ ID NO: 391372 - RNA, 20 nt, Human
uagauuaaaaaacacaacga

SEQ ID NO: 391373 - RNA, 27 nt, Human
ucagggcaggaaagaaguuucugagga

SEQ ID NO: 391374 - RNA, 19 nt, Human
ugcgccgccaccugcagcc

SEQ ID NO: 391375 - RNA, 20 nt, Human
aaaacaaacaccgcggcucc

SEQ ID NO: 391376 - RNA, 19 nt, Human
aaacaaacaccgcggcucc

SEQ ID NO: 391377 - RNA, 19 nt, Human
aaaccaaacaccaaguaga

SEQ ID NO: 391378 - RNA, 21 nt, Human
aagagaccaaaacagaggaaa

SEQ ID NO: 391379 - RNA, 22 nt, Human
aagcagagcagucaggagacaa

SEQ ID NO: 391380 - RNA, 24 nt, Human
aaggugauggaauauggggugagg

SEQ ID NO: 391381 - RNA, 18 nt, Human
aaggugcccuuucacccu

SEQ ID NO: 391382 - RNA, 21 nt, Human
aauauggggugaggggaggaa

SEQ ID NO: 391383 - RNA, 19 nt, Human
aaugcaggcaacacugaga

SEQ ID NO: 391384 - RNA, 19 nt, Human
acaaugcuaaaggaaagcc

SEQ ID NO: 391385 - RNA, 22 nt, Human
acagaggaaaacaguuuccaaa

SEQ ID NO: 391386 - RNA, 24 nt, Human
acaggcagugcccagugccgaggu

SEQ ID NO: 391387 - RNA, 20 nt, Human
accccacccccaaguccugg

SEQ ID NO: 391388 - RNA, 20 nt, Human
agaagagugagaugucuugc

SEQ ID NO: 391389 - RNA, 21 nt, Human
agaagcuuucacaaaacaaac

SEQ ID NO: 391390 - RNA, 22 nt, Human
agagaccaaaacagaggaaaac

SEQ ID NO: 391391 - RNA, 18 nt, Human
agagaggaugagggcugg

SEQ ID NO: 391392 - RNA, 24 nt, Human
agagcagucaggagacaagcauaa

SEQ ID NO: 391393 - RNA, 18 nt, Human
agaggccaagauaugcuu

SEQ ID NO: 391394 - RNA, 21 nt, Human
agcuuucacaaaacaaacacc

SEQ ID NO: 391395 - RNA, 18 nt, Human
aggguagagagagguucc

SEQ ID NO: 391396 - RNA, 24 nt, Human
agucuaggcacaaggugcccuuuc

SEQ ID NO: 391397 - RNA, 22 nt, Human
agugcugcccaucugaaaacgg

SEQ ID NO: 391398 - RNA, 23 nt, Human
auguugcccaaacuugggccaaa

SEQ ID NO: 391399 - RNA, 24 nt, Human
caagagcaagaagcaguucuuugu

SEQ ID NO: 391400 - RNA, 22 nt, Human
cacaaaacaaacaccgcggcuc

SEQ ID NO: 391401 - RNA, 22 nt, Human
cacaauaucauaaacugacagg

SEQ ID NO: 391402 - RNA, 22 nt, Human
cacugagacaugggagaggcca

SEQ ID NO: 391403 - RNA, 18 nt, Human
cacuggcuaccuuguuuu

SEQ ID NO: 391404 - RNA, 22 nt, Human
cagaagcuuucacaaaacaaag

SEQ ID NO: 391405 - RNA, 25 nt, Human
cagagcagacgcccaucccaaggac

SEQ ID NO: 391406 - RNA, 23 nt, Human
caggacugguggggacugcagga

SEQ ID NO: 391407 - RNA, 19 nt, Human
caggagacaagcauaaacc

SEQ ID NO: 391408 - RNA, 20 nt, Human
caggcuacagagcugucuga

SEQ ID NO: 391409 - RNA, 25 nt, Human
ccaaaacagaggaaaacaguuucca

SEQ ID NO: 391410 - RNA, 22 nt, Human
ccaggagcccuuuuaaguaucu

SEQ ID NO: 391411 - RNA, 20 nt, Human
ccaggcagcccuagucuagg

SEQ ID NO: 391412 - RNA, 21 nt, Human
cccacccccaaguccugggag

SEQ ID NO: 391413 - RNA, 20 nt, Human
cccaccggaccggaaacggg

SEQ ID NO: 391414 - RNA, 23 nt, Human
cccacggucaggacuggugggga

SEQ ID NO: 391415 - RNA, 23 nt, Human
cccauacagcuacugccaaaaug

SEQ ID NO: 391416 - RNA, 22 nt, Human
ccccaaguccugggagaaaugc

SEQ ID NO: 391417 - RNA, 21 nt, Human
ccccacccccaaguccuggga

SEQ ID NO: 391418 - RNA, 20 nt, Human
cccugagauggccagaaagc

SEQ ID NO: 391419 - RNA, 19 nt, Human
cccuuggccucaccuggga

SEQ ID NO: 391420 - RNA, 19 nt, Human
ccucuggauagucaaaccu

SEQ ID NO: 391421 - RNA, 21 nt, Human
ccugagauggccagaaagccc

SEQ ID NO: 391422 - RNA, 23 nt, Human
ccuguggucuuauccuggugaca

SEQ ID NO: 391423 - RNA, 20 nt, Human
cucuuccuucuuugcuuccc

SEQ ID NO: 391424 - RNA, 18 nt, Human
cugguggggacugcagga

SEQ ID NO: 391425 - RNA, 24 nt, Human
cugguggggacugcaggaugucag

SEQ ID NO: 391426 - RNA, 23 nt, Human
cuucccuguggucuuauccuggu

SEQ ID NO: 391427 - RNA, 22 nt, Human
cuuggccucaccugggacugac

SEQ ID NO: 391428 - RNA, 18 nt, Human
gaaaaaccaaacaccaag

SEQ ID NO: 391429 - RNA, 24 nt, Human
gaccagugugagguguuguagucc

SEQ ID NO: 391430 - RNA, 20 nt, Human
gagaccaaaacagaggaaaa

SEQ ID NO: 391431 - RNA, 22 nt, Human
gagcagaaaucugaggcuugaa

SEQ ID NO: 391432 - RNA, 22 nt, Human
gagcauuuggagggcccacggc

SEQ ID NO: 391433 - RNA, 19 nt, Human
gcacuggcuaccuuguuuu

SEQ ID NO: 391434 - RNA, 21 nt, Human
gcagagcagucaggagacaag

SEQ ID NO: 391435 - RNA, 19 nt, Human
gcagcccuagucuaggcac

SEQ ID NO: 391436 - RNA, 20 nt, Human
gcaggagcucuuuggggugu

SEQ ID NO: 391437 - RNA, 19 nt, Human
gcugcccaucugaaaacgg

SEQ ID NO: 391438 - RNA, 19 nt, Human
gcuguguuauaccugccuc

SEQ ID NO: 391439 - RNA, 20 nt, Human
gcuuguguaccccaggagcc

SEQ ID NO: 391440 - RNA, 20 nt, Human
ggaugagggcugguggcugg

SEQ ID NO: 391441 - RNA, 21 nt, Human
gggcaggagcucuuuggggug

SEQ ID NO: 391442 - RNA, 23 nt, Human
uaaaacgagcauuuggagggccc

SEQ ID NO: 391443 - RNA, 22 nt, Human
uaugcuugacagaaagggugau

SEQ ID NO: 391444 - RNA, 27 nt, Human
ucaagggccucuuguuggcuguucucc

SEQ ID NO: 391445 - RNA, 18 nt, Human
ucaccccacccccaaguc

SEQ ID NO: 391446 - RNA, 21 nt, Human
ucacucaggaccugcugggcu

SEQ ID NO: 391447 - RNA, 22 nt, Human
uccauggaguggggggaaggcu

SEQ ID NO: 391448 - RNA, 21 nt, Human
ucccagaccccugaggggccc

SEQ ID NO: 391449 - RNA, 21 nt, Human
ucccauacagcuacugccaaa

SEQ ID NO: 391450 - RNA, 24 nt, Human
ucccugagauggccagaaagcccu

SEQ ID NO: 391451 - RNA, 18 nt, Human
ucccuguggucuuauccu

SEQ ID NO: 391452 - RNA, 23 nt, Human
ucccuguggucuuauccugguga

SEQ ID NO: 391453 - RNA, 22 nt, Human
uccgcugaagauaaaauggggc

SEQ ID NO: 391454 - RNA, 20 nt, Human
ugaagauaaaauggggcugg

SEQ ID NO: 391455 - RNA, 18 nt, Human
ugagagggcaggagcucu

SEQ ID NO: 391456 - RNA, 21 nt, Human
ugagagggcaggagcucuucc

SEQ ID NO: 391457 - RNA, 24 nt, Human
ugagaugucuugcacuggcuaccu

SEQ ID NO: 391458 - RNA, 21 nt, Human
ugaggaaggcagaagugaauu

SEQ ID NO: 391459 - RNA, 23 nt, Human
ugauggaauauggggugagggga

SEQ ID NO: 391460 - RNA, 23 nt, Human
ugcaauacuugaaggauacccca

SEQ ID NO: 391461 - RNA, 21 nt, Human
ugcagcaucauagccuguggg

SEQ ID NO: 391462 - RNA, 22 nt, Human
ugcaggaugucagaagagugag

SEQ ID NO: 391463 - RNA, 22 nt, Human
ugcccaaacuugggccaaaaau

SEQ ID NO: 391464 - RNA, 20 nt, Human
ugcccaagagaccaaaacag

SEQ ID NO: 391465 - RNA, 22 nt, Human
ugcuauaaaacgagcauuugga

SEQ ID NO: 391466 - RNA, 23 nt, Human
uggaacaaugcuaaaggaaagca

SEQ ID NO: 391467 - RNA, 23 nt, Human
ugggaaaaaccaaacaccaagua

SEQ ID NO: 391468 - RNA, 22 nt, Human
ugggacugaccaggcagcccua

SEQ ID NO: 391469 - RNA, 18 nt, Human
ugggagaggccaagauau

SEQ ID NO: 391470 - RNA, 25 nt, Human
ugggagaggccaagauaugcuugac

SEQ ID NO: 391471 - RNA, 20 nt, Human
ugggccaaauguugcccaaa

SEQ ID NO: 391472 - RNA, 23 nt, Human
uggggugaggggaggaaccuggu

SEQ ID NO: 391473 - RNA, 19 nt, Human
uggguagguuugaguuuua

SEQ ID NO: 391474 - RNA, 22 nt, Human
ugguggcuggggguagacccag

SEQ ID NO: 391475 - RNA, 22 nt, Human
uguuguaguccagucucccggg

SEQ ID NO: 391476 - RNA, 25 nt, Human
uuacaacgucacacucccagacccc

SEQ ID NO: 391477 - RNA, 18 nt, Human
uucacaaaacaaacaccg

SEQ ID NO: 391478 - RNA, 20 nt, Human
uuccucuuacucuuuuucuc

SEQ ID NO: 391479 - RNA, 18 nt, Human
uucucccauacagcuacu

SEQ ID NO: 391480 - RNA, 26 nt, Human
uuuaagcagagcagucaggagacaag

SEQ ID NO: 391481 - RNA, 18 nt, Human
uuucacaaaacaaacacc

SEQ ID NO: 391482 - RNA, 23 nt, Human
uuuccucuuacucuuuuucuccc

SEQ ID NO: 391483 - RNA, 18 nt, Human
uuuguuguuguuccugcu

SEQ ID NO: 391484 - RNA, 20 nt, Human
aagccgcggcaggcccuccg

SEQ ID NO: 391485 - RNA, 22 nt, Human
acucacuugacccucagguccu

SEQ ID NO: 391486 - RNA, 19 nt, Human
aggaccagaagaggagaac

SEQ ID NO: 391487 - RNA, 18 nt, Human
aggaggaggcggggccag

SEQ ID NO: 391488 - RNA, 29 nt, Human
aggccccccgggcaggacccugcccagga

SEQ ID NO: 391489 - RNA, 18 nt, Human
agggcuagggcuugggac

SEQ ID NO: 391490 - RNA, 24 nt, Human
caccaggccccccgggcaggaccc

SEQ ID NO: 391491 - RNA, 20 nt, Human
cacggggcugggcagggcuu

SEQ ID NO: 391492 - RNA, 18 nt, Human
cagaacugcacucccgcc

SEQ ID NO: 391493 - RNA, 23 nt, Human
cagcggcugcuccagcucccuga

SEQ ID NO: 391494 - RNA, 23 nt, Human
caggaccagaagaggagaacccc

SEQ ID NO: 391495 - RNA, 18 nt, Human
caggaccugcagugggcc

SEQ ID NO: 391496 - RNA, 25 nt, Human
ccaccaggccccccgggcaggaccc

SEQ ID NO: 391497 - RNA, 19 nt, Human
ccacggggcugggcagggc

SEQ ID NO: 391498 - RNA, 18 nt, Human
ccagcccagcgacuggcc

SEQ ID NO: 391499 - RNA, 21 nt, Human
cccccaccaggccccccgggc

SEQ ID NO: 391500 - RNA, 22 nt, Human
ccccccgggcaggacccugccc

SEQ ID NO: 391501 - RNA, 20 nt, Human
cccccgggcaggacccugcc

SEQ ID NO: 391502 - RNA, 21 nt, Human
ccccgcuccgcgcacgccggg

SEQ ID NO: 391503 - RNA, 20 nt, Human
ccccgggggccuggagcagg

SEQ ID NO: 391504 - RNA, 19 nt, Human
cccucagguccuggugcgg

SEQ ID NO: 391505 - RNA, 21 nt, Human
ccuagggcuagggcuugggac

SEQ ID NO: 391506 - RNA, 21 nt, Human
ccuccugcccugccuccccca

SEQ ID NO: 391507 - RNA, 27 nt, Human
ccuccugcccugccucccccaccaggc

SEQ ID NO: 391508 - RNA, 25 nt, Human
ccugccacaaagcuggcggccacgg

SEQ ID NO: 391509 - RNA, 18 nt, Human
ccuggcccagcccagcga

SEQ ID NO: 391510 - RNA, 23 nt, Human
ccuggcccagcccagcgacuggc

SEQ ID NO: 391511 - RNA, 26 nt, Human
cgccgcgccuccgcugcuggcugccc

SEQ ID NO: 391512 - RNA, 19 nt, Human
cgggcaggaccagaagagg

SEQ ID NO: 391513 - RNA, 22 nt, Human
cgggggccuggagcaggggcgu

SEQ ID NO: 391514 - RNA, 22 nt, Human
cuccugccucagaggucaggaa

SEQ ID NO: 391515 - RNA, 24 nt, Human
cucuccugccucagaggucaggaa

SEQ ID NO: 391516 - RNA, 22 nt, Human
cugcccugccucccccaccagg

SEQ ID NO: 391517 - RNA, 18 nt, Human
gacccugcccagcacggg

SEQ ID NO: 391518 - RNA, 23 nt, Human
gaggcggggccagccuggggaga

SEQ ID NO: 391519 - RNA, 24 nt, Human
gaggcggggccagccuggggagag

SEQ ID NO: 391520 - RNA, 20 nt, Human
gcacacuggcccugcccaca

SEQ ID NO: 391521 - RNA, 27 nt, Human
gcgccgcgccuccgcugcuggcugccc

SEQ ID NO: 391522 - RNA, 24 nt, Human
gcgccuccgcugcuggcugccccg

SEQ ID NO: 391523 - RNA, 20 nt, Human
gcgcgccgcgccuccgcugc

SEQ ID NO: 391524 - RNA, 30 nt, Human
gcuccaaccuccugcccugccucccccacu

SEQ ID NO: 391525 - RNA, 20 nt, Human
ggcagggcugcuccaaccuc

SEQ ID NO: 391526 - RNA, 18 nt, Human
ggcggaccgucuuuauuc

SEQ ID NO: 391527 - RNA, 19 nt, Human
gggcggaccgucuuuauuc

SEQ ID NO: 391528 - RNA, 22 nt, Human
gggcuagggcuugggacugugg

SEQ ID NO: 391529 - RNA, 23 nt, Human
gucaucccucacucacuugaccc

SEQ ID NO: 391530 - RNA, 22 nt, Human
uagggcuagggcuugggacugu

SEQ ID NO: 391531 - RNA, 20 nt, Human
ucagaggucaggaaggaggu

SEQ ID NO: 391532 - RNA, 18 nt, Human
uccacggcaccugccaca

SEQ ID NO: 391533 - RNA, 21 nt, Human
ucccgccagcccgggacuagg

SEQ ID NO: 391534 - RNA, 19 nt, Human
uccugcccugccuccccca

SEQ ID NO: 391535 - RNA, 25 nt, Human
ugccacaaagcuggcggccacgggg

SEQ ID NO: 391536 - RNA, 18 nt, Human
ugcccugccucccccacc

SEQ ID NO: 391537 - RNA, 18 nt, Human
uggccagaaagggcauga

SEQ ID NO: 391538 - RNA, 18 nt, Human
uggcggccacggggcugg

SEQ ID NO: 391539 - RNA, 19 nt, Human
uggcggccacggggcuggg

SEQ ID NO: 391540 - RNA, 23 nt, Human
uggggagagcacuggacaaggag

SEQ ID NO: 391541 - RNA, 22 nt, Human
uucacugccagggcggaccguc

SEQ ID NO: 391542 - RNA, 23 nt, Human
uucugggcuggccagaaagggca

SEQ ID NO: 391543 - RNA, 27 nt, Human
uuuuuuuuuuuuuuuucacugccaggg

SEQ ID NO: 391544 - RNA, 20 nt, Human
uuuuuuuuuuuuuuuuucac

SEQ ID NO: 391545 - RNA, 24 nt, Human
uuuuuuuuuuuuuuuuuuucacug

SEQ ID NO: 391546 - RNA, 23 nt, Human
aaacgaaggugaacagaagggac

SEQ ID NO: 391547 - RNA, 24 nt, Human
aagaagcucugccaaauggaaucc

SEQ ID NO: 391548 - RNA, 21 nt, Human
aagucaaggauagaagcugau

SEQ ID NO: 391549 - RNA, 21 nt, Human
agaagacacaggcauaguaaa

SEQ ID NO: 391550 - RNA, 22 nt, Human
aggcguagcaccaugugagacc

SEQ ID NO: 391551 - RNA, 18 nt, Human
agggacagaagggacaga

SEQ ID NO: 391552 - RNA, 21 nt, Human
auucucacuucucuccaccag

SEQ ID NO: 391553 - RNA, 21 nt, Human
caagccaaggguucugagggc

SEQ ID NO: 391554 - RNA, 21 nt, Human
cagaaagaggcugaagaccau

SEQ ID NO: 391555 - RNA, 24 nt, Human
cagcugagaaaagccgaggcacag

SEQ ID NO: 391556 - RNA, 21 nt, Human
ccaaggguucugagggcucau

SEQ ID NO: 391557 - RNA, 21 nt, Human
ccagaggcuucugaguccuga

SEQ ID NO: 391558 - RNA, 24 nt, Human
ccucccagaccccagcguggugga

SEQ ID NO: 391559 - RNA, 18 nt, Human
ccucuaucccuuuuccac

SEQ ID NO: 391560 - RNA, 22 nt, Human
ccugcaggcccuggguagagcu

SEQ ID NO: 391561 - RNA, 19 nt, Human
ccuggggugaaaggagaca

SEQ ID NO: 391562 - RNA, 23 nt, Human
cuuucaggccuuuccuugagcug

SEQ ID NO: 391563 - RNA, 21 nt, Human
gaacagaaacacaacaucccc

SEQ ID NO: 391564 - RNA, 19 nt, Human
gcaggcguguuuacaugca

SEQ ID NO: 391565 - RNA, 21 nt, Human
gccaggcucaggcccuggggu

SEQ ID NO: 391566 - RNA, 22 nt, Human
ggaaacccaaccucuaucccuu

SEQ ID NO: 391567 - RNA, 18 nt, Human
ggauguggaccacugacc

SEQ ID NO: 391568 - RNA, 20 nt, Human
ggcgagcagagugggcuaca

SEQ ID NO: 391569 - RNA, 22 nt, Human
guccauuccucccagaccccag

SEQ ID NO: 391570 - RNA, 21 nt, Human
gugggcaggcagcguuugcag

SEQ ID NO: 391571 - RNA, 21 nt, Human
uaacacccaggugcgugacca

SEQ ID NO: 391572 - RNA, 19 nt, Human
uaagaagcaagagccagag

SEQ ID NO: 391573 - RNA, 22 nt, Human
uacaaaaaguauucaugccaca

SEQ ID NO: 391574 - RNA, 20 nt, Human
uagcugggcaccuggaagaa

SEQ ID NO: 391575 - RNA, 25 nt, Human
ucaaggauagaagcugauugcgcac

SEQ ID NO: 391576 - RNA, 23 nt, Human
ucaggcccuggggugaaaggaga

SEQ ID NO: 391577 - RNA, 22 nt, Human
uccaugaauauuuuuuauuugg

SEQ ID NO: 391578 - RNA, 21 nt, Human
uccccauuguaggcuggccag

SEQ ID NO: 391579 - RNA, 22 nt, Human
uccugagcacagauaagggcuc

SEQ ID NO: 391580 - RNA, 23 nt, Human
uccuugagcugcacgugaaccug

SEQ ID NO: 391581 - RNA, 22 nt, Human
ucuguccauuccucccagaccc

SEQ ID NO: 391582 - RNA, 19 nt, Human
ugaaauacuagugcuguga

SEQ ID NO: 391583 - RNA, 23 nt, Human
ugaacagaaacacaacaucccca

SEQ ID NO: 391584 - RNA, 24 nt, Human
ugagcacagauaagggcuccuuuc

SEQ ID NO: 391585 - RNA, 18 nt, Human
ugagggcucauccacagg

SEQ ID NO: 391586 - RNA, 20 nt, Human
ugagggcucauccacagggc

SEQ ID NO: 391587 - RNA, 19 nt, Human
ugaguccugagcacagaua

SEQ ID NO: 391588 - RNA, 23 nt, Human
ugcaacaugaaauacuagugcug

SEQ ID NO: 391589 - RNA, 20 nt, Human
ugcugugagggacagaaggg

SEQ ID NO: 391590 - RNA, 20 nt, Human
ugcugugagggacagaaggg

SEQ ID NO: 391591 - RNA, 22 nt, Human
uggcaggagugguagugcuaag

SEQ ID NO: 391592 - RNA, 22 nt, Human
uggccaggcucaggcccugggg

SEQ ID NO: 391593 - RNA, 21 nt, Human
ugggcaggcagcguuugcagg

SEQ ID NO: 391594 - RNA, 22 nt, Human
uggguagagcucauccucuguc

SEQ ID NO: 391595 - RNA, 18 nt, Human
ugucuguccauuccuccc

SEQ ID NO: 391596 - RNA, 21 nt, Human
ugugagaccacugguccaggg

SEQ ID NO: 391597 - RNA, 22 nt, Human
uguggaccacugacccagaggc

SEQ ID NO: 391598 - RNA, 24 nt, Human
ugugggcaggcagcguuugcaggc

SEQ ID NO: 391599 - RNA, 21 nt, Human
uugcaggcguguuuacaugca

SEQ ID NO: 391600 - RNA, 23 nt, Human
uuugcaggcguguuuacaugcag

SEQ ID NO: 391601 - RNA, 21 nt, Human
aaacagaagagcagguacaug

SEQ ID NO: 391602 - RNA, 25 nt, Human
aaacccaucccuccaugcuccccac

SEQ ID NO: 391603 - RNA, 21 nt, Human
aacccaucccuccaugcuccc

SEQ ID NO: 391604 - RNA, 23 nt, Human
aacccaucccuccaugcucccca

SEQ ID NO: 391605 - RNA, 25 nt, Human
aacccaucccuccaugcuccccacu

SEQ ID NO: 391606 - RNA, 24 nt, Human
aagcacaggccaaacccaucccuc

SEQ ID NO: 391607 - RNA, 18 nt, Human
aagcagaagcacaggcca

SEQ ID NO: 391608 - RNA, 19 nt, Human
aagcagaagcacaggccaa

SEQ ID NO: 391609 - RNA, 24 nt, Human
aagcagaagcacaggccaaaccca

SEQ ID NO: 391610 - RNA, 22 nt, Human
acagacagggccccagugaagc

SEQ ID NO: 391611 - RNA, 20 nt, Human
agaaagaacccacagcuugc

SEQ ID NO: 391612 - RNA, 19 nt, Human
agaccugagugggacagga

SEQ ID NO: 391613 - RNA, 24 nt, Human
agcaugaggggcacagaggagaaa

SEQ ID NO: 391614 - RNA, 24 nt, Human
aggaaaacgagagaaaccgguacc

SEQ ID NO: 391615 - RNA, 23 nt, Human
aggagaaagaacccacagcuugc

SEQ ID NO: 391616 - RNA, 18 nt, Human
aggggauuugggaguggc

SEQ ID NO: 391617 - RNA, 21 nt, Human
aucuagaagaucagcaugagg

SEQ ID NO: 391618 - RNA, 21 nt, Human
cacaggccaaacccaucccuc

SEQ ID NO: 391619 - RNA, 18 nt, Human
cacugagggggcaugagg

SEQ ID NO: 391620 - RNA, 23 nt, Human
cacuggaucuauuucgggccaaa

SEQ ID NO: 391621 - RNA, 21 nt, Human
cagaugggcucacugaggcuc

SEQ ID NO: 391622 - RNA, 22 nt, Human
cagcacacagacagggccccag

SEQ ID NO: 391623 - RNA, 18 nt, Human
cagcaugaggggcacaga

SEQ ID NO: 391624 - RNA, 21 nt, Human
cauccaaguccacauccagac

SEQ ID NO: 391625 - RNA, 24 nt, Human
cauccagacugggcucccucuaau

SEQ ID NO: 391626 - RNA, 21 nt, Human
caucccuccaugcuccccacu

SEQ ID NO: 391627 - RNA, 22 nt, Human
caucccuuccgugagcugaagg

SEQ ID NO: 391628 - RNA, 22 nt, Human
ccauccaggccagcugcccuaa

SEQ ID NO: 391629 - RNA, 22 nt, Human
cccacagggcauccaaguccac

SEQ ID NO: 391630 - RNA, 24 nt, Human
cccucuaaugccaucucuuaaacc

SEQ ID NO: 391631 - RNA, 20 nt, Human
ccuccaugcuccccacugug

SEQ ID NO: 391632 - RNA, 18 nt, Human
cuaaggaaaacgagagaa

SEQ ID NO: 391633 - RNA, 19 nt, Human
cucagcacuggaucuauuu

SEQ ID NO: 391634 - RNA, 25 nt, Human
cuggcugggcacacauccugguggg

SEQ ID NO: 391635 - RNA, 24 nt, Human
gauaacuaaggaaaacgagagaaa

SEQ ID NO: 391636 - RNA, 20 nt, Human
gcacagaggagaaagaaccc

SEQ ID NO: 391637 - RNA, 22 nt, Human
gcagaacugauacccacagggc

SEQ ID NO: 391638 - RNA, 18 nt, Human
gcagaagcacaggccaaa

SEQ ID NO: 391639 - RNA, 23 nt, Human
gcagaagcacaggccaaacccag

SEQ ID NO: 391640 - RNA, 21 nt, Human
gcagccagcaggggaaacugg

SEQ ID NO: 391641 - RNA, 21 nt, Human
gcuaugcugggugugcaaaca

SEQ ID NO: 391642 - RNA, 21 nt, Human
ggaguggcaucuagaagauca

SEQ ID NO: 391643 - RNA, 21 nt, Human
ggcacagaggagaaagaaccc

SEQ ID NO: 391644 - RNA, 24 nt, Human
ggcacagaggagaaagaacccaca

SEQ ID NO: 391645 - RNA, 20 nt, Human
ggccagaagaggcagggcca

SEQ ID NO: 391646 - RNA, 27 nt, Human
gggcacagaggagaaagaacccacagc

SEQ ID NO: 391647 - RNA, 25 nt, Human
gggcucacugaggcuccgguguaca

SEQ ID NO: 391648 - RNA, 20 nt, Human
ggugcuggaggccuggcugg

SEQ ID NO: 391649 - RNA, 18 nt, Human
guuuaauuaaccaguacu

SEQ ID NO: 391650 - RNA, 19 nt, Human
uaaaccgaaccacugccug

SEQ ID NO: 391651 - RNA, 21 nt, Human
uacagaccugagugggacagg

SEQ ID NO: 391652 - RNA, 19 nt, Human
ucacugagggggcaugagg

SEQ ID NO: 391653 - RNA, 22 nt, Human
ucagcagaacugauacccacag

SEQ ID NO: 391654 - RNA, 19 nt, Human
uccaaguccacauccagac

SEQ ID NO: 391655 - RNA, 22 nt, Human
uccacauccagacugggcuccc

SEQ ID NO: 391656 - RNA, 24 nt, Human
ucccuccaugcuccccacugugca

SEQ ID NO: 391657 - RNA, 19 nt, Human
uccucacugagggggcaug

SEQ ID NO: 391658 - RNA, 19 nt, Human
ucuagaagaucagcaugaa

SEQ ID NO: 391659 - RNA, 23 nt, Human
ugaauaagcagaagcacaggcca

SEQ ID NO: 391660 - RNA, 19 nt, Human
uggcucagcacacagacag

SEQ ID NO: 391661 - RNA, 23 nt, Human
ugugcaaacagaagagcagguac

SEQ ID NO: 391662 - RNA, 22 nt, Human
ugugcagaugggcucacugagg

SEQ ID NO: 391663 - RNA, 22 nt, Human
uugacagugagcaauaaaguuu

SEQ ID NO: 391664 - RNA, 19 nt, Human
uugggaguggcaucuagaa

SEQ ID NO: 391665 - RNA, 22 nt, Human
uuuuuuuuuuuuuuuuugacag

SEQ ID NO: 391666 - RNA, 27 nt, Human
uuuuuuuuuuuuuuuuuuuuuuugggg

SEQ ID NO: 391667 - RNA, 21 nt, Human
aacauggaacuccacugcaaa

SEQ ID NO: 391668 - RNA, 19 nt, Human
aagaaggcauaaggacaau

SEQ ID NO: 391669 - RNA, 20 nt, Human
aaugaagaagaaggcauaag

SEQ ID NO: 391670 - RNA, 26 nt, Human
caauaaacauggaacuccacugcaaa

SEQ ID NO: 391671 - RNA, 18 nt, Human
guagagagagaaggggag

SEQ ID NO: 391672 - RNA, 19 nt, Human
aaccagcucggagcugcca

SEQ ID NO: 391673 - RNA, 24 nt, Human
aagacuccuggggcuggcccugcu

SEQ ID NO: 391674 - RNA, 25 nt, Human
agaaagacuucccagggaagaugcu

SEQ ID NO: 391675 - RNA, 21 nt, Human
agaggcaggcacugagcagcc

SEQ ID NO: 391676 - RNA, 22 nt, Human
agaggcaggcacugagcagccc

SEQ ID NO: 391677 - RNA, 23 nt, Human
agcagcaggugggugagcaguga

SEQ ID NO: 391678 - RNA, 18 nt, Human
aggaggccuucuugcagg

SEQ ID NO: 391679 - RNA, 19 nt, Human
aggcacugagcagcccugc

SEQ ID NO: 391680 - RNA, 22 nt, Human
aggcugcugggaugagggagcc

SEQ ID NO: 391681 - RNA, 18 nt, Human
agggaagaugcuuggcuc

SEQ ID NO: 391682 - RNA, 21 nt, Human
agguggcagcagggucaggcg

SEQ ID NO: 391683 - RNA, 22 nt, Human
agugagcaagaaucgggaaaga

SEQ ID NO: 391684 - RNA, 25 nt, Human
caaggugggccaugguauagggccc

SEQ ID NO: 391685 - RNA, 23 nt, Human
cagggccaggcuggccagacuug

SEQ ID NO: 391686 - RNA, 20 nt, Human
cagggucaggcgaguuccug

SEQ ID NO: 391687 - RNA, 22 nt, Human
cccagcuacugugccacaacca

SEQ ID NO: 391688 - RNA, 18 nt, Human
cccucgaagggcuugugg

SEQ ID NO: 391689 - RNA, 18 nt, Human
cccugcugaggcucuccu

SEQ ID NO: 391690 - RNA, 19 nt, Human
cccugcugaggucucccca

SEQ ID NO: 391691 - RNA, 19 nt, Human
cccugcugaggucucccca

SEQ ID NO: 391692 - RNA, 19 nt, Human
ccugaccacagcuggucac

SEQ ID NO: 391693 - RNA, 23 nt, Human
ccugcaaugcacggcuaagucug

SEQ ID NO: 391694 - RNA, 20 nt, Human
ccugcagggccaggcuggcc

SEQ ID NO: 391695 - RNA, 21 nt, Human
ccugcggccugcggacuccgu

SEQ ID NO: 391696 - RNA, 19 nt, Human
cugcggccugcggacuccg

SEQ ID NO: 391697 - RNA, 18 nt, Human
cuugcaggaccccaacca

SEQ ID NO: 391698 - RNA, 19 nt, Human
cuuggcucucugcuccaag

SEQ ID NO: 391699 - RNA, 20 nt, Human
gagcagugagcaagaaucgg

SEQ ID NO: 391700 - RNA, 22 nt, Human
gaggaggccuucuugcaggacc

SEQ ID NO: 391701 - RNA, 20 nt, Human
gagguggcagcagggucagg

SEQ ID NO: 391702 - RNA, 21 nt, Human
gcagcagcaggugggugagca

SEQ ID NO: 391703 - RNA, 19 nt, Human
gcccccgggcugaggaggc

SEQ ID NO: 391704 - RNA, 19 nt, Human
gccuagggagugugcgagg

SEQ ID NO: 391705 - RNA, 18 nt, Human
gcuuggcucucugcucca

SEQ ID NO: 391706 - RNA, 18 nt, Human
ggcuggcccugcugaggc

SEQ ID NO: 391707 - RNA, 23 nt, Human
ggcuggggugaucccagggggca

SEQ ID NO: 391708 - RNA, 24 nt, Human
gggucagggccauagcccccgggc

SEQ ID NO: 391709 - RNA, 18 nt, Human
ucacugauuaauccucca

SEQ ID NO: 391710 - RNA, 21 nt, Human
ucacugauuaauccuccaugc

SEQ ID NO: 391711 - RNA, 20 nt, Human
ucagggccauagcccccggg

SEQ ID NO: 391712 - RNA, 23 nt, Human
uccaugccugcaaugcacggcua

SEQ ID NO: 391713 - RNA, 22 nt, Human
ucccagggaagaugcuuggcuc

SEQ ID NO: 391714 - RNA, 18 nt, Human
uccgagagacgcagcuuc

SEQ ID NO: 391715 - RNA, 21 nt, Human
uccugaccacagcuggucacc

SEQ ID NO: 391716 - RNA, 23 nt, Human
ugaccacagcuggucaccgcucc

SEQ ID NO: 391717 - RNA, 19 nt, Human
uggccagaaagacuuccca

SEQ ID NO: 391718 - RNA, 20 nt, Human
uggccagaaagacuucccag

SEQ ID NO: 391719 - RNA, 21 nt, Human
uggccagaaagacuucccagg

SEQ ID NO: 391720 - RNA, 22 nt, Human
uggcccugcugaggcucuccug

SEQ ID NO: 391721 - RNA, 20 nt, Human
uggggugaucccagggggca

SEQ ID NO: 391722 - RNA, 22 nt, Human
uggggugaucccagggggcauu

SEQ ID NO: 391723 - RNA, 23 nt, Human
aaaaaaaaacaaaaaacacaacc

SEQ ID NO: 391724 - RNA, 25 nt, Human
aaaaaaaacaaaaaacacaaccaaa

SEQ ID NO: 391725 - RNA, 26 nt, Human
aaaaaaaacaaaaaacacaaccaaaa

SEQ ID NO: 391726 - RNA, 22 nt, Human
aaaaaacaaaaaacacaaccaa

SEQ ID NO: 391727 - RNA, 20 nt, Human
aaaaaacacaaccaaaagaa

SEQ ID NO: 391728 - RNA, 18 nt, Human
aaaacaaaaaacacaacc

SEQ ID NO: 391729 - RNA, 25 nt, Human
aaaacaaaaaacacaaccaaaagaa

SEQ ID NO: 391730 - RNA, 21 nt, Human
aaaacacaaccaaaagaacug

SEQ ID NO: 391731 - RNA, 21 nt, Human
aaacaaaaaacacaaccaaaa

SEQ ID NO: 391732 - RNA, 21 nt, Human
aaacacaaccaaaagaacuga

SEQ ID NO: 391733 - RNA, 23 nt, Human
aagaacugacgagaggaagacaa

SEQ ID NO: 391734 - RNA, 24 nt, Human
aagacaaagccucgggaucagcca

SEQ ID NO: 391735 - RNA, 19 nt, Human
agcaagguggugggaaguc

SEQ ID NO: 391736 - RNA, 21 nt, Human
auacauauacuguacacaucu

SEQ ID NO: 391737 - RNA, 25 nt, Human
caaaaaacacaaccaaaagaacuga

SEQ ID NO: 391738 - RNA, 26 nt, Human
caaaaaacacaaccaaaagaacugac

SEQ ID NO: 391739 - RNA, 19 nt, Human
caaccaaaagaacugacgg

SEQ ID NO: 391740 - RNA, 18 nt, Human
cacaaccaaaagaacuga

SEQ ID NO: 391741 - RNA, 19 nt, Human
cacaaccaaaagaacugac

SEQ ID NO: 391742 - RNA, 24 nt, Human
cacaggucaggccuagcuggaucu

SEQ ID NO: 391743 - RNA, 18 nt, Human
cacgggaugaggcacagg

SEQ ID NO: 391744 - RNA, 23 nt, Human
cauauacuguacacaucuauaug

SEQ ID NO: 391745 - RNA, 20 nt, Human
ccccgcccgccacuucccuc

SEQ ID NO: 391746 - RNA, 21 nt, Human
ccccgcccgccacuucccucg

SEQ ID NO: 391747 - RNA, 23 nt, Human
ccccugaagcuggcugucuucuu

SEQ ID NO: 391748 - RNA, 25 nt, Human
cccgcgacccccggccggccggcua

SEQ ID NO: 391749 - RNA, 19 nt, Human
cccugugccuggugcuggu

SEQ ID NO: 391750 - RNA, 21 nt, Human
ccggccggccggcuaccugca

SEQ ID NO: 391751 - RNA, 20 nt, Human
ccuuggaccagccuccccgc

SEQ ID NO: 391752 - RNA, 25 nt, Human
cuuugggcauguggggucuguggaa

SEQ ID NO: 391753 - RNA, 20 nt, Human
gagaggaagacaaagccucg

SEQ ID NO: 391754 - RNA, 22 nt, Human
gaggccuuugggcauguggggu

SEQ ID NO: 391755 - RNA, 18 nt, Human
gggcagaggucgguggag

SEQ ID NO: 391756 - RNA, 21 nt, Human
gggugaggucaugggagcugg

SEQ ID NO: 391757 - RNA, 25 nt, Human
uaaaaaaaaaacaaaaaacacaacc

SEQ ID NO: 391758 - RNA, 20 nt, Human
ucagccagagaccgagcggc

SEQ ID NO: 391759 - RNA, 23 nt, Human
ucccgaggccuuugggcaugugg

SEQ ID NO: 391760 - RNA, 22 nt, Human
ucccugugccuggugcuggugc

SEQ ID NO: 391761 - RNA, 18 nt, Human
ucuguggaaggagaggag

SEQ ID NO: 391762 - RNA, 19 nt, Human
ugaagcguccuguguuggg

SEQ ID NO: 391763 - RNA, 19 nt, Human
uggaaggagaggaggucac

SEQ ID NO: 391764 - RNA, 22 nt, Human
uggcuuggccagcacagggacc

SEQ ID NO: 391765 - RNA, 20 nt, Human
uggggauggccacugcucgg

SEQ ID NO: 391766 - RNA, 21 nt, Human
uggugggaagucccgaggccu

SEQ ID NO: 391767 - RNA, 18 nt, Human
uugggggaguggggugag

SEQ ID NO: 391768 - RNA, 24 nt, Human
uuuacccuuccuccaagucuuuua

SEQ ID NO: 391769 - RNA, 18 nt, Human
uuuauuuuuuuuuugagu

SEQ ID NO: 391770 - RNA, 24 nt, Human
uuuuacccuuccuccaagucuuuu

SEQ ID NO: 391771 - RNA, 21 nt, Human
uuuuuuuuuuacccuuccucc

SEQ ID NO: 391772 - RNA, 27 nt, Human
uuuuuuuuuuacccuuccuccaagucu

SEQ ID NO: 391773 - RNA, 23 nt, Human
uuuuuuuuuuuuuacccuuccuc

SEQ ID NO: 391774 - RNA, 23 nt, Human
uuuuuuuuuuuuuuuuuacccuu

SEQ ID NO: 391775 - RNA, 23 nt, Human
aauguguguucagagagaaugaa

SEQ ID NO: 391776 - RNA, 22 nt, Human
accaaaguacagauggaaacca

SEQ ID NO: 391777 - RNA, 23 nt, Human
agcccugugcauuggggguggga

SEQ ID NO: 391778 - RNA, 19 nt, Human
auggaaaccauuuccuaca

SEQ ID NO: 391779 - RNA, 20 nt, Human
caaaaacccaaguuuacagc

SEQ ID NO: 391780 - RNA, 25 nt, Human
caauaucugaaaucagaggaccaaa

SEQ ID NO: 391781 - RNA, 19 nt, Human
ccugugcauuggggguggg

SEQ ID NO: 391782 - RNA, 20 nt, Human
ggcagaagucgugguguugc

SEQ ID NO: 391783 - RNA, 19 nt, Human
uccuacaucacaaaaaccc

SEQ ID NO: 391784 - RNA, 19 nt, Human
ugacggcagcgauacacgu

SEQ ID NO: 391785 - RNA, 24 nt, Human
uggaaaccauuuccuacaucacaa

SEQ ID NO: 391786 - RNA, 18 nt, Human
ugggcagaagucguggug

SEQ ID NO: 391787 - RNA, 21 nt, Human
ugggggugggaugggaauagc

SEQ ID NO: 391788 - RNA, 21 nt, Human
uugaacaaccucaauuucuuu

SEQ ID NO: 391789 - RNA, 25 nt, Human
aaacaacaaagaaguaaguaacugg

SEQ ID NO: 391790 - RNA, 26 nt, Human
aaacaugaguacauaauggaaaaaaa

SEQ ID NO: 391791 - RNA, 19 nt, Human
aaauauugagggcuacaau

SEQ ID NO: 391792 - RNA, 18 nt, Human
aguacauaauggaaaaaa

SEQ ID NO: 391793 - RNA, 19 nt, Human
aucaaggagggugcagccu

SEQ ID NO: 391794 - RNA, 24 nt, Human
auuaccaaauauugagggcuacaa

SEQ ID NO: 391795 - RNA, 20 nt, Human
caaggcagaaauggccccug

SEQ ID NO: 391796 - RNA, 21 nt, Human
cacaaggcagaaauggccccu

SEQ ID NO: 391797 - RNA, 22 nt, Human
cacaaggcagaaauggccccug

SEQ ID NO: 391798 - RNA, 19 nt, Human
ccacagcuguccccaaguc

SEQ ID NO: 391799 - RNA, 19 nt, Human
ccccacagcuguccccaag

SEQ ID NO: 391800 - RNA, 21 nt, Human
cccuuggguguccuuguagug

SEQ ID NO: 391801 - RNA, 21 nt, Human
ccgccagucacuucugcuggg

SEQ ID NO: 391802 - RNA, 19 nt, Human
ccucuugucccagcgagga

SEQ ID NO: 391803 - RNA, 19 nt, Human
cucugcagagaccuccugg

SEQ ID NO: 391804 - RNA, 21 nt, Human
cugagcuucuauaauucugga

SEQ ID NO: 391805 - RNA, 18 nt, Human
cugcagagaccuccuggg

SEQ ID NO: 391806 - RNA, 20 nt, Human
gagucacuuuaaauagcauu

SEQ ID NO: 391807 - RNA, 21 nt, Human
gggaccagagcaucugggccg

SEQ ID NO: 391808 - RNA, 24 nt, Human
ggggagagaaugucuuuuccuuug

SEQ ID NO: 391809 - RNA, 18 nt, Human
guggccugcaaacaacaa

SEQ ID NO: 391810 - RNA, 22 nt, Human
guggccugcaaacaacaaagaa

SEQ ID NO: 391811 - RNA, 18 nt, Human
uaaaauaaucccuggccc

SEQ ID NO: 391812 - RNA, 21 nt, Human
uagguggccugcaaacaacaa

SEQ ID NO: 391813 - RNA, 20 nt, Human
uauuucauaaaaacaugagu

SEQ ID NO: 391814 - RNA, 18 nt, Human
uccccacagcugucccca

SEQ ID NO: 391815 - RNA, 21 nt, Human
ucuagaugacuuggguagucc

SEQ ID NO: 391816 - RNA, 22 nt, Human
ucugcagagaccuccugggucc

SEQ ID NO: 391817 - RNA, 23 nt, Human
ucugcagagaccuccugggucca

SEQ ID NO: 391818 - RNA, 24 nt, Human
ucugcagagaccuccuggguccau

SEQ ID NO: 391819 - RNA, 18 nt, Human
ucugcugggaccagagca

SEQ ID NO: 391820 - RNA, 23 nt, Human
ucuuuuccuuugcaauuucuaga

SEQ ID NO: 391821 - RNA, 19 nt, Human
ugaccagaggggagcaggc

SEQ ID NO: 391822 - RNA, 20 nt, Human
ugacuagaauugucucccuc

SEQ ID NO: 391823 - RNA, 19 nt, Human
ugccuggggugggccacac

SEQ ID NO: 391824 - RNA, 21 nt, Human
uggagcccugacucagacccc

SEQ ID NO: 391825 - RNA, 19 nt, Human
uggccugcaaacaacaaag

SEQ ID NO: 391826 - RNA, 19 nt, Human
uggguaguccuaaaguuuu

SEQ ID NO: 391827 - RNA, 23 nt, Human
ugucccagcgaggacagggguug

SEQ ID NO: 391828 - RNA, 20 nt, Human
ugucggugaccagaggggag

SEQ ID NO: 391829 - RNA, 21 nt, Human
ugucuuuuccuuugcaauuuc

SEQ ID NO: 391830 - RNA, 20 nt, Human
ugugagccuccuguucuccg

SEQ ID NO: 391831 - RNA, 20 nt, Human
ugugaugaucaaggagggug

SEQ ID NO: 391832 - RNA, 19 nt, Human
ugugcugcucuaaccaagu

SEQ ID NO: 391833 - RNA, 20 nt, Human
uuaccaaauauugagggcua

SEQ ID NO: 391834 - RNA, 23 nt, Human
uugcucugcagagaccuccuggg

SEQ ID NO: 391835 - RNA, 24 nt, Human
aaccagcagcgaccucauguggcc

SEQ ID NO: 391836 - RNA, 21 nt, Human
agaaaaaccaaucuaauucag

SEQ ID NO: 391837 - RNA, 18 nt, Human
agccgcaaagccucaauc

SEQ ID NO: 391838 - RNA, 20 nt, Human
cagcagcgaccucauguggc

SEQ ID NO: 391839 - RNA, 22 nt, Human
ccuacagccuugguguacuggc

SEQ ID NO: 391840 - RNA, 21 nt, Human
cuuggguccaagguaccaggg

SEQ ID NO: 391841 - RNA, 18 nt, Human
ggccugggauagaagcuc

SEQ ID NO: 391842 - RNA, 19 nt, Human
uaaccagcagcgaccucau

SEQ ID NO: 391843 - RNA, 19 nt, Human
uggcugcagggccugggau

SEQ ID NO: 391844 - RNA, 22 nt, Human
ugggauagaagcucacugucug

SEQ ID NO: 391845 - RNA, 18 nt, Human
uuuuuuuuuuucuucuug

SEQ ID NO: 391846 - RNA, 25 nt, Human
aaagcaaaaccagagauucagaaaa

SEQ ID NO: 391847 - RNA, 24 nt, Human
aaaguguugggauuacaggcguga

SEQ ID NO: 391848 - RNA, 26 nt, Human
aacacaaucucucuccuuaaggcacc

SEQ ID NO: 391849 - RNA, 22 nt, Human
aagccacauccucaguugagcc

SEQ ID NO: 391850 - RNA, 21 nt, Human
aaguguugggauuacaggcgu

SEQ ID NO: 391851 - RNA, 26 nt, Human
aaguguugggauuacaggcgugagcc

SEQ ID NO: 391852 - RNA, 21 nt, Human
aaucagcuuacccccaagaag

SEQ ID NO: 391853 - RNA, 22 nt, Human
acaaaccccagagcuggucaac

SEQ ID NO: 391854 - RNA, 21 nt, Human
accaacccugaacccccggcc

SEQ ID NO: 391855 - RNA, 24 nt, Human
accauguuggucaggcuggucucg

SEQ ID NO: 391856 - RNA, 18 nt, Human
acccugccuuauaccuga

SEQ ID NO: 391857 - RNA, 18 nt, Human
agacaaaagaacugaugg

SEQ ID NO: 391858 - RNA, 24 nt, Human
agaggcccagcccuguaggcacug

SEQ ID NO: 391859 - RNA, 20 nt, Human
agaugcuaguggggaggagc

SEQ ID NO: 391860 - RNA, 23 nt, Human
agcugggauuacuggugugugcc

SEQ ID NO: 391861 - RNA, 23 nt, Human
aggaaaagaaaccuaagacaaaa

SEQ ID NO: 391862 - RNA, 25 nt, Human
aggaagaacacaaucucucuccuua

SEQ ID NO: 391863 - RNA, 18 nt, Human
aggaaggaaguaggcagg

SEQ ID NO: 391864 - RNA, 20 nt, Human
aggaaggaaguaggcagggg

SEQ ID NO: 391865 - RNA, 26 nt, Human
aggagaaaacagaccugccuuacaaa

SEQ ID NO: 391866 - RNA, 22 nt, Human
aggaggcagguccagggcuaca

SEQ ID NO: 391867 - RNA, 23 nt, Human
aguagcugggauuacuggugugu

SEQ ID NO: 391868 - RNA, 18 nt, Human
agugggugggccaggggc

SEQ ID NO: 391869 - RNA, 22 nt, Human
auaggggcauuugccacccaca

SEQ ID NO: 391870 - RNA, 19 nt, Human
auuagugggugggccaggg

SEQ ID NO: 391871 - RNA, 24 nt, Human
auuuuuguauuuuuaguagagaug

SEQ ID NO: 391872 - RNA, 23 nt, Human
caaaagaacugauggucuuccca

SEQ ID NO: 391873 - RNA, 24 nt, Human
caaaguguugggauuacaggcgug

SEQ ID NO: 391874 - RNA, 19 nt, Human
caacaaagcaaaaccagag

SEQ ID NO: 391875 - RNA, 18 nt, Human
caacggcgcaaucuuggc

SEQ ID NO: 391876 - RNA, 22 nt, Human
caagcaaaucuccugcuucagc

SEQ ID NO: 391877 - RNA, 23 nt, Human
cacaaucucucuccuuaaggcac

SEQ ID NO: 391878 - RNA, 24 nt, Human
caccacacccggcuaauuuuugua

SEQ ID NO: 391879 - RNA, 18 nt, Human
caccacccugccuuauac

SEQ ID NO: 391880 - RNA, 24 nt, Human
caccacccugccuuauaccugaau

SEQ ID NO: 391881 - RNA, 20 nt, Human
caccaugccuggccaacucg

SEQ ID NO: 391882 - RNA, 21 nt, Human
caccauguuggucaggcuggu

SEQ ID NO: 391883 - RNA, 24 nt, Human
caccauguuggucaggcuggucuc

SEQ ID NO: 391884 - RNA, 21 nt, Human
cacccagauaagaguacaggc

SEQ ID NO: 391885 - RNA, 22 nt, Human
cacccgggguacugucaccccg

SEQ ID NO: 391886 - RNA, 22 nt, Human
caccuaaccccacccugcuugc

SEQ ID NO: 391887 - RNA, 18 nt, Human
cacugcaaccucugccuc

SEQ ID NO: 391888 - RNA, 21 nt, Human
cacugcaaccucugccuccca

SEQ ID NO: 391889 - RNA, 23 nt, Human
cagcagacccagugaugcccuug

SEQ ID NO: 391890 - RNA, 19 nt, Human
cagguacaccacccugccu

SEQ ID NO: 391891 - RNA, 21 nt, Human
cagguacaccacccugccuua

SEQ ID NO: 391892 - RNA, 23 nt, Human
cauuugccacccacaucuuugga

SEQ ID NO: 391893 - RNA, 22 nt, Human
ccaaaguguugggauuacaggc

SEQ ID NO: 391894 - RNA, 22 nt, Human
ccaaaguguugggauuacaggc

SEQ ID NO: 391895 - RNA, 24 nt, Human
ccaaaguguugggauuacaggcgu

SEQ ID NO: 391896 - RNA, 19 nt, Human
ccaacccugaacccccggc

SEQ ID NO: 391897 - RNA, 20 nt, Human
ccaccacacccggcuaauuu

SEQ ID NO: 391898 - RNA, 18 nt, Human
ccaccaugccuggccaac

SEQ ID NO: 391899 - RNA, 18 nt, Human
ccagugccugggugaggg

SEQ ID NO: 391900 - RNA, 18 nt, Human
cccaacccagaggcuucc

SEQ ID NO: 391901 - RNA, 23 nt, Human
cccagauaagaguacaggcaaac

SEQ ID NO: 391902 - RNA, 20 nt, Human
cccagguucaagcaaaucuc

SEQ ID NO: 391903 - RNA, 23 nt, Human
cccagguucaagcaaaucucccc

SEQ ID NO: 391904 - RNA, 23 nt, Human
cccagguucaagcaaaucuccug

SEQ ID NO: 391905 - RNA, 23 nt, Human
ccccucuaccacaaagauggcuu

SEQ ID NO: 391906 - RNA, 20 nt, Human
cccgaguagcugggauuacu

SEQ ID NO: 391907 - RNA, 25 nt, Human
cccugcuaccaacccugaacccccg

SEQ ID NO: 391908 - RNA, 18 nt, Human
ccuaugaggggacaaggu

SEQ ID NO: 391909 - RNA, 24 nt, Human
ccucccagguucaagcaaaucucc

SEQ ID NO: 391910 - RNA, 21 nt, Human
ccugaccucgugaucugccug

SEQ ID NO: 391911 - RNA, 19 nt, Human
cgagggaaggaggcagguc

SEQ ID NO: 391912 - RNA, 20 nt, Human
cgcacgcguaaacccagcca

SEQ ID NO: 391913 - RNA, 21 nt, Human
cgcgcacgcgcaccuaacccc

SEQ ID NO: 391914 - RNA, 23 nt, Human
cgggaccaggcccguuagugcgc

SEQ ID NO: 391915 - RNA, 24 nt, Human
cgugaucugccugccucagccucc

SEQ ID NO: 391916 - RNA, 19 nt, Human
cuaaaugcuugguaccauc

SEQ ID NO: 391917 - RNA, 23 nt, Human
cuaauuuuuguauuuuuaguaga

SEQ ID NO: 391918 - RNA, 24 nt, Human
cucacugcaaccucugccucccag

SEQ ID NO: 391919 - RNA, 24 nt, Human
cucacugcaaccucugccucccag

SEQ ID NO: 391920 - RNA, 24 nt, Human
cuccugaccucgugaucugccugc

SEQ ID NO: 391921 - RNA, 20 nt, Human
cucuguugcccaggcuggag

SEQ ID NO: 391922 - RNA, 29 nt, Human
cucuguugcccaggcuggaguacaacggg

SEQ ID NO: 391923 - RNA, 31 nt, Human
cugauggucuucccaacccagaggcuuccuu

SEQ ID NO: 391924 - RNA, 23 nt, Human
cugcaaccucugccucccagguu

SEQ ID NO: 391925 - RNA, 24 nt, Human
cugcaaccucugccucccagguuc

SEQ ID NO: 391926 - RNA, 18 nt, Human
cugccucagccucccaaa

SEQ ID NO: 391927 - RNA, 23 nt, Human
cugcuucagccucccgaguagcu

SEQ ID NO: 391928 - RNA, 23 nt, Human
cugugaauaacaucauccucagu

SEQ ID NO: 391929 - RNA, 23 nt, Human
cuucccaacccagaggcuuccug

SEQ ID NO: 391930 - RNA, 19 nt, Human
cuuccgggaccaggcccgu

SEQ ID NO: 391931 - RNA, 21 nt, Human
cuugcucuguugcccaggcug

SEQ ID NO: 391932 - RNA, 24 nt, Human
gaccucgugaucugccugccucag

SEQ ID NO: 391933 - RNA, 25 nt, Human
gagaugggguuuucaccauguuggu

SEQ ID NO: 391934 - RNA, 24 nt, Human
gaggcccagcccuguaggcacugg

SEQ ID NO: 391935 - RNA, 20 nt, Human
gauaggaggcuaccccaggg

SEQ ID NO: 391936 - RNA, 18 nt, Human
gauuacaggcgugagcca

SEQ ID NO: 391937 - RNA, 21 nt, Human
gauuacaggcgugagccacca

SEQ ID NO: 391938 - RNA, 24 nt, Human
gauuacaggcgugagccaccaugc

SEQ ID NO: 391939 - RNA, 18 nt, Human
gcaaacucuucacuugcc

SEQ ID NO: 391940 - RNA, 22 nt, Human
gcaaccucugccucccagguuc

SEQ ID NO: 391941 - RNA, 22 nt, Human
gccaacaaagcaaaaccagaga

SEQ ID NO: 391942 - RNA, 24 nt, Human
gccagcagguacaccacccugccu

SEQ ID NO: 391943 - RNA, 19 nt, Human
gcccaggcuggaguacaac

SEQ ID NO: 391944 - RNA, 20 nt, Human
gcccuuggagacccucugcu

SEQ ID NO: 391945 - RNA, 19 nt, Human
gccucagccucccaaagug

SEQ ID NO: 391946 - RNA, 21 nt, Human
gcucacugcaaccucugccuc

SEQ ID NO: 391947 - RNA, 19 nt, Human
gcuggaguacaacggcgca

SEQ ID NO: 391948 - RNA, 23 nt, Human
gcuggucucgaacuccugaccuc

SEQ ID NO: 391949 - RNA, 21 nt, Human
ggaaggaggcagguccagggc

SEQ ID NO: 391950 - RNA, 19 nt, Human
ggagaagucugguugggcc

SEQ ID NO: 391951 - RNA, 24 nt, Human
ggauuacaggcgugagccaccaug

SEQ ID NO: 391952 - RNA, 20 nt, Human
ggccuaggagaaaacagacc

SEQ ID NO: 391953 - RNA, 24 nt, Human
ggcuggucucgaacuccugaccuc

SEQ ID NO: 391954 - RNA, 23 nt, Human
gggaaaugaugaggcugcaggcu

SEQ ID NO: 391955 - RNA, 21 nt, Human
gggaaggaggcagguccaggg

SEQ ID NO: 391956 - RNA, 22 nt, Human
gggaaggaggcagguccagggc

SEQ ID NO: 391957 - RNA, 23 nt, Human
ggggaggagcugagccugugacg

SEQ ID NO: 391958 - RNA, 24 nt, Human
gggguuuucaccauguuggucagg

SEQ ID NO: 391959 - RNA, 22 nt, Human
ggguuuucaccauguuggucag

SEQ ID NO: 391960 - RNA, 23 nt, Human
ggguuuucaccauguuggucagg

SEQ ID NO: 391961 - RNA, 19 nt, Human
ggucucgaacuccugaccu

SEQ ID NO: 391962 - RNA, 21 nt, Human
ggugagggagcaggcuuaaga

SEQ ID NO: 391963 - RNA, 24 nt, Human
guagagaugggguuuucaccaugu

SEQ ID NO: 391964 - RNA, 25 nt, Human
guagcagaacccaguguagaagcca

SEQ ID NO: 391965 - RNA, 24 nt, Human
guagcugggauuacuggugugugc

SEQ ID NO: 391966 - RNA, 24 nt, Human
gucuugcucuguugcccaggcugg

SEQ ID NO: 391967 - RNA, 22 nt, Human
gugacauggcagggcugccugg

SEQ ID NO: 391968 - RNA, 24 nt, Human
gugaucugccugccucagccuccc

SEQ ID NO: 391969 - RNA, 18 nt, Human
gugcaguaguauuagugg

SEQ ID NO: 391970 - RNA, 20 nt, Human
guggcccagcagauggaaac

SEQ ID NO: 391971 - RNA, 20 nt, Human
uaacaucauccucaguacag

SEQ ID NO: 391972 - RNA, 22 nt, Human
uaacaucauccucaguacagcu

SEQ ID NO: 391973 - RNA, 24 nt, Human
uaacaucauccucaguacagcugc

SEQ ID NO: 391974 - RNA, 24 nt, Human
uaauuuuuguauuuuuaguagaga

SEQ ID NO: 391975 - RNA, 23 nt, Human
uacaacggcgcaaucuuggcuca

SEQ ID NO: 391976 - RNA, 24 nt, Human
uacaccacccugccuuauaccuga

SEQ ID NO: 391977 - RNA, 22 nt, Human
uacaggcgugagccaccaugcc

SEQ ID NO: 391978 - RNA, 23 nt, Human
uacaggcgugagccaccaugccu

SEQ ID NO: 391979 - RNA, 22 nt, Human
uacagugcuuucagguacuggu

SEQ ID NO: 391980 - RNA, 23 nt, Human
uaccacaaagauggcuuaagcaa

SEQ ID NO: 391981 - RNA, 24 nt, Human
uacuggugugugccaccacacccg

SEQ ID NO: 391982 - RNA, 23 nt, Human
uagcagaacccaguguagaagcc

SEQ ID NO: 391983 - RNA, 23 nt, Human
uagcugggauuacuggugugugc

SEQ ID NO: 391984 - RNA, 20 nt, Human
uaggacaguuggcagaugac

SEQ ID NO: 391985 - RNA, 23 nt, Human
uaggagaaaacagaccugccuua

SEQ ID NO: 391986 - RNA, 25 nt, Human
uaguagagaugggguuuucaccaug

SEQ ID NO: 391987 - RNA, 25 nt, Human
uauggccccgagggaaggaggcagg

SEQ ID NO: 391988 - RNA, 22 nt, Human
ucaccccugagagaggaagaac

SEQ ID NO: 391989 - RNA, 19 nt, Human
ucacugcaaccucugccuc

SEQ ID NO: 391990 - RNA, 23 nt, Human
ucacugcaaccucugccucccag

SEQ ID NO: 391991 - RNA, 24 nt, Human
ucacugcaaccucugccucccagg

SEQ ID NO: 391992 - RNA, 20 nt, Human
ucagaaaacucagggccuag

SEQ ID NO: 391993 - RNA, 20 nt, Human
ucagccucccgaguagcugg

SEQ ID NO: 391994 - RNA, 22 nt, Human
ucagccucccgaguagcuggga

SEQ ID NO: 391995 - RNA, 24 nt, Human
uccagggccccucuaccacaaaga

SEQ ID NO: 391996 - RNA, 24 nt, Human
ucccaaaguguugggauuacaggc

SEQ ID NO: 391997 - RNA, 25 nt, Human
ucccaacccagaggcuuccugaguu

SEQ ID NO: 391998 - RNA, 21 nt, Human
ucccagguucaagcaaaucuc

SEQ ID NO: 391999 - RNA, 24 nt, Human
ucccagguucaagcaaaucuccug

SEQ ID NO: 392000 - RNA, 18 nt, Human
ucccauaggcacuuaagc

SEQ ID NO: 392001 - RNA, 23 nt, Human
ucccgaguagcugggauuacugg

SEQ ID NO: 392002 - RNA, 24 nt, Human
ucccgaguagcugggauuacuggu

SEQ ID NO: 392003 - RNA, 19 nt, Human
ucucgaacuccugaccucg

SEQ ID NO: 392004 - RNA, 18 nt, Human
ucuguugcccaggcugga

SEQ ID NO: 392005 - RNA, 23 nt, Human
ucuugcucuguugcccaggcugg

SEQ ID NO: 392006 - RNA, 24 nt, Human
ucuugcucuguugcccaggcugga

SEQ ID NO: 392007 - RNA, 22 nt, Human
ugaacccccggcaguugucccu

SEQ ID NO: 392008 - RNA, 18 nt, Human
ugaagaguuggcaguucc

SEQ ID NO: 392009 - RNA, 18 nt, Human
ugaagguagagaagaugc

SEQ ID NO: 392010 - RNA, 23 nt, Human
ugacgugcauuuguaccaggucc

SEQ ID NO: 392011 - RNA, 21 nt, Human
ugagaugggucuugcucuguu

SEQ ID NO: 392012 - RNA, 24 nt, Human
ugauggucuucccaacccagaggc

SEQ ID NO: 392013 - RNA, 25 nt, Human
ugcagacccacauucccauaggcac

SEQ ID NO: 392014 - RNA, 21 nt, Human
ugcccaggcuggaguacaacg

SEQ ID NO: 392015 - RNA, 24 nt, Human
ugccucagccucccaaaguguugg

SEQ ID NO: 392016 - RNA, 21 nt, Human
ugccugggugagggagcaggc

SEQ ID NO: 392017 - RNA, 24 nt, Human
ugcuucagccucccgaguagcugg

SEQ ID NO: 392018 - RNA, 18 nt, Human
uggaaguaugauauccaa

SEQ ID NO: 392019 - RNA, 26 nt, Human
uggaaguaugauauccaacaggaagg

SEQ ID NO: 392020 - RNA, 24 nt, Human
uggaguacaacggcgcaaucuugg

SEQ ID NO: 392021 - RNA, 23 nt, Human
uggauaggaggcuaccccagggg

SEQ ID NO: 392022 - RNA, 19 nt, Human
uggcagaugacaauuuccu

SEQ ID NO: 392023 - RNA, 22 nt, Human
uggcccagcagauggaaacagg

SEQ ID NO: 392024 - RNA, 19 nt, Human
uggcugguggcccagcaga

SEQ ID NO: 392025 - RNA, 19 nt, Human
ugggaaaugaugaggcugc

SEQ ID NO: 392026 - RNA, 20 nt, Human
ugggaaaugaugaggcugca

SEQ ID NO: 392027 - RNA, 18 nt, Human
ugggauuacaggcgugag

SEQ ID NO: 392028 - RNA, 22 nt, Human
ugggauuacaggcgugagccac

SEQ ID NO: 392029 - RNA, 23 nt, Human
ugggauuacaggcgugagccacc

SEQ ID NO: 392030 - RNA, 24 nt, Human
ugggauuacaggcgugagccacca

SEQ ID NO: 392031 - RNA, 25 nt, Human
ugggauuacaggcgugagccaccau

SEQ ID NO: 392032 - RNA, 22 nt, Human
ugggauuacuggugugugccac

SEQ ID NO: 392033 - RNA, 24 nt, Human
ugggauuacuggugugugccacca

SEQ ID NO: 392034 - RNA, 21 nt, Human
ugggccagguauguggguguu

SEQ ID NO: 392035 - RNA, 21 nt, Human
uggggauggaagagggacagg

SEQ ID NO: 392036 - RNA, 24 nt, Human
ugggguuuucaccauguuggucag

SEQ ID NO: 392037 - RNA, 23 nt, Human
ugggucuugcucuguugcccagg

SEQ ID NO: 392038 - RNA, 24 nt, Human
uggucaggcuggucucgaacuccu

SEQ ID NO: 392039 - RNA, 21 nt, Human
ugguugggccagguauguggg

SEQ ID NO: 392040 - RNA, 21 nt, Human
ugguugggccagguauguggg

SEQ ID NO: 392041 - RNA, 24 nt, Human
uguagaagccagcagacccaguga

SEQ ID NO: 392042 - RNA, 21 nt, Human
uguauuuuuaguagagauggg

SEQ ID NO: 392043 - RNA, 21 nt, Human
ugugagauccugacucugugc

SEQ ID NO: 392044 - RNA, 18 nt, Human
uuaguagagaugggguuu

SEQ ID NO: 392045 - RNA, 18 nt, Human
uuaguagagaugggguuu

SEQ ID NO: 392046 - RNA, 25 nt, Human
uuaguagagaugggguuuucaccau

SEQ ID NO: 392047 - RNA, 19 nt, Human
uugaagguagagaagaugc

SEQ ID NO: 392048 - RNA, 20 nt, Human
uugagaugggucuugcucug

SEQ ID NO: 392049 - RNA, 19 nt, Human
uugcccagugccuggguga

SEQ ID NO: 392050 - RNA, 23 nt, Human
uugccuggcucacgggagaaguc

SEQ ID NO: 392051 - RNA, 24 nt, Human
uugcucuguugcccaggcuggagu

SEQ ID NO: 392052 - RNA, 24 nt, Human
uuucaccauguuggucaggcuggu

SEQ ID NO: 392053 - RNA, 21 nt, Human
uuugagaugggucuugcucug

SEQ ID NO: 392054 - RNA, 25 nt, Human
uuuuuaguagagaugggguuuucac

SEQ ID NO: 392055 - RNA, 20 nt, Human
uuuuuguauuuuuaguagag

SEQ ID NO: 392056 - RNA, 24 nt, Human
aaaaaacuuaaaaauguuagcuaa

SEQ ID NO: 392057 - RNA, 21 nt, Human
aaacaugcacauaguauuccu

SEQ ID NO: 392058 - RNA, 19 nt, Human
aaagcaauaagugcuuuuc

SEQ ID NO: 392059 - RNA, 23 nt, Human
aacugaacaauugcuaaaaggaa

SEQ ID NO: 392060 - RNA, 21 nt, Human
acagcacauugacaacuaugg

SEQ ID NO: 392061 - RNA, 22 nt, Human
acagcacauugacaacuauggu

SEQ ID NO: 392062 - RNA, 18 nt, Human
acccuaauuuuucaucua

SEQ ID NO: 392063 - RNA, 23 nt, Human
acgaugcuguauagaauaugagc

SEQ ID NO: 392064 - RNA, 19 nt, Human
acucaauuugaaccccaca

SEQ ID NO: 392065 - RNA, 21 nt, Human
agcgccggcucucccuggggc

SEQ ID NO: 392066 - RNA, 23 nt, Human
auugacaacuauggugcuuagca

SEQ ID NO: 392067 - RNA, 24 nt, Human
cagcauaaagaaacaugaauaaug

SEQ ID NO: 392068 - RNA, 24 nt, Human
ccccaucaccuuagguacaaaaua

SEQ ID NO: 392069 - RNA, 20 nt, Human
ccgguagagcaccgcggccg

SEQ ID NO: 392070 - RNA, 22 nt, Human
ccgguagagcaccgcggccgcg

SEQ ID NO: 392071 - RNA, 25 nt, Human
cuuaaacaacaauaauaaaaaacaa

SEQ ID NO: 392072 - RNA, 22 nt, Human
gcacaaaagccagcagcauaaa

SEQ ID NO: 392073 - RNA, 18 nt, Human
gcuuauuccucuccaaaa

SEQ ID NO: 392074 - RNA, 20 nt, Human
ggcaaaauaucaaacaugca

SEQ ID NO: 392075 - RNA, 19 nt, Human
gggcacaaaagccagcagc

SEQ ID NO: 392076 - RNA, 24 nt, Human
guuuucaggguuaaguagcagauu

SEQ ID NO: 392077 - RNA, 18 nt, Human
uaaagcaaugacaaaauu

SEQ ID NO: 392078 - RNA, 23 nt, Human
uaagugcuuuucauuuugcuuac

SEQ ID NO: 392079 - RNA, 22 nt, Human
uaauccucagaaaaaguaaaca

SEQ ID NO: 392080 - RNA, 21 nt, Human
uacccucaaguguaaauccaa

SEQ ID NO: 392081 - RNA, 22 nt, Human
uacgucuuccaacugaacaauu

SEQ ID NO: 392082 - RNA, 21 nt, Human
uagaauaugagcuaaucugcc

SEQ ID NO: 392083 - RNA, 24 nt, Human
uagcacacuaguaaacaacuauua

SEQ ID NO: 392084 - RNA, 21 nt, Human
uagcagagacauaugcccaua

SEQ ID NO: 392085 - RNA, 18 nt, Human
uaguguuagugguaauau

SEQ ID NO: 392086 - RNA, 26 nt, Human
uauagaauaugagcuaaucugccaaa

SEQ ID NO: 392087 - RNA, 21 nt, Human
uauuaguguuagugguaauau

SEQ ID NO: 392088 - RNA, 23 nt, Human
uauuuucuuaauaaauuuaauua

SEQ ID NO: 392089 - RNA, 21 nt, Human
ugagcuaaucugccaauuacu

SEQ ID NO: 392090 - RNA, 18 nt, Human
ugauauugcuugcuuaua

SEQ ID NO: 392091 - RNA, 27 nt, Human
ugcuuaaacaacaauaauaaaaaacaa

SEQ ID NO: 392092 - RNA, 20 nt, Human
uggcaaaauaucaaacaugc

SEQ ID NO: 392093 - RNA, 18 nt, Human
uguaaggcagcuguuuga

SEQ ID NO: 392094 - RNA, 21 nt, Human
uguguaaccagauucacuuuu

SEQ ID NO: 392095 - RNA, 24 nt, Human
uuaaguacaacuaagugaggggaa

SEQ ID NO: 392096 - RNA, 21 nt, Human
uuaauuacauuucauaagccc

SEQ ID NO: 392097 - RNA, 22 nt, Human
uucauaagcccugagauaacgu

SEQ ID NO: 392098 - RNA, 22 nt, Human
uuccuuccccaaauauuaauac

SEQ ID NO: 392099 - RNA, 23 nt, Human
uugcuaaaaggaacuuagcauuu

SEQ ID NO: 392100 - RNA, 20 nt, Human
uuuaaguuauuuacagaugg

SEQ ID NO: 392101 - RNA, 21 nt, Human
uuugcacagcacauugacaac

SEQ ID NO: 392102 - RNA, 22 nt, Human
acaaaacaaagagaaugagaaa

SEQ ID NO: 392103 - RNA, 21 nt, Human
acauugugaaagugccacaaa

SEQ ID NO: 392104 - RNA, 19 nt, Human
acuagcagauuucagauuu

SEQ ID NO: 392105 - RNA, 22 nt, Human
agacaaaaggagaaagggggac

SEQ ID NO: 392106 - RNA, 23 nt, Human
caaaacaaagagaaugagaaaag

SEQ ID NO: 392107 - RNA, 22 nt, Human
caaaaguauaaaguauggaaaa

SEQ ID NO: 392108 - RNA, 19 nt, Human
cacaaaacaaagagaauga

SEQ ID NO: 392109 - RNA, 26 nt, Human
caucacagugcggucauuugguuuuu

SEQ ID NO: 392110 - RNA, 24 nt, Human
ggaugaacuagagacaaaaggaga

SEQ ID NO: 392111 - RNA, 18 nt, Human
uacagggauacucaucug

SEQ ID NO: 392112 - RNA, 22 nt, Human
ugaaagugccacaaaacaaaga

SEQ ID NO: 392113 - RNA, 22 nt, Human
ugaccuacagggauacucaucu

SEQ ID NO: 392114 - RNA, 20 nt, Human
uucacaucacagugcgguca

SEQ ID NO: 392115 - RNA, 19 nt, Human
uugaaucauuucagagagu

SEQ ID NO: 392116 - RNA, 18 nt, Human
aaacuuaaaagguauaug

SEQ ID NO: 392117 - RNA, 24 nt, Human
aagcauucacuuaauauuuuaguu

SEQ ID NO: 392118 - RNA, 24 nt, Human
aguaaacauaauauacagauaaau

SEQ ID NO: 392119 - RNA, 22 nt, Human
cagcacagcuguaguucacuuu

SEQ ID NO: 392120 - RNA, 22 nt, Human
cagcuguaguucacuuuaaaca

SEQ ID NO: 392121 - RNA, 18 nt, Human
cagugauggagguggccg

SEQ ID NO: 392122 - RNA, 24 nt, Human
ccaaaguuaaaagaaccuacaggc

SEQ ID NO: 392123 - RNA, 24 nt, Human
ccagugauggagguggccgguccu

SEQ ID NO: 392124 - RNA, 20 nt, Human
cugccagcugagcucgugcc

SEQ ID NO: 392125 - RNA, 24 nt, Human
cuucugauauaaaccugcauacag

SEQ ID NO: 392126 - RNA, 23 nt, Human
ggagguggccgguccugaggcug

SEQ ID NO: 392127 - RNA, 22 nt, Human
uaaaggauacugcaauauaaau

SEQ ID NO: 392128 - RNA, 26 nt, Human
ucaaauauccaacauuuuccuaucuu

SEQ ID NO: 392129 - RNA, 20 nt, Human
ucaaucucaccuucugauau

SEQ ID NO: 392130 - RNA, 21 nt, Human
ucaaucucaccuucugauaua

SEQ ID NO: 392131 - RNA, 20 nt, Human
ugaaggagaccuuugugagu

SEQ ID NO: 392132 - RNA, 19 nt, Human
ugcaucaagcauuauucaa

SEQ ID NO: 392133 - RNA, 21 nt, Human
ugugaguuccagugguguccu

SEQ ID NO: 392134 - RNA, 22 nt, Human
uuaaaccaaaguuaaaagaacc

SEQ ID NO: 392135 - RNA, 24 nt, Human
aaaagugacucccaaaagaaaauc

SEQ ID NO: 392136 - RNA, 19 nt, Human
aaacugcagcauuuaagca

SEQ ID NO: 392137 - RNA, 18 nt, Human
aaagcacccgcacaaaac

SEQ ID NO: 392138 - RNA, 18 nt, Human
aacaauucuuaauaucuu

SEQ ID NO: 392139 - RNA, 20 nt, Human
aacacagaugaguggcaaaa

SEQ ID NO: 392140 - RNA, 21 nt, Human
aagacaaccccagagaccugg

SEQ ID NO: 392141 - RNA, 21 nt, Human
aagcagagcugagaagcacca

SEQ ID NO: 392142 - RNA, 22 nt, Human
aauuacaccacuagaguaaaau

SEQ ID NO: 392143 - RNA, 18 nt, Human
acaaaacagcaugcuccc

SEQ ID NO: 392144 - RNA, 23 nt, Human
acaaacagcaaugaugcagauaa

SEQ ID NO: 392145 - RNA, 24 nt, Human
acacagaagacaucagucaaacuc

SEQ ID NO: 392146 - RNA, 20 nt, Human
accgcacccagccagaagca

SEQ ID NO: 392147 - RNA, 21 nt, Human
accuuauaaccaaugcgacug

SEQ ID NO: 392148 - RNA, 20 nt, Human
acgggcagccggucucugua

SEQ ID NO: 392149 - RNA, 21 nt, Human
acucgauucucuggaaccugc

SEQ ID NO: 392150 - RNA, 21 nt, Human
agacaaccccagagaccuggg

SEQ ID NO: 392151 - RNA, 23 nt, Human
agccagaagcaaaccuuauaacc

SEQ ID NO: 392152 - RNA, 24 nt, Human
aggugguccgccugccuuggccuc

SEQ ID NO: 392153 - RNA, 19 nt, Human
aguuaagaaucaacuauaa

SEQ ID NO: 392154 - RNA, 23 nt, Human
augcaaggcacuucaaagcaccc

SEQ ID NO: 392155 - RNA, 23 nt, Human
caaaacagcaugcucccugggua

SEQ ID NO: 392156 - RNA, 22 nt, Human
caauguuggauuacaggcauga

SEQ ID NO: 392157 - RNA, 24 nt, Human
cacaaacaccacugguaaagcaaa

SEQ ID NO: 392158 - RNA, 25 nt, Human
cacacagaagacaucagucaaacuc

SEQ ID NO: 392159 - RNA, 23 nt, Human
cacacagggcugagcaggucaaa

SEQ ID NO: 392160 - RNA, 19 nt, Human
cacacgggcagccggucuc

SEQ ID NO: 392161 - RNA, 25 nt, Human
cacacuaccacacaacuguucuaca

SEQ ID NO: 392162 - RNA, 18 nt, Human
cacacucuuaaagccaag

SEQ ID NO: 392163 - RNA, 23 nt, Human
cacagcuugaccuaggaaaaaau

SEQ ID NO: 392164 - RNA, 18 nt, Human
caccgcacccagccagaa

SEQ ID NO: 392165 - RNA, 22 nt, Human
caccgcacccagccagaagcaa

SEQ ID NO: 392166 - RNA, 19 nt, Human
caccucaaccuuuccauga

SEQ ID NO: 392167 - RNA, 24 nt, Human
cagucaaacucaaguucgaaagcc

SEQ ID NO: 392168 - RNA, 21 nt, Human
cauagccacagcuaaaaagca

SEQ ID NO: 392169 - RNA, 26 nt, Human
cauagccacagcuaaaaagcauguua

SEQ ID NO: 392170 - RNA, 21 nt, Human
ccaauguuggauuacaggcau

SEQ ID NO: 392171 - RNA, 21 nt, Human
ccacacagaagacaucaguca

SEQ ID NO: 392172 - RNA, 22 nt, Human
cccaauguuggauuacaggcau

SEQ ID NO: 392173 - RNA, 23 nt, Human
cccgcugcguggcgcaggcaauu

SEQ ID NO: 392174 - RNA, 23 nt, Human
ccgcacccagccagaagcagugg

SEQ ID NO: 392175 - RNA, 21 nt, Human
ccugccuuggccucccaaugu

SEQ ID NO: 392176 - RNA, 22 nt, Human
ccugccuuggccucccaauguu

SEQ ID NO: 392177 - RNA, 21 nt, Human
cguggcgcaggcaauucuccc

SEQ ID NO: 392178 - RNA, 18 nt, Human
cuacuuagguucauacgg

SEQ ID NO: 392179 - RNA, 22 nt, Human
cucaaccuuuccaugagguuca

SEQ ID NO: 392180 - RNA, 26 nt, Human
cucccgacuucaggugguccgccugc

SEQ ID NO: 392181 - RNA, 18 nt, Human
cuccuaaucccugaugca

SEQ ID NO: 392182 - RNA, 18 nt, Human
gauuacaggcaugagcca

SEQ ID NO: 392183 - RNA, 22 nt, Human
gauuacaggcaugagccaccgc

SEQ ID NO: 392184 - RNA, 23 nt, Human
gauuacaggcaugagccaccgca

SEQ ID NO: 392185 - RNA, 22 nt, Human
gauuuagcggacaccacacaga

SEQ ID NO: 392186 - RNA, 25 nt, Human
gcaauucucccaaacggcuccacua

SEQ ID NO: 392187 - RNA, 18 nt, Human
gcuaguauacaaaaaccc

SEQ ID NO: 392188 - RNA, 24 nt, Human
ggaaaaaauaaaauccaucauagc

SEQ ID NO: 392189 - RNA, 21 nt, Human
ggauuacaggcaugagccacc

SEQ ID NO: 392190 - RNA, 22 nt, Human
ggauuacaggcaugagccaccg

SEQ ID NO: 392191 - RNA, 22 nt, Human
guaagacaaccccagagaccug

SEQ ID NO: 392192 - RNA, 22 nt, Human
guuagcaaacugagguucuacu

SEQ ID NO: 392193 - RNA, 19 nt, Human
uaaaacacagaugaguggc

SEQ ID NO: 392194 - RNA, 21 nt, Human
uaaaacacagaugaguggcaa

SEQ ID NO: 392195 - RNA, 22 nt, Human
uaaaacacagaugaguggcaaa

SEQ ID NO: 392196 - RNA, 24 nt, Human
uaaaacacagaugaguggcaaaag

SEQ ID NO: 392197 - RNA, 19 nt, Human
uaaaauuacagauuaaaag

SEQ ID NO: 392198 - RNA, 18 nt, Human
uaaagcaaagaggucuga

SEQ ID NO: 392199 - RNA, 23 nt, Human
uaaccaaugcgacugauccuaua

SEQ ID NO: 392200 - RNA, 24 nt, Human
uaagcagagcugagaagcaccauu

SEQ ID NO: 392201 - RNA, 21 nt, Human
uacaaaaacccuacuuuuucu

SEQ ID NO: 392202 - RNA, 23 nt, Human
uacaaaaacccuacuuuuucuuc

SEQ ID NO: 392203 - RNA, 25 nt, Human
uacaaaaacccuacuuuuucuucca

SEQ ID NO: 392204 - RNA, 24 nt, Human
uacaggcaugagccaccgcaccca

SEQ ID NO: 392205 - RNA, 23 nt, Human
uacaugucucaaguaaaacacag

SEQ ID NO: 392206 - RNA, 19 nt, Human
uacucaucugucauguuag

SEQ ID NO: 392207 - RNA, 20 nt, Human
uauaaaaagcuggaaugaua

SEQ ID NO: 392208 - RNA, 19 nt, Human
uauauaaaaagcuggaaug

SEQ ID NO: 392209 - RNA, 18 nt, Human
ucacaauaagaauuuguu

SEQ ID NO: 392210 - RNA, 19 nt, Human
ucacaauaagaauuuguuu

SEQ ID NO: 392211 - RNA, 22 nt, Human
ucacacugucauguauaggaua

SEQ ID NO: 392212 - RNA, 24 nt, Human
uccauggcacacucuuaaagccaa

SEQ ID NO: 392213 - RNA, 21 nt, Human
ucccaaacggcuccacugggc

SEQ ID NO: 392214 - RNA, 21 nt, Human
ucccaauguuggauuacaggc

SEQ ID NO: 392215 - RNA, 22 nt, Human
uccugggggugggggagaccuc

SEQ ID NO: 392216 - RNA, 22 nt, Human
ucucauguacauaaagcaccag

SEQ ID NO: 392217 - RNA, 18 nt, Human
ucucuggaaccugccacc

SEQ ID NO: 392218 - RNA, 23 nt, Human
ucucuggaaccugccaccccaga

SEQ ID NO: 392219 - RNA, 23 nt, Human
ucuuccaaacuacuuagguucau

SEQ ID NO: 392220 - RNA, 22 nt, Human
ugaauggagaaauucaguuccu

SEQ ID NO: 392221 - RNA, 23 nt, Human
ugaccuaggaaaaaauaaaaucc

SEQ ID NO: 392222 - RNA, 25 nt, Human
ugacucccaaaagaaaaucaauuuc

SEQ ID NO: 392223 - RNA, 19 nt, Human
ugagcaacucacaaacacc

SEQ ID NO: 392224 - RNA, 21 nt, Human
ugagcaacucacaaacaccac

SEQ ID NO: 392225 - RNA, 23 nt, Human
ugauaauuaauucaaauacaaaa

SEQ ID NO: 392226 - RNA, 24 nt, Human
ugccuuggccucccaauguuggau

SEQ ID NO: 392227 - RNA, 20 nt, Human
uggauuacaggcaugagcca

SEQ ID NO: 392228 - RNA, 23 nt, Human
uggauuacaggcaugagccaccg

SEQ ID NO: 392229 - RNA, 19 nt, Human
uggcacacucuuaaagcca

SEQ ID NO: 392230 - RNA, 26 nt, Human
uuagguucauacgguucacacuacca

SEQ ID NO: 392231 - RNA, 21 nt, Human
uucuauauuacuuauuuuagu

SEQ ID NO: 392232 - RNA, 22 nt, Human
uucucuggaaccugccacccca

SEQ ID NO: 392233 - RNA, 21 nt, Human
uucuuccaaacuacuuagguu

SEQ ID NO: 392234 - RNA, 22 nt, Human
uugcuccuaaucccugaugcaa

SEQ ID NO: 392235 - RNA, 18 nt, Human
uuggauuacaggcaugag

SEQ ID NO: 392236 - RNA, 22 nt, Human
uuggauuacaggcaugagccac

SEQ ID NO: 392237 - RNA, 24 nt, Human
uuggauuacaggcaugagccaccg

SEQ ID NO: 392238 - RNA, 21 nt, Human
uuguauuuuaaaauuacagau

SEQ ID NO: 392239 - RNA, 26 nt, Human
uuuaaaauuauuggcuuacuggauuu

SEQ ID NO: 392240 - RNA, 19 nt, Human
aaaaaaaaaaaagaaacac

SEQ ID NO: 392241 - RNA, 23 nt, Human
aaacagccaaaggaaaacauuca

SEQ ID NO: 392242 - RNA, 18 nt, Human
aacccauuuuguuuuuca

SEQ ID NO: 392243 - RNA, 21 nt, Human
aagaagaaaaugagaaauucg

SEQ ID NO: 392244 - RNA, 19 nt, Human
aagcaggagcaaggcgucc

SEQ ID NO: 392245 - RNA, 23 nt, Human
aagcaggagcaaggcguccaggg

SEQ ID NO: 392246 - RNA, 22 nt, Human
aauauggugaaacccccaucuc

SEQ ID NO: 392247 - RNA, 18 nt, Human
acaauauguaguuugauc

SEQ ID NO: 392248 - RNA, 23 nt, Human
acagagugagacuccgucucaaa

SEQ ID NO: 392249 - RNA, 24 nt, Human
acagagugagacuccgucucaaaa

SEQ ID NO: 392250 - RNA, 21 nt, Human
acuugcuucucuaccaccacc

SEQ ID NO: 392251 - RNA, 19 nt, Human
agaaguaguucuguaagga

SEQ ID NO: 392252 - RNA, 24 nt, Human
agacuggccaauauggugaaaccc

SEQ ID NO: 392253 - RNA, 22 nt, Human
agagaccauuuuggaaauugua

SEQ ID NO: 392254 - RNA, 23 nt, Human
agagucauugccaaaacagccaa

SEQ ID NO: 392255 - RNA, 24 nt, Human
agccugggugacagagugagacuc

SEQ ID NO: 392256 - RNA, 19 nt, Human
agccuuuuuacuugcuucu

SEQ ID NO: 392257 - RNA, 23 nt, Human
agcugggcauggugacacaugcc

SEQ ID NO: 392258 - RNA, 19 nt, Human
aggcacaauggagauaugg

SEQ ID NO: 392259 - RNA, 18 nt, Human
aggcaggagaauggcuug

SEQ ID NO: 392260 - RNA, 24 nt, Human
aggcuuaggcaggagaauggcuug

SEQ ID NO: 392261 - RNA, 22 nt, Human
agggcaaagaaguaagaaguag

SEQ ID NO: 392262 - RNA, 21 nt, Human
agucauugccaaaacagccaa

SEQ ID NO: 392263 - RNA, 24 nt, Human
aucacaaggucagaguucgagacc

SEQ ID NO: 392264 - RNA, 24 nt, Human
aucgcgucauugcaguccagccug

SEQ ID NO: 392265 - RNA, 18 nt, Human
auggugaaacccccaucu

SEQ ID NO: 392266 - RNA, 21 nt, Human
auggugaaacccccaucucua

SEQ ID NO: 392267 - RNA, 21 nt, Human
auuaagcaaucuuguugggga

SEQ ID NO: 392268 - RNA, 24 nt, Human
auugcaguccagccugggugacag

SEQ ID NO: 392269 - RNA, 19 nt, Human
caagaucgcgucauugcag

SEQ ID NO: 392270 - RNA, 23 nt, Human
cacguguguaaucucagcacucg

SEQ ID NO: 392271 - RNA, 22 nt, Human
caggagaauggcuugaaccccg

SEQ ID NO: 392272 - RNA, 23 nt, Human
caguccagccugggugacagagu

SEQ ID NO: 392273 - RNA, 24 nt, Human
caguccagccugggugacagagug

SEQ ID NO: 392274 - RNA, 21 nt, Human
cauacacauauauacaaugua

SEQ ID NO: 392275 - RNA, 24 nt, Human
caugccuguaaucccaguuacuug

SEQ ID NO: 392276 - RNA, 22 nt, Human
cauuagaauuagucuccaauaa

SEQ ID NO: 392277 - RNA, 19 nt, Human
cauugcaguccagccuggg

SEQ ID NO: 392278 - RNA, 19 nt, Human
cauugcaguccagccuggg

SEQ ID NO: 392279 - RNA, 21 nt, Human
cauugcaguccagccugggug

SEQ ID NO: 392280 - RNA, 22 nt, Human
cauugcaguccagccuggguga

SEQ ID NO: 392281 - RNA, 23 nt, Human
cauugcaguccagccugggugac

SEQ ID NO: 392282 - RNA, 24 nt, Human
cauugcaguccagccugggugaca

SEQ ID NO: 392283 - RNA, 25 nt, Human
cauugcaguccagccugggugacag

SEQ ID NO: 392284 - RNA, 22 nt, Human
cauugccaaaacagccaaagga

SEQ ID NO: 392285 - RNA, 18 nt, Human
cauuuagccuuuuuacuu

SEQ ID NO: 392286 - RNA, 21 nt, Human
cauuuagccuuuuuacuugcu

SEQ ID NO: 392287 - RNA, 22 nt, Human
ccagaaggucguagcagaagca

SEQ ID NO: 392288 - RNA, 20 nt, Human
cccggaugcggagguugcag

SEQ ID NO: 392289 - RNA, 22 nt, Human
ccugggugacagagugagacuc

SEQ ID NO: 392290 - RNA, 18 nt, Human
ccuguaaucccaguuacu

SEQ ID NO: 392291 - RNA, 21 nt, Human
ccuguaaucccaguuacuugg

SEQ ID NO: 392292 - RNA, 24 nt, Human
cgagaccagacuggccaauauggu

SEQ ID NO: 392293 - RNA, 18 nt, Human
cucaaaaaaaaaaaaaaa

SEQ ID NO: 392294 - RNA, 24 nt, Human
cucaaaaaaaaaaaaaaaaagaaa

SEQ ID NO: 392295 - RNA, 23 nt, Human
cucacguguguaaucucagcacu

SEQ ID NO: 392296 - RNA, 19 nt, Human
cuccgucucaaaaaaaaaa

SEQ ID NO: 392297 - RNA, 21 nt, Human
cucgagaggcugaucgaugga

SEQ ID NO: 392298 - RNA, 21 nt, Human
cuggagggcuuucggccuugg

SEQ ID NO: 392299 - RNA, 22 nt, Human
cuggccaauauggugaaacccc

SEQ ID NO: 392300 - RNA, 24 nt, Human
cugguuccuccccuuaaagauguu

SEQ ID NO: 392301 - RNA, 20 nt, Human
cuugaaccccggaugcggag

SEQ ID NO: 392302 - RNA, 21 nt, Human
gacagagugagacuccgucuc

SEQ ID NO: 392303 - RNA, 23 nt, Human
gacuuccauuccuucagcacucu

SEQ ID NO: 392304 - RNA, 18 nt, Human
gagggcuuucggccuugg

SEQ ID NO: 392305 - RNA, 18 nt, Human
gagguugcagugaaccaa

SEQ ID NO: 392306 - RNA, 23 nt, Human
gagguugcagugaaccaagaucg

SEQ ID NO: 392307 - RNA, 21 nt, Human
gaucgauggaucacaagguca

SEQ ID NO: 392308 - RNA, 23 nt, Human
gaucgauggaucacaaggucaga

SEQ ID NO: 392309 - RNA, 25 nt, Human
gccaauauggugaaacccccaucuc

SEQ ID NO: 392310 - RNA, 20 nt, Human
gccuguaaucccaguuacuu

SEQ ID NO: 392311 - RNA, 22 nt, Human
gcggagguugcagugaaccaag

SEQ ID NO: 392312 - RNA, 21 nt, Human
gcuucucuaccaccaccuaau

SEQ ID NO: 392313 - RNA, 23 nt, Human
ggaaaacauucaucuccuaaagc

SEQ ID NO: 392314 - RNA, 24 nt, Human
ggagguugcagugaaccaagaucg

SEQ ID NO: 392315 - RNA, 24 nt, Human
gggcauggugacacaugccuguaa

SEQ ID NO: 392316 - RNA, 24 nt, Human
ggugacacaugccuguaaucccag

SEQ ID NO: 392317 - RNA, 24 nt, Human
gucauugcaguccagccuggguga

SEQ ID NO: 392318 - RNA, 18 nt, Human
uaagaagaaaaugagaaa

SEQ ID NO: 392319 - RNA, 20 nt, Human
uaaggaaauguuagagacca

SEQ ID NO: 392320 - RNA, 24 nt, Human
uaaggaggcuucauucuuuuuaua

SEQ ID NO: 392321 - RNA, 23 nt, Human
uacugugcauacacauauauaca

SEQ ID NO: 392322 - RNA, 20 nt, Human
uagcagcagccuuuacuggu

SEQ ID NO: 392323 - RNA, 18 nt, Human
uaucaagaaacaccaggc

SEQ ID NO: 392324 - RNA, 20 nt, Human
uaucaagaaacaccaggccu

SEQ ID NO: 392325 - RNA, 23 nt, Human
ucacaaggucagaguucgagacc

SEQ ID NO: 392326 - RNA, 18 nt, Human
ucauugcaguccagccug

SEQ ID NO: 392327 - RNA, 21 nt, Human
ucauugcaguccagccugggu

SEQ ID NO: 392328 - RNA, 24 nt, Human
ucauugcaguccagccugggugac

SEQ ID NO: 392329 - RNA, 19 nt, Human
ucauugccaaaacagccaa

SEQ ID NO: 392330 - RNA, 24 nt, Human
uccacauuagaauuagucuccaau

SEQ ID NO: 392331 - RNA, 19 nt, Human
uccagccugggugacagag

SEQ ID NO: 392332 - RNA, 23 nt, Human
uccagccugggugacagagugag

SEQ ID NO: 392333 - RNA, 24 nt, Human
uccagccugggugacagagugaga

SEQ ID NO: 392334 - RNA, 23 nt, Human
uccgucucaaaaaaaaaaaaaaa

SEQ ID NO: 392335 - RNA, 20 nt, Human
uccuucagcacucugguucc

SEQ ID NO: 392336 - RNA, 23 nt, Human
ucgcgucauugcaguccagccug

SEQ ID NO: 392337 - RNA, 18 nt, Human
ucguagcagaagcaggag

SEQ ID NO: 392338 - RNA, 21 nt, Human
ucuaccaccaccuaaucacca

SEQ ID NO: 392339 - RNA, 21 nt, Human
ucucuacuaaaauacaaaaaa

SEQ ID NO: 392340 - RNA, 18 nt, Human
ucugaacauauaauucaa

SEQ ID NO: 392341 - RNA, 22 nt, Human
ugacacaugccuguaaucccag

SEQ ID NO: 392342 - RNA, 21 nt, Human
ugcacaguugcucacgugugu

SEQ ID NO: 392343 - RNA, 22 nt, Human
ugcaguccagccugggugacag

SEQ ID NO: 392344 - RNA, 24 nt, Human
ugcaguccagccugggugacagag

SEQ ID NO: 392345 - RNA, 21 nt, Human
ugccaaaacagccaaaggaaa

SEQ ID NO: 392346 - RNA, 24 nt, Human
ugccuguaaucccaguuacuuggg

SEQ ID NO: 392347 - RNA, 24 nt, Human
ugccuuugggaaaaaaaggggagu

SEQ ID NO: 392348 - RNA, 25 nt, Human
ugccuuugggaaaaaaaggggaguu

SEQ ID NO: 392349 - RNA, 18 nt, Human
uggccaauauggugaaac

SEQ ID NO: 392350 - RNA, 24 nt, Human
ugggagagggcagggcaaagaagu

SEQ ID NO: 392351 - RNA, 24 nt, Human
uggugacacaugccuguaauccca

SEQ ID NO: 392352 - RNA, 21 nt, Human
uguaucaagaaacaccaggcc

SEQ ID NO: 392353 - RNA, 24 nt, Human
ugugcauacacauauauacaaugu

SEQ ID NO: 392354 - RNA, 24 nt, Human
uuagcugggcauggugacacaugc

SEQ ID NO: 392355 - RNA, 24 nt, Human
uuaggcaggagaauggcuugaacc

SEQ ID NO: 392356 - RNA, 18 nt, Human
uugcaguccagccugggu

SEQ ID NO: 392357 - RNA, 22 nt, Human
uugcagugaaccaagaucgcgu

SEQ ID NO: 392358 - RNA, 21 nt, Human
uugcuucucuaccaccaccua

SEQ ID NO: 392359 - RNA, 24 nt, Human
uugugaacauuuugucuucuacaa

SEQ ID NO: 392360 - RNA, 20 nt, Human
uuuaagaagaaaaugagaaa

SEQ ID NO: 392361 - RNA, 18 nt, Human
uuugggagagggcagggc

SEQ ID NO: 392362 - RNA, 21 nt, Human
aaaaaauaggcugugaaacca

SEQ ID NO: 392363 - RNA, 21 nt, Human
aaggcacugucugagaagcac

SEQ ID NO: 392364 - RNA, 22 nt, Human
acugucugagaagcacggaggu

SEQ ID NO: 392365 - RNA, 21 nt, Human
agaauaauauaauguacugca

SEQ ID NO: 392366 - RNA, 26 nt, Human
aggcagaugcuaucauugaccuucuu

SEQ ID NO: 392367 - RNA, 24 nt, Human
aucaaauuguuucuagaauuaaau

SEQ ID NO: 392368 - RNA, 20 nt, Human
augcauacauauauucaaac

SEQ ID NO: 392369 - RNA, 20 nt, Human
caaacuguauuuaugaaaau

SEQ ID NO: 392370 - RNA, 22 nt, Human
gaaguuuacaaguuuauaaaga

SEQ ID NO: 392371 - RNA, 24 nt, Human
ugaaaaggcacugucugagaagca

SEQ ID NO: 392372 - RNA, 18 nt, Human
ugucugagaagcacggag

SEQ ID NO: 392373 - RNA, 20 nt, Human
uugaaauagaugaaguuuac

SEQ ID NO: 392374 - RNA, 20 nt, Human
uuuaauaggaaaacacccua

SEQ ID NO: 392375 - RNA, 22 nt, Human
uuuuuaauaggaaaacacccua

SEQ ID NO: 392376 - RNA, 18 nt, Human
uuuuuuuuuuuuuuuuug

SEQ ID NO: 392377 - RNA, 23 nt, Human
aaaaacagcagaagcauuaugac

SEQ ID NO: 392378 - RNA, 19 nt, Human
aaacaacaguaaggaaagg

SEQ ID NO: 392379 - RNA, 21 nt, Human
aaccucaggucauuaaaucac

SEQ ID NO: 392380 - RNA, 24 nt, Human
acaacaguaaggaaaggcuauuac

SEQ ID NO: 392381 - RNA, 21 nt, Human
acaaggaggaaacaagucaau

SEQ ID NO: 392382 - RNA, 19 nt, Human
acagaagaggcgaaaacau

SEQ ID NO: 392383 - RNA, 21 nt, Human
acaggaauauagucuuuuuca

SEQ ID NO: 392384 - RNA, 21 nt, Human
auucacagaaccaaacaacag

SEQ ID NO: 392385 - RNA, 24 nt, Human
caauagguuucacuccauuagcuc

SEQ ID NO: 392386 - RNA, 18 nt, Human
cacagaaccaaacaacag

SEQ ID NO: 392387 - RNA, 19 nt, Human
cacuccauuagcucuaucc

SEQ ID NO: 392388 - RNA, 23 nt, Human
cacuccauuagcucuauccugcc

SEQ ID NO: 392389 - RNA, 24 nt, Human
cagaagcauuaugaccaaaccuca

SEQ ID NO: 392390 - RNA, 19 nt, Human
cagauaaaccuacaaaaac

SEQ ID NO: 392391 - RNA, 25 nt, Human
cagauaaaccuacaaaaacagcaga

SEQ ID NO: 392392 - RNA, 21 nt, Human
caguagcaaaggaaaacgauc

SEQ ID NO: 392393 - RNA, 23 nt, Human
caugcacauuggccuuugcaguu

SEQ ID NO: 392394 - RNA, 21 nt, Human
cauucacagaaccaaacaaca

SEQ ID NO: 392395 - RNA, 19 nt, Human
gcagucccccugccggaau

SEQ ID NO: 392396 - RNA, 22 nt, Human
ggccuuugcagucccccugccg

SEQ ID NO: 392397 - RNA, 18 nt, Human
ggggguucaguuccauua

SEQ ID NO: 392398 - RNA, 21 nt, Human
gguuucacuccauuagcucua

SEQ ID NO: 392399 - RNA, 21 nt, Human
uaccccuggggguucaguucc

SEQ ID NO: 392400 - RNA, 18 nt, Human
ucaauguuccuguugagg

SEQ ID NO: 392401 - RNA, 18 nt, Human
ucacagaaccaaacaaca

SEQ ID NO: 392402 - RNA, 21 nt, Human
ucagauaaaccuacaaaaaca

SEQ ID NO: 392403 - RNA, 22 nt, Human
uccacauaucaauaacauaggc

SEQ ID NO: 392404 - RNA, 23 nt, Human
uccacauaucaauaacauaggca

SEQ ID NO: 392405 - RNA, 24 nt, Human
ugccaauaugccugaagauguccu

SEQ ID NO: 392406 - RNA, 19 nt, Human
ugccugaagauguccuauu

SEQ ID NO: 392407 - RNA, 19 nt, Human
ugcuccaauucccuucugc

SEQ ID NO: 392408 - RNA, 21 nt, Human
ugcugggauaacauuggcuac

SEQ ID NO: 392409 - RNA, 24 nt, Human
ugggauaacauuggcuacaaagca

SEQ ID NO: 392410 - RNA, 23 nt, Human
uuaacaggaauauagucuuuuuc

SEQ ID NO: 392411 - RNA, 24 nt, Human
uuggccuuugcagucccccugccg

SEQ ID NO: 392412 - RNA, 22 nt, Human
aaaauagcuuuauccucuguca

SEQ ID NO: 392413 - RNA, 23 nt, Human
aaagucaagacccuagcacccac

SEQ ID NO: 392414 - RNA, 18 nt, Human
aagcaugaggugagcugg

SEQ ID NO: 392415 - RNA, 22 nt, Human
aagcaugaggugagcuggagga

SEQ ID NO: 392416 - RNA, 23 nt, Human
aaguaaaggggacaagccaaugu

SEQ ID NO: 392417 - RNA, 22 nt, Human
acagcccucuccccaaauaaga

SEQ ID NO: 392418 - RNA, 21 nt, Human
acaucacagcccucuccccaa

SEQ ID NO: 392419 - RNA, 20 nt, Human
acuccuguccccacaauccc

SEQ ID NO: 392420 - RNA, 24 nt, Human
agaaaagccagugcuguaccuggg

SEQ ID NO: 392421 - RNA, 20 nt, Human
agaggaguggggguggccug

SEQ ID NO: 392422 - RNA, 26 nt, Human
aggaguggggguggccugucaggggc

SEQ ID NO: 392423 - RNA, 21 nt, Human
aggccucugaggucaaccccu

SEQ ID NO: 392424 - RNA, 24 nt, Human
aggucauggagugagggugguaga

SEQ ID NO: 392425 - RNA, 18 nt, Human
aucacagcccucucccca

SEQ ID NO: 392426 - RNA, 20 nt, Human
caaacaaacaaacuuugaga

SEQ ID NO: 392427 - RNA, 21 nt, Human
cacuuugugaucucacagguc

SEQ ID NO: 392428 - RNA, 20 nt, Human
cagaacacaaacaaacaaac

SEQ ID NO: 392429 - RNA, 20 nt, Human
cagcccucuccccaaauaag

SEQ ID NO: 392430 - RNA, 24 nt, Human
cagcccucuccccaaauaagaagc

SEQ ID NO: 392431 - RNA, 24 nt, Human
cagccuguucagcucuccaaccaa

SEQ ID NO: 392432 - RNA, 18 nt, Human
ccccuuuacaucacagcc

SEQ ID NO: 392433 - RNA, 18 nt, Human
ccucccggccuggggcug

SEQ ID NO: 392434 - RNA, 24 nt, Human
cuccaagacaugcagaggaguggg

SEQ ID NO: 392435 - RNA, 23 nt, Human
gaggggcagaaauuucaggggga

SEQ ID NO: 392436 - RNA, 23 nt, Human
gaucuguccuuucagacacccac

SEQ ID NO: 392437 - RNA, 18 nt, Human
gccuggggcuggggagcc

SEQ ID NO: 392438 - RNA, 20 nt, Human
gcugaaaagaaaagccagug

SEQ ID NO: 392439 - RNA, 22 nt, Human
ggaaaaaguaaaggggacaagc

SEQ ID NO: 392440 - RNA, 22 nt, Human
ggagugagggugguagagaggg

SEQ ID NO: 392441 - RNA, 23 nt, Human
gggcccaccuggcucugcuccug

SEQ ID NO: 392442 - RNA, 19 nt, Human
gggcggggcgcugcgaggg

SEQ ID NO: 392443 - RNA, 20 nt, Human
gggcugaaaagaaaagccag

SEQ ID NO: 392444 - RNA, 25 nt, Human
ggggcuggggagccgcgggcgggcg

SEQ ID NO: 392445 - RNA, 19 nt, Human
ggggggugagccaguuuug

SEQ ID NO: 392446 - RNA, 20 nt, Human
ggggguggccugucaggggc

SEQ ID NO: 392447 - RNA, 19 nt, Human
gggguuuauccuuuccuca

SEQ ID NO: 392448 - RNA, 21 nt, Human
gucaaccccuuuacaucacag

SEQ ID NO: 392449 - RNA, 22 nt, Human
guccccacaaucccugauacuc

SEQ ID NO: 392450 - RNA, 24 nt, Human
guggggguggccugucaggggcug

SEQ ID NO: 392451 - RNA, 22 nt, Human
uaaaaaaaaaaaaaauguccag

SEQ ID NO: 392452 - RNA, 25 nt, Human
uaaagucaagacccuagcacccacu

SEQ ID NO: 392453 - RNA, 18 nt, Human
uauccuuuccucaguccc

SEQ ID NO: 392454 - RNA, 22 nt, Human
ucaucuucacuuugugaucuca

SEQ ID NO: 392455 - RNA, 19 nt, Human
uccagggcccaccuggcuc

SEQ ID NO: 392456 - RNA, 21 nt, Human
uccccacaaucccugauacuc

SEQ ID NO: 392457 - RNA, 25 nt, Human
ucccugggaggaggguguucugggg

SEQ ID NO: 392458 - RNA, 20 nt, Human
uccucagucccagccuguuc

SEQ ID NO: 392459 - RNA, 19 nt, Human
uccuuucagacacccacug

SEQ ID NO: 392460 - RNA, 20 nt, Human
ugagcuggaggacccucccu

SEQ ID NO: 392461 - RNA, 21 nt, Human
ugagggugguagagaggggca

SEQ ID NO: 392462 - RNA, 23 nt, Human
ugaucuguccuuucagacaccca

SEQ ID NO: 392463 - RNA, 22 nt, Human
ugcagcggagauaaagucaaga

SEQ ID NO: 392464 - RNA, 20 nt, Human
ugcuguaccugggggguugu

SEQ ID NO: 392465 - RNA, 18 nt, Human
ugggaaaaaguaaagggg

SEQ ID NO: 392466 - RNA, 22 nt, Human
uucagggggagggguggcuggg

SEQ ID NO: 392467 - RNA, 23 nt, Human
uuuacaucacagcccucucccca

SEQ ID NO: 392468 - RNA, 20 nt, Human
uuuuuuuuuuuuuuuuuggu

SEQ ID NO: 392469 - RNA, 28 nt, Human
uuuuuuuuuuuuuuuuuuuuuuuggggg

SEQ ID NO: 392470 - RNA, 18 nt, Human
aaccugggcucuggggac

SEQ ID NO: 392471 - RNA, 19 nt, Human
aagcagcccuggaugagac

SEQ ID NO: 392472 - RNA, 20 nt, Human
aaggggggccggggaagggg

SEQ ID NO: 392473 - RNA, 18 nt, Human
aaggugcuggggggugcc

SEQ ID NO: 392474 - RNA, 18 nt, Human
accugcugugcucccuuc

SEQ ID NO: 392475 - RNA, 21 nt, Human
agaacaguggcagggagugug

SEQ ID NO: 392476 - RNA, 19 nt, Human
agagcagggugaugguggg

SEQ ID NO: 392477 - RNA, 23 nt, Human
aggcagguaaauugaggugggga

SEQ ID NO: 392478 - RNA, 21 nt, Human
agggaacagugcccaccaagg

SEQ ID NO: 392479 - RNA, 19 nt, Human
aggugcuccccuaacccag

SEQ ID NO: 392480 - RNA, 20 nt, Human
cagggucgggaugaagaagg

SEQ ID NO: 392481 - RNA, 22 nt, Human
cagugcccaccaaggguuuguc

SEQ ID NO: 392482 - RNA, 25 nt, Human
caguggcagggagugugugugcugg

SEQ ID NO: 392483 - RNA, 21 nt, Human
caguggccacacaugcuggag

SEQ ID NO: 392484 - RNA, 18 nt, Human
caucaugcucccccaagg

SEQ ID NO: 392485 - RNA, 24 nt, Human
ccacugggcggcugagccuggucc

SEQ ID NO: 392486 - RNA, 24 nt, Human
cccaccucucccugugggucccuc

SEQ ID NO: 392487 - RNA, 18 nt, Human
ccccaccucucugagguc

SEQ ID NO: 392488 - RNA, 24 nt, Human
ccccccaggggugccaggcaggug

SEQ ID NO: 392489 - RNA, 23 nt, Human
ccccgaccggacacucccagggc

SEQ ID NO: 392490 - RNA, 19 nt, Human
cccuaacccagcgccccuc

SEQ ID NO: 392491 - RNA, 19 nt, Human
cccuccucuccucucuucu

SEQ ID NO: 392492 - RNA, 23 nt, Human
cccuggaugagaacuccagcucu

SEQ ID NO: 392493 - RNA, 21 nt, Human
ccuaacccagcgccccucgau

SEQ ID NO: 392494 - RNA, 21 nt, Human
ccucaacuuccuggagccugg

SEQ ID NO: 392495 - RNA, 20 nt, Human
ccucaauccuggaccccccc

SEQ ID NO: 392496 - RNA, 23 nt, Human
ccucaauccuggacccccccagg

SEQ ID NO: 392497 - RNA, 21 nt, Human
ccugcccaucaugcuccccca

SEQ ID NO: 392498 - RNA, 21 nt, Human
ccuggguccugggccugaggc

SEQ ID NO: 392499 - RNA, 19 nt, Human
cgcagaacaguggcaggga

SEQ ID NO: 392500 - RNA, 18 nt, Human
cuccuggguccugggccu

SEQ ID NO: 392501 - RNA, 24 nt, Human
cugcuacucucucccucugggccu

SEQ ID NO: 392502 - RNA, 24 nt, Human
cuggacccccccaggggugccagg

SEQ ID NO: 392503 - RNA, 25 nt, Human
cugggguagguggggaggccuccug

SEQ ID NO: 392504 - RNA, 20 nt, Human
cuuccuggagccugggcacu

SEQ ID NO: 392505 - RNA, 18 nt, Human
cuuggucuccauccugcc

SEQ ID NO: 392506 - RNA, 22 nt, Human
gaacuccagcucugcccaccuc

SEQ ID NO: 392507 - RNA, 19 nt, Human
gagccugguccgagcucgc

SEQ ID NO: 392508 - RNA, 18 nt, Human
gagugugugugcuggggu

SEQ ID NO: 392509 - RNA, 19 nt, Human
gcagggugaugguggguca

SEQ ID NO: 392510 - RNA, 18 nt, Human
gccacacaugcuggaggc

SEQ ID NO: 392511 - RNA, 20 nt, Human
gccaugcaaggagucugggc

SEQ ID NO: 392512 - RNA, 23 nt, Human
gcccuccucuccucucuucuccc

SEQ ID NO: 392513 - RNA, 19 nt, Human
gcggaaugagccgggcugg

SEQ ID NO: 392514 - RNA, 19 nt, Human
gcucugcccaccucucccu

SEQ ID NO: 392515 - RNA, 27 nt, Human
gcuggggggugccccaucuuccugggc

SEQ ID NO: 392516 - RNA, 20 nt, Human
gcugguugcucugggcucug

SEQ ID NO: 392517 - RNA, 22 nt, Human
ggaaggggggucguggggaggg

SEQ ID NO: 392518 - RNA, 21 nt, Human
ggacacucccagggccucugc

SEQ ID NO: 392519 - RNA, 23 nt, Human
ggacacucccagggccucugcuc

SEQ ID NO: 392520 - RNA, 21 nt, Human
ggagaugcucacccugcaucc

SEQ ID NO: 392521 - RNA, 20 nt, Human
ggccugggacacaaaggggc

SEQ ID NO: 392522 - RNA, 19 nt, Human
ggccuuugagggccccugc

SEQ ID NO: 392523 - RNA, 20 nt, Human
gggccuuugagggccccugc

SEQ ID NO: 392524 - RNA, 18 nt, Human
gggcucuggggacaagca

SEQ ID NO: 392525 - RNA, 21 nt, Human
gggcucuggggacaagcagcc

SEQ ID NO: 392526 - RNA, 20 nt, Human
ggguggguggggguacagug

SEQ ID NO: 392527 - RNA, 20 nt, Human
gguagguggggaggccuccu

SEQ ID NO: 392528 - RNA, 20 nt, Human
ggugggguuuggagguggcc

SEQ ID NO: 392529 - RNA, 20 nt, Human
gguggguggggguacagugg

SEQ ID NO: 392530 - RNA, 19 nt, Human
gguguccccuauccccacc

SEQ ID NO: 392531 - RNA, 18 nt, Human
gguuuggagguggccuga

SEQ ID NO: 392532 - RNA, 23 nt, Human
gugcugguugcucugggcucugg

SEQ ID NO: 392533 - RNA, 20 nt, Human
gugggguuuggagguggccu

SEQ ID NO: 392534 - RNA, 23 nt, Human
uacaguggccacacaugcuggag

SEQ ID NO: 392535 - RNA, 22 nt, Human
uacccugcggccagcccccgcc

SEQ ID NO: 392536 - RNA, 23 nt, Human
ucauaugaaacucauaaauaccc

SEQ ID NO: 392537 - RNA, 22 nt, Human
uccacuccacacugcagagucu

SEQ ID NO: 392538 - RNA, 22 nt, Human
ucccccaagggugggugggggu

SEQ ID NO: 392539 - RNA, 18 nt, Human
ucugaaacccagagaccu

SEQ ID NO: 392540 - RNA, 22 nt, Human
ucuggggacaagcagcccugga

SEQ ID NO: 392541 - RNA, 20 nt, Human
ugaaacaggugcuccccuaa

SEQ ID NO: 392542 - RNA, 21 nt, Human
ugaagaagggaaggggcacag

SEQ ID NO: 392543 - RNA, 22 nt, Human
ugaagaagggaaggggcacagu

SEQ ID NO: 392544 - RNA, 21 nt, Human
ugaagguguccccuaucccca

SEQ ID NO: 392545 - RNA, 20 nt, Human
ugagccugguccgagcucgc

SEQ ID NO: 392546 - RNA, 18 nt, Human
ugaggaccacacaagcca

SEQ ID NO: 392547 - RNA, 22 nt, Human
ugagggccccugcuccaacccc

SEQ ID NO: 392548 - RNA, 24 nt, Human
ugcaaggagucugggcaccaggcc

SEQ ID NO: 392549 - RNA, 18 nt, Human
ugccaggcagguguggag

SEQ ID NO: 392550 - RNA, 25 nt, Human
ugcuccaaccccaagcugcauuuau

SEQ ID NO: 392551 - RNA, 28 nt, Human
ugcuggggggugccccaucuuccugggc

SEQ ID NO: 392552 - RNA, 18 nt, Human
uggaggcugaaggugucc

SEQ ID NO: 392553 - RNA, 24 nt, Human
ugggcggcugagccugguccgagg

SEQ ID NO: 392554 - RNA, 23 nt, Human
ugggcucuggggacaagcagccc

SEQ ID NO: 392555 - RNA, 22 nt, Human
ugggucagcgccccggacaggc

SEQ ID NO: 392556 - RNA, 25 nt, Human
ugggucccucaacuucccccuaggg

SEQ ID NO: 392557 - RNA, 21 nt, Human
uggguccugggccugaggccu

SEQ ID NO: 392558 - RNA, 22 nt, Human
uggguggggguacaguggccac

SEQ ID NO: 392559 - RNA, 21 nt, Human
uguccccuauccccaccucuc

SEQ ID NO: 392560 - RNA, 22 nt, Human
uuuuuuuuuuugaacaggaacu

SEQ ID NO: 392561 - RNA, 24 nt, Human
uuuuuuuuuuugaacaggaacugg

SEQ ID NO: 392562 - RNA, 22 nt, Human
uuuuuuuuuuuuuugaacagga

SEQ ID NO: 392563 - RNA, 23 nt, Human
uuuuuuuuuuuuuuuugaacagg

SEQ ID NO: 392564 - RNA, 18 nt, Human
uuuuuuuuuuuuuuuuug

SEQ ID NO: 392565 - RNA, 23 nt, Human
aaaagaauaaacacagccuucag

SEQ ID NO: 392566 - RNA, 23 nt, Human
aaacacagccuucaguggaugga

SEQ ID NO: 392567 - RNA, 22 nt, Human
aaggcaaaaaggaaggcccuaa

SEQ ID NO: 392568 - RNA, 21 nt, Human
aagucaaagggaaaaagaagg

SEQ ID NO: 392569 - RNA, 22 nt, Human
aagugcucaauaaauuaaaagc

SEQ ID NO: 392570 - RNA, 21 nt, Human
aaugcccauccuuccuugugc

SEQ ID NO: 392571 - RNA, 19 nt, Human
acaaggcaaaaaggaaggc

SEQ ID NO: 392572 - RNA, 22 nt, Human
acccaaguccaaccaggccucc

SEQ ID NO: 392573 - RNA, 22 nt, Human
accccaccaacagcaagaauaa

SEQ ID NO: 392574 - RNA, 20 nt, Human
acuacaggauuaaaaguuuc

SEQ ID NO: 392575 - RNA, 18 nt, Human
acucugggagauucuguc

SEQ ID NO: 392576 - RNA, 23 nt, Human
agcagaccaucguggccugcaga

SEQ ID NO: 392577 - RNA, 20 nt, Human
aggaacccaaguccaaccag

SEQ ID NO: 392578 - RNA, 23 nt, Human
aggaacccaaguccaaccaggcc

SEQ ID NO: 392579 - RNA, 21 nt, Human
aggaaugaauagaaaugagug

SEQ ID NO: 392580 - RNA, 21 nt, Human
auccaggaacccaaguccaac

SEQ ID NO: 392581 - RNA, 20 nt, Human
caaggcaaaaaggaaggccc

SEQ ID NO: 392582 - RNA, 20 nt, Human
cacaaggcaaaaaggaaggc

SEQ ID NO: 392583 - RNA, 23 nt, Human
cacacagugccugguaaacaacu

SEQ ID NO: 392584 - RNA, 20 nt, Human
cacagucuugacagcagggu

SEQ ID NO: 392585 - RNA, 19 nt, Human
caccaacagcaagaauaac

SEQ ID NO: 392586 - RNA, 23 nt, Human
caccauccaggaacccaagucca

SEQ ID NO: 392587 - RNA, 19 nt, Human
caccaugcuggcugcuucu

SEQ ID NO: 392588 - RNA, 21 nt, Human
caccugauccuucugccccag

SEQ ID NO: 392589 - RNA, 19 nt, Human
cagcucaggcugcuuccgg

SEQ ID NO: 392590 - RNA, 21 nt, Human
ccaaauacccuggccuucaac

SEQ ID NO: 392591 - RNA, 24 nt, Human
ccaaauacccuggccuucaacugg

SEQ ID NO: 392592 - RNA, 22 nt, Human
ccaccaacagcaagaauaacgu

SEQ ID NO: 392593 - RNA, 19 nt, Human
ccaggaacccaaguccaac

SEQ ID NO: 392594 - RNA, 19 nt, Human
ccauuaugaggggcacagg

SEQ ID NO: 392595 - RNA, 22 nt, Human
cccaaauacccuggccuucaac

SEQ ID NO: 392596 - RNA, 20 nt, Human
cccaccaacagcaagaauaa

SEQ ID NO: 392597 - RNA, 24 nt, Human
cccauccuuccuugugcuugggaa

SEQ ID NO: 392598 - RNA, 18 nt, Human
cccaugugugcaccccug

SEQ ID NO: 392599 - RNA, 18 nt, Human
ccccagagcucagcacuu

SEQ ID NO: 392600 - RNA, 25 nt, Human
ccccugaauggccaaacccuggggc

SEQ ID NO: 392601 - RNA, 21 nt, Human
ccuauacuacaggauuaaaag

SEQ ID NO: 392602 - RNA, 18 nt, Human
cuaauacccuuccccuuc

SEQ ID NO: 392603 - RNA, 19 nt, Human
cuaguccuaagaaggugaa

SEQ ID NO: 392604 - RNA, 22 nt, Human
cuccgucuucugauuacuccuc

SEQ ID NO: 392605 - RNA, 18 nt, Human
cugaagaucccaguauuc

SEQ ID NO: 392606 - RNA, 19 nt, Human
cugauuacuccuccugcca

SEQ ID NO: 392607 - RNA, 24 nt, Human
cuggauccuccgccacagcucagg

SEQ ID NO: 392608 - RNA, 27 nt, Human
cuguacaacaaucccaccauccaggaa

SEQ ID NO: 392609 - RNA, 21 nt, Human
cuuccuggauccuccgccaca

SEQ ID NO: 392610 - RNA, 21 nt, Human
gaccuggggagacugcgaggu

SEQ ID NO: 392611 - RNA, 21 nt, Human
gauuucuguagaagucaaagg

SEQ ID NO: 392612 - RNA, 18 nt, Human
gcaauaaacggucucugg

SEQ ID NO: 392613 - RNA, 24 nt, Human
gcucaauaaauuaaaagccacaaa

SEQ ID NO: 392614 - RNA, 23 nt, Human
gcugcuggcggaccuggggagac

SEQ ID NO: 392615 - RNA, 25 nt, Human
ggaggcacggaacaccaugcuggcu

SEQ ID NO: 392616 - RNA, 23 nt, Human
guccgggaggcacggaacaccau

SEQ ID NO: 392617 - RNA, 19 nt, Human
gugugcaccccugaauggc

SEQ ID NO: 392618 - RNA, 24 nt, Human
uaaaaguuucaauuaaaagacaau

SEQ ID NO: 392619 - RNA, 23 nt, Human
uacauaggccaaaugcacguggu

SEQ ID NO: 392620 - RNA, 18 nt, Human
uaccccaccaacagcaag

SEQ ID NO: 392621 - RNA, 19 nt, Human
uaccugagugaggaggggg

SEQ ID NO: 392622 - RNA, 22 nt, Human
uacuaagagcagucuugaaaac

SEQ ID NO: 392623 - RNA, 24 nt, Human
uagaagucaaagggaaaaagaagg

SEQ ID NO: 392624 - RNA, 19 nt, Human
uauauacagcauacaaaua

SEQ ID NO: 392625 - RNA, 18 nt, Human
uauuuauuuauccaagau

SEQ ID NO: 392626 - RNA, 23 nt, Human
ucacaaggcaaaaaggaaggccc

SEQ ID NO: 392627 - RNA, 19 nt, Human
uccacuguauaaguaaaau

SEQ ID NO: 392628 - RNA, 20 nt, Human
uccccagacacauuuaccug

SEQ ID NO: 392629 - RNA, 19 nt, Human
uccuaagaaggugaacucc

SEQ ID NO: 392630 - RNA, 21 nt, Human
uccuaagaaggugaacuccua

SEQ ID NO: 392631 - RNA, 23 nt, Human
ucucuggaugacugauacaguuu

SEQ ID NO: 392632 - RNA, 19 nt, Human
ucugauuagcugcggccac

SEQ ID NO: 392633 - RNA, 21 nt, Human
ugaaaacugagauguuuucaa

SEQ ID NO: 392634 - RNA, 21 nt, Human
ugaaggcgcugcccagagcag

SEQ ID NO: 392635 - RNA, 20 nt, Human
ugacucuaauacccuucccc

SEQ ID NO: 392636 - RNA, 23 nt, Human
ugagauguuuucaaaacaaaaga

SEQ ID NO: 392637 - RNA, 23 nt, Human
ugagugauuuuaaucaccauuuc

SEQ ID NO: 392638 - RNA, 20 nt, Human
ugcccagagcagccagccug

SEQ ID NO: 392639 - RNA, 19 nt, Human
uggauccuccgccacagcu

SEQ ID NO: 392640 - RNA, 25 nt, Human
uuaccccaccaacagcaagaauaac

SEQ ID NO: 392641 - RNA, 19 nt, Human
uuaccugagugaggagggg

SEQ ID NO: 392642 - RNA, 19 nt, Human
uuauuuauguguuuccacu

SEQ ID NO: 392643 - RNA, 19 nt, Human
uuccuuggcgcucacaagg

SEQ ID NO: 392644 - RNA, 24 nt, Human
uuccuugugcuugggaaucuggga

SEQ ID NO: 392645 - RNA, 24 nt, Human
uucuggcugaaccggcugcuggcg

SEQ ID NO: 392646 - RNA, 20 nt, Human
uugaaaacugagauguuuuc

SEQ ID NO: 392647 - RNA, 24 nt, Human
uuggcgcucacaaggcaaaaagga

SEQ ID NO: 392648 - RNA, 20 nt, Human
uugugcuugggaaucuggga

SEQ ID NO: 392649 - RNA, 20 nt, Human
aggcaguaccccgcccgggc

SEQ ID NO: 392650 - RNA, 19 nt, Human
ggugcaggcaguaccccgc

SEQ ID NO: 392651 - RNA, 23 nt, Human
ugccccggacucggcucgcgcac

SEQ ID NO: 392652 - RNA, 27 nt, Human
aaaaaaacaaaaacagggcaaguuuag

SEQ ID NO: 392653 - RNA, 23 nt, Human
aaaacucacggcccagucccaca

SEQ ID NO: 392654 - RNA, 23 nt, Human
aaacaaaaacagggcaaguuuag

SEQ ID NO: 392655 - RNA, 24 nt, Human
aaacaacaaugaggaaggaagggc

SEQ ID NO: 392656 - RNA, 18 nt, Human
aaacagguaacagaccaa

SEQ ID NO: 392657 - RNA, 19 nt, Human
aaacagguaacagaccaaa

SEQ ID NO: 392658 - RNA, 20 nt, Human
aaaguacaaaagcuuuucug

SEQ ID NO: 392659 - RNA, 21 nt, Human
aacaaacuaaaaaaacaaaaa

SEQ ID NO: 392660 - RNA, 20 nt, Human
aacuaaaaaaacaaaaacag

SEQ ID NO: 392661 - RNA, 26 nt, Human
aacuuagaaacaaaugauuucguagg

SEQ ID NO: 392662 - RNA, 25 nt, Human
aacuucuuuccaauggaaaacucac

SEQ ID NO: 392663 - RNA, 22 nt, Human
aagcaaaaagcacagaagggac

SEQ ID NO: 392664 - RNA, 22 nt, Human
aagcaaaaagcacagaaggugg

SEQ ID NO: 392665 - RNA, 18 nt, Human
aagcacagaagguggagu

SEQ ID NO: 392666 - RNA, 24 nt, Human
acacuugaagccacaaaacugcag

SEQ ID NO: 392667 - RNA, 22 nt, Human
acuaaaaaaacaaaaacagggc

SEQ ID NO: 392668 - RNA, 20 nt, Human
acuccauuaucccaagcaag

SEQ ID NO: 392669 - RNA, 20 nt, Human
acugguugugaauagggaga

SEQ ID NO: 392670 - RNA, 22 nt, Human
agaccaaaaacuaaagugcauc

SEQ ID NO: 392671 - RNA, 22 nt, Human
agagcagcucagagccacaacc

SEQ ID NO: 392672 - RNA, 19 nt, Human
agaggaagaggcuacagau

SEQ ID NO: 392673 - RNA, 22 nt, Human
agcccacaggaaggagcuggag

SEQ ID NO: 392674 - RNA, 23 nt, Human
agccuggugggaaagcggacucc

SEQ ID NO: 392675 - RNA, 18 nt, Human
agcucagagggagcaaag

SEQ ID NO: 392676 - RNA, 21 nt, Human
agcugucuguggcagcccaca

SEQ ID NO: 392677 - RNA, 20 nt, Human
aggaaaugagggguggaagg

SEQ ID NO: 392678 - RNA, 24 nt, Human
aggaagugccuuuaguaaguucuc

SEQ ID NO: 392679 - RNA, 20 nt, Human
agguccacugggugaaugaa

SEQ ID NO: 392680 - RNA, 19 nt, Human
auaaacacaacuuagaaac

SEQ ID NO: 392681 - RNA, 23 nt, Human
caaaaaggaaaugagggguggaa

SEQ ID NO: 392682 - RNA, 22 nt, Human
caaagcauccaccagaagaggc

SEQ ID NO: 392683 - RNA, 22 nt, Human
caaaguacaaaagcuuuucuga

SEQ ID NO: 392684 - RNA, 23 nt, Human
caaaugauuucguaggauagcac

SEQ ID NO: 392685 - RNA, 18 nt, Human
caagccagaggcuggagg

SEQ ID NO: 392686 - RNA, 23 nt, Human
cacaggaaggagcuggagauccc

SEQ ID NO: 392687 - RNA, 20 nt, Human
cagaacacaccaccuguaau

SEQ ID NO: 392688 - RNA, 23 nt, Human
cagcccacaggaaggagcuggag

SEQ ID NO: 392689 - RNA, 19 nt, Human
cagcucagagggagcaaag

SEQ ID NO: 392690 - RNA, 23 nt, Human
cauuaucacagaacacaccaccu

SEQ ID NO: 392691 - RNA, 21 nt, Human
cauucuuggcacuguuucuaa

SEQ ID NO: 392692 - RNA, 23 nt, Human
ccccacugccccaaacaggucug

SEQ ID NO: 392693 - RNA, 23 nt, Human
ccccuucccuauccuugcuuggg

SEQ ID NO: 392694 - RNA, 19 nt, Human
cccgaaucucuggcuugac

SEQ ID NO: 392695 - RNA, 20 nt, Human
cccucugcuggucccacuuc

SEQ ID NO: 392696 - RNA, 22 nt, Human
ccugaaguuggcgcccucugcu

SEQ ID NO: 392697 - RNA, 21 nt, Human
ccuuaucuagguuugcucccc

SEQ ID NO: 392698 - RNA, 19 nt, Human
cgaaucucuggcuugacac

SEQ ID NO: 392699 - RNA, 22 nt, Human
cgccuaaaaggccacaaauuuc

SEQ ID NO: 392700 - RNA, 20 nt, Human
cgggguggcaugucacucca

SEQ ID NO: 392701 - RNA, 20 nt, Human
cggguggcucuaccaaacag

SEQ ID NO: 392702 - RNA, 20 nt, Human
cucagagccacaaccacucc

SEQ ID NO: 392703 - RNA, 21 nt, Human
cucccgccuaaaaggccacaa

SEQ ID NO: 392704 - RNA, 18 nt, Human
cugaacuucuuuccaaug

SEQ ID NO: 392705 - RNA, 22 nt, Human
cuggggguagcugucuguggca

SEQ ID NO: 392706 - RNA, 19 nt, Human
cuugaagccacaaaacugc

SEQ ID NO: 392707 - RNA, 22 nt, Human
cuuuguagggccugacaguuga

SEQ ID NO: 392708 - RNA, 22 nt, Human
gaacugugcgcauaccaaacaa

SEQ ID NO: 392709 - RNA, 20 nt, Human
gaaggaagggccggguggcu

SEQ ID NO: 392710 - RNA, 19 nt, Human
gaagucuucccacccaugg

SEQ ID NO: 392711 - RNA, 21 nt, Human
gaagugccuuuaguaaguucu

SEQ ID NO: 392712 - RNA, 19 nt, Human
gagccacaaccacucccaa

SEQ ID NO: 392713 - RNA, 20 nt, Human
gaugggguugacaaaaaagg

SEQ ID NO: 392714 - RNA, 19 nt, Human
gcaaagcauccaccagaag

SEQ ID NO: 392715 - RNA, 18 nt, Human
gcuaaaucagaggacagc

SEQ ID NO: 392716 - RNA, 21 nt, Human
ggaaaacucacggcccagucc

SEQ ID NO: 392717 - RNA, 19 nt, Human
ggaaaugagggguggaagg

SEQ ID NO: 392718 - RNA, 25 nt, Human
gggaaagggaacacauuacuuuugu

SEQ ID NO: 392719 - RNA, 21 nt, Human
gggauaacaaacuaaaaaaac

SEQ ID NO: 392720 - RNA, 20 nt, Human
gggauuggggcucucacugg

SEQ ID NO: 392721 - RNA, 18 nt, Human
ggguggaaggagaggaag

SEQ ID NO: 392722 - RNA, 19 nt, Human
gguccacugggugaaugaa

SEQ ID NO: 392723 - RNA, 18 nt, Human
gucccacuucucaucgug

SEQ ID NO: 392724 - RNA, 19 nt, Human
guggcagcccacaggaagg

SEQ ID NO: 392725 - RNA, 21 nt, Human
uaaaaaaacaaaaacagggca

SEQ ID NO: 392726 - RNA, 19 nt, Human
uaaaaggccacaaauuucu

SEQ ID NO: 392727 - RNA, 23 nt, Human
uaacagggguuuaacaggaagga

SEQ ID NO: 392728 - RNA, 27 nt, Human
uaauaucuugucauucuuggcacuguu

SEQ ID NO: 392729 - RNA, 23 nt, Human
uaggccuagcagagaaucaccaa

SEQ ID NO: 392730 - RNA, 19 nt, Human
ucaagagauguuaacucaa

SEQ ID NO: 392731 - RNA, 23 nt, Human
ucacacugaagcucuguagagca

SEQ ID NO: 392732 - RNA, 18 nt, Human
ucagugaaagugagccau

SEQ ID NO: 392733 - RNA, 23 nt, Human
uccaaacuauauucugcuaauca

SEQ ID NO: 392734 - RNA, 19 nt, Human
uccacugggugaaugaagc

SEQ ID NO: 392735 - RNA, 20 nt, Human
ucccugcugccccaaacagg

SEQ ID NO: 392736 - RNA, 21 nt, Human
uccgugcagcagucuccacuc

SEQ ID NO: 392737 - RNA, 23 nt, Human
ucuaccaaacaguucagguccac

SEQ ID NO: 392738 - RNA, 19 nt, Human
ucucuggcuugacacuacc

SEQ ID NO: 392739 - RNA, 21 nt, Human
ugaaggcaaagcagaaaggug

SEQ ID NO: 392740 - RNA, 20 nt, Human
ugacaaaaaagggagugagg

SEQ ID NO: 392741 - RNA, 19 nt, Human
ugaggaacugcuugguugu

SEQ ID NO: 392742 - RNA, 23 nt, Human
ugaggaaggaagggccggguggc

SEQ ID NO: 392743 - RNA, 24 nt, Human
ugaggaaggaagggccggguggcu

SEQ ID NO: 392744 - RNA, 20 nt, Human
ugagggguggaaggagagga

SEQ ID NO: 392745 - RNA, 19 nt, Human
ugagggucaggcaaggggu

SEQ ID NO: 392746 - RNA, 21 nt, Human
ugcaaaaaggaaaugaggggu

SEQ ID NO: 392747 - RNA, 19 nt, Human
ugcacugugaaccugaggc

SEQ ID NO: 392748 - RNA, 24 nt, Human
ugccccgaaucucuggcuugacac

SEQ ID NO: 392749 - RNA, 20 nt, Human
uggaaaacagguaacagacc

SEQ ID NO: 392750 - RNA, 24 nt, Human
uggaaggagaggaagucuaauugg

SEQ ID NO: 392751 - RNA, 21 nt, Human
ugggaaagcggacuccugaag

SEQ ID NO: 392752 - RNA, 21 nt, Human
ugggguugacaaaaaagggag

SEQ ID NO: 392753 - RNA, 18 nt, Human
ugggugaaugaagccugg

SEQ ID NO: 392754 - RNA, 23 nt, Human
ugguguccaguuggagacagacu

SEQ ID NO: 392755 - RNA, 22 nt, Human
ugugaaggcaaagcagaaaggu

SEQ ID NO: 392756 - RNA, 18 nt, Human
ugugcaaaaaggaaauga

SEQ ID NO: 392757 - RNA, 22 nt, Human
ugugcaaaaaggaaaugagggg

SEQ ID NO: 392758 - RNA, 18 nt, Human
ugugcugaagucuuccca

SEQ ID NO: 392759 - RNA, 24 nt, Human
uuaucccaagcaaaaagcacagaa

SEQ ID NO: 392760 - RNA, 24 nt, Human
uucauuaucacagaacacaccacc

SEQ ID NO: 392761 - RNA, 23 nt, Human
uugacccuucuggggguagcugu

SEQ ID NO: 392762 - RNA, 24 nt, Human
uuuauggagaguuaacagggguuu

SEQ ID NO: 392763 - RNA, 23 nt, Human
uuugcuccccacugccccaaaca

SEQ ID NO: 392764 - RNA, 23 nt, Human
uuugcucccugcugccccaaaca

SEQ ID NO: 392765 - RNA, 24 nt, Human
aacagaggguauacagauguucug

SEQ ID NO: 392766 - RNA, 21 nt, Human
aagcaaugagauuuaagucua

SEQ ID NO: 392767 - RNA, 23 nt, Human
aaggauccuuucaaaaacccagc

SEQ ID NO: 392768 - RNA, 19 nt, Human
aagucaauauuaccagaga

SEQ ID NO: 392769 - RNA, 21 nt, Human
aaugucacccaggcuuucugu

SEQ ID NO: 392770 - RNA, 22 nt, Human
agaaaagaaaagaaaaucccau

SEQ ID NO: 392771 - RNA, 18 nt, Human
agacagaguggucacaug

SEQ ID NO: 392772 - RNA, 21 nt, Human
agagaaaagaaaagaaaaucc

SEQ ID NO: 392773 - RNA, 19 nt, Human
agcaaugagauuuaagucu

SEQ ID NO: 392774 - RNA, 23 nt, Human
aggcaagaaggaacagcacagaa

SEQ ID NO: 392775 - RNA, 22 nt, Human
aggcaagaaggaacagcacagg

SEQ ID NO: 392776 - RNA, 23 nt, Human
agggauaaaaugagagagaagaa

SEQ ID NO: 392777 - RNA, 23 nt, Human
cauauguacacuuauauaucaca

SEQ ID NO: 392778 - RNA, 21 nt, Human
caugccagugaaagggaaaca

SEQ ID NO: 392779 - RNA, 25 nt, Human
gaggucccaaggauccuuucaaaaa

SEQ ID NO: 392780 - RNA, 20 nt, Human
gcaagaaggaacagcacaga

SEQ ID NO: 392781 - RNA, 24 nt, Human
uaaaugucacaugucucccaaaug

SEQ ID NO: 392782 - RNA, 21 nt, Human
uacaaguuagaggcaagaagg

SEQ ID NO: 392783 - RNA, 24 nt, Human
uaccagagaaaagaaaagaaaauc

SEQ ID NO: 392784 - RNA, 26 nt, Human
uagaauuccagcacauauguacacuu

SEQ ID NO: 392785 - RNA, 24 nt, Human
uauaaaugucacaugucucccaaa

SEQ ID NO: 392786 - RNA, 24 nt, Human
uauguacacuuauauaucacaucc

SEQ ID NO: 392787 - RNA, 23 nt, Human
uauuaccagagaaaagaaaagaa

SEQ ID NO: 392788 - RNA, 20 nt, Human
ucaagggucucccaugccag

SEQ ID NO: 392789 - RNA, 23 nt, Human
ucagugcaaagugugccuacagu

SEQ ID NO: 392790 - RNA, 19 nt, Human
ucuccauccaguuuccaca

SEQ ID NO: 392791 - RNA, 21 nt, Human
ucuuaaauauuaaccuaugac

SEQ ID NO: 392792 - RNA, 23 nt, Human
ugaaacgggacuggcaugcuaca

SEQ ID NO: 392793 - RNA, 18 nt, Human
ugaaagggaaacagaggg

SEQ ID NO: 392794 - RNA, 19 nt, Human
ugaaagggaaacagagggu

SEQ ID NO: 392795 - RNA, 24 nt, Human
ugaguaggcaagacauuuauucac

SEQ ID NO: 392796 - RNA, 18 nt, Human
ugccuacaguauacaagg

SEQ ID NO: 392797 - RNA, 23 nt, Human
uguacacuuauauaucacauccu

SEQ ID NO: 392798 - RNA, 24 nt, Human
uucacucaugauauaucagugcaa

SEQ ID NO: 392799 - RNA, 23 nt, Human
uuccacaaaugugcaugaggucc

SEQ ID NO: 392800 - RNA, 21 nt, Human
uuggcagaggcauguuuucuc

SEQ ID NO: 392801 - RNA, 21 nt, Human
uuuucagugucuuaaauauua

SEQ ID NO: 392802 - RNA, 19 nt, Human
uuuuuuuuuuugaguaggc

SEQ ID NO: 392803 - RNA, 23 nt, Human
agccccaggauugcccugcccaa

SEQ ID NO: 392804 - RNA, 20 nt, Human
agcgcuccccuggcuguggc

SEQ ID NO: 392805 - RNA, 22 nt, Human
agggacuucauucccuucaucu

SEQ ID NO: 392806 - RNA, 20 nt, Human
agguggaggugaggaagcca

SEQ ID NO: 392807 - RNA, 27 nt, Human
augacacuccugcccccaguguccugg

SEQ ID NO: 392808 - RNA, 19 nt, Human
auuccauuuacaggggugg

SEQ ID NO: 392809 - RNA, 22 nt, Human
caauggcuguaauccugugggu

SEQ ID NO: 392810 - RNA, 20 nt, Human
cagugagggacuucauuccc

SEQ ID NO: 392811 - RNA, 22 nt, Human
caucgguaccgggugccuggag

SEQ ID NO: 392812 - RNA, 23 nt, Human
ccaaaagaugacacuccugcccc

SEQ ID NO: 392813 - RNA, 22 nt, Human
cccaaaagaugacacuccugcc

SEQ ID NO: 392814 - RNA, 22 nt, Human
cuaucggugccuggcuuccucu

SEQ ID NO: 392815 - RNA, 24 nt, Human
gacacuccugcccccaguguccug

SEQ ID NO: 392816 - RNA, 19 nt, Human
gaggaagccaccggcuuuc

SEQ ID NO: 392817 - RNA, 19 nt, Human
gccucccagccuucccaag

SEQ ID NO: 392818 - RNA, 19 nt, Human
gccuggaguccaccugccc

SEQ ID NO: 392819 - RNA, 18 nt, Human
gcugcuggggcccuaggc

SEQ ID NO: 392820 - RNA, 19 nt, Human
gcuguggcugcuggggccc

SEQ ID NO: 392821 - RNA, 19 nt, Human
ggguacagagucuggcugg

SEQ ID NO: 392822 - RNA, 21 nt, Human
uacagggguggggcugggugc

SEQ ID NO: 392823 - RNA, 24 nt, Human
uacagggguggggcugggugcucu

SEQ ID NO: 392824 - RNA, 19 nt, Human
uacagguggaggugaggaa

SEQ ID NO: 392825 - RNA, 18 nt, Human
uccugcugcucugcuggg

SEQ ID NO: 392826 - RNA, 18 nt, Human
uggcuguaauccuguggg

SEQ ID NO: 392827 - RNA, 18 nt, Human
uggcuguggcugcugggg

SEQ ID NO: 392828 - RNA, 21 nt, Human
uggguacagagucuggcuggg

SEQ ID NO: 392829 - RNA, 21 nt, Human
ugguaaauuccauuuacaggg

SEQ ID NO: 392830 - RNA, 22 nt, Human
uuuccugccucagcccauuuca

SEQ ID NO: 392831 - RNA, 19 nt, Human
aagaccccagcacccgccc

SEQ ID NO: 392832 - RNA, 21 nt, Human
agaagaccccagcacccgccc

SEQ ID NO: 392833 - RNA, 25 nt, Human
agcaggaagccaucuguccagcugg

SEQ ID NO: 392834 - RNA, 19 nt, Human
ccagcgccccauacuccau

SEQ ID NO: 392835 - RNA, 21 nt, Human
cccuggcugggccuggggagc

SEQ ID NO: 392836 - RNA, 22 nt, Human
cuggcugggccuggggagcagg

SEQ ID NO: 392837 - RNA, 18 nt, Human
gaggacccuggcugggcc

SEQ ID NO: 392838 - RNA, 27 nt, Human
gcacccgcccccugaggucuuaagggc

SEQ ID NO: 392839 - RNA, 21 nt, Human
gcccccugaggucuuaagggc

SEQ ID NO: 392840 - RNA, 21 nt, Human
gcgcugggccaggaagcagag

SEQ ID NO: 392841 - RNA, 19 nt, Human
ggggagcaggaagccaucu

SEQ ID NO: 392842 - RNA, 19 nt, Human
gucuuaagggcuuuggugu

SEQ ID NO: 392843 - RNA, 22 nt, Human
uguccagcugggcagcccccau

SEQ ID NO: 392844 - RNA, 23 nt, Human
uuuuuuuuuuuuuuuuuuuaagg

SEQ ID NO: 392845 - RNA, 26 nt, Human
aaaaacauguuuucuuuggcacuuuc

SEQ ID NO: 392846 - RNA, 19 nt, Human
aaacagcagccagcauaug

SEQ ID NO: 392847 - RNA, 18 nt, Human
aaagcuuuuuuuuuucuu

SEQ ID NO: 392848 - RNA, 19 nt, Human
aaaugauugggaugguucu

SEQ ID NO: 392849 - RNA, 24 nt, Human
aacugcuucuccaaacaccaccug

SEQ ID NO: 392850 - RNA, 22 nt, Human
aagcagcaccuugugacuuaac

SEQ ID NO: 392851 - RNA, 21 nt, Human
acggaggcaaggaagugcucu

SEQ ID NO: 392852 - RNA, 21 nt, Human
agacaccuuggagggccccga

SEQ ID NO: 392853 - RNA, 20 nt, Human
agacugggagggaacccuag

SEQ ID NO: 392854 - RNA, 18 nt, Human
agagggcagggaggaaag

SEQ ID NO: 392855 - RNA, 21 nt, Human
agcagccagcauauguggaag

SEQ ID NO: 392856 - RNA, 23 nt, Human
agcugccuuucacguggccccac

SEQ ID NO: 392857 - RNA, 24 nt, Human
aggcauaggccccucaugaccugc

SEQ ID NO: 392858 - RNA, 23 nt, Human
aggccuuccccguuccugggagg

SEQ ID NO: 392859 - RNA, 18 nt, Human
aggcggggugggaguacu

SEQ ID NO: 392860 - RNA, 21 nt, Human
aggcggggugggaguacuugg

SEQ ID NO: 392861 - RNA, 21 nt, Human
agggaccccagccacugccuc

SEQ ID NO: 392862 - RNA, 24 nt, Human
agggaccuaggaucuaggcagggg

SEQ ID NO: 392863 - RNA, 24 nt, Human
aggguguguaaacagcagccagca

SEQ ID NO: 392864 - RNA, 18 nt, Human
aggguucccucgguuucc

SEQ ID NO: 392865 - RNA, 20 nt, Human
aggguucccucgguuuccau

SEQ ID NO: 392866 - RNA, 23 nt, Human
agugaugugaagacugggaggga

SEQ ID NO: 392867 - RNA, 24 nt, Human
caagacccaggguucccucgguuu

SEQ ID NO: 392868 - RNA, 26 nt, Human
caccucugaacccugcugucugguuu

SEQ ID NO: 392869 - RNA, 19 nt, Human
cagcagccagcauaugugg

SEQ ID NO: 392870 - RNA, 19 nt, Human
cagcuuucuggggcaccau

SEQ ID NO: 392871 - RNA, 20 nt, Human
cagcuuucuggggcaccauu

SEQ ID NO: 392872 - RNA, 23 nt, Human
caggacccauuccaaggagugug

SEQ ID NO: 392873 - RNA, 23 nt, Human
ccaccucugaacccugcugucug

SEQ ID NO: 392874 - RNA, 19 nt, Human
ccacugccucugggcuugg

SEQ ID NO: 392875 - RNA, 20 nt, Human
cccacaggcaccuggcaguc

SEQ ID NO: 392876 - RNA, 24 nt, Human
cccccaggacugguugaugucuag

SEQ ID NO: 392877 - RNA, 19 nt, Human
cccccggcgcccaucaacc

SEQ ID NO: 392878 - RNA, 22 nt, Human
cccccggcgcccaucaacccau

SEQ ID NO: 392879 - RNA, 23 nt, Human
cccccggcgcccaucaacccauc

SEQ ID NO: 392880 - RNA, 21 nt, Human
ccccuguguccucugucaccu

SEQ ID NO: 392881 - RNA, 18 nt, Human
ccgccugugggcuuccuc

SEQ ID NO: 392882 - RNA, 21 nt, Human
ccggcgcccaucaacccaucg

SEQ ID NO: 392883 - RNA, 22 nt, Human
ccucaguucacccacaggcacc

SEQ ID NO: 392884 - RNA, 21 nt, Human
ccucucccucuacuccccuca

SEQ ID NO: 392885 - RNA, 19 nt, Human
ccugcagggaccccagcca

SEQ ID NO: 392886 - RNA, 18 nt, Human
ccuuccccguuccuggga

SEQ ID NO: 392887 - RNA, 22 nt, Human
ccuuggagggccccgaggagcg

SEQ ID NO: 392888 - RNA, 19 nt, Human
cgggaagcugguuugacau

SEQ ID NO: 392889 - RNA, 22 nt, Human
cucaucucugcuuugcugguga

SEQ ID NO: 392890 - RNA, 21 nt, Human
cuccccucccccaggacuggu

SEQ ID NO: 392891 - RNA, 21 nt, Human
cuccucugccuccaaccugcu

SEQ ID NO: 392892 - RNA, 22 nt, Human
cucucuacuguggagcuggaga

SEQ ID NO: 392893 - RNA, 18 nt, Human
cugaacccugcugucugg

SEQ ID NO: 392894 - RNA, 22 nt, Human
cugguuugacauuuuguagguu

SEQ ID NO: 392895 - RNA, 21 nt, Human
cugucugguuuaaguaccacu

SEQ ID NO: 392896 - RNA, 20 nt, Human
gaaagaacacaguucccacg

SEQ ID NO: 392897 - RNA, 20 nt, Human
gaagaauaauacaaagcuuu

SEQ ID NO: 392898 - RNA, 18 nt, Human
gaggaaaagggaccuagg

SEQ ID NO: 392899 - RNA, 19 nt, Human
gagggcaccgacagucaga

SEQ ID NO: 392900 - RNA, 19 nt, Human
gcagggaggaaagaacaca

SEQ ID NO: 392901 - RNA, 20 nt, Human
gcccccagugaggccgcaug

SEQ ID NO: 392902 - RNA, 19 nt, Human
gcuuggcuugagcuccugg

SEQ ID NO: 392903 - RNA, 23 nt, Human
ggaggccuuccccguuccuggga

SEQ ID NO: 392904 - RNA, 23 nt, Human
ggagggcaccgacagucagacug

SEQ ID NO: 392905 - RNA, 20 nt, Human
ggaguacuuggggagggugc

SEQ ID NO: 392906 - RNA, 21 nt, Human
ggcagggaggaaagaacacag

SEQ ID NO: 392907 - RNA, 22 nt, Human
ggcgcccaucaacccaucgccc

SEQ ID NO: 392908 - RNA, 20 nt, Human
gggaugguucuuccucuggc

SEQ ID NO: 392909 - RNA, 22 nt, Human
gggcagggaggaaagaacacag

SEQ ID NO: 392910 - RNA, 22 nt, Human
gggccucagcuuugucccggug

SEQ ID NO: 392911 - RNA, 22 nt, Human
ggggaacgagccgcguggccag

SEQ ID NO: 392912 - RNA, 27 nt, Human
guuguucuucccaagacccaggguucc

SEQ ID NO: 392913 - RNA, 20 nt, Human
uagcucaaagggcuuugcaa

SEQ ID NO: 392914 - RNA, 23 nt, Human
uagcucaaagggcuuugcaaaau

SEQ ID NO: 392915 - RNA, 23 nt, Human
uagguuucucucuacuguggagc

SEQ ID NO: 392916 - RNA, 22 nt, Human
uaguggaucugaaaagcagcac

SEQ ID NO: 392917 - RNA, 22 nt, Human
uccccagcauauugcaaaaagc

SEQ ID NO: 392918 - RNA, 19 nt, Human
ucccucccuccccuuuccc

SEQ ID NO: 392919 - RNA, 18 nt, Human
ucgggaggaaaagggacc

SEQ ID NO: 392920 - RNA, 18 nt, Human
ucugucgcuaccccagag

SEQ ID NO: 392921 - RNA, 24 nt, Human
ugaaaagcagcaccuugugacuua

SEQ ID NO: 392922 - RNA, 25 nt, Human
ugaggccgcauggacaguaggcggg

SEQ ID NO: 392923 - RNA, 24 nt, Human
ugaugaggccagagugaugugaag

SEQ ID NO: 392924 - RNA, 19 nt, Human
ugaugugaagacugggagg

SEQ ID NO: 392925 - RNA, 20 nt, Human
ugcagggccucagcuuuguc

SEQ ID NO: 392926 - RNA, 26 nt, Human
ugcccgguucccacuccccuccccca

SEQ ID NO: 392927 - RNA, 24 nt, Human
ugccucugggcuuggcuugagcuc

SEQ ID NO: 392928 - RNA, 21 nt, Human
ugcuaaggcauuggcagggug

SEQ ID NO: 392929 - RNA, 18 nt, Human
ugcugguguuuaaaagga

SEQ ID NO: 392930 - RNA, 20 nt, Human
uggcaggguguguaaacagc

SEQ ID NO: 392931 - RNA, 18 nt, Human
ugggagucgggaagcugg

SEQ ID NO: 392932 - RNA, 20 nt, Human
uggggagggugcaccuggga

SEQ ID NO: 392933 - RNA, 20 nt, Human
ugguugguuuuagguugggg

SEQ ID NO: 392934 - RNA, 23 nt, Human
uguagguuucucucuacugugga

SEQ ID NO: 392935 - RNA, 24 nt, Human
ugugaagacugggagggaacccua

SEQ ID NO: 392936 - RNA, 20 nt, Human
ugugcccgguucccacuccc

SEQ ID NO: 392937 - RNA, 24 nt, Human
ugugcccgguucccacuccccucc

SEQ ID NO: 392938 - RNA, 20 nt, Human
uucacguggccccacccucc

SEQ ID NO: 392939 - RNA, 27 nt, Human
uucauucccucccuccccuuuccccag

SEQ ID NO: 392940 - RNA, 19 nt, Human
uucccccuccccugugucc

SEQ ID NO: 392941 - RNA, 20 nt, Human
uucccucgguuuccauuugg

SEQ ID NO: 392942 - RNA, 20 nt, Human
uuccuccagccaucggcucc

SEQ ID NO: 392943 - RNA, 23 nt, Human
uugcauaguggaucugaaaagca

SEQ ID NO: 392944 - RNA, 22 nt, Human
uugguccuguagugaaaugcug

SEQ ID NO: 392945 - RNA, 20 nt, Human
uuggugaugaggccagagug

SEQ ID NO: 392946 - RNA, 21 nt, Human
uuugucccggugugccaccuc

SEQ ID NO: 392947 - RNA, 27 nt, Human
uuuuuuuuuuuuuuuuuuuuuuugggg

SEQ ID NO: 392948 - RNA, 21 nt, Human
aaaaaccgagaugcuagaggc

SEQ ID NO: 392949 - RNA, 21 nt, Human
aaaaaucacaccuggccaaug

SEQ ID NO: 392950 - RNA, 22 nt, Human
aaauucccccaaaccuuugacc

SEQ ID NO: 392951 - RNA, 23 nt, Human
aacagauucaagcaggaaaacca

SEQ ID NO: 392952 - RNA, 18 nt, Human
aacggcugucuccagggc

SEQ ID NO: 392953 - RNA, 22 nt, Human
aagaaacuuccuauaccagcuc

SEQ ID NO: 392954 - RNA, 25 nt, Human
aaggagcagcacaaagagggcugau

SEQ ID NO: 392955 - RNA, 21 nt, Human
aagggccugacuugcacaaac

SEQ ID NO: 392956 - RNA, 20 nt, Human
acaggagcuugugacaccag

SEQ ID NO: 392957 - RNA, 20 nt, Human
acaggcucuccccagcccag

SEQ ID NO: 392958 - RNA, 22 nt, Human
acauucccaaaccccagcuccc

SEQ ID NO: 392959 - RNA, 21 nt, Human
accauggugggguggcauggg

SEQ ID NO: 392960 - RNA, 22 nt, Human
acccccauccucacagcccauu

SEQ ID NO: 392961 - RNA, 19 nt, Human
acguucuuuuacugaguag

SEQ ID NO: 392962 - RNA, 20 nt, Human
acuuucaggaaaggccaauu

SEQ ID NO: 392963 - RNA, 21 nt, Human
agaaaagaagucauccacaau

SEQ ID NO: 392964 - RNA, 18 nt, Human
agaagggccugacuugca

SEQ ID NO: 392965 - RNA, 19 nt, Human
agacaaaaugccuggaaac

SEQ ID NO: 392966 - RNA, 20 nt, Human
agagcuggaagauccucuuu

SEQ ID NO: 392967 - RNA, 19 nt, Human
agcaggaaccccaaggugg

SEQ ID NO: 392968 - RNA, 22 nt, Human
aggaggcacagagcacucacca

SEQ ID NO: 392969 - RNA, 20 nt, Human
aggaucugcugaaaaugcca

SEQ ID NO: 392970 - RNA, 21 nt, Human
aggcauggcuucaugagggcc

SEQ ID NO: 392971 - RNA, 19 nt, Human
aggcugcagcauuugacac

SEQ ID NO: 392972 - RNA, 21 nt, Human
aucguggaaacuugcuuccuu

SEQ ID NO: 392973 - RNA, 20 nt, Human
caaagcacauucccaaaccc

SEQ ID NO: 392974 - RNA, 25 nt, Human
caaauucccccaaaccuuugaccac

SEQ ID NO: 392975 - RNA, 24 nt, Human
cacaaagcacauucccaaacccca

SEQ ID NO: 392976 - RNA, 24 nt, Human
cacagcccaucgcaaaggccccuc

SEQ ID NO: 392977 - RNA, 22 nt, Human
cacaugguccccagcaggaacc

SEQ ID NO: 392978 - RNA, 21 nt, Human
cacauucccaaaccccagcuc

SEQ ID NO: 392979 - RNA, 20 nt, Human
cacccccauccucacagccc

SEQ ID NO: 392980 - RNA, 25 nt, Human
caccuaggcugugagaggauggggc

SEQ ID NO: 392981 - RNA, 18 nt, Human
caccuuugggcggcaccg

SEQ ID NO: 392982 - RNA, 28 nt, Human
cacguuuaccuuguguaaaaaucacacc

SEQ ID NO: 392983 - RNA, 22 nt, Human
cagagcaccuaggcugugagag

SEQ ID NO: 392984 - RNA, 20 nt, Human
caguucgugaacucuccgca

SEQ ID NO: 392985 - RNA, 19 nt, Human
cauccucacagcccaucgc

SEQ ID NO: 392986 - RNA, 25 nt, Human
caugcccagcuucuucuacccaaaa

SEQ ID NO: 392987 - RNA, 18 nt, Human
cauggcagucacucggca

SEQ ID NO: 392988 - RNA, 21 nt, Human
ccaaggcaaacauuuggcaca

SEQ ID NO: 392989 - RNA, 19 nt, Human
ccagggucacaaauucccc

SEQ ID NO: 392990 - RNA, 18 nt, Human
ccauggggacccuagggg

SEQ ID NO: 392991 - RNA, 20 nt, Human
ccauggggacccuagggggu

SEQ ID NO: 392992 - RNA, 21 nt, Human
cccaaaccccagcucccugac

SEQ ID NO: 392993 - RNA, 20 nt, Human
cccacaguccacugcacacu

SEQ ID NO: 392994 - RNA, 22 nt, Human
cccacugugauuuggcugcuuc

SEQ ID NO: 392995 - RNA, 19 nt, Human
cccagcccagcucgcccag

SEQ ID NO: 392996 - RNA, 28 nt, Human
cccaugcccagcuucuucuacccaaaaa

SEQ ID NO: 392997 - RNA, 25 nt, Human
ccccagcccagcucgcccagcucgc

SEQ ID NO: 392998 - RNA, 22 nt, Human
cccccaaaccuuugaccacgaa

SEQ ID NO: 392999 - RNA, 23 nt, Human
cccccaaaccuuugaccacgaac

SEQ ID NO: 393000 - RNA, 20 nt, Human
ccuggaaacguuccuuuucc

SEQ ID NO: 393001 - RNA, 20 nt, Human
cgaccaaggcaaacauuugg

SEQ ID NO: 393002 - RNA, 19 nt, Human
cgcacacacacacaacacc

SEQ ID NO: 393003 - RNA, 19 nt, Human
cggcucgaugacgaugcag

SEQ ID NO: 393004 - RNA, 27 nt, Human
cguggccaauucuucccaccacccccc

SEQ ID NO: 393005 - RNA, 24 nt, Human
cucacacaugccacaaccacacau

SEQ ID NO: 393006 - RNA, 23 nt, Human
cucacccaacggcugucuccagg

SEQ ID NO: 393007 - RNA, 19 nt, Human
cucuccgcauuuacucccc

SEQ ID NO: 393008 - RNA, 23 nt, Human
cucugugauucccuggcaggcug

SEQ ID NO: 393009 - RNA, 24 nt, Human
cugacagucaugccaccgcaaguu

SEQ ID NO: 393010 - RNA, 19 nt, Human
cugcagagcaccuaggcug

SEQ ID NO: 393011 - RNA, 22 nt, Human
cuucugcucacacaugccacaa

SEQ ID NO: 393012 - RNA, 24 nt, Human
cuuuggguuaaacauggguagaga

SEQ ID NO: 393013 - RNA, 18 nt, Human
gaaaagaagucauccaca

SEQ ID NO: 393014 - RNA, 19 nt, Human
gacccuaggggguggggug

SEQ ID NO: 393015 - RNA, 18 nt, Human
gagggccaucgcgggcac

SEQ ID NO: 393016 - RNA, 21 nt, Human
gaugcugagcuuaaauccagg

SEQ ID NO: 393017 - RNA, 25 nt, Human
gaugcugagcuuaaauccaggaguu

SEQ ID NO: 393018 - RNA, 19 nt, Human
gcauggggucucuaacgug

SEQ ID NO: 393019 - RNA, 25 nt, Human
gcccagcucgcccagcucgcccagc

SEQ ID NO: 393020 - RNA, 20 nt, Human
gcuauaacaugcguugggca

SEQ ID NO: 393021 - RNA, 21 nt, Human
gcugcagcauuugacacuggu

SEQ ID NO: 393022 - RNA, 19 nt, Human
gcuuccugaaugccgucga

SEQ ID NO: 393023 - RNA, 20 nt, Human
gcuuccuuugguuccucaga

SEQ ID NO: 393024 - RNA, 21 nt, Human
ggagcaaauuccccgaugccc

SEQ ID NO: 393025 - RNA, 19 nt, Human
gggaccaccucguguucug

SEQ ID NO: 393026 - RNA, 22 nt, Human
ggugagggaaacccccggccuc

SEQ ID NO: 393027 - RNA, 19 nt, Human
ggugcagcuggacagaagc

SEQ ID NO: 393028 - RNA, 18 nt, Human
gucacaaauucccccaaa

SEQ ID NO: 393029 - RNA, 19 nt, Human
guggggugcacccaugccc

SEQ ID NO: 393030 - RNA, 18 nt, Human
uaaaaaucacaccuggcc

SEQ ID NO: 393031 - RNA, 19 nt, Human
uaaaugagcucucucaucc

SEQ ID NO: 393032 - RNA, 25 nt, Human
uaagaaugggggauuugacuuuuga

SEQ ID NO: 393033 - RNA, 22 nt, Human
uaaggagcagagaaaaugacua

SEQ ID NO: 393034 - RNA, 24 nt, Human
uaaguaaaauauaaauuacauaga

SEQ ID NO: 393035 - RNA, 24 nt, Human
uaaguaaaauauaaauuacauaga

SEQ ID NO: 393036 - RNA, 18 nt, Human
uacaguaucagaaaagua

SEQ ID NO: 393037 - RNA, 22 nt, Human
uacccaaaaagcauguggcuac

SEQ ID NO: 393038 - RNA, 22 nt, Human
uacugagacccuaguuugcucu

SEQ ID NO: 393039 - RNA, 20 nt, Human
uagaggccucugcuaaagac

SEQ ID NO: 393040 - RNA, 20 nt, Human
uaugggagacccacagucca

SEQ ID NO: 393041 - RNA, 21 nt, Human
ucagaaaagaagucauccaca

SEQ ID NO: 393042 - RNA, 23 nt, Human
ucaggaugaggaccucuugggga

SEQ ID NO: 393043 - RNA, 18 nt, Human
ucaugggccuggaauguc

SEQ ID NO: 393044 - RNA, 24 nt, Human
uccacaacgaccaaggcaaacauu

SEQ ID NO: 393045 - RNA, 23 nt, Human
uccacaaucggggaaaaacauuc

SEQ ID NO: 393046 - RNA, 27 nt, Human
uccacaaucggggaaaaaccggggucc

SEQ ID NO: 393047 - RNA, 24 nt, Human
ucccaaaccccagcucccugacag

SEQ ID NO: 393048 - RNA, 23 nt, Human
ucccaccacccccauccucacag

SEQ ID NO: 393049 - RNA, 24 nt, Human
uccccagcccagcucgcccagcuc

SEQ ID NO: 393050 - RNA, 24 nt, Human
ucccccaaaccuuugaccacgaac

SEQ ID NO: 393051 - RNA, 20 nt, Human
uccucuuuccccucaugggc

SEQ ID NO: 393052 - RNA, 20 nt, Human
ucgaugacgaugcagauccu

SEQ ID NO: 393053 - RNA, 24 nt, Human
ucgcaaucaggacagucagcaugc

SEQ ID NO: 393054 - RNA, 18 nt, Human
ucgcccagcucaccacag

SEQ ID NO: 393055 - RNA, 18 nt, Human
ucgcccagcucgcccagc

SEQ ID NO: 393056 - RNA, 18 nt, Human
ucgcccagcucgcccagc

SEQ ID NO: 393057 - RNA, 22 nt, Human
ucucgguccucacaggcucucc

SEQ ID NO: 393058 - RNA, 23 nt, Human
ucuucucuuuuuccucauccucc

SEQ ID NO: 393059 - RNA, 22 nt, Human
ugaaaaaccgagaugcuagagg

SEQ ID NO: 393060 - RNA, 18 nt, Human
ugacaggagcuugugaca

SEQ ID NO: 393061 - RNA, 21 nt, Human
ugacaggagcuugugacacca

SEQ ID NO: 393062 - RNA, 18 nt, Human
ugagcucucucauccuuc

SEQ ID NO: 393063 - RNA, 18 nt, Human
ugaggcacuugguuuggu

SEQ ID NO: 393064 - RNA, 20 nt, Human
ugagggaaacccccggccuc

SEQ ID NO: 393065 - RNA, 24 nt, Human
ugauguuguuuguucuuguuuuug

SEQ ID NO: 393066 - RNA, 22 nt, Human
ugcacaaaccuucgucaaacau

SEQ ID NO: 393067 - RNA, 19 nt, Human
ugcacacacgcacacacac

SEQ ID NO: 393068 - RNA, 20 nt, Human
ugcagagcuggaagauccuc

SEQ ID NO: 393069 - RNA, 22 nt, Human
ugccagggacauggggaccacc

SEQ ID NO: 393070 - RNA, 25 nt, Human
ugccagggacauggggaccaccucg

SEQ ID NO: 393071 - RNA, 22 nt, Human
ugcuguguuccagaagggccug

SEQ ID NO: 393072 - RNA, 19 nt, Human
ugcuuccaacucugccugu

SEQ ID NO: 393073 - RNA, 21 nt, Human
uggaaacuugcuuccuuuggu

SEQ ID NO: 393074 - RNA, 22 nt, Human
uggcaaacaguggcacucaaaa

SEQ ID NO: 393075 - RNA, 21 nt, Human
uggcauggggucucuaacgug

SEQ ID NO: 393076 - RNA, 23 nt, Human
uggcuacagagaugugucagaua

SEQ ID NO: 393077 - RNA, 20 nt, Human
uggcugcuuccaacucugcc

SEQ ID NO: 393078 - RNA, 18 nt, Human
ugggcggcaccgcauaug

SEQ ID NO: 393079 - RNA, 22 nt, Human
uggggacccuaggggguggggu

SEQ ID NO: 393080 - RNA, 23 nt, Human
ugggggaugcugagcuuaaaucc

SEQ ID NO: 393081 - RNA, 18 nt, Human
uggggugcacccaugccc

SEQ ID NO: 393082 - RNA, 25 nt, Human
ugguacaguauagcaauggcaaauu

SEQ ID NO: 393083 - RNA, 19 nt, Human
ugugggggaugcugagcuu

SEQ ID NO: 393084 - RNA, 20 nt, Human
uuagaugauggcaaacagug

SEQ ID NO: 393085 - RNA, 18 nt, Human
uuccccgaugcccuugac

SEQ ID NO: 393086 - RNA, 19 nt, Human
uuccugcaguggaugaaaa

SEQ ID NO: 393087 - RNA, 18 nt, Human
uuccuucuucucauuucu

SEQ ID NO: 393088 - RNA, 22 nt, Human
uucucaguuucguuagcaucuc

SEQ ID NO: 393089 - RNA, 20 nt, Human
uucuccucucgguccucaca

SEQ ID NO: 393090 - RNA, 21 nt, Human
uugucaguaccgggguuucuu

SEQ ID NO: 393091 - RNA, 22 nt, Human
aaaacacuuggacaaagucucc

SEQ ID NO: 393092 - RNA, 23 nt, Human
aaaauaccugugugugcauaucu

SEQ ID NO: 393093 - RNA, 18 nt, Human
aaacacacacacaaacau

SEQ ID NO: 393094 - RNA, 22 nt, Human
aaacacacacacaaacauacac

SEQ ID NO: 393095 - RNA, 18 nt, Human
aaacaggaugagauuagg

SEQ ID NO: 393096 - RNA, 19 nt, Human
aaagugcugggaguacagg

SEQ ID NO: 393097 - RNA, 24 nt, Human
aaagugcugggauuacaggcguga

SEQ ID NO: 393098 - RNA, 19 nt, Human
aaaguuccagaugccucgg

SEQ ID NO: 393099 - RNA, 18 nt, Human
aaccaccaucucaucuca

SEQ ID NO: 393100 - RNA, 23 nt, Human
aaccccugggcucaagcaacccu

SEQ ID NO: 393101 - RNA, 21 nt, Human
aagcugaagccugagcacagc

SEQ ID NO: 393102 - RNA, 21 nt, Human
aaggaagagcugaggguggag

SEQ ID NO: 393103 - RNA, 19 nt, Human
aagugcugggauuacaggc

SEQ ID NO: 393104 - RNA, 19 nt, Human
aagugcugggauuacaggc

SEQ ID NO: 393105 - RNA, 21 nt, Human
aaguugccaccaacuccccag

SEQ ID NO: 393106 - RNA, 20 nt, Human
aauagaaccaagcaucucau

SEQ ID NO: 393107 - RNA, 23 nt, Human
aauccuuugcacuuucuuuugca

SEQ ID NO: 393108 - RNA, 23 nt, Human
aaugcagugggaugaucauagcu

SEQ ID NO: 393109 - RNA, 24 nt, Human
aauuauguuggccaggcuggucuc

SEQ ID NO: 393110 - RNA, 19 nt, Human
acaaacacacacacaaaca

SEQ ID NO: 393111 - RNA, 23 nt, Human
acaaccgcagacaucuggacacc

SEQ ID NO: 393112 - RNA, 18 nt, Human
acacagugagacccuguc

SEQ ID NO: 393113 - RNA, 19 nt, Human
acacagugagacccugucu

SEQ ID NO: 393114 - RNA, 20 nt, Human
acacagugagacccugucuc

SEQ ID NO: 393115 - RNA, 24 nt, Human
acacagugagacccugucucaaaa

SEQ ID NO: 393116 - RNA, 21 nt, Human
acagcaccacucaucucacuc

SEQ ID NO: 393117 - RNA, 21 nt, Human
acagcccaccagcagagcauu

SEQ ID NO: 393118 - RNA, 19 nt, Human
acaggcacugacaucagaa

SEQ ID NO: 393119 - RNA, 19 nt, Human
acagggcagugaguaaacc

SEQ ID NO: 393120 - RNA, 19 nt, Human
accaacuccccagcucugu

SEQ ID NO: 393121 - RNA, 23 nt, Human
accagcaaggguccaggggaggu

SEQ ID NO: 393122 - RNA, 24 nt, Human
acccaggcuggaguacaguggcau

SEQ ID NO: 393123 - RNA, 19 nt, Human
acccaggcuggagugcagu

SEQ ID NO: 393124 - RNA, 21 nt, Human
acgccuccccaccccacaggc

SEQ ID NO: 393125 - RNA, 18 nt, Human
acucugucacccaggcug

SEQ ID NO: 393126 - RNA, 25 nt, Human
acugcuacagagcagaccauugacc

SEQ ID NO: 393127 - RNA, 25 nt, Human
agaaaaaggacagugcagcaaagag

SEQ ID NO: 393128 - RNA, 22 nt, Human
agaacagggcagugaguaaacc

SEQ ID NO: 393129 - RNA, 24 nt, Human
agacaguagauaaaaaugcauggg

SEQ ID NO: 393130 - RNA, 24 nt, Human
agagaacccuugcaucaaaacagg

SEQ ID NO: 393131 - RNA, 20 nt, Human
agcaacaaaauaccugugug

SEQ ID NO: 393132 - RNA, 25 nt, Human
agcauuucuuuuuccguucuuuuuu

SEQ ID NO: 393133 - RNA, 21 nt, Human
agccugagcacagcuacaacc

SEQ ID NO: 393134 - RNA, 21 nt, Human
agccuguaacugaguccaaau

SEQ ID NO: 393135 - RNA, 22 nt, Human
agcucacugcaaccucugccuc

SEQ ID NO: 393136 - RNA, 22 nt, Human
agcucuggagccauaaaccacc

SEQ ID NO: 393137 - RNA, 22 nt, Human
agcuugugagucuagggaaccu

SEQ ID NO: 393138 - RNA, 21 nt, Human
aggaaagggacuuuauuucgg

SEQ ID NO: 393139 - RNA, 19 nt, Human
aggagguagguacuucaca

SEQ ID NO: 393140 - RNA, 19 nt, Human
aggcaaggaagagcugagg

SEQ ID NO: 393141 - RNA, 25 nt, Human
aggcuggagugcaguggcacuaucu

SEQ ID NO: 393142 - RNA, 20 nt, Human
aggcugggcugcagguuggg

SEQ ID NO: 393143 - RNA, 19 nt, Human
agggaagcacagcccacca

SEQ ID NO: 393144 - RNA, 24 nt, Human
aggugauccgccugccucagccuc

SEQ ID NO: 393145 - RNA, 20 nt, Human
aguagaaagggcaagguaag

SEQ ID NO: 393146 - RNA, 23 nt, Human
agugcaguggcacuaucugagcu

SEQ ID NO: 393147 - RNA, 19 nt, Human
aguuccugcuguggccuga

SEQ ID NO: 393148 - RNA, 18 nt, Human
aguuggaaacguggggcc

SEQ ID NO: 393149 - RNA, 20 nt, Human
aucucaggcagccguagacc

SEQ ID NO: 393150 - RNA, 21 nt, Human
augagcagauagcuggaggcu

SEQ ID NO: 393151 - RNA, 21 nt, Human
auggagacaugggucuugugg

SEQ ID NO: 393152 - RNA, 20 nt, Human
auguuggccaggcuggucuc

SEQ ID NO: 393153 - RNA, 18 nt, Human
auuauguuggccaggcug

SEQ ID NO: 393154 - RNA, 24 nt, Human
auuccuauaaaucuuuaacaaaaa

SEQ ID NO: 393155 - RNA, 22 nt, Human
caaacauacacagauacacugu

SEQ ID NO: 393156 - RNA, 18 nt, Human
caaagccuaaaaaugcag

SEQ ID NO: 393157 - RNA, 22 nt, Human
caagacacagaagagaacccuu

SEQ ID NO: 393158 - RNA, 23 nt, Human
caagcgucaccacacccagcuaa

SEQ ID NO: 393159 - RNA, 21 nt, Human
caagcuggucucaaaccccug

SEQ ID NO: 393160 - RNA, 19 nt, Human
caaggagcccucuagccac

SEQ ID NO: 393161 - RNA, 22 nt, Human
caagugauucucgugucucagc

SEQ ID NO: 393162 - RNA, 24 nt, Human
cacacaaacauacacagauacacu

SEQ ID NO: 393163 - RNA, 25 nt, Human
cacacacaaacauacacagauacac

SEQ ID NO: 393164 - RNA, 20 nt, Human
cacccagggaaggcugggcu

SEQ ID NO: 393165 - RNA, 24 nt, Human
caccucagccucccaaagugcugg

SEQ ID NO: 393166 - RNA, 22 nt, Human
cacucugucacccaggcuggag

SEQ ID NO: 393167 - RNA, 23 nt, Human
cacucugucacccaggcuggagu

SEQ ID NO: 393168 - RNA, 18 nt, Human
cacugcaaccucugccuc

SEQ ID NO: 393169 - RNA, 21 nt, Human
cacugcaaccucugccuccca

SEQ ID NO: 393170 - RNA, 20 nt, Human
cacugcagccucaaccuccc

SEQ ID NO: 393171 - RNA, 21 nt, Human
cacugcagccucaaccucccg

SEQ ID NO: 393172 - RNA, 19 nt, Human
cagaaccaagguaugugug

SEQ ID NO: 393173 - RNA, 19 nt, Human
cagaauccaccugcaguuc

SEQ ID NO: 393174 - RNA, 18 nt, Human
cagccccugaucagugcu

SEQ ID NO: 393175 - RNA, 24 nt, Human
cagccucaaccucccgggcucaag

SEQ ID NO: 393176 - RNA, 26 nt, Human
cagcucugugagaaguuuuagggggg

SEQ ID NO: 393177 - RNA, 19 nt, Human
cagcugccugugucccaac

SEQ ID NO: 393178 - RNA, 20 nt, Human
cagcuuccugaguagcuggg

SEQ ID NO: 393179 - RNA, 22 nt, Human
caggugauccgccugccucagc

SEQ ID NO: 393180 - RNA, 18 nt, Human
caggugccucuccaaccu

SEQ ID NO: 393181 - RNA, 22 nt, Human
cagugggcuguaacagagcucu

SEQ ID NO: 393182 - RNA, 22 nt, Human
caucaggcuuggccaaauaagc

SEQ ID NO: 393183 - RNA, 19 nt, Human
ccaaagugcugggaguaca

SEQ ID NO: 393184 - RNA, 22 nt, Human
ccaaagugcugggauuacaggc

SEQ ID NO: 393185 - RNA, 22 nt, Human
ccaaagugcugggauuacaggc

SEQ ID NO: 393186 - RNA, 24 nt, Human
ccaaagugcugggauuacaggcgu

SEQ ID NO: 393187 - RNA, 23 nt, Human
ccaacucuauagccaugagguuc

SEQ ID NO: 393188 - RNA, 24 nt, Human
ccaaucucuuuagcaacaaaauac

SEQ ID NO: 393189 - RNA, 18 nt, Human
ccacugcaccuggccaag

SEQ ID NO: 393190 - RNA, 19 nt, Human
ccacugcaccuggccaagg

SEQ ID NO: 393191 - RNA, 20 nt, Human
ccacugcaccuggccaagga

SEQ ID NO: 393192 - RNA, 21 nt, Human
ccacugcaccuggccaaggac

SEQ ID NO: 393193 - RNA, 24 nt, Human
ccacugcagccucaaccucccggg

SEQ ID NO: 393194 - RNA, 31 nt, Human
ccagaguuaguuuugcaaacggcaugauucc

SEQ ID NO: 393195 - RNA, 24 nt, Human
cccaaguaccugggacuacaggcg

SEQ ID NO: 393196 - RNA, 20 nt, Human
cccagguucaagugauucuc

SEQ ID NO: 393197 - RNA, 20 nt, Human
cccagguucaagugauucuc

SEQ ID NO: 393198 - RNA, 21 nt, Human
cccaugauaacaugccccaag

SEQ ID NO: 393199 - RNA, 21 nt, Human
ccccaccccacaggcacaugc

SEQ ID NO: 393200 - RNA, 21 nt, Human
ccccagaguaaaaaauggcag

SEQ ID NO: 393201 - RNA, 18 nt, Human
ccccccacugcagccuca

SEQ ID NO: 393202 - RNA, 21 nt, Human
cccccggccugcuugcugccc

SEQ ID NO: 393203 - RNA, 19 nt, Human
ccccugggcucaagcaacc

SEQ ID NO: 393204 - RNA, 25 nt, Human
ccccugggcucaagcaacccuccca

SEQ ID NO: 393205 - RNA, 19 nt, Human
ccccuuaaacaaaaaugga

SEQ ID NO: 393206 - RNA, 21 nt, Human
cccgggcucaagugauccucc

SEQ ID NO: 393207 - RNA, 22 nt, Human
cccgggcucaagugauccuccu

SEQ ID NO: 393208 - RNA, 23 nt, Human
cccgggcucaagugauccuccug

SEQ ID NO: 393209 - RNA, 21 nt, Human
cccuggcucaggcugcggccg

SEQ ID NO: 393210 - RNA, 21 nt, Human
cccugggcucaagcaacccuc

SEQ ID NO: 393211 - RNA, 21 nt, Human
ccuaguagcugggacuacagg

SEQ ID NO: 393212 - RNA, 22 nt, Human
ccucccagguucaagugauucu

SEQ ID NO: 393213 - RNA, 23 nt, Human
ccucccaugauaacaugccccaa

SEQ ID NO: 393214 - RNA, 20 nt, Human
ccugagcucaagcaauccuc

SEQ ID NO: 393215 - RNA, 22 nt, Human
ccugaguagcugggauacaggc

SEQ ID NO: 393216 - RNA, 19 nt, Human
ccugauuccauggacagca

SEQ ID NO: 393217 - RNA, 24 nt, Human
ccugccucagccucccaaagugcu

SEQ ID NO: 393218 - RNA, 22 nt, Human
ccugcuguggccugauuccaug

SEQ ID NO: 393219 - RNA, 24 nt, Human
ccugcuugcugccccgguccugac

SEQ ID NO: 393220 - RNA, 22 nt, Human
ccugggcgacacagugagaccc

SEQ ID NO: 393221 - RNA, 23 nt, Human
ccuugaacuccugagcucaagca

SEQ ID NO: 393222 - RNA, 18 nt, Human
cgaagcgaacagcagcuc

SEQ ID NO: 393223 - RNA, 19 nt, Human
cgagggagggggcccuggc

SEQ ID NO: 393224 - RNA, 24 nt, Human
cgcucugucacccaggcuggagug

SEQ ID NO: 393225 - RNA, 22 nt, Human
cggagacagggucucacucugu

SEQ ID NO: 393226 - RNA, 23 nt, Human
cuaaaggacacagugggcuguaa

SEQ ID NO: 393227 - RNA, 23 nt, Human
cuaauuuuuuguauuuuuaguag

SEQ ID NO: 393228 - RNA, 24 nt, Human
cucaagcaacccucccaccucagc

SEQ ID NO: 393229 - RNA, 25 nt, Human
cucaagcaauccuccugccucaggc

SEQ ID NO: 393230 - RNA, 22 nt, Human
cucaaggagcccucuagccacc

SEQ ID NO: 393231 - RNA, 24 nt, Human
cucacucugucacccaggcuggag

SEQ ID NO: 393232 - RNA, 24 nt, Human
cucacugcaaccucugccucccag

SEQ ID NO: 393233 - RNA, 24 nt, Human
cucacugcaaccucugccucccag

SEQ ID NO: 393234 - RNA, 24 nt, Human
cucagccucccuaguagcugggac

SEQ ID NO: 393235 - RNA, 22 nt, Human
cucagcuuccugaguagcuggg

SEQ ID NO: 393236 - RNA, 23 nt, Human
cucagcuuccugaguagcuggga

SEQ ID NO: 393237 - RNA, 19 nt, Human
cuccaaaguuuagagcagg

SEQ ID NO: 393238 - RNA, 22 nt, Human
cuccaaccuggugucuuugggc

SEQ ID NO: 393239 - RNA, 19 nt, Human
cucccagguucaagugauu

SEQ ID NO: 393240 - RNA, 24 nt, Human
cucgcucugucacccaggcuggag

SEQ ID NO: 393241 - RNA, 19 nt, Human
cucuaaaguuauccuagcc

SEQ ID NO: 393242 - RNA, 18 nt, Human
cugacaucagaacagggc

SEQ ID NO: 393243 - RNA, 25 nt, Human
cugacccauaggaugucaguggcau

SEQ ID NO: 393244 - RNA, 20 nt, Human
cugacuucaggugauccgcc

SEQ ID NO: 393245 - RNA, 23 nt, Human
cugcaaccucugccucccagguu

SEQ ID NO: 393246 - RNA, 24 nt, Human
cugcaaccucugccucccagguuc

SEQ ID NO: 393247 - RNA, 23 nt, Human
cugcagccuugaacuccugagcu

SEQ ID NO: 393248 - RNA, 24 nt, Human
cugccucagccucccaaagugcug

SEQ ID NO: 393249 - RNA, 20 nt, Human
cugcgcauagcaagcucacc

SEQ ID NO: 393250 - RNA, 19 nt, Human
cuggcuaucuccagguagu

SEQ ID NO: 393251 - RNA, 18 nt, Human
cugggauacaggcaagcg

SEQ ID NO: 393252 - RNA, 19 nt, Human
cugucacccaggcuggagu

SEQ ID NO: 393253 - RNA, 18 nt, Human
cuguuucucuuggaggug

SEQ ID NO: 393254 - RNA, 22 nt, Human
cuugcaucaaaacaggaugaga

SEQ ID NO: 393255 - RNA, 23 nt, Human
cuuggaaaguugccaccaacucc

SEQ ID NO: 393256 - RNA, 22 nt, Human
gaaggcugggcugcagguuggg

SEQ ID NO: 393257 - RNA, 21 nt, Human
gacacagugagacccugucuc

SEQ ID NO: 393258 - RNA, 21 nt, Human
gaccagcuugugagucuaggg

SEQ ID NO: 393259 - RNA, 22 nt, Human
gaccccuacgccuccccacccc

SEQ ID NO: 393260 - RNA, 19 nt, Human
gacccugucucaaaaaaag

SEQ ID NO: 393261 - RNA, 18 nt, Human
gacuacaggcgugagcca

SEQ ID NO: 393262 - RNA, 22 nt, Human
gacuacaggcgugagccacugc

SEQ ID NO: 393263 - RNA, 23 nt, Human
gacuacaggcgugagccacugca

SEQ ID NO: 393264 - RNA, 24 nt, Human
gacuucaggugauccgccugccuc

SEQ ID NO: 393265 - RNA, 18 nt, Human
gagagacaaggaguugga

SEQ ID NO: 393266 - RNA, 21 nt, Human
gagagcaaagccuaaaaaugc

SEQ ID NO: 393267 - RNA, 19 nt, Human
gagcaaagccuaaaaaugc

SEQ ID NO: 393268 - RNA, 24 nt, Human
gagggggcccuggcucaggcugcg

SEQ ID NO: 393269 - RNA, 23 nt, Human
gaguagaaagggcaagguaagag

SEQ ID NO: 393270 - RNA, 18 nt, Human
gauuacaggcgugagcca

SEQ ID NO: 393271 - RNA, 22 nt, Human
gauuacaggcgugagccacugc

SEQ ID NO: 393272 - RNA, 23 nt, Human
gauuacaggcgugagccacugca

SEQ ID NO: 393273 - RNA, 21 nt, Human
gauucucgugucucagcuucc

SEQ ID NO: 393274 - RNA, 23 nt, Human
gcaacccucccaccucagccucc

SEQ ID NO: 393275 - RNA, 20 nt, Human
gcagaaguuauugguucuga

SEQ ID NO: 393276 - RNA, 22 nt, Human
gcagccucaaccucccgggcuc

SEQ ID NO: 393277 - RNA, 21 nt, Human
gcauccuugcccugggcgaca

SEQ ID NO: 393278 - RNA, 21 nt, Human
gccaggagcagggcaucuggc

SEQ ID NO: 393279 - RNA, 20 nt, Human
gccguagaccccuacgccuc

SEQ ID NO: 393280 - RNA, 18 nt, Human
gccucaaccucccgggcu

SEQ ID NO: 393281 - RNA, 23 nt, Human
gcgacacagugagacccugucuc

SEQ ID NO: 393282 - RNA, 21 nt, Human
gcgcauagcaagcucacccag

SEQ ID NO: 393283 - RNA, 18 nt, Human
gcucaaaacauuaaacaa

SEQ ID NO: 393284 - RNA, 18 nt, Human
gcucucugaaugagggaa

SEQ ID NO: 393285 - RNA, 26 nt, Human
gcugacccauaggaugucaguggcau

SEQ ID NO: 393286 - RNA, 20 nt, Human
gcugacgaagcgaacagcag

SEQ ID NO: 393287 - RNA, 19 nt, Human
gcuggaguacaguggcaug

SEQ ID NO: 393288 - RNA, 24 nt, Human
gcuggagugcaguggcacuaucug

SEQ ID NO: 393289 - RNA, 19 nt, Human
gcuuggcugaugguuuucc

SEQ ID NO: 393290 - RNA, 21 nt, Human
ggaagggguggugaugcggug

SEQ ID NO: 393291 - RNA, 20 nt, Human
ggacuacaggcgugagccac

SEQ ID NO: 393292 - RNA, 22 nt, Human
ggacuacaggcgugagccacug

SEQ ID NO: 393293 - RNA, 23 nt, Human
ggagagagagccuuagccuugcc

SEQ ID NO: 393294 - RNA, 18 nt, Human
ggcuuuaaagguggccag

SEQ ID NO: 393295 - RNA, 24 nt, Human
ggguuucuuuuuaggcuguuucuc

SEQ ID NO: 393296 - RNA, 24 nt, Human
ggugauccgccugccucagccucc

SEQ ID NO: 393297 - RNA, 19 nt, Human
guagguuuuuggagacaga

SEQ ID NO: 393298 - RNA, 24 nt, Human
guauacaaacacacacacaaacau

SEQ ID NO: 393299 - RNA, 22 nt, Human
gugaagccucugcugcuagccc

SEQ ID NO: 393300 - RNA, 18 nt, Human
gugauccgccugccucag

SEQ ID NO: 393301 - RNA, 24 nt, Human
gugauccgccugccucagccuccc

SEQ ID NO: 393302 - RNA, 24 nt, Human
gugauccuccuggcucagccuccc

SEQ ID NO: 393303 - RNA, 18 nt, Human
guggugaugcggugaagc

SEQ ID NO: 393304 - RNA, 27 nt, Human
guuuacacuaaacacaugaauacauug

SEQ ID NO: 393305 - RNA, 26 nt, Human
uaaaaugccaacucuauagccaugag

SEQ ID NO: 393306 - RNA, 19 nt, Human
uaaaggccccuuaaacaaa

SEQ ID NO: 393307 - RNA, 24 nt, Human
uaacagauggagagaauaccuucu

SEQ ID NO: 393308 - RNA, 20 nt, Human
uaaguguaagggaaucuggu

SEQ ID NO: 393309 - RNA, 24 nt, Human
uaauuuuuuguauuuuuaguagag

SEQ ID NO: 393310 - RNA, 25 nt, Human
uaauuuuuuguauuuuuaguagaga

SEQ ID NO: 393311 - RNA, 24 nt, Human
uacaggcaagcgucaccacaccca

SEQ ID NO: 393312 - RNA, 22 nt, Human
uacaggcgugagccacugcacc

SEQ ID NO: 393313 - RNA, 22 nt, Human
uacaggcgugagccacugcacc

SEQ ID NO: 393314 - RNA, 22 nt, Human
uacaggcgugagccacugcacc

SEQ ID NO: 393315 - RNA, 22 nt, Human
uacaggcgugagccacugcacc

SEQ ID NO: 393316 - RNA, 23 nt, Human
uacaggcgugagccacugcaccu

SEQ ID NO: 393317 - RNA, 23 nt, Human
uacaggcgugagccacugcaccu

SEQ ID NO: 393318 - RNA, 22 nt, Human
uacaggugcaccccaccacacc

SEQ ID NO: 393319 - RNA, 20 nt, Human
uacuguguuuaacagaugga

SEQ ID NO: 393320 - RNA, 19 nt, Human
uagaaggcugggugcccuc

SEQ ID NO: 393321 - RNA, 18 nt, Human
uagaguuaaugauugucu

SEQ ID NO: 393322 - RNA, 24 nt, Human
uagcucucugcagccuugaacucc

SEQ ID NO: 393323 - RNA, 23 nt, Human
uaggucgggggaaaggaaggggc

SEQ ID NO: 393324 - RNA, 19 nt, Human
uauccuuugugaagaugca

SEQ ID NO: 393325 - RNA, 19 nt, Human
uaugacaaaaaguacuaga

SEQ ID NO: 393326 - RNA, 22 nt, Human
uaugaccagauggagacauggg

SEQ ID NO: 393327 - RNA, 22 nt, Human
uauguuaguucuucugcuguuu

SEQ ID NO: 393328 - RNA, 23 nt, Human
uauguuggccaggcuggucucaa

SEQ ID NO: 393329 - RNA, 24 nt, Human
uauguuggccaggcuggucucaaa

SEQ ID NO: 393330 - RNA, 20 nt, Human
ucaaagcaagccuggcugac

SEQ ID NO: 393331 - RNA, 21 nt, Human
ucaaagcaagccuggcugacc

SEQ ID NO: 393332 - RNA, 24 nt, Human
ucaaagcaagccuggcugacccau

SEQ ID NO: 393333 - RNA, 21 nt, Human
ucaccaagagaggccuaugga

SEQ ID NO: 393334 - RNA, 24 nt, Human
ucacccaggcuggagugcaguggc

SEQ ID NO: 393335 - RNA, 25 nt, Human
ucacccagggaaggcugggcugcag

SEQ ID NO: 393336 - RNA, 19 nt, Human
ucacugcaaccucugccuc

SEQ ID NO: 393337 - RNA, 24 nt, Human
ucacugcaaccucugccucccagg

SEQ ID NO: 393338 - RNA, 25 nt, Human
ucacugcaaccucugccucccaggu

SEQ ID NO: 393339 - RNA, 20 nt, Human
ucagagcuacagaagcuggg

SEQ ID NO: 393340 - RNA, 18 nt, Human
ucagccucccaaagugcu

SEQ ID NO: 393341 - RNA, 20 nt, Human
ucagcuuccugaguagcugg

SEQ ID NO: 393342 - RNA, 22 nt, Human
ucaggugauccgccugccucag

SEQ ID NO: 393343 - RNA, 20 nt, Human
ucauaucugugacacugacu

SEQ ID NO: 393344 - RNA, 25 nt, Human
uccauggacagcaccacucaucucc

SEQ ID NO: 393345 - RNA, 22 nt, Human
ucccaaaaaaauagaaccaagc

SEQ ID NO: 393346 - RNA, 24 nt, Human
ucccaaagugcugggaguacaggc

SEQ ID NO: 393347 - RNA, 24 nt, Human
ucccaaagugcugggauuacaggc

SEQ ID NO: 393348 - RNA, 24 nt, Human
ucccaaguaccugggacuacaggc

SEQ ID NO: 393349 - RNA, 21 nt, Human
ucccagguucaagugauucuc

SEQ ID NO: 393350 - RNA, 21 nt, Human
ucccagguucaagugauucuc

SEQ ID NO: 393351 - RNA, 23 nt, Human
ucccagugaugaguuggggcugc

SEQ ID NO: 393352 - RNA, 22 nt, Human
ucccaugauaacaugccccaag

SEQ ID NO: 393353 - RNA, 21 nt, Human
ucccgggcucaagugauccuc

SEQ ID NO: 393354 - RNA, 24 nt, Human
ucccgggcucaagugauccuccug

SEQ ID NO: 393355 - RNA, 23 nt, Human
ucccuaguagcugggacuacagg

SEQ ID NO: 393356 - RNA, 20 nt, Human
ucccugaagggaaagaaugu

SEQ ID NO: 393357 - RNA, 23 nt, Human
uccugaguagcugggauacaggc

SEQ ID NO: 393358 - RNA, 24 nt, Human
ucgcucugucacccaggcuggagu

SEQ ID NO: 393359 - RNA, 24 nt, Human
ucggagagccagcaaaccaagaag

SEQ ID NO: 393360 - RNA, 19 nt, Human
ucuaaaggacacagugggc

SEQ ID NO: 393361 - RNA, 25 nt, Human
ucuauagccaugagguucugcuuug

SEQ ID NO: 393362 - RNA, 23 nt, Human
ucucacucugucacccaggcugg

SEQ ID NO: 393363 - RNA, 24 nt, Human
ucucacucugucacccaggcugga

SEQ ID NO: 393364 - RNA, 25 nt, Human
ucucacucugucacccaggcuggag

SEQ ID NO: 393365 - RNA, 26 nt, Human
ucucacucugucacccaggcuggagu

SEQ ID NO: 393366 - RNA, 19 nt, Human
ucucgcucugucacccagg

SEQ ID NO: 393367 - RNA, 23 nt, Human
ucucgcucugucacccaggcugg

SEQ ID NO: 393368 - RNA, 24 nt, Human
ucucgcucugucacccaggcugga

SEQ ID NO: 393369 - RNA, 26 nt, Human
ucucgcucugucacccaggcuggagu

SEQ ID NO: 393370 - RNA, 27 nt, Human
ucucgcucugucacccaggcuggagug

SEQ ID NO: 393371 - RNA, 19 nt, Human
ucucgugucucagcuuccu

SEQ ID NO: 393372 - RNA, 23 nt, Human
ucucugaaugagggaagcacagc

SEQ ID NO: 393373 - RNA, 22 nt, Human
ucucugcagccuugaacuccug

SEQ ID NO: 393374 - RNA, 18 nt, Human
ucugagugcagccccuga

SEQ ID NO: 393375 - RNA, 18 nt, Human
ucugucacccaggcugga

SEQ ID NO: 393376 - RNA, 24 nt, Human
ucugucacccaggcuggaguacag

SEQ ID NO: 393377 - RNA, 24 nt, Human
ucugucacccaggcuggagugcag

SEQ ID NO: 393378 - RNA, 21 nt, Human
ucuucggaaugccacuccaaa

SEQ ID NO: 393379 - RNA, 21 nt, Human
ucuuuagcaacaaaauaccug

SEQ ID NO: 393380 - RNA, 21 nt, Human
ucuuugggcauccuugcccug

SEQ ID NO: 393381 - RNA, 23 nt, Human
ucuuuuuuuuuuuuugagacgga

SEQ ID NO: 393382 - RNA, 26 nt, Human
ugaaggacuuucuaagcaagaccuug

SEQ ID NO: 393383 - RNA, 18 nt, Human
ugaccccccacugcagcc

SEQ ID NO: 393384 - RNA, 18 nt, Human
ugacuucaggugauccgc

SEQ ID NO: 393385 - RNA, 24 nt, Human
ugacuucaggugauccgccugccu

SEQ ID NO: 393386 - RNA, 23 nt, Human
ugagaaguuuuaggggcaggggg

SEQ ID NO: 393387 - RNA, 19 nt, Human
ugagagacaaggaguugga

SEQ ID NO: 393388 - RNA, 20 nt, Human
ugagcagauagcuggaggcu

SEQ ID NO: 393389 - RNA, 23 nt, Human
ugagcagauagcuggaggcuguu

SEQ ID NO: 393390 - RNA, 24 nt, Human
ugagcucaagcaauccuccugccu

SEQ ID NO: 393391 - RNA, 24 nt, Human
ugaggaaagcaccucugaugagca

SEQ ID NO: 393392 - RNA, 19 nt, Human
ugaggguggaguagggggg

SEQ ID NO: 393393 - RNA, 21 nt, Human
ugaggguggaguaggggggug

SEQ ID NO: 393394 - RNA, 18 nt, Human
ugaguagaaagggcaagg

SEQ ID NO: 393395 - RNA, 21 nt, Human
ugagucuagggaaccuggaau

SEQ ID NO: 393396 - RNA, 18 nt, Human
ugaugagcagauagcugg

SEQ ID NO: 393397 - RNA, 22 nt, Human
ugcaagugacaaucagaguugg

SEQ ID NO: 393398 - RNA, 21 nt, Human
ugcagaacuucuuuguccuug

SEQ ID NO: 393399 - RNA, 20 nt, Human
ugcagccuugaacuccugag

SEQ ID NO: 393400 - RNA, 19 nt, Human
ugcaguggcacuaucugag

SEQ ID NO: 393401 - RNA, 22 nt, Human
ugcccugggcgacacagugaga

SEQ ID NO: 393402 - RNA, 24 nt, Human
ugccucagccucccaaagugcugg

SEQ ID NO: 393403 - RNA, 21 nt, Human
ugccucaggcucccaaguacc

SEQ ID NO: 393404 - RNA, 24 nt, Human
ugccucaggcucccaaguaccugg

SEQ ID NO: 393405 - RNA, 23 nt, Human
ugccugugucccaaccacucagg

SEQ ID NO: 393406 - RNA, 25 nt, Human
ugccuuuggagguauguacaggcac

SEQ ID NO: 393407 - RNA, 24 nt, Human
ugcugggauuacaggcgugagcca

SEQ ID NO: 393408 - RNA, 19 nt, Human
uggaguacaguggcaugau

SEQ ID NO: 393409 - RNA, 21 nt, Human
uggagugcaguggcacuaucu

SEQ ID NO: 393410 - RNA, 24 nt, Human
uggcacuaucugagcucacugcaa

SEQ ID NO: 393411 - RNA, 23 nt, Human
uggcaggugccucuccaaccugg

SEQ ID NO: 393412 - RNA, 24 nt, Human
uggccaggcuggucucaaacuucu

SEQ ID NO: 393413 - RNA, 18 nt, Human
uggccuguuuguuuauga

SEQ ID NO: 393414 - RNA, 23 nt, Human
uggcggcagauggccuguuuguu

SEQ ID NO: 393415 - RNA, 24 nt, Human
uggcucagccucccuaguagcugg

SEQ ID NO: 393416 - RNA, 19 nt, Human
ugggacuacaggcgugagc

SEQ ID NO: 393417 - RNA, 22 nt, Human
ugggacuacaggcgugagccac

SEQ ID NO: 393418 - RNA, 22 nt, Human
ugggacuacaggcgugagccac

SEQ ID NO: 393419 - RNA, 24 nt, Human
ugggacuacaggcgugagccacug

SEQ ID NO: 393420 - RNA, 24 nt, Human
ugggacuacaggcgugagccacug

SEQ ID NO: 393421 - RNA, 24 nt, Human
ugggacuacaggugcaccccacca

SEQ ID NO: 393422 - RNA, 21 nt, Human
ugggaguacaggcacgagcca

SEQ ID NO: 393423 - RNA, 23 nt, Human
ugggaguacaggcacgagccauc

SEQ ID NO: 393424 - RNA, 24 nt, Human
ugggaguacaggcacgagccauca

SEQ ID NO: 393425 - RNA, 21 nt, Human
ugggauacaggcaagcgucac

SEQ ID NO: 393426 - RNA, 23 nt, Human
ugggauacaggcaagcgucacca

SEQ ID NO: 393427 - RNA, 19 nt, Human
ugggauuacaggcgugagc

SEQ ID NO: 393428 - RNA, 22 nt, Human
ugggauuacaggcgugagccac

SEQ ID NO: 393429 - RNA, 22 nt, Human
ugggauuacaggcgugagccac

SEQ ID NO: 393430 - RNA, 24 nt, Human
ugggauuacaggcgugagccacug

SEQ ID NO: 393431 - RNA, 24 nt, Human
ugggauuacaggcgugagccacug

SEQ ID NO: 393432 - RNA, 23 nt, Human
uggugcaggagguugaggaaagc

SEQ ID NO: 393433 - RNA, 19 nt, Human
uguaagcauuucuuuuucc

SEQ ID NO: 393434 - RNA, 21 nt, Human
ugucacccaggcuggagugca

SEQ ID NO: 393435 - RNA, 22 nt, Human
ugucaguggcauggggagugga

SEQ ID NO: 393436 - RNA, 22 nt, Human
ugucucagcuuccugaguagcu

SEQ ID NO: 393437 - RNA, 24 nt, Human
ugucucagcuuccugaguagcugg

SEQ ID NO: 393438 - RNA, 19 nt, Human
ugugucccaaccacucagg

SEQ ID NO: 393439 - RNA, 21 nt, Human
ugugugugcauaucuuauugc

SEQ ID NO: 393440 - RNA, 20 nt, Human
uguuagaucacagccucuuu

SEQ ID NO: 393441 - RNA, 22 nt, Human
uguugcccaagcuggucucaaa

SEQ ID NO: 393442 - RNA, 27 nt, Human
uuaacacugagaauccaugcagagagu

SEQ ID NO: 393443 - RNA, 22 nt, Human
uuauuauuaacacugagaaucc

SEQ ID NO: 393444 - RNA, 23 nt, Human
uucaagugauucucgugucucag

SEQ ID NO: 393445 - RNA, 25 nt, Human
uucacacacugugcacacccaucuc

SEQ ID NO: 393446 - RNA, 21 nt, Human
uucaggugauccgccugccuc

SEQ ID NO: 393447 - RNA, 23 nt, Human
uucaggugauccgccugccucag

SEQ ID NO: 393448 - RNA, 23 nt, Human
uugcagggggaguucuuucccag

SEQ ID NO: 393449 - RNA, 24 nt, Human
uuggcaggugccucuccaaccugg

SEQ ID NO: 393450 - RNA, 25 nt, Human
uuggcccccucuucaauauucgggg

SEQ ID NO: 393451 - RNA, 23 nt, Human
uuguugcccaagcuggucucaaa

SEQ ID NO: 393452 - RNA, 23 nt, Human
uuuagcaacaaaauaccugugug

SEQ ID NO: 393453 - RNA, 18 nt, Human
uuucucagauuuauugua

SEQ ID NO: 393454 - RNA, 24 nt, Human
uuugcagaacuucuuuguccuugg

SEQ ID NO: 393455 - RNA, 21 nt, Human
uuuguuguuguugcccaagcu

SEQ ID NO: 393456 - RNA, 21 nt, Human
uuuuguuguuguugcccaagc

SEQ ID NO: 393457 - RNA, 23 nt, Human
uuuuguuguuguugcccaagcug

SEQ ID NO: 393458 - RNA, 21 nt, Human
uuuuuguauuuuuaguagaga

SEQ ID NO: 393459 - RNA, 24 nt, Human
uuuuuuguauuuuuaguagagaca

SEQ ID NO: 393460 - RNA, 21 nt, Human
aacccugcaccuaagccaaaa

SEQ ID NO: 393461 - RNA, 19 nt, Human
agaaaucuugucuucuuca

SEQ ID NO: 393462 - RNA, 23 nt, Human
agacaucagagaacauuugaacc

SEQ ID NO: 393463 - RNA, 19 nt, Human
agccaaaagcauuauaauc

SEQ ID NO: 393464 - RNA, 25 nt, Human
auuuuagucuuaacaccuguaaacc

SEQ ID NO: 393465 - RNA, 22 nt, Human
caacccugcaccuaagccaaaa

SEQ ID NO: 393466 - RNA, 22 nt, Human
cccucaugaacuaaagcuuuau

SEQ ID NO: 393467 - RNA, 22 nt, Human
cccuuuguuuccugggcugagc

SEQ ID NO: 393468 - RNA, 23 nt, Human
ccugggcugagcuuguccagaaa

SEQ ID NO: 393469 - RNA, 21 nt, Human
ccuuuguuuccugggcugagc

SEQ ID NO: 393470 - RNA, 24 nt, Human
ccuuuguuuccugggcugagcuug

SEQ ID NO: 393471 - RNA, 21 nt, Human
cgaucccucaugaacuaaagc

SEQ ID NO: 393472 - RNA, 21 nt, Human
cuugucuucuucaggcuacag

SEQ ID NO: 393473 - RNA, 22 nt, Human
gaaaggguucaggcuuuggaaa

SEQ ID NO: 393474 - RNA, 25 nt, Human
gagcuuguccagaaaucuugucuuc

SEQ ID NO: 393475 - RNA, 23 nt, Human
ugggcugagcuuguccagaaauc

SEQ ID NO: 393476 - RNA, 23 nt, Human
ugggcuguuuuucuuagcaaucu

SEQ ID NO: 393477 - RNA, 22 nt, Human
uguaaaugguaucuuguauaag

SEQ ID NO: 393478 - RNA, 19 nt, Human
uuguuuacccuuuguuucc

SEQ ID NO: 393479 - RNA, 22 nt, Human
uuuagucuuaacaccuguaaac

SEQ ID NO: 393480 - RNA, 18 nt, Human
uuuuuuuuuuuuuuuuug

SEQ ID NO: 393481 - RNA, 23 nt, Human
aaaaaacaaacaaacaaaaaaaa

SEQ ID NO: 393482 - RNA, 20 nt, Human
aaaacaaacaaacaaaaaaa

SEQ ID NO: 393483 - RNA, 18 nt, Human
aaacaaaaaaaacuagug

SEQ ID NO: 393484 - RNA, 27 nt, Human
aaacaacaucuuguaacugcacugggc

SEQ ID NO: 393485 - RNA, 19 nt, Human
aaacuggcugaugcuccca

SEQ ID NO: 393486 - RNA, 24 nt, Human
aaagguauacauuuggaacuucaa

SEQ ID NO: 393487 - RNA, 19 nt, Human
aacaaaaaacaaacaaaca

SEQ ID NO: 393488 - RNA, 18 nt, Human
aacacaaauuuggcuuua

SEQ ID NO: 393489 - RNA, 18 nt, Human
aacagcaagugguggggg

SEQ ID NO: 393490 - RNA, 18 nt, Human
aacucacaaaaugaggac

SEQ ID NO: 393491 - RNA, 19 nt, Human
aacucacaaaaugaggacc

SEQ ID NO: 393492 - RNA, 18 nt, Human
aagaagaaaguuagaaga

SEQ ID NO: 393493 - RNA, 22 nt, Human
aagcuagagagagagauaauuu

SEQ ID NO: 393494 - RNA, 20 nt, Human
aauaaccggggaugacacac

SEQ ID NO: 393495 - RNA, 24 nt, Human
acaaaaugaggaccucucuuuuaa

SEQ ID NO: 393496 - RNA, 21 nt, Human
acagcaagugguggggggagu

SEQ ID NO: 393497 - RNA, 21 nt, Human
accacaccagggaccccagca

SEQ ID NO: 393498 - RNA, 20 nt, Human
acugagucgguuuaagaaca

SEQ ID NO: 393499 - RNA, 27 nt, Human
acuucauaccucaagugauuuaaacug

SEQ ID NO: 393500 - RNA, 19 nt, Human
agaaacuggcugaugcucc

SEQ ID NO: 393501 - RNA, 19 nt, Human
agagcaggguccgcuccuu

SEQ ID NO: 393502 - RNA, 20 nt, Human
agaggaaaagacugucuaga

SEQ ID NO: 393503 - RNA, 22 nt, Human
agauccagaaagaccuggauaa

SEQ ID NO: 393504 - RNA, 20 nt, Human
agaugagcaacuggagcugg

SEQ ID NO: 393505 - RNA, 26 nt, Human
agaugagcaacuggagcuggaagcac

SEQ ID NO: 393506 - RNA, 20 nt, Human
aggacaagcucagccccgcu

SEQ ID NO: 393507 - RNA, 20 nt, Human
agggagcaggcgguauucuc

SEQ ID NO: 393508 - RNA, 18 nt, Human
aggguuggggagaggcug

SEQ ID NO: 393509 - RNA, 21 nt, Human
aggguuggggagaggcugggg

SEQ ID NO: 393510 - RNA, 18 nt, Human
auccgcgggcccuuccuc

SEQ ID NO: 393511 - RNA, 28 nt, Human
augcucccaugaauacgccccugucuau

SEQ ID NO: 393512 - RNA, 19 nt, Human
auucauuaacagguugcuc

SEQ ID NO: 393513 - RNA, 24 nt, Human
auuucauauagcuauuuauugaau

SEQ ID NO: 393514 - RNA, 23 nt, Human
auuuucuucaaugaauaguuuua

SEQ ID NO: 393515 - RNA, 28 nt, Human
caaaaaacaaacaaacaaaaaaaacuag

SEQ ID NO: 393516 - RNA, 19 nt, Human
caaaacaguugugaugggc

SEQ ID NO: 393517 - RNA, 25 nt, Human
caaauccugcugagccuuuucaaaa

SEQ ID NO: 393518 - RNA, 18 nt, Human
caacuccccggaagcaau

SEQ ID NO: 393519 - RNA, 21 nt, Human
caagcucagccccgcuccuuc

SEQ ID NO: 393520 - RNA, 22 nt, Human
caaugucugccauggccacaaa

SEQ ID NO: 393521 - RNA, 24 nt, Human
caccagggaccccagcauuuccaa

SEQ ID NO: 393522 - RNA, 21 nt, Human
cacgggggcugaaaacaauaa

SEQ ID NO: 393523 - RNA, 23 nt, Human
cacucagugugcguaacuccagg

SEQ ID NO: 393524 - RNA, 22 nt, Human
cagaagucuguggugcauggcu

SEQ ID NO: 393525 - RNA, 24 nt, Human
cagcccaugggguugcaucuuccu

SEQ ID NO: 393526 - RNA, 19 nt, Human
cagcccggggagagcaggg

SEQ ID NO: 393527 - RNA, 18 nt, Human
caggacaagcucagcccc

SEQ ID NO: 393528 - RNA, 21 nt, Human
cagggguccagcaaugucacu

SEQ ID NO: 393529 - RNA, 23 nt, Human
caggguuggggagaggcuggggg

SEQ ID NO: 393530 - RNA, 21 nt, Human
cauaaucacaugucuccugcc

SEQ ID NO: 393531 - RNA, 23 nt, Human
caucaaaaugcuuugccgaaaca

SEQ ID NO: 393532 - RNA, 18 nt, Human
caucauuuguuuucuggc

SEQ ID NO: 393533 - RNA, 21 nt, Human
caucucggcuugaacuucuga

SEQ ID NO: 393534 - RNA, 21 nt, Human
caugggguggguggacuguuu

SEQ ID NO: 393535 - RNA, 22 nt, Human
caugguggaaauuucaggcaga

SEQ ID NO: 393536 - RNA, 19 nt, Human
cauuagggaugacauucuc

SEQ ID NO: 393537 - RNA, 19 nt, Human
ccagaaagaccuggauaaa

SEQ ID NO: 393538 - RNA, 20 nt, Human
ccagagcaggaacuuugggc

SEQ ID NO: 393539 - RNA, 21 nt, Human
ccagcaaugucacugcaggug

SEQ ID NO: 393540 - RNA, 18 nt, Human
cccacuaugaagauauca

SEQ ID NO: 393541 - RNA, 25 nt, Human
cccagaagaacauccuucugcauac

SEQ ID NO: 393542 - RNA, 22 nt, Human
cccauggccagauaucgaagac

SEQ ID NO: 393543 - RNA, 22 nt, Human
cccccaucugacauaguguuug

SEQ ID NO: 393544 - RNA, 24 nt, Human
ccgcgggcccuuccucgcgggucc

SEQ ID NO: 393545 - RNA, 24 nt, Human
ccuauaaugggagagaaccggggc

SEQ ID NO: 393546 - RNA, 19 nt, Human
ccucagggacgcgccaucc

SEQ ID NO: 393547 - RNA, 23 nt, Human
ccuccugauguuucuuuccaugu

SEQ ID NO: 393548 - RNA, 25 nt, Human
ccucgcucccucgcaacuccccgga

SEQ ID NO: 393549 - RNA, 22 nt, Human
ccucuagcugcugauggccugu

SEQ ID NO: 393550 - RNA, 19 nt, Human
ccugacuaaggcacucugc

SEQ ID NO: 393551 - RNA, 21 nt, Human
ccuuuauucccccucgcuccc

SEQ ID NO: 393552 - RNA, 19 nt, Human
cuccaccucaaaguugggu

SEQ ID NO: 393553 - RNA, 25 nt, Human
cuccaggccugucucugcccuccac

SEQ ID NO: 393554 - RNA, 25 nt, Human
cucccucgcaacuccccggaagcaa

SEQ ID NO: 393555 - RNA, 23 nt, Human
cucgcaacuccccggaagcaauu

SEQ ID NO: 393556 - RNA, 19 nt, Human
cugaaaacaauaauuuugu

SEQ ID NO: 393557 - RNA, 22 nt, Human
cuggaagcacuucuguggucaa

SEQ ID NO: 393558 - RNA, 21 nt, Human
cuggagcuggaagcacuucug

SEQ ID NO: 393559 - RNA, 24 nt, Human
cuuuaauaaaaaaaaaacaguuca

SEQ ID NO: 393560 - RNA, 24 nt, Human
cuuuuaugcccccuggcuuuccca

SEQ ID NO: 393561 - RNA, 22 nt, Human
gaaacaacaucuuguaacugca

SEQ ID NO: 393562 - RNA, 19 nt, Human
gaaauccuccaccucaaag

SEQ ID NO: 393563 - RNA, 21 nt, Human
gaacaaauccugcugagccuu

SEQ ID NO: 393564 - RNA, 19 nt, Human
gaacuacaugaaagaagaa

SEQ ID NO: 393565 - RNA, 18 nt, Human
gaacucgccacgacccuc

SEQ ID NO: 393566 - RNA, 19 nt, Human
gaacucgccacgacccuca

SEQ ID NO: 393567 - RNA, 22 nt, Human
gacaauaacacgggggcugaaa

SEQ ID NO: 393568 - RNA, 21 nt, Human
gacuguuuuagacugccagca

SEQ ID NO: 393569 - RNA, 22 nt, Human
gagccuggggaacccauucucc

SEQ ID NO: 393570 - RNA, 20 nt, Human
gaguagaggcaggaaggcag

SEQ ID NO: 393571 - RNA, 20 nt, Human
gaucauaaucacaugucucc

SEQ ID NO: 393572 - RNA, 19 nt, Human
gaucugauguauuuccccu

SEQ ID NO: 393573 - RNA, 19 nt, Human
gauuuguggaaagcuagag

SEQ ID NO: 393574 - RNA, 18 nt, Human
gccacgacccucagggac

SEQ ID NO: 393575 - RNA, 24 nt, Human
gcccggggagagcaggguccgcuu

SEQ ID NO: 393576 - RNA, 22 nt, Human
gcgggcccuuccucgcgggucc

SEQ ID NO: 393577 - RNA, 24 nt, Human
gcucccaacucacaaaaugaggac

SEQ ID NO: 393578 - RNA, 26 nt, Human
gcucccucgcaacuccccggaagcaa

SEQ ID NO: 393579 - RNA, 20 nt, Human
gcuccucucuccccguuuuc

SEQ ID NO: 393580 - RNA, 19 nt, Human
gcuuuaccaagaaaaaaaa

SEQ ID NO: 393581 - RNA, 20 nt, Human
ggaaagggaggaggauagaa

SEQ ID NO: 393582 - RNA, 20 nt, Human
ggaaauuucaggcagagcau

SEQ ID NO: 393583 - RNA, 22 nt, Human
ggacaagcucagccccgcuccu

SEQ ID NO: 393584 - RNA, 19 nt, Human
ggagguggaguagaggcag

SEQ ID NO: 393585 - RNA, 20 nt, Human
ggauuuguggaaagcuagag

SEQ ID NO: 393586 - RNA, 24 nt, Human
ggauuuguggaaagcuagagagag

SEQ ID NO: 393587 - RNA, 21 nt, Human
ggccuuuaauuuuaacaauuu

SEQ ID NO: 393588 - RNA, 21 nt, Human
ggcuccucucuccccguuuuc

SEQ ID NO: 393589 - RNA, 18 nt, Human
gggaacuagaggaaaaga

SEQ ID NO: 393590 - RNA, 19 nt, Human
gggagaaggcuaggguugg

SEQ ID NO: 393591 - RNA, 21 nt, Human
gggauuucuuucuuucuucuu

SEQ ID NO: 393592 - RNA, 20 nt, Human
ggguuggggagaggcugggg

SEQ ID NO: 393593 - RNA, 23 nt, Human
ggguuggggagaggcuggggggu

SEQ ID NO: 393594 - RNA, 18 nt, Human
guaaagugagugaaugaa

SEQ ID NO: 393595 - RNA, 18 nt, Human
guggguuuuagaaacugg

SEQ ID NO: 393596 - RNA, 20 nt, Human
guuccagaaaagaucugaga

SEQ ID NO: 393597 - RNA, 24 nt, Human
guuucuccuucuuaacuguaauuc

SEQ ID NO: 393598 - RNA, 19 nt, Human
uaaacugaagccaaaccuu

SEQ ID NO: 393599 - RNA, 28 nt, Human
uaaagugccuccaguaaggucuugaaaa

SEQ ID NO: 393600 - RNA, 24 nt, Human
uaacaagaaaaggcaauugguuag

SEQ ID NO: 393601 - RNA, 19 nt, Human
uaacaugauucauuaacag

SEQ ID NO: 393602 - RNA, 24 nt, Human
uaacuggguugacauugggcugaa

SEQ ID NO: 393603 - RNA, 21 nt, Human
uaagauagagauagcaaguag

SEQ ID NO: 393604 - RNA, 23 nt, Human
uaaugcugugcaaacaagggucu

SEQ ID NO: 393605 - RNA, 20 nt, Human
uaauggauuuuacccccauc

SEQ ID NO: 393606 - RNA, 25 nt, Human
uaauucuuuuaauuugguuaucugg

SEQ ID NO: 393607 - RNA, 19 nt, Human
uacaacuguucuuuuuauu

SEQ ID NO: 393608 - RNA, 22 nt, Human
uacacugugagccuggggaacc

SEQ ID NO: 393609 - RNA, 19 nt, Human
uacagucuuauagaaguuu

SEQ ID NO: 393610 - RNA, 19 nt, Human
uaccaagaaaaaaaacaaa

SEQ ID NO: 393611 - RNA, 30 nt, Human
uaccaagaaaaaaaacaaaaaacaaacaag

SEQ ID NO: 393612 - RNA, 21 nt, Human
uaccacaccagggaccccagc

SEQ ID NO: 393613 - RNA, 22 nt, Human
uagaacacuccauucccacagg

SEQ ID NO: 393614 - RNA, 23 nt, Human
uagaaguuucuccuucuuaacug

SEQ ID NO: 393615 - RNA, 22 nt, Human
uagcccacuaugaagauaucag

SEQ ID NO: 393616 - RNA, 21 nt, Human
uagcugcugauggccuguggg

SEQ ID NO: 393617 - RNA, 22 nt, Human
uaggcuccuaggccaagggucc

SEQ ID NO: 393618 - RNA, 21 nt, Human
uauauucugccuuguuccaga

SEQ ID NO: 393619 - RNA, 21 nt, Human
uaugucuuuauauaguuugca

SEQ ID NO: 393620 - RNA, 18 nt, Human
uauuaaggaggcagacag

SEQ ID NO: 393621 - RNA, 19 nt, Human
uauuuuauauucugccuug

SEQ ID NO: 393622 - RNA, 23 nt, Human
uauuuuauauucugccuuguucc

SEQ ID NO: 393623 - RNA, 20 nt, Human
ucaaagguauacauuuggaa

SEQ ID NO: 393624 - RNA, 20 nt, Human
ucacuuggaaacuggaagaa

SEQ ID NO: 393625 - RNA, 20 nt, Human
ucagccccgcuccuucauuc

SEQ ID NO: 393626 - RNA, 26 nt, Human
ucaggagugugcuguccggagggagc

SEQ ID NO: 393627 - RNA, 20 nt, Human
ucaggcaagaaacugugagc

SEQ ID NO: 393628 - RNA, 23 nt, Human
ucaggcagagcauuucuguguug

SEQ ID NO: 393629 - RNA, 18 nt, Human
ucaguaaauaaggaaagu

SEQ ID NO: 393630 - RNA, 19 nt, Human
uccaacucugcauuucacc

SEQ ID NO: 393631 - RNA, 21 nt, Human
uccaucaaaaugcuuugccga

SEQ ID NO: 393632 - RNA, 22 nt, Human
ucccucgcaacuccccggaagc

SEQ ID NO: 393633 - RNA, 20 nt, Human
ucgcucccucgcaacucccc

SEQ ID NO: 393634 - RNA, 19 nt, Human
ucuaacaucuccugaaguu

SEQ ID NO: 393635 - RNA, 23 nt, Human
ucucccuggaaacuccuguuugu

SEQ ID NO: 393636 - RNA, 21 nt, Human
ucuccugccuuuuacagggaa

SEQ ID NO: 393637 - RNA, 18 nt, Human
ucucucagcucugcccag

SEQ ID NO: 393638 - RNA, 23 nt, Human
ucucugagaaggcugggagacuc

SEQ ID NO: 393639 - RNA, 23 nt, Human
ucugauguugaguuucuuaccac

SEQ ID NO: 393640 - RNA, 20 nt, Human
ucugcucccaacucacaaaa

SEQ ID NO: 393641 - RNA, 20 nt, Human
ucuguggucaagcaggcagc

SEQ ID NO: 393642 - RNA, 18 nt, Human
ucuuucuuucuucuucuc

SEQ ID NO: 393643 - RNA, 21 nt, Human
ugaaagcaucucuugcuuggc

SEQ ID NO: 393644 - RNA, 22 nt, Human
ugaaauaucaucggcuuuauaa

SEQ ID NO: 393645 - RNA, 22 nt, Human
ugaaggaucuuuggagaccaua

SEQ ID NO: 393646 - RNA, 23 nt, Human
ugagacauaauccuguugagagc

SEQ ID NO: 393647 - RNA, 18 nt, Human
ugagcuggcugucaacag

SEQ ID NO: 393648 - RNA, 19 nt, Human
ugcaaggaaaagaugccau

SEQ ID NO: 393649 - RNA, 21 nt, Human
ugccauugucuguugauuuag

SEQ ID NO: 393650 - RNA, 24 nt, Human
ugccuccaguaaggucuugaaaac

SEQ ID NO: 393651 - RNA, 19 nt, Human
ugcugauggccuguggguu

SEQ ID NO: 393652 - RNA, 20 nt, Human
ugcugcuccuuucuguuuuc

SEQ ID NO: 393653 - RNA, 19 nt, Human
uggaaaacaggauaaacuu

SEQ ID NO: 393654 - RNA, 21 nt, Human
uggaagaauuugcaaggaaaa

SEQ ID NO: 393655 - RNA, 19 nt, Human
uggagguggaguagaggca

SEQ ID NO: 393656 - RNA, 22 nt, Human
uggaguagaggcaggaaggcag

SEQ ID NO: 393657 - RNA, 22 nt, Human
uggcuccucucuccccguuuuc

SEQ ID NO: 393658 - RNA, 19 nt, Human
ugggaaaaaccaacaagca

SEQ ID NO: 393659 - RNA, 19 nt, Human
uggguggugcacaggggug

SEQ ID NO: 393660 - RNA, 21 nt, Human
ugguggggggaguucucagau

SEQ ID NO: 393661 - RNA, 24 nt, Human
uguaccugcaaaucccagaagaac

SEQ ID NO: 393662 - RNA, 24 nt, Human
ugucaggaccauugucucucagcu

SEQ ID NO: 393663 - RNA, 18 nt, Human
ugucucugcccuccacuc

SEQ ID NO: 393664 - RNA, 18 nt, Human
ugugaagaaaucaguggg

SEQ ID NO: 393665 - RNA, 20 nt, Human
ugugcguaacuccaggccug

SEQ ID NO: 393666 - RNA, 19 nt, Human
ugugggaaagggaggagga

SEQ ID NO: 393667 - RNA, 18 nt, Human
ugugggagaaggcuaggg

SEQ ID NO: 393668 - RNA, 25 nt, Human
uguuuucuuuugugggaaagggagg

SEQ ID NO: 393669 - RNA, 21 nt, Human
uuaaugcugugcaaacaaggg

SEQ ID NO: 393670 - RNA, 31 nt, Human
uuaccaagaaaaaaaacaaaaaacaaacaag

SEQ ID NO: 393671 - RNA, 22 nt, Human
uucaaaauaaagaaacugugaa

SEQ ID NO: 393672 - RNA, 24 nt, Human
uugaagauccauaacuaucuucug

SEQ ID NO: 393673 - RNA, 20 nt, Human
uugcaguuucacugucucug

SEQ ID NO: 393674 - RNA, 23 nt, Human
uuggcuccucucuccccguuuuc

SEQ ID NO: 393675 - RNA, 25 nt, Human
uugggucugcaccaggauucugccu

SEQ ID NO: 393676 - RNA, 21 nt, Human
uuuaaacugaagccaaaccuu

SEQ ID NO: 393677 - RNA, 25 nt, Human
uuuccugucccuccugauguuucuu

SEQ ID NO: 393678 - RNA, 21 nt, Human
uuucuguuuucuuuuguggga

SEQ ID NO: 393679 - RNA, 27 nt, Human
uuucuuuccauguuggggcacucagug

SEQ ID NO: 393680 - RNA, 23 nt, Human
uuuuuuuuuuuuuuuuuugauuu

SEQ ID NO: 393681 - RNA, 27 nt, Human
uuuuuuuuuuuuuuuuuuuuuuugggg

SEQ ID NO: 393682 - RNA, 18 nt, Human
aaagugcugggauuacaa

SEQ ID NO: 393683 - RNA, 24 nt, Human
aaagugcugggauuacaagcguga

SEQ ID NO: 393684 - RNA, 21 nt, Human
aagaagagacacacauuagaa

SEQ ID NO: 393685 - RNA, 19 nt, Human
aagugcugggauuacaagc

SEQ ID NO: 393686 - RNA, 19 nt, Human
aagugcugggauuacaagc

SEQ ID NO: 393687 - RNA, 26 nt, Human
aagugcugggauuacaagcgugagcc

SEQ ID NO: 393688 - RNA, 18 nt, Human
acaggguuucacuauguu

SEQ ID NO: 393689 - RNA, 19 nt, Human
acaggguuucacuauguua

SEQ ID NO: 393690 - RNA, 20 nt, Human
acaggguuucacuauguuag

SEQ ID NO: 393691 - RNA, 24 nt, Human
acaggguuucacuauguuagccag

SEQ ID NO: 393692 - RNA, 20 nt, Human
acauauacauacacauagaa

SEQ ID NO: 393693 - RNA, 24 nt, Human
agugcugggauuacaagcgugagc

SEQ ID NO: 393694 - RNA, 19 nt, Human
auccacaugagaacacagg

SEQ ID NO: 393695 - RNA, 21 nt, Human
auguacauauacauacacaua

SEQ ID NO: 393696 - RNA, 24 nt, Human
caaagugcugggauuacaagcgug

SEQ ID NO: 393697 - RNA, 22 nt, Human
caccaugcccggccuccucugg

SEQ ID NO: 393698 - RNA, 24 nt, Human
caccucggccucccaaagugcugg

SEQ ID NO: 393699 - RNA, 18 nt, Human
cacuauguuagccaggau

SEQ ID NO: 393700 - RNA, 24 nt, Human
cacuauguuagccaggauggucuu

SEQ ID NO: 393701 - RNA, 24 nt, Human
caggguuucacuauguuagccagg

SEQ ID NO: 393702 - RNA, 24 nt, Human
cauuccuccuccuggcaagaaugg

SEQ ID NO: 393703 - RNA, 22 nt, Human
ccaaagugcugggauuacaagc

SEQ ID NO: 393704 - RNA, 24 nt, Human
ccaaagugcugggauuacaagcgu

SEQ ID NO: 393705 - RNA, 19 nt, Human
cccucccucauucuuuccc

SEQ ID NO: 393706 - RNA, 18 nt, Human
ccuccuguucuaaaucca

SEQ ID NO: 393707 - RNA, 18 nt, Human
ccuguucuaaauccacau

SEQ ID NO: 393708 - RNA, 19 nt, Human
cucauuccuccuccuggca

SEQ ID NO: 393709 - RNA, 22 nt, Human
cuccugaccucgugaucugccc

SEQ ID NO: 393710 - RNA, 24 nt, Human
cuccuggcaagaauggcauccuag

SEQ ID NO: 393711 - RNA, 22 nt, Human
cugaaacucagcuuguauaugc

SEQ ID NO: 393712 - RNA, 19 nt, Human
cugaaaggucuuccaugcu

SEQ ID NO: 393713 - RNA, 18 nt, Human
cuggcaagaauggcaucc

SEQ ID NO: 393714 - RNA, 22 nt, Human
gacacacauuagaauguacaua

SEQ ID NO: 393715 - RNA, 22 nt, Human
gaccucgugaucugcccaccuc

SEQ ID NO: 393716 - RNA, 22 nt, Human
gaccucgugaucugcccaccuc

SEQ ID NO: 393717 - RNA, 24 nt, Human
gaccucgugaucugcccaccucgg

SEQ ID NO: 393718 - RNA, 18 nt, Human
gauuacaagcgugagcca

SEQ ID NO: 393719 - RNA, 24 nt, Human
gauuacaagcgugagccaccaugc

SEQ ID NO: 393720 - RNA, 24 nt, Human
ggauuacaagcgugagccaccaug

SEQ ID NO: 393721 - RNA, 18 nt, Human
ggccuccucuggguaguu

SEQ ID NO: 393722 - RNA, 20 nt, Human
ggucuugaucuccugaccuc

SEQ ID NO: 393723 - RNA, 21 nt, Human
guaucauuauucccgaguggc

SEQ ID NO: 393724 - RNA, 24 nt, Human
gugaucugcccaccucggccuccc

SEQ ID NO: 393725 - RNA, 22 nt, Human
guucaaauugaauguuggccaa

SEQ ID NO: 393726 - RNA, 22 nt, Human
uaaaagcuaccagugucuucag

SEQ ID NO: 393727 - RNA, 22 nt, Human
uaaaugcccugaugcaugacug

SEQ ID NO: 393728 - RNA, 25 nt, Human
uaacuuuuuguauuuuuuaguagag

SEQ ID NO: 393729 - RNA, 26 nt, Human
uaacuuuuuguauuuuuuaguagaga

SEQ ID NO: 393730 - RNA, 19 nt, Human
uaagaagagacacacauua

SEQ ID NO: 393731 - RNA, 23 nt, Human
uacaagcgugagccaccaugccc

SEQ ID NO: 393732 - RNA, 22 nt, Human
uagagacaggguuucacuaugu

SEQ ID NO: 393733 - RNA, 24 nt, Human
uaguagagacaggguuucacuaug

SEQ ID NO: 393734 - RNA, 21 nt, Human
uauuaaaagcuaccagugucu

SEQ ID NO: 393735 - RNA, 22 nt, Human
ucaaaagaguaccuacuaaaga

SEQ ID NO: 393736 - RNA, 24 nt, Human
ucacuauguuagccaggauggucu

SEQ ID NO: 393737 - RNA, 18 nt, Human
ucccaaagugcugggauu

SEQ ID NO: 393738 - RNA, 24 nt, Human
ucccaaagugcugggauuacaagc

SEQ ID NO: 393739 - RNA, 18 nt, Human
ucggccucccaaagugcu

SEQ ID NO: 393740 - RNA, 22 nt, Human
ucuagcacaagggguaucaacu

SEQ ID NO: 393741 - RNA, 27 nt, Human
ucugugacagaaacauagccggggucc

SEQ ID NO: 393742 - RNA, 21 nt, Human
ucuugugguucuaguaaggau

SEQ ID NO: 393743 - RNA, 23 nt, Human
ugaaaggucuuccaugcucuguu

SEQ ID NO: 393744 - RNA, 21 nt, Human
ugacuuauucucccucccuca

SEQ ID NO: 393745 - RNA, 18 nt, Human
ugagaacacaggcaggcc

SEQ ID NO: 393746 - RNA, 24 nt, Human
ugaucugcccaccucggccuccca

SEQ ID NO: 393747 - RNA, 26 nt, Human
ugcccggccuccucuggguaguucug

SEQ ID NO: 393748 - RNA, 25 nt, Human
ugcugggauuacaagcgugagccac

SEQ ID NO: 393749 - RNA, 18 nt, Human
ugggauuacaagcgugag

SEQ ID NO: 393750 - RNA, 22 nt, Human
ugggauuacaagcgugagccac

SEQ ID NO: 393751 - RNA, 23 nt, Human
ugggauuacaagcgugagccacc

SEQ ID NO: 393752 - RNA, 24 nt, Human
ugggauuacaagcgugagccacca

SEQ ID NO: 393753 - RNA, 25 nt, Human
ugggauuacaagcgugagccaccau

SEQ ID NO: 393754 - RNA, 18 nt, Human
uguacauauacauacaca

SEQ ID NO: 393755 - RNA, 25 nt, Human
uguacauauacauacacauagaaua

SEQ ID NO: 393756 - RNA, 21 nt, Human
uuaguagagacaggguuucac

SEQ ID NO: 393757 - RNA, 24 nt, Human
uuaguagagacaggguuucacuau

SEQ ID NO: 393758 - RNA, 19 nt, Human
uuucacuauguuagccagg

SEQ ID NO: 393759 - RNA, 23 nt, Human
uuuuauaauuauuaaaagcuacc

SEQ ID NO: 393760 - RNA, 24 nt, Human
uuuuuaguagagacaggguuucac

SEQ ID NO: 393761 - RNA, 22 nt, Human
uuuuuguauuuuuuaguagaga

SEQ ID NO: 393762 - RNA, 24 nt, Human
uuuuuguauuuuuuaguagagaca

SEQ ID NO: 393763 - RNA, 23 nt, Human
uuuuuuaguagagacaggguuuc

SEQ ID NO: 393764 - RNA, 18 nt, Human
aaacaaaaugcagugauc

SEQ ID NO: 393765 - RNA, 22 nt, Human
aaacaaaaugcagugaucaaaa

SEQ ID NO: 393766 - RNA, 19 nt, Human
aauggguuacguuacaggg

SEQ ID NO: 393767 - RNA, 21 nt, Human
acagacacaaaauagguuaac

SEQ ID NO: 393768 - RNA, 21 nt, Human
acagagagaaacucugucuua

SEQ ID NO: 393769 - RNA, 24 nt, Human
acagagagaaacucugucuuaaaa

SEQ ID NO: 393770 - RNA, 24 nt, Human
accagcauggugaaaccccgccuc

SEQ ID NO: 393771 - RNA, 24 nt, Human
accccgccucuacuaaaaauacaa

SEQ ID NO: 393772 - RNA, 24 nt, Human
acugcacuccagccugggcaacag

SEQ ID NO: 393773 - RNA, 24 nt, Human
acugcacuccagccugggcaacag

SEQ ID NO: 393774 - RNA, 23 nt, Human
agaaucuuguauuuaggcaucag

SEQ ID NO: 393775 - RNA, 23 nt, Human
agagguucagugagcugaaauug

SEQ ID NO: 393776 - RNA, 24 nt, Human
agcacuuugggaggccgagguggg

SEQ ID NO: 393777 - RNA, 20 nt, Human
agcauggugaaaccccgccu

SEQ ID NO: 393778 - RNA, 24 nt, Human
agccugggcaacagagagaaacuc

SEQ ID NO: 393779 - RNA, 21 nt, Human
agcuggcugguggugugugcc

SEQ ID NO: 393780 - RNA, 18 nt, Human
aggcagagguucagugag

SEQ ID NO: 393781 - RNA, 22 nt, Human
aggcaggacgcaguggcucacg

SEQ ID NO: 393782 - RNA, 18 nt, Human
aggcaggagaaucacuug

SEQ ID NO: 393783 - RNA, 21 nt, Human
aggcaggagaaucacuugacc

SEQ ID NO: 393784 - RNA, 24 nt, Human
aggcaggagaaucacuugaccugg

SEQ ID NO: 393785 - RNA, 20 nt, Human
aggccgagguggguggauca

SEQ ID NO: 393786 - RNA, 24 nt, Human
aggcugaggcaggagaaucacuug

SEQ ID NO: 393787 - RNA, 23 nt, Human
agguauguaugaccuuguuuauu

SEQ ID NO: 393788 - RNA, 24 nt, Human
agguggguggaucaugaagucagg

SEQ ID NO: 393789 - RNA, 24 nt, Human
aguggcucacgucuguaaucucag

SEQ ID NO: 393790 - RNA, 24 nt, Human
agugucuauuauucccauggguac

SEQ ID NO: 393791 - RNA, 24 nt, Human
auugcgccacugcacuccagccug

SEQ ID NO: 393792 - RNA, 24 nt, Human
auuuuugucaaaguuuaaacacug

SEQ ID NO: 393793 - RNA, 18 nt, Human
caaaaugauucuugcuaa

SEQ ID NO: 393794 - RNA, 20 nt, Human
caaguuucaaacaaaaugca

SEQ ID NO: 393795 - RNA, 22 nt, Human
cacaaaaugauucuugcuaaua

SEQ ID NO: 393796 - RNA, 24 nt, Human
cacgucuguaaucucagcacuuug

SEQ ID NO: 393797 - RNA, 19 nt, Human
cacugcacuccagccuggg

SEQ ID NO: 393798 - RNA, 21 nt, Human
cacugcacuccagccugggca

SEQ ID NO: 393799 - RNA, 22 nt, Human
cacugcacuccagccugggcaa

SEQ ID NO: 393800 - RNA, 23 nt, Human
cacugcacuccagccugggcaac

SEQ ID NO: 393801 - RNA, 24 nt, Human
cacugcacuccagccugggcaaca

SEQ ID NO: 393802 - RNA, 24 nt, Human
cagcacuuugggaggccgaggugg

SEQ ID NO: 393803 - RNA, 20 nt, Human
cagcauggugaaaccccgcc

SEQ ID NO: 393804 - RNA, 22 nt, Human
cagccugggcaacagagagaaa

SEQ ID NO: 393805 - RNA, 18 nt, Human
cauggugaaaccccgccu

SEQ ID NO: 393806 - RNA, 19 nt, Human
cauggugaaaccccgccuc

SEQ ID NO: 393807 - RNA, 21 nt, Human
cauggugaaaccccgccucua

SEQ ID NO: 393808 - RNA, 20 nt, Human
ccacugcacuccagccuggg

SEQ ID NO: 393809 - RNA, 20 nt, Human
ccacugcacuccagccuggg

SEQ ID NO: 393810 - RNA, 21 nt, Human
ccacugcacuccagccugggc

SEQ ID NO: 393811 - RNA, 23 nt, Human
ccacugcacuccagccugggcaa

SEQ ID NO: 393812 - RNA, 24 nt, Human
ccacugcacuccagccugggcaac

SEQ ID NO: 393813 - RNA, 19 nt, Human
cccagugucuauuauuccc

SEQ ID NO: 393814 - RNA, 18 nt, Human
ccccacccuaccucccca

SEQ ID NO: 393815 - RNA, 18 nt, Human
cccuaccuccccaguguc

SEQ ID NO: 393816 - RNA, 22 nt, Human
ccugaccagcauggugaaaccc

SEQ ID NO: 393817 - RNA, 23 nt, Human
ccugaccagcauggugaaacccc

SEQ ID NO: 393818 - RNA, 24 nt, Human
ccugaccagcauggugaaaccccg

SEQ ID NO: 393819 - RNA, 24 nt, Human
ccugggaggcagagguucagugag

SEQ ID NO: 393820 - RNA, 21 nt, Human
ccuguaaucccagcuacucag

SEQ ID NO: 393821 - RNA, 22 nt, Human
ccuguaaucccagcuacucaga

SEQ ID NO: 393822 - RNA, 22 nt, Human
cgagguggguggaucaugaagu

SEQ ID NO: 393823 - RNA, 24 nt, Human
cgagguggguggaucaugaaguca

SEQ ID NO: 393824 - RNA, 24 nt, Human
cgccacugcacuccagccugggca

SEQ ID NO: 393825 - RNA, 22 nt, Human
cgcuccccacccuaccucccca

SEQ ID NO: 393826 - RNA, 24 nt, Human
cucacgucuguaaucucagcacuu

SEQ ID NO: 393827 - RNA, 20 nt, Human
cuccccacccuaccucccca

SEQ ID NO: 393828 - RNA, 20 nt, Human
cucuacuaaaaauacaaaaa

SEQ ID NO: 393829 - RNA, 21 nt, Human
cuguaaucucagcacuuuggg

SEQ ID NO: 393830 - RNA, 19 nt, Human
cuucgucccgcuccccacc

SEQ ID NO: 393831 - RNA, 21 nt, Human
gaaaauucauuuuaggcagga

SEQ ID NO: 393832 - RNA, 24 nt, Human
gaaucacuugaccugggaggcaga

SEQ ID NO: 393833 - RNA, 23 nt, Human
gacgcaguggcucacgucuguaa

SEQ ID NO: 393834 - RNA, 22 nt, Human
gagaaucacuugaccugggagg

SEQ ID NO: 393835 - RNA, 18 nt, Human
gauacuaaauguggcagg

SEQ ID NO: 393836 - RNA, 22 nt, Human
gaucauaguuaauaccaauuua

SEQ ID NO: 393837 - RNA, 24 nt, Human
gaucaugaagucaggaguuggaga

SEQ ID NO: 393838 - RNA, 22 nt, Human
gauuuggggguggggauacuaa

SEQ ID NO: 393839 - RNA, 23 nt, Human
gauuuuuauuuuagauucaggaa

SEQ ID NO: 393840 - RNA, 21 nt, Human
gcaggagaaucacuugaccug

SEQ ID NO: 393841 - RNA, 22 nt, Human
gccacugcacuccagccugggc

SEQ ID NO: 393842 - RNA, 24 nt, Human
gccacugcacuccagccugggcaa

SEQ ID NO: 393843 - RNA, 24 nt, Human
ggguggaucaugaagucaggaguu

SEQ ID NO: 393844 - RNA, 24 nt, Human
gguggugugugccuguaaucccag

SEQ ID NO: 393845 - RNA, 19 nt, Human
gucacagaaaaauacugua

SEQ ID NO: 393846 - RNA, 21 nt, Human
gugaaaccccgccucuacuaa

SEQ ID NO: 393847 - RNA, 24 nt, Human
guggugugugccuguaaucccagc

SEQ ID NO: 393848 - RNA, 22 nt, Human
uaauaguacaaauuuuguccca

SEQ ID NO: 393849 - RNA, 19 nt, Human
uacaugaaacuacugaaag

SEQ ID NO: 393850 - RNA, 22 nt, Human
uagcauaugcuuuaacucuggu

SEQ ID NO: 393851 - RNA, 23 nt, Human
ucaaacaaaaugcagugaucaaa

SEQ ID NO: 393852 - RNA, 21 nt, Human
ucacccagguagugagcacag

SEQ ID NO: 393853 - RNA, 23 nt, Human
ucacuugaccugggaggcagagg

SEQ ID NO: 393854 - RNA, 24 nt, Human
ucacuugaccugggaggcagaggu

SEQ ID NO: 393855 - RNA, 24 nt, Human
ucagaggcugaggcaggagaauca

SEQ ID NO: 393856 - RNA, 18 nt, Human
ucagugagcugaaauugc

SEQ ID NO: 393857 - RNA, 19 nt, Human
ucaugcuuauagguuacuc

SEQ ID NO: 393858 - RNA, 23 nt, Human
ucauuaauugauggucacagaaa

SEQ ID NO: 393859 - RNA, 24 nt, Human
ucccauggguacucagguauuacu

SEQ ID NO: 393860 - RNA, 24 nt, Human
uccccaguagguaaguuuuucagc

SEQ ID NO: 393861 - RNA, 22 nt, Human
uccccagugucuauuauuccca

SEQ ID NO: 393862 - RNA, 18 nt, Human
uccugucacccagguagu

SEQ ID NO: 393863 - RNA, 24 nt, Human
ugaaauugcgccacugcacuccag

SEQ ID NO: 393864 - RNA, 18 nt, Human
ugaccagcauggugaaac

SEQ ID NO: 393865 - RNA, 22 nt, Human
ugagcugaaauugcgccacugc

SEQ ID NO: 393866 - RNA, 20 nt, Human
ugaggcaggagaaucacuug

SEQ ID NO: 393867 - RNA, 19 nt, Human
ugccuguaaucccagcuac

SEQ ID NO: 393868 - RNA, 18 nt, Human
uggaauuuuuuuuuuuuc

SEQ ID NO: 393869 - RNA, 22 nt, Human
uggcucacgucuguaaucucag

SEQ ID NO: 393870 - RNA, 24 nt, Human
uggcucacgucuguaaucucagca

SEQ ID NO: 393871 - RNA, 23 nt, Human
ugggaggccgagguggguggauc

SEQ ID NO: 393872 - RNA, 24 nt, Human
ugggaggccgagguggguggauca

SEQ ID NO: 393873 - RNA, 20 nt, Human
uggggauacuaaauguggca

SEQ ID NO: 393874 - RNA, 24 nt, Human
ugggguacguaugauccugucacc

SEQ ID NO: 393875 - RNA, 23 nt, Human
uggguggaucaugaagucaggag

SEQ ID NO: 393876 - RNA, 24 nt, Human
ugguggugugugccuguaauccca

SEQ ID NO: 393877 - RNA, 21 nt, Human
uggugugugccuguaauccca

SEQ ID NO: 393878 - RNA, 22 nt, Human
uggugugugccuguaaucccag

SEQ ID NO: 393879 - RNA, 24 nt, Human
uggugugugccuguaaucccagcu

SEQ ID NO: 393880 - RNA, 21 nt, Human
ugucaaaguuuaaacacugga

SEQ ID NO: 393881 - RNA, 22 nt, Human
uuagcuggcugguggugugugc

SEQ ID NO: 393882 - RNA, 21 nt, Human
uucagugagcugaaauugcgc

SEQ ID NO: 393883 - RNA, 21 nt, Human
uugaggucagccuacagacac

SEQ ID NO: 393884 - RNA, 23 nt, Human
uugcgccacugcacuccagccug

SEQ ID NO: 393885 - RNA, 25 nt, Human
uugggaggccgagguggguggauca

SEQ ID NO: 393886 - RNA, 18 nt, Human
uuucaaacaaaaugcagu

SEQ ID NO: 393887 - RNA, 21 nt, Human
uuuggggguggggauacuaaa

SEQ ID NO: 393888 - RNA, 20 nt, Human
uuuuucuuuuuuaaaaaaau

SEQ ID NO: 393889 - RNA, 19 nt, Human
aaaaaaaaaaagaaaaaga

SEQ ID NO: 393890 - RNA, 24 nt, Human
aaaaaaaaaaagaaaaagaaagaa

SEQ ID NO: 393891 - RNA, 18 nt, Human
aacacaguacaaaaggag

SEQ ID NO: 393892 - RNA, 19 nt, Human
aacacggugaaaccccguc

SEQ ID NO: 393893 - RNA, 20 nt, Human
aacacggugaaaccccgucu

SEQ ID NO: 393894 - RNA, 21 nt, Human
aacacggugaaaccccgucuc

SEQ ID NO: 393895 - RNA, 18 nt, Human
aaccuggguucauaacag

SEQ ID NO: 393896 - RNA, 22 nt, Human
aagaaaaagaaagaaagagcag

SEQ ID NO: 393897 - RNA, 23 nt, Human
aagaaacagcagaugccaggcgc

SEQ ID NO: 393898 - RNA, 23 nt, Human
aagaggcaggggacagggggcag

SEQ ID NO: 393899 - RNA, 21 nt, Human
aagcaaccauuucacaaagaa

SEQ ID NO: 393900 - RNA, 22 nt, Human
acaacacaguacaaaaggagaa

SEQ ID NO: 393901 - RNA, 24 nt, Human
acagagcgagacucugucucaaaa

SEQ ID NO: 393902 - RNA, 24 nt, Human
accccgucucuacuaaaaauacaa

SEQ ID NO: 393903 - RNA, 18 nt, Human
acgccacugcacuccagc

SEQ ID NO: 393904 - RNA, 22 nt, Human
acgccacugcacuccagccugg

SEQ ID NO: 393905 - RNA, 24 nt, Human
acugcacuccagccugggugacag

SEQ ID NO: 393906 - RNA, 26 nt, Human
acugcacuccagccugggugacagag

SEQ ID NO: 393907 - RNA, 22 nt, Human
agaaguggaggauuaaccugcc

SEQ ID NO: 393908 - RNA, 20 nt, Human
agacacgaacacagcacaaa

SEQ ID NO: 393909 - RNA, 24 nt, Human
agacggaggucgcagugagccgag

SEQ ID NO: 393910 - RNA, 21 nt, Human
agaggcaggggacagggggca

SEQ ID NO: 393911 - RNA, 22 nt, Human
agaggcaggggacagggggcag

SEQ ID NO: 393912 - RNA, 24 nt, Human
agaugccaggcgcgguggcucaug

SEQ ID NO: 393913 - RNA, 24 nt, Human
agcacuuugggaggccgaguuggg

SEQ ID NO: 393914 - RNA, 24 nt, Human
agccugggugacagagcgagacuc

SEQ ID NO: 393915 - RNA, 21 nt, Human
agcuucugaaagaaacagcag

SEQ ID NO: 393916 - RNA, 24 nt, Human
aggcaggagaauggcgugagcccg

SEQ ID NO: 393917 - RNA, 22 nt, Human
aggcaggggacagggggcaggg

SEQ ID NO: 393918 - RNA, 23 nt, Human
aggcaggggacagggggcagggg

SEQ ID NO: 393919 - RNA, 21 nt, Human
aggccgaguuggguggaucac

SEQ ID NO: 393920 - RNA, 24 nt, Human
aggcgcgguggcucaugccuguaa

SEQ ID NO: 393921 - RNA, 19 nt, Human
aggcugaggcaggagaaug

SEQ ID NO: 393922 - RNA, 24 nt, Human
aguuggguggaucacgaggucagg

SEQ ID NO: 393923 - RNA, 22 nt, Human
aucaccauuuuaccaaaaaaca

SEQ ID NO: 393924 - RNA, 24 nt, Human
aucacgccacugcacuccagccug

SEQ ID NO: 393925 - RNA, 19 nt, Human
augccuguaaucccagcac

SEQ ID NO: 393926 - RNA, 20 nt, Human
auggcgugagcccgggagac

SEQ ID NO: 393927 - RNA, 24 nt, Human
caaaaaacacacugguucaaccac

SEQ ID NO: 393928 - RNA, 20 nt, Human
caaaugccaaggcagacagg

SEQ ID NO: 393929 - RNA, 19 nt, Human
caacacaguacaaaaggag

SEQ ID NO: 393930 - RNA, 22 nt, Human
cacaacacaguacaaaaggaga

SEQ ID NO: 393931 - RNA, 22 nt, Human
cacuccagccugggugacagag

SEQ ID NO: 393932 - RNA, 24 nt, Human
cacuccagccugggugacagagcg

SEQ ID NO: 393933 - RNA, 19 nt, Human
cacugcacuccagccuggg

SEQ ID NO: 393934 - RNA, 19 nt, Human
cacugcacuccagccuggg

SEQ ID NO: 393935 - RNA, 22 nt, Human
cacugcacuccagccuggguga

SEQ ID NO: 393936 - RNA, 23 nt, Human
cacugcacuccagccugggugac

SEQ ID NO: 393937 - RNA, 24 nt, Human
cacugcacuccagccugggugaca

SEQ ID NO: 393938 - RNA, 24 nt, Human
cacugcacuccagccugggugaca

SEQ ID NO: 393939 - RNA, 21 nt, Human
cagaaaacacuuuacugaaau

SEQ ID NO: 393940 - RNA, 20 nt, Human
cagcacuuugggaggccgag

SEQ ID NO: 393941 - RNA, 26 nt, Human
cagcacuuugggaggccgaguugggu

SEQ ID NO: 393942 - RNA, 24 nt, Human
cagcuacucgggaggcugaggcag

SEQ ID NO: 393943 - RNA, 20 nt, Human
ccacugcacuccagccuggg

SEQ ID NO: 393944 - RNA, 20 nt, Human
ccacugcacuccagccuggg

SEQ ID NO: 393945 - RNA, 21 nt, Human
ccacugcacuccagccugggu

SEQ ID NO: 393946 - RNA, 21 nt, Human
ccacugcacuccagccugggu

SEQ ID NO: 393947 - RNA, 23 nt, Human
ccacugcacuccagccuggguga

SEQ ID NO: 393948 - RNA, 23 nt, Human
ccacugcacuccagccuggguga

SEQ ID NO: 393949 - RNA, 24 nt, Human
ccacugcacuccagccugggugac

SEQ ID NO: 393950 - RNA, 18 nt, Human
ccagugcaagacacgaac

SEQ ID NO: 393951 - RNA, 20 nt, Human
ccgcccucccggccgggccg

SEQ ID NO: 393952 - RNA, 19 nt, Human
ccgcgcgcccuccccgccc

SEQ ID NO: 393953 - RNA, 22 nt, Human
ccgcgcgcccuccccgcccucc

SEQ ID NO: 393954 - RNA, 18 nt, Human
ccggaagcggggcccgcc

SEQ ID NO: 393955 - RNA, 23 nt, Human
ccuggcuaacacggugaaacccc

SEQ ID NO: 393956 - RNA, 24 nt, Human
ccuggcuaacacggugaaaccccg

SEQ ID NO: 393957 - RNA, 22 nt, Human
ccugggugacagagcgagacuc

SEQ ID NO: 393958 - RNA, 20 nt, Human
ccuguaaucccagcacuuug

SEQ ID NO: 393959 - RNA, 19 nt, Human
ccuguagucccagcuacuc

SEQ ID NO: 393960 - RNA, 21 nt, Human
ccuguagucccagcuacucgg

SEQ ID NO: 393961 - RNA, 22 nt, Human
ccuguagucccagcuacucggg

SEQ ID NO: 393962 - RNA, 24 nt, Human
cgagaccauccuggcuaacacggu

SEQ ID NO: 393963 - RNA, 24 nt, Human
cgagaucacgccacugcacuccag

SEQ ID NO: 393964 - RNA, 24 nt, Human
cgaguuggguggaucacgagguca

SEQ ID NO: 393965 - RNA, 19 nt, Human
cgcccgggccggaagcggg

SEQ ID NO: 393966 - RNA, 21 nt, Human
cgccgcgcgcccuccccgccc

SEQ ID NO: 393967 - RNA, 22 nt, Human
cgccgcgcgcccuccccgcccu

SEQ ID NO: 393968 - RNA, 22 nt, Human
cuaauagacuucaccauuuccu

SEQ ID NO: 393969 - RNA, 24 nt, Human
cuacaaucaccauuuuaccaaaaa

SEQ ID NO: 393970 - RNA, 18 nt, Human
cucaaaaaaaaaaaaaaa

SEQ ID NO: 393971 - RNA, 26 nt, Human
cucaaaaaaaaaaaaaaaagaaaaag

SEQ ID NO: 393972 - RNA, 24 nt, Human
cucaugccuguaaucccagcacuu

SEQ ID NO: 393973 - RNA, 19 nt, Human
cucugucucaaaaaaaaaa

SEQ ID NO: 393974 - RNA, 18 nt, Human
cuggcuaacacggugaaa

SEQ ID NO: 393975 - RNA, 22 nt, Human
gaacuaaucuuaucuacaauca

SEQ ID NO: 393976 - RNA, 24 nt, Human
gacagagcgagacucugucucaaa

SEQ ID NO: 393977 - RNA, 22 nt, Human
gaggucgcagugagccgagauc

SEQ ID NO: 393978 - RNA, 20 nt, Human
gaucgccgcgcgcccucccc

SEQ ID NO: 393979 - RNA, 24 nt, Human
gauggcgggcgccuguagucccag

SEQ ID NO: 393980 - RNA, 24 nt, Human
gcacuccagccugggugacagagc

SEQ ID NO: 393981 - RNA, 19 nt, Human
gccacugcacuccagccug

SEQ ID NO: 393982 - RNA, 24 nt, Human
gccacugcacuccagccuggguga

SEQ ID NO: 393983 - RNA, 20 nt, Human
gccgagaucacgccacugca

SEQ ID NO: 393984 - RNA, 23 nt, Human
gccuguagucccagcuacucggg

SEQ ID NO: 393985 - RNA, 24 nt, Human
gcuaacacggugaaaccccgucuc

SEQ ID NO: 393986 - RNA, 22 nt, Human
gcugaggcaggagaauggcgug

SEQ ID NO: 393987 - RNA, 21 nt, Human
ggaaaagaggcaggggacagg

SEQ ID NO: 393988 - RNA, 24 nt, Human
ggacagggggcaggggaucaggga

SEQ ID NO: 393989 - RNA, 22 nt, Human
ggaccucccccacgucgaagga

SEQ ID NO: 393990 - RNA, 18 nt, Human
ggaggucgcagugagccg

SEQ ID NO: 393991 - RNA, 24 nt, Human
ggaggucgcagugagccgagauca

SEQ ID NO: 393992 - RNA, 18 nt, Human
ggcgugauggcgggcgcc

SEQ ID NO: 393993 - RNA, 22 nt, Human
ggcgugauggcgggcgccugua

SEQ ID NO: 393994 - RNA, 24 nt, Human
gggacagggggcaggggaucaggg

SEQ ID NO: 393995 - RNA, 20 nt, Human
gggaggccgaguugggugga

SEQ ID NO: 393996 - RNA, 21 nt, Human
gguggaucacgaggucaggag

SEQ ID NO: 393997 - RNA, 23 nt, Human
gguggcucaugccuguaauccca

SEQ ID NO: 393998 - RNA, 24 nt, Human
gguggcucaugccuguaaucccag

SEQ ID NO: 393999 - RNA, 24 nt, Human
gugacagagcgagacucugucuca

SEQ ID NO: 394000 - RNA, 22 nt, Human
guggaggauuaaccugccuaca

SEQ ID NO: 394001 - RNA, 22 nt, Human
uaacacggugaaaccccgucuc

SEQ ID NO: 394002 - RNA, 24 nt, Human
uaacacggugaaaccccgucucua

SEQ ID NO: 394003 - RNA, 22 nt, Human
uaagcaaaccacuaaagaaggg

SEQ ID NO: 394004 - RNA, 24 nt, Human
uacucacauugcugguuuuaacag

SEQ ID NO: 394005 - RNA, 24 nt, Human
uagcccagcagauguugacagcaa

SEQ ID NO: 394006 - RNA, 22 nt, Human
ucaaaaaaaaaaaaaaaagaaa

SEQ ID NO: 394007 - RNA, 24 nt, Human
ucaaaaaaaaaaaaaaaagaaaaa

SEQ ID NO: 394008 - RNA, 18 nt, Human
ucacgaggucaggagauc

SEQ ID NO: 394009 - RNA, 24 nt, Human
ucacgaggucaggagaucgagacc

SEQ ID NO: 394010 - RNA, 23 nt, Human
ucacgccacugcacuccagccug

SEQ ID NO: 394011 - RNA, 22 nt, Human
ucaugccuguaaucccagcacu

SEQ ID NO: 394012 - RNA, 23 nt, Human
uccagccugggugacagagcgag

SEQ ID NO: 394013 - RNA, 24 nt, Human
uccagccugggugacagagcgaga

SEQ ID NO: 394014 - RNA, 24 nt, Human
uccgaucgccgcgcgcccuccccg

SEQ ID NO: 394015 - RNA, 20 nt, Human
ucgcagugagccgagaucac

SEQ ID NO: 394016 - RNA, 20 nt, Human
ucgccgcgcgcccuccccgc

SEQ ID NO: 394017 - RNA, 22 nt, Human
ucgccgcgcgcccuccccgccc

SEQ ID NO: 394018 - RNA, 18 nt, Human
ucucaaaaaaaaaaaaaa

SEQ ID NO: 394019 - RNA, 24 nt, Human
ucucuacuaaaaauacaaaacauu

SEQ ID NO: 394020 - RNA, 23 nt, Human
ucuggcacugcacaagcugugug

SEQ ID NO: 394021 - RNA, 23 nt, Human
ucugucucaaaaaaaaaaaaaaa

SEQ ID NO: 394022 - RNA, 18 nt, Human
ugacagcaaaugccaagg

SEQ ID NO: 394023 - RNA, 22 nt, Human
ugagccgagaucacgccacugc

SEQ ID NO: 394024 - RNA, 23 nt, Human
ugaggcaggagaauggcgugagc

SEQ ID NO: 394025 - RNA, 24 nt, Human
ugaggcaggagaauggcgugagcc

SEQ ID NO: 394026 - RNA, 25 nt, Human
ugaggcaggagaauggcgugagccc

SEQ ID NO: 394027 - RNA, 24 nt, Human
ugauggcgggcgccuguaguccca

SEQ ID NO: 394028 - RNA, 20 nt, Human
ugcaagacacgaacacagca

SEQ ID NO: 394029 - RNA, 19 nt, Human
ugccaaggcagacaggucu

SEQ ID NO: 394030 - RNA, 21 nt, Human
ugccaaggcagacaggucuag

SEQ ID NO: 394031 - RNA, 23 nt, Human
ugccuguaaucccagcacuuugg

SEQ ID NO: 394032 - RNA, 24 nt, Human
ugccuguaaucccagcacuuuggg

SEQ ID NO: 394033 - RNA, 24 nt, Human
ugcuccugugaauucuguggaaau

SEQ ID NO: 394034 - RNA, 18 nt, Human
uggaaaugggaccucccc

SEQ ID NO: 394035 - RNA, 22 nt, Human
uggcucaugccuguaaucccag

SEQ ID NO: 394036 - RNA, 24 nt, Human
uggcucaugccuguaaucccagca

SEQ ID NO: 394037 - RNA, 19 nt, Human
ugggaggccgaguugggug

SEQ ID NO: 394038 - RNA, 24 nt, Human
ugggaggccgaguuggguggauca

SEQ ID NO: 394039 - RNA, 23 nt, Human
uggguucauaacagacuaaguuc

SEQ ID NO: 394040 - RNA, 21 nt, Human
uuccucggcugugacgccgcu

SEQ ID NO: 394041 - RNA, 22 nt, Human
uuggcucugcuucuuagcucca

SEQ ID NO: 394042 - RNA, 20 nt, Human
uuuuuuuuuuaaaaaaagau

SEQ ID NO: 394043 - RNA, 23 nt, Human
uuuuuuuuuuuuaaaaaaagauu

SEQ ID NO: 394044 - RNA, 18 nt, Human
acagcaccuccccccaau

SEQ ID NO: 394045 - RNA, 25 nt, Human
acguagagcccggcgugacagggcu

SEQ ID NO: 394046 - RNA, 24 nt, Human
agcgccagccuguggggaagugaa

SEQ ID NO: 394047 - RNA, 19 nt, Human
aggcaaaggagggcagggc

SEQ ID NO: 394048 - RNA, 19 nt, Human
aucuggggauggacuauuc

SEQ ID NO: 394049 - RNA, 22 nt, Human
cagagcucccaggguccuucuc

SEQ ID NO: 394050 - RNA, 22 nt, Human
cagggcacaccuuuggucacuc

SEQ ID NO: 394051 - RNA, 21 nt, Human
cagggcgaggggugaacaaug

SEQ ID NO: 394052 - RNA, 18 nt, Human
cagggucuccaccuggau

SEQ ID NO: 394053 - RNA, 18 nt, Human
ccacagcaccucccccca

SEQ ID NO: 394054 - RNA, 19 nt, Human
ccacagggacccccaucca

SEQ ID NO: 394055 - RNA, 21 nt, Human
ccagcggugcgggccugggug

SEQ ID NO: 394056 - RNA, 20 nt, Human
ccagggcuucccacgugcgc

SEQ ID NO: 394057 - RNA, 23 nt, Human
ccaggguccuucucagggucucc

SEQ ID NO: 394058 - RNA, 18 nt, Human
cccacagcaccucccccc

SEQ ID NO: 394059 - RNA, 18 nt, Human
cccccauccaggugcagg

SEQ ID NO: 394060 - RNA, 21 nt, Human
ccgccccucccucccugggac

SEQ ID NO: 394061 - RNA, 21 nt, Human
ccucagccggacacucagccu

SEQ ID NO: 394062 - RNA, 18 nt, Human
ccuccccccaauuugacc

SEQ ID NO: 394063 - RNA, 22 nt, Human
cggccaaacacucacucaggcc

SEQ ID NO: 394064 - RNA, 19 nt, Human
cgggccugggugugggccg

SEQ ID NO: 394065 - RNA, 25 nt, Human
cucaggccucagccggacacucagc

SEQ ID NO: 394066 - RNA, 26 nt, Human
cucauauauucaguauuuuacuccca

SEQ ID NO: 394067 - RNA, 24 nt, Human
cucggccaaacacucacucaggcc

SEQ ID NO: 394068 - RNA, 20 nt, Human
cuggcccugggguggagccg

SEQ ID NO: 394069 - RNA, 18 nt, Human
gaaggcaaaggagggcag

SEQ ID NO: 394070 - RNA, 24 nt, Human
gaagugaagacggcaggugugcug

SEQ ID NO: 394071 - RNA, 24 nt, Human
gagccgagcgccagccugugggga

SEQ ID NO: 394072 - RNA, 24 nt, Human
gagggcagggcgaggggugaacaa

SEQ ID NO: 394073 - RNA, 20 nt, Human
gcacaccuuuggucacucca

SEQ ID NO: 394074 - RNA, 22 nt, Human
gccggacacucagccuucagcc

SEQ ID NO: 394075 - RNA, 20 nt, Human
gcugcuggugucugcucucg

SEQ ID NO: 394076 - RNA, 22 nt, Human
ggaaggcaaaggagggcagggc

SEQ ID NO: 394077 - RNA, 20 nt, Human
ggcgugacagggcugcuggu

SEQ ID NO: 394078 - RNA, 23 nt, Human
ggggaguggaagccgggcuccug

SEQ ID NO: 394079 - RNA, 19 nt, Human
gggguggaaggcaaaggag

SEQ ID NO: 394080 - RNA, 24 nt, Human
gucacuccaaauucccagagcucc

SEQ ID NO: 394081 - RNA, 25 nt, Human
uauguggggaguggaagccgggcuc

SEQ ID NO: 394082 - RNA, 26 nt, Human
uauuuuacucccacagcaccuccccc

SEQ ID NO: 394083 - RNA, 26 nt, Human
uccaggugcaggguccucgggccgac

SEQ ID NO: 394084 - RNA, 25 nt, Human
ucccagagcucccaggguccuucuc

SEQ ID NO: 394085 - RNA, 18 nt, Human
ucccagcggugcgggccu

SEQ ID NO: 394086 - RNA, 21 nt, Human
ucccagcggugcgggccuggg

SEQ ID NO: 394087 - RNA, 22 nt, Human
ugacccacagggacccccaucc

SEQ ID NO: 394088 - RNA, 19 nt, Human
ugaggaaaagcuggcccug

SEQ ID NO: 394089 - RNA, 22 nt, Human
ugaggaaaagcuggcccugggg

SEQ ID NO: 394090 - RNA, 25 nt, Human
ugaggaaaagcuggcccuggggugg

SEQ ID NO: 394091 - RNA, 23 nt, Human
uggugucugcucucggccuggcu

SEQ ID NO: 394092 - RNA, 22 nt, Human
ugugcuggacacucagcccuug

SEQ ID NO: 394093 - RNA, 30 nt, Human
aaaaaaauagagaaaugcaauaaagaaaaa

SEQ ID NO: 394094 - RNA, 22 nt, Human
aaaaaccaugcaaaaaaaaucu

SEQ ID NO: 394095 - RNA, 20 nt, Human
aaaagcaaauggguggcuug

SEQ ID NO: 394096 - RNA, 21 nt, Human
aaagugugugggucaggcaug

SEQ ID NO: 394097 - RNA, 23 nt, Human
aaauggaauagagacaugaaguu

SEQ ID NO: 394098 - RNA, 19 nt, Human
aacauggugaaaaccuguc

SEQ ID NO: 394099 - RNA, 20 nt, Human
aacauggugaaaaccugucu

SEQ ID NO: 394100 - RNA, 19 nt, Human
aacuaggaaugcucaucuu

SEQ ID NO: 394101 - RNA, 23 nt, Human
aagcuauggaaagauacaauuau

SEQ ID NO: 394102 - RNA, 25 nt, Human
aaggcaggcggaucaucugagguca

SEQ ID NO: 394103 - RNA, 24 nt, Human
aagugcaaucaauauaaaucauag

SEQ ID NO: 394104 - RNA, 23 nt, Human
aauugcucaaaauaaaaaaaaaa

SEQ ID NO: 394105 - RNA, 22 nt, Human
acaagugaagacauuugauaua

SEQ ID NO: 394106 - RNA, 23 nt, Human
acacugcauuucucuuugucaaa

SEQ ID NO: 394107 - RNA, 18 nt, Human
agagaaaugcaauaaaga

SEQ ID NO: 394108 - RNA, 22 nt, Human
agagaaaugcaauaaagaaaaa

SEQ ID NO: 394109 - RNA, 24 nt, Human
agccuggcuaacauggugaaaacc

SEQ ID NO: 394110 - RNA, 18 nt, Human
agcuauggaaagauacaa

SEQ ID NO: 394111 - RNA, 20 nt, Human
aggaaagaauaaaaaccaug

SEQ ID NO: 394112 - RNA, 20 nt, Human
aggaguuugagaccagccug

SEQ ID NO: 394113 - RNA, 19 nt, Human
aggcaggagaauugcucaa

SEQ ID NO: 394114 - RNA, 26 nt, Human
aggcaggcggaucaucugaggucagg

SEQ ID NO: 394115 - RNA, 20 nt, Human
aggcugaggcaggagaauug

SEQ ID NO: 394116 - RNA, 21 nt, Human
aggcugaggcaggagaauugc

SEQ ID NO: 394117 - RNA, 18 nt, Human
auaaaauauucaaggcca

SEQ ID NO: 394118 - RNA, 18 nt, Human
auccaagcuuccaaaaau

SEQ ID NO: 394119 - RNA, 24 nt, Human
auccgggaucccacggccggguuc

SEQ ID NO: 394120 - RNA, 24 nt, Human
aucugaggucaggaguuugagacc

SEQ ID NO: 394121 - RNA, 23 nt, Human
augaagaaaaaauggccaaaaaa

SEQ ID NO: 394122 - RNA, 24 nt, Human
augccaccucugccuaaaucagga

SEQ ID NO: 394123 - RNA, 24 nt, Human
caaggcaggcggaucaucugaggu

SEQ ID NO: 394124 - RNA, 24 nt, Human
cacaccuguaaucccagcacuuug

SEQ ID NO: 394125 - RNA, 19 nt, Human
caccuguaaucccagcacu

SEQ ID NO: 394126 - RNA, 24 nt, Human
caccuguaaucccagcacuuuggg

SEQ ID NO: 394127 - RNA, 22 nt, Human
caccuguaaucccagcuauuug

SEQ ID NO: 394128 - RNA, 23 nt, Human
caccuguaaucccagcuauuugg

SEQ ID NO: 394129 - RNA, 24 nt, Human
caccuguaaucccagcuauuuggg

SEQ ID NO: 394130 - RNA, 22 nt, Human
cacuguguaucauuacaaaggu

SEQ ID NO: 394131 - RNA, 24 nt, Human
cagcacuuugggaggccaaggcag

SEQ ID NO: 394132 - RNA, 25 nt, Human
cagcacuuugggaggccaaggcagg

SEQ ID NO: 394133 - RNA, 24 nt, Human
cagcuauuugggaggcugaggcag

SEQ ID NO: 394134 - RNA, 24 nt, Human
caggcggaucaucugaggucagga

SEQ ID NO: 394135 - RNA, 20 nt, Human
caguagaaaugcagaccacu

SEQ ID NO: 394136 - RNA, 23 nt, Human
caucugaggucaggaguuugaga

SEQ ID NO: 394137 - RNA, 19 nt, Human
ccacaccuguaaucccagc

SEQ ID NO: 394138 - RNA, 22 nt, Human
ccaccucugccuaaaucaggaa

SEQ ID NO: 394139 - RNA, 25 nt, Human
ccaugcaaaaaaaaucuuaucuaaa

SEQ ID NO: 394140 - RNA, 22 nt, Human
cccacaccuguaaucccagcac

SEQ ID NO: 394141 - RNA, 24 nt, Human
cccacaccuguaaucccagcacuu

SEQ ID NO: 394142 - RNA, 18 nt, Human
cccgcggcgccgcucaac

SEQ ID NO: 394143 - RNA, 19 nt, Human
cccgcggcgccgcucaaca

SEQ ID NO: 394144 - RNA, 23 nt, Human
cccgcggcgccgcucaacagcca

SEQ ID NO: 394145 - RNA, 18 nt, Human
ccuauggguccccuccuc

SEQ ID NO: 394146 - RNA, 22 nt, Human
ccuggcuaacauggugaaaacc

SEQ ID NO: 394147 - RNA, 24 nt, Human
ccuggcuaacauggugaaaaccug

SEQ ID NO: 394148 - RNA, 21 nt, Human
ccuguaaucccagcuauuugg

SEQ ID NO: 394149 - RNA, 22 nt, Human
ccugucucuacuaaaaauacaa

SEQ ID NO: 394150 - RNA, 23 nt, Human
cgaaaaaaaauugaugaagaaaa

SEQ ID NO: 394151 - RNA, 18 nt, Human
cgcguccuaugggucccc

SEQ ID NO: 394152 - RNA, 24 nt, Human
cggaucaucugaggucaggaguuu

SEQ ID NO: 394153 - RNA, 23 nt, Human
cucaaaauaaaaaaaaaaaaaua

SEQ ID NO: 394154 - RNA, 20 nt, Human
cuguaaucccagcuauuugg

SEQ ID NO: 394155 - RNA, 22 nt, Human
gaaaaaaaauugaugaagaaaa

SEQ ID NO: 394156 - RNA, 18 nt, Human
gaggcaauaaacguagcg

SEQ ID NO: 394157 - RNA, 24 nt, Human
gaucaucugaggucaggaguuuga

SEQ ID NO: 394158 - RNA, 20 nt, Human
gcaugguggcucccacaccu

SEQ ID NO: 394159 - RNA, 18 nt, Human
gccaccucugccuaaauc

SEQ ID NO: 394160 - RNA, 18 nt, Human
gcuaacauggugaaaacc

SEQ ID NO: 394161 - RNA, 24 nt, Human
gcuaacauggugaaaaccugucuc

SEQ ID NO: 394162 - RNA, 22 nt, Human
ggaaagaauaaaaaccaugcaa

SEQ ID NO: 394163 - RNA, 22 nt, Human
ggaaagaguaaaugcauaggca

SEQ ID NO: 394164 - RNA, 22 nt, Human
ggaucaucugaggucaggaguu

SEQ ID NO: 394165 - RNA, 22 nt, Human
ggaucaucugaggucaggaguu

SEQ ID NO: 394166 - RNA, 19 nt, Human
ggucaggaguuugagacca

SEQ ID NO: 394167 - RNA, 24 nt, Human
gguggcaugcaccuguaaucccag

SEQ ID NO: 394168 - RNA, 23 nt, Human
ggugugguggcaugcaccuguaa

SEQ ID NO: 394169 - RNA, 23 nt, Human
guguguggcacaaauggaauaga

SEQ ID NO: 394170 - RNA, 26 nt, Human
guuuccuuuacaguuucuuuuuuugc

SEQ ID NO: 394171 - RNA, 20 nt, Human
uaaaaaaauagagaaaugca

SEQ ID NO: 394172 - RNA, 19 nt, Human
uaacauggugaaaaccugu

SEQ ID NO: 394173 - RNA, 22 nt, Human
uaacauggugaaaaccugucuc

SEQ ID NO: 394174 - RNA, 24 nt, Human
uaacauggugaaaaccugucucua

SEQ ID NO: 394175 - RNA, 23 nt, Human
uaacgcguccuauggguccccuc

SEQ ID NO: 394176 - RNA, 24 nt, Human
uacacuaacuuuuaaguguguggc

SEQ ID NO: 394177 - RNA, 24 nt, Human
uacaguagaaaugcagaccacuuu

SEQ ID NO: 394178 - RNA, 22 nt, Human
uaccuagccaugaaaauauaca

SEQ ID NO: 394179 - RNA, 19 nt, Human
uacuucugggugcccuccu

SEQ ID NO: 394180 - RNA, 20 nt, Human
uagcugggugugguggcaug

SEQ ID NO: 394181 - RNA, 21 nt, Human
uaggaaagaauaaaaaccaug

SEQ ID NO: 394182 - RNA, 22 nt, Human
uauaaaacaggauccauuagga

SEQ ID NO: 394183 - RNA, 18 nt, Human
uauccgggaucccacggc

SEQ ID NO: 394184 - RNA, 20 nt, Human
ucaaaauaaaaaaaaaaaaa

SEQ ID NO: 394185 - RNA, 19 nt, Human
ucaucugaggucaggaguu

SEQ ID NO: 394186 - RNA, 22 nt, Human
uccaagcuuccaaaaaugauuu

SEQ ID NO: 394187 - RNA, 21 nt, Human
ucccacaccuguaaucccagc

SEQ ID NO: 394188 - RNA, 21 nt, Human
uccgcugcgaacacgggaaac

SEQ ID NO: 394189 - RNA, 21 nt, Human
uccuauggguccccuccuccu

SEQ ID NO: 394190 - RNA, 21 nt, Human
uccuccuauccgggaucccac

SEQ ID NO: 394191 - RNA, 23 nt, Human
ucucuacuaaaaauacaaaaauu

SEQ ID NO: 394192 - RNA, 22 nt, Human
ucugaggucaggaguuugagac

SEQ ID NO: 394193 - RNA, 23 nt, Human
ucugaggucaggaguuugagacc

SEQ ID NO: 394194 - RNA, 20 nt, Human
ucugcauacuacacugcauu

SEQ ID NO: 394195 - RNA, 23 nt, Human
ugagaccagccuggcuaacaugg

SEQ ID NO: 394196 - RNA, 20 nt, Human
ugaggcaggagaauugcucc

SEQ ID NO: 394197 - RNA, 18 nt, Human
ugaggucaggaguuugag

SEQ ID NO: 394198 - RNA, 18 nt, Human
uggaaguauuauaaaaca

SEQ ID NO: 394199 - RNA, 24 nt, Human
uggcucccacaccuguaaucccag

SEQ ID NO: 394200 - RNA, 24 nt, Human
uggcucccacaccuguaaucccuu

SEQ ID NO: 394201 - RNA, 24 nt, Human
ugggaggccaaggcaggcggauca

SEQ ID NO: 394202 - RNA, 19 nt, Human
ugggaggcugaggcaggag

SEQ ID NO: 394203 - RNA, 22 nt, Human
ugggaggcugaggcaggagaau

SEQ ID NO: 394204 - RNA, 21 nt, Human
uggguccccuccuccuccuau

SEQ ID NO: 394205 - RNA, 22 nt, Human
ugggugugguggcaugcaccug

SEQ ID NO: 394206 - RNA, 24 nt, Human
ugguggcaugcaccuguaauccca

SEQ ID NO: 394207 - RNA, 26 nt, Human
ugguggcucccacaccuguaauccca

SEQ ID NO: 394208 - RNA, 19 nt, Human
uguagaaguacacagggaa

SEQ ID NO: 394209 - RNA, 18 nt, Human
ugugguggcaugcaccug

SEQ ID NO: 394210 - RNA, 20 nt, Human
uuagcugggugugguggcau

SEQ ID NO: 394211 - RNA, 22 nt, Human
uuagcugggugugguggcaugc

SEQ ID NO: 394212 - RNA, 18 nt, Human
uucacuguguaucauuac

SEQ ID NO: 394213 - RNA, 23 nt, Human
uugggaggcugaggcaggagaau

SEQ ID NO: 394214 - RNA, 22 nt, Human
uuuaaugagauccaagcuucca

SEQ ID NO: 394215 - RNA, 21 nt, Human
uuuucauuuuacacaugaggg

SEQ ID NO: 394216 - RNA, 22 nt, Human
agaauggaagauccgccgaaga

SEQ ID NO: 394217 - RNA, 21 nt, Human
agccggggggucgacuggaag

SEQ ID NO: 394218 - RNA, 22 nt, Human
agccggucagcccaucuggaac

SEQ ID NO: 394219 - RNA, 21 nt, Human
aggcaguuuuauugaaaucuu

SEQ ID NO: 394220 - RNA, 19 nt, Human
cagggccugggcuugggcc

SEQ ID NO: 394221 - RNA, 21 nt, Human
caucuggaacuggcacugucc

SEQ ID NO: 394222 - RNA, 22 nt, Human
ccagggcccgggcaggccgcgc

SEQ ID NO: 394223 - RNA, 20 nt, Human
ccgcgccggcuggcugggcc

SEQ ID NO: 394224 - RNA, 21 nt, Human
ccugccucacauggcaggguc

SEQ ID NO: 394225 - RNA, 23 nt, Human
cgaagauccgccgaagauccugg

SEQ ID NO: 394226 - RNA, 20 nt, Human
cgcccggacuccggcucccg

SEQ ID NO: 394227 - RNA, 22 nt, Human
cggcccggagccagccaggcag

SEQ ID NO: 394228 - RNA, 19 nt, Human
cgggcccccagcccgggcc

SEQ ID NO: 394229 - RNA, 18 nt, Human
cuggaagugcucuguccc

SEQ ID NO: 394230 - RNA, 19 nt, Human
gcagggccugggcuugggc

SEQ ID NO: 394231 - RNA, 20 nt, Human
gcucccgcccugagaaugga

SEQ ID NO: 394232 - RNA, 21 nt, Human
gcuccgcgcagggccugggcu

SEQ ID NO: 394233 - RNA, 19 nt, Human
ggccugagaccacgggcuc

SEQ ID NO: 394234 - RNA, 18 nt, Human
gggcccccagcccgggcc

SEQ ID NO: 394235 - RNA, 19 nt, Human
gggcgcgggcccagcccga

SEQ ID NO: 394236 - RNA, 19 nt, Human
gggcuugggccuggaccag

SEQ ID NO: 394237 - RNA, 22 nt, Human
gggcuugggccuggaccaggcg

SEQ ID NO: 394238 - RNA, 20 nt, Human
gucagcccaucuggaacugg

SEQ ID NO: 394239 - RNA, 22 nt, Human
ucagcccaucuggaacuggcac

SEQ ID NO: 394240 - RNA, 24 nt, Human
ucccgggcgcccggacuccggcuc

SEQ ID NO: 394241 - RNA, 18 nt, Human
uccugaaggccaaaguug

SEQ ID NO: 394242 - RNA, 18 nt, Human
ugagaccacgggcuccac

SEQ ID NO: 394243 - RNA, 20 nt, Human
ugcucugucccuugagucca

SEQ ID NO: 394244 - RNA, 18 nt, Human
uggcugggcccgggugga

SEQ ID NO: 394245 - RNA, 18 nt, Human
ugggcgcgggcccagccc

SEQ ID NO: 394246 - RNA, 18 nt, Human
uguccugaaggccaaagu

SEQ ID NO: 394247 - RNA, 18 nt, Human
acaacaugaaaacagggu

SEQ ID NO: 394248 - RNA, 19 nt, Human
agcucaagagaaacucugg

SEQ ID NO: 394249 - RNA, 23 nt, Human
caaacagaaacaaaagcucaaga

SEQ ID NO: 394250 - RNA, 21 nt, Human
ucgggacaauguaucuucuuc

SEQ ID NO: 394251 - RNA, 23 nt, Human
ucugagcaaacagaaacaaaagc

SEQ ID NO: 394252 - RNA, 24 nt, Human
agcuacaaaguucgcgguaugggg

SEQ ID NO: 394253 - RNA, 21 nt, Human
cgaaggcaccagcuacaaagu

SEQ ID NO: 394254 - RNA, 24 nt, Human
uaaauucucagcuuauuucaagua

SEQ ID NO: 394255 - RNA, 18 nt, Human
uacaaaguucgcgguaug

SEQ ID NO: 394256 - RNA, 18 nt, Human
ugucauucuuucauuaua

SEQ ID NO: 394257 - RNA, 20 nt, Human
aggaaguacaggccaacccc

SEQ ID NO: 394258 - RNA, 24 nt, Human
aggccaaccccgcugucuuaacac

SEQ ID NO: 394259 - RNA, 18 nt, Human
cagccagggccagaggaa

SEQ ID NO: 394260 - RNA, 23 nt, Human
ccaaccccgcugucuuaacacgc

SEQ ID NO: 394261 - RNA, 21 nt, Human
ccagggccagaggaaguacag

SEQ ID NO: 394262 - RNA, 22 nt, Human
ccccgcugucuuaacacgcccg

SEQ ID NO: 394263 - RNA, 22 nt, Human
gaaguacaggccaaccccgcug

SEQ ID NO: 394264 - RNA, 19 nt, Human
ggccagaggaaguacaggc

SEQ ID NO: 394265 - RNA, 21 nt, Human
uacaggccaaccccgcugucu

SEQ ID NO: 394266 - RNA, 24 nt, Human
uuaacgguuucacuagcccucuuc

SEQ ID NO: 394267 - RNA, 20 nt, Human
aggaaguacaggccaacccc

SEQ ID NO: 394268 - RNA, 23 nt, Human
aggccaaccccgcugcuuaacac

SEQ ID NO: 394269 - RNA, 18 nt, Human
cagccagggccagaggaa

SEQ ID NO: 394270 - RNA, 22 nt, Human
ccaaccccgcugcuuaacacgc

SEQ ID NO: 394271 - RNA, 21 nt, Human
ccagaggaagcaauuuucccu

SEQ ID NO: 394272 - RNA, 21 nt, Human
ccagggccagaggaaguacag

SEQ ID NO: 394273 - RNA, 24 nt, Human
cccacagaggaagcaauuuucccu

SEQ ID NO: 394274 - RNA, 21 nt, Human
ccccgcugcuuaacacgccug

SEQ ID NO: 394275 - RNA, 20 nt, Human
cugaggcuuuugcagccaga

SEQ ID NO: 394276 - RNA, 22 nt, Human
cugaggcuuuugcagccagauu

SEQ ID NO: 394277 - RNA, 24 nt, Human
cugauggaguucggagucucuccu

SEQ ID NO: 394278 - RNA, 19 nt, Human
cuggaggucuucucugcug

SEQ ID NO: 394279 - RNA, 22 nt, Human
gaaguacaggccaaccccgcug

SEQ ID NO: 394280 - RNA, 22 nt, Human
ggccaaccccgcugcuuaacac

SEQ ID NO: 394281 - RNA, 19 nt, Human
ggccagaggaaguacaggc

SEQ ID NO: 394282 - RNA, 21 nt, Human
uacaggccaaccccgcugcuu

SEQ ID NO: 394283 - RNA, 25 nt, Human
uccccagaggaagcaauuuucccuc

SEQ ID NO: 394284 - RNA, 23 nt, Human
ucgccucccacagaggaagcaau

SEQ ID NO: 394285 - RNA, 22 nt, Human
ucgccuccccagaggaagcaau

SEQ ID NO: 394286 - RNA, 22 nt, Human
ucucuugggggcucuugagggu

SEQ ID NO: 394287 - RNA, 19 nt, Human
ugaaaaauucacagcuuua

SEQ ID NO: 394288 - RNA, 24 nt, Human
uuaacgguuucacuagcccucuuc

SEQ ID NO: 394289 - RNA, 24 nt, Human
uuacugaggcuuuugcagccguau

SEQ ID NO: 394290 - RNA, 21 nt, Human
uugcagccagauucgccuccc

SEQ ID NO: 394291 - RNA, 22 nt, Human
uugggggcucuugagggucuau

SEQ ID NO: 394292 - RNA, 25 nt, Human
aaaauuaacaucaacaaaaccaaag

SEQ ID NO: 394293 - RNA, 22 nt, Human
aaaccaaagccauucuaggcac

SEQ ID NO: 394294 - RNA, 26 nt, Human
aagcagaaagagaagaaaggggaccc

SEQ ID NO: 394295 - RNA, 23 nt, Human
acagcaacugaagcagaaagaga

SEQ ID NO: 394296 - RNA, 19 nt, Human
agaagaaaggagcuuacaa

SEQ ID NO: 394297 - RNA, 25 nt, Human
agcaacugaagcagaaagagaagaa

SEQ ID NO: 394298 - RNA, 19 nt, Human
caaaaccaaagccauucua

SEQ ID NO: 394299 - RNA, 18 nt, Human
cagaaaucugacugaaaa

SEQ ID NO: 394300 - RNA, 22 nt, Human
cagagagggccaaacgaugaug

SEQ ID NO: 394301 - RNA, 25 nt, Human
caggacacucaaacucaggccagga

SEQ ID NO: 394302 - RNA, 21 nt, Human
ccaaagccauucuaggcacaa

SEQ ID NO: 394303 - RNA, 23 nt, Human
gagcuuacaaccaggacacucaa

SEQ ID NO: 394304 - RNA, 23 nt, Human
uaacaauaucauaguaagguuuc

SEQ ID NO: 394305 - RNA, 18 nt, Human
uacaaccaggacacucaa

SEQ ID NO: 394306 - RNA, 25 nt, Human
uaggcacaaccaaaaauuuuuacua

SEQ ID NO: 394307 - RNA, 21 nt, Human
ucaaacucaggccaggagucc

SEQ ID NO: 394308 - RNA, 22 nt, Human
ugaacaaagugagacuuacaga

SEQ ID NO: 394309 - RNA, 21 nt, Human
uuacaaccaggacacucaaac

SEQ ID NO: 394310 - RNA, 18 nt, Human
aaaaaguuugcaaaagca

SEQ ID NO: 394311 - RNA, 30 nt, Human
aaacauaaaucaaauggcuguuauucauuu

SEQ ID NO: 394312 - RNA, 22 nt, Human
aaagaaacaauccuuaacuaga

SEQ ID NO: 394313 - RNA, 22 nt, Human
aaagugcuucauugccaauaua

SEQ ID NO: 394314 - RNA, 25 nt, Human
aaugccaucaacaauguauugaaaa

SEQ ID NO: 394315 - RNA, 21 nt, Human
aauugcuuccaacauaaacau

SEQ ID NO: 394316 - RNA, 18 nt, Human
acaaaguagaauuauagu

SEQ ID NO: 394317 - RNA, 23 nt, Human
acauaaacauuuaaaacaucucu

SEQ ID NO: 394318 - RNA, 22 nt, Human
agaaagguaauacaugaaaaga

SEQ ID NO: 394319 - RNA, 20 nt, Human
agaagcagcuuagguauucu

SEQ ID NO: 394320 - RNA, 22 nt, Human
agacaaugucaacagaaucuga

SEQ ID NO: 394321 - RNA, 21 nt, Human
agauguuagaaauugaugucc

SEQ ID NO: 394322 - RNA, 24 nt, Human
aggcauugaaagugcuucauugcc

SEQ ID NO: 394323 - RNA, 20 nt, Human
auggcucuuguagaaaaagg

SEQ ID NO: 394324 - RNA, 22 nt, Human
caaaagcacugaagcuuugcua

SEQ ID NO: 394325 - RNA, 20 nt, Human
caaacauaaaccaaaugacu

SEQ ID NO: 394326 - RNA, 19 nt, Human
caugaaaagagacagcuca

SEQ ID NO: 394327 - RNA, 27 nt, Human
caugaaaagagacagcucaagacuggu

SEQ ID NO: 394328 - RNA, 23 nt, Human
cauguuuuaauauucugucacgu

SEQ ID NO: 394329 - RNA, 23 nt, Human
cauuuaaaacaucucuacucaag

SEQ ID NO: 394330 - RNA, 22 nt, Human
ccugugccagauaacacaaaaa

SEQ ID NO: 394331 - RNA, 21 nt, Human
cugguauaucagauguuagaa

SEQ ID NO: 394332 - RNA, 23 nt, Human
cuugccauaaccaaacauaaacc

SEQ ID NO: 394333 - RNA, 18 nt, Human
gaaaagucuaugacaaga

SEQ ID NO: 394334 - RNA, 24 nt, Human
gaaaggucuauccaguugugaggg

SEQ ID NO: 394335 - RNA, 22 nt, Human
gccaaaccaauucucuugucac

SEQ ID NO: 394336 - RNA, 19 nt, Human
uaacugcauaagcauaaac

SEQ ID NO: 394337 - RNA, 21 nt, Human
uacagaaaacaggaauagcug

SEQ ID NO: 394338 - RNA, 21 nt, Human
uaugacaagagcaugaaaaaa

SEQ ID NO: 394339 - RNA, 23 nt, Human
uaugcaaaccaauuuuucuuauu

SEQ ID NO: 394340 - RNA, 21 nt, Human
ucaaaggccugugccagauaa

SEQ ID NO: 394341 - RNA, 23 nt, Human
uccaaaaacaaaauaaucuucug

SEQ ID NO: 394342 - RNA, 23 nt, Human
ucccuuuuuaaagaucucuaugu

SEQ ID NO: 394343 - RNA, 25 nt, Human
ugaaaaaaaauccugcuuucagcug

SEQ ID NO: 394344 - RNA, 22 nt, Human
ugaaaagagacagcucaagacu

SEQ ID NO: 394345 - RNA, 18 nt, Human
ugaaauaaaaauaccaca

SEQ ID NO: 394346 - RNA, 20 nt, Human
ugacuaaugaaaaaaaaucc

SEQ ID NO: 394347 - RNA, 23 nt, Human
ugccauaaccaaacauaaaccaa

SEQ ID NO: 394348 - RNA, 22 nt, Human
ugccaucaacaauguauugaaa

SEQ ID NO: 394349 - RNA, 19 nt, Human
uggaaauggcucuuguaga

SEQ ID NO: 394350 - RNA, 21 nt, Human
uuauagucuuuucaaaggccu

SEQ ID NO: 394351 - RNA, 25 nt, Human
uucaaaucucuuacuucuuucgguu

SEQ ID NO: 394352 - RNA, 20 nt, Human
uugaagaaauuugccauauc

SEQ ID NO: 394353 - RNA, 22 nt, Human
uugcagaagguuaaaaagaaaa

SEQ ID NO: 394354 - RNA, 18 nt, Human
uugcuaguuauuuguugu

SEQ ID NO: 394355 - RNA, 21 nt, Human
uuuagguaagucuuuaagaga

SEQ ID NO: 394356 - RNA, 18 nt, Human
uuuuuuuuuugaagcaaa

SEQ ID NO: 394357 - RNA, 18 nt, Human
uuuuuuuuuuuuuuuuug

SEQ ID NO: 394358 - RNA, 21 nt, Human
aaaccagggcaaacucaugga

SEQ ID NO: 394359 - RNA, 19 nt, Human
agcacacauggcaacacag

SEQ ID NO: 394360 - RNA, 20 nt, Human
agcagcgagcacagucggac

SEQ ID NO: 394361 - RNA, 24 nt, Human
caaaccacuugggccagugaaacc

SEQ ID NO: 394362 - RNA, 20 nt, Human
cacacauggcaacacagagc

SEQ ID NO: 394363 - RNA, 22 nt, Human
cuucaccuugguggcagcccua

SEQ ID NO: 394364 - RNA, 20 nt, Human
ggugcggcgcugagcagcga

SEQ ID NO: 394365 - RNA, 20 nt, Human
uagcacaaaccacuugggcc

SEQ ID NO: 394366 - RNA, 20 nt, Human
ucagcacacauggcaacaca

SEQ ID NO: 394367 - RNA, 21 nt, Human
ucugcguucccaucuucaccu

SEQ ID NO: 394368 - RNA, 21 nt, Human
ugaaaccagggcaaacucaug

SEQ ID NO: 394369 - RNA, 22 nt, Human
ugcggcgcugagcagcgagcac

SEQ ID NO: 394370 - RNA, 24 nt, Human
uggcaacacagagcugugaagaca

SEQ ID NO: 394371 - RNA, 22 nt, Human
uggcagcccuaccucugagauu

SEQ ID NO: 394372 - RNA, 24 nt, Human
uuuuuuguucagcacacauggcaa

SEQ ID NO: 394373 - RNA, 18 nt, Human
agcagcagcaggaagggu

SEQ ID NO: 394374 - RNA, 25 nt, Human
agcggguggggaggucgaggcgggu

SEQ ID NO: 394375 - RNA, 20 nt, Human
aggcgugggaggggcggggc

SEQ ID NO: 394376 - RNA, 25 nt, Human
agggcagcggcggcggcggcggcgg

SEQ ID NO: 394377 - RNA, 25 nt, Human
agggugggcgcgcggggggcuggug

SEQ ID NO: 394378 - RNA, 22 nt, Human
aggucgaggcgggugcagaguc

SEQ ID NO: 394379 - RNA, 18 nt, Human
cagagucggagaggcugc

SEQ ID NO: 394380 - RNA, 23 nt, Human
cagcagcaguagcagcagcagga

SEQ ID NO: 394381 - RNA, 23 nt, Human
cagcaggaaggguugcugauccc

SEQ ID NO: 394382 - RNA, 24 nt, Human
cagcaggaaggguugcugaucccg

SEQ ID NO: 394383 - RNA, 25 nt, Human
cggggggcuggugaggcgugggagg

SEQ ID NO: 394384 - RNA, 20 nt, Human
gcggcggcggcggcggcagc

SEQ ID NO: 394385 - RNA, 20 nt, Human
gcggcggcggcggcggcggc

SEQ ID NO: 394386 - RNA, 21 nt, Human
gcggcggcggcggcggcggca

SEQ ID NO: 394387 - RNA, 24 nt, Human
gcggcggcggcggcggcggcagca

SEQ ID NO: 394388 - RNA, 19 nt, Human
gcgugaacggauaugcccc

SEQ ID NO: 394389 - RNA, 18 nt, Human
gcugccccacugacaguc

SEQ ID NO: 394390 - RNA, 20 nt, Human
ggacccaagggcagcggcgg

SEQ ID NO: 394391 - RNA, 21 nt, Human
ggcggcagcagcagcagcagu

SEQ ID NO: 394392 - RNA, 21 nt, Human
ggcuggugaggcgugggaggg

SEQ ID NO: 394393 - RNA, 20 nt, Human
gggugugggagcgggugggg

SEQ ID NO: 394394 - RNA, 18 nt, Human
ugggagcggguggggagg

SEQ ID NO: 394395 - RNA, 24 nt, Human
ugggagcggguggggaggucgagg

SEQ ID NO: 394396 - RNA, 21 nt, Human
ugggaggggcggggcgggagg

SEQ ID NO: 394397 - RNA, 22 nt, Human
ugugggagcggguggggagguc

SEQ ID NO: 394398 - RNA, 19 nt, Human
ggcagccuggucucuagga

SEQ ID NO: 394399 - RNA, 18 nt, Human
ucucuaggaggugagugc

SEQ ID NO: 394400 - RNA, 24 nt, Human
uggcagccuggucucuaggaggug

SEQ ID NO: 394401 - RNA, 29 nt, Human
aaaaaaaaaaagcuuaaugaauaaagagg

SEQ ID NO: 394402 - RNA, 23 nt, Human
aaccauuaccuuaacacugaaaa

SEQ ID NO: 394403 - RNA, 22 nt, Human
aaccuuugccuccuaccagagg

SEQ ID NO: 394404 - RNA, 24 nt, Human
aagaaguccaggggcgggugaugc

SEQ ID NO: 394405 - RNA, 23 nt, Human
aagggaacaugucauuucaaaga

SEQ ID NO: 394406 - RNA, 20 nt, Human
aaguuuacucgaaacaucug

SEQ ID NO: 394407 - RNA, 31 nt, Human
acuuucaaaguuaaaaaaaaaaaaaaaaaaa

SEQ ID NO: 394408 - RNA, 21 nt, Human
agaacagagcccagcauccuc

SEQ ID NO: 394409 - RNA, 21 nt, Human
agaaucuuccaagccaagaac

SEQ ID NO: 394410 - RNA, 19 nt, Human
aguuauugcuuucugaaca

SEQ ID NO: 394411 - RNA, 20 nt, Human
auccaggauccccccagccc

SEQ ID NO: 394412 - RNA, 23 nt, Human
auucuaaaacuuauagcaccacu

SEQ ID NO: 394413 - RNA, 20 nt, Human
caagaacagagcccagcauc

SEQ ID NO: 394414 - RNA, 24 nt, Human
caagaacagagcccagcauccucc

SEQ ID NO: 394415 - RNA, 28 nt, Human
caagcagcaacaaauugcuucgugccua

SEQ ID NO: 394416 - RNA, 22 nt, Human
cacccacacacacuguacugca

SEQ ID NO: 394417 - RNA, 18 nt, Human
cagaaggcccccguuuga

SEQ ID NO: 394418 - RNA, 22 nt, Human
cagaaggcccccguuugaacac

SEQ ID NO: 394419 - RNA, 24 nt, Human
cagcccccaagcgguaaauccaaa

SEQ ID NO: 394420 - RNA, 18 nt, Human
caggauccccccagcccc

SEQ ID NO: 394421 - RNA, 21 nt, Human
ccaggccaggagggguuccca

SEQ ID NO: 394422 - RNA, 24 nt, Human
ccaggccaggagggguucccaguu

SEQ ID NO: 394423 - RNA, 20 nt, Human
cccacacacacuguacugca

SEQ ID NO: 394424 - RNA, 22 nt, Human
cccacacacacuguacugcaca

SEQ ID NO: 394425 - RNA, 25 nt, Human
cccagcccccaagcgguaaauccaa

SEQ ID NO: 394426 - RNA, 24 nt, Human
cccccaggccaggagggguuccca

SEQ ID NO: 394427 - RNA, 20 nt, Human
ccgccgcccccgccgcgcgc

SEQ ID NO: 394428 - RNA, 25 nt, Human
ccgccgcgcgcgggccuugcugucc

SEQ ID NO: 394429 - RNA, 19 nt, Human
ccgcgcgcgggccuugcug

SEQ ID NO: 394430 - RNA, 20 nt, Human
ccgcgcgcgggccuugcugu

SEQ ID NO: 394431 - RNA, 19 nt, Human
ccuaccagaggacuugauc

SEQ ID NO: 394432 - RNA, 24 nt, Human
ccuuaugauguguuauagauuacc

SEQ ID NO: 394433 - RNA, 23 nt, Human
cgccaguuaaauccaggaucccc

SEQ ID NO: 394434 - RNA, 18 nt, Human
cuaaaaccagaaggcccc

SEQ ID NO: 394435 - RNA, 19 nt, Human
cuaaaaccagaaggccccc

SEQ ID NO: 394436 - RNA, 19 nt, Human
cuaaaaccagaaggccccc

SEQ ID NO: 394437 - RNA, 21 nt, Human
cuacaaguuuccuaaaaccag

SEQ ID NO: 394438 - RNA, 19 nt, Human
cugccgccgcccccgccgc

SEQ ID NO: 394439 - RNA, 25 nt, Human
cuuccaagccaagaacagagcccag

SEQ ID NO: 394440 - RNA, 18 nt, Human
cuuuucaaguuuacucga

SEQ ID NO: 394441 - RNA, 22 nt, Human
gaauguauuuaaaagauucuaa

SEQ ID NO: 394442 - RNA, 22 nt, Human
gagggguucccagucugugcgg

SEQ ID NO: 394443 - RNA, 19 nt, Human
gcggacacaaaaaccaacc

SEQ ID NO: 394444 - RNA, 23 nt, Human
ggccaggagggguucccagucuu

SEQ ID NO: 394445 - RNA, 18 nt, Human
gggguucaaaaaaaaaaa

SEQ ID NO: 394446 - RNA, 24 nt, Human
ggugaccaggcgucugccgccgcc

SEQ ID NO: 394447 - RNA, 18 nt, Human
gguucccagucugugcgg

SEQ ID NO: 394448 - RNA, 18 nt, Human
gucauuucaaagagucuc

SEQ ID NO: 394449 - RNA, 23 nt, Human
gugaccaggcgucugccgccgcc

SEQ ID NO: 394450 - RNA, 23 nt, Human
gugugggucuguuggcccaggga

SEQ ID NO: 394451 - RNA, 21 nt, Human
uaaaagauucuaaaacuuaua

SEQ ID NO: 394452 - RNA, 24 nt, Human
uaaaauacagaaccuccacgggga

SEQ ID NO: 394453 - RNA, 24 nt, Human
uaaauagaaucuuccaagccaaga

SEQ ID NO: 394454 - RNA, 20 nt, Human
uacccuguauauauaugaau

SEQ ID NO: 394455 - RNA, 21 nt, Human
uagaaccuuugccuccuacca

SEQ ID NO: 394456 - RNA, 23 nt, Human
uagaaucuuccaagccaagaaca

SEQ ID NO: 394457 - RNA, 18 nt, Human
uagggcacaucaauuuga

SEQ ID NO: 394458 - RNA, 27 nt, Human
uaugcaaauaaagcuucaguaccuuaa

SEQ ID NO: 394459 - RNA, 22 nt, Human
uauuguugaucuguugaucuag

SEQ ID NO: 394460 - RNA, 26 nt, Human
ucaacgcacuguuucuuaaaauacag

SEQ ID NO: 394461 - RNA, 18 nt, Human
ucccuacucuccuaaccu

SEQ ID NO: 394462 - RNA, 22 nt, Human
uccgggucacuggacacgcauc

SEQ ID NO: 394463 - RNA, 22 nt, Human
ucuccauuucacccacacacac

SEQ ID NO: 394464 - RNA, 21 nt, Human
ugaauaaagagccaguacuug

SEQ ID NO: 394465 - RNA, 18 nt, Human
ugugcgguggagaaggau

SEQ ID NO: 394466 - RNA, 20 nt, Human
uuaaaaaaaaaaaaaaaaaa

SEQ ID NO: 394467 - RNA, 25 nt, Human
uuauuuggggaacauuuacaggcca

SEQ ID NO: 394468 - RNA, 23 nt, Human
uucaaaguuaaaaaaaaaaaaaa

SEQ ID NO: 394469 - RNA, 23 nt, Human
uucaagguaaauauuuagcggac

SEQ ID NO: 394470 - RNA, 20 nt, Human
uuccuaaaaccagaaggccc

SEQ ID NO: 394471 - RNA, 20 nt, Human
uugaucucugaagaagcuag

SEQ ID NO: 394472 - RNA, 20 nt, Human
uugggggugacaagcagcaa

SEQ ID NO: 394473 - RNA, 21 nt, Human
uuucaaaguuaaaaaaaaaaa

SEQ ID NO: 394474 - RNA, 23 nt, Human
aaaaaagaaaaacaaaacaaaaa

SEQ ID NO: 394475 - RNA, 27 nt, Human
aaaaaagaaaaacaaaacaaaaacaga

SEQ ID NO: 394476 - RNA, 22 nt, Human
aaaaacagaaagcaaaccaaaa

SEQ ID NO: 394477 - RNA, 26 nt, Human
aaaaacagaaagcaaaccaaaaagaa

SEQ ID NO: 394478 - RNA, 21 nt, Human
aaaaagaaauaaaaaaccaac

SEQ ID NO: 394479 - RNA, 26 nt, Human
aaaacaaaaacagaaagcaaaccaaa

SEQ ID NO: 394480 - RNA, 21 nt, Human
aaaacaaaacaaaaacagaaa

SEQ ID NO: 394481 - RNA, 22 nt, Human
aaaagaaaaacaaaacaaaaac

SEQ ID NO: 394482 - RNA, 26 nt, Human
aaaagaaaaacaaaacaaaaacagaa

SEQ ID NO: 394483 - RNA, 24 nt, Human
aaacaaaaacagaaagcaaaccaa

SEQ ID NO: 394484 - RNA, 26 nt, Human
aaacaaaaacagaaagcaaaccaaaa

SEQ ID NO: 394485 - RNA, 18 nt, Human
aaacaaaaagagagagac

SEQ ID NO: 394486 - RNA, 23 nt, Human
aaacaaaacaaaaacagaaagca

SEQ ID NO: 394487 - RNA, 24 nt, Human
aaacaaaacaaaaacagaaagcaa

SEQ ID NO: 394488 - RNA, 24 nt, Human
aaaccaaaaagaaauaaaaaacca

SEQ ID NO: 394489 - RNA, 21 nt, Human
aaaccaacaacaaacaaaaca

SEQ ID NO: 394490 - RNA, 20 nt, Human
aaagaagaaaacccaaaaag

SEQ ID NO: 394491 - RNA, 24 nt, Human
aacaaaaacagaaagcaaaccaaa

SEQ ID NO: 394492 - RNA, 24 nt, Human
aacaaaacaaaaagagagagacag

SEQ ID NO: 394493 - RNA, 24 nt, Human
aacaaacaaaacaaaaagagagag

SEQ ID NO: 394494 - RNA, 26 nt, Human
aagaaaaacaaaacaaaaacagaaag

SEQ ID NO: 394495 - RNA, 19 nt, Human
aagaaagaaaaaaaagaaa

SEQ ID NO: 394496 - RNA, 20 nt, Human
aagaaauaaaaaaccaacaa

SEQ ID NO: 394497 - RNA, 22 nt, Human
aagagacccaaaugacaucgua

SEQ ID NO: 394498 - RNA, 23 nt, Human
aaggcacgguggccucuugguuu

SEQ ID NO: 394499 - RNA, 22 nt, Human
acaaaacaaaaacagaaagcaa

SEQ ID NO: 394500 - RNA, 27 nt, Human
acaaaacaaaaacagaaagcaaaccaa

SEQ ID NO: 394501 - RNA, 28 nt, Human
acaaaacaaaaacagaaagcaaaccaaa

SEQ ID NO: 394502 - RNA, 22 nt, Human
accuggaggcagaggugggggc

SEQ ID NO: 394503 - RNA, 23 nt, Human
accuggaggcagaggugggggcu

SEQ ID NO: 394504 - RNA, 18 nt, Human
agaaaaaaaagaaaaaca

SEQ ID NO: 394505 - RNA, 25 nt, Human
agaaaaaaaagaaaaacaaaacaaa

SEQ ID NO: 394506 - RNA, 26 nt, Human
agaaaaaaaagaaaaacaaaacaaaa

SEQ ID NO: 394507 - RNA, 22 nt, Human
agaaaaacaaaacaaaaacaga

SEQ ID NO: 394508 - RNA, 18 nt, Human
agaaaacccaaaaagagg

SEQ ID NO: 394509 - RNA, 26 nt, Human
agaaagaagaaaacccaaaaagagga

SEQ ID NO: 394510 - RNA, 26 nt, Human
agaaagaagaaaacccaaaaagagga

SEQ ID NO: 394511 - RNA, 21 nt, Human
agaaagcaaaccaaaaagaaa

SEQ ID NO: 394512 - RNA, 19 nt, Human
agaaugccccagccuaguc

SEQ ID NO: 394513 - RNA, 18 nt, Human
agaccuccgggcccccag

SEQ ID NO: 394514 - RNA, 19 nt, Human
agaccuggaggcagaggug

SEQ ID NO: 394515 - RNA, 18 nt, Human
agaggaaggaaaggggau

SEQ ID NO: 394516 - RNA, 24 nt, Human
agaugcuggcggcggcggcggcgg

SEQ ID NO: 394517 - RNA, 27 nt, Human
agaugcuggcggcggcggcggcggcga

SEQ ID NO: 394518 - RNA, 20 nt, Human
aggagaaagaagaaaaccca

SEQ ID NO: 394519 - RNA, 23 nt, Human
aggagaaagaagaaaacccaaaa

SEQ ID NO: 394520 - RNA, 24 nt, Human
aggagaaagaagaaaacccaaaaa

SEQ ID NO: 394521 - RNA, 25 nt, Human
aggagaaagaagaaaacccaaaaag

SEQ ID NO: 394522 - RNA, 21 nt, Human
aggcagaggugggggcugggg

SEQ ID NO: 394523 - RNA, 22 nt, Human
aggcagaggugggggcuggggg

SEQ ID NO: 394524 - RNA, 24 nt, Human
aggcagaggugggggcuggggggu

SEQ ID NO: 394525 - RNA, 19 nt, Human
aggcuggcucugggcaggg

SEQ ID NO: 394526 - RNA, 23 nt, Human
agggagaggagggcugggggggu

SEQ ID NO: 394527 - RNA, 26 nt, Human
agggaggcgggcaugggaggggcggg

SEQ ID NO: 394528 - RNA, 22 nt, Human
aggugggggcugggggguggga

SEQ ID NO: 394529 - RNA, 22 nt, Human
augugugugugugugugugugu

SEQ ID NO: 394530 - RNA, 22 nt, Human
augugugugugugugugugugu

SEQ ID NO: 394531 - RNA, 22 nt, Human
auugaaaaagaggucauaaaag

SEQ ID NO: 394532 - RNA, 22 nt, Human
caaaacaaaaacagaaagcaaa

SEQ ID NO: 394533 - RNA, 23 nt, Human
caaaacaaaaacagaaagcaaac

SEQ ID NO: 394534 - RNA, 22 nt, Human
caacaaacaaaacaaaaagaga

SEQ ID NO: 394535 - RNA, 19 nt, Human
caacaacaaacaaaacaaa

SEQ ID NO: 394536 - RNA, 25 nt, Human
caacaacaaacaaaacaaaaagaga

SEQ ID NO: 394537 - RNA, 19 nt, Human
cagaggugggggcuggggg

SEQ ID NO: 394538 - RNA, 23 nt, Human
cagcaaaccccaaccaagaagca

SEQ ID NO: 394539 - RNA, 20 nt, Human
cagcccccagaagggagagg

SEQ ID NO: 394540 - RNA, 22 nt, Human
cagcccccggggccgaggcccc

SEQ ID NO: 394541 - RNA, 24 nt, Human
cagccuagucuuacccccaaccau

SEQ ID NO: 394542 - RNA, 23 nt, Human
caggucccgcgaucagccggaga

SEQ ID NO: 394543 - RNA, 22 nt, Human
caucuccgugucagcuuccucc

SEQ ID NO: 394544 - RNA, 22 nt, Human
ccaaaaagaggaaggaaagggg

SEQ ID NO: 394545 - RNA, 22 nt, Human
ccagcccccagaagggagagga

SEQ ID NO: 394546 - RNA, 18 nt, Human
ccagccccgggaccucgg

SEQ ID NO: 394547 - RNA, 18 nt, Human
ccaggcaucuccguguca

SEQ ID NO: 394548 - RNA, 22 nt, Human
cccagaaugccccagccuaguc

SEQ ID NO: 394549 - RNA, 18 nt, Human
ccccaaccaagaagcaac

SEQ ID NO: 394550 - RNA, 20 nt, Human
ccccaaccaagaagcaacgg

SEQ ID NO: 394551 - RNA, 18 nt, Human
ccccagccccgggaccuc

SEQ ID NO: 394552 - RNA, 22 nt, Human
cccccagaaugccccagccuag

SEQ ID NO: 394553 - RNA, 21 nt, Human
cccuguggcugccccggcucc

SEQ ID NO: 394554 - RNA, 25 nt, Human
ccuccagcccccggggccgaggccc

SEQ ID NO: 394555 - RNA, 18 nt, Human
ccuugaacacgaagaccu

SEQ ID NO: 394556 - RNA, 21 nt, Human
cggccccccuccucugcacga

SEQ ID NO: 394557 - RNA, 23 nt, Human
cggcggcggcgaggggagggagg

SEQ ID NO: 394558 - RNA, 28 nt, Human
cucaaaauuguaaaaaaaaaaaaaagaa

SEQ ID NO: 394559 - RNA, 22 nt, Human
cucccacagcucugcgacaccc

SEQ ID NO: 394560 - RNA, 19 nt, Human
cucccuccagcccccagaa

SEQ ID NO: 394561 - RNA, 20 nt, Human
cucccuguggcugccccggc

SEQ ID NO: 394562 - RNA, 18 nt, Human
cuggaggcagaggugggg

SEQ ID NO: 394563 - RNA, 21 nt, Human
gaagaugagaccuggaggcag

SEQ ID NO: 394564 - RNA, 21 nt, Human
gaccucggguugaguggcuuc

SEQ ID NO: 394565 - RNA, 21 nt, Human
gagaaagaagaaaacccaaaa

SEQ ID NO: 394566 - RNA, 23 nt, Human
gagaaagaagaaaacccaaaaag

SEQ ID NO: 394567 - RNA, 23 nt, Human
gcagaggugggggcuggggggug

SEQ ID NO: 394568 - RNA, 21 nt, Human
gcccaugucucucccuguggc

SEQ ID NO: 394569 - RNA, 21 nt, Human
gccccggcucccuccagcccc

SEQ ID NO: 394570 - RNA, 19 nt, Human
gcugccccggcucccucca

SEQ ID NO: 394571 - RNA, 21 nt, Human
gcuggcggcggcggcggcggc

SEQ ID NO: 394572 - RNA, 22 nt, Human
ggaaaaaaugcuuuuuggcaga

SEQ ID NO: 394573 - RNA, 25 nt, Human
ggagaaagaagaaaacccaaaaaga

SEQ ID NO: 394574 - RNA, 21 nt, Human
ggagaggagggcugggggggu

SEQ ID NO: 394575 - RNA, 20 nt, Human
ggagggaggcgggcauggga

SEQ ID NO: 394576 - RNA, 25 nt, Human
ggcagaggugggggcuggggggugg

SEQ ID NO: 394577 - RNA, 22 nt, Human
ggcaugggaggggcgggaggga

SEQ ID NO: 394578 - RNA, 24 nt, Human
ggcugccccggcucccuccagccc

SEQ ID NO: 394579 - RNA, 19 nt, Human
gggagggaggcgggcaugg

SEQ ID NO: 394580 - RNA, 25 nt, Human
gggcaugggaggggcgggagggagg

SEQ ID NO: 394581 - RNA, 23 nt, Human
gggcccccagaaugccccagccu

SEQ ID NO: 394582 - RNA, 20 nt, Human
ggggagggaggcgggcaugg

SEQ ID NO: 394583 - RNA, 26 nt, Human
ggggauugaaggcugacaaucccagg

SEQ ID NO: 394584 - RNA, 18 nt, Human
guguguaugugugugugu

SEQ ID NO: 394585 - RNA, 21 nt, Human
gugugugugugugugugugug

SEQ ID NO: 394586 - RNA, 21 nt, Human
gugugugugugugugugugug

SEQ ID NO: 394587 - RNA, 21 nt, Human
gugugugugugugugugugug

SEQ ID NO: 394588 - RNA, 21 nt, Human
gugugugugugugugugugug

SEQ ID NO: 394589 - RNA, 19 nt, Human
uaaaaaaccaacaacaaac

SEQ ID NO: 394590 - RNA, 24 nt, Human
uaaaaaaccaacaacaaacaaaac

SEQ ID NO: 394591 - RNA, 27 nt, Human
uaaaaaaccaacaacaaacaaaacaaa

SEQ ID NO: 394592 - RNA, 20 nt, Human
uaaaagagacccaaaugaca

SEQ ID NO: 394593 - RNA, 21 nt, Human
uacaguauugaaaaagagguc

SEQ ID NO: 394594 - RNA, 18 nt, Human
uaugugugugugugugug

SEQ ID NO: 394595 - RNA, 24 nt, Human
uaugugugugugugugugugugag

SEQ ID NO: 394596 - RNA, 23 nt, Human
uaugugugugugugugugugugu

SEQ ID NO: 394597 - RNA, 24 nt, Human
ucccagaugcuggcggcggcggcg

SEQ ID NO: 394598 - RNA, 22 nt, Human
ucccuguggcugccccggcucc

SEQ ID NO: 394599 - RNA, 21 nt, Human
ucugcgacaccccagccccgg

SEQ ID NO: 394600 - RNA, 21 nt, Human
ugccccggcucccuccagccc

SEQ ID NO: 394601 - RNA, 22 nt, Human
ugcccuggugcguguguaugug

SEQ ID NO: 394602 - RNA, 21 nt, Human
ugccgaugcucccacagcucu

SEQ ID NO: 394603 - RNA, 21 nt, Human
ugcguguguaugugugugugu

SEQ ID NO: 394604 - RNA, 27 nt, Human
ugcguguguaugugugugugugugugu

SEQ ID NO: 394605 - RNA, 18 nt, Human
ugcucccacagcucugcg

SEQ ID NO: 394606 - RNA, 22 nt, Human
uggaggcagaggugggggcugg

SEQ ID NO: 394607 - RNA, 24 nt, Human
uggaggcagaggugggggcugggg

SEQ ID NO: 394608 - RNA, 18 nt, Human
uggcagagagaggccagg

SEQ ID NO: 394609 - RNA, 20 nt, Human
uggcagagagaggccaggca

SEQ ID NO: 394610 - RNA, 24 nt, Human
uggccucuugguuuuuuuucuccc

SEQ ID NO: 394611 - RNA, 18 nt, Human
uggcggcggcggcggcgg

SEQ ID NO: 394612 - RNA, 25 nt, Human
uggcggcggcggcggcggcgagggg

SEQ ID NO: 394613 - RNA, 20 nt, Human
ugggaggggcgggagggagg

SEQ ID NO: 394614 - RNA, 21 nt, Human
ugggaggggcgggagggaggu

SEQ ID NO: 394615 - RNA, 18 nt, Human
ugggggcugggggguggg

SEQ ID NO: 394616 - RNA, 20 nt, Human
ugggggcuggggggugggag

SEQ ID NO: 394617 - RNA, 19 nt, Human
ugggguggaagaugagacc

SEQ ID NO: 394618 - RNA, 22 nt, Human
uggugcguguguaugugugugu

SEQ ID NO: 394619 - RNA, 24 nt, Human
uguggcugccccggcucccuccag

SEQ ID NO: 394620 - RNA, 20 nt, Human
uguguaugugugugugugug

SEQ ID NO: 394621 - RNA, 18 nt, Human
ugugugugugugugugug

SEQ ID NO: 394622 - RNA, 18 nt, Human
ugugugugugugugugug

SEQ ID NO: 394623 - RNA, 18 nt, Human
ugugugugugugugugug

SEQ ID NO: 394624 - RNA, 18 nt, Human
ugugugugugugugugug

SEQ ID NO: 394625 - RNA, 18 nt, Human
ugugugugugugugugug

SEQ ID NO: 394626 - RNA, 18 nt, Human
ugugugugugugugugug

SEQ ID NO: 394627 - RNA, 18 nt, Human
ugugugugugugugugug

SEQ ID NO: 394628 - RNA, 18 nt, Human
ugugugugugugugugug

SEQ ID NO: 394629 - RNA, 18 nt, Human
ugugugugugugugugug

SEQ ID NO: 394630 - RNA, 18 nt, Human
ugugugugugugugugug

SEQ ID NO: 394631 - RNA, 18 nt, Human
ugugugugugugugugug

SEQ ID NO: 394632 - RNA, 18 nt, Human
ugugugugugugugugug

SEQ ID NO: 394633 - RNA, 18 nt, Human
ugugugugugugugugug

SEQ ID NO: 394634 - RNA, 21 nt, Human
ugugugugugugugugugugu

SEQ ID NO: 394635 - RNA, 21 nt, Human
ugugugugugugugugugugu

SEQ ID NO: 394636 - RNA, 21 nt, Human
ugugugugugugugugugugu

SEQ ID NO: 394637 - RNA, 21 nt, Human
ugugugugugugugugugugu

SEQ ID NO: 394638 - RNA, 21 nt, Human
ugugugugugugugugugugu

SEQ ID NO: 394639 - RNA, 21 nt, Human
ugugugugugugugugugugu

SEQ ID NO: 394640 - RNA, 21 nt, Human
ugugugugugugugugugugu

SEQ ID NO: 394641 - RNA, 21 nt, Human
ugugugugugugugugugugu

SEQ ID NO: 394642 - RNA, 21 nt, Human
ugugugugugugugugugugu

SEQ ID NO: 394643 - RNA, 21 nt, Human
ugugugugugugugugugugu

SEQ ID NO: 394644 - RNA, 21 nt, Human
ugugugugugugugugugugu

SEQ ID NO: 394645 - RNA, 21 nt, Human
ugugugugugugugugugugu

SEQ ID NO: 394646 - RNA, 21 nt, Human
ugugugugugugugugugugu

SEQ ID NO: 394647 - RNA, 21 nt, Human
ugugugugugugugugugugu

SEQ ID NO: 394648 - RNA, 21 nt, Human
ugugugugugugugugugugu

SEQ ID NO: 394649 - RNA, 21 nt, Human
ugugugugugugugugugugu

SEQ ID NO: 394650 - RNA, 21 nt, Human
ugugugugugugugugugugu

SEQ ID NO: 394651 - RNA, 21 nt, Human
ugugugugugugugugugugu

SEQ ID NO: 394652 - RNA, 21 nt, Human
ugugugugugugugugugugu

SEQ ID NO: 394653 - RNA, 21 nt, Human
ugugugugugugugugugugu

SEQ ID NO: 394654 - RNA, 21 nt, Human
ugugugugugugugugugugu

SEQ ID NO: 394655 - RNA, 22 nt, Human
ugugugugugugugugugugug

SEQ ID NO: 394656 - RNA, 22 nt, Human
ugugugugugugugugugugug

SEQ ID NO: 394657 - RNA, 22 nt, Human
ugugugugugugugugugugug

SEQ ID NO: 394658 - RNA, 22 nt, Human
ugugugugugugugugugugug

SEQ ID NO: 394659 - RNA, 22 nt, Human
ugugugugugugugugugugug

SEQ ID NO: 394660 - RNA, 22 nt, Human
ugugugugugugugugugugug

SEQ ID NO: 394661 - RNA, 22 nt, Human
ugugugugugugugugugugug

SEQ ID NO: 394662 - RNA, 22 nt, Human
uuaaaaaacauauuuaaaggaa

SEQ ID NO: 394663 - RNA, 22 nt, Human
uuaaaggaaaaaaugcuuuuug

SEQ ID NO: 394664 - RNA, 22 nt, Human
uuuuguuuaauuuucccuguuc

SEQ ID NO: 394665 - RNA, 18 nt, Human
accucacccaggaccuuc

SEQ ID NO: 394666 - RNA, 20 nt, Human
agcaccauccaacccuaccu

SEQ ID NO: 394667 - RNA, 21 nt, Human
cauucuguaaagacaaaagag

SEQ ID NO: 394668 - RNA, 21 nt, Human
ccauccaacccuaccucaccc

SEQ ID NO: 394669 - RNA, 21 nt, Human
cuggucauuggcauuuguauc

SEQ ID NO: 394670 - RNA, 19 nt, Human
cuguauaguaaaaggaaaa

SEQ ID NO: 394671 - RNA, 20 nt, Human
uaguaaaaggaaaauaaguc

SEQ ID NO: 394672 - RNA, 21 nt, Human
uauaagaagcuccacguagug

SEQ ID NO: 394673 - RNA, 22 nt, Human
uauaguaaaaggaaaauaaguc

SEQ ID NO: 394674 - RNA, 19 nt, Human
ucacccaggaccuucaccu

SEQ ID NO: 394675 - RNA, 23 nt, Human
uccaacccuaccucacccaggac

SEQ ID NO: 394676 - RNA, 20 nt, Human
ugaugauauuuauuuucucu

SEQ ID NO: 394677 - RNA, 21 nt, Human
aaaauccccccugcccagcuc

SEQ ID NO: 394678 - RNA, 20 nt, Human
aagaaaacuacaaaccaagg

SEQ ID NO: 394679 - RNA, 21 nt, Human
acaaaccaagguuucccacgc

SEQ ID NO: 394680 - RNA, 20 nt, Human
acacagucagacgagucagg

SEQ ID NO: 394681 - RNA, 20 nt, Human
acccccaagcccgacuagca

SEQ ID NO: 394682 - RNA, 20 nt, Human
accccucccucccaggucuc

SEQ ID NO: 394683 - RNA, 21 nt, Human
agacuucccagaggcagcucu

SEQ ID NO: 394684 - RNA, 21 nt, Human
agagcuugggccaacacagag

SEQ ID NO: 394685 - RNA, 21 nt, Human
agccagcccggcgcucccacg

SEQ ID NO: 394686 - RNA, 20 nt, Human
aggaguaacgcaaaccaaga

SEQ ID NO: 394687 - RNA, 19 nt, Human
aguaacgcaaaccaagaaa

SEQ ID NO: 394688 - RNA, 21 nt, Human
caaaccaagaaaacuacaaac

SEQ ID NO: 394689 - RNA, 22 nt, Human
caaaccaagaaaacuacaaacc

SEQ ID NO: 394690 - RNA, 24 nt, Human
caaaccaagaaaacuacaaaccaa

SEQ ID NO: 394691 - RNA, 25 nt, Human
caacuacugcagacuucccagaggc

SEQ ID NO: 394692 - RNA, 22 nt, Human
caagguuucccacgcagugccc

SEQ ID NO: 394693 - RNA, 21 nt, Human
cacaacuaaucucccguaccc

SEQ ID NO: 394694 - RNA, 19 nt, Human
caccagccacccccaagcc

SEQ ID NO: 394695 - RNA, 23 nt, Human
cagcucuggacucccgcacuccc

SEQ ID NO: 394696 - RNA, 21 nt, Human
caggagacaccgugucuugua

SEQ ID NO: 394697 - RNA, 19 nt, Human
cagugcccaccagccaccc

SEQ ID NO: 394698 - RNA, 19 nt, Human
ccacaagagcuugggccaa

SEQ ID NO: 394699 - RNA, 23 nt, Human
ccacaagagcuugggccaacaca

SEQ ID NO: 394700 - RNA, 19 nt, Human
ccaccagccacccccaagc

SEQ ID NO: 394701 - RNA, 21 nt, Human
ccacgcagugcccaccagcca

SEQ ID NO: 394702 - RNA, 23 nt, Human
ccacugggcacgaaacgccgcac

SEQ ID NO: 394703 - RNA, 18 nt, Human
ccagaggcagcucuggac

SEQ ID NO: 394704 - RNA, 18 nt, Human
cccaccagccacccccaa

SEQ ID NO: 394705 - RNA, 21 nt, Human
cccaccagccacccccaagcc

SEQ ID NO: 394706 - RNA, 19 nt, Human
ccccaggagacaccguguc

SEQ ID NO: 394707 - RNA, 18 nt, Human
cccccaagcccgacuagc

SEQ ID NO: 394708 - RNA, 22 nt, Human
cccgccccuuucugcuggagga

SEQ ID NO: 394709 - RNA, 18 nt, Human
ccguacccuuggcugcuc

SEQ ID NO: 394710 - RNA, 19 nt, Human
ccucccaggucucgcucuc

SEQ ID NO: 394711 - RNA, 24 nt, Human
ccuucaaaucuccauucauauccc

SEQ ID NO: 394712 - RNA, 21 nt, Human
cgcaaaccaagaaaacuacaa

SEQ ID NO: 394713 - RNA, 19 nt, Human
cuagcacugcucugugcac

SEQ ID NO: 394714 - RNA, 21 nt, Human
cuccauucauaucccccuuca

SEQ ID NO: 394715 - RNA, 23 nt, Human
cucccgcacucccacuccucuug

SEQ ID NO: 394716 - RNA, 19 nt, Human
cuccuccacacacagucag

SEQ ID NO: 394717 - RNA, 27 nt, Human
cuccuccacacacagucagacgaguca

SEQ ID NO: 394718 - RNA, 21 nt, Human
cucugugcacaacuaaucucc

SEQ ID NO: 394719 - RNA, 24 nt, Human
cuugcagaccuucaaaucuccauu

SEQ ID NO: 394720 - RNA, 19 nt, Human
cuuucugcuggaggacccc

SEQ ID NO: 394721 - RNA, 22 nt, Human
gagcuugggccaacacagaggg

SEQ ID NO: 394722 - RNA, 19 nt, Human
gcaccuuuucccccgcccc

SEQ ID NO: 394723 - RNA, 20 nt, Human
gcuccuuccuugccccagga

SEQ ID NO: 394724 - RNA, 20 nt, Human
gcucuggacucccgcacucc

SEQ ID NO: 394725 - RNA, 21 nt, Human
uaacaacaacaagguccagaa

SEQ ID NO: 394726 - RNA, 25 nt, Human
uauaagaaaaaaauuacagggcucc

SEQ ID NO: 394727 - RNA, 19 nt, Human
uaucccccuucaagagggc

SEQ ID NO: 394728 - RNA, 18 nt, Human
uccaaaauccccccugcc

SEQ ID NO: 394729 - RNA, 18 nt, Human
ucccagaggcagcucugg

SEQ ID NO: 394730 - RNA, 20 nt, Human
ucccccgccccuuucugcug

SEQ ID NO: 394731 - RNA, 24 nt, Human
ucuggacucccgcacucccacucc

SEQ ID NO: 394732 - RNA, 21 nt, Human
ugaaggaaggagcagccacug

SEQ ID NO: 394733 - RNA, 21 nt, Human
ugcucguucuuggcugcccca

SEQ ID NO: 394734 - RNA, 23 nt, Human
uggacucccgcacucccacuccu

SEQ ID NO: 394735 - RNA, 19 nt, Human
uggccuggacuccuccaca

SEQ ID NO: 394736 - RNA, 19 nt, Human
ugguggcuugcugcuuccc

SEQ ID NO: 394737 - RNA, 26 nt, Human
ugugcacaacuaaucucccguacccu

SEQ ID NO: 394738 - RNA, 20 nt, Human
uuccaaaauccccccugccc

SEQ ID NO: 394739 - RNA, 21 nt, Human
uucccccgccccuuucugcug

SEQ ID NO: 394740 - RNA, 26 nt, Human
uucguagugguggcuugcugcuuccc

SEQ ID NO: 394741 - RNA, 26 nt, Human
uucugcuggaggaccccucccuccca

SEQ ID NO: 394742 - RNA, 20 nt, Human
uucuuggcugccccagguuc

SEQ ID NO: 394743 - RNA, 22 nt, Human
uuuaacaacaacaagguccaga

SEQ ID NO: 394744 - RNA, 18 nt, Human
aaacaaacaaacaaaagc

SEQ ID NO: 394745 - RNA, 27 nt, Human
aaacacaaaauccuaacaacuaaauaa

SEQ ID NO: 394746 - RNA, 19 nt, Human
aaagaaaaauagcaaauga

SEQ ID NO: 394747 - RNA, 22 nt, Human
aaggaaacagaaaacccacauu

SEQ ID NO: 394748 - RNA, 18 nt, Human
acaaacaaaagcacuucg

SEQ ID NO: 394749 - RNA, 20 nt, Human
acugguaucaaaacacacau

SEQ ID NO: 394750 - RNA, 22 nt, Human
agcaaaugaaaacacaaaaucc

SEQ ID NO: 394751 - RNA, 22 nt, Human
agcauggcaauaagcuuuaacc

SEQ ID NO: 394752 - RNA, 21 nt, Human
aggccaaaaggaaacagaaaa

SEQ ID NO: 394753 - RNA, 23 nt, Human
caaaacacacauccacagcacgu

SEQ ID NO: 394754 - RNA, 23 nt, Human
caaacgaaaacaaacaaacaaaa

SEQ ID NO: 394755 - RNA, 25 nt, Human
caauaagcuuuaaccaaacgaaaac

SEQ ID NO: 394756 - RNA, 19 nt, Human
caauccuugcuuaucagag

SEQ ID NO: 394757 - RNA, 20 nt, Human
cacacauccacagcacgucc

SEQ ID NO: 394758 - RNA, 22 nt, Human
cacugaacaaacuccacagagu

SEQ ID NO: 394759 - RNA, 22 nt, Human
cagacagucuccauagccgcac

SEQ ID NO: 394760 - RNA, 22 nt, Human
cccagagaagaaaaaugauuuu

SEQ ID NO: 394761 - RNA, 20 nt, Human
ccggccguggcggggucccu

SEQ ID NO: 394762 - RNA, 21 nt, Human
ccguggcggggucccugcccu

SEQ ID NO: 394763 - RNA, 24 nt, Human
cguggcggggucccugcccugggc

SEQ ID NO: 394764 - RNA, 22 nt, Human
cuaaacguuuuccugaagccga

SEQ ID NO: 394765 - RNA, 21 nt, Human
cugcuguuugcuuggggcugu

SEQ ID NO: 394766 - RNA, 23 nt, Human
gagggcgcggugcggagcgcggg

SEQ ID NO: 394767 - RNA, 20 nt, Human
gcaauaaaccauuccaagcc

SEQ ID NO: 394768 - RNA, 19 nt, Human
gcaccagcauggcaauaag

SEQ ID NO: 394769 - RNA, 22 nt, Human
gccagcaggggugccguccaaa

SEQ ID NO: 394770 - RNA, 20 nt, Human
gcgcgggcggggacgcggag

SEQ ID NO: 394771 - RNA, 18 nt, Human
gcgcgggcuggggccggg

SEQ ID NO: 394772 - RNA, 18 nt, Human
gcgcggggcggcgcggag

SEQ ID NO: 394773 - RNA, 18 nt, Human
gcgcggugcggagcgcgg

SEQ ID NO: 394774 - RNA, 18 nt, Human
gcgcggugcggagcgcgg

SEQ ID NO: 394775 - RNA, 19 nt, Human
gcggggacgcggagagggc

SEQ ID NO: 394776 - RNA, 18 nt, Human
gggcuggggccgggccgg

SEQ ID NO: 394777 - RNA, 24 nt, Human
uaccauaagcaauaaaccauucca

SEQ ID NO: 394778 - RNA, 26 nt, Human
uaucuaaauucaauagcuuaccaaua

SEQ ID NO: 394779 - RNA, 19 nt, Human
ucaaaacacacauccacag

SEQ ID NO: 394780 - RNA, 21 nt, Human
ucaaaacacacauccacagca

SEQ ID NO: 394781 - RNA, 26 nt, Human
ucaaaacacacauccacagcacgucc

SEQ ID NO: 394782 - RNA, 23 nt, Human
ucaauagcuuaccaauaucuucu

SEQ ID NO: 394783 - RNA, 23 nt, Human
ucagcaaaaacuuuucaggggca

SEQ ID NO: 394784 - RNA, 18 nt, Human
uccacaacaggagguguu

SEQ ID NO: 394785 - RNA, 21 nt, Human
ugaaaacacaaaauccuaaca

SEQ ID NO: 394786 - RNA, 23 nt, Human
ugaaauacaauuucuucagcaaa

SEQ ID NO: 394787 - RNA, 23 nt, Human
ugauagacuuauaaguauguaaa

SEQ ID NO: 394788 - RNA, 26 nt, Human
ugcaaaacagggagagaaaagagugu

SEQ ID NO: 394789 - RNA, 20 nt, Human
ugcccgguccggccgcgcgg

SEQ ID NO: 394790 - RNA, 18 nt, Human
ugcggagcgcggggcggc

SEQ ID NO: 394791 - RNA, 26 nt, Human
ugcugcaaaacagggagagaaaagag

SEQ ID NO: 394792 - RNA, 19 nt, Human
ugcuguuugcuuggggcug

SEQ ID NO: 394793 - RNA, 21 nt, Human
uggcggggucccugcccuggg

SEQ ID NO: 394794 - RNA, 18 nt, Human
uggggccgggccgggcgg

SEQ ID NO: 394795 - RNA, 21 nt, Human
uugcuauccgccagcaggggu

SEQ ID NO: 394796 - RNA, 18 nt, Human
uuuuuuuuuuuuuuuuug

SEQ ID NO: 394797 - RNA, 20 nt, Human
uuuuuuuuuuuuuuuuuguu

SEQ ID NO: 394798 - RNA, 22 nt, Human
aaaaguaaugacauuugguuca

SEQ ID NO: 394799 - RNA, 19 nt, Human
aaaaucccaccucacagaa

SEQ ID NO: 394800 - RNA, 24 nt, Human
aaacaaaggcaaagacugaagcaa

SEQ ID NO: 394801 - RNA, 20 nt, Human
aaacaagagcucacacuaca

SEQ ID NO: 394802 - RNA, 25 nt, Human
aaacuccagauuuaggaugcuggca

SEQ ID NO: 394803 - RNA, 27 nt, Human
aaagcaccucaucuagaccuccaacua

SEQ ID NO: 394804 - RNA, 23 nt, Human
aacaaaggcaaagacugaagcaa

SEQ ID NO: 394805 - RNA, 22 nt, Human
aacuuucaucucaaucaucuca

SEQ ID NO: 394806 - RNA, 21 nt, Human
aagcaccucaucuagaccucc

SEQ ID NO: 394807 - RNA, 24 nt, Human
aagcaccucaucuagaccuccaac

SEQ ID NO: 394808 - RNA, 19 nt, Human
acaaaggcaaagacugaag

SEQ ID NO: 394809 - RNA, 22 nt, Human
acaagagcucacacuacaaaca

SEQ ID NO: 394810 - RNA, 21 nt, Human
acacagugcaaacaaaggcaa

SEQ ID NO: 394811 - RNA, 20 nt, Human
acucacacugccaacucuuc

SEQ ID NO: 394812 - RNA, 22 nt, Human
acugaacacacagugcaaacaa

SEQ ID NO: 394813 - RNA, 21 nt, Human
acuuaaguacuuaagaaguag

SEQ ID NO: 394814 - RNA, 22 nt, Human
agagcucacacuacaaacacac

SEQ ID NO: 394815 - RNA, 23 nt, Human
auacaguuuccuucuugguaaaa

SEQ ID NO: 394816 - RNA, 23 nt, Human
auagacuuuucuuuaagacaaaa

SEQ ID NO: 394817 - RNA, 22 nt, Human
aucucaaucaucucagccuuca

SEQ ID NO: 394818 - RNA, 21 nt, Human
auuuccacaaauugcacacug

SEQ ID NO: 394819 - RNA, 21 nt, Human
caaacaaaggcaaagacugaa

SEQ ID NO: 394820 - RNA, 23 nt, Human
caaacaaaggcaaagacugaagc

SEQ ID NO: 394821 - RNA, 24 nt, Human
caagagcucacacuacaaacacac

SEQ ID NO: 394822 - RNA, 22 nt, Human
cacaaaaaucccaccucacaga

SEQ ID NO: 394823 - RNA, 20 nt, Human
cacacagugcaaacaaaggc

SEQ ID NO: 394824 - RNA, 20 nt, Human
cacuauguuaacuuucaucu

SEQ ID NO: 394825 - RNA, 18 nt, Human
cagcaguucaaucugugc

SEQ ID NO: 394826 - RNA, 20 nt, Human
cagcaguucaaucugugccc

SEQ ID NO: 394827 - RNA, 21 nt, Human
caucuagaccuccaacuaguu

SEQ ID NO: 394828 - RNA, 21 nt, Human
ccacugcuguccauauucuug

SEQ ID NO: 394829 - RNA, 21 nt, Human
ccagauuuaggaugcuggcaa

SEQ ID NO: 394830 - RNA, 23 nt, Human
ccucacuacacagcuccccucuc

SEQ ID NO: 394831 - RNA, 21 nt, Human
cugcuccguguagcaaucuca

SEQ ID NO: 394832 - RNA, 19 nt, Human
cuucuugguaaaacuccag

SEQ ID NO: 394833 - RNA, 22 nt, Human
gaagauaaaugaguuggacuca

SEQ ID NO: 394834 - RNA, 18 nt, Human
gagcaucacauauugaaa

SEQ ID NO: 394835 - RNA, 18 nt, Human
gaguuggacucacacugc

SEQ ID NO: 394836 - RNA, 19 nt, Human
gaguugguauuggaaacug

SEQ ID NO: 394837 - RNA, 20 nt, Human
gcucacacuacaaacacaca

SEQ ID NO: 394838 - RNA, 20 nt, Human
ggauuauccccacuaucucc

SEQ ID NO: 394839 - RNA, 22 nt, Human
ggcaagcaauuuggucauagga

SEQ ID NO: 394840 - RNA, 21 nt, Human
ggcuuccagaaguagcccuag

SEQ ID NO: 394841 - RNA, 21 nt, Human
ggugaguugguauuggaaacu

SEQ ID NO: 394842 - RNA, 19 nt, Human
gguggugagggaacacaaa

SEQ ID NO: 394843 - RNA, 21 nt, Human
uaaagcaccucaucuagaccu

SEQ ID NO: 394844 - RNA, 18 nt, Human
uaaauuaucuaaauguca

SEQ ID NO: 394845 - RNA, 20 nt, Human
uacaaacacacaugagcauc

SEQ ID NO: 394846 - RNA, 20 nt, Human
uagaccuccaacuaguucag

SEQ ID NO: 394847 - RNA, 26 nt, Human
uagaccuccaacuaguucagcaguuc

SEQ ID NO: 394848 - RNA, 18 nt, Human
uaggaugcuggcaaaggc

SEQ ID NO: 394849 - RNA, 24 nt, Human
ucacacuacaaacacacaugagca

SEQ ID NO: 394850 - RNA, 21 nt, Human
ucagcaguucaaucugugccc

SEQ ID NO: 394851 - RNA, 25 nt, Human
ucaguaucccucacuacacagcucc

SEQ ID NO: 394852 - RNA, 19 nt, Human
ucgcuccuuucuagaagcu

SEQ ID NO: 394853 - RNA, 21 nt, Human
ucuauugggggcuuccagaag

SEQ ID NO: 394854 - RNA, 20 nt, Human
ucuccuggggacuuuucaug

SEQ ID NO: 394855 - RNA, 22 nt, Human
ucuucagggauuauccccacua

SEQ ID NO: 394856 - RNA, 20 nt, Human
ugaaaaagcuauaugaaaug

SEQ ID NO: 394857 - RNA, 19 nt, Human
ugaacacacagugcaaaca

SEQ ID NO: 394858 - RNA, 22 nt, Human
ugagaucauacaauuacugcag

SEQ ID NO: 394859 - RNA, 19 nt, Human
ugaguuggacucacacugc

SEQ ID NO: 394860 - RNA, 19 nt, Human
ugcccucaguaucccucac

SEQ ID NO: 394861 - RNA, 18 nt, Human
uggguggugagggaacac

SEQ ID NO: 394862 - RNA, 19 nt, Human
uguuucucuaguuuucacu

SEQ ID NO: 394863 - RNA, 21 nt, Human
uucagcaguucaaucugugcc

SEQ ID NO: 394864 - RNA, 21 nt, Human
uucucuaguuuucacugaaca

SEQ ID NO: 394865 - RNA, 22 nt, Human
aaaaaaaucagauaaacaaaug

SEQ ID NO: 394866 - RNA, 18 nt, Human
aaagaauacugagguacu

SEQ ID NO: 394867 - RNA, 20 nt, Human
aacauccugacaucucccuu

SEQ ID NO: 394868 - RNA, 22 nt, Human
aacucagucccccacuaauacc

SEQ ID NO: 394869 - RNA, 23 nt, Human
aacugccccucaaggaagaaggc

SEQ ID NO: 394870 - RNA, 21 nt, Human
aaggaagaaggcaggacucug

SEQ ID NO: 394871 - RNA, 18 nt, Human
aaggcuuccaguuuuucc

SEQ ID NO: 394872 - RNA, 22 nt, Human
aauaagaguccccccucccccc

SEQ ID NO: 394873 - RNA, 22 nt, Human
acaaaugaggggguacaauaug

SEQ ID NO: 394874 - RNA, 18 nt, Human
accacuccucccugcagu

SEQ ID NO: 394875 - RNA, 22 nt, Human
acccccagggcugggaccucca

SEQ ID NO: 394876 - RNA, 24 nt, Human
accucauccugucuccuucccuca

SEQ ID NO: 394877 - RNA, 21 nt, Human
acucugcccaagggugggggc

SEQ ID NO: 394878 - RNA, 19 nt, Human
acuggugguuccaagacaa

SEQ ID NO: 394879 - RNA, 23 nt, Human
aggagaccuggcuaggacagucc

SEQ ID NO: 394880 - RNA, 21 nt, Human
aggauaccugggcagggcagu

SEQ ID NO: 394881 - RNA, 18 nt, Human
aggggcaggggugaggcu

SEQ ID NO: 394882 - RNA, 24 nt, Human
agggugggggaaaaggcggggccu

SEQ ID NO: 394883 - RNA, 19 nt, Human
aucacaucuccucuucccc

SEQ ID NO: 394884 - RNA, 18 nt, Human
auccugucuccuucccuc

SEQ ID NO: 394885 - RNA, 25 nt, Human
auguugcugagggacaagggugggg

SEQ ID NO: 394886 - RNA, 25 nt, Human
caaaauaagaguccccccucccccc

SEQ ID NO: 394887 - RNA, 26 nt, Human
caaaguuaaaagcgcaucaaacacgc

SEQ ID NO: 394888 - RNA, 24 nt, Human
caaccuaaccccggacgaccgccc

SEQ ID NO: 394889 - RNA, 18 nt, Human
caagacaaaggauggagc

SEQ ID NO: 394890 - RNA, 25 nt, Human
cacuaauacccaucaccuucccaaa

SEQ ID NO: 394891 - RNA, 18 nt, Human
cacugccgccuccuccgc

SEQ ID NO: 394892 - RNA, 19 nt, Human
cacugcgcgggcgggcggc

SEQ ID NO: 394893 - RNA, 24 nt, Human
caggggcaggggugaggcugugau

SEQ ID NO: 394894 - RNA, 20 nt, Human
cauguugaaaaagaauacuu

SEQ ID NO: 394895 - RNA, 19 nt, Human
ccacugccgccuccuccgc

SEQ ID NO: 394896 - RNA, 18 nt, Human
ccaggggaggggugaggc

SEQ ID NO: 394897 - RNA, 22 nt, Human
ccauuacuugacuccucuucug

SEQ ID NO: 394898 - RNA, 26 nt, Human
cccagcucgccacugccgccuccucc

SEQ ID NO: 394899 - RNA, 21 nt, Human
cccagguuaaggcaggggagc

SEQ ID NO: 394900 - RNA, 24 nt, Human
ccccacuaauacccaucaccuucc

SEQ ID NO: 394901 - RNA, 18 nt, Human
ccccagcaauccaaagcu

SEQ ID NO: 394902 - RNA, 18 nt, Human
cccccagcucgccacugc

SEQ ID NO: 394903 - RNA, 21 nt, Human
cccccuaacaaaauaagaguc

SEQ ID NO: 394904 - RNA, 19 nt, Human
ccccggacgaccgcccucc

SEQ ID NO: 394905 - RNA, 24 nt, Human
ccccuaacaaaauaagaguccccc

SEQ ID NO: 394906 - RNA, 19 nt, Human
ccccucaaccuaaccccgg

SEQ ID NO: 394907 - RNA, 19 nt, Human
ccccuuccuucauccucuu

SEQ ID NO: 394908 - RNA, 19 nt, Human
ccgggcgagcccugccagg

SEQ ID NO: 394909 - RNA, 19 nt, Human
ccucaucugacuccuccuc

SEQ ID NO: 394910 - RNA, 20 nt, Human
ccuccaagcuucugccuugc

SEQ ID NO: 394911 - RNA, 24 nt, Human
ccuccaagcuucugccuugcuggg

SEQ ID NO: 394912 - RNA, 20 nt, Human
ccuccauuccuagaaggcca

SEQ ID NO: 394913 - RNA, 25 nt, Human
ccuccuccaagcuucugccuugcug

SEQ ID NO: 394914 - RNA, 23 nt, Human
ccucuugcccuacauguugaaaa

SEQ ID NO: 394915 - RNA, 18 nt, Human
ccugaaauaccugugcug

SEQ ID NO: 394916 - RNA, 23 nt, Human
ccuggccccagcaauccaaagcu

SEQ ID NO: 394917 - RNA, 21 nt, Human
ccugggcagagcagggcaggg

SEQ ID NO: 394918 - RNA, 18 nt, Human
ccuuggguguagguauga

SEQ ID NO: 394919 - RNA, 19 nt, Human
ccuuggguguagguaugag

SEQ ID NO: 394920 - RNA, 22 nt, Human
ccuuuggggaaggugcagggcc

SEQ ID NO: 394921 - RNA, 21 nt, Human
cgagaccucauccugucuccu

SEQ ID NO: 394922 - RNA, 23 nt, Human
cggccccgggcgagcccugccag

SEQ ID NO: 394923 - RNA, 18 nt, Human
cuaaccccggacgaccgc

SEQ ID NO: 394924 - RNA, 21 nt, Human
cucaaccuaaccccggacgac

SEQ ID NO: 394925 - RNA, 18 nt, Human
cucagagcccuccuaggu

SEQ ID NO: 394926 - RNA, 19 nt, Human
cucauccugucuccuuccc

SEQ ID NO: 394927 - RNA, 19 nt, Human
cucauguccuucuccagcc

SEQ ID NO: 394928 - RNA, 19 nt, Human
cucggcccggucccccuaa

SEQ ID NO: 394929 - RNA, 23 nt, Human
cugggggaaggcuuccaguuuuu

SEQ ID NO: 394930 - RNA, 23 nt, Human
gaacggaccgacgcccccccuca

SEQ ID NO: 394931 - RNA, 20 nt, Human
gaagggguggggccuggcuc

SEQ ID NO: 394932 - RNA, 20 nt, Human
gacuggugguuccaagacaa

SEQ ID NO: 394933 - RNA, 22 nt, Human
gaucucauguccuucuccagcc

SEQ ID NO: 394934 - RNA, 21 nt, Human
ggaagggguggggccuggcuc

SEQ ID NO: 394935 - RNA, 26 nt, Human
ggagcaacauccugacaucucccuuu

SEQ ID NO: 394936 - RNA, 18 nt, Human
ggagcaauaaaaaaauca

SEQ ID NO: 394937 - RNA, 19 nt, Human
ggagggugggggaaaaggc

SEQ ID NO: 394938 - RNA, 20 nt, Human
ggcggcgucggggagauggg

SEQ ID NO: 394939 - RNA, 20 nt, Human
gggaaggggcagagcuuaaa

SEQ ID NO: 394940 - RNA, 18 nt, Human
gggaagggguggggccug

SEQ ID NO: 394941 - RNA, 19 nt, Human
gggaagggguggggccugg

SEQ ID NO: 394942 - RNA, 23 nt, Human
gggagugucucuugauaacucug

SEQ ID NO: 394943 - RNA, 19 nt, Human
gggcagagcagggcagggu

SEQ ID NO: 394944 - RNA, 18 nt, Human
gggcaggguucaugggga

SEQ ID NO: 394945 - RNA, 21 nt, Human
gggcugugaucuccacaagca

SEQ ID NO: 394946 - RNA, 18 nt, Human
ggucagguuggucccagg

SEQ ID NO: 394947 - RNA, 22 nt, Human
gguggggccuggcuccuccauu

SEQ ID NO: 394948 - RNA, 21 nt, Human
guccuucuccagccuucuccu

SEQ ID NO: 394949 - RNA, 20 nt, Human
gugggggaaaaggcggggcc

SEQ ID NO: 394950 - RNA, 24 nt, Human
uaaacccccagggcugggaccucc

SEQ ID NO: 394951 - RNA, 27 nt, Human
uaacaaaauaagaguccccccuccccc

SEQ ID NO: 394952 - RNA, 20 nt, Human
uaaccccggacgaccgcccu

SEQ ID NO: 394953 - RNA, 21 nt, Human
uaagaguccccccucccccca

SEQ ID NO: 394954 - RNA, 25 nt, Human
uaagaguccccccuccccccagcuc

SEQ ID NO: 394955 - RNA, 19 nt, Human
uaaucuguccccuucccca

SEQ ID NO: 394956 - RNA, 22 nt, Human
uagaccccucaguauacccucc

SEQ ID NO: 394957 - RNA, 19 nt, Human
uaggacagucccuagggga

SEQ ID NO: 394958 - RNA, 24 nt, Human
uaggucagguuggucccagguuaa

SEQ ID NO: 394959 - RNA, 23 nt, Human
uauagggaagggguggggccugg

SEQ ID NO: 394960 - RNA, 18 nt, Human
ucacaaaccuauagaccc

SEQ ID NO: 394961 - RNA, 21 nt, Human
ucacaucuccucuucccccag

SEQ ID NO: 394962 - RNA, 21 nt, Human
ucaguauacccuccauggggc

SEQ ID NO: 394963 - RNA, 18 nt, Human
ucauggggaaggggcaga

SEQ ID NO: 394964 - RNA, 22 nt, Human
uccaagacaaaggauggagcaa

SEQ ID NO: 394965 - RNA, 22 nt, Human
uccauuacuugacuccucuucu

SEQ ID NO: 394966 - RNA, 22 nt, Human
uccccaagagcaagguuggcuc

SEQ ID NO: 394967 - RNA, 24 nt, Human
uccccagggggcaggcccugaucu

SEQ ID NO: 394968 - RNA, 23 nt, Human
ucccccacuaauacccaucaccu

SEQ ID NO: 394969 - RNA, 25 nt, Human
uccccccagcucgccacugccgccu

SEQ ID NO: 394970 - RNA, 20 nt, Human
ucccccgcccagaacggacc

SEQ ID NO: 394971 - RNA, 20 nt, Human
ucccucaccugggcaaggau

SEQ ID NO: 394972 - RNA, 22 nt, Human
uccuauagggaagggguggggc

SEQ ID NO: 394973 - RNA, 20 nt, Human
uccuccgcuaagccauggag

SEQ ID NO: 394974 - RNA, 18 nt, Human
ucugaaauaccugcacug

SEQ ID NO: 394975 - RNA, 21 nt, Human
ucugaaauaccugcacugggc

SEQ ID NO: 394976 - RNA, 22 nt, Human
ugaaauggggugauuccuccaa

SEQ ID NO: 394977 - RNA, 22 nt, Human
ugaaauuucauaaucugucccc

SEQ ID NO: 394978 - RNA, 19 nt, Human
ugaggggguacaauaugcu

SEQ ID NO: 394979 - RNA, 18 nt, Human
ugaggggugggaauggag

SEQ ID NO: 394980 - RNA, 19 nt, Human
ugagucaucccccgcccag

SEQ ID NO: 394981 - RNA, 24 nt, Human
ugcagggccucaucugacuccucc

SEQ ID NO: 394982 - RNA, 18 nt, Human
ugccugggcagagcaggg

SEQ ID NO: 394983 - RNA, 21 nt, Human
ugccugggcagagcagggcag

SEQ ID NO: 394984 - RNA, 19 nt, Human
ugcugagggacaagggugg

SEQ ID NO: 394985 - RNA, 20 nt, Human
ugcuuuuacaacccuccucc

SEQ ID NO: 394986 - RNA, 23 nt, Human
uggccugguccuacugauucuuu

SEQ ID NO: 394987 - RNA, 20 nt, Human
ugggaaagucccaggggagg

SEQ ID NO: 394988 - RNA, 23 nt, Human
ugggaaagucccaggggaggggu

SEQ ID NO: 394989 - RNA, 22 nt, Human
ugggcaaggaugagucccacag

SEQ ID NO: 394990 - RNA, 18 nt, Human
uggggaaggggcagagcu

SEQ ID NO: 394991 - RNA, 19 nt, Human
uggggccuggcuccuccau

SEQ ID NO: 394992 - RNA, 20 nt, Human
ugguuccaagacaaaggaug

SEQ ID NO: 394993 - RNA, 20 nt, Human
uugcugagggacaagggugg

SEQ ID NO: 394994 - RNA, 22 nt, Human
uugcugagggacaagggugggg

SEQ ID NO: 394995 - RNA, 20 nt, Human
uuucccaggagaccuggcua

SEQ ID NO: 394996 - RNA, 24 nt, Human
uuuuuuuuuuuuuuuuuuucaaag

SEQ ID NO: 394997 - RNA, 23 nt, Human
aacucccacccuccgaucagagg

SEQ ID NO: 394998 - RNA, 24 nt, Human
aagcacaguguuuacuaaaggcac

SEQ ID NO: 394999 - RNA, 21 nt, Human
aagccaggccccaagugcuga

SEQ ID NO: 395000 - RNA, 18 nt, Human
aauuuccauggucaucuc

SEQ ID NO: 395001 - RNA, 18 nt, Human
acaaagcacaguguuuac

SEQ ID NO: 395002 - RNA, 18 nt, Human
agcaccaaaguggggggu

SEQ ID NO: 395003 - RNA, 22 nt, Human
agccgaggaccaggcugcgggg

SEQ ID NO: 395004 - RNA, 18 nt, Human
aggagggaggcagggcag

SEQ ID NO: 395005 - RNA, 19 nt, Human
aggggccaacggggaggag

SEQ ID NO: 395006 - RNA, 18 nt, Human
aggggcugaaggccucuu

SEQ ID NO: 395007 - RNA, 19 nt, Human
aguccucacaacagccugu

SEQ ID NO: 395008 - RNA, 23 nt, Human
aucuccaccaggcccucuucuca

SEQ ID NO: 395009 - RNA, 20 nt, Human
cacccugccccucccugccc

SEQ ID NO: 395010 - RNA, 24 nt, Human
cacccuuaguccucacaacagccu

SEQ ID NO: 395011 - RNA, 21 nt, Human
caccugugggagagccgagga

SEQ ID NO: 395012 - RNA, 23 nt, Human
cagacaggcacuaaguccaaaca

SEQ ID NO: 395013 - RNA, 21 nt, Human
cagccccaagccaggccccaa

SEQ ID NO: 395014 - RNA, 18 nt, Human
cagcccccaggccggccc

SEQ ID NO: 395015 - RNA, 19 nt, Human
cagcccccgcgcucacacc

SEQ ID NO: 395016 - RNA, 23 nt, Human
cagcccccgcgcucacaccaccu

SEQ ID NO: 395017 - RNA, 22 nt, Human
caggcugccagacaggcacuaa

SEQ ID NO: 395018 - RNA, 18 nt, Human
ccaccaggcccucuucuc

SEQ ID NO: 395019 - RNA, 20 nt, Human
ccagcccccaggccggcccc

SEQ ID NO: 395020 - RNA, 21 nt, Human
ccagcccccaggccggccccu

SEQ ID NO: 395021 - RNA, 19 nt, Human
ccaggccccaagugcugac

SEQ ID NO: 395022 - RNA, 20 nt, Human
ccagggcagccccaagccag

SEQ ID NO: 395023 - RNA, 18 nt, Human
ccauggucaucuccaggg

SEQ ID NO: 395024 - RNA, 21 nt, Human
cccagcccccaggccggcccc

SEQ ID NO: 395025 - RNA, 23 nt, Human
cccauguaccaggcacugccgca

SEQ ID NO: 395026 - RNA, 22 nt, Human
ccccaggccggccccuguuccc

SEQ ID NO: 395027 - RNA, 19 nt, Human
cccccaggaccaguugccu

SEQ ID NO: 395028 - RNA, 20 nt, Human
cccccgcgcucacaccaccu

SEQ ID NO: 395029 - RNA, 26 nt, Human
cccccgcgcucacaccaccuggugga

SEQ ID NO: 395030 - RNA, 22 nt, Human
ccccucccugccccgcgauucc

SEQ ID NO: 395031 - RNA, 20 nt, Human
ccccuggcccucccagcccc

SEQ ID NO: 395032 - RNA, 19 nt, Human
cccugaacucccacccucc

SEQ ID NO: 395033 - RNA, 21 nt, Human
ccugaagggugggagggaggu

SEQ ID NO: 395034 - RNA, 22 nt, Human
cgaucagaggaggccaacccaa

SEQ ID NO: 395035 - RNA, 23 nt, Human
cgaucagaggaggccaacccaau

SEQ ID NO: 395036 - RNA, 24 nt, Human
cggcagugaccccucccgcuucug

SEQ ID NO: 395037 - RNA, 25 nt, Human
cggcagugaccccucccgcuucugg

SEQ ID NO: 395038 - RNA, 21 nt, Human
cuagaacacccugccccuccc

SEQ ID NO: 395039 - RNA, 22 nt, Human
cucccagcccccaggccggccc

SEQ ID NO: 395040 - RNA, 20 nt, Human
cugagcacccccaggaccag

SEQ ID NO: 395041 - RNA, 18 nt, Human
cugagucccaaaaaggca

SEQ ID NO: 395042 - RNA, 21 nt, Human
gaggaggccaacccaauuucc

SEQ ID NO: 395043 - RNA, 21 nt, Human
gcagugaccccucccgcuucu

SEQ ID NO: 395044 - RNA, 18 nt, Human
gccccgcgauuccaucuc

SEQ ID NO: 395045 - RNA, 19 nt, Human
gccgaggaccaggcugcgg

SEQ ID NO: 395046 - RNA, 21 nt, Human
ggaacccugaacucccacccu

SEQ ID NO: 395047 - RNA, 24 nt, Human
ggagcuucccgaaccccucaagca

SEQ ID NO: 395048 - RNA, 20 nt, Human
ggaggagggaggcagggcag

SEQ ID NO: 395049 - RNA, 19 nt, Human
ggauccacacuguacaugc

SEQ ID NO: 395050 - RNA, 19 nt, Human
ggcacaggggcagccaggg

SEQ ID NO: 395051 - RNA, 22 nt, Human
ggcgcuggcucccauguaccag

SEQ ID NO: 395052 - RNA, 22 nt, Human
gggcagcugcucuuccggcagu

SEQ ID NO: 395053 - RNA, 18 nt, Human
gggcucagaagacaggga

SEQ ID NO: 395054 - RNA, 19 nt, Human
guggagagcuauuagcacc

SEQ ID NO: 395055 - RNA, 20 nt, Human
uacaugcauauauguucacu

SEQ ID NO: 395056 - RNA, 28 nt, Human
uaccaggcacugccgcacccuuaguccu

SEQ ID NO: 395057 - RNA, 18 nt, Human
ucaccucuagaacacccu

SEQ ID NO: 395058 - RNA, 18 nt, Human
uccauggucaucuccagg

SEQ ID NO: 395059 - RNA, 19 nt, Human
uccauggucaucuccaggg

SEQ ID NO: 395060 - RNA, 23 nt, Human
ucucccuccucucagaugaggau

SEQ ID NO: 395061 - RNA, 21 nt, Human
ucugagucccaaaaaggcagg

SEQ ID NO: 395062 - RNA, 22 nt, Human
ucugggaacccugaacucccac

SEQ ID NO: 395063 - RNA, 18 nt, Human
ugaccccacaggcugccu

SEQ ID NO: 395064 - RNA, 18 nt, Human
ugacugcccuccaucccc

SEQ ID NO: 395065 - RNA, 21 nt, Human
ugccccuggcccucccagccc

SEQ ID NO: 395066 - RNA, 22 nt, Human
ugccccuggcccucccagcccc

SEQ ID NO: 395067 - RNA, 22 nt, Human
ugcccugggggugcuucuccug

SEQ ID NO: 395068 - RNA, 23 nt, Human
uggcagcccccgcgcucacacca

SEQ ID NO: 395069 - RNA, 20 nt, Human
ugggagagccgaggaccagg

SEQ ID NO: 395070 - RNA, 20 nt, Human
ugggagggaggugccccugg

SEQ ID NO: 395071 - RNA, 21 nt, Human
ugggagggaggugccccugga

SEQ ID NO: 395072 - RNA, 22 nt, Human
uggggggugcccaccuguggga

SEQ ID NO: 395073 - RNA, 21 nt, Human
uguaccaggcacugccgcacc

SEQ ID NO: 395074 - RNA, 20 nt, Human
uuagcaccaaaguggggggu

SEQ ID NO: 395075 - RNA, 21 nt, Human
uuaguccucacaacagccugu

SEQ ID NO: 395076 - RNA, 21 nt, Human
aggaugcaggcagaucccugc

SEQ ID NO: 395077 - RNA, 23 nt, Human
cacagcugcagaagcgugucuga

SEQ ID NO: 395078 - RNA, 21 nt, Human
caccgugcuggggacggcacc

SEQ ID NO: 395079 - RNA, 20 nt, Human
caggaugcaggcagaucccu

SEQ ID NO: 395080 - RNA, 22 nt, Human
cgucaggaugcaggcagauccc

SEQ ID NO: 395081 - RNA, 21 nt, Human
ugagccgaggcacagcugcag

SEQ ID NO: 395082 - RNA, 21 nt, Human
uguccgguggagguggcagcc

SEQ ID NO: 395083 - RNA, 19 nt, Human
aaagaaacaaaacccaggg

SEQ ID NO: 395084 - RNA, 27 nt, Human
aagcacaaccucagaaagucucaggca

SEQ ID NO: 395085 - RNA, 19 nt, Human
aauguuuacuguacaaaga

SEQ ID NO: 395086 - RNA, 18 nt, Human
acagaaaagcugagauga

SEQ ID NO: 395087 - RNA, 20 nt, Human
acccucccgcccucucccac

SEQ ID NO: 395088 - RNA, 21 nt, Human
acugcagcuccuuagggaguc

SEQ ID NO: 395089 - RNA, 22 nt, Human
agaaaagcugagaugaacagug

SEQ ID NO: 395090 - RNA, 21 nt, Human
agaaagucucaggcacgaaga

SEQ ID NO: 395091 - RNA, 18 nt, Human
aggaagcggcacuuacag

SEQ ID NO: 395092 - RNA, 18 nt, Human
caaagaaacaaaacccag

SEQ ID NO: 395093 - RNA, 19 nt, Human
caccaagaaagacuuguga

SEQ ID NO: 395094 - RNA, 23 nt, Human
cacccucccgcccucucccacga

SEQ ID NO: 395095 - RNA, 21 nt, Human
cagacaguuuuucucucccaa

SEQ ID NO: 395096 - RNA, 23 nt, Human
cagacucuccccugacacccucc

SEQ ID NO: 395097 - RNA, 18 nt, Human
cagcaagcgguaagggcc

SEQ ID NO: 395098 - RNA, 18 nt, Human
cagcagaaauaaagcaca

SEQ ID NO: 395099 - RNA, 18 nt, Human
caguucagcccccacugu

SEQ ID NO: 395100 - RNA, 22 nt, Human
ccucccgcccucucccacgacg

SEQ ID NO: 395101 - RNA, 24 nt, Human
cgggcaagggugcuccgagccucg

SEQ ID NO: 395102 - RNA, 18 nt, Human
cucucccaaaggggagag

SEQ ID NO: 395103 - RNA, 26 nt, Human
cugacacccucccgcccucucccacg

SEQ ID NO: 395104 - RNA, 24 nt, Human
cuuugucaagcucccagacaguuu

SEQ ID NO: 395105 - RNA, 21 nt, Human
gacucuccccugacacccucc

SEQ ID NO: 395106 - RNA, 23 nt, Human
gacuugugauuuuugaaaacuuc

SEQ ID NO: 395107 - RNA, 23 nt, Human
gcacaaccucagaaagucucagg

SEQ ID NO: 395108 - RNA, 24 nt, Human
gcacaaccucagaaagucucaggc

SEQ ID NO: 395109 - RNA, 21 nt, Human
ggagaggucaguucagccccc

SEQ ID NO: 395110 - RNA, 23 nt, Human
ggccgggggcagcuggaggugcc

SEQ ID NO: 395111 - RNA, 18 nt, Human
ggguggagcaugggaccu

SEQ ID NO: 395112 - RNA, 18 nt, Human
guuccuaggcuuuccugu

SEQ ID NO: 395113 - RNA, 30 nt, Human
uagggagucuuuuccugcccuugaggccuu

SEQ ID NO: 395114 - RNA, 18 nt, Human
ucaagcucccagacaguu

SEQ ID NO: 395115 - RNA, 20 nt, Human
ucagcccccacuguuuuggc

SEQ ID NO: 395116 - RNA, 21 nt, Human
ugaaauaaaggaccacuuugg

SEQ ID NO: 395117 - RNA, 22 nt, Human
ugaacuuucagcagaagcgcuu

SEQ ID NO: 395118 - RNA, 18 nt, Human
ugacgugggugccagucu

SEQ ID NO: 395119 - RNA, 20 nt, Human
ugagaugaacagugccuggc

SEQ ID NO: 395120 - RNA, 23 nt, Human
uggaagacaguuuuauuggcuug

SEQ ID NO: 395121 - RNA, 21 nt, Human
uucaaaauauccuugcaugca

SEQ ID NO: 395122 - RNA, 21 nt, Human
aaaaaauguccuuucgccccu

SEQ ID NO: 395123 - RNA, 27 nt, Human
aaaaagccaaguaagauggugggcacc

SEQ ID NO: 395124 - RNA, 21 nt, Human
aagaacagaggcgggagcaag

SEQ ID NO: 395125 - RNA, 22 nt, Human
agaaagucaagucaaucacuuu

SEQ ID NO: 395126 - RNA, 22 nt, Human
auaaaaaaugcucugcuuuuaa

SEQ ID NO: 395127 - RNA, 18 nt, Human
caacaaugauaucauaaa

SEQ ID NO: 395128 - RNA, 22 nt, Human
caaguaagauggcuaaaccuca

SEQ ID NO: 395129 - RNA, 21 nt, Human
cccaacaagccuagcgagaac

SEQ ID NO: 395130 - RNA, 21 nt, Human
ccuagcauuuuaauauccucc

SEQ ID NO: 395131 - RNA, 20 nt, Human
cgggagcaagaaaaaaaaaa

SEQ ID NO: 395132 - RNA, 24 nt, Human
cgggagcaagaaaaaaaaaaaugu

SEQ ID NO: 395133 - RNA, 22 nt, Human
cuccggacaagggaagcuagaa

SEQ ID NO: 395134 - RNA, 22 nt, Human
gaacagaggcgggagcaagaaa

SEQ ID NO: 395135 - RNA, 21 nt, Human
gagcaagaaaaaaaaaaaugu

SEQ ID NO: 395136 - RNA, 19 nt, Human
gcccccucgguugcccuuc

SEQ ID NO: 395137 - RNA, 21 nt, Human
gcgaggccacuggacuggggc

SEQ ID NO: 395138 - RNA, 21 nt, Human
gcgggccccggccaaucgcgc

SEQ ID NO: 395139 - RNA, 19 nt, Human
gcucuguacguggcaggug

SEQ ID NO: 395140 - RNA, 23 nt, Human
ggaagaacagaggcgggagcaag

SEQ ID NO: 395141 - RNA, 22 nt, Human
ggacuggggcgucgcggggagg

SEQ ID NO: 395142 - RNA, 24 nt, Human
ggggaggcgguggucacggccccc

SEQ ID NO: 395143 - RNA, 24 nt, Human
guacuggagucuuuugggaggcca

SEQ ID NO: 395144 - RNA, 24 nt, Human
uaaaaagccaaguaagauggcuaa

SEQ ID NO: 395145 - RNA, 24 nt, Human
uaacaccaacaaugauaucauaaa

SEQ ID NO: 395146 - RNA, 20 nt, Human
uaacuaagaagcugcuacau

SEQ ID NO: 395147 - RNA, 18 nt, Human
uaagauggcuaaaccuca

SEQ ID NO: 395148 - RNA, 18 nt, Human
uagagaaagacggcuugc

SEQ ID NO: 395149 - RNA, 23 nt, Human
uagagaaagacggcuugcggagg

SEQ ID NO: 395150 - RNA, 22 nt, Human
uauuaaccuaucaucaguguua

SEQ ID NO: 395151 - RNA, 20 nt, Human
ucuuuugggaggccaauagc

SEQ ID NO: 395152 - RNA, 22 nt, Human
ugaaugggcggacgcgaggcca

SEQ ID NO: 395153 - RNA, 20 nt, Human
ugacccaacaagccuagcga

SEQ ID NO: 395154 - RNA, 22 nt, Human
ugacccaacaagccuagcgaga

SEQ ID NO: 395155 - RNA, 20 nt, Human
uggcuaaaccucacccuagc

SEQ ID NO: 395156 - RNA, 22 nt, Human
uggcuaaaccucacccuagcau

SEQ ID NO: 395157 - RNA, 22 nt, Human
ugggcucuguacguggcaggug

SEQ ID NO: 395158 - RNA, 21 nt, Human
uggggcgucgcggggaggcgg

SEQ ID NO: 395159 - RNA, 18 nt, Human
uuuuuuuuuuuuuuuuug

SEQ ID NO: 395160 - RNA, 20 nt, Human
uuuuuuuuuuuuuuuuuugg

SEQ ID NO: 395161 - RNA, 23 nt, Human
aaaucaggaauacgaccccaaga

SEQ ID NO: 395162 - RNA, 21 nt, Human
aaccauaaaggcaaauaagcc

SEQ ID NO: 395163 - RNA, 21 nt, Human
aagccauaaagacaaacaaga

SEQ ID NO: 395164 - RNA, 23 nt, Human
aagugacuuguauuaauaaaaac

SEQ ID NO: 395165 - RNA, 22 nt, Human
aauaagccauaaagacaaacaa

SEQ ID NO: 395166 - RNA, 22 nt, Human
aauucagucucacaaacaguug

SEQ ID NO: 395167 - RNA, 23 nt, Human
acaaccauaaaggcaaauaagcc

SEQ ID NO: 395168 - RNA, 20 nt, Human
accccaagaaaugagugagu

SEQ ID NO: 395169 - RNA, 20 nt, Human
agccauaaagacaaacaaga

SEQ ID NO: 395170 - RNA, 25 nt, Human
auaaaaacuggugaauaaaucacca

SEQ ID NO: 395171 - RNA, 21 nt, Human
caaccauaaaggcaaauaagc

SEQ ID NO: 395172 - RNA, 20 nt, Human
cucacaaacaguugaaccau

SEQ ID NO: 395173 - RNA, 21 nt, Human
uaaaggcaaauaagccauaaa

SEQ ID NO: 395174 - RNA, 20 nt, Human
uacgaccccaagaaaugagg

SEQ ID NO: 395175 - RNA, 21 nt, Human
ugaaaucaggaauacgacccc

SEQ ID NO: 395176 - RNA, 20 nt, Human
ugaauaaaucaccaaugaag

SEQ ID NO: 395177 - RNA, 22 nt, Human
ugauccucuucugaaaucagga

SEQ ID NO: 395178 - RNA, 23 nt, Human
ugauccucuucugaaaucaggaa

SEQ ID NO: 395179 - RNA, 23 nt, Human
ugauuuguuuccucaugcuguca

SEQ ID NO: 395180 - RNA, 19 nt, Human
ugguagacucacauuugaa

SEQ ID NO: 395181 - RNA, 24 nt, Human
aggagcucuugacugggggacggg

SEQ ID NO: 395182 - RNA, 23 nt, Human
cucugagccaccucccugacccu

SEQ ID NO: 395183 - RNA, 21 nt, Human
cuuguguccccuccugaagcc

SEQ ID NO: 395184 - RNA, 25 nt, Human
gaggagcucuugacugggggacggg

SEQ ID NO: 395185 - RNA, 23 nt, Human
gcucuugacugggggacggggau

SEQ ID NO: 395186 - RNA, 19 nt, Human
ucccugacccugaaucauu

SEQ ID NO: 395187 - RNA, 22 nt, Human
ucccugacccugaaucauucaa

SEQ ID NO: 395188 - RNA, 27 nt, Human
ugagagguggacucugagccaccuccc

SEQ ID NO: 395189 - RNA, 20 nt, Human
uggacucugagccaccuccc

SEQ ID NO: 395190 - RNA, 19 nt, Human
uucaagcgaggagcagagg

SEQ ID NO: 395191 - RNA, 21 nt, Human
uuguguccccuccugaagccu

SEQ ID NO: 395192 - RNA, 19 nt, Human
aaaagauagggaauuauag

SEQ ID NO: 395193 - RNA, 20 nt, Human
aaacugguucucuuucaaug

SEQ ID NO: 395194 - RNA, 19 nt, Human
aaaggacagaaagcucucc

SEQ ID NO: 395195 - RNA, 22 nt, Human
aacauuauaaauguaugcugcu

SEQ ID NO: 395196 - RNA, 23 nt, Human
aaccacuuacaaccuucagcaga

SEQ ID NO: 395197 - RNA, 22 nt, Human
aaccauaaagguaacaaaaacc

SEQ ID NO: 395198 - RNA, 21 nt, Human
aacugguuucugacauuuuca

SEQ ID NO: 395199 - RNA, 24 nt, Human
aagacaucucaagaccaggagcuu

SEQ ID NO: 395200 - RNA, 19 nt, Human
aagaugucauugcaugaag

SEQ ID NO: 395201 - RNA, 18 nt, Human
accacgaauggguaggca

SEQ ID NO: 395202 - RNA, 21 nt, Human
accacgaauggguaggcagac

SEQ ID NO: 395203 - RNA, 23 nt, Human
acccaaugcuuaaugaccacaaa

SEQ ID NO: 395204 - RNA, 22 nt, Human
acugcauuuaggaaaaccagca

SEQ ID NO: 395205 - RNA, 21 nt, Human
agaaacaaaaauaacaaagaa

SEQ ID NO: 395206 - RNA, 22 nt, Human
agacacugcucccgauaaugug

SEQ ID NO: 395207 - RNA, 19 nt, Human
agcccuuaggauucagaga

SEQ ID NO: 395208 - RNA, 20 nt, Human
aggaaagaggcaguucccau

SEQ ID NO: 395209 - RNA, 23 nt, Human
aggaggccguuuccaacugcccu

SEQ ID NO: 395210 - RNA, 23 nt, Human
aggcagacgugucagaccuucag

SEQ ID NO: 395211 - RNA, 21 nt, Human
aggcuuaugggggaagggaca

SEQ ID NO: 395212 - RNA, 19 nt, Human
aggggacucuccuucccca

SEQ ID NO: 395213 - RNA, 23 nt, Human
aguaacucaacccuaacuguaga

SEQ ID NO: 395214 - RNA, 23 nt, Human
agugguugaauuuacccacccaa

SEQ ID NO: 395215 - RNA, 21 nt, Human
augacaaacagcuguacuaca

SEQ ID NO: 395216 - RNA, 22 nt, Human
caaaguaagcgaaccacuuaca

SEQ ID NO: 395217 - RNA, 21 nt, Human
caacaggaaagaggcaguucc

SEQ ID NO: 395218 - RNA, 23 nt, Human
caagaccaggagcuugucacuag

SEQ ID NO: 395219 - RNA, 22 nt, Human
cacaaaauguuucugcaacuaa

SEQ ID NO: 395220 - RNA, 25 nt, Human
cacaagucuagaaaccagacuaccc

SEQ ID NO: 395221 - RNA, 21 nt, Human
cacucacacuagcgcguccuc

SEQ ID NO: 395222 - RNA, 18 nt, Human
cacugcauuuaggaaaac

SEQ ID NO: 395223 - RNA, 23 nt, Human
cacugcauuuaggaaaaccagca

SEQ ID NO: 395224 - RNA, 18 nt, Human
cacuuagcuacgcuaaau

SEQ ID NO: 395225 - RNA, 22 nt, Human
cagcacaagucuagaaaccaga

SEQ ID NO: 395226 - RNA, 20 nt, Human
cagugccaaaaggacagaaa

SEQ ID NO: 395227 - RNA, 21 nt, Human
caucauggacauuuuuuaagu

SEQ ID NO: 395228 - RNA, 20 nt, Human
caugaagaaaauuaugggaa

SEQ ID NO: 395229 - RNA, 28 nt, Human
cauuacaaagcacuuaaaauucuagaga

SEQ ID NO: 395230 - RNA, 18 nt, Human
ccaaaaggacagaaagcu

SEQ ID NO: 395231 - RNA, 22 nt, Human
ccaaaaggacagaaagcucucc

SEQ ID NO: 395232 - RNA, 21 nt, Human
ccaacugcccuaugacaaaca

SEQ ID NO: 395233 - RNA, 18 nt, Human
ccaaugcuuaaugaccac

SEQ ID NO: 395234 - RNA, 22 nt, Human
ccacagccccuuccccacaggc

SEQ ID NO: 395235 - RNA, 19 nt, Human
ccacaggcucgcggccccg

SEQ ID NO: 395236 - RNA, 19 nt, Human
ccauaaagguaacaaaaac

SEQ ID NO: 395237 - RNA, 21 nt, Human
ccccgccuggggccgcgaccg

SEQ ID NO: 395238 - RNA, 21 nt, Human
ccgcucgaggcgccgccacag

SEQ ID NO: 395239 - RNA, 22 nt, Human
ccuacauuuaauugaucaccac

SEQ ID NO: 395240 - RNA, 22 nt, Human
ccuacuccuuaacgagaagaca

SEQ ID NO: 395241 - RNA, 18 nt, Human
ccugcagccgcucgaggc

SEQ ID NO: 395242 - RNA, 21 nt, Human
cgagaagacaucucaagacca

SEQ ID NO: 395243 - RNA, 24 nt, Human
cgagaagacaucucaagaccagga

SEQ ID NO: 395244 - RNA, 21 nt, Human
cgaggcgccgccacagccccu

SEQ ID NO: 395245 - RNA, 19 nt, Human
cgccacagccccuucccca

SEQ ID NO: 395246 - RNA, 23 nt, Human
cgccacagccccuuccccacagg

SEQ ID NO: 395247 - RNA, 27 nt, Human
cgccgccacagccccuuccccacaggc

SEQ ID NO: 395248 - RNA, 23 nt, Human
cuccagccagccccgcaggauga

SEQ ID NO: 395249 - RNA, 20 nt, Human
cuccccgugcggcucccuaa

SEQ ID NO: 395250 - RNA, 24 nt, Human
cugccuaaagacaucuaguaguac

SEQ ID NO: 395251 - RNA, 20 nt, Human
gaaccugaagagacccuaug

SEQ ID NO: 395252 - RNA, 23 nt, Human
gaagaaacaaaaauaacaaagaa

SEQ ID NO: 395253 - RNA, 22 nt, Human
gagucugcaacuaaacaccuga

SEQ ID NO: 395254 - RNA, 18 nt, Human
gaucacucaaaguaagcg

SEQ ID NO: 395255 - RNA, 23 nt, Human
gcaagaaaacaagcccaucucuu

SEQ ID NO: 395256 - RNA, 20 nt, Human
gcaggaugaagggaggacac

SEQ ID NO: 395257 - RNA, 27 nt, Human
gcccccaaaccuucuauacaaaguccc

SEQ ID NO: 395258 - RNA, 22 nt, Human
gccgccacagccccuuccccac

SEQ ID NO: 395259 - RNA, 20 nt, Human
gcuucugguccccucuuuuc

SEQ ID NO: 395260 - RNA, 21 nt, Human
ggaaaagaaaauauacuaagu

SEQ ID NO: 395261 - RNA, 25 nt, Human
ggaccuggagaaaccauaaagguag

SEQ ID NO: 395262 - RNA, 22 nt, Human
gggacagaggaaaagaaaauau

SEQ ID NO: 395263 - RNA, 20 nt, Human
guaacaugcaaauaauguga

SEQ ID NO: 395264 - RNA, 20 nt, Human
guagaaaaggguuuucugaa

SEQ ID NO: 395265 - RNA, 23 nt, Human
guaguaccaagaugaugggaugg

SEQ ID NO: 395266 - RNA, 25 nt, Human
uaaagagacugugaguagugacaca

SEQ ID NO: 395267 - RNA, 18 nt, Human
uaacaacaacaggaaaga

SEQ ID NO: 395268 - RNA, 21 nt, Human
uaacacccgaaccaggaaucu

SEQ ID NO: 395269 - RNA, 19 nt, Human
uaagaaccugaagagaccc

SEQ ID NO: 395270 - RNA, 23 nt, Human
uacaaagcacuuaaaauucuaga

SEQ ID NO: 395271 - RNA, 23 nt, Human
uacuacacguuuauaugaugguu

SEQ ID NO: 395272 - RNA, 18 nt, Human
uaggaaguaacucaaccc

SEQ ID NO: 395273 - RNA, 22 nt, Human
uaggaaguaacucaacccuaac

SEQ ID NO: 395274 - RNA, 21 nt, Human
uauggaagacacugcucccga

SEQ ID NO: 395275 - RNA, 21 nt, Human
uauggaaggcacugcuuccga

SEQ ID NO: 395276 - RNA, 21 nt, Human
ucauggacauuuuuuaagugg

SEQ ID NO: 395277 - RNA, 19 nt, Human
uccaaaaggcccuacuccu

SEQ ID NO: 395278 - RNA, 18 nt, Human
uccaagauaaaagaggag

SEQ ID NO: 395279 - RNA, 21 nt, Human
uccaagauaaaagaggagauu

SEQ ID NO: 395280 - RNA, 22 nt, Human
ucccggccgccccgccuggggc

SEQ ID NO: 395281 - RNA, 24 nt, Human
ucccggccgccccgccuggggccg

SEQ ID NO: 395282 - RNA, 21 nt, Human
uccgcacuaaguuuauaggag

SEQ ID NO: 395283 - RNA, 21 nt, Human
uccuuccccacagcccccaaa

SEQ ID NO: 395284 - RNA, 22 nt, Human
ucugcaacuaaacaccugaaac

SEQ ID NO: 395285 - RNA, 22 nt, Human
ugaagagacucacugcugcaaa

SEQ ID NO: 395286 - RNA, 20 nt, Human
ugaagggaggacacgaggga

SEQ ID NO: 395287 - RNA, 21 nt, Human
ugagucugcaacuaaacaccu

SEQ ID NO: 395288 - RNA, 18 nt, Human
ugcuggacagcaccggag

SEQ ID NO: 395289 - RNA, 20 nt, Human
uggaaaggcuuagaucucau

SEQ ID NO: 395290 - RNA, 21 nt, Human
uggaagaaacaaaaauaacaa

SEQ ID NO: 395291 - RNA, 20 nt, Human
uggcaagaaaacaagcccau

SEQ ID NO: 395292 - RNA, 26 nt, Human
ugggauggaauuuuaacaucagguuu

SEQ ID NO: 395293 - RNA, 18 nt, Human
uguacuacacguuuauau

SEQ ID NO: 395294 - RNA, 24 nt, Human
uuagauacuaacgaucuucaagcu

SEQ ID NO: 395295 - RNA, 21 nt, Human
uuauggaaaggcuuagaucuu

SEQ ID NO: 395296 - RNA, 21 nt, Human
uucaaugugcuuuggaagaaa

SEQ ID NO: 395297 - RNA, 24 nt, Human
uucagaccucauuggcaagaaaac

SEQ ID NO: 395298 - RNA, 23 nt, Human
uuccaguaucuguuggguuuuau

SEQ ID NO: 395299 - RNA, 19 nt, Human
uucccgcuccccgugcggc

SEQ ID NO: 395300 - RNA, 24 nt, Human
uuggagaggucuuucaaccuggua

SEQ ID NO: 395301 - RNA, 23 nt, Human
uuggcuucugguccccucuuuuc

SEQ ID NO: 395302 - RNA, 20 nt, Human
uuucauaaaugacacugagg

SEQ ID NO: 395303 - RNA, 21 nt, Human
uuucccuaggaggccguuucc

SEQ ID NO: 395304 - RNA, 24 nt, Human
aaguggcuauuuuagagaaaaaga

SEQ ID NO: 395305 - RNA, 22 nt, Human
agagaaaaagaugaccauagug

SEQ ID NO: 395306 - RNA, 24 nt, Human
agguuuuuggggagcucaagggcu

SEQ ID NO: 395307 - RNA, 18 nt, Human
ggcagccucgggugaggu

SEQ ID NO: 395308 - RNA, 21 nt, Human
uagauacuuuauugaagguaa

SEQ ID NO: 395309 - RNA, 22 nt, Human
ugagguuuuuggggagcucaag

SEQ ID NO: 395310 - RNA, 19 nt, Human
uuuagagaaaaagaugacc

SEQ ID NO: 395311 - RNA, 18 nt, Human
agcgcgggcgcgggagag

SEQ ID NO: 395312 - RNA, 21 nt, Human
aggaagccgcucccacagucc

SEQ ID NO: 395313 - RNA, 22 nt, Human
aucucauaaggcaauuucuuuc

SEQ ID NO: 395314 - RNA, 26 nt, Human
caagcgcggaauccaaggaagccgcu

SEQ ID NO: 395315 - RNA, 23 nt, Human
ccggggccggaagcgcgggcgcg

SEQ ID NO: 395316 - RNA, 22 nt, Human
cgacgcagcgguuggccaaagc

SEQ ID NO: 395317 - RNA, 19 nt, Human
cgcgcgggcgcgccggggc

SEQ ID NO: 395318 - RNA, 23 nt, Human
gagagacgcggcgccaagggggu

SEQ ID NO: 395319 - RNA, 22 nt, Human
ggaauccaaggaagccgcuccc

SEQ ID NO: 395320 - RNA, 22 nt, Human
gggcccagggacgacgcagcgg

SEQ ID NO: 395321 - RNA, 25 nt, Human
uaaaagaaaaaaacaacuuaaaugc

SEQ ID NO: 395322 - RNA, 21 nt, Human
uaaaugcauacauacagaaua

SEQ ID NO: 395323 - RNA, 24 nt, Human
uacagaauagaauacacuuacuua

SEQ ID NO: 395324 - RNA, 20 nt, Human
ucccacaguccucgcgcggg

SEQ ID NO: 395325 - RNA, 23 nt, Human
ugcauacauacagaauagaauac

SEQ ID NO: 395326 - RNA, 21 nt, Human
uggccaaagcgcgacgccgag

SEQ ID NO: 395327 - RNA, 21 nt, Human
aaaaagcaacuggugacccau

SEQ ID NO: 395328 - RNA, 20 nt, Human
aaaaauccccaaauaagcca

SEQ ID NO: 395329 - RNA, 19 nt, Human
aaccaagcaacaaaaugga

SEQ ID NO: 395330 - RNA, 24 nt, Human
aagaaauauauagccuggaaucca

SEQ ID NO: 395331 - RNA, 19 nt, Human
aagacccacauaguggagg

SEQ ID NO: 395332 - RNA, 18 nt, Human
aagacuuuucccaagccu

SEQ ID NO: 395333 - RNA, 20 nt, Human
aagagaucaaagcccagaac

SEQ ID NO: 395334 - RNA, 21 nt, Human
aagcaacaaaccaaccaagca

SEQ ID NO: 395335 - RNA, 19 nt, Human
aaggcacuucuagggaggc

SEQ ID NO: 395336 - RNA, 22 nt, Human
aagugcuucagguguggcauug

SEQ ID NO: 395337 - RNA, 18 nt, Human
aauggaaaauaaaugacu

SEQ ID NO: 395338 - RNA, 19 nt, Human
acaaaccaaccaagcaaca

SEQ ID NO: 395339 - RNA, 21 nt, Human
acccagccucugguuccaucu

SEQ ID NO: 395340 - RNA, 19 nt, Human
accugcaaaacacaauccc

SEQ ID NO: 395341 - RNA, 26 nt, Human
agaaaucuccuguguugggcagaauu

SEQ ID NO: 395342 - RNA, 20 nt, Human
agaacauucacagacacuaa

SEQ ID NO: 395343 - RNA, 21 nt, Human
agaaccaacuagagggcaggg

SEQ ID NO: 395344 - RNA, 22 nt, Human
agacacacacacucuuccucuc

SEQ ID NO: 395345 - RNA, 26 nt, Human
agagggcaggggucuccugagcagga

SEQ ID NO: 395346 - RNA, 18 nt, Human
agaggucuaaaaaccagu

SEQ ID NO: 395347 - RNA, 20 nt, Human
agaucaaagcccagaaccaa

SEQ ID NO: 395348 - RNA, 21 nt, Human
agccggggcccugucuuccag

SEQ ID NO: 395349 - RNA, 18 nt, Human
aggaagacccacauagug

SEQ ID NO: 395350 - RNA, 27 nt, Human
aggcaaaugacagaaaacaagggaccc

SEQ ID NO: 395351 - RNA, 20 nt, Human
agggagcuugcagagaugga

SEQ ID NO: 395352 - RNA, 25 nt, Human
aucccaucuuuuucuccuuucucag

SEQ ID NO: 395353 - RNA, 19 nt, Human
augcauuuuuaacuugaaa

SEQ ID NO: 395354 - RNA, 22 nt, Human
augggggcuuuucauugucucc

SEQ ID NO: 395355 - RNA, 23 nt, Human
caaaauuaacuuaccacacaaaa

SEQ ID NO: 395356 - RNA, 23 nt, Human
caaaggacugacuuggaaggcac

SEQ ID NO: 395357 - RNA, 24 nt, Human
caauguguucuugguuuugggcau

SEQ ID NO: 395358 - RNA, 19 nt, Human
cacacucuuccucucuccc

SEQ ID NO: 395359 - RNA, 18 nt, Human
cacauaaggaguuuauau

SEQ ID NO: 395360 - RNA, 23 nt, Human
cacccuggaagacuuuucccaag

SEQ ID NO: 395361 - RNA, 25 nt, Human
cagaaccaacuagagggcagggguu

SEQ ID NO: 395362 - RNA, 19 nt, Human
cagugggaaaaauccaggc

SEQ ID NO: 395363 - RNA, 18 nt, Human
cauguguguuacaggcau

SEQ ID NO: 395364 - RNA, 21 nt, Human
cauuaaauggcagagggagcc

SEQ ID NO: 395365 - RNA, 28 nt, Human
ccaaccaagcaacaaaauggaaaauaaa

SEQ ID NO: 395366 - RNA, 23 nt, Human
ccagaagcacaaauucuccuccc

SEQ ID NO: 395367 - RNA, 18 nt, Human
ccagccucugguuccauc

SEQ ID NO: 395368 - RNA, 21 nt, Human
ccaucuguccagccucauucc

SEQ ID NO: 395369 - RNA, 26 nt, Human
cccaguaggcaaaugacagaaaacaa

SEQ ID NO: 395370 - RNA, 22 nt, Human
ccccaugggucagauggaccca

SEQ ID NO: 395371 - RNA, 20 nt, Human
ccccuccuucacuuucuucc

SEQ ID NO: 395372 - RNA, 21 nt, Human
ccggggcccugucuuccagau

SEQ ID NO: 395373 - RNA, 20 nt, Human
ccucucuccccaacagaggg

SEQ ID NO: 395374 - RNA, 22 nt, Human
ccuggccaaacuccuccucugg

SEQ ID NO: 395375 - RNA, 20 nt, Human
ccuggcuugguuccacgugu

SEQ ID NO: 395376 - RNA, 18 nt, Human
ccuuagcugucuugaaga

SEQ ID NO: 395377 - RNA, 20 nt, Human
ccuucucuugaggggaaagg

SEQ ID NO: 395378 - RNA, 20 nt, Human
cucaauaacaaugcacauua

SEQ ID NO: 395379 - RNA, 26 nt, Human
cuccagaagcacaaauucuccucccu

SEQ ID NO: 395380 - RNA, 20 nt, Human
cugaauaaccccaagcagac

SEQ ID NO: 395381 - RNA, 22 nt, Human
cugcggggacacaauggccagc

SEQ ID NO: 395382 - RNA, 21 nt, Human
cuggaagacuuuucccaagcc

SEQ ID NO: 395383 - RNA, 20 nt, Human
gagaucaaagcccagaacca

SEQ ID NO: 395384 - RNA, 23 nt, Human
gaggaagugaacccauuuaauca

SEQ ID NO: 395385 - RNA, 20 nt, Human
gcagaagacaacugcacaca

SEQ ID NO: 395386 - RNA, 20 nt, Human
ggagccaaugcuuaucaguc

SEQ ID NO: 395387 - RNA, 21 nt, Human
ggaugcuacagucaagccuca

SEQ ID NO: 395388 - RNA, 22 nt, Human
ggcacuggcaggugugacuugc

SEQ ID NO: 395389 - RNA, 22 nt, Human
ggcacuggcaggugugacuugc

SEQ ID NO: 395390 - RNA, 27 nt, Human
ggcacuggcaggugugacuugcuggga

SEQ ID NO: 395391 - RNA, 20 nt, Human
ggcagcuuaccaggucagga

SEQ ID NO: 395392 - RNA, 22 nt, Human
gggaaaaauccaggcuccauaa

SEQ ID NO: 395393 - RNA, 19 nt, Human
gggcacuggcaggugugac

SEQ ID NO: 395394 - RNA, 21 nt, Human
gggcacuggcaggugugacuu

SEQ ID NO: 395395 - RNA, 23 nt, Human
gggcacuggcaggugugacuugc

SEQ ID NO: 395396 - RNA, 22 nt, Human
ggugaacaggaguccgucucuu

SEQ ID NO: 395397 - RNA, 23 nt, Human
ggugaacaggaguccgucucuuu

SEQ ID NO: 395398 - RNA, 23 nt, Human
guacaguacaacucaauaacaau

SEQ ID NO: 395399 - RNA, 18 nt, Human
guccauggaagauguugg

SEQ ID NO: 395400 - RNA, 20 nt, Human
gucuccugagcaguguuaga

SEQ ID NO: 395401 - RNA, 19 nt, Human
guguccauggaagauguug

SEQ ID NO: 395402 - RNA, 19 nt, Human
guguguccagccggggccc

SEQ ID NO: 395403 - RNA, 23 nt, Human
uaaaaaccuggagcugugucaac

SEQ ID NO: 395404 - RNA, 21 nt, Human
uaaaaauaaagcaacaaacca

SEQ ID NO: 395405 - RNA, 30 nt, Human
uaaagcaacaaaccaaccaagcaacaaaag

SEQ ID NO: 395406 - RNA, 24 nt, Human
uaaauuauuaagacuaagaagagg

SEQ ID NO: 395407 - RNA, 24 nt, Human
uaacuuaccacacaaaauaaauua

SEQ ID NO: 395408 - RNA, 22 nt, Human
uagaacauucacagacacuaaa

SEQ ID NO: 395409 - RNA, 22 nt, Human
uaggggaagacaaaauucucug

SEQ ID NO: 395410 - RNA, 23 nt, Human
uauguuagaacauuuaaaaauau

SEQ ID NO: 395411 - RNA, 23 nt, Human
ucaaaauuaacuuaccacacaaa

SEQ ID NO: 395412 - RNA, 18 nt, Human
ucagcucugaacagaucc

SEQ ID NO: 395413 - RNA, 24 nt, Human
ucaguacucucucucucucugugu

SEQ ID NO: 395414 - RNA, 22 nt, Human
ucauugucuccugagccauugg

SEQ ID NO: 395415 - RNA, 19 nt, Human
ucccugcugauggauuugc

SEQ ID NO: 395416 - RNA, 18 nt, Human
uccgcugauuucuucucu

SEQ ID NO: 395417 - RNA, 19 nt, Human
uccgucucuuugcaguucu

SEQ ID NO: 395418 - RNA, 25 nt, Human
ucgaaaauaaauagcaaaguuaaac

SEQ ID NO: 395419 - RNA, 18 nt, Human
ucuccuguguugggcaga

SEQ ID NO: 395420 - RNA, 20 nt, Human
ucuccuuucucagggaaaag

SEQ ID NO: 395421 - RNA, 24 nt, Human
ucugaaccccuaccuuuauucccc

SEQ ID NO: 395422 - RNA, 21 nt, Human
ucugaauuauaaaaaaaaaau

SEQ ID NO: 395423 - RNA, 19 nt, Human
ucuguaccugcaaaacaca

SEQ ID NO: 395424 - RNA, 22 nt, Human
ucuuccagaucaggguuggcug

SEQ ID NO: 395425 - RNA, 21 nt, Human
ugaaaugccuauggcucgugg

SEQ ID NO: 395426 - RNA, 24 nt, Human
ugaauaaccccaagcagacggagu

SEQ ID NO: 395427 - RNA, 22 nt, Human
ugacugaaaaagcaacugguga

SEQ ID NO: 395428 - RNA, 19 nt, Human
ugacugggcagguuggaag

SEQ ID NO: 395429 - RNA, 20 nt, Human
ugagccauuggaaacagcga

SEQ ID NO: 395430 - RNA, 21 nt, Human
ugaggccucucacugcaugug

SEQ ID NO: 395431 - RNA, 22 nt, Human
ugagggcacuggcaggugugac

SEQ ID NO: 395432 - RNA, 21 nt, Human
ugauauuaaacaguuuccccu

SEQ ID NO: 395433 - RNA, 18 nt, Human
ugccaaaaaugaagacac

SEQ ID NO: 395434 - RNA, 18 nt, Human
ugcuagggggucagcucu

SEQ ID NO: 395435 - RNA, 19 nt, Human
ugcuagggggucagcucug

SEQ ID NO: 395436 - RNA, 22 nt, Human
uggaggccuuuuaaaaaauguu

SEQ ID NO: 395437 - RNA, 23 nt, Human
uggcagugcuguccugaagaagc

SEQ ID NO: 395438 - RNA, 23 nt, Human
uggccaaacuccuccucugggcu

SEQ ID NO: 395439 - RNA, 21 nt, Human
uggcgauagcuugggaugguc

SEQ ID NO: 395440 - RNA, 23 nt, Human
uggcgauagcuugggauggucuu

SEQ ID NO: 395441 - RNA, 19 nt, Human
ugggugggugaguggcaau

SEQ ID NO: 395442 - RNA, 23 nt, Human
ugguuccaucuccgcacccugga

SEQ ID NO: 395443 - RNA, 21 nt, Human
uguagaagucugaagggguuu

SEQ ID NO: 395444 - RNA, 19 nt, Human
uguggcacacccaggcauc

SEQ ID NO: 395445 - RNA, 19 nt, Human
uguguggcagcuuaccagg

SEQ ID NO: 395446 - RNA, 19 nt, Human
uguguggcagcuuaccagg

SEQ ID NO: 395447 - RNA, 24 nt, Human
uguuacaggcauaaggaugagggc

SEQ ID NO: 395448 - RNA, 18 nt, Human
uuacuggaauaguuuucc

SEQ ID NO: 395449 - RNA, 23 nt, Human
uuagagccucauuaguccauccc

SEQ ID NO: 395450 - RNA, 18 nt, Human
uuaggaaaaaaagguuca

SEQ ID NO: 395451 - RNA, 22 nt, Human
uucaaugucauguguccaugga

SEQ ID NO: 395452 - RNA, 23 nt, Human
uucauuuucuaaagggcaaggaa

SEQ ID NO: 395453 - RNA, 19 nt, Human
uuccuagggaugagcuauc

SEQ ID NO: 395454 - RNA, 21 nt, Human
uucuccuuuuaaaaauaaagc

SEQ ID NO: 395455 - RNA, 21 nt, Human
uugaagauaacaggcaguuuu

SEQ ID NO: 395456 - RNA, 23 nt, Human
uuuccccuccuucacuuucuucc

SEQ ID NO: 395457 - RNA, 19 nt, Human
aaagugcuaggauuacagg

SEQ ID NO: 395458 - RNA, 22 nt, Human
aaagugcuaggauuacaggcgu

SEQ ID NO: 395459 - RNA, 23 nt, Human
aaagugcuaggauuacaggcgug

SEQ ID NO: 395460 - RNA, 24 nt, Human
aaagugcuaggauuacaggcguga

SEQ ID NO: 395461 - RNA, 27 nt, Human
aagagguccccgcgccuccggcuccca

SEQ ID NO: 395462 - RNA, 25 nt, Human
aagugauccucccaccuuagccucc

SEQ ID NO: 395463 - RNA, 25 nt, Human
aagugauccucccaccuuagccucc

SEQ ID NO: 395464 - RNA, 19 nt, Human
accccgccuggccugaacu

SEQ ID NO: 395465 - RNA, 25 nt, Human
acuaucccccacuaaagcagguucc

SEQ ID NO: 395466 - RNA, 25 nt, Human
acuauguuacccaggcuggucucaa

SEQ ID NO: 395467 - RNA, 19 nt, Human
agaaagggucuaggaugcg

SEQ ID NO: 395468 - RNA, 21 nt, Human
agacaggcaggaggaggcaga

SEQ ID NO: 395469 - RNA, 20 nt, Human
agagagggagagagagggag

SEQ ID NO: 395470 - RNA, 18 nt, Human
agccuccagaguagcugg

SEQ ID NO: 395471 - RNA, 21 nt, Human
aggaacuccucccuuaaccuc

SEQ ID NO: 395472 - RNA, 18 nt, Human
aggcagcgggggcggggc

SEQ ID NO: 395473 - RNA, 24 nt, Human
aggcagcgggggcggggcggggug

SEQ ID NO: 395474 - RNA, 22 nt, Human
agggggcagggagggagcaagc

SEQ ID NO: 395475 - RNA, 21 nt, Human
aguauccucccaucucugccu

SEQ ID NO: 395476 - RNA, 21 nt, Human
agugguggaggggaggcuugg

SEQ ID NO: 395477 - RNA, 22 nt, Human
auccgcaguccucucuccaucu

SEQ ID NO: 395478 - RNA, 24 nt, Human
auccucccaucucugccucccaaa

SEQ ID NO: 395479 - RNA, 24 nt, Human
caaaagugcuaggauuacaggcgu

SEQ ID NO: 395480 - RNA, 20 nt, Human
caagagguccccgcgccucc

SEQ ID NO: 395481 - RNA, 24 nt, Human
caaguauccucccaucucugccuc

SEQ ID NO: 395482 - RNA, 24 nt, Human
cacuauguuacccaggcuggucuc

SEQ ID NO: 395483 - RNA, 23 nt, Human
cacuucaacagugcccaaggugc

SEQ ID NO: 395484 - RNA, 21 nt, Human
cagacaggcaggaggaggcag

SEQ ID NO: 395485 - RNA, 23 nt, Human
cagccuugaccucccaggaucaa

SEQ ID NO: 395486 - RNA, 18 nt, Human
cagcggcaacggaaaagu

SEQ ID NO: 395487 - RNA, 20 nt, Human
caggccggggaugaaggcgg

SEQ ID NO: 395488 - RNA, 22 nt, Human
caguaguguuccccacuggucc

SEQ ID NO: 395489 - RNA, 21 nt, Human
cagugguggaggggaggcuug

SEQ ID NO: 395490 - RNA, 22 nt, Human
cagugguggaggggaggcuugg

SEQ ID NO: 395491 - RNA, 22 nt, Human
ccagaguagcugggaccacagg

SEQ ID NO: 395492 - RNA, 25 nt, Human
ccagaguagcugggaccacaggugu

SEQ ID NO: 395493 - RNA, 21 nt, Human
ccaggugggcuuggggcacgg

SEQ ID NO: 395494 - RNA, 21 nt, Human
cccaaugacacagagauccgc

SEQ ID NO: 395495 - RNA, 23 nt, Human
cccaccuuagccuccagaguagc

SEQ ID NO: 395496 - RNA, 20 nt, Human
cccacuaaagcagguuccug

SEQ ID NO: 395497 - RNA, 21 nt, Human
cccaucucugccucccaaaag

SEQ ID NO: 395498 - RNA, 22 nt, Human
cccaugggcaaggcagcggggg

SEQ ID NO: 395499 - RNA, 24 nt, Human
cccaugggcaaggcagcgggggcg

SEQ ID NO: 395500 - RNA, 18 nt, Human
ccccaggugggcuugggg

SEQ ID NO: 395501 - RNA, 25 nt, Human
cccccaugggcaaggcagcgggggc

SEQ ID NO: 395502 - RNA, 18 nt, Human
cccccggccggggcccuc

SEQ ID NO: 395503 - RNA, 18 nt, Human
ccccgccccugcaggggc

SEQ ID NO: 395504 - RNA, 20 nt, Human
ccccugcaggggcugggggu

SEQ ID NO: 395505 - RNA, 25 nt, Human
cccgagggcugguccggaauggggg

SEQ ID NO: 395506 - RNA, 18 nt, Human
cccgcgggcggcucagag

SEQ ID NO: 395507 - RNA, 20 nt, Human
cccgcuccuccucccccucc

SEQ ID NO: 395508 - RNA, 19 nt, Human
cccugcccccggccggggc

SEQ ID NO: 395509 - RNA, 24 nt, Human
ccucccaccuuagccuccagagua

SEQ ID NO: 395510 - RNA, 19 nt, Human
ccucccaucucugccuccc

SEQ ID NO: 395511 - RNA, 22 nt, Human
ccucccaucucugccucccaaa

SEQ ID NO: 395512 - RNA, 18 nt, Human
ccucccccuccuccccgc

SEQ ID NO: 395513 - RNA, 21 nt, Human
ccuccccgcaguggcgggggc

SEQ ID NO: 395514 - RNA, 22 nt, Human
ccuggauucaaguauccuccca

SEQ ID NO: 395515 - RNA, 19 nt, Human
cgacuccuuccuccgcucc

SEQ ID NO: 395516 - RNA, 18 nt, Human
cgcgccuccggcucccag

SEQ ID NO: 395517 - RNA, 22 nt, Human
cggaaugggggcgccugaggga

SEQ ID NO: 395518 - RNA, 21 nt, Human
cggggcggggcggggcggggc

SEQ ID NO: 395519 - RNA, 24 nt, Human
cuccagaguagcugggaccacagg

SEQ ID NO: 395520 - RNA, 21 nt, Human
cucccuuaaccucucugggcu

SEQ ID NO: 395521 - RNA, 22 nt, Human
cucccuuaaccucucugggcuu

SEQ ID NO: 395522 - RNA, 19 nt, Human
cugcagccuugaccuccca

SEQ ID NO: 395523 - RNA, 24 nt, Human
cuuagccuccagaguagcugggac

SEQ ID NO: 395524 - RNA, 18 nt, Human
gagggaaagcugaggcuc

SEQ ID NO: 395525 - RNA, 24 nt, Human
gaguagcugggaccacagguguac

SEQ ID NO: 395526 - RNA, 23 nt, Human
gauuacaggcgugagcaccccgc

SEQ ID NO: 395527 - RNA, 20 nt, Human
gcagcgggggcggggcgggg

SEQ ID NO: 395528 - RNA, 21 nt, Human
gcccccaugggcaaggcagcg

SEQ ID NO: 395529 - RNA, 18 nt, Human
gcgcagugguggagggga

SEQ ID NO: 395530 - RNA, 19 nt, Human
gcgccaagagguccccgcg

SEQ ID NO: 395531 - RNA, 26 nt, Human
gcggcgugcagggggugcgcccgagg

SEQ ID NO: 395532 - RNA, 22 nt, Human
gcgggguggggccgggccugcc

SEQ ID NO: 395533 - RNA, 20 nt, Human
gcuccucggcgacuccuucc

SEQ ID NO: 395534 - RNA, 18 nt, Human
ggaaugggggcgccugag

SEQ ID NO: 395535 - RNA, 21 nt, Human
ggaaugggggcgccugaggga

SEQ ID NO: 395536 - RNA, 20 nt, Human
ggagagagagggagugggag

SEQ ID NO: 395537 - RNA, 18 nt, Human
ggaggcggcgccccccgg

SEQ ID NO: 395538 - RNA, 20 nt, Human
ggaggcuuggaccgggggug

SEQ ID NO: 395539 - RNA, 21 nt, Human
ggaggggaggcuuggaccggg

SEQ ID NO: 395540 - RNA, 21 nt, Human
ggauuacaggcgugagcaccc

SEQ ID NO: 395541 - RNA, 23 nt, Human
ggcagagagggagagagagggag

SEQ ID NO: 395542 - RNA, 21 nt, Human
ggcagcgggggcggggcgggg

SEQ ID NO: 395543 - RNA, 18 nt, Human
ggcagggagggagcaagc

SEQ ID NO: 395544 - RNA, 21 nt, Human
ggcuggugugguggggaggcc

SEQ ID NO: 395545 - RNA, 24 nt, Human
gggccgggccugccggggcggggc

SEQ ID NO: 395546 - RNA, 21 nt, Human
gggcgcagugguggaggggag

SEQ ID NO: 395547 - RNA, 18 nt, Human
gggcgggguggggccggg

SEQ ID NO: 395548 - RNA, 19 nt, Human
gggcuggugugguggggag

SEQ ID NO: 395549 - RNA, 21 nt, Human
ggggaugaaggcggcgugcag

SEQ ID NO: 395550 - RNA, 19 nt, Human
ggggcggggcggggugggg

SEQ ID NO: 395551 - RNA, 21 nt, Human
gggggcggggcgggguggggc

SEQ ID NO: 395552 - RNA, 19 nt, Human
gggggcucaggagacaggc

SEQ ID NO: 395553 - RNA, 22 nt, Human
ggggggggugccccggacgggg

SEQ ID NO: 395554 - RNA, 20 nt, Human
gguaccagaagguggguggu

SEQ ID NO: 395555 - RNA, 25 nt, Human
ggucggagagagauccgucuccugg

SEQ ID NO: 395556 - RNA, 19 nt, Human
ggucuggggaaaagucuuu

SEQ ID NO: 395557 - RNA, 19 nt, Human
gucugggguccccaagucc

SEQ ID NO: 395558 - RNA, 23 nt, Human
guggcgggggcggcggcggcucg

SEQ ID NO: 395559 - RNA, 18 nt, Human
uacagcccccaugggcaa

SEQ ID NO: 395560 - RNA, 20 nt, Human
uaccagaagguggguggucu

SEQ ID NO: 395561 - RNA, 22 nt, Human
uagagauagggucucacuaugu

SEQ ID NO: 395562 - RNA, 18 nt, Human
uaggauuacaggcgugag

SEQ ID NO: 395563 - RNA, 20 nt, Human
uaggauuacaggcgugagca

SEQ ID NO: 395564 - RNA, 22 nt, Human
uaggauuacaggcgugagcacc

SEQ ID NO: 395565 - RNA, 23 nt, Human
uaggauuacaggcgugagcaccc

SEQ ID NO: 395566 - RNA, 24 nt, Human
uagggucucacuauguuacccagg

SEQ ID NO: 395567 - RNA, 21 nt, Human
uaguguuccccacuggucccc

SEQ ID NO: 395568 - RNA, 23 nt, Human
uauccucccaucucugccuccca

SEQ ID NO: 395569 - RNA, 23 nt, Human
uauguuacccaggcuggucucaa

SEQ ID NO: 395570 - RNA, 24 nt, Human
uauguuacccaggcuggucucaaa

SEQ ID NO: 395571 - RNA, 23 nt, Human
ucaagugauccucccaccuuagc

SEQ ID NO: 395572 - RNA, 25 nt, Human
ucaagugauccucccaccuuagccu

SEQ ID NO: 395573 - RNA, 19 nt, Human
ucagagucccugccaucuc

SEQ ID NO: 395574 - RNA, 18 nt, Human
ucagggagaagggcgcag

SEQ ID NO: 395575 - RNA, 25 nt, Human
ucccaaaagugcuaggauuacaggc

SEQ ID NO: 395576 - RNA, 21 nt, Human
uccccgcgccuccggcuccca

SEQ ID NO: 395577 - RNA, 27 nt, Human
ucccgaccagcucgucccuccucccgc

SEQ ID NO: 395578 - RNA, 19 nt, Human
ucccgcuccuccucccccu

SEQ ID NO: 395579 - RNA, 19 nt, Human
ucccggcaaaagguaggag

SEQ ID NO: 395580 - RNA, 19 nt, Human
ucccuccucccgcuccucc

SEQ ID NO: 395581 - RNA, 19 nt, Human
uccuccucccccuccuccc

SEQ ID NO: 395582 - RNA, 18 nt, Human
uccuggaggagaaagggu

SEQ ID NO: 395583 - RNA, 22 nt, Human
uccuuaaauacagcccccaugg

SEQ ID NO: 395584 - RNA, 19 nt, Human
ucucacuauguuacccagg

SEQ ID NO: 395585 - RNA, 24 nt, Human
ucucacuauguuacccaggcuggu

SEQ ID NO: 395586 - RNA, 26 nt, Human
ucucacuauguuacccaggcuggucu

SEQ ID NO: 395587 - RNA, 27 nt, Human
ucucacuauguuacccaggcuggucuc

SEQ ID NO: 395588 - RNA, 18 nt, Human
ucucagacucuggggccu

SEQ ID NO: 395589 - RNA, 24 nt, Human
ucugggguccccaaguccugccuc

SEQ ID NO: 395590 - RNA, 18 nt, Human
ugagcaccccgccuggcc

SEQ ID NO: 395591 - RNA, 21 nt, Human
ugcagggggugcgcccgaggu

SEQ ID NO: 395592 - RNA, 18 nt, Human
ugccggggcggggcgggg

SEQ ID NO: 395593 - RNA, 23 nt, Human
ugcuaggauuacaggcgugagca

SEQ ID NO: 395594 - RNA, 18 nt, Human
uggcgggggcggcggcgg

SEQ ID NO: 395595 - RNA, 18 nt, Human
ugggaccacagguguaca

SEQ ID NO: 395596 - RNA, 19 nt, Human
ugggagugggggaacguca

SEQ ID NO: 395597 - RNA, 23 nt, Human
uggucuugaauaggggaucugug

SEQ ID NO: 395598 - RNA, 22 nt, Human
ugguggaggggaggcuuggacc

SEQ ID NO: 395599 - RNA, 21 nt, Human
uguacauuuuuuaaaaguguu

SEQ ID NO: 395600 - RNA, 24 nt, Human
uguagagauagggucucacuaugu

SEQ ID NO: 395601 - RNA, 20 nt, Human
ugucuucuucacuauccccc

SEQ ID NO: 395602 - RNA, 23 nt, Human
uucaaguauccucccaucucugc

SEQ ID NO: 395603 - RNA, 22 nt, Human
uuccuggugggcaggaacuccu

SEQ ID NO: 395604 - RNA, 24 nt, Human
uuguagagauagggucucacuaug

SEQ ID NO: 395605 - RNA, 18 nt, Human
uuuguagagauagggucu

SEQ ID NO: 395606 - RNA, 24 nt, Human
uuuguagagauagggucucacuau

SEQ ID NO: 395607 - RNA, 23 nt, Human
aaacagaacacaaacuuccaaag

SEQ ID NO: 395608 - RNA, 21 nt, Human
acagaacacaaacuuccaaag

SEQ ID NO: 395609 - RNA, 22 nt, Human
cagaacacaaacuuccaaagug

SEQ ID NO: 395610 - RNA, 24 nt, Human
ccaguuuuaacaaacagaacacaa

SEQ ID NO: 395611 - RNA, 19 nt, Human
cucaaaguauagaucaagg

SEQ ID NO: 395612 - RNA, 30 nt, Human
guuuuuuguuguuguuguuuguuuuugauu

SEQ ID NO: 395613 - RNA, 23 nt, Human
ucaaggagaguuguuugguuuuu

SEQ ID NO: 395614 - RNA, 21 nt, Human
ucaaugcccaacagaaaaacg

SEQ ID NO: 395615 - RNA, 19 nt, Human
aagaaagaaauguuccaaa

SEQ ID NO: 395616 - RNA, 23 nt, Human
aagaaagaaauguuccaaaagga

SEQ ID NO: 395617 - RNA, 21 nt, Human
aagaagcggacugugugccuu

SEQ ID NO: 395618 - RNA, 19 nt, Human
aagagaccccagcagacgu

SEQ ID NO: 395619 - RNA, 22 nt, Human
aagagaggccagggggacggca

SEQ ID NO: 395620 - RNA, 19 nt, Human
aagcgcuggcaacccugag

SEQ ID NO: 395621 - RNA, 25 nt, Human
acacaacaucucaacuuaccauccc

SEQ ID NO: 395622 - RNA, 27 nt, Human
accacaauccagaaaugugcauccuga

SEQ ID NO: 395623 - RNA, 18 nt, Human
accaccgugauucucaga

SEQ ID NO: 395624 - RNA, 18 nt, Human
acccugaggacgaagaag

SEQ ID NO: 395625 - RNA, 22 nt, Human
acccugaggacgaagaagcgga

SEQ ID NO: 395626 - RNA, 23 nt, Human
agaaggagggaggaaaaccaggc

SEQ ID NO: 395627 - RNA, 22 nt, Human
agaggagggacccagagggcag

SEQ ID NO: 395628 - RNA, 19 nt, Human
agaucccaaagacugaggc

SEQ ID NO: 395629 - RNA, 20 nt, Human
agcaagaaagaaauguucca

SEQ ID NO: 395630 - RNA, 22 nt, Human
agcaagaaagaaauguuccaaa

SEQ ID NO: 395631 - RNA, 27 nt, Human
agcaagaaagaaauguuccaaaaggaa

SEQ ID NO: 395632 - RNA, 20 nt, Human
aggaaaccuccaucucagcc

SEQ ID NO: 395633 - RNA, 20 nt, Human
auccaggaugccccaaaaau

SEQ ID NO: 395634 - RNA, 22 nt, Human
augcuugccuuguauaacauaa

SEQ ID NO: 395635 - RNA, 21 nt, Human
caaaaggaaaccuccaucuca

SEQ ID NO: 395636 - RNA, 23 nt, Human
caaauccaaccucagaucugaag

SEQ ID NO: 395637 - RNA, 22 nt, Human
cacuguguggcacaugugcagc

SEQ ID NO: 395638 - RNA, 22 nt, Human
cagaagaugaaaucauccagga

SEQ ID NO: 395639 - RNA, 20 nt, Human
cagaucccaaagacugaggg

SEQ ID NO: 395640 - RNA, 18 nt, Human
cagccauucucugcccuu

SEQ ID NO: 395641 - RNA, 19 nt, Human
cagccauucucugcccuuc

SEQ ID NO: 395642 - RNA, 22 nt, Human
cagcuuccccgaaugccucaca

SEQ ID NO: 395643 - RNA, 18 nt, Human
caggaugccccaaaaaua

SEQ ID NO: 395644 - RNA, 18 nt, Human
cagucaggcagugguggu

SEQ ID NO: 395645 - RNA, 19 nt, Human
cauaauccagauucccuag

SEQ ID NO: 395646 - RNA, 24 nt, Human
ccaaaaggaaaccuccaucucagc

SEQ ID NO: 395647 - RNA, 22 nt, Human
ccaaaucccauugccacacaac

SEQ ID NO: 395648 - RNA, 19 nt, Human
ccaucccuuuccucuaucc

SEQ ID NO: 395649 - RNA, 18 nt, Human
cccauaaugccccaaggc

SEQ ID NO: 395650 - RNA, 20 nt, Human
ccccaaggcugcauggaacc

SEQ ID NO: 395651 - RNA, 19 nt, Human
ccucacauguuguagcacc

SEQ ID NO: 395652 - RNA, 23 nt, Human
ccucacauguuguagcaccugcu

SEQ ID NO: 395653 - RNA, 21 nt, Human
ccucuauccccauccccucug

SEQ ID NO: 395654 - RNA, 20 nt, Human
ccugacccagccauucucug

SEQ ID NO: 395655 - RNA, 23 nt, Human
cggccuccccagaucccaaagac

SEQ ID NO: 395656 - RNA, 19 nt, Human
cucccuuuaggguagccca

SEQ ID NO: 395657 - RNA, 21 nt, Human
cucuaaccaaacccacacuuu

SEQ ID NO: 395658 - RNA, 19 nt, Human
cuggauuuucucccuguag

SEQ ID NO: 395659 - RNA, 20 nt, Human
cuggcaacccugaggacgaa

SEQ ID NO: 395660 - RNA, 23 nt, Human
cuuccaggaacaccaaaugaaca

SEQ ID NO: 395661 - RNA, 18 nt, Human
cuuuaaaaaaaaaaaugc

SEQ ID NO: 395662 - RNA, 19 nt, Human
gacggcaaggccuggagag

SEQ ID NO: 395663 - RNA, 25 nt, Human
gcaaauccaaccucagaucugaagu

SEQ ID NO: 395664 - RNA, 19 nt, Human
gcagacgugcagaaggagg

SEQ ID NO: 395665 - RNA, 24 nt, Human
gcagcuuccccgaaugccucacau

SEQ ID NO: 395666 - RNA, 18 nt, Human
gccauuugcccggagccg

SEQ ID NO: 395667 - RNA, 21 nt, Human
gccuccccagaucccaaagac

SEQ ID NO: 395668 - RNA, 23 nt, Human
ggacccagagggcagacaggaga

SEQ ID NO: 395669 - RNA, 22 nt, Human
ggacuuccaggaagcgcuggca

SEQ ID NO: 395670 - RNA, 22 nt, Human
ggcaagaaggugcaugaacucc

SEQ ID NO: 395671 - RNA, 21 nt, Human
gggcuccaggccucucaguga

SEQ ID NO: 395672 - RNA, 19 nt, Human
ggggacggcaaggccugga

SEQ ID NO: 395673 - RNA, 19 nt, Human
uagaggacaguuugcaaaa

SEQ ID NO: 395674 - RNA, 22 nt, Human
uagcaccugcuuccaggaacac

SEQ ID NO: 395675 - RNA, 19 nt, Human
uagcgcugggauuguuguc

SEQ ID NO: 395676 - RNA, 20 nt, Human
ucagcauauccaaaaggccc

SEQ ID NO: 395677 - RNA, 23 nt, Human
ucauacuugucuuuauaccucag

SEQ ID NO: 395678 - RNA, 20 nt, Human
uccagaagaugaaaucaucc

SEQ ID NO: 395679 - RNA, 22 nt, Human
uccaggaacaccaaaugaacac

SEQ ID NO: 395680 - RNA, 20 nt, Human
uccaucucagccauuugccc

SEQ ID NO: 395681 - RNA, 23 nt, Human
ucccauugccacacaacaucuca

SEQ ID NO: 395682 - RNA, 21 nt, Human
ucucagugagguuuguugcuu

SEQ ID NO: 395683 - RNA, 19 nt, Human
ucuccccucucucugucgc

SEQ ID NO: 395684 - RNA, 20 nt, Human
ucugcccuuccuucuccccc

SEQ ID NO: 395685 - RNA, 23 nt, Human
ucugcguucagcauauccaaaag

SEQ ID NO: 395686 - RNA, 20 nt, Human
ucuggcccugacccagccau

SEQ ID NO: 395687 - RNA, 23 nt, Human
ugaagaguucagccuuccucuaa

SEQ ID NO: 395688 - RNA, 19 nt, Human
ugaccuggauuuucucccu

SEQ ID NO: 395689 - RNA, 21 nt, Human
ugagaggagggacccagaggg

SEQ ID NO: 395690 - RNA, 19 nt, Human
ugagcugggaagagaggcc

SEQ ID NO: 395691 - RNA, 21 nt, Human
ugagcugggaagagaggccag

SEQ ID NO: 395692 - RNA, 20 nt, Human
ugaucgagggagaggugaga

SEQ ID NO: 395693 - RNA, 23 nt, Human
ugaucgagggagaggugagagga

SEQ ID NO: 395694 - RNA, 18 nt, Human
uggaggggaaguggggga

SEQ ID NO: 395695 - RNA, 24 nt, Human
ugggaagagaggccagggggacgg

SEQ ID NO: 395696 - RNA, 22 nt, Human
ugggacuuugucuucguaaccu

SEQ ID NO: 395697 - RNA, 21 nt, Human
ugggggaagacccauaaugcc

SEQ ID NO: 395698 - RNA, 18 nt, Human
uguggcacaugugcagcu

SEQ ID NO: 395699 - RNA, 20 nt, Human
uguuguagcaccugcuucca

SEQ ID NO: 395700 - RNA, 19 nt, Human
uuaaucccagacaguauga

SEQ ID NO: 395701 - RNA, 23 nt, Human
uuccaggaagcgcuggcaacccu

SEQ ID NO: 395702 - RNA, 22 nt, Human
uuguugcuuguguguuucccga

SEQ ID NO: 395703 - RNA, 22 nt, Human
uuuaggguagcccaaaucccau

SEQ ID NO: 395704 - RNA, 21 nt, Human
acaucucucucccuccucccc

SEQ ID NO: 395705 - RNA, 19 nt, Human
auacugaagcuccuuuucc

SEQ ID NO: 395706 - RNA, 22 nt, Human
aucucucucccuccucccccac

SEQ ID NO: 395707 - RNA, 21 nt, Human
augccauuucuccagcugugc

SEQ ID NO: 395708 - RNA, 18 nt, Human
caccauggcucugucaca

SEQ ID NO: 395709 - RNA, 19 nt, Human
caccauggcucugucacaa

SEQ ID NO: 395710 - RNA, 19 nt, Human
cagggccccauaaaagccu

SEQ ID NO: 395711 - RNA, 21 nt, Human
cauuaaagugugauacuuggu

SEQ ID NO: 395712 - RNA, 19 nt, Human
ccaagccacguguagaugg

SEQ ID NO: 395713 - RNA, 20 nt, Human
ccacaugcacaaggcucaca

SEQ ID NO: 395714 - RNA, 22 nt, Human
cccauaaaagccuccaagccac

SEQ ID NO: 395715 - RNA, 19 nt, Human
ccccauaaaagccuccaag

SEQ ID NO: 395716 - RNA, 18 nt, Human
cggagagcugccguggug

SEQ ID NO: 395717 - RNA, 23 nt, Human
cuccagcugugcaagggcuuuac

SEQ ID NO: 395718 - RNA, 22 nt, Human
cuuauaaugaugccauuucucc

SEQ ID NO: 395719 - RNA, 23 nt, Human
gccccauaaaagccuccaagcca

SEQ ID NO: 395720 - RNA, 20 nt, Human
ggacagggccccauaaaagc

SEQ ID NO: 395721 - RNA, 24 nt, Human
uaaaaaguacaucucucucccucc

SEQ ID NO: 395722 - RNA, 21 nt, Human
uacaaaaacugugccaggacu

SEQ ID NO: 395723 - RNA, 20 nt, Human
ucccaugaggcuggauugcu

SEQ ID NO: 395724 - RNA, 18 nt, Human
ucccccacaugcacaagg

SEQ ID NO: 395725 - RNA, 21 nt, Human
ucuuuucuaccuggacagggc

SEQ ID NO: 395726 - RNA, 18 nt, Human
ugaaaacauucaaacagu

SEQ ID NO: 395727 - RNA, 23 nt, Human
ugaaaacauucaaacagucucug

SEQ ID NO: 395728 - RNA, 19 nt, Human
ugccguggugcauuccucc

SEQ ID NO: 395729 - RNA, 20 nt, Human
ugccguggugcauuccuccu

SEQ ID NO: 395730 - RNA, 18 nt, Human
ugguuuuauuauuacaaa

SEQ ID NO: 395731 - RNA, 24 nt, Human
uuaaagugugauacuugguuuuga

SEQ ID NO: 395732 - RNA, 26 nt, Human
uuaugagccccacaauacugaagcuc

SEQ ID NO: 395733 - RNA, 21 nt, Human
uucuccagcugugcaagggcu

SEQ ID NO: 395734 - RNA, 22 nt, Human
uuuccagggacuuggcauaggc

SEQ ID NO: 395735 - RNA, 20 nt, Human
uuugguuuuauuauuacaaa

SEQ ID NO: 395736 - RNA, 28 nt, Human
aagcguucauagugcacagaaaggaccc

SEQ ID NO: 395737 - RNA, 21 nt, Human
aaggacccacauggcuguuuc

SEQ ID NO: 395738 - RNA, 21 nt, Human
accccagcaaaccucgccucg

SEQ ID NO: 395739 - RNA, 21 nt, Human
acuaaccaggaguaaaucacu

SEQ ID NO: 395740 - RNA, 23 nt, Human
agcacagcagaguuaccuaaagu

SEQ ID NO: 395741 - RNA, 23 nt, Human
agguagaacaacugaccucccaa

SEQ ID NO: 395742 - RNA, 21 nt, Human
agguagacuacacauuuucug

SEQ ID NO: 395743 - RNA, 22 nt, Human
auagugcacagaaaggacccac

SEQ ID NO: 395744 - RNA, 27 nt, Human
caacuccuuugcccuuaaagaugaucu

SEQ ID NO: 395745 - RNA, 21 nt, Human
cccaaauuaaaacccaggagc

SEQ ID NO: 395746 - RNA, 21 nt, Human
ccccagcaaaccucgccucgc

SEQ ID NO: 395747 - RNA, 24 nt, Human
ccgccgccaccgccuguggcccgg

SEQ ID NO: 395748 - RNA, 24 nt, Human
ccugggaaguuuuuaauugacuuu

SEQ ID NO: 395749 - RNA, 24 nt, Human
ccuguggcccggcccggcccggcc

SEQ ID NO: 395750 - RNA, 23 nt, Human
cuaaaguuaagaccagcaaucau

SEQ ID NO: 395751 - RNA, 19 nt, Human
cuagugguucagaauccuc

SEQ ID NO: 395752 - RNA, 18 nt, Human
cucccaaauuaaaaccca

SEQ ID NO: 395753 - RNA, 25 nt, Human
cuggguccaaagaaauccugggaag

SEQ ID NO: 395754 - RNA, 18 nt, Human
gaaagacacagaaguggc

SEQ ID NO: 395755 - RNA, 21 nt, Human
gcccggccgcgccgcugccuc

SEQ ID NO: 395756 - RNA, 18 nt, Human
gccgcugccucaccccag

SEQ ID NO: 395757 - RNA, 19 nt, Human
gcugccucaccccagcaaa

SEQ ID NO: 395758 - RNA, 23 nt, Human
ggcccggccgcgccgcugccuca

SEQ ID NO: 395759 - RNA, 18 nt, Human
guagaacaacugaccucc

SEQ ID NO: 395760 - RNA, 19 nt, Human
uacacugcugcaaaaggaa

SEQ ID NO: 395761 - RNA, 21 nt, Human
uagaaagacacagaaguggca

SEQ ID NO: 395762 - RNA, 19 nt, Human
uagguuuuaacauagagac

SEQ ID NO: 395763 - RNA, 23 nt, Human
uauacaaaauacaauugcaugaa

SEQ ID NO: 395764 - RNA, 19 nt, Human
uauccuucuguucccucuc

SEQ ID NO: 395765 - RNA, 20 nt, Human
uccaaagaaauccugggaag

SEQ ID NO: 395766 - RNA, 21 nt, Human
ucccaaauuaaaacccaggag

SEQ ID NO: 395767 - RNA, 20 nt, Human
uccuggguccaaagaaaucc

SEQ ID NO: 395768 - RNA, 23 nt, Human
ugaauuauguuccucacuacuau

SEQ ID NO: 395769 - RNA, 26 nt, Human
ugagguagaacaacugaccucccaaa

SEQ ID NO: 395770 - RNA, 19 nt, Human
uggcccggcccggcccggc

SEQ ID NO: 395771 - RNA, 22 nt, Human
ugggaaagaagcguucauagug

SEQ ID NO: 395772 - RNA, 19 nt, Human
uuaagaccagcaaucaucu

SEQ ID NO: 395773 - RNA, 20 nt, Human
uucaaagucugaaucaagga

SEQ ID NO: 395774 - RNA, 25 nt, Human
aaaaaaacauaaacaaaacaagcca

SEQ ID NO: 395775 - RNA, 21 nt, Human
aaaaaacauaaacaaaacaag

SEQ ID NO: 395776 - RNA, 24 nt, Human
aaaaacacaauaaauuacaugaca

SEQ ID NO: 395777 - RNA, 22 nt, Human
aaaaagaguauauagcauucac

SEQ ID NO: 395778 - RNA, 18 nt, Human
aaaacaaagauaucuaca

SEQ ID NO: 395779 - RNA, 21 nt, Human
aaaacaagccacaguauccuc

SEQ ID NO: 395780 - RNA, 22 nt, Human
aaagaugaaaaaaagaacaauu

SEQ ID NO: 395781 - RNA, 26 nt, Human
aaagcacuauuuuuucauuccaauua

SEQ ID NO: 395782 - RNA, 23 nt, Human
aaagcuucuuggaguaaagcacu

SEQ ID NO: 395783 - RNA, 24 nt, Human
aaaguaaacacgauaaagccuaga

SEQ ID NO: 395784 - RNA, 21 nt, Human
aaaugaucacuuugcaauuuu

SEQ ID NO: 395785 - RNA, 21 nt, Human
aaauguuaaaaaucgaagaga

SEQ ID NO: 395786 - RNA, 23 nt, Human
aacauaaaauguuaaaaaucgaa

SEQ ID NO: 395787 - RNA, 19 nt, Human
aacauaaacaaaacaagcc

SEQ ID NO: 395788 - RNA, 21 nt, Human
aacauaagugcaggggaaaga

SEQ ID NO: 395789 - RNA, 23 nt, Human
aaccaaaagauaauaccauaucu

SEQ ID NO: 395790 - RNA, 27 nt, Human
aaccacgaagcaaaauuagcaauaacc

SEQ ID NO: 395791 - RNA, 22 nt, Human
aagaacaguccaaaccuucagu

SEQ ID NO: 395792 - RNA, 21 nt, Human
aagacccuccacccaucccag

SEQ ID NO: 395793 - RNA, 19 nt, Human
aagagcuaauguuuacagu

SEQ ID NO: 395794 - RNA, 21 nt, Human
aagauggaacccauugguguu

SEQ ID NO: 395795 - RNA, 23 nt, Human
aagggccaaggugagcacuagca

SEQ ID NO: 395796 - RNA, 22 nt, Human
aaggggcuccccaaauauagca

SEQ ID NO: 395797 - RNA, 26 nt, Human
aauaagaaaaaaaaacauaaacaaaa

SEQ ID NO: 395798 - RNA, 19 nt, Human
aaucaggagcccagaaaga

SEQ ID NO: 395799 - RNA, 24 nt, Human
aauuauauaaaauagaucuuacua

SEQ ID NO: 395800 - RNA, 23 nt, Human
aauuuuggguuaagaguugaaaa

SEQ ID NO: 395801 - RNA, 23 nt, Human
acaaaacaagccacaguauccuc

SEQ ID NO: 395802 - RNA, 23 nt, Human
acaaacccuggugaaaccaaaag

SEQ ID NO: 395803 - RNA, 19 nt, Human
acagaauguuauuccuugg

SEQ ID NO: 395804 - RNA, 19 nt, Human
acauuucuuacaagggacc

SEQ ID NO: 395805 - RNA, 22 nt, Human
accaaaccacgaagcaaaauua

SEQ ID NO: 395806 - RNA, 21 nt, Human
accaagacccuccacccaucc

SEQ ID NO: 395807 - RNA, 28 nt, Human
acggcgccuuuuuuuuuuuuuuuuuuuc

SEQ ID NO: 395808 - RNA, 19 nt, Human
acugaggagggugccuaga

SEQ ID NO: 395809 - RNA, 21 nt, Human
agaaauaagggcacacaggaa

SEQ ID NO: 395810 - RNA, 21 nt, Human
agacaagaccaagacccucca

SEQ ID NO: 395811 - RNA, 23 nt, Human
agacaggaacuaaagggccaagg

SEQ ID NO: 395812 - RNA, 20 nt, Human
agaguugaaaaacuaaguua

SEQ ID NO: 395813 - RNA, 18 nt, Human
agaguuucuaaacuaggu

SEQ ID NO: 395814 - RNA, 24 nt, Human
agaugggguagaguuucuaaacua

SEQ ID NO: 395815 - RNA, 22 nt, Human
agcaaucaggagcccagaaaga

SEQ ID NO: 395816 - RNA, 21 nt, Human
aggccaaaagacaagaccaag

SEQ ID NO: 395817 - RNA, 23 nt, Human
aggccaacuucaaaucuuaacac

SEQ ID NO: 395818 - RNA, 19 nt, Human
agggcacacaggaaccccg

SEQ ID NO: 395819 - RNA, 21 nt, Human
aggucaaugggcaacagcuau

SEQ ID NO: 395820 - RNA, 24 nt, Human
aguaacauaagugcaggggaaaga

SEQ ID NO: 395821 - RNA, 22 nt, Human
agucccucucuaauauuccuau

SEQ ID NO: 395822 - RNA, 19 nt, Human
agugcaauguggucauagc

SEQ ID NO: 395823 - RNA, 23 nt, Human
auaacacaaagaaugcguuccac

SEQ ID NO: 395824 - RNA, 21 nt, Human
auagaaugcucuaugucaccc

SEQ ID NO: 395825 - RNA, 20 nt, Human
aucaggagcccagaaagaug

SEQ ID NO: 395826 - RNA, 24 nt, Human
aucuguucugauuuuucugcaacc

SEQ ID NO: 395827 - RNA, 25 nt, Human
augaaggcugggagcagagaauagu

SEQ ID NO: 395828 - RNA, 22 nt, Human
augagaccuuccaccauccaaa

SEQ ID NO: 395829 - RNA, 24 nt, Human
caaaagacaagaccaagacccucc

SEQ ID NO: 395830 - RNA, 22 nt, Human
caaaagcaagugcaaugugguc

SEQ ID NO: 395831 - RNA, 21 nt, Human
caaaccacgaagcaaaauuag

SEQ ID NO: 395832 - RNA, 24 nt, Human
caagaccaagacccuccacccauc

SEQ ID NO: 395833 - RNA, 21 nt, Human
caaggccaaaagacaagacca

SEQ ID NO: 395834 - RNA, 22 nt, Human
caaggccaaaagacaagaccaa

SEQ ID NO: 395835 - RNA, 23 nt, Human
caaggggcuccccaaauauagca

SEQ ID NO: 395836 - RNA, 19 nt, Human
cacaggaaccccgggaaca

SEQ ID NO: 395837 - RNA, 19 nt, Human
cacccacucccugcugcug

SEQ ID NO: 395838 - RNA, 20 nt, Human
cacugaggagggugccuaga

SEQ ID NO: 395839 - RNA, 20 nt, Human
cacuguacuuaguuccaugg

SEQ ID NO: 395840 - RNA, 19 nt, Human
cagaaaagcuaaagaggua

SEQ ID NO: 395841 - RNA, 18 nt, Human
cagaaagauggaacccau

SEQ ID NO: 395842 - RNA, 26 nt, Human
cagcuauugggaugguaucagcaugc

SEQ ID NO: 395843 - RNA, 19 nt, Human
cagcuuuguaagugucucc

SEQ ID NO: 395844 - RNA, 19 nt, Human
caggagaaauaagggcaca

SEQ ID NO: 395845 - RNA, 18 nt, Human
caggggcagcuuccugcu

SEQ ID NO: 395846 - RNA, 19 nt, Human
caggggcagcuuccugcug

SEQ ID NO: 395847 - RNA, 27 nt, Human
caguauagacaaggggcuccccaaaua

SEQ ID NO: 395848 - RNA, 24 nt, Human
cauaaacaaaacaagccacaguau

SEQ ID NO: 395849 - RNA, 23 nt, Human
ccagauuuuccugcaaaaucucc

SEQ ID NO: 395850 - RNA, 22 nt, Human
ccagucccucucuaauauuccu

SEQ ID NO: 395851 - RNA, 19 nt, Human
ccauaucuuccuaagcauc

SEQ ID NO: 395852 - RNA, 18 nt, Human
cccacucccugcugcugu

SEQ ID NO: 395853 - RNA, 24 nt, Human
cccaugaagguaaaaagugggguu

SEQ ID NO: 395854 - RNA, 20 nt, Human
cccuacggugcaaguggaau

SEQ ID NO: 395855 - RNA, 19 nt, Human
ccuccaugguaacucaauc

SEQ ID NO: 395856 - RNA, 19 nt, Human
ccucuguucuuuggugaga

SEQ ID NO: 395857 - RNA, 23 nt, Human
ccuuugcauguaucuuaaaaauc

SEQ ID NO: 395858 - RNA, 21 nt, Human
cgcugugcugaccaaacaaaa

SEQ ID NO: 395859 - RNA, 18 nt, Human
cguuccacugguaaaaca

SEQ ID NO: 395860 - RNA, 21 nt, Human
cuaaagggccaaggugagcac

SEQ ID NO: 395861 - RNA, 20 nt, Human
cuagaagaaauguuugggaa

SEQ ID NO: 395862 - RNA, 21 nt, Human
cuaucuauuaaagaaacaaaa

SEQ ID NO: 395863 - RNA, 23 nt, Human
cuaugcuacugcagccacacugu

SEQ ID NO: 395864 - RNA, 23 nt, Human
cucaaaaaugaaaaaaaaaaaaa

SEQ ID NO: 395865 - RNA, 18 nt, Human
cucucagcccacccacac

SEQ ID NO: 395866 - RNA, 23 nt, Human
cugaaaaccaucugcuauccuua

SEQ ID NO: 395867 - RNA, 21 nt, Human
cugaaaauguuacuuaaaaua

SEQ ID NO: 395868 - RNA, 24 nt, Human
cugguccucaaacagugccacugu

SEQ ID NO: 395869 - RNA, 25 nt, Human
cugguccucaaacagugccacugua

SEQ ID NO: 395870 - RNA, 21 nt, Human
cuucaaaucuuaacaccagau

SEQ ID NO: 395871 - RNA, 19 nt, Human
cuuguggacacaaauuuuc

SEQ ID NO: 395872 - RNA, 20 nt, Human
cuuuggugagaggggcagcc

SEQ ID NO: 395873 - RNA, 18 nt, Human
cuuugugucccacauuca

SEQ ID NO: 395874 - RNA, 23 nt, Human
cuuuuuuuuuuuuuuuuugacau

SEQ ID NO: 395875 - RNA, 24 nt, Human
cuuuuuuuuuuuuuuuuugacaug

SEQ ID NO: 395876 - RNA, 22 nt, Human
gaaaguaccuaaagucucaagg

SEQ ID NO: 395877 - RNA, 20 nt, Human
gaagaaagaacuagaagaaa

SEQ ID NO: 395878 - RNA, 22 nt, Human
gaauauuugauguuuuuccuug

SEQ ID NO: 395879 - RNA, 20 nt, Human
gaggcuuuucucugcuccau

SEQ ID NO: 395880 - RNA, 19 nt, Human
gccaaggugagcacuagca

SEQ ID NO: 395881 - RNA, 22 nt, Human
gccacuguacuuaguuccaugg

SEQ ID NO: 395882 - RNA, 22 nt, Human
ggacauggcccagccugcccca

SEQ ID NO: 395883 - RNA, 21 nt, Human
ggagcuuaaaugaaaagucca

SEQ ID NO: 395884 - RNA, 22 nt, Human
ggcgccuuuuuuuuuuuuuuuu

SEQ ID NO: 395885 - RNA, 19 nt, Human
ggcugugagacauggagcc

SEQ ID NO: 395886 - RNA, 19 nt, Human
gggaacacugguccucaaa

SEQ ID NO: 395887 - RNA, 21 nt, Human
gggucccuuccuucucugcuu

SEQ ID NO: 395888 - RNA, 20 nt, Human
ggugaaaccaaaagauaaua

SEQ ID NO: 395889 - RNA, 24 nt, Human
ggugagaggggcagccucuuugga

SEQ ID NO: 395890 - RNA, 23 nt, Human
guaaauaaccaaaccacgaagca

SEQ ID NO: 395891 - RNA, 20 nt, Human
gucauagaccgagcccccag

SEQ ID NO: 395892 - RNA, 18 nt, Human
gucauguuagccucugag

SEQ ID NO: 395893 - RNA, 20 nt, Human
gucuagacauauuggugggu

SEQ ID NO: 395894 - RNA, 22 nt, Human
guggaaagagcuaauguuuaca

SEQ ID NO: 395895 - RNA, 19 nt, Human
gugucuccacaccuucaca

SEQ ID NO: 395896 - RNA, 24 nt, Human
uaaaagacaaacaaugcauagaau

SEQ ID NO: 395897 - RNA, 21 nt, Human
uaaagccuagagugagaauuu

SEQ ID NO: 395898 - RNA, 19 nt, Human
uaaagucucaaggccaaaa

SEQ ID NO: 395899 - RNA, 26 nt, Human
uaaauuuucuucaucaaacuggaggc

SEQ ID NO: 395900 - RNA, 24 nt, Human
uaacucaaucucaaaaaugaaaaa

SEQ ID NO: 395901 - RNA, 23 nt, Human
uaacugagacccuuaaaggaguu

SEQ ID NO: 395902 - RNA, 25 nt, Human
uaaggacccaagcaaguagaaccag

SEQ ID NO: 395903 - RNA, 21 nt, Human
uaaguagcuucaaaaaguuuu

SEQ ID NO: 395904 - RNA, 26 nt, Human
uaagugucuccacaccuucacauuuu

SEQ ID NO: 395905 - RNA, 25 nt, Human
uacaugacauggaagaaagaacuag

SEQ ID NO: 395906 - RNA, 20 nt, Human
uaccaaguaauucaacacaa

SEQ ID NO: 395907 - RNA, 18 nt, Human
uacugcagccacacuguc

SEQ ID NO: 395908 - RNA, 19 nt, Human
uacuuuguucuuguccuug

SEQ ID NO: 395909 - RNA, 20 nt, Human
uagaaugcucuaugucaccc

SEQ ID NO: 395910 - RNA, 23 nt, Human
uagacaaggggcuccccaaauau

SEQ ID NO: 395911 - RNA, 21 nt, Human
uagcaauaacccaacacuagu

SEQ ID NO: 395912 - RNA, 18 nt, Human
uauagaaaacuagaaaau

SEQ ID NO: 395913 - RNA, 24 nt, Human
uauagauauauauauauauauaua

SEQ ID NO: 395914 - RNA, 18 nt, Human
uauagcagccauuuaaaa

SEQ ID NO: 395915 - RNA, 20 nt, Human
uauauagauauauauauaua

SEQ ID NO: 395916 - RNA, 20 nt, Human
uauauagauauauauauaua

SEQ ID NO: 395917 - RNA, 22 nt, Human
uauauagauauauauauauaua

SEQ ID NO: 395918 - RNA, 25 nt, Human
uauauagauauauauauauauauau

SEQ ID NO: 395919 - RNA, 19 nt, Human
uauauagcauucacauucc

SEQ ID NO: 395920 - RNA, 24 nt, Human
uauauauauauauauauaaaacau

SEQ ID NO: 395921 - RNA, 22 nt, Human
uaucaaaacaggcucaauggga

SEQ ID NO: 395922 - RNA, 20 nt, Human
uauccccacagcuuacaggg

SEQ ID NO: 395923 - RNA, 20 nt, Human
uaucuuuaaaccugcuaaca

SEQ ID NO: 395924 - RNA, 25 nt, Human
ucaagucaaguguaaugaaaaagua

SEQ ID NO: 395925 - RNA, 22 nt, Human
ucaaucucaaaaaugaaaaaaa

SEQ ID NO: 395926 - RNA, 23 nt, Human
ucaaugggcaacagcuauuggga

SEQ ID NO: 395927 - RNA, 20 nt, Human
uccacauuuuuaauguguga

SEQ ID NO: 395928 - RNA, 19 nt, Human
uccaccauccaaacagagc

SEQ ID NO: 395929 - RNA, 20 nt, Human
uccaccauccaaacagagcu

SEQ ID NO: 395930 - RNA, 23 nt, Human
uccaccauccaaacagagcugau

SEQ ID NO: 395931 - RNA, 22 nt, Human
uccauggccagaagagaagugc

SEQ ID NO: 395932 - RNA, 22 nt, Human
ucccacauucaaauccucucua

SEQ ID NO: 395933 - RNA, 24 nt, Human
ucccacauucaaauccucucuagu

SEQ ID NO: 395934 - RNA, 26 nt, Human
uccucaugcaaaguucacuguuuuac

SEQ ID NO: 395935 - RNA, 21 nt, Human
uccucugacacuacauuccag

SEQ ID NO: 395936 - RNA, 24 nt, Human
ucuaauauuccuauuuggcugaaa

SEQ ID NO: 395937 - RNA, 18 nt, Human
ucugcaaagguugagaag

SEQ ID NO: 395938 - RNA, 22 nt, Human
ucuuuggacauggcccagccuu

SEQ ID NO: 395939 - RNA, 19 nt, Human
ucuuuggugagaggggcag

SEQ ID NO: 395940 - RNA, 18 nt, Human
ugaaaaaaaaaaaaaagc

SEQ ID NO: 395941 - RNA, 19 nt, Human
ugacccaaaggaguggagc

SEQ ID NO: 395942 - RNA, 19 nt, Human
ugagaggggcagccucuuu

SEQ ID NO: 395943 - RNA, 18 nt, Human
ugaggagggugccuagag

SEQ ID NO: 395944 - RNA, 19 nt, Human
ugagucuagacauauuggu

SEQ ID NO: 395945 - RNA, 24 nt, Human
ugcaaaugggaccuuuguguccca

SEQ ID NO: 395946 - RNA, 22 nt, Human
uggaaaaacacaauaaauuaca

SEQ ID NO: 395947 - RNA, 19 nt, Human
uggcuggggcuguuuucug

SEQ ID NO: 395948 - RNA, 23 nt, Human
uggguauggaaaguaccuaaagu

SEQ ID NO: 395949 - RNA, 21 nt, Human
uguaaucaguauucacaaacc

SEQ ID NO: 395950 - RNA, 21 nt, Human
ugucacccacucccugcugcu

SEQ ID NO: 395951 - RNA, 19 nt, Human
ugugcugaccaaacaaaac

SEQ ID NO: 395952 - RNA, 25 nt, Human
uguguaguugaaauccucuucauca

SEQ ID NO: 395953 - RNA, 25 nt, Human
uguucuuucccuccaugguaacuca

SEQ ID NO: 395954 - RNA, 19 nt, Human
uguuuuacagucagagaac

SEQ ID NO: 395955 - RNA, 18 nt, Human
uuaaaaugucauacuuuu

SEQ ID NO: 395956 - RNA, 19 nt, Human
uuacaagggaccuugguua

SEQ ID NO: 395957 - RNA, 19 nt, Human
uuacagucagagaaccacu

SEQ ID NO: 395958 - RNA, 18 nt, Human
uuagacaggaacuaaagg

SEQ ID NO: 395959 - RNA, 19 nt, Human
uuccugggaauauuugaug

SEQ ID NO: 395960 - RNA, 21 nt, Human
uuuaaaaugucauacuuuuga

SEQ ID NO: 395961 - RNA, 18 nt, Human
uuuaacucucagcccacc

SEQ ID NO: 395962 - RNA, 21 nt, Human
uuuaugcugauaacccagaag

SEQ ID NO: 395963 - RNA, 18 nt, Human
uuuccaggaagcaucagu

SEQ ID NO: 395964 - RNA, 25 nt, Human
uuuccugcaaaaucuccaaauauuu

SEQ ID NO: 395965 - RNA, 24 nt, Human
uuugcaauuuuuaaaacaauauaa

SEQ ID NO: 395966 - RNA, 26 nt, Human
aaacaggaagcugauaagggggaccc

SEQ ID NO: 395967 - RNA, 19 nt, Human
aaacugccaccaaagacua

SEQ ID NO: 395968 - RNA, 21 nt, Human
aaggauucucugccgucccuc

SEQ ID NO: 395969 - RNA, 18 nt, Human
accaaagacuacacacaa

SEQ ID NO: 395970 - RNA, 18 nt, Human
agaaaaugaaugugccag

SEQ ID NO: 395971 - RNA, 18 nt, Human
agacaggaggaucgcuua

SEQ ID NO: 395972 - RNA, 19 nt, Human
agacaggaggaucgcuuag

SEQ ID NO: 395973 - RNA, 21 nt, Human
agaccccacagguuguggcag

SEQ ID NO: 395974 - RNA, 22 nt, Human
agccauugguccugcccuugga

SEQ ID NO: 395975 - RNA, 18 nt, Human
agcugagcugggcugggc

SEQ ID NO: 395976 - RNA, 18 nt, Human
agcugcaaaguggcauca

SEQ ID NO: 395977 - RNA, 25 nt, Human
aggcaagagaaguaaggcaauccaa

SEQ ID NO: 395978 - RNA, 21 nt, Human
aucagaccccacagguugugg

SEQ ID NO: 395979 - RNA, 23 nt, Human
aucgcuuagaaagccucaaagca

SEQ ID NO: 395980 - RNA, 20 nt, Human
caaagcagcauuuuaaaaac

SEQ ID NO: 395981 - RNA, 23 nt, Human
caacucuaaaagcauaaggacau

SEQ ID NO: 395982 - RNA, 18 nt, Human
caagccugugaggggcug

SEQ ID NO: 395983 - RNA, 22 nt, Human
caccucaagcccuuuuugacau

SEQ ID NO: 395984 - RNA, 18 nt, Human
cacugugcaaauucgucc

SEQ ID NO: 395985 - RNA, 18 nt, Human
caucagcauugguuuugg

SEQ ID NO: 395986 - RNA, 19 nt, Human
ccaucuuugcaaaucagaa

SEQ ID NO: 395987 - RNA, 19 nt, Human
cccaaggaaaaaaagcucc

SEQ ID NO: 395988 - RNA, 21 nt, Human
cccaaggaaaaaaagcuccuu

SEQ ID NO: 395989 - RNA, 20 nt, Human
cccagggcacaagcaaggaa

SEQ ID NO: 395990 - RNA, 23 nt, Human
ccuugcaauuuucaaacugccac

SEQ ID NO: 395991 - RNA, 19 nt, Human
cggguugggccuggguugg

SEQ ID NO: 395992 - RNA, 22 nt, Human
cucagcacugucuugguggaau

SEQ ID NO: 395993 - RNA, 26 nt, Human
cugagcugagcugggcugggcugggu

SEQ ID NO: 395994 - RNA, 20 nt, Human
cuuccugcacagccugaugu

SEQ ID NO: 395995 - RNA, 20 nt, Human
cuuucucacaugaauucuag

SEQ ID NO: 395996 - RNA, 20 nt, Human
gacucaauguugccagagcu

SEQ ID NO: 395997 - RNA, 19 nt, Human
gagaccgacagauuugcca

SEQ ID NO: 395998 - RNA, 18 nt, Human
gagguaucacugagcuua

SEQ ID NO: 395999 - RNA, 18 nt, Human
gcauccaucugcagauag

SEQ ID NO: 396000 - RNA, 18 nt, Human
gcugagcugggcugggcu

SEQ ID NO: 396001 - RNA, 28 nt, Human
gcugagcugggcugggcuggguuggggg

SEQ ID NO: 396002 - RNA, 18 nt, Human
gcugggcuggguugggcc

SEQ ID NO: 396003 - RNA, 21 nt, Human
ggaaacacucacccuaccaaa

SEQ ID NO: 396004 - RNA, 18 nt, Human
ggaaugggcacaaaucug

SEQ ID NO: 396005 - RNA, 25 nt, Human
ggcagcaaggucagaagagugcauc

SEQ ID NO: 396006 - RNA, 19 nt, Human
ggcugggcuggguugggcc

SEQ ID NO: 396007 - RNA, 19 nt, Human
gggccggguugggccuggg

SEQ ID NO: 396008 - RNA, 19 nt, Human
ggguugggccggguugggc

SEQ ID NO: 396009 - RNA, 18 nt, Human
gugacauauuauauacuu

SEQ ID NO: 396010 - RNA, 22 nt, Human
gugguuccugauuuuggucauu

SEQ ID NO: 396011 - RNA, 25 nt, Human
uagaaaacccccaagccugugaggg

SEQ ID NO: 396012 - RNA, 19 nt, Human
uagcugagcugagcugggc

SEQ ID NO: 396013 - RNA, 18 nt, Human
uauuaggaaugggcacaa

SEQ ID NO: 396014 - RNA, 22 nt, Human
ucacugagcuuauuuuagcugc

SEQ ID NO: 396015 - RNA, 26 nt, Human
ucagaaguagucuuaaagucccuccu

SEQ ID NO: 396016 - RNA, 21 nt, Human
ucuugggacacaucagacccc

SEQ ID NO: 396017 - RNA, 18 nt, Human
ucuuugcaaaucagaagu

SEQ ID NO: 396018 - RNA, 22 nt, Human
ucuuuggccgcaucuccucacu

SEQ ID NO: 396019 - RNA, 22 nt, Human
ugaaggcccaaggaaaaaaagc

SEQ ID NO: 396020 - RNA, 22 nt, Human
ugagaaaaugaaugugccaggu

SEQ ID NO: 396021 - RNA, 19 nt, Human
ugagcugggcugggcuggg

SEQ ID NO: 396022 - RNA, 22 nt, Human
ugauaaggucaucagcauuggu

SEQ ID NO: 396023 - RNA, 18 nt, Human
ugcaaauucguccuugac

SEQ ID NO: 396024 - RNA, 19 nt, Human
ugccagagcucugcuuccu

SEQ ID NO: 396025 - RNA, 22 nt, Human
ugcccuuggaguagcugagcug

SEQ ID NO: 396026 - RNA, 21 nt, Human
ugcgguucuuucaguuugaag

SEQ ID NO: 396027 - RNA, 19 nt, Human
uggaaacacucacccuacc

SEQ ID NO: 396028 - RNA, 19 nt, Human
uggcccagggcacaagcaa

SEQ ID NO: 396029 - RNA, 20 nt, Human
ugggcugggcuggguugggc

SEQ ID NO: 396030 - RNA, 19 nt, Human
ugggcuggguugggccggg

SEQ ID NO: 396031 - RNA, 20 nt, Human
ugggcuggguugggccgggu

SEQ ID NO: 396032 - RNA, 20 nt, Human
uggguugggccggguugggc

SEQ ID NO: 396033 - RNA, 21 nt, Human
ugguacagaagcccaggguca

SEQ ID NO: 396034 - RNA, 24 nt, Human
ugguacagaagcccagggucaugg

SEQ ID NO: 396035 - RNA, 19 nt, Human
uguacuugcauacacauag

SEQ ID NO: 396036 - RNA, 24 nt, Human
ugugguuccugauuuuggucauuu

SEQ ID NO: 396037 - RNA, 20 nt, Human
uguuaagaccaugcgccguc

SEQ ID NO: 396038 - RNA, 25 nt, Human
uucaguuugaaggcccaaggaaaaa

SEQ ID NO: 396039 - RNA, 23 nt, Human
uugggccggguugggccuggguu

SEQ ID NO: 396040 - RNA, 18 nt, Human
uugguccugcccuuggag

SEQ ID NO: 396041 - RNA, 19 nt, Human
uuucuuguuuuacaucuug

SEQ ID NO: 396042 - RNA, 20 nt, Human
uuucuuguuuuacaucuugg

SEQ ID NO: 396043 - RNA, 22 nt, Human
uuugaaggcccaaggaaaaaaa

SEQ ID NO: 396044 - RNA, 22 nt, Human
uuugccaugcauuugcaucuug

SEQ ID NO: 396045 - RNA, 25 nt, Human
uuuuuaugaaagggccuauuuuuuu

SEQ ID NO: 396046 - RNA, 22 nt, Human
aaaauaacaaaaaaagggaagg

SEQ ID NO: 396047 - RNA, 18 nt, Human
aacaaaaaaagggaaggg

SEQ ID NO: 396048 - RNA, 20 nt, Human
aacaaaaaaagggaagggga

SEQ ID NO: 396049 - RNA, 18 nt, Human
aaggggaggaaaaaaaaa

SEQ ID NO: 396050 - RNA, 20 nt, Human
aaguuuauaguucuuggaau

SEQ ID NO: 396051 - RNA, 18 nt, Human
acaguaugugggcauccu

SEQ ID NO: 396052 - RNA, 24 nt, Human
acagucugaaaaaauaacaaaaaa

SEQ ID NO: 396053 - RNA, 25 nt, Human
accaagaaacauuuaaaaaagaaaa

SEQ ID NO: 396054 - RNA, 24 nt, Human
agccguuauugcuaaacaggacgc

SEQ ID NO: 396055 - RNA, 18 nt, Human
agcuguuuuagcaauccc

SEQ ID NO: 396056 - RNA, 20 nt, Human
aggcgggggucuggaggggc

SEQ ID NO: 396057 - RNA, 24 nt, Human
aggggccaggagcggggacacagg

SEQ ID NO: 396058 - RNA, 23 nt, Human
caagugacacuugggcuuccucc

SEQ ID NO: 396059 - RNA, 19 nt, Human
cagucugaaaaaauaacaa

SEQ ID NO: 396060 - RNA, 19 nt, Human
cauccuguuccacauggga

SEQ ID NO: 396061 - RNA, 19 nt, Human
ccaacucucuccccucccc

SEQ ID NO: 396062 - RNA, 19 nt, Human
ccauugaagacaucucagu

SEQ ID NO: 396063 - RNA, 22 nt, Human
cccaacucucuccccuccccuc

SEQ ID NO: 396064 - RNA, 19 nt, Human
ccccuccccucuccgcucc

SEQ ID NO: 396065 - RNA, 22 nt, Human
ccccucuccgcuccuuuguucc

SEQ ID NO: 396066 - RNA, 24 nt, Human
cccuuuguuucuacaguagcuuua

SEQ ID NO: 396067 - RNA, 25 nt, Human
ccuccccucuccgcuccuuuguucc

SEQ ID NO: 396068 - RNA, 26 nt, Human
cuggcagccggccgggggcucucccu

SEQ ID NO: 396069 - RNA, 20 nt, Human
cuucuggcagccggccgggg

SEQ ID NO: 396070 - RNA, 18 nt, Human
gcccgcuccuugggugga

SEQ ID NO: 396071 - RNA, 24 nt, Human
gggaggaaaaaaaaaaaucacaug

SEQ ID NO: 396072 - RNA, 25 nt, Human
gggccaggagcggggacacagggga

SEQ ID NO: 396073 - RNA, 22 nt, Human
gucuggaggggccaggagcggg

SEQ ID NO: 396074 - RNA, 24 nt, Human
uaaaaaauauauaaaauaaugcaa

SEQ ID NO: 396075 - RNA, 18 nt, Human
uaacaaaaaaagggaagg

SEQ ID NO: 396076 - RNA, 19 nt, Human
uaacuuguaggacgugcuc

SEQ ID NO: 396077 - RNA, 18 nt, Human
uccacaugggaaugagaa

SEQ ID NO: 396078 - RNA, 26 nt, Human
ucuaccaagaaacauuuaaaaaagaa

SEQ ID NO: 396079 - RNA, 18 nt, Human
ucugaaaaaauaacaaaa

SEQ ID NO: 396080 - RNA, 19 nt, Human
ucuucuggcagccggccgg

SEQ ID NO: 396081 - RNA, 23 nt, Human
ugaaaaaauaacaaaaaaaggga

SEQ ID NO: 396082 - RNA, 24 nt, Human
ugaaaaaauaacaaaaaaagggaa

SEQ ID NO: 396083 - RNA, 22 nt, Human
ugauauugggaaccaucucaca

SEQ ID NO: 396084 - RNA, 23 nt, Human
ugcacagucugaaaaaauaacaa

SEQ ID NO: 396085 - RNA, 19 nt, Human
ugggcuuccucccgccagg

SEQ ID NO: 396086 - RNA, 21 nt, Human
uuauuaauuagacaguaugug

SEQ ID NO: 396087 - RNA, 20 nt, Human
uugggcuuccucccgccagg

SEQ ID NO: 396088 - RNA, 27 nt, Human
uuuuuuuuuuuuuuuuuacuuguuuga

SEQ ID NO: 396089 - RNA, 22 nt, Human
aacaguuuauuagcaucuguuc

SEQ ID NO: 396090 - RNA, 19 nt, Human
agcuccuggggagcugcuc

SEQ ID NO: 396091 - RNA, 22 nt, Human
caagugaagacugacucccucu

SEQ ID NO: 396092 - RNA, 23 nt, Human
cccuggacuccccaccugagcuc

SEQ ID NO: 396093 - RNA, 21 nt, Human
gaacaggucaggauggauggg

SEQ ID NO: 396094 - RNA, 19 nt, Human
gcaguacugaguccugggg

SEQ ID NO: 396095 - RNA, 18 nt, Human
gcuccuggggagcugcuc

SEQ ID NO: 396096 - RNA, 21 nt, Human
gcuccuggggagcugcucugu

SEQ ID NO: 396097 - RNA, 21 nt, Human
ggagcccuggacuccccaccu

SEQ ID NO: 396098 - RNA, 22 nt, Human
ggagcccuggacuccccaccug

SEQ ID NO: 396099 - RNA, 23 nt, Human
gggagcccuggacuccccaccug

SEQ ID NO: 396100 - RNA, 19 nt, Human
uaaaaaacaguuuauuagc

SEQ ID NO: 396101 - RNA, 20 nt, Human
ucccccagugcaagugaaga

SEQ ID NO: 396102 - RNA, 20 nt, Human
ucuccgggagcccuggacuc

SEQ ID NO: 396103 - RNA, 21 nt, Human
ugagcuccuggggagcugcuc

SEQ ID NO: 396104 - RNA, 18 nt, Human
ugaguccuggggcugaga

SEQ ID NO: 396105 - RNA, 21 nt, Human
uguccuugcucaucugacucc

SEQ ID NO: 396106 - RNA, 24 nt, Human
aacaaggaaacaaaggcccagaga

SEQ ID NO: 396107 - RNA, 18 nt, Human
aaggaaacaaaggcccag

SEQ ID NO: 396108 - RNA, 18 nt, Human
aaggauugggaucaaggu

SEQ ID NO: 396109 - RNA, 22 nt, Human
aaggauugggaucaaggugggg

SEQ ID NO: 396110 - RNA, 18 nt, Human
aagggccccuggagcugg

SEQ ID NO: 396111 - RNA, 20 nt, Human
aagggccccuggagcugggu

SEQ ID NO: 396112 - RNA, 22 nt, Human
acaaggaaacaaaggcccagag

SEQ ID NO: 396113 - RNA, 23 nt, Human
acagagcauuccucacagcaaag

SEQ ID NO: 396114 - RNA, 23 nt, Human
accaacaaggaaacaaaggccca

SEQ ID NO: 396115 - RNA, 25 nt, Human
accccagccccagucagcacagguc

SEQ ID NO: 396116 - RNA, 21 nt, Human
accugaacccagccagggcuc

SEQ ID NO: 396117 - RNA, 23 nt, Human
accuugggccuaucacugucccc

SEQ ID NO: 396118 - RNA, 21 nt, Human
agagcccccauaggcugccca

SEQ ID NO: 396119 - RNA, 21 nt, Human
agcuaugaaguagaucaaaca

SEQ ID NO: 396120 - RNA, 18 nt, Human
aggcagucgcuggccaga

SEQ ID NO: 396121 - RNA, 23 nt, Human
aggccccagacagccucugcgac

SEQ ID NO: 396122 - RNA, 26 nt, Human
aggcugcccacccugcccuggggucu

SEQ ID NO: 396123 - RNA, 18 nt, Human
aguccccucucuaccucc

SEQ ID NO: 396124 - RNA, 24 nt, Human
aguggacucagagucagaggccca

SEQ ID NO: 396125 - RNA, 22 nt, Human
auaaaggccccagacagccucu

SEQ ID NO: 396126 - RNA, 23 nt, Human
aucacuguccccacccagcucug

SEQ ID NO: 396127 - RNA, 18 nt, Human
augagcagguucaaucac

SEQ ID NO: 396128 - RNA, 23 nt, Human
caaacaauaugguggguggucaa

SEQ ID NO: 396129 - RNA, 25 nt, Human
caacaaggaaacaaaggcccagaga

SEQ ID NO: 396130 - RNA, 26 nt, Human
caauaugguggguggucaauggcuuu

SEQ ID NO: 396131 - RNA, 21 nt, Human
cacagcaaagggggugagugg

SEQ ID NO: 396132 - RNA, 25 nt, Human
cacaggcucaggaggcugagauggg

SEQ ID NO: 396133 - RNA, 19 nt, Human
cagcacaggucagggcucc

SEQ ID NO: 396134 - RNA, 23 nt, Human
cagccagggcucugacucccagu

SEQ ID NO: 396135 - RNA, 18 nt, Human
cagggcucugacucccag

SEQ ID NO: 396136 - RNA, 21 nt, Human
caguccccucucuaccuccuu

SEQ ID NO: 396137 - RNA, 18 nt, Human
ccaauaaggggcauauuu

SEQ ID NO: 396138 - RNA, 23 nt, Human
ccccagacagccucugcgacagu

SEQ ID NO: 396139 - RNA, 19 nt, Human
ccccauaggcugcccaccc

SEQ ID NO: 396140 - RNA, 20 nt, Human
ccccucucuaccuccuuguc

SEQ ID NO: 396141 - RNA, 18 nt, Human
cccugcccuggggucugg

SEQ ID NO: 396142 - RNA, 18 nt, Human
ccucucuaccuccuuguc

SEQ ID NO: 396143 - RNA, 21 nt, Human
ccugcccuggggucuggggcc

SEQ ID NO: 396144 - RNA, 18 nt, Human
cgagagcccccauaggcu

SEQ ID NO: 396145 - RNA, 23 nt, Human
cgagagcccccauaggcugccca

SEQ ID NO: 396146 - RNA, 18 nt, Human
cgcuggccagacguggga

SEQ ID NO: 396147 - RNA, 20 nt, Human
cgugagauuuaugcuuuaag

SEQ ID NO: 396148 - RNA, 21 nt, Human
cucugggugucccaagggccc

SEQ ID NO: 396149 - RNA, 23 nt, Human
cugaccaacaaggaaacaaaggc

SEQ ID NO: 396150 - RNA, 23 nt, Human
cuggagcugggugcagucauggg

SEQ ID NO: 396151 - RNA, 21 nt, Human
cuguccccacccagcucuggg

SEQ ID NO: 396152 - RNA, 19 nt, Human
cuuauaaccacgaggccac

SEQ ID NO: 396153 - RNA, 21 nt, Human
gagcugggugcagucauggga

SEQ ID NO: 396154 - RNA, 25 nt, Human
gaggcccagacucugcucuugggcc

SEQ ID NO: 396155 - RNA, 26 nt, Human
gaggcccagacucugcucuugggccu

SEQ ID NO: 396156 - RNA, 24 nt, Human
gaggcugagaugggccaggggcac

SEQ ID NO: 396157 - RNA, 18 nt, Human
gagggggcugccuccucu

SEQ ID NO: 396158 - RNA, 21 nt, Human
gaguggggacccacaggcuca

SEQ ID NO: 396159 - RNA, 23 nt, Human
gaguggggacccacaggcucagg

SEQ ID NO: 396160 - RNA, 19 nt, Human
gcagucuagggagcuggau

SEQ ID NO: 396161 - RNA, 19 nt, Human
gcccuggggucuggggccc

SEQ ID NO: 396162 - RNA, 21 nt, Human
gcgggggcgguggcuccuucc

SEQ ID NO: 396163 - RNA, 22 nt, Human
gcugcccacccugcccuggggu

SEQ ID NO: 396164 - RNA, 21 nt, Human
gcugucccuuuuuugccugcu

SEQ ID NO: 396165 - RNA, 23 nt, Human
gcuucacaauggugagguugagg

SEQ ID NO: 396166 - RNA, 21 nt, Human
ggagaaggcagucgcuggcca

SEQ ID NO: 396167 - RNA, 20 nt, Human
ggaugcagucuagggagcug

SEQ ID NO: 396168 - RNA, 23 nt, Human
ggcaggagagggaauguaggucu

SEQ ID NO: 396169 - RNA, 20 nt, Human
gggcugcugggauguggagg

SEQ ID NO: 396170 - RNA, 24 nt, Human
gggugaguggggacccacaggccg

SEQ ID NO: 396171 - RNA, 23 nt, Human
ggugggggcucucagcaggcugg

SEQ ID NO: 396172 - RNA, 24 nt, Human
gucucaggucaggcugggguuaua

SEQ ID NO: 396173 - RNA, 20 nt, Human
gugagguugagggggagggc

SEQ ID NO: 396174 - RNA, 21 nt, Human
guggacucagagucagaggcc

SEQ ID NO: 396175 - RNA, 18 nt, Human
uauugcaaacauggagug

SEQ ID NO: 396176 - RNA, 22 nt, Human
ucacuguccccacccagcucug

SEQ ID NO: 396177 - RNA, 21 nt, Human
ucagcaggcugggagcagggg

SEQ ID NO: 396178 - RNA, 20 nt, Human
ucccauggugauuaaauggg

SEQ ID NO: 396179 - RNA, 22 nt, Human
ucccccaguccccucucuaccu

SEQ ID NO: 396180 - RNA, 23 nt, Human
uccuugucuuggcugagucuuuu

SEQ ID NO: 396181 - RNA, 22 nt, Human
ugacucccagucccccaguccc

SEQ ID NO: 396182 - RNA, 24 nt, Human
ugacucccagucccccaguccccu

SEQ ID NO: 396183 - RNA, 21 nt, Human
uggaggccccgugagccccag

SEQ ID NO: 396184 - RNA, 19 nt, Human
ugggaagagguacgggaug

SEQ ID NO: 396185 - RNA, 22 nt, Human
ugggaagagguacgggaugcag

SEQ ID NO: 396186 - RNA, 23 nt, Human
ugggauaaggauugggaucaagg

SEQ ID NO: 396187 - RNA, 20 nt, Human
ugggauguggaggggaccuu

SEQ ID NO: 396188 - RNA, 23 nt, Human
ugggccuucacauuacccagccu

SEQ ID NO: 396189 - RNA, 20 nt, Human
uggggcccaauaaggggcau

SEQ ID NO: 396190 - RNA, 18 nt, Human
ugguggguggucaauggc

SEQ ID NO: 396191 - RNA, 21 nt, Human
ugguggguggucaauggcuuu

SEQ ID NO: 396192 - RNA, 20 nt, Human
ugguguggagggggcugccu

SEQ ID NO: 396193 - RNA, 22 nt, Human
ugguguggagggggcugccucc

SEQ ID NO: 396194 - RNA, 18 nt, Human
uguaggucuuuccucucu

SEQ ID NO: 396195 - RNA, 23 nt, Human
uguaggucuuuccucucucaccc

SEQ ID NO: 396196 - RNA, 18 nt, Human
uuccucacagcaaagggg

SEQ ID NO: 396197 - RNA, 19 nt, Human
uuccucacagcaaaggggg

SEQ ID NO: 396198 - RNA, 23 nt, Human
uuccucucucaccccagccccag

SEQ ID NO: 396199 - RNA, 21 nt, Human
uuggaggccccgugagcccca

SEQ ID NO: 396200 - RNA, 19 nt, Human
uuuugauaaaggccccaga

SEQ ID NO: 396201 - RNA, 20 nt, Human
aagucauaggacagggugga

SEQ ID NO: 396202 - RNA, 24 nt, Human
agaggagagggggaugugcuggag

SEQ ID NO: 396203 - RNA, 18 nt, Human
agagucccugggucaggg

SEQ ID NO: 396204 - RNA, 21 nt, Human
aucagcaaacagucuagacca

SEQ ID NO: 396205 - RNA, 20 nt, Human
cagcauugaagggcgugagg

SEQ ID NO: 396206 - RNA, 24 nt, Human
cagggcuguggggcucacagagca

SEQ ID NO: 396207 - RNA, 22 nt, Human
cauuuauuuugaguuagggugu

SEQ ID NO: 396208 - RNA, 18 nt, Human
ccccgugcagguugggga

SEQ ID NO: 396209 - RNA, 19 nt, Human
cccugggucaggggccagu

SEQ ID NO: 396210 - RNA, 19 nt, Human
ccggacagcaugggcgggg

SEQ ID NO: 396211 - RNA, 23 nt, Human
ccucuucucaggcuccucuaaag

SEQ ID NO: 396212 - RNA, 20 nt, Human
ccugggggagaggagagggg

SEQ ID NO: 396213 - RNA, 18 nt, Human
cugcccucugugguggcc

SEQ ID NO: 396214 - RNA, 22 nt, Human
cuggagcccggaguccaugucu

SEQ ID NO: 396215 - RNA, 18 nt, Human
gagaagcaggaaugcccc

SEQ ID NO: 396216 - RNA, 20 nt, Human
gaguccaugucuggcagccu

SEQ ID NO: 396217 - RNA, 21 nt, Human
gccuugggagauggagagggu

SEQ ID NO: 396218 - RNA, 23 nt, Human
gcucuggggagaaacggccaggg

SEQ ID NO: 396219 - RNA, 19 nt, Human
ggacagcaugggcgggggg

SEQ ID NO: 396220 - RNA, 21 nt, Human
ggagauggagaggguuuccca

SEQ ID NO: 396221 - RNA, 21 nt, Human
guggacccagccccaaccugg

SEQ ID NO: 396222 - RNA, 23 nt, Human
ucacagagcaggcagcucugggg

SEQ ID NO: 396223 - RNA, 22 nt, Human
uccauccugcagcauugaaggg

SEQ ID NO: 396224 - RNA, 19 nt, Human
ucccugcuccguguugucc

SEQ ID NO: 396225 - RNA, 19 nt, Human
ucccugggucaggggccag

SEQ ID NO: 396226 - RNA, 19 nt, Human
uccguguuguccaaguuug

SEQ ID NO: 396227 - RNA, 20 nt, Human
uccguguuguccaaguuugu

SEQ ID NO: 396228 - RNA, 23 nt, Human
uccugcagcauugaagggcguga

SEQ ID NO: 396229 - RNA, 20 nt, Human
ucugccucuucucaggcucc

SEQ ID NO: 396230 - RNA, 20 nt, Human
ucugccucuucucaggcucc

SEQ ID NO: 396231 - RNA, 19 nt, Human
ugagcucucccugcuccgu

SEQ ID NO: 396232 - RNA, 21 nt, Human
uggggcaggugacuaaccauc

SEQ ID NO: 396233 - RNA, 20 nt, Human
uggggcucacagagcaggca

SEQ ID NO: 396234 - RNA, 20 nt, Human
ugggggagaggagaggggga

SEQ ID NO: 396235 - RNA, 20 nt, Human
ugggggagaggagagggggg

SEQ ID NO: 396236 - RNA, 21 nt, Human
uguccaaguuuguacgggagg

SEQ ID NO: 396237 - RNA, 19 nt, Human
aacagaagcagccuugagu

SEQ ID NO: 396238 - RNA, 21 nt, Human
aacuaaggcuccacagcauca

SEQ ID NO: 396239 - RNA, 28 nt, Human
aagaaggagcaggcuucaguuaacagaa

SEQ ID NO: 396240 - RNA, 20 nt, Human
aagcacaagguaggaaaugc

SEQ ID NO: 396241 - RNA, 24 nt, Human
acuaaggcuccacagcaucagaca

SEQ ID NO: 396242 - RNA, 20 nt, Human
acuucuaucaggcccauccc

SEQ ID NO: 396243 - RNA, 18 nt, Human
agacaaugguggcccuga

SEQ ID NO: 396244 - RNA, 25 nt, Human
agcuuuagaauaagggaagaggauu

SEQ ID NO: 396245 - RNA, 19 nt, Human
aggccugaggacaggguug

SEQ ID NO: 396246 - RNA, 23 nt, Human
agggcagaacaagaaggagcagg

SEQ ID NO: 396247 - RNA, 24 nt, Human
aguggauggaauaccaaagaaaga

SEQ ID NO: 396248 - RNA, 21 nt, Human
aguuaacagaagcagccuuga

SEQ ID NO: 396249 - RNA, 20 nt, Human
aucaggcccaucccagugcu

SEQ ID NO: 396250 - RNA, 22 nt, Human
aucaggcccaucccagugcuga

SEQ ID NO: 396251 - RNA, 20 nt, Human
auggaauaccaaagaaagag

SEQ ID NO: 396252 - RNA, 20 nt, Human
augggucucuauggugaguu

SEQ ID NO: 396253 - RNA, 18 nt, Human
augguggcccugauuuuu

SEQ ID NO: 396254 - RNA, 21 nt, Human
cacaggaccuggccuuguggg

SEQ ID NO: 396255 - RNA, 23 nt, Human
cacauggcccuugagaaaugucc

SEQ ID NO: 396256 - RNA, 27 nt, Human
caccaggagagggacuuccuggauuuc

SEQ ID NO: 396257 - RNA, 19 nt, Human
caccagggaggaagcaaug

SEQ ID NO: 396258 - RNA, 21 nt, Human
cacuucuaucaggcccauccc

SEQ ID NO: 396259 - RNA, 18 nt, Human
cagggauagagagaggag

SEQ ID NO: 396260 - RNA, 25 nt, Human
cauccauaaucugaaagcuaagcac

SEQ ID NO: 396261 - RNA, 23 nt, Human
ccagggaggaagcaaugccuucu

SEQ ID NO: 396262 - RNA, 24 nt, Human
ccagugcugagagagcacuccagu

SEQ ID NO: 396263 - RNA, 18 nt, Human
ccugaggacaggguuguc

SEQ ID NO: 396264 - RNA, 22 nt, Human
ccuugagaaauguccuugcaga

SEQ ID NO: 396265 - RNA, 20 nt, Human
cucaacuaaggcuccacagc

SEQ ID NO: 396266 - RNA, 22 nt, Human
cugcaaugccagggaagacucu

SEQ ID NO: 396267 - RNA, 21 nt, Human
cuggcucuugaaucugcccuc

SEQ ID NO: 396268 - RNA, 22 nt, Human
cuuccuggauuucagggauaga

SEQ ID NO: 396269 - RNA, 18 nt, Human
gagaauggaggcaauagg

SEQ ID NO: 396270 - RNA, 19 nt, Human
gagaauggaggcaauagga

SEQ ID NO: 396271 - RNA, 24 nt, Human
gagaauggaggcaauaggaggaga

SEQ ID NO: 396272 - RNA, 19 nt, Human
gaggccaugacucaggaaa

SEQ ID NO: 396273 - RNA, 18 nt, Human
gagggcagaacaagaagg

SEQ ID NO: 396274 - RNA, 21 nt, Human
gcaaaucucuggagggcagaa

SEQ ID NO: 396275 - RNA, 18 nt, Human
ggagggcagaacaagaag

SEQ ID NO: 396276 - RNA, 27 nt, Human
ggauucuguggccucggcugguguuuc

SEQ ID NO: 396277 - RNA, 23 nt, Human
gugacccugugauagcacaggac

SEQ ID NO: 396278 - RNA, 22 nt, Human
uaaaagaggugacccugugaua

SEQ ID NO: 396279 - RNA, 21 nt, Human
uaagggaagaggauuugcugg

SEQ ID NO: 396280 - RNA, 19 nt, Human
uagcacaggaccuggccuu

SEQ ID NO: 396281 - RNA, 22 nt, Human
uaggaaaugcugaaaucucaac

SEQ ID NO: 396282 - RNA, 19 nt, Human
ucacaccagggaggaagca

SEQ ID NO: 396283 - RNA, 21 nt, Human
ucggcugguguuucuaacugu

SEQ ID NO: 396284 - RNA, 19 nt, Human
ucucaacuaaggcuccaca

SEQ ID NO: 396285 - RNA, 18 nt, Human
ugcaaaaccacauggccc

SEQ ID NO: 396286 - RNA, 22 nt, Human
ugcaaaaccacauggcccuuga

SEQ ID NO: 396287 - RNA, 19 nt, Human
uggaauaccaaagaaagag

SEQ ID NO: 396288 - RNA, 23 nt, Human
ugggucuggcugcuuaugguugu

SEQ ID NO: 396289 - RNA, 24 nt, Human
ugguuguguuggccuuuuugaccu

SEQ ID NO: 396290 - RNA, 20 nt, Human
uguccuugcagauugggcuu

SEQ ID NO: 396291 - RNA, 22 nt, Human
uucucaagggucgucagcaggu

SEQ ID NO: 396292 - RNA, 28 nt, Human
uugaaguagaguuuaauuuaaagcuuau

SEQ ID NO: 396293 - RNA, 18 nt, Human
uugaaucugcccucauau

SEQ ID NO: 396294 - RNA, 19 nt, Human
aaggagccagguggggcag

SEQ ID NO: 396295 - RNA, 23 nt, Human
aaggagccagguggggcaggggu

SEQ ID NO: 396296 - RNA, 24 nt, Human
agaaaggagccagguggggcaggg

SEQ ID NO: 396297 - RNA, 20 nt, Human
agaggacagagguggagcca

SEQ ID NO: 396298 - RNA, 23 nt, Human
aggaguagaaaggagccaggugg

SEQ ID NO: 396299 - RNA, 23 nt, Human
agggagggcagcuggagggcggg

SEQ ID NO: 396300 - RNA, 20 nt, Human
cacgguguuucuaacagagc

SEQ ID NO: 396301 - RNA, 23 nt, Human
caggcuagagagaggacagaggu

SEQ ID NO: 396302 - RNA, 21 nt, Human
ccaggcaggcuagagagagga

SEQ ID NO: 396303 - RNA, 24 nt, Human
cgacauagccaggaguagaaagga

SEQ ID NO: 396304 - RNA, 24 nt, Human
cuucccaaagcacacgguguuucu

SEQ ID NO: 396305 - RNA, 25 nt, Human
gcuagagagaggacagagguggagc

SEQ ID NO: 396306 - RNA, 20 nt, Human
ggcaggggugccagggaggg

SEQ ID NO: 396307 - RNA, 18 nt, Human
ugccagggagggcagcug

SEQ ID NO: 396308 - RNA, 23 nt, Human
aaaaaaaaaccuuucaaaaagga

SEQ ID NO: 396309 - RNA, 25 nt, Human
auaaaaaaaaaccuuucaaaaagga

SEQ ID NO: 396310 - RNA, 27 nt, Human
ccagccccucccucccuuccuuccucc

SEQ ID NO: 396311 - RNA, 23 nt, Human
ccccucccucccuuccuuccucc

SEQ ID NO: 396312 - RNA, 21 nt, Human
ccuuccucccucccucuccca

SEQ ID NO: 396313 - RNA, 22 nt, Human
ccuuccuuccucccucccucuc

SEQ ID NO: 396314 - RNA, 21 nt, Human
cucccucccuuccuuccuccc

SEQ ID NO: 396315 - RNA, 18 nt, Human
uccuuccucccucccucu

SEQ ID NO: 396316 - RNA, 19 nt, Human
uccuuccucccucccucuc

SEQ ID NO: 396317 - RNA, 19 nt, Human
aaagaagucauccaccucc

SEQ ID NO: 396318 - RNA, 21 nt, Human
aaaguugcacgaagucagagg

SEQ ID NO: 396319 - RNA, 21 nt, Human
acacuuucggauguaacugac

SEQ ID NO: 396320 - RNA, 18 nt, Human
agaaaacugaggucagcu

SEQ ID NO: 396321 - RNA, 22 nt, Human
aggaaaaguugcacgaagucag

SEQ ID NO: 396322 - RNA, 23 nt, Human
aggaaaaguugcacgaagucaga

SEQ ID NO: 396323 - RNA, 21 nt, Human
caacaggaaguacauaaccuc

SEQ ID NO: 396324 - RNA, 24 nt, Human
caacaggaaguacauaaccucgac

SEQ ID NO: 396325 - RNA, 19 nt, Human
caacggguucuggaauguu

SEQ ID NO: 396326 - RNA, 20 nt, Human
cagcaggugaaccauccuuc

SEQ ID NO: 396327 - RNA, 24 nt, Human
cagcuuggaaaggaguuccccgag

SEQ ID NO: 396328 - RNA, 24 nt, Human
caggaaguacauaaccucgacuca

SEQ ID NO: 396329 - RNA, 20 nt, Human
caggugaaccauccugucca

SEQ ID NO: 396330 - RNA, 24 nt, Human
ccaggauggggaggaaaaguugca

SEQ ID NO: 396331 - RNA, 22 nt, Human
cgacucagcaggugaaccaucc

SEQ ID NO: 396332 - RNA, 18 nt, Human
gagccucuuaaaacagcu

SEQ ID NO: 396333 - RNA, 20 nt, Human
gauggggaggaaaaguugca

SEQ ID NO: 396334 - RNA, 21 nt, Human
gcagugucuucuucaacucaa

SEQ ID NO: 396335 - RNA, 22 nt, Human
gcagugucuucuucaacucaag

SEQ ID NO: 396336 - RNA, 22 nt, Human
ggaaaggaguuccccgagugga

SEQ ID NO: 396337 - RNA, 19 nt, Human
ggauggggaggaaaaguug

SEQ ID NO: 396338 - RNA, 20 nt, Human
ggcccgcggcugacggccag

SEQ ID NO: 396339 - RNA, 23 nt, Human
uaacuggguucuugugagaaaac

SEQ ID NO: 396340 - RNA, 25 nt, Human
uccacaacggguucuggaauguucu

SEQ ID NO: 396341 - RNA, 22 nt, Human
uccuguccagcagugucuucuu

SEQ ID NO: 396342 - RNA, 19 nt, Human
ugacaaaauagcgaaugag

SEQ ID NO: 396343 - RNA, 20 nt, Human
ugacaaaauagcgaaugagu

SEQ ID NO: 396344 - RNA, 24 nt, Human
ugacaaaauagcgaaugagugaaa

SEQ ID NO: 396345 - RNA, 23 nt, Human
ugcacgaagucagagguauaagg

SEQ ID NO: 396346 - RNA, 18 nt, Human
ugcuccaucacguccagc

SEQ ID NO: 396347 - RNA, 23 nt, Human
ugcuucagcucuggaggaugcuc

SEQ ID NO: 396348 - RNA, 21 nt, Human
uggaaaggaguuccccgagug

SEQ ID NO: 396349 - RNA, 20 nt, Human
uggguucuugugagaaaacu

SEQ ID NO: 396350 - RNA, 24 nt, Human
uguccagcagugucuucuucaacu

SEQ ID NO: 396351 - RNA, 19 nt, Human
ugugagaaaacugagguca

SEQ ID NO: 396352 - RNA, 20 nt, Human
uuccccgaguggaguuccca

SEQ ID NO: 396353 - RNA, 21 nt, Human
uuuuuccacaacggguucugg

SEQ ID NO: 396354 - RNA, 19 nt, Human
uuuuuuuuuuuuuuuugcu

SEQ ID NO: 396355 - RNA, 21 nt, Human
uuuuuuuuuuuuuuuuugcuu

SEQ ID NO: 396356 - RNA, 27 nt, Human
uuuuuuuuuuuuuuuuuuuuuuugggg

SEQ ID NO: 396357 - RNA, 24 nt, Human
aaaaaaggaaauugcauaagaaga

SEQ ID NO: 396358 - RNA, 23 nt, Human
aaaaaggaaauugcauaagaaga

SEQ ID NO: 396359 - RNA, 20 nt, Human
aaaauuggaagcagucugga

SEQ ID NO: 396360 - RNA, 20 nt, Human
aaacagcuuggggggugcgg

SEQ ID NO: 396361 - RNA, 20 nt, Human
aacaaaggaaacaaacaaaa

SEQ ID NO: 396362 - RNA, 21 nt, Human
aacaaaggaaacaaacaaaaa

SEQ ID NO: 396363 - RNA, 22 nt, Human
aaccuucugaacauuuucaaca

SEQ ID NO: 396364 - RNA, 22 nt, Human
aaggaaacaaacaaaaaccuaa

SEQ ID NO: 396365 - RNA, 22 nt, Human
aaugugagagggcuaggaaaaa

SEQ ID NO: 396366 - RNA, 18 nt, Human
agaagaaaacagcuuggg

SEQ ID NO: 396367 - RNA, 21 nt, Human
agagcaaagcuacacaaagaa

SEQ ID NO: 396368 - RNA, 24 nt, Human
agagggcuaggaaaaaaaaauuca

SEQ ID NO: 396369 - RNA, 21 nt, Human
agauaaauaccucuuugggug

SEQ ID NO: 396370 - RNA, 23 nt, Human
aggggcaggcgccagggaaggcc

SEQ ID NO: 396371 - RNA, 18 nt, Human
aggggccacauuccaaaa

SEQ ID NO: 396372 - RNA, 20 nt, Human
agguagggugacucagguga

SEQ ID NO: 396373 - RNA, 22 nt, Human
aguaauaauaacaaaaaaggaa

SEQ ID NO: 396374 - RNA, 26 nt, Human
aucaccucgccgggaugaguaaaccc

SEQ ID NO: 396375 - RNA, 28 nt, Human
caaacaaaaaccuaaauacuuaaaaaaa

SEQ ID NO: 396376 - RNA, 18 nt, Human
caaagaccuugcagaccc

SEQ ID NO: 396377 - RNA, 19 nt, Human
caaaucaaaacagcaacaa

SEQ ID NO: 396378 - RNA, 24 nt, Human
cacagguagggugacucaggugag

SEQ ID NO: 396379 - RNA, 22 nt, Human
cacccccugcagaucuuguuaa

SEQ ID NO: 396380 - RNA, 21 nt, Human
cacuuccaaggaaagccugga

SEQ ID NO: 396381 - RNA, 20 nt, Human
cagccccugcgaggcagccu

SEQ ID NO: 396382 - RNA, 20 nt, Human
cagcccucuuucaucucuug

SEQ ID NO: 396383 - RNA, 23 nt, Human
caugacaagugggaguuuguaga

SEQ ID NO: 396384 - RNA, 24 nt, Human
cauucuccucccucuaaucacccc

SEQ ID NO: 396385 - RNA, 25 nt, Human
ccacgcgugcagcccucuuucaucu

SEQ ID NO: 396386 - RNA, 18 nt, Human
cccagaaggcugccgacc

SEQ ID NO: 396387 - RNA, 19 nt, Human
cccaggcgcgccgcgugca

SEQ ID NO: 396388 - RNA, 20 nt, Human
ccgaggcucauucuccuccc

SEQ ID NO: 396389 - RNA, 25 nt, Human
ccgguagugaggaccugggacaaag

SEQ ID NO: 396390 - RNA, 20 nt, Human
ccucaguuucuugaaaauaa

SEQ ID NO: 396391 - RNA, 20 nt, Human
ccuccaggauccauucccaa

SEQ ID NO: 396392 - RNA, 21 nt, Human
ccucgcgcaugggaucaccuc

SEQ ID NO: 396393 - RNA, 19 nt, Human
ccugcgcccgguagugagg

SEQ ID NO: 396394 - RNA, 22 nt, Human
ccuggacggagccaggcuccug

SEQ ID NO: 396395 - RNA, 19 nt, Human
cgaccaauaacgcucaccc

SEQ ID NO: 396396 - RNA, 21 nt, Human
cgccgcgugcaggcgccgggg

SEQ ID NO: 396397 - RNA, 18 nt, Human
cggagcagaggggcacag

SEQ ID NO: 396398 - RNA, 21 nt, Human
cgggcggggccgacaggggca

SEQ ID NO: 396399 - RNA, 26 nt, Human
cgugcaggcgccggggaaagcgcggg

SEQ ID NO: 396400 - RNA, 22 nt, Human
cuccuuucuuucuuuucauaca

SEQ ID NO: 396401 - RNA, 22 nt, Human
cucgggcccccacgcgugcagc

SEQ ID NO: 396402 - RNA, 22 nt, Human
cucgggcccccacgcgugcagc

SEQ ID NO: 396403 - RNA, 19 nt, Human
cuugguccuccuuucuuuc

SEQ ID NO: 396404 - RNA, 26 nt, Human
gaacauuuucaacacugucaaaaaua

SEQ ID NO: 396405 - RNA, 24 nt, Human
gaagugccuggugggaagggcuga

SEQ ID NO: 396406 - RNA, 26 nt, Human
gacaagugggaguuuguagagagaga

SEQ ID NO: 396407 - RNA, 21 nt, Human
gacccuguguggcagugucua

SEQ ID NO: 396408 - RNA, 25 nt, Human
gagagggcuaggaaaaaaaaauuca

SEQ ID NO: 396409 - RNA, 20 nt, Human
gcaaaucuggugaaaaagca

SEQ ID NO: 396410 - RNA, 22 nt, Human
gcacagguagggugacucaggu

SEQ ID NO: 396411 - RNA, 21 nt, Human
gcagacccuguguggcagugu

SEQ ID NO: 396412 - RNA, 20 nt, Human
gcccagugguccagugacgu

SEQ ID NO: 396413 - RNA, 24 nt, Human
gccgacaggggcaggcgccaggga

SEQ ID NO: 396414 - RNA, 19 nt, Human
gccggagcagaggggcaca

SEQ ID NO: 396415 - RNA, 23 nt, Human
ggaaaaccuuugucuuacaaaag

SEQ ID NO: 396416 - RNA, 23 nt, Human
ggaaacaaacaaaaaccuaaaua

SEQ ID NO: 396417 - RNA, 26 nt, Human
ggacgccgauggcgacagccucuccu

SEQ ID NO: 396418 - RNA, 21 nt, Human
ggacggagccaggcuccugga

SEQ ID NO: 396419 - RNA, 19 nt, Human
ggccugcuacuuauaacug

SEQ ID NO: 396420 - RNA, 22 nt, Human
gggaggagaaaacuaggaagaa

SEQ ID NO: 396421 - RNA, 19 nt, Human
gggcccccacgcgugcagc

SEQ ID NO: 396422 - RNA, 24 nt, Human
gggugcggggagggucuucuccag

SEQ ID NO: 396423 - RNA, 21 nt, Human
gugggaagggcugaugccgca

SEQ ID NO: 396424 - RNA, 22 nt, Human
uaagaacaaaggaaacaaacaa

SEQ ID NO: 396425 - RNA, 25 nt, Human
uaauuucuaugacaguccagcaaca

SEQ ID NO: 396426 - RNA, 23 nt, Human
uaccaaagagcaaagcuacacaa

SEQ ID NO: 396427 - RNA, 24 nt, Human
uaccaaagagcaaagcuacacaaa

SEQ ID NO: 396428 - RNA, 19 nt, Human
uacugagcagacacacccc

SEQ ID NO: 396429 - RNA, 22 nt, Human
uagaaauucucugaggaccuga

SEQ ID NO: 396430 - RNA, 23 nt, Human
uagaagaaaacagcuuggggggu

SEQ ID NO: 396431 - RNA, 20 nt, Human
uagggugacucaggugaguu

SEQ ID NO: 396432 - RNA, 23 nt, Human
ucccaugggcagggcagcuucca

SEQ ID NO: 396433 - RNA, 19 nt, Human
ucccucuaaucacccccuc

SEQ ID NO: 396434 - RNA, 19 nt, Human
uccuagcuuagcugaacca

SEQ ID NO: 396435 - RNA, 22 nt, Human
ucuagagcuguguaccuagccu

SEQ ID NO: 396436 - RNA, 25 nt, Human
ucuccagcuguaaugccagcuaagg

SEQ ID NO: 396437 - RNA, 18 nt, Human
ugaaauuucaggauaaau

SEQ ID NO: 396438 - RNA, 21 nt, Human
ugaaauuucaggauaaauuag

SEQ ID NO: 396439 - RNA, 24 nt, Human
ugaacugucuccugggagguguuu

SEQ ID NO: 396440 - RNA, 19 nt, Human
ugacaaggaacagugacag

SEQ ID NO: 396441 - RNA, 22 nt, Human
ugacaugcggaucggccagggc

SEQ ID NO: 396442 - RNA, 22 nt, Human
ugagagggcuaggaaaaaaaaa

SEQ ID NO: 396443 - RNA, 19 nt, Human
ugagcaaaagaaguagggu

SEQ ID NO: 396444 - RNA, 23 nt, Human
ugagcagacacacccccugcaga

SEQ ID NO: 396445 - RNA, 23 nt, Human
ugaggaccugauuaaggcuaggc

SEQ ID NO: 396446 - RNA, 19 nt, Human
ugaguuggcccaguuccug

SEQ ID NO: 396447 - RNA, 20 nt, Human
ugaguuggcccaguuccugg

SEQ ID NO: 396448 - RNA, 23 nt, Human
ugaguuggcccaguuccugggag

SEQ ID NO: 396449 - RNA, 23 nt, Human
ugccaucauugcccaguggucca

SEQ ID NO: 396450 - RNA, 24 nt, Human
ugccaucauugcccagugguccag

SEQ ID NO: 396451 - RNA, 18 nt, Human
ugcccagaaggcugccga

SEQ ID NO: 396452 - RNA, 20 nt, Human
ugccuggugggaagggcuga

SEQ ID NO: 396453 - RNA, 19 nt, Human
ugcggggagggucuucucc

SEQ ID NO: 396454 - RNA, 25 nt, Human
ugcggggagggucuucuccagcugu

SEQ ID NO: 396455 - RNA, 20 nt, Human
ugcuuugguagcaaagcugg

SEQ ID NO: 396456 - RNA, 22 nt, Human
ugcuuugguagcaaagcugggg

SEQ ID NO: 396457 - RNA, 21 nt, Human
uggaugggguggagccuagga

SEQ ID NO: 396458 - RNA, 18 nt, Human
uggcaugaaucaugcagu

SEQ ID NO: 396459 - RNA, 21 nt, Human
ugggaagggcugaugccgcau

SEQ ID NO: 396460 - RNA, 19 nt, Human
ugggaggagaaaacuagga

SEQ ID NO: 396461 - RNA, 23 nt, Human
uggggggugcggggagggucuuc

SEQ ID NO: 396462 - RNA, 24 nt, Human
uggggggugcggggagggucuucu

SEQ ID NO: 396463 - RNA, 25 nt, Human
ugggguggagccuaggauucugcau

SEQ ID NO: 396464 - RNA, 22 nt, Human
uggguguaauuucuaugacagu

SEQ ID NO: 396465 - RNA, 21 nt, Human
ugguccuccuuucuuucuuuu

SEQ ID NO: 396466 - RNA, 21 nt, Human
uggugaaaaagcaaauggcca

SEQ ID NO: 396467 - RNA, 19 nt, Human
uguagagagagagagaccg

SEQ ID NO: 396468 - RNA, 20 nt, Human
uguucuagauuaucuccaau

SEQ ID NO: 396469 - RNA, 21 nt, Human
uuagcugaaccaaagaccuug

SEQ ID NO: 396470 - RNA, 25 nt, Human
aaaaaaaaaaaaaaaaacaaaaaag

SEQ ID NO: 396471 - RNA, 23 nt, Human
aaaaaaaaaaaaaaaacaaaaaa

SEQ ID NO: 396472 - RNA, 22 nt, Human
aaaaaaaaaaaaaaacaaaaaa

SEQ ID NO: 396473 - RNA, 22 nt, Human
aaaaaaaagcacauuccuagaa

SEQ ID NO: 396474 - RNA, 28 nt, Human
aaaaaaagaaaaaaccaacaauucuuca

SEQ ID NO: 396475 - RNA, 23 nt, Human
aaaaaagcacauuccuagaaaaa

SEQ ID NO: 396476 - RNA, 23 nt, Human
aaaaauucuuuacucagucacac

SEQ ID NO: 396477 - RNA, 23 nt, Human
aaacaaaaaaaagaaaaaaccaa

SEQ ID NO: 396478 - RNA, 23 nt, Human
aaacagagaaaaaaggaauccca

SEQ ID NO: 396479 - RNA, 23 nt, Human
aagcaaguagaugcuuuuucaaa

SEQ ID NO: 396480 - RNA, 21 nt, Human
aaggagaagugauccuggggg

SEQ ID NO: 396481 - RNA, 25 nt, Human
aaggagaagugauccuggggguuuu

SEQ ID NO: 396482 - RNA, 20 nt, Human
aagugauccuggggguuuuc

SEQ ID NO: 396483 - RNA, 18 nt, Human
acaaaaaaaagaaaaaac

SEQ ID NO: 396484 - RNA, 21 nt, Human
acaaaaaaaagaaaaaaccaa

SEQ ID NO: 396485 - RNA, 23 nt, Human
acaaaaaaaagcacauuccuaga

SEQ ID NO: 396486 - RNA, 18 nt, Human
acacugguuugauucuga

SEQ ID NO: 396487 - RNA, 21 nt, Human
acaguuccuccauauuuucuu

SEQ ID NO: 396488 - RNA, 23 nt, Human
acaguuccuccauauuuucuuca

SEQ ID NO: 396489 - RNA, 23 nt, Human
accuaguaauuacggaaaaaaga

SEQ ID NO: 396490 - RNA, 18 nt, Human
acucucaacaaagaugac

SEQ ID NO: 396491 - RNA, 24 nt, Human
agaaaaaaaacauaacuuucagaa

SEQ ID NO: 396492 - RNA, 21 nt, Human
agaguggaaugggcaccuucc

SEQ ID NO: 396493 - RNA, 20 nt, Human
agauaaaacagagaaaaaag

SEQ ID NO: 396494 - RNA, 21 nt, Human
agcaaaaaaaaaaaaaaaaaa

SEQ ID NO: 396495 - RNA, 24 nt, Human
agcgguggcgagggcggcgagggc

SEQ ID NO: 396496 - RNA, 20 nt, Human
agucuuugucucccuuuccu

SEQ ID NO: 396497 - RNA, 21 nt, Human
auaagaaacaguaauauacaa

SEQ ID NO: 396498 - RNA, 25 nt, Human
auagaaaaaaaacauaacuuucaga

SEQ ID NO: 396499 - RNA, 23 nt, Human
caaaaaaaagcacauuccuagaa

SEQ ID NO: 396500 - RNA, 24 nt, Human
caaaaaaaagcacauuccuagaaa

SEQ ID NO: 396501 - RNA, 20 nt, Human
caaaaauucuuuacucaguc

SEQ ID NO: 396502 - RNA, 22 nt, Human
caauagcacccugcucugugac

SEQ ID NO: 396503 - RNA, 21 nt, Human
cagaauaaguaaaaaauaaau

SEQ ID NO: 396504 - RNA, 24 nt, Human
ccagaaggugcaauaccagcauug

SEQ ID NO: 396505 - RNA, 22 nt, Human
cccauaacauccacucugagca

SEQ ID NO: 396506 - RNA, 23 nt, Human
ccuagaaaaagguauuggcaaau

SEQ ID NO: 396507 - RNA, 21 nt, Human
ccuuuugucauuuuuuucucu

SEQ ID NO: 396508 - RNA, 22 nt, Human
cgagggcggcgagggcuggagg

SEQ ID NO: 396509 - RNA, 19 nt, Human
cggccgggagcgguggcga

SEQ ID NO: 396510 - RNA, 23 nt, Human
cuaaauuuccaggcagaacagag

SEQ ID NO: 396511 - RNA, 19 nt, Human
cucugugacaaaggcagag

SEQ ID NO: 396512 - RNA, 20 nt, Human
cucugugacaaaggcagagu

SEQ ID NO: 396513 - RNA, 18 nt, Human
cugaaugcugaugagucu

SEQ ID NO: 396514 - RNA, 19 nt, Human
cugaugcaagcacagaaaa

SEQ ID NO: 396515 - RNA, 20 nt, Human
gagaaaaggaauguuuuagu

SEQ ID NO: 396516 - RNA, 23 nt, Human
gcaaaaaaaaaaaaaaaaaaaaa

SEQ ID NO: 396517 - RNA, 20 nt, Human
gcaaauggauaaccaacuaa

SEQ ID NO: 396518 - RNA, 21 nt, Human
gcaauagucuuucaauccccu

SEQ ID NO: 396519 - RNA, 21 nt, Human
gcacagaaaagaaggaagcca

SEQ ID NO: 396520 - RNA, 23 nt, Human
gcgagggcuggaggggcgcgggg

SEQ ID NO: 396521 - RNA, 23 nt, Human
gggaggucaaaagcaaaaaaaaa

SEQ ID NO: 396522 - RNA, 22 nt, Human
guaaaacaguauugaagaccuc

SEQ ID NO: 396523 - RNA, 22 nt, Human
guccucccuucucugacaugcc

SEQ ID NO: 396524 - RNA, 20 nt, Human
gugacaaaggcagaguggaa

SEQ ID NO: 396525 - RNA, 24 nt, Human
uaaaacagagaaaaaaggaauccc

SEQ ID NO: 396526 - RNA, 27 nt, Human
uaaaacagagaaaaaaggaaucccauu

SEQ ID NO: 396527 - RNA, 23 nt, Human
uaaaacaguauugaagaccucau

SEQ ID NO: 396528 - RNA, 21 nt, Human
uaauucuagugaguccucccu

SEQ ID NO: 396529 - RNA, 23 nt, Human
uaccagcauugguuuaugaucag

SEQ ID NO: 396530 - RNA, 25 nt, Human
uagaaaaaaaacauaacuuucagaa

SEQ ID NO: 396531 - RNA, 21 nt, Human
uaguaaaaaugggaggucaaa

SEQ ID NO: 396532 - RNA, 22 nt, Human
uaguaaaaaugggaggucaaaa

SEQ ID NO: 396533 - RNA, 23 nt, Human
uauaccagaugauagaaaaaaaa

SEQ ID NO: 396534 - RNA, 23 nt, Human
ucaaaagcaaaaaaaaaaaaaaa

SEQ ID NO: 396535 - RNA, 18 nt, Human
ucacacaacaaaugaggu

SEQ ID NO: 396536 - RNA, 18 nt, Human
ucggguaugcgcccuccc

SEQ ID NO: 396537 - RNA, 25 nt, Human
ucuagaaugaagccaccaauuucaa

SEQ ID NO: 396538 - RNA, 26 nt, Human
ucuugcaagagauuugcugauaaaug

SEQ ID NO: 396539 - RNA, 24 nt, Human
ugaaaaugcuuuugaguccacugc

SEQ ID NO: 396540 - RNA, 18 nt, Human
ugaagcaaguagaugcuu

SEQ ID NO: 396541 - RNA, 20 nt, Human
ugaagcaaguagaugcuuuu

SEQ ID NO: 396542 - RNA, 23 nt, Human
ugaagcaaguagaugcuuuuuca

SEQ ID NO: 396543 - RNA, 18 nt, Human
ugaauaauccuucagcca

SEQ ID NO: 396544 - RNA, 22 nt, Human
ugacuuaguaccgaacauguaa

SEQ ID NO: 396545 - RNA, 25 nt, Human
ugacuuuuuagguacuacaguagcu

SEQ ID NO: 396546 - RNA, 23 nt, Human
ugagaaaauaauuuauaaaaaua

SEQ ID NO: 396547 - RNA, 22 nt, Human
ugauccuggggguuuucucaag

SEQ ID NO: 396548 - RNA, 24 nt, Human
ugcaagcacagaaaagaaggaagc

SEQ ID NO: 396549 - RNA, 24 nt, Human
ugccauuguaaccauaaaaauaua

SEQ ID NO: 396550 - RNA, 19 nt, Human
ugcucagagauggccucac

SEQ ID NO: 396551 - RNA, 18 nt, Human
uggaaugggcaccuuccc

SEQ ID NO: 396552 - RNA, 21 nt, Human
uggaggggcgcggggaaugcc

SEQ ID NO: 396553 - RNA, 22 nt, Human
uggcgagggcggcgagggcugg

SEQ ID NO: 396554 - RNA, 28 nt, Human
ugggaggcagcuggugcucacugagaug

SEQ ID NO: 396555 - RNA, 22 nt, Human
uguacaaaaaaaagcacauucc

SEQ ID NO: 396556 - RNA, 19 nt, Human
uguguacaaaaaaaagcac

SEQ ID NO: 396557 - RNA, 27 nt, Human
uuaaaacauuugcaaauggauaaccaa

SEQ ID NO: 396558 - RNA, 21 nt, Human
uucaaaaggaaaccaaagcaa

SEQ ID NO: 396559 - RNA, 22 nt, Human
uucagaaauuguauuuaacauu

SEQ ID NO: 396560 - RNA, 21 nt, Human
uuccagaauaaguaaaaaaua

SEQ ID NO: 396561 - RNA, 22 nt, Human
uuccuguuccaugaauaauccu

SEQ ID NO: 396562 - RNA, 19 nt, Human
uuguauguaaguuucaccu

SEQ ID NO: 396563 - RNA, 20 nt, Human
uuuauuguuguuccuuguac

SEQ ID NO: 396564 - RNA, 23 nt, Human
uuucagaaauuguauuuaacauu

SEQ ID NO: 396565 - RNA, 21 nt, Human
uuugucauuuuuuucucuuuu

SEQ ID NO: 396566 - RNA, 18 nt, Human
uuuuccugcuacaucugc

SEQ ID NO: 396567 - RNA, 23 nt, Human
uuuuccugcuacaucugcacaag

SEQ ID NO: 396568 - RNA, 26 nt, Human
aacacuuucagccauuacugaaaaua

SEQ ID NO: 396569 - RNA, 20 nt, Human
aagcaacaaguuaaaauaca

SEQ ID NO: 396570 - RNA, 21 nt, Human
aagcauuucagaauggaaaua

SEQ ID NO: 396571 - RNA, 24 nt, Human
caacaaguuaaaauacaguaaugc

SEQ ID NO: 396572 - RNA, 27 nt, Human
cagcacauugugcuaaaaguauggaac

SEQ ID NO: 396573 - RNA, 18 nt, Human
cuaaaaguauggaacagu

SEQ ID NO: 396574 - RNA, 18 nt, Human
cuugcuggaaaucucugu

SEQ ID NO: 396575 - RNA, 19 nt, Human
gaaauaaaaacugaaccca

SEQ ID NO: 396576 - RNA, 21 nt, Human
gcaauaaagcagguaacugaa

SEQ ID NO: 396577 - RNA, 20 nt, Human
gcccucuucauucuuaauuc

SEQ ID NO: 396578 - RNA, 22 nt, Human
ggaaaucucuguauguugaacu

SEQ ID NO: 396579 - RNA, 18 nt, Human
ggagaugcaaauggcccu

SEQ ID NO: 396580 - RNA, 20 nt, Human
ucaaacaauaaaaaggaagc

SEQ ID NO: 396581 - RNA, 20 nt, Human
uccacauggagcaauaaagc

SEQ ID NO: 396582 - RNA, 19 nt, Human
ugcuggaaaucucuguaug

SEQ ID NO: 396583 - RNA, 25 nt, Human
uggaaauaaaaacugaacccaggca

SEQ ID NO: 396584 - RNA, 18 nt, Human
ugugcuaaaaguauggaa

SEQ ID NO: 396585 - RNA, 26 nt, Human
uuaauuacaugauaugacaacucaua

SEQ ID NO: 396586 - RNA, 19 nt, Human
uuacugaaaauaaacaugu

SEQ ID NO: 396587 - RNA, 21 nt, Human
uucaaacaauaaaaaggaagc

SEQ ID NO: 396588 - RNA, 24 nt, Human
uucagaauggaaauaaaaacugaa

SEQ ID NO: 396589 - RNA, 21 nt, Human
aagacagccgcucagccaccc

SEQ ID NO: 396590 - RNA, 18 nt, Human
acagccgcucagccaccc

SEQ ID NO: 396591 - RNA, 22 nt, Human
accgccgccaccgccgccacgg

SEQ ID NO: 396592 - RNA, 19 nt, Human
agagaggagacguguuagu

SEQ ID NO: 396593 - RNA, 22 nt, Human
agccacgaaagcccuccagaug

SEQ ID NO: 396594 - RNA, 20 nt, Human
agccugccccauccugugcc

SEQ ID NO: 396595 - RNA, 22 nt, Human
aggcacugugccagagccugcc

SEQ ID NO: 396596 - RNA, 19 nt, Human
caaagaagagccgucuccu

SEQ ID NO: 396597 - RNA, 28 nt, Human
caacaaagaccaggcccuggcagccacg

SEQ ID NO: 396598 - RNA, 22 nt, Human
caagacagccgcucagccaccc

SEQ ID NO: 396599 - RNA, 22 nt, Human
caagaggcaagacagccgcuca

SEQ ID NO: 396600 - RNA, 22 nt, Human
cacccugccagucccaggcacu

SEQ ID NO: 396601 - RNA, 23 nt, Human
ccaccgccgccacggccgccuga

SEQ ID NO: 396602 - RNA, 21 nt, Human
ccccauccugugccgggggcu

SEQ ID NO: 396603 - RNA, 26 nt, Human
ccgccaccgccgccacggccgccuga

SEQ ID NO: 396604 - RNA, 24 nt, Human
ccgccgccaccgccgccacggccg

SEQ ID NO: 396605 - RNA, 20 nt, Human
ccgccgccacggccgccuga

SEQ ID NO: 396606 - RNA, 21 nt, Human
ccucccuccuuccaccugcua

SEQ ID NO: 396607 - RNA, 20 nt, Human
cucccuccuuccaccugcua

SEQ ID NO: 396608 - RNA, 22 nt, Human
cugacaagggacguuucccaga

SEQ ID NO: 396609 - RNA, 18 nt, Human
cugcgccugcggcucccu

SEQ ID NO: 396610 - RNA, 26 nt, Human
cugcggcucccucccuccuuccaccu

SEQ ID NO: 396611 - RNA, 22 nt, Human
cuggcagccacgaaagcccucc

SEQ ID NO: 396612 - RNA, 19 nt, Human
gccaccgccgccacggccg

SEQ ID NO: 396613 - RNA, 20 nt, Human
gccgccaccgccgccacggc

SEQ ID NO: 396614 - RNA, 20 nt, Human
gccgcccgcgcucccggggc

SEQ ID NO: 396615 - RNA, 21 nt, Human
ggccacgaccggguggggaca

SEQ ID NO: 396616 - RNA, 19 nt, Human
ggcuaaggcaccagggcgg

SEQ ID NO: 396617 - RNA, 18 nt, Human
gggcggcgggagcgcagg

SEQ ID NO: 396618 - RNA, 24 nt, Human
ggugggccacgaccggguggggaa

SEQ ID NO: 396619 - RNA, 18 nt, Human
uaaggcaccagggcggcg

SEQ ID NO: 396620 - RNA, 19 nt, Human
uaaggcaccagggcggcgg

SEQ ID NO: 396621 - RNA, 21 nt, Human
ucugcgccugcggcucccucc

SEQ ID NO: 396622 - RNA, 21 nt, Human
ugccagagccugccccauccu

SEQ ID NO: 396623 - RNA, 20 nt, Human
ugccccauccugugccgggg

SEQ ID NO: 396624 - RNA, 20 nt, Human
uguuuccuuuuaaugaccuc

SEQ ID NO: 396625 - RNA, 20 nt, Human
acagaaaaagagcauguaga

SEQ ID NO: 396626 - RNA, 25 nt, Human
acagugaaaaaugauucccuuuuca

SEQ ID NO: 396627 - RNA, 18 nt, Human
agaaaauagaccaaagag

SEQ ID NO: 396628 - RNA, 20 nt, Human
aggggaugggggcguuggaa

SEQ ID NO: 396629 - RNA, 20 nt, Human
agugcacagcaggcagcccu

SEQ ID NO: 396630 - RNA, 23 nt, Human
auccggguggagaagggcuccag

SEQ ID NO: 396631 - RNA, 19 nt, Human
aucuguuaagaauauggga

SEQ ID NO: 396632 - RNA, 22 nt, Human
caacugccaggccagcccaggc

SEQ ID NO: 396633 - RNA, 18 nt, Human
cagcaggcagcccucugg

SEQ ID NO: 396634 - RNA, 20 nt, Human
cagcccucuggggagcagau

SEQ ID NO: 396635 - RNA, 22 nt, Human
caggagaaaguaggaaaucuug

SEQ ID NO: 396636 - RNA, 24 nt, Human
ccaggccagcccaggccuuugcag

SEQ ID NO: 396637 - RNA, 22 nt, Human
cccaagugcacagcaggcagcc

SEQ ID NO: 396638 - RNA, 19 nt, Human
ccccugaauccuuccuggg

SEQ ID NO: 396639 - RNA, 24 nt, Human
ccucuccccugaauccuuccuggg

SEQ ID NO: 396640 - RNA, 24 nt, Human
cgggccaagggugaggaaucuauc

SEQ ID NO: 396641 - RNA, 19 nt, Human
cugggcagaguaggguggg

SEQ ID NO: 396642 - RNA, 18 nt, Human
gacccaagugcacagcag

SEQ ID NO: 396643 - RNA, 18 nt, Human
gcuggcguggcucccugu

SEQ ID NO: 396644 - RNA, 23 nt, Human
ggagaagggcuccaggacccaag

SEQ ID NO: 396645 - RNA, 24 nt, Human
ggaggcggcuuaggcucuugcacu

SEQ ID NO: 396646 - RNA, 23 nt, Human
ggcucuugcacuucugggcagag

SEQ ID NO: 396647 - RNA, 18 nt, Human
gggaucagagucccacug

SEQ ID NO: 396648 - RNA, 23 nt, Human
uacagugaaaaaugauucccuuu

SEQ ID NO: 396649 - RNA, 18 nt, Human
uacccuuucucuguuuuc

SEQ ID NO: 396650 - RNA, 25 nt, Human
uagcugcucugaugaguauugcuga

SEQ ID NO: 396651 - RNA, 24 nt, Human
ucaagaguaaagaucuguuaagaa

SEQ ID NO: 396652 - RNA, 18 nt, Human
ucacagaaaaagagcaug

SEQ ID NO: 396653 - RNA, 19 nt, Human
uccggguggagaagggcuc

SEQ ID NO: 396654 - RNA, 22 nt, Human
ugcagggaagggagcuguacau

SEQ ID NO: 396655 - RNA, 21 nt, Human
ugccaggccagcccaggccuu

SEQ ID NO: 396656 - RNA, 24 nt, Human
ugccaggccagcccaggccuuugc

SEQ ID NO: 396657 - RNA, 23 nt, Human
uggccggggugucuggcuggcgu

SEQ ID NO: 396658 - RNA, 23 nt, Human
uggcucccuguuuggggccucuc

SEQ ID NO: 396659 - RNA, 19 nt, Human
uggcuggcguggcucccug

SEQ ID NO: 396660 - RNA, 23 nt, Human
uggcuggcguggcucccuguuug

SEQ ID NO: 396661 - RNA, 19 nt, Human
ugggcagaguagggugggg

SEQ ID NO: 396662 - RNA, 19 nt, Human
uggggccucuccccugaau

SEQ ID NO: 396663 - RNA, 25 nt, Human
uguacaugagacaaugcugaugucg

SEQ ID NO: 396664 - RNA, 18 nt, Human
uucaggagaaaguaggaa

SEQ ID NO: 396665 - RNA, 21 nt, Human
uuucaguccuguguaucccuu

SEQ ID NO: 396666 - RNA, 19 nt, Human
uuuucaguccuguguaucc

SEQ ID NO: 396667 - RNA, 27 nt, Human
uuuuuuuuuuuuuuuuuuuuucugggg

SEQ ID NO: 396668 - RNA, 20 nt, Human
aaccaaggaagcacagacaa

SEQ ID NO: 396669 - RNA, 18 nt, Human
aacuacacagcaaaaagc

SEQ ID NO: 396670 - RNA, 18 nt, Human
aagagacuggggugggca

SEQ ID NO: 396671 - RNA, 22 nt, Human
acacagcaaaaagcaagggagu

SEQ ID NO: 396672 - RNA, 22 nt, Human
acacccacaggccacccacccc

SEQ ID NO: 396673 - RNA, 22 nt, Human
acucuaugccaggcccugcacc

SEQ ID NO: 396674 - RNA, 19 nt, Human
acuggggugggcacacugg

SEQ ID NO: 396675 - RNA, 26 nt, Human
acuucaauuccauccaggaugcccuc

SEQ ID NO: 396676 - RNA, 24 nt, Human
aggcccuagggcacagcacccaug

SEQ ID NO: 396677 - RNA, 19 nt, Human
cacaggccacccacccccu

SEQ ID NO: 396678 - RNA, 20 nt, Human
cacccacaggccacccaccc

SEQ ID NO: 396679 - RNA, 22 nt, Human
cacccacaggccacccaccccc

SEQ ID NO: 396680 - RNA, 20 nt, Human
cacccaugauacccgccuca

SEQ ID NO: 396681 - RNA, 18 nt, Human
cacccccugccacccagg

SEQ ID NO: 396682 - RNA, 21 nt, Human
cacuccuucuccuuccccauc

SEQ ID NO: 396683 - RNA, 23 nt, Human
caggcagagggaacuacacagca

SEQ ID NO: 396684 - RNA, 20 nt, Human
caggccacccacccccugcc

SEQ ID NO: 396685 - RNA, 24 nt, Human
caggccacccacccccugccaccc

SEQ ID NO: 396686 - RNA, 19 nt, Human
ccacaggccacccaccccc

SEQ ID NO: 396687 - RNA, 22 nt, Human
ccaggcagagaaagggggaagg

SEQ ID NO: 396688 - RNA, 20 nt, Human
ccaggcagagggaacuacac

SEQ ID NO: 396689 - RNA, 18 nt, Human
ccaggcccugcaccgggc

SEQ ID NO: 396690 - RNA, 20 nt, Human
cccacccccugccacccagg

SEQ ID NO: 396691 - RNA, 20 nt, Human
cccccugccacccaggcccu

SEQ ID NO: 396692 - RNA, 20 nt, Human
cccggcacacccacaggcca

SEQ ID NO: 396693 - RNA, 19 nt, Human
ccggcacacccacaggcca

SEQ ID NO: 396694 - RNA, 20 nt, Human
ccgggcugugugcuggggga

SEQ ID NO: 396695 - RNA, 18 nt, Human
ccuccugcucuuggggca

SEQ ID NO: 396696 - RNA, 23 nt, Human
ccuccugcucuuggggcagaggc

SEQ ID NO: 396697 - RNA, 24 nt, Human
ccugccacccaggcccuagggcac

SEQ ID NO: 396698 - RNA, 18 nt, Human
ccuucuccuuccccaucg

SEQ ID NO: 396699 - RNA, 22 nt, Human
cgcucccagcuuucaggcaccu

SEQ ID NO: 396700 - RNA, 24 nt, Human
cggcacacccacaggccacccacc

SEQ ID NO: 396701 - RNA, 23 nt, Human
cucagcacuuggccuuucacacc

SEQ ID NO: 396702 - RNA, 21 nt, Human
cucccagcuuucaggcaccuc

SEQ ID NO: 396703 - RNA, 18 nt, Human
cugcugagcccacgcucc

SEQ ID NO: 396704 - RNA, 24 nt, Human
cugggggagcuggggaaggaggug

SEQ ID NO: 396705 - RNA, 20 nt, Human
gaacuacacagcaaaaagca

SEQ ID NO: 396706 - RNA, 19 nt, Human
gagcuggggaaggagguga

SEQ ID NO: 396707 - RNA, 22 nt, Human
gagcuggggaaggaggugacac

SEQ ID NO: 396708 - RNA, 20 nt, Human
gcacuccuucuccuucccca

SEQ ID NO: 396709 - RNA, 22 nt, Human
gcacuuggccuuucacaccaug

SEQ ID NO: 396710 - RNA, 20 nt, Human
gccagggaguggcagguggg

SEQ ID NO: 396711 - RNA, 18 nt, Human
ggagggcugggggcaagc

SEQ ID NO: 396712 - RNA, 21 nt, Human
ggaguaccuacucuaugccag

SEQ ID NO: 396713 - RNA, 21 nt, Human
ggccagggaguggcagguggg

SEQ ID NO: 396714 - RNA, 25 nt, Human
ggcugugugcugggggagucgaggc

SEQ ID NO: 396715 - RNA, 25 nt, Human
gggaaggaggugacacuugaguugg

SEQ ID NO: 396716 - RNA, 19 nt, Human
gggcacuggggauacagac

SEQ ID NO: 396717 - RNA, 24 nt, Human
gggcacuggggauacagacaugau

SEQ ID NO: 396718 - RNA, 22 nt, Human
gggcugggggcaagcuggguuu

SEQ ID NO: 396719 - RNA, 20 nt, Human
gggggcgggcggugggaggg

SEQ ID NO: 396720 - RNA, 21 nt, Human
guccauggggggccggugggg

SEQ ID NO: 396721 - RNA, 22 nt, Human
uacacagcaaaaagcaagggag

SEQ ID NO: 396722 - RNA, 19 nt, Human
uacucuaugccaggcccug

SEQ ID NO: 396723 - RNA, 18 nt, Human
uagggcacagcacccaug

SEQ ID NO: 396724 - RNA, 24 nt, Human
uagggcacagcacccaugauaccc

SEQ ID NO: 396725 - RNA, 25 nt, Human
uauuucugccugggggagcugggga

SEQ ID NO: 396726 - RNA, 19 nt, Human
ucacaccaugcccugcgcc

SEQ ID NO: 396727 - RNA, 22 nt, Human
ugaaccaaggaagcacagacaa

SEQ ID NO: 396728 - RNA, 21 nt, Human
ugcugagcccacgcucccagc

SEQ ID NO: 396729 - RNA, 21 nt, Human
uggcacuccuucuccuucccc

SEQ ID NO: 396730 - RNA, 20 nt, Human
uggcaggugggagggcuggg

SEQ ID NO: 396731 - RNA, 21 nt, Human
ugggagggcugggggcaagcu

SEQ ID NO: 396732 - RNA, 24 nt, Human
ugggagggcugggggcaagcuggg

SEQ ID NO: 396733 - RNA, 19 nt, Human
ugggaggggccagggagug

SEQ ID NO: 396734 - RNA, 22 nt, Human
ugggaggggccagggaguggca

SEQ ID NO: 396735 - RNA, 20 nt, Human
ugggaggugaccagcccugc

SEQ ID NO: 396736 - RNA, 21 nt, Human
uggggauacagacaugauuca

SEQ ID NO: 396737 - RNA, 21 nt, Human
ugggggagcuggggaaggagg

SEQ ID NO: 396738 - RNA, 23 nt, Human
ugggggcaagcuggguuuguggg

SEQ ID NO: 396739 - RNA, 22 nt, Human
ugugggucccgggcugugugcu

SEQ ID NO: 396740 - RNA, 21 nt, Human
uuucacaccaugcccugcgcc

SEQ ID NO: 396741 - RNA, 21 nt, Human
aaauuaccagugcccuggagc

SEQ ID NO: 396742 - RNA, 22 nt, Human
agcaggaggucucuuuuccaag

SEQ ID NO: 396743 - RNA, 20 nt, Human
agcccgcggagcaggagguc

SEQ ID NO: 396744 - RNA, 27 nt, Human
caggaggucucuuuuccaagcgcacuc

SEQ ID NO: 396745 - RNA, 21 nt, Human
cagugcccuggagccgguugg

SEQ ID NO: 396746 - RNA, 18 nt, Human
cccgcugccuccgcgcgg

SEQ ID NO: 396747 - RNA, 22 nt, Human
cccgcugccuccgcgcgguccu

SEQ ID NO: 396748 - RNA, 25 nt, Human
cgcaggacagccaaccagaaggaaa

SEQ ID NO: 396749 - RNA, 23 nt, Human
gagcaggaggucucuuuuccaag

SEQ ID NO: 396750 - RNA, 18 nt, Human
gcccuggagccgguuggg

SEQ ID NO: 396751 - RNA, 22 nt, Human
gguccucuagccaaauuaccag

SEQ ID NO: 396752 - RNA, 26 nt, Human
guugagcgccccugcccggggaaggu

SEQ ID NO: 396753 - RNA, 18 nt, Human
uagccaaauuaccagugc

SEQ ID NO: 396754 - RNA, 20 nt, Human
uccgcgcgguccucuagcca

SEQ ID NO: 396755 - RNA, 21 nt, Human
ucuagccaaauuaccagugcc

SEQ ID NO: 396756 - RNA, 19 nt, Human
ugccccgagcccgcggagc

SEQ ID NO: 396757 - RNA, 25 nt, Human
ugcgggcucuugccccgagcccgcg

SEQ ID NO: 396758 - RNA, 23 nt, Human
uuaguaaucauucuggaucccuu

SEQ ID NO: 396759 - RNA, 25 nt, Human
uuaguaaucauucuggaucccuuuu

SEQ ID NO: 396760 - RNA, 21 nt, Human
uucacugacaucuccuucuua

SEQ ID NO: 396761 - RNA, 21 nt, Human
aaaaagacagccagaggugug

SEQ ID NO: 396762 - RNA, 24 nt, Human
aaaaccuaaauaaaccagacagaa

SEQ ID NO: 396763 - RNA, 24 nt, Human
aaguguccggcuccugggucucac

SEQ ID NO: 396764 - RNA, 24 nt, Human
acaaaaaguacaaaaagacagcca

SEQ ID NO: 396765 - RNA, 21 nt, Human
acagaacaggaagaaccaccg

SEQ ID NO: 396766 - RNA, 20 nt, Human
acagaagcagcucuggaaca

SEQ ID NO: 396767 - RNA, 25 nt, Human
acagucacagaacaggaagaaccac

SEQ ID NO: 396768 - RNA, 21 nt, Human
accaccgggugggggcugggg

SEQ ID NO: 396769 - RNA, 26 nt, Human
accacuccucauccaagucucuccca

SEQ ID NO: 396770 - RNA, 22 nt, Human
accccaccugacuuggaggcug

SEQ ID NO: 396771 - RNA, 24 nt, Human
agaaaaggaaggauaaaaccuaaa

SEQ ID NO: 396772 - RNA, 24 nt, Human
agacagccagaggugugcggagag

SEQ ID NO: 396773 - RNA, 22 nt, Human
agccagaggugugcggagaggg

SEQ ID NO: 396774 - RNA, 24 nt, Human
agccagaggugugcggagagggug

SEQ ID NO: 396775 - RNA, 18 nt, Human
aggaaggauaaaaccuaa

SEQ ID NO: 396776 - RNA, 20 nt, Human
aggcagggaggggcagcagg

SEQ ID NO: 396777 - RNA, 22 nt, Human
aggcagggaggggcagcagggc

SEQ ID NO: 396778 - RNA, 23 nt, Human
agguaggccacaaauucuuggug

SEQ ID NO: 396779 - RNA, 19 nt, Human
agugguaaggagggcugcc

SEQ ID NO: 396780 - RNA, 26 nt, Human
aucccacuaccccucacaugcucuca

SEQ ID NO: 396781 - RNA, 24 nt, Human
auccuuaccuccuucuccaacccu

SEQ ID NO: 396782 - RNA, 24 nt, Human
caaauucuugguggugcccucaca

SEQ ID NO: 396783 - RNA, 20 nt, Human
caaccacuccucauccaagu

SEQ ID NO: 396784 - RNA, 19 nt, Human
cacagcccaaccacuccuc

SEQ ID NO: 396785 - RNA, 20 nt, Human
caccagccagcaggggcugg

SEQ ID NO: 396786 - RNA, 19 nt, Human
cacuccucauccaagucuc

SEQ ID NO: 396787 - RNA, 23 nt, Human
cacuucuccucaagguuugaggg

SEQ ID NO: 396788 - RNA, 21 nt, Human
cagaacaggaagaaccaccgg

SEQ ID NO: 396789 - RNA, 21 nt, Human
cagcaggggcuggcacugaug

SEQ ID NO: 396790 - RNA, 23 nt, Human
cagcccaaccacuccucauccaa

SEQ ID NO: 396791 - RNA, 19 nt, Human
caggaagaaccaccgggug

SEQ ID NO: 396792 - RNA, 21 nt, Human
caguucucucccucacaaggu

SEQ ID NO: 396793 - RNA, 25 nt, Human
caguuuucuuuguccucaaugagau

SEQ ID NO: 396794 - RNA, 22 nt, Human
caugcagcacuggaacuccuga

SEQ ID NO: 396795 - RNA, 25 nt, Human
ccacuccucauccaagucucuccca

SEQ ID NO: 396796 - RNA, 25 nt, Human
ccagcaggggcuggcacugaugggc

SEQ ID NO: 396797 - RNA, 23 nt, Human
ccccaccaucccacuaccccuca

SEQ ID NO: 396798 - RNA, 20 nt, Human
ccccgcagaagucccugaga

SEQ ID NO: 396799 - RNA, 21 nt, Human
ccccuccaguggcugguaccc

SEQ ID NO: 396800 - RNA, 25 nt, Human
cccucauccuuaccuccuucuccaa

SEQ ID NO: 396801 - RNA, 24 nt, Human
ccucccuuagaaacuugggccaaa

SEQ ID NO: 396802 - RNA, 19 nt, Human
ccuccuucuccaacccucc

SEQ ID NO: 396803 - RNA, 22 nt, Human
ccucuccacuguggguggaggc

SEQ ID NO: 396804 - RNA, 20 nt, Human
ccugcggggcagggggcugu

SEQ ID NO: 396805 - RNA, 22 nt, Human
ccugcggggcagggggcugucc

SEQ ID NO: 396806 - RNA, 18 nt, Human
ccuuagaaacuugggcca

SEQ ID NO: 396807 - RNA, 24 nt, Human
cgaacucucaaagaaaaggaaggg

SEQ ID NO: 396808 - RNA, 24 nt, Human
cggcuccugggucucacuccaugg

SEQ ID NO: 396809 - RNA, 20 nt, Human
cucacaugcucucacucucc

SEQ ID NO: 396810 - RNA, 22 nt, Human
cucacucuccaucaggucccca

SEQ ID NO: 396811 - RNA, 23 nt, Human
cucccagguuucuggucccgaug

SEQ ID NO: 396812 - RNA, 24 nt, Human
cucugcacuggaacuugaggcuuc

SEQ ID NO: 396813 - RNA, 19 nt, Human
cucugggacuccaccccac

SEQ ID NO: 396814 - RNA, 21 nt, Human
cuggaacaaaaaguacaaaaa

SEQ ID NO: 396815 - RNA, 24 nt, Human
cuggaucuggacuggggucuuccg

SEQ ID NO: 396816 - RNA, 19 nt, Human
cuggggucuuccgcugcug

SEQ ID NO: 396817 - RNA, 20 nt, Human
cugugcagcucugggacucc

SEQ ID NO: 396818 - RNA, 23 nt, Human
cuuguccuccuuuguagcccucu

SEQ ID NO: 396819 - RNA, 24 nt, Human
gacagaccauguccgugcuaggcc

SEQ ID NO: 396820 - RNA, 23 nt, Human
gaggcuuccugucuccuccaugg

SEQ ID NO: 396821 - RNA, 18 nt, Human
gagggugagguggccgcg

SEQ ID NO: 396822 - RNA, 19 nt, Human
gcacuggaacuccugauga

SEQ ID NO: 396823 - RNA, 19 nt, Human
gccccaaggccucugaggg

SEQ ID NO: 396824 - RNA, 22 nt, Human
gcugucaggacagaccaugucc

SEQ ID NO: 396825 - RNA, 20 nt, Human
gcugugggucagagcucugg

SEQ ID NO: 396826 - RNA, 19 nt, Human
gcuugccucaggccccgca

SEQ ID NO: 396827 - RNA, 21 nt, Human
ggaaaagccauuuccugaggg

SEQ ID NO: 396828 - RNA, 24 nt, Human
ggacuggggucuuccgcugcugca

SEQ ID NO: 396829 - RNA, 21 nt, Human
ggaggcagggaggggcagcag

SEQ ID NO: 396830 - RNA, 22 nt, Human
ggcacagcccaaccacuccuca

SEQ ID NO: 396831 - RNA, 24 nt, Human
ggcaggccugcggggcagggggcu

SEQ ID NO: 396832 - RNA, 21 nt, Human
gggcuggggguugggaaaagc

SEQ ID NO: 396833 - RNA, 24 nt, Human
gggcuggggguugggaaaagccau

SEQ ID NO: 396834 - RNA, 18 nt, Human
ggggagggggucagcuga

SEQ ID NO: 396835 - RNA, 19 nt, Human
gggggcuggggguugggaa

SEQ ID NO: 396836 - RNA, 20 nt, Human
ggggucuucaggcaccagcc

SEQ ID NO: 396837 - RNA, 21 nt, Human
gggugggggcuggggguuggg

SEQ ID NO: 396838 - RNA, 22 nt, Human
gguggugcccucacaucugggg

SEQ ID NO: 396839 - RNA, 20 nt, Human
guccgugcuaggcccaggcc

SEQ ID NO: 396840 - RNA, 26 nt, Human
guccuccuuuguagcccucuccacug

SEQ ID NO: 396841 - RNA, 19 nt, Human
gugggggcuggggguuggg

SEQ ID NO: 396842 - RNA, 23 nt, Human
gugggggcuggggguugggaaaa

SEQ ID NO: 396843 - RNA, 18 nt, Human
guucugggaucucagucc

SEQ ID NO: 396844 - RNA, 21 nt, Human
uagaaacuugggccaaacccu

SEQ ID NO: 396845 - RNA, 21 nt, Human
uagcuuccuuaggcagggagg

SEQ ID NO: 396846 - RNA, 21 nt, Human
ucacucuccaucaggucccca

SEQ ID NO: 396847 - RNA, 18 nt, Human
uccacuguggguggaggc

SEQ ID NO: 396848 - RNA, 24 nt, Human
ucccagguuucuggucccgauggg

SEQ ID NO: 396849 - RNA, 23 nt, Human
ucccugagaaggcaggccugcgg

SEQ ID NO: 396850 - RNA, 24 nt, Human
ucccuuagaaacuugggccaaacc

SEQ ID NO: 396851 - RNA, 21 nt, Human
uccucauccaagucucuccca

SEQ ID NO: 396852 - RNA, 24 nt, Human
ucucacucuccaucagguccccaa

SEQ ID NO: 396853 - RNA, 19 nt, Human
ucugcacuggaacuugagg

SEQ ID NO: 396854 - RNA, 21 nt, Human
ucuuccgcugcugcagccucc

SEQ ID NO: 396855 - RNA, 23 nt, Human
ugacuuggaggcugugggucaga

SEQ ID NO: 396856 - RNA, 21 nt, Human
ugagaaguguccggcuccugg

SEQ ID NO: 396857 - RNA, 24 nt, Human
ugagaaguguccggcuccuggguc

SEQ ID NO: 396858 - RNA, 20 nt, Human
ugagaugccauaagcugugg

SEQ ID NO: 396859 - RNA, 21 nt, Human
ugagaugccauaagcuguggu

SEQ ID NO: 396860 - RNA, 21 nt, Human
ugaugaacccucauccuuacc

SEQ ID NO: 396861 - RNA, 19 nt, Human
ugccauaagcugugguggc

SEQ ID NO: 396862 - RNA, 22 nt, Human
ugccccaaggccucugagggac

SEQ ID NO: 396863 - RNA, 18 nt, Human
ugcggggagggggucagc

SEQ ID NO: 396864 - RNA, 18 nt, Human
ugcucaguucucucccuc

SEQ ID NO: 396865 - RNA, 22 nt, Human
ugcucucacucuccaucagguc

SEQ ID NO: 396866 - RNA, 24 nt, Human
uggaacaaaaaguacaaaaagaca

SEQ ID NO: 396867 - RNA, 24 nt, Human
uggaacuugaggcuuccugucucc

SEQ ID NO: 396868 - RNA, 23 nt, Human
uggacuggggucuuccgcugcug

SEQ ID NO: 396869 - RNA, 18 nt, Human
uggagaugcucaguucuc

SEQ ID NO: 396870 - RNA, 19 nt, Human
uggagaugcucaguucucu

SEQ ID NO: 396871 - RNA, 19 nt, Human
uggaucuggacuggggucu

SEQ ID NO: 396872 - RNA, 18 nt, Human
ugggaaaagccauuuccu

SEQ ID NO: 396873 - RNA, 23 nt, Human
ugggaaaagccauuuccugagaa

SEQ ID NO: 396874 - RNA, 24 nt, Human
ugggaaaagccauuuccugagaag

SEQ ID NO: 396875 - RNA, 19 nt, Human
ugggaucucaguccuggau

SEQ ID NO: 396876 - RNA, 19 nt, Human
ugggggcuggggguuggga

SEQ ID NO: 396877 - RNA, 18 nt, Human
ugggguccccacuucucc

SEQ ID NO: 396878 - RNA, 20 nt, Human
ugguaaggagggcugcccuu

SEQ ID NO: 396879 - RNA, 21 nt, Human
ugguaaggagggcugcccuuu

SEQ ID NO: 396880 - RNA, 22 nt, Human
uggucaaaccugcaucuucacu

SEQ ID NO: 396881 - RNA, 19 nt, Human
ugucugaggggcucaggca

SEQ ID NO: 396882 - RNA, 18 nt, Human
ugugcggagagggugagg

SEQ ID NO: 396883 - RNA, 23 nt, Human
uuagaaacuugggccaaacccug

SEQ ID NO: 396884 - RNA, 23 nt, Human
uuagauuccagaggcuugguuuu

SEQ ID NO: 396885 - RNA, 20 nt, Human
uucacugggucaugccccaa

SEQ ID NO: 396886 - RNA, 20 nt, Human
uuccugagaaguguccggcu

SEQ ID NO: 396887 - RNA, 20 nt, Human
uugggaaaagccauuuccug

SEQ ID NO: 396888 - RNA, 19 nt, Human
aaacccaaagggauaacag

SEQ ID NO: 396889 - RNA, 22 nt, Human
aaacuuuaucaaaaaagguaau

SEQ ID NO: 396890 - RNA, 20 nt, Human
aaaucauaucaggaaugcaa

SEQ ID NO: 396891 - RNA, 24 nt, Human
aagguaaugaaggcaaaaauuggc

SEQ ID NO: 396892 - RNA, 21 nt, Human
acaaaaaugauguaaacuaau

SEQ ID NO: 396893 - RNA, 22 nt, Human
acacuaaaccgcccggcccagc

SEQ ID NO: 396894 - RNA, 24 nt, Human
aucccugcauuuguguuugaaaca

SEQ ID NO: 396895 - RNA, 20 nt, Human
augaaggcaaaaauuggcag

SEQ ID NO: 396896 - RNA, 18 nt, Human
cagcaaucccugcauuug

SEQ ID NO: 396897 - RNA, 18 nt, Human
cagcaaucccugcauuug

SEQ ID NO: 396898 - RNA, 28 nt, Human
ccagagguuacuccgccuccuccuccgg

SEQ ID NO: 396899 - RNA, 18 nt, Human
cgcccggcccagcgggaa

SEQ ID NO: 396900 - RNA, 20 nt, Human
cgccuccagguccagcuccc

SEQ ID NO: 396901 - RNA, 24 nt, Human
cgccuccuccuccggcggcaauua

SEQ ID NO: 396902 - RNA, 22 nt, Human
gaacaucauuuuuuccauuuaa

SEQ ID NO: 396903 - RNA, 22 nt, Human
gauuuucacaugcaaacaacuu

SEQ ID NO: 396904 - RNA, 21 nt, Human
gcagcaaucccugcauuugug

SEQ ID NO: 396905 - RNA, 24 nt, Human
gcagcaaucccugcauuuguguuu

SEQ ID NO: 396906 - RNA, 20 nt, Human
ggcagacauccagcaucuug

SEQ ID NO: 396907 - RNA, 20 nt, Human
ggcggcaauuacacuaaacc

SEQ ID NO: 396908 - RNA, 23 nt, Human
ggcggcaauuacacuaaaccgcc

SEQ ID NO: 396909 - RNA, 21 nt, Human
gguaaugaaggcaaaaauugg

SEQ ID NO: 396910 - RNA, 25 nt, Human
gucaacucugcaugaugccuugaag

SEQ ID NO: 396911 - RNA, 24 nt, Human
uaaaugaacaucauuuuuuccauu

SEQ ID NO: 396912 - RNA, 19 nt, Human
uaaggcaagacaaauuugu

SEQ ID NO: 396913 - RNA, 22 nt, Human
uacaaaaaugauguaaacuaau

SEQ ID NO: 396914 - RNA, 30 nt, Human
ucaaacaaugccuuuuuuuaaccuaaaacc

SEQ ID NO: 396915 - RNA, 21 nt, Human
ucaaagacuaccaaaguaugu

SEQ ID NO: 396916 - RNA, 20 nt, Human
ugaaggaaaugacauacaaa

SEQ ID NO: 396917 - RNA, 18 nt, Human
ugaaggcaaaaauuggca

SEQ ID NO: 396918 - RNA, 24 nt, Human
ugauaaguaauuucaugauuaaaa

SEQ ID NO: 396919 - RNA, 22 nt, Human
ugcacaagcugaagaugacaaa

SEQ ID NO: 396920 - RNA, 24 nt, Human
ugcacacuacuucaguggaaaaaa

SEQ ID NO: 396921 - RNA, 21 nt, Human
ugcccuucacuaccucccaaa

SEQ ID NO: 396922 - RNA, 19 nt, Human
ugcugucgcggcggcgccu

SEQ ID NO: 396923 - RNA, 19 nt, Human
uggcagcaaucccugcauu

SEQ ID NO: 396924 - RNA, 23 nt, Human
ugguacacagcaaaguuuaucac

SEQ ID NO: 396925 - RNA, 22 nt, Human
ugucgcggcggcgccuccaggu

SEQ ID NO: 396926 - RNA, 18 nt, Human
uuaaacaaauccaacagg

SEQ ID NO: 396927 - RNA, 22 nt, Human
uuacauguuuuaaaucauauca

SEQ ID NO: 396928 - RNA, 20 nt, Human
uucugccucuuaauaguuaa

SEQ ID NO: 396929 - RNA, 20 nt, Human
uuuauaguuccugguacaca

SEQ ID NO: 396930 - RNA, 19 nt, Human
uuuuuguuuuuauaguucc

SEQ ID NO: 396931 - RNA, 23 nt, Human
aaggcagaacuagaagacacgug

SEQ ID NO: 396932 - RNA, 23 nt, Human
aaggcagaacuagaagacacgug

SEQ ID NO: 396933 - RNA, 24 nt, Human
acccacguaucuaggcucuaaaca

SEQ ID NO: 396934 - RNA, 19 nt, Human
agagaaaaacuaaguaagc

SEQ ID NO: 396935 - RNA, 22 nt, Human
aggaagagaaaaacuaaguaag

SEQ ID NO: 396936 - RNA, 22 nt, Human
aggcagaacuagaagacacgug

SEQ ID NO: 396937 - RNA, 22 nt, Human
aggcagaacuagaagacacgug

SEQ ID NO: 396938 - RNA, 23 nt, Human
aguuuauugggguggugacaccu

SEQ ID NO: 396939 - RNA, 19 nt, Human
auccacccauccaagcagc

SEQ ID NO: 396940 - RNA, 21 nt, Human
aucuacuccaaauccuuguug

SEQ ID NO: 396941 - RNA, 22 nt, Human
cacaucucuggaaagguuaccc

SEQ ID NO: 396942 - RNA, 21 nt, Human
caguuaauaccgcaaauaauc

SEQ ID NO: 396943 - RNA, 25 nt, Human
caugucuucagagugucacaggaaa

SEQ ID NO: 396944 - RNA, 27 nt, Human
caugucuucagagugucacaggaaaaa

SEQ ID NO: 396945 - RNA, 27 nt, Human
caugucuucagagugucacaggaaaaa

SEQ ID NO: 396946 - RNA, 19 nt, Human
ccacccauccaagcagcag

SEQ ID NO: 396947 - RNA, 23 nt, Human
ccacguaucuaggcucuaaacac

SEQ ID NO: 396948 - RNA, 19 nt, Human
cccacguaucuaggcucua

SEQ ID NO: 396949 - RNA, 21 nt, Human
cccauuugccauauacugucc

SEQ ID NO: 396950 - RNA, 27 nt, Human
cgaucccgggacaaggccgagggcagg

SEQ ID NO: 396951 - RNA, 25 nt, Human
cuccauaaggcgguacuugccaccc

SEQ ID NO: 396952 - RNA, 20 nt, Human
gaagacacguguccuucacc

SEQ ID NO: 396953 - RNA, 20 nt, Human
gaagacacguguccuucacc

SEQ ID NO: 396954 - RNA, 20 nt, Human
gagaaaaacuaaguaagcac

SEQ ID NO: 396955 - RNA, 19 nt, Human
gaggagcuuguccuugggg

SEQ ID NO: 396956 - RNA, 24 nt, Human
gcccguauacuccauaaggcggua

SEQ ID NO: 396957 - RNA, 19 nt, Human
gcgguacuugccacccauu

SEQ ID NO: 396958 - RNA, 18 nt, Human
gggaggagcuuguccuug

SEQ ID NO: 396959 - RNA, 19 nt, Human
gggaggagcuuguccuugg

SEQ ID NO: 396960 - RNA, 19 nt, Human
uaaaaaggcagaacuagaa

SEQ ID NO: 396961 - RNA, 19 nt, Human
uaaaaaggcagaacuagaa

SEQ ID NO: 396962 - RNA, 22 nt, Human
uaaaaaggcagaacuagaagac

SEQ ID NO: 396963 - RNA, 22 nt, Human
uaaaaaggcagaacuagaagac

SEQ ID NO: 396964 - RNA, 20 nt, Human
uaagaaacaccguauaugaa

SEQ ID NO: 396965 - RNA, 23 nt, Human
uaaggcgguacuugccacccauu

SEQ ID NO: 396966 - RNA, 22 nt, Human
uaaguaagcacccuuaugugaa

SEQ ID NO: 396967 - RNA, 28 nt, Human
uaaguaagcacccuuauguuguaaugac

SEQ ID NO: 396968 - RNA, 21 nt, Human
uaaguuuauugggguggugac

SEQ ID NO: 396969 - RNA, 21 nt, Human
uacacuuggcuccauuggccc

SEQ ID NO: 396970 - RNA, 21 nt, Human
uacagggggaggagcuugucc

SEQ ID NO: 396971 - RNA, 22 nt, Human
uacagggggaggagcuuguccu

SEQ ID NO: 396972 - RNA, 24 nt, Human
uacagggggaggagcuuguccuug

SEQ ID NO: 396973 - RNA, 21 nt, Human
uauacuguccauacuguugug

SEQ ID NO: 396974 - RNA, 18 nt, Human
uaugaagaaagaguggga

SEQ ID NO: 396975 - RNA, 21 nt, Human
ucacaggaaaucgaagccuau

SEQ ID NO: 396976 - RNA, 21 nt, Human
ucacaggaaaucgaagccuau

SEQ ID NO: 396977 - RNA, 21 nt, Human
ucaccaaagcaaaucugugcu

SEQ ID NO: 396978 - RNA, 21 nt, Human
ucaccaaagcaaaucugugcu

SEQ ID NO: 396979 - RNA, 25 nt, Human
ucagagugucacaggaaaucgaagc

SEQ ID NO: 396980 - RNA, 25 nt, Human
ucagagugucacaggaaaucgaagc

SEQ ID NO: 396981 - RNA, 22 nt, Human
uccauacuguuguggguuucca

SEQ ID NO: 396982 - RNA, 28 nt, Human
uccaucaugaacaaaaacuuaaaaaggc

SEQ ID NO: 396983 - RNA, 28 nt, Human
uccaucaugaacaaaaacuuaaaaaggc

SEQ ID NO: 396984 - RNA, 20 nt, Human
ugaaauacaaucaacugaaa

SEQ ID NO: 396985 - RNA, 19 nt, Human
ugacugaacaacugaagua

SEQ ID NO: 396986 - RNA, 18 nt, Human
ugucacaggaaaucgaag

SEQ ID NO: 396987 - RNA, 18 nt, Human
ugucacaggaaaucgaag

SEQ ID NO: 396988 - RNA, 23 nt, Human
uguccuucaccaaagcaaaucug

SEQ ID NO: 396989 - RNA, 23 nt, Human
uguccuucaccaaagcaaaucug

SEQ ID NO: 396990 - RNA, 24 nt, Human
ugugaaaagaaaguauuaagauuc

SEQ ID NO: 396991 - RNA, 29 nt, Human
uuacagggggaggagcuugucccguccgg

SEQ ID NO: 396992 - RNA, 21 nt, Human
uuccaugguugcccguauacu

SEQ ID NO: 396993 - RNA, 19 nt, Human
uucugaagauagaaccaua

SEQ ID NO: 396994 - RNA, 21 nt, Human
uugucuaaguuuauuggggug

SEQ ID NO: 396995 - RNA, 21 nt, Human
uuuacagaguuuccaaagcuu

SEQ ID NO: 396996 - RNA, 27 nt, Human
uuuauuguucauuuuacagaguuucca

SEQ ID NO: 396997 - RNA, 21 nt, Human
aaaaaccccauuggaaacaga

SEQ ID NO: 396998 - RNA, 23 nt, Human
aaacagaagaggcuuugucaaga

SEQ ID NO: 396999 - RNA, 25 nt, Human
aaccagccuccucuuccuccuccug

SEQ ID NO: 397000 - RNA, 22 nt, Human
aagagcgcgaccuaaggggaca

SEQ ID NO: 397001 - RNA, 24 nt, Human
acaaaguuggguggcuacauggcu

SEQ ID NO: 397002 - RNA, 24 nt, Human
accagccuccucuuccuccuccug

SEQ ID NO: 397003 - RNA, 18 nt, Human
agccuccucuuccuccuc

SEQ ID NO: 397004 - RNA, 24 nt, Human
agggcaggaaguaucuacacacag

SEQ ID NO: 397005 - RNA, 23 nt, Human
cacagugauucuaccauaugacc

SEQ ID NO: 397006 - RNA, 20 nt, Human
cagaaccaagucagcugcca

SEQ ID NO: 397007 - RNA, 20 nt, Human
cagaaccaagucagcugcca

SEQ ID NO: 397008 - RNA, 23 nt, Human
cagcccaacuugcuccaagagca

SEQ ID NO: 397009 - RNA, 19 nt, Human
cagccuccucuuccuccuc

SEQ ID NO: 397010 - RNA, 24 nt, Human
ccaugguaccaaccagccuccucu

SEQ ID NO: 397011 - RNA, 22 nt, Human
ccuccucuuccuccuccugggc

SEQ ID NO: 397012 - RNA, 24 nt, Human
cgccaaaaaccccauuggaaacag

SEQ ID NO: 397013 - RNA, 19 nt, Human
cgcgacggggccgggcacg

SEQ ID NO: 397014 - RNA, 24 nt, Human
cuuucugauguuguugaaaaugac

SEQ ID NO: 397015 - RNA, 20 nt, Human
ggucuuaaaaggcaacagug

SEQ ID NO: 397016 - RNA, 19 nt, Human
uaccauaugaccgucaggc

SEQ ID NO: 397017 - RNA, 18 nt, Human
ucaacccgcgacggucgu

SEQ ID NO: 397018 - RNA, 18 nt, Human
ucagaaccaagucagcug

SEQ ID NO: 397019 - RNA, 21 nt, Human
ucaguccacagugauucuacc

SEQ ID NO: 397020 - RNA, 21 nt, Human
ucucaguccacagugauucua

SEQ ID NO: 397021 - RNA, 19 nt, Human
ucugaucaauucuuucuga

SEQ ID NO: 397022 - RNA, 22 nt, Human
ugacaaaguuggguggcuacau

SEQ ID NO: 397023 - RNA, 22 nt, Human
ugagaaugcgccaaaaacccca

SEQ ID NO: 397024 - RNA, 24 nt, Human
ugcccaugguaccaaccagccucc

SEQ ID NO: 397025 - RNA, 25 nt, Human
ugcgccaaaaaccccauuggaaaca

SEQ ID NO: 397026 - RNA, 20 nt, Human
ugcuccaagagcacuguggc

SEQ ID NO: 397027 - RNA, 23 nt, Human
ugucuugucuuuuuugggcuuuu

SEQ ID NO: 397028 - RNA, 21 nt, Human
uugggcuuuuaguuagcuaau

SEQ ID NO: 397029 - RNA, 22 nt, Human
aaaagcugcccaggagugcccc

SEQ ID NO: 397030 - RNA, 19 nt, Human
gagugccccggacaucugc

SEQ ID NO: 397031 - RNA, 20 nt, Human
aacauuuauuuuuuucuggg

SEQ ID NO: 397032 - RNA, 19 nt, Human
acaaagcaugggaacccag

SEQ ID NO: 397033 - RNA, 25 nt, Human
acaaagcaugggaacccaguucccc

SEQ ID NO: 397034 - RNA, 20 nt, Human
aguagcugaacagggcaugu

SEQ ID NO: 397035 - RNA, 19 nt, Human
caccccauccccagauccc

SEQ ID NO: 397036 - RNA, 19 nt, Human
cccaccccauccccagauc

SEQ ID NO: 397037 - RNA, 18 nt, Human
ccccuaagcccaccccau

SEQ ID NO: 397038 - RNA, 19 nt, Human
ccccuaagcccaccccauc

SEQ ID NO: 397039 - RNA, 22 nt, Human
cgacccaggccagccaggacga

SEQ ID NO: 397040 - RNA, 22 nt, Human
gaguggggguuuguguuggggg

SEQ ID NO: 397041 - RNA, 19 nt, Human
gggaaacacaccugugggg

SEQ ID NO: 397042 - RNA, 20 nt, Human
guggggcagcugaacuagaa

SEQ ID NO: 397043 - RNA, 22 nt, Human
uaagcccaccccauccccagau

SEQ ID NO: 397044 - RNA, 21 nt, Human
uaaguuaaaaaaauuccuuga

SEQ ID NO: 397045 - RNA, 24 nt, Human
ucccuuuuuuucucccuuaaguua

SEQ ID NO: 397046 - RNA, 22 nt, Human
ugaacagggcauguuaguggug

SEQ ID NO: 397047 - RNA, 21 nt, Human
ugagacaccuacaaagcaugg

SEQ ID NO: 397048 - RNA, 19 nt, Human
ugcccaggauagcuaugag

SEQ ID NO: 397049 - RNA, 21 nt, Human
ugggaguagcugaacagggca

SEQ ID NO: 397050 - RNA, 19 nt, Human
uguguugggggagcagugg

SEQ ID NO: 397051 - RNA, 24 nt, Human
uuccuugaggcagcuuaagucaga

SEQ ID NO: 397052 - RNA, 19 nt, Human
uuuuuuggagcuuauuaga

SEQ ID NO: 397053 - RNA, 21 nt, Human
aaaaaaaucuaaaaaccagca

SEQ ID NO: 397054 - RNA, 24 nt, Human
aaaaaaaucuaaaaaccagcacaa

SEQ ID NO: 397055 - RNA, 24 nt, Human
aaacguccaaaacagagaugagaa

SEQ ID NO: 397056 - RNA, 20 nt, Human
aagcacacauccaaaccaca

SEQ ID NO: 397057 - RNA, 19 nt, Human
acgaccuccuccuccuccu

SEQ ID NO: 397058 - RNA, 25 nt, Human
agcaucuaaccuacccuucuguugc

SEQ ID NO: 397059 - RNA, 19 nt, Human
auccuuuuucuauccuccu

SEQ ID NO: 397060 - RNA, 24 nt, Human
aucuccuucuuuccuuucuuucuu

SEQ ID NO: 397061 - RNA, 19 nt, Human
cacacauccaaaccacaua

SEQ ID NO: 397062 - RNA, 24 nt, Human
ccaaaacagagaugagaauaguca

SEQ ID NO: 397063 - RNA, 23 nt, Human
cccgacgaccuccuccuccuccu

SEQ ID NO: 397064 - RNA, 21 nt, Human
cccgccgcccccgacgaccuc

SEQ ID NO: 397065 - RNA, 19 nt, Human
ccugcccuugccgccgccg

SEQ ID NO: 397066 - RNA, 22 nt, Human
cguccaaaacagagaugagaau

SEQ ID NO: 397067 - RNA, 19 nt, Human
cuccuucuuuccuuucuuu

SEQ ID NO: 397068 - RNA, 20 nt, Human
cuuccauccuuuuucuaucc

SEQ ID NO: 397069 - RNA, 19 nt, Human
cuuuccauuuucuuucuuc

SEQ ID NO: 397070 - RNA, 19 nt, Human
cuuuccuuucuuucuuagu

SEQ ID NO: 397071 - RNA, 22 nt, Human
gaaaacaaaaaaaucuaaaaac

SEQ ID NO: 397072 - RNA, 23 nt, Human
gaaaacaaaaaaaucuaaaaacc

SEQ ID NO: 397073 - RNA, 22 nt, Human
gucuuuguuuucaaugcuucuu

SEQ ID NO: 397074 - RNA, 23 nt, Human
uaagagguuaacagaaaugggcu

SEQ ID NO: 397075 - RNA, 20 nt, Human
ucagaggccgcucgguggac

SEQ ID NO: 397076 - RNA, 26 nt, Human
uccaaaacagagaugagaauagucac

SEQ ID NO: 397077 - RNA, 18 nt, Human
uccaagaagugggaagaa

SEQ ID NO: 397078 - RNA, 26 nt, Human
uccuccuuuuuuccuucuuuccauuu

SEQ ID NO: 397079 - RNA, 19 nt, Human
uccuuuuucuauccuccuu

SEQ ID NO: 397080 - RNA, 19 nt, Human
ucuacaguagcuaucacuc

SEQ ID NO: 397081 - RNA, 21 nt, Human
ucuuccauccuuuuucuaucc

SEQ ID NO: 397082 - RNA, 23 nt, Human
ucuuucuucuauucaucuccuuc

SEQ ID NO: 397083 - RNA, 28 nt, Human
ugaaaacaaaaaaaucuaaaaaccagca

SEQ ID NO: 397084 - RNA, 20 nt, Human
ugcccuugccgccgccgggg

SEQ ID NO: 397085 - RNA, 18 nt, Human
uguccugcccuugccgcc

SEQ ID NO: 397086 - RNA, 22 nt, Human
uuaaagcacacauccaaaccac

SEQ ID NO: 397087 - RNA, 22 nt, Human
uucaaugcuucuuucuuccauc

SEQ ID NO: 397088 - RNA, 27 nt, Human
uucuuccauccuuuuucuauccuccuu

SEQ ID NO: 397089 - RNA, 22 nt, Human
uugcaccguuuggccuccuggg

SEQ ID NO: 397090 - RNA, 24 nt, Human
uuucaaugcuucuuucuuccaucc

SEQ ID NO: 397091 - RNA, 20 nt, Human
uuuccuucuuuccauuuucu

SEQ ID NO: 397092 - RNA, 20 nt, Human
uuuggccuccugggauggaa

SEQ ID NO: 397093 - RNA, 24 nt, Human
uuuuuccuucuuuccauuuucuuu

SEQ ID NO: 397094 - RNA, 27 nt, Human
aaaaacaaaaagggaucaccgguaccc

SEQ ID NO: 397095 - RNA, 18 nt, Human
aaaaagacaaaacaccaa

SEQ ID NO: 397096 - RNA, 20 nt, Human
aaacaaaaagggaucacaga

SEQ ID NO: 397097 - RNA, 20 nt, Human
aaagaagggcuaugcacugg

SEQ ID NO: 397098 - RNA, 18 nt, Human
aacaaaaagggaucacag

SEQ ID NO: 397099 - RNA, 20 nt, Human
aacagagcaagacuccaucu

SEQ ID NO: 397100 - RNA, 20 nt, Human
aacauggugaaacccugucu

SEQ ID NO: 397101 - RNA, 21 nt, Human
aacauggugaaacccugucuc

SEQ ID NO: 397102 - RNA, 21 nt, Human
aagcaagacagaucaagccua

SEQ ID NO: 397103 - RNA, 26 nt, Human
aaucacaugagcaguagccgccccca

SEQ ID NO: 397104 - RNA, 22 nt, Human
aaucaugaggucaggaguuuga

SEQ ID NO: 397105 - RNA, 24 nt, Human
aaucaugaggucaggaguuugaga

SEQ ID NO: 397106 - RNA, 24 nt, Human
aaucgcuugaacccaggaggcgga

SEQ ID NO: 397107 - RNA, 21 nt, Human
aaucuucaagaucaagguaga

SEQ ID NO: 397108 - RNA, 22 nt, Human
acaagcaaaacuuggccaauac

SEQ ID NO: 397109 - RNA, 23 nt, Human
acaauaagcaagacagaucaagc

SEQ ID NO: 397110 - RNA, 24 nt, Human
acagagcaagacuccaucucaaaa

SEQ ID NO: 397111 - RNA, 24 nt, Human
acccugucucuacuaaaaauacaa

SEQ ID NO: 397112 - RNA, 24 nt, Human
acuggccaacauggugaaacccug

SEQ ID NO: 397113 - RNA, 21 nt, Human
agaaccuccaaaaccagucag

SEQ ID NO: 397114 - RNA, 25 nt, Human
agacaaaagaagggcuaugcacugg

SEQ ID NO: 397115 - RNA, 24 nt, Human
agccugggcaacagagcaagacuc

SEQ ID NO: 397116 - RNA, 23 nt, Human
agcugggcaugguggugcaugcc

SEQ ID NO: 397117 - RNA, 24 nt, Human
aggcaaaucaugaggucaggaguu

SEQ ID NO: 397118 - RNA, 23 nt, Human
aggcaggagaaucgcuugaaccc

SEQ ID NO: 397119 - RNA, 24 nt, Human
aggcaggagaaucgcuugaaccca

SEQ ID NO: 397120 - RNA, 24 nt, Human
aggcaggcaaaucaugaggucagg

SEQ ID NO: 397121 - RNA, 18 nt, Human
aggccgaggcaggcaaau

SEQ ID NO: 397122 - RNA, 23 nt, Human
aggccgaggcaggcaaaucauga

SEQ ID NO: 397123 - RNA, 21 nt, Human
aggcggagcuugcagugagcc

SEQ ID NO: 397124 - RNA, 24 nt, Human
aggcggagcuugcagugagccgag

SEQ ID NO: 397125 - RNA, 20 nt, Human
aggcugaggcaggagaaucg

SEQ ID NO: 397126 - RNA, 24 nt, Human
aggcugaggcaggagaaucgcuug

SEQ ID NO: 397127 - RNA, 18 nt, Human
agucagaggacaccucug

SEQ ID NO: 397128 - RNA, 24 nt, Human
agugcuuugggaggccgaggcagg

SEQ ID NO: 397129 - RNA, 21 nt, Human
auacaacaaauuagcugggca

SEQ ID NO: 397130 - RNA, 19 nt, Human
augaugugcccgaauuucc

SEQ ID NO: 397131 - RNA, 20 nt, Human
augccuguaaucccagccac

SEQ ID NO: 397132 - RNA, 24 nt, Human
auugcacuccagccugggcaacag

SEQ ID NO: 397133 - RNA, 24 nt, Human
auugugccauugcacuccagccug

SEQ ID NO: 397134 - RNA, 23 nt, Human
caaaaaacaaaaagggaucacag

SEQ ID NO: 397135 - RNA, 21 nt, Human
caaaacaccaagcucaaaaau

SEQ ID NO: 397136 - RNA, 24 nt, Human
caaaucaugaggucaggaguuuga

SEQ ID NO: 397137 - RNA, 22 nt, Human
caacaauaagcaagacagauca

SEQ ID NO: 397138 - RNA, 24 nt, Human
caacauggugaaacccugucucua

SEQ ID NO: 397139 - RNA, 20 nt, Human
caagcacacaacaagcaaaa

SEQ ID NO: 397140 - RNA, 19 nt, Human
caagggaaucuucaagauc

SEQ ID NO: 397141 - RNA, 26 nt, Human
caauacacaccaaucaaaugcacuuc

SEQ ID NO: 397142 - RNA, 23 nt, Human
cacacaacaagcaaaacuuggcc

SEQ ID NO: 397143 - RNA, 24 nt, Human
cacgccuguaaucccagugcuuug

SEQ ID NO: 397144 - RNA, 23 nt, Human
cagaggacaccucuguuaggcac

SEQ ID NO: 397145 - RNA, 24 nt, Human
cagccacucaggaggcugaggcag

SEQ ID NO: 397146 - RNA, 22 nt, Human
caggcaaaucaugaggucagga

SEQ ID NO: 397147 - RNA, 20 nt, Human
cagguagugcucaaauaagc

SEQ ID NO: 397148 - RNA, 25 nt, Human
caggugacacagcucauaguuucug

SEQ ID NO: 397149 - RNA, 24 nt, Human
cagugcuuugggaggccgaggcag

SEQ ID NO: 397150 - RNA, 25 nt, Human
cagugcuuugggaggccgaggcagg

SEQ ID NO: 397151 - RNA, 24 nt, Human
caugaggucaggaguuugagacca

SEQ ID NO: 397152 - RNA, 19 nt, Human
cauugcacuccagccuggg

SEQ ID NO: 397153 - RNA, 21 nt, Human
cauugcacuccagccugggca

SEQ ID NO: 397154 - RNA, 22 nt, Human
cauugcacuccagccugggcaa

SEQ ID NO: 397155 - RNA, 24 nt, Human
cauugcacuccagccugggcaaca

SEQ ID NO: 397156 - RNA, 26 nt, Human
cauugcacuccagccugggcaacaga

SEQ ID NO: 397157 - RNA, 22 nt, Human
ccaacugucuacuccacaauca

SEQ ID NO: 397158 - RNA, 18 nt, Human
ccagucaggugacacagc

SEQ ID NO: 397159 - RNA, 24 nt, Human
ccaucucaaaaacaaaaaacaaaa

SEQ ID NO: 397160 - RNA, 20 nt, Human
ccauugcacuccagccuggg

SEQ ID NO: 397161 - RNA, 21 nt, Human
ccauugcacuccagccugggc

SEQ ID NO: 397162 - RNA, 22 nt, Human
ccauugcacuccagccugggca

SEQ ID NO: 397163 - RNA, 23 nt, Human
ccauugcacuccagccugggcaa

SEQ ID NO: 397164 - RNA, 24 nt, Human
ccauugcacuccagccugggcaac

SEQ ID NO: 397165 - RNA, 19 nt, Human
cccagugcuuugggaggcc

SEQ ID NO: 397166 - RNA, 22 nt, Human
ccugggcaacagagcaagacuc

SEQ ID NO: 397167 - RNA, 19 nt, Human
ccuguaaucccagccacuc

SEQ ID NO: 397168 - RNA, 22 nt, Human
ccuguaaucccagugcuuuggg

SEQ ID NO: 397169 - RNA, 24 nt, Human
cgagauugugccauugcacuccag

SEQ ID NO: 397170 - RNA, 24 nt, Human
cgaggcaggcaaaucaugagguca

SEQ ID NO: 397171 - RNA, 23 nt, Human
cgucuugaaauuuaaguuuaggg

SEQ ID NO: 397172 - RNA, 19 nt, Human
cucacgccuguaaucccag

SEQ ID NO: 397173 - RNA, 24 nt, Human
cucacgccuguaaucccagugcuu

SEQ ID NO: 397174 - RNA, 28 nt, Human
cuccacaaucacaugagcaguagccgcc

SEQ ID NO: 397175 - RNA, 21 nt, Human
cuggccaacauggugaaaccc

SEQ ID NO: 397176 - RNA, 21 nt, Human
cuggccaacauggugaaaccc

SEQ ID NO: 397177 - RNA, 24 nt, Human
cuggccaacauggugaaacccugu

SEQ ID NO: 397178 - RNA, 23 nt, Human
cuggcuggaugugguggcucacg

SEQ ID NO: 397179 - RNA, 24 nt, Human
cuugcagugagccgagauugugcc

SEQ ID NO: 397180 - RNA, 23 nt, Human
gaaaaagacaaaacaccaagcuc

SEQ ID NO: 397181 - RNA, 19 nt, Human
gaaacccugucucuacuaa

SEQ ID NO: 397182 - RNA, 22 nt, Human
gacaaaacaccaagcucaaaaa

SEQ ID NO: 397183 - RNA, 23 nt, Human
gagaaucgcuugaacccaggagg

SEQ ID NO: 397184 - RNA, 23 nt, Human
gagcaagacuccaucucaaaaac

SEQ ID NO: 397185 - RNA, 18 nt, Human
gagcuugcagugagccga

SEQ ID NO: 397186 - RNA, 23 nt, Human
gagcuugcagugagccgagauug

SEQ ID NO: 397187 - RNA, 24 nt, Human
gcacuccagccugggcaacagagc

SEQ ID NO: 397188 - RNA, 24 nt, Human
gcacuggcacugacaguugggcag

SEQ ID NO: 397189 - RNA, 22 nt, Human
gcaggagaaucgcuugaaccca

SEQ ID NO: 397190 - RNA, 21 nt, Human
gcaguggacagaaccuccaaa

SEQ ID NO: 397191 - RNA, 24 nt, Human
gccaacauggugaaacccugucuc

SEQ ID NO: 397192 - RNA, 22 nt, Human
gccauugcacuccagccugggc

SEQ ID NO: 397193 - RNA, 24 nt, Human
gccauugcacuccagccugggcaa

SEQ ID NO: 397194 - RNA, 20 nt, Human
gcuuaaauacagaggcaaug

SEQ ID NO: 397195 - RNA, 24 nt, Human
ggagcuccugccacaucucagccc

SEQ ID NO: 397196 - RNA, 24 nt, Human
ggagcuugcagugagccgagauug

SEQ ID NO: 397197 - RNA, 24 nt, Human
ggaugugguggcucacgccuguaa

SEQ ID NO: 397198 - RNA, 23 nt, Human
ggcaggcaaaucaugaggucagg

SEQ ID NO: 397199 - RNA, 18 nt, Human
ggcagucuucauaaggga

SEQ ID NO: 397200 - RNA, 24 nt, Human
gggcaugguggugcaugccuguaa

SEQ ID NO: 397201 - RNA, 24 nt, Human
gguggcucacgccuguaaucccag

SEQ ID NO: 397202 - RNA, 24 nt, Human
gguggugcaugccuguaaucccag

SEQ ID NO: 397203 - RNA, 21 nt, Human
guggacagaaccuccaaaacc

SEQ ID NO: 397204 - RNA, 23 nt, Human
guggugcaugccuguaaucccag

SEQ ID NO: 397205 - RNA, 24 nt, Human
guuucauggacauaugaugugccc

SEQ ID NO: 397206 - RNA, 18 nt, Human
uaaggaucacuggcugga

SEQ ID NO: 397207 - RNA, 20 nt, Human
uacaacaaauuagcugggca

SEQ ID NO: 397208 - RNA, 21 nt, Human
ucaaauaagccuaaaucucaa

SEQ ID NO: 397209 - RNA, 22 nt, Human
ucacgccuguaaucccagugcu

SEQ ID NO: 397210 - RNA, 23 nt, Human
ucaguggccccuuuagacuuucu

SEQ ID NO: 397211 - RNA, 24 nt, Human
ucaugaggucaggaguuugagacc

SEQ ID NO: 397212 - RNA, 19 nt, Human
ucccuaguuuaucugaagu

SEQ ID NO: 397213 - RNA, 24 nt, Human
uccugccacaucucagcccugcag

SEQ ID NO: 397214 - RNA, 24 nt, Human
ucucuacuaaaaauacaacaaauu

SEQ ID NO: 397215 - RNA, 26 nt, Human
ucugaaaaagacaaaacaccaagcuc

SEQ ID NO: 397216 - RNA, 20 nt, Human
ugaaaaagacaaaacaccaa

SEQ ID NO: 397217 - RNA, 25 nt, Human
ugaaaaagacaaaacaccaagcuca

SEQ ID NO: 397218 - RNA, 18 nt, Human
ugaaaaugggaaaacucu

SEQ ID NO: 397219 - RNA, 20 nt, Human
ugacacagcucauaguuucu

SEQ ID NO: 397220 - RNA, 24 nt, Human
ugagaccacacuggccaacauggu

SEQ ID NO: 397221 - RNA, 22 nt, Human
ugagccgagauugugccauugc

SEQ ID NO: 397222 - RNA, 20 nt, Human
ugaggcaggagaaucgcuug

SEQ ID NO: 397223 - RNA, 24 nt, Human
ugaggcaggagaaucgcuugaacc

SEQ ID NO: 397224 - RNA, 25 nt, Human
ugaggcaggagaaucgcuugaaccc

SEQ ID NO: 397225 - RNA, 18 nt, Human
ugaggucaggaguuugag

SEQ ID NO: 397226 - RNA, 22 nt, Human
ugcacuccagccugggcaacag

SEQ ID NO: 397227 - RNA, 24 nt, Human
ugccuguaaucccagccacucagg

SEQ ID NO: 397228 - RNA, 24 nt, Human
uggccaacauggugaaacccuguc

SEQ ID NO: 397229 - RNA, 27 nt, Human
uggccaauacacaccaaucaaaugcac

SEQ ID NO: 397230 - RNA, 22 nt, Human
uggcucacgccuguaaucccag

SEQ ID NO: 397231 - RNA, 22 nt, Human
uggcucacgccuguaaucccag

SEQ ID NO: 397232 - RNA, 23 nt, Human
ugggaaaacucugcuccauagca

SEQ ID NO: 397233 - RNA, 19 nt, Human
ugggaggccgaggcaggca

SEQ ID NO: 397234 - RNA, 24 nt, Human
ugggaggccgaggcaggcaaauca

SEQ ID NO: 397235 - RNA, 18 nt, Human
uggguuggguaacucugu

SEQ ID NO: 397236 - RNA, 21 nt, Human
uggugcaugccuguaauccca

SEQ ID NO: 397237 - RNA, 24 nt, Human
ugguggcucacgccuguaauccca

SEQ ID NO: 397238 - RNA, 24 nt, Human
ugguggugcaugccuguaauccca

SEQ ID NO: 397239 - RNA, 21 nt, Human
ugucuacuccacaaucacaug

SEQ ID NO: 397240 - RNA, 20 nt, Human
ugugagucauuaucuucuga

SEQ ID NO: 397241 - RNA, 24 nt, Human
uuagcugggcaugguggugcaugc

SEQ ID NO: 397242 - RNA, 21 nt, Human
uucaagcacacaacaagcaaa

SEQ ID NO: 397243 - RNA, 20 nt, Human
uucugaaaaugggaaaacuc

SEQ ID NO: 397244 - RNA, 19 nt, Human
uugcagugagccgagauug

SEQ ID NO: 397245 - RNA, 22 nt, Human
uugcagugagccgagauugugc

SEQ ID NO: 397246 - RNA, 25 nt, Human
uugggaggccgaggcaggcaaauca

SEQ ID NO: 397247 - RNA, 23 nt, Human
uugugccauugcacuccagccug

SEQ ID NO: 397248 - RNA, 24 nt, Human
uuuaacucuccaaauggacugggu

SEQ ID NO: 397249 - RNA, 22 nt, Human
uuucauggacauaugaugugcc

SEQ ID NO: 397250 - RNA, 23 nt, Human
uuuuuuuuuuuuuuuuuuaacag

SEQ ID NO: 397251 - RNA, 20 nt, Human
aaaacugggagaaacaaaga

SEQ ID NO: 397252 - RNA, 21 nt, Human
aaaggaacagaccaauaaaag

SEQ ID NO: 397253 - RNA, 22 nt, Human
aagggguccggggugcuuucuc

SEQ ID NO: 397254 - RNA, 22 nt, Human
agaaggaaguggagaaacagga

SEQ ID NO: 397255 - RNA, 21 nt, Human
agacagaaaugaugaggcccg

SEQ ID NO: 397256 - RNA, 19 nt, Human
caaaaugaggacagaggca

SEQ ID NO: 397257 - RNA, 25 nt, Human
caaacacaaagcaaacacauucauc

SEQ ID NO: 397258 - RNA, 22 nt, Human
caacccuaucucaaaugcagga

SEQ ID NO: 397259 - RNA, 22 nt, Human
caccuccaagagaaagccaaag

SEQ ID NO: 397260 - RNA, 23 nt, Human
caccuccaagagaaagccaaagg

SEQ ID NO: 397261 - RNA, 26 nt, Human
cauaccgauaaaaacugggagaaaca

SEQ ID NO: 397262 - RNA, 19 nt, Human
caucaguggaccaaccaag

SEQ ID NO: 397263 - RNA, 21 nt, Human
ccaaaggaacagaccaauaaa

SEQ ID NO: 397264 - RNA, 23 nt, Human
ccagagagcugcuggggcauacc

SEQ ID NO: 397265 - RNA, 18 nt, Human
cgauaaaaacugggagaa

SEQ ID NO: 397266 - RNA, 23 nt, Human
cuaaaaacgugucuaucucuacc

SEQ ID NO: 397267 - RNA, 22 nt, Human
cuccaagagaaagccaaaggaa

SEQ ID NO: 397268 - RNA, 18 nt, Human
cuuucucuauuucacuca

SEQ ID NO: 397269 - RNA, 19 nt, Human
gaaguccaauacugcugcu

SEQ ID NO: 397270 - RNA, 18 nt, Human
gaaguggagaaacaggag

SEQ ID NO: 397271 - RNA, 19 nt, Human
gagaaacaggagacagaaa

SEQ ID NO: 397272 - RNA, 19 nt, Human
gagaaacaggagacagaaa

SEQ ID NO: 397273 - RNA, 24 nt, Human
gagaaagccaaaggaacagaccaa

SEQ ID NO: 397274 - RNA, 19 nt, Human
gccugggauucuacugcuc

SEQ ID NO: 397275 - RNA, 23 nt, Human
ggaaugggccucuaucugguauc

SEQ ID NO: 397276 - RNA, 18 nt, Human
uaaaagggguccggggug

SEQ ID NO: 397277 - RNA, 18 nt, Human
uaauaccaaacacaaagc

SEQ ID NO: 397278 - RNA, 21 nt, Human
uaccccuaggcuucuuagcuc

SEQ ID NO: 397279 - RNA, 19 nt, Human
uauuucacucacuccucuu

SEQ ID NO: 397280 - RNA, 23 nt, Human
uccaagagaaagccaaaggaaca

SEQ ID NO: 397281 - RNA, 19 nt, Human
uccaauaaccaaaagaaau

SEQ ID NO: 397282 - RNA, 18 nt, Human
ucccugcggguccucaga

SEQ ID NO: 397283 - RNA, 21 nt, Human
ucccugcggguccucagaagc

SEQ ID NO: 397284 - RNA, 25 nt, Human
ucuaucucuaccccuaggcuucuua

SEQ ID NO: 397285 - RNA, 23 nt, Human
ucucaaaugcaggaaugggccuc

SEQ ID NO: 397286 - RNA, 18 nt, Human
ucuccagagagcugcugg

SEQ ID NO: 397287 - RNA, 19 nt, Human
ugaaugcaccaucuaaaaa

SEQ ID NO: 397288 - RNA, 22 nt, Human
ugacagcagagaaguccaauac

SEQ ID NO: 397289 - RNA, 21 nt, Human
ugaggcccgcucccugcgggu

SEQ ID NO: 397290 - RNA, 19 nt, Human
uggagaaacaggagacaga

SEQ ID NO: 397291 - RNA, 21 nt, Human
uggagaaacaggagacagaaa

SEQ ID NO: 397292 - RNA, 24 nt, Human
ugggagaaacaaagacugacagca

SEQ ID NO: 397293 - RNA, 26 nt, Human
ugguaucuagaggaugaucauaggaa

SEQ ID NO: 397294 - RNA, 22 nt, Human
ugucauaaagcuccccaucugg

SEQ ID NO: 397295 - RNA, 21 nt, Human
uucaucaucuagaguacuaua

SEQ ID NO: 397296 - RNA, 27 nt, Human
uuuuuuuuuuuuuuuuuuuuuuugggg

SEQ ID NO: 397297 - RNA, 23 nt, Human
aaacacaaucaguaauuaaaugc

SEQ ID NO: 397298 - RNA, 23 nt, Human
aaacaguacauacuuuauuuuca

SEQ ID NO: 397299 - RNA, 18 nt, Human
aacacacaaaaccaggca

SEQ ID NO: 397300 - RNA, 23 nt, Human
aagcauacaagaaacacuaaacu

SEQ ID NO: 397301 - RNA, 21 nt, Human
aaugccuaccauauguauggc

SEQ ID NO: 397302 - RNA, 22 nt, Human
acacuaaacucuuccagugcca

SEQ ID NO: 397303 - RNA, 25 nt, Human
acagaacacacaaaaccaggcagag

SEQ ID NO: 397304 - RNA, 20 nt, Human
acaguacccacauggcuuug

SEQ ID NO: 397305 - RNA, 24 nt, Human
acucugcauaauucucagaaguca

SEQ ID NO: 397306 - RNA, 25 nt, Human
agaacacacaaaaccaggcagagaa

SEQ ID NO: 397307 - RNA, 24 nt, Human
agagaguuuuguauccaauauccu

SEQ ID NO: 397308 - RNA, 21 nt, Human
aggcccaaccagaccccaaaa

SEQ ID NO: 397309 - RNA, 23 nt, Human
auaacagaacacacaaaaccagg

SEQ ID NO: 397310 - RNA, 23 nt, Human
auuggaagcaaguuguuucuggu

SEQ ID NO: 397311 - RNA, 23 nt, Human
caaaugcaauucaagugugaaga

SEQ ID NO: 397312 - RNA, 21 nt, Human
caccuaugguuuuaaaaacag

SEQ ID NO: 397313 - RNA, 24 nt, Human
cagugccaguacacucuccaugaa

SEQ ID NO: 397314 - RNA, 20 nt, Human
caucucacugugaaaugauc

SEQ ID NO: 397315 - RNA, 22 nt, Human
ccaaaauacaucguuuaugcag

SEQ ID NO: 397316 - RNA, 26 nt, Human
ccauauccuucaauccauaaagcauc

SEQ ID NO: 397317 - RNA, 24 nt, Human
ccuauuggccauagcugucccacc

SEQ ID NO: 397318 - RNA, 19 nt, Human
gaaauccuucucgaaccac

SEQ ID NO: 397319 - RNA, 24 nt, Human
gaacacacaaaaccaggcagagaa

SEQ ID NO: 397320 - RNA, 22 nt, Human
gaucuucugaaauccuucucga

SEQ ID NO: 397321 - RNA, 18 nt, Human
gcauacaagaaacacuaa

SEQ ID NO: 397322 - RNA, 18 nt, Human
ggcuuuguucuccauuuc

SEQ ID NO: 397323 - RNA, 20 nt, Human
uaaacuauaaacauuuuacc

SEQ ID NO: 397324 - RNA, 21 nt, Human
uaaaugccuaccauauguaug

SEQ ID NO: 397325 - RNA, 29 nt, Human
uaacagaacacacaaaaccaggcagagaa

SEQ ID NO: 397326 - RNA, 21 nt, Human
uaccacagucgaaaauuccca

SEQ ID NO: 397327 - RNA, 20 nt, Human
uagaaaaaagugcuaaaugg

SEQ ID NO: 397328 - RNA, 19 nt, Human
ucaaaguaaacuauaaaca

SEQ ID NO: 397329 - RNA, 22 nt, Human
uccuauagggccacaugucacu

SEQ ID NO: 397330 - RNA, 24 nt, Human
ucuacaacuuaucuuaaaagaaag

SEQ ID NO: 397331 - RNA, 21 nt, Human
ucuucugaaauccuucucgaa

SEQ ID NO: 397332 - RNA, 23 nt, Human
ugaauaacagaacacacaaaacc

SEQ ID NO: 397333 - RNA, 20 nt, Human
uuccaggcccaaccagaccc

SEQ ID NO: 397334 - RNA, 20 nt, Human
uugguccuucaucuuucaag

SEQ ID NO: 397335 - RNA, 21 nt, Human
uuucaaaguaaacuauaaaca

SEQ ID NO: 397336 - RNA, 19 nt, Human
uuuggccuuuugguccuuc

SEQ ID NO: 397337 - RNA, 21 nt, Human
uuuuauguauauuuuaccaca

SEQ ID NO: 397338 - RNA, 27 nt, Human
uuuuccaggcccaaccagaccccaaaa

SEQ ID NO: 397339 - RNA, 24 nt, Human
uuuuuuuuuuuuuuuuuuaauaag

SEQ ID NO: 397340 - RNA, 20 nt, Human
agcuggggugccccaccccc

SEQ ID NO: 397341 - RNA, 19 nt, Human
cacucuuuuggagcuggag

SEQ ID NO: 397342 - RNA, 24 nt, Human
ccacccccacccugggacuaggga

SEQ ID NO: 397343 - RNA, 20 nt, Human
cccacccccacccugggacu

SEQ ID NO: 397344 - RNA, 21 nt, Human
cccaugguggcaguggcuucc

SEQ ID NO: 397345 - RNA, 23 nt, Human
ccucccuucgagguagaccaucg

SEQ ID NO: 397346 - RNA, 24 nt, Human
cugagagagaaaaaggggacccau

SEQ ID NO: 397347 - RNA, 18 nt, Human
gaagugcugcccucugcu

SEQ ID NO: 397348 - RNA, 19 nt, Human
gagccagcccucccuucga

SEQ ID NO: 397349 - RNA, 19 nt, Human
gagcuggggugagaacuuc

SEQ ID NO: 397350 - RNA, 25 nt, Human
gccacgcccccagcguagacgcaca

SEQ ID NO: 397351 - RNA, 23 nt, Human
gggugcccugagagagaaaaagg

SEQ ID NO: 397352 - RNA, 20 nt, Human
gugcccugagagagaaaaag

SEQ ID NO: 397353 - RNA, 21 nt, Human
uagaaacccucucuggagggu

SEQ ID NO: 397354 - RNA, 23 nt, Human
uagaccaucggggagggaaccga

SEQ ID NO: 397355 - RNA, 19 nt, Human
ucccagggcuaacugggag

SEQ ID NO: 397356 - RNA, 23 nt, Human
ucccagggcuaacugggagccag

SEQ ID NO: 397357 - RNA, 19 nt, Human
ucggagcuuuccgccugca

SEQ ID NO: 397358 - RNA, 26 nt, Human
ucuggagggucccagggcuaacuggg

SEQ ID NO: 397359 - RNA, 20 nt, Human
ugccacacaaaggagcuggg

SEQ ID NO: 397360 - RNA, 21 nt, Human
uggggugcccugagagagaaa

SEQ ID NO: 397361 - RNA, 18 nt, Human
uggggugggugcacucuu

SEQ ID NO: 397362 - RNA, 23 nt, Human
ugggugcacucuuuuggagcugg

SEQ ID NO: 397363 - RNA, 19 nt, Human
ugucagggcagcuggggug

SEQ ID NO: 397364 - RNA, 24 nt, Human
aaacuguccuuaauaaaaggaucc

SEQ ID NO: 397365 - RNA, 22 nt, Human
aaaugucagagguacacuuacu

SEQ ID NO: 397366 - RNA, 19 nt, Human
acaaaaauaacagcauaaa

SEQ ID NO: 397367 - RNA, 19 nt, Human
acuacugaaguguccucca

SEQ ID NO: 397368 - RNA, 21 nt, Human
agaaauaacucccaaacuguc

SEQ ID NO: 397369 - RNA, 20 nt, Human
aggagccagacagcagcaca

SEQ ID NO: 397370 - RNA, 22 nt, Human
aggccaaggcaggcggcuggga

SEQ ID NO: 397371 - RNA, 20 nt, Human
aggugcuccucacuucccag

SEQ ID NO: 397372 - RNA, 21 nt, Human
agguggagguuguagcuagcc

SEQ ID NO: 397373 - RNA, 20 nt, Human
auggguggccgggccaagac

SEQ ID NO: 397374 - RNA, 21 nt, Human
caccagcugggauugacacac

SEQ ID NO: 397375 - RNA, 21 nt, Human
cagagacgcuccucacuuccc

SEQ ID NO: 397376 - RNA, 22 nt, Human
cagcaaaccgagugguucccgc

SEQ ID NO: 397377 - RNA, 22 nt, Human
cauuccauggaaaagucagagg

SEQ ID NO: 397378 - RNA, 20 nt, Human
cccagacggggucgcggcca

SEQ ID NO: 397379 - RNA, 18 nt, Human
ccccgcguugccagcgcc

SEQ ID NO: 397380 - RNA, 19 nt, Human
cccgccgcugccucaagcc

SEQ ID NO: 397381 - RNA, 21 nt, Human
ccgcugccucaagccugggug

SEQ ID NO: 397382 - RNA, 22 nt, Human
ccgcugccucaagccugggugg

SEQ ID NO: 397383 - RNA, 23 nt, Human
ccgcugccucaagccuggguggu

SEQ ID NO: 397384 - RNA, 22 nt, Human
ccgggcagaggggcuccucaca

SEQ ID NO: 397385 - RNA, 18 nt, Human
ccucacuucccagacugg

SEQ ID NO: 397386 - RNA, 24 nt, Human
cgagugguucccgccgcugccuca

SEQ ID NO: 397387 - RNA, 25 nt, Human
cggcacuuugggaggccaaggcagg

SEQ ID NO: 397388 - RNA, 20 nt, Human
cggcugggagguggagguug

SEQ ID NO: 397389 - RNA, 18 nt, Human
cgggauggcagccgggaa

SEQ ID NO: 397390 - RNA, 18 nt, Human
cggggcagaggcgcuccc

SEQ ID NO: 397391 - RNA, 18 nt, Human
cuccucaauaacagcggg

SEQ ID NO: 397392 - RNA, 23 nt, Human
gaaguguccuccauucaugaguu

SEQ ID NO: 397393 - RNA, 22 nt, Human
gcacuuugggaggccaaggcag

SEQ ID NO: 397394 - RNA, 21 nt, Human
gccagacagcagcacacagaa

SEQ ID NO: 397395 - RNA, 21 nt, Human
gcggccaggcagaggcgcucc

SEQ ID NO: 397396 - RNA, 21 nt, Human
gcggggcagaggcgcuccccu

SEQ ID NO: 397397 - RNA, 21 nt, Human
ggcagaggcugcaaucucggc

SEQ ID NO: 397398 - RNA, 21 nt, Human
ggcugcaaucucggcacuuug

SEQ ID NO: 397399 - RNA, 25 nt, Human
ggcugggagguggagguuggggacc

SEQ ID NO: 397400 - RNA, 22 nt, Human
gggcagaggcugcaaucucggc

SEQ ID NO: 397401 - RNA, 23 nt, Human
gguaaccccgcguugccagcgcc

SEQ ID NO: 397402 - RNA, 21 nt, Human
guucaggagccagacagcagc

SEQ ID NO: 397403 - RNA, 24 nt, Human
uccaaagccaucucugacacuccc

SEQ ID NO: 397404 - RNA, 25 nt, Human
ucgcagcaaaccgagugguucccgc

SEQ ID NO: 397405 - RNA, 23 nt, Human
ugaggugaguaaacacaaaaaua

SEQ ID NO: 397406 - RNA, 27 nt, Human
ugaguaaacacaaaaauaacagcauug

SEQ ID NO: 397407 - RNA, 18 nt, Human
ugccuuuuguguagcuuc

SEQ ID NO: 397408 - RNA, 22 nt, Human
uggaaaagucagaggugguuaa

SEQ ID NO: 397409 - RNA, 21 nt, Human
ugggaggccaaggcaggcggc

SEQ ID NO: 397410 - RNA, 24 nt, Human
ugggagguggagguuguagcuagc

SEQ ID NO: 397411 - RNA, 21 nt, Human
ugggauugacacaccucuaca

SEQ ID NO: 397412 - RNA, 19 nt, Human
ugguucccgccgcugccuc

SEQ ID NO: 397413 - RNA, 23 nt, Human
ugucagagguacacuuacuaaua

SEQ ID NO: 397414 - RNA, 21 nt, Human
uuacuccucaauaacagcggg

SEQ ID NO: 397415 - RNA, 22 nt, Human
acccaggccggggcuaccuggc

SEQ ID NO: 397416 - RNA, 22 nt, Human
accccugcagggcagagcaaca

SEQ ID NO: 397417 - RNA, 23 nt, Human
acugugugaccugugugcacccc

SEQ ID NO: 397418 - RNA, 21 nt, Human
caaaucucaggcuuaugcaca

SEQ ID NO: 397419 - RNA, 19 nt, Human
caacagcccguuguccccu

SEQ ID NO: 397420 - RNA, 20 nt, Human
cagccguccuggcagagcug

SEQ ID NO: 397421 - RNA, 18 nt, Human
cccugggcccuggggccu

SEQ ID NO: 397422 - RNA, 19 nt, Human
cccugggcccuggggccuc

SEQ ID NO: 397423 - RNA, 20 nt, Human
cccugggcccuggggccucu

SEQ ID NO: 397424 - RNA, 22 nt, Human
ccgcgggucccgggucccaccc

SEQ ID NO: 397425 - RNA, 21 nt, Human
ccggggcuaccuggcuccggc

SEQ ID NO: 397426 - RNA, 23 nt, Human
ccugaugacccaggccggggcua

SEQ ID NO: 397427 - RNA, 21 nt, Human
cuggaguugccgcaggugguu

SEQ ID NO: 397428 - RNA, 20 nt, Human
cugggcccuggggccucuug

SEQ ID NO: 397429 - RNA, 25 nt, Human
gaguugccgcaggugguguugcggu

SEQ ID NO: 397430 - RNA, 20 nt, Human
gcccuggggccucuuggcac

SEQ ID NO: 397431 - RNA, 21 nt, Human
ggagucccugggcccuggggc

SEQ ID NO: 397432 - RNA, 19 nt, Human
ggcagggguuggcccugcg

SEQ ID NO: 397433 - RNA, 18 nt, Human
gggcagagcccgcagucu

SEQ ID NO: 397434 - RNA, 23 nt, Human
gggcagggguuggcccugcgggg

SEQ ID NO: 397435 - RNA, 24 nt, Human
gggggagucccugggcccuggggc

SEQ ID NO: 397436 - RNA, 19 nt, Human
gggucccgggucccacccu

SEQ ID NO: 397437 - RNA, 18 nt, Human
ggguuggcccugcggggg

SEQ ID NO: 397438 - RNA, 22 nt, Human
gugccugaugacccaggccggg

SEQ ID NO: 397439 - RNA, 18 nt, Human
guggggggagucccuggg

SEQ ID NO: 397440 - RNA, 20 nt, Human
guuguccccucccgggccag

SEQ ID NO: 397441 - RNA, 19 nt, Human
uagagccgcgcaagccuga

SEQ ID NO: 397442 - RNA, 22 nt, Human
uagagccgcgcaagccugagaa

SEQ ID NO: 397443 - RNA, 21 nt, Human
ucccagaggucuggaguugcc

SEQ ID NO: 397444 - RNA, 18 nt, Human
ucccugggcccuggggcc

SEQ ID NO: 397445 - RNA, 21 nt, Human
uccgccgcuucggccuagagc

SEQ ID NO: 397446 - RNA, 20 nt, Human
ucugcaauucgguguuuuau

SEQ ID NO: 397447 - RNA, 20 nt, Human
ucuggaguugccgcaggugg

SEQ ID NO: 397448 - RNA, 25 nt, Human
ucugugccugaugacccaggccggg

SEQ ID NO: 397449 - RNA, 23 nt, Human
ugaccugugugcaccccagguga

SEQ ID NO: 397450 - RNA, 18 nt, Human
ugagaaaagccgcuccag

SEQ ID NO: 397451 - RNA, 23 nt, Human
ugcagggcagagcaacagggcag

SEQ ID NO: 397452 - RNA, 21 nt, Human
ugccucugugccugaugaccc

SEQ ID NO: 397453 - RNA, 22 nt, Human
ugcuguggggggagucccuggg

SEQ ID NO: 397454 - RNA, 22 nt, Human
uggcagagcugggggcagagcc

SEQ ID NO: 397455 - RNA, 26 nt, Human
ugggggcagagcccgcagucuuguuc

SEQ ID NO: 397456 - RNA, 22 nt, Human
ugugugcaccccaggugaccag

SEQ ID NO: 397457 - RNA, 23 nt, Human
uguuuuauucuuuccaaaucuca

SEQ ID NO: 397458 - RNA, 23 nt, Human
aagaaugcaguaaauggaaucua

SEQ ID NO: 397459 - RNA, 25 nt, Human
aagaguaacaaaagaugggagccgg

SEQ ID NO: 397460 - RNA, 24 nt, Human
acacacaaaaaauuggucuuuguu

SEQ ID NO: 397461 - RNA, 18 nt, Human
acucucaggcugccuacc

SEQ ID NO: 397462 - RNA, 21 nt, Human
agcauuaaaaaauacaagcaa

SEQ ID NO: 397463 - RNA, 20 nt, Human
augucccaagaguaacaaaa

SEQ ID NO: 397464 - RNA, 24 nt, Human
caaggaucuccccugaaaucagaa

SEQ ID NO: 397465 - RNA, 22 nt, Human
cacuaacuaacauuaggcaugc

SEQ ID NO: 397466 - RNA, 20 nt, Human
cagcauugacaaucaaacac

SEQ ID NO: 397467 - RNA, 22 nt, Human
caggaugucccaagaguaacaa

SEQ ID NO: 397468 - RNA, 19 nt, Human
cauauaggaaagggagauc

SEQ ID NO: 397469 - RNA, 23 nt, Human
caucccaucaacagcucuucauu

SEQ ID NO: 397470 - RNA, 20 nt, Human
cauuaaaaaauacaagcaaa

SEQ ID NO: 397471 - RNA, 18 nt, Human
ccaaagagguaaugcuga

SEQ ID NO: 397472 - RNA, 25 nt, Human
ccaucaacagcucuucauuucuuga

SEQ ID NO: 397473 - RNA, 26 nt, Human
cccaucaacagcucuucauuucuuga

SEQ ID NO: 397474 - RNA, 19 nt, Human
ccugaaaucagaaaugacu

SEQ ID NO: 397475 - RNA, 25 nt, Human
cuccacacaaaugagagauuuuuac

SEQ ID NO: 397476 - RNA, 24 nt, Human
cuccccugaaaucagaaaugacuc

SEQ ID NO: 397477 - RNA, 18 nt, Human
cucuagacucucaggcug

SEQ ID NO: 397478 - RNA, 19 nt, Human
cucucaggcugccuacccu

SEQ ID NO: 397479 - RNA, 23 nt, Human
cuuaagcuucacacacaaaaaau

SEQ ID NO: 397480 - RNA, 25 nt, Human
cuuaauauggauauuuaagcaaauc

SEQ ID NO: 397481 - RNA, 20 nt, Human
gaaaugacuccacacaaaug

SEQ ID NO: 397482 - RNA, 22 nt, Human
gcauuaaaaaauacaagcaaac

SEQ ID NO: 397483 - RNA, 19 nt, Human
gggcuuugagaaaagcaua

SEQ ID NO: 397484 - RNA, 18 nt, Human
uaacaaaagaugggagcc

SEQ ID NO: 397485 - RNA, 28 nt, Human
uaacaaaagaugggagccaauccucuca

SEQ ID NO: 397486 - RNA, 21 nt, Human
uaagcaaaucaucauauagga

SEQ ID NO: 397487 - RNA, 22 nt, Human
uaccugaaacugcuguuagcuu

SEQ ID NO: 397488 - RNA, 26 nt, Human
uagcauuaaaaaauacaagcaaacau

SEQ ID NO: 397489 - RNA, 21 nt, Human
uauaggaaagggagaucaaga

SEQ ID NO: 397490 - RNA, 20 nt, Human
ucccaagaguaacaaaagau

SEQ ID NO: 397491 - RNA, 24 nt, Human
uccccuacuucugcccuuucugau

SEQ ID NO: 397492 - RNA, 18 nt, Human
uccuuuuccaaagaggua

SEQ ID NO: 397493 - RNA, 23 nt, Human
ucucaggcugccuacccuaccuu

SEQ ID NO: 397494 - RNA, 25 nt, Human
ucuccagcauugacaaucaaacacu

SEQ ID NO: 397495 - RNA, 20 nt, Human
ucuccccugaaaucagaaau

SEQ ID NO: 397496 - RNA, 21 nt, Human
ucugcccuuucugauaaacac

SEQ ID NO: 397497 - RNA, 18 nt, Human
ugagaaaagcauaguccc

SEQ ID NO: 397498 - RNA, 21 nt, Human
ugcaccucuaccugaaacugc

SEQ ID NO: 397499 - RNA, 19 nt, Human
uguggucccacuaucaaaa

SEQ ID NO: 397500 - RNA, 22 nt, Human
uuucagugaucagaagaaugca

SEQ ID NO: 397501 - RNA, 24 nt, Human
aacccuuggaggcuuuuuuugcag

SEQ ID NO: 397502 - RNA, 25 nt, Human
agagcuggaccagucgaaacccuug

SEQ ID NO: 397503 - RNA, 18 nt, Human
aggaagggaugucagagc

SEQ ID NO: 397504 - RNA, 18 nt, Human
augucagagcuggaccag

SEQ ID NO: 397505 - RNA, 21 nt, Human
ccacaggggcguuggaggccu

SEQ ID NO: 397506 - RNA, 21 nt, Human
gccacaggggcguuggaggcc

SEQ ID NO: 397507 - RNA, 19 nt, Human
gcuuuggcccugaucacuu

SEQ ID NO: 397508 - RNA, 19 nt, Human
uauucaugcuguuuccagg

SEQ ID NO: 397509 - RNA, 19 nt, Human
uuccagaguccacuuccuu

SEQ ID NO: 397510 - RNA, 25 nt, Human
aaaaaaaaaaaaaaacacaacagaa

SEQ ID NO: 397511 - RNA, 23 nt, Human
aaaaacacaacagaaacccuaca

SEQ ID NO: 397512 - RNA, 19 nt, Human
aaaaauuagcuuauguccc

SEQ ID NO: 397513 - RNA, 27 nt, Human
aaacagaguucuggguuggacauggug

SEQ ID NO: 397514 - RNA, 20 nt, Human
aaacaucaagucugggcuca

SEQ ID NO: 397515 - RNA, 19 nt, Human
aaacucaggcuuuccccag

SEQ ID NO: 397516 - RNA, 23 nt, Human
aaagagccaauuuggaaguuguu

SEQ ID NO: 397517 - RNA, 24 nt, Human
aaauguguauacaaacauaucccc

SEQ ID NO: 397518 - RNA, 20 nt, Human
aacacaaagcccuugccccc

SEQ ID NO: 397519 - RNA, 22 nt, Human
aacacccacccaccccagcagg

SEQ ID NO: 397520 - RNA, 23 nt, Human
aagaaaacaaaacagaguucugg

SEQ ID NO: 397521 - RNA, 22 nt, Human
aagaagccucuacccccaaagc

SEQ ID NO: 397522 - RNA, 19 nt, Human
aagcaaaaacuauucucca

SEQ ID NO: 397523 - RNA, 20 nt, Human
aagcaacacaaagcccuugc

SEQ ID NO: 397524 - RNA, 21 nt, Human
aagcucaaaaccgcccucuga

SEQ ID NO: 397525 - RNA, 23 nt, Human
aaggaucagcucuggggcaaguc

SEQ ID NO: 397526 - RNA, 24 nt, Human
aaggggcaggguggggccaggagg

SEQ ID NO: 397527 - RNA, 21 nt, Human
aaucauggcuucccaacugga

SEQ ID NO: 397528 - RNA, 22 nt, Human
acacugccucacaaagaaggcc

SEQ ID NO: 397529 - RNA, 20 nt, Human
acagaggagaaagacccaaa

SEQ ID NO: 397530 - RNA, 18 nt, Human
acaggguucgagaucucu

SEQ ID NO: 397531 - RNA, 20 nt, Human
acaugcagacacagacagac

SEQ ID NO: 397532 - RNA, 19 nt, Human
acaugcuggcaucagcuuc

SEQ ID NO: 397533 - RNA, 18 nt, Human
accaaagcguuuuccagg

SEQ ID NO: 397534 - RNA, 21 nt, Human
accaagcugucuccacaccca

SEQ ID NO: 397535 - RNA, 19 nt, Human
accacuuuacuguuuagaa

SEQ ID NO: 397536 - RNA, 19 nt, Human
acccaaaccagaaccaacu

SEQ ID NO: 397537 - RNA, 20 nt, Human
acccacccaccccagcagga

SEQ ID NO: 397538 - RNA, 20 nt, Human
acgcgagugggugggcuggg

SEQ ID NO: 397539 - RNA, 23 nt, Human
acuaguuccuucuauuuccccca

SEQ ID NO: 397540 - RNA, 24 nt, Human
agaaaacaggcacuaauuccaguc

SEQ ID NO: 397541 - RNA, 21 nt, Human
agaaccaacuaacacccaccc

SEQ ID NO: 397542 - RNA, 22 nt, Human
agaaccaacuaacacccaccca

SEQ ID NO: 397543 - RNA, 19 nt, Human
agaaggggcaggguggggc

SEQ ID NO: 397544 - RNA, 25 nt, Human
agaggugaggaucucaggagguggc

SEQ ID NO: 397545 - RNA, 18 nt, Human
agcaagaggaggaggaga

SEQ ID NO: 397546 - RNA, 22 nt, Human
agcaagaggaggaggagaagcc

SEQ ID NO: 397547 - RNA, 22 nt, Human
agccaaggcaggcaggacacuc

SEQ ID NO: 397548 - RNA, 21 nt, Human
agccauugggauuccaauagg

SEQ ID NO: 397549 - RNA, 23 nt, Human
agccgcauuaccucaucggcccu

SEQ ID NO: 397550 - RNA, 22 nt, Human
agcgcccgccgccugccugcug

SEQ ID NO: 397551 - RNA, 22 nt, Human
agcgggaagggagggaagugag

SEQ ID NO: 397552 - RNA, 22 nt, Human
aggaaaacuguaaacagugcua

SEQ ID NO: 397553 - RNA, 21 nt, Human
aggaaaaucauggcuucccaa

SEQ ID NO: 397554 - RNA, 21 nt, Human
aggagacggacaggggucaga

SEQ ID NO: 397555 - RNA, 24 nt, Human
aggcacagaggagaaagacccaaa

SEQ ID NO: 397556 - RNA, 21 nt, Human
aggcagaagagaugcccaaag

SEQ ID NO: 397557 - RNA, 22 nt, Human
aggcaggucuggaacgagggga

SEQ ID NO: 397558 - RNA, 19 nt, Human
aggcuggaggagucucagu

SEQ ID NO: 397559 - RNA, 24 nt, Human
agggaacuuguguagguuggucag

SEQ ID NO: 397560 - RNA, 20 nt, Human
agggagggaagugagguggg

SEQ ID NO: 397561 - RNA, 21 nt, Human
auaaaagaaagcuccuggcca

SEQ ID NO: 397562 - RNA, 21 nt, Human
auaaggacaaucccaaaacau

SEQ ID NO: 397563 - RNA, 19 nt, Human
auagaaagcucaaaaccgc

SEQ ID NO: 397564 - RNA, 21 nt, Human
auauagcgcugggcccccggg

SEQ ID NO: 397565 - RNA, 23 nt, Human
aucacugggcuggggaauugugu

SEQ ID NO: 397566 - RNA, 20 nt, Human
auggaggaaaacuguaaaca

SEQ ID NO: 397567 - RNA, 23 nt, Human
auggggaugugguucugcuaauu

SEQ ID NO: 397568 - RNA, 21 nt, Human
auuacaauccucaaauggagu

SEQ ID NO: 397569 - RNA, 26 nt, Human
caaacauaucccccuaggugagcuaa

SEQ ID NO: 397570 - RNA, 21 nt, Human
caaaccagaaccaacuaacac

SEQ ID NO: 397571 - RNA, 24 nt, Human
caaaccagaaccaacuaacaccca

SEQ ID NO: 397572 - RNA, 18 nt, Human
caacacaaagcccuugcc

SEQ ID NO: 397573 - RNA, 19 nt, Human
caacuaacacccacccacc

SEQ ID NO: 397574 - RNA, 24 nt, Human
caagaaaacaggcacuaauuucau

SEQ ID NO: 397575 - RNA, 20 nt, Human
caagcaacgacaacaaaaua

SEQ ID NO: 397576 - RNA, 21 nt, Human
caaggagacggacagggguca

SEQ ID NO: 397577 - RNA, 21 nt, Human
caaggcaggcaaauugccucc

SEQ ID NO: 397578 - RNA, 21 nt, Human
caagggguaacggggcggggc

SEQ ID NO: 397579 - RNA, 19 nt, Human
cacaaagaaggccaagccu

SEQ ID NO: 397580 - RNA, 23 nt, Human
cacaagauuuagcaaaaggacau

SEQ ID NO: 397581 - RNA, 18 nt, Human
cacacucagccuucaccc

SEQ ID NO: 397582 - RNA, 21 nt, Human
cacagaggagaaagacccaaa

SEQ ID NO: 397583 - RNA, 26 nt, Human
cacccacccaccccagcaggaccgcu

SEQ ID NO: 397584 - RNA, 18 nt, Human
cacccaccccagcaggac

SEQ ID NO: 397585 - RNA, 22 nt, Human
caccccagcaggaccgcuucca

SEQ ID NO: 397586 - RNA, 19 nt, Human
cacucugcagcucucccuc

SEQ ID NO: 397587 - RNA, 18 nt, Human
cagagcacuggcccgaga

SEQ ID NO: 397588 - RNA, 18 nt, Human
cagagcagagcacuggcc

SEQ ID NO: 397589 - RNA, 18 nt, Human
caggacacucugcagcuc

SEQ ID NO: 397590 - RNA, 22 nt, Human
caugacacaagauuuagcaaaa

SEQ ID NO: 397591 - RNA, 21 nt, Human
cauuccuucuagacaggguuc

SEQ ID NO: 397592 - RNA, 20 nt, Human
ccaaacaugaagcagggaca

SEQ ID NO: 397593 - RNA, 19 nt, Human
ccaaaccagaaccaacuaa

SEQ ID NO: 397594 - RNA, 24 nt, Human
ccaaaccagaaccaacuaacaccc

SEQ ID NO: 397595 - RNA, 22 nt, Human
ccaaacucucucucuuucucuc

SEQ ID NO: 397596 - RNA, 19 nt, Human
ccaaggccuaacagauggg

SEQ ID NO: 397597 - RNA, 21 nt, Human
ccacccaccccagcaggaccg

SEQ ID NO: 397598 - RNA, 21 nt, Human
ccagaaccaacuaacacccac

SEQ ID NO: 397599 - RNA, 20 nt, Human
ccaggagaggugucccucca

SEQ ID NO: 397600 - RNA, 22 nt, Human
ccaguauuaccuacccuggacc

SEQ ID NO: 397601 - RNA, 23 nt, Human
cccaaacucucucucuuucucuc

SEQ ID NO: 397602 - RNA, 18 nt, Human
cccaaaucuacuuggcua

SEQ ID NO: 397603 - RNA, 19 nt, Human
cccacgcccaccugggcca

SEQ ID NO: 397604 - RNA, 22 nt, Human
cccagcaggaccgcuuccacag

SEQ ID NO: 397605 - RNA, 19 nt, Human
cccagggccuccucaccaa

SEQ ID NO: 397606 - RNA, 23 nt, Human
cccaguauuaccuacccuggaca

SEQ ID NO: 397607 - RNA, 19 nt, Human
cccaugauagggaagagag

SEQ ID NO: 397608 - RNA, 25 nt, Human
ccccagugaccaacaauuuuaauuc

SEQ ID NO: 397609 - RNA, 18 nt, Human
cccccaaagcaaaaacua

SEQ ID NO: 397610 - RNA, 19 nt, Human
ccccgccucgggcuguugg

SEQ ID NO: 397611 - RNA, 25 nt, Human
ccccugccaaauggcaugaccacaa

SEQ ID NO: 397612 - RNA, 18 nt, Human
ccccuuccucucgccucc

SEQ ID NO: 397613 - RNA, 19 nt, Human
cccgccgccugccugcugc

SEQ ID NO: 397614 - RNA, 21 nt, Human
cccgccgccugccugcugccc

SEQ ID NO: 397615 - RNA, 20 nt, Human
cccuccaaaaagggggcggg

SEQ ID NO: 397616 - RNA, 20 nt, Human
ccgccgccugccugcugccc

SEQ ID NO: 397617 - RNA, 22 nt, Human
ccgccgcugccggggcugcugc

SEQ ID NO: 397618 - RNA, 19 nt, Human
ccgcugccggggcugcugc

SEQ ID NO: 397619 - RNA, 21 nt, Human
ccucacacucagccuucaccc

SEQ ID NO: 397620 - RNA, 23 nt, Human
ccuccagccaaggcaggcaggac

SEQ ID NO: 397621 - RNA, 21 nt, Human
ccucccauucucccccugcca

SEQ ID NO: 397622 - RNA, 23 nt, Human
ccucccggcgaaggagcaggagc

SEQ ID NO: 397623 - RNA, 19 nt, Human
ccuccgagugcccggcggg

SEQ ID NO: 397624 - RNA, 20 nt, Human
ccugccugcugcccgcucug

SEQ ID NO: 397625 - RNA, 19 nt, Human
cgaaggagcaggagcugga

SEQ ID NO: 397626 - RNA, 22 nt, Human
cgaaggagcaggagcuggagga

SEQ ID NO: 397627 - RNA, 20 nt, Human
cgcugggcccccggggaccc

SEQ ID NO: 397628 - RNA, 22 nt, Human
cgggaccggugcuugccgcugg

SEQ ID NO: 397629 - RNA, 25 nt, Human
cgggauggggcgcagcgaggcugcc

SEQ ID NO: 397630 - RNA, 29 nt, Human
cgggggcaagggguaacggggggaagucc

SEQ ID NO: 397631 - RNA, 19 nt, Human
cgugccccuucucgucugc

SEQ ID NO: 397632 - RNA, 21 nt, Human
cuacccccaaagcaaaaacua

SEQ ID NO: 397633 - RNA, 18 nt, Human
cuacgaaauuuagcaaca

SEQ ID NO: 397634 - RNA, 20 nt, Human
cuagagaccuugacugugcu

SEQ ID NO: 397635 - RNA, 19 nt, Human
cucacaaagaaggccaagc

SEQ ID NO: 397636 - RNA, 24 nt, Human
cucacagagaagacacugaugucc

SEQ ID NO: 397637 - RNA, 19 nt, Human
cuccaaguucuccccuucc

SEQ ID NO: 397638 - RNA, 22 nt, Human
cuccaggagccauugggauucc

SEQ ID NO: 397639 - RNA, 19 nt, Human
cuccggcgcgcugcccucc

SEQ ID NO: 397640 - RNA, 18 nt, Human
cucuuguaguuccuuccu

SEQ ID NO: 397641 - RNA, 27 nt, Human
cugccgccgcugccggggcugcugcuc

SEQ ID NO: 397642 - RNA, 20 nt, Human
cugcgcccuggccccacgcc

SEQ ID NO: 397643 - RNA, 21 nt, Human
cuggccccacgcccaccuggg

SEQ ID NO: 397644 - RNA, 19 nt, Human
cugggccacugggugucuc

SEQ ID NO: 397645 - RNA, 18 nt, Human
cugguucuuacucucugg

SEQ ID NO: 397646 - RNA, 18 nt, Human
cuguuuccuaaaguggaa

SEQ ID NO: 397647 - RNA, 18 nt, Human
cuuguugguuucucucca

SEQ ID NO: 397648 - RNA, 24 nt, Human
gaacagaauucuguguccuguaaa

SEQ ID NO: 397649 - RNA, 22 nt, Human
gaauugugugugugcugcauca

SEQ ID NO: 397650 - RNA, 19 nt, Human
gaccggugcuugccgcugg

SEQ ID NO: 397651 - RNA, 20 nt, Human
gacuggcuaaagggaaaggc

SEQ ID NO: 397652 - RNA, 20 nt, Human
gagaagacacugauguccac

SEQ ID NO: 397653 - RNA, 18 nt, Human
gagcaggagcuggaggag

SEQ ID NO: 397654 - RNA, 22 nt, Human
gagcaggagcuggaggagcaag

SEQ ID NO: 397655 - RNA, 22 nt, Human
gagcaggcacagaggagaaaga

SEQ ID NO: 397656 - RNA, 20 nt, Human
gaggagaagccgucugagcg

SEQ ID NO: 397657 - RNA, 22 nt, Human
gaggagcaagaggaggaggaga

SEQ ID NO: 397658 - RNA, 23 nt, Human
gaggaggaggagaagccgucuga

SEQ ID NO: 397659 - RNA, 21 nt, Human
gaggauaguucccaauaaacc

SEQ ID NO: 397660 - RNA, 19 nt, Human
gagggaagugagguggggc

SEQ ID NO: 397661 - RNA, 21 nt, Human
gagggaagugagguggggcag

SEQ ID NO: 397662 - RNA, 18 nt, Human
gaggguaaaagacaggag

SEQ ID NO: 397663 - RNA, 22 nt, Human
gagguggggaagaagcaagagg

SEQ ID NO: 397664 - RNA, 18 nt, Human
gcacagaggagaaagacc

SEQ ID NO: 397665 - RNA, 24 nt, Human
gcccagggccuccucaccaaggcc

SEQ ID NO: 397666 - RNA, 22 nt, Human
gccgcugcugccgccgcugccg

SEQ ID NO: 397667 - RNA, 18 nt, Human
gccggggcugcugcucgc

SEQ ID NO: 397668 - RNA, 19 nt, Human
gccugcugcccgcucugcg

SEQ ID NO: 397669 - RNA, 21 nt, Human
gcgaaggagcaggagcuggag

SEQ ID NO: 397670 - RNA, 19 nt, Human
gcgcaggacucggcgggcg

SEQ ID NO: 397671 - RNA, 18 nt, Human
gcggagcccucgugcccc

SEQ ID NO: 397672 - RNA, 20 nt, Human
gcugccgccgcugccggggc

SEQ ID NO: 397673 - RNA, 19 nt, Human
gcugcugcucgccucucca

SEQ ID NO: 397674 - RNA, 21 nt, Human
gcuggggaauugugugugugc

SEQ ID NO: 397675 - RNA, 20 nt, Human
gcuuuuuuuuuuuuucuucu

SEQ ID NO: 397676 - RNA, 19 nt, Human
ggaaauaguauccucuacc

SEQ ID NO: 397677 - RNA, 20 nt, Human
ggaaauaguauccucuaccc

SEQ ID NO: 397678 - RNA, 19 nt, Human
ggacaaucccaaaacauca

SEQ ID NO: 397679 - RNA, 22 nt, Human
ggacaggggucagaugacccau

SEQ ID NO: 397680 - RNA, 18 nt, Human
ggagaagccgucugagcg

SEQ ID NO: 397681 - RNA, 20 nt, Human
ggagauggugagguggggaa

SEQ ID NO: 397682 - RNA, 19 nt, Human
ggaggaagcgagaacuugg

SEQ ID NO: 397683 - RNA, 20 nt, Human
ggaggaagucuggugggaga

SEQ ID NO: 397684 - RNA, 19 nt, Human
ggaggagcaagaggaggag

SEQ ID NO: 397685 - RNA, 18 nt, Human
ggagggaagugagguggg

SEQ ID NO: 397686 - RNA, 22 nt, Human
ggaucucaggagguggcauuca

SEQ ID NO: 397687 - RNA, 22 nt, Human
ggccgagugacacagaacaaga

SEQ ID NO: 397688 - RNA, 18 nt, Human
ggccgugcggggcaaccu

SEQ ID NO: 397689 - RNA, 19 nt, Human
gggaagaagcaagaggggu

SEQ ID NO: 397690 - RNA, 21 nt, Human
gggaagcucagcgggaaggga

SEQ ID NO: 397691 - RNA, 18 nt, Human
gggagcuagggaaaggga

SEQ ID NO: 397692 - RNA, 25 nt, Human
gggcaaagggaagagggucugggag

SEQ ID NO: 397693 - RNA, 21 nt, Human
gggcaggguggggccaggagg

SEQ ID NO: 397694 - RNA, 22 nt, Human
gggcggggccgggggcaagggg

SEQ ID NO: 397695 - RNA, 20 nt, Human
gggcucaucccuucaaaacc

SEQ ID NO: 397696 - RNA, 20 nt, Human
ggggccaggaggauaguucc

SEQ ID NO: 397697 - RNA, 18 nt, Human
guauacaaacauaucccc

SEQ ID NO: 397698 - RNA, 24 nt, Human
guaucucccauggcccuggauucu

SEQ ID NO: 397699 - RNA, 19 nt, Human
gugaaguaaaugguagacu

SEQ ID NO: 397700 - RNA, 19 nt, Human
gugaugcuagggcuaugaa

SEQ ID NO: 397701 - RNA, 22 nt, Human
gugcggggcaaccuuggccucc

SEQ ID NO: 397702 - RNA, 23 nt, Human
guuucucuggagagagcaggcac

SEQ ID NO: 397703 - RNA, 21 nt, Human
uaaaauauacauuaucaccua

SEQ ID NO: 397704 - RNA, 18 nt, Human
uaaaauguucaugauaug

SEQ ID NO: 397705 - RNA, 24 nt, Human
uaacugcuaccccuccaguuucuc

SEQ ID NO: 397706 - RNA, 18 nt, Human
uaagcugaaaaaagagac

SEQ ID NO: 397707 - RNA, 19 nt, Human
uaagcugaaaaaagagaca

SEQ ID NO: 397708 - RNA, 20 nt, Human
uacacgguaaugaaauugau

SEQ ID NO: 397709 - RNA, 24 nt, Human
uacauuaucaccuacucucagcau

SEQ ID NO: 397710 - RNA, 25 nt, Human
uacauuaucaccuacucucagcauc

SEQ ID NO: 397711 - RNA, 21 nt, Human
uauaaaauucauaaauaacau

SEQ ID NO: 397712 - RNA, 20 nt, Human
uauacauuaucaccuacucu

SEQ ID NO: 397713 - RNA, 18 nt, Human
uauagaaagcucaaaacc

SEQ ID NO: 397714 - RNA, 19 nt, Human
uauagaaagcucaaaaccg

SEQ ID NO: 397715 - RNA, 28 nt, Human
uaucacgaagaagaggaauacagguucc

SEQ ID NO: 397716 - RNA, 26 nt, Human
uaugacagcauagaccuuucuuuaaa

SEQ ID NO: 397717 - RNA, 19 nt, Human
ucaaaaaaaaaaaaaaaaa

SEQ ID NO: 397718 - RNA, 23 nt, Human
ucaaaaaaaaaaaaaaaaacaca

SEQ ID NO: 397719 - RNA, 21 nt, Human
ucaccauccugccaaccccca

SEQ ID NO: 397720 - RNA, 23 nt, Human
uccacaggugagggguggccaug

SEQ ID NO: 397721 - RNA, 19 nt, Human
uccggcgcgcugcccuccg

SEQ ID NO: 397722 - RNA, 21 nt, Human
uccggcgcgcugcccuccgag

SEQ ID NO: 397723 - RNA, 21 nt, Human
uccuccuugugugagagaggc

SEQ ID NO: 397724 - RNA, 22 nt, Human
uccuggccaaaucuaccaaagc

SEQ ID NO: 397725 - RNA, 23 nt, Human
uccuugugugagagaggcugacc

SEQ ID NO: 397726 - RNA, 20 nt, Human
ucgugccccuucucgucugc

SEQ ID NO: 397727 - RNA, 20 nt, Human
ucuaagaagccucuaccccc

SEQ ID NO: 397728 - RNA, 20 nt, Human
ucuacccaaaucuacuuggc

SEQ ID NO: 397729 - RNA, 18 nt, Human
ucuagacaggguucgaga

SEQ ID NO: 397730 - RNA, 18 nt, Human
ucuaucugcuugcugccu

SEQ ID NO: 397731 - RNA, 19 nt, Human
ucucccagagcaaacgggg

SEQ ID NO: 397732 - RNA, 18 nt, Human
ucucugguucuuacucuc

SEQ ID NO: 397733 - RNA, 23 nt, Human
ucucugguucuuacucucuggga

SEQ ID NO: 397734 - RNA, 23 nt, Human
ucucuuguugguuucucuccauc

SEQ ID NO: 397735 - RNA, 18 nt, Human
ucugccaagcaccuugcc

SEQ ID NO: 397736 - RNA, 18 nt, Human
ucuguguccuuuauguau

SEQ ID NO: 397737 - RNA, 19 nt, Human
ucuuucucucucucucucc

SEQ ID NO: 397738 - RNA, 24 nt, Human
ugaaaaaaaaaugucaacuuggaa

SEQ ID NO: 397739 - RNA, 20 nt, Human
ugaaauaaacaaagcuauag

SEQ ID NO: 397740 - RNA, 21 nt, Human
ugaaaugguuggccuuucagc

SEQ ID NO: 397741 - RNA, 24 nt, Human
ugacaucgcuuugcgaaagacccu

SEQ ID NO: 397742 - RNA, 25 nt, Human
ugacaucgcuuugcgaaagacccuu

SEQ ID NO: 397743 - RNA, 23 nt, Human
ugacuacacucucaucugccauc

SEQ ID NO: 397744 - RNA, 24 nt, Human
ugacugugcuugguggaaccagcg

SEQ ID NO: 397745 - RNA, 19 nt, Human
ugagaaguggacaaagaca

SEQ ID NO: 397746 - RNA, 20 nt, Human
ugagaaguggacaaagacaa

SEQ ID NO: 397747 - RNA, 19 nt, Human
ugagcgcccgccgccugcc

SEQ ID NO: 397748 - RNA, 19 nt, Human
ugagggguggccauguccu

SEQ ID NO: 397749 - RNA, 20 nt, Human
ugagguggggaagaagcaag

SEQ ID NO: 397750 - RNA, 19 nt, Human
ugauagaaauaaaaccacu

SEQ ID NO: 397751 - RNA, 18 nt, Human
ugcccagggccuccucac

SEQ ID NO: 397752 - RNA, 27 nt, Human
ugccgcugcugccgccgcugccggggg

SEQ ID NO: 397753 - RNA, 23 nt, Human
ugccgguacucucuucccacucu

SEQ ID NO: 397754 - RNA, 20 nt, Human
ugccugcugcccgcucugcg

SEQ ID NO: 397755 - RNA, 19 nt, Human
ugccugggcacuugugugu

SEQ ID NO: 397756 - RNA, 20 nt, Human
ugcgauaguaagggaagggc

SEQ ID NO: 397757 - RNA, 23 nt, Human
ugcugccuuugacugauccugaa

SEQ ID NO: 397758 - RNA, 18 nt, Human
ugcugggagaaucuaaga

SEQ ID NO: 397759 - RNA, 21 nt, Human
ugcuuuuuuuuuuuuucuucu

SEQ ID NO: 397760 - RNA, 24 nt, Human
uggaaaugaaugaugucaaaacca

SEQ ID NO: 397761 - RNA, 22 nt, Human
uggaaccagcgggggaaugcua

SEQ ID NO: 397762 - RNA, 21 nt, Human
uggaaggguagugucuccugg

SEQ ID NO: 397763 - RNA, 19 nt, Human
uggaaugaacugaagauac

SEQ ID NO: 397764 - RNA, 24 nt, Human
uggaaugaacugaagauacaaaua

SEQ ID NO: 397765 - RNA, 20 nt, Human
uggaggagaagggcaaaggg

SEQ ID NO: 397766 - RNA, 25 nt, Human
uggccagaugccucacagagaagac

SEQ ID NO: 397767 - RNA, 21 nt, Human
uggccuccggcgcgcugcccu

SEQ ID NO: 397768 - RNA, 18 nt, Human
uggcgcaggacucggcgg

SEQ ID NO: 397769 - RNA, 18 nt, Human
ugggacaugcaguggcag

SEQ ID NO: 397770 - RNA, 20 nt, Human
ugggacaugcaguggcagcu

SEQ ID NO: 397771 - RNA, 18 nt, Human
ugggagaaucuaagaagc

SEQ ID NO: 397772 - RNA, 18 nt, Human
ugggcccccggggacccc

SEQ ID NO: 397773 - RNA, 22 nt, Human
uggggccaggaggauaguuccc

SEQ ID NO: 397774 - RNA, 19 nt, Human
uggguccucggagcggagc

SEQ ID NO: 397775 - RNA, 21 nt, Human
ugggugucucugacccaaacc

SEQ ID NO: 397776 - RNA, 22 nt, Human
uggguuggacaugacuggggag

SEQ ID NO: 397777 - RNA, 23 nt, Human
uggugagguggggaagaagcaag

SEQ ID NO: 397778 - RNA, 21 nt, Human
ugguuggccuuucagcaaguu

SEQ ID NO: 397779 - RNA, 24 nt, Human
uguacacauauuacagccuacaca

SEQ ID NO: 397780 - RNA, 23 nt, Human
uguauaacaucuuucacacaccu

SEQ ID NO: 397781 - RNA, 24 nt, Human
ugucacaugcaagacagaggucug

SEQ ID NO: 397782 - RNA, 19 nt, Human
uguccaagggaagcucagc

SEQ ID NO: 397783 - RNA, 22 nt, Human
uguggauaguguauggugugug

SEQ ID NO: 397784 - RNA, 24 nt, Human
uguggguauaugcaaauguguaua

SEQ ID NO: 397785 - RNA, 23 nt, Human
uguguauuuauccaauuuacaua

SEQ ID NO: 397786 - RNA, 21 nt, Human
uguuccaagugcuaaauuugc

SEQ ID NO: 397787 - RNA, 22 nt, Human
uguuuugcuuuugccaucagau

SEQ ID NO: 397788 - RNA, 27 nt, Human
uuaaacuauuggcauauuuaacagcaa

SEQ ID NO: 397789 - RNA, 21 nt, Human
uucaagaaccauguugccacc

SEQ ID NO: 397790 - RNA, 19 nt, Human
uucaaugucaccauccugc

SEQ ID NO: 397791 - RNA, 24 nt, Human
uucuggguuucaggacagcagacu

SEQ ID NO: 397792 - RNA, 20 nt, Human
uugaucccaaggaaacccga

SEQ ID NO: 397793 - RNA, 22 nt, Human
uugaucccaaggaaacccgaug

SEQ ID NO: 397794 - RNA, 21 nt, Human
uugccugggcacuugugugug

SEQ ID NO: 397795 - RNA, 21 nt, Human
uugcuccagacucaggaacau

SEQ ID NO: 397796 - RNA, 18 nt, Human
uugcugccuuugacugau

SEQ ID NO: 397797 - RNA, 20 nt, Human
uuucuucaaacaagcaacga

SEQ ID NO: 397798 - RNA, 21 nt, Human
uuugacacuaaaacuuaaaau

SEQ ID NO: 397799 - RNA, 18 nt, Human
uuugcccagggccuccuc

SEQ ID NO: 397800 - RNA, 24 nt, Human
uuugcgaaagacccuucuuugccc

SEQ ID NO: 397801 - RNA, 22 nt, Human
uuuuuuuuuucuucuucuguuu

SEQ ID NO: 397802 - RNA, 23 nt, Human
aacacuugcaguaacagcuacaa

SEQ ID NO: 397803 - RNA, 18 nt, Human
aagggaugugauggucac

SEQ ID NO: 397804 - RNA, 22 nt, Human
acaaaggaaaacacauauuccu

SEQ ID NO: 397805 - RNA, 23 nt, Human
agaaacacuugcaguaacagcua

SEQ ID NO: 397806 - RNA, 18 nt, Human
agggaugugauggucacu

SEQ ID NO: 397807 - RNA, 19 nt, Human
cagacuguccacuuggcac

SEQ ID NO: 397808 - RNA, 18 nt, Human
cagggcagaaaagucaug

SEQ ID NO: 397809 - RNA, 23 nt, Human
caguggccagacuguccacuugg

SEQ ID NO: 397810 - RNA, 21 nt, Human
caucucauguguaugacauuc

SEQ ID NO: 397811 - RNA, 20 nt, Human
cauggccccuucccugccuu

SEQ ID NO: 397812 - RNA, 21 nt, Human
ccagacuguccacuuggcacu

SEQ ID NO: 397813 - RNA, 22 nt, Human
cucugcagggaaggagaacugg

SEQ ID NO: 397814 - RNA, 18 nt, Human
cuucugauucuguacauc

SEQ ID NO: 397815 - RNA, 19 nt, Human
gaaaacacauauuccuggg

SEQ ID NO: 397816 - RNA, 18 nt, Human
gccuguuuaugaugcugu

SEQ ID NO: 397817 - RNA, 20 nt, Human
ggccaaagcucugcagggaa

SEQ ID NO: 397818 - RNA, 24 nt, Human
uagaaaacagacuaagccagaaga

SEQ ID NO: 397819 - RNA, 25 nt, Human
uagaaaacagacuaagccagaagaa

SEQ ID NO: 397820 - RNA, 18 nt, Human
uauaccaucucaugugua

SEQ ID NO: 397821 - RNA, 25 nt, Human
ucaggugguaauggccaaagcucuu

SEQ ID NO: 397822 - RNA, 21 nt, Human
ugagccugugaggucuggggg

SEQ ID NO: 397823 - RNA, 26 nt, Human
ugagccugugaggucugggggacugg

SEQ ID NO: 397824 - RNA, 20 nt, Human
ugaugcugucaaaccaccuu

SEQ ID NO: 397825 - RNA, 19 nt, Human
uggcagcaagaggucaggu

SEQ ID NO: 397826 - RNA, 19 nt, Human
ugggaggcagggcaacagg

SEQ ID NO: 397827 - RNA, 18 nt, Human
ugggguuugggaggcagg

SEQ ID NO: 397828 - RNA, 20 nt, Human
uuaagacaaaggaaaacaca

SEQ ID NO: 397829 - RNA, 21 nt, Human
uuagaaaacagacuaagccag

SEQ ID NO: 397830 - RNA, 22 nt, Human
uugaagggaugugauggucacu

SEQ ID NO: 397831 - RNA, 21 nt, Human
uuuuuuuuuuuuuuuuucauu

SEQ ID NO: 397832 - RNA, 26 nt, Human
aaacagauaaaguaaagggaggagac

SEQ ID NO: 397833 - RNA, 23 nt, Human
aaagaacaacaaaaacccaaaca

SEQ ID NO: 397834 - RNA, 24 nt, Human
aaagaacaacaaaaacccaaacaa

SEQ ID NO: 397835 - RNA, 26 nt, Human
aaagaacaacaaaaacccaaacaaaa

SEQ ID NO: 397836 - RNA, 19 nt, Human
aaagaccuaaauaugaaaa

SEQ ID NO: 397837 - RNA, 24 nt, Human
aacaacaaaaacccaaacaaaaaa

SEQ ID NO: 397838 - RNA, 27 nt, Human
aacaacaaaaacccaaacaaaaaaucc

SEQ ID NO: 397839 - RNA, 22 nt, Human
aacuagccccgugagaccaggc

SEQ ID NO: 397840 - RNA, 24 nt, Human
acaaaaacccaaacaaaaaaucca

SEQ ID NO: 397841 - RNA, 20 nt, Human
accagcacagggauacacaa

SEQ ID NO: 397842 - RNA, 23 nt, Human
agaacaacaaaaacccaaacaaa

SEQ ID NO: 397843 - RNA, 23 nt, Human
agaacccaguaacagccccccac

SEQ ID NO: 397844 - RNA, 18 nt, Human
agaagaaaacagauguag

SEQ ID NO: 397845 - RNA, 25 nt, Human
agaagugggugccaggcuucccaag

SEQ ID NO: 397846 - RNA, 21 nt, Human
agaggaacagaguagugugag

SEQ ID NO: 397847 - RNA, 20 nt, Human
agcacagggauacacaaaca

SEQ ID NO: 397848 - RNA, 21 nt, Human
agcagccaucaggguaugagc

SEQ ID NO: 397849 - RNA, 21 nt, Human
agccccgugagaccaggcauu

SEQ ID NO: 397850 - RNA, 23 nt, Human
agggcagcuggcaggcagcucuu

SEQ ID NO: 397851 - RNA, 20 nt, Human
agguggauuaaagaccuaaa

SEQ ID NO: 397852 - RNA, 20 nt, Human
aguaaagggaggagacugga

SEQ ID NO: 397853 - RNA, 24 nt, Human
augcccauuccaggguuuccccag

SEQ ID NO: 397854 - RNA, 19 nt, Human
augucccugauggcggaca

SEQ ID NO: 397855 - RNA, 20 nt, Human
auuggugaagggggaggagg

SEQ ID NO: 397856 - RNA, 25 nt, Human
cacaaaaagcacaaaguaaaaggua

SEQ ID NO: 397857 - RNA, 21 nt, Human
cacagggauacacaaacagau

SEQ ID NO: 397858 - RNA, 22 nt, Human
caccagcacagggauacacaaa

SEQ ID NO: 397859 - RNA, 24 nt, Human
cacgccuguaaucccagcacuuug

SEQ ID NO: 397860 - RNA, 20 nt, Human
cagagcaacuggcacagggc

SEQ ID NO: 397861 - RNA, 20 nt, Human
cagagcaacuggcacagggc

SEQ ID NO: 397862 - RNA, 26 nt, Human
cagaggaugucccugauggcggacac

SEQ ID NO: 397863 - RNA, 23 nt, Human
caggaagaauugacauacaaaug

SEQ ID NO: 397864 - RNA, 26 nt, Human
caggcauuggugaagggggaggaggg

SEQ ID NO: 397865 - RNA, 23 nt, Human
caggguuuccccaggcaacuagg

SEQ ID NO: 397866 - RNA, 20 nt, Human
cauuggugaagggggaggag

SEQ ID NO: 397867 - RNA, 25 nt, Human
ccaccuccaauuucuggcuuccuca

SEQ ID NO: 397868 - RNA, 18 nt, Human
ccacuuccuaccaccucc

SEQ ID NO: 397869 - RNA, 23 nt, Human
ccacuuccuaccaccuccaauuu

SEQ ID NO: 397870 - RNA, 25 nt, Human
ccagcacuuuggggugaaucgaugu

SEQ ID NO: 397871 - RNA, 18 nt, Human
ccucauggccuucuuggg

SEQ ID NO: 397872 - RNA, 22 nt, Human
ccuguaaucccagcacuuuggg

SEQ ID NO: 397873 - RNA, 23 nt, Human
cgccuguaaucccagcacuuugg

SEQ ID NO: 397874 - RNA, 24 nt, Human
cuaaagaacaacaaaaacccaaac

SEQ ID NO: 397875 - RNA, 22 nt, Human
cuggcacagggcugcuuucucu

SEQ ID NO: 397876 - RNA, 24 nt, Human
gaacaacaaaaacccaaacaaaaa

SEQ ID NO: 397877 - RNA, 20 nt, Human
gaacgaggcaguguggcacc

SEQ ID NO: 397878 - RNA, 19 nt, Human
gaagaggaacagaguagug

SEQ ID NO: 397879 - RNA, 20 nt, Human
gacccagucuugaccucaug

SEQ ID NO: 397880 - RNA, 18 nt, Human
gagacccagucuugaccu

SEQ ID NO: 397881 - RNA, 23 nt, Human
gagcagccaucaggguaugagcu

SEQ ID NO: 397882 - RNA, 18 nt, Human
gaguccugcuggccauca

SEQ ID NO: 397883 - RNA, 24 nt, Human
gauggauaagaagagcaggaagaa

SEQ ID NO: 397884 - RNA, 19 nt, Human
gcagagccugugggggcug

SEQ ID NO: 397885 - RNA, 18 nt, Human
gcagcuggcaggcagcuc

SEQ ID NO: 397886 - RNA, 19 nt, Human
gccauguucuuuucccacc

SEQ ID NO: 397887 - RNA, 18 nt, Human
gcgugggggucaaaacua

SEQ ID NO: 397888 - RNA, 20 nt, Human
gcuucacgccuguaauccca

SEQ ID NO: 397889 - RNA, 21 nt, Human
gcuucacgccuguaaucccag

SEQ ID NO: 397890 - RNA, 22 nt, Human
ggaagacagaagugggugccag

SEQ ID NO: 397891 - RNA, 23 nt, Human
ggcguggugcuucacgccuguaa

SEQ ID NO: 397892 - RNA, 21 nt, Human
gggaggagggaggagacccag

SEQ ID NO: 397893 - RNA, 23 nt, Human
gggcccaguugcgaugagggcug

SEQ ID NO: 397894 - RNA, 19 nt, Human
ggggaguccgaggcccugc

SEQ ID NO: 397895 - RNA, 21 nt, Human
ggguaugagcucagcaugacc

SEQ ID NO: 397896 - RNA, 24 nt, Human
ggugcuucacgccuguaaucccag

SEQ ID NO: 397897 - RNA, 22 nt, Human
guaaaacacaaaaagcacaaag

SEQ ID NO: 397898 - RNA, 26 nt, Human
guaaagggaggagacuggagaaccca

SEQ ID NO: 397899 - RNA, 20 nt, Human
guccaaugaaaauacuaaca

SEQ ID NO: 397900 - RNA, 22 nt, Human
gugaacgaggcaguguggcacc

SEQ ID NO: 397901 - RNA, 20 nt, Human
guugcuuucuccugaugccc

SEQ ID NO: 397902 - RNA, 21 nt, Human
uaaaacacaaaaagcacaaag

SEQ ID NO: 397903 - RNA, 21 nt, Human
uaaaguaaagggaggagacug

SEQ ID NO: 397904 - RNA, 23 nt, Human
uaaauagaaaaaagaauuggauc

SEQ ID NO: 397905 - RNA, 23 nt, Human
uaacaggcuuuuuccuggaaccu

SEQ ID NO: 397906 - RNA, 22 nt, Human
uacugaaauacacuuaaagaca

SEQ ID NO: 397907 - RNA, 20 nt, Human
uaggaagaccauccauggug

SEQ ID NO: 397908 - RNA, 19 nt, Human
uaggcaggagaugaguccu

SEQ ID NO: 397909 - RNA, 23 nt, Human
ucacgccuguaaucccagcacuu

SEQ ID NO: 397910 - RNA, 24 nt, Human
ucaggcugggcguggugcuucacg

SEQ ID NO: 397911 - RNA, 23 nt, Human
ucaguaccacuuccuaccaccuc

SEQ ID NO: 397912 - RNA, 20 nt, Human
ucauugaucaguaccacuuc

SEQ ID NO: 397913 - RNA, 24 nt, Human
ucuccugugaaaggcuggcagagc

SEQ ID NO: 397914 - RNA, 21 nt, Human
ucucugggaagaggaacagag

SEQ ID NO: 397915 - RNA, 24 nt, Human
ugaaaagauagaaagcuuuacuga

SEQ ID NO: 397916 - RNA, 21 nt, Human
ugaauaaacaauuuauaugga

SEQ ID NO: 397917 - RNA, 22 nt, Human
ugaauaaacaauuuauauggaa

SEQ ID NO: 397918 - RNA, 18 nt, Human
ugaccucauggagcagcc

SEQ ID NO: 397919 - RNA, 23 nt, Human
ugacuaaagaacaacaaaaaccc

SEQ ID NO: 397920 - RNA, 21 nt, Human
ugaguaaaacacaaaaagcac

SEQ ID NO: 397921 - RNA, 18 nt, Human
ugauggcggacacucuuu

SEQ ID NO: 397922 - RNA, 24 nt, Human
ugcuucacgccuguaaucccagca

SEQ ID NO: 397923 - RNA, 18 nt, Human
ugcuuucuccugaugccc

SEQ ID NO: 397924 - RNA, 20 nt, Human
uggagcagagccuguggggg

SEQ ID NO: 397925 - RNA, 23 nt, Human
ugggugccaggcuuccuguccag

SEQ ID NO: 397926 - RNA, 24 nt, Human
uggugcuucacgccuguaauccca

SEQ ID NO: 397927 - RNA, 24 nt, Human
ugguggaucugcgcgcgggcccag

SEQ ID NO: 397928 - RNA, 24 nt, Human
uguaggggaggacuuccugaggag

SEQ ID NO: 397929 - RNA, 25 nt, Human
uguggagcagagccugugggggcug

SEQ ID NO: 397930 - RNA, 21 nt, Human
uuauauggaagaguaaaggaa

SEQ ID NO: 397931 - RNA, 19 nt, Human
uucaaaaucuacaaauucc

SEQ ID NO: 397932 - RNA, 22 nt, Human
uuccauguaaguccaaugaaaa

SEQ ID NO: 397933 - RNA, 22 nt, Human
uucuuuucccaccguagugaca

SEQ ID NO: 397934 - RNA, 23 nt, Human
uugacuaaagaacaacaaaaacc

SEQ ID NO: 397935 - RNA, 25 nt, Human
uugguggaucugcgcgcgggcccag

SEQ ID NO: 397936 - RNA, 22 nt, Human
uuuccuggaaccugaugguuga

SEQ ID NO: 397937 - RNA, 27 nt, Human
uuuccuggaaccugaugguugaauaaa

SEQ ID NO: 397938 - RNA, 20 nt, Human
uuuuuuuuuuuuuuuuuugg

SEQ ID NO: 397939 - RNA, 23 nt, Human
aagcggugaggcagagcgcuggg

SEQ ID NO: 397940 - RNA, 18 nt, Human
agcagcgguggauggugg

SEQ ID NO: 397941 - RNA, 19 nt, Human
aggcagagcgcugggcuag

SEQ ID NO: 397942 - RNA, 22 nt, Human
aggcagagcgcugggcuagggc

SEQ ID NO: 397943 - RNA, 21 nt, Human
agggaagcggugaggcagagc

SEQ ID NO: 397944 - RNA, 19 nt, Human
gagcagcgguggauggugg

SEQ ID NO: 397945 - RNA, 22 nt, Human
gagggaagcggugaggcagagc

SEQ ID NO: 397946 - RNA, 20 nt, Human
gccuuugugguuuuuuuguu

SEQ ID NO: 397947 - RNA, 18 nt, Human
uccccggguaccgagcuc

SEQ ID NO: 397948 - RNA, 22 nt, Human
uguggcgggcaggagggaagcg

SEQ ID NO: 397949 - RNA, 24 nt, Human
uguggcgggcaggagggaagcggu

SEQ ID NO: 397950 - RNA, 24 nt, Human
aaaaaaaaaaaaaaaagaaaagaa

SEQ ID NO: 397951 - RNA, 23 nt, Human
aaaaaaaaaagaaaagaaaagaa

SEQ ID NO: 397952 - RNA, 25 nt, Human
aaaaaaagaaaagaaaagaaaagaa

SEQ ID NO: 397953 - RNA, 21 nt, Human
aaaagaaauucagucacaccu

SEQ ID NO: 397954 - RNA, 20 nt, Human
aaaauauccccaaaucacac

SEQ ID NO: 397955 - RNA, 19 nt, Human
aaaauuacaaaaaucacaa

SEQ ID NO: 397956 - RNA, 18 nt, Human
aaagaacagaaaaccacc

SEQ ID NO: 397957 - RNA, 20 nt, Human
aaagaacagaccucaaaugc

SEQ ID NO: 397958 - RNA, 21 nt, Human
aaagcaaaauaucuuugaacc

SEQ ID NO: 397959 - RNA, 21 nt, Human
aaauaaacaucucccgagagc

SEQ ID NO: 397960 - RNA, 21 nt, Human
aacacauuucugaaaccacca

SEQ ID NO: 397961 - RNA, 25 nt, Human
aaccucuagccaauaccaacagucc

SEQ ID NO: 397962 - RNA, 22 nt, Human
aagaauuaagaacaugagggua

SEQ ID NO: 397963 - RNA, 19 nt, Human
aaggcugcagugagcugag

SEQ ID NO: 397964 - RNA, 23 nt, Human
aaggcugcagugagcugagguug

SEQ ID NO: 397965 - RNA, 21 nt, Human
aauacaaagguagccuuuaga

SEQ ID NO: 397966 - RNA, 20 nt, Human
aauaucuuugaaccucuagc

SEQ ID NO: 397967 - RNA, 18 nt, Human
aauucagucacaccuaau

SEQ ID NO: 397968 - RNA, 25 nt, Human
acaaaagccauaaaaacuuaguaac

SEQ ID NO: 397969 - RNA, 20 nt, Human
acaaacaugcaguguguagc

SEQ ID NO: 397970 - RNA, 25 nt, Human
acaaagcaaaauaucuuugaaccuc

SEQ ID NO: 397971 - RNA, 22 nt, Human
acacauuucugaaaccaccaaa

SEQ ID NO: 397972 - RNA, 22 nt, Human
acauggacuccucagcaucucu

SEQ ID NO: 397973 - RNA, 24 nt, Human
acgccuucugcccuuggucucacu

SEQ ID NO: 397974 - RNA, 25 nt, Human
acggcaaaagaaauucagucacacc

SEQ ID NO: 397975 - RNA, 19 nt, Human
acugcacuccugccuggac

SEQ ID NO: 397976 - RNA, 24 nt, Human
acugcacuccugccuggaccacag

SEQ ID NO: 397977 - RNA, 19 nt, Human
agaaaagaaaagaaaagaa

SEQ ID NO: 397978 - RNA, 21 nt, Human
agacggccacgaccugggagc

SEQ ID NO: 397979 - RNA, 18 nt, Human
agcaggugagggugggga

SEQ ID NO: 397980 - RNA, 19 nt, Human
agccaauaccaacaguccc

SEQ ID NO: 397981 - RNA, 27 nt, Human
agccaauaccaacagucccgucaauca

SEQ ID NO: 397982 - RNA, 19 nt, Human
agccagaaagaacagaaaa

SEQ ID NO: 397983 - RNA, 27 nt, Human
agccggcgccggcaacucagcggccac

SEQ ID NO: 397984 - RNA, 28 nt, Human
agggggagggaauucaacucggacaaaa

SEQ ID NO: 397985 - RNA, 21 nt, Human
aggguggggaggaccuggggg

SEQ ID NO: 397986 - RNA, 24 nt, Human
aggucaaggcugcagugagcugag

SEQ ID NO: 397987 - RNA, 24 nt, Human
auagccagaaagaacagaaaacca

SEQ ID NO: 397988 - RNA, 21 nt, Human
auggaaccagucucacaugcu

SEQ ID NO: 397989 - RNA, 29 nt, Human
augugugcauauuacuucaugcauagugu

SEQ ID NO: 397990 - RNA, 20 nt, Human
auuaguaaaaaaauacacuu

SEQ ID NO: 397991 - RNA, 19 nt, Human
auugcugcagaggucaaag

SEQ ID NO: 397992 - RNA, 27 nt, Human
caacagucccgucaaucacaaacaugc

SEQ ID NO: 397993 - RNA, 20 nt, Human
caacucggacaaaaguccgg

SEQ ID NO: 397994 - RNA, 19 nt, Human
cacccacucggccucccgc

SEQ ID NO: 397995 - RNA, 21 nt, Human
caccucccuccgagcgcgguc

SEQ ID NO: 397996 - RNA, 24 nt, Human
cacugcacuccugccuggaccaca

SEQ ID NO: 397997 - RNA, 19 nt, Human
cagaaagaacagaaaacca

SEQ ID NO: 397998 - RNA, 21 nt, Human
cagaaagaacagaaaaccacc

SEQ ID NO: 397999 - RNA, 21 nt, Human
cagcaaaguggccgcgcagag

SEQ ID NO: 398000 - RNA, 19 nt, Human
ccacugcacuccugccugg

SEQ ID NO: 398001 - RNA, 19 nt, Human
ccacugcacuccugccugg

SEQ ID NO: 398002 - RNA, 20 nt, Human
ccacugcacuccugccugga

SEQ ID NO: 398003 - RNA, 21 nt, Human
ccacugcacuccugccuggac

SEQ ID NO: 398004 - RNA, 21 nt, Human
ccagcaaaguggccgcgcaga

SEQ ID NO: 398005 - RNA, 19 nt, Human
ccauaaaaacuuaguaaca

SEQ ID NO: 398006 - RNA, 19 nt, Human
ccccagcaacucccacgcc

SEQ ID NO: 398007 - RNA, 22 nt, Human
cccgcuccucacgccacagccc

SEQ ID NO: 398008 - RNA, 27 nt, Human
cccgcuccucacgccacagcccaaaua

SEQ ID NO: 398009 - RNA, 23 nt, Human
cccguggccucccggcgucuccu

SEQ ID NO: 398010 - RNA, 19 nt, Human
cccugcacauggacuccuc

SEQ ID NO: 398011 - RNA, 27 nt, Human
cccuugucaaaaaaaaaaaaaaaagaa

SEQ ID NO: 398012 - RNA, 20 nt, Human
ccgcagcucuggcggacauc

SEQ ID NO: 398013 - RNA, 23 nt, Human
ccgcagcucuggcggacaucuug

SEQ ID NO: 398014 - RNA, 18 nt, Human
ccgcagcuuucgcagccc

SEQ ID NO: 398015 - RNA, 23 nt, Human
ccggggaggucaaggcugcagug

SEQ ID NO: 398016 - RNA, 19 nt, Human
ccggucgcccgcccgucag

SEQ ID NO: 398017 - RNA, 19 nt, Human
ccucucccugacugccucu

SEQ ID NO: 398018 - RNA, 19 nt, Human
ccucucccuuucccucccc

SEQ ID NO: 398019 - RNA, 18 nt, Human
ccugcccacuucuucagu

SEQ ID NO: 398020 - RNA, 22 nt, Human
ccuugucaaaaaaaaaaaaaaa

SEQ ID NO: 398021 - RNA, 24 nt, Human
cgccuucugcccuuggucucacuc

SEQ ID NO: 398022 - RNA, 20 nt, Human
cgcuggcccgcccgcuccuc

SEQ ID NO: 398023 - RNA, 24 nt, Human
cgcuggcccgcccgcuccucacgc

SEQ ID NO: 398024 - RNA, 22 nt, Human
cggggccuuuccugaaagucuu

SEQ ID NO: 398025 - RNA, 19 nt, Human
cgucagcagcacccguggc

SEQ ID NO: 398026 - RNA, 19 nt, Human
cuaaugauuaacagaaugu

SEQ ID NO: 398027 - RNA, 21 nt, Human
cuagccaauaccaacaguccc

SEQ ID NO: 398028 - RNA, 23 nt, Human
cucagcggccacgcaaaccugcc

SEQ ID NO: 398029 - RNA, 24 nt, Human
cucagcuaggcuuccugagcucug

SEQ ID NO: 398030 - RNA, 20 nt, Human
cuccccugcacauggacucc

SEQ ID NO: 398031 - RNA, 25 nt, Human
cugagguugcaccacugcacuccug

SEQ ID NO: 398032 - RNA, 24 nt, Human
cugcacauggacuccucagcaucu

SEQ ID NO: 398033 - RNA, 19 nt, Human
cugcagugagcugagguug

SEQ ID NO: 398034 - RNA, 22 nt, Human
cugcagugagcugagguugcac

SEQ ID NO: 398035 - RNA, 19 nt, Human
cuuguuuauguauaaaaaa

SEQ ID NO: 398036 - RNA, 18 nt, Human
gaacagccaagccuccca

SEQ ID NO: 398037 - RNA, 21 nt, Human
gaaccggcggccgccaaggaa

SEQ ID NO: 398038 - RNA, 24 nt, Human
gaccucaaaugcacccccauuuac

SEQ ID NO: 398039 - RNA, 19 nt, Human
gagcagcaggugagggugg

SEQ ID NO: 398040 - RNA, 22 nt, Human
gagcagcaggugagggugggga

SEQ ID NO: 398041 - RNA, 26 nt, Human
gagcagcaggugaggguggggaggac

SEQ ID NO: 398042 - RNA, 22 nt, Human
gagcgcggucacccacucggcc

SEQ ID NO: 398043 - RNA, 18 nt, Human
gaggaccuggggcccugc

SEQ ID NO: 398044 - RNA, 20 nt, Human
gaggcuccucggacccgaaa

SEQ ID NO: 398045 - RNA, 19 nt, Human
gagugguuccauuuagauu

SEQ ID NO: 398046 - RNA, 23 nt, Human
gccagaaagaacagaaaaccacc

SEQ ID NO: 398047 - RNA, 19 nt, Human
gccauaaaaacuuaguaac

SEQ ID NO: 398048 - RNA, 20 nt, Human
gcggucacccacucggccuc

SEQ ID NO: 398049 - RNA, 20 nt, Human
gcucuuggcggccgcagcuc

SEQ ID NO: 398050 - RNA, 20 nt, Human
gcugcgaggacgggcugggg

SEQ ID NO: 398051 - RNA, 20 nt, Human
ggacccgaaacuccgcggcg

SEQ ID NO: 398052 - RNA, 23 nt, Human
ggacggaagggcccggcccaggg

SEQ ID NO: 398053 - RNA, 26 nt, Human
ggcccggcccagggggagggaauuca

SEQ ID NO: 398054 - RNA, 21 nt, Human
gggaagcgcccgccccgcccg

SEQ ID NO: 398055 - RNA, 23 nt, Human
gggagcagcaggugagggugacg

SEQ ID NO: 398056 - RNA, 21 nt, Human
ggguggggaggaccuggggcc

SEQ ID NO: 398057 - RNA, 21 nt, Human
ggguggggaggaccuggggcc

SEQ ID NO: 398058 - RNA, 20 nt, Human
gguggggaggaccuggggcc

SEQ ID NO: 398059 - RNA, 23 nt, Human
gugggcuguggaugauggggggc

SEQ ID NO: 398060 - RNA, 24 nt, Human
guugcaccacugcacuccugccug

SEQ ID NO: 398061 - RNA, 22 nt, Human
uaaaaaaauacacuuuagggca

SEQ ID NO: 398062 - RNA, 23 nt, Human
uaaaaaagguaaaguuuauaaaa

SEQ ID NO: 398063 - RNA, 21 nt, Human
uaaaacaucaaaauuuucaaa

SEQ ID NO: 398064 - RNA, 22 nt, Human
uaacacauuucugaaaccacca

SEQ ID NO: 398065 - RNA, 18 nt, Human
uaacuucccgggaaccgg

SEQ ID NO: 398066 - RNA, 21 nt, Human
uaagcagugacgauaaaaaaa

SEQ ID NO: 398067 - RNA, 19 nt, Human
uacaaaaaucacaaagcaa

SEQ ID NO: 398068 - RNA, 21 nt, Human
uacaguaucuagauaaugcac

SEQ ID NO: 398069 - RNA, 18 nt, Human
uaccaacagucccgucaa

SEQ ID NO: 398070 - RNA, 23 nt, Human
uagaaacgcugcuuuauugcugc

SEQ ID NO: 398071 - RNA, 18 nt, Human
uaguaaaaaaauacacuu

SEQ ID NO: 398072 - RNA, 22 nt, Human
ucaaaaaaaaaaaaaaaagaaa

SEQ ID NO: 398073 - RNA, 21 nt, Human
ucacaccuaaugauuaacaga

SEQ ID NO: 398074 - RNA, 25 nt, Human
ucccccaguuguaaaucuccuugcu

SEQ ID NO: 398075 - RNA, 18 nt, Human
uccuccagccgcugaaca

SEQ ID NO: 398076 - RNA, 24 nt, Human
ucgcccgcccgucagcagcacccg

SEQ ID NO: 398077 - RNA, 19 nt, Human
ucgcuugagcccggggagg

SEQ ID NO: 398078 - RNA, 23 nt, Human
ucuagccaauaccaacagucccg

SEQ ID NO: 398079 - RNA, 20 nt, Human
ucuccagcgccgcgcgaggc

SEQ ID NO: 398080 - RNA, 20 nt, Human
ucugaagaggccauggaacc

SEQ ID NO: 398081 - RNA, 20 nt, Human
ucuuugaaccucuagccaau

SEQ ID NO: 398082 - RNA, 21 nt, Human
ugaaaccaccaaaugcacaac

SEQ ID NO: 398083 - RNA, 21 nt, Human
ugaaccucuagccaauaccaa

SEQ ID NO: 398084 - RNA, 27 nt, Human
ugaaccucuagccaauaccaacagucc

SEQ ID NO: 398085 - RNA, 23 nt, Human
ugacugccucucccuuucccucc

SEQ ID NO: 398086 - RNA, 25 nt, Human
ugagcccggggaggucaaggcugca

SEQ ID NO: 398087 - RNA, 19 nt, Human
ugagcuaagaauuaagaac

SEQ ID NO: 398088 - RNA, 21 nt, Human
ugagcugagguugcaccacug

SEQ ID NO: 398089 - RNA, 22 nt, Human
ugagcugagguugcaccacugc

SEQ ID NO: 398090 - RNA, 22 nt, Human
ugaggguaaggcauuucugcug

SEQ ID NO: 398091 - RNA, 20 nt, Human
ugcagcacuuaaaaauguaa

SEQ ID NO: 398092 - RNA, 20 nt, Human
ugccccagcaacucccacgc

SEQ ID NO: 398093 - RNA, 24 nt, Human
ugcccuuggucucacucuaagccc

SEQ ID NO: 398094 - RNA, 22 nt, Human
ugccggcccggcccacugagca

SEQ ID NO: 398095 - RNA, 24 nt, Human
ugcucacucaucuuuaucaguuca

SEQ ID NO: 398096 - RNA, 22 nt, Human
uggaaagaacagaccucaaaug

SEQ ID NO: 398097 - RNA, 21 nt, Human
uggaagagcaagacggccacg

SEQ ID NO: 398098 - RNA, 19 nt, Human
uggccucccggcgucuccu

SEQ ID NO: 398099 - RNA, 18 nt, Human
uggcucagccggcgccgg

SEQ ID NO: 398100 - RNA, 18 nt, Human
uggggaggaccuggggcc

SEQ ID NO: 398101 - RNA, 24 nt, Human
ugggugggcuguggaugauggggg

SEQ ID NO: 398102 - RNA, 22 nt, Human
ugguaugcacgcauuauguaca

SEQ ID NO: 398103 - RNA, 19 nt, Human
uguaaaucuccuugcugua

SEQ ID NO: 398104 - RNA, 20 nt, Human
ugucaaaaaaaaaaaaaaaa

SEQ ID NO: 398105 - RNA, 21 nt, Human
uguccuucccuggcugcccca

SEQ ID NO: 398106 - RNA, 23 nt, Human
ugucuucacuucacccuccccca

SEQ ID NO: 398107 - RNA, 18 nt, Human
uguguuuucauguacagu

SEQ ID NO: 398108 - RNA, 23 nt, Human
uuaaucaaacuagagaauucuga

SEQ ID NO: 398109 - RNA, 21 nt, Human
uucgccacguaacuucccggg

SEQ ID NO: 398110 - RNA, 19 nt, Human
uuuggaaagaacagaccuc

SEQ ID NO: 398111 - RNA, 21 nt, Human
aaacaagagggcgugaaucca

SEQ ID NO: 398112 - RNA, 21 nt, Human
aaacaagagggcgugaauccg

SEQ ID NO: 398113 - RNA, 25 nt, Human
aggagggagcaugcggcaggugggg

SEQ ID NO: 398114 - RNA, 19 nt, Human
aggcucaaaggugcuggca

SEQ ID NO: 398115 - RNA, 20 nt, Human
agggagcaugcggcaggugg

SEQ ID NO: 398116 - RNA, 22 nt, Human
agggcgugaauccaggccaucc

SEQ ID NO: 398117 - RNA, 23 nt, Human
agguaggaagggcuuugagccca

SEQ ID NO: 398118 - RNA, 18 nt, Human
cagagaggccuaagccuc

SEQ ID NO: 398119 - RNA, 21 nt, Human
cagcguggggcucugucccuc

SEQ ID NO: 398120 - RNA, 20 nt, Human
caguggguaggagaggaggg

SEQ ID NO: 398121 - RNA, 25 nt, Human
caguggguaggagaggagggagcau

SEQ ID NO: 398122 - RNA, 20 nt, Human
cauccucaggggaggguggg

SEQ ID NO: 398123 - RNA, 18 nt, Human
ccaaggcucaaaggugcu

SEQ ID NO: 398124 - RNA, 20 nt, Human
ccaccaagcggggccagcuc

SEQ ID NO: 398125 - RNA, 19 nt, Human
ccagcagcugagagggaag

SEQ ID NO: 398126 - RNA, 18 nt, Human
ccagcuccagccugggcg

SEQ ID NO: 398127 - RNA, 19 nt, Human
ccucccgacuuccuccugg

SEQ ID NO: 398128 - RNA, 23 nt, Human
ccuccgggaaguucacgaacccg

SEQ ID NO: 398129 - RNA, 18 nt, Human
ccuguggaaaccaucacc

SEQ ID NO: 398130 - RNA, 20 nt, Human
cgaacccgaguacucuccaa

SEQ ID NO: 398131 - RNA, 24 nt, Human
cuuggugaaagaugcuguuguucc

SEQ ID NO: 398132 - RNA, 18 nt, Human
gaacccgaguacucucca

SEQ ID NO: 398133 - RNA, 23 nt, Human
gaccaguggguaggagaggaggg

SEQ ID NO: 398134 - RNA, 19 nt, Human
gacccugcccucuccacac

SEQ ID NO: 398135 - RNA, 22 nt, Human
gagcaugcggcagguggggcag

SEQ ID NO: 398136 - RNA, 21 nt, Human
gagggugggagcccaucccag

SEQ ID NO: 398137 - RNA, 18 nt, Human
gccagcuccagccugggc

SEQ ID NO: 398138 - RNA, 20 nt, Human
gcuccagccugggcgaucgu

SEQ ID NO: 398139 - RNA, 20 nt, Human
ggccaaggcucaaaggugcu

SEQ ID NO: 398140 - RNA, 18 nt, Human
guggggcagccacacaaa

SEQ ID NO: 398141 - RNA, 21 nt, Human
guggggcagccacacaaagga

SEQ ID NO: 398142 - RNA, 19 nt, Human
guuccuguggaaaccauca

SEQ ID NO: 398143 - RNA, 22 nt, Human
uaagccccugggauccaagucc

SEQ ID NO: 398144 - RNA, 19 nt, Human
ucaaaggugcuggcacagg

SEQ ID NO: 398145 - RNA, 23 nt, Human
ucacccuccacgccucccgacuu

SEQ ID NO: 398146 - RNA, 19 nt, Human
uccacgccucccgacuucc

SEQ ID NO: 398147 - RNA, 26 nt, Human
ucccaggccaccaagcggggccagcu

SEQ ID NO: 398148 - RNA, 19 nt, Human
ucccagggagaacagaaac

SEQ ID NO: 398149 - RNA, 19 nt, Human
ucccucaccccaaggagag

SEQ ID NO: 398150 - RNA, 24 nt, Human
ugaagagauaagccccugggaucc

SEQ ID NO: 398151 - RNA, 19 nt, Human
ugagcccaaaaggaaacaa

SEQ ID NO: 398152 - RNA, 22 nt, Human
ugcagggcagcguccaguaggc

SEQ ID NO: 398153 - RNA, 21 nt, Human
uggcaggaagggagcgggcgg

SEQ ID NO: 398154 - RNA, 22 nt, Human
uggguaggagaggagggagcau

SEQ ID NO: 398155 - RNA, 21 nt, Human
aaagagacaugagagccucca

SEQ ID NO: 398156 - RNA, 23 nt, Human
aacaggugcucuccccuaagggc

SEQ ID NO: 398157 - RNA, 19 nt, Human
aagaggcagggcggugggg

SEQ ID NO: 398158 - RNA, 21 nt, Human
aaggagacugagcacccuuca

SEQ ID NO: 398159 - RNA, 23 nt, Human
accaaaagcgacuucccugacau

SEQ ID NO: 398160 - RNA, 20 nt, Human
agagacgcaugacaaagaca

SEQ ID NO: 398161 - RNA, 18 nt, Human
aggaggaggcagcccagg

SEQ ID NO: 398162 - RNA, 22 nt, Human
aggaggaggcagcccagggcaa

SEQ ID NO: 398163 - RNA, 21 nt, Human
aggcagggcgguggggaacag

SEQ ID NO: 398164 - RNA, 26 nt, Human
aggcugugugaccucuggggagcccc

SEQ ID NO: 398165 - RNA, 22 nt, Human
agucuagaaaugcugacuguug

SEQ ID NO: 398166 - RNA, 23 nt, Human
augacaaagacacuagcaaagga

SEQ ID NO: 398167 - RNA, 25 nt, Human
augacaaagacacuagcaaaggaga

SEQ ID NO: 398168 - RNA, 19 nt, Human
augcagcauaauuuugugg

SEQ ID NO: 398169 - RNA, 25 nt, Human
auggaguuggcagcaguucaagcag

SEQ ID NO: 398170 - RNA, 22 nt, Human
caaagacacuagcaaaggagau

SEQ ID NO: 398171 - RNA, 20 nt, Human
caaagggcuuggcaaaccca

SEQ ID NO: 398172 - RNA, 18 nt, Human
caaaucccaacuuuccag

SEQ ID NO: 398173 - RNA, 24 nt, Human
caaaucccaacuuuccagacuauc

SEQ ID NO: 398174 - RNA, 20 nt, Human
caaauuccucaccugggaua

SEQ ID NO: 398175 - RNA, 19 nt, Human
cacacugccagcucucccc

SEQ ID NO: 398176 - RNA, 22 nt, Human
cacacugccagcucuccccaaa

SEQ ID NO: 398177 - RNA, 20 nt, Human
cacugcacacaggcugugug

SEQ ID NO: 398178 - RNA, 18 nt, Human
cagacacaaagcccuccu

SEQ ID NO: 398179 - RNA, 18 nt, Human
cagcaggcauuuuucaga

SEQ ID NO: 398180 - RNA, 24 nt, Human
cagcaguucaagcaggaccuuaau

SEQ ID NO: 398181 - RNA, 18 nt, Human
cagcccagggcaagggaa

SEQ ID NO: 398182 - RNA, 22 nt, Human
caugacaaagacacuagcaaag

SEQ ID NO: 398183 - RNA, 20 nt, Human
ccaaaagcgacuucccugac

SEQ ID NO: 398184 - RNA, 22 nt, Human
ccagagacgcaugacaaagaca

SEQ ID NO: 398185 - RNA, 18 nt, Human
ccagggcuggcugccccu

SEQ ID NO: 398186 - RNA, 23 nt, Human
cccaacuuuccagacuaucccca

SEQ ID NO: 398187 - RNA, 21 nt, Human
ccccucaaccuuucugagcuu

SEQ ID NO: 398188 - RNA, 26 nt, Human
ccccuugccccagcuuggcucugggc

SEQ ID NO: 398189 - RNA, 22 nt, Human
ccgcacacugccagcucucccc

SEQ ID NO: 398190 - RNA, 21 nt, Human
ccucuggggagccccucaacu

SEQ ID NO: 398191 - RNA, 18 nt, Human
ccuugccccagcuuggcu

SEQ ID NO: 398192 - RNA, 19 nt, Human
cggaagaggcagggcggug

SEQ ID NO: 398193 - RNA, 24 nt, Human
cgguggggaacagcucucaggagg

SEQ ID NO: 398194 - RNA, 21 nt, Human
cucaaccuuucugagcuucaa

SEQ ID NO: 398195 - RNA, 20 nt, Human
cuccgcacacugccagcucu

SEQ ID NO: 398196 - RNA, 23 nt, Human
cucuccccaaagagacaugagag

SEQ ID NO: 398197 - RNA, 19 nt, Human
cucuccccuaagggcuuca

SEQ ID NO: 398198 - RNA, 20 nt, Human
cuuucuuucucuuguuuucu

SEQ ID NO: 398199 - RNA, 18 nt, Human
gagcacccuucaggagcc

SEQ ID NO: 398200 - RNA, 22 nt, Human
gaguuggcagcaguucaagcag

SEQ ID NO: 398201 - RNA, 23 nt, Human
gaguuggcagcaguucaagcagg

SEQ ID NO: 398202 - RNA, 20 nt, Human
gauugcucccaauagcuaac

SEQ ID NO: 398203 - RNA, 19 nt, Human
gcagcccagggcaagggaa

SEQ ID NO: 398204 - RNA, 21 nt, Human
gcgaacagcaaagggcuuggc

SEQ ID NO: 398205 - RNA, 20 nt, Human
ggacacagacaguacgggag

SEQ ID NO: 398206 - RNA, 24 nt, Human
ggccacagacuuucaguaauucca

SEQ ID NO: 398207 - RNA, 24 nt, Human
ggccagagacgcaugacaaagaca

SEQ ID NO: 398208 - RNA, 19 nt, Human
gggaacugcucaauauugg

SEQ ID NO: 398209 - RNA, 24 nt, Human
gggaaugugagggcugcgaacagc

SEQ ID NO: 398210 - RNA, 21 nt, Human
gucuagaaaugcugacugucc

SEQ ID NO: 398211 - RNA, 18 nt, Human
guuuucugcuugauccaa

SEQ ID NO: 398212 - RNA, 21 nt, Human
guuuucugcuugauccaaggg

SEQ ID NO: 398213 - RNA, 21 nt, Human
uaagguauuuucugagccaaa

SEQ ID NO: 398214 - RNA, 26 nt, Human
uaccucggccuccuaaugaaggcuga

SEQ ID NO: 398215 - RNA, 22 nt, Human
uauacaaggacacagacaguac

SEQ ID NO: 398216 - RNA, 19 nt, Human
ucaaaaagacuuaaggcca

SEQ ID NO: 398217 - RNA, 19 nt, Human
ucaauguccacaugaagau

SEQ ID NO: 398218 - RNA, 23 nt, Human
ucaccugggauauaagacuccua

SEQ ID NO: 398219 - RNA, 20 nt, Human
ucaggcacacaacaggugcu

SEQ ID NO: 398220 - RNA, 23 nt, Human
uccccuaagggcuucaugagagc

SEQ ID NO: 398221 - RNA, 24 nt, Human
ucucaggaggaggcagcccagggc

SEQ ID NO: 398222 - RNA, 24 nt, Human
ucuccccuaagggcuucaugagag

SEQ ID NO: 398223 - RNA, 19 nt, Human
ucucuuguuuucugcuuga

SEQ ID NO: 398224 - RNA, 21 nt, Human
ugaaauaacacuucaaaaaga

SEQ ID NO: 398225 - RNA, 20 nt, Human
ugacauggaguuggcagcag

SEQ ID NO: 398226 - RNA, 22 nt, Human
ugacauggaguuggcagcaguu

SEQ ID NO: 398227 - RNA, 19 nt, Human
ugaccucuggggagccccu

SEQ ID NO: 398228 - RNA, 19 nt, Human
ugagagcgacucagcagca

SEQ ID NO: 398229 - RNA, 21 nt, Human
ugagggcugcgaacagcaaag

SEQ ID NO: 398230 - RNA, 20 nt, Human
uggaagccagggcuggcugc

SEQ ID NO: 398231 - RNA, 19 nt, Human
uggcucgaggcauuucccu

SEQ ID NO: 398232 - RNA, 25 nt, Human
ugugaccucuggggagccccucaac

SEQ ID NO: 398233 - RNA, 22 nt, Human
uucaagcaggaccuuaaucacc

SEQ ID NO: 398234 - RNA, 24 nt, Human
uuuccagauugcucccaauagcua

SEQ ID NO: 398235 - RNA, 22 nt, Human
uuuuuuuuuuuuuuuaaugcuu

SEQ ID NO: 398236 - RNA, 24 nt, Human
uuuuuuuuuuuuuuuuuuuuaaug

SEQ ID NO: 398237 - RNA, 24 nt, Human
agaaucucaggaauguauagaccc

SEQ ID NO: 398238 - RNA, 21 nt, Human
caaaacauauauuuaccccuc

SEQ ID NO: 398239 - RNA, 23 nt, Human
ccgccccacacuucauacccgcc

SEQ ID NO: 398240 - RNA, 19 nt, Human
gacccccgccccacacuuc

SEQ ID NO: 398241 - RNA, 25 nt, Human
ucaaaacauauauuuaccccuccuc

SEQ ID NO: 398242 - RNA, 21 nt, Human
ucuuugagcaccuuucccaga

SEQ ID NO: 398243 - RNA, 22 nt, Human
ugagcaccuuucccagaaucuc

SEQ ID NO: 398244 - RNA, 24 nt, Human
uuucauuuuucucaaaacauauau

SEQ ID NO: 398245 - RNA, 24 nt, Human
uuuuuuuuuuuuuuuuucauuuuu

SEQ ID NO: 398246 - RNA, 22 nt, Human
aaaagaccaaggcuaacagcua

SEQ ID NO: 398247 - RNA, 18 nt, Human
aaacuauuaccucuacca

SEQ ID NO: 398248 - RNA, 20 nt, Human
aagaacugcuacaugaugua

SEQ ID NO: 398249 - RNA, 18 nt, Human
aagaggccaaaagaccaa

SEQ ID NO: 398250 - RNA, 21 nt, Human
aagaggccaaaagaccaaggc

SEQ ID NO: 398251 - RNA, 23 nt, Human
aagaggccaaaagaccaaggcua

SEQ ID NO: 398252 - RNA, 24 nt, Human
aagcagcacaggacauccuaacaa

SEQ ID NO: 398253 - RNA, 27 nt, Human
aagcagcacaggacauccuaacaagcu

SEQ ID NO: 398254 - RNA, 20 nt, Human
aauuccagggcagcugcagg

SEQ ID NO: 398255 - RNA, 20 nt, Human
acacgaccucggcacauggu

SEQ ID NO: 398256 - RNA, 22 nt, Human
acgaaggaaacacuucggaaga

SEQ ID NO: 398257 - RNA, 18 nt, Human
agcgaagggaauuccagg

SEQ ID NO: 398258 - RNA, 24 nt, Human
aggugguuguuuuguuaccuauuu

SEQ ID NO: 398259 - RNA, 23 nt, Human
augaaggaaauacauugaaaaaa

SEQ ID NO: 398260 - RNA, 23 nt, Human
caaaagaccaaggcuaacagcua

SEQ ID NO: 398261 - RNA, 26 nt, Human
cacacagaaucccaaggugggaacag

SEQ ID NO: 398262 - RNA, 18 nt, Human
cacagaaucccaaggugg

SEQ ID NO: 398263 - RNA, 20 nt, Human
cacagaaucccaagguggga

SEQ ID NO: 398264 - RNA, 20 nt, Human
cagaaucccaaggugggaag

SEQ ID NO: 398265 - RNA, 21 nt, Human
cagcacaggacauccuaacaa

SEQ ID NO: 398266 - RNA, 18 nt, Human
cagcaguaggcgucaugg

SEQ ID NO: 398267 - RNA, 19 nt, Human
cagcaguaggcgucauggu

SEQ ID NO: 398268 - RNA, 21 nt, Human
caggugguuguuuuguuaccu

SEQ ID NO: 398269 - RNA, 24 nt, Human
caggugguuguuuuguuaccuauu

SEQ ID NO: 398270 - RNA, 22 nt, Human
caggugguuguuuuguuaccuc

SEQ ID NO: 398271 - RNA, 20 nt, Human
ccuagcacacgaccucggcc

SEQ ID NO: 398272 - RNA, 22 nt, Human
cuaggcuacuggaaucuauacu

SEQ ID NO: 398273 - RNA, 21 nt, Human
cuuccuagcacacgaccucgg

SEQ ID NO: 398274 - RNA, 22 nt, Human
cuugcauaugcagugacaguuu

SEQ ID NO: 398275 - RNA, 20 nt, Human
gaaggaaacacuucggaaga

SEQ ID NO: 398276 - RNA, 21 nt, Human
gaaggaaauacauugaaaaaa

SEQ ID NO: 398277 - RNA, 18 nt, Human
gccaaaagaccaaggcua

SEQ ID NO: 398278 - RNA, 26 nt, Human
ggagaugaaggcaaacagcgaaggga

SEQ ID NO: 398279 - RNA, 18 nt, Human
ggagggagaugaaggcaa

SEQ ID NO: 398280 - RNA, 22 nt, Human
gggcagcugcaggugggauggc

SEQ ID NO: 398281 - RNA, 20 nt, Human
guacaguguggaggcucuca

SEQ ID NO: 398282 - RNA, 23 nt, Human
guggcugaaagacagacaugaca

SEQ ID NO: 398283 - RNA, 22 nt, Human
uaacaagcuuucgcugcugccu

SEQ ID NO: 398284 - RNA, 18 nt, Human
uaccacuuaucuauaguc

SEQ ID NO: 398285 - RNA, 18 nt, Human
uaccucuaccaguuauuc

SEQ ID NO: 398286 - RNA, 22 nt, Human
uagcacacgaccucggcacaug

SEQ ID NO: 398287 - RNA, 25 nt, Human
ucacagcaacuggcuuccuagcaca

SEQ ID NO: 398288 - RNA, 21 nt, Human
ucagaagaacugcuacaugau

SEQ ID NO: 398289 - RNA, 22 nt, Human
ucagaagaacugcuacaugaug

SEQ ID NO: 398290 - RNA, 20 nt, Human
ucggcacauggucuccucau

SEQ ID NO: 398291 - RNA, 21 nt, Human
ugaaaaaacuauuaccucuac

SEQ ID NO: 398292 - RNA, 22 nt, Human
ugaaagacagacaugacacugg

SEQ ID NO: 398293 - RNA, 23 nt, Human
ugaaggaaauacauugaaaaaac

SEQ ID NO: 398294 - RNA, 21 nt, Human
ugacagccucucaaacgugga

SEQ ID NO: 398295 - RNA, 24 nt, Human
ugcagugacaguuuaaaggguaag

SEQ ID NO: 398296 - RNA, 18 nt, Human
uggaacaaacauaaacac

SEQ ID NO: 398297 - RNA, 20 nt, Human
uggaaucuauacuucaaucc

SEQ ID NO: 398298 - RNA, 23 nt, Human
uggcugaaagacagacaugacac

SEQ ID NO: 398299 - RNA, 21 nt, Human
uggcuuccuagcacacgaccu

SEQ ID NO: 398300 - RNA, 25 nt, Human
uuaaaugaugguuuuggaacaaaca

SEQ ID NO: 398301 - RNA, 19 nt, Human
uugauuaccucuaccacuu

SEQ ID NO: 398302 - RNA, 28 nt, Human
aaaaaaacauuucacaagaugcaaaacc

SEQ ID NO: 398303 - RNA, 24 nt, Human
aaauauauuuacaauuuauacaaa

SEQ ID NO: 398304 - RNA, 20 nt, Human
aaauucgaaacauuuuggcc

SEQ ID NO: 398305 - RNA, 18 nt, Human
acagaaagguaaucucac

SEQ ID NO: 398306 - RNA, 19 nt, Human
acugcaaggaacagaaagg

SEQ ID NO: 398307 - RNA, 18 nt, Human
agacaggugacuuucugc

SEQ ID NO: 398308 - RNA, 23 nt, Human
agcgcgcuggccacgcacgcgcg

SEQ ID NO: 398309 - RNA, 18 nt, Human
aggcgggggcgcggugac

SEQ ID NO: 398310 - RNA, 22 nt, Human
caacccccggccucagcugccc

SEQ ID NO: 398311 - RNA, 21 nt, Human
cagcugcccgggcggggagga

SEQ ID NO: 398312 - RNA, 21 nt, Human
cagguguuuguaauuuuuuuu

SEQ ID NO: 398313 - RNA, 23 nt, Human
cccccggccucagcugcccgggc

SEQ ID NO: 398314 - RNA, 18 nt, Human
ccccggccucagcugccc

SEQ ID NO: 398315 - RNA, 20 nt, Human
cccgcagcugcuccggcucc

SEQ ID NO: 398316 - RNA, 24 nt, Human
cccgcagcugcuccggcucccgcu

SEQ ID NO: 398317 - RNA, 20 nt, Human
ccuacaacccauggccccuc

SEQ ID NO: 398318 - RNA, 23 nt, Human
cgcacuccccucggcgauccgcg

SEQ ID NO: 398319 - RNA, 22 nt, Human
cgcuuggccuuggugcuccauu

SEQ ID NO: 398320 - RNA, 21 nt, Human
cggucaauuuccaacuuuaau

SEQ ID NO: 398321 - RNA, 19 nt, Human
cuccggucaauuuccaacu

SEQ ID NO: 398322 - RNA, 24 nt, Human
cuguccgcuuggccuuggugcucc

SEQ ID NO: 398323 - RNA, 24 nt, Human
cuuggccuuggugcuccauuuggu

SEQ ID NO: 398324 - RNA, 19 nt, Human
gacuccgaccgcacucccc

SEQ ID NO: 398325 - RNA, 18 nt, Human
gagacaccacugcucuac

SEQ ID NO: 398326 - RNA, 20 nt, Human
gcaccggccacucggcgccc

SEQ ID NO: 398327 - RNA, 20 nt, Human
gccacauuagugggcgcccc

SEQ ID NO: 398328 - RNA, 23 nt, Human
gcccagcugcuucaagaaccugc

SEQ ID NO: 398329 - RNA, 19 nt, Human
gccccaggcccagcugcuu

SEQ ID NO: 398330 - RNA, 18 nt, Human
gcccgggcggggaggcgg

SEQ ID NO: 398331 - RNA, 23 nt, Human
gcccgggcggggaggcgggggcg

SEQ ID NO: 398332 - RNA, 18 nt, Human
ggaaagccaagcagaagc

SEQ ID NO: 398333 - RNA, 21 nt, Human
gggcaaacaaauccagacgga

SEQ ID NO: 398334 - RNA, 20 nt, Human
gggcgccccaggcccagcug

SEQ ID NO: 398335 - RNA, 23 nt, Human
gguguuuguaauuuuuuuucucu

SEQ ID NO: 398336 - RNA, 28 nt, Human
guacuaaagccuuuacuguaauaaacca

SEQ ID NO: 398337 - RNA, 22 nt, Human
gucgccuccucuuuguagacuc

SEQ ID NO: 398338 - RNA, 18 nt, Human
uaagccggaaagccaagc

SEQ ID NO: 398339 - RNA, 18 nt, Human
uacaaaggacggaaagug

SEQ ID NO: 398340 - RNA, 19 nt, Human
uacaacccauggccccucu

SEQ ID NO: 398341 - RNA, 25 nt, Human
uacaacccauggccccucuguccgc

SEQ ID NO: 398342 - RNA, 18 nt, Human
uagugggcgccccaggcc

SEQ ID NO: 398343 - RNA, 19 nt, Human
ucauuggagacaccacugc

SEQ ID NO: 398344 - RNA, 21 nt, Human
uccccagaucacccagaaaga

SEQ ID NO: 398345 - RNA, 18 nt, Human
uccgcgugcgcggcgcca

SEQ ID NO: 398346 - RNA, 19 nt, Human
ucgaaacauuuuggcccaa

SEQ ID NO: 398347 - RNA, 21 nt, Human
ucggugcgggcuccggcccuc

SEQ ID NO: 398348 - RNA, 23 nt, Human
ucggugcgggcuccggcccucag

SEQ ID NO: 398349 - RNA, 24 nt, Human
ucucacacuugggcaaggcgugau

SEQ ID NO: 398350 - RNA, 23 nt, Human
ucuguccgcuuggccuuggugcu

SEQ ID NO: 398351 - RNA, 21 nt, Human
ugcccgggcggggaggcgggg

SEQ ID NO: 398352 - RNA, 24 nt, Human
uuccccggcaacucaauucuccgg

SEQ ID NO: 398353 - RNA, 21 nt, Human
uuuccaacuuuaaucccgccg

SEQ ID NO: 398354 - RNA, 19 nt, Human
agaaagagggaggagagag

SEQ ID NO: 398355 - RNA, 23 nt, Human
agagugggggaggcugaaguggg

SEQ ID NO: 398356 - RNA, 24 nt, Human
aggcagggcugggaggcggcugcu

SEQ ID NO: 398357 - RNA, 19 nt, Human
cccacaugcagcaggggaa

SEQ ID NO: 398358 - RNA, 21 nt, Human
cccacaugcagcaggggaagg

SEQ ID NO: 398359 - RNA, 20 nt, Human
cccccaggcgccaccagagc

SEQ ID NO: 398360 - RNA, 21 nt, Human
cccccaggcgccaccagagcu

SEQ ID NO: 398361 - RNA, 23 nt, Human
cccccaggcgccaccagagcuuu

SEQ ID NO: 398362 - RNA, 18 nt, Human
cccugcccaucggccccc

SEQ ID NO: 398363 - RNA, 19 nt, Human
ccgaaaagccccccaggcg

SEQ ID NO: 398364 - RNA, 21 nt, Human
cgauccgaaaagccccccagg

SEQ ID NO: 398365 - RNA, 19 nt, Human
cugaagugggguggugggg

SEQ ID NO: 398366 - RNA, 22 nt, Human
gaagaaagagggaggagagagc

SEQ ID NO: 398367 - RNA, 18 nt, Human
gacuucggguacaggaag

SEQ ID NO: 398368 - RNA, 19 nt, Human
gggaggcugaaguggggug

SEQ ID NO: 398369 - RNA, 25 nt, Human
ggggugguggggaggcugcccgaag

SEQ ID NO: 398370 - RNA, 25 nt, Human
ggugugaagccguuggccagagagc

SEQ ID NO: 398371 - RNA, 21 nt, Human
gucuggacuucggguacagga

SEQ ID NO: 398372 - RNA, 21 nt, Human
uccaccgagguccccugccca

SEQ ID NO: 398373 - RNA, 24 nt, Human
ucggcccccacaugcagcagggga

SEQ ID NO: 398374 - RNA, 18 nt, Human
uggccagagagcagaugg

SEQ ID NO: 398375 - RNA, 20 nt, Human
uggcugcugauuccccuggg

SEQ ID NO: 398376 - RNA, 23 nt, Human
ugggagucuggacuucggguaca

SEQ ID NO: 398377 - RNA, 20 nt, Human
ugggggaggcugaagugggg

SEQ ID NO: 398378 - RNA, 25 nt, Human
ugggggaggcugaagugggguggug

SEQ ID NO: 398379 - RNA, 19 nt, Human
uggggugguggggaggcug

SEQ ID NO: 398380 - RNA, 20 nt, Human
uggggugguggggaggcugc

SEQ ID NO: 398381 - RNA, 18 nt, Human
uguccuggcugcugauuc

SEQ ID NO: 398382 - RNA, 22 nt, Human
ugugaagccguuggccagagag

SEQ ID NO: 398383 - RNA, 19 nt, Human
uucggguacaggaaggggg

SEQ ID NO: 398384 - RNA, 19 nt, Human
uuuuuuuuuuuuuugcgga

SEQ ID NO: 398385 - RNA, 21 nt, Human
uuuuuuuuuuuuuuuuugcgg

SEQ ID NO: 398386 - RNA, 23 nt, Human
uuuuuuuuuuuuuuuuugcggau

SEQ ID NO: 398387 - RNA, 22 nt, Human
uuuuuuuuuuuuuuuuuugcgg

SEQ ID NO: 398388 - RNA, 19 nt, Human
aaaaauaugucuucucucc

SEQ ID NO: 398389 - RNA, 20 nt, Human
aaacugaaagaauacaccca

SEQ ID NO: 398390 - RNA, 27 nt, Human
aaauauccuuguaaugcugaugagggu

SEQ ID NO: 398391 - RNA, 24 nt, Human
aaaucacccucagaagacucccau

SEQ ID NO: 398392 - RNA, 18 nt, Human
aaaugcuaccagccauag

SEQ ID NO: 398393 - RNA, 25 nt, Human
aagaauccugcucacaccucuucgg

SEQ ID NO: 398394 - RNA, 23 nt, Human
aaggugcuauuucaaauggaauu

SEQ ID NO: 398395 - RNA, 23 nt, Human
acacauacacauggaaaguacaa

SEQ ID NO: 398396 - RNA, 21 nt, Human
agaauccugcucacaccucuu

SEQ ID NO: 398397 - RNA, 18 nt, Human
agacuuaaagaacugaug

SEQ ID NO: 398398 - RNA, 20 nt, Human
aggaagggacgggacccaga

SEQ ID NO: 398399 - RNA, 21 nt, Human
aggaagggacgggacccagaa

SEQ ID NO: 398400 - RNA, 18 nt, Human
aguaaucuauauugacau

SEQ ID NO: 398401 - RNA, 22 nt, Human
auagaguuucucuaaaggaaag

SEQ ID NO: 398402 - RNA, 21 nt, Human
aucccaguuuccaaacaccag

SEQ ID NO: 398403 - RNA, 21 nt, Human
augaaaccuaaggaaggugcu

SEQ ID NO: 398404 - RNA, 21 nt, Human
auggaucugguuuacacugua

SEQ ID NO: 398405 - RNA, 22 nt, Human
auuauccuaagacaaccaaaaa

SEQ ID NO: 398406 - RNA, 21 nt, Human
caaauugucaaaaagaacacu

SEQ ID NO: 398407 - RNA, 19 nt, Human
caacaauaacagaucgaca

SEQ ID NO: 398408 - RNA, 22 nt, Human
caacaauaacagaucgacaaca

SEQ ID NO: 398409 - RNA, 19 nt, Human
caccauaagaagucuuuca

SEQ ID NO: 398410 - RNA, 20 nt, Human
cagucgcagggagaaguugg

SEQ ID NO: 398411 - RNA, 19 nt, Human
cauacacauggaaaguaca

SEQ ID NO: 398412 - RNA, 23 nt, Human
caucaacaauaauaauacaacaa

SEQ ID NO: 398413 - RNA, 19 nt, Human
cauggaaaguacaaaucac

SEQ ID NO: 398414 - RNA, 25 nt, Human
cauuuucuacaaaaaaagcaggaca

SEQ ID NO: 398415 - RNA, 22 nt, Human
ccacccggaggcuccucggcgg

SEQ ID NO: 398416 - RNA, 18 nt, Human
ccggugcucuucucccca

SEQ ID NO: 398417 - RNA, 22 nt, Human
ccuugaaguauaugaugcccuu

SEQ ID NO: 398418 - RNA, 21 nt, Human
ccuuguaaugcugaugagggu

SEQ ID NO: 398419 - RNA, 23 nt, Human
cggaggcuccucggcgggaccgg

SEQ ID NO: 398420 - RNA, 24 nt, Human
cgggacaguagagagggcaagcac

SEQ ID NO: 398421 - RNA, 21 nt, Human
cugccuguuacccccagucgc

SEQ ID NO: 398422 - RNA, 20 nt, Human
cuggaaacuucucuuuuagu

SEQ ID NO: 398423 - RNA, 22 nt, Human
cugggcguuuucugagacuuaa

SEQ ID NO: 398424 - RNA, 19 nt, Human
cuucaaaugcuaccagcca

SEQ ID NO: 398425 - RNA, 19 nt, Human
cuucagggucacaguuccu

SEQ ID NO: 398426 - RNA, 19 nt, Human
cuuccaaaaaaaagaacua

SEQ ID NO: 398427 - RNA, 21 nt, Human
gaaggugcuauuucaaaugga

SEQ ID NO: 398428 - RNA, 21 nt, Human
gacaaauugucaaaaagaaca

SEQ ID NO: 398429 - RNA, 22 nt, Human
gacaaauugucaaaaagaacac

SEQ ID NO: 398430 - RNA, 25 nt, Human
gagaaaaaugaaagagaccgguacc

SEQ ID NO: 398431 - RNA, 21 nt, Human
gagaccuuucaguucucacaa

SEQ ID NO: 398432 - RNA, 19 nt, Human
gagccuuuuuuuaauggga

SEQ ID NO: 398433 - RNA, 18 nt, Human
gaggaucuguuugaucau

SEQ ID NO: 398434 - RNA, 21 nt, Human
gauacaaagucagcaauuauc

SEQ ID NO: 398435 - RNA, 27 nt, Human
ggacagguaacagacacaaagcuacuu

SEQ ID NO: 398436 - RNA, 21 nt, Human
ggacaguagagagggcaagca

SEQ ID NO: 398437 - RNA, 20 nt, Human
ggauugaucaaaauuagaag

SEQ ID NO: 398438 - RNA, 19 nt, Human
ggcagccgcgguccgcgcu

SEQ ID NO: 398439 - RNA, 19 nt, Human
ggcgggaccggggugcuca

SEQ ID NO: 398440 - RNA, 21 nt, Human
gggacaguagagagggcaagc

SEQ ID NO: 398441 - RNA, 18 nt, Human
ggugcucuucuccccacc

SEQ ID NO: 398442 - RNA, 24 nt, Human
gucuucucuccauuaugcacauuc

SEQ ID NO: 398443 - RNA, 24 nt, Human
uaaaaaauagauuaaccaugacaa

SEQ ID NO: 398444 - RNA, 19 nt, Human
uaaagcagaaaauucaucc

SEQ ID NO: 398445 - RNA, 18 nt, Human
uaaaguggucucaagauc

SEQ ID NO: 398446 - RNA, 18 nt, Human
uaacagacacaaagcuac

SEQ ID NO: 398447 - RNA, 22 nt, Human
uacaacaauaacagaucgacaa

SEQ ID NO: 398448 - RNA, 26 nt, Human
uacaacaauaacagaucgacaacaaa

SEQ ID NO: 398449 - RNA, 22 nt, Human
uaccagccauagggagacauuc

SEQ ID NO: 398450 - RNA, 21 nt, Human
uagcagcagcaguaacuugag

SEQ ID NO: 398451 - RNA, 24 nt, Human
uagcagcagcaguaacuugaguaa

SEQ ID NO: 398452 - RNA, 23 nt, Human
uaggaggaucuguuugaucaugu

SEQ ID NO: 398453 - RNA, 20 nt, Human
uauggaauagcaccauaaga

SEQ ID NO: 398454 - RNA, 19 nt, Human
ucaaaaagaacacuucagg

SEQ ID NO: 398455 - RNA, 20 nt, Human
ucacccucagaagacuccca

SEQ ID NO: 398456 - RNA, 23 nt, Human
uccaaacaccagacacacacaua

SEQ ID NO: 398457 - RNA, 18 nt, Human
ucccaguuuccaaacacc

SEQ ID NO: 398458 - RNA, 20 nt, Human
ucccaguuuccaaacaccag

SEQ ID NO: 398459 - RNA, 23 nt, Human
ucccaguuuccaaacaccagaca

SEQ ID NO: 398460 - RNA, 22 nt, Human
uccuuuguguucugacagaggu

SEQ ID NO: 398461 - RNA, 20 nt, Human
ucgacaacaaaggaaagaca

SEQ ID NO: 398462 - RNA, 22 nt, Human
ucuacaaaaaaagcaggacacc

SEQ ID NO: 398463 - RNA, 23 nt, Human
ucuuggauuuggugugaaaaggc

SEQ ID NO: 398464 - RNA, 24 nt, Human
ugaaaaggcagcacuuccaaaaaa

SEQ ID NO: 398465 - RNA, 31 nt, Human
ugaaaaggcagcacuuccaaaaaaaagaaag

SEQ ID NO: 398466 - RNA, 24 nt, Human
ugaugucuagaauuuaacugcaau

SEQ ID NO: 398467 - RNA, 23 nt, Human
ugcacauuccuuuguguucugac

SEQ ID NO: 398468 - RNA, 22 nt, Human
ugcuaccagccauagggagaca

SEQ ID NO: 398469 - RNA, 21 nt, Human
uggcucaaaggucaaaaacuu

SEQ ID NO: 398470 - RNA, 20 nt, Human
uguaaugcugaugaggguuu

SEQ ID NO: 398471 - RNA, 21 nt, Human
uguccggaaacauguggaugc

SEQ ID NO: 398472 - RNA, 22 nt, Human
ugugaaaaggcagcacuuccaa

SEQ ID NO: 398473 - RNA, 23 nt, Human
uguuuugaaaaaaugaaucccag

SEQ ID NO: 398474 - RNA, 22 nt, Human
uuaaaaaauagauuaaccauga

SEQ ID NO: 398475 - RNA, 22 nt, Human
uuaggcagccgcgguccgcgcu

SEQ ID NO: 398476 - RNA, 22 nt, Human
uuauaaguaguuguuccacagg

SEQ ID NO: 398477 - RNA, 21 nt, Human
uuccaaaaaaaagaacuaagu

SEQ ID NO: 398478 - RNA, 23 nt, Human
uucggaguuuucucauaagguuc

SEQ ID NO: 398479 - RNA, 23 nt, Human
uugaaaaaaaguuuauggaauag

SEQ ID NO: 398480 - RNA, 25 nt, Human
uugcuggaaacuucucuuuuaguac

SEQ ID NO: 398481 - RNA, 19 nt, Human
uuggcacauacauuuuaac

SEQ ID NO: 398482 - RNA, 21 nt, Human
uuguaguuucacucacucaga

SEQ ID NO: 398483 - RNA, 23 nt, Human
uuguguucugacagagguuuugg

SEQ ID NO: 398484 - RNA, 22 nt, Human
uuucaccagcuuuauuaauacc

SEQ ID NO: 398485 - RNA, 22 nt, Human
uuugcuggaaacuucucuuuua

SEQ ID NO: 398486 - RNA, 25 nt, Human
uuuuuuuuuuuuuuuuuuacaucug

SEQ ID NO: 398487 - RNA, 25 nt, Human
aaaacaaaacaaaacaaaaaaauuc

SEQ ID NO: 398488 - RNA, 19 nt, Human
aaacaaaacaaaacaaaaa

SEQ ID NO: 398489 - RNA, 24 nt, Human
aaacaggacuuacaguuauguaaa

SEQ ID NO: 398490 - RNA, 19 nt, Human
aacaaaacaaaaaaauucu

SEQ ID NO: 398491 - RNA, 22 nt, Human
aacaaaacaaaaaaauucucag

SEQ ID NO: 398492 - RNA, 19 nt, Human
aagaagcauagccggaaug

SEQ ID NO: 398493 - RNA, 20 nt, Human
aagaagcauagccggaaugg

SEQ ID NO: 398494 - RNA, 21 nt, Human
aaggugcuauuguuguuaaaa

SEQ ID NO: 398495 - RNA, 23 nt, Human
aaucuuuaacacuuuaacaguuc

SEQ ID NO: 398496 - RNA, 19 nt, Human
aaugccauucaaaacuacc

SEQ ID NO: 398497 - RNA, 24 nt, Human
acaaaacaaaacaaaaaaauucuc

SEQ ID NO: 398498 - RNA, 25 nt, Human
acaaaacaaaacaaaaaaauucuca

SEQ ID NO: 398499 - RNA, 24 nt, Human
acgugcuuggcugaggagccaaug

SEQ ID NO: 398500 - RNA, 22 nt, Human
acucugagaaauggcuuugugg

SEQ ID NO: 398501 - RNA, 25 nt, Human
agaaagaaaaugauuccagccaaag

SEQ ID NO: 398502 - RNA, 22 nt, Human
agacaggacucucgccagcaaa

SEQ ID NO: 398503 - RNA, 23 nt, Human
agagagaaagaaaaugauuccag

SEQ ID NO: 398504 - RNA, 21 nt, Human
aggagagugaaugacucugag

SEQ ID NO: 398505 - RNA, 24 nt, Human
agucacugauugacuuguuccaca

SEQ ID NO: 398506 - RNA, 21 nt, Human
auaggagcaagggacaacaag

SEQ ID NO: 398507 - RNA, 19 nt, Human
augcccaacauggacagaa

SEQ ID NO: 398508 - RNA, 21 nt, Human
auuaaggaaggggggaaacca

SEQ ID NO: 398509 - RNA, 19 nt, Human
caaaaacacucaugugccg

SEQ ID NO: 398510 - RNA, 22 nt, Human
caaaaacacucaugugccgccc

SEQ ID NO: 398511 - RNA, 26 nt, Human
caacauugcagacagaagcaaaagaa

SEQ ID NO: 398512 - RNA, 23 nt, Human
caagugccuccaaagcuaaaaga

SEQ ID NO: 398513 - RNA, 21 nt, Human
cacagggcugcugggcauggc

SEQ ID NO: 398514 - RNA, 21 nt, Human
cagaagacagccuggcaccuu

SEQ ID NO: 398515 - RNA, 25 nt, Human
cagcuuuuagcucauaaugcccaua

SEQ ID NO: 398516 - RNA, 22 nt, Human
caggaagcuagucacugauuga

SEQ ID NO: 398517 - RNA, 22 nt, Human
caguuucugucuuucaagaaca

SEQ ID NO: 398518 - RNA, 21 nt, Human
cauucuaguuuuugcucccag

SEQ ID NO: 398519 - RNA, 20 nt, Human
ccagucuucaacaguguuca

SEQ ID NO: 398520 - RNA, 18 nt, Human
ccccaaggcugaccuuuu

SEQ ID NO: 398521 - RNA, 21 nt, Human
ccccaaggcugaccuuuugcc

SEQ ID NO: 398522 - RNA, 19 nt, Human
cccccacugcaauuaagga

SEQ ID NO: 398523 - RNA, 22 nt, Human
cccccugucuucuucgaggcaa

SEQ ID NO: 398524 - RNA, 23 nt, Human
ccuugaagugcuaaaauuauguu

SEQ ID NO: 398525 - RNA, 23 nt, Human
cgagaggaaccgcagguucagac

SEQ ID NO: 398526 - RNA, 23 nt, Human
cgcccccugucuucuucgaggca

SEQ ID NO: 398527 - RNA, 21 nt, Human
cgcccugcguccaacaacaac

SEQ ID NO: 398528 - RNA, 22 nt, Human
cggcaagugccuccaaagcuaa

SEQ ID NO: 398529 - RNA, 20 nt, Human
cggccaaccccaaggcugac

SEQ ID NO: 398530 - RNA, 20 nt, Human
cggccgaggcugccuggguu

SEQ ID NO: 398531 - RNA, 21 nt, Human
cucauaaugcccauagaugcc

SEQ ID NO: 398532 - RNA, 20 nt, Human
cuguacacuguuuuagggca

SEQ ID NO: 398533 - RNA, 22 nt, Human
cuuacauaacuuauaauuaacc

SEQ ID NO: 398534 - RNA, 25 nt, Human
gaaacucccucugugcucacugcuc

SEQ ID NO: 398535 - RNA, 22 nt, Human
gaacaaaauuaccaacgcccuc

SEQ ID NO: 398536 - RNA, 21 nt, Human
gacacaguccucuggugccac

SEQ ID NO: 398537 - RNA, 21 nt, Human
gcagacagaagcaaaagaaca

SEQ ID NO: 398538 - RNA, 19 nt, Human
gcauggcucaggcgcggag

SEQ ID NO: 398539 - RNA, 25 nt, Human
gccacaauauugucuucucagcaga

SEQ ID NO: 398540 - RNA, 18 nt, Human
gcccauggaauuccaagc

SEQ ID NO: 398541 - RNA, 18 nt, Human
gccgaggcugccuggguu

SEQ ID NO: 398542 - RNA, 21 nt, Human
ggaauggucagugacuccaau

SEQ ID NO: 398543 - RNA, 18 nt, Human
gggaaaccaaagggacaa

SEQ ID NO: 398544 - RNA, 26 nt, Human
gugccuccaaagcuaaagauacaaua

SEQ ID NO: 398545 - RNA, 22 nt, Human
uaaaaugaugcugauucauccc

SEQ ID NO: 398546 - RNA, 25 nt, Human
uaacauaccacagcuuuuagcucau

SEQ ID NO: 398547 - RNA, 22 nt, Human
uaaccaaaaacacucaugugcc

SEQ ID NO: 398548 - RNA, 24 nt, Human
uaaccaaaaacacucaugugccgc

SEQ ID NO: 398549 - RNA, 21 nt, Human
uaacuuauaauuaaccagucu

SEQ ID NO: 398550 - RNA, 23 nt, Human
uaacuuauaauuaaccagucuuc

SEQ ID NO: 398551 - RNA, 21 nt, Human
uagaccgucgugagacagguu

SEQ ID NO: 398552 - RNA, 24 nt, Human
ucaaagucaaugaaugaaaaaaua

SEQ ID NO: 398553 - RNA, 19 nt, Human
ucauucaaauauauaccuc

SEQ ID NO: 398554 - RNA, 22 nt, Human
uccaaagcuaaaagaagaaaug

SEQ ID NO: 398555 - RNA, 23 nt, Human
uccaaagcuaaaagaagaaaugu

SEQ ID NO: 398556 - RNA, 23 nt, Human
uccaagcacagguggagucuucu

SEQ ID NO: 398557 - RNA, 18 nt, Human
uccaauccuaaucuuuaa

SEQ ID NO: 398558 - RNA, 20 nt, Human
ucccucugugcucacugcuc

SEQ ID NO: 398559 - RNA, 20 nt, Human
ucuacacuucucuagaacaa

SEQ ID NO: 398560 - RNA, 21 nt, Human
ugaagcccauggaauuccaag

SEQ ID NO: 398561 - RNA, 19 nt, Human
ugacaacauugcagacaga

SEQ ID NO: 398562 - RNA, 23 nt, Human
ugacaugucccuggcagagagaa

SEQ ID NO: 398563 - RNA, 24 nt, Human
ugacuccaauccuaaucuuuaaca

SEQ ID NO: 398564 - RNA, 18 nt, Human
ugacucugagaaauggcu

SEQ ID NO: 398565 - RNA, 24 nt, Human
ugagaaaaauacuguacacuguuu

SEQ ID NO: 398566 - RNA, 22 nt, Human
ugaucuguaaaaaauauaaccu

SEQ ID NO: 398567 - RNA, 19 nt, Human
ugcagacagaagcaaaaga

SEQ ID NO: 398568 - RNA, 18 nt, Human
uggcagagagaaagaaaa

SEQ ID NO: 398569 - RNA, 20 nt, Human
uggcagagagaaagaaaaug

SEQ ID NO: 398570 - RNA, 19 nt, Human
uggcucaggcgcggagcaa

SEQ ID NO: 398571 - RNA, 19 nt, Human
ugguaugaagaagcauagc

SEQ ID NO: 398572 - RNA, 18 nt, Human
uguuaaaaacaaaacaaa

SEQ ID NO: 398573 - RNA, 21 nt, Human
uguuaaaaacaaaacaaaaca

SEQ ID NO: 398574 - RNA, 23 nt, Human
uucaccuuuuacauauacuuugu

SEQ ID NO: 398575 - RNA, 22 nt, Human
uucagguuucuugguugacaug

SEQ ID NO: 398576 - RNA, 23 nt, Human
uuccggugcaugggagcuaucuu

SEQ ID NO: 398577 - RNA, 19 nt, Human
uugaagcccauggaauucc

SEQ ID NO: 398578 - RNA, 24 nt, Human
uuuaacacuuuaacaguucaugaa

SEQ ID NO: 398579 - RNA, 19 nt, Human
uuuaaccugauuggcuaca

SEQ ID NO: 398580 - RNA, 23 nt, Human
uuuaguccugacauccauccaua

SEQ ID NO: 398581 - RNA, 18 nt, Human
uuucagguuucuugguug

SEQ ID NO: 398582 - RNA, 27 nt, Human
uuuuuaguccugacauccauccauauu

SEQ ID NO: 398583 - RNA, 22 nt, Human
uuuuuuaguccugacauccauc

SEQ ID NO: 398584 - RNA, 19 nt, Human
uuuuuuuuuuuuaaagaaa

SEQ ID NO: 398585 - RNA, 22 nt, Human
aaaaacacaagagcugaacagc

SEQ ID NO: 398586 - RNA, 22 nt, Human
acaaaaacacaagagcugaaca

SEQ ID NO: 398587 - RNA, 19 nt, Human
acaagagcugaacagcagc

SEQ ID NO: 398588 - RNA, 20 nt, Human
accacauauaaauggugaac

SEQ ID NO: 398589 - RNA, 24 nt, Human
auauauuuuuaccuacaucauaca

SEQ ID NO: 398590 - RNA, 23 nt, Human
aucuaugcugaugcaaaauaaag

SEQ ID NO: 398591 - RNA, 20 nt, Human
auuguuggaacuuccaaaag

SEQ ID NO: 398592 - RNA, 21 nt, Human
caaaaacacaagagcugaaca

SEQ ID NO: 398593 - RNA, 18 nt, Human
cauacacucacaauugug

SEQ ID NO: 398594 - RNA, 19 nt, Human
cugacucauaucucauuuu

SEQ ID NO: 398595 - RNA, 25 nt, Human
cuggccacaaaaacacaagagcuga

SEQ ID NO: 398596 - RNA, 24 nt, Human
ggaacuuccaaaagcagcaauauc

SEQ ID NO: 398597 - RNA, 22 nt, Human
gggugcccaauauaccuuuguu

SEQ ID NO: 398598 - RNA, 18 nt, Human
uaacacaagacaaccugc

SEQ ID NO: 398599 - RNA, 18 nt, Human
uaacugacucauaucuca

SEQ ID NO: 398600 - RNA, 25 nt, Human
ucuucuaacaaggaagagggccugg

SEQ ID NO: 398601 - RNA, 22 nt, Human
uggaacuuccaaaagcagcaau

SEQ ID NO: 398602 - RNA, 19 nt, Human
ugucuguuccauuuggcag

SEQ ID NO: 398603 - RNA, 19 nt, Human
uguuggaacuuccaaaagc

SEQ ID NO: 398604 - RNA, 21 nt, Human
aagaucccaacuagacaaaga

SEQ ID NO: 398605 - RNA, 21 nt, Human
aucccaacuagacaaagacug

SEQ ID NO: 398606 - RNA, 23 nt, Human
cccacagguaccuucacuugguc

SEQ ID NO: 398607 - RNA, 24 nt, Human
gaaagcagugaaagagcaaugggc

SEQ ID NO: 398608 - RNA, 20 nt, Human
gaacuuaacuauaacuagug

SEQ ID NO: 398609 - RNA, 19 nt, Human
gagucacuauaggucuccu

SEQ ID NO: 398610 - RNA, 19 nt, Human
gcagugaaagagcaauggg

SEQ ID NO: 398611 - RNA, 21 nt, Human
gucacuaagagcuccugggag

SEQ ID NO: 398612 - RNA, 20 nt, Human
uauaggucuccuuuggaucc

SEQ ID NO: 398613 - RNA, 20 nt, Human
ugaaagagcaaugggcacaa

SEQ ID NO: 398614 - RNA, 18 nt, Human
ugaaagcagugaaagagc

SEQ ID NO: 398615 - RNA, 19 nt, Human
ugaaagcagugaaagagca

SEQ ID NO: 398616 - RNA, 19 nt, Human
ugcuucaacccacaacuac

SEQ ID NO: 398617 - RNA, 21 nt, Human
ugggcacaaugagccccacag

SEQ ID NO: 398618 - RNA, 22 nt, Human
ccuuuccuuuuuucuuuagucc

SEQ ID NO: 398619 - RNA, 22 nt, Human
uagaagagauguaauugugaua

SEQ ID NO: 398620 - RNA, 22 nt, Human
uauggaaaacuuaaauuugcca

SEQ ID NO: 398621 - RNA, 21 nt, Human
ucuuuaguccaaauccagaca

SEQ ID NO: 398622 - RNA, 19 nt, Human
uggaaaacuuaaauuugcc

SEQ ID NO: 398623 - RNA, 18 nt, Human
uggguaaaauuaagucaa

SEQ ID NO: 398624 - RNA, 23 nt, Human
uuggaugacugcuagccuuuccu

SEQ ID NO: 398625 - RNA, 22 nt, Human
aaacaaccuuauuuaugauauu

SEQ ID NO: 398626 - RNA, 21 nt, Human
aacaaccuuauuuaugauauu

SEQ ID NO: 398627 - RNA, 21 nt, Human
aagcacgucuuaaacaaccuu

SEQ ID NO: 398628 - RNA, 20 nt, Human
acgcagggcucccagcuuuc

SEQ ID NO: 398629 - RNA, 21 nt, Human
acuuugaaucuuguugcugga

SEQ ID NO: 398630 - RNA, 18 nt, Human
agauguccaauggggaag

SEQ ID NO: 398631 - RNA, 21 nt, Human
agcauuuauucccucugcacu

SEQ ID NO: 398632 - RNA, 19 nt, Human
aggaaaaagugaacaccca

SEQ ID NO: 398633 - RNA, 22 nt, Human
agggccaagucuccacgcaggg

SEQ ID NO: 398634 - RNA, 20 nt, Human
agucaaaacuaccaaaaugg

SEQ ID NO: 398635 - RNA, 24 nt, Human
agugagaaggguacaggggaggga

SEQ ID NO: 398636 - RNA, 18 nt, Human
aguucugggcuaaagggu

SEQ ID NO: 398637 - RNA, 19 nt, Human
aucagagucccagccaggc

SEQ ID NO: 398638 - RNA, 23 nt, Human
aucccacuuccuuccugccucua

SEQ ID NO: 398639 - RNA, 27 nt, Human
aucccacuuccuuccugccucuagccc

SEQ ID NO: 398640 - RNA, 21 nt, Human
aucggggugaagggcugaggc

SEQ ID NO: 398641 - RNA, 20 nt, Human
caagaaaugccucaggaggu

SEQ ID NO: 398642 - RNA, 20 nt, Human
caaguguuggacccagcugg

SEQ ID NO: 398643 - RNA, 23 nt, Human
cacaccuccacgcagggcuccca

SEQ ID NO: 398644 - RNA, 21 nt, Human
caccauggaauuacucacccu

SEQ ID NO: 398645 - RNA, 21 nt, Human
caccuccacgcagggcuccca

SEQ ID NO: 398646 - RNA, 24 nt, Human
cacgcagggcucccagcuuucugg

SEQ ID NO: 398647 - RNA, 21 nt, Human
cacgucuuaaacaaccuuauu

SEQ ID NO: 398648 - RNA, 19 nt, Human
cacugcuucugugagcagc

SEQ ID NO: 398649 - RNA, 22 nt, Human
cagaaaaggcucccagggcuaa

SEQ ID NO: 398650 - RNA, 22 nt, Human
cagucaaaacuaccaaaauggu

SEQ ID NO: 398651 - RNA, 23 nt, Human
caguggcccugugaaugcguggc

SEQ ID NO: 398652 - RNA, 24 nt, Human
caguggcccugugaaugcguggcu

SEQ ID NO: 398653 - RNA, 19 nt, Human
cauaaggccugacaugugg

SEQ ID NO: 398654 - RNA, 18 nt, Human
caucaggagccccuugac

SEQ ID NO: 398655 - RNA, 19 nt, Human
caucccacuuccuuccugc

SEQ ID NO: 398656 - RNA, 21 nt, Human
caugacagucauuacuuagua

SEQ ID NO: 398657 - RNA, 18 nt, Human
ccagccaucugugucucc

SEQ ID NO: 398658 - RNA, 19 nt, Human
ccaugauaagaccaggaag

SEQ ID NO: 398659 - RNA, 19 nt, Human
cccacuuccuuccugccuc

SEQ ID NO: 398660 - RNA, 21 nt, Human
cccacuuccuuccugccucua

SEQ ID NO: 398661 - RNA, 19 nt, Human
cccugugaaugcguggcuc

SEQ ID NO: 398662 - RNA, 24 nt, Human
ccuccacgcagggcucccagcuuu

SEQ ID NO: 398663 - RNA, 18 nt, Human
ccugcauaucuagugcac

SEQ ID NO: 398664 - RNA, 18 nt, Human
cucacugcuucugugagc

SEQ ID NO: 398665 - RNA, 22 nt, Human
cucaggaaaagaacaaugucuc

SEQ ID NO: 398666 - RNA, 21 nt, Human
cuccggagucugaaagcucug

SEQ ID NO: 398667 - RNA, 18 nt, Human
cucugcacuggaagcucc

SEQ ID NO: 398668 - RNA, 20 nt, Human
cugcaacucauuucaugagg

SEQ ID NO: 398669 - RNA, 21 nt, Human
cugcauaucuagugcaccaug

SEQ ID NO: 398670 - RNA, 18 nt, Human
cuggucucacgcaggaga

SEQ ID NO: 398671 - RNA, 19 nt, Human
cuggucucacgcaggagag

SEQ ID NO: 398672 - RNA, 22 nt, Human
gaaagcucuggguuucaugcca

SEQ ID NO: 398673 - RNA, 24 nt, Human
gacagaguguacuuuuccauacuu

SEQ ID NO: 398674 - RNA, 21 nt, Human
gagcagcaguggcccugugaa

SEQ ID NO: 398675 - RNA, 19 nt, Human
gauauuugaagcacgucuu

SEQ ID NO: 398676 - RNA, 19 nt, Human
gcacgucuuaaacaaccuu

SEQ ID NO: 398677 - RNA, 22 nt, Human
gcagggcucccagcuuucuggu

SEQ ID NO: 398678 - RNA, 25 nt, Human
gcagugagaaggguacaggggaggg

SEQ ID NO: 398679 - RNA, 20 nt, Human
gcccauauguuucuggaauc

SEQ ID NO: 398680 - RNA, 21 nt, Human
gcccugugaaugcguggcucg

SEQ ID NO: 398681 - RNA, 22 nt, Human
gcuccuugagauuagcagcccu

SEQ ID NO: 398682 - RNA, 26 nt, Human
gcucuggguuucaugccagcucuucu

SEQ ID NO: 398683 - RNA, 22 nt, Human
gcuggaaagguccaagugcucu

SEQ ID NO: 398684 - RNA, 18 nt, Human
ggaaaaagugaacaccca

SEQ ID NO: 398685 - RNA, 20 nt, Human
ggaaaaagugaacacccagu

SEQ ID NO: 398686 - RNA, 19 nt, Human
gggaucagagucccagccg

SEQ ID NO: 398687 - RNA, 19 nt, Human
ggggaaguucucuagagau

SEQ ID NO: 398688 - RNA, 21 nt, Human
uaaaaaauagaacaugcucga

SEQ ID NO: 398689 - RNA, 23 nt, Human
uaaaaaauagaacaugcucgaga

SEQ ID NO: 398690 - RNA, 20 nt, Human
uaagaccaggaagcggaaau

SEQ ID NO: 398691 - RNA, 21 nt, Human
uacuuugaaucuuguugcugg

SEQ ID NO: 398692 - RNA, 19 nt, Human
uagaacaugcucgagaaug

SEQ ID NO: 398693 - RNA, 22 nt, Human
ucaaaacuaccaaaaugguuuu

SEQ ID NO: 398694 - RNA, 23 nt, Human
ucaaucaaaaaggaaaaagugaa

SEQ ID NO: 398695 - RNA, 23 nt, Human
ucagauuagaaaaauacucaggu

SEQ ID NO: 398696 - RNA, 21 nt, Human
ucaggaaaagaacaaugucuc

SEQ ID NO: 398697 - RNA, 21 nt, Human
uccaugauaagaccaggaagc

SEQ ID NO: 398698 - RNA, 22 nt, Human
ucccacuuccuuccugccucua

SEQ ID NO: 398699 - RNA, 23 nt, Human
ucccagcuuucuggucucacgca

SEQ ID NO: 398700 - RNA, 24 nt, Human
ucccagcuuucuggucucacgcag

SEQ ID NO: 398701 - RNA, 19 nt, Human
ucccagggcuaaacucugg

SEQ ID NO: 398702 - RNA, 21 nt, Human
ucccucugcacuggaagcucc

SEQ ID NO: 398703 - RNA, 18 nt, Human
uccggagucugaaagcuc

SEQ ID NO: 398704 - RNA, 22 nt, Human
uccugaggucaucccacuuccu

SEQ ID NO: 398705 - RNA, 24 nt, Human
ucuccacgcagggcucccagcuuu

SEQ ID NO: 398706 - RNA, 19 nt, Human
ucucuuccucgagccgccc

SEQ ID NO: 398707 - RNA, 22 nt, Human
ucugaccgagcaguuucugagg

SEQ ID NO: 398708 - RNA, 22 nt, Human
ucugauaugccccaucuucaau

SEQ ID NO: 398709 - RNA, 19 nt, Human
ugaagcacgucuuaaacaa

SEQ ID NO: 398710 - RNA, 20 nt, Human
ugaccuccugaggucauccc

SEQ ID NO: 398711 - RNA, 20 nt, Human
ugagaaggguacaggggagg

SEQ ID NO: 398712 - RNA, 21 nt, Human
ugagaaggguacaggggaggg

SEQ ID NO: 398713 - RNA, 21 nt, Human
ugauaagaccaggaagcggaa

SEQ ID NO: 398714 - RNA, 21 nt, Human
ugccucuagcccaaauugucc

SEQ ID NO: 398715 - RNA, 23 nt, Human
uggaaucaagaaaaggugaccuc

SEQ ID NO: 398716 - RNA, 20 nt, Human
uggcagugagaaggguacag

SEQ ID NO: 398717 - RNA, 25 nt, Human
uggcagugagaaggguacaggggag

SEQ ID NO: 398718 - RNA, 27 nt, Human
uggcagugagaaggguacaggggaggg

SEQ ID NO: 398719 - RNA, 18 nt, Human
uggcuauaacauaauaca

SEQ ID NO: 398720 - RNA, 21 nt, Human
ugggaucagagucccagccag

SEQ ID NO: 398721 - RNA, 22 nt, Human
ugucauggguuccuugacugag

SEQ ID NO: 398722 - RNA, 18 nt, Human
ugugucucccuaaagaga

SEQ ID NO: 398723 - RNA, 19 nt, Human
uguguuaaucagguuuccu

SEQ ID NO: 398724 - RNA, 24 nt, Human
uucucugucuuuauucaacuugau

SEQ ID NO: 398725 - RNA, 23 nt, Human
uuuagggccaagucuccacgcag

SEQ ID NO: 398726 - RNA, 24 nt, Human
uuucuuugucauggguuccuugac

SEQ ID NO: 398727 - RNA, 18 nt, Human
uuugagauguccaauggg

SEQ ID NO: 398728 - RNA, 18 nt, Human
uuuuuuuuuuuuuuucug

SEQ ID NO: 398729 - RNA, 24 nt, Human
uuuuuuuuuuuuuuuuucuguuuu

SEQ ID NO: 398730 - RNA, 23 nt, Human
aaaaaaaaaaccuccagagagga

SEQ ID NO: 398731 - RNA, 23 nt, Human
aaaaaaaccuccagagaggaccu

SEQ ID NO: 398732 - RNA, 25 nt, Human
aaaaagaaaaaaaaaaccuccagag

SEQ ID NO: 398733 - RNA, 24 nt, Human
aaaagaaaaaaaaaaccuccagag

SEQ ID NO: 398734 - RNA, 22 nt, Human
aaaccuccagagaggaccccaa

SEQ ID NO: 398735 - RNA, 22 nt, Human
aagauaguuaugauucaaauac

SEQ ID NO: 398736 - RNA, 23 nt, Human
aagaugagaaagucccucaaaaa

SEQ ID NO: 398737 - RNA, 23 nt, Human
aagucaauugccaggaaagcugg

SEQ ID NO: 398738 - RNA, 18 nt, Human
aaucgcuugaacccugga

SEQ ID NO: 398739 - RNA, 23 nt, Human
aaucuguaaucccagcuacuugg

SEQ ID NO: 398740 - RNA, 21 nt, Human
acccuggaggcagugguugca

SEQ ID NO: 398741 - RNA, 21 nt, Human
acugcaguccagccugggcgg

SEQ ID NO: 398742 - RNA, 24 nt, Human
acugcaguccagccugggcggcag

SEQ ID NO: 398743 - RNA, 26 nt, Human
acugcaguccagccugggcggcagag

SEQ ID NO: 398744 - RNA, 23 nt, Human
agaaaaaaaaaaccuccagagag

SEQ ID NO: 398745 - RNA, 21 nt, Human
agaacuugaagaugagaaagu

SEQ ID NO: 398746 - RNA, 22 nt, Human
agaagagggaaaccccagagaa

SEQ ID NO: 398747 - RNA, 24 nt, Human
agagagaagagggaaaccccagag

SEQ ID NO: 398748 - RNA, 21 nt, Human
agcaaaaagaaaaaaaaaacc

SEQ ID NO: 398749 - RNA, 22 nt, Human
agcaaaaagaaaaaaaaaaccu

SEQ ID NO: 398750 - RNA, 23 nt, Human
agcaucccugguuuggugacugu

SEQ ID NO: 398751 - RNA, 20 nt, Human
agccgagauugugucacugc

SEQ ID NO: 398752 - RNA, 24 nt, Human
agccugggcggcagagugagacuc

SEQ ID NO: 398753 - RNA, 23 nt, Human
agcugggcaacuauaaggucagg

SEQ ID NO: 398754 - RNA, 18 nt, Human
aggcaagagaaucgcuug

SEQ ID NO: 398755 - RNA, 21 nt, Human
aggcagugguugcagucagcc

SEQ ID NO: 398756 - RNA, 24 nt, Human
aggcagugguugcagucagccgag

SEQ ID NO: 398757 - RNA, 24 nt, Human
aggcugaggcaagagaaucgcuug

SEQ ID NO: 398758 - RNA, 18 nt, Human
aggggcagagggucccug

SEQ ID NO: 398759 - RNA, 19 nt, Human
aggggcagagggucccugg

SEQ ID NO: 398760 - RNA, 19 nt, Human
aucucaucacagugauggu

SEQ ID NO: 398761 - RNA, 24 nt, Human
auugugucacugcaguccagccug

SEQ ID NO: 398762 - RNA, 18 nt, Human
caaucuguaaucccagcu

SEQ ID NO: 398763 - RNA, 21 nt, Human
cacaauauaugucugcaggag

SEQ ID NO: 398764 - RNA, 18 nt, Human
cacagugaugguagucag

SEQ ID NO: 398765 - RNA, 19 nt, Human
cacugcaguccagccuggg

SEQ ID NO: 398766 - RNA, 19 nt, Human
cacugcaguccagccuggg

SEQ ID NO: 398767 - RNA, 20 nt, Human
cacugcaguccagccugggc

SEQ ID NO: 398768 - RNA, 24 nt, Human
cacugcaguccagccugggcggca

SEQ ID NO: 398769 - RNA, 18 nt, Human
cagaagggacuucuagua

SEQ ID NO: 398770 - RNA, 22 nt, Human
cagagaggaccccaaaaugaua

SEQ ID NO: 398771 - RNA, 23 nt, Human
caguccagccugggcggcagagu

SEQ ID NO: 398772 - RNA, 20 nt, Human
cccucaaaaacaucccaaca

SEQ ID NO: 398773 - RNA, 18 nt, Human
ccucccggacgcaaaagc

SEQ ID NO: 398774 - RNA, 22 nt, Human
ccugggcggcagagugagacuc

SEQ ID NO: 398775 - RNA, 20 nt, Human
cuggagcagaugagaguagg

SEQ ID NO: 398776 - RNA, 18 nt, Human
cuguaaucccagcuacuu

SEQ ID NO: 398777 - RNA, 21 nt, Human
cuguaaucccagcuacuuggg

SEQ ID NO: 398778 - RNA, 27 nt, Human
cuuuaagacuuccucuucaucacaacc

SEQ ID NO: 398779 - RNA, 19 nt, Human
cuuuuuguuuuccugucuc

SEQ ID NO: 398780 - RNA, 19 nt, Human
gacucugggacgccucccc

SEQ ID NO: 398781 - RNA, 20 nt, Human
gagaggaccccaaaaugaua

SEQ ID NO: 398782 - RNA, 19 nt, Human
ggacagcgccaacauucuc

SEQ ID NO: 398783 - RNA, 18 nt, Human
ggagcagaugagaguagg

SEQ ID NO: 398784 - RNA, 23 nt, Human
ggcggcagagugagacucuggga

SEQ ID NO: 398785 - RNA, 21 nt, Human
gguugcagucagccgagauug

SEQ ID NO: 398786 - RNA, 24 nt, Human
guagcaaaaagaaaaaaaaaaccc

SEQ ID NO: 398787 - RNA, 24 nt, Human
gucacugcaguccagccugggcgg

SEQ ID NO: 398788 - RNA, 18 nt, Human
gugccaggaacaugaaca

SEQ ID NO: 398789 - RNA, 24 nt, Human
guugcagucagccgagauuguguc

SEQ ID NO: 398790 - RNA, 22 nt, Human
uacaaauacaucaggauuagga

SEQ ID NO: 398791 - RNA, 19 nt, Human
uacagaacuugaagaugag

SEQ ID NO: 398792 - RNA, 23 nt, Human
uagaaaauuaacaucugaggcuc

SEQ ID NO: 398793 - RNA, 22 nt, Human
uagcaaaaagaaaaaaaaaacc

SEQ ID NO: 398794 - RNA, 23 nt, Human
uagcaaaaagaaaaaaaaaaccu

SEQ ID NO: 398795 - RNA, 24 nt, Human
uagcaaaaagaaaaaaaaaaccuc

SEQ ID NO: 398796 - RNA, 28 nt, Human
uagcaaaaagaaaaaaaaaaccuccaga

SEQ ID NO: 398797 - RNA, 19 nt, Human
uaggggcagagggucccug

SEQ ID NO: 398798 - RNA, 25 nt, Human
uaguagcaaaaagaaaaaaaaaacc

SEQ ID NO: 398799 - RNA, 19 nt, Human
uaguauguucuuauucuag

SEQ ID NO: 398800 - RNA, 20 nt, Human
uauccaagacacuaagugau

SEQ ID NO: 398801 - RNA, 19 nt, Human
uauguuguuuucauaguag

SEQ ID NO: 398802 - RNA, 20 nt, Human
uauuuuauuuuuuggugaau

SEQ ID NO: 398803 - RNA, 18 nt, Human
ucacauucacaaaugaac

SEQ ID NO: 398804 - RNA, 21 nt, Human
ucacugcaguccagccugggc

SEQ ID NO: 398805 - RNA, 24 nt, Human
ucagagugacagugcauacaauga

SEQ ID NO: 398806 - RNA, 24 nt, Human
ucauaguagcaaaaagaaaaaaaa

SEQ ID NO: 398807 - RNA, 23 nt, Human
uccagccugggcggcagagugag

SEQ ID NO: 398808 - RNA, 24 nt, Human
uccagccugggcggcagagugaga

SEQ ID NO: 398809 - RNA, 18 nt, Human
ucccucaaaaacauccca

SEQ ID NO: 398810 - RNA, 19 nt, Human
ucccugguuuggugacugu

SEQ ID NO: 398811 - RNA, 18 nt, Human
ucgcuugaacccuggagg

SEQ ID NO: 398812 - RNA, 21 nt, Human
ucuguaaucccagcuacuugg

SEQ ID NO: 398813 - RNA, 22 nt, Human
ucuguaaucccagcuacuuggg

SEQ ID NO: 398814 - RNA, 18 nt, Human
ugacagugcauacaauga

SEQ ID NO: 398815 - RNA, 23 nt, Human
ugacuguggagaagccacguugu

SEQ ID NO: 398816 - RNA, 21 nt, Human
ugagaaagaacugucagccug

SEQ ID NO: 398817 - RNA, 21 nt, Human
ugagaaagaacugucagccug

SEQ ID NO: 398818 - RNA, 22 nt, Human
ugagaaagucccucaaaaacau

SEQ ID NO: 398819 - RNA, 20 nt, Human
ugaggcaagagaaucgcuug

SEQ ID NO: 398820 - RNA, 24 nt, Human
ugaggcaagagaaucgcuugaacc

SEQ ID NO: 398821 - RNA, 25 nt, Human
ugaggcaagagaaucgcuugaaccc

SEQ ID NO: 398822 - RNA, 23 nt, Human
ugcauacaaugaaaagggagaac

SEQ ID NO: 398823 - RNA, 19 nt, Human
ugccaggaacaugaacauc

SEQ ID NO: 398824 - RNA, 22 nt, Human
uggagaagccacguugucagua

SEQ ID NO: 398825 - RNA, 18 nt, Human
uggcuugagauaaguugg

SEQ ID NO: 398826 - RNA, 20 nt, Human
ugggaggcugaggcaagaga

SEQ ID NO: 398827 - RNA, 23 nt, Human
ugggaggcugaggcaagagaauc

SEQ ID NO: 398828 - RNA, 20 nt, Human
ugggcaaagucaauugccag

SEQ ID NO: 398829 - RNA, 21 nt, Human
ugggcggcagagugagacucu

SEQ ID NO: 398830 - RNA, 22 nt, Human
uguccuagcagaagggacuucu

SEQ ID NO: 398831 - RNA, 24 nt, Human
uguuuuccugucuccagguucgga

SEQ ID NO: 398832 - RNA, 26 nt, Human
uucauaguagcaaaaagaaaaaaaaa

SEQ ID NO: 398833 - RNA, 18 nt, Human
uucccuggaugcuaaauc

SEQ ID NO: 398834 - RNA, 23 nt, Human
uugagagauuuauguuguuuuca

SEQ ID NO: 398835 - RNA, 22 nt, Human
uugcagucagccgagauugugu

SEQ ID NO: 398836 - RNA, 24 nt, Human
uugggaggcugaggcaagagaauc

SEQ ID NO: 398837 - RNA, 23 nt, Human
uugugucacugcaguccagccug

SEQ ID NO: 398838 - RNA, 22 nt, Human
uuuguggcuugagauaaguugg

SEQ ID NO: 398839 - RNA, 23 nt, Human
uuuuccugucuccagguucggac

SEQ ID NO: 398840 - RNA, 22 nt, Human
aaacauaaugauuaaaccagaa

SEQ ID NO: 398841 - RNA, 19 nt, Human
aagcagaguggagaggagc

SEQ ID NO: 398842 - RNA, 24 nt, Human
acauaaugauuaaaccagaagaga

SEQ ID NO: 398843 - RNA, 19 nt, Human
acugggcugucucuaacuu

SEQ ID NO: 398844 - RNA, 23 nt, Human
agacugggcugucucuaacuggc

SEQ ID NO: 398845 - RNA, 21 nt, Human
aggcuaaccucaccgccuagc

SEQ ID NO: 398846 - RNA, 19 nt, Human
ccugaaggcaugaggauaa

SEQ ID NO: 398847 - RNA, 23 nt, Human
gaguggagaggagcugaaaaacu

SEQ ID NO: 398848 - RNA, 21 nt, Human
gauaauggaggcaccuccaga

SEQ ID NO: 398849 - RNA, 19 nt, Human
ggagcugaaaaacugagca

SEQ ID NO: 398850 - RNA, 23 nt, Human
ggagcugaaaaacugagcauuua

SEQ ID NO: 398851 - RNA, 20 nt, Human
uccauuugggaaagcagagu

SEQ ID NO: 398852 - RNA, 25 nt, Human
ugaaaaacugagcauuuacucaaaa

SEQ ID NO: 398853 - RNA, 23 nt, Human
uggagaggagcugaaaaacugag

SEQ ID NO: 398854 - RNA, 20 nt, Human
uuaaaccagaagagacuggg

SEQ ID NO: 398855 - RNA, 23 nt, Human
uucuucuucagagcaucuugaua

SEQ ID NO: 398856 - RNA, 22 nt, Human
acagccuacaucccaugagggc

SEQ ID NO: 398857 - RNA, 26 nt, Human
accccuuccucuuuccacuccccucu

SEQ ID NO: 398858 - RNA, 23 nt, Human
agacagccuacaucccaugaggg

SEQ ID NO: 398859 - RNA, 22 nt, Human
aggagcuaaggcccagagcuca

SEQ ID NO: 398860 - RNA, 18 nt, Human
aggaggcuaggcugcacc

SEQ ID NO: 398861 - RNA, 19 nt, Human
aggcaggcagaggugaggu

SEQ ID NO: 398862 - RNA, 19 nt, Human
aggcccagagcucaggcag

SEQ ID NO: 398863 - RNA, 21 nt, Human
agggagagaugggaauucugg

SEQ ID NO: 398864 - RNA, 23 nt, Human
aggguguagcuugagcaggaggc

SEQ ID NO: 398865 - RNA, 24 nt, Human
aguagcucccccuccacuccaccc

SEQ ID NO: 398866 - RNA, 18 nt, Human
auggcagacagcuccuuc

SEQ ID NO: 398867 - RNA, 19 nt, Human
cacaccuguccucuaccaa

SEQ ID NO: 398868 - RNA, 24 nt, Human
cacacucgaggucccuucccacag

SEQ ID NO: 398869 - RNA, 19 nt, Human
caccaguagcggguacacc

SEQ ID NO: 398870 - RNA, 18 nt, Human
caccugccuucaccacag

SEQ ID NO: 398871 - RNA, 18 nt, Human
cacuccacccugccccca

SEQ ID NO: 398872 - RNA, 24 nt, Human
cacuccccauucuaagaggacacu

SEQ ID NO: 398873 - RNA, 22 nt, Human
cacuccccucucagacagccua

SEQ ID NO: 398874 - RNA, 19 nt, Human
cagaguucugcagggccuc

SEQ ID NO: 398875 - RNA, 19 nt, Human
cagcagcuacagggaaggg

SEQ ID NO: 398876 - RNA, 26 nt, Human
caggcaggcagaggugaggugagugu

SEQ ID NO: 398877 - RNA, 22 nt, Human
caggggcagcagcggcucagag

SEQ ID NO: 398878 - RNA, 20 nt, Human
caggggcuucuccagagggu

SEQ ID NO: 398879 - RNA, 21 nt, Human
cagggucccaugagucaaagg

SEQ ID NO: 398880 - RNA, 22 nt, Human
ccacagccuugcaacaucuucc

SEQ ID NO: 398881 - RNA, 20 nt, Human
ccagagcucaggcagagagc

SEQ ID NO: 398882 - RNA, 19 nt, Human
ccccagugaggaggacagg

SEQ ID NO: 398883 - RNA, 25 nt, Human
cccccuccacuccacccugccccca

SEQ ID NO: 398884 - RNA, 18 nt, Human
ccccucucagacagccua

SEQ ID NO: 398885 - RNA, 21 nt, Human
ccccuuccucuuuccacuccc

SEQ ID NO: 398886 - RNA, 21 nt, Human
cccuuguaggcaccaucucca

SEQ ID NO: 398887 - RNA, 18 nt, Human
ccucuaccaagcccaggg

SEQ ID NO: 398888 - RNA, 22 nt, Human
ccugcaccacagcuggugcccu

SEQ ID NO: 398889 - RNA, 22 nt, Human
cucccccuccacuccacccugc

SEQ ID NO: 398890 - RNA, 21 nt, Human
cuucacacucgaggucccuuc

SEQ ID NO: 398891 - RNA, 23 nt, Human
cuuccacccucaggucuuggcuc

SEQ ID NO: 398892 - RNA, 18 nt, Human
cuugcugggcacucccca

SEQ ID NO: 398893 - RNA, 21 nt, Human
cuuguaggcaccaucuccaga

SEQ ID NO: 398894 - RNA, 26 nt, Human
ggaggagcuaaggcccagagcucagg

SEQ ID NO: 398895 - RNA, 21 nt, Human
ggagguggcaccgugcaggau

SEQ ID NO: 398896 - RNA, 23 nt, Human
gggcuucuccagagggucuggcg

SEQ ID NO: 398897 - RNA, 18 nt, Human
gggucagaccaggcaggc

SEQ ID NO: 398898 - RNA, 23 nt, Human
uaccaagcccagggaggagcuaa

SEQ ID NO: 398899 - RNA, 24 nt, Human
uagcaccaguagcggguacaccuu

SEQ ID NO: 398900 - RNA, 22 nt, Human
uaggcaccaucuccagaguucu

SEQ ID NO: 398901 - RNA, 25 nt, Human
uaguagcucccccuccacuccaccc

SEQ ID NO: 398902 - RNA, 21 nt, Human
ucaccccuuccucuuuccacu

SEQ ID NO: 398903 - RNA, 24 nt, Human
ucaccccuuccucuuuccacuccc

SEQ ID NO: 398904 - RNA, 22 nt, Human
ucagaccaggcaggcagaggug

SEQ ID NO: 398905 - RNA, 21 nt, Human
ucaggucuuggcuccugcacc

SEQ ID NO: 398906 - RNA, 19 nt, Human
uccacuccacccugccccc

SEQ ID NO: 398907 - RNA, 18 nt, Human
ucccaugagucaaaggcc

SEQ ID NO: 398908 - RNA, 20 nt, Human
ucccccuccacuccacccug

SEQ ID NO: 398909 - RNA, 18 nt, Human
ucccuucccacaggggca

SEQ ID NO: 398910 - RNA, 26 nt, Human
uccuucaccccuuccucuuuccacuc

SEQ ID NO: 398911 - RNA, 21 nt, Human
ucuaagaggacacuuccaccc

SEQ ID NO: 398912 - RNA, 18 nt, Human
ucugugucaggugugggg

SEQ ID NO: 398913 - RNA, 18 nt, Human
ugagcaggaggcuaggcu

SEQ ID NO: 398914 - RNA, 19 nt, Human
ugaguguggagguggcacc

SEQ ID NO: 398915 - RNA, 21 nt, Human
ugaguguggagguggcaccgu

SEQ ID NO: 398916 - RNA, 23 nt, Human
uggauagcaccaguagcggguac

SEQ ID NO: 398917 - RNA, 20 nt, Human
uggcagacagcuccuucacc

SEQ ID NO: 398918 - RNA, 19 nt, Human
uggcuccugcaccacagcu

SEQ ID NO: 398919 - RNA, 19 nt, Human
uuuauugagugccugcucu

SEQ ID NO: 398920 - RNA, 19 nt, Human
aaaaagcccggugcaagag

SEQ ID NO: 398921 - RNA, 20 nt, Human
aaaaagcccggugcaagaga

SEQ ID NO: 398922 - RNA, 21 nt, Human
aaaaagcccggugcaagagag

SEQ ID NO: 398923 - RNA, 20 nt, Human
aaaacacaggccuaugaaca

SEQ ID NO: 398924 - RNA, 25 nt, Human
aaacagaugcgucaagaaguaaaau

SEQ ID NO: 398925 - RNA, 23 nt, Human
aaacaggaagcgaccauucccag

SEQ ID NO: 398926 - RNA, 25 nt, Human
aaacaggaagcgaccauucccagag

SEQ ID NO: 398927 - RNA, 21 nt, Human
aacaccuuauaagugcauaaa

SEQ ID NO: 398928 - RNA, 22 nt, Human
aaccacccccccaacucagccu

SEQ ID NO: 398929 - RNA, 21 nt, Human
aagccgaggacagaugcagga

SEQ ID NO: 398930 - RNA, 18 nt, Human
aaggaguccagcccacaa

SEQ ID NO: 398931 - RNA, 21 nt, Human
aaggaguccagcccacaaggc

SEQ ID NO: 398932 - RNA, 26 nt, Human
aaggcgaggcuuaaaaggaaaaggga

SEQ ID NO: 398933 - RNA, 19 nt, Human
aaguguaaacacugugacc

SEQ ID NO: 398934 - RNA, 28 nt, Human
accccagaagcuccuccucccuuaccuc

SEQ ID NO: 398935 - RNA, 23 nt, Human
agacagacaaacccaaggagggu

SEQ ID NO: 398936 - RNA, 18 nt, Human
agacuuggaagcgaagug

SEQ ID NO: 398937 - RNA, 24 nt, Human
agacuuggaagcgaagugguaaaa

SEQ ID NO: 398938 - RNA, 20 nt, Human
agaugcaggagccagagaua

SEQ ID NO: 398939 - RNA, 22 nt, Human
agcaaccacccccccaacucag

SEQ ID NO: 398940 - RNA, 19 nt, Human
aggcaacagcggcuccugg

SEQ ID NO: 398941 - RNA, 18 nt, Human
aggccaggagggugggga

SEQ ID NO: 398942 - RNA, 20 nt, Human
aggggagggggagaggaagg

SEQ ID NO: 398943 - RNA, 22 nt, Human
aggggagggggagaggaaggcc

SEQ ID NO: 398944 - RNA, 19 nt, Human
aggggggcgcguguccuug

SEQ ID NO: 398945 - RNA, 24 nt, Human
aggguggggaggaguccugggucu

SEQ ID NO: 398946 - RNA, 18 nt, Human
aguucaggcuugcccuuc

SEQ ID NO: 398947 - RNA, 22 nt, Human
augcaggagccagagauagagg

SEQ ID NO: 398948 - RNA, 23 nt, Human
auucagaugacagcccuggggac

SEQ ID NO: 398949 - RNA, 21 nt, Human
caaaggaguccagcccacaag

SEQ ID NO: 398950 - RNA, 18 nt, Human
cacagggcagaaugggca

SEQ ID NO: 398951 - RNA, 19 nt, Human
caccaggagggacaguaac

SEQ ID NO: 398952 - RNA, 20 nt, Human
caccaggagggacaguaaca

SEQ ID NO: 398953 - RNA, 25 nt, Human
caccaggcgaaaaagcccggugcaa

SEQ ID NO: 398954 - RNA, 18 nt, Human
cacccccccaacucagcc

SEQ ID NO: 398955 - RNA, 18 nt, Human
cacccccccaacucagcc

SEQ ID NO: 398956 - RNA, 23 nt, Human
cagaugacagcccuggggacccc

SEQ ID NO: 398957 - RNA, 18 nt, Human
caggagccagagauagag

SEQ ID NO: 398958 - RNA, 21 nt, Human
caguguggccaugaccuugug

SEQ ID NO: 398959 - RNA, 25 nt, Human
ccacccccccaacucagccuucuua

SEQ ID NO: 398960 - RNA, 19 nt, Human
cccaacucagccuucuuag

SEQ ID NO: 398961 - RNA, 21 nt, Human
cccagagacggacagacagac

SEQ ID NO: 398962 - RNA, 25 nt, Human
cccaugccucaacauaccccuuugg

SEQ ID NO: 398963 - RNA, 18 nt, Human
ccccagaagcuccuccuc

SEQ ID NO: 398964 - RNA, 21 nt, Human
ccccagaagcuccuccucccu

SEQ ID NO: 398965 - RNA, 25 nt, Human
ccccagaagcuccuccucccuuacc

SEQ ID NO: 398966 - RNA, 24 nt, Human
ccccccaacucagccuucuuagac

SEQ ID NO: 398967 - RNA, 18 nt, Human
cccccccaccccucaaau

SEQ ID NO: 398968 - RNA, 20 nt, Human
ccccugagugggccuggggu

SEQ ID NO: 398969 - RNA, 24 nt, Human
cccuuuggggcgugcgagggcagu

SEQ ID NO: 398970 - RNA, 19 nt, Human
ccuaugaacaacugcuaua

SEQ ID NO: 398971 - RNA, 22 nt, Human
ccucacuuugaacugggccaaa

SEQ ID NO: 398972 - RNA, 20 nt, Human
ccuuguguuugugcuggacc

SEQ ID NO: 398973 - RNA, 24 nt, Human
cgaaggagaacagugucggcacaa

SEQ ID NO: 398974 - RNA, 21 nt, Human
cgaagugcgcagaaaggcuaa

SEQ ID NO: 398975 - RNA, 20 nt, Human
cggacagacagacaaaccca

SEQ ID NO: 398976 - RNA, 21 nt, Human
cggccuguuggagcccucccc

SEQ ID NO: 398977 - RNA, 22 nt, Human
cggcucggggggcagcuagcag

SEQ ID NO: 398978 - RNA, 20 nt, Human
cucuggggugacaccaggag

SEQ ID NO: 398979 - RNA, 22 nt, Human
cucugucugguugacacucucc

SEQ ID NO: 398980 - RNA, 18 nt, Human
cuggacccagugccaugc

SEQ ID NO: 398981 - RNA, 22 nt, Human
cuggcccuggccccaccggggg

SEQ ID NO: 398982 - RNA, 24 nt, Human
cuggcccuggccccaccggggggc

SEQ ID NO: 398983 - RNA, 22 nt, Human
cuguuggagcccuccccucacu

SEQ ID NO: 398984 - RNA, 18 nt, Human
gaaaaagcccggugcaag

SEQ ID NO: 398985 - RNA, 22 nt, Human
gaaggagaacagugucggcaca

SEQ ID NO: 398986 - RNA, 19 nt, Human
gagaagggguuucccaggg

SEQ ID NO: 398987 - RNA, 24 nt, Human
gagaaucuccuuaagggcucagcu

SEQ ID NO: 398988 - RNA, 19 nt, Human
gagggagagagggggcgcc

SEQ ID NO: 398989 - RNA, 18 nt, Human
gcagaaaggcuaaaguag

SEQ ID NO: 398990 - RNA, 19 nt, Human
gcagucugaggccaggagg

SEQ ID NO: 398991 - RNA, 20 nt, Human
gcccggugcaagagagcuuc

SEQ ID NO: 398992 - RNA, 19 nt, Human
gccgaggacagaugcagga

SEQ ID NO: 398993 - RNA, 22 nt, Human
gcgaaacacugucacucaacag

SEQ ID NO: 398994 - RNA, 21 nt, Human
gcgagggaggggaggggaggg

SEQ ID NO: 398995 - RNA, 19 nt, Human
ggaacaaggcgaggcuuaa

SEQ ID NO: 398996 - RNA, 18 nt, Human
ggacagacagacaaaccc

SEQ ID NO: 398997 - RNA, 20 nt, Human
ggagggacaguaacaccacc

SEQ ID NO: 398998 - RNA, 23 nt, Human
ggagggagagagggggcgccgua

SEQ ID NO: 398999 - RNA, 19 nt, Human
ggaggggagggagagaggg

SEQ ID NO: 399000 - RNA, 21 nt, Human
ggagggggagaggaaggccag

SEQ ID NO: 399001 - RNA, 18 nt, Human
ggcaguguuccccuccug

SEQ ID NO: 399002 - RNA, 25 nt, Human
ggcgaggcuuaaaaggaaaagggaa

SEQ ID NO: 399003 - RNA, 22 nt, Human
ggcggcggcgcucgcugcgcuc

SEQ ID NO: 399004 - RNA, 25 nt, Human
gggaaaacaggaagcgaccgguacc

SEQ ID NO: 399005 - RNA, 23 nt, Human
gggaggggagggagagagggggc

SEQ ID NO: 399006 - RNA, 23 nt, Human
gggauguguggugggggccuggc

SEQ ID NO: 399007 - RNA, 21 nt, Human
gggcaguguuccccuccuggg

SEQ ID NO: 399008 - RNA, 21 nt, Human
gggcugggauguguggugggg

SEQ ID NO: 399009 - RNA, 21 nt, Human
ggggaggggagggagagaggg

SEQ ID NO: 399010 - RNA, 23 nt, Human
ggggaggggagggggagaggaag

SEQ ID NO: 399011 - RNA, 24 nt, Human
ggggggcagcuagcaggggcuggg

SEQ ID NO: 399012 - RNA, 18 nt, Human
gggucugcugccagggug

SEQ ID NO: 399013 - RNA, 18 nt, Human
gggugaaugacagcgcga

SEQ ID NO: 399014 - RNA, 22 nt, Human
gggugcagucugaggccaggag

SEQ ID NO: 399015 - RNA, 20 nt, Human
ggguggggaggaguccuggg

SEQ ID NO: 399016 - RNA, 21 nt, Human
ggguggggaggaguccugggu

SEQ ID NO: 399017 - RNA, 20 nt, Human
ggguucuggagaaaugggcu

SEQ ID NO: 399018 - RNA, 24 nt, Human
ggucacagagaagggguuucccag

SEQ ID NO: 399019 - RNA, 19 nt, Human
gguggggaggaguccuggg

SEQ ID NO: 399020 - RNA, 21 nt, Human
guccugggucucaggccucag

SEQ ID NO: 399021 - RNA, 25 nt, Human
gugcuggacccagugccaugcuguu

SEQ ID NO: 399022 - RNA, 19 nt, Human
guguagugugucacagugu

SEQ ID NO: 399023 - RNA, 18 nt, Human
guucagacaggugcggga

SEQ ID NO: 399024 - RNA, 24 nt, Human
guuuggggucugcugccagggugc

SEQ ID NO: 399025 - RNA, 24 nt, Human
uaaaacacaggccuaugaacaacc

SEQ ID NO: 399026 - RNA, 22 nt, Human
uaaauaaacagaugcgucaaga

SEQ ID NO: 399027 - RNA, 23 nt, Human
uaaauuacacaagcacuuuauaa

SEQ ID NO: 399028 - RNA, 24 nt, Human
uaagguccaaaguguaaacacugu

SEQ ID NO: 399029 - RNA, 20 nt, Human
uagaugcccauguguggcuc

SEQ ID NO: 399030 - RNA, 19 nt, Human
uagcuguuggcuguugugu

SEQ ID NO: 399031 - RNA, 18 nt, Human
ucagacaggugcgggacg

SEQ ID NO: 399032 - RNA, 20 nt, Human
uccaaaguguaaacacugug

SEQ ID NO: 399033 - RNA, 22 nt, Human
ucccagagacggacagacagac

SEQ ID NO: 399034 - RNA, 23 nt, Human
ucccuuaccucccuugccuuucu

SEQ ID NO: 399035 - RNA, 18 nt, Human
uccugggucucaggccuc

SEQ ID NO: 399036 - RNA, 21 nt, Human
ucucuggcuucugcuuccccg

SEQ ID NO: 399037 - RNA, 25 nt, Human
ugaaggcaggcacaagucaagaggg

SEQ ID NO: 399038 - RNA, 19 nt, Human
ugaagucaacugucuuccc

SEQ ID NO: 399039 - RNA, 22 nt, Human
ugagugggccuggggucccaca

SEQ ID NO: 399040 - RNA, 21 nt, Human
ugccaugcuguucaggaugag

SEQ ID NO: 399041 - RNA, 27 nt, Human
ugcccaacugagaaucuccuuaagggc

SEQ ID NO: 399042 - RNA, 22 nt, Human
ugccucaacauaccccuuuggu

SEQ ID NO: 399043 - RNA, 23 nt, Human
ugggaggcaacagcggcuccugg

SEQ ID NO: 399044 - RNA, 21 nt, Human
ugggaggggggcgcguguccu

SEQ ID NO: 399045 - RNA, 24 nt, Human
ugggauguguggugggggccuggc

SEQ ID NO: 399046 - RNA, 21 nt, Human
ugggucacagagaagggguuu

SEQ ID NO: 399047 - RNA, 19 nt, Human
ugggugcagucugaggcca

SEQ ID NO: 399048 - RNA, 22 nt, Human
ugggugcagucugaggccagga

SEQ ID NO: 399049 - RNA, 18 nt, Human
ugguguagugugucacag

SEQ ID NO: 399050 - RNA, 23 nt, Human
uguccuugucccuugagcucuuc

SEQ ID NO: 399051 - RNA, 19 nt, Human
ugucggcacaaaugugggg

SEQ ID NO: 399052 - RNA, 18 nt, Human
ugugacccucugucuggu

SEQ ID NO: 399053 - RNA, 21 nt, Human
uguggcucuggggugacacca

SEQ ID NO: 399054 - RNA, 22 nt, Human
uguggcucuggggugacaccag

SEQ ID NO: 399055 - RNA, 18 nt, Human
ugugugaugagaaguggg

SEQ ID NO: 399056 - RNA, 18 nt, Human
uguuguagcuguuggcug

SEQ ID NO: 399057 - RNA, 23 nt, Human
uuaaaacacaggccuaugaacaa

SEQ ID NO: 399058 - RNA, 21 nt, Human
uuaacacccccccaccccuca

SEQ ID NO: 399059 - RNA, 19 nt, Human
uuccccuccugggugcagu

SEQ ID NO: 399060 - RNA, 18 nt, Human
uucccggccuguuggagc

SEQ ID NO: 399061 - RNA, 20 nt, Human
uuuauuuauuuuuuucacau

SEQ ID NO: 399062 - RNA, 20 nt, Human
uuugugcuggacccagugcc

SEQ ID NO: 399063 - RNA, 20 nt, Human
aaggaggccaccucaaguuc

SEQ ID NO: 399064 - RNA, 22 nt, Human
acaaaauggacacuacacguga

SEQ ID NO: 399065 - RNA, 22 nt, Human
agacagaggcauuauuuuugaa

SEQ ID NO: 399066 - RNA, 25 nt, Human
agagcuccggcggcggcggcggcgg

SEQ ID NO: 399067 - RNA, 24 nt, Human
aggcagccugaagaagguaggaaa

SEQ ID NO: 399068 - RNA, 21 nt, Human
auaucacaaauguucacaauu

SEQ ID NO: 399069 - RNA, 20 nt, Human
augagguccucaaugucuau

SEQ ID NO: 399070 - RNA, 22 nt, Human
caaaagaacagauaacuaucgu

SEQ ID NO: 399071 - RNA, 21 nt, Human
caaauguucacaauaucaaug

SEQ ID NO: 399072 - RNA, 22 nt, Human
caacugagaggcaaagaugcac

SEQ ID NO: 399073 - RNA, 23 nt, Human
caaugcaagaaaaaauacagaga

SEQ ID NO: 399074 - RNA, 24 nt, Human
cacaauagcaauuaauuggggaaa

SEQ ID NO: 399075 - RNA, 33 nt, Human
cacaauagcaauuaauuggggaaaaacaaaaag

SEQ ID NO: 399076 - RNA, 18 nt, Human
caccgaugaugaguugca

SEQ ID NO: 399077 - RNA, 22 nt, Human
cacucuguggcacaacagggcu

SEQ ID NO: 399078 - RNA, 22 nt, Human
cagagcuccggcggcggcggcg

SEQ ID NO: 399079 - RNA, 23 nt, Human
caugucuuaggcagccugaagaa

SEQ ID NO: 399080 - RNA, 25 nt, Human
caugucuuaggcagccugaagaagg

SEQ ID NO: 399081 - RNA, 19 nt, Human
ccaaaugagauuaagucaa

SEQ ID NO: 399082 - RNA, 23 nt, Human
ccaaguacagauggaggggcugg

SEQ ID NO: 399083 - RNA, 26 nt, Human
cccacacuacaugcagggcccaaagg

SEQ ID NO: 399084 - RNA, 19 nt, Human
cggcggcggcggcggcggc

SEQ ID NO: 399085 - RNA, 18 nt, Human
cggcgggcgggcgcgcgg

SEQ ID NO: 399086 - RNA, 18 nt, Human
cuacacucuguggcacaa

SEQ ID NO: 399087 - RNA, 22 nt, Human
cucccacacuacaugcagggcc

SEQ ID NO: 399088 - RNA, 19 nt, Human
cucuguggcacaacagggc

SEQ ID NO: 399089 - RNA, 18 nt, Human
gacuuguucccccuucac

SEQ ID NO: 399090 - RNA, 22 nt, Human
gacuuguucccccuucacacuc

SEQ ID NO: 399091 - RNA, 21 nt, Human
gcacguugugggguaaggggu

SEQ ID NO: 399092 - RNA, 21 nt, Human
gcaggcggcgggcgggcgcgc

SEQ ID NO: 399093 - RNA, 21 nt, Human
gcggcggcggcggcaggcggc

SEQ ID NO: 399094 - RNA, 28 nt, Human
gcggcggcggcggcaggcggcgggcgac

SEQ ID NO: 399095 - RNA, 21 nt, Human
gcggcggcggcggcggcaggc

SEQ ID NO: 399096 - RNA, 20 nt, Human
gcggcggcggcggcggcggc

SEQ ID NO: 399097 - RNA, 21 nt, Human
gcggcggcggcggcggcggca

SEQ ID NO: 399098 - RNA, 19 nt, Human
gcgggcgggcgcgcgggag

SEQ ID NO: 399099 - RNA, 21 nt, Human
gcgggcgggcgcgcgggaggg

SEQ ID NO: 399100 - RNA, 20 nt, Human
ggaccaaguacagauggagg

SEQ ID NO: 399101 - RNA, 21 nt, Human
ggaccaaguacagauggaggg

SEQ ID NO: 399102 - RNA, 22 nt, Human
ggccagcgauggugugauaacc

SEQ ID NO: 399103 - RNA, 20 nt, Human
ggcggcggcggcggcggcgg

SEQ ID NO: 399104 - RNA, 22 nt, Human
gggaaaaacaaaauaucauggc

SEQ ID NO: 399105 - RNA, 20 nt, Human
gggcccaaaggggccagcga

SEQ ID NO: 399106 - RNA, 20 nt, Human
guaacaagcaaggaggccac

SEQ ID NO: 399107 - RNA, 24 nt, Human
guggcacaacagggcuucacaaaa

SEQ ID NO: 399108 - RNA, 23 nt, Human
uaacaggagccucccacacuaca

SEQ ID NO: 399109 - RNA, 21 nt, Human
uacacauacccagguauguac

SEQ ID NO: 399110 - RNA, 21 nt, Human
uaccacagugaggagcuaaca

SEQ ID NO: 399111 - RNA, 22 nt, Human
uacccagguauguaacaagcaa

SEQ ID NO: 399112 - RNA, 25 nt, Human
uaucauggccuucacaagaagcaac

SEQ ID NO: 399113 - RNA, 23 nt, Human
uauuuugacuuguucccccuuca

SEQ ID NO: 399114 - RNA, 21 nt, Human
uccggcggcggcggcggcggc

SEQ ID NO: 399115 - RNA, 23 nt, Human
uccucauggacaauuauugaagu

SEQ ID NO: 399116 - RNA, 25 nt, Human
ucucuuauuccgucauucuugaaag

SEQ ID NO: 399117 - RNA, 18 nt, Human
ugacgugggcugaaaggu

SEQ ID NO: 399118 - RNA, 22 nt, Human
ugcacuaaacugccuacacaua

SEQ ID NO: 399119 - RNA, 19 nt, Human
ugcagggggaccuggcuac

SEQ ID NO: 399120 - RNA, 22 nt, Human
uggcacaacagggcuucacaaa

SEQ ID NO: 399121 - RNA, 24 nt, Human
uggcacaacagggcuucacaaaau

SEQ ID NO: 399122 - RNA, 20 nt, Human
uuuuuuuuuuuuuuuugcuu

SEQ ID NO: 399123 - RNA, 24 nt, Human
uuuuuuuuuuuuuuuugcuuguaa

SEQ ID NO: 399124 - RNA, 19 nt, Human
aaaaaaagacaacaaauaa

SEQ ID NO: 399125 - RNA, 23 nt, Human
aaaaauagcagaaccucgauggc

SEQ ID NO: 399126 - RNA, 25 nt, Human
aagcugguuggaaagaaggaauaac

SEQ ID NO: 399127 - RNA, 22 nt, Human
agaagaaguuuuaugaaaagaa

SEQ ID NO: 399128 - RNA, 24 nt, Human
agagaagaaguuuuaugaaaagaa

SEQ ID NO: 399129 - RNA, 23 nt, Human
agcaaggcagcaaaaaaagacaa

SEQ ID NO: 399130 - RNA, 21 nt, Human
caaaaaaagacaacaaauaac

SEQ ID NO: 399131 - RNA, 19 nt, Human
caaauaacaauacuuagga

SEQ ID NO: 399132 - RNA, 19 nt, Human
caagcaacucaagcaaggc

SEQ ID NO: 399133 - RNA, 28 nt, Human
caagcaaggcagcaaaaaaagacaacaa

SEQ ID NO: 399134 - RNA, 25 nt, Human
cagcaaaaaaagacaacaaauaaca

SEQ ID NO: 399135 - RNA, 19 nt, Human
cauaaaagaacccuagcca

SEQ ID NO: 399136 - RNA, 22 nt, Human
ccucuuaaaaacagaaauuggu

SEQ ID NO: 399137 - RNA, 18 nt, Human
cuggggugguacgacaca

SEQ ID NO: 399138 - RNA, 19 nt, Human
cuggggugguacgacacag

SEQ ID NO: 399139 - RNA, 18 nt, Human
gaaccaaauuucugugaa

SEQ ID NO: 399140 - RNA, 18 nt, Human
gcaaaaaaagacaacaaa

SEQ ID NO: 399141 - RNA, 21 nt, Human
gcaacucaagcaaggcagcaa

SEQ ID NO: 399142 - RNA, 21 nt, Human
guccuuguaauugucuccaau

SEQ ID NO: 399143 - RNA, 26 nt, Human
uaacaauacuuaggauacaucaauca

SEQ ID NO: 399144 - RNA, 22 nt, Human
uacgacacaggucagcaaucaa

SEQ ID NO: 399145 - RNA, 23 nt, Human
uauacauucucccugaccugaag

SEQ ID NO: 399146 - RNA, 23 nt, Human
uauggcaguacaugugacuuuau

SEQ ID NO: 399147 - RNA, 22 nt, Human
ucaaaagcuccucacugccucc

SEQ ID NO: 399148 - RNA, 21 nt, Human
ucacugccuccuucacggggc

SEQ ID NO: 399149 - RNA, 19 nt, Human
ucgauggcaauggacauuu

SEQ ID NO: 399150 - RNA, 18 nt, Human
ucucaaaaauagcagaac

SEQ ID NO: 399151 - RNA, 18 nt, Human
ugaaaauaacaaaauucu

SEQ ID NO: 399152 - RNA, 20 nt, Human
ugcuuucuuccuuugauuua

SEQ ID NO: 399153 - RNA, 20 nt, Human
uggaaagaaggaauaacugc

SEQ ID NO: 399154 - RNA, 21 nt, Human
uggaaagaaggaauaacugcc

SEQ ID NO: 399155 - RNA, 24 nt, Human
ugguuggaaagaaggaauaacugc

SEQ ID NO: 399156 - RNA, 23 nt, Human
uuauacauucucccugaccugaa

SEQ ID NO: 399157 - RNA, 23 nt, Human
uucaaggguuuuuggccagagag

SEQ ID NO: 399158 - RNA, 22 nt, Human
uuuauaaaucaaauuuguuaag

SEQ ID NO: 399159 - RNA, 20 nt, Human
agcguccaggaaggagcagg

SEQ ID NO: 399160 - RNA, 18 nt, Human
agggagugagcguccagg

SEQ ID NO: 399161 - RNA, 18 nt, Human
caggaaggacaggcggug

SEQ ID NO: 399162 - RNA, 18 nt, Human
uaacccggcggucagugg

SEQ ID NO: 399163 - RNA, 26 nt, Human
aaaccagauaaccuugacugggaagg

SEQ ID NO: 399164 - RNA, 18 nt, Human
aaauucacagugccuucc

SEQ ID NO: 399165 - RNA, 23 nt, Human
aagaaaaauaacagucaagagga

SEQ ID NO: 399166 - RNA, 20 nt, Human
acacuacaucaauagcaaag

SEQ ID NO: 399167 - RNA, 24 nt, Human
acucucugccugucagcagaacag

SEQ ID NO: 399168 - RNA, 20 nt, Human
agaacagagagucauaaaac

SEQ ID NO: 399169 - RNA, 24 nt, Human
aggcacaaacgaaaacuaagacuu

SEQ ID NO: 399170 - RNA, 19 nt, Human
caagagggaaaguaugaac

SEQ ID NO: 399171 - RNA, 21 nt, Human
caagcaacuuucuaauucaca

SEQ ID NO: 399172 - RNA, 22 nt, Human
cacaaacgaaaacuaagacuua

SEQ ID NO: 399173 - RNA, 21 nt, Human
cacagugccuuccaaaggccc

SEQ ID NO: 399174 - RNA, 23 nt, Human
cacagugccuuccaaaggccccc

SEQ ID NO: 399175 - RNA, 18 nt, Human
cagcagaacagagaguca

SEQ ID NO: 399176 - RNA, 20 nt, Human
ccagcagauuuucuacaagu

SEQ ID NO: 399177 - RNA, 19 nt, Human
ccagccaagcaacuuucua

SEQ ID NO: 399178 - RNA, 27 nt, Human
cccgagacccugcaccaccgcaccggg

SEQ ID NO: 399179 - RNA, 19 nt, Human
ccuaaggaaaauacaacaa

SEQ ID NO: 399180 - RNA, 21 nt, Human
ccucaauuuggaggcaaagaa

SEQ ID NO: 399181 - RNA, 24 nt, Human
cuaaaaacaguacucugaauagaa

SEQ ID NO: 399182 - RNA, 21 nt, Human
cuacaaguuaauuuaaacacg

SEQ ID NO: 399183 - RNA, 23 nt, Human
gcaccgggcgauuggaacacaga

SEQ ID NO: 399184 - RNA, 24 nt, Human
gccauggugguuugcugcaccuau

SEQ ID NO: 399185 - RNA, 19 nt, Human
ggauagaagguggacuuag

SEQ ID NO: 399186 - RNA, 21 nt, Human
guagagaggaauaggcccaca

SEQ ID NO: 399187 - RNA, 22 nt, Human
uaaauguccuuaaagguagaga

SEQ ID NO: 399188 - RNA, 20 nt, Human
uaaccuugacugggaaggag

SEQ ID NO: 399189 - RNA, 19 nt, Human
uacaaucaaaccagauaac

SEQ ID NO: 399190 - RNA, 27 nt, Human
uacacuguuaucaccaucuggcaaccc

SEQ ID NO: 399191 - RNA, 23 nt, Human
uacaucaauagcaaagucagagg

SEQ ID NO: 399192 - RNA, 23 nt, Human
uagcuuucucaguggaaaacaac

SEQ ID NO: 399193 - RNA, 23 nt, Human
ucaaaggcacaaacgaaaacuaa

SEQ ID NO: 399194 - RNA, 22 nt, Human
ucacaggggggacccuaaaugu

SEQ ID NO: 399195 - RNA, 24 nt, Human
ucauaauaaaugccucaauuugga

SEQ ID NO: 399196 - RNA, 21 nt, Human
uccccgagucuccccggaaac

SEQ ID NO: 399197 - RNA, 20 nt, Human
uccccggaaacugccgaaaa

SEQ ID NO: 399198 - RNA, 19 nt, Human
ucuaaaaacaguacucuga

SEQ ID NO: 399199 - RNA, 19 nt, Human
ucugaauagaaauguaggg

SEQ ID NO: 399200 - RNA, 18 nt, Human
uggacuuagaacauagca

SEQ ID NO: 399201 - RNA, 25 nt, Human
ugggaaggagccaguucagaggggu

SEQ ID NO: 399202 - RNA, 18 nt, Human
uguaguuuuuuggucuau

SEQ ID NO: 399203 - RNA, 19 nt, Human
uuacauagguauacaugug

SEQ ID NO: 399204 - RNA, 19 nt, Human
uuaucaccaucuggcaacc

SEQ ID NO: 399205 - RNA, 23 nt, Human
aacuguuucucaagaauuuccau

SEQ ID NO: 399206 - RNA, 21 nt, Human
acaauaccauauagcucacac

SEQ ID NO: 399207 - RNA, 19 nt, Human
acacaauaccauauagcuc

SEQ ID NO: 399208 - RNA, 20 nt, Human
aggaggaacaugaaguaaua

SEQ ID NO: 399209 - RNA, 21 nt, Human
caaaauaucaguaccaguaua

SEQ ID NO: 399210 - RNA, 20 nt, Human
cagccgccgcgccgcucgcc

SEQ ID NO: 399211 - RNA, 21 nt, Human
cauauucuuaaguacucacgu

SEQ ID NO: 399212 - RNA, 18 nt, Human
ccgccgcgccgcucgccc

SEQ ID NO: 399213 - RNA, 21 nt, Human
ccuucaaaaaaaauuuacaca

SEQ ID NO: 399214 - RNA, 20 nt, Human
cgccgcgccgcucgcccuuc

SEQ ID NO: 399215 - RNA, 18 nt, Human
gaaaggaggaacaugaag

SEQ ID NO: 399216 - RNA, 19 nt, Human
uacagugcagagcaagaau

SEQ ID NO: 399217 - RNA, 19 nt, Human
uaguaauuuagaaaggagg

SEQ ID NO: 399218 - RNA, 21 nt, Human
uccauuuuccuucaaaaaaaa

SEQ ID NO: 399219 - RNA, 22 nt, Human
uuuuuuuuuuuuuugagaugga

SEQ ID NO: 399220 - RNA, 18 nt, Human
uuuuuuuuuuuuuuuuug

SEQ ID NO: 399221 - RNA, 23 nt, Human
aaacacccaacccccgcuucccc

SEQ ID NO: 399222 - RNA, 28 nt, Human
aaacuaccauagccaagacuaaagacac

SEQ ID NO: 399223 - RNA, 19 nt, Human
aacccccgcuuccccaggu

SEQ ID NO: 399224 - RNA, 23 nt, Human
aaggguuuuuacugaaaggaucc

SEQ ID NO: 399225 - RNA, 21 nt, Human
acccaacccccgcuuccccag

SEQ ID NO: 399226 - RNA, 21 nt, Human
agcauggugacagugaaacua

SEQ ID NO: 399227 - RNA, 18 nt, Human
aggauccauggggggaug

SEQ ID NO: 399228 - RNA, 18 nt, Human
auagccaagacuaaagac

SEQ ID NO: 399229 - RNA, 20 nt, Human
cagguagggcugacugggca

SEQ ID NO: 399230 - RNA, 20 nt, Human
ccauagccaagacuaaagac

SEQ ID NO: 399231 - RNA, 22 nt, Human
ccauagccaagacuaaagacac

SEQ ID NO: 399232 - RNA, 19 nt, Human
cccgcacaaaggucgaccc

SEQ ID NO: 399233 - RNA, 22 nt, Human
cccgcugcgcccugggcaggcc

SEQ ID NO: 399234 - RNA, 20 nt, Human
ccgcugcgcccugggcaggc

SEQ ID NO: 399235 - RNA, 21 nt, Human
cguaaacagaguccugggucc

SEQ ID NO: 399236 - RNA, 23 nt, Human
gaaacuaccauagccaagacuaa

SEQ ID NO: 399237 - RNA, 23 nt, Human
gagcauggugacagugaaacuac

SEQ ID NO: 399238 - RNA, 18 nt, Human
gccaagacuaaagacacc

SEQ ID NO: 399239 - RNA, 19 nt, Human
ggggggaugauggguaagu

SEQ ID NO: 399240 - RNA, 19 nt, Human
guaaguucuggaaggggua

SEQ ID NO: 399241 - RNA, 20 nt, Human
uaaaacacccaacccccgcu

SEQ ID NO: 399242 - RNA, 23 nt, Human
uaaaacacccaacccccgcuucc

SEQ ID NO: 399243 - RNA, 24 nt, Human
uccuggguccugaguccacagcuc

SEQ ID NO: 399244 - RNA, 19 nt, Human
ucucuaaaacacccaaccc

SEQ ID NO: 399245 - RNA, 23 nt, Human
ugaaacuaccauagccaagacua

SEQ ID NO: 399246 - RNA, 22 nt, Human
uggaccccggcucagccccgac

SEQ ID NO: 399247 - RNA, 20 nt, Human
uggguccugaguccacagcu

SEQ ID NO: 399248 - RNA, 21 nt, Human
uggguccugaguccacagcuc

SEQ ID NO: 399249 - RNA, 25 nt, Human
aaaaaguuuaaauuauacccacuga

SEQ ID NO: 399250 - RNA, 20 nt, Human
aaaagucugugcaaacuaca

SEQ ID NO: 399251 - RNA, 24 nt, Human
aacauucucaagaaaaaaaaaccc

SEQ ID NO: 399252 - RNA, 18 nt, Human
aaccuacggccugaaccu

SEQ ID NO: 399253 - RNA, 23 nt, Human
aguaacauucucaagaaaaaaaa

SEQ ID NO: 399254 - RNA, 18 nt, Human
cacuaugcuuuucugaag

SEQ ID NO: 399255 - RNA, 19 nt, Human
ccauuggaaaccuguaaca

SEQ ID NO: 399256 - RNA, 24 nt, Human
ccgccgccgcccccgcgggggucu

SEQ ID NO: 399257 - RNA, 24 nt, Human
ccucuuuaguacuaaaauaagggu

SEQ ID NO: 399258 - RNA, 19 nt, Human
ccugaaccuuaaaaaaaaa

SEQ ID NO: 399259 - RNA, 25 nt, Human
ccugaaccuuaaaaaaaaaucucua

SEQ ID NO: 399260 - RNA, 22 nt, Human
ccuuacagucugcugcuuuacc

SEQ ID NO: 399261 - RNA, 23 nt, Human
cggccgccgccgcccccgcgggg

SEQ ID NO: 399262 - RNA, 25 nt, Human
cuaaaauaaggguuuaucagucuac

SEQ ID NO: 399263 - RNA, 22 nt, Human
gaaccuacggccugaaccuuaa

SEQ ID NO: 399264 - RNA, 19 nt, Human
gagugaccaucagugaccu

SEQ ID NO: 399265 - RNA, 21 nt, Human
gccauuggaaaccuguaacaa

SEQ ID NO: 399266 - RNA, 25 nt, Human
gccgcccccgcgggggucuccgcgc

SEQ ID NO: 399267 - RNA, 21 nt, Human
ggaauacuuuaguccaaaagc

SEQ ID NO: 399268 - RNA, 26 nt, Human
guugcaauuggcuaaguugucaacuu

SEQ ID NO: 399269 - RNA, 21 nt, Human
uaaggaaaagugcccuaaaaa

SEQ ID NO: 399270 - RNA, 23 nt, Human
uacagauuuucuuuaaaaaguuu

SEQ ID NO: 399271 - RNA, 22 nt, Human
uacauuagcgcccuacugaaag

SEQ ID NO: 399272 - RNA, 21 nt, Human
uagcgcccuacugaaaggaag

SEQ ID NO: 399273 - RNA, 21 nt, Human
uaggagucuaccaauguggca

SEQ ID NO: 399274 - RNA, 19 nt, Human
ucucaagaaaaaaaaaccc

SEQ ID NO: 399275 - RNA, 21 nt, Human
ucucuaaagaccuuacagucu

SEQ ID NO: 399276 - RNA, 18 nt, Human
ugaagcuuuucaucugag

SEQ ID NO: 399277 - RNA, 19 nt, Human
ugugcaaacuacaacauga

SEQ ID NO: 399278 - RNA, 21 nt, Human
uuaugcauaaaagucugugca

SEQ ID NO: 399279 - RNA, 22 nt, Human
uuggcuaaguugucaacuguau

SEQ ID NO: 399280 - RNA, 23 nt, Human
accaccucuucucugagguuguu

SEQ ID NO: 399281 - RNA, 19 nt, Human
acccgcuccagcucuccuu

SEQ ID NO: 399282 - RNA, 21 nt, Human
aggaaacacuguccgccccau

SEQ ID NO: 399283 - RNA, 21 nt, Human
cacaauagucagucaaggaaa

SEQ ID NO: 399284 - RNA, 21 nt, Human
cagcucuccuucgcuuagccu

SEQ ID NO: 399285 - RNA, 18 nt, Human
cccccgcucuuaguucac

SEQ ID NO: 399286 - RNA, 18 nt, Human
cccgggggccugaguggg

SEQ ID NO: 399287 - RNA, 18 nt, Human
ccuccgaauuccagcggg

SEQ ID NO: 399288 - RNA, 25 nt, Human
ccuugcucuaaaccaccucuucucu

SEQ ID NO: 399289 - RNA, 22 nt, Human
cgcuccagcucuccuucgcuua

SEQ ID NO: 399290 - RNA, 21 nt, Human
cuccgcuccgccggagagaga

SEQ ID NO: 399291 - RNA, 19 nt, Human
cucuaaaccaccucuucuc

SEQ ID NO: 399292 - RNA, 23 nt, Human
cucucugccccauuacccagggg

SEQ ID NO: 399293 - RNA, 20 nt, Human
gcccgggggccugagugggg

SEQ ID NO: 399294 - RNA, 22 nt, Human
ucgcuuagccuuugccccaggu

SEQ ID NO: 399295 - RNA, 22 nt, Human
ucucugccccauuacccagggg

SEQ ID NO: 399296 - RNA, 22 nt, Human
ugcucuaaaccaccucuucucu

SEQ ID NO: 399297 - RNA, 19 nt, Human
ugggggccauggucuccgc

SEQ ID NO: 399298 - RNA, 25 nt, Human
uuaguucacccgcuccagcucuccu

SEQ ID NO: 399299 - RNA, 21 nt, Human
uucacccgcuccagcucuccu

SEQ ID NO: 399300 - RNA, 19 nt, Human
uugcucuaaaccaccucuu

SEQ ID NO: 399301 - RNA, 18 nt, Human
uuugccccaggucccauc

SEQ ID NO: 399302 - RNA, 22 nt, Human
uuugccccaggucccaucucuc

SEQ ID NO: 399303 - RNA, 20 nt, Human
aaaaagaaacaccagugcuc

SEQ ID NO: 399304 - RNA, 18 nt, Human
aacuccaaagcugaggca

SEQ ID NO: 399305 - RNA, 22 nt, Human
aagggguuauaaaaagaaacac

SEQ ID NO: 399306 - RNA, 22 nt, Human
acaaucaaggcucacuguagcc

SEQ ID NO: 399307 - RNA, 18 nt, Human
agcugggaguaggcaugu

SEQ ID NO: 399308 - RNA, 21 nt, Human
agcugggaguaggcaugugcc

SEQ ID NO: 399309 - RNA, 23 nt, Human
aggcucaggugagagacuuguuu

SEQ ID NO: 399310 - RNA, 24 nt, Human
agggauccucccaucucagucucc

SEQ ID NO: 399311 - RNA, 24 nt, Human
agggucucugucacccaagcugga

SEQ ID NO: 399312 - RNA, 22 nt, Human
aguauugggauuacagguguga

SEQ ID NO: 399313 - RNA, 23 nt, Human
agucuccuugggagcugggagua

SEQ ID NO: 399314 - RNA, 21 nt, Human
auaauaaacucccuccgaaag

SEQ ID NO: 399315 - RNA, 21 nt, Human
aucaaaucccuaaaucuccaa

SEQ ID NO: 399316 - RNA, 23 nt, Human
cacaaucaaggcucacuguagcc

SEQ ID NO: 399317 - RNA, 22 nt, Human
caccaugucuggcuugcuucuc

SEQ ID NO: 399318 - RNA, 21 nt, Human
cacuccaggcaugaacuccaa

SEQ ID NO: 399319 - RNA, 23 nt, Human
cagggauccucccaucucagucu

SEQ ID NO: 399320 - RNA, 19 nt, Human
cagggcuccagggauccuc

SEQ ID NO: 399321 - RNA, 23 nt, Human
caguauugggauuacagguguga

SEQ ID NO: 399322 - RNA, 24 nt, Human
caguauugggauuacaggugugag

SEQ ID NO: 399323 - RNA, 27 nt, Human
caucucagucuccuugggagcugggag

SEQ ID NO: 399324 - RNA, 21 nt, Human
caugucggucucaaacuccug

SEQ ID NO: 399325 - RNA, 24 nt, Human
cauguugcccaugucggucucaaa

SEQ ID NO: 399326 - RNA, 27 nt, Human
ccagggauccucccaucucagucuccu

SEQ ID NO: 399327 - RNA, 19 nt, Human
ccaguauugggauuacagg

SEQ ID NO: 399328 - RNA, 23 nt, Human
cccaagcuggagugcagugacac

SEQ ID NO: 399329 - RNA, 23 nt, Human
cccaguauugggauuacaggugu

SEQ ID NO: 399330 - RNA, 21 nt, Human
cccuaaaucuccaaauacugu

SEQ ID NO: 399331 - RNA, 25 nt, Human
ccucccaucucagucuccuugggag

SEQ ID NO: 399332 - RNA, 22 nt, Human
ccugggcucaagcgauacuccc

SEQ ID NO: 399333 - RNA, 20 nt, Human
ccuugggagcugggaguagg

SEQ ID NO: 399334 - RNA, 24 nt, Human
cucaagcgauacucccaccuuggc

SEQ ID NO: 399335 - RNA, 21 nt, Human
cucaauaauaaacucccuccg

SEQ ID NO: 399336 - RNA, 21 nt, Human
cucagucuccuugggagcugg

SEQ ID NO: 399337 - RNA, 19 nt, Human
cucugucacccaagcugga

SEQ ID NO: 399338 - RNA, 23 nt, Human
cucugucacccaagcuggagugc

SEQ ID NO: 399339 - RNA, 20 nt, Human
gaaaaagccucccuaccacc

SEQ ID NO: 399340 - RNA, 20 nt, Human
gagauggggucuugucaugu

SEQ ID NO: 399341 - RNA, 18 nt, Human
gauuacaggugugagcca

SEQ ID NO: 399342 - RNA, 21 nt, Human
gauuacaggugugagccacca

SEQ ID NO: 399343 - RNA, 24 nt, Human
gauuacaggugugagccaccaugu

SEQ ID NO: 399344 - RNA, 24 nt, Human
gcaaagaacagauauauaugccug

SEQ ID NO: 399345 - RNA, 19 nt, Human
gcuggagugcagugacaca

SEQ ID NO: 399346 - RNA, 23 nt, Human
ggaaauaagaaaaagccucccua

SEQ ID NO: 399347 - RNA, 24 nt, Human
ggauuacaggugugagccaccaug

SEQ ID NO: 399348 - RNA, 25 nt, Human
ggccgggcugggcccacgccagggc

SEQ ID NO: 399349 - RNA, 22 nt, Human
guacacccuuaccauauaucaa

SEQ ID NO: 399350 - RNA, 22 nt, Human
guagagauggggucuugucaug

SEQ ID NO: 399351 - RNA, 20 nt, Human
uaagaaaaagccucccuacc

SEQ ID NO: 399352 - RNA, 27 nt, Human
uaauaaacucccuccgaaaguuuagac

SEQ ID NO: 399353 - RNA, 18 nt, Human
uacaggugugagccacca

SEQ ID NO: 399354 - RNA, 18 nt, Human
uacaggugugagccacca

SEQ ID NO: 399355 - RNA, 23 nt, Human
uacaggugugagccaccaugucu

SEQ ID NO: 399356 - RNA, 25 nt, Human
ucaauaauaaacucccuccgaaagu

SEQ ID NO: 399357 - RNA, 18 nt, Human
ucauagauuuguaaacca

SEQ ID NO: 399358 - RNA, 22 nt, Human
uccaaagcugaggcacacugac

SEQ ID NO: 399359 - RNA, 19 nt, Human
uccaggcaugaacuccaaa

SEQ ID NO: 399360 - RNA, 19 nt, Human
ucccaccuuggcuucccag

SEQ ID NO: 399361 - RNA, 21 nt, Human
ucccaguauugggauuacagg

SEQ ID NO: 399362 - RNA, 21 nt, Human
ucccaguauugggauuacagg

SEQ ID NO: 399363 - RNA, 19 nt, Human
uccgaaaguuuagacaggc

SEQ ID NO: 399364 - RNA, 21 nt, Human
uccugggcucaagcgauacuc

SEQ ID NO: 399365 - RNA, 24 nt, Human
uccugggcucaagcgauacuccca

SEQ ID NO: 399366 - RNA, 22 nt, Human
ucucaaacuccugggcucaagc

SEQ ID NO: 399367 - RNA, 19 nt, Human
ucuccuugggagcugggag

SEQ ID NO: 399368 - RNA, 24 nt, Human
ucugucacccaagcuggagugcag

SEQ ID NO: 399369 - RNA, 23 nt, Human
ugaaccacuccaggcaugaacuc

SEQ ID NO: 399370 - RNA, 20 nt, Human
ugacacaaucaaggcucacu

SEQ ID NO: 399371 - RNA, 21 nt, Human
ugaggcacacugaccaagccc

SEQ ID NO: 399372 - RNA, 19 nt, Human
ugccugggccgggcugggc

SEQ ID NO: 399373 - RNA, 22 nt, Human
ugccugggccgggcugggccca

SEQ ID NO: 399374 - RNA, 24 nt, Human
uggagugcagugacacaaucaagg

SEQ ID NO: 399375 - RNA, 21 nt, Human
ugggagcugggaguaggcaug

SEQ ID NO: 399376 - RNA, 18 nt, Human
ugggauuacaggugugag

SEQ ID NO: 399377 - RNA, 22 nt, Human
ugggauuacaggugugagccac

SEQ ID NO: 399378 - RNA, 23 nt, Human
ugggauuacaggugugagccacc

SEQ ID NO: 399379 - RNA, 24 nt, Human
ugggauuacaggugugagccacca

SEQ ID NO: 399380 - RNA, 25 nt, Human
ugggauuacaggugugagccaccau

SEQ ID NO: 399381 - RNA, 21 nt, Human
uggucaucuuucucauucucu

SEQ ID NO: 399382 - RNA, 24 nt, Human
uguagagauggggucuugucaugu

SEQ ID NO: 399383 - RNA, 21 nt, Human
ugugagccaccaugucuggcu

SEQ ID NO: 399384 - RNA, 21 nt, Human
uugggauuacaggugugagcc

SEQ ID NO: 399385 - RNA, 24 nt, Human
uuguagagauggggucuugucaug

SEQ ID NO: 399386 - RNA, 21 nt, Human
uuuaauuuuuuuaauguaucu

SEQ ID NO: 399387 - RNA, 23 nt, Human
uuuggucaucuuucucauucucu

SEQ ID NO: 399388 - RNA, 18 nt, Human
uuuguagagauggggucu

SEQ ID NO: 399389 - RNA, 24 nt, Human
uuuguagagauggggucuugucau

SEQ ID NO: 399390 - RNA, 27 nt, Human
uuuuaauuuuuuuaauguaucuauuua

SEQ ID NO: 399391 - RNA, 24 nt, Human
uuuuuuguagagauggggucuugu

SEQ ID NO: 399392 - RNA, 22 nt, Human
uuuuuuuguagagauggggucu

SEQ ID NO: 399393 - RNA, 22 nt, Human
aagcauucaccagaccacucca

SEQ ID NO: 399394 - RNA, 24 nt, Human
aaucacuugaaccugggaggcgga

SEQ ID NO: 399395 - RNA, 22 nt, Human
accacugcacuccagccugggc

SEQ ID NO: 399396 - RNA, 24 nt, Human
acugcaccacgcagacuaaaacag

SEQ ID NO: 399397 - RNA, 24 nt, Human
acugcacuccagccugggcaacag

SEQ ID NO: 399398 - RNA, 24 nt, Human
acugcacuccagccugggcaacag

SEQ ID NO: 399399 - RNA, 18 nt, Human
agaaacaguuucugacuu

SEQ ID NO: 399400 - RNA, 22 nt, Human
agaaucacuugaaccugggagg

SEQ ID NO: 399401 - RNA, 21 nt, Human
agccugggcaacagaguaaga

SEQ ID NO: 399402 - RNA, 23 nt, Human
aggaggccgaggcaggagaauca

SEQ ID NO: 399403 - RNA, 20 nt, Human
aggcaaaguguaccuuuucu

SEQ ID NO: 399404 - RNA, 22 nt, Human
aggcaggagaaucacuugaacc

SEQ ID NO: 399405 - RNA, 24 nt, Human
aggcaggagaaucacuugaaccug

SEQ ID NO: 399406 - RNA, 24 nt, Human
aggccgaggcaggagaaucacuug

SEQ ID NO: 399407 - RNA, 21 nt, Human
aggcggagguugcagagagcc

SEQ ID NO: 399408 - RNA, 24 nt, Human
aggcggagguugcagagagccgag

SEQ ID NO: 399409 - RNA, 21 nt, Human
aggggagagaguggcucugca

SEQ ID NO: 399410 - RNA, 24 nt, Human
aucgcaccacugcacuccagccug

SEQ ID NO: 399411 - RNA, 28 nt, Human
aucgcaccacugcacuccagccugggca

SEQ ID NO: 399412 - RNA, 19 nt, Human
caaaccgaggucuaucugu

SEQ ID NO: 399413 - RNA, 28 nt, Human
caccagaccacuccacguggacaguucc

SEQ ID NO: 399414 - RNA, 20 nt, Human
cacugcaccacgcagacuaa

SEQ ID NO: 399415 - RNA, 19 nt, Human
cacugcacuccagccuggg

SEQ ID NO: 399416 - RNA, 21 nt, Human
cacugcacuccagccugggca

SEQ ID NO: 399417 - RNA, 22 nt, Human
cacugcacuccagccugggcaa

SEQ ID NO: 399418 - RNA, 23 nt, Human
cacugcacuccagccugggcaac

SEQ ID NO: 399419 - RNA, 24 nt, Human
cacugcacuccagccugggcaaca

SEQ ID NO: 399420 - RNA, 25 nt, Human
cacugcacuccagccugggcaacaa

SEQ ID NO: 399421 - RNA, 27 nt, Human
cacugcacuccagccugggcaacagag

SEQ ID NO: 399422 - RNA, 21 nt, Human
cacuugaaccugggaggcgga

SEQ ID NO: 399423 - RNA, 21 nt, Human
cagaguaagaucccaucuggc

SEQ ID NO: 399424 - RNA, 24 nt, Human
cagcuacucaggaggccgaggcag

SEQ ID NO: 399425 - RNA, 22 nt, Human
caggggagagaguggcucugca

SEQ ID NO: 399426 - RNA, 26 nt, Human
caggggguuuuccauuuuugaggcuu

SEQ ID NO: 399427 - RNA, 23 nt, Human
caguagagcugagauucaaaccg

SEQ ID NO: 399428 - RNA, 26 nt, Human
cagugaucuuucauggccugaaaucc

SEQ ID NO: 399429 - RNA, 18 nt, Human
caguuccuuccccacagg

SEQ ID NO: 399430 - RNA, 21 nt, Human
ccacgcagacuaaaacaguga

SEQ ID NO: 399431 - RNA, 20 nt, Human
ccacugcacuccagccuggg

SEQ ID NO: 399432 - RNA, 21 nt, Human
ccacugcacuccagccugggc

SEQ ID NO: 399433 - RNA, 23 nt, Human
ccacugcacuccagccugggcaa

SEQ ID NO: 399434 - RNA, 24 nt, Human
ccacugcacuccagccugggcaac

SEQ ID NO: 399435 - RNA, 24 nt, Human
cgagaucgcaccacugcacuccag

SEQ ID NO: 399436 - RNA, 20 nt, Human
cgaggcaggagaaucacuug

SEQ ID NO: 399437 - RNA, 24 nt, Human
cgaggcaggagaaucacuugaacc

SEQ ID NO: 399438 - RNA, 21 nt, Human
cgcaccacugcacuccagccu

SEQ ID NO: 399439 - RNA, 22 nt, Human
cuaucuguuccacugcaccacg

SEQ ID NO: 399440 - RNA, 27 nt, Human
cucaauuuguuaaaaaaaaaaaaaaaa

SEQ ID NO: 399441 - RNA, 21 nt, Human
cuccacguggacaguuccuuc

SEQ ID NO: 399442 - RNA, 19 nt, Human
cuggcuaguuuggagaggg

SEQ ID NO: 399443 - RNA, 24 nt, Human
cuugaaaauccaucaaggguagaa

SEQ ID NO: 399444 - RNA, 23 nt, Human
gaaauggagcaggggagagagug

SEQ ID NO: 399445 - RNA, 20 nt, Human
gcaccacugcacuccagccu

SEQ ID NO: 399446 - RNA, 24 nt, Human
gcacuccagccugggcaacagagu

SEQ ID NO: 399447 - RNA, 23 nt, Human
gcaggagaaucacuugaaccugg

SEQ ID NO: 399448 - RNA, 19 nt, Human
gccgagaucgcaccacugc

SEQ ID NO: 399449 - RNA, 23 nt, Human
gccugaaaucccagcuacucagg

SEQ ID NO: 399450 - RNA, 24 nt, Human
ggagguugcagagagccgagaucg

SEQ ID NO: 399451 - RNA, 27 nt, Human
ggccgaggcaggagaaucacuugaacc

SEQ ID NO: 399452 - RNA, 18 nt, Human
gguucugcccucauaguu

SEQ ID NO: 399453 - RNA, 20 nt, Human
guuaaaaaaaaaaaaaaagu

SEQ ID NO: 399454 - RNA, 21 nt, Human
guugcagagagccgagaucgc

SEQ ID NO: 399455 - RNA, 22 nt, Human
uaaaaugaaaguucauaugagc

SEQ ID NO: 399456 - RNA, 19 nt, Human
uaacccaccaacuaaacca

SEQ ID NO: 399457 - RNA, 23 nt, Human
uaugagcaaauuuuuuuuaauua

SEQ ID NO: 399458 - RNA, 25 nt, Human
ucaauuuguuaaaaaaaaaaaaaaa

SEQ ID NO: 399459 - RNA, 24 nt, Human
ucacuugaaccugggaggcggagg

SEQ ID NO: 399460 - RNA, 25 nt, Human
ucacuugaaccugggaggcggaggu

SEQ ID NO: 399461 - RNA, 18 nt, Human
ucagaaggucucaguggc

SEQ ID NO: 399462 - RNA, 21 nt, Human
uccacguggacaguuccuucc

SEQ ID NO: 399463 - RNA, 20 nt, Human
uccauuuuugaggcuucugg

SEQ ID NO: 399464 - RNA, 23 nt, Human
ucgcaccacugcacuccagccug

SEQ ID NO: 399465 - RNA, 31 nt, Human
ucuaaacucaauuuguuaaaaaaaaaaaaag

SEQ ID NO: 399466 - RNA, 24 nt, Human
ugaaccugggaggcggagguugca

SEQ ID NO: 399467 - RNA, 25 nt, Human
ugauuccuaaauuucagcaacuccu

SEQ ID NO: 399468 - RNA, 27 nt, Human
ugauuccuaaauuucagcaacuccuuu

SEQ ID NO: 399469 - RNA, 18 nt, Human
uggauuacacucacuucu

SEQ ID NO: 399470 - RNA, 19 nt, Human
uggcucugcagaaacaguu

SEQ ID NO: 399471 - RNA, 24 nt, Human
ugggaggcggagguugcagagagc

SEQ ID NO: 399472 - RNA, 24 nt, Human
uuaaacagcaaggcaaaguguacc

SEQ ID NO: 399473 - RNA, 22 nt, Human
uuccauuuuugaggcuucuggc

SEQ ID NO: 399474 - RNA, 24 nt, Human
uugaaccugggaggcggagguugc

SEQ ID NO: 399475 - RNA, 22 nt, Human
uugcagagagccgagaucgcac

SEQ ID NO: 399476 - RNA, 18 nt, Human
uugcuggguucugcccuc

SEQ ID NO: 399477 - RNA, 21 nt, Human
uuucauggccugaaaucccag

SEQ ID NO: 399478 - RNA, 23 nt, Human
uuuggggcaaugauuccuaaauu

SEQ ID NO: 399479 - RNA, 21 nt, Human
uuuuaauuaacccaccaacua

SEQ ID NO: 399480 - RNA, 20 nt, Human
aagccacugucuuccuccuu

SEQ ID NO: 399481 - RNA, 22 nt, Human
acuccgaaaaucgggaggcaag

SEQ ID NO: 399482 - RNA, 18 nt, Human
agacagagcauguaugug

SEQ ID NO: 399483 - RNA, 22 nt, Human
aggcccuucuccaucccccucc

SEQ ID NO: 399484 - RNA, 21 nt, Human
caucccccuccugguuaggga

SEQ ID NO: 399485 - RNA, 22 nt, Human
caugcauuccaagagaggagac

SEQ ID NO: 399486 - RNA, 22 nt, Human
cauggcccuuccccaacuccga

SEQ ID NO: 399487 - RNA, 18 nt, Human
cccuagggucgaggcucc

SEQ ID NO: 399488 - RNA, 22 nt, Human
cccuuccccaacuccgaaaauc

SEQ ID NO: 399489 - RNA, 24 nt, Human
ccuccuucgguagcugacaagggc

SEQ ID NO: 399490 - RNA, 21 nt, Human
cugucuuccuccuucgguagc

SEQ ID NO: 399491 - RNA, 19 nt, Human
gagaggagacagagcaugu

SEQ ID NO: 399492 - RNA, 21 nt, Human
gcccuucuccaucccccuccu

SEQ ID NO: 399493 - RNA, 21 nt, Human
gcugacaagggccugaaggaa

SEQ ID NO: 399494 - RNA, 20 nt, Human
gggagagaaccuugguuugg

SEQ ID NO: 399495 - RNA, 23 nt, Human
gugaagccacugucuuccuccuu

SEQ ID NO: 399496 - RNA, 23 nt, Human
ucaugcauuccaagagaggagac

SEQ ID NO: 399497 - RNA, 21 nt, Human
ucauggcccuuccccaacucc

SEQ ID NO: 399498 - RNA, 19 nt, Human
ucccuaaaggacaggugaa

SEQ ID NO: 399499 - RNA, 21 nt, Human
ugaaggaaucaaaguucaugc

SEQ ID NO: 399500 - RNA, 19 nt, Human
ugagaggaaagaggggaga

SEQ ID NO: 399501 - RNA, 20 nt, Human
uggaaaaagucuacgagggu

SEQ ID NO: 399502 - RNA, 21 nt, Human
uggaaaaagucuacgagggug

SEQ ID NO: 399503 - RNA, 19 nt, Human
ugguaugugugaaacuggg

SEQ ID NO: 399504 - RNA, 27 nt, Human
ugucugaaccaagauauuugggagggc

SEQ ID NO: 399505 - RNA, 25 nt, Human
ugucuuccuccuucgguagcugaca

SEQ ID NO: 399506 - RNA, 22 nt, Human
aaaaaaagacauaauaaaugua

SEQ ID NO: 399507 - RNA, 21 nt, Human
aaaaaagacauaauaaaugua

SEQ ID NO: 399508 - RNA, 30 nt, Human
aauguacauacacauggucaguguacauag

SEQ ID NO: 399509 - RNA, 19 nt, Human
acacuauaaaauguccaaa

SEQ ID NO: 399510 - RNA, 23 nt, Human
acauaaaacaaagacuacuaaac

SEQ ID NO: 399511 - RNA, 27 nt, Human
caaagacuacuaaacaguccaaaacug

SEQ ID NO: 399512 - RNA, 21 nt, Human
cauacacauggucaguguaca

SEQ ID NO: 399513 - RNA, 20 nt, Human
ccauggguaaagaacaaguc

SEQ ID NO: 399514 - RNA, 23 nt, Human
ccccuguuauaguuaugugccug

SEQ ID NO: 399515 - RNA, 24 nt, Human
cugaggucaaagaucauaauuuau

SEQ ID NO: 399516 - RNA, 23 nt, Human
uaaaaaaagacauaauaaaugua

SEQ ID NO: 399517 - RNA, 20 nt, Human
uaaaacaaagacuacuaaac

SEQ ID NO: 399518 - RNA, 25 nt, Human
uacuacacuauaaaauguccaaaaa

SEQ ID NO: 399519 - RNA, 23 nt, Human
ucaaauaucgagccaacaguacu

SEQ ID NO: 399520 - RNA, 19 nt, Human
uggauaugacuuuauaacc

SEQ ID NO: 399521 - RNA, 23 nt, Human
uggucauuguggaagaaguggau

SEQ ID NO: 399522 - RNA, 18 nt, Human
uguuuuuuuuucuguuuu

SEQ ID NO: 399523 - RNA, 23 nt, Human
uuaugugccuguuuuaucuuccc

SEQ ID NO: 399524 - RNA, 23 nt, Human
uuggcauguacuauguuuuuuuu

SEQ ID NO: 399525 - RNA, 24 nt, Human
uugggucauuugcuguggucauug

SEQ ID NO: 399526 - RNA, 24 nt, Human
uuuucuguuuuuuuuuuuuuuuuu

SEQ ID NO: 399527 - RNA, 24 nt, Human
uuuuuuuuuuuuuuuuuaauuuuu

SEQ ID NO: 399528 - RNA, 24 nt, Human
aagaaaaaacuauauugugugaua

SEQ ID NO: 399529 - RNA, 18 nt, Human
aagcagcagccaaacccg

SEQ ID NO: 399530 - RNA, 24 nt, Human
aaggcgccccgcagcccggcagcc

SEQ ID NO: 399531 - RNA, 20 nt, Human
aauaguuuauuuacauuaca

SEQ ID NO: 399532 - RNA, 25 nt, Human
acagaaaaaacaucaagacaaugua

SEQ ID NO: 399533 - RNA, 20 nt, Human
agcagcagccaaacccgcgc

SEQ ID NO: 399534 - RNA, 18 nt, Human
agcgagagggucguccgc

SEQ ID NO: 399535 - RNA, 22 nt, Human
aggaggagacgggaguccaggg

SEQ ID NO: 399536 - RNA, 20 nt, Human
aggcaggguggagggagagu

SEQ ID NO: 399537 - RNA, 20 nt, Human
aggcggcggcgguggcaggg

SEQ ID NO: 399538 - RNA, 20 nt, Human
aggcggcggcgguggcagug

SEQ ID NO: 399539 - RNA, 22 nt, Human
aggcggcggcgguggcaguggc

SEQ ID NO: 399540 - RNA, 18 nt, Human
agggagcucugggaagcc

SEQ ID NO: 399541 - RNA, 21 nt, Human
aggggcagacgaguggagccc

SEQ ID NO: 399542 - RNA, 19 nt, Human
cagccgccucucgagcucu

SEQ ID NO: 399543 - RNA, 27 nt, Human
caucccgcggacggcggcagcagaggc

SEQ ID NO: 399544 - RNA, 22 nt, Human
cgcagcccggcagccgccucuc

SEQ ID NO: 399545 - RNA, 20 nt, Human
cgggcagcgggcuacugagc

SEQ ID NO: 399546 - RNA, 21 nt, Human
cucugcagcagcaaacggcuu

SEQ ID NO: 399547 - RNA, 18 nt, Human
gaagccggaggacaggag

SEQ ID NO: 399548 - RNA, 18 nt, Human
gcaacucugcagcagcaa

SEQ ID NO: 399549 - RNA, 20 nt, Human
gccccgcagcccggcagccg

SEQ ID NO: 399550 - RNA, 19 nt, Human
gcggcagcagaggcggcgg

SEQ ID NO: 399551 - RNA, 30 nt, Human
gcggcagcagaggcggcggcgguggcagug

SEQ ID NO: 399552 - RNA, 18 nt, Human
ggacaggaggagacggga

SEQ ID NO: 399553 - RNA, 19 nt, Human
ggcggcggcgguggcagug

SEQ ID NO: 399554 - RNA, 19 nt, Human
gggacugggcucagccccg

SEQ ID NO: 399555 - RNA, 23 nt, Human
uacagaaaaaacaucaagacaau

SEQ ID NO: 399556 - RNA, 24 nt, Human
uagcuguaguacauguuuucauug

SEQ ID NO: 399557 - RNA, 24 nt, Human
uauaacaaauacaugggaaagaaa

SEQ ID NO: 399558 - RNA, 24 nt, Human
uauauccauacauaaucaaauaua

SEQ ID NO: 399559 - RNA, 20 nt, Human
ucucuugucuuauucuuuug

SEQ ID NO: 399560 - RNA, 22 nt, Human
ucuuuugucuauaauacuguaa

SEQ ID NO: 399561 - RNA, 18 nt, Human
ugcgccggagacgcggga

SEQ ID NO: 399562 - RNA, 19 nt, Human
ugucuuauucuuuugucua

SEQ ID NO: 399563 - RNA, 26 nt, Human
aaaagacaacacagagaauacuggaa

SEQ ID NO: 399564 - RNA, 27 nt, Human
aaacaauaaacauccaauuacaguuac

SEQ ID NO: 399565 - RNA, 19 nt, Human
aaauggccuuccacgaaga

SEQ ID NO: 399566 - RNA, 21 nt, Human
aacauuaagaaaaaaaugacc

SEQ ID NO: 399567 - RNA, 21 nt, Human
aacccggugcuccuucucucc

SEQ ID NO: 399568 - RNA, 24 nt, Human
aagaaaaucaaacaguaauaaaug

SEQ ID NO: 399569 - RNA, 20 nt, Human
aagcaggaaucugagaucac

SEQ ID NO: 399570 - RNA, 23 nt, Human
aagcaggaaucugagaucacagg

SEQ ID NO: 399571 - RNA, 21 nt, Human
aagcauucauguaacauaguu

SEQ ID NO: 399572 - RNA, 25 nt, Human
aaugaaaaagacaggaggaaaaaaa

SEQ ID NO: 399573 - RNA, 18 nt, Human
aauuucuggaaaguuuaa

SEQ ID NO: 399574 - RNA, 23 nt, Human
acaccagcauggggacgggguga

SEQ ID NO: 399575 - RNA, 26 nt, Human
acagaaaaacaacauauuaaccccca

SEQ ID NO: 399576 - RNA, 19 nt, Human
acauuaagaaaaaaaugac

SEQ ID NO: 399577 - RNA, 21 nt, Human
accagaccaaaaacacacuga

SEQ ID NO: 399578 - RNA, 25 nt, Human
accagaccaaaaacacacugaggac

SEQ ID NO: 399579 - RNA, 24 nt, Human
acccggugcuccuucucuccacaa

SEQ ID NO: 399580 - RNA, 25 nt, Human
agaaacauuuaucccuaaaccaccu

SEQ ID NO: 399581 - RNA, 26 nt, Human
agacaggaggaaaaaaaaagggaccc

SEQ ID NO: 399582 - RNA, 20 nt, Human
agcugggaaguggcgugugu

SEQ ID NO: 399583 - RNA, 19 nt, Human
aggcagaagcauucaugua

SEQ ID NO: 399584 - RNA, 20 nt, Human
agggggagggaggccagggc

SEQ ID NO: 399585 - RNA, 20 nt, Human
agggggagggaggccagggc

SEQ ID NO: 399586 - RNA, 20 nt, Human
aguaccuuucacguggcucc

SEQ ID NO: 399587 - RNA, 25 nt, Human
agugucuaccugaaagacaaauggc

SEQ ID NO: 399588 - RNA, 24 nt, Human
augccccaccgccucccgcaagcu

SEQ ID NO: 399589 - RNA, 19 nt, Human
augggggaccacaggguuc

SEQ ID NO: 399590 - RNA, 22 nt, Human
auucacacgagggccacccacc

SEQ ID NO: 399591 - RNA, 20 nt, Human
auuuuauuuuccauuugaca

SEQ ID NO: 399592 - RNA, 24 nt, Human
caacaaaaccugcuugucucaaac

SEQ ID NO: 399593 - RNA, 26 nt, Human
caacacagagaauacuggaaaugacg

SEQ ID NO: 399594 - RNA, 21 nt, Human
cacaccuguaaaaacaaacac

SEQ ID NO: 399595 - RNA, 22 nt, Human
cacagagaauacuggaaaugac

SEQ ID NO: 399596 - RNA, 23 nt, Human
cacagauauuuguaaaacggcug

SEQ ID NO: 399597 - RNA, 19 nt, Human
caccuguaaaaacaaacac

SEQ ID NO: 399598 - RNA, 25 nt, Human
cagaaaaacaacauauuaaccccca

SEQ ID NO: 399599 - RNA, 22 nt, Human
cagaacucagcuggccagcugc

SEQ ID NO: 399600 - RNA, 18 nt, Human
cagcccaguuugcccuuu

SEQ ID NO: 399601 - RNA, 24 nt, Human
caggacuugaguccuucccuacaa

SEQ ID NO: 399602 - RNA, 21 nt, Human
cagugcugggcaggaacccgg

SEQ ID NO: 399603 - RNA, 21 nt, Human
caguugaaaguaaaacauuua

SEQ ID NO: 399604 - RNA, 23 nt, Human
cauaggacaucccaugaaauuca

SEQ ID NO: 399605 - RNA, 20 nt, Human
caugaaaacaacaacagaac

SEQ ID NO: 399606 - RNA, 26 nt, Human
caugccccaccgccucccgcaagcug

SEQ ID NO: 399607 - RNA, 20 nt, Human
cauuaagaaaaaaaugacaa

SEQ ID NO: 399608 - RNA, 21 nt, Human
cauuacaucaguuagucugua

SEQ ID NO: 399609 - RNA, 21 nt, Human
cauuuaucccuaaaccaccuc

SEQ ID NO: 399610 - RNA, 23 nt, Human
ccacccacugcuggacccgacuc

SEQ ID NO: 399611 - RNA, 19 nt, Human
ccacggggauucacacgag

SEQ ID NO: 399612 - RNA, 21 nt, Human
ccacggggauucacacgaggg

SEQ ID NO: 399613 - RNA, 22 nt, Human
ccacugaaggucuggcuggagc

SEQ ID NO: 399614 - RNA, 24 nt, Human
ccagaacggaagaguccagucaca

SEQ ID NO: 399615 - RNA, 21 nt, Human
ccccaccgccucccgcaagca

SEQ ID NO: 399616 - RNA, 18 nt, Human
ccccgaggccgcgccggg

SEQ ID NO: 399617 - RNA, 21 nt, Human
ccccgaggccgcgccgggccc

SEQ ID NO: 399618 - RNA, 21 nt, Human
cccgcccggccgcgccaggca

SEQ ID NO: 399619 - RNA, 23 nt, Human
cccggucugugccuccuuccucc

SEQ ID NO: 399620 - RNA, 20 nt, Human
cccggugcuccuucucucca

SEQ ID NO: 399621 - RNA, 23 nt, Human
cccucccccacccgccuccccua

SEQ ID NO: 399622 - RNA, 20 nt, Human
ccgcagcugccgcccgcugc

SEQ ID NO: 399623 - RNA, 18 nt, Human
ccuacaaccagaccaaaa

SEQ ID NO: 399624 - RNA, 26 nt, Human
ccucccccacccgccuccccuagaag

SEQ ID NO: 399625 - RNA, 21 nt, Human
ccuccuuccucccaugcccca

SEQ ID NO: 399626 - RNA, 23 nt, Human
ccugcuugucucaaacacauaca

SEQ ID NO: 399627 - RNA, 21 nt, Human
cgccgggcccagccggagccc

SEQ ID NO: 399628 - RNA, 21 nt, Human
cgccucccgcaagcacagugc

SEQ ID NO: 399629 - RNA, 22 nt, Human
cggcccggcccgccgcgcgcga

SEQ ID NO: 399630 - RNA, 22 nt, Human
cuacaaccagaccaaaaacaca

SEQ ID NO: 399631 - RNA, 21 nt, Human
cucaccgcugaggcgcuccuc

SEQ ID NO: 399632 - RNA, 20 nt, Human
cucccaucucuuuauucaca

SEQ ID NO: 399633 - RNA, 21 nt, Human
cucccucccccacccgccucc

SEQ ID NO: 399634 - RNA, 21 nt, Human
cugaaguucuaauuugcuaac

SEQ ID NO: 399635 - RNA, 23 nt, Human
cugcuggacccgacucuaucugc

SEQ ID NO: 399636 - RNA, 18 nt, Human
gaacagugugacugcaac

SEQ ID NO: 399637 - RNA, 23 nt, Human
gacacucucugauguccccacgg

SEQ ID NO: 399638 - RNA, 18 nt, Human
gagcagcgugugagguag

SEQ ID NO: 399639 - RNA, 23 nt, Human
gaggaccucucucauccucacga

SEQ ID NO: 399640 - RNA, 21 nt, Human
gagggaggccagggcucugag

SEQ ID NO: 399641 - RNA, 21 nt, Human
gauuauacagcuacaauuaca

SEQ ID NO: 399642 - RNA, 22 nt, Human
gcagcuccggagccgguugcgc

SEQ ID NO: 399643 - RNA, 21 nt, Human
gcgaugggcagccccgaggcc

SEQ ID NO: 399644 - RNA, 19 nt, Human
gcgcgaugggcagccccga

SEQ ID NO: 399645 - RNA, 21 nt, Human
ggaagaguccagucacagucc

SEQ ID NO: 399646 - RNA, 18 nt, Human
ggaccacaggguuccaga

SEQ ID NO: 399647 - RNA, 22 nt, Human
ggaggacauuccaggacuugag

SEQ ID NO: 399648 - RNA, 21 nt, Human
ggcaggaccacugaaggucug

SEQ ID NO: 399649 - RNA, 20 nt, Human
ggccacccacugcuggaccc

SEQ ID NO: 399650 - RNA, 20 nt, Human
gggccuccaggucccccagc

SEQ ID NO: 399651 - RNA, 23 nt, Human
gggccuccaggucccccagcucc

SEQ ID NO: 399652 - RNA, 24 nt, Human
ggugagaaaagcaggaaucugaga

SEQ ID NO: 399653 - RNA, 21 nt, Human
uaauaaaugaaacauucccuc

SEQ ID NO: 399654 - RNA, 27 nt, Human
uagaaaagcacaaugagaggaucugcg

SEQ ID NO: 399655 - RNA, 21 nt, Human
uagaaccagauacaagaaaau

SEQ ID NO: 399656 - RNA, 19 nt, Human
uaguauagcuuuucauuuu

SEQ ID NO: 399657 - RNA, 26 nt, Human
uaucaacaaaaccugcuugucucaaa

SEQ ID NO: 399658 - RNA, 22 nt, Human
uauuucaaguguacaaaaauac

SEQ ID NO: 399659 - RNA, 21 nt, Human
ucaaacaguaauaaaugaaac

SEQ ID NO: 399660 - RNA, 23 nt, Human
uccaagcacauuugcccaguaaa

SEQ ID NO: 399661 - RNA, 24 nt, Human
uccaagcacauuugcccaguaaau

SEQ ID NO: 399662 - RNA, 21 nt, Human
uccacggggauucacacgagg

SEQ ID NO: 399663 - RNA, 22 nt, Human
ucccuacaaccagaccaaaaac

SEQ ID NO: 399664 - RNA, 21 nt, Human
ucucccaucucuuuauucaca

SEQ ID NO: 399665 - RNA, 21 nt, Human
ucucucauccucacgauggaa

SEQ ID NO: 399666 - RNA, 22 nt, Human
ugagaaaagcaggaaucugaga

SEQ ID NO: 399667 - RNA, 19 nt, Human
ugagguagggggagggagg

SEQ ID NO: 399668 - RNA, 21 nt, Human
ugagguagggggagggaggcc

SEQ ID NO: 399669 - RNA, 22 nt, Human
ugagguagggggagggaggcca

SEQ ID NO: 399670 - RNA, 26 nt, Human
ugaucccucccucccccacccgccuc

SEQ ID NO: 399671 - RNA, 20 nt, Human
ugaugggccuccaggucccc

SEQ ID NO: 399672 - RNA, 24 nt, Human
ugcacauccacggggauucacacg

SEQ ID NO: 399673 - RNA, 20 nt, Human
uggaacagugugacugcaac

SEQ ID NO: 399674 - RNA, 18 nt, Human
uggagacagcgugggugg

SEQ ID NO: 399675 - RNA, 19 nt, Human
uggagacagcgugggugga

SEQ ID NO: 399676 - RNA, 20 nt, Human
uggcguguguucacccuggc

SEQ ID NO: 399677 - RNA, 21 nt, Human
ugggaaguggcguguguucac

SEQ ID NO: 399678 - RNA, 20 nt, Human
ugggccuccaggucccccag

SEQ ID NO: 399679 - RNA, 19 nt, Human
ugucucaaacacauacacc

SEQ ID NO: 399680 - RNA, 22 nt, Human
uuaaagaacacaguugaaagua

SEQ ID NO: 399681 - RNA, 23 nt, Human
uuaaagaacacaguugaaaguaa

SEQ ID NO: 399682 - RNA, 22 nt, Human
uuagauaaaaacaauaaacauc

SEQ ID NO: 399683 - RNA, 20 nt, Human
uuaucccuaaaccaccucac

SEQ ID NO: 399684 - RNA, 23 nt, Human
uugcgccgcagcugccgcccgcu

SEQ ID NO: 399685 - RNA, 24 nt, Human
aaaaaaaaaaaaaacaaaccagaa

SEQ ID NO: 399686 - RNA, 24 nt, Human
aaaaaaaaaaaacaaaccagaaaa

SEQ ID NO: 399687 - RNA, 22 nt, Human
aaaaaaaaaaacaaaccagggu

SEQ ID NO: 399688 - RNA, 21 nt, Human
aaaaaaacaaaccagaaaaca

SEQ ID NO: 399689 - RNA, 22 nt, Human
aaaaaaacaaaccagaaaacaa

SEQ ID NO: 399690 - RNA, 24 nt, Human
aaaaaacaaaccagaaaacaaaaa

SEQ ID NO: 399691 - RNA, 21 nt, Human
aaaaaacacacguaaagauau

SEQ ID NO: 399692 - RNA, 22 nt, Human
aaaaaacccaagugcaagagca

SEQ ID NO: 399693 - RNA, 21 nt, Human
aaaacaaaacaaaaaaggaaa

SEQ ID NO: 399694 - RNA, 23 nt, Human
aaaacaaaacaaaacaaaaaagg

SEQ ID NO: 399695 - RNA, 23 nt, Human
aaaacaaaacaaaacaaaacaaa

SEQ ID NO: 399696 - RNA, 22 nt, Human
aaaacaaaccagaaaacaaaaa

SEQ ID NO: 399697 - RNA, 18 nt, Human
aaacaaaaaaggaaauau

SEQ ID NO: 399698 - RNA, 22 nt, Human
aaacaaaaaaggaaauauucag

SEQ ID NO: 399699 - RNA, 19 nt, Human
aaacaaaacaaaacaaaaa

SEQ ID NO: 399700 - RNA, 22 nt, Human
aaacaaaacaaaacaaaacaaa

SEQ ID NO: 399701 - RNA, 23 nt, Human
aaacaaaccagaaaacaaaaaac

SEQ ID NO: 399702 - RNA, 18 nt, Human
aacaaaaaacccaagugc

SEQ ID NO: 399703 - RNA, 23 nt, Human
aacaaaacaaaacaaaaaaggaa

SEQ ID NO: 399704 - RNA, 23 nt, Human
aaccagaaaacaaaaaacuaacu

SEQ ID NO: 399705 - RNA, 23 nt, Human
aacucaggugccuacacagcggu

SEQ ID NO: 399706 - RNA, 24 nt, Human
aacugagcauuaaacuucaaguau

SEQ ID NO: 399707 - RNA, 23 nt, Human
acaaaaaaaaaaaaaacaaacca

SEQ ID NO: 399708 - RNA, 23 nt, Human
acaaaacaaaacaaaaaaggaaa

SEQ ID NO: 399709 - RNA, 22 nt, Human
acaaaacaaaacaaaacaaaaa

SEQ ID NO: 399710 - RNA, 25 nt, Human
acaaaccagaaaacaaaaaacuaac

SEQ ID NO: 399711 - RNA, 19 nt, Human
acaacguaaaggcauuuug

SEQ ID NO: 399712 - RNA, 18 nt, Human
acaauaacaaaaaaccca

SEQ ID NO: 399713 - RNA, 23 nt, Human
acacacacacacacacacacaca

SEQ ID NO: 399714 - RNA, 23 nt, Human
acacacacacacacacacacaca

SEQ ID NO: 399715 - RNA, 23 nt, Human
acacacacacacacacacacaca

SEQ ID NO: 399716 - RNA, 23 nt, Human
acacacacacacacacacacaca

SEQ ID NO: 399717 - RNA, 23 nt, Human
acacacacacacacacacacaca

SEQ ID NO: 399718 - RNA, 23 nt, Human
acacacacacacacacacacaca

SEQ ID NO: 399719 - RNA, 23 nt, Human
acacacacacacacacacacaca

SEQ ID NO: 399720 - RNA, 24 nt, Human
acacacacacacacacacacacag

SEQ ID NO: 399721 - RNA, 22 nt, Human
acacacacacacacacacacag

SEQ ID NO: 399722 - RNA, 23 nt, Human
acccaagugcaagagcaauacca

SEQ ID NO: 399723 - RNA, 18 nt, Human
acggagaggagucccugg

SEQ ID NO: 399724 - RNA, 21 nt, Human
agcacuuugagguagcauauu

SEQ ID NO: 399725 - RNA, 22 nt, Human
agccaccaagucaacugccacc

SEQ ID NO: 399726 - RNA, 26 nt, Human
aggcaaaaaagggcaugagcugggcc

SEQ ID NO: 399727 - RNA, 18 nt, Human
agguagcauauuuuguaa

SEQ ID NO: 399728 - RNA, 22 nt, Human
agugcaagagcaauaccaagaa

SEQ ID NO: 399729 - RNA, 19 nt, Human
auaaaacagaaaaaccaag

SEQ ID NO: 399730 - RNA, 22 nt, Human
auacaaaaaguaaaaacaggga

SEQ ID NO: 399731 - RNA, 23 nt, Human
auggucauuacaaaauacggggg

SEQ ID NO: 399732 - RNA, 21 nt, Human
caaaacaauaacaaaaaaccc

SEQ ID NO: 399733 - RNA, 18 nt, Human
caaaccagaaaacaaaaa

SEQ ID NO: 399734 - RNA, 21 nt, Human
caacuagaaggugcaugaagc

SEQ ID NO: 399735 - RNA, 19 nt, Human
caagagcaauaccaagaac

SEQ ID NO: 399736 - RNA, 20 nt, Human
cacaaaacaauaacaaaaaa

SEQ ID NO: 399737 - RNA, 20 nt, Human
cacacacacacacacacaca

SEQ ID NO: 399738 - RNA, 20 nt, Human
cacacacacacacacacaca

SEQ ID NO: 399739 - RNA, 20 nt, Human
cacacacacacacacacaca

SEQ ID NO: 399740 - RNA, 20 nt, Human
cacacacacacacacacaca

SEQ ID NO: 399741 - RNA, 20 nt, Human
cacacacacacacacacaca

SEQ ID NO: 399742 - RNA, 20 nt, Human
cacacacacacacacacaca

SEQ ID NO: 399743 - RNA, 20 nt, Human
cacacacacacacacacaca

SEQ ID NO: 399744 - RNA, 20 nt, Human
cacacacacacacacacaca

SEQ ID NO: 399745 - RNA, 20 nt, Human
cacacacacacacacacaca

SEQ ID NO: 399746 - RNA, 20 nt, Human
cacacacacacacacacaca

SEQ ID NO: 399747 - RNA, 22 nt, Human
cacacacacacacacacacaca

SEQ ID NO: 399748 - RNA, 22 nt, Human
cacacacacacacacacacaca

SEQ ID NO: 399749 - RNA, 26 nt, Human
cacacacacacacacacacacacaca

SEQ ID NO: 399750 - RNA, 26 nt, Human
cacacacacacacacacacacacaca

SEQ ID NO: 399751 - RNA, 26 nt, Human
cacacacacacacacacacacacaca

SEQ ID NO: 399752 - RNA, 26 nt, Human
cacacacacacacacacacacacaca

SEQ ID NO: 399753 - RNA, 28 nt, Human
cacacacacacacacacacacacacuca

SEQ ID NO: 399754 - RNA, 22 nt, Human
caccaagucaacugccacccga

SEQ ID NO: 399755 - RNA, 21 nt, Human
caccccauuauacaaaaagua

SEQ ID NO: 399756 - RNA, 18 nt, Human
cacccuuggccaucccuc

SEQ ID NO: 399757 - RNA, 18 nt, Human
cagcaggagacgcaugca

SEQ ID NO: 399758 - RNA, 27 nt, Human
cagccuuacaaauacaaacaacgucuu

SEQ ID NO: 399759 - RNA, 21 nt, Human
caggaaaacaaccuacuucuu

SEQ ID NO: 399760 - RNA, 20 nt, Human
caggcacugcugaacaugcc

SEQ ID NO: 399761 - RNA, 23 nt, Human
cagugucagccugaacacacuuu

SEQ ID NO: 399762 - RNA, 21 nt, Human
caguuucuccuggauacaaag

SEQ ID NO: 399763 - RNA, 20 nt, Human
cauaaaacacacacacacac

SEQ ID NO: 399764 - RNA, 22 nt, Human
cauagaaaauccucaaaggcug

SEQ ID NO: 399765 - RNA, 21 nt, Human
ccaaaucuuuaaagaaccaag

SEQ ID NO: 399766 - RNA, 27 nt, Human
ccaagaacagacuuccuuugugcaagu

SEQ ID NO: 399767 - RNA, 23 nt, Human
ccaccaagucaacugccacccga

SEQ ID NO: 399768 - RNA, 20 nt, Human
ccagaaaacaaaaaacuaac

SEQ ID NO: 399769 - RNA, 21 nt, Human
ccagugucagccugaacacac

SEQ ID NO: 399770 - RNA, 20 nt, Human
cccaccccauuauacaaaaa

SEQ ID NO: 399771 - RNA, 25 nt, Human
cccacuccaccccaccccauuauac

SEQ ID NO: 399772 - RNA, 26 nt, Human
cccacuccaccccaccccauuauaca

SEQ ID NO: 399773 - RNA, 19 nt, Human
ccccacuccaccccacccc

SEQ ID NO: 399774 - RNA, 22 nt, Human
ccccauucuguaucaaacugga

SEQ ID NO: 399775 - RNA, 26 nt, Human
ccuagaaagcgcuccuuuuuuuccuc

SEQ ID NO: 399776 - RNA, 25 nt, Human
ccucaggcugacucucagaagcccc

SEQ ID NO: 399777 - RNA, 24 nt, Human
ccucuaaagaccucaggcugacuc

SEQ ID NO: 399778 - RNA, 20 nt, Human
ccugaacacacuuucuacca

SEQ ID NO: 399779 - RNA, 24 nt, Human
cucagaagcccccacuccacccca

SEQ ID NO: 399780 - RNA, 24 nt, Human
cucaggugccuacacagcggucca

SEQ ID NO: 399781 - RNA, 25 nt, Human
cucucagaagcccccacuccacccc

SEQ ID NO: 399782 - RNA, 19 nt, Human
cuugccgcaugugauucac

SEQ ID NO: 399783 - RNA, 21 nt, Human
cuuuaacauuucauuaaguaa

SEQ ID NO: 399784 - RNA, 23 nt, Human
gaagcccccacuccaccccaccc

SEQ ID NO: 399785 - RNA, 20 nt, Human
gcacccuguggaaagggaag

SEQ ID NO: 399786 - RNA, 23 nt, Human
gccuacacagcgguccagggaga

SEQ ID NO: 399787 - RNA, 24 nt, Human
ggaaaacaaccuacuucuuaaaac

SEQ ID NO: 399788 - RNA, 19 nt, Human
ggagacgcaugcacccugu

SEQ ID NO: 399789 - RNA, 21 nt, Human
ggcagcaucccaggcugugga

SEQ ID NO: 399790 - RNA, 20 nt, Human
gguacggcagcaucccaggc

SEQ ID NO: 399791 - RNA, 33 nt, Human
gucauaaaacacacacacacacacacacacagu

SEQ ID NO: 399792 - RNA, 21 nt, Human
uaaaacaaaacaaaacaaaac

SEQ ID NO: 399793 - RNA, 20 nt, Human
uaaaacacacacacacacac

SEQ ID NO: 399794 - RNA, 20 nt, Human
uaaaacagaaaaaccaagug

SEQ ID NO: 399795 - RNA, 24 nt, Human
uaaagaaccaagcucuaaaaaaca

SEQ ID NO: 399796 - RNA, 19 nt, Human
uaacaaaaaacccaagugc

SEQ ID NO: 399797 - RNA, 23 nt, Human
uaacucaggugccuacacagcgg

SEQ ID NO: 399798 - RNA, 31 nt, Human
uaagucauaaaacacacacacacacacacag

SEQ ID NO: 399799 - RNA, 21 nt, Human
uaauuucaaacgcuuucuuuu

SEQ ID NO: 399800 - RNA, 24 nt, Human
uacaauagcugguccucuaaagac

SEQ ID NO: 399801 - RNA, 24 nt, Human
uacuucuuaaaacaaaacaaaaca

SEQ ID NO: 399802 - RNA, 22 nt, Human
uauaaaacagaaaaaccaagug

SEQ ID NO: 399803 - RNA, 24 nt, Human
uauacaaaaaaaaaaaaaacaaac

SEQ ID NO: 399804 - RNA, 24 nt, Human
uauauaaaacagaaaaaccaagug

SEQ ID NO: 399805 - RNA, 23 nt, Human
uauauaagugaauaaaaauagca

SEQ ID NO: 399806 - RNA, 21 nt, Human
uauccaaggugcuacaauagc

SEQ ID NO: 399807 - RNA, 19 nt, Human
uauucaguugagcucugca

SEQ ID NO: 399808 - RNA, 19 nt, Human
ucaaaagaggcuaaggauu

SEQ ID NO: 399809 - RNA, 18 nt, Human
ucacagggcugcucugca

SEQ ID NO: 399810 - RNA, 23 nt, Human
ucagacuuuugcugcaggaaaau

SEQ ID NO: 399811 - RNA, 21 nt, Human
uccaccccaccccauuauaca

SEQ ID NO: 399812 - RNA, 18 nt, Human
ucccaacagccucagacu

SEQ ID NO: 399813 - RNA, 22 nt, Human
ucccuggguguaaucauuuugg

SEQ ID NO: 399814 - RNA, 19 nt, Human
uccucaaaggcugcccaga

SEQ ID NO: 399815 - RNA, 23 nt, Human
ucuaccacccacccuuggccauc

SEQ ID NO: 399816 - RNA, 21 nt, Human
ucuaccacccacccuuggccu

SEQ ID NO: 399817 - RNA, 23 nt, Human
ucuccauggccaggaagccacuc

SEQ ID NO: 399818 - RNA, 19 nt, Human
ucucugaauacaccagccu

SEQ ID NO: 399819 - RNA, 24 nt, Human
ucugggauuuuccuggcaggaggg

SEQ ID NO: 399820 - RNA, 23 nt, Human
ucuuuccucuugguacggcagca

SEQ ID NO: 399821 - RNA, 25 nt, Human
ugaacagaaaagcuuuaaaaaaucc

SEQ ID NO: 399822 - RNA, 21 nt, Human
ugagcauuaaacuucaaguau

SEQ ID NO: 399823 - RNA, 20 nt, Human
ugauacaaguuuacgguuca

SEQ ID NO: 399824 - RNA, 20 nt, Human
ugcaagagcaauaccaagaa

SEQ ID NO: 399825 - RNA, 25 nt, Human
ugcccagaaacagggccccaggcac

SEQ ID NO: 399826 - RNA, 21 nt, Human
ugcucugcaguuucuccugga

SEQ ID NO: 399827 - RNA, 19 nt, Human
uggccaggaagccacucga

SEQ ID NO: 399828 - RNA, 20 nt, Human
ugggauuuuccuggcaggag

SEQ ID NO: 399829 - RNA, 23 nt, Human
ugggguaucauuaagcuuucugg

SEQ ID NO: 399830 - RNA, 20 nt, Human
ugucccaauauacuuccugu

SEQ ID NO: 399831 - RNA, 18 nt, Human
uugagguagcauauuuug

SEQ ID NO: 399832 - RNA, 20 nt, Human
uuguaaagucacagggcugc

SEQ ID NO: 399833 - RNA, 19 nt, Human
uuuguacaacuagaaggug

SEQ ID NO: 399834 - RNA, 25 nt, Human
aaacucucgcgcgaacaggcagcuu

SEQ ID NO: 399835 - RNA, 18 nt, Human
aacagcaaggaccccggu

SEQ ID NO: 399836 - RNA, 24 nt, Human
aacccgccccuccaaacucucgcg

SEQ ID NO: 399837 - RNA, 25 nt, Human
aacccgccccuccaaacucucgcgc

SEQ ID NO: 399838 - RNA, 23 nt, Human
aagcgcuggaagaccgcuggacu

SEQ ID NO: 399839 - RNA, 18 nt, Human
aauggggucgcuccaccu

SEQ ID NO: 399840 - RNA, 25 nt, Human
acagauccacgugaccaccaggggu

SEQ ID NO: 399841 - RNA, 19 nt, Human
accaggggucagccguaga

SEQ ID NO: 399842 - RNA, 19 nt, Human
accaggggucagccguaga

SEQ ID NO: 399843 - RNA, 18 nt, Human
accccaaacccgccccuc

SEQ ID NO: 399844 - RNA, 22 nt, Human
agggcuguccgggauucuccag

SEQ ID NO: 399845 - RNA, 23 nt, Human
caccgaccccaaacccgccccuc

SEQ ID NO: 399846 - RNA, 22 nt, Human
caccucugcucccagggccgcc

SEQ ID NO: 399847 - RNA, 19 nt, Human
cacuuuggccccaguggcu

SEQ ID NO: 399848 - RNA, 25 nt, Human
cauuuuccccuccugggggugaucc

SEQ ID NO: 399849 - RNA, 18 nt, Human
ccccaaacccgccccucc

SEQ ID NO: 399850 - RNA, 24 nt, Human
ccccaaacccgccccuccaaacuc

SEQ ID NO: 399851 - RNA, 21 nt, Human
ccgaccccaaacccgccccuc

SEQ ID NO: 399852 - RNA, 22 nt, Human
ccgaccccaaacccgccccucc

SEQ ID NO: 399853 - RNA, 21 nt, Human
ccuccaaacucucgcgcgaac

SEQ ID NO: 399854 - RNA, 24 nt, Human
ccuccaaacucucgcgcgaacagg

SEQ ID NO: 399855 - RNA, 22 nt, Human
ccugccacacacgggguguccc

SEQ ID NO: 399856 - RNA, 25 nt, Human
cguggcgaacagauccacgugacca

SEQ ID NO: 399857 - RNA, 24 nt, Human
cucccagggccgccgccguggccc

SEQ ID NO: 399858 - RNA, 24 nt, Human
cuccccugacgcuaacugguaccu

SEQ ID NO: 399859 - RNA, 19 nt, Human
cuggaagaccgcuggacuc

SEQ ID NO: 399860 - RNA, 20 nt, Human
gacccagcuccccugacgcu

SEQ ID NO: 399861 - RNA, 18 nt, Human
gcauugccaccauuuucc

SEQ ID NO: 399862 - RNA, 24 nt, Human
gccagugugggcugcuccaguggu

SEQ ID NO: 399863 - RNA, 21 nt, Human
gcccaagcgcuggaagaccgc

SEQ ID NO: 399864 - RNA, 18 nt, Human
gcuggacucucacuuugg

SEQ ID NO: 399865 - RNA, 19 nt, Human
ggcauugccaccauuuucc

SEQ ID NO: 399866 - RNA, 25 nt, Human
ggcugcagggagcagggcuguccgg

SEQ ID NO: 399867 - RNA, 22 nt, Human
uaggagaggcucccgaacagca

SEQ ID NO: 399868 - RNA, 19 nt, Human
ucccgaacagcaaggaccc

SEQ ID NO: 399869 - RNA, 19 nt, Human
ucccgaacagcaaggaccc

SEQ ID NO: 399870 - RNA, 23 nt, Human
ucucacuuuggccccaguggcuc

SEQ ID NO: 399871 - RNA, 22 nt, Human
ucuccagagcgcuucgccgccu

SEQ ID NO: 399872 - RNA, 20 nt, Human
ucucgcgcgaacaggcagcu

SEQ ID NO: 399873 - RNA, 27 nt, Human
ugacccagcuccccugacgcuaacugg

SEQ ID NO: 399874 - RNA, 19 nt, Human
ugcgagccccaaucagaca

SEQ ID NO: 399875 - RNA, 20 nt, Human
uggcucccgaaacuacaccu

SEQ ID NO: 399876 - RNA, 18 nt, Human
agucaggcauccaccgcc

SEQ ID NO: 399877 - RNA, 23 nt, Human
cggcggcguccgaggcaggccca

SEQ ID NO: 399878 - RNA, 20 nt, Human
ggaaagagaauccgcgacac

SEQ ID NO: 399879 - RNA, 18 nt, Human
ucaggcauccaccgccau

SEQ ID NO: 399880 - RNA, 21 nt, Human
uccagucaggcauccaccgcc

SEQ ID NO: 399881 - RNA, 18 nt, Human
aaaaaagaagaggaaaaa

SEQ ID NO: 399882 - RNA, 18 nt, Human
aaaaacaacaacaacgac

SEQ ID NO: 399883 - RNA, 24 nt, Human
aaaauacuccugcccucgcacaua

SEQ ID NO: 399884 - RNA, 20 nt, Human
aaaccuggagaacaagagcg

SEQ ID NO: 399885 - RNA, 24 nt, Human
aaagaauccucuucaagagagaaa

SEQ ID NO: 399886 - RNA, 23 nt, Human
aacaaaagaaaauaagcauucac

SEQ ID NO: 399887 - RNA, 18 nt, Human
aacaaauuuuaggcugac

SEQ ID NO: 399888 - RNA, 23 nt, Human
aacaacgacauuuucuuuccuua

SEQ ID NO: 399889 - RNA, 21 nt, Human
aacccggcucucccccagccc

SEQ ID NO: 399890 - RNA, 27 nt, Human
aagcauuggaaucagcacaacagccau

SEQ ID NO: 399891 - RNA, 21 nt, Human
aagccccaccccucaugcucu

SEQ ID NO: 399892 - RNA, 22 nt, Human
acaacagccauggaaucaggca

SEQ ID NO: 399893 - RNA, 22 nt, Human
acaaggcuagagaaagccacgc

SEQ ID NO: 399894 - RNA, 25 nt, Human
acacagcucaacaaagagggaacgc

SEQ ID NO: 399895 - RNA, 23 nt, Human
acaguuggaaaaaagaagaggaa

SEQ ID NO: 399896 - RNA, 24 nt, Human
acaguuuauuuucauuuuugggaa

SEQ ID NO: 399897 - RNA, 19 nt, Human
acauaaguuuaacuugaac

SEQ ID NO: 399898 - RNA, 25 nt, Human
accuacgcagccccagcccggcccc

SEQ ID NO: 399899 - RNA, 18 nt, Human
acgcagccccagcccggc

SEQ ID NO: 399900 - RNA, 19 nt, Human
acuagaaacaagaaagacu

SEQ ID NO: 399901 - RNA, 24 nt, Human
acuggaaaagagggccuccucagg

SEQ ID NO: 399902 - RNA, 22 nt, Human
agaaacccaggcuugucaccuu

SEQ ID NO: 399903 - RNA, 21 nt, Human
agaaagccacgcucggccuuc

SEQ ID NO: 399904 - RNA, 24 nt, Human
agaauucugcgcccgaagcucggg

SEQ ID NO: 399905 - RNA, 25 nt, Human
agagcaguucccacgccaggaacca

SEQ ID NO: 399906 - RNA, 23 nt, Human
agagcuugggaaauggggcugca

SEQ ID NO: 399907 - RNA, 18 nt, Human
agaucaacagacacacca

SEQ ID NO: 399908 - RNA, 23 nt, Human
agaucaacagacacaccagaagg

SEQ ID NO: 399909 - RNA, 20 nt, Human
agauguaaaugaaaacacag

SEQ ID NO: 399910 - RNA, 22 nt, Human
agcagcugggagucugcucuuc

SEQ ID NO: 399911 - RNA, 21 nt, Human
agccauucccacaaauccaga

SEQ ID NO: 399912 - RNA, 21 nt, Human
aggaggucagauugcgaauac

SEQ ID NO: 399913 - RNA, 18 nt, Human
aggcaggggaggacgggc

SEQ ID NO: 399914 - RNA, 21 nt, Human
aggcaggggaggacgggcugu

SEQ ID NO: 399915 - RNA, 18 nt, Human
aggcgcgccccggcucgc

SEQ ID NO: 399916 - RNA, 21 nt, Human
agggaaacagacaggaggagg

SEQ ID NO: 399917 - RNA, 21 nt, Human
agggaggggguagcagcugga

SEQ ID NO: 399918 - RNA, 18 nt, Human
auacaaaaauacuccugc

SEQ ID NO: 399919 - RNA, 20 nt, Human
auggaacggcagaccccuga

SEQ ID NO: 399920 - RNA, 21 nt, Human
caaaaaaagguuggaggagca

SEQ ID NO: 399921 - RNA, 19 nt, Human
caaaaauacuccugcccuc

SEQ ID NO: 399922 - RNA, 25 nt, Human
caaagccccaccccucaugcucucc

SEQ ID NO: 399923 - RNA, 19 nt, Human
caaagcgcccugcagagac

SEQ ID NO: 399924 - RNA, 20 nt, Human
caaaggagagcaguucccac

SEQ ID NO: 399925 - RNA, 23 nt, Human
caacaagcaguuucuucaggccu

SEQ ID NO: 399926 - RNA, 19 nt, Human
caaccaccaaagcgcccug

SEQ ID NO: 399927 - RNA, 22 nt, Human
caagacacagcucaacaaagaa

SEQ ID NO: 399928 - RNA, 18 nt, Human
caagcaagcacugacaua

SEQ ID NO: 399929 - RNA, 19 nt, Human
caagccggcugagggcagc

SEQ ID NO: 399930 - RNA, 20 nt, Human
cacaaauccagaccauacca

SEQ ID NO: 399931 - RNA, 19 nt, Human
cacagaucaacagacacac

SEQ ID NO: 399932 - RNA, 19 nt, Human
cacauaggaaaaaaaauuu

SEQ ID NO: 399933 - RNA, 22 nt, Human
cacaugccccuuccuguccuuc

SEQ ID NO: 399934 - RNA, 23 nt, Human
caccagaagggaagcguuguuuc

SEQ ID NO: 399935 - RNA, 21 nt, Human
caccaugcacacacacaaggu

SEQ ID NO: 399936 - RNA, 21 nt, Human
caccccucaugcucuccucug

SEQ ID NO: 399937 - RNA, 30 nt, Human
caccuacgcagccccagcccggccccccuu

SEQ ID NO: 399938 - RNA, 18 nt, Human
caccugcacgucaccagc

SEQ ID NO: 399939 - RNA, 19 nt, Human
caccugcacgucaccagca

SEQ ID NO: 399940 - RNA, 25 nt, Human
cacgcaaagccauucccacaaaucc

SEQ ID NO: 399941 - RNA, 21 nt, Human
cagaccccugaaacgaagcuu

SEQ ID NO: 399942 - RNA, 18 nt, Human
cagcacaacagccaugga

SEQ ID NO: 399943 - RNA, 19 nt, Human
cagcugaacaaccaccaaa

SEQ ID NO: 399944 - RNA, 21 nt, Human
cagcugggggcccucccaccc

SEQ ID NO: 399945 - RNA, 23 nt, Human
caggaggaggucagauugcgaau

SEQ ID NO: 399946 - RNA, 22 nt, Human
caguuggaaaaaagaagaggaa

SEQ ID NO: 399947 - RNA, 21 nt, Human
ccacaaauccagaccauacca

SEQ ID NO: 399948 - RNA, 24 nt, Human
ccacggggaccuucacaguuggaa

SEQ ID NO: 399949 - RNA, 19 nt, Human
cccacccccauggggagga

SEQ ID NO: 399950 - RNA, 20 nt, Human
cccagcccggccccccuggg

SEQ ID NO: 399951 - RNA, 24 nt, Human
cccagcccggccccccuggggacc

SEQ ID NO: 399952 - RNA, 21 nt, Human
ccccccggccuccccucggca

SEQ ID NO: 399953 - RNA, 21 nt, Human
cccccgccuuccucucacucc

SEQ ID NO: 399954 - RNA, 22 nt, Human
ccccgccuuccucucacuccuc

SEQ ID NO: 399955 - RNA, 23 nt, Human
ccccggccuccccucggcagccc

SEQ ID NO: 399956 - RNA, 23 nt, Human
ccccucgggaaagcccgccgcuc

SEQ ID NO: 399957 - RNA, 18 nt, Human
cccucgggaaagcccgcc

SEQ ID NO: 399958 - RNA, 20 nt, Human
cccugcagagacaagucauc

SEQ ID NO: 399959 - RNA, 19 nt, Human
ccgcugcgcccccccggcc

SEQ ID NO: 399960 - RNA, 21 nt, Human
ccggccuccccucggcagccc

SEQ ID NO: 399961 - RNA, 26 nt, Human
ccugaaacgaagcuuguccccuucca

SEQ ID NO: 399962 - RNA, 21 nt, Human
ccugggagaaacccaggcuug

SEQ ID NO: 399963 - RNA, 19 nt, Human
ccuucaagacacagcucaa

SEQ ID NO: 399964 - RNA, 22 nt, Human
cgaauaccuggggcuuccuagg

SEQ ID NO: 399965 - RNA, 27 nt, Human
cgacuucacggagaggcagguucugcu

SEQ ID NO: 399966 - RNA, 24 nt, Human
cgcaugccacggaaagcuuacaua

SEQ ID NO: 399967 - RNA, 23 nt, Human
cgccaggaaccaacgugaaagca

SEQ ID NO: 399968 - RNA, 22 nt, Human
cgcccggagcuggggccccgca

SEQ ID NO: 399969 - RNA, 21 nt, Human
cgcggcggcgcggcgcggggc

SEQ ID NO: 399970 - RNA, 23 nt, Human
cggcagaccccugaaacgaagcu

SEQ ID NO: 399971 - RNA, 23 nt, Human
cguugcugcgccccccgccuucc

SEQ ID NO: 399972 - RNA, 19 nt, Human
cucuauaguacagcaagau

SEQ ID NO: 399973 - RNA, 18 nt, Human
cucuccuccccuuucuca

SEQ ID NO: 399974 - RNA, 21 nt, Human
cuggccaaggccucucugcag

SEQ ID NO: 399975 - RNA, 19 nt, Human
cuugugcauucagaccaga

SEQ ID NO: 399976 - RNA, 20 nt, Human
gaaaggagauggaaagggga

SEQ ID NO: 399977 - RNA, 22 nt, Human
gaacuucugccauccacuggac

SEQ ID NO: 399978 - RNA, 18 nt, Human
gaagggaggggguagcag

SEQ ID NO: 399979 - RNA, 22 nt, Human
gaggcacuguccgggaacgucc

SEQ ID NO: 399980 - RNA, 20 nt, Human
gcacucaaaaauugccauuu

SEQ ID NO: 399981 - RNA, 24 nt, Human
gcaggggaggacgggcuguguccu

SEQ ID NO: 399982 - RNA, 19 nt, Human
gccacuucugagaaccccc

SEQ ID NO: 399983 - RNA, 20 nt, Human
gcccagccuuugagaggcca

SEQ ID NO: 399984 - RNA, 23 nt, Human
gccccagcccggccccccugggg

SEQ ID NO: 399985 - RNA, 18 nt, Human
gcgcggcgcggggcgcgg

SEQ ID NO: 399986 - RNA, 19 nt, Human
gcgcggcggcgcggcgcgg

SEQ ID NO: 399987 - RNA, 20 nt, Human
gcgcuccgcugcgccccccc

SEQ ID NO: 399988 - RNA, 20 nt, Human
gcggccggggggggcuccgg

SEQ ID NO: 399989 - RNA, 21 nt, Human
gcuccaccccacggggaccuu

SEQ ID NO: 399990 - RNA, 18 nt, Human
gcuccuggccaaggccuc

SEQ ID NO: 399991 - RNA, 22 nt, Human
gcucgggggcggccgggggggg

SEQ ID NO: 399992 - RNA, 20 nt, Human
gcugccgccggggcugagcc

SEQ ID NO: 399993 - RNA, 18 nt, Human
ggaaaggagauggaaagg

SEQ ID NO: 399994 - RNA, 21 nt, Human
ggaaaggagauggaaagggga

SEQ ID NO: 399995 - RNA, 23 nt, Human
ggaggcgcgcggcgggggaggcg

SEQ ID NO: 399996 - RNA, 20 nt, Human
ggaggggguagcagcuggga

SEQ ID NO: 399997 - RNA, 20 nt, Human
ggagucugcucuuccagcug

SEQ ID NO: 399998 - RNA, 25 nt, Human
ggccacuaccccaugaacuucugcc

SEQ ID NO: 399999 - RNA, 23 nt, Human
ggcgcggcggcgcggcgcggggc

SEQ ID NO: 400000 - RNA, 18 nt, Human
ggcgcggggcgcgggggg

SEQ ID NO: 400001 - RNA, 21 nt, Human
ggcucagugcgcgggaccgcc

SEQ ID NO: 400002 - RNA, 20 nt, Human
ggcugacgacuucacggaga

SEQ ID NO: 400003 - RNA, 21 nt, Human
gggaggggauaccagucccag

SEQ ID NO: 400004 - RNA, 19 nt, Human
gggaggggguagcagcugg

SEQ ID NO: 400005 - RNA, 22 nt, Human
gggagugucacugcuucuucag

SEQ ID NO: 400006 - RNA, 21 nt, Human
gggcgcggggggcucgggggc

SEQ ID NO: 400007 - RNA, 21 nt, Human
gggcucagugcgcgggaccgc

SEQ ID NO: 400008 - RNA, 21 nt, Human
gggcucgggggcggccggggg

SEQ ID NO: 400009 - RNA, 24 nt, Human
ggggacgugggugcgcgccccgca

SEQ ID NO: 400010 - RNA, 18 nt, Human
gggggcuccggccggcgc

SEQ ID NO: 400011 - RNA, 18 nt, Human
ggugaaccuuuagccagc

SEQ ID NO: 400012 - RNA, 21 nt, Human
gucaccuuuucauguuggguu

SEQ ID NO: 400013 - RNA, 19 nt, Human
guggugauugacaggcagg

SEQ ID NO: 400014 - RNA, 31 nt, Human
guugcugcgccccccgccuuccucucacucc

SEQ ID NO: 400015 - RNA, 18 nt, Human
guuuuuguuuuggaaguu

SEQ ID NO: 400016 - RNA, 23 nt, Human
uaaguauugcagcuuuucagaau

SEQ ID NO: 400017 - RNA, 22 nt, Human
uacaaaaauacuccugcccucg

SEQ ID NO: 400018 - RNA, 24 nt, Human
uaccccaugaacuucugccaucca

SEQ ID NO: 400019 - RNA, 18 nt, Human
uaccuggggcuuccuagg

SEQ ID NO: 400020 - RNA, 19 nt, Human
uagaaacaagaaagacuac

SEQ ID NO: 400021 - RNA, 21 nt, Human
uaggaaaaaaaauuucucuga

SEQ ID NO: 400022 - RNA, 22 nt, Human
uaggcugacgacuucacggaga

SEQ ID NO: 400023 - RNA, 18 nt, Human
uaggcuggcggcaugcag

SEQ ID NO: 400024 - RNA, 19 nt, Human
uaggcuggcggcaugcaga

SEQ ID NO: 400025 - RNA, 23 nt, Human
ucaaaaauugccauuuuuuuccu

SEQ ID NO: 400026 - RNA, 23 nt, Human
ucaaagauaacgugacaacuacc

SEQ ID NO: 400027 - RNA, 20 nt, Human
ucacgcaaagccauucccac

SEQ ID NO: 400028 - RNA, 19 nt, Human
ucagaccagacaucacaug

SEQ ID NO: 400029 - RNA, 19 nt, Human
ucagugcgcgggaccgcgc

SEQ ID NO: 400030 - RNA, 18 nt, Human
ucaugagagggacaggcu

SEQ ID NO: 400031 - RNA, 22 nt, Human
uccugggagaaacccaggcuug

SEQ ID NO: 400032 - RNA, 20 nt, Human
ucuucaggccuguggauugg

SEQ ID NO: 400033 - RNA, 22 nt, Human
ucuucaguaaggcacuagagac

SEQ ID NO: 400034 - RNA, 19 nt, Human
ucuugggaugcgcccagcc

SEQ ID NO: 400035 - RNA, 20 nt, Human
ucuugggaugcgcccagccu

SEQ ID NO: 400036 - RNA, 21 nt, Human
ugaaaacacagaucaacagac

SEQ ID NO: 400037 - RNA, 22 nt, Human
ugaaaacacagaucaacagaca

SEQ ID NO: 400038 - RNA, 24 nt, Human
ugaaaacacagaucaacagacaca

SEQ ID NO: 400039 - RNA, 19 nt, Human
ugaaagcauuggaaucagc

SEQ ID NO: 400040 - RNA, 19 nt, Human
ugaagcugaggacacuggg

SEQ ID NO: 400041 - RNA, 21 nt, Human
ugacaaggcuagagaaagcca

SEQ ID NO: 400042 - RNA, 18 nt, Human
ugacaggcagggagacag

SEQ ID NO: 400043 - RNA, 23 nt, Human
ugagaacacggacgguucuuagc

SEQ ID NO: 400044 - RNA, 22 nt, Human
ugagaacccccaucuaacuucc

SEQ ID NO: 400045 - RNA, 20 nt, Human
ugcaaaggagagcaguuccc

SEQ ID NO: 400046 - RNA, 23 nt, Human
ugcacacacacaagguccacuuc

SEQ ID NO: 400047 - RNA, 18 nt, Human
ugcagggacaguggcccc

SEQ ID NO: 400048 - RNA, 19 nt, Human
ugcaggggagauaauuuuc

SEQ ID NO: 400049 - RNA, 21 nt, Human
ugccaaugaacgagaacuuuc

SEQ ID NO: 400050 - RNA, 21 nt, Human
ugcucaacugcuuuacucauu

SEQ ID NO: 400051 - RNA, 21 nt, Human
uggaaaagagggccuccucag

SEQ ID NO: 400052 - RNA, 21 nt, Human
uggaaagccacucccauggga

SEQ ID NO: 400053 - RNA, 21 nt, Human
uggaaaggggaagagaaggug

SEQ ID NO: 400054 - RNA, 18 nt, Human
uggaacggcagaccccug

SEQ ID NO: 400055 - RNA, 21 nt, Human
uggaacggcagaccccugaaa

SEQ ID NO: 400056 - RNA, 21 nt, Human
uggaggagcaggaguaaccuc

SEQ ID NO: 400057 - RNA, 24 nt, Human
uggcaaaaaaagguuggaggagca

SEQ ID NO: 400058 - RNA, 18 nt, Human
uggcaugucccugguagc

SEQ ID NO: 400059 - RNA, 21 nt, Human
uggcugucuugggaugcgccc

SEQ ID NO: 400060 - RNA, 18 nt, Human
ugggaagggaggggguag

SEQ ID NO: 400061 - RNA, 20 nt, Human
uggggaggaaagacgucaag

SEQ ID NO: 400062 - RNA, 25 nt, Human
ugggggcccucccacccccaugggg

SEQ ID NO: 400063 - RNA, 19 nt, Human
ugggucaggggggaaaagg

SEQ ID NO: 400064 - RNA, 19 nt, Human
ugggucaggggggaaaagg

SEQ ID NO: 400065 - RNA, 22 nt, Human
ugggucccaaagccccaccccu

SEQ ID NO: 400066 - RNA, 18 nt, Human
ugguagagacagggugag

SEQ ID NO: 400067 - RNA, 18 nt, Human
ugucacugcuucuucagu

SEQ ID NO: 400068 - RNA, 23 nt, Human
ugucugaaaagcaggagcccuug

SEQ ID NO: 400069 - RNA, 22 nt, Human
uguggauuggcauccaaauaca

SEQ ID NO: 400070 - RNA, 18 nt, Human
uuaacccuuucaccuauc

SEQ ID NO: 400071 - RNA, 22 nt, Human
uugcaggggagauaauuuuccu

SEQ ID NO: 400072 - RNA, 27 nt, Human
uuggcaaaaaaagguuggaggagcagg

SEQ ID NO: 400073 - RNA, 23 nt, Human
aaacugggcuccuggggcuaagu

SEQ ID NO: 400074 - RNA, 24 nt, Human
aaacugggcuccuggggcuaaguc

SEQ ID NO: 400075 - RNA, 20 nt, Human
aaauaauaaccagauucaac

SEQ ID NO: 400076 - RNA, 22 nt, Human
aaaugcacuugaaacaccacac

SEQ ID NO: 400077 - RNA, 19 nt, Human
aacaccacacagcaaggcc

SEQ ID NO: 400078 - RNA, 18 nt, Human
aacuugucugugucuccu

SEQ ID NO: 400079 - RNA, 21 nt, Human
aaggagaagccaaauggggau

SEQ ID NO: 400080 - RNA, 20 nt, Human
aagggcauuguggcuuaagg

SEQ ID NO: 400081 - RNA, 23 nt, Human
acaaccacuagucaaccuaaaac

SEQ ID NO: 400082 - RNA, 22 nt, Human
acuacaaccacuagucaaccua

SEQ ID NO: 400083 - RNA, 18 nt, Human
aggcccuggccccgccuc

SEQ ID NO: 400084 - RNA, 21 nt, Human
aggcccuggccccgccuccag

SEQ ID NO: 400085 - RNA, 21 nt, Human
agguuuucaaaauuccaagga

SEQ ID NO: 400086 - RNA, 20 nt, Human
auaacucccaaaagcaacaa

SEQ ID NO: 400087 - RNA, 22 nt, Human
auagaacacauccaguucaaag

SEQ ID NO: 400088 - RNA, 25 nt, Human
auagaacacauccaguucaaaggca

SEQ ID NO: 400089 - RNA, 21 nt, Human
augcacuugaaacaccacaca

SEQ ID NO: 400090 - RNA, 23 nt, Human
caaaggcauggacuccaccgcca

SEQ ID NO: 400091 - RNA, 19 nt, Human
caaccuaaaaccuuagugc

SEQ ID NO: 400092 - RNA, 21 nt, Human
cacagcaaggccauugaaacu

SEQ ID NO: 400093 - RNA, 18 nt, Human
cacauaagccauuugccc

SEQ ID NO: 400094 - RNA, 20 nt, Human
cauaaaucccaaauguucuu

SEQ ID NO: 400095 - RNA, 23 nt, Human
cauuuuaaaugcacuugaaacac

SEQ ID NO: 400096 - RNA, 18 nt, Human
cauuuugccuucugguuu

SEQ ID NO: 400097 - RNA, 19 nt, Human
ccaagagacgcacaugaug

SEQ ID NO: 400098 - RNA, 21 nt, Human
ccacacagcaaggccauugaa

SEQ ID NO: 400099 - RNA, 20 nt, Human
ccacugugcaauauagaaag

SEQ ID NO: 400100 - RNA, 21 nt, Human
ccauagccauguugaucugga

SEQ ID NO: 400101 - RNA, 22 nt, Human
ccauugaaacugggcuccuggg

SEQ ID NO: 400102 - RNA, 24 nt, Human
ccauugaaacugggcuccuggggc

SEQ ID NO: 400103 - RNA, 20 nt, Human
cccuguacugcccacugccu

SEQ ID NO: 400104 - RNA, 25 nt, Human
cuacaaccacuagucaaccuaaaac

SEQ ID NO: 400105 - RNA, 19 nt, Human
cucacauaagccauuugcc

SEQ ID NO: 400106 - RNA, 24 nt, Human
cuuaacacuuuugcuggaucccaa

SEQ ID NO: 400107 - RNA, 28 nt, Human
cuuaacacuuuugcuggaucccaagaga

SEQ ID NO: 400108 - RNA, 22 nt, Human
cuucaccuuuucaucaccagcc

SEQ ID NO: 400109 - RNA, 18 nt, Human
gaaaauaacucccaaaag

SEQ ID NO: 400110 - RNA, 21 nt, Human
gauccaguaaucaauuuggca

SEQ ID NO: 400111 - RNA, 22 nt, Human
gaugguugucccugcaacaugg

SEQ ID NO: 400112 - RNA, 24 nt, Human
gcauaaagaacugaaccacaaaag

SEQ ID NO: 400113 - RNA, 20 nt, Human
gcccuggccccgccuccagu

SEQ ID NO: 400114 - RNA, 18 nt, Human
guggaagaacuugucugu

SEQ ID NO: 400115 - RNA, 22 nt, Human
uaaagaaaaacuucacauuaac

SEQ ID NO: 400116 - RNA, 23 nt, Human
uaaaucccaaauguucuuaaaga

SEQ ID NO: 400117 - RNA, 21 nt, Human
uaacucccaaaagcaacaaac

SEQ ID NO: 400118 - RNA, 18 nt, Human
uaaggagaagccaaaugg

SEQ ID NO: 400119 - RNA, 19 nt, Human
uaaggagaagccaaauggg

SEQ ID NO: 400120 - RNA, 25 nt, Human
uaauaaccagauucaacuucuguga

SEQ ID NO: 400121 - RNA, 20 nt, Human
uaccauagccauguugaucu

SEQ ID NO: 400122 - RNA, 19 nt, Human
uacugcccacugccuuaca

SEQ ID NO: 400123 - RNA, 22 nt, Human
uagccauguugaucuggaaauu

SEQ ID NO: 400124 - RNA, 21 nt, Human
uagcuaagacaaauuuguaau

SEQ ID NO: 400125 - RNA, 20 nt, Human
uauuuggccguagauuuuca

SEQ ID NO: 400126 - RNA, 21 nt, Human
ucauguugacuccuggcagag

SEQ ID NO: 400127 - RNA, 22 nt, Human
ucccaaaagcaacaaacaaaaa

SEQ ID NO: 400128 - RNA, 23 nt, Human
ucccaaaagcaacaaacaaaaau

SEQ ID NO: 400129 - RNA, 22 nt, Human
ucccugcaacauggugccacuc

SEQ ID NO: 400130 - RNA, 27 nt, Human
ucucugcucagugcucuggaguucuug

SEQ ID NO: 400131 - RNA, 27 nt, Human
ucugugacuaaagaaaaaccggggucc

SEQ ID NO: 400132 - RNA, 18 nt, Human
ugaaaauaacucccaaaa

SEQ ID NO: 400133 - RNA, 20 nt, Human
ugaaaauaacucccaaaagc

SEQ ID NO: 400134 - RNA, 22 nt, Human
ugacuaaagaaaaacuucacau

SEQ ID NO: 400135 - RNA, 19 nt, Human
ugaggcccuggccccgccu

SEQ ID NO: 400136 - RNA, 23 nt, Human
ugcacuugaaacaccacacagca

SEQ ID NO: 400137 - RNA, 20 nt, Human
ugcauauccagcaaaaggaa

SEQ ID NO: 400138 - RNA, 20 nt, Human
ugccagcauuuugccuucug

SEQ ID NO: 400139 - RNA, 18 nt, Human
ugcuggaucccaagagac

SEQ ID NO: 400140 - RNA, 23 nt, Human
uggauccaguaaucaauuuggca

SEQ ID NO: 400141 - RNA, 25 nt, Human
ugguuuccccugcagagcacagguc

SEQ ID NO: 400142 - RNA, 19 nt, Human
ugugcagccucaguggaca

SEQ ID NO: 400143 - RNA, 22 nt, Human
uuacuaaauaccauagccaugu

SEQ ID NO: 400144 - RNA, 21 nt, Human
uucaaaggcauggacuccacc

SEQ ID NO: 400145 - RNA, 24 nt, Human
uucacauccaucauaagguuggca

SEQ ID NO: 400146 - RNA, 19 nt, Human
uuugccuucugguuucccc

SEQ ID NO: 400147 - RNA, 23 nt, Human
uuuuauaaaauuuucaacuacaa

SEQ ID NO: 400148 - RNA, 27 nt, Human
aaaaaaacaaguucauguaagaaagca

SEQ ID NO: 400149 - RNA, 22 nt, Human
aagaaagcaagacaacccaaua

SEQ ID NO: 400150 - RNA, 23 nt, Human
aagcuaugcauguaaacagagau

SEQ ID NO: 400151 - RNA, 22 nt, Human
acacuacugaucuccaaucaac

SEQ ID NO: 400152 - RNA, 20 nt, Human
accaaucacaaccucaggca

SEQ ID NO: 400153 - RNA, 21 nt, Human
accacagugaaacuucacuuc

SEQ ID NO: 400154 - RNA, 21 nt, Human
aggcugcagucaccugcuuca

SEQ ID NO: 400155 - RNA, 26 nt, Human
caaaaaaugcaaucaucugcaucaga

SEQ ID NO: 400156 - RNA, 23 nt, Human
cacagugaaacuucacuucuccu

SEQ ID NO: 400157 - RNA, 23 nt, Human
cagaaugucaccaaucacaaccu

SEQ ID NO: 400158 - RNA, 25 nt, Human
cauuuuuacaccacuacauugaagg

SEQ ID NO: 400159 - RNA, 23 nt, Human
ccacagugaaacuucacuucucc

SEQ ID NO: 400160 - RNA, 20 nt, Human
cccaugagcaaauaaaacaa

SEQ ID NO: 400161 - RNA, 19 nt, Human
ccguccgugcgcucauccc

SEQ ID NO: 400162 - RNA, 24 nt, Human
cggggccaggaucccaguuccacc

SEQ ID NO: 400163 - RNA, 19 nt, Human
cuccugacguuugcaaaug

SEQ ID NO: 400164 - RNA, 24 nt, Human
cuugagccaaaggcugcagucacc

SEQ ID NO: 400165 - RNA, 22 nt, Human
gaaaaacuuuaaaacagcuuug

SEQ ID NO: 400166 - RNA, 22 nt, Human
gcugcagucaccugcuucauua

SEQ ID NO: 400167 - RNA, 20 nt, Human
gcuugaugcuacauuugugg

SEQ ID NO: 400168 - RNA, 23 nt, Human
guagaacacuucugauguauuua

SEQ ID NO: 400169 - RNA, 24 nt, Human
guugucuugcuuuaugaagaugac

SEQ ID NO: 400170 - RNA, 21 nt, Human
uaaaagcuucucucuuacuaa

SEQ ID NO: 400171 - RNA, 18 nt, Human
uaccacagugaaacuuca

SEQ ID NO: 400172 - RNA, 19 nt, Human
uaccacagugaaacuucaa

SEQ ID NO: 400173 - RNA, 18 nt, Human
uagauaauuaaccugaau

SEQ ID NO: 400174 - RNA, 22 nt, Human
uaggccucuaucauaagacccu

SEQ ID NO: 400175 - RNA, 23 nt, Human
ucaccaaucacaaccucaggcac

SEQ ID NO: 400176 - RNA, 20 nt, Human
ucagacagccuugauuaaga

SEQ ID NO: 400177 - RNA, 19 nt, Human
ucucaugggccaugcacau

SEQ ID NO: 400178 - RNA, 18 nt, Human
ucuggaacuaagagagaa

SEQ ID NO: 400179 - RNA, 25 nt, Human
ugccaaaaaaugcaaucaucugcau

SEQ ID NO: 400180 - RNA, 26 nt, Human
ugcuaaaaaagaauagcaauuaaauu

SEQ ID NO: 400181 - RNA, 19 nt, Human
ugcuaccugugagucuggc

SEQ ID NO: 400182 - RNA, 19 nt, Human
uggacaaaaaucuagauaa

SEQ ID NO: 400183 - RNA, 22 nt, Human
uggagcggggccaggaucccag

SEQ ID NO: 400184 - RNA, 22 nt, Human
uggcuugaugcuacauuugugg

SEQ ID NO: 400185 - RNA, 19 nt, Human
uggguuaauaaauagacuu

SEQ ID NO: 400186 - RNA, 23 nt, Human
uguaagaaagcaagacaacccaa

SEQ ID NO: 400187 - RNA, 27 nt, Human
uguguaauucauuuugcuaccugugag

SEQ ID NO: 400188 - RNA, 18 nt, Human
uguuaaagauucaauuua

SEQ ID NO: 400189 - RNA, 22 nt, Human
uuaaaagcuucucucuuacuaa

SEQ ID NO: 400190 - RNA, 23 nt, Human
uuagccuaacucaaagcuaugca

SEQ ID NO: 400191 - RNA, 18 nt, Human
uugaugcuacauuugugg

SEQ ID NO: 400192 - RNA, 21 nt, Human
uugccuugggcagugucagaa

SEQ ID NO: 400193 - RNA, 21 nt, Human
uuuaaaacagcuuuguaaaua

SEQ ID NO: 400194 - RNA, 19 nt, Human
uuuaaagugucauaauguu

SEQ ID NO: 400195 - RNA, 21 nt, Human
uuucacaggcuuuguccuuga

SEQ ID NO: 400196 - RNA, 23 nt, Human
uuuucuccugacguuugcaaaug

SEQ ID NO: 400197 - RNA, 19 nt, Human
aaaaaauggaaaacucucc

SEQ ID NO: 400198 - RNA, 24 nt, Human
aacaauucugauaccagcaacauc

SEQ ID NO: 400199 - RNA, 25 nt, Human
agcagaaaguagaaauguuucagaa

SEQ ID NO: 400200 - RNA, 18 nt, Human
aggaaggaaaacacuuaa

SEQ ID NO: 400201 - RNA, 20 nt, Human
augaagaauagcaguuuucc

SEQ ID NO: 400202 - RNA, 26 nt, Human
augaagcaauaacaauucugauacca

SEQ ID NO: 400203 - RNA, 21 nt, Human
caccaaguaauuuacauacau

SEQ ID NO: 400204 - RNA, 18 nt, Human
caguaaccaucaguuuaa

SEQ ID NO: 400205 - RNA, 23 nt, Human
cagucccucgugccgaaucuugg

SEQ ID NO: 400206 - RNA, 19 nt, Human
cagucuuuucccuucuacc

SEQ ID NO: 400207 - RNA, 30 nt, Human
caugagcccuuggugaucuucugaagucuu

SEQ ID NO: 400208 - RNA, 21 nt, Human
cauuuuguucucuugauaaag

SEQ ID NO: 400209 - RNA, 27 nt, Human
cauuuuguucucuugauaaagaaaaau

SEQ ID NO: 400210 - RNA, 22 nt, Human
ccaacugacuuacaguaaccau

SEQ ID NO: 400211 - RNA, 24 nt, Human
ccaacugacuuacaguaaccauca

SEQ ID NO: 400212 - RNA, 18 nt, Human
cugauaccagcaacaucc

SEQ ID NO: 400213 - RNA, 21 nt, Human
cuugguuggaagauuuguagc

SEQ ID NO: 400214 - RNA, 22 nt, Human
gaagucuuccaaagauuacacu

SEQ ID NO: 400215 - RNA, 21 nt, Human
gcauuuuguucucuugauaaa

SEQ ID NO: 400216 - RNA, 19 nt, Human
ggggagggagaccugcuuu

SEQ ID NO: 400217 - RNA, 19 nt, Human
ggggguggggagggagacc

SEQ ID NO: 400218 - RNA, 21 nt, Human
uaacaccaaguaauuuacaua

SEQ ID NO: 400219 - RNA, 23 nt, Human
uaacuguuuuaacauucuggcau

SEQ ID NO: 400220 - RNA, 24 nt, Human
uacccaggaaaauuuuacaugaug

SEQ ID NO: 400221 - RNA, 24 nt, Human
uagauuuaugaagaauagcaguuu

SEQ ID NO: 400222 - RNA, 20 nt, Human
uagcagaaaguagaaauguu

SEQ ID NO: 400223 - RNA, 25 nt, Human
uagcagaaaguagaaauguuucaga

SEQ ID NO: 400224 - RNA, 21 nt, Human
uagcaguuuuccuucuugguu

SEQ ID NO: 400225 - RNA, 20 nt, Human
uaugcaauucugcacugcac

SEQ ID NO: 400226 - RNA, 18 nt, Human
ucaccaacaugagcccuu

SEQ ID NO: 400227 - RNA, 24 nt, Human
ucuaucauauuuauuaucuuugau

SEQ ID NO: 400228 - RNA, 19 nt, Human
ugauaccagcaacaucccu

SEQ ID NO: 400229 - RNA, 23 nt, Human
ugcuuuuauuauagaaaugacuu

SEQ ID NO: 400230 - RNA, 18 nt, Human
ugggggguggggagggag

SEQ ID NO: 400231 - RNA, 21 nt, Human
uguuuaacaguuuucuuuuuu

SEQ ID NO: 400232 - RNA, 22 nt, Human
uugauaacaacuaaaaaaaaaa

SEQ ID NO: 400233 - RNA, 23 nt, Human
uuggugaucuucugaagucuucc

SEQ ID NO: 400234 - RNA, 22 nt, Human
uuuaaaaaauggaaaacucucc

SEQ ID NO: 400235 - RNA, 23 nt, Human
uuuuacaguuguauuuuuuugcc

SEQ ID NO: 400236 - RNA, 20 nt, Human
aggaaaggaggacagaugag

SEQ ID NO: 400237 - RNA, 22 nt, Human
cacugugugguacucacagagc

SEQ ID NO: 400238 - RNA, 21 nt, Human
cccccucccacugugugguac

SEQ ID NO: 400239 - RNA, 23 nt, Human
gaggacagaugaggauuuaagug

SEQ ID NO: 400240 - RNA, 23 nt, Human
gggcuuuuauuuacaggaaagga

SEQ ID NO: 400241 - RNA, 18 nt, Human
uccagugcucccagcgcu

SEQ ID NO: 400242 - RNA, 21 nt, Human
uccagugcucccagcgcuagu

SEQ ID NO: 400243 - RNA, 19 nt, Human
uccugguggucaccucccu

SEQ ID NO: 400244 - RNA, 20 nt, Human
ugguaaagggaaaugcagug

SEQ ID NO: 400245 - RNA, 24 nt, Human
uuuuuuuuuuuggauagaagggcu

SEQ ID NO: 400246 - RNA, 21 nt, Human
uuuuuuuuuuuuuuggauaga

SEQ ID NO: 400247 - RNA, 18 nt, Human
uuuuuuuuuuuuuuuuug

SEQ ID NO: 400248 - RNA, 18 nt, Human
uuuuuuuuuuuuuuuuug

SEQ ID NO: 400249 - RNA, 24 nt, Human
aaaagaaaacauaguccaaacaga

SEQ ID NO: 400250 - RNA, 20 nt, Human
aaacauaguccaaacagauc

SEQ ID NO: 400251 - RNA, 24 nt, Human
aaacauaguccaaacagaucacac

SEQ ID NO: 400252 - RNA, 24 nt, Human
aaagauaucaccagaagcuaugua

SEQ ID NO: 400253 - RNA, 21 nt, Human
aaggccucaaccgcgccggaa

SEQ ID NO: 400254 - RNA, 18 nt, Human
aauagaccuauuguugca

SEQ ID NO: 400255 - RNA, 20 nt, Human
aauagaccuauuguugcaaa

SEQ ID NO: 400256 - RNA, 29 nt, Human
acacaaaaaucuugguaaaagaacuagaa

SEQ ID NO: 400257 - RNA, 22 nt, Human
agaaaagaaaacauaguccaaa

SEQ ID NO: 400258 - RNA, 22 nt, Human
agaagaaaagaaaacauagucc

SEQ ID NO: 400259 - RNA, 21 nt, Human
agcaagugggagaagaaaaga

SEQ ID NO: 400260 - RNA, 22 nt, Human
aggacaaaugcugacuuuggca

SEQ ID NO: 400261 - RNA, 21 nt, Human
aggguaaagagaaaguuaagg

SEQ ID NO: 400262 - RNA, 21 nt, Human
aggguguuuucacaaggaaau

SEQ ID NO: 400263 - RNA, 23 nt, Human
caaaaccagucaaaauccuacca

SEQ ID NO: 400264 - RNA, 20 nt, Human
caaacagaucacacaaggga

SEQ ID NO: 400265 - RNA, 28 nt, Human
caaacagaucacacaagggaacccagga

SEQ ID NO: 400266 - RNA, 19 nt, Human
cacaagggaacccaggaca

SEQ ID NO: 400267 - RNA, 22 nt, Human
caccgaaggccucaaccgcgcc

SEQ ID NO: 400268 - RNA, 22 nt, Human
caugaaaagauaucaccagaag

SEQ ID NO: 400269 - RNA, 19 nt, Human
cauguccucccacaccaaa

SEQ ID NO: 400270 - RNA, 20 nt, Human
ccaccgaaggccucaaccuc

SEQ ID NO: 400271 - RNA, 23 nt, Human
ccauguccucccacaccaaaaga

SEQ ID NO: 400272 - RNA, 21 nt, Human
ccccauguccucccacaccaa

SEQ ID NO: 400273 - RNA, 22 nt, Human
ccccauguccucccacaccaaa

SEQ ID NO: 400274 - RNA, 18 nt, Human
ccgcgccggaaccggggc

SEQ ID NO: 400275 - RNA, 19 nt, Human
cugcuggcugagguacaag

SEQ ID NO: 400276 - RNA, 25 nt, Human
gaaaagaaaacauaguccaaacaga

SEQ ID NO: 400277 - RNA, 19 nt, Human
gaacccaggacaaaugcug

SEQ ID NO: 400278 - RNA, 21 nt, Human
gaagcccaagcugcugagcaa

SEQ ID NO: 400279 - RNA, 23 nt, Human
uacaguucaaagcucacuuuuau

SEQ ID NO: 400280 - RNA, 21 nt, Human
uaggugguaccccaugucccc

SEQ ID NO: 400281 - RNA, 18 nt, Human
ucacauccaucaccauuu

SEQ ID NO: 400282 - RNA, 19 nt, Human
uccaaacagaucacacaag

SEQ ID NO: 400283 - RNA, 22 nt, Human
ucccacaccaaaagagaucagu

SEQ ID NO: 400284 - RNA, 19 nt, Human
ugccuugauggugcuguug

SEQ ID NO: 400285 - RNA, 22 nt, Human
ugcuggcugagguacaaggugg

SEQ ID NO: 400286 - RNA, 22 nt, Human
uggaagcccaagcugcugagca

SEQ ID NO: 400287 - RNA, 21 nt, Human
uuaauugucuaaaaugacauu

SEQ ID NO: 400288 - RNA, 21 nt, Human
uucugcuggcugagguacaag

SEQ ID NO: 400289 - RNA, 20 nt, Human
uuuuuuuuuuuucaagcagu

SEQ ID NO: 400290 - RNA, 24 nt, Human
uuuuuuuuuuuuuuuuuuuucaag

SEQ ID NO: 400291 - RNA, 20 nt, Human
aaaagacaaguaguucuaca

SEQ ID NO: 400292 - RNA, 21 nt, Human
aaguaccugaaagauaagaua

SEQ ID NO: 400293 - RNA, 23 nt, Human
acaaaaacucgcggacacaaagc

SEQ ID NO: 400294 - RNA, 21 nt, Human
acuaaaacaaccuuaacagaa

SEQ ID NO: 400295 - RNA, 24 nt, Human
agacccggacacaaaagaccccag

SEQ ID NO: 400296 - RNA, 25 nt, Human
agccaagccagacccggacacaaaa

SEQ ID NO: 400297 - RNA, 22 nt, Human
caaaaacucgcggacacaaagc

SEQ ID NO: 400298 - RNA, 22 nt, Human
caaccuuaacagaaaagaaaau

SEQ ID NO: 400299 - RNA, 19 nt, Human
cacaaagccaagccagacc

SEQ ID NO: 400300 - RNA, 18 nt, Human
cauaaaguaccugaaaga

SEQ ID NO: 400301 - RNA, 23 nt, Human
cauaaaguaccugaaagauaaga

SEQ ID NO: 400302 - RNA, 19 nt, Human
ccaagccagacccggacac

SEQ ID NO: 400303 - RNA, 24 nt, Human
ccaagccagacccggacacaaaag

SEQ ID NO: 400304 - RNA, 20 nt, Human
ccagacccggacacaaaaga

SEQ ID NO: 400305 - RNA, 21 nt, Human
cccuccccacagccuuugccg

SEQ ID NO: 400306 - RNA, 24 nt, Human
ccgccuccgagccucacggcuccu

SEQ ID NO: 400307 - RNA, 23 nt, Human
ccgcgcugccgccuccgagccuc

SEQ ID NO: 400308 - RNA, 22 nt, Human
ccuccgagccucacggcuccug

SEQ ID NO: 400309 - RNA, 24 nt, Human
cgcugccgccuccgagccucacgg

SEQ ID NO: 400310 - RNA, 19 nt, Human
cgcugcggagcggaacaaa

SEQ ID NO: 400311 - RNA, 24 nt, Human
cggagcggaacaaaaacucgcgga

SEQ ID NO: 400312 - RNA, 24 nt, Human
cuccuggccggggaccgcgcugcc

SEQ ID NO: 400313 - RNA, 24 nt, Human
gacacaaaagaccccagagccgaa

SEQ ID NO: 400314 - RNA, 18 nt, Human
gaucugcgaagcccccuc

SEQ ID NO: 400315 - RNA, 19 nt, Human
gccgccgccgcucacgccg

SEQ ID NO: 400316 - RNA, 20 nt, Human
gccggcgcgcuugcuccugg

SEQ ID NO: 400317 - RNA, 21 nt, Human
gccuuugccgccgccgcucac

SEQ ID NO: 400318 - RNA, 20 nt, Human
gcuugcuccuggccggggac

SEQ ID NO: 400319 - RNA, 19 nt, Human
ggacacaaagccaagccag

SEQ ID NO: 400320 - RNA, 22 nt, Human
uaaaacaaccuuaacagaaaag

SEQ ID NO: 400321 - RNA, 19 nt, Human
uacacaggcaauuacuuuu

SEQ ID NO: 400322 - RNA, 23 nt, Human
uagaaaagacaaguaguucuaca

SEQ ID NO: 400323 - RNA, 26 nt, Human
uagcccuaucuggaaacuaaaacaac

SEQ ID NO: 400324 - RNA, 21 nt, Human
uaucuggaaacuaaaacaacc

SEQ ID NO: 400325 - RNA, 19 nt, Human
ucugcgaagcccccucccc

SEQ ID NO: 400326 - RNA, 20 nt, Human
ucugcgaagcccccucccca

SEQ ID NO: 400327 - RNA, 19 nt, Human
ugcccgggaagagcgcugc

SEQ ID NO: 400328 - RNA, 18 nt, Human
aaaacgacgucaaggacg

SEQ ID NO: 400329 - RNA, 25 nt, Human
aaaagggacccuuccccugguugga

SEQ ID NO: 400330 - RNA, 23 nt, Human
aaacauaacauggaaacagugua

SEQ ID NO: 400331 - RNA, 22 nt, Human
aacaaaacacaucuuucucuuc

SEQ ID NO: 400332 - RNA, 19 nt, Human
aagaaggggcaauaaagaa

SEQ ID NO: 400333 - RNA, 20 nt, Human
aauggcagagagugccaaag

SEQ ID NO: 400334 - RNA, 18 nt, Human
acacaucuuucucuucuu

SEQ ID NO: 400335 - RNA, 21 nt, Human
acuguuuccaaggucccuggg

SEQ ID NO: 400336 - RNA, 18 nt, Human
agagcaggcugggcaggg

SEQ ID NO: 400337 - RNA, 23 nt, Human
agggaccacagagaguccaaaac

SEQ ID NO: 400338 - RNA, 20 nt, Human
agggagagcaggcugggcag

SEQ ID NO: 400339 - RNA, 23 nt, Human
agggagagcaggcugggcagggg

SEQ ID NO: 400340 - RNA, 21 nt, Human
agggaggaugaggaggaaggc

SEQ ID NO: 400341 - RNA, 21 nt, Human
agggucagggaggaugaggag

SEQ ID NO: 400342 - RNA, 21 nt, Human
agggugcuaggagcaggguca

SEQ ID NO: 400343 - RNA, 21 nt, Human
aucaacagcaucgaguaauga

SEQ ID NO: 400344 - RNA, 24 nt, Human
caaaaaaagacaaacaguuguuca

SEQ ID NO: 400345 - RNA, 20 nt, Human
caaaauuggccccuggaaaa

SEQ ID NO: 400346 - RNA, 19 nt, Human
caaagcagcugaaauaggc

SEQ ID NO: 400347 - RNA, 21 nt, Human
caaagcagcugaaauaggcca

SEQ ID NO: 400348 - RNA, 22 nt, Human
caaagccagacaaguucacugu

SEQ ID NO: 400349 - RNA, 26 nt, Human
cacccaaugugcagguggagaccugc

SEQ ID NO: 400350 - RNA, 20 nt, Human
caccccucuccuccacacuu

SEQ ID NO: 400351 - RNA, 22 nt, Human
caccccucuccuccacacuuga

SEQ ID NO: 400352 - RNA, 23 nt, Human
caccuuacagugccaacuguuuc

SEQ ID NO: 400353 - RNA, 25 nt, Human
caccuuuuaggaugugucuugggga

SEQ ID NO: 400354 - RNA, 22 nt, Human
cagccgcugcaggugccaccug

SEQ ID NO: 400355 - RNA, 24 nt, Human
caggccugaagaggccaacauggu

SEQ ID NO: 400356 - RNA, 22 nt, Human
caggcggcgcuccccgccccuc

SEQ ID NO: 400357 - RNA, 21 nt, Human
caucucaagucauccagcagc

SEQ ID NO: 400358 - RNA, 22 nt, Human
caugcacggggaagcaaaacca

SEQ ID NO: 400359 - RNA, 19 nt, Human
cccacaaccagccggccau

SEQ ID NO: 400360 - RNA, 18 nt, Human
cccaugaagggcuggucc

SEQ ID NO: 400361 - RNA, 21 nt, Human
ccccauggaccucaauuucca

SEQ ID NO: 400362 - RNA, 20 nt, Human
ccccuggaaaggacucagca

SEQ ID NO: 400363 - RNA, 23 nt, Human
ccccuggaaaggacucagcaggg

SEQ ID NO: 400364 - RNA, 20 nt, Human
ccgccuccgccuccgccucc

SEQ ID NO: 400365 - RNA, 20 nt, Human
ccuccgccuccgccuccugc

SEQ ID NO: 400366 - RNA, 23 nt, Human
ccuuccccugguuggaaacccac

SEQ ID NO: 400367 - RNA, 23 nt, Human
cgcccuccgccuccgccuccgcc

SEQ ID NO: 400368 - RNA, 20 nt, Human
cgccuccgccuccugcuuag

SEQ ID NO: 400369 - RNA, 23 nt, Human
cgccuccgccuccugcuuagcuc

SEQ ID NO: 400370 - RNA, 20 nt, Human
cuccaggcggcgcuccccgc

SEQ ID NO: 400371 - RNA, 20 nt, Human
cuccccgccccucgcccucc

SEQ ID NO: 400372 - RNA, 20 nt, Human
cucuaagaguaaaucaugca

SEQ ID NO: 400373 - RNA, 21 nt, Human
cuggccaccauccagggcugc

SEQ ID NO: 400374 - RNA, 19 nt, Human
cuggucccuuuauuucugg

SEQ ID NO: 400375 - RNA, 19 nt, Human
gaccgccagugcccacaac

SEQ ID NO: 400376 - RNA, 19 nt, Human
gagagguaggcuggggaca

SEQ ID NO: 400377 - RNA, 21 nt, Human
gccuccaccccucuccuccac

SEQ ID NO: 400378 - RNA, 21 nt, Human
ggaagcaaaaccagccccauu

SEQ ID NO: 400379 - RNA, 24 nt, Human
ggagugcucagggcaaguuccuuu

SEQ ID NO: 400380 - RNA, 23 nt, Human
ggccaccacucuuacuuggcaaa

SEQ ID NO: 400381 - RNA, 28 nt, Human
ggcgcuccccgccccucgcccuccgccu

SEQ ID NO: 400382 - RNA, 18 nt, Human
gggaagcaaaaccagccc

SEQ ID NO: 400383 - RNA, 19 nt, Human
ggggcagccuccaccccuc

SEQ ID NO: 400384 - RNA, 19 nt, Human
ggguuagggagagcaggcu

SEQ ID NO: 400385 - RNA, 23 nt, Human
ggugcuaggagcagggucaggga

SEQ ID NO: 400386 - RNA, 19 nt, Human
gucccuuuauuucuggccc

SEQ ID NO: 400387 - RNA, 24 nt, Human
guccuagcuguagaaucauucauu

SEQ ID NO: 400388 - RNA, 22 nt, Human
gugccaaagccagacaaguuca

SEQ ID NO: 400389 - RNA, 21 nt, Human
uaaaaaugaagugaccucuga

SEQ ID NO: 400390 - RNA, 24 nt, Human
uaagaacccaucagcaaaaucccc

SEQ ID NO: 400391 - RNA, 20 nt, Human
uacaaaaaaagacaaacagu

SEQ ID NO: 400392 - RNA, 20 nt, Human
uaccaaguggccccagaggg

SEQ ID NO: 400393 - RNA, 23 nt, Human
uaucuggaauguucaauaugacc

SEQ ID NO: 400394 - RNA, 25 nt, Human
uaucuggaauguucaauaugaccug

SEQ ID NO: 400395 - RNA, 19 nt, Human
ucaggagccagucauuuug

SEQ ID NO: 400396 - RNA, 18 nt, Human
ucaugguuauggcacuug

SEQ ID NO: 400397 - RNA, 19 nt, Human
ucauucauuucauucuugc

SEQ ID NO: 400398 - RNA, 18 nt, Human
uccagggcugcuaaggcu

SEQ ID NO: 400399 - RNA, 18 nt, Human
uccccgccccucgcccuc

SEQ ID NO: 400400 - RNA, 24 nt, Human
ucucuacagaggcaugugcacaga

SEQ ID NO: 400401 - RNA, 18 nt, Human
ugaccucugaaucaucuc

SEQ ID NO: 400402 - RNA, 20 nt, Human
ugacuaccacgucaccaccc

SEQ ID NO: 400403 - RNA, 20 nt, Human
ugagcauccuugauuucccc

SEQ ID NO: 400404 - RNA, 18 nt, Human
ugaggaggaaggcugagu

SEQ ID NO: 400405 - RNA, 20 nt, Human
ugauuucccccauggaccuc

SEQ ID NO: 400406 - RNA, 19 nt, Human
ugccaccuggcugucuccc

SEQ ID NO: 400407 - RNA, 18 nt, Human
ugcuuugaaaaaaaaauc

SEQ ID NO: 400408 - RNA, 18 nt, Human
uggaaaggacucagcagg

SEQ ID NO: 400409 - RNA, 19 nt, Human
uggaauguucaauaugacc

SEQ ID NO: 400410 - RNA, 19 nt, Human
uggccaccauccagggcug

SEQ ID NO: 400411 - RNA, 22 nt, Human
uggccaccauccagggcugcua

SEQ ID NO: 400412 - RNA, 24 nt, Human
ugggcaggggagccacugcagccu

SEQ ID NO: 400413 - RNA, 19 nt, Human
ugucuauauucucacccca

SEQ ID NO: 400414 - RNA, 23 nt, Human
uuaucaacagcaucgaguaauga

SEQ ID NO: 400415 - RNA, 20 nt, Human
uuguggagagguaggcuggg

SEQ ID NO: 400416 - RNA, 18 nt, Human
uuuaauaaaaaugaagug

SEQ ID NO: 400417 - RNA, 21 nt, Human
uuucacaauugaacuuuacag

SEQ ID NO: 400418 - RNA, 22 nt, Human
uuucuggccaccauccagggcu

SEQ ID NO: 400419 - RNA, 27 nt, Human
uuuuuuuuuuuuuuuuuuuugcuuuga

SEQ ID NO: 400420 - RNA, 27 nt, Human
uuuuuuuuuuuuuuuuuuuuuuugggg

SEQ ID NO: 400421 - RNA, 21 nt, Human
aaaaaaacaaaaaacaaaaag

SEQ ID NO: 400422 - RNA, 23 nt, Human
aaaaacaaaaagcagcuugaagg

SEQ ID NO: 400423 - RNA, 20 nt, Human
aacagagcgagacuccaccu

SEQ ID NO: 400424 - RNA, 20 nt, Human
aacauggugaaacccugucu

SEQ ID NO: 400425 - RNA, 21 nt, Human
aacauggugaaacccugucuc

SEQ ID NO: 400426 - RNA, 23 nt, Human
aagaccccuggagagaaaaccag

SEQ ID NO: 400427 - RNA, 22 nt, Human
aagcaccaaaugcuacaaagaa

SEQ ID NO: 400428 - RNA, 22 nt, Human
aagcaggcacaucauuugaggu

SEQ ID NO: 400429 - RNA, 26 nt, Human
aagcaggcacaucauuugaggucagg

SEQ ID NO: 400430 - RNA, 21 nt, Human
aagucuuggaaguagaaaggg

SEQ ID NO: 400431 - RNA, 21 nt, Human
aaugagucauuagggugggcc

SEQ ID NO: 400432 - RNA, 24 nt, Human
acagagcgagacuccaccucaaaa

SEQ ID NO: 400433 - RNA, 24 nt, Human
accaaaugcuacaaagaaaucaug

SEQ ID NO: 400434 - RNA, 24 nt, Human
accagggaagcggaggcugcagug

SEQ ID NO: 400435 - RNA, 24 nt, Human
acccugucucuacuaaaaauacaa

SEQ ID NO: 400436 - RNA, 21 nt, Human
acggcauucugaccacccacc

SEQ ID NO: 400437 - RNA, 21 nt, Human
acggcauucugaccacccacc

SEQ ID NO: 400438 - RNA, 22 nt, Human
acucguccuccccgucuuugca

SEQ ID NO: 400439 - RNA, 22 nt, Human
acucguccuccccgucuuugca

SEQ ID NO: 400440 - RNA, 24 nt, Human
acugcacuccagccugggcaacag

SEQ ID NO: 400441 - RNA, 24 nt, Human
acugcacuccagccugggcaacag

SEQ ID NO: 400442 - RNA, 19 nt, Human
agaaagacacguugagguc

SEQ ID NO: 400443 - RNA, 21 nt, Human
agaaucgcuugaaccagggaa

SEQ ID NO: 400444 - RNA, 20 nt, Human
agcacugugggaggcugaag

SEQ ID NO: 400445 - RNA, 22 nt, Human
agccuggccaacauggugaaac

SEQ ID NO: 400446 - RNA, 24 nt, Human
agccuggccaacauggugaaaccc

SEQ ID NO: 400447 - RNA, 24 nt, Human
agccugggcaacagagcgagacuc

SEQ ID NO: 400448 - RNA, 21 nt, Human
agcuacuggggaagcugaggc

SEQ ID NO: 400449 - RNA, 20 nt, Human
agcugugaacaccuggagca

SEQ ID NO: 400450 - RNA, 23 nt, Human
aggaagagcagaaagccccagaa

SEQ ID NO: 400451 - RNA, 18 nt, Human
aggcaagagaaucgcuug

SEQ ID NO: 400452 - RNA, 21 nt, Human
aggcaggaauuaaccaacagc

SEQ ID NO: 400453 - RNA, 24 nt, Human
aggcgugguggcccaugccuguaa

SEQ ID NO: 400454 - RNA, 22 nt, Human
aggcuaggcgugguggcccaug

SEQ ID NO: 400455 - RNA, 24 nt, Human
agggaaagggccacccaccaaggg

SEQ ID NO: 400456 - RNA, 24 nt, Human
agggauuucgccacugcacuccag

SEQ ID NO: 400457 - RNA, 20 nt, Human
agguuccuacacgggagucc

SEQ ID NO: 400458 - RNA, 19 nt, Human
aguguuacuggcuucccau

SEQ ID NO: 400459 - RNA, 22 nt, Human
auaaucaacugaugccaacacc

SEQ ID NO: 400460 - RNA, 18 nt, Human
aucaaugcaaugauccca

SEQ ID NO: 400461 - RNA, 18 nt, Human
aucaaugcaaugauccca

SEQ ID NO: 400462 - RNA, 20 nt, Human
aucauuugaggucagggguu

SEQ ID NO: 400463 - RNA, 23 nt, Human
aucauuugaggucagggguuuga

SEQ ID NO: 400464 - RNA, 24 nt, Human
aucauuugaggucagggguuugag

SEQ ID NO: 400465 - RNA, 18 nt, Human
auccuuucccccuccccu

SEQ ID NO: 400466 - RNA, 19 nt, Human
augccuguaaucccagcac

SEQ ID NO: 400467 - RNA, 24 nt, Human
auuucgccacugcacuccagccug

SEQ ID NO: 400468 - RNA, 24 nt, Human
caaaugcuacaaagaaaucaugaa

SEQ ID NO: 400469 - RNA, 23 nt, Human
caacagagcgagacuccaccuca

SEQ ID NO: 400470 - RNA, 24 nt, Human
caacauggugaaacccugucucua

SEQ ID NO: 400471 - RNA, 19 nt, Human
caacugaugccaacaccaa

SEQ ID NO: 400472 - RNA, 21 nt, Human
caagcaccaaaugcuacaaag

SEQ ID NO: 400473 - RNA, 22 nt, Human
cacagcgguacucguccucccc

SEQ ID NO: 400474 - RNA, 24 nt, Human
cacaucauuugaggucagggguuu

SEQ ID NO: 400475 - RNA, 22 nt, Human
caccaaaugcuacaaagaaauc

SEQ ID NO: 400476 - RNA, 21 nt, Human
caccucaaaaaaacaaaaaac

SEQ ID NO: 400477 - RNA, 24 nt, Human
caccucaaaaaaacaaaaaacaaa

SEQ ID NO: 400478 - RNA, 20 nt, Human
caccuguggucccagcuacu

SEQ ID NO: 400479 - RNA, 23 nt, Human
caccuguggucccagcuacuggg

SEQ ID NO: 400480 - RNA, 22 nt, Human
cacgggaguccaggggaggauc

SEQ ID NO: 400481 - RNA, 19 nt, Human
cacuaacaacugucccccu

SEQ ID NO: 400482 - RNA, 24 nt, Human
cacuccagccugggcaacagagcg

SEQ ID NO: 400483 - RNA, 18 nt, Human
cacugcacuccagccugg

SEQ ID NO: 400484 - RNA, 19 nt, Human
cacugcacuccagccuggg

SEQ ID NO: 400485 - RNA, 21 nt, Human
cacugcacuccagccugggca

SEQ ID NO: 400486 - RNA, 22 nt, Human
cacugcacuccagccugggcaa

SEQ ID NO: 400487 - RNA, 23 nt, Human
cacugcacuccagccugggcaac

SEQ ID NO: 400488 - RNA, 24 nt, Human
cacugcacuccagccugggcaaca

SEQ ID NO: 400489 - RNA, 19 nt, Human
cagaaccugacuuggagug

SEQ ID NO: 400490 - RNA, 22 nt, Human
cagaaccugacuuggagugcca

SEQ ID NO: 400491 - RNA, 23 nt, Human
cagaaccugacuuggagugccau

SEQ ID NO: 400492 - RNA, 19 nt, Human
cagauggaagggugccucu

SEQ ID NO: 400493 - RNA, 18 nt, Human
cagcacugugggaggcug

SEQ ID NO: 400494 - RNA, 24 nt, Human
cagcacugugggaggcugaagcag

SEQ ID NO: 400495 - RNA, 20 nt, Human
cagcagugacaggaucugug

SEQ ID NO: 400496 - RNA, 21 nt, Human
cagcugugaacaccuggagca

SEQ ID NO: 400497 - RNA, 24 nt, Human
cagcugugaacaccuggagcacgg

SEQ ID NO: 400498 - RNA, 24 nt, Human
cagcugugaacaccuggagcacgg

SEQ ID NO: 400499 - RNA, 19 nt, Human
cagguggcuacuugucccc

SEQ ID NO: 400500 - RNA, 24 nt, Human
caucauuugaggucagggguuuga

SEQ ID NO: 400501 - RNA, 20 nt, Human
caugccuguaaucccagcac

SEQ ID NO: 400502 - RNA, 22 nt, Human
caugccuguaaucccagcacug

SEQ ID NO: 400503 - RNA, 23 nt, Human
ccaaaugcuacaaagaaaucaug

SEQ ID NO: 400504 - RNA, 23 nt, Human
ccaacagcucuuucagagugcaa

SEQ ID NO: 400505 - RNA, 20 nt, Human
ccaagggugucugcucgugu

SEQ ID NO: 400506 - RNA, 22 nt, Human
ccaccucaaaaaaacaaaaaac

SEQ ID NO: 400507 - RNA, 20 nt, Human
ccacugcacuccagccuggg

SEQ ID NO: 400508 - RNA, 21 nt, Human
ccacugcacuccagccugggc

SEQ ID NO: 400509 - RNA, 22 nt, Human
ccacugcacuccagccugggca

SEQ ID NO: 400510 - RNA, 23 nt, Human
ccacugcacuccagccugggcaa

SEQ ID NO: 400511 - RNA, 24 nt, Human
ccacugcacuccagccugggcaac

SEQ ID NO: 400512 - RNA, 22 nt, Human
ccagaccaauggccagugcuaa

SEQ ID NO: 400513 - RNA, 19 nt, Human
ccaggggaggaucgggcug

SEQ ID NO: 400514 - RNA, 18 nt, Human
ccaugccuguaaucccag

SEQ ID NO: 400515 - RNA, 19 nt, Human
cccacaugugaaaauaagu

SEQ ID NO: 400516 - RNA, 23 nt, Human
cccaugccuguaaucccagcacu

SEQ ID NO: 400517 - RNA, 20 nt, Human
cccccagaaagacacguuga

SEQ ID NO: 400518 - RNA, 21 nt, Human
cccccagaaagacacguugag

SEQ ID NO: 400519 - RNA, 19 nt, Human
cccgagccguccggugccc

SEQ ID NO: 400520 - RNA, 20 nt, Human
cccugagcagucgaagugga

SEQ ID NO: 400521 - RNA, 21 nt, Human
cccuugcaaguugcugcuucu

SEQ ID NO: 400522 - RNA, 19 nt, Human
ccuacacgggaguccaggg

SEQ ID NO: 400523 - RNA, 22 nt, Human
ccuggccaacauggugaaaccc

SEQ ID NO: 400524 - RNA, 24 nt, Human
ccuggccaacauggugaaacccug

SEQ ID NO: 400525 - RNA, 22 nt, Human
ccugggcaacagagcgagacuc

SEQ ID NO: 400526 - RNA, 21 nt, Human
ccuguaaucccagcacugugg

SEQ ID NO: 400527 - RNA, 22 nt, Human
ccuguaaucccagcacuguggg

SEQ ID NO: 400528 - RNA, 22 nt, Human
ccuguggucccagcuacugggg

SEQ ID NO: 400529 - RNA, 18 nt, Human
ccuuaauuagggaaaggg

SEQ ID NO: 400530 - RNA, 20 nt, Human
ccuuucccccuccccucuuu

SEQ ID NO: 400531 - RNA, 26 nt, Human
cgaaguggaugcccagaccaauggcc

SEQ ID NO: 400532 - RNA, 20 nt, Human
cgccacugcacuccagccug

SEQ ID NO: 400533 - RNA, 24 nt, Human
cgccacugcacuccagccugggca

SEQ ID NO: 400534 - RNA, 25 nt, Human
cgccuccaccucuaccucauaauuc

SEQ ID NO: 400535 - RNA, 21 nt, Human
cgggcaccuguggucccagcu

SEQ ID NO: 400536 - RNA, 18 nt, Human
cgggccugcuacuggugc

SEQ ID NO: 400537 - RNA, 21 nt, Human
cgucaagcaccaaaugcuaca

SEQ ID NO: 400538 - RNA, 19 nt, Human
cgucaggaauuuugcaaga

SEQ ID NO: 400539 - RNA, 19 nt, Human
cugaugccaacaccaacau

SEQ ID NO: 400540 - RNA, 24 nt, Human
cuggccaacauggugaaacccugu

SEQ ID NO: 400541 - RNA, 21 nt, Human
cuugaagguugugcuggaauc

SEQ ID NO: 400542 - RNA, 19 nt, Human
gaaaagggaggaaggcagg

SEQ ID NO: 400543 - RNA, 19 nt, Human
gaaacccugucucuacuaa

SEQ ID NO: 400544 - RNA, 25 nt, Human
gaaagggccacccaccaaggggcac

SEQ ID NO: 400545 - RNA, 19 nt, Human
gaagguugugcuggaauca

SEQ ID NO: 400546 - RNA, 21 nt, Human
gacuccaccucaaaaaaacaa

SEQ ID NO: 400547 - RNA, 22 nt, Human
gagaaucgcuugaaccagggaa

SEQ ID NO: 400548 - RNA, 23 nt, Human
gagagcagccuggccaacauggu

SEQ ID NO: 400549 - RNA, 18 nt, Human
gagucauuccuagauuaa

SEQ ID NO: 400550 - RNA, 23 nt, Human
gauaaucaacugaugccaacacc

SEQ ID NO: 400551 - RNA, 24 nt, Human
gcacuccagccugggcaacagagc

SEQ ID NO: 400552 - RNA, 24 nt, Human
gccaacauggugaaacccugucuc

SEQ ID NO: 400553 - RNA, 22 nt, Human
gccacugcacuccagccugggc

SEQ ID NO: 400554 - RNA, 24 nt, Human
gccacugcacuccagccugggcaa

SEQ ID NO: 400555 - RNA, 20 nt, Human
gcccaaagaaaggugccuua

SEQ ID NO: 400556 - RNA, 21 nt, Human
gccccagaaccugacuuggag

SEQ ID NO: 400557 - RNA, 21 nt, Human
gcccuugcaaguugcugcuuc

SEQ ID NO: 400558 - RNA, 19 nt, Human
gccggaacucagagcucca

SEQ ID NO: 400559 - RNA, 24 nt, Human
gccuccaccucuaccucauaauuc

SEQ ID NO: 400560 - RNA, 19 nt, Human
gccuuaauuagggaaaggg

SEQ ID NO: 400561 - RNA, 22 nt, Human
gcgggcaccuguggucccagcu

SEQ ID NO: 400562 - RNA, 19 nt, Human
gcgucuuuucugaguggcu

SEQ ID NO: 400563 - RNA, 23 nt, Human
ggaggcugcagugagcagggauu

SEQ ID NO: 400564 - RNA, 19 nt, Human
ggccacaguguuacuggcu

SEQ ID NO: 400565 - RNA, 19 nt, Human
gggaagcugaggcaagaga

SEQ ID NO: 400566 - RNA, 23 nt, Human
gggauuucgccacugcacuccag

SEQ ID NO: 400567 - RNA, 24 nt, Human
gguggcccaugccuguaaucccag

SEQ ID NO: 400568 - RNA, 21 nt, Human
gugggaggcugaagcaggcac

SEQ ID NO: 400569 - RNA, 31 nt, Human
uaaccagaaaaaggaagagcagaaagccccc

SEQ ID NO: 400570 - RNA, 22 nt, Human
uacaaagaaaucaugaaaauag

SEQ ID NO: 400571 - RNA, 23 nt, Human
uacaaagaaaucaugaaaauagg

SEQ ID NO: 400572 - RNA, 20 nt, Human
ucaaaggacaauaauacguc

SEQ ID NO: 400573 - RNA, 18 nt, Human
ucagcccaaagaaaggug

SEQ ID NO: 400574 - RNA, 20 nt, Human
ucagcccaaagaaaggugcc

SEQ ID NO: 400575 - RNA, 22 nt, Human
ucagcccaaagaaaggugccuu

SEQ ID NO: 400576 - RNA, 21 nt, Human
ucaggaacucagguggcuacu

SEQ ID NO: 400577 - RNA, 20 nt, Human
ucaguccuaccugcuccacc

SEQ ID NO: 400578 - RNA, 22 nt, Human
ucauaauucccgagucccaaaa

SEQ ID NO: 400579 - RNA, 24 nt, Human
uccaagggugucugcucgggcgca

SEQ ID NO: 400580 - RNA, 18 nt, Human
uccaccucaaaaaaacaa

SEQ ID NO: 400581 - RNA, 19 nt, Human
uccacgaagcagcugugaa

SEQ ID NO: 400582 - RNA, 19 nt, Human
uccacgaagcagcugugaa

SEQ ID NO: 400583 - RNA, 23 nt, Human
uccagccugggcaacagagcgag

SEQ ID NO: 400584 - RNA, 24 nt, Human
uccagccugggcaacagagcgaga

SEQ ID NO: 400585 - RNA, 22 nt, Human
ucccaaaaauguagauggcacc

SEQ ID NO: 400586 - RNA, 25 nt, Human
ucccaaaaauguagauggcaccucg

SEQ ID NO: 400587 - RNA, 18 nt, Human
ucccauaaacacagcccu

SEQ ID NO: 400588 - RNA, 19 nt, Human
ucccgagucccaaaaaugu

SEQ ID NO: 400589 - RNA, 21 nt, Human
ucccugagcagucgaagugga

SEQ ID NO: 400590 - RNA, 21 nt, Human
ucucuacuaaaaauacaaaaa

SEQ ID NO: 400591 - RNA, 19 nt, Human
ucuggucccuagagaugaa

SEQ ID NO: 400592 - RNA, 21 nt, Human
ugaaccagggaagcggaggcu

SEQ ID NO: 400593 - RNA, 26 nt, Human
ugaagcaggcacaucauuugagguca

SEQ ID NO: 400594 - RNA, 20 nt, Human
ugacaaggauuauaaagcag

SEQ ID NO: 400595 - RNA, 19 nt, Human
ugacccgguuauuccaugg

SEQ ID NO: 400596 - RNA, 24 nt, Human
ugagagcagccuggccaacauggu

SEQ ID NO: 400597 - RNA, 18 nt, Human
ugagcagucgaaguggac

SEQ ID NO: 400598 - RNA, 20 nt, Human
ugaggcaagagaaucgcuug

SEQ ID NO: 400599 - RNA, 24 nt, Human
ugaggcaagagaaucgcuugaacc

SEQ ID NO: 400600 - RNA, 24 nt, Human
ugaggcuaggcgugguggcccaug

SEQ ID NO: 400601 - RNA, 24 nt, Human
ugagggaaggaaacauauuauuug

SEQ ID NO: 400602 - RNA, 19 nt, Human
ugaggggaugugcuauggg

SEQ ID NO: 400603 - RNA, 18 nt, Human
ugaggucagggguuugag

SEQ ID NO: 400604 - RNA, 22 nt, Human
ugcccagaccaauggccagugc

SEQ ID NO: 400605 - RNA, 23 nt, Human
ugccuguaaucccagcacugugg

SEQ ID NO: 400606 - RNA, 23 nt, Human
ugccuguaaucccagcacugugg

SEQ ID NO: 400607 - RNA, 24 nt, Human
ugccuguaaucccagcacuguggg

SEQ ID NO: 400608 - RNA, 20 nt, Human
ugcuggaaucagauggaagg

SEQ ID NO: 400609 - RNA, 20 nt, Human
uggaaaaaacuucaauggca

SEQ ID NO: 400610 - RNA, 21 nt, Human
uggaaaaaacuucaauggcag

SEQ ID NO: 400611 - RNA, 19 nt, Human
uggaaucaaaggacaauaa

SEQ ID NO: 400612 - RNA, 22 nt, Human
uggaaucagauggaagggugcc

SEQ ID NO: 400613 - RNA, 24 nt, Human
uggccaacauggugaaacccuguc

SEQ ID NO: 400614 - RNA, 21 nt, Human
uggcccaugccuguaauccca

SEQ ID NO: 400615 - RNA, 22 nt, Human
uggcccaugccuguaaucccag

SEQ ID NO: 400616 - RNA, 24 nt, Human
uggcccaugccuguaaucccagca

SEQ ID NO: 400617 - RNA, 21 nt, Human
uggccuggagagucuuuacag

SEQ ID NO: 400618 - RNA, 24 nt, Human
uggcgggcaccuguggucccagcu

SEQ ID NO: 400619 - RNA, 24 nt, Human
ugggaggcugaagcaggcacauca

SEQ ID NO: 400620 - RNA, 24 nt, Human
ugguggcccaugccuguaauccca

SEQ ID NO: 400621 - RNA, 24 nt, Human
ugguggcgggcaccugugguccca

SEQ ID NO: 400622 - RNA, 22 nt, Human
ugugcagguuccuacacgggag

SEQ ID NO: 400623 - RNA, 23 nt, Human
ugugguggcgggcaccugugguc

SEQ ID NO: 400624 - RNA, 18 nt, Human
uuaguugggugugguggc

SEQ ID NO: 400625 - RNA, 24 nt, Human
uuaguugggugugguggcgggcac

SEQ ID NO: 400626 - RNA, 24 nt, Human
uucccccuccccucuuugcagaga

SEQ ID NO: 400627 - RNA, 20 nt, Human
uuccuagauuaaccucccca

SEQ ID NO: 400628 - RNA, 21 nt, Human
uucugaguggcuguugguggc

SEQ ID NO: 400629 - RNA, 19 nt, Human
uugaauaguaucccccaga

SEQ ID NO: 400630 - RNA, 21 nt, Human
uuggaaguagaaagggugggu

SEQ ID NO: 400631 - RNA, 19 nt, Human
uuuaaugagaaaagauaau

SEQ ID NO: 400632 - RNA, 21 nt, Human
uuuggaaucaaaggacaauaa

SEQ ID NO: 400633 - RNA, 21 nt, Human
uuuuuuuuuuuaggagcauca

SEQ ID NO: 400634 - RNA, 18 nt, Human
uuuuuuuuuuuuaggagc

SEQ ID NO: 400635 - RNA, 19 nt, Human
uuuuuuuuuuuuugaggga

SEQ ID NO: 400636 - RNA, 22 nt, Human
uuuuuuuuuuuuuuuuugaggg

SEQ ID NO: 400637 - RNA, 21 nt, Human
uuuuuuuuuuuuuuuuuuagg

SEQ ID NO: 400638 - RNA, 28 nt, Human
uuuuuuuuuuuuuuuuuuuuuuugaggg

SEQ ID NO: 400639 - RNA, 21 nt, Human
aagucccuggucagcacuggc

SEQ ID NO: 400640 - RNA, 20 nt, Human
acacagcucuuuaauaauag

SEQ ID NO: 400641 - RNA, 24 nt, Human
accccugagaccuuguucaguggg

SEQ ID NO: 400642 - RNA, 20 nt, Human
acccuuuccuucuccucucc

SEQ ID NO: 400643 - RNA, 21 nt, Human
accuuguucagugggcugugu

SEQ ID NO: 400644 - RNA, 22 nt, Human
agauugucaccccaaggcagca

SEQ ID NO: 400645 - RNA, 21 nt, Human
agggcaggaaggaagcggcuc

SEQ ID NO: 400646 - RNA, 25 nt, Human
augacaacaguagguaacgguaguc

SEQ ID NO: 400647 - RNA, 24 nt, Human
cagcccacagugaucugggcuuuu

SEQ ID NO: 400648 - RNA, 18 nt, Human
ccacacagguccuggcug

SEQ ID NO: 400649 - RNA, 23 nt, Human
cccacacagguccuggcuggcca

SEQ ID NO: 400650 - RNA, 18 nt, Human
cccacagugaucugggcu

SEQ ID NO: 400651 - RNA, 22 nt, Human
ccgcugagcaagcugcugccuc

SEQ ID NO: 400652 - RNA, 23 nt, Human
ccucugggcgccucugggcugcg

SEQ ID NO: 400653 - RNA, 23 nt, Human
ccugagaccuuguucagugggcu

SEQ ID NO: 400654 - RNA, 18 nt, Human
ccuucuccucuccagccc

SEQ ID NO: 400655 - RNA, 21 nt, Human
cuagggcugcugacuuccucu

SEQ ID NO: 400656 - RNA, 25 nt, Human
cuccaagaaaugcugaggcuguggg

SEQ ID NO: 400657 - RNA, 24 nt, Human
cuccagcccacagugaucugggcu

SEQ ID NO: 400658 - RNA, 23 nt, Human
ggcagagggguguacccaagggg

SEQ ID NO: 400659 - RNA, 21 nt, Human
gggcaggaaggaagcggcucc

SEQ ID NO: 400660 - RNA, 23 nt, Human
gggcaggaaggaagcggcuccca

SEQ ID NO: 400661 - RNA, 20 nt, Human
uacaagacagccugcuucca

SEQ ID NO: 400662 - RNA, 18 nt, Human
uagcaauaccccugagac

SEQ ID NO: 400663 - RNA, 21 nt, Human
uagggcagugcauuuuauauu

SEQ ID NO: 400664 - RNA, 19 nt, Human
uagugugggaaaguuccuu

SEQ ID NO: 400665 - RNA, 24 nt, Human
ucagaagucccuggucagcacugg

SEQ ID NO: 400666 - RNA, 25 nt, Human
ucaguagugugggaaaguuccuucu

SEQ ID NO: 400667 - RNA, 21 nt, Human
ucagugggcugugucucuccc

SEQ ID NO: 400668 - RNA, 20 nt, Human
uccgcugagcaagcugcugc

SEQ ID NO: 400669 - RNA, 19 nt, Human
ucucuuacaggaauugagg

SEQ ID NO: 400670 - RNA, 22 nt, Human
ucugugauccucccggucuccc

SEQ ID NO: 400671 - RNA, 18 nt, Human
ucuugcucugugucugac

SEQ ID NO: 400672 - RNA, 22 nt, Human
ucuugcucugugucugacuuug

SEQ ID NO: 400673 - RNA, 23 nt, Human
ucuugcucugugucugacuuugg

SEQ ID NO: 400674 - RNA, 24 nt, Human
ucuugcucugugucugacuuuggg

SEQ ID NO: 400675 - RNA, 18 nt, Human
ucuuuaauaauaguggcc

SEQ ID NO: 400676 - RNA, 18 nt, Human
ugacuuccucugggcgcc

SEQ ID NO: 400677 - RNA, 19 nt, Human
ugauccucccggucucccu

SEQ ID NO: 400678 - RNA, 19 nt, Human
ugcuccaagaaaugcugag

SEQ ID NO: 400679 - RNA, 18 nt, Human
ugcugaggcugugggcag

SEQ ID NO: 400680 - RNA, 24 nt, Human
uggagcugagauugucaccccaag

SEQ ID NO: 400681 - RNA, 21 nt, Human
uggccagcaggucagaagucc

SEQ ID NO: 400682 - RNA, 18 nt, Human
uggcgcagacccuuuccu

SEQ ID NO: 400683 - RNA, 21 nt, Human
uggcucugugauccucccggu

SEQ ID NO: 400684 - RNA, 20 nt, Human
uggcuggaggaggcccgagu

SEQ ID NO: 400685 - RNA, 19 nt, Human
ugggaaaguuccuucuugg

SEQ ID NO: 400686 - RNA, 18 nt, Human
ugggagcaccaagugugg

SEQ ID NO: 400687 - RNA, 21 nt, Human
ugggagcaccaaguguggccg

SEQ ID NO: 400688 - RNA, 19 nt, Human
ugggaugcugggagcacca

SEQ ID NO: 400689 - RNA, 25 nt, Human
ugggaugcugggagcaccaaguguc

SEQ ID NO: 400690 - RNA, 20 nt, Human
ugggcagggcaggaaggaag

SEQ ID NO: 400691 - RNA, 21 nt, Human
ugggcuuuuacaagacagccu

SEQ ID NO: 400692 - RNA, 24 nt, Human
ugggugaagacggacagggcuggc

SEQ ID NO: 400693 - RNA, 23 nt, Human
uuaauaauaguggccauagcuuu

SEQ ID NO: 400694 - RNA, 19 nt, Human
uucuccucuccagcccaca

SEQ ID NO: 400695 - RNA, 20 nt, Human
uuuauauuacaacugguuuc

SEQ ID NO: 400696 - RNA, 23 nt, Human
uuuauauuacaacugguuucuug

SEQ ID NO: 400697 - RNA, 18 nt, Human
uuuuuuuuuuuuuuuuug

SEQ ID NO: 400698 - RNA, 20 nt, Human
aaaagcacuuccauuuugua

SEQ ID NO: 400699 - RNA, 23 nt, Human
aaaagcacuuccauuuuguagcc

SEQ ID NO: 400700 - RNA, 19 nt, Human
aaagcccuucucgcccucc

SEQ ID NO: 400701 - RNA, 22 nt, Human
aggaagccguagggagcaaucc

SEQ ID NO: 400702 - RNA, 21 nt, Human
aggcggaggcugcagcuggag

SEQ ID NO: 400703 - RNA, 22 nt, Human
aggcggaggcugcagcuggagg

SEQ ID NO: 400704 - RNA, 24 nt, Human
agugagcgugagaaacagccaccu

SEQ ID NO: 400705 - RNA, 19 nt, Human
auccaaagugagcgugaga

SEQ ID NO: 400706 - RNA, 21 nt, Human
augggagaagcaggcguggcc

SEQ ID NO: 400707 - RNA, 21 nt, Human
cacuccgcuaagucuuucacc

SEQ ID NO: 400708 - RNA, 25 nt, Human
cacuuccgcguucaagugguuaaaa

SEQ ID NO: 400709 - RNA, 22 nt, Human
cagcccgcagagccgucugagg

SEQ ID NO: 400710 - RNA, 21 nt, Human
cagcgcagcgccgccgcugcc

SEQ ID NO: 400711 - RNA, 19 nt, Human
cagcgccgccgcugccagg

SEQ ID NO: 400712 - RNA, 21 nt, Human
caggucgcaaaagcacuucca

SEQ ID NO: 400713 - RNA, 19 nt, Human
caggucuuugaugucaaaa

SEQ ID NO: 400714 - RNA, 24 nt, Human
ccaaagugagcgugagaaacagcc

SEQ ID NO: 400715 - RNA, 27 nt, Human
ccacacugcagcccagcacacaaagcg

SEQ ID NO: 400716 - RNA, 19 nt, Human
ccacagaaaaagaggcgac

SEQ ID NO: 400717 - RNA, 20 nt, Human
cccgcaaccugagaaagccc

SEQ ID NO: 400718 - RNA, 19 nt, Human
cccgcaaccugagaaagcu

SEQ ID NO: 400719 - RNA, 19 nt, Human
cccgcgccacacugcagcc

SEQ ID NO: 400720 - RNA, 22 nt, Human
cccgcgccacacugcagcccag

SEQ ID NO: 400721 - RNA, 18 nt, Human
cccuccguccccugcugu

SEQ ID NO: 400722 - RNA, 20 nt, Human
cccuccguccccugcuguuu

SEQ ID NO: 400723 - RNA, 23 nt, Human
cgacccgcaaccugagaaagccc

SEQ ID NO: 400724 - RNA, 23 nt, Human
cgcaaccugagaaagcccuucuc

SEQ ID NO: 400725 - RNA, 20 nt, Human
cuaaaauggagcccaggucu

SEQ ID NO: 400726 - RNA, 22 nt, Human
cuaccaguucuucgcccgcgcc

SEQ ID NO: 400727 - RNA, 18 nt, Human
cucgcccuccguccccug

SEQ ID NO: 400728 - RNA, 21 nt, Human
cugagaaagcccuucucgccc

SEQ ID NO: 400729 - RNA, 18 nt, Human
cugaggcugggagacggc

SEQ ID NO: 400730 - RNA, 23 nt, Human
cugcagcuggagcuugcgacaac

SEQ ID NO: 400731 - RNA, 23 nt, Human
gagcuuccucuuuccacagaaaa

SEQ ID NO: 400732 - RNA, 19 nt, Human
gcagcccagcacacaaagc

SEQ ID NO: 400733 - RNA, 18 nt, Human
gccacacugcagcccagc

SEQ ID NO: 400734 - RNA, 21 nt, Human
gccacacugcagcccagcaca

SEQ ID NO: 400735 - RNA, 26 nt, Human
gccuccauugucagcaggucuuugau

SEQ ID NO: 400736 - RNA, 18 nt, Human
gcgcccgcuuucuagucu

SEQ ID NO: 400737 - RNA, 19 nt, Human
gcgugagaaacagccaccu

SEQ ID NO: 400738 - RNA, 21 nt, Human
ggagacggcucggggcucggg

SEQ ID NO: 400739 - RNA, 21 nt, Human
ggcaagaauuccuaaaaugga

SEQ ID NO: 400740 - RNA, 22 nt, Human
ggcaucccuagcacacaugccu

SEQ ID NO: 400741 - RNA, 19 nt, Human
ggcccggaagcuaguccug

SEQ ID NO: 400742 - RNA, 23 nt, Human
uaaaauggagcccaggucgcaaa

SEQ ID NO: 400743 - RNA, 24 nt, Human
uaagucuuucaccaacauucaagc

SEQ ID NO: 400744 - RNA, 23 nt, Human
uaccaguucuucgcccgcgccac

SEQ ID NO: 400745 - RNA, 24 nt, Human
ucacguaggcggaggcugcagcug

SEQ ID NO: 400746 - RNA, 19 nt, Human
uccaaagugagcgugagaa

SEQ ID NO: 400747 - RNA, 19 nt, Human
uccacagaaaaagaggcga

SEQ ID NO: 400748 - RNA, 23 nt, Human
uccacagaaaaagaggcgacacc

SEQ ID NO: 400749 - RNA, 19 nt, Human
ucccugccagccagacagg

SEQ ID NO: 400750 - RNA, 19 nt, Human
uccgcuaagucuuucacca

SEQ ID NO: 400751 - RNA, 18 nt, Human
uccgggucucuguacugg

SEQ ID NO: 400752 - RNA, 18 nt, Human
ucucacguaggcggaggc

SEQ ID NO: 400753 - RNA, 20 nt, Human
ugagaaagcccuucucgccc

SEQ ID NO: 400754 - RNA, 21 nt, Human
ugagcuuccucuuuccacaga

SEQ ID NO: 400755 - RNA, 20 nt, Human
uggaagagaauaggaaagcu

SEQ ID NO: 400756 - RNA, 20 nt, Human
uggaauguuccggaauaaag

SEQ ID NO: 400757 - RNA, 22 nt, Human
uggagcccaggucgcaaaagca

SEQ ID NO: 400758 - RNA, 18 nt, Human
ugggagaagcaggcgugg

SEQ ID NO: 400759 - RNA, 24 nt, Human
ugggagaagcaggcguggccucca

SEQ ID NO: 400760 - RNA, 19 nt, Human
uguccgggucucuguacug

SEQ ID NO: 400761 - RNA, 23 nt, Human
uucaagcuauuuuccuucccugc

SEQ ID NO: 400762 - RNA, 26 nt, Human
uuccacagaaaaagaggcgacaccuu

SEQ ID NO: 400763 - RNA, 22 nt, Human
acgcagugagcagccacggccc

SEQ ID NO: 400764 - RNA, 22 nt, Human
aggccccccacggcccccgccc

SEQ ID NO: 400765 - RNA, 19 nt, Human
caggccccccacggccccc

SEQ ID NO: 400766 - RNA, 19 nt, Human
cccacccuccucccggccu

SEQ ID NO: 400767 - RNA, 19 nt, Human
cccccacggcccccgcccc

SEQ ID NO: 400768 - RNA, 21 nt, Human
cccccacggcccccgccccgc

SEQ ID NO: 400769 - RNA, 20 nt, Human
ccuccaggccccccacggcc

SEQ ID NO: 400770 - RNA, 22 nt, Human
ccucccgcggcuccugcccucc

SEQ ID NO: 400771 - RNA, 20 nt, Human
ccuccuccaggccccccacg

SEQ ID NO: 400772 - RNA, 21 nt, Human
cgcagugagcagccacggccc

SEQ ID NO: 400773 - RNA, 27 nt, Human
cggcuccugcccuccuccaggcccccc

SEQ ID NO: 400774 - RNA, 22 nt, Human
cgggggcugcugcugccugcag

SEQ ID NO: 400775 - RNA, 20 nt, Human
cuccaggccccccacggccc

SEQ ID NO: 400776 - RNA, 19 nt, Human
cuccugcccuccuccaggc

SEQ ID NO: 400777 - RNA, 18 nt, Human
cugcugcugccugcagcg

SEQ ID NO: 400778 - RNA, 21 nt, Human
gcaagguccccacccuccucc

SEQ ID NO: 400779 - RNA, 21 nt, Human
gcccuccuccaggccccccac

SEQ ID NO: 400780 - RNA, 22 nt, Human
ucccgcggcuccugcccuccuc

SEQ ID NO: 400781 - RNA, 23 nt, Human
uccgaacgcagugagcagccacg

SEQ ID NO: 400782 - RNA, 19 nt, Human
ugcaaaaagaggcuccaag

SEQ ID NO: 400783 - RNA, 24 nt, Human
ugcugcugccugcagcgggucugg

SEQ ID NO: 400784 - RNA, 18 nt, Human
uuuuuuuccucuccgcga

SEQ ID NO: 400785 - RNA, 22 nt, Human
aaacuaccccuguacauccuac

SEQ ID NO: 400786 - RNA, 21 nt, Human
aaagaaagaaaucacagagga

SEQ ID NO: 400787 - RNA, 23 nt, Human
aaauacaaucagguacuguccag

SEQ ID NO: 400788 - RNA, 19 nt, Human
aagaaagaaaucacagagg

SEQ ID NO: 400789 - RNA, 19 nt, Human
aauguaaaaaaagggaugg

SEQ ID NO: 400790 - RNA, 23 nt, Human
agaaaucacagaggaggugaggc

SEQ ID NO: 400791 - RNA, 23 nt, Human
auccuaccccucucccaucccag

SEQ ID NO: 400792 - RNA, 25 nt, Human
auuauuauauuaauaauauuaauca

SEQ ID NO: 400793 - RNA, 20 nt, Human
caaaucaguugucccugauc

SEQ ID NO: 400794 - RNA, 25 nt, Human
caacaaaacagaaacauguuggaga

SEQ ID NO: 400795 - RNA, 21 nt, Human
cacuuucagcagaauugggga

SEQ ID NO: 400796 - RNA, 18 nt, Human
cagcgcugccuuugugcc

SEQ ID NO: 400797 - RNA, 19 nt, Human
cagguacuguccagaaaug

SEQ ID NO: 400798 - RNA, 20 nt, Human
caucccagagccaccuaaga

SEQ ID NO: 400799 - RNA, 26 nt, Human
ccacgugcgcguucccccgaguuccc

SEQ ID NO: 400800 - RNA, 24 nt, Human
ccagguguggaccgaugguugggc

SEQ ID NO: 400801 - RNA, 22 nt, Human
ccccagcagcgcugccuuugug

SEQ ID NO: 400802 - RNA, 24 nt, Human
ccccagcagcgcugccuuugugcc

SEQ ID NO: 400803 - RNA, 22 nt, Human
ccccagggauccauggucagcu

SEQ ID NO: 400804 - RNA, 19 nt, Human
ccccgaguuccccagcagc

SEQ ID NO: 400805 - RNA, 20 nt, Human
cccuguacauccuaccccuc

SEQ ID NO: 400806 - RNA, 25 nt, Human
ccuuugugcccacggaggcgggggc

SEQ ID NO: 400807 - RNA, 22 nt, Human
cgagagaccuagguccuuggaa

SEQ ID NO: 400808 - RNA, 20 nt, Human
cgcucugggccgccuuauuc

SEQ ID NO: 400809 - RNA, 23 nt, Human
cuguugccguuggccccagggau

SEQ ID NO: 400810 - RNA, 23 nt, Human
gaaguaccuggaguguggagcug

SEQ ID NO: 400811 - RNA, 20 nt, Human
gaggugaggcccaugcuguu

SEQ ID NO: 400812 - RNA, 18 nt, Human
gagguggguuuggcuggg

SEQ ID NO: 400813 - RNA, 19 nt, Human
gcagcgcugccuuugugcc

SEQ ID NO: 400814 - RNA, 19 nt, Human
gcccacggaggcgggggcg

SEQ ID NO: 400815 - RNA, 18 nt, Human
gccuuauuccucucucac

SEQ ID NO: 400816 - RNA, 21 nt, Human
gccuuauuccucucucaccca

SEQ ID NO: 400817 - RNA, 19 nt, Human
gcugcuggggcucuagggc

SEQ ID NO: 400818 - RNA, 20 nt, Human
gcugcuggggcucuagggcu

SEQ ID NO: 400819 - RNA, 18 nt, Human
gcugggugcugcuggggc

SEQ ID NO: 400820 - RNA, 23 nt, Human
ggaagaaguaccuggagugugga

SEQ ID NO: 400821 - RNA, 19 nt, Human
ggaccgaugguugggcugg

SEQ ID NO: 400822 - RNA, 21 nt, Human
ggaggugaggcccaugcuguu

SEQ ID NO: 400823 - RNA, 26 nt, Human
ggagguggguuuggcuggggggaucc

SEQ ID NO: 400824 - RNA, 23 nt, Human
ggagguggguuuggcugggugcu

SEQ ID NO: 400825 - RNA, 19 nt, Human
guggagcugcggcgguucc

SEQ ID NO: 400826 - RNA, 25 nt, Human
uaacaaaaauaaugacaauuaauua

SEQ ID NO: 400827 - RNA, 19 nt, Human
uagggcucuagggauucac

SEQ ID NO: 400828 - RNA, 19 nt, Human
ucaguugucccugaucuuc

SEQ ID NO: 400829 - RNA, 22 nt, Human
ucccacgugcgcguucccccga

SEQ ID NO: 400830 - RNA, 24 nt, Human
ucccaucccagagccaccuaagag

SEQ ID NO: 400831 - RNA, 20 nt, Human
uccuaccccucucccauccc

SEQ ID NO: 400832 - RNA, 20 nt, Human
uccuuggaagaaguaccugg

SEQ ID NO: 400833 - RNA, 24 nt, Human
ugaaucaaacaacaaaacagaaac

SEQ ID NO: 400834 - RNA, 21 nt, Human
ugccguuggccccagggaucc

SEQ ID NO: 400835 - RNA, 23 nt, Human
ugccguuggccccagggauccau

SEQ ID NO: 400836 - RNA, 19 nt, Human
ugcgcgcgggagaggcggg

SEQ ID NO: 400837 - RNA, 21 nt, Human
ugcggcgguucccacgugcgc

SEQ ID NO: 400838 - RNA, 22 nt, Human
ugcugaaucaaacaacaaaaca

SEQ ID NO: 400839 - RNA, 20 nt, Human
uggaagaaguaccuggagug

SEQ ID NO: 400840 - RNA, 19 nt, Human
uggagguggguuuggcugg

SEQ ID NO: 400841 - RNA, 18 nt, Human
uggggcucuagggcucua

SEQ ID NO: 400842 - RNA, 21 nt, Human
uguaaaaaaagggauggcuuc

SEQ ID NO: 400843 - RNA, 24 nt, Human
uguaaaaaaagggauggcuuccaa

SEQ ID NO: 400844 - RNA, 19 nt, Human
uguccagaaauguuuugga

SEQ ID NO: 400845 - RNA, 21 nt, Human
uguccagaaauguuuuggaaa

SEQ ID NO: 400846 - RNA, 22 nt, Human
uuggaagaaguaccuggagugu

SEQ ID NO: 400847 - RNA, 20 nt, Human
aaaaaacauaaucaaaagaa

SEQ ID NO: 400848 - RNA, 24 nt, Human
aaaacauaaucaaaagaaggcaca

SEQ ID NO: 400849 - RNA, 22 nt, Human
aagaaggcacagaggccagggg

SEQ ID NO: 400850 - RNA, 19 nt, Human
aagcccccaauucucuuuu

SEQ ID NO: 400851 - RNA, 26 nt, Human
aagcuguaggccccagugaguucugg

SEQ ID NO: 400852 - RNA, 22 nt, Human
aaggaggggguaauaaagggau

SEQ ID NO: 400853 - RNA, 20 nt, Human
acccuaagcccccaauucuc

SEQ ID NO: 400854 - RNA, 27 nt, Human
agaggccagggggcuacaugggaacag

SEQ ID NO: 400855 - RNA, 19 nt, Human
agaugucagggaucaaagc

SEQ ID NO: 400856 - RNA, 20 nt, Human
agcauucuggccagaaccaa

SEQ ID NO: 400857 - RNA, 18 nt, Human
aggaaggccuaaggucca

SEQ ID NO: 400858 - RNA, 24 nt, Human
agggagcuggcuccauggggaggg

SEQ ID NO: 400859 - RNA, 18 nt, Human
aggggagagaggguggag

SEQ ID NO: 400860 - RNA, 23 nt, Human
aggggguaauaaagggauugggg

SEQ ID NO: 400861 - RNA, 22 nt, Human
auaguagggcgauuacagacac

SEQ ID NO: 400862 - RNA, 23 nt, Human
caaacauaaauagagggagcugg

SEQ ID NO: 400863 - RNA, 18 nt, Human
cacacauuccugaauccc

SEQ ID NO: 400864 - RNA, 22 nt, Human
cacggaaaacaugucugagcca

SEQ ID NO: 400865 - RNA, 19 nt, Human
ccagugaguucuggaggcc

SEQ ID NO: 400866 - RNA, 24 nt, Human
ccccaggauaccccggucucccaa

SEQ ID NO: 400867 - RNA, 19 nt, Human
cccccaggauaccccgguc

SEQ ID NO: 400868 - RNA, 19 nt, Human
cccuaagcccccaauucuc

SEQ ID NO: 400869 - RNA, 23 nt, Human
ccugcagcauucuggccagaacc

SEQ ID NO: 400870 - RNA, 21 nt, Human
cuccccuggggagcagaggcu

SEQ ID NO: 400871 - RNA, 18 nt, Human
gagaggaagagaaccugc

SEQ ID NO: 400872 - RNA, 20 nt, Human
gauuacagacacaacucccc

SEQ ID NO: 400873 - RNA, 20 nt, Human
gcauucuggccagaaccaaa

SEQ ID NO: 400874 - RNA, 23 nt, Human
ggagcuggcuccauggggagggc

SEQ ID NO: 400875 - RNA, 23 nt, Human
ggcucccuggucuccagauucca

SEQ ID NO: 400876 - RNA, 18 nt, Human
ggcugggcuccgugucuc

SEQ ID NO: 400877 - RNA, 22 nt, Human
gggguaauaaagggauuggggc

SEQ ID NO: 400878 - RNA, 23 nt, Human
guguccuuuccaggggagagagg

SEQ ID NO: 400879 - RNA, 20 nt, Human
uaagcccccaauucucuuuu

SEQ ID NO: 400880 - RNA, 21 nt, Human
uacauugggucccccaggaua

SEQ ID NO: 400881 - RNA, 25 nt, Human
ucaauuucuaggugaggucuucuca

SEQ ID NO: 400882 - RNA, 19 nt, Human
uccaggggagagagggugg

SEQ ID NO: 400883 - RNA, 22 nt, Human
ucugagccaaggcagcuccuac

SEQ ID NO: 400884 - RNA, 19 nt, Human
ugagaggaagagaaccugc

SEQ ID NO: 400885 - RNA, 21 nt, Human
ugagccagaagagguugaggg

SEQ ID NO: 400886 - RNA, 22 nt, Human
uggagagaggaaggccuaaggu

SEQ ID NO: 400887 - RNA, 24 nt, Human
uggggcaggggaggcguucugagu

SEQ ID NO: 400888 - RNA, 20 nt, Human
ugguugccagcacuucacug

SEQ ID NO: 400889 - RNA, 21 nt, Human
ugucagggaucaaagcuguag

SEQ ID NO: 400890 - RNA, 18 nt, Human
ugucugaaggagggggua

SEQ ID NO: 400891 - RNA, 24 nt, Human
aaaauucuuuccugcccaggaccu

SEQ ID NO: 400892 - RNA, 21 nt, Human
aaacaaaaaggaaugaaaacc

SEQ ID NO: 400893 - RNA, 25 nt, Human
aaacaaaaaggaaugaaaaccaaag

SEQ ID NO: 400894 - RNA, 26 nt, Human
aaacugacaagaaaaucugaccuuca

SEQ ID NO: 400895 - RNA, 19 nt, Human
aaaugcccagucccagacu

SEQ ID NO: 400896 - RNA, 19 nt, Human
aaccaaacuuaucaagccu

SEQ ID NO: 400897 - RNA, 21 nt, Human
aagaaacagaucccacaggca

SEQ ID NO: 400898 - RNA, 23 nt, Human
aagcagcuccgucgggcaggaag

SEQ ID NO: 400899 - RNA, 27 nt, Human
aagcaucacaacaccucaguggggagc

SEQ ID NO: 400900 - RNA, 23 nt, Human
aagccaaacaaaaaggaaugaaa

SEQ ID NO: 400901 - RNA, 28 nt, Human
aagccaaagccugaauuuggccaaagaa

SEQ ID NO: 400902 - RNA, 24 nt, Human
aauaacaguacaaagugcuuuaaa

SEQ ID NO: 400903 - RNA, 22 nt, Human
acaccaugcagugcccacgggc

SEQ ID NO: 400904 - RNA, 22 nt, Human
acauucaagacugugacuaaca

SEQ ID NO: 400905 - RNA, 22 nt, Human
acccaacaaggagugaaggccu

SEQ ID NO: 400906 - RNA, 18 nt, Human
agagacccaggcagcagc

SEQ ID NO: 400907 - RNA, 21 nt, Human
agaugaacuugauaaccugug

SEQ ID NO: 400908 - RNA, 23 nt, Human
agcagggccugucaugccucugg

SEQ ID NO: 400909 - RNA, 21 nt, Human
agccagcaccaaccaagagca

SEQ ID NO: 400910 - RNA, 19 nt, Human
aggaaaaaagacgucccac

SEQ ID NO: 400911 - RNA, 24 nt, Human
aggaacucaccuccuggcuagugc

SEQ ID NO: 400912 - RNA, 21 nt, Human
aggaaugaaaaccaaagcccu

SEQ ID NO: 400913 - RNA, 22 nt, Human
aggcagcagcagcauggggugg

SEQ ID NO: 400914 - RNA, 20 nt, Human
agggaaguggggauuagggg

SEQ ID NO: 400915 - RNA, 21 nt, Human
agggcaaaagaaaugcucagu

SEQ ID NO: 400916 - RNA, 21 nt, Human
aggggaauguggucccuccuc

SEQ ID NO: 400917 - RNA, 22 nt, Human
aggggauggggaggucaaaagg

SEQ ID NO: 400918 - RNA, 20 nt, Human
auaggccaguggucucaggc

SEQ ID NO: 400919 - RNA, 22 nt, Human
caaagcccuaaagaggaacuca

SEQ ID NO: 400920 - RNA, 19 nt, Human
caaaguaguaagcagggac

SEQ ID NO: 400921 - RNA, 19 nt, Human
caagguaccugaccugaga

SEQ ID NO: 400922 - RNA, 19 nt, Human
caccagaacugccuuuccc

SEQ ID NO: 400923 - RNA, 24 nt, Human
caccuuaggaaaaaagacguccca

SEQ ID NO: 400924 - RNA, 23 nt, Human
cagaucccacaggcauggagagg

SEQ ID NO: 400925 - RNA, 19 nt, Human
cagcaggcugccagguuuc

SEQ ID NO: 400926 - RNA, 22 nt, Human
caguagccuucugcacagggcc

SEQ ID NO: 400927 - RNA, 21 nt, Human
cagucccagacuacugugcuu

SEQ ID NO: 400928 - RNA, 21 nt, Human
caucacaacaccucagugggg

SEQ ID NO: 400929 - RNA, 18 nt, Human
cauccuuuaggccgaccu

SEQ ID NO: 400930 - RNA, 24 nt, Human
caucuccauggcugaguuacccaa

SEQ ID NO: 400931 - RNA, 23 nt, Human
caugccagccaacaccaugcagu

SEQ ID NO: 400932 - RNA, 19 nt, Human
caugugccaccucuguagg

SEQ ID NO: 400933 - RNA, 22 nt, Human
cauguuucuggcccaugugaca

SEQ ID NO: 400934 - RNA, 22 nt, Human
ccaaagccugaauuuggccaaa

SEQ ID NO: 400935 - RNA, 22 nt, Human
ccaaauauuacaguuaugugau

SEQ ID NO: 400936 - RNA, 20 nt, Human
ccagagccucauaaucucag

SEQ ID NO: 400937 - RNA, 23 nt, Human
ccagccaacaccaugcagugccc

SEQ ID NO: 400938 - RNA, 24 nt, Human
ccagccaacaccaugcagugccca

SEQ ID NO: 400939 - RNA, 25 nt, Human
cccaauacuggccuguguuguuaac

SEQ ID NO: 400940 - RNA, 23 nt, Human
cccccagcugaggccuaaggggc

SEQ ID NO: 400941 - RNA, 18 nt, Human
ccccgggggcgccucucc

SEQ ID NO: 400942 - RNA, 21 nt, Human
cccgugcccugacucccugag

SEQ ID NO: 400943 - RNA, 18 nt, Human
ccucccugacagcauucc

SEQ ID NO: 400944 - RNA, 23 nt, Human
ccucuacagcaccagaacugccu

SEQ ID NO: 400945 - RNA, 19 nt, Human
ccuguguuguuaacagcag

SEQ ID NO: 400946 - RNA, 18 nt, Human
cggcaaaaaagacugaga

SEQ ID NO: 400947 - RNA, 19 nt, Human
cuaacccugggucuggcau

SEQ ID NO: 400948 - RNA, 22 nt, Human
cucagaaacugacaagaaaauc

SEQ ID NO: 400949 - RNA, 22 nt, Human
cucaguuuccucauuacuagau

SEQ ID NO: 400950 - RNA, 23 nt, Human
cucccugacagcauuccuuugga

SEQ ID NO: 400951 - RNA, 19 nt, Human
cucggcaaaaaagacugag

SEQ ID NO: 400952 - RNA, 23 nt, Human
cucugcccagacccucugaccuc

SEQ ID NO: 400953 - RNA, 20 nt, Human
cugaccucugagcagggccu

SEQ ID NO: 400954 - RNA, 22 nt, Human
cugagcaaccaaauauuacagu

SEQ ID NO: 400955 - RNA, 21 nt, Human
cugcagguagaucaccacacg

SEQ ID NO: 400956 - RNA, 26 nt, Human
cuggaaacuuucaaagaaaaccccca

SEQ ID NO: 400957 - RNA, 19 nt, Human
cuggcccaugugacagcuc

SEQ ID NO: 400958 - RNA, 21 nt, Human
cuuaccccugggcugcuugga

SEQ ID NO: 400959 - RNA, 22 nt, Human
cuuucccccagcugaggccuaa

SEQ ID NO: 400960 - RNA, 23 nt, Human
gaaacagaucccacaggcaugga

SEQ ID NO: 400961 - RNA, 18 nt, Human
gaaaugcucaguuuccuc

SEQ ID NO: 400962 - RNA, 21 nt, Human
gaagguucucagcaggaggug

SEQ ID NO: 400963 - RNA, 22 nt, Human
gaggucaaaaggcaagcaucac

SEQ ID NO: 400964 - RNA, 22 nt, Human
gaucaccaagguaccugaccug

SEQ ID NO: 400965 - RNA, 19 nt, Human
gcaaccaaauauuacaguu

SEQ ID NO: 400966 - RNA, 20 nt, Human
gcagaacagucccucccuga

SEQ ID NO: 400967 - RNA, 21 nt, Human
gcagaagcagcuccgucgggc

SEQ ID NO: 400968 - RNA, 20 nt, Human
gcaugccagccaacaccaug

SEQ ID NO: 400969 - RNA, 18 nt, Human
gcuggaagccaaggguac

SEQ ID NO: 400970 - RNA, 19 nt, Human
ggaagccaaggguacucaa

SEQ ID NO: 400971 - RNA, 19 nt, Human
ggaggucaaaaggcaagca

SEQ ID NO: 400972 - RNA, 22 nt, Human
gggcaaaagaaaugcucaguuu

SEQ ID NO: 400973 - RNA, 22 nt, Human
gggcggguuccacaggauggga

SEQ ID NO: 400974 - RNA, 19 nt, Human
gggucuuggcacccuggag

SEQ ID NO: 400975 - RNA, 18 nt, Human
ggucuuggcacccuggag

SEQ ID NO: 400976 - RNA, 22 nt, Human
guggauuugucuuuaucuuguu

SEQ ID NO: 400977 - RNA, 23 nt, Human
gugucuaacccugggucuggcau

SEQ ID NO: 400978 - RNA, 23 nt, Human
uaaagaaacagaucccacaggca

SEQ ID NO: 400979 - RNA, 19 nt, Human
uaaagaggaacucaccucc

SEQ ID NO: 400980 - RNA, 19 nt, Human
uacuggccuguguuguuaa

SEQ ID NO: 400981 - RNA, 18 nt, Human
uacuuuguuuacuuaccc

SEQ ID NO: 400982 - RNA, 21 nt, Human
uagggucuuggcacccuggag

SEQ ID NO: 400983 - RNA, 19 nt, Human
uaucaaccuccugaauaac

SEQ ID NO: 400984 - RNA, 19 nt, Human
uaugauguggggguaaaau

SEQ ID NO: 400985 - RNA, 22 nt, Human
uaugugaggacagcauggcugg

SEQ ID NO: 400986 - RNA, 19 nt, Human
ucaaagaaaacccccaaac

SEQ ID NO: 400987 - RNA, 20 nt, Human
ucaaagaaaacccccaaacu

SEQ ID NO: 400988 - RNA, 22 nt, Human
uccaaagagcagaaagugggua

SEQ ID NO: 400989 - RNA, 23 nt, Human
uccaaagagcagaaaguggguac

SEQ ID NO: 400990 - RNA, 18 nt, Human
uccacggucuuccugccg

SEQ ID NO: 400991 - RNA, 18 nt, Human
ucuccaaagagcagaaag

SEQ ID NO: 400992 - RNA, 19 nt, Human
ucuccauggcugaguuacc

SEQ ID NO: 400993 - RNA, 18 nt, Human
ucugcccagacccucuga

SEQ ID NO: 400994 - RNA, 24 nt, Human
ugaauaacaguacaaagugcuuua

SEQ ID NO: 400995 - RNA, 21 nt, Human
ugagcagggccugucaugccu

SEQ ID NO: 400996 - RNA, 21 nt, Human
ugcacagggccuaggggaagg

SEQ ID NO: 400997 - RNA, 22 nt, Human
ugcaccagggccucuacagcac

SEQ ID NO: 400998 - RNA, 18 nt, Human
ugccagguuucucagaaa

SEQ ID NO: 400999 - RNA, 22 nt, Human
ugccccagggagcagaagcagc

SEQ ID NO: 401000 - RNA, 20 nt, Human
uggaaaauaauucagauaag

SEQ ID NO: 401001 - RNA, 18 nt, Human
uggccaguggaggccaga

SEQ ID NO: 401002 - RNA, 19 nt, Human
uggcucauguuucuggccc

SEQ ID NO: 401003 - RNA, 18 nt, Human
uggggaggucaaaaggca

SEQ ID NO: 401004 - RNA, 23 nt, Human
uggggcggguuccacaggauggg

SEQ ID NO: 401005 - RNA, 19 nt, Human
uggucccuccucugcccag

SEQ ID NO: 401006 - RNA, 19 nt, Human
ugugaggacagcauggcug

SEQ ID NO: 401007 - RNA, 21 nt, Human
uguggccaagcaugugccacc

SEQ ID NO: 401008 - RNA, 19 nt, Human
uuaaagaaacagaucccac

SEQ ID NO: 401009 - RNA, 18 nt, Human
uuagccauccuucccucc

SEQ ID NO: 401010 - RNA, 19 nt, Human
uuaguguuugcuuccauca

SEQ ID NO: 401011 - RNA, 18 nt, Human
uuccacaggaugggagau

SEQ ID NO: 401012 - RNA, 26 nt, Human
uuccacaggaugggagauagggccuc

SEQ ID NO: 401013 - RNA, 20 nt, Human
uugcuuccaucacuuaugcu

SEQ ID NO: 401014 - RNA, 22 nt, Human
uuggaguugaaaaaugcacaca

SEQ ID NO: 401015 - RNA, 19 nt, Human
uuggcacccuggagggcaa

SEQ ID NO: 401016 - RNA, 20 nt, Human
uuggccaagccaaacaaaaa

SEQ ID NO: 401017 - RNA, 21 nt, Human
uuuaaagaaacagaucccaca

SEQ ID NO: 401018 - RNA, 20 nt, Human
uuuaggccgaccuuggucac

SEQ ID NO: 401019 - RNA, 21 nt, Human
uuucucggcaaaaaagacuga

SEQ ID NO: 401020 - RNA, 24 nt, Human
aaaaaaaaaaaaagugguggaggg

SEQ ID NO: 401021 - RNA, 25 nt, Human
aaaaagauucaacuacccacagcug

SEQ ID NO: 401022 - RNA, 22 nt, Human
aaagugguggagggaggcagga

SEQ ID NO: 401023 - RNA, 20 nt, Human
aaaguugcagauggaacuaa

SEQ ID NO: 401024 - RNA, 20 nt, Human
aacacagcaagacccugucu

SEQ ID NO: 401025 - RNA, 21 nt, Human
aacacagcaagacccugucuc

SEQ ID NO: 401026 - RNA, 24 nt, Human
aaccaggagguccaggcugcagug

SEQ ID NO: 401027 - RNA, 22 nt, Human
aagaggaucacuugaaccagga

SEQ ID NO: 401028 - RNA, 21 nt, Human
aagcaguacucuaaaaaauaa

SEQ ID NO: 401029 - RNA, 21 nt, Human
aagccccugccagacgagagc

SEQ ID NO: 401030 - RNA, 20 nt, Human
aagcuugcccugccccugcc

SEQ ID NO: 401031 - RNA, 21 nt, Human
aaugaaaaggccagaaaugaa

SEQ ID NO: 401032 - RNA, 24 nt, Human
acacagcaagacccugucucaaaa

SEQ ID NO: 401033 - RNA, 24 nt, Human
accaggccacugcacuccagccug

SEQ ID NO: 401034 - RNA, 28 nt, Human
acccugucucaaaaaaaaaaaaaaaaaa

SEQ ID NO: 401035 - RNA, 18 nt, Human
acggcaauaggaaacaaa

SEQ ID NO: 401036 - RNA, 18 nt, Human
acugcacuccagccuggg

SEQ ID NO: 401037 - RNA, 23 nt, Human
acugcacuccagccugggcaaca

SEQ ID NO: 401038 - RNA, 20 nt, Human
agaaagacgaccuggguucu

SEQ ID NO: 401039 - RNA, 21 nt, Human
agacccaagagagccggcccc

SEQ ID NO: 401040 - RNA, 19 nt, Human
agacccgggaggaaccgag

SEQ ID NO: 401041 - RNA, 27 nt, Human
agagcucaucuuuuccuucaggggccu

SEQ ID NO: 401042 - RNA, 22 nt, Human
agcacaggagacccgggaggaa

SEQ ID NO: 401043 - RNA, 20 nt, Human
agcacuuuaggaggcuaagg

SEQ ID NO: 401044 - RNA, 27 nt, Human
agccagacuucuggguggcagggccca

SEQ ID NO: 401045 - RNA, 24 nt, Human
agccugggcaacacagcaagaccc

SEQ ID NO: 401046 - RNA, 18 nt, Human
aggaaacaaauacagagg

SEQ ID NO: 401047 - RNA, 19 nt, Human
aggaaacaaauacagaggc

SEQ ID NO: 401048 - RNA, 23 nt, Human
aggaaacaaauacagaggccaaa

SEQ ID NO: 401049 - RNA, 21 nt, Human
aggagugcaggacugccgaca

SEQ ID NO: 401050 - RNA, 21 nt, Human
aggaucacuugaaccaggagg

SEQ ID NO: 401051 - RNA, 19 nt, Human
aggcagaaguagcaucaga

SEQ ID NO: 401052 - RNA, 19 nt, Human
aggcaggagaggggaggcc

SEQ ID NO: 401053 - RNA, 20 nt, Human
aggcaggucaggccacagga

SEQ ID NO: 401054 - RNA, 18 nt, Human
aggcccagggaggagcag

SEQ ID NO: 401055 - RNA, 23 nt, Human
aggggccguggggccaccuggau

SEQ ID NO: 401056 - RNA, 24 nt, Human
agugacucaugccuauaaucccag

SEQ ID NO: 401057 - RNA, 23 nt, Human
aucuuuuccuucuuucucuucca

SEQ ID NO: 401058 - RNA, 19 nt, Human
augccuauaaucccagcac

SEQ ID NO: 401059 - RNA, 22 nt, Human
caacacagcaagacccugucuc

SEQ ID NO: 401060 - RNA, 20 nt, Human
caacuacccacagcuggcuc

SEQ ID NO: 401061 - RNA, 26 nt, Human
cacagcaagacccugucucaaaaaaa

SEQ ID NO: 401062 - RNA, 24 nt, Human
cacagcucgccacaggacccuaaa

SEQ ID NO: 401063 - RNA, 18 nt, Human
cacaggacccuaaaagcc

SEQ ID NO: 401064 - RNA, 19 nt, Human
cacugcacuccagccuggg

SEQ ID NO: 401065 - RNA, 21 nt, Human
cacugcacuccagccugggca

SEQ ID NO: 401066 - RNA, 22 nt, Human
cacugcacuccagccugggcaa

SEQ ID NO: 401067 - RNA, 23 nt, Human
cacugcacuccagccugggcaac

SEQ ID NO: 401068 - RNA, 24 nt, Human
cacugcacuccagccugggcaaca

SEQ ID NO: 401069 - RNA, 25 nt, Human
cacugcacuccagccugggcaacac

SEQ ID NO: 401070 - RNA, 20 nt, Human
cacugcacuccagccugggg

SEQ ID NO: 401071 - RNA, 27 nt, Human
cagaauaacggccucccaaagaugucc

SEQ ID NO: 401072 - RNA, 19 nt, Human
cagcacugcagaggcauca

SEQ ID NO: 401073 - RNA, 20 nt, Human
cagcacugcagaggcaucag

SEQ ID NO: 401074 - RNA, 20 nt, Human
cagcacuuuaggaggcuaag

SEQ ID NO: 401075 - RNA, 21 nt, Human
cagcacuuuaggaggcuaagg

SEQ ID NO: 401076 - RNA, 20 nt, Human
cagccucuaaaaaugaaaag

SEQ ID NO: 401077 - RNA, 18 nt, Human
caggacccuaaaagcccc

SEQ ID NO: 401078 - RNA, 18 nt, Human
caggaugggagcuccugc

SEQ ID NO: 401079 - RNA, 24 nt, Human
caggccggguacgagugacucaug

SEQ ID NO: 401080 - RNA, 24 nt, Human
caggggacugagacaagaggauca

SEQ ID NO: 401081 - RNA, 22 nt, Human
caguaccugggaaaaggggaca

SEQ ID NO: 401082 - RNA, 23 nt, Human
caugccuauaaucccagcacuuu

SEQ ID NO: 401083 - RNA, 18 nt, Human
ccacgaggaggacaguca

SEQ ID NO: 401084 - RNA, 20 nt, Human
ccacugcacuccagccuggg

SEQ ID NO: 401085 - RNA, 21 nt, Human
ccacugcacuccagccugggc

SEQ ID NO: 401086 - RNA, 23 nt, Human
ccacugcacuccagccugggcaa

SEQ ID NO: 401087 - RNA, 24 nt, Human
ccacugcacuccagccugggcaac

SEQ ID NO: 401088 - RNA, 20 nt, Human
cccacgguggcacccccagg

SEQ ID NO: 401089 - RNA, 22 nt, Human
cccacgguggcacccccagggc

SEQ ID NO: 401090 - RNA, 23 nt, Human
cccaggucagccuucugacccgc

SEQ ID NO: 401091 - RNA, 21 nt, Human
cccccagggccugucccugcc

SEQ ID NO: 401092 - RNA, 20 nt, Human
ccccucucaggcugagaagg

SEQ ID NO: 401093 - RNA, 19 nt, Human
cccugcccagaccucagcc

SEQ ID NO: 401094 - RNA, 19 nt, Human
cccugucucaaaaaaaaaa

SEQ ID NO: 401095 - RNA, 20 nt, Human
ccgacacccagauuugagcc

SEQ ID NO: 401096 - RNA, 19 nt, Human
ccggccccaaauccugacu

SEQ ID NO: 401097 - RNA, 20 nt, Human
ccuaaaagccccugccagac

SEQ ID NO: 401098 - RNA, 18 nt, Human
ccucagccagacuucugg

SEQ ID NO: 401099 - RNA, 20 nt, Human
ccuccugguucuuuccuugc

SEQ ID NO: 401100 - RNA, 21 nt, Human
ccucugacucugccucugaug

SEQ ID NO: 401101 - RNA, 19 nt, Human
ccugcaccuccgccagggc

SEQ ID NO: 401102 - RNA, 20 nt, Human
ccuggcugcacucucccucc

SEQ ID NO: 401103 - RNA, 22 nt, Human
ccuggcugcacucucccuccug

SEQ ID NO: 401104 - RNA, 22 nt, Human
ccugggcaacacagcaagaccc

SEQ ID NO: 401105 - RNA, 22 nt, Human
ccugggguagagcgaggugccc

SEQ ID NO: 401106 - RNA, 20 nt, Human
ccuggguucucuggguaggc

SEQ ID NO: 401107 - RNA, 23 nt, Human
ccugucucaaaaaaaaaaaaaaa

SEQ ID NO: 401108 - RNA, 19 nt, Human
cgccacaggacccuaaaag

SEQ ID NO: 401109 - RNA, 19 nt, Human
cgccagggcuaggcagaag

SEQ ID NO: 401110 - RNA, 20 nt, Human
cgugacaguccccagagccu

SEQ ID NO: 401111 - RNA, 19 nt, Human
cuaaaagccccugccagac

SEQ ID NO: 401112 - RNA, 18 nt, Human
cucaaaaaaaaaaaaaaa

SEQ ID NO: 401113 - RNA, 24 nt, Human
cucacauuuuccugggguagagcg

SEQ ID NO: 401114 - RNA, 24 nt, Human
cucaugccuauaaucccagcacuu

SEQ ID NO: 401115 - RNA, 26 nt, Human
cugcacucucccuccugguucuuucc

SEQ ID NO: 401116 - RNA, 19 nt, Human
cuggaagaccucguuuuga

SEQ ID NO: 401117 - RNA, 21 nt, Human
cuggaagaccucguuuugauc

SEQ ID NO: 401118 - RNA, 20 nt, Human
cuggcucugaagauggagga

SEQ ID NO: 401119 - RNA, 23 nt, Human
cuguaggggccguggggccaccu

SEQ ID NO: 401120 - RNA, 23 nt, Human
cugucccugccuuggggaagggg

SEQ ID NO: 401121 - RNA, 21 nt, Human
cuuccaguucugucuuccauu

SEQ ID NO: 401122 - RNA, 18 nt, Human
cuuuauaccggccacuuc

SEQ ID NO: 401123 - RNA, 18 nt, Human
gaagagggagggcucagg

SEQ ID NO: 401124 - RNA, 21 nt, Human
gaccaggccacugcacuccag

SEQ ID NO: 401125 - RNA, 24 nt, Human
gaggacccaggaggucuugggccc

SEQ ID NO: 401126 - RNA, 23 nt, Human
gaggagcagagccuuagggggag

SEQ ID NO: 401127 - RNA, 19 nt, Human
gaggugcccggcagggcag

SEQ ID NO: 401128 - RNA, 19 nt, Human
gcacaggagacccgggagg

SEQ ID NO: 401129 - RNA, 20 nt, Human
gcaguaccugggaaaagggg

SEQ ID NO: 401130 - RNA, 22 nt, Human
gccacugcacuccagccugggc

SEQ ID NO: 401131 - RNA, 24 nt, Human
gccacugcacuccagccugggcaa

SEQ ID NO: 401132 - RNA, 21 nt, Human
gccuuggggaagggggagccu

SEQ ID NO: 401133 - RNA, 19 nt, Human
gcuaacuccuacacacgua

SEQ ID NO: 401134 - RNA, 24 nt, Human
gcucacggcggcccugggcugcag

SEQ ID NO: 401135 - RNA, 27 nt, Human
gcucagggccccauugcagggccagcc

SEQ ID NO: 401136 - RNA, 18 nt, Human
gcucuagaggccuuggaa

SEQ ID NO: 401137 - RNA, 21 nt, Human
gcucugaagauggaggagccu

SEQ ID NO: 401138 - RNA, 19 nt, Human
ggaggccucugacucugcc

SEQ ID NO: 401139 - RNA, 18 nt, Human
ggagggaggcaggagagg

SEQ ID NO: 401140 - RNA, 18 nt, Human
ggagggaggcaggagagg

SEQ ID NO: 401141 - RNA, 20 nt, Human
ggagugcaggacugccgaca

SEQ ID NO: 401142 - RNA, 21 nt, Human
ggcagaauaacggccucccaa

SEQ ID NO: 401143 - RNA, 21 nt, Human
ggcagaugggugaggcucggc

SEQ ID NO: 401144 - RNA, 19 nt, Human
ggcaggggaugaacggagg

SEQ ID NO: 401145 - RNA, 23 nt, Human
ggcaggggaugaacggagggugc

SEQ ID NO: 401146 - RNA, 24 nt, Human
ggccacugcacuccagccugggca

SEQ ID NO: 401147 - RNA, 21 nt, Human
ggccccaaauccugacucagc

SEQ ID NO: 401148 - RNA, 21 nt, Human
ggucuugggcccuucgguagu

SEQ ID NO: 401149 - RNA, 23 nt, Human
guccacgugacaguccccagagc

SEQ ID NO: 401150 - RNA, 20 nt, Human
guggagggaggcaggagagg

SEQ ID NO: 401151 - RNA, 24 nt, Human
guugaggccuugggggaugaagag

SEQ ID NO: 401152 - RNA, 22 nt, Human
uaacggccucccaaagaugucc

SEQ ID NO: 401153 - RNA, 19 nt, Human
uaagguggcuaaucagcug

SEQ ID NO: 401154 - RNA, 19 nt, Human
uaccggccacuuccuggcc

SEQ ID NO: 401155 - RNA, 21 nt, Human
uaggaggcuaaggcuacaaga

SEQ ID NO: 401156 - RNA, 20 nt, Human
uauaccggccacuuccuggc

SEQ ID NO: 401157 - RNA, 20 nt, Human
uauauuaacaauaucaaaca

SEQ ID NO: 401158 - RNA, 19 nt, Human
uauguagcugggcgugggg

SEQ ID NO: 401159 - RNA, 22 nt, Human
ucaugccuauaaucccagcacu

SEQ ID NO: 401160 - RNA, 23 nt, Human
uccagaaggagugcaggacugcc

SEQ ID NO: 401161 - RNA, 22 nt, Human
ucccgcucacggcggcccuggg

SEQ ID NO: 401162 - RNA, 22 nt, Human
ucccugagccuggcugcacucu

SEQ ID NO: 401163 - RNA, 24 nt, Human
ucccuugagcccaggaguuccaga

SEQ ID NO: 401164 - RNA, 23 nt, Human
uccuucuuucucuuccaguucug

SEQ ID NO: 401165 - RNA, 23 nt, Human
ucuggacagagguguccggggau

SEQ ID NO: 401166 - RNA, 24 nt, Human
ucuuccaguucugucuuccauucc

SEQ ID NO: 401167 - RNA, 24 nt, Human
ugacucaugccuauaaucccagca

SEQ ID NO: 401168 - RNA, 20 nt, Human
ugagacaagaggaucacuug

SEQ ID NO: 401169 - RNA, 24 nt, Human
ugagacaagaggaucacuugaacc

SEQ ID NO: 401170 - RNA, 23 nt, Human
ugagaggacccaggaggucuugg

SEQ ID NO: 401171 - RNA, 20 nt, Human
ugagccuugaugccaugacc

SEQ ID NO: 401172 - RNA, 20 nt, Human
ugauguggacugcaacuuuu

SEQ ID NO: 401173 - RNA, 23 nt, Human
ugcagauggaacuaagguggcua

SEQ ID NO: 401174 - RNA, 21 nt, Human
ugcccaaggcuugcugggcac

SEQ ID NO: 401175 - RNA, 18 nt, Human
ugcccagaccucagccag

SEQ ID NO: 401176 - RNA, 25 nt, Human
ugcccagaccucagccagacuucug

SEQ ID NO: 401177 - RNA, 21 nt, Human
ugcccaggaugggagcuccug

SEQ ID NO: 401178 - RNA, 26 nt, Human
ugcccugccccugcccagaccucagc

SEQ ID NO: 401179 - RNA, 21 nt, Human
ugccgagcaggaaaacgagcu

SEQ ID NO: 401180 - RNA, 18 nt, Human
ugccugagaucgaagggc

SEQ ID NO: 401181 - RNA, 21 nt, Human
ugccugguuggcugcccagga

SEQ ID NO: 401182 - RNA, 23 nt, Human
ugccugguuggcugcccaggaug

SEQ ID NO: 401183 - RNA, 19 nt, Human
ugccuuggggaagggggag

SEQ ID NO: 401184 - RNA, 23 nt, Human
ugccuuggggaagggggagccug

SEQ ID NO: 401185 - RNA, 23 nt, Human
ugguggagggaggcaggagaggg

SEQ ID NO: 401186 - RNA, 24 nt, Human
ugguggagggaggcaggagagggg

SEQ ID NO: 401187 - RNA, 18 nt, Human
uucuggguggcagggccc

SEQ ID NO: 401188 - RNA, 22 nt, Human
uuucucuuccaguucugucuuc

SEQ ID NO: 401189 - RNA, 19 nt, Human
uuuguggaaaccugucacc

SEQ ID NO: 401190 - RNA, 19 nt, Human
aaagugaugggauuacagg

SEQ ID NO: 401191 - RNA, 21 nt, Human
aaguaacagccuguuaggggc

SEQ ID NO: 401192 - RNA, 23 nt, Human
agagauccucugccucggccuuc

SEQ ID NO: 401193 - RNA, 24 nt, Human
agagauccucugccucggccuucc

SEQ ID NO: 401194 - RNA, 19 nt, Human
agauccucugccucggccu

SEQ ID NO: 401195 - RNA, 21 nt, Human
aggucuugcuauguugcccag

SEQ ID NO: 401196 - RNA, 22 nt, Human
aucuugcuucugaggccuucca

SEQ ID NO: 401197 - RNA, 24 nt, Human
caaagugaugggauuacaggagug

SEQ ID NO: 401198 - RNA, 23 nt, Human
cagagaucuugcuucugaggccu

SEQ ID NO: 401199 - RNA, 19 nt, Human
caggagugagccacugcgc

SEQ ID NO: 401200 - RNA, 19 nt, Human
ccaaagugaugggauuaca

SEQ ID NO: 401201 - RNA, 20 nt, Human
ccugagcucaagagauccuc

SEQ ID NO: 401202 - RNA, 19 nt, Human
cucugccucggccuuccaa

SEQ ID NO: 401203 - RNA, 22 nt, Human
gagcucaagagauccucugccu

SEQ ID NO: 401204 - RNA, 18 nt, Human
gauuacaggagugagcca

SEQ ID NO: 401205 - RNA, 22 nt, Human
gauuacaggagugagccacugc

SEQ ID NO: 401206 - RNA, 22 nt, Human
gauuacaggagugagccacugc

SEQ ID NO: 401207 - RNA, 18 nt, Human
gcccagccugguuuugaa

SEQ ID NO: 401208 - RNA, 22 nt, Human
ggcaagagggaagauggaagga

SEQ ID NO: 401209 - RNA, 28 nt, Human
gugaaguaacagccuguuaggggccaga

SEQ ID NO: 401210 - RNA, 19 nt, Human
uacaggagugagccacugc

SEQ ID NO: 401211 - RNA, 23 nt, Human
uacaggagugagccacugcgccc

SEQ ID NO: 401212 - RNA, 22 nt, Human
uagagaugaggucuugcuaugu

SEQ ID NO: 401213 - RNA, 24 nt, Human
uauguugcccagccugguuuugaa

SEQ ID NO: 401214 - RNA, 24 nt, Human
ucauagagaugaggucuugcuaug

SEQ ID NO: 401215 - RNA, 23 nt, Human
uccaaagugaugggauuacagga

SEQ ID NO: 401216 - RNA, 18 nt, Human
ucuugcuauguugcccag

SEQ ID NO: 401217 - RNA, 23 nt, Human
ucuugcuauguugcccagccugg

SEQ ID NO: 401218 - RNA, 24 nt, Human
ucuugcuauguugcccagccuggu

SEQ ID NO: 401219 - RNA, 25 nt, Human
ugaacuccugagcucaagagauccu

SEQ ID NO: 401220 - RNA, 22 nt, Human
ugaaguaacagccuguuaggga

SEQ ID NO: 401221 - RNA, 23 nt, Human
ugaggucuugcuauguugcccag

SEQ ID NO: 401222 - RNA, 24 nt, Human
ugcccagccugguuuugaacuccu

SEQ ID NO: 401223 - RNA, 19 nt, Human
ugggauuacaggagugagc

SEQ ID NO: 401224 - RNA, 22 nt, Human
ugggauuacaggagugagccac

SEQ ID NO: 401225 - RNA, 22 nt, Human
ugggauuacaggagugagccac

SEQ ID NO: 401226 - RNA, 24 nt, Human
ugggauuacaggagugagccacug

SEQ ID NO: 401227 - RNA, 23 nt, Human
uuuugaacuccugagcucaagag

SEQ ID NO: 401228 - RNA, 26 nt, Human
aaaaaaaaaaaaccuaauauguauua

SEQ ID NO: 401229 - RNA, 24 nt, Human
aaagugcugggauuacaggcauga

SEQ ID NO: 401230 - RNA, 24 nt, Human
aagugauccacccgccucagccuc

SEQ ID NO: 401231 - RNA, 19 nt, Human
aagugcugggauuacaggc

SEQ ID NO: 401232 - RNA, 21 nt, Human
aagugcugggauuacaggcau

SEQ ID NO: 401233 - RNA, 26 nt, Human
aagugcugggauuacaggcaugagcc

SEQ ID NO: 401234 - RNA, 25 nt, Human
acccgccucagccucccaaagugcu

SEQ ID NO: 401235 - RNA, 24 nt, Human
acgauguuggucaggcuggucuug

SEQ ID NO: 401236 - RNA, 25 nt, Human
acuuuguauacauguuaaaaaaaaa

SEQ ID NO: 401237 - RNA, 18 nt, Human
agugcugggauuacaggc

SEQ ID NO: 401238 - RNA, 24 nt, Human
caaagugcugggauuacaggcaug

SEQ ID NO: 401239 - RNA, 23 nt, Human
cacccgccucagccucccaaagu

SEQ ID NO: 401240 - RNA, 21 nt, Human
cacgauguuggucaggcuggu

SEQ ID NO: 401241 - RNA, 24 nt, Human
cacgauguuggucaggcuggucuu

SEQ ID NO: 401242 - RNA, 23 nt, Human
ccaaagugcugggauuacaggca

SEQ ID NO: 401243 - RNA, 24 nt, Human
ccaaagugcugggauuacaggcau

SEQ ID NO: 401244 - RNA, 26 nt, Human
ccacccgccucagccucccaaagugc

SEQ ID NO: 401245 - RNA, 19 nt, Human
ccaggucaauccaagaagc

SEQ ID NO: 401246 - RNA, 24 nt, Human
cccaaagugcugggauuacaggca

SEQ ID NO: 401247 - RNA, 24 nt, Human
ccgccucagccucccaaagugcug

SEQ ID NO: 401248 - RNA, 22 nt, Human
ccuggcuaagaauuuacuuugu

SEQ ID NO: 401249 - RNA, 21 nt, Human
cugaccucaagugauccaccc

SEQ ID NO: 401250 - RNA, 29 nt, Human
cugccaggucaauccaagaagcagcgugc

SEQ ID NO: 401251 - RNA, 24 nt, Human
gaccucaagugauccacccgccuc

SEQ ID NO: 401252 - RNA, 24 nt, Human
gauguuggucaggcuggucuugaa

SEQ ID NO: 401253 - RNA, 18 nt, Human
gauuacaggcaugagcca

SEQ ID NO: 401254 - RNA, 21 nt, Human
gauuacaggcaugagccacua

SEQ ID NO: 401255 - RNA, 22 nt, Human
gauuacaggcaugagccacuac

SEQ ID NO: 401256 - RNA, 23 nt, Human
gccucagccucccaaagugcugg

SEQ ID NO: 401257 - RNA, 19 nt, Human
gcuaagaauuuacuuugua

SEQ ID NO: 401258 - RNA, 19 nt, Human
ggauuacaggcaugagcca

SEQ ID NO: 401259 - RNA, 24 nt, Human
ggcuggucuugaacuucugaccuc

SEQ ID NO: 401260 - RNA, 19 nt, Human
ggucuugaacuucugaccu

SEQ ID NO: 401261 - RNA, 24 nt, Human
gugauccacccgccucagccuccc

SEQ ID NO: 401262 - RNA, 19 nt, Human
uaagaggaaaccucuggua

SEQ ID NO: 401263 - RNA, 25 nt, Human
uaauuuuuguauuuuuuuguaaaga

SEQ ID NO: 401264 - RNA, 22 nt, Human
uacaggcaugagccacuacacc

SEQ ID NO: 401265 - RNA, 21 nt, Human
uccacccgccucagccuccca

SEQ ID NO: 401266 - RNA, 24 nt, Human
ucccaaagugcugggauuacaggc

SEQ ID NO: 401267 - RNA, 24 nt, Human
ugaccucaagugauccacccgccu

SEQ ID NO: 401268 - RNA, 18 nt, Human
ugggauuacaggcaugag

SEQ ID NO: 401269 - RNA, 19 nt, Human
ugggauuacaggcaugagc

SEQ ID NO: 401270 - RNA, 21 nt, Human
ugggauuacaggcaugagcca

SEQ ID NO: 401271 - RNA, 22 nt, Human
ugggauuacaggcaugagccac

SEQ ID NO: 401272 - RNA, 22 nt, Human
ugggauuacaggcaugagccac

SEQ ID NO: 401273 - RNA, 23 nt, Human
ugggauuacaggcaugagccacu

SEQ ID NO: 401274 - RNA, 24 nt, Human
ugggauuacaggcaugagccacua

SEQ ID NO: 401275 - RNA, 24 nt, Human
ugggauuacaggcaugagccacua

SEQ ID NO: 401276 - RNA, 24 nt, Human
uggucaggcuggucuugaacuucu

SEQ ID NO: 401277 - RNA, 22 nt, Human
uucacgauguuggucaggcuga

SEQ ID NO: 401278 - RNA, 24 nt, Human
uuuuuguauuuuuuuguaaagacg

SEQ ID NO: 401279 - RNA, 24 nt, Human
aaaacccccaauuauuucaugucg

SEQ ID NO: 401280 - RNA, 22 nt, Human
aaacaacaaaacccccaauuau

SEQ ID NO: 401281 - RNA, 19 nt, Human
aacauggugaaaccccguc

SEQ ID NO: 401282 - RNA, 20 nt, Human
aacauggugaaaccccgucu

SEQ ID NO: 401283 - RNA, 21 nt, Human
aacauggugaaaccccgucuc

SEQ ID NO: 401284 - RNA, 22 nt, Human
aacugccccgcaccccccaccc

SEQ ID NO: 401285 - RNA, 24 nt, Human
aagaaaaccuuaaugcgucagcca

SEQ ID NO: 401286 - RNA, 18 nt, Human
aagaccagaaaggucacc

SEQ ID NO: 401287 - RNA, 22 nt, Human
aagcaccaucuacucuuccccc

SEQ ID NO: 401288 - RNA, 24 nt, Human
aaggacaccaaccacgagugacac

SEQ ID NO: 401289 - RNA, 22 nt, Human
aaggcagcucaugggcucaggg

SEQ ID NO: 401290 - RNA, 27 nt, Human
aaggcccagcaaaggcaaagaccagga

SEQ ID NO: 401291 - RNA, 23 nt, Human
aaggcuauagugagccaagauug

SEQ ID NO: 401292 - RNA, 24 nt, Human
aagguggaucaccugaggucagga

SEQ ID NO: 401293 - RNA, 26 nt, Human
aaucauugaagccaaaguacaucuga

SEQ ID NO: 401294 - RNA, 24 nt, Human
aaucgcuugaacccaggaggcgga

SEQ ID NO: 401295 - RNA, 24 nt, Human
accaacauggugaaaccccgucuc

SEQ ID NO: 401296 - RNA, 24 nt, Human
accccgucucuacuaaaaauacaa

SEQ ID NO: 401297 - RNA, 21 nt, Human
acccugagcaacauagagagc

SEQ ID NO: 401298 - RNA, 26 nt, Human
acccugagcaacauagagagccccua

SEQ ID NO: 401299 - RNA, 22 nt, Human
accguugcacuccagccugggc

SEQ ID NO: 401300 - RNA, 24 nt, Human
accugaggucaggaguucgagacc

SEQ ID NO: 401301 - RNA, 23 nt, Human
acuauggagaaggguuugcugga

SEQ ID NO: 401302 - RNA, 24 nt, Human
acuccagccugggagacagaguga

SEQ ID NO: 401303 - RNA, 24 nt, Human
acuccagccugggcgagagaguga

SEQ ID NO: 401304 - RNA, 21 nt, Human
acugcccagguagggaccagc

SEQ ID NO: 401305 - RNA, 19 nt, Human
acuggcaccuucugagccc

SEQ ID NO: 401306 - RNA, 19 nt, Human
acuuucggaggccaaggug

SEQ ID NO: 401307 - RNA, 24 nt, Human
agagagugagauucugucucaaaa

SEQ ID NO: 401308 - RNA, 21 nt, Human
agagugagauucugucucaaa

SEQ ID NO: 401309 - RNA, 18 nt, Human
agaguuucuuccaguacc

SEQ ID NO: 401310 - RNA, 23 nt, Human
agccaggcgugguggcgggugcc

SEQ ID NO: 401311 - RNA, 24 nt, Human
agccugaccaacauggugaaaccc

SEQ ID NO: 401312 - RNA, 24 nt, Human
agccugggcgagagagugagauuc

SEQ ID NO: 401313 - RNA, 24 nt, Human
agcuauuuggauggcugagguggg

SEQ ID NO: 401314 - RNA, 18 nt, Human
agcuuggccuggcuggug

SEQ ID NO: 401315 - RNA, 18 nt, Human
aggaaggccucuguggaa

SEQ ID NO: 401316 - RNA, 24 nt, Human
aggaauucgagaccacccugagca

SEQ ID NO: 401317 - RNA, 24 nt, Human
aggaggcggagguugcacugagcc

SEQ ID NO: 401318 - RNA, 24 nt, Human
aggcaaagaccaggaggcagcagc

SEQ ID NO: 401319 - RNA, 18 nt, Human
aggcacgagaaucgcuug

SEQ ID NO: 401320 - RNA, 19 nt, Human
aggcagcucaugggcucag

SEQ ID NO: 401321 - RNA, 24 nt, Human
aggccaagguggaucaccugaggu

SEQ ID NO: 401322 - RNA, 19 nt, Human
aggcggagguugcacugag

SEQ ID NO: 401323 - RNA, 24 nt, Human
aggcggagguugcacugagccaag

SEQ ID NO: 401324 - RNA, 28 nt, Human
aggcuauagugagccaagauugcaccau

SEQ ID NO: 401325 - RNA, 24 nt, Human
aggcugaggcacgagaaucgcuug

SEQ ID NO: 401326 - RNA, 21 nt, Human
agggaccugggaccggacugg

SEQ ID NO: 401327 - RNA, 22 nt, Human
agguggaucaccugaggucagg

SEQ ID NO: 401328 - RNA, 24 nt, Human
aggugggagaaucgcuugagccug

SEQ ID NO: 401329 - RNA, 21 nt, Human
agucugaggugggcagacugc

SEQ ID NO: 401330 - RNA, 20 nt, Human
agugaacugccccgcacccc

SEQ ID NO: 401331 - RNA, 24 nt, Human
aucguaccguugcacuccagccug

SEQ ID NO: 401332 - RNA, 18 nt, Human
aucuacucuucccccuug

SEQ ID NO: 401333 - RNA, 24 nt, Human
auugcaccauugcacuccagccug

SEQ ID NO: 401334 - RNA, 18 nt, Human
auugcacuccagccuggg

SEQ ID NO: 401335 - RNA, 24 nt, Human
auugcacuccagccugggagacag

SEQ ID NO: 401336 - RNA, 21 nt, Human
caaagaccagaaaggucaccg

SEQ ID NO: 401337 - RNA, 24 nt, Human
caacauggugaaaccccgucucua

SEQ ID NO: 401338 - RNA, 21 nt, Human
caacgacuguguagauggauc

SEQ ID NO: 401339 - RNA, 21 nt, Human
caagcauggggcucacgccuc

SEQ ID NO: 401340 - RNA, 22 nt, Human
caagguggaucaccugagguca

SEQ ID NO: 401341 - RNA, 21 nt, Human
cacaaacggaaugauccagac

SEQ ID NO: 401342 - RNA, 24 nt, Human
cacaccuguggucccagcuauuug

SEQ ID NO: 401343 - RNA, 22 nt, Human
cacagaaggcccagcaaaggca

SEQ ID NO: 401344 - RNA, 19 nt, Human
cacaugcuauuuggccugg

SEQ ID NO: 401345 - RNA, 26 nt, Human
caccauugcacuccagccugggagac

SEQ ID NO: 401346 - RNA, 21 nt, Human
cacccaaaaaagguucauauc

SEQ ID NO: 401347 - RNA, 24 nt, Human
caccgcuuugggagucugaggugg

SEQ ID NO: 401348 - RNA, 23 nt, Human
caccugaggucaggaguucgaga

SEQ ID NO: 401349 - RNA, 23 nt, Human
caccuguggucccagcuauuugg

SEQ ID NO: 401350 - RNA, 23 nt, Human
cacgccuguaaucccagcacuuu

SEQ ID NO: 401351 - RNA, 22 nt, Human
cacuccagccugggagacagag

SEQ ID NO: 401352 - RNA, 23 nt, Human
cacuccagccugggagacagagu

SEQ ID NO: 401353 - RNA, 24 nt, Human
cacuccagccugggagacagagug

SEQ ID NO: 401354 - RNA, 22 nt, Human
cacuccagccugggcgagagag

SEQ ID NO: 401355 - RNA, 23 nt, Human
cacuccagccugggcgagagagu

SEQ ID NO: 401356 - RNA, 24 nt, Human
cacuccagccugggcgagagagug

SEQ ID NO: 401357 - RNA, 23 nt, Human
cacuccuaaaacuccacagacac

SEQ ID NO: 401358 - RNA, 20 nt, Human
cagaaaagaccaaaaacucc

SEQ ID NO: 401359 - RNA, 20 nt, Human
cagaaggcccagcaaaggca

SEQ ID NO: 401360 - RNA, 24 nt, Human
cagcacuuucggaggccaaggugg

SEQ ID NO: 401361 - RNA, 22 nt, Human
cagcagcacccugugccuucca

SEQ ID NO: 401362 - RNA, 25 nt, Human
cagcagcacccugugccuuccagaa

SEQ ID NO: 401363 - RNA, 22 nt, Human
cagggcucaaguucacuuggga

SEQ ID NO: 401364 - RNA, 18 nt, Human
cauugcacuccagccugg

SEQ ID NO: 401365 - RNA, 19 nt, Human
cauugcacuccagccuggg

SEQ ID NO: 401366 - RNA, 22 nt, Human
cauugcacuccagccugggaga

SEQ ID NO: 401367 - RNA, 23 nt, Human
cauugcacuccagccugggagac

SEQ ID NO: 401368 - RNA, 24 nt, Human
cauugcacuccagccugggagaca

SEQ ID NO: 401369 - RNA, 25 nt, Human
cauugcacuccagccugggagacag

SEQ ID NO: 401370 - RNA, 27 nt, Human
ccaaacagggcucaaguucacuuggga

SEQ ID NO: 401371 - RNA, 21 nt, Human
ccacacacaggacuucacgug

SEQ ID NO: 401372 - RNA, 24 nt, Human
ccacccaaaccagucccggaacaa

SEQ ID NO: 401373 - RNA, 23 nt, Human
ccacuccuaaaacuccacagaca

SEQ ID NO: 401374 - RNA, 20 nt, Human
ccagaaaggucaccccccac

SEQ ID NO: 401375 - RNA, 22 nt, Human
ccagcaaaggcaaagaccagga

SEQ ID NO: 401376 - RNA, 26 nt, Human
ccagucccggaacaaaacacacaaug

SEQ ID NO: 401377 - RNA, 19 nt, Human
ccauugcacuccagccugg

SEQ ID NO: 401378 - RNA, 20 nt, Human
ccauugcacuccagccugga

SEQ ID NO: 401379 - RNA, 21 nt, Human
ccauugcacuccagccuggga

SEQ ID NO: 401380 - RNA, 22 nt, Human
ccauugcacuccagccugggag

SEQ ID NO: 401381 - RNA, 24 nt, Human
ccauugcacuccagccugggagac

SEQ ID NO: 401382 - RNA, 25 nt, Human
ccauugcacuccagccugggagaca

SEQ ID NO: 401383 - RNA, 22 nt, Human
ccccacuccuaaaacuccacag

SEQ ID NO: 401384 - RNA, 18 nt, Human
ccccccacccaaaaaagg

SEQ ID NO: 401385 - RNA, 18 nt, Human
ccccgcaccccccaccca

SEQ ID NO: 401386 - RNA, 19 nt, Human
cccgcaccccccacccaaa

SEQ ID NO: 401387 - RNA, 21 nt, Human
cccgcaccccccacccaaaaa

SEQ ID NO: 401388 - RNA, 22 nt, Human
cccugagcaacauagagagccc

SEQ ID NO: 401389 - RNA, 20 nt, Human
ccguugcacuccagccuggg

SEQ ID NO: 401390 - RNA, 21 nt, Human
ccguugcacuccagccugggc

SEQ ID NO: 401391 - RNA, 23 nt, Human
ccguugcacuccagccugggcga

SEQ ID NO: 401392 - RNA, 24 nt, Human
ccguugcacuccagccugggcgag

SEQ ID NO: 401393 - RNA, 22 nt, Human
ccuauaucuagacaaaauacaa

SEQ ID NO: 401394 - RNA, 23 nt, Human
ccugaccaacauggugaaacccc

SEQ ID NO: 401395 - RNA, 24 nt, Human
ccugaccaacauggugaaaccccg

SEQ ID NO: 401396 - RNA, 22 nt, Human
ccugaggucaggaguucgagac

SEQ ID NO: 401397 - RNA, 21 nt, Human
ccugcaaucccagcuacuccg

SEQ ID NO: 401398 - RNA, 22 nt, Human
ccugcaaucccagcuacuccgg

SEQ ID NO: 401399 - RNA, 23 nt, Human
ccugcaaucccagcuacuccgga

SEQ ID NO: 401400 - RNA, 18 nt, Human
ccugcacagaaggcccag

SEQ ID NO: 401401 - RNA, 20 nt, Human
ccuggcugguggcucacgcc

SEQ ID NO: 401402 - RNA, 22 nt, Human
ccugggcgagagagugagauuc

SEQ ID NO: 401403 - RNA, 21 nt, Human
ccuguggucccagcuauuugg

SEQ ID NO: 401404 - RNA, 24 nt, Human
cgagaccagccugaccaacauggu

SEQ ID NO: 401405 - RNA, 24 nt, Human
cgccuguaaucccagcacuuucgg

SEQ ID NO: 401406 - RNA, 20 nt, Human
cguugcacuccagccugggc

SEQ ID NO: 401407 - RNA, 21 nt, Human
cguugcacuccagccugggcg

SEQ ID NO: 401408 - RNA, 22 nt, Human
cguugcacuccagccugggcga

SEQ ID NO: 401409 - RNA, 21 nt, Human
cucaaguaggcaaucuguacc

SEQ ID NO: 401410 - RNA, 22 nt, Human
cucacgccucuaauuccaccgc

SEQ ID NO: 401411 - RNA, 24 nt, Human
cucacgccuguaaucccagcacuu

SEQ ID NO: 401412 - RNA, 25 nt, Human
cucacgccuguaaucccagcacuuu

SEQ ID NO: 401413 - RNA, 23 nt, Human
cucagggugacagauaaccagaa

SEQ ID NO: 401414 - RNA, 19 nt, Human
cugcccagguagggaccag

SEQ ID NO: 401415 - RNA, 24 nt, Human
cuggcaccuucugagcccugaggc

SEQ ID NO: 401416 - RNA, 25 nt, Human
cuuaaaacaauaauagaacaggaca

SEQ ID NO: 401417 - RNA, 20 nt, Human
cuuugggagucugagguggg

SEQ ID NO: 401418 - RNA, 23 nt, Human
gaaggucugacuuccugaagaga

SEQ ID NO: 401419 - RNA, 22 nt, Human
gaccagaaaggucaccccccac

SEQ ID NO: 401420 - RNA, 20 nt, Human
gaccugggaccggacuggca

SEQ ID NO: 401421 - RNA, 23 nt, Human
gagguugcacugagccaagaucg

SEQ ID NO: 401422 - RNA, 24 nt, Human
gaucaccugaggucaggaguucga

SEQ ID NO: 401423 - RNA, 18 nt, Human
gauggaagugggagagga

SEQ ID NO: 401424 - RNA, 20 nt, Human
gcacaccuguggucccagcu

SEQ ID NO: 401425 - RNA, 20 nt, Human
gcacccugugccuuccagaa

SEQ ID NO: 401426 - RNA, 24 nt, Human
gcacuccagccugggagacagagu

SEQ ID NO: 401427 - RNA, 18 nt, Human
gcagcagcacccugugcc

SEQ ID NO: 401428 - RNA, 22 nt, Human
gccuggggauauagcaaagccu

SEQ ID NO: 401429 - RNA, 24 nt, Human
gcgagagagugagauucugucuca

SEQ ID NO: 401430 - RNA, 24 nt, Human
gcgugguggugcacaccugugguc

SEQ ID NO: 401431 - RNA, 18 nt, Human
ggaacaaaacacacaaug

SEQ ID NO: 401432 - RNA, 24 nt, Human
ggagguugcacugagccaagaucg

SEQ ID NO: 401433 - RNA, 20 nt, Human
ggaucaccugaggucaggaa

SEQ ID NO: 401434 - RNA, 22 nt, Human
ggaucaccugaggucaggaguu

SEQ ID NO: 401435 - RNA, 23 nt, Human
ggcugaggugggagaaucgcuug

SEQ ID NO: 401436 - RNA, 22 nt, Human
ggcugguggcucacgccuguaa

SEQ ID NO: 401437 - RNA, 24 nt, Human
gggcgugguggugcacaccugugg

SEQ ID NO: 401438 - RNA, 24 nt, Human
gguggcucacgccuguaaucccag

SEQ ID NO: 401439 - RNA, 24 nt, Human
gguggugcacaccuguggucccag

SEQ ID NO: 401440 - RNA, 23 nt, Human
gucaccccccacuccuaaaacuc

SEQ ID NO: 401441 - RNA, 18 nt, Human
gugcagugaaaaguuaca

SEQ ID NO: 401442 - RNA, 20 nt, Human
guggaucaccugaggucagg

SEQ ID NO: 401443 - RNA, 21 nt, Human
guggaucaccugaggucagga

SEQ ID NO: 401444 - RNA, 23 nt, Human
guggcucacgccuguaaucccag

SEQ ID NO: 401445 - RNA, 22 nt, Human
guugcacuccagccugggcgag

SEQ ID NO: 401446 - RNA, 21 nt, Human
uaaaaauacaaaaauuagcca

SEQ ID NO: 401447 - RNA, 23 nt, Human
uaacuaaacaacaaaacccccaa

SEQ ID NO: 401448 - RNA, 18 nt, Human
uaccguugcacuccagcc

SEQ ID NO: 401449 - RNA, 20 nt, Human
uaccuauaaauaauacucau

SEQ ID NO: 401450 - RNA, 22 nt, Human
uagacaaaauacaaaaaauuag

SEQ ID NO: 401451 - RNA, 19 nt, Human
uaggaaggccucuguggaa

SEQ ID NO: 401452 - RNA, 23 nt, Human
uauagcaaagccuaauguaacua

SEQ ID NO: 401453 - RNA, 24 nt, Human
uaucuagacaaaauacaaaaaauu

SEQ ID NO: 401454 - RNA, 25 nt, Human
uauguaaacaacuaccuauaaauaa

SEQ ID NO: 401455 - RNA, 21 nt, Human
uauuucaugucgucaggaagc

SEQ ID NO: 401456 - RNA, 25 nt, Human
ucaaggcuauagugagccaagauug

SEQ ID NO: 401457 - RNA, 20 nt, Human
ucaaguaggcaaucuguacc

SEQ ID NO: 401458 - RNA, 20 nt, Human
ucaccugaggucaggaguuc

SEQ ID NO: 401459 - RNA, 24 nt, Human
ucagaugcuuacagagcggccaag

SEQ ID NO: 401460 - RNA, 21 nt, Human
ucaugugacaauuguggcacu

SEQ ID NO: 401461 - RNA, 19 nt, Human
uccacagacacaacagucu

SEQ ID NO: 401462 - RNA, 19 nt, Human
uccagaaaaaagguaaacc

SEQ ID NO: 401463 - RNA, 23 nt, Human
uccagccugggcgagagagugag

SEQ ID NO: 401464 - RNA, 24 nt, Human
uccagccugggcgagagagugaga

SEQ ID NO: 401465 - RNA, 22 nt, Human
ucccagccuguccauagauggg

SEQ ID NO: 401466 - RNA, 21 nt, Human
uccugagcccaaacagggcuc

SEQ ID NO: 401467 - RNA, 21 nt, Human
uccugugucacaugcuauuug

SEQ ID NO: 401468 - RNA, 23 nt, Human
ucgagaccacccugagcaacaua

SEQ ID NO: 401469 - RNA, 24 nt, Human
ucgagaccacccugagcaacauag

SEQ ID NO: 401470 - RNA, 24 nt, Human
ucgcuugaacccaggaggcggagg

SEQ ID NO: 401471 - RNA, 24 nt, Human
ucgcuugagccugagaggucaagg

SEQ ID NO: 401472 - RNA, 23 nt, Human
ucguaccguugcacuccagccug

SEQ ID NO: 401473 - RNA, 21 nt, Human
ucuaucuccugagcccaaaca

SEQ ID NO: 401474 - RNA, 24 nt, Human
ucucaggcccguggguuucagccc

SEQ ID NO: 401475 - RNA, 21 nt, Human
ucucuacuaaaaauacaaaaa

SEQ ID NO: 401476 - RNA, 18 nt, Human
ucuuuggucccgacucau

SEQ ID NO: 401477 - RNA, 18 nt, Human
ugaacugccccgcacccc

SEQ ID NO: 401478 - RNA, 19 nt, Human
ugaacugccccgcaccccc

SEQ ID NO: 401479 - RNA, 24 nt, Human
ugaacugccccgcaccccccaccc

SEQ ID NO: 401480 - RNA, 24 nt, Human
ugaccaacauggugaaaccccguc

SEQ ID NO: 401481 - RNA, 24 nt, Human
ugacuuccugaagagaaucacacc

SEQ ID NO: 401482 - RNA, 24 nt, Human
ugagacagaaaagaccaaaaacca

SEQ ID NO: 401483 - RNA, 23 nt, Human
ugagauggcaaccauuucacacc

SEQ ID NO: 401484 - RNA, 22 nt, Human
ugagcccaaacagggcucaagu

SEQ ID NO: 401485 - RNA, 24 nt, Human
ugaggcacgagaaucgcuugaacc

SEQ ID NO: 401486 - RNA, 24 nt, Human
ugaggugggagaaucgcuugagcc

SEQ ID NO: 401487 - RNA, 25 nt, Human
ugaggugggcagacugcuugagucc

SEQ ID NO: 401488 - RNA, 21 nt, Human
ugcaccauugcacuccagccu

SEQ ID NO: 401489 - RNA, 22 nt, Human
ugcacuccagccugggagacag

SEQ ID NO: 401490 - RNA, 22 nt, Human
ugcacuccagccugggcgagag

SEQ ID NO: 401491 - RNA, 22 nt, Human
ugccaaucauugaagccaaagu

SEQ ID NO: 401492 - RNA, 24 nt, Human
ugccugcaaucccagcuacuccgg

SEQ ID NO: 401493 - RNA, 25 nt, Human
ugcuuccuuguuuguauuauaacac

SEQ ID NO: 401494 - RNA, 20 nt, Human
uggaacccagacagugacau

SEQ ID NO: 401495 - RNA, 24 nt, Human
uggaucaccugaggucaggaguuc

SEQ ID NO: 401496 - RNA, 27 nt, Human
uggaucaccugaggucaggaguucgag

SEQ ID NO: 401497 - RNA, 18 nt, Human
uggauggcugagguggga

SEQ ID NO: 401498 - RNA, 24 nt, Human
uggcgggugccugcaaucccagcu

SEQ ID NO: 401499 - RNA, 24 nt, Human
uggcucacgccuguaaucccagca

SEQ ID NO: 401500 - RNA, 19 nt, Human
ugggcagacugcuugaguc

SEQ ID NO: 401501 - RNA, 22 nt, Human
uggugcacaccuguggucccag

SEQ ID NO: 401502 - RNA, 24 nt, Human
ugguggcucacgccuguaauccca

SEQ ID NO: 401503 - RNA, 24 nt, Human
ugguggugcacaccugugguccca

SEQ ID NO: 401504 - RNA, 18 nt, Human
ugucacaugcuauuuggc

SEQ ID NO: 401505 - RNA, 23 nt, Human
uguuuaucuaaucuauucacaua

SEQ ID NO: 401506 - RNA, 22 nt, Human
uuaaacacugauaaggcugaca

SEQ ID NO: 401507 - RNA, 20 nt, Human
uuagccgggcgugguggugc

SEQ ID NO: 401508 - RNA, 22 nt, Human
uuagccgggcgugguggugcac

SEQ ID NO: 401509 - RNA, 24 nt, Human
uugaacccaggaggcggagguugc

SEQ ID NO: 401510 - RNA, 23 nt, Human
uugcaccauugcacuccagccug

SEQ ID NO: 401511 - RNA, 18 nt, Human
uugcacuccagccugggc

SEQ ID NO: 401512 - RNA, 20 nt, Human
uugcacuccagccugggcga

SEQ ID NO: 401513 - RNA, 21 nt, Human
uugcacuccagccugggcgag

SEQ ID NO: 401514 - RNA, 22 nt, Human
uugcacugagccaagaucguac

SEQ ID NO: 401515 - RNA, 24 nt, Human
uuggauggcugaggugggagaauc

SEQ ID NO: 401516 - RNA, 19 nt, Human
uuguaugucuccuccuuuu

SEQ ID NO: 401517 - RNA, 22 nt, Human
uuucacaccauucucaagcacc

SEQ ID NO: 401518 - RNA, 20 nt, Human
uuugugggcgcagagauugc

SEQ ID NO: 401519 - RNA, 21 nt, Human
uuuugugggcgcagagauugc

SEQ ID NO: 401520 - RNA, 26 nt, Human
uuuuuuuuuuuuuuuuuuauauaagg

SEQ ID NO: 401521 - RNA, 20 nt, Human
aaaucccgugaccacuucuc

SEQ ID NO: 401522 - RNA, 20 nt, Human
aaggcugaauaaaucccgug

SEQ ID NO: 401523 - RNA, 22 nt, Human
acuggcccugcccucuuggacu

SEQ ID NO: 401524 - RNA, 20 nt, Human
agacaccaggacuuggggca

SEQ ID NO: 401525 - RNA, 19 nt, Human
agagggaggcagggcagag

SEQ ID NO: 401526 - RNA, 23 nt, Human
agaguguccagcgccccccgccc

SEQ ID NO: 401527 - RNA, 22 nt, Human
aggagccgacugcccccugccu

SEQ ID NO: 401528 - RNA, 24 nt, Human
aggaggaagauagagccaggcugg

SEQ ID NO: 401529 - RNA, 21 nt, Human
aggcuggagacaccaggacuu

SEQ ID NO: 401530 - RNA, 24 nt, Human
augagaccaggguccuggggggug

SEQ ID NO: 401531 - RNA, 27 nt, Human
auuaaagaucuuuuuuuuuuuuuuuuu

SEQ ID NO: 401532 - RNA, 23 nt, Human
cacccuugucacccaguugagga

SEQ ID NO: 401533 - RNA, 21 nt, Human
cagccagcgccuaccugaacc

SEQ ID NO: 401534 - RNA, 22 nt, Human
cagggcagagaguguccagcgc

SEQ ID NO: 401535 - RNA, 21 nt, Human
ccaggcuggagacaccaggac

SEQ ID NO: 401536 - RNA, 20 nt, Human
ccccccgcccucagccagcc

SEQ ID NO: 401537 - RNA, 24 nt, Human
ccccccgcccucagccagcgccua

SEQ ID NO: 401538 - RNA, 26 nt, Human
ccucacccuugucacccaguugagga

SEQ ID NO: 401539 - RNA, 18 nt, Human
ccuggggggugcacggga

SEQ ID NO: 401540 - RNA, 24 nt, Human
cgggauguggggaugggacgauca

SEQ ID NO: 401541 - RNA, 23 nt, Human
cugaauaaaucccgugaccacuu

SEQ ID NO: 401542 - RNA, 21 nt, Human
cuggcugggccugaagauggg

SEQ ID NO: 401543 - RNA, 19 nt, Human
gaccaggguccuggggggu

SEQ ID NO: 401544 - RNA, 20 nt, Human
gaucuuuuuuuuuuuuuuuu

SEQ ID NO: 401545 - RNA, 20 nt, Human
gccuggcugggccugaagau

SEQ ID NO: 401546 - RNA, 23 nt, Human
gcuccaggagagggacugaugag

SEQ ID NO: 401547 - RNA, 18 nt, Human
ggaggaagauagagccag

SEQ ID NO: 401548 - RNA, 23 nt, Human
ggaggcagggcagagagugucca

SEQ ID NO: 401549 - RNA, 22 nt, Human
gggcaggggcaggcguuucugu

SEQ ID NO: 401550 - RNA, 19 nt, Human
guccuggggggugcacggg

SEQ ID NO: 401551 - RNA, 20 nt, Human
ugaagaugggaggaacuggc

SEQ ID NO: 401552 - RNA, 22 nt, Human
ugagaccaggguccuggggggu

SEQ ID NO: 401553 - RNA, 19 nt, Human
ugaugagaccaggguccug

SEQ ID NO: 401554 - RNA, 20 nt, Human
ugccuggcugggccugaaga

SEQ ID NO: 401555 - RNA, 24 nt, Human
ugggaggaacuggcccugcccucu

SEQ ID NO: 401556 - RNA, 23 nt, Human
uggggggugcacgggaugugggg

SEQ ID NO: 401557 - RNA, 24 nt, Human
uguguggacccccagcuccaggag

SEQ ID NO: 401558 - RNA, 18 nt, Human
uugaggagccgacugccc

SEQ ID NO: 401559 - RNA, 23 nt, Human
uuucugcucugaccaaggcugaa

SEQ ID NO: 401560 - RNA, 18 nt, Human
uuuuuuuuuuuuuuucug

SEQ ID NO: 401561 - RNA, 20 nt, Human
uuuuuuuuuuuuuuucugcu

SEQ ID NO: 401562 - RNA, 23 nt, Human
aaacucccgagcucaagcaaucc

SEQ ID NO: 401563 - RNA, 24 nt, Human
aaagugcugggauuacaggcauga

SEQ ID NO: 401564 - RNA, 18 nt, Human
aacuaugcagccaagaau

SEQ ID NO: 401565 - RNA, 18 nt, Human
aagcaauccaccugccuc

SEQ ID NO: 401566 - RNA, 19 nt, Human
aagcagaaaaaaagacuug

SEQ ID NO: 401567 - RNA, 20 nt, Human
aagcgccaaaaaucaaucag

SEQ ID NO: 401568 - RNA, 19 nt, Human
aagugcugggauuacaggc

SEQ ID NO: 401569 - RNA, 21 nt, Human
aagugcugggauuacaggcau

SEQ ID NO: 401570 - RNA, 26 nt, Human
aagugcugggauuacaggcaugagcc

SEQ ID NO: 401571 - RNA, 22 nt, Human
aaucugauauaaauuucucccg

SEQ ID NO: 401572 - RNA, 23 nt, Human
acuguuucuuccaggcugcuucc

SEQ ID NO: 401573 - RNA, 21 nt, Human
agaaaaaaagacuugucucau

SEQ ID NO: 401574 - RNA, 18 nt, Human
agaagggaggagggugga

SEQ ID NO: 401575 - RNA, 21 nt, Human
agcaauccaccugccucagcc

SEQ ID NO: 401576 - RNA, 18 nt, Human
agugcugggauuacaggc

SEQ ID NO: 401577 - RNA, 20 nt, Human
augaugaagaacugcaaaga

SEQ ID NO: 401578 - RNA, 19 nt, Human
auggaguuucacuguguug

SEQ ID NO: 401579 - RNA, 21 nt, Human
caaagugcugggauuacaggc

SEQ ID NO: 401580 - RNA, 23 nt, Human
caaagugcugggauuacaggcau

SEQ ID NO: 401581 - RNA, 24 nt, Human
caaagugcugggauuacaggcaug

SEQ ID NO: 401582 - RNA, 22 nt, Human
caaaguucuaggaccauuggua

SEQ ID NO: 401583 - RNA, 23 nt, Human
caccugccucagccuaucaaagu

SEQ ID NO: 401584 - RNA, 21 nt, Human
cacuguguugaugaggcuggu

SEQ ID NO: 401585 - RNA, 24 nt, Human
cacuguguugaugaggcuggucuc

SEQ ID NO: 401586 - RNA, 19 nt, Human
cauguggccuaaaacgacc

SEQ ID NO: 401587 - RNA, 26 nt, Human
ccacuuuuuuucuuuuuaaauugaga

SEQ ID NO: 401588 - RNA, 23 nt, Human
cgcauguggccuaaaacgacccu

SEQ ID NO: 401589 - RNA, 18 nt, Human
cuuccaggcugcuucccu

SEQ ID NO: 401590 - RNA, 21 nt, Human
cuuccaggcugcuucccuuug

SEQ ID NO: 401591 - RNA, 22 nt, Human
cuuccaggcugcuucccuuugu

SEQ ID NO: 401592 - RNA, 18 nt, Human
gagauggaguuucacugu

SEQ ID NO: 401593 - RNA, 24 nt, Human
gagcucaagcaauccaccugccuc

SEQ ID NO: 401594 - RNA, 18 nt, Human
gauuacaggcaugagcca

SEQ ID NO: 401595 - RNA, 23 nt, Human
gauuacaggcaugagccaccgca

SEQ ID NO: 401596 - RNA, 25 nt, Human
gauuacaggcaugagccaccgcaug

SEQ ID NO: 401597 - RNA, 23 nt, Human
gcaauauaagaagcagaaaaaaa

SEQ ID NO: 401598 - RNA, 18 nt, Human
gcaauccaccugccucag

SEQ ID NO: 401599 - RNA, 24 nt, Human
gcucaagcaauccaccugccucag

SEQ ID NO: 401600 - RNA, 25 nt, Human
ggauuacaggcaugagccaccgcau

SEQ ID NO: 401601 - RNA, 18 nt, Human
uaagaagcagaaaaaaag

SEQ ID NO: 401602 - RNA, 20 nt, Human
uacaggcaugagccaccgca

SEQ ID NO: 401603 - RNA, 22 nt, Human
uaggagaaaagguaaaugagga

SEQ ID NO: 401604 - RNA, 23 nt, Human
uaggagaaaagguaaaugaggga

SEQ ID NO: 401605 - RNA, 22 nt, Human
ucaaagugcugggauuacaggc

SEQ ID NO: 401606 - RNA, 23 nt, Human
ucaaagugcugggauuacaggca

SEQ ID NO: 401607 - RNA, 24 nt, Human
ucaaagugcugggauuacaggcau

SEQ ID NO: 401608 - RNA, 22 nt, Human
ucacuguguugaugaggcuggu

SEQ ID NO: 401609 - RNA, 23 nt, Human
uccuaaaaccacuuuuuuucuuu

SEQ ID NO: 401610 - RNA, 23 nt, Human
ugagauggaguuucacuguguug

SEQ ID NO: 401611 - RNA, 24 nt, Human
uggaguuucacuguguugaugagg

SEQ ID NO: 401612 - RNA, 18 nt, Human
ugggauuacaggcaugag

SEQ ID NO: 401613 - RNA, 19 nt, Human
ugggauuacaggcaugagc

SEQ ID NO: 401614 - RNA, 21 nt, Human
ugggauuacaggcaugagcca

SEQ ID NO: 401615 - RNA, 22 nt, Human
ugggauuacaggcaugagccac

SEQ ID NO: 401616 - RNA, 23 nt, Human
ugggauuacaggcaugagccacc

SEQ ID NO: 401617 - RNA, 24 nt, Human
ugggauuacaggcaugagccaccg

SEQ ID NO: 401618 - RNA, 24 nt, Human
ugggauuacaggcaugagccaccg

SEQ ID NO: 401619 - RNA, 26 nt, Human
uguuucuuccaggcugcuucccuuug

SEQ ID NO: 401620 - RNA, 21 nt, Human
uuucuuuuuaaauugagaugg

SEQ ID NO: 401621 - RNA, 19 nt, Human
aaaaaaaaaaggaaaagag

SEQ ID NO: 401622 - RNA, 21 nt, Human
aaaaaaagaaaaaaaaaagga

SEQ ID NO: 401623 - RNA, 22 nt, Human
aaaaaaggaaaagagaaaagaa

SEQ ID NO: 401624 - RNA, 21 nt, Human
aaaaaggaaaagagaaaagaa

SEQ ID NO: 401625 - RNA, 24 nt, Human
aaaagaaaaaaaaaaggaaaagag

SEQ ID NO: 401626 - RNA, 19 nt, Human
aaacauagacccccccccc

SEQ ID NO: 401627 - RNA, 18 nt, Human
aaagagacccucaccuuu

SEQ ID NO: 401628 - RNA, 21 nt, Human
aaagucccaccacauguuccu

SEQ ID NO: 401629 - RNA, 19 nt, Human
aaauuugcuuaccaaguac

SEQ ID NO: 401630 - RNA, 21 nt, Human
aacauggugggaccgugucuc

SEQ ID NO: 401631 - RNA, 20 nt, Human
aacuuagcaacuaucuccag

SEQ ID NO: 401632 - RNA, 21 nt, Human
aagaaaaaaaaaaggaaaaga

SEQ ID NO: 401633 - RNA, 22 nt, Human
aagaaaaaaaaaaggaaaagag

SEQ ID NO: 401634 - RNA, 19 nt, Human
aagaaaaguuaugaaaagg

SEQ ID NO: 401635 - RNA, 18 nt, Human
aagaaugccaagcugcag

SEQ ID NO: 401636 - RNA, 18 nt, Human
aagcaggccagcgugggg

SEQ ID NO: 401637 - RNA, 18 nt, Human
aagcugcagcaacuugga

SEQ ID NO: 401638 - RNA, 21 nt, Human
aaggaauacaaauaugggggg

SEQ ID NO: 401639 - RNA, 19 nt, Human
acugcacucuagccugggc

SEQ ID NO: 401640 - RNA, 22 nt, Human
acugcacucuagccugggccag

SEQ ID NO: 401641 - RNA, 24 nt, Human
acugcacucuagccugggccagag

SEQ ID NO: 401642 - RNA, 25 nt, Human
agaaaaaaaaaaggaaaagagaaaa

SEQ ID NO: 401643 - RNA, 21 nt, Human
agaaaagaaagagacccucac

SEQ ID NO: 401644 - RNA, 23 nt, Human
agcgugggggcucacgccuguaa

SEQ ID NO: 401645 - RNA, 24 nt, Human
agcuacuccgaagguugagguggg

SEQ ID NO: 401646 - RNA, 19 nt, Human
aggaaagauaucaagaaaa

SEQ ID NO: 401647 - RNA, 24 nt, Human
aggaguuagaggcugcaccgggcu

SEQ ID NO: 401648 - RNA, 18 nt, Human
aggugggaggaucacuug

SEQ ID NO: 401649 - RNA, 23 nt, Human
aggugggaggaucacuuggauug

SEQ ID NO: 401650 - RNA, 24 nt, Human
agguugaggugggaggaucacuug

SEQ ID NO: 401651 - RNA, 24 nt, Human
aguacuuugggaggccgaggcugg

SEQ ID NO: 401652 - RNA, 22 nt, Human
aucaauucacuuccugaaaagc

SEQ ID NO: 401653 - RNA, 24 nt, Human
aucgcaccacugcacucuagccug

SEQ ID NO: 401654 - RNA, 24 nt, Human
cacaaaagaaaauacguaaagcag

SEQ ID NO: 401655 - RNA, 24 nt, Human
cacgccuguaaucccaguacuuug

SEQ ID NO: 401656 - RNA, 18 nt, Human
cacugcacucuagccugg

SEQ ID NO: 401657 - RNA, 19 nt, Human
cacugcacucuagccuggg

SEQ ID NO: 401658 - RNA, 20 nt, Human
cacugcacucuagccugggc

SEQ ID NO: 401659 - RNA, 22 nt, Human
cacugcacucuagccugggcca

SEQ ID NO: 401660 - RNA, 23 nt, Human
cagaauaugaaagucccaccaca

SEQ ID NO: 401661 - RNA, 19 nt, Human
cagcauggauaaauuaacc

SEQ ID NO: 401662 - RNA, 19 nt, Human
cagcugugaucccagcuac

SEQ ID NO: 401663 - RNA, 24 nt, Human
cagcugugaucccagcuacuccga

SEQ ID NO: 401664 - RNA, 19 nt, Human
caggagccccauguccugu

SEQ ID NO: 401665 - RNA, 25 nt, Human
caguacuuugggaggccgaggcugg

SEQ ID NO: 401666 - RNA, 22 nt, Human
cauguuuagcccuuucccaaaa

SEQ ID NO: 401667 - RNA, 23 nt, Human
ccaaaaguguuuacaaugaacac

SEQ ID NO: 401668 - RNA, 20 nt, Human
ccacugcacucuagccuggg

SEQ ID NO: 401669 - RNA, 21 nt, Human
ccacugcacucuagccugggc

SEQ ID NO: 401670 - RNA, 21 nt, Human
ccacugcacucuagccugggc

SEQ ID NO: 401671 - RNA, 24 nt, Human
ccacugcacucuagccugggccag

SEQ ID NO: 401672 - RNA, 26 nt, Human
ccagguugccaaaaaaagaaaaaaaa

SEQ ID NO: 401673 - RNA, 21 nt, Human
cccacagaacaggauagucau

SEQ ID NO: 401674 - RNA, 19 nt, Human
ccccagugcggcgggcugc

SEQ ID NO: 401675 - RNA, 26 nt, Human
ccccccacagaacaggauagucauaa

SEQ ID NO: 401676 - RNA, 18 nt, Human
ccgggcccuuucuuucca

SEQ ID NO: 401677 - RNA, 24 nt, Human
ccgggcuauaaucgcaccacugca

SEQ ID NO: 401678 - RNA, 19 nt, Human
ccgugggcauggggacagu

SEQ ID NO: 401679 - RNA, 20 nt, Human
ccucgcgagcccuggcuccg

SEQ ID NO: 401680 - RNA, 20 nt, Human
ccugcagcugugaucccagc

SEQ ID NO: 401681 - RNA, 19 nt, Human
ccuugaacuucccgggccc

SEQ ID NO: 401682 - RNA, 24 nt, Human
cgccuguaaucccaguacuuuggg

SEQ ID NO: 401683 - RNA, 22 nt, Human
cucacgccuguaaucccaguac

SEQ ID NO: 401684 - RNA, 24 nt, Human
cucacgccuguaaucccaguacuu

SEQ ID NO: 401685 - RNA, 19 nt, Human
cuccgaagguugagguggg

SEQ ID NO: 401686 - RNA, 21 nt, Human
cucuaaaacacugugagcagg

SEQ ID NO: 401687 - RNA, 18 nt, Human
cugagugccucugccagc

SEQ ID NO: 401688 - RNA, 21 nt, Human
cugggccagagccagguugcc

SEQ ID NO: 401689 - RNA, 22 nt, Human
gacaggcuggcgggcgccggac

SEQ ID NO: 401690 - RNA, 23 nt, Human
gacaggcuggcgggcgccggacc

SEQ ID NO: 401691 - RNA, 18 nt, Human
gaucacuuggauugcuug

SEQ ID NO: 401692 - RNA, 19 nt, Human
gaucccagcuacuccgaag

SEQ ID NO: 401693 - RNA, 23 nt, Human
gcccuuucccaaaaguguuuaca

SEQ ID NO: 401694 - RNA, 21 nt, Human
gccggggcuggggcagaggcu

SEQ ID NO: 401695 - RNA, 19 nt, Human
gcugcaccgggcuauaauc

SEQ ID NO: 401696 - RNA, 22 nt, Human
ggaaaacauagacccccccccc

SEQ ID NO: 401697 - RNA, 20 nt, Human
ggaacgacacaaacuuaaaa

SEQ ID NO: 401698 - RNA, 18 nt, Human
ggccggggcuggggcaga

SEQ ID NO: 401699 - RNA, 22 nt, Human
ggccggggcuggggcagaggcu

SEQ ID NO: 401700 - RNA, 18 nt, Human
ggccugcagcugugaucc

SEQ ID NO: 401701 - RNA, 20 nt, Human
ggcucacgccuguaauccca

SEQ ID NO: 401702 - RNA, 21 nt, Human
ggcucacgccuguaaucccag

SEQ ID NO: 401703 - RNA, 19 nt, Human
ggcugcggugcugcccucg

SEQ ID NO: 401704 - RNA, 24 nt, Human
ggcuggggcagaggcugcggugcu

SEQ ID NO: 401705 - RNA, 21 nt, Human
gggaaaacauagacccccccc

SEQ ID NO: 401706 - RNA, 25 nt, Human
gggaaaacauagaccccccccccac

SEQ ID NO: 401707 - RNA, 19 nt, Human
gggcagagaaugccgggug

SEQ ID NO: 401708 - RNA, 20 nt, Human
gggcagaggcugcggugcug

SEQ ID NO: 401709 - RNA, 24 nt, Human
gggccagagccagguugccaaaaa

SEQ ID NO: 401710 - RNA, 24 nt, Human
gggcucacgccuguaaucccagua

SEQ ID NO: 401711 - RNA, 28 nt, Human
ggggaaaacauagaccccccccccaauu

SEQ ID NO: 401712 - RNA, 24 nt, Human
gggggcucacgccuguaaucccag

SEQ ID NO: 401713 - RNA, 23 nt, Human
gguugccaaaaaaagaaaaaaaa

SEQ ID NO: 401714 - RNA, 21 nt, Human
gugaucccagcuacuccgaag

SEQ ID NO: 401715 - RNA, 24 nt, Human
uaaaaauagcugucauagugccac

SEQ ID NO: 401716 - RNA, 22 nt, Human
uaaagcaggccagcgugggggc

SEQ ID NO: 401717 - RNA, 23 nt, Human
uaacauggugggaccgugucucu

SEQ ID NO: 401718 - RNA, 24 nt, Human
uaacauggugggaccgugucucug

SEQ ID NO: 401719 - RNA, 24 nt, Human
uaagaagaaugccaagcugcagca

SEQ ID NO: 401720 - RNA, 22 nt, Human
uacaaugaacacacacugggaa

SEQ ID NO: 401721 - RNA, 22 nt, Human
uaccaaguaccugagugccucu

SEQ ID NO: 401722 - RNA, 18 nt, Human
uaccugagugccucugcc

SEQ ID NO: 401723 - RNA, 18 nt, Human
uagaauaagaagaaugcc

SEQ ID NO: 401724 - RNA, 21 nt, Human
uagaccccccccccacagaac

SEQ ID NO: 401725 - RNA, 18 nt, Human
uagcccuuucccaaaagu

SEQ ID NO: 401726 - RNA, 23 nt, Human
ucaauucacuuccugaaaagccc

SEQ ID NO: 401727 - RNA, 24 nt, Human
ucacauguuuagcccuuucccaaa

SEQ ID NO: 401728 - RNA, 22 nt, Human
ucacgccuguaaucccaguacu

SEQ ID NO: 401729 - RNA, 19 nt, Human
ucagaauaugaaaguccca

SEQ ID NO: 401730 - RNA, 19 nt, Human
ucaggagaaauaaaucggg

SEQ ID NO: 401731 - RNA, 19 nt, Human
ucccaccacauguuccuag

SEQ ID NO: 401732 - RNA, 20 nt, Human
ucccuggguggccggggcug

SEQ ID NO: 401733 - RNA, 18 nt, Human
ugaaaagcccauuuccug

SEQ ID NO: 401734 - RNA, 22 nt, Human
ugaaaaggaauacaaauauggg

SEQ ID NO: 401735 - RNA, 23 nt, Human
ugaaaaggaauacaaauaugggg

SEQ ID NO: 401736 - RNA, 18 nt, Human
ugaggaguggcaggggag

SEQ ID NO: 401737 - RNA, 19 nt, Human
ugaggugggaggaucacuu

SEQ ID NO: 401738 - RNA, 20 nt, Human
ugaggugggaggaucacuug

SEQ ID NO: 401739 - RNA, 21 nt, Human
ugaggugggaggaucacuugg

SEQ ID NO: 401740 - RNA, 23 nt, Human
ugaggugggaggaucacuuggau

SEQ ID NO: 401741 - RNA, 21 nt, Human
ugcaccgggcuauaaucgcac

SEQ ID NO: 401742 - RNA, 20 nt, Human
ugccaaaaaaagaaaaaaaa

SEQ ID NO: 401743 - RNA, 25 nt, Human
ugccaaaaaaagaaaaaaaaaagga

SEQ ID NO: 401744 - RNA, 29 nt, Human
uggaggacugcuuuagcuggggaguuucc

SEQ ID NO: 401745 - RNA, 22 nt, Human
uggcgggcgccgcggccucagc

SEQ ID NO: 401746 - RNA, 25 nt, Human
uggcuccgagcuucgggcucccucc

SEQ ID NO: 401747 - RNA, 22 nt, Human
ugggaggccgaggcuggaggac

SEQ ID NO: 401748 - RNA, 19 nt, Human
ugggcagagaaugccgggu

SEQ ID NO: 401749 - RNA, 21 nt, Human
ugggcagagaaugccgggugg

SEQ ID NO: 401750 - RNA, 23 nt, Human
uggggaguuugagaccaggcugg

SEQ ID NO: 401751 - RNA, 24 nt, Human
ugggggcucacgccuguaauccca

SEQ ID NO: 401752 - RNA, 23 nt, Human
uggggggggggagucggggggag

SEQ ID NO: 401753 - RNA, 25 nt, Human
uguccuguucauuuucuccaucuuu

SEQ ID NO: 401754 - RNA, 24 nt, Human
uuacugcugcgaguuugaggagug

SEQ ID NO: 401755 - RNA, 19 nt, Human
uuccuugaacuucccgggc

SEQ ID NO: 401756 - RNA, 24 nt, Human
uugcuugagcccaggaguuagagg

SEQ ID NO: 401757 - RNA, 22 nt, Human
uuuaggagaauuuuugagaaaa

SEQ ID NO: 401758 - RNA, 23 nt, Human
uuuccuggaaggcaaagugggca

SEQ ID NO: 401759 - RNA, 18 nt, Human
aucauccaugggaucucg

SEQ ID NO: 401760 - RNA, 24 nt, Human
cguacgcucaucacguuauauaua

SEQ ID NO: 401761 - RNA, 20 nt, Human
ugaggaaacagcucaauggc

SEQ ID NO: 401762 - RNA, 21 nt, Human
ugaggaaacagcucaauggcc

SEQ ID NO: 401763 - RNA, 18 nt, Human
aaaaugucuacacgcaua

SEQ ID NO: 401764 - RNA, 22 nt, Human
aaugucuacacgcauaaguaac

SEQ ID NO: 401765 - RNA, 24 nt, Human
cagccaaacuccggccgagaaguu

SEQ ID NO: 401766 - RNA, 22 nt, Human
ccuuggcuggagcgauaggggc

SEQ ID NO: 401767 - RNA, 21 nt, Human
cggcuccgugcucucugcccg

SEQ ID NO: 401768 - RNA, 19 nt, Human
cucugcccgucgugguucc

SEQ ID NO: 401769 - RNA, 18 nt, Human
cuucacccccucucgaca

SEQ ID NO: 401770 - RNA, 20 nt, Human
gagcagggguggggccggcu

SEQ ID NO: 401771 - RNA, 22 nt, Human
gagcgauaggggcgagcagggg

SEQ ID NO: 401772 - RNA, 20 nt, Human
gcuucuucgccuuggcugga

SEQ ID NO: 401773 - RNA, 20 nt, Human
ggcuccgugcucucugcccg

SEQ ID NO: 401774 - RNA, 18 nt, Human
gggcgagcaggggugggg

SEQ ID NO: 401775 - RNA, 22 nt, Human
gggcgcccaggggcuucccggc

SEQ ID NO: 401776 - RNA, 19 nt, Human
guacuuagggcuucugcaa

SEQ ID NO: 401777 - RNA, 18 nt, Human
uaaguaaccguacuuagg

SEQ ID NO: 401778 - RNA, 20 nt, Human
uaaguaaccguacuuagggc

SEQ ID NO: 401779 - RNA, 20 nt, Human
uaccgcgaucucagccaaac

SEQ ID NO: 401780 - RNA, 22 nt, Human
ucuacacgcauaaguaaccgua

SEQ ID NO: 401781 - RNA, 21 nt, Human
ucucugcccgucgugguuccg

SEQ ID NO: 401782 - RNA, 20 nt, Human
uuaauaccgcgaucucagcu

SEQ ID NO: 401783 - RNA, 26 nt, Human
uucgccuuggcuggagcgauaggggc

SEQ ID NO: 401784 - RNA, 20 nt, Human
uuggcuggagcgauaggggc

SEQ ID NO: 401785 - RNA, 18 nt, Human
uuuuuuuuuuuuguuuuc

SEQ ID NO: 401786 - RNA, 24 nt, Human
uuuuuuuuuuuuuuuuuuuguuuu

SEQ ID NO: 401787 - RNA, 27 nt, Human
uuuuuuuuuuuuuuuuuuuuuuugggg

SEQ ID NO: 401788 - RNA, 23 nt, Human
aagccaaaggcaagcacaccaaa

SEQ ID NO: 401789 - RNA, 20 nt, Human
aggcaagcacaccaaacucc

SEQ ID NO: 401790 - RNA, 20 nt, Human
auggugccuuccccauuuua

SEQ ID NO: 401791 - RNA, 19 nt, Human
caaaggcaagcacaccaaa

SEQ ID NO: 401792 - RNA, 23 nt, Human
caagcacaccaaacuccaugggg

SEQ ID NO: 401793 - RNA, 22 nt, Human
caagccccuggcugggggucca

SEQ ID NO: 401794 - RNA, 25 nt, Human
cacaccaaacuccaugggggcugaa

SEQ ID NO: 401795 - RNA, 20 nt, Human
caggaacaggagcugggcua

SEQ ID NO: 401796 - RNA, 19 nt, Human
ccaagccccuggcuggggg

SEQ ID NO: 401797 - RNA, 19 nt, Human
ccuggcuggggguccagag

SEQ ID NO: 401798 - RNA, 26 nt, Human
ccuuuugaaggcacaggaacaggagc

SEQ ID NO: 401799 - RNA, 18 nt, Human
gaaggcacaggaacagga

SEQ ID NO: 401800 - RNA, 19 nt, Human
ucugcagguuagccugguc

SEQ ID NO: 401801 - RNA, 18 nt, Human
ugaaggcacaggaacagg

SEQ ID NO: 401802 - RNA, 19 nt, Human
ugaaggcacaggaacagga

SEQ ID NO: 401803 - RNA, 19 nt, Human
ugccccagccuuuugaagg

SEQ ID NO: 401804 - RNA, 24 nt, Human
uggcuggggguccagagggagggc

SEQ ID NO: 401805 - RNA, 21 nt, Human
uggcuuaauggugccuucccc

SEQ ID NO: 401806 - RNA, 18 nt, Human
ugggggcugaaugcugug

SEQ ID NO: 401807 - RNA, 19 nt, Human
ugggggcugaaugcugugg

SEQ ID NO: 401808 - RNA, 20 nt, Human
uggggguccagagggagggc

SEQ ID NO: 401809 - RNA, 23 nt, Human
uggugaggucugaagccaaaggc

SEQ ID NO: 401810 - RNA, 19 nt, Human
uucauuuuggcuuaauggu

SEQ ID NO: 401811 - RNA, 21 nt, Human
aaacaccacacugcagccaac

SEQ ID NO: 401812 - RNA, 20 nt, Human
aagccgaggggaagggccgg

SEQ ID NO: 401813 - RNA, 19 nt, Human
acagaggccccaggcccuc

SEQ ID NO: 401814 - RNA, 18 nt, Human
agaacagaggccccaggc

SEQ ID NO: 401815 - RNA, 24 nt, Human
agacaggaccggaauucaaaucca

SEQ ID NO: 401816 - RNA, 19 nt, Human
agagaaagagaaagagaau

SEQ ID NO: 401817 - RNA, 25 nt, Human
agaggaacucagcgccauugcugcg

SEQ ID NO: 401818 - RNA, 20 nt, Human
agcagaggaacucagcgcca

SEQ ID NO: 401819 - RNA, 21 nt, Human
aggagggcugggugugugguc

SEQ ID NO: 401820 - RNA, 22 nt, Human
aggccugcuggguggagcggcg

SEQ ID NO: 401821 - RNA, 19 nt, Human
agugggcagcagggggugu

SEQ ID NO: 401822 - RNA, 25 nt, Human
agugggcagcagggggugucuggca

SEQ ID NO: 401823 - RNA, 22 nt, Human
caaagccgaggggaagggccgg

SEQ ID NO: 401824 - RNA, 18 nt, Human
caagcugugccucagaac

SEQ ID NO: 401825 - RNA, 21 nt, Human
caccucucccuccacuggagg

SEQ ID NO: 401826 - RNA, 22 nt, Human
cacuaaacaccacacugcagcc

SEQ ID NO: 401827 - RNA, 20 nt, Human
cacugcagccaacccagucc

SEQ ID NO: 401828 - RNA, 21 nt, Human
cagaacagaggccccaggccc

SEQ ID NO: 401829 - RNA, 21 nt, Human
cagaacccgagcagcaggaga

SEQ ID NO: 401830 - RNA, 23 nt, Human
cagcagagaggggcucaggccug

SEQ ID NO: 401831 - RNA, 19 nt, Human
cagcaggggccccaccucu

SEQ ID NO: 401832 - RNA, 19 nt, Human
cagcagggggugucuggca

SEQ ID NO: 401833 - RNA, 23 nt, Human
cagcucgggaacccagcuagcag

SEQ ID NO: 401834 - RNA, 20 nt, Human
caggaccggaauucaaaucc

SEQ ID NO: 401835 - RNA, 22 nt, Human
caggaccggaauucaaauccaa

SEQ ID NO: 401836 - RNA, 28 nt, Human
ccacuaaacaccacacugcagccaaccc

SEQ ID NO: 401837 - RNA, 21 nt, Human
ccaguccagccuuggcuguga

SEQ ID NO: 401838 - RNA, 27 nt, Human
ccccaaauacacuguuucaugacaaau

SEQ ID NO: 401839 - RNA, 18 nt, Human
ccccaagccuccgggcuc

SEQ ID NO: 401840 - RNA, 22 nt, Human
cccccaagccuccgggcuccgg

SEQ ID NO: 401841 - RNA, 20 nt, Human
cccucugggcuggcccagga

SEQ ID NO: 401842 - RNA, 26 nt, Human
ccucaggcucagaccggcagcucggg

SEQ ID NO: 401843 - RNA, 24 nt, Human
ccuguccugcugaggccacaagag

SEQ ID NO: 401844 - RNA, 19 nt, Human
cucagaacccgagcagcag

SEQ ID NO: 401845 - RNA, 23 nt, Human
cucaggacucuggggagcucagg

SEQ ID NO: 401846 - RNA, 22 nt, Human
cuggcccaggagggcugggugu

SEQ ID NO: 401847 - RNA, 19 nt, Human
cuggguggagcggcgcugg

SEQ ID NO: 401848 - RNA, 20 nt, Human
gagaaacaagauauuuacau

SEQ ID NO: 401849 - RNA, 20 nt, Human
gagcagcaggagagugggca

SEQ ID NO: 401850 - RNA, 18 nt, Human
gagcucaggccacagcag

SEQ ID NO: 401851 - RNA, 18 nt, Human
gaggcaggagcuguccag

SEQ ID NO: 401852 - RNA, 19 nt, Human
gcagcaggagagugggcag

SEQ ID NO: 401853 - RNA, 22 nt, Human
gccaacccaguccagccuuggc

SEQ ID NO: 401854 - RNA, 19 nt, Human
gcccaugggaauggcacgu

SEQ ID NO: 401855 - RNA, 18 nt, Human
gccccaccucucccucca

SEQ ID NO: 401856 - RNA, 22 nt, Human
gccgaggggaagggccgguaug

SEQ ID NO: 401857 - RNA, 20 nt, Human
gcugggggacacaggugggc

SEQ ID NO: 401858 - RNA, 20 nt, Human
ggacagccucuuucagcagc

SEQ ID NO: 401859 - RNA, 20 nt, Human
ggccccaggcccucacuggc

SEQ ID NO: 401860 - RNA, 19 nt, Human
ggccuguccugcugaggcc

SEQ ID NO: 401861 - RNA, 18 nt, Human
gggaacccagcuagcagg

SEQ ID NO: 401862 - RNA, 22 nt, Human
gggcagcagggggugucuggca

SEQ ID NO: 401863 - RNA, 22 nt, Human
gggcccugcgggaggcaggagc

SEQ ID NO: 401864 - RNA, 25 nt, Human
gggcggagcccccaagccuccgggc

SEQ ID NO: 401865 - RNA, 21 nt, Human
ggggccuguccugcugaggcc

SEQ ID NO: 401866 - RNA, 23 nt, Human
gguggagcggcgcugggggacac

SEQ ID NO: 401867 - RNA, 20 nt, Human
ggugucuggcagcagagagg

SEQ ID NO: 401868 - RNA, 20 nt, Human
guggcguccccagcucuacc

SEQ ID NO: 401869 - RNA, 22 nt, Human
gugggccagaagagaaagagaa

SEQ ID NO: 401870 - RNA, 19 nt, Human
uagcaggaugaacuccagc

SEQ ID NO: 401871 - RNA, 21 nt, Human
uccacuggaggagacggaagc

SEQ ID NO: 401872 - RNA, 20 nt, Human
ucccacagcaucuccccaaa

SEQ ID NO: 401873 - RNA, 21 nt, Human
uccccaaauacacuguuucau

SEQ ID NO: 401874 - RNA, 21 nt, Human
uccucccacagcaucucccca

SEQ ID NO: 401875 - RNA, 23 nt, Human
ucgccagguggacagccucuuuc

SEQ ID NO: 401876 - RNA, 22 nt, Human
ucuggcgucggggugcagaguc

SEQ ID NO: 401877 - RNA, 23 nt, Human
ugaggcagugcccggggccuguc

SEQ ID NO: 401878 - RNA, 20 nt, Human
ugccucagaacccgagcagc

SEQ ID NO: 401879 - RNA, 22 nt, Human
ugccucagaacccgagcagcag

SEQ ID NO: 401880 - RNA, 21 nt, Human
ugcuggguggagcggcgcugg

SEQ ID NO: 401881 - RNA, 23 nt, Human
uggcagcagagaggggcucaggg

SEQ ID NO: 401882 - RNA, 18 nt, Human
ugggaauggcacguggcg

SEQ ID NO: 401883 - RNA, 19 nt, Human
ugggcuggcccaggagggc

SEQ ID NO: 401884 - RNA, 22 nt, Human
ugugacaagcugugccucagaa

SEQ ID NO: 401885 - RNA, 18 nt, Human
uuuuuuuuuuuuuuuuug

SEQ ID NO: 401886 - RNA, 21 nt, Human
uuuuuuuuuuuuuuuuugagg

SEQ ID NO: 401887 - RNA, 26 nt, Human
aaaaagaaaacaagggagcuacagaa

SEQ ID NO: 401888 - RNA, 21 nt, Human
acaaaaagaaaacaagggagc

SEQ ID NO: 401889 - RNA, 21 nt, Human
acaguuagaggacaaaaagcu

SEQ ID NO: 401890 - RNA, 18 nt, Human
agaaagaacagccuggaa

SEQ ID NO: 401891 - RNA, 20 nt, Human
agccuggaaggacaaguaau

SEQ ID NO: 401892 - RNA, 21 nt, Human
aggaaguuucuaccauuaagc

SEQ ID NO: 401893 - RNA, 27 nt, Human
caaaaagaaaacaagggagcuacagaa

SEQ ID NO: 401894 - RNA, 23 nt, Human
caaaaagcuguaucggcaacuga

SEQ ID NO: 401895 - RNA, 22 nt, Human
caaguuucuaaguuugagucuu

SEQ ID NO: 401896 - RNA, 24 nt, Human
ccagagcaaaugcagcaagagcag

SEQ ID NO: 401897 - RNA, 25 nt, Human
gaaaacaagggagcuacagaaagaa

SEQ ID NO: 401898 - RNA, 25 nt, Human
gcaaaugcagcaagagcagcuagaa

SEQ ID NO: 401899 - RNA, 26 nt, Human
ggaaaaaaaaagacuuuaaucaugaa

SEQ ID NO: 401900 - RNA, 26 nt, Human
ggaaggacaaguaauaucucuacaag

SEQ ID NO: 401901 - RNA, 19 nt, Human
ggggcugucugugucuucg

SEQ ID NO: 401902 - RNA, 18 nt, Human
uaagcucccaacaguaac

SEQ ID NO: 401903 - RNA, 31 nt, Human
uaccauuaagcucccaacaguaaccuagagg

SEQ ID NO: 401904 - RNA, 20 nt, Human
uaucucuacaagaauuccag

SEQ ID NO: 401905 - RNA, 23 nt, Human
uccacaguuagaggacaaaaagc

SEQ ID NO: 401906 - RNA, 19 nt, Human
ucuucgcggcacguaagga

SEQ ID NO: 401907 - RNA, 19 nt, Human
ugaaaccaaggaaguuucu

SEQ ID NO: 401908 - RNA, 21 nt, Human
uggcacugcucgagucgaaau

SEQ ID NO: 401909 - RNA, 24 nt, Human
uuucuaccauuaagcucccaacag

SEQ ID NO: 401910 - RNA, 26 nt, Human
aaaaaaaacugcuuaugcacugugaa

SEQ ID NO: 401911 - RNA, 21 nt, Human
aaaaacaaaaaaaacugcuua

SEQ ID NO: 401912 - RNA, 20 nt, Human
aaaacaaaacaaaacaaaaa

SEQ ID NO: 401913 - RNA, 24 nt, Human
aaacaaaaacaaaaaaaacugcuu

SEQ ID NO: 401914 - RNA, 22 nt, Human
aaacaaaacaaaaacaaaaaaa

SEQ ID NO: 401915 - RNA, 23 nt, Human
aaacaaaacaaaacaaaaacaaa

SEQ ID NO: 401916 - RNA, 22 nt, Human
aaacaaaacaaaacaaaacaaa

SEQ ID NO: 401917 - RNA, 21 nt, Human
aacaaaaacaaaaaaaacugc

SEQ ID NO: 401918 - RNA, 19 nt, Human
aagugggguuggaaggcga

SEQ ID NO: 401919 - RNA, 21 nt, Human
acaaaaacaaaaaaaacugcu

SEQ ID NO: 401920 - RNA, 19 nt, Human
acaaaacaaaaacaaaaaa

SEQ ID NO: 401921 - RNA, 26 nt, Human
acaaaacaaaaacaaaaaaaacugcu

SEQ ID NO: 401922 - RNA, 24 nt, Human
acaaaacaaaacaaaaacaaaaaa

SEQ ID NO: 401923 - RNA, 23 nt, Human
acaaaacaaaacaaaacaaaaac

SEQ ID NO: 401924 - RNA, 19 nt, Human
acacccaaaacgggcauga

SEQ ID NO: 401925 - RNA, 18 nt, Human
aggcauagcgucccucau

SEQ ID NO: 401926 - RNA, 20 nt, Human
aggcauagcgucccucaucc

SEQ ID NO: 401927 - RNA, 25 nt, Human
caaaaacaaaaaaaacugcuuaugc

SEQ ID NO: 401928 - RNA, 25 nt, Human
caaaacaaaaacaaaaaaaacugcu

SEQ ID NO: 401929 - RNA, 24 nt, Human
caaaacaaaacaaaaacaaaaaaa

SEQ ID NO: 401930 - RNA, 25 nt, Human
caaaacaaaacaaaaacaaaaaaaa

SEQ ID NO: 401931 - RNA, 22 nt, Human
caaaacaaaacaaaacaaaaac

SEQ ID NO: 401932 - RNA, 19 nt, Human
caaguaggcggcugcuagc

SEQ ID NO: 401933 - RNA, 20 nt, Human
cacagcuccagcugaaggcc

SEQ ID NO: 401934 - RNA, 20 nt, Human
cacccaaaacgggcaugagg

SEQ ID NO: 401935 - RNA, 21 nt, Human
cagcugagaaaagcuauguac

SEQ ID NO: 401936 - RNA, 24 nt, Human
caggggcccccgagcagccuugcu

SEQ ID NO: 401937 - RNA, 21 nt, Human
ccaaaacgggcaugaggcaua

SEQ ID NO: 401938 - RNA, 21 nt, Human
cccccgagcagccuugcuggu

SEQ ID NO: 401939 - RNA, 22 nt, Human
ccccuccucucugcuuuaauuu

SEQ ID NO: 401940 - RNA, 24 nt, Human
cccucauccucgcaaaccacccac

SEQ ID NO: 401941 - RNA, 20 nt, Human
cccuccucucugcuuuaauu

SEQ ID NO: 401942 - RNA, 22 nt, Human
ccugcaggaccccuccuuucca

SEQ ID NO: 401943 - RNA, 22 nt, Human
ccuggucccagugaucucuccc

SEQ ID NO: 401944 - RNA, 25 nt, Human
cgagcagccuugcuggugaggacac

SEQ ID NO: 401945 - RNA, 23 nt, Human
cgccccugccuuaggacaguuca

SEQ ID NO: 401946 - RNA, 18 nt, Human
cuccagcugaaggcccca

SEQ ID NO: 401947 - RNA, 20 nt, Human
cuuuccagaaaaaagugggg

SEQ ID NO: 401948 - RNA, 23 nt, Human
gagaaaagcuauguacaucgagg

SEQ ID NO: 401949 - RNA, 20 nt, Human
gagcccacggcgcaccucuc

SEQ ID NO: 401950 - RNA, 20 nt, Human
gcucagggcaguguggcagc

SEQ ID NO: 401951 - RNA, 19 nt, Human
ggcaguguggcagcggcag

SEQ ID NO: 401952 - RNA, 25 nt, Human
gggcaguguggcagcggccgggccc

SEQ ID NO: 401953 - RNA, 19 nt, Human
gggcauagagaucacggcc

SEQ ID NO: 401954 - RNA, 24 nt, Human
gggcucagggcaguguggcagcgg

SEQ ID NO: 401955 - RNA, 23 nt, Human
gugcuggggcuucccgggacucg

SEQ ID NO: 401956 - RNA, 24 nt, Human
uaaaaacaaaacaaaacaaaacaa

SEQ ID NO: 401957 - RNA, 25 nt, Human
uacaaaaguccacagcuccagcuga

SEQ ID NO: 401958 - RNA, 18 nt, Human
ucacggccuggucccagu

SEQ ID NO: 401959 - RNA, 28 nt, Human
ucccagugaucucuccccuccucucugc

SEQ ID NO: 401960 - RNA, 18 nt, Human
uccgugcucgccccugcc

SEQ ID NO: 401961 - RNA, 20 nt, Human
uccucgcaaaccacccacuc

SEQ ID NO: 401962 - RNA, 23 nt, Human
ucucuggacugaggcuccaguuc

SEQ ID NO: 401963 - RNA, 26 nt, Human
ucuggccuuugggguucaagaucacu

SEQ ID NO: 401964 - RNA, 19 nt, Human
ugccuuaggacaguucagc

SEQ ID NO: 401965 - RNA, 21 nt, Human
ugccuuggggugacaguugag

SEQ ID NO: 401966 - RNA, 19 nt, Human
ugggguuggaaggcgaucu

SEQ ID NO: 401967 - RNA, 22 nt, Human
uguccaggacgucccaagugcc

SEQ ID NO: 401968 - RNA, 20 nt, Human
uguggcagcggcagugcugg

SEQ ID NO: 401969 - RNA, 26 nt, Human
uuaaaaacaaaacaaaacaaaacaaa

SEQ ID NO: 401970 - RNA, 24 nt, Human
uuaguguaacaugauugauuuaaa

SEQ ID NO: 401971 - RNA, 19 nt, Human
uugccccugcaggaccccu

SEQ ID NO: 401972 - RNA, 25 nt, Human
aaaacccaagggcuccagaagccag

SEQ ID NO: 401973 - RNA, 20 nt, Human
aaaaggacaaguuagcauuu

SEQ ID NO: 401974 - RNA, 22 nt, Human
aaacaaacaaacaaaaaaccca

SEQ ID NO: 401975 - RNA, 19 nt, Human
aaacaaacaaacaaacaaa

SEQ ID NO: 401976 - RNA, 24 nt, Human
aaagugcugggaucauaggcguga

SEQ ID NO: 401977 - RNA, 23 nt, Human
aacaaacaaacaaacaaacaaac

SEQ ID NO: 401978 - RNA, 23 nt, Human
aacaaacaaacaaacaaacaaac

SEQ ID NO: 401979 - RNA, 18 nt, Human
aacagguuuauugauaag

SEQ ID NO: 401980 - RNA, 20 nt, Human
aacccaagggcuccagaagc

SEQ ID NO: 401981 - RNA, 24 nt, Human
aaccucaggugauccacccgccuc

SEQ ID NO: 401982 - RNA, 19 nt, Human
aaccuggccagucccagca

SEQ ID NO: 401983 - RNA, 29 nt, Human
aagccagagcugggcagagcccaggggga

SEQ ID NO: 401984 - RNA, 21 nt, Human
aaggccccacagagucuccaa

SEQ ID NO: 401985 - RNA, 19 nt, Human
aagugcugggaucauaggc

SEQ ID NO: 401986 - RNA, 26 nt, Human
aagugcugggaucauaggcgugagcc

SEQ ID NO: 401987 - RNA, 24 nt, Human
acaaacaaacaaaaaacccaaggg

SEQ ID NO: 401988 - RNA, 24 nt, Human
acaaacaaacaaacaaacaaaaaa

SEQ ID NO: 401989 - RNA, 22 nt, Human
acacagacgcagacacaagacu

SEQ ID NO: 401990 - RNA, 18 nt, Human
acagcccacaccggccug

SEQ ID NO: 401991 - RNA, 23 nt, Human
accaaaguggcagggcagcccgg

SEQ ID NO: 401992 - RNA, 20 nt, Human
accauguuggccaggcuggu

SEQ ID NO: 401993 - RNA, 23 nt, Human
accauguuggccaggcuggucuc

SEQ ID NO: 401994 - RNA, 24 nt, Human
accauguuggccaggcuggucucg

SEQ ID NO: 401995 - RNA, 25 nt, Human
acccgccucagccucccaaagugcu

SEQ ID NO: 401996 - RNA, 25 nt, Human
acucuguugcucaggcuggagugua

SEQ ID NO: 401997 - RNA, 21 nt, Human
agagacagggucucacucugu

SEQ ID NO: 401998 - RNA, 23 nt, Human
agcaaggaaggaggcgcggggcc

SEQ ID NO: 401999 - RNA, 22 nt, Human
agcagucugacuuuuuuuuucu

SEQ ID NO: 402000 - RNA, 22 nt, Human
agccagagcugggcagagccca

SEQ ID NO: 402001 - RNA, 19 nt, Human
agccaggcuggcaggugca

SEQ ID NO: 402002 - RNA, 23 nt, Human
agccucaggcuucugaguagcug

SEQ ID NO: 402003 - RNA, 21 nt, Human
agcuaacuugaaggacccccu

SEQ ID NO: 402004 - RNA, 22 nt, Human
aggaacuuggcccagaaagagc

SEQ ID NO: 402005 - RNA, 21 nt, Human
aggaagccugagguucuccca

SEQ ID NO: 402006 - RNA, 21 nt, Human
aggaauugaagguggggagug

SEQ ID NO: 402007 - RNA, 25 nt, Human
aggaccccguucccuacagggcugc

SEQ ID NO: 402008 - RNA, 19 nt, Human
aggcgugagccacugcacc

SEQ ID NO: 402009 - RNA, 22 nt, Human
aggcugcggcuguggagggcac

SEQ ID NO: 402010 - RNA, 25 nt, Human
aggcuggagugcaguggcgugaucu

SEQ ID NO: 402011 - RNA, 19 nt, Human
aggcuggcaggugcagcug

SEQ ID NO: 402012 - RNA, 24 nt, Human
agggggagaaacaaacaaacaaac

SEQ ID NO: 402013 - RNA, 24 nt, Human
aggugauccacccgccucagccuc

SEQ ID NO: 402014 - RNA, 20 nt, Human
aggugcccgccaccacgccc

SEQ ID NO: 402015 - RNA, 21 nt, Human
aggugcccgccaccacgcccg

SEQ ID NO: 402016 - RNA, 18 nt, Human
agguggggaguggggaag

SEQ ID NO: 402017 - RNA, 22 nt, Human
agguggggaguggggaagagga

SEQ ID NO: 402018 - RNA, 18 nt, Human
aguagcugggacuauagg

SEQ ID NO: 402019 - RNA, 19 nt, Human
agugcaguggcgugaucuc

SEQ ID NO: 402020 - RNA, 20 nt, Human
agugcaguggcgugaucucg

SEQ ID NO: 402021 - RNA, 23 nt, Human
agugcaguggcgugaucucggcu

SEQ ID NO: 402022 - RNA, 24 nt, Human
agugcaguggcgugaucucggcuc

SEQ ID NO: 402023 - RNA, 21 nt, Human
aguguaguggcgcgaucauag

SEQ ID NO: 402024 - RNA, 24 nt, Human
aguguaguggcgcgaucauagcuc

SEQ ID NO: 402025 - RNA, 18 nt, Human
auagcucgcugcagccuc

SEQ ID NO: 402026 - RNA, 18 nt, Human
aucauagcucgcugcagc

SEQ ID NO: 402027 - RNA, 23 nt, Human
augcuccugagacugagccuuuc

SEQ ID NO: 402028 - RNA, 24 nt, Human
augcuccugagacugagccuuucc

SEQ ID NO: 402029 - RNA, 23 nt, Human
augggguuuuaccauguuggcca

SEQ ID NO: 402030 - RNA, 24 nt, Human
augggguuuuaccauguuggccag

SEQ ID NO: 402031 - RNA, 21 nt, Human
caaaaaacccaagggcuccag

SEQ ID NO: 402032 - RNA, 30 nt, Human
caaacuccugggcuccagugauccucccuc

SEQ ID NO: 402033 - RNA, 24 nt, Human
caaagugcugggaucauaggcgug

SEQ ID NO: 402034 - RNA, 19 nt, Human
caacaauuuaucacccugc

SEQ ID NO: 402035 - RNA, 23 nt, Human
cacacacccacgacacgcaacac

SEQ ID NO: 402036 - RNA, 21 nt, Human
cacagagccccaggaccaucc

SEQ ID NO: 402037 - RNA, 22 nt, Human
cacagagccccaggaccauccc

SEQ ID NO: 402038 - RNA, 18 nt, Human
caccauggcagcagaggc

SEQ ID NO: 402039 - RNA, 20 nt, Human
caccaugguacaaaaggaca

SEQ ID NO: 402040 - RNA, 23 nt, Human
cacccgccucagccucccaaagu

SEQ ID NO: 402041 - RNA, 22 nt, Human
caccuccucccuacacagagcc

SEQ ID NO: 402042 - RNA, 22 nt, Human
cacgacacgcaacacagacgca

SEQ ID NO: 402043 - RNA, 24 nt, Human
cacucuguugcucaggcuggagug

SEQ ID NO: 402044 - RNA, 24 nt, Human
cagagcugggcagagcccaggggg

SEQ ID NO: 402045 - RNA, 26 nt, Human
cagagucuccaaauucaucgcuuccc

SEQ ID NO: 402046 - RNA, 23 nt, Human
cagccucaaacuccugggcucca

SEQ ID NO: 402047 - RNA, 18 nt, Human
cagccuccugaguacagg

SEQ ID NO: 402048 - RNA, 22 nt, Human
caggagccccucaaccugcuuc

SEQ ID NO: 402049 - RNA, 22 nt, Human
cagggcucagcccaccuuggcu

SEQ ID NO: 402050 - RNA, 24 nt, Human
cagggcucagcccaccuuggcuac

SEQ ID NO: 402051 - RNA, 21 nt, Human
caggucacagagagucaggga

SEQ ID NO: 402052 - RNA, 25 nt, Human
cagucugacuuuuuuuuucuuuaag

SEQ ID NO: 402053 - RNA, 24 nt, Human
cauguuggccaggcuggucucgaa

SEQ ID NO: 402054 - RNA, 22 nt, Human
ccaaagugcugggaucauaggc

SEQ ID NO: 402055 - RNA, 24 nt, Human
ccaaagugcugggaucauaggcgu

SEQ ID NO: 402056 - RNA, 26 nt, Human
ccacccgccucagccucccaaagugc

SEQ ID NO: 402057 - RNA, 19 nt, Human
ccacugcaccuggccugag

SEQ ID NO: 402058 - RNA, 19 nt, Human
ccacugcaccuggccugag

SEQ ID NO: 402059 - RNA, 21 nt, Human
ccacugcaccuggccugaggu

SEQ ID NO: 402060 - RNA, 23 nt, Human
ccacugcaccuggccugagguga

SEQ ID NO: 402061 - RNA, 25 nt, Human
ccaggagccccucaaccugcuuccu

SEQ ID NO: 402062 - RNA, 23 nt, Human
ccagggcucagcccaccuuggcu

SEQ ID NO: 402063 - RNA, 25 nt, Human
ccagugauccuccccucagccuccu

SEQ ID NO: 402064 - RNA, 21 nt, Human
cccacagagucuccaaauuca

SEQ ID NO: 402065 - RNA, 19 nt, Human
cccagcaugccccgaacgu

SEQ ID NO: 402066 - RNA, 18 nt, Human
ccccacagagucuccaaa

SEQ ID NO: 402067 - RNA, 23 nt, Human
ccccacagagucuccaaauucau

SEQ ID NO: 402068 - RNA, 21 nt, Human
cccccugcccucgcgcccucg

SEQ ID NO: 402069 - RNA, 18 nt, Human
cccucgcagcccagcgcc

SEQ ID NO: 402070 - RNA, 24 nt, Human
cccucgcagcccagcgccuucucu

SEQ ID NO: 402071 - RNA, 24 nt, Human
ccgccucagccucccaaagugcug

SEQ ID NO: 402072 - RNA, 18 nt, Human
ccggagugaaggcggagg

SEQ ID NO: 402073 - RNA, 22 nt, Human
ccuaaccucaggugauccaccc

SEQ ID NO: 402074 - RNA, 23 nt, Human
ccuaaccucaggugauccacccg

SEQ ID NO: 402075 - RNA, 19 nt, Human
ccucagaguccuaguggug

SEQ ID NO: 402076 - RNA, 20 nt, Human
ccucagccuccugaguacag

SEQ ID NO: 402077 - RNA, 22 nt, Human
ccugcaaccuccgcuucccggg

SEQ ID NO: 402078 - RNA, 20 nt, Human
ccugggcuccagugauccuc

SEQ ID NO: 402079 - RNA, 22 nt, Human
ccugggcuccagugauccuccc

SEQ ID NO: 402080 - RNA, 24 nt, Human
cgcccaggcuggagugcaguggcg

SEQ ID NO: 402081 - RNA, 22 nt, Human
cgcccucgcgcccucgcagccc

SEQ ID NO: 402082 - RNA, 20 nt, Human
cgcuccaucauguccucaug

SEQ ID NO: 402083 - RNA, 25 nt, Human
cggagggugcaaauggcaggugggg

SEQ ID NO: 402084 - RNA, 24 nt, Human
cggggcugcaggcacaccggagug

SEQ ID NO: 402085 - RNA, 19 nt, Human
cgguugcccccugcccucg

SEQ ID NO: 402086 - RNA, 18 nt, Human
cuaggacagcaaggaagg

SEQ ID NO: 402087 - RNA, 23 nt, Human
cucaaacuccugggcuccaguga

SEQ ID NO: 402088 - RNA, 24 nt, Human
cucacucuguugcucaggcuggag

SEQ ID NO: 402089 - RNA, 19 nt, Human
cuccaauaguucagcugcc

SEQ ID NO: 402090 - RNA, 18 nt, Human
cucccaggacuguccacc

SEQ ID NO: 402091 - RNA, 19 nt, Human
cucccaggacuguccacca

SEQ ID NO: 402092 - RNA, 19 nt, Human
cuccucccuacacagagcc

SEQ ID NO: 402093 - RNA, 23 nt, Human
cuccucccuacacagagccccag

SEQ ID NO: 402094 - RNA, 28 nt, Human
cuccucuccagaaagccccucugcagaa

SEQ ID NO: 402095 - RNA, 20 nt, Human
cuccugagcuaacuugaagg

SEQ ID NO: 402096 - RNA, 23 nt, Human
cuccugggcuccagugauccucc

SEQ ID NO: 402097 - RNA, 24 nt, Human
cucgcucugucgcccaggcuggag

SEQ ID NO: 402098 - RNA, 21 nt, Human
cucgcugcagccucaaacucc

SEQ ID NO: 402099 - RNA, 20 nt, Human
cucugucgcccaggcuggag

SEQ ID NO: 402100 - RNA, 23 nt, Human
cugcaaccuccgcuucccggguu

SEQ ID NO: 402101 - RNA, 24 nt, Human
cugcaaccuccgcuucccggguuc

SEQ ID NO: 402102 - RNA, 23 nt, Human
cugcagccucaaacuccugggcu

SEQ ID NO: 402103 - RNA, 18 nt, Human
cugggcagagcccagggg

SEQ ID NO: 402104 - RNA, 19 nt, Human
cugggcccucugggcaucu

SEQ ID NO: 402105 - RNA, 23 nt, Human
cuguauuuuuaguagagaugggg

SEQ ID NO: 402106 - RNA, 19 nt, Human
cuguugcucaggcuggagu

SEQ ID NO: 402107 - RNA, 20 nt, Human
cuuggcuacacacacccacg

SEQ ID NO: 402108 - RNA, 18 nt, Human
gagaugggguuuuaccau

SEQ ID NO: 402109 - RNA, 18 nt, Human
gaucauaggcgugagcca

SEQ ID NO: 402110 - RNA, 22 nt, Human
gaucauaggcgugagccacugc

SEQ ID NO: 402111 - RNA, 23 nt, Human
gaucauaggcgugagccacugca

SEQ ID NO: 402112 - RNA, 20 nt, Human
gaugccaaggaagccugagg

SEQ ID NO: 402113 - RNA, 23 nt, Human
gauuucccagccucaggcuucug

SEQ ID NO: 402114 - RNA, 23 nt, Human
gcacuagaggaacuuggcccaga

SEQ ID NO: 402115 - RNA, 22 nt, Human
gcaucugacuuucacaccaugg

SEQ ID NO: 402116 - RNA, 19 nt, Human
gcccagcgccuucucucca

SEQ ID NO: 402117 - RNA, 20 nt, Human
gcccaggcuggagugcagug

SEQ ID NO: 402118 - RNA, 24 nt, Human
gcccaggcuggagugcaguggcgu

SEQ ID NO: 402119 - RNA, 25 nt, Human
gccccaggaccaucccgcagucuca

SEQ ID NO: 402120 - RNA, 23 nt, Human
gccucagccucccaaagugcugg

SEQ ID NO: 402121 - RNA, 24 nt, Human
gcggggcugcaggcacaccggagu

SEQ ID NO: 402122 - RNA, 20 nt, Human
gcucagcccaccuuggcuac

SEQ ID NO: 402123 - RNA, 25 nt, Human
gcucugucgcccaggcuggagugca

SEQ ID NO: 402124 - RNA, 19 nt, Human
gcugcagccucaaacuccu

SEQ ID NO: 402125 - RNA, 30 nt, Human
gcugcagccucaaacuccugggcuccaguu

SEQ ID NO: 402126 - RNA, 18 nt, Human
gcugccaagcucaagucc

SEQ ID NO: 402127 - RNA, 19 nt, Human
gcuggagugcaguggcgug

SEQ ID NO: 402128 - RNA, 23 nt, Human
gcuggucucgaacuccuaaccuc

SEQ ID NO: 402129 - RNA, 22 nt, Human
ggaagccugagguucucccagg

SEQ ID NO: 402130 - RNA, 18 nt, Human
ggagccccucaaccugcu

SEQ ID NO: 402131 - RNA, 19 nt, Human
ggaggaggagggucuaggc

SEQ ID NO: 402132 - RNA, 27 nt, Human
ggaggcggugcuuuuuuuuuuuucuuu

SEQ ID NO: 402133 - RNA, 23 nt, Human
ggaguggggaagaggaacccacc

SEQ ID NO: 402134 - RNA, 23 nt, Human
ggaucacacuggccauguaccaa

SEQ ID NO: 402135 - RNA, 19 nt, Human
ggcagcagaggcuuucccc

SEQ ID NO: 402136 - RNA, 21 nt, Human
ggcccagaaagagccucagag

SEQ ID NO: 402137 - RNA, 22 nt, Human
ggcuggagugcaguggcgugau

SEQ ID NO: 402138 - RNA, 23 nt, Human
gggcacuagaggaacuuggccca

SEQ ID NO: 402139 - RNA, 18 nt, Human
gggcagaaaccuggccag

SEQ ID NO: 402140 - RNA, 24 nt, Human
gggcaucugacuuucacaccaugg

SEQ ID NO: 402141 - RNA, 21 nt, Human
gggggaggaggagggucuagg

SEQ ID NO: 402142 - RNA, 22 nt, Human
gggguuuuaccauguuggccag

SEQ ID NO: 402143 - RNA, 21 nt, Human
ggguccgguugcccccugccc

SEQ ID NO: 402144 - RNA, 24 nt, Human
ggucagagggaggcugcggcugug

SEQ ID NO: 402145 - RNA, 22 nt, Human
gguuuccccucugcagggcccu

SEQ ID NO: 402146 - RNA, 23 nt, Human
guagagaugggguuuuaccaugu

SEQ ID NO: 402147 - RNA, 21 nt, Human
gucuccaugguaauggcuggg

SEQ ID NO: 402148 - RNA, 24 nt, Human
gugauccacccgccucagccuccc

SEQ ID NO: 402149 - RNA, 21 nt, Human
gugauccuccccucagccucc

SEQ ID NO: 402150 - RNA, 19 nt, Human
gugcacgucacugcagcca

SEQ ID NO: 402151 - RNA, 21 nt, Human
guggccuaggacagcaaggaa

SEQ ID NO: 402152 - RNA, 26 nt, Human
uaaaacaaacagguuuauugauaagc

SEQ ID NO: 402153 - RNA, 24 nt, Human
uaaccucaggugauccacccgccu

SEQ ID NO: 402154 - RNA, 24 nt, Human
uaauuucuguauuuuuaguagaga

SEQ ID NO: 402155 - RNA, 21 nt, Human
uacacacacccacgacacgca

SEQ ID NO: 402156 - RNA, 21 nt, Human
uaccauguuggccaggcuggu

SEQ ID NO: 402157 - RNA, 24 nt, Human
uaccauguuggccaggcuggucuc

SEQ ID NO: 402158 - RNA, 27 nt, Human
uaccauguuggccaggcuggucucgaa

SEQ ID NO: 402159 - RNA, 18 nt, Human
uacgacacagcccacacc

SEQ ID NO: 402160 - RNA, 23 nt, Human
uacgacacagcccacaccggccu

SEQ ID NO: 402161 - RNA, 22 nt, Human
uagagaugggguuuuaccaugu

SEQ ID NO: 402162 - RNA, 24 nt, Human
uagcucgcugcagccucaaacucc

SEQ ID NO: 402163 - RNA, 19 nt, Human
uaggugcccgccaccacgc

SEQ ID NO: 402164 - RNA, 21 nt, Human
uaggugcccgccaccacgccc

SEQ ID NO: 402165 - RNA, 24 nt, Human
uaguagagaugggguuuuaccaug

SEQ ID NO: 402166 - RNA, 26 nt, Human
uaucuugcccaggccacagcacugaa

SEQ ID NO: 402167 - RNA, 22 nt, Human
ucaacacacacacacaagggaa

SEQ ID NO: 402168 - RNA, 21 nt, Human
ucacaccaugguacaaaagga

SEQ ID NO: 402169 - RNA, 23 nt, Human
ucacagagagucagggacuugcc

SEQ ID NO: 402170 - RNA, 18 nt, Human
ucacugcagccagccagu

SEQ ID NO: 402171 - RNA, 19 nt, Human
ucagccuccugaguacagg

SEQ ID NO: 402172 - RNA, 25 nt, Human
ucaugccuucuccuuuauccccccu

SEQ ID NO: 402173 - RNA, 22 nt, Human
uccaagccuccugagcuaacuu

SEQ ID NO: 402174 - RNA, 21 nt, Human
uccacccgccucagccuccca

SEQ ID NO: 402175 - RNA, 24 nt, Human
ucccaaagugcugggaucauaggc

SEQ ID NO: 402176 - RNA, 21 nt, Human
ucccagaauccgggcaaggcu

SEQ ID NO: 402177 - RNA, 19 nt, Human
ucccagccucaggcuucug

SEQ ID NO: 402178 - RNA, 26 nt, Human
ucccgcagucucagccucaggagacu

SEQ ID NO: 402179 - RNA, 18 nt, Human
ucccggguucaaacgauu

SEQ ID NO: 402180 - RNA, 19 nt, Human
ucccggguucaaacgauuu

SEQ ID NO: 402181 - RNA, 20 nt, Human
ucccuacagggcugccaccu

SEQ ID NO: 402182 - RNA, 23 nt, Human
ucccugaaaggagaugguguggc

SEQ ID NO: 402183 - RNA, 24 nt, Human
ucccugaaaggagaugguguggcc

SEQ ID NO: 402184 - RNA, 21 nt, Human
ucccugcaaccuccgcuuccc

SEQ ID NO: 402185 - RNA, 24 nt, Human
ucccugcaaccuccgcuucccggg

SEQ ID NO: 402186 - RNA, 25 nt, Human
ucccugcaaccuccgcuucccgggu

SEQ ID NO: 402187 - RNA, 23 nt, Human
uccugagcuaacuugaaggaccc

SEQ ID NO: 402188 - RNA, 24 nt, Human
uccugagcuaacuugaaggacccc

SEQ ID NO: 402189 - RNA, 21 nt, Human
uccugggcuccagugauccuc

SEQ ID NO: 402190 - RNA, 24 nt, Human
ucgcccaggcuggagugcaguggc

SEQ ID NO: 402191 - RNA, 24 nt, Human
ucgcucugucgcccaggcuggagu

SEQ ID NO: 402192 - RNA, 24 nt, Human
ucgcugcagccucaaacuccuggg

SEQ ID NO: 402193 - RNA, 19 nt, Human
ucucacucuguugcucagg

SEQ ID NO: 402194 - RNA, 23 nt, Human
ucucacucuguugcucaggcugg

SEQ ID NO: 402195 - RNA, 24 nt, Human
ucucacucuguugcucaggcugga

SEQ ID NO: 402196 - RNA, 19 nt, Human
ucucgcucugucgcccagg

SEQ ID NO: 402197 - RNA, 23 nt, Human
ucucgcucugucgcccaggcugg

SEQ ID NO: 402198 - RNA, 24 nt, Human
ucucgcucugucgcccaggcugga

SEQ ID NO: 402199 - RNA, 26 nt, Human
ucucgcucugucgcccaggcuggagu

SEQ ID NO: 402200 - RNA, 27 nt, Human
ucucgcucugucgcccaggcuggagug

SEQ ID NO: 402201 - RNA, 22 nt, Human
ucugaguagcugggacuauagg

SEQ ID NO: 402202 - RNA, 24 nt, Human
ucugaguagcugggacuauaggug

SEQ ID NO: 402203 - RNA, 25 nt, Human
ucugcagaaaaggaugcugggguuu

SEQ ID NO: 402204 - RNA, 24 nt, Human
ucugucgcccaggcuggagugcag

SEQ ID NO: 402205 - RNA, 24 nt, Human
ucuguugcucaggcuggaguguag

SEQ ID NO: 402206 - RNA, 22 nt, Human
ugagacagacucucgcucuguc

SEQ ID NO: 402207 - RNA, 22 nt, Human
ugagcuaacuugaaggaccccg

SEQ ID NO: 402208 - RNA, 20 nt, Human
ugaguacaggugcacgucac

SEQ ID NO: 402209 - RNA, 21 nt, Human
ugcaaacuuucauugucuugg

SEQ ID NO: 402210 - RNA, 22 nt, Human
ugcaguggcgugaucucggcuc

SEQ ID NO: 402211 - RNA, 20 nt, Human
ugcccaggccacagcacuga

SEQ ID NO: 402212 - RNA, 22 nt, Human
ugcccccugcccucgcgcccuc

SEQ ID NO: 402213 - RNA, 24 nt, Human
ugcgcuccaucauguccucaugug

SEQ ID NO: 402214 - RNA, 20 nt, Human
ugcucaggcuggaguguagu

SEQ ID NO: 402215 - RNA, 22 nt, Human
ugcucaggcuggaguguagugg

SEQ ID NO: 402216 - RNA, 24 nt, Human
ugcucaggcuggaguguaguggcg

SEQ ID NO: 402217 - RNA, 22 nt, Human
uggaagccagagcugggcagag

SEQ ID NO: 402218 - RNA, 19 nt, Human
uggagugcaguggcgugau

SEQ ID NO: 402219 - RNA, 23 nt, Human
uggagugcaguggcgugaucucg

SEQ ID NO: 402220 - RNA, 24 nt, Human
uggagugcaguggcgugaucucgg

SEQ ID NO: 402221 - RNA, 21 nt, Human
uggcaggugggggguuggaug

SEQ ID NO: 402222 - RNA, 24 nt, Human
uggccaggcuggucucgaacuccu

SEQ ID NO: 402223 - RNA, 20 nt, Human
uggcccagaaagagccucag

SEQ ID NO: 402224 - RNA, 20 nt, Human
uggccugccugggcccucug

SEQ ID NO: 402225 - RNA, 23 nt, Human
uggcuggcagaguuuggcuuugu

SEQ ID NO: 402226 - RNA, 21 nt, Human
ugggacuauaggugcccgcca

SEQ ID NO: 402227 - RNA, 22 nt, Human
ugggacuauaggugcccgccac

SEQ ID NO: 402228 - RNA, 24 nt, Human
ugggacuauaggugcccgccacca

SEQ ID NO: 402229 - RNA, 19 nt, Human
ugggaucauaggcgugagc

SEQ ID NO: 402230 - RNA, 21 nt, Human
ugggaucauaggcgugagcca

SEQ ID NO: 402231 - RNA, 22 nt, Human
ugggaucauaggcgugagccac

SEQ ID NO: 402232 - RNA, 22 nt, Human
ugggaucauaggcgugagccac

SEQ ID NO: 402233 - RNA, 24 nt, Human
ugggaucauaggcgugagccacug

SEQ ID NO: 402234 - RNA, 19 nt, Human
ugggggaggaggagggucu

SEQ ID NO: 402235 - RNA, 24 nt, Human
ugggguuuuaccauguuggccagg

SEQ ID NO: 402236 - RNA, 18 nt, Human
uuaguagagaugggguuu

SEQ ID NO: 402237 - RNA, 22 nt, Human
uuaguagagaugggguuuuacc

SEQ ID NO: 402238 - RNA, 24 nt, Human
uuaguagagaugggguuuuaccau

SEQ ID NO: 402239 - RNA, 24 nt, Human
uucuaguuagaagugcguuaucuu

SEQ ID NO: 402240 - RNA, 19 nt, Human
uucuccuuuauccccaugc

SEQ ID NO: 402241 - RNA, 21 nt, Human
uucuccuuuauccccaugcuc

SEQ ID NO: 402242 - RNA, 20 nt, Human
uucuguauuuuuaguagaga

SEQ ID NO: 402243 - RNA, 24 nt, Human
uugcucaggcuggaguguaguggc

SEQ ID NO: 402244 - RNA, 18 nt, Human
uuuccaagccuccugagc

SEQ ID NO: 402245 - RNA, 20 nt, Human
uuucuguauuuuuaguagag

SEQ ID NO: 402246 - RNA, 21 nt, Human
uuuuuaguagagaugggguuu

SEQ ID NO: 402247 - RNA, 25 nt, Human
uuuuuuucuuuugagacagacucuc

SEQ ID NO: 402248 - RNA, 29 nt, Human
uuuuuuuucuuuaagagacagggucucaa

SEQ ID NO: 402249 - RNA, 24 nt, Human
uuuuuuuuucuuuaagagacaggg

SEQ ID NO: 402250 - RNA, 18 nt, Human
uuuuuuuuuuuucuuuug

SEQ ID NO: 402251 - RNA, 23 nt, Human
aaacagcaaguacugugggucug

SEQ ID NO: 402252 - RNA, 27 nt, Human
aagaguaguggggggaaaccgguaccc

SEQ ID NO: 402253 - RNA, 21 nt, Human
acauacagugccgccaccagc

SEQ ID NO: 402254 - RNA, 21 nt, Human
accugaaggguacaucuuaac

SEQ ID NO: 402255 - RNA, 21 nt, Human
agaguaguggggggaaacagg

SEQ ID NO: 402256 - RNA, 20 nt, Human
aggaaaucaaggaccuaaaa

SEQ ID NO: 402257 - RNA, 21 nt, Human
aggaaaucaaggaccuaaaac

SEQ ID NO: 402258 - RNA, 18 nt, Human
caagguggacgcugggcc

SEQ ID NO: 402259 - RNA, 26 nt, Human
cacccuggccaagaucugaccugggc

SEQ ID NO: 402260 - RNA, 18 nt, Human
cagcccccugagcccugu

SEQ ID NO: 402261 - RNA, 22 nt, Human
ccagcccccugagcccugucuc

SEQ ID NO: 402262 - RNA, 20 nt, Human
ccccacuccacccuggccaa

SEQ ID NO: 402263 - RNA, 20 nt, Human
cccccugagcccugucucca

SEQ ID NO: 402264 - RNA, 20 nt, Human
ccccgcccagcagacccucc

SEQ ID NO: 402265 - RNA, 21 nt, Human
ccgaagucauggccgucaugc

SEQ ID NO: 402266 - RNA, 24 nt, Human
ccgaagucauggccgucaugccca

SEQ ID NO: 402267 - RNA, 22 nt, Human
ccugucuccacaaauuuggaag

SEQ ID NO: 402268 - RNA, 24 nt, Human
cgcugggccccgcccagcagaccc

SEQ ID NO: 402269 - RNA, 25 nt, Human
cggggcccagcguccaccuuggugg

SEQ ID NO: 402270 - RNA, 25 nt, Human
cugggcccaccaagguggacgcugg

SEQ ID NO: 402271 - RNA, 19 nt, Human
gacgcugggccccgcccag

SEQ ID NO: 402272 - RNA, 19 nt, Human
gcugggccccacuccaccc

SEQ ID NO: 402273 - RNA, 21 nt, Human
gggcuccagccuggcggggcc

SEQ ID NO: 402274 - RNA, 21 nt, Human
ggggcccagcguccaccuugg

SEQ ID NO: 402275 - RNA, 21 nt, Human
uacugugggucugauaccagg

SEQ ID NO: 402276 - RNA, 22 nt, Human
uacugugggucugauaccaggu

SEQ ID NO: 402277 - RNA, 21 nt, Human
ucagaaagaucaggaaaucaa

SEQ ID NO: 402278 - RNA, 21 nt, Human
uccgcacugggcgaugcaaag

SEQ ID NO: 402279 - RNA, 20 nt, Human
ucuccacaaauuuggaagag

SEQ ID NO: 402280 - RNA, 21 nt, Human
uggacgcugggccccgcccag

SEQ ID NO: 402281 - RNA, 21 nt, Human
uggcggggcccagcguccacc

SEQ ID NO: 402282 - RNA, 21 nt, Human
uggggggaaacagggcucagg

SEQ ID NO: 402283 - RNA, 28 nt, Human
uggggggaaacagggcucagggggcugg

SEQ ID NO: 402284 - RNA, 26 nt, Human
uuaacagcauccagaaggcuuucuuu

SEQ ID NO: 402285 - RNA, 25 nt, Human
uucagaaagaucaggaaaucaagga

SEQ ID NO: 402286 - RNA, 18 nt, Human
uucucaaacagcaaguac

SEQ ID NO: 402287 - RNA, 20 nt, Human
uuuggaagaguagugggggg

SEQ ID NO: 402288 - RNA, 21 nt, Human
uuuggaagaguagugggggga

SEQ ID NO: 402289 - RNA, 25 nt, Human
uuuuuuuuugaccuuuuuguuuuuu

SEQ ID NO: 402290 - RNA, 24 nt, Human
caaggugaacuguuucugcaucca

SEQ ID NO: 402291 - RNA, 18 nt, Human
cccacguggccacacucc

SEQ ID NO: 402292 - RNA, 24 nt, Human
cgcccgagcgaggccucugcugac

SEQ ID NO: 402293 - RNA, 20 nt, Human
cugccuguuugcccacgugg

SEQ ID NO: 402294 - RNA, 18 nt, Human
gagcuaugcccagucagu

SEQ ID NO: 402295 - RNA, 21 nt, Human
gaggugagaccaggcggcagg

SEQ ID NO: 402296 - RNA, 21 nt, Human
gagguucuucaaggugaacug

SEQ ID NO: 402297 - RNA, 23 nt, Human
gcagcagcaccaggcucucuggc

SEQ ID NO: 402298 - RNA, 19 nt, Human
gccacagcagcagcagcac

SEQ ID NO: 402299 - RNA, 22 nt, Human
ggggagcuaugcccagucagug

SEQ ID NO: 402300 - RNA, 24 nt, Human
ggggugcaggcagaagcggggagc

SEQ ID NO: 402301 - RNA, 22 nt, Human
guggccacacuccugggugggu

SEQ ID NO: 402302 - RNA, 23 nt, Human
ugcaggggugcaggcagaagcgg

SEQ ID NO: 402303 - RNA, 25 nt, Human
uuuuuuuucugccucugucuuuaau

SEQ ID NO: 402304 - RNA, 18 nt, Human
uuuuuuuuuuuuuuucug

SEQ ID NO: 402305 - RNA, 21 nt, Human
uuuuuuuuuuuuuuucugccu

SEQ ID NO: 402306 - RNA, 23 nt, Human
aaacacaaggggcaaaaaaaucc

SEQ ID NO: 402307 - RNA, 21 nt, Human
aaccaagcaguauuuacagcc

SEQ ID NO: 402308 - RNA, 18 nt, Human
aagagcaauuccuaaauc

SEQ ID NO: 402309 - RNA, 21 nt, Human
aagcugccauuuguagcaggu

SEQ ID NO: 402310 - RNA, 18 nt, Human
aaggaagccucgcugggg

SEQ ID NO: 402311 - RNA, 21 nt, Human
aaguuuguuuucccaacuaga

SEQ ID NO: 402312 - RNA, 19 nt, Human
aauacucuccugcucaaaa

SEQ ID NO: 402313 - RNA, 20 nt, Human
acucguaaaccgcuucccuc

SEQ ID NO: 402314 - RNA, 21 nt, Human
acucguaaaccgcuucccuca

SEQ ID NO: 402315 - RNA, 22 nt, Human
agccuuauuuaaauucugcacu

SEQ ID NO: 402316 - RNA, 22 nt, Human
aggcaaaaauggagagguggca

SEQ ID NO: 402317 - RNA, 25 nt, Human
aggcaaaaauggagagguggcaaag

SEQ ID NO: 402318 - RNA, 20 nt, Human
aguagguaguuuugagccag

SEQ ID NO: 402319 - RNA, 21 nt, Human
aguagguaguuuugagccagu

SEQ ID NO: 402320 - RNA, 18 nt, Human
auagacauuuguacuaac

SEQ ID NO: 402321 - RNA, 22 nt, Human
caaagcucuaguaauacucucc

SEQ ID NO: 402322 - RNA, 22 nt, Human
cacucuugcgcgagaucagaga

SEQ ID NO: 402323 - RNA, 23 nt, Human
ccaaaccaggcuagaauuucuaa

SEQ ID NO: 402324 - RNA, 22 nt, Human
ccugggcagccagggcuggccu

SEQ ID NO: 402325 - RNA, 20 nt, Human
cgccugggcagccagggcug

SEQ ID NO: 402326 - RNA, 22 nt, Human
cgguggucaggaggaugggaag

SEQ ID NO: 402327 - RNA, 22 nt, Human
cuaauaaaugauaaaauguacc

SEQ ID NO: 402328 - RNA, 20 nt, Human
cuuaaaucuuagaaacuugg

SEQ ID NO: 402329 - RNA, 23 nt, Human
gaaguuuguuuucccaacuagau

SEQ ID NO: 402330 - RNA, 23 nt, Human
gacaagagcaauuccuaaaucca

SEQ ID NO: 402331 - RNA, 20 nt, Human
gggaacgcccggguugggga

SEQ ID NO: 402332 - RNA, 25 nt, Human
gggcagccagggcuggccucagggu

SEQ ID NO: 402333 - RNA, 21 nt, Human
gggggugggggaaaaauaaga

SEQ ID NO: 402334 - RNA, 22 nt, Human
guaaaaugcauacacauauaua

SEQ ID NO: 402335 - RNA, 21 nt, Human
guaauacucuccugcucaaaa

SEQ ID NO: 402336 - RNA, 22 nt, Human
guagagccuuauuuaaauucug

SEQ ID NO: 402337 - RNA, 19 nt, Human
uaaaaucucuagaauuauc

SEQ ID NO: 402338 - RNA, 23 nt, Human
uaagaugagcaccaaggcaaaaa

SEQ ID NO: 402339 - RNA, 24 nt, Human
uaagggcagucuugccuuuuggug

SEQ ID NO: 402340 - RNA, 21 nt, Human
uaggugguuccagguaucugc

SEQ ID NO: 402341 - RNA, 24 nt, Human
uaguaaggagaaucuuaaaucuua

SEQ ID NO: 402342 - RNA, 24 nt, Human
uaguaguaaggagaaucuuaaauc

SEQ ID NO: 402343 - RNA, 21 nt, Human
ucagcgcuaauaaaugauaaa

SEQ ID NO: 402344 - RNA, 22 nt, Human
uccaccaacccgcgggagaaga

SEQ ID NO: 402345 - RNA, 18 nt, Human
ucuaagggcagucuugcc

SEQ ID NO: 402346 - RNA, 21 nt, Human
ugaaagagcuuccccaacucc

SEQ ID NO: 402347 - RNA, 22 nt, Human
ugacaccaauaaacugugcaaa

SEQ ID NO: 402348 - RNA, 23 nt, Human
ugauaaaauguacccaguaaaaa

SEQ ID NO: 402349 - RNA, 22 nt, Human
ugcccgccccugaggcuccagc

SEQ ID NO: 402350 - RNA, 19 nt, Human
ugcucaaaaugcuuuugau

SEQ ID NO: 402351 - RNA, 20 nt, Human
uggccugccuguucaguaac

SEQ ID NO: 402352 - RNA, 23 nt, Human
ugggggaaaaauaagaaucuauu

SEQ ID NO: 402353 - RNA, 20 nt, Human
uggguacuuagcaugccacu

SEQ ID NO: 402354 - RNA, 24 nt, Human
uggguacuuagcaugccacugcau

SEQ ID NO: 402355 - RNA, 25 nt, Human
ugucacaaagcuacuuucucugaga

SEQ ID NO: 402356 - RNA, 20 nt, Human
uuaauacaaacuuucaaaga

SEQ ID NO: 402357 - RNA, 22 nt, Human
uucacauuuaauacaaacuuuc

SEQ ID NO: 402358 - RNA, 21 nt, Human
uuggguacuuagcaugccacu

SEQ ID NO: 402359 - RNA, 23 nt, Human
uuuuuggugauauuuccauguuu

SEQ ID NO: 402360 - RNA, 22 nt, Human
uuuuuuuuuuuuuuuuuaccaa

SEQ ID NO: 402361 - RNA, 20 nt, Human
aaacccaccccagaccccaa

SEQ ID NO: 402362 - RNA, 21 nt, Human
aaacccaccccagaccccaag

SEQ ID NO: 402363 - RNA, 18 nt, Human
aagaaaccucauuucuuc

SEQ ID NO: 402364 - RNA, 18 nt, Human
aagaaaccucauuucuuc

SEQ ID NO: 402365 - RNA, 21 nt, Human
aagaccugcaugacgcucugc

SEQ ID NO: 402366 - RNA, 21 nt, Human
aagaccugcaugacgcucugc

SEQ ID NO: 402367 - RNA, 24 nt, Human
aagcacuuucccagaaacccaccc

SEQ ID NO: 402368 - RNA, 24 nt, Human
aagcacuuucccagaaacccaccc

SEQ ID NO: 402369 - RNA, 26 nt, Human
aagcagaaaccagcgugcgcgaagaa

SEQ ID NO: 402370 - RNA, 23 nt, Human
aagccucuccuccuggggucccg

SEQ ID NO: 402371 - RNA, 22 nt, Human
acaaccaguuuuaugaaaaagc

SEQ ID NO: 402372 - RNA, 20 nt, Human
acaugccaccuccuuugccc

SEQ ID NO: 402373 - RNA, 22 nt, Human
acaugccaccuccuuugccccc

SEQ ID NO: 402374 - RNA, 18 nt, Human
acaugcugaaccugugca

SEQ ID NO: 402375 - RNA, 22 nt, Human
acccaccccagaccccaaggua

SEQ ID NO: 402376 - RNA, 22 nt, Human
acccaccccagaccccaaggua

SEQ ID NO: 402377 - RNA, 22 nt, Human
accccagaccccaagguagcuc

SEQ ID NO: 402378 - RNA, 20 nt, Human
accccgaguagccggagagg

SEQ ID NO: 402379 - RNA, 22 nt, Human
acgcagcuucagcugcaaggcc

SEQ ID NO: 402380 - RNA, 24 nt, Human
acgcuccgcuccagcccgggcauc

SEQ ID NO: 402381 - RNA, 26 nt, Human
acgcuccgcuccagcccgggcauccu

SEQ ID NO: 402382 - RNA, 18 nt, Human
acuuccgccccccacuuc

SEQ ID NO: 402383 - RNA, 19 nt, Human
agaaacccaccccagaccc

SEQ ID NO: 402384 - RNA, 19 nt, Human
agaaacccaccccagaccc

SEQ ID NO: 402385 - RNA, 22 nt, Human
agagcguggcugaggggcaggc

SEQ ID NO: 402386 - RNA, 23 nt, Human
agaggcaggcccagauccggucc

SEQ ID NO: 402387 - RNA, 24 nt, Human
agaggcaggcccagauccgguccc

SEQ ID NO: 402388 - RNA, 24 nt, Human
agcagggggaaguccucuggcuuu

SEQ ID NO: 402389 - RNA, 21 nt, Human
agccagugcagcuggugcaca

SEQ ID NO: 402390 - RNA, 25 nt, Human
agccggugcggcagcggcaggcacg

SEQ ID NO: 402391 - RNA, 21 nt, Human
agcugcacgggccuccucccc

SEQ ID NO: 402392 - RNA, 19 nt, Human
agcuggggugccccugugg

SEQ ID NO: 402393 - RNA, 19 nt, Human
agcuggggugccccugugg

SEQ ID NO: 402394 - RNA, 27 nt, Human
aggaaggacgagaucuugcucuggguc

SEQ ID NO: 402395 - RNA, 18 nt, Human
aggcacgguugugggugg

SEQ ID NO: 402396 - RNA, 21 nt, Human
aggcagaaaucuggggucccg

SEQ ID NO: 402397 - RNA, 25 nt, Human
aggccaggagccagggaaguucugg

SEQ ID NO: 402398 - RNA, 18 nt, Human
aggcccagggccgugcag

SEQ ID NO: 402399 - RNA, 19 nt, Human
agggaaguucuggggaagc

SEQ ID NO: 402400 - RNA, 19 nt, Human
agggaaguucuggggaagc

SEQ ID NO: 402401 - RNA, 20 nt, Human
aggggccugguuggggagcc

SEQ ID NO: 402402 - RNA, 20 nt, Human
aggggcucagcuggggugcc

SEQ ID NO: 402403 - RNA, 20 nt, Human
aggggcucagcuggggugcc

SEQ ID NO: 402404 - RNA, 19 nt, Human
agggggaaguccucuggcu

SEQ ID NO: 402405 - RNA, 18 nt, Human
agggugucaugggaggaa

SEQ ID NO: 402406 - RNA, 24 nt, Human
agguagcucagggcuucucagagg

SEQ ID NO: 402407 - RNA, 24 nt, Human
agguagcucagggcuucucagagg

SEQ ID NO: 402408 - RNA, 20 nt, Human
augacgcucugcuuccugga

SEQ ID NO: 402409 - RNA, 20 nt, Human
augacgcucugcuuccugga

SEQ ID NO: 402410 - RNA, 19 nt, Human
caagguagcucagggcuuc

SEQ ID NO: 402411 - RNA, 19 nt, Human
caagguagcucagggcuuc

SEQ ID NO: 402412 - RNA, 24 nt, Human
cacacuccucagcuccugguaccc

SEQ ID NO: 402413 - RNA, 19 nt, Human
cacaggacccugcugugcc

SEQ ID NO: 402414 - RNA, 23 nt, Human
caccccagaccccaagguagcuc

SEQ ID NO: 402415 - RNA, 23 nt, Human
caccccagaccccaagguagcuc

SEQ ID NO: 402416 - RNA, 26 nt, Human
caccgcccgcccccacagucccugcu

SEQ ID NO: 402417 - RNA, 19 nt, Human
caccuccuuugcccccggu

SEQ ID NO: 402418 - RNA, 20 nt, Human
cacgggccuccuccccagag

SEQ ID NO: 402419 - RNA, 25 nt, Human
cacgggccuccuccccagaggcauc

SEQ ID NO: 402420 - RNA, 19 nt, Human
cacugcacuuccgcccccc

SEQ ID NO: 402421 - RNA, 21 nt, Human
cacugcacuuccgccccccac

SEQ ID NO: 402422 - RNA, 19 nt, Human
cacuggcuggcagcagggc

SEQ ID NO: 402423 - RNA, 21 nt, Human
cagaccccaagguagcucagg

SEQ ID NO: 402424 - RNA, 21 nt, Human
cagaccccaagguagcucagg

SEQ ID NO: 402425 - RNA, 22 nt, Human
cagaccccaagguagcucaggg

SEQ ID NO: 402426 - RNA, 22 nt, Human
cagaccccaagguagcucaggg

SEQ ID NO: 402427 - RNA, 22 nt, Human
cagcagccgcugcagccucuug

SEQ ID NO: 402428 - RNA, 18 nt, Human
cagcagcgccccguccug

SEQ ID NO: 402429 - RNA, 18 nt, Human
cagcgccugcagcagccg

SEQ ID NO: 402430 - RNA, 19 nt, Human
cagcgcggacacaggaccc

SEQ ID NO: 402431 - RNA, 18 nt, Human
cagcuuuauuagagagcu

SEQ ID NO: 402432 - RNA, 20 nt, Human
caggagccagggaaguucug

SEQ ID NO: 402433 - RNA, 20 nt, Human
caggagccagggaaguucug

SEQ ID NO: 402434 - RNA, 20 nt, Human
caggaucagugcacagggag

SEQ ID NO: 402435 - RNA, 24 nt, Human
cagugaaccucacuuccaucgccc

SEQ ID NO: 402436 - RNA, 23 nt, Human
cauggccaaaguugucauacacc

SEQ ID NO: 402437 - RNA, 20 nt, Human
ccacucacaggccaggagcu

SEQ ID NO: 402438 - RNA, 20 nt, Human
ccacucacaggccaggagcu

SEQ ID NO: 402439 - RNA, 20 nt, Human
ccacugcacuuccgcccccc

SEQ ID NO: 402440 - RNA, 22 nt, Human
ccacugcacuuccgccccccac

SEQ ID NO: 402441 - RNA, 21 nt, Human
ccagcacccggcacuggcugg

SEQ ID NO: 402442 - RNA, 21 nt, Human
ccaggagccagggaaguucug

SEQ ID NO: 402443 - RNA, 26 nt, Human
ccaugggccccgccugccugaggccu

SEQ ID NO: 402444 - RNA, 26 nt, Human
ccaugggccccgccugccugaggccu

SEQ ID NO: 402445 - RNA, 19 nt, Human
cccacugcacuuccgcccc

SEQ ID NO: 402446 - RNA, 21 nt, Human
ccccagaccccaagguagcuc

SEQ ID NO: 402447 - RNA, 24 nt, Human
ccccagaccccaagguagcucagg

SEQ ID NO: 402448 - RNA, 24 nt, Human
ccccagaccccaagguagcucagg

SEQ ID NO: 402449 - RNA, 22 nt, Human
ccccguccugcgcccccaggag

SEQ ID NO: 402450 - RNA, 24 nt, Human
ccccguccugcgcccccaggagcu

SEQ ID NO: 402451 - RNA, 18 nt, Human
ccccucuccuuccucucc

SEQ ID NO: 402452 - RNA, 18 nt, Human
ccccugauuaaaagugga

SEQ ID NO: 402453 - RNA, 24 nt, Human
ccccuguggcaccacucacaggcc

SEQ ID NO: 402454 - RNA, 24 nt, Human
ccccuguggcaccacucacaggcc

SEQ ID NO: 402455 - RNA, 19 nt, Human
cccgaguagccggagaggc

SEQ ID NO: 402456 - RNA, 24 nt, Human
cccgcaguggucccggcgggccuc

SEQ ID NO: 402457 - RNA, 19 nt, Human
cccgcccccacagucccug

SEQ ID NO: 402458 - RNA, 19 nt, Human
cccgcggaggggguccgcc

SEQ ID NO: 402459 - RNA, 22 nt, Human
cccggcuccugagagcccugac

SEQ ID NO: 402460 - RNA, 21 nt, Human
cccguccugcgcccccaggag

SEQ ID NO: 402461 - RNA, 19 nt, Human
cccugaguccccagcaccc

SEQ ID NO: 402462 - RNA, 18 nt, Human
ccgcaccagcagcgcccc

SEQ ID NO: 402463 - RNA, 24 nt, Human
ccgcaccagcagcgccccguccug

SEQ ID NO: 402464 - RNA, 24 nt, Human
ccgcagggaccaaccaugggcccc

SEQ ID NO: 402465 - RNA, 24 nt, Human
ccgcagggaccaaccaugggcccc

SEQ ID NO: 402466 - RNA, 20 nt, Human
ccgccccccacuuccggucc

SEQ ID NO: 402467 - RNA, 19 nt, Human
ccgcccgcccccacagucc

SEQ ID NO: 402468 - RNA, 24 nt, Human
ccgccgacgcagcuucagcugcaa

SEQ ID NO: 402469 - RNA, 19 nt, Human
ccggggccucgagggccug

SEQ ID NO: 402470 - RNA, 22 nt, Human
ccuauggcacagacugcucacu

SEQ ID NO: 402471 - RNA, 24 nt, Human
ccucaggaacucaaccgacuccag

SEQ ID NO: 402472 - RNA, 21 nt, Human
ccuccaggccuacacggcguu

SEQ ID NO: 402473 - RNA, 22 nt, Human
ccucccugaguccccagcaccc

SEQ ID NO: 402474 - RNA, 18 nt, Human
ccuccggggccucgaggg

SEQ ID NO: 402475 - RNA, 19 nt, Human
ccuccggggccucgagggc

SEQ ID NO: 402476 - RNA, 19 nt, Human
ccucuccuuccucuccugc

SEQ ID NO: 402477 - RNA, 22 nt, Human
ccugaaaauuugaaaacggcug

SEQ ID NO: 402478 - RNA, 22 nt, Human
ccugaccgcccccucuccuucc

SEQ ID NO: 402479 - RNA, 19 nt, Human
ccugaggccugcagcgggc

SEQ ID NO: 402480 - RNA, 19 nt, Human
ccugaggccugcagcgggc

SEQ ID NO: 402481 - RNA, 20 nt, Human
ccugcagcagccgcugcagc

SEQ ID NO: 402482 - RNA, 23 nt, Human
ccugcauccucaccgcccgcccc

SEQ ID NO: 402483 - RNA, 19 nt, Human
ccuggggggcacggcuggc

SEQ ID NO: 402484 - RNA, 19 nt, Human
ccuggggucccgguggcuc

SEQ ID NO: 402485 - RNA, 26 nt, Human
ccuugcuggagcagggagagcgcggc

SEQ ID NO: 402486 - RNA, 23 nt, Human
cgaagugaagacccucaucugcu

SEQ ID NO: 402487 - RNA, 20 nt, Human
cgccggcaccagguggacac

SEQ ID NO: 402488 - RNA, 23 nt, Human
cggcaacacggaagaacugggcc

SEQ ID NO: 402489 - RNA, 25 nt, Human
cggcaagccucuccuccuggggucc

SEQ ID NO: 402490 - RNA, 19 nt, Human
cggcucagcgcggacacag

SEQ ID NO: 402491 - RNA, 21 nt, Human
cgguccguugcuuugugcucc

SEQ ID NO: 402492 - RNA, 19 nt, Human
cgguuguggguggcguggc

SEQ ID NO: 402493 - RNA, 19 nt, Human
cgugcaguugcgguggggc

SEQ ID NO: 402494 - RNA, 21 nt, Human
cguuuugcgcguucugugucc

SEQ ID NO: 402495 - RNA, 20 nt, Human
cucacaggccaggagccagg

SEQ ID NO: 402496 - RNA, 20 nt, Human
cucacaggccaggagccagg

SEQ ID NO: 402497 - RNA, 26 nt, Human
cuccagcccgggcauccuggccacgc

SEQ ID NO: 402498 - RNA, 21 nt, Human
cuccugagagcccugaccgcc

SEQ ID NO: 402499 - RNA, 20 nt, Human
cuccuggggucccgguggcu

SEQ ID NO: 402500 - RNA, 19 nt, Human
cucuugcgucggcaaaggc

SEQ ID NO: 402501 - RNA, 21 nt, Human
cugaccccgaguagccggaga

SEQ ID NO: 402502 - RNA, 20 nt, Human
cugcacgggccuccucccca

SEQ ID NO: 402503 - RNA, 20 nt, Human
cugcagccucuugauggaga

SEQ ID NO: 402504 - RNA, 21 nt, Human
cugcccacagccgcuucaagg

SEQ ID NO: 402505 - RNA, 19 nt, Human
cugcugcccugcccacagc

SEQ ID NO: 402506 - RNA, 18 nt, Human
cuggugcugagggggaag

SEQ ID NO: 402507 - RNA, 19 nt, Human
cugucagccagcucagagu

SEQ ID NO: 402508 - RNA, 20 nt, Human
cugugcacgucugugagaag

SEQ ID NO: 402509 - RNA, 18 nt, Human
cuuccagaaccggggucc

SEQ ID NO: 402510 - RNA, 21 nt, Human
cuucccggugaggggcucagc

SEQ ID NO: 402511 - RNA, 21 nt, Human
cuucccggugaggggcucagc

SEQ ID NO: 402512 - RNA, 24 nt, Human
cuuccgguccguugcuuugugcuc

SEQ ID NO: 402513 - RNA, 19 nt, Human
cuucuauuuaaaaaaaagc

SEQ ID NO: 402514 - RNA, 19 nt, Human
cuucuauuuaaaaaaaagc

SEQ ID NO: 402515 - RNA, 20 nt, Human
gaaaaaaccacuccgaacau

SEQ ID NO: 402516 - RNA, 26 nt, Human
gaaaaaaccacuccgaacaucuuagg

SEQ ID NO: 402517 - RNA, 22 nt, Human
gaaccugugcagcagggggaag

SEQ ID NO: 402518 - RNA, 18 nt, Human
gaagaagccggugcggca

SEQ ID NO: 402519 - RNA, 24 nt, Human
gaagcacuuucccagaaacccacc

SEQ ID NO: 402520 - RNA, 24 nt, Human
gaagcacuuucccagaaacccacc

SEQ ID NO: 402521 - RNA, 20 nt, Human
gagcgcggcucagcgcggac

SEQ ID NO: 402522 - RNA, 20 nt, Human
gagggcaguugggcucuugc

SEQ ID NO: 402523 - RNA, 21 nt, Human
gaggggcucagcuggggugcc

SEQ ID NO: 402524 - RNA, 23 nt, Human
gcaguggucccggcgggccuccc

SEQ ID NO: 402525 - RNA, 21 nt, Human
gcauccucaccgcccgccccc

SEQ ID NO: 402526 - RNA, 22 nt, Human
gccaccuccuuugcccccgguc

SEQ ID NO: 402527 - RNA, 23 nt, Human
gccaggagccagggaaguucugg

SEQ ID NO: 402528 - RNA, 23 nt, Human
gccaggagccagggaaguucugg

SEQ ID NO: 402529 - RNA, 20 nt, Human
gcccacgggggucuccuccu

SEQ ID NO: 402530 - RNA, 20 nt, Human
gcccacgggggucuccuccu

SEQ ID NO: 402531 - RNA, 25 nt, Human
gccccgccugccugaggccugcagc

SEQ ID NO: 402532 - RNA, 25 nt, Human
gccccgccugccugaggccugcagc

SEQ ID NO: 402533 - RNA, 20 nt, Human
gcguuccacuaccgccucuc

SEQ ID NO: 402534 - RNA, 21 nt, Human
ggaggggguccgccugcucuu

SEQ ID NO: 402535 - RNA, 18 nt, Human
ggcacgcucacacuccuc

SEQ ID NO: 402536 - RNA, 24 nt, Human
ggcccguggggagguccugaggac

SEQ ID NO: 402537 - RNA, 18 nt, Human
ggccugcagcagccgcug

SEQ ID NO: 402538 - RNA, 23 nt, Human
ggccugcagcagccgcugcagcc

SEQ ID NO: 402539 - RNA, 20 nt, Human
ggccugguuggggagcccug

SEQ ID NO: 402540 - RNA, 22 nt, Human
ggccugguuggggagcccugug

SEQ ID NO: 402541 - RNA, 23 nt, Human
gggccaggaucagugcacaggga

SEQ ID NO: 402542 - RNA, 18 nt, Human
gggcuggcacugcucuga

SEQ ID NO: 402543 - RNA, 23 nt, Human
ggggcuccggccagaagaccugc

SEQ ID NO: 402544 - RNA, 20 nt, Human
ggggucccgcccgucuccuc

SEQ ID NO: 402545 - RNA, 23 nt, Human
gggucugcguuccacuaccgccu

SEQ ID NO: 402546 - RNA, 19 nt, Human
gggugugcugggggccucc

SEQ ID NO: 402547 - RNA, 19 nt, Human
gggugugcugggggccucc

SEQ ID NO: 402548 - RNA, 19 nt, Human
gguggggcuggcacugcuc

SEQ ID NO: 402549 - RNA, 18 nt, Human
gucuccucccuugauguc

SEQ ID NO: 402550 - RNA, 23 nt, Human
gugcaguugcgguggggcuggca

SEQ ID NO: 402551 - RNA, 19 nt, Human
gugugcugggggccuccgu

SEQ ID NO: 402552 - RNA, 19 nt, Human
gugugcugggggccuccgu

SEQ ID NO: 402553 - RNA, 25 nt, Human
uauuagagagcccuguccccugauu

SEQ ID NO: 402554 - RNA, 26 nt, Human
uauuagagagcccuguccccugauua

SEQ ID NO: 402555 - RNA, 23 nt, Human
ucagcgcggacacaggacccugc

SEQ ID NO: 402556 - RNA, 19 nt, Human
ucccagaaacccaccccag

SEQ ID NO: 402557 - RNA, 19 nt, Human
ucccagaaacccaccccag

SEQ ID NO: 402558 - RNA, 22 nt, Human
ucccagaaacccaccccagacc

SEQ ID NO: 402559 - RNA, 22 nt, Human
ucccagaaacccaccccagacc

SEQ ID NO: 402560 - RNA, 21 nt, Human
ucccccgcggaggggguccgc

SEQ ID NO: 402561 - RNA, 19 nt, Human
uccccugauuaaaagugga

SEQ ID NO: 402562 - RNA, 18 nt, Human
ucccgcccgucuccuccc

SEQ ID NO: 402563 - RNA, 21 nt, Human
ucccggugaggggcucagcug

SEQ ID NO: 402564 - RNA, 21 nt, Human
ucccggugaggggcucagcug

SEQ ID NO: 402565 - RNA, 21 nt, Human
ucccuauggcacagacugcuc

SEQ ID NO: 402566 - RNA, 18 nt, Human
ucccugcuggccucuguc

SEQ ID NO: 402567 - RNA, 22 nt, Human
uccgcggcgaaccuuccagaac

SEQ ID NO: 402568 - RNA, 22 nt, Human
uccgcuccagcccgggcauccu

SEQ ID NO: 402569 - RNA, 20 nt, Human
uccucagcuccugguacccu

SEQ ID NO: 402570 - RNA, 26 nt, Human
uccuccccagaggcaucuuuuuacug

SEQ ID NO: 402571 - RNA, 21 nt, Human
uccuggaaagccacaaagucg

SEQ ID NO: 402572 - RNA, 25 nt, Human
ucgcccacaggcagaaaucuggggu

SEQ ID NO: 402573 - RNA, 24 nt, Human
ucugugcgaaaaaaccacuccgaa

SEQ ID NO: 402574 - RNA, 25 nt, Human
ucuguguccggcuccgcugacagug

SEQ ID NO: 402575 - RNA, 20 nt, Human
ugagaaggugccuggggggc

SEQ ID NO: 402576 - RNA, 21 nt, Human
ugagaaggugccuggggggca

SEQ ID NO: 402577 - RNA, 20 nt, Human
ugaguccccagcacccggca

SEQ ID NO: 402578 - RNA, 24 nt, Human
ugcacgggccuccuccccagaggc

SEQ ID NO: 402579 - RNA, 24 nt, Human
ugccaaggauguagaauaaauaag

SEQ ID NO: 402580 - RNA, 24 nt, Human
ugccaaggauguagaauaaauaag

SEQ ID NO: 402581 - RNA, 25 nt, Human
ugcccaggacccggcuccugagagc

SEQ ID NO: 402582 - RNA, 21 nt, Human
ugcccggggcaaucacgccgg

SEQ ID NO: 402583 - RNA, 22 nt, Human
ugcccugcccacagccgcuuca

SEQ ID NO: 402584 - RNA, 22 nt, Human
ugcucggcucacugucccgcag

SEQ ID NO: 402585 - RNA, 27 nt, Human
ugcucggcucacugucccgcagugguc

SEQ ID NO: 402586 - RNA, 23 nt, Human
ugcugggggccuccgugggcacu

SEQ ID NO: 402587 - RNA, 20 nt, Human
ugcuuugugcucccggcgga

SEQ ID NO: 402588 - RNA, 24 nt, Human
uggacacgugcccacgggggucuc

SEQ ID NO: 402589 - RNA, 24 nt, Human
uggacacgugcccacgggggucuc

SEQ ID NO: 402590 - RNA, 23 nt, Human
uggcaugggcuggccuauucugu

SEQ ID NO: 402591 - RNA, 22 nt, Human
ugggcacauccuagaggcccca

SEQ ID NO: 402592 - RNA, 24 nt, Human
uguccuggaaagccacaaagucga

SEQ ID NO: 402593 - RNA, 23 nt, Human
ugugagccgaccgcuuuccugaa

SEQ ID NO: 402594 - RNA, 19 nt, Human
uucaaggguucaguucacc

SEQ ID NO: 402595 - RNA, 19 nt, Human
uuccuggaggcgguguggc

SEQ ID NO: 402596 - RNA, 19 nt, Human
uuccuggaggcgguguggc

SEQ ID NO: 402597 - RNA, 24 nt, Human
uucggcuccuccaggccuacacgg

SEQ ID NO: 402598 - RNA, 20 nt, Human
uucucggaccgugaggggcc

SEQ ID NO: 402599 - RNA, 21 nt, Human
uucuggggaagcacuuuccca

SEQ ID NO: 402600 - RNA, 21 nt, Human
uucuggggaagcacuuuccca

SEQ ID NO: 402601 - RNA, 20 nt, Human
uugcccccgguccgccugcg

SEQ ID NO: 402602 - RNA, 19 nt, Human
uuggggagcccugugggua

SEQ ID NO: 402603 - RNA, 22 nt, Human
uuucccagaaacccaccccaga

SEQ ID NO: 402604 - RNA, 22 nt, Human
uuucccagaaacccaccccaga

SEQ ID NO: 402605 - RNA, 22 nt, Human
uuuuuuuuuuuuuuuuccuggg

SEQ ID NO: 402606 - RNA, 22 nt, Human
acaaccagagcccccgcccucc

SEQ ID NO: 402607 - RNA, 20 nt, Human
auuuguccucgucccugcca

SEQ ID NO: 402608 - RNA, 26 nt, Human
cagcgcaggcgcagcugaccccuugg

SEQ ID NO: 402609 - RNA, 21 nt, Human
caggcgcagcuggcugggcuu

SEQ ID NO: 402610 - RNA, 20 nt, Human
caguggcugcuucagguggc

SEQ ID NO: 402611 - RNA, 21 nt, Human
ccagagcccccgcccuccugc

SEQ ID NO: 402612 - RNA, 22 nt, Human
ccagagcccccgcccuccugca

SEQ ID NO: 402613 - RNA, 22 nt, Human
cccccugggcaguggcugcuuc

SEQ ID NO: 402614 - RNA, 22 nt, Human
ccuccugcagcgcaggcgcagc

SEQ ID NO: 402615 - RNA, 25 nt, Human
ccuccugcagcgcaggcgcagcugg

SEQ ID NO: 402616 - RNA, 21 nt, Human
ccugcccaggcggcuccuuuc

SEQ ID NO: 402617 - RNA, 25 nt, Human
cgggguggggguggaggccagggcu

SEQ ID NO: 402618 - RNA, 24 nt, Human
cuauuguggcuguuuuuuuuuuuc

SEQ ID NO: 402619 - RNA, 18 nt, Human
cuccaagcugggcgcugc

SEQ ID NO: 402620 - RNA, 20 nt, Human
cugggcuccugcuucccacu

SEQ ID NO: 402621 - RNA, 21 nt, Human
cugucucuucuuugcaccccc

SEQ ID NO: 402622 - RNA, 18 nt, Human
cuuugcacccccugggca

SEQ ID NO: 402623 - RNA, 20 nt, Human
cuuugcacccccugggcagu

SEQ ID NO: 402624 - RNA, 22 nt, Human
gacugcaguuguggcugccagg

SEQ ID NO: 402625 - RNA, 19 nt, Human
gcccugacaagaggauggg

SEQ ID NO: 402626 - RNA, 18 nt, Human
gcgcaggcgcagcuggcu

SEQ ID NO: 402627 - RNA, 22 nt, Human
gcuccugcuucccacucuccac

SEQ ID NO: 402628 - RNA, 22 nt, Human
ggaguuagcaccuccaagcugg

SEQ ID NO: 402629 - RNA, 20 nt, Human
ggcgcugcugucucuucuuu

SEQ ID NO: 402630 - RNA, 22 nt, Human
gggcaguggcugcuucaggugg

SEQ ID NO: 402631 - RNA, 23 nt, Human
guggcuguuuuuuuuuuucucuc

SEQ ID NO: 402632 - RNA, 20 nt, Human
uacaaccagagcccccgccc

SEQ ID NO: 402633 - RNA, 19 nt, Human
ucacucucccuuggauggu

SEQ ID NO: 402634 - RNA, 24 nt, Human
ucuccaccucauccauauuugucc

SEQ ID NO: 402635 - RNA, 20 nt, Human
ucuuugcacccccugggcag

SEQ ID NO: 402636 - RNA, 23 nt, Human
ugacaagaggaugggacugcagu

SEQ ID NO: 402637 - RNA, 22 nt, Human
ugcagcuaccgcaggugcuggc

SEQ ID NO: 402638 - RNA, 21 nt, Human
ugcccaggcggcuccuuucug

SEQ ID NO: 402639 - RNA, 21 nt, Human
uggccucuggaguuagcaccu

SEQ ID NO: 402640 - RNA, 23 nt, Human
uggcugggcuccugcuucccacu

SEQ ID NO: 402641 - RNA, 20 nt, Human
uggcuguuuuuuuuuuucuc

SEQ ID NO: 402642 - RNA, 26 nt, Human
uggggguggaggccagggcuguagug

SEQ ID NO: 402643 - RNA, 20 nt, Human
uguccucgucccugccaguc

SEQ ID NO: 402644 - RNA, 18 nt, Human
ugucucuucuuugcaccc

SEQ ID NO: 402645 - RNA, 19 nt, Human
ugucucuucuuugcacccc

SEQ ID NO: 402646 - RNA, 21 nt, Human
uguuuuuuuuuuucucucuca

SEQ ID NO: 402647 - RNA, 19 nt, Human
uuuuuuuuuuuugcagggu

SEQ ID NO: 402648 - RNA, 22 nt, Human
uuuuuuuuuuuuuugcagggug

SEQ ID NO: 402649 - RNA, 23 nt, Human
uuuuuuuuuuuuuuuuugcaggg

SEQ ID NO: 402650 - RNA, 24 nt, Human
uuuuuuuuuuuuuuuuuugcaggg

SEQ ID NO: 402651 - RNA, 20 nt, Human
aaacaaccacaggcacuggc

SEQ ID NO: 402652 - RNA, 23 nt, Human
aaacagcagccuucccgggccug

SEQ ID NO: 402653 - RNA, 22 nt, Human
aaacccaaaauccugaugaaac

SEQ ID NO: 402654 - RNA, 21 nt, Human
aacaucacugcugggauccag

SEQ ID NO: 402655 - RNA, 25 nt, Human
aaccacaggcacuggcuccaugccc

SEQ ID NO: 402656 - RNA, 24 nt, Human
aaccaggugguggggucggugcua

SEQ ID NO: 402657 - RNA, 19 nt, Human
aagucacuucaaaaguggu

SEQ ID NO: 402658 - RNA, 23 nt, Human
aagugguuguuccuccgagguuu

SEQ ID NO: 402659 - RNA, 25 nt, Human
acccugcugcccuccuagccccagc

SEQ ID NO: 402660 - RNA, 18 nt, Human
accucggugccaacagug

SEQ ID NO: 402661 - RNA, 19 nt, Human
agaaacaaccacaggcacu

SEQ ID NO: 402662 - RNA, 22 nt, Human
agaguacaguguggccgcugca

SEQ ID NO: 402663 - RNA, 21 nt, Human
agaugcuucuucauuucccag

SEQ ID NO: 402664 - RNA, 19 nt, Human
aggggccccgggagcuggc

SEQ ID NO: 402665 - RNA, 19 nt, Human
aggggcggucugcagcugc

SEQ ID NO: 402666 - RNA, 18 nt, Human
aguacaguguggccgcug

SEQ ID NO: 402667 - RNA, 21 nt, Human
augcuguucucggcagugccc

SEQ ID NO: 402668 - RNA, 18 nt, Human
caacagugccauccuggc

SEQ ID NO: 402669 - RNA, 25 nt, Human
caagcagagaccaccagaccccugc

SEQ ID NO: 402670 - RNA, 21 nt, Human
cacaccccaaagcgugcagag

SEQ ID NO: 402671 - RNA, 21 nt, Human
cacaggcacuggcuccaugcc

SEQ ID NO: 402672 - RNA, 21 nt, Human
caccagaccccugcagugacc

SEQ ID NO: 402673 - RNA, 21 nt, Human
cacccugcugcccuccuagcc

SEQ ID NO: 402674 - RNA, 23 nt, Human
cacccugcugcccuccuagcccc

SEQ ID NO: 402675 - RNA, 21 nt, Human
cagaaacuaucacuuccucca

SEQ ID NO: 402676 - RNA, 24 nt, Human
cagcagagacagugccagcugacg

SEQ ID NO: 402677 - RNA, 18 nt, Human
cagcugcggcugugggug

SEQ ID NO: 402678 - RNA, 22 nt, Human
cagcugcggcugugggugaugc

SEQ ID NO: 402679 - RNA, 19 nt, Human
cagggcccgaaguucccca

SEQ ID NO: 402680 - RNA, 25 nt, Human
cagugcccauccugccaucuguuug

SEQ ID NO: 402681 - RNA, 21 nt, Human
ccacagagagcggucaaggac

SEQ ID NO: 402682 - RNA, 24 nt, Human
ccagcacacucccgccggggccac

SEQ ID NO: 402683 - RNA, 26 nt, Human
ccaggacagaguggguggggcccaca

SEQ ID NO: 402684 - RNA, 18 nt, Human
cccaaccucggugccaac

SEQ ID NO: 402685 - RNA, 25 nt, Human
cccagaggccacccugcugcccucc

SEQ ID NO: 402686 - RNA, 22 nt, Human
cccauguucacauggggaggaa

SEQ ID NO: 402687 - RNA, 19 nt, Human
ccccggauccccuaggcuc

SEQ ID NO: 402688 - RNA, 21 nt, Human
ccccgggagcuggccucacga

SEQ ID NO: 402689 - RNA, 19 nt, Human
ccccuaggcccugggccca

SEQ ID NO: 402690 - RNA, 21 nt, Human
ccccuaggcccugggcccacc

SEQ ID NO: 402691 - RNA, 21 nt, Human
ccgcacccaacgcacgccgcg

SEQ ID NO: 402692 - RNA, 23 nt, Human
ccuagccccagcccagcccaggc

SEQ ID NO: 402693 - RNA, 19 nt, Human
ccuaugguccagaguaaag

SEQ ID NO: 402694 - RNA, 22 nt, Human
ccuccuagccccagcccagccc

SEQ ID NO: 402695 - RNA, 26 nt, Human
ccuccuagccccagcccagcccaggc

SEQ ID NO: 402696 - RNA, 18 nt, Human
ccucugagguccagggag

SEQ ID NO: 402697 - RNA, 18 nt, Human
ccuuacagcugcggcugu

SEQ ID NO: 402698 - RNA, 21 nt, Human
cgccagacugcccugccuggc

SEQ ID NO: 402699 - RNA, 18 nt, Human
cggaagggcccaaugggu

SEQ ID NO: 402700 - RNA, 19 nt, Human
cggaagggcccaaugggug

SEQ ID NO: 402701 - RNA, 22 nt, Human
cggcgcccacgugcggucccgg

SEQ ID NO: 402702 - RNA, 20 nt, Human
cggggccggacgugaggugg

SEQ ID NO: 402703 - RNA, 23 nt, Human
cuaggcccugggcccaccgaggg

SEQ ID NO: 402704 - RNA, 20 nt, Human
cuaguccgcacccaacgcac

SEQ ID NO: 402705 - RNA, 26 nt, Human
cuccuagccccagcccagcccaggcc

SEQ ID NO: 402706 - RNA, 20 nt, Human
cugcagcugcugagggcugc

SEQ ID NO: 402707 - RNA, 18 nt, Human
cugcccgcaacuccaaga

SEQ ID NO: 402708 - RNA, 21 nt, Human
cuggagccucaguucaggcca

SEQ ID NO: 402709 - RNA, 19 nt, Human
cuggcuccaugcccacugg

SEQ ID NO: 402710 - RNA, 23 nt, Human
cugggcccaccgagggggcuaca

SEQ ID NO: 402711 - RNA, 19 nt, Human
cugggcugugggccuggug

SEQ ID NO: 402712 - RNA, 22 nt, Human
cugggucaggggacagcuaagu

SEQ ID NO: 402713 - RNA, 23 nt, Human
cuugcacaaacacugggcaaaca

SEQ ID NO: 402714 - RNA, 26 nt, Human
gaaggugggcagcaccaggagggucc

SEQ ID NO: 402715 - RNA, 23 nt, Human
gagggucccacaguccaggcagg

SEQ ID NO: 402716 - RNA, 23 nt, Human
gagguggccuggcggccggcgcc

SEQ ID NO: 402717 - RNA, 24 nt, Human
gagucuccaggcugcccgcaacuc

SEQ ID NO: 402718 - RNA, 20 nt, Human
gccccagcccagcccaggcc

SEQ ID NO: 402719 - RNA, 18 nt, Human
gccccggauccccuaggc

SEQ ID NO: 402720 - RNA, 21 nt, Human
gcccgaaguuccccauguuca

SEQ ID NO: 402721 - RNA, 22 nt, Human
gccuuacagcugcggcuguggg

SEQ ID NO: 402722 - RNA, 18 nt, Human
gcuacaggacagggaagg

SEQ ID NO: 402723 - RNA, 22 nt, Human
gcuccagcacacucccgccggg

SEQ ID NO: 402724 - RNA, 20 nt, Human
ggaaggugggcagcaccagg

SEQ ID NO: 402725 - RNA, 21 nt, Human
ggaaggugggcagcaccagga

SEQ ID NO: 402726 - RNA, 21 nt, Human
ggccacauuuacaguaacugg

SEQ ID NO: 402727 - RNA, 21 nt, Human
ggcgguaaguccacgagucuc

SEQ ID NO: 402728 - RNA, 21 nt, Human
gggaaggugggcagcaccagg

SEQ ID NO: 402729 - RNA, 18 nt, Human
gggccaccuaguccgcac

SEQ ID NO: 402730 - RNA, 21 nt, Human
gggcccaaugggugucaccuc

SEQ ID NO: 402731 - RNA, 19 nt, Human
gugaugcagagacacccac

SEQ ID NO: 402732 - RNA, 20 nt, Human
uaaagcagaugccuggguga

SEQ ID NO: 402733 - RNA, 26 nt, Human
ucacauggggaggaagucccugggca

SEQ ID NO: 402734 - RNA, 19 nt, Human
ucaggccagaugggccucu

SEQ ID NO: 402735 - RNA, 21 nt, Human
uccacaccccaaagcgugcag

SEQ ID NO: 402736 - RNA, 21 nt, Human
uccaccacuagaugcuggagc

SEQ ID NO: 402737 - RNA, 23 nt, Human
uccaugcccacugggggccacaa

SEQ ID NO: 402738 - RNA, 22 nt, Human
ucccagaggccacccugcugcc

SEQ ID NO: 402739 - RNA, 22 nt, Human
uccccuaggcucugggucaggg

SEQ ID NO: 402740 - RNA, 23 nt, Human
ucccucgacuucccuuuugacuc

SEQ ID NO: 402741 - RNA, 30 nt, Human
ucccugggcaaaguaaagcagguucucugg

SEQ ID NO: 402742 - RNA, 25 nt, Human
uccgcacccaacgcacgccgcgaag

SEQ ID NO: 402743 - RNA, 20 nt, Human
uccuagccccagcccagccc

SEQ ID NO: 402744 - RNA, 20 nt, Human
uccuccagagagcacguggc

SEQ ID NO: 402745 - RNA, 18 nt, Human
uccugggccccuaggccc

SEQ ID NO: 402746 - RNA, 25 nt, Human
uccugggccccuaggcccugggccc

SEQ ID NO: 402747 - RNA, 23 nt, Human
ucuccaacuuuccccaaaacauc

SEQ ID NO: 402748 - RNA, 24 nt, Human
ucuccaggcugcccgcaacuccaa

SEQ ID NO: 402749 - RNA, 19 nt, Human
ucugcagcugcugagggcu

SEQ ID NO: 402750 - RNA, 18 nt, Human
ucuggagaaacaaccaca

SEQ ID NO: 402751 - RNA, 18 nt, Human
ucuggccaauguccaggu

SEQ ID NO: 402752 - RNA, 19 nt, Human
ucugggaccaaugcuguuc

SEQ ID NO: 402753 - RNA, 27 nt, Human
ucuucuggccaauguccagguucuggg

SEQ ID NO: 402754 - RNA, 24 nt, Human
ugaaaaacccaaaauccugaugaa

SEQ ID NO: 402755 - RNA, 24 nt, Human
ugacucuggagaaacaaccacagg

SEQ ID NO: 402756 - RNA, 22 nt, Human
ugacuugauccugggccccuag

SEQ ID NO: 402757 - RNA, 20 nt, Human
ugagggcugcagacaucugg

SEQ ID NO: 402758 - RNA, 20 nt, Human
ugaggggcggucugcagcug

SEQ ID NO: 402759 - RNA, 22 nt, Human
ugauccugggccccuaggcccu

SEQ ID NO: 402760 - RNA, 20 nt, Human
ugcccgcaacuccaagacuc

SEQ ID NO: 402761 - RNA, 19 nt, Human
uggccagccgaccggaagu

SEQ ID NO: 402762 - RNA, 19 nt, Human
uggcuccaugcccacuggg

SEQ ID NO: 402763 - RNA, 18 nt, Human
ugggauccaguccccuuu

SEQ ID NO: 402764 - RNA, 20 nt, Human
ugggcaaacagugucugccc

SEQ ID NO: 402765 - RNA, 22 nt, Human
ugggccccuaggcccugggccc

SEQ ID NO: 402766 - RNA, 18 nt, Human
ugggccucugcccccaac

SEQ ID NO: 402767 - RNA, 20 nt, Human
ugggcugugggccugguggu

SEQ ID NO: 402768 - RNA, 19 nt, Human
ugguggggucggugcuagu

SEQ ID NO: 402769 - RNA, 20 nt, Human
ugucucuucuguacaagccc

SEQ ID NO: 402770 - RNA, 21 nt, Human
ugugaaaaacccaaaauccug

SEQ ID NO: 402771 - RNA, 20 nt, Human
uucagaaacuaucacuuccu

SEQ ID NO: 402772 - RNA, 23 nt, Human
uuccuccgagguuucagccuuag

SEQ ID NO: 402773 - RNA, 23 nt, Human
uugcauacacgucugaaggcccu

SEQ ID NO: 402774 - RNA, 18 nt, Human
aaaaaacaaaaaaguuag

SEQ ID NO: 402775 - RNA, 20 nt, Human
aacaaaaaacaaaaaaguua

SEQ ID NO: 402776 - RNA, 21 nt, Human
aacagcccuauugacuuccau

SEQ ID NO: 402777 - RNA, 20 nt, Human
aacauggugaaaugccaucu

SEQ ID NO: 402778 - RNA, 20 nt, Human
aagaaagucccaacagcccu

SEQ ID NO: 402779 - RNA, 19 nt, Human
acaaaaaaguuagucaggu

SEQ ID NO: 402780 - RNA, 18 nt, Human
acagagugagacccuguc

SEQ ID NO: 402781 - RNA, 22 nt, Human
acagagugagacccugucaaaa

SEQ ID NO: 402782 - RNA, 21 nt, Human
acccuaaacucaggcacucug

SEQ ID NO: 402783 - RNA, 24 nt, Human
acuccagccugggugacagaguga

SEQ ID NO: 402784 - RNA, 24 nt, Human
acugcacuccagccugggugacag

SEQ ID NO: 402785 - RNA, 26 nt, Human
acugcacuccagccugggugacagag

SEQ ID NO: 402786 - RNA, 21 nt, Human
agaacuuuccacuccccucgu

SEQ ID NO: 402787 - RNA, 24 nt, Human
agacugaggcaggaggaucacuug

SEQ ID NO: 402788 - RNA, 18 nt, Human
agcaaagcugauuccaag

SEQ ID NO: 402789 - RNA, 22 nt, Human
agccugggugacagagugagac

SEQ ID NO: 402790 - RNA, 20 nt, Human
aggaguuugagaccagccug

SEQ ID NO: 402791 - RNA, 18 nt, Human
aggcaggaggaucacuug

SEQ ID NO: 402792 - RNA, 19 nt, Human
aggcaggaggaucacuuga

SEQ ID NO: 402793 - RNA, 22 nt, Human
aucccagcacuuugggaggcca

SEQ ID NO: 402794 - RNA, 19 nt, Human
augucuguaaucccagcac

SEQ ID NO: 402795 - RNA, 24 nt, Human
caaaaaacaaaaaaguuagucagg

SEQ ID NO: 402796 - RNA, 21 nt, Human
caaaaaacaaaccugcauuga

SEQ ID NO: 402797 - RNA, 22 nt, Human
caaaacuuccuccaggccugag

SEQ ID NO: 402798 - RNA, 21 nt, Human
caacauggugaaaugccaucu

SEQ ID NO: 402799 - RNA, 24 nt, Human
caacauggugaaaugccaucuuua

SEQ ID NO: 402800 - RNA, 22 nt, Human
caccaaaaaacaaaccugcauu

SEQ ID NO: 402801 - RNA, 25 nt, Human
caccucguggcuuauugucauaugu

SEQ ID NO: 402802 - RNA, 22 nt, Human
cacuccagccugggugacagag

SEQ ID NO: 402803 - RNA, 24 nt, Human
cacuccagccugggugacagagug

SEQ ID NO: 402804 - RNA, 19 nt, Human
cacugcacuccagccuggg

SEQ ID NO: 402805 - RNA, 21 nt, Human
cacugcacuccagccugggug

SEQ ID NO: 402806 - RNA, 22 nt, Human
cacugcacuccagccuggguga

SEQ ID NO: 402807 - RNA, 23 nt, Human
cacugcacuccagccugggugac

SEQ ID NO: 402808 - RNA, 24 nt, Human
cacugcacuccagccugggugaca

SEQ ID NO: 402809 - RNA, 24 nt, Human
cacugcacuccagccugggugaca

SEQ ID NO: 402810 - RNA, 18 nt, Human
cacuggacuauguaauug

SEQ ID NO: 402811 - RNA, 24 nt, Human
cagaggucaaggcugcagagagcc

SEQ ID NO: 402812 - RNA, 21 nt, Human
cagcacuuugggaggccaaag

SEQ ID NO: 402813 - RNA, 24 nt, Human
caggagacugaggcaggaggauca

SEQ ID NO: 402814 - RNA, 24 nt, Human
caguucaugucuguaaucccagca

SEQ ID NO: 402815 - RNA, 20 nt, Human
caugucuguaaucccagcac

SEQ ID NO: 402816 - RNA, 24 nt, Human
caugucuguaaucccagcacuuug

SEQ ID NO: 402817 - RNA, 23 nt, Human
ccaaaacuuccuccaggccugag

SEQ ID NO: 402818 - RNA, 20 nt, Human
ccacugcacuccagccuggg

SEQ ID NO: 402819 - RNA, 20 nt, Human
ccacugcacuccagccuggg

SEQ ID NO: 402820 - RNA, 21 nt, Human
ccacugcacuccagccugggu

SEQ ID NO: 402821 - RNA, 21 nt, Human
ccacugcacuccagccugggu

SEQ ID NO: 402822 - RNA, 24 nt, Human
ccacugcacuccagccugggugac

SEQ ID NO: 402823 - RNA, 22 nt, Human
cccaacagcccuauugacuucc

SEQ ID NO: 402824 - RNA, 20 nt, Human
ccugggugacagagugagac

SEQ ID NO: 402825 - RNA, 27 nt, Human
ccugucaaaaaaaaaaaaaaaguggug

SEQ ID NO: 402826 - RNA, 23 nt, Human
cggaaacuuuagucggguacuua

SEQ ID NO: 402827 - RNA, 22 nt, Human
cguguuacaugacagaacccac

SEQ ID NO: 402828 - RNA, 22 nt, Human
cucugcucauacuccccccuga

SEQ ID NO: 402829 - RNA, 20 nt, Human
cugucaaaaaaaaaaaaaaa

SEQ ID NO: 402830 - RNA, 19 nt, Human
cuugacccuaaacucaggc

SEQ ID NO: 402831 - RNA, 18 nt, Human
cuugagaucucagggcug

SEQ ID NO: 402832 - RNA, 20 nt, Human
gaaaaugcuuuuuuuuuuuu

SEQ ID NO: 402833 - RNA, 24 nt, Human
gaaaaugcuuuuuuuuuuuuuuuu

SEQ ID NO: 402834 - RNA, 25 nt, Human
gaacguguguugggggaauccuggg

SEQ ID NO: 402835 - RNA, 23 nt, Human
gaacucuuuccaaaacuuccucc

SEQ ID NO: 402836 - RNA, 24 nt, Human
gcacuccagccugggugacagagu

SEQ ID NO: 402837 - RNA, 23 nt, Human
gcaguucaugucuguaaucccag

SEQ ID NO: 402838 - RNA, 19 nt, Human
gccacugcacuccagccug

SEQ ID NO: 402839 - RNA, 24 nt, Human
gccacugcacuccagccuggguga

SEQ ID NO: 402840 - RNA, 21 nt, Human
gcugcagagagccaugguggu

SEQ ID NO: 402841 - RNA, 20 nt, Human
ggcacagguaugauacuagc

SEQ ID NO: 402842 - RNA, 24 nt, Human
ggcaguucaugucuguaaucccag

SEQ ID NO: 402843 - RNA, 24 nt, Human
guggugccacugcacuccagccug

SEQ ID NO: 402844 - RNA, 21 nt, Human
guguuacaugacagaacccac

SEQ ID NO: 402845 - RNA, 23 nt, Human
uaaaagggagcaggacaaaggca

SEQ ID NO: 402846 - RNA, 22 nt, Human
uagaauguaaccuggcuuaaaa

SEQ ID NO: 402847 - RNA, 22 nt, Human
uagcaaagcugauuccaagaga

SEQ ID NO: 402848 - RNA, 23 nt, Human
uagcaccaaaaaacaaaccugca

SEQ ID NO: 402849 - RNA, 19 nt, Human
uauuggcuuugguauaaaa

SEQ ID NO: 402850 - RNA, 19 nt, Human
ucaaaaaaaaaaaaaaagu

SEQ ID NO: 402851 - RNA, 22 nt, Human
ucaugucuguaaucccagcacu

SEQ ID NO: 402852 - RNA, 23 nt, Human
ucaugucuguaaucccagcacuu

SEQ ID NO: 402853 - RNA, 23 nt, Human
uccagccugggugacagagugag

SEQ ID NO: 402854 - RNA, 24 nt, Human
uccagccugggugacagagugaga

SEQ ID NO: 402855 - RNA, 24 nt, Human
uccuuguaguuccagcuacucagg

SEQ ID NO: 402856 - RNA, 24 nt, Human
ucuugagaucucagggcugccgga

SEQ ID NO: 402857 - RNA, 20 nt, Human
ugaaaugccaucuuuaccaa

SEQ ID NO: 402858 - RNA, 22 nt, Human
ugaaaugccaucuuuaccaaac

SEQ ID NO: 402859 - RNA, 23 nt, Human
ugaaccuaggaguuugagaccag

SEQ ID NO: 402860 - RNA, 18 nt, Human
ugacagaacccacggaaa

SEQ ID NO: 402861 - RNA, 23 nt, Human
ugagaucucagggcugccggaga

SEQ ID NO: 402862 - RNA, 20 nt, Human
ugaggcaggaggaucacuug

SEQ ID NO: 402863 - RNA, 21 nt, Human
ugaggcaggaggaucacuuga

SEQ ID NO: 402864 - RNA, 24 nt, Human
ugaggcaggaggaucacuugagcu

SEQ ID NO: 402865 - RNA, 24 nt, Human
ugaggcaggaggaucacuugagcu

SEQ ID NO: 402866 - RNA, 27 nt, Human
ugcuuuugaaagcugugauagcggaug

SEQ ID NO: 402867 - RNA, 24 nt, Human
uggcaguucaugucuguaauccca

SEQ ID NO: 402868 - RNA, 22 nt, Human
uggccgggccuggcaguucaug

SEQ ID NO: 402869 - RNA, 24 nt, Human
uggccgggccuggcaguucauguc

SEQ ID NO: 402870 - RNA, 18 nt, Human
ugggaggccaaagugaac

SEQ ID NO: 402871 - RNA, 21 nt, Human
ugggugacagagugagacccu

SEQ ID NO: 402872 - RNA, 23 nt, Human
ugguggcccuuccuuguaguucc

SEQ ID NO: 402873 - RNA, 22 nt, Human
ugguggugccacugcacuccag

SEQ ID NO: 402874 - RNA, 25 nt, Human
ugucaaaaaaaaaaaaaaaguggug

SEQ ID NO: 402875 - RNA, 19 nt, Human
uguccuugacccuaaacuc

SEQ ID NO: 402876 - RNA, 23 nt, Human
ugucuguaaucccagcacuuugg

SEQ ID NO: 402877 - RNA, 23 nt, Human
ugucuguaaucccagcacuuugg

SEQ ID NO: 402878 - RNA, 24 nt, Human
ugucuguaaucccagcacuuuggg

SEQ ID NO: 402879 - RNA, 18 nt, Human
ugugaggauggagaagac

SEQ ID NO: 402880 - RNA, 20 nt, Human
uguguugggggaauccuggg

SEQ ID NO: 402881 - RNA, 22 nt, Human
uguuacaugacagaacccacgg

SEQ ID NO: 402882 - RNA, 19 nt, Human
uuauguuaaaaguuaagaa

SEQ ID NO: 402883 - RNA, 22 nt, Human
uucaagaaagucccaacagccc

SEQ ID NO: 402884 - RNA, 22 nt, Human
uuccaaaacuuccuccaggccu

SEQ ID NO: 402885 - RNA, 23 nt, Human
uuuagucggguacuuacugcacc

SEQ ID NO: 402886 - RNA, 26 nt, Human
uuuuuuuuuaucaccagcucuguccu

SEQ ID NO: 402887 - RNA, 24 nt, Human
aaaauguugggauuacagguguga

SEQ ID NO: 402888 - RNA, 19 nt, Human
aaacaucuucauaguguau

SEQ ID NO: 402889 - RNA, 24 nt, Human
aaacaucuucauaguguaucaucc

SEQ ID NO: 402890 - RNA, 26 nt, Human
aaauguugggauuacaggugugagcc

SEQ ID NO: 402891 - RNA, 24 nt, Human
aacgauucuccugccucagccucu

SEQ ID NO: 402892 - RNA, 20 nt, Human
aaguagcugggacuacaggc

SEQ ID NO: 402893 - RNA, 24 nt, Human
aaguagcugggacuacaggcaugu

SEQ ID NO: 402894 - RNA, 25 nt, Human
aaguagcugggacuacaggcaugug

SEQ ID NO: 402895 - RNA, 24 nt, Human
acacugcaaccucugccucccggg

SEQ ID NO: 402896 - RNA, 25 nt, Human
acacugcaaccucugccucccgggu

SEQ ID NO: 402897 - RNA, 24 nt, Human
acuauguuggucacuauggucuug

SEQ ID NO: 402898 - RNA, 21 nt, Human
aggaaaccuggaggcuacuac

SEQ ID NO: 402899 - RNA, 19 nt, Human
aggcagccggucacugaag

SEQ ID NO: 402900 - RNA, 23 nt, Human
agugagucacuuucagaacagug

SEQ ID NO: 402901 - RNA, 19 nt, Human
aguguaguggcaugaucuc

SEQ ID NO: 402902 - RNA, 20 nt, Human
augggguuucacuauguugg

SEQ ID NO: 402903 - RNA, 23 nt, Human
augggguuucacuauguugguca

SEQ ID NO: 402904 - RNA, 18 nt, Human
auuauaaagacagaagau

SEQ ID NO: 402905 - RNA, 24 nt, Human
caaaauguugggauuacaggugug

SEQ ID NO: 402906 - RNA, 20 nt, Human
caaacgauucuccugccuca

SEQ ID NO: 402907 - RNA, 22 nt, Human
caaacgauucuccugccucagc

SEQ ID NO: 402908 - RNA, 22 nt, Human
caaguagcugggacuacaggca

SEQ ID NO: 402909 - RNA, 24 nt, Human
cacacugcaaccucugccucccgg

SEQ ID NO: 402910 - RNA, 25 nt, Human
cacacugcaaccucugccucccggg

SEQ ID NO: 402911 - RNA, 21 nt, Human
cacugcaaccucugccucccg

SEQ ID NO: 402912 - RNA, 23 nt, Human
cacugcaaccucugccucccggg

SEQ ID NO: 402913 - RNA, 24 nt, Human
cacugcaaccucugccucccgggg

SEQ ID NO: 402914 - RNA, 20 nt, Human
cacugcaccaggcaaacugc

SEQ ID NO: 402915 - RNA, 18 nt, Human
cagccggucacugaagcc

SEQ ID NO: 402916 - RNA, 24 nt, Human
caguagagaugggguuucacuaug

SEQ ID NO: 402917 - RNA, 21 nt, Human
ccaaaauguugggauuacagg

SEQ ID NO: 402918 - RNA, 21 nt, Human
ccaaaauguugggauuacagg

SEQ ID NO: 402919 - RNA, 24 nt, Human
ccaaaauguugggauuacaggugu

SEQ ID NO: 402920 - RNA, 23 nt, Human
cccggguucaaacgauucuccug

SEQ ID NO: 402921 - RNA, 24 nt, Human
ccucccggguucaaacgauucucc

SEQ ID NO: 402922 - RNA, 19 nt, Human
ccuuccuucucuauucuuu

SEQ ID NO: 402923 - RNA, 24 nt, Human
cgccaggcuggaguguaguggcau

SEQ ID NO: 402924 - RNA, 23 nt, Human
cgcucugucgccaggcuggagug

SEQ ID NO: 402925 - RNA, 23 nt, Human
cucaaguagcugggacuacaggc

SEQ ID NO: 402926 - RNA, 24 nt, Human
cucagccucucaaguagcugggac

SEQ ID NO: 402927 - RNA, 20 nt, Human
cucgcucugucgccaggcug

SEQ ID NO: 402928 - RNA, 23 nt, Human
cucgcucugucgccaggcuggag

SEQ ID NO: 402929 - RNA, 18 nt, Human
cucgugaucuacccaccu

SEQ ID NO: 402930 - RNA, 18 nt, Human
cucuugaucucgugaucu

SEQ ID NO: 402931 - RNA, 19 nt, Human
cugcaaccucugccucccg

SEQ ID NO: 402932 - RNA, 23 nt, Human
cugcaaccucugccucccggguu

SEQ ID NO: 402933 - RNA, 24 nt, Human
cugcaaccucugccucccggguuc

SEQ ID NO: 402934 - RNA, 23 nt, Human
cugccucagccucucaaguagcu

SEQ ID NO: 402935 - RNA, 24 nt, Human
cuggaguguaguggcaugaucuca

SEQ ID NO: 402936 - RNA, 24 nt, Human
cuuucaguagagaugggguuucac

SEQ ID NO: 402937 - RNA, 20 nt, Human
gaacaguguguguuguagaa

SEQ ID NO: 402938 - RNA, 24 nt, Human
gagaugggguuucacuauguuggu

SEQ ID NO: 402939 - RNA, 21 nt, Human
gaucucgugaucuacccaccu

SEQ ID NO: 402940 - RNA, 24 nt, Human
gaucucgugaucuacccaccuugg

SEQ ID NO: 402941 - RNA, 18 nt, Human
gauuacaggugugagcca

SEQ ID NO: 402942 - RNA, 19 nt, Human
gauuacaggugugagccac

SEQ ID NO: 402943 - RNA, 23 nt, Human
gauuacaggugugagccacugca

SEQ ID NO: 402944 - RNA, 22 nt, Human
gcaaccucugccucccggguuc

SEQ ID NO: 402945 - RNA, 21 nt, Human
gcaccaggcaaacugcgaucu

SEQ ID NO: 402946 - RNA, 23 nt, Human
gcaccaggcaaacugcgaucuuu

SEQ ID NO: 402947 - RNA, 19 nt, Human
ggacuacaggcaugugcca

SEQ ID NO: 402948 - RNA, 23 nt, Human
ggguucaaacgauucuccugccu

SEQ ID NO: 402949 - RNA, 24 nt, Human
gucucgcucugucgccaggcugga

SEQ ID NO: 402950 - RNA, 24 nt, Human
gugaucuacccaccuuggguuccc

SEQ ID NO: 402951 - RNA, 26 nt, Human
guuuuuuuuuuuuuuuuuuuuugggg

SEQ ID NO: 402952 - RNA, 18 nt, Human
uaaccauugcauuaaugu

SEQ ID NO: 402953 - RNA, 19 nt, Human
uacaggugugagccacugc

SEQ ID NO: 402954 - RNA, 22 nt, Human
uacaggugugagccacugcacc

SEQ ID NO: 402955 - RNA, 22 nt, Human
uacccaccuuggguucccaaaa

SEQ ID NO: 402956 - RNA, 22 nt, Human
uagagaugggguuucacuaugu

SEQ ID NO: 402957 - RNA, 26 nt, Human
uaguggugccucuucucucuuuugac

SEQ ID NO: 402958 - RNA, 19 nt, Human
ucaaacgauucuccugccu

SEQ ID NO: 402959 - RNA, 30 nt, Human
ucaccacacugcaaccucugccucccgggg

SEQ ID NO: 402960 - RNA, 22 nt, Human
ucacuauguuggucacuauggu

SEQ ID NO: 402961 - RNA, 18 nt, Human
ucacuuucagaacagugu

SEQ ID NO: 402962 - RNA, 18 nt, Human
ucaguagagaugggguuu

SEQ ID NO: 402963 - RNA, 21 nt, Human
ucaguagagaugggguuucac

SEQ ID NO: 402964 - RNA, 24 nt, Human
ucaguagagaugggguuucacuau

SEQ ID NO: 402965 - RNA, 23 nt, Human
ucccaaaauguugggauuacagg

SEQ ID NO: 402966 - RNA, 21 nt, Human
ucccggguucaaacgauucuc

SEQ ID NO: 402967 - RNA, 24 nt, Human
ucccggguucaaacgauucuccug

SEQ ID NO: 402968 - RNA, 19 nt, Human
ucgugaucuacccaccuug

SEQ ID NO: 402969 - RNA, 24 nt, Human
ucucaaguagcugggacuacaggc

SEQ ID NO: 402970 - RNA, 26 nt, Human
ucuccugccucagccucucaaguagc

SEQ ID NO: 402971 - RNA, 21 nt, Human
ucucgcucugucgccaggcug

SEQ ID NO: 402972 - RNA, 22 nt, Human
ucucgcucugucgccaggcugg

SEQ ID NO: 402973 - RNA, 23 nt, Human
ucucgcucugucgccaggcugga

SEQ ID NO: 402974 - RNA, 18 nt, Human
ucugucgccaggcuggag

SEQ ID NO: 402975 - RNA, 21 nt, Human
ucugucgccaggcuggagugu

SEQ ID NO: 402976 - RNA, 23 nt, Human
ucugucgccaggcuggaguguag

SEQ ID NO: 402977 - RNA, 22 nt, Human
ugagguagaguccugaaagauc

SEQ ID NO: 402978 - RNA, 21 nt, Human
ugauaugagguagaguccuga

SEQ ID NO: 402979 - RNA, 24 nt, Human
ugccucagccucucaaguagcugg

SEQ ID NO: 402980 - RNA, 22 nt, Human
uggaagcugacagucuucuaga

SEQ ID NO: 402981 - RNA, 23 nt, Human
uggaguguaguggcaugaucuca

SEQ ID NO: 402982 - RNA, 24 nt, Human
uggcaugaucucaccacacugcaa

SEQ ID NO: 402983 - RNA, 18 nt, Human
ugggacuacaggcaugug

SEQ ID NO: 402984 - RNA, 21 nt, Human
ugggacuacaggcaugugcca

SEQ ID NO: 402985 - RNA, 26 nt, Human
ugggacuacaggcaugugccaacaca

SEQ ID NO: 402986 - RNA, 18 nt, Human
ugggauuacaggugugag

SEQ ID NO: 402987 - RNA, 19 nt, Human
ugggauuacaggugugagc

SEQ ID NO: 402988 - RNA, 22 nt, Human
ugggauuacaggugugagccac

SEQ ID NO: 402989 - RNA, 22 nt, Human
ugggauuacaggugugagccac

SEQ ID NO: 402990 - RNA, 24 nt, Human
ugggauuacaggugugagccacug

SEQ ID NO: 402991 - RNA, 30 nt, Human
ugggauuacaggugugagccacugcaccaa

SEQ ID NO: 402992 - RNA, 23 nt, Human
ugggguuucacuauguuggucac

SEQ ID NO: 402993 - RNA, 22 nt, Human
ugucccuuaaggaaaccuggaa

SEQ ID NO: 402994 - RNA, 22 nt, Human
ugucccuuaaggaaaccuggag

SEQ ID NO: 402995 - RNA, 24 nt, Human
uucaaacgauucuccugccucagc

SEQ ID NO: 402996 - RNA, 21 nt, Human
uucucuauucuuuuauaguca

SEQ ID NO: 402997 - RNA, 21 nt, Human
uugggauuacaggugugagcc

SEQ ID NO: 402998 - RNA, 24 nt, Human
uuucugcuagcaaacugauaugag

SEQ ID NO: 402999 - RNA, 28 nt, Human
uuucuguuuguuuguuuuggucagauuu

SEQ ID NO: 403000 - RNA, 23 nt, Human
uuuuuuuuuugaaaccaagucuc

SEQ ID NO: 403001 - RNA, 20 nt, Human
uuuuuuuuuuuuuuuuuugg

SEQ ID NO: 403002 - RNA, 20 nt, Human
aaaaaaaagguacaauuugc

SEQ ID NO: 403003 - RNA, 21 nt, Human
aaacaaaaaagguacaauuug

SEQ ID NO: 403004 - RNA, 22 nt, Human
aaagguacaauuugcggcacuu

SEQ ID NO: 403005 - RNA, 23 nt, Human
aaggcaccugguggccaacaucc

SEQ ID NO: 403006 - RNA, 23 nt, Human
accaaccccucccauagcccaca

SEQ ID NO: 403007 - RNA, 20 nt, Human
agcccggcuuuggcuccugg

SEQ ID NO: 403008 - RNA, 25 nt, Human
aggaaauacauaacacuccaaaaac

SEQ ID NO: 403009 - RNA, 25 nt, Human
agguuccagcaugauguaacaauuc

SEQ ID NO: 403010 - RNA, 18 nt, Human
auaagauaacauuuacua

SEQ ID NO: 403011 - RNA, 18 nt, Human
auauacaucuuucuuggc

SEQ ID NO: 403012 - RNA, 22 nt, Human
augacacccucuccacuucagc

SEQ ID NO: 403013 - RNA, 20 nt, Human
augcaguuucucauaagguc

SEQ ID NO: 403014 - RNA, 19 nt, Human
cacuuguggaaaaacaccu

SEQ ID NO: 403015 - RNA, 21 nt, Human
cagggaccaaccccucccaua

SEQ ID NO: 403016 - RNA, 24 nt, Human
caucugaaauauaacuuuagauau

SEQ ID NO: 403017 - RNA, 22 nt, Human
caugccucuuaguagucucaca

SEQ ID NO: 403018 - RNA, 18 nt, Human
cauucaaaggcaauguuu

SEQ ID NO: 403019 - RNA, 24 nt, Human
ccaaacauccaggaaauacauaac

SEQ ID NO: 403020 - RNA, 25 nt, Human
ccaaccccucccauagcccacaugc

SEQ ID NO: 403021 - RNA, 24 nt, Human
cccacaugcaguuucucauaaggu

SEQ ID NO: 403022 - RNA, 23 nt, Human
cccguaauugcuccaaucugguu

SEQ ID NO: 403023 - RNA, 19 nt, Human
ccgcucccuccccuucuug

SEQ ID NO: 403024 - RNA, 20 nt, Human
ccuuagcugcaaguuuuccc

SEQ ID NO: 403025 - RNA, 20 nt, Human
cuccucccucucccgcuccc

SEQ ID NO: 403026 - RNA, 22 nt, Human
cucuccucccucucccgcuccc

SEQ ID NO: 403027 - RNA, 21 nt, Human
cugaaauauaacuuuagauau

SEQ ID NO: 403028 - RNA, 20 nt, Human
cugcggccaacuccggaggc

SEQ ID NO: 403029 - RNA, 25 nt, Human
cuuuuuggcaaugucagcuuucuaa

SEQ ID NO: 403030 - RNA, 19 nt, Human
gaagaaauauacugcauuu

SEQ ID NO: 403031 - RNA, 26 nt, Human
gacacccucuccacuucagggcacuc

SEQ ID NO: 403032 - RNA, 23 nt, Human
gcaaagaaaacauuacaucugaa

SEQ ID NO: 403033 - RNA, 20 nt, Human
gcaccugguggccaacaucc

SEQ ID NO: 403034 - RNA, 21 nt, Human
gcauccauuuuaauuuuuuug

SEQ ID NO: 403035 - RNA, 20 nt, Human
gcauggauacugagucgugu

SEQ ID NO: 403036 - RNA, 20 nt, Human
gcccucucgcuucggagcuc

SEQ ID NO: 403037 - RNA, 23 nt, Human
ggccaugccucuuaguagucuca

SEQ ID NO: 403038 - RNA, 19 nt, Human
uaaaaagaacgaagaaaua

SEQ ID NO: 403039 - RNA, 22 nt, Human
uaaaccacuaauaacuuuucua

SEQ ID NO: 403040 - RNA, 23 nt, Human
uaaggucaacccguaauugcucc

SEQ ID NO: 403041 - RNA, 24 nt, Human
uacaaaauuuaaaaaccauugugu

SEQ ID NO: 403042 - RNA, 25 nt, Human
uacaaaauuuaaaaaccauugugua

SEQ ID NO: 403043 - RNA, 21 nt, Human
uacaucugaaauauaacuuua

SEQ ID NO: 403044 - RNA, 22 nt, Human
uacaucuuucuuggcuuguuuu

SEQ ID NO: 403045 - RNA, 22 nt, Human
uauuguacaguauaagauaaca

SEQ ID NO: 403046 - RNA, 23 nt, Human
ucaauugcgcuagaugacacccu

SEQ ID NO: 403047 - RNA, 22 nt, Human
uccaggaaauacauaacacucc

SEQ ID NO: 403048 - RNA, 20 nt, Human
uccccuucuugucugcggcc

SEQ ID NO: 403049 - RNA, 19 nt, Human
ucuuugguggcuucuaagu

SEQ ID NO: 403050 - RNA, 21 nt, Human
ucuuugguggcuucuaagugu

SEQ ID NO: 403051 - RNA, 24 nt, Human
ugauaaaccacuaauaacuuuucu

SEQ ID NO: 403052 - RNA, 21 nt, Human
uggggcgccgacuuggagccc

SEQ ID NO: 403053 - RNA, 21 nt, Human
uggggcgcgcggacgcguggg

SEQ ID NO: 403054 - RNA, 18 nt, Human
uguaacacaccaugaguc

SEQ ID NO: 403055 - RNA, 18 nt, Human
uuagaaaaaguauuuuuu

SEQ ID NO: 403056 - RNA, 19 nt, Human
uucaacaauuauauaacua

SEQ ID NO: 403057 - RNA, 21 nt, Human
uucagaugauccuucaauugc

SEQ ID NO: 403058 - RNA, 20 nt, Human
uugguggcuucuaaguguug

SEQ ID NO: 403059 - RNA, 23 nt, Human
uuugauauuaggaaacaacauuu

SEQ ID NO: 403060 - RNA, 18 nt, Human
uuugcacaggcuugacaa

SEQ ID NO: 403061 - RNA, 23 nt, Human
uuuuuuuuguuuuuuuuuucagg

SEQ ID NO: 403062 - RNA, 23 nt, Human
uuuuuuuuuuuuuuucagguuuu

SEQ ID NO: 403063 - RNA, 23 nt, Human
uuuuuuuuuuuuuuuuuuucagg

SEQ ID NO: 403064 - RNA, 18 nt, Human
agcggcugaggguggggc

SEQ ID NO: 403065 - RNA, 22 nt, Human
agguggagagugggcggugggg

SEQ ID NO: 403066 - RNA, 22 nt, Human
agugaacacaaugcccuggggg

SEQ ID NO: 403067 - RNA, 20 nt, Human
auaauaauaaaaauaauauc

SEQ ID NO: 403068 - RNA, 19 nt, Human
cagaguacagugaacacaa

SEQ ID NO: 403069 - RNA, 21 nt, Human
cagaguacagugaacacaaug

SEQ ID NO: 403070 - RNA, 20 nt, Human
cccacagaguacagugaaca

SEQ ID NO: 403071 - RNA, 21 nt, Human
cccucacauuugggaacuccu

SEQ ID NO: 403072 - RNA, 20 nt, Human
ccucuagagggaggggcagg

SEQ ID NO: 403073 - RNA, 25 nt, Human
ccucuuagugccugaaguggggucu

SEQ ID NO: 403074 - RNA, 19 nt, Human
gaggguggggcagagggga

SEQ ID NO: 403075 - RNA, 24 nt, Human
gcccugggggucuguggccagggg

SEQ ID NO: 403076 - RNA, 19 nt, Human
ggacccauccuugcccaca

SEQ ID NO: 403077 - RNA, 22 nt, Human
gggcggugggggaguuguaaga

SEQ ID NO: 403078 - RNA, 24 nt, Human
uauccauuuaucaacauuuuguca

SEQ ID NO: 403079 - RNA, 19 nt, Human
uccugccgccagguccagc

SEQ ID NO: 403080 - RNA, 18 nt, Human
ucuagagggaggggcagg

SEQ ID NO: 403081 - RNA, 25 nt, Human
ugaaguggggucuucuggacccauc

SEQ ID NO: 403082 - RNA, 22 nt, Human
ugaggguggggcagaggggacc

SEQ ID NO: 403083 - RNA, 19 nt, Human
ugagguggagagugggcgg

SEQ ID NO: 403084 - RNA, 21 nt, Human
ugagguggagagugggcggug

SEQ ID NO: 403085 - RNA, 18 nt, Human
ugcccugggggucugugg

SEQ ID NO: 403086 - RNA, 21 nt, Human
uggagagugggcgguggggga

SEQ ID NO: 403087 - RNA, 24 nt, Human
uggccuaggcccagucucuuuggc

SEQ ID NO: 403088 - RNA, 18 nt, Human
uggcuuccugccgccagg

SEQ ID NO: 403089 - RNA, 20 nt, Human
ugggcggugggggaguugua

SEQ ID NO: 403090 - RNA, 20 nt, Human
ugucuuguuucucgccccuc

SEQ ID NO: 403091 - RNA, 21 nt, Human
ugugggauggaaaacacguga

SEQ ID NO: 403092 - RNA, 19 nt, Human
uuggcuuccugccgccagg

SEQ ID NO: 403093 - RNA, 21 nt, Human
uuucucgccccucacauuugg

SEQ ID NO: 403094 - RNA, 21 nt, Human
agaaagggaggaaaauagcua

SEQ ID NO: 403095 - RNA, 21 nt, Human
cuuucugcaucucuaccccuc

SEQ ID NO: 403096 - RNA, 19 nt, Human
gguacagagaaagggagga

SEQ ID NO: 403097 - RNA, 19 nt, Human
uguguuuguugauguccug

SEQ ID NO: 403098 - RNA, 22 nt, Human
uguguuuguugauguccugcca

SEQ ID NO: 403099 - RNA, 23 nt, Human
uugaacuuugaagguuggggccu

SEQ ID NO: 403100 - RNA, 18 nt, Human
uuuuuuuuuuuuuuucug

SEQ ID NO: 403101 - RNA, 22 nt, Human
uuuuuuuuuuuuuuuuucuguu

SEQ ID NO: 403102 - RNA, 24 nt, Human
uuuuuuuuuuuuuuuuuuucuguu

SEQ ID NO: 403103 - RNA, 24 nt, Human
uuuuuuuuuuuuuuuuuuuuucuu

SEQ ID NO: 403104 - RNA, 19 nt, Human
aaagugcugggauuacagg

SEQ ID NO: 403105 - RNA, 20 nt, Human
aaagugcugggauuacaggc

SEQ ID NO: 403106 - RNA, 22 nt, Human
aaagugcugggauuacaggcga

SEQ ID NO: 403107 - RNA, 18 nt, Human
aagugcugggauuacagg

SEQ ID NO: 403108 - RNA, 19 nt, Human
aagugcugggauuacaggc

SEQ ID NO: 403109 - RNA, 26 nt, Human
aagugcugggauuacaggcgagagcc

SEQ ID NO: 403110 - RNA, 19 nt, Human
acaggcgagagccaccacg

SEQ ID NO: 403111 - RNA, 19 nt, Human
aggcaggcaccaccacguc

SEQ ID NO: 403112 - RNA, 24 nt, Human
aggugauccgccugccuuggccuc

SEQ ID NO: 403113 - RNA, 25 nt, Human
agguuggagugcaguggugugaucu

SEQ ID NO: 403114 - RNA, 22 nt, Human
aguagagaugggguuuugccau

SEQ ID NO: 403115 - RNA, 19 nt, Human
agugcaguggugugaucuc

SEQ ID NO: 403116 - RNA, 20 nt, Human
agugcaguggugugaucucg

SEQ ID NO: 403117 - RNA, 23 nt, Human
agugcaguggugugaucucggcu

SEQ ID NO: 403118 - RNA, 24 nt, Human
agugcaguggugugaucucggcuc

SEQ ID NO: 403119 - RNA, 18 nt, Human
agugcugggauuacaggc

SEQ ID NO: 403120 - RNA, 20 nt, Human
augggguuuugccauguuag

SEQ ID NO: 403121 - RNA, 24 nt, Human
augggguuuugccauguuagccag

SEQ ID NO: 403122 - RNA, 26 nt, Human
caaagugcugggauuacaggcgagag

SEQ ID NO: 403123 - RNA, 24 nt, Human
caccacguccggcuaauuuuugua

SEQ ID NO: 403124 - RNA, 21 nt, Human
cacugcaaccuccgccucccg

SEQ ID NO: 403125 - RNA, 23 nt, Human
cacugcaaccuccgccucccggg

SEQ ID NO: 403126 - RNA, 19 nt, Human
cagccuccugaguagcugg

SEQ ID NO: 403127 - RNA, 23 nt, Human
caggcaccaccacguccggcuaa

SEQ ID NO: 403128 - RNA, 21 nt, Human
cauguuagccaggcuggucuc

SEQ ID NO: 403129 - RNA, 24 nt, Human
cauguuagccaggcuggucucgaa

SEQ ID NO: 403130 - RNA, 19 nt, Human
ccaaagugcugggauuaca

SEQ ID NO: 403131 - RNA, 20 nt, Human
ccaaagugcugggauuacag

SEQ ID NO: 403132 - RNA, 22 nt, Human
ccaaagugcugggauuacaggc

SEQ ID NO: 403133 - RNA, 23 nt, Human
ccaaagugcugggauuacaggcg

SEQ ID NO: 403134 - RNA, 21 nt, Human
ccagccucugcuucgugaguu

SEQ ID NO: 403135 - RNA, 19 nt, Human
ccauguuagccaggcuggu

SEQ ID NO: 403136 - RNA, 22 nt, Human
ccauguuagccaggcuggucuc

SEQ ID NO: 403137 - RNA, 23 nt, Human
ccauguuagccaggcuggucucg

SEQ ID NO: 403138 - RNA, 22 nt, Human
cccagguuggagugcaguggug

SEQ ID NO: 403139 - RNA, 25 nt, Human
cccggguuuaagcaaaauuauccug

SEQ ID NO: 403140 - RNA, 22 nt, Human
ccucugaguucuccacguguca

SEQ ID NO: 403141 - RNA, 18 nt, Human
ccugaccucaggugaucc

SEQ ID NO: 403142 - RNA, 21 nt, Human
ccugaccucaggugauccgcc

SEQ ID NO: 403143 - RNA, 23 nt, Human
ccugaccucaggugauccgccug

SEQ ID NO: 403144 - RNA, 22 nt, Human
ccugaguagcuggauuacaggc

SEQ ID NO: 403145 - RNA, 23 nt, Human
ccugccucagccuccugaguagc

SEQ ID NO: 403146 - RNA, 22 nt, Human
ccugccuuggccucccaaagug

SEQ ID NO: 403147 - RNA, 24 nt, Human
cucacugcaaccuccgccucccgg

SEQ ID NO: 403148 - RNA, 26 nt, Human
cuccugaccucaggugauccgccugc

SEQ ID NO: 403149 - RNA, 23 nt, Human
cugcaaccuccgccucccggguu

SEQ ID NO: 403150 - RNA, 24 nt, Human
cugcaaccuccgccucccggguuu

SEQ ID NO: 403151 - RNA, 23 nt, Human
cugccucagccuccugaguagcu

SEQ ID NO: 403152 - RNA, 23 nt, Human
cugccuuggccucccaaagugcu

SEQ ID NO: 403153 - RNA, 24 nt, Human
gaccucaggugauccgccugccuu

SEQ ID NO: 403154 - RNA, 20 nt, Human
gagaugggguuuugccaugu

SEQ ID NO: 403155 - RNA, 18 nt, Human
gauuacaggcgagagcca

SEQ ID NO: 403156 - RNA, 20 nt, Human
gccauguuagccaggcuggu

SEQ ID NO: 403157 - RNA, 22 nt, Human
gccuuggccucccaaagugcug

SEQ ID NO: 403158 - RNA, 21 nt, Human
gcguuucccagguuggagugc

SEQ ID NO: 403159 - RNA, 23 nt, Human
gcuggucucgaacuccugaccuc

SEQ ID NO: 403160 - RNA, 22 nt, Human
ggauuacaggcaggcaccacca

SEQ ID NO: 403161 - RNA, 19 nt, Human
ggauuacaggcgagagcca

SEQ ID NO: 403162 - RNA, 24 nt, Human
ggcuggucucgaacuccugaccuc

SEQ ID NO: 403163 - RNA, 22 nt, Human
gggguuuugccauguuagccag

SEQ ID NO: 403164 - RNA, 23 nt, Human
gggguuuugccauguuagccagg

SEQ ID NO: 403165 - RNA, 22 nt, Human
ggguuuugccauguuagccagg

SEQ ID NO: 403166 - RNA, 19 nt, Human
ggucucgaacuccugaccu

SEQ ID NO: 403167 - RNA, 21 nt, Human
ggucucuggagcagggcugac

SEQ ID NO: 403168 - RNA, 22 nt, Human
gguuggagugcaguggugugau

SEQ ID NO: 403169 - RNA, 23 nt, Human
guagagaugggguuuugccaugu

SEQ ID NO: 403170 - RNA, 24 nt, Human
uaauuuuuguauuuuuaguagaga

SEQ ID NO: 403171 - RNA, 23 nt, Human
uacaggcaggcaccaccacgucc

SEQ ID NO: 403172 - RNA, 24 nt, Human
uacaggcgagagccaccacgccca

SEQ ID NO: 403173 - RNA, 22 nt, Human
uagagaugggguuuugccaugu

SEQ ID NO: 403174 - RNA, 24 nt, Human
uagccaggcuggucucgaacuccu

SEQ ID NO: 403175 - RNA, 24 nt, Human
uaguagagaugggguuuugccaug

SEQ ID NO: 403176 - RNA, 23 nt, Human
ucacugcaaccuccgccucccgg

SEQ ID NO: 403177 - RNA, 24 nt, Human
ucacugcaaccuccgccucccggg

SEQ ID NO: 403178 - RNA, 25 nt, Human
ucacugcaaccuccgccucccgggu

SEQ ID NO: 403179 - RNA, 27 nt, Human
ucacugcaaccuccgccucccggguuu

SEQ ID NO: 403180 - RNA, 26 nt, Human
ucacugcguuucccaggucgaacggu

SEQ ID NO: 403181 - RNA, 21 nt, Human
ucagccuccugaguagcugga

SEQ ID NO: 403182 - RNA, 24 nt, Human
ucccaaagugcugggauuacaggc

SEQ ID NO: 403183 - RNA, 23 nt, Human
uccugaguagcuggauuacaggc

SEQ ID NO: 403184 - RNA, 24 nt, Human
uccugaguagcuggauuacaggca

SEQ ID NO: 403185 - RNA, 20 nt, Human
ucgugaguuuucuuuccccu

SEQ ID NO: 403186 - RNA, 26 nt, Human
ucucacugcguuucccagguuggagu

SEQ ID NO: 403187 - RNA, 23 nt, Human
ucucgaacuccugaccucaggug

SEQ ID NO: 403188 - RNA, 18 nt, Human
ugaccucaggugauccgc

SEQ ID NO: 403189 - RNA, 24 nt, Human
ugaccucaggugauccgccugccu

SEQ ID NO: 403190 - RNA, 22 nt, Human
ugcaguggugugaucucggcuc

SEQ ID NO: 403191 - RNA, 24 nt, Human
ugccauguuagccaggcuggucuc

SEQ ID NO: 403192 - RNA, 27 nt, Human
ugccauguuagccaggcuggucucgaa

SEQ ID NO: 403193 - RNA, 24 nt, Human
ugccucagccuccugaguagcugg

SEQ ID NO: 403194 - RNA, 24 nt, Human
ugcguuucccagguuggagugcag

SEQ ID NO: 403195 - RNA, 24 nt, Human
ugcugggauuacaggcgagagcca

SEQ ID NO: 403196 - RNA, 19 nt, Human
uggagugcaguggugugau

SEQ ID NO: 403197 - RNA, 23 nt, Human
uggagugcaguggugugaucucg

SEQ ID NO: 403198 - RNA, 24 nt, Human
uggagugcaguggugugaucucgg

SEQ ID NO: 403199 - RNA, 19 nt, Human
uggauuacaggcaggcacc

SEQ ID NO: 403200 - RNA, 23 nt, Human
uggauuacaggcaggcaccacca

SEQ ID NO: 403201 - RNA, 18 nt, Human
ugggauuacaggcgagag

SEQ ID NO: 403202 - RNA, 19 nt, Human
ugggauuacaggcgagagc

SEQ ID NO: 403203 - RNA, 21 nt, Human
ugggauuacaggcgagagcca

SEQ ID NO: 403204 - RNA, 22 nt, Human
ugggauuacaggcgagagccac

SEQ ID NO: 403205 - RNA, 23 nt, Human
ugggauuacaggcgagagccacc

SEQ ID NO: 403206 - RNA, 24 nt, Human
ugggauuacaggcgagagccacca

SEQ ID NO: 403207 - RNA, 24 nt, Human
ugggguuuugccauguuagccagg

SEQ ID NO: 403208 - RNA, 18 nt, Human
uuaguagagaugggguuu

SEQ ID NO: 403209 - RNA, 22 nt, Human
uuaguagagaugggguuuugcc

SEQ ID NO: 403210 - RNA, 24 nt, Human
uuaguagagaugggguuuugccau

SEQ ID NO: 403211 - RNA, 24 nt, Human
uucccagguuggagugcaguggug

SEQ ID NO: 403212 - RNA, 24 nt, Human
uugccauguuagccaggcuggucu

SEQ ID NO: 403213 - RNA, 18 nt, Human
uuggccucccaaagugcu

SEQ ID NO: 403214 - RNA, 23 nt, Human
uuguauuuuuaguagagaugggg

SEQ ID NO: 403215 - RNA, 24 nt, Human
uuucccagguuggagugcaguggu

SEQ ID NO: 403216 - RNA, 23 nt, Human
uuuugccauguuagccaggcugg

SEQ ID NO: 403217 - RNA, 20 nt, Human
uuuuguauuuuuaguagaga

SEQ ID NO: 403218 - RNA, 21 nt, Human
uuuuuaguagagaugggguuu

SEQ ID NO: 403219 - RNA, 21 nt, Human
uuuuuaguagagaugggguuu

SEQ ID NO: 403220 - RNA, 20 nt, Human
uuuuuguauuuuuaguagag

SEQ ID NO: 403221 - RNA, 20 nt, Human
uuuuuuuuuuuugaggcaca

SEQ ID NO: 403222 - RNA, 27 nt, Human
uuuuuuuuuuuuugaggcacagucuca

SEQ ID NO: 403223 - RNA, 18 nt, Human
uuuuuuuuuuuuuuuuug

SEQ ID NO: 403224 - RNA, 21 nt, Human
uuuuuuuuuuuuuuuuugagg

SEQ ID NO: 403225 - RNA, 19 nt, Human
aaaaauuggugaaggauuu

SEQ ID NO: 403226 - RNA, 23 nt, Human
aaacucuacugaauacaagcaac

SEQ ID NO: 403227 - RNA, 24 nt, Human
aaaguguugggauuacagguguga

SEQ ID NO: 403228 - RNA, 21 nt, Human
aacucgccaauccuccaaccc

SEQ ID NO: 403229 - RNA, 21 nt, Human
aaguguugggauuacaggugu

SEQ ID NO: 403230 - RNA, 26 nt, Human
aaguguugggauuacaggugugagcc

SEQ ID NO: 403231 - RNA, 18 nt, Human
aaugcccccuacucccgg

SEQ ID NO: 403232 - RNA, 24 nt, Human
aauuuuguauuuuuaguagagaug

SEQ ID NO: 403233 - RNA, 18 nt, Human
accacgcccggcuaauuu

SEQ ID NO: 403234 - RNA, 19 nt, Human
acccaggcuggagugcaau

SEQ ID NO: 403235 - RNA, 24 nt, Human
agaugauccacccaccuuggccuc

SEQ ID NO: 403236 - RNA, 23 nt, Human
aggauuacagccaugcgcuacca

SEQ ID NO: 403237 - RNA, 19 nt, Human
agugcaauggcgcgaucug

SEQ ID NO: 403238 - RNA, 24 nt, Human
augauccacccaccuuggccuccc

SEQ ID NO: 403239 - RNA, 20 nt, Human
augggguuucuccacguugg

SEQ ID NO: 403240 - RNA, 21 nt, Human
augggguuucuccacguuggu

SEQ ID NO: 403241 - RNA, 24 nt, Human
augggguuucuccacguuggucag

SEQ ID NO: 403242 - RNA, 24 nt, Human
auuugcucucuucagccuuuuucc

SEQ ID NO: 403243 - RNA, 22 nt, Human
caaaauaggugggcaagaaaac

SEQ ID NO: 403244 - RNA, 24 nt, Human
caaaguguugggauuacaggugug

SEQ ID NO: 403245 - RNA, 22 nt, Human
caagcaauucuucugccucggc

SEQ ID NO: 403246 - RNA, 22 nt, Human
cacccaccuuggccucccaaag

SEQ ID NO: 403247 - RNA, 23 nt, Human
cacccaccuuggccucccaaagu

SEQ ID NO: 403248 - RNA, 21 nt, Human
cacugcgccuggccaagacug

SEQ ID NO: 403249 - RNA, 18 nt, Human
cagaggacuuucauauaa

SEQ ID NO: 403250 - RNA, 20 nt, Human
cagaggacuuucauauaaug

SEQ ID NO: 403251 - RNA, 20 nt, Human
cauagcuaaaccguuguccc

SEQ ID NO: 403252 - RNA, 18 nt, Human
cauuguauagcaggaggu

SEQ ID NO: 403253 - RNA, 20 nt, Human
cauuguauagcaggaggugu

SEQ ID NO: 403254 - RNA, 21 nt, Human
ccaaaguguugggauuacagg

SEQ ID NO: 403255 - RNA, 21 nt, Human
ccaaaguguugggauuacagg

SEQ ID NO: 403256 - RNA, 24 nt, Human
ccaaaguguugggauuacaggugu

SEQ ID NO: 403257 - RNA, 19 nt, Human
ccacguuggucaggcuggu

SEQ ID NO: 403258 - RNA, 19 nt, Human
ccccaaauuucauagcuaa

SEQ ID NO: 403259 - RNA, 24 nt, Human
ccccuacucccggccccaagaaaa

SEQ ID NO: 403260 - RNA, 24 nt, Human
cccggccuuagaugauccacccac

SEQ ID NO: 403261 - RNA, 24 nt, Human
ccgcaaccucugccuccccaguuc

SEQ ID NO: 403262 - RNA, 23 nt, Human
ccuguggaaugcccccuacuccc

SEQ ID NO: 403263 - RNA, 19 nt, Human
cgcaaccucugccucccca

SEQ ID NO: 403264 - RNA, 19 nt, Human
cggccccaagaaaaccccu

SEQ ID NO: 403265 - RNA, 19 nt, Human
cggccuccugaguagccag

SEQ ID NO: 403266 - RNA, 22 nt, Human
cguuggucaggcuggucuugaa

SEQ ID NO: 403267 - RNA, 24 nt, Human
cuaauuuuguauuuuuaguagaga

SEQ ID NO: 403268 - RNA, 25 nt, Human
cucaccgcaaccucugccuccccag

SEQ ID NO: 403269 - RNA, 24 nt, Human
cuccacguuggucaggcuggucuu

SEQ ID NO: 403270 - RNA, 18 nt, Human
cucccggccccaagaaaa

SEQ ID NO: 403271 - RNA, 21 nt, Human
cucccggccccaagaaaaccc

SEQ ID NO: 403272 - RNA, 27 nt, Human
cucccggccuuagaugauccacccacc

SEQ ID NO: 403273 - RNA, 22 nt, Human
cugccucggccuccugaguagc

SEQ ID NO: 403274 - RNA, 24 nt, Human
cuuagaugauccacccaccuuggc

SEQ ID NO: 403275 - RNA, 24 nt, Human
cuuguuacccaggcuggagugcaa

SEQ ID NO: 403276 - RNA, 20 nt, Human
gagaugggguuucuccacgu

SEQ ID NO: 403277 - RNA, 24 nt, Human
gagaugggguuucuccacguuggu

SEQ ID NO: 403278 - RNA, 24 nt, Human
gaguagccaggauuacagccaugc

SEQ ID NO: 403279 - RNA, 18 nt, Human
gauuacaggugugagcca

SEQ ID NO: 403280 - RNA, 19 nt, Human
gauuacaggugugagccac

SEQ ID NO: 403281 - RNA, 22 nt, Human
gauuacaggugugagccacugc

SEQ ID NO: 403282 - RNA, 21 nt, Human
gcucaccgcaaccucugccuc

SEQ ID NO: 403283 - RNA, 20 nt, Human
gcucuuguuacccaggcugg

SEQ ID NO: 403284 - RNA, 21 nt, Human
gcucuuguuacccaggcugga

SEQ ID NO: 403285 - RNA, 24 nt, Human
gcucuuguuacccaggcuggagug

SEQ ID NO: 403286 - RNA, 24 nt, Human
gcuggagugcaauggcgcgaucug

SEQ ID NO: 403287 - RNA, 24 nt, Human
ggccuuagaugauccacccaccuu

SEQ ID NO: 403288 - RNA, 23 nt, Human
ggcuggucuugaacucccggccu

SEQ ID NO: 403289 - RNA, 22 nt, Human
gggguuucuccacguuggucag

SEQ ID NO: 403290 - RNA, 22 nt, Human
ggguuucuccacguuggucagg

SEQ ID NO: 403291 - RNA, 20 nt, Human
guggaaugcccccuacuccc

SEQ ID NO: 403292 - RNA, 22 nt, Human
uacagccaugcgcuaccacgcc

SEQ ID NO: 403293 - RNA, 22 nt, Human
uacaggugugagccacugcgcc

SEQ ID NO: 403294 - RNA, 23 nt, Human
uacaggugugagccacugcgccu

SEQ ID NO: 403295 - RNA, 21 nt, Human
uacccaggcuggagugcaaug

SEQ ID NO: 403296 - RNA, 24 nt, Human
uacccaggcuggagugcaauggcg

SEQ ID NO: 403297 - RNA, 18 nt, Human
uaguagagaugggguuuc

SEQ ID NO: 403298 - RNA, 19 nt, Human
uaguagagaugggguuucu

SEQ ID NO: 403299 - RNA, 24 nt, Human
uaguagagaugggguuucuccacg

SEQ ID NO: 403300 - RNA, 25 nt, Human
ucaauccugacccgaguagaucauc

SEQ ID NO: 403301 - RNA, 19 nt, Human
ucaccgcaaccucugccuc

SEQ ID NO: 403302 - RNA, 27 nt, Human
ucaccgcaaccucugccuccccaguuc

SEQ ID NO: 403303 - RNA, 24 nt, Human
uccacguuggucaggcuggucuug

SEQ ID NO: 403304 - RNA, 23 nt, Human
ucccaaaguguugggauuacagg

SEQ ID NO: 403305 - RNA, 24 nt, Human
uccccaguucaagcaauucuucug

SEQ ID NO: 403306 - RNA, 23 nt, Human
ucccuguggaaugcccccuacuc

SEQ ID NO: 403307 - RNA, 19 nt, Human
uccugaguagccaggauua

SEQ ID NO: 403308 - RNA, 24 nt, Human
ucuagagcuuuccuuggacuuccu

SEQ ID NO: 403309 - RNA, 18 nt, Human
ucuuguuacccaggcugg

SEQ ID NO: 403310 - RNA, 19 nt, Human
ucuuguuacccaggcugga

SEQ ID NO: 403311 - RNA, 24 nt, Human
ugauccacccaccuuggccuccca

SEQ ID NO: 403312 - RNA, 22 nt, Human
ugccucggccuccugaguagcc

SEQ ID NO: 403313 - RNA, 23 nt, Human
ugccucggccuccugaguagcca

SEQ ID NO: 403314 - RNA, 24 nt, Human
ugccucggccuccugaguagccag

SEQ ID NO: 403315 - RNA, 21 nt, Human
ugcucuuguuacccaggcugg

SEQ ID NO: 403316 - RNA, 24 nt, Human
ugcucuuguuacccaggcuggagu

SEQ ID NO: 403317 - RNA, 23 nt, Human
uggagugcaauggcgcgaucugg

SEQ ID NO: 403318 - RNA, 18 nt, Human
ugggauuacaggugugag

SEQ ID NO: 403319 - RNA, 19 nt, Human
ugggauuacaggugugagc

SEQ ID NO: 403320 - RNA, 21 nt, Human
ugggauuacaggugugagcca

SEQ ID NO: 403321 - RNA, 22 nt, Human
ugggauuacaggugugagccac

SEQ ID NO: 403322 - RNA, 22 nt, Human
ugggauuacaggugugagccac

SEQ ID NO: 403323 - RNA, 24 nt, Human
ugggauuacaggugugagccacug

SEQ ID NO: 403324 - RNA, 24 nt, Human
ugggguuucuccacguuggucagg

SEQ ID NO: 403325 - RNA, 23 nt, Human
uggucaggcuggucuugaacucc

SEQ ID NO: 403326 - RNA, 21 nt, Human
uguauuuuuaguagagauggg

SEQ ID NO: 403327 - RNA, 25 nt, Human
uguguacauaaucaaaagaaaggua

SEQ ID NO: 403328 - RNA, 25 nt, Human
ugugugaacauucaugagacauacc

SEQ ID NO: 403329 - RNA, 20 nt, Human
uguuacccaggcuggagugc

SEQ ID NO: 403330 - RNA, 18 nt, Human
uuacccaggcuggagugc

SEQ ID NO: 403331 - RNA, 18 nt, Human
uuaguagagaugggguuu

SEQ ID NO: 403332 - RNA, 24 nt, Human
uucaagcaauucuucugccucggc

SEQ ID NO: 403333 - RNA, 24 nt, Human
uuccuuggacuuccuucaaagcuc

SEQ ID NO: 403334 - RNA, 23 nt, Human
uugcucuuguuacccaggcugga

SEQ ID NO: 403335 - RNA, 21 nt, Human
uugggauuacaggugugagcc

SEQ ID NO: 403336 - RNA, 21 nt, Human
uuugauauacaugugaaacuc

SEQ ID NO: 403337 - RNA, 24 nt, Human
uuugcucuuguuacccaggcugga

SEQ ID NO: 403338 - RNA, 24 nt, Human
uuuugcucuuguuacccaggcugg

SEQ ID NO: 403339 - RNA, 19 nt, Human
uuuuguauuuuuaguagag

SEQ ID NO: 403340 - RNA, 20 nt, Human
uuuuguauuuuuaguagaga

SEQ ID NO: 403341 - RNA, 22 nt, Human
uuuuuaguagagaugggguuuc

SEQ ID NO: 403342 - RNA, 21 nt, Human
uuuuuuuuuuuggacagaguu

SEQ ID NO: 403343 - RNA, 18 nt, Human
uuuuuuuuuuuuuuuuug

SEQ ID NO: 403344 - RNA, 20 nt, Human
aaacaggaaaaaaaaaucca

SEQ ID NO: 403345 - RNA, 21 nt, Human
aaacaggaaaaaaaaauccaa

SEQ ID NO: 403346 - RNA, 22 nt, Human
aaagaaaagcaagacccagaaa

SEQ ID NO: 403347 - RNA, 24 nt, Human
aaauacauaucucaaaaauuuaug

SEQ ID NO: 403348 - RNA, 25 nt, Human
aacacagaaucauccagaaagauuc

SEQ ID NO: 403349 - RNA, 20 nt, Human
aacuauguuuggaggcuggg

SEQ ID NO: 403350 - RNA, 19 nt, Human
aagaaaagcaagacccaga

SEQ ID NO: 403351 - RNA, 21 nt, Human
aagaggaaauagaaaacagga

SEQ ID NO: 403352 - RNA, 27 nt, Human
aagcaaaaugguaaagaaaagggaccc

SEQ ID NO: 403353 - RNA, 24 nt, Human
aagggcgaacagcccuccaccuuu

SEQ ID NO: 403354 - RNA, 20 nt, Human
aauaaguuaucucacucucc

SEQ ID NO: 403355 - RNA, 20 nt, Human
acaacauauacuuaggccug

SEQ ID NO: 403356 - RNA, 24 nt, Human
acaagaaaaucucucuuaagucac

SEQ ID NO: 403357 - RNA, 25 nt, Human
acacacacacacaaacacacacaca

SEQ ID NO: 403358 - RNA, 26 nt, Human
acacacacacacacaaacacacacaa

SEQ ID NO: 403359 - RNA, 21 nt, Human
acacacacacacacacacaca

SEQ ID NO: 403360 - RNA, 24 nt, Human
acacagaaucauccagaaagauuc

SEQ ID NO: 403361 - RNA, 24 nt, Human
acagaaagaaaagcaagacccaga

SEQ ID NO: 403362 - RNA, 21 nt, Human
acagcgccauaagcauaacac

SEQ ID NO: 403363 - RNA, 21 nt, Human
acccagaaaugggaaaugacu

SEQ ID NO: 403364 - RNA, 19 nt, Human
accccacuccuucacuccu

SEQ ID NO: 403365 - RNA, 21 nt, Human
accuuggagaggccgcuuugg

SEQ ID NO: 403366 - RNA, 22 nt, Human
agaaaacaggaaaaaaaaaucc

SEQ ID NO: 403367 - RNA, 25 nt, Human
agacaaacacacacaacauauacuu

SEQ ID NO: 403368 - RNA, 20 nt, Human
agacggcucucuucaagucc

SEQ ID NO: 403369 - RNA, 21 nt, Human
agaggccgcuuuggcuuccag

SEQ ID NO: 403370 - RNA, 20 nt, Human
agauucauaaccccacuccu

SEQ ID NO: 403371 - RNA, 20 nt, Human
agcaggccaggugcacccaa

SEQ ID NO: 403372 - RNA, 22 nt, Human
aggcaauaugcaaacugcaauc

SEQ ID NO: 403373 - RNA, 21 nt, Human
aggcaggaggaugagcaugug

SEQ ID NO: 403374 - RNA, 20 nt, Human
agggcgaacagcccuccacc

SEQ ID NO: 403375 - RNA, 20 nt, Human
auaacacuguaagcauaaga

SEQ ID NO: 403376 - RNA, 23 nt, Human
auaaccccacuccuucacuccuu

SEQ ID NO: 403377 - RNA, 20 nt, Human
auagacauuuaauaugugca

SEQ ID NO: 403378 - RNA, 19 nt, Human
aucauccagaaagauucug

SEQ ID NO: 403379 - RNA, 18 nt, Human
augcccuguccaccccca

SEQ ID NO: 403380 - RNA, 23 nt, Human
augcccuguccacccccagcuug

SEQ ID NO: 403381 - RNA, 23 nt, Human
caaaaugguaaagaaaaaaagca

SEQ ID NO: 403382 - RNA, 22 nt, Human
cacacaaacacacacacaaucu

SEQ ID NO: 403383 - RNA, 21 nt, Human
cacacacaaacacacacacaa

SEQ ID NO: 403384 - RNA, 28 nt, Human
cacacacacacacacaaacacacacaca

SEQ ID NO: 403385 - RNA, 20 nt, Human
cacacacacacacacacaca

SEQ ID NO: 403386 - RNA, 19 nt, Human
cacugcacaucugugagaa

SEQ ID NO: 403387 - RNA, 22 nt, Human
caggaaagcacuaaauacaaaa

SEQ ID NO: 403388 - RNA, 20 nt, Human
caggaucugcuucuugucac

SEQ ID NO: 403389 - RNA, 20 nt, Human
cagggaaacaugugcuacaa

SEQ ID NO: 403390 - RNA, 18 nt, Human
cagggacugagacacaca

SEQ ID NO: 403391 - RNA, 19 nt, Human
cauauacuuaggccugcau

SEQ ID NO: 403392 - RNA, 21 nt, Human
caucacauccccagacaguuc

SEQ ID NO: 403393 - RNA, 24 nt, Human
ccaauagaaacaaugcaucuugaa

SEQ ID NO: 403394 - RNA, 25 nt, Human
ccagcuugguguucaugcuggugcc

SEQ ID NO: 403395 - RNA, 22 nt, Human
ccaggcuauuaaaauccguacu

SEQ ID NO: 403396 - RNA, 18 nt, Human
cccagacaguucuuugaa

SEQ ID NO: 403397 - RNA, 18 nt, Human
cccugaggggugggggcg

SEQ ID NO: 403398 - RNA, 18 nt, Human
cccuguauacaagaaaau

SEQ ID NO: 403399 - RNA, 21 nt, Human
ccugcccaguauacuuaagaa

SEQ ID NO: 403400 - RNA, 20 nt, Human
cuccuugcuccucuucauuu

SEQ ID NO: 403401 - RNA, 19 nt, Human
cugaggaagauguaagcuu

SEQ ID NO: 403402 - RNA, 24 nt, Human
cuggugccugguuuuagauauugc

SEQ ID NO: 403403 - RNA, 18 nt, Human
cuucacuccuugcuccuc

SEQ ID NO: 403404 - RNA, 18 nt, Human
cuugaagaagaggcaucu

SEQ ID NO: 403405 - RNA, 21 nt, Human
gaaaaaaaaauccaacugaga

SEQ ID NO: 403406 - RNA, 19 nt, Human
gaaaagcaagacccagaaa

SEQ ID NO: 403407 - RNA, 19 nt, Human
gaagguggagugaggcugg

SEQ ID NO: 403408 - RNA, 20 nt, Human
gaagguggagugaggcuggu

SEQ ID NO: 403409 - RNA, 19 nt, Human
gaaguguacacuccuugac

SEQ ID NO: 403410 - RNA, 21 nt, Human
gagcaccuaagagaggggacc

SEQ ID NO: 403411 - RNA, 22 nt, Human
gauucuucuuuugaacccccac

SEQ ID NO: 403412 - RNA, 18 nt, Human
gcagauucauaaccccac

SEQ ID NO: 403413 - RNA, 21 nt, Human
gcauaggcaggaggaugagca

SEQ ID NO: 403414 - RNA, 18 nt, Human
gcuugguguucaugcugg

SEQ ID NO: 403415 - RNA, 19 nt, Human
ggaccugcccaguauacuu

SEQ ID NO: 403416 - RNA, 19 nt, Human
gggcgggagggccaggauc

SEQ ID NO: 403417 - RNA, 21 nt, Human
ggggaccugcccaguauacuu

SEQ ID NO: 403418 - RNA, 18 nt, Human
ggggugggggcgggaggg

SEQ ID NO: 403419 - RNA, 23 nt, Human
ggugcacccaaagcgagugagca

SEQ ID NO: 403420 - RNA, 23 nt, Human
gugaagccagauaucauugaaua

SEQ ID NO: 403421 - RNA, 19 nt, Human
gugguauuucuuagacggc

SEQ ID NO: 403422 - RNA, 23 nt, Human
uaacacuguaagcauaagauucu

SEQ ID NO: 403423 - RNA, 25 nt, Human
uaacagaaagaaaagcaagacccag

SEQ ID NO: 403424 - RNA, 26 nt, Human
uaacagaaagaaaagcaagacccaga

SEQ ID NO: 403425 - RNA, 20 nt, Human
uacacacacacacacacaca

SEQ ID NO: 403426 - RNA, 19 nt, Human
uacuauuccauugaagccc

SEQ ID NO: 403427 - RNA, 19 nt, Human
uacuuaggccugcaugugc

SEQ ID NO: 403428 - RNA, 20 nt, Human
uaugacaauugccugaccaa

SEQ ID NO: 403429 - RNA, 22 nt, Human
uauggucuaugguauuucuaga

SEQ ID NO: 403430 - RNA, 21 nt, Human
uauuuuuucuuucucacaaag

SEQ ID NO: 403431 - RNA, 24 nt, Human
ucaaagacaaacacacacaacaua

SEQ ID NO: 403432 - RNA, 20 nt, Human
ucauuuaacagaaagaaaag

SEQ ID NO: 403433 - RNA, 21 nt, Human
uccagaaaaaaauacauucaa

SEQ ID NO: 403434 - RNA, 20 nt, Human
uccagcaaaugguagucagg

SEQ ID NO: 403435 - RNA, 23 nt, Human
uccagcaaaugguagucagguac

SEQ ID NO: 403436 - RNA, 19 nt, Human
ucccugaggggugggggcg

SEQ ID NO: 403437 - RNA, 20 nt, Human
ucccugaggggugggggcgg

SEQ ID NO: 403438 - RNA, 19 nt, Human
ucccugugugguugcagag

SEQ ID NO: 403439 - RNA, 19 nt, Human
ucugcuucuugucacaucc

SEQ ID NO: 403440 - RNA, 19 nt, Human
ucuuaaauauuaccuauag

SEQ ID NO: 403441 - RNA, 23 nt, Human
ucuuggggugugacggcuccacc

SEQ ID NO: 403442 - RNA, 20 nt, Human
ugaaauacacacacacacac

SEQ ID NO: 403443 - RNA, 27 nt, Human
ugaaggacucacaaagauggcugagga

SEQ ID NO: 403444 - RNA, 23 nt, Human
ugacuuucccaagguuacauggc

SEQ ID NO: 403445 - RNA, 19 nt, Human
ugaggggugggggcgggag

SEQ ID NO: 403446 - RNA, 22 nt, Human
ugaggggugggggcgggagggc

SEQ ID NO: 403447 - RNA, 19 nt, Human
ugccugaccaauagaaaca

SEQ ID NO: 403448 - RNA, 18 nt, Human
ugcuucuugucacauccc

SEQ ID NO: 403449 - RNA, 20 nt, Human
uggaaggaagguggagugag

SEQ ID NO: 403450 - RNA, 24 nt, Human
uggaaggaagguggagugaggcug

SEQ ID NO: 403451 - RNA, 25 nt, Human
uggaaggaagguggagugaggcugg

SEQ ID NO: 403452 - RNA, 20 nt, Human
uggcugaggaagauguaagc

SEQ ID NO: 403453 - RNA, 19 nt, Human
uggggugugacggcuaggc

SEQ ID NO: 403454 - RNA, 19 nt, Human
ugugugguugcagaggcca

SEQ ID NO: 403455 - RNA, 23 nt, Human
uguuagauauuuaacauuccucu

SEQ ID NO: 403456 - RNA, 21 nt, Human
uucacaaucuggguagaggga

SEQ ID NO: 403457 - RNA, 22 nt, Human
uugaaaaugucagggaaacaug

SEQ ID NO: 403458 - RNA, 20 nt, Human
uugaagaagaggcaucuauu

SEQ ID NO: 403459 - RNA, 21 nt, Human
uugaaggacucacaaagaugg

SEQ ID NO: 403460 - RNA, 22 nt, Human
uuucccacaaaacucugccaug

SEQ ID NO: 403461 - RNA, 22 nt, Human
uuuggcagauucauaaccccac

SEQ ID NO: 403462 - RNA, 19 nt, Human
aaagagaaugaauaacugu

SEQ ID NO: 403463 - RNA, 24 nt, Human
aaauacagucauuucguaaugagg

SEQ ID NO: 403464 - RNA, 22 nt, Human
aacagggggugggcuuaaccgc

SEQ ID NO: 403465 - RNA, 18 nt, Human
agagacugggggagggaa

SEQ ID NO: 403466 - RNA, 25 nt, Human
agagauagggacaggguggaaagaa

SEQ ID NO: 403467 - RNA, 23 nt, Human
agagauugaaagagaaugaauaa

SEQ ID NO: 403468 - RNA, 18 nt, Human
aggaacccagagucaacc

SEQ ID NO: 403469 - RNA, 21 nt, Human
agggacaggguggaaagaaga

SEQ ID NO: 403470 - RNA, 23 nt, Human
aguuaucugcuguuuacucagaa

SEQ ID NO: 403471 - RNA, 20 nt, Human
auccauggaaagacacugca

SEQ ID NO: 403472 - RNA, 23 nt, Human
auggagcagggcccguuuugguu

SEQ ID NO: 403473 - RNA, 20 nt, Human
cacugcacgcaaagaaacaa

SEQ ID NO: 403474 - RNA, 22 nt, Human
cacugcacgcaaagaaacaaaa

SEQ ID NO: 403475 - RNA, 27 nt, Human
cagcuccaccacagccugcaaggugac

SEQ ID NO: 403476 - RNA, 20 nt, Human
cagggcccguuuugguuuca

SEQ ID NO: 403477 - RNA, 20 nt, Human
ccccauuucccuucugcauc

SEQ ID NO: 403478 - RNA, 22 nt, Human
ccuccaacaaggccauaggaac

SEQ ID NO: 403479 - RNA, 24 nt, Human
cuccccauuucccuucugcaucuu

SEQ ID NO: 403480 - RNA, 19 nt, Human
cugcacgcaaagaaacaaa

SEQ ID NO: 403481 - RNA, 24 nt, Human
cuggaugucugcaucagugggguu

SEQ ID NO: 403482 - RNA, 18 nt, Human
cuggcccccuccaacaag

SEQ ID NO: 403483 - RNA, 19 nt, Human
cuggcccccuccaacaagg

SEQ ID NO: 403484 - RNA, 24 nt, Human
cuggcccccuccaacaaggccaua

SEQ ID NO: 403485 - RNA, 20 nt, Human
gacaaagggaaacagagaga

SEQ ID NO: 403486 - RNA, 20 nt, Human
gaggagugggcaggcucagg

SEQ ID NO: 403487 - RNA, 20 nt, Human
gagggaagagacugacaaag

SEQ ID NO: 403488 - RNA, 22 nt, Human
ggacaggguggaaagaagagaa

SEQ ID NO: 403489 - RNA, 24 nt, Human
gggaaacagagagauugagaaaga

SEQ ID NO: 403490 - RNA, 24 nt, Human
gggagggaagagacugacaaaggg

SEQ ID NO: 403491 - RNA, 24 nt, Human
ggggagggaagagacugacaaagg

SEQ ID NO: 403492 - RNA, 25 nt, Human
ggguggcgggggggggggggggggu

SEQ ID NO: 403493 - RNA, 20 nt, Human
gugagcugaggcuccccauu

SEQ ID NO: 403494 - RNA, 23 nt, Human
guggcgggggggggggggggggu

SEQ ID NO: 403495 - RNA, 21 nt, Human
gugugugugugugugugugug

SEQ ID NO: 403496 - RNA, 21 nt, Human
gugugugugugugugugugug

SEQ ID NO: 403497 - RNA, 21 nt, Human
gugugugugugugugugugug

SEQ ID NO: 403498 - RNA, 21 nt, Human
gugugugugugugugugugug

SEQ ID NO: 403499 - RNA, 21 nt, Human
gugugugugugugugugugug

SEQ ID NO: 403500 - RNA, 21 nt, Human
gugugugugugugugugugug

SEQ ID NO: 403501 - RNA, 21 nt, Human
gugugugugugugugugugug

SEQ ID NO: 403502 - RNA, 21 nt, Human
gugugugugugugugugugug

SEQ ID NO: 403503 - RNA, 19 nt, Human
uaacaagauaauuacaagu

SEQ ID NO: 403504 - RNA, 19 nt, Human
uaagcucuuauggagcagg

SEQ ID NO: 403505 - RNA, 18 nt, Human
uaggaacccagagucaac

SEQ ID NO: 403506 - RNA, 20 nt, Human
uaggacucucuggaugucug

SEQ ID NO: 403507 - RNA, 21 nt, Human
uaggcaguuaacagggggugg

SEQ ID NO: 403508 - RNA, 21 nt, Human
uauagugguagagauagggac

SEQ ID NO: 403509 - RNA, 21 nt, Human
ucagcuccaccacagccugca

SEQ ID NO: 403510 - RNA, 23 nt, Human
ucagugggguugcugcuucagau

SEQ ID NO: 403511 - RNA, 21 nt, Human
uccaccacagccugcaaggug

SEQ ID NO: 403512 - RNA, 19 nt, Human
uccgagaggguggcggggg

SEQ ID NO: 403513 - RNA, 20 nt, Human
ucuauagugguagagauagg

SEQ ID NO: 403514 - RNA, 21 nt, Human
ucuggaaacaauggagacugc

SEQ ID NO: 403515 - RNA, 24 nt, Human
ucugugugugugugugugugugug

SEQ ID NO: 403516 - RNA, 26 nt, Human
ugacucugugugugugugugugugug

SEQ ID NO: 403517 - RNA, 21 nt, Human
ugagaagagagacugggggag

SEQ ID NO: 403518 - RNA, 19 nt, Human
uggaaacaauggagacugc

SEQ ID NO: 403519 - RNA, 23 nt, Human
uggaaagacacugcacgcaaaga

SEQ ID NO: 403520 - RNA, 24 nt, Human
uggaugucugcaucagugggguug

SEQ ID NO: 403521 - RNA, 18 nt, Human
ugugugugugugugugug

SEQ ID NO: 403522 - RNA, 18 nt, Human
ugugugugugugugugug

SEQ ID NO: 403523 - RNA, 18 nt, Human
ugugugugugugugugug

SEQ ID NO: 403524 - RNA, 18 nt, Human
ugugugugugugugugug

SEQ ID NO: 403525 - RNA, 18 nt, Human
ugugugugugugugugug

SEQ ID NO: 403526 - RNA, 18 nt, Human
ugugugugugugugugug

SEQ ID NO: 403527 - RNA, 18 nt, Human
ugugugugugugugugug

SEQ ID NO: 403528 - RNA, 18 nt, Human
ugugugugugugugugug

SEQ ID NO: 403529 - RNA, 18 nt, Human
ugugugugugugugugug

SEQ ID NO: 403530 - RNA, 18 nt, Human
ugugugugugugugugug

SEQ ID NO: 403531 - RNA, 18 nt, Human
ugugugugugugugugug

SEQ ID NO: 403532 - RNA, 18 nt, Human
ugugugugugugugugug

SEQ ID NO: 403533 - RNA, 18 nt, Human
ugugugugugugugugug

SEQ ID NO: 403534 - RNA, 18 nt, Human
ugugugugugugugugug

SEQ ID NO: 403535 - RNA, 18 nt, Human
ugugugugugugugugug

SEQ ID NO: 403536 - RNA, 18 nt, Human
ugugugugugugugugug

SEQ ID NO: 403537 - RNA, 18 nt, Human
ugugugugugugugugug

SEQ ID NO: 403538 - RNA, 18 nt, Human
ugugugugugugugugug

SEQ ID NO: 403539 - RNA, 18 nt, Human
ugugugugugugugugug

SEQ ID NO: 403540 - RNA, 18 nt, Human
ugugugugugugugugug

SEQ ID NO: 403541 - RNA, 18 nt, Human
ugugugugugugugugug

SEQ ID NO: 403542 - RNA, 18 nt, Human
ugugugugugugugugug

SEQ ID NO: 403543 - RNA, 18 nt, Human
ugugugugugugugugug

SEQ ID NO: 403544 - RNA, 18 nt, Human
ugugugugugugugugug

SEQ ID NO: 403545 - RNA, 21 nt, Human
ugugugugugugugugugugu

SEQ ID NO: 403546 - RNA, 21 nt, Human
ugugugugugugugugugugu

SEQ ID NO: 403547 - RNA, 21 nt, Human
ugugugugugugugugugugu

SEQ ID NO: 403548 - RNA, 21 nt, Human
ugugugugugugugugugugu

SEQ ID NO: 403549 - RNA, 21 nt, Human
ugugugugugugugugugugu

SEQ ID NO: 403550 - RNA, 21 nt, Human
ugugugugugugugugugugu

SEQ ID NO: 403551 - RNA, 21 nt, Human
ugugugugugugugugugugu

SEQ ID NO: 403552 - RNA, 21 nt, Human
ugugugugugugugugugugu

SEQ ID NO: 403553 - RNA, 21 nt, Human
ugugugugugugugugugugu

SEQ ID NO: 403554 - RNA, 21 nt, Human
ugugugugugugugugugugu

SEQ ID NO: 403555 - RNA, 21 nt, Human
ugugugugugugugugugugu

SEQ ID NO: 403556 - RNA, 21 nt, Human
ugugugugugugugugugugu

SEQ ID NO: 403557 - RNA, 21 nt, Human
ugugugugugugugugugugu

SEQ ID NO: 403558 - RNA, 21 nt, Human
ugugugugugugugugugugu

SEQ ID NO: 403559 - RNA, 21 nt, Human
ugugugugugugugugugugu

SEQ ID NO: 403560 - RNA, 21 nt, Human
ugugugugugugugugugugu

SEQ ID NO: 403561 - RNA, 21 nt, Human
ugugugugugugugugugugu

SEQ ID NO: 403562 - RNA, 21 nt, Human
ugugugugugugugugugugu

SEQ ID NO: 403563 - RNA, 21 nt, Human
ugugugugugugugugugugu

SEQ ID NO: 403564 - RNA, 21 nt, Human
ugugugugugugugugugugu

SEQ ID NO: 403565 - RNA, 21 nt, Human
ugugugugugugugugugugu

SEQ ID NO: 403566 - RNA, 21 nt, Human
ugugugugugugugugugugu

SEQ ID NO: 403567 - RNA, 21 nt, Human
ugugugugugugugugugugu

SEQ ID NO: 403568 - RNA, 21 nt, Human
ugugugugugugugugugugu

SEQ ID NO: 403569 - RNA, 21 nt, Human
ugugugugugugugugugugu

SEQ ID NO: 403570 - RNA, 21 nt, Human
ugugugugugugugugugugu

SEQ ID NO: 403571 - RNA, 21 nt, Human
ugugugugugugugugugugu

SEQ ID NO: 403572 - RNA, 21 nt, Human
ugugugugugugugugugugu

SEQ ID NO: 403573 - RNA, 21 nt, Human
ugugugugugugugugugugu

SEQ ID NO: 403574 - RNA, 21 nt, Human
ugugugugugugugugugugu

SEQ ID NO: 403575 - RNA, 21 nt, Human
ugugugugugugugugugugu

SEQ ID NO: 403576 - RNA, 21 nt, Human
ugugugugugugugugugugu

SEQ ID NO: 403577 - RNA, 21 nt, Human
ugugugugugugugugugugu

SEQ ID NO: 403578 - RNA, 21 nt, Human
ugugugugugugugugugugu

SEQ ID NO: 403579 - RNA, 21 nt, Human
ugugugugugugugugugugu

SEQ ID NO: 403580 - RNA, 21 nt, Human
ugugugugugugugugugugu

SEQ ID NO: 403581 - RNA, 21 nt, Human
ugugugugugugugugugugu

SEQ ID NO: 403582 - RNA, 21 nt, Human
ugugugugugugugugugugu

SEQ ID NO: 403583 - RNA, 21 nt, Human
ugugugugugugugugugugu

SEQ ID NO: 403584 - RNA, 21 nt, Human
ugugugugugugugugugugu

SEQ ID NO: 403585 - RNA, 21 nt, Human
ugugugugugugugugugugu

SEQ ID NO: 403586 - RNA, 21 nt, Human
ugugugugugugugugugugu

SEQ ID NO: 403587 - RNA, 21 nt, Human
ugugugugugugugugugugu

SEQ ID NO: 403588 - RNA, 21 nt, Human
ugugugugugugugugugugu

SEQ ID NO: 403589 - RNA, 21 nt, Human
ugugugugugugugugugugu

SEQ ID NO: 403590 - RNA, 22 nt, Human
ugugugugugugugugugugug

SEQ ID NO: 403591 - RNA, 22 nt, Human
ugugugugugugugugugugug

SEQ ID NO: 403592 - RNA, 22 nt, Human
ugugugugugugugugugugug

SEQ ID NO: 403593 - RNA, 22 nt, Human
ugugugugugugugugugugug

SEQ ID NO: 403594 - RNA, 22 nt, Human
ugugugugugugugugugugug

SEQ ID NO: 403595 - RNA, 22 nt, Human
ugugugugugugugugugugug

SEQ ID NO: 403596 - RNA, 22 nt, Human
ugugugugugugugugugugug

SEQ ID NO: 403597 - RNA, 22 nt, Human
ugugugugugugugugugugug

SEQ ID NO: 403598 - RNA, 22 nt, Human
ugugugugugugugugugugug

SEQ ID NO: 403599 - RNA, 22 nt, Human
ugugugugugugugugugugug

SEQ ID NO: 403600 - RNA, 22 nt, Human
ugugugugugugugugugugug

SEQ ID NO: 403601 - RNA, 22 nt, Human
ugugugugugugugugugugug

SEQ ID NO: 403602 - RNA, 22 nt, Human
ugugugugugugugugugugug

SEQ ID NO: 403603 - RNA, 20 nt, Human
uguguguguguguguguuag

SEQ ID NO: 403604 - RNA, 18 nt, Human
uguguuagaaagggggau

SEQ ID NO: 403605 - RNA, 19 nt, Human
uuaaauacagucauuucgu

SEQ ID NO: 403606 - RNA, 22 nt, Human
aaaugcaacccauauuuuccua

SEQ ID NO: 403607 - RNA, 19 nt, Human
aagcauucaaaaucuugac

SEQ ID NO: 403608 - RNA, 18 nt, Human
aauugcacuggaaauaca

SEQ ID NO: 403609 - RNA, 23 nt, Human
acacacacacacacacacacaca

SEQ ID NO: 403610 - RNA, 23 nt, Human
acacacacacacacacacacaca

SEQ ID NO: 403611 - RNA, 29 nt, Human
acacacacacacacacacacacaccccua

SEQ ID NO: 403612 - RNA, 23 nt, Human
accuugagaggugaguuaaaagg

SEQ ID NO: 403613 - RNA, 20 nt, Human
agaaucccaaagugcuucuc

SEQ ID NO: 403614 - RNA, 21 nt, Human
agcuacagacauuuugaaccc

SEQ ID NO: 403615 - RNA, 23 nt, Human
auacacacacacacacacacaca

SEQ ID NO: 403616 - RNA, 21 nt, Human
auuauauuauaggaaaacauc

SEQ ID NO: 403617 - RNA, 23 nt, Human
caaaugcaacccauauuuuccua

SEQ ID NO: 403618 - RNA, 21 nt, Human
caaucaaugauuuuuaagcac

SEQ ID NO: 403619 - RNA, 20 nt, Human
cacacacacacacacacaca

SEQ ID NO: 403620 - RNA, 20 nt, Human
cacacacacacacacacaca

SEQ ID NO: 403621 - RNA, 20 nt, Human
cacacacacacacacacaca

SEQ ID NO: 403622 - RNA, 20 nt, Human
cacacacacacacacacaca

SEQ ID NO: 403623 - RNA, 20 nt, Human
cacacacacacacacacaca

SEQ ID NO: 403624 - RNA, 20 nt, Human
cacacacacacacacacaca

SEQ ID NO: 403625 - RNA, 22 nt, Human
cacacacacacacacacacaca

SEQ ID NO: 403626 - RNA, 22 nt, Human
cacacacacacacacacacaca

SEQ ID NO: 403627 - RNA, 22 nt, Human
cacacacacacacacacacaca

SEQ ID NO: 403628 - RNA, 26 nt, Human
cacacacacacacacacacacacaca

SEQ ID NO: 403629 - RNA, 26 nt, Human
cacacacacacacacacacacacaca

SEQ ID NO: 403630 - RNA, 26 nt, Human
cacacacacacacacacacacacaca

SEQ ID NO: 403631 - RNA, 22 nt, Human
cacacacacacacacacacccu

SEQ ID NO: 403632 - RNA, 21 nt, Human
cacaccccuacaauugcacug

SEQ ID NO: 403633 - RNA, 21 nt, Human
cauuggccucuuucagccucu

SEQ ID NO: 403634 - RNA, 24 nt, Human
ccagcaaacgguuuuacuucuucu

SEQ ID NO: 403635 - RNA, 18 nt, Human
ccaguggggcauuggccu

SEQ ID NO: 403636 - RNA, 19 nt, Human
cuacagacauuuugaaccc

SEQ ID NO: 403637 - RNA, 30 nt, Human
cucuuuagucauacacacacacacacagug

SEQ ID NO: 403638 - RNA, 20 nt, Human
cugaaagacagucccccuug

SEQ ID NO: 403639 - RNA, 18 nt, Human
cugcucaagaggaggcaa

SEQ ID NO: 403640 - RNA, 18 nt, Human
gaagaugcugccaguggg

SEQ ID NO: 403641 - RNA, 21 nt, Human
gaagugaagaugcugccagug

SEQ ID NO: 403642 - RNA, 24 nt, Human
gaugcugccaguggggcauuggcc

SEQ ID NO: 403643 - RNA, 18 nt, Human
gcaagccucuagucuucc

SEQ ID NO: 403644 - RNA, 22 nt, Human
gcucaagaggaggcaagcugga

SEQ ID NO: 403645 - RNA, 25 nt, Human
gucauacacacacacacacacacag

SEQ ID NO: 403646 - RNA, 18 nt, Human
guuaguuucaccgauggc

SEQ ID NO: 403647 - RNA, 27 nt, Human
uaagaagacccucacugaauacaacag

SEQ ID NO: 403648 - RNA, 22 nt, Human
uaagaugaguguagaacaccug

SEQ ID NO: 403649 - RNA, 25 nt, Human
uaauauguacuucacaauaucuaca

SEQ ID NO: 403650 - RNA, 20 nt, Human
uacacacacacacacacaca

SEQ ID NO: 403651 - RNA, 25 nt, Human
uacacacacacacacacacacacac

SEQ ID NO: 403652 - RNA, 23 nt, Human
uaucugaaagacagucccccuug

SEQ ID NO: 403653 - RNA, 24 nt, Human
uccauagcuaagggaaaccggggc

SEQ ID NO: 403654 - RNA, 21 nt, Human
uccaucccuuaaauccucagg

SEQ ID NO: 403655 - RNA, 21 nt, Human
uccccaaaacaucucucuugc

SEQ ID NO: 403656 - RNA, 18 nt, Human
uccucaggucacaaccau

SEQ ID NO: 403657 - RNA, 20 nt, Human
ucucaggcacuaagaugagu

SEQ ID NO: 403658 - RNA, 25 nt, Human
ucuuauagaguuuccauagcuaagg

SEQ ID NO: 403659 - RNA, 22 nt, Human
ucuugcuuaucuguuaguuuca

SEQ ID NO: 403660 - RNA, 21 nt, Human
ugccuaaauacucucaggcac

SEQ ID NO: 403661 - RNA, 19 nt, Human
uggaaagaaucccaaagug

SEQ ID NO: 403662 - RNA, 20 nt, Human
ugucaaggacgggacccugu

SEQ ID NO: 403663 - RNA, 18 nt, Human
uguguuaggaaugaaaug

SEQ ID NO: 403664 - RNA, 20 nt, Human
uguguuaggaaugaaaugag

SEQ ID NO: 403665 - RNA, 19 nt, Human
uucaaucugccuaaauacu

SEQ ID NO: 403666 - RNA, 22 nt, Human
uucaugcuucucccucuucaca

SEQ ID NO: 403667 - RNA, 20 nt, Human
uucucaguccuguagaggcu

SEQ ID NO: 403668 - RNA, 18 nt, Human
uugagguagcaaggccca

SEQ ID NO: 403669 - RNA, 31 nt, Human
uuuagucauacacacacacacacacacacag

SEQ ID NO: 403670 - RNA, 18 nt, Human
uuuuuuuuuuuuuuuuug

SEQ ID NO: 403671 - RNA, 19 nt, Human
uuuuuuuuuuuuuuuuugu

SEQ ID NO: 403672 - RNA, 18 nt, Human
aaaaaacccuaaucagca

SEQ ID NO: 403673 - RNA, 19 nt, Human
aagaaaaagcucaaugccu

SEQ ID NO: 403674 - RNA, 18 nt, Human
accacacucccaccccaa

SEQ ID NO: 403675 - RNA, 22 nt, Human
acuaccccccaccacacuccca

SEQ ID NO: 403676 - RNA, 21 nt, Human
acucccaccccaaccccgggu

SEQ ID NO: 403677 - RNA, 18 nt, Human
agcgcaggaggggcgaug

SEQ ID NO: 403678 - RNA, 19 nt, Human
cacacucccaccccaaccc

SEQ ID NO: 403679 - RNA, 20 nt, Human
caccacacucccaccccaac

SEQ ID NO: 403680 - RNA, 22 nt, Human
caccacacucccaccccaaccc

SEQ ID NO: 403681 - RNA, 21 nt, Human
caccccaaccccggguggccc

SEQ ID NO: 403682 - RNA, 24 nt, Human
cacuaccccccaccacacucccac

SEQ ID NO: 403683 - RNA, 21 nt, Human
cacucccaccccaaccccggg

SEQ ID NO: 403684 - RNA, 23 nt, Human
cacucccaccccaaccccgggug

SEQ ID NO: 403685 - RNA, 20 nt, Human
caggaggggcgaugggggcg

SEQ ID NO: 403686 - RNA, 19 nt, Human
ccaccacacucccacccca

SEQ ID NO: 403687 - RNA, 26 nt, Human
ccacuaccccccaccacacucccacc

SEQ ID NO: 403688 - RNA, 21 nt, Human
cccaccacacucccaccccaa

SEQ ID NO: 403689 - RNA, 22 nt, Human
cccaccacacucccaccccaac

SEQ ID NO: 403690 - RNA, 21 nt, Human
cccaccccaaccccggguggc

SEQ ID NO: 403691 - RNA, 19 nt, Human
ccccaaccccggguggccc

SEQ ID NO: 403692 - RNA, 20 nt, Human
ccccaccacacucccacccc

SEQ ID NO: 403693 - RNA, 21 nt, Human
ccccaccacacucccacccca

SEQ ID NO: 403694 - RNA, 23 nt, Human
ccccaccacacucccaccccaac

SEQ ID NO: 403695 - RNA, 26 nt, Human
cccccaccacacucccaccccaaccc

SEQ ID NO: 403696 - RNA, 23 nt, Human
cuaccccccaccacacucccacc

SEQ ID NO: 403697 - RNA, 21 nt, Human
cucccaccccaaccccgggug

SEQ ID NO: 403698 - RNA, 19 nt, Human
gaaaaagcucaaugccuuc

SEQ ID NO: 403699 - RNA, 21 nt, Human
gccaccacuaccccccaccac

SEQ ID NO: 403700 - RNA, 24 nt, Human
ggcgcggagcgcugccgagaagga

SEQ ID NO: 403701 - RNA, 19 nt, Human
gggcgaugggggcgcggag

SEQ ID NO: 403702 - RNA, 21 nt, Human
uaccccccaccacacucccac

SEQ ID NO: 403703 - RNA, 22 nt, Human
uaccccccaccacacucccacc

SEQ ID NO: 403704 - RNA, 18 nt, Human
ucccggggcuccugggcg

SEQ ID NO: 403705 - RNA, 18 nt, Human
ucucuuguccugccacca

SEQ ID NO: 403706 - RNA, 19 nt, Human
ugaaagaaaaagcucaaug

SEQ ID NO: 403707 - RNA, 26 nt, Human
ugaaagaaaaagcucaaugccuucuc

SEQ ID NO: 403708 - RNA, 27 nt, Human
ugaaagaaaaagcucaaugccuucucu

SEQ ID NO: 403709 - RNA, 23 nt, Human
uguccugccaccacuacccccca

SEQ ID NO: 403710 - RNA, 25 nt, Human
uuguccugccaccacuaccccccac

SEQ ID NO: 403711 - RNA, 21 nt, Human
aaacacucacacccagcuccc

SEQ ID NO: 403712 - RNA, 21 nt, Human
aaacagaagaaauagaucaag

SEQ ID NO: 403713 - RNA, 24 nt, Human
aaacucucuuuuuaacccuggagc

SEQ ID NO: 403714 - RNA, 19 nt, Human
aaguguaucugccaguaua

SEQ ID NO: 403715 - RNA, 20 nt, Human
agaagaaauagaucaagacc

SEQ ID NO: 403716 - RNA, 20 nt, Human
agggguggggucauauggag

SEQ ID NO: 403717 - RNA, 18 nt, Human
aguguaaacacucacacc

SEQ ID NO: 403718 - RNA, 20 nt, Human
aguucugggcccaucucugu

SEQ ID NO: 403719 - RNA, 25 nt, Human
auacagugaauuagugguugggcug

SEQ ID NO: 403720 - RNA, 18 nt, Human
aucucucuucaucugauu

SEQ ID NO: 403721 - RNA, 18 nt, Human
auggguuucugguucuau

SEQ ID NO: 403722 - RNA, 23 nt, Human
caccucuggccagagacaagaac

SEQ ID NO: 403723 - RNA, 19 nt, Human
cacuacauugcuucccugc

SEQ ID NO: 403724 - RNA, 21 nt, Human
cacuacauugcuucccugccu

SEQ ID NO: 403725 - RNA, 24 nt, Human
cacuacauugcuucccugccugcu

SEQ ID NO: 403726 - RNA, 24 nt, Human
cagaagaaauagaucaagaccaua

SEQ ID NO: 403727 - RNA, 18 nt, Human
cagacagaccauucaggc

SEQ ID NO: 403728 - RNA, 19 nt, Human
cagccuccuagugccagag

SEQ ID NO: 403729 - RNA, 23 nt, Human
cagccuccuagugccagagugac

SEQ ID NO: 403730 - RNA, 21 nt, Human
cagggggcuguccgagccugg

SEQ ID NO: 403731 - RNA, 21 nt, Human
cauuugccagugaauugagag

SEQ ID NO: 403732 - RNA, 21 nt, Human
ccacacuacauugcuucccug

SEQ ID NO: 403733 - RNA, 23 nt, Human
ccccugaauccugaaucauguga

SEQ ID NO: 403734 - RNA, 20 nt, Human
cccuggggguuccuaggggu

SEQ ID NO: 403735 - RNA, 23 nt, Human
cccuggggguuccuagggguggg

SEQ ID NO: 403736 - RNA, 18 nt, Human
cccuugauauggguuucu

SEQ ID NO: 403737 - RNA, 18 nt, Human
ccugccugcuaucugaaa

SEQ ID NO: 403738 - RNA, 23 nt, Human
ccuucauuucccauuagggcaga

SEQ ID NO: 403739 - RNA, 18 nt, Human
ccuuggcaaccauuuugu

SEQ ID NO: 403740 - RNA, 23 nt, Human
cucaaaacagaagaaauagauca

SEQ ID NO: 403741 - RNA, 26 nt, Human
cucaaaacagaagaaauagaucaaga

SEQ ID NO: 403742 - RNA, 20 nt, Human
cucaggaacagggggcuguc

SEQ ID NO: 403743 - RNA, 22 nt, Human
cuugcugucucugucugacuuc

SEQ ID NO: 403744 - RNA, 22 nt, Human
cuuuccaucucaggaacagggg

SEQ ID NO: 403745 - RNA, 22 nt, Human
gagaaggaggacugcccuucag

SEQ ID NO: 403746 - RNA, 24 nt, Human
gagcuguaucuuuccaagagacag

SEQ ID NO: 403747 - RNA, 22 nt, Human
gcauaaacugggcaugguucag

SEQ ID NO: 403748 - RNA, 20 nt, Human
gcccaucucuguuccaagaa

SEQ ID NO: 403749 - RNA, 19 nt, Human
guugccuuggcaaccauuu

SEQ ID NO: 403750 - RNA, 23 nt, Human
uacguuguuaacugucuugcugu

SEQ ID NO: 403751 - RNA, 18 nt, Human
uauaccacaccucuggcc

SEQ ID NO: 403752 - RNA, 19 nt, Human
uaucugaaagauacuucac

SEQ ID NO: 403753 - RNA, 18 nt, Human
ucacaaguguaucugcca

SEQ ID NO: 403754 - RNA, 21 nt, Human
ucagacaggcauaaacugggc

SEQ ID NO: 403755 - RNA, 24 nt, Human
ucagacaggcauaaacugggcaug

SEQ ID NO: 403756 - RNA, 21 nt, Human
ucccuggggguuccuaggggu

SEQ ID NO: 403757 - RNA, 19 nt, Human
uccugugugagagaguccu

SEQ ID NO: 403758 - RNA, 21 nt, Human
ucuaaaguuuucuuuuugccc

SEQ ID NO: 403759 - RNA, 25 nt, Human
ucuauaccacaccucuggccagaga

SEQ ID NO: 403760 - RNA, 25 nt, Human
ucugcagauaaaagaaguaucccgu

SEQ ID NO: 403761 - RNA, 20 nt, Human
ucuuauaauuuuauguugcc

SEQ ID NO: 403762 - RNA, 19 nt, Human
ugaagggcacaguguaaac

SEQ ID NO: 403763 - RNA, 20 nt, Human
ugcucugguacugaagcccc

SEQ ID NO: 403764 - RNA, 20 nt, Human
uggccagagacaagaacuua

SEQ ID NO: 403765 - RNA, 19 nt, Human
ugggacauccauucauccc

SEQ ID NO: 403766 - RNA, 23 nt, Human
uggugguguauuaaauuugugcu

SEQ ID NO: 403767 - RNA, 19 nt, Human
uguaaacacucacacccag

SEQ ID NO: 403768 - RNA, 21 nt, Human
ugucuuggucuaaaguuuucu

SEQ ID NO: 403769 - RNA, 22 nt, Human
uguugccuuggcaaccauuuug

SEQ ID NO: 403770 - RNA, 23 nt, Human
uuauauagucuuccccacaucac

SEQ ID NO: 403771 - RNA, 20 nt, Human
uuccuagggguggggucaua

SEQ ID NO: 403772 - RNA, 22 nt, Human
uucuauaccacaccucuggcca

SEQ ID NO: 403773 - RNA, 20 nt, Human
uucugggcccaucucuguuc

SEQ ID NO: 403774 - RNA, 20 nt, Human
uugcuuccuucagacagacc

SEQ ID NO: 403775 - RNA, 25 nt, Human
uuuccugugugagagaguccuugau

SEQ ID NO: 403776 - RNA, 24 nt, Human
uuucugguucuauaccacaccuua

SEQ ID NO: 403777 - RNA, 18 nt, Human
aaaaaagcuagcccccaa

SEQ ID NO: 403778 - RNA, 24 nt, Human
aaaaagcuagcccccaaguaucac

SEQ ID NO: 403779 - RNA, 23 nt, Human
aaacaacuccucuaaaaaagucc

SEQ ID NO: 403780 - RNA, 23 nt, Human
aaagaaagaaagaaaaaagcuag

SEQ ID NO: 403781 - RNA, 19 nt, Human
aaaguccauucacaaacuc

SEQ ID NO: 403782 - RNA, 20 nt, Human
aagaaaaaagcuagccccca

SEQ ID NO: 403783 - RNA, 19 nt, Human
aagcagcagggacccagca

SEQ ID NO: 403784 - RNA, 24 nt, Human
aaggaugaaucccaguugcuuggg

SEQ ID NO: 403785 - RNA, 24 nt, Human
acccagcaccaggggucuccauga

SEQ ID NO: 403786 - RNA, 18 nt, Human
accgcugcauucuagccu

SEQ ID NO: 403787 - RNA, 20 nt, Human
agaaaaaagcuagcccccaa

SEQ ID NO: 403788 - RNA, 21 nt, Human
agaaagcagcagggacccagc

SEQ ID NO: 403789 - RNA, 23 nt, Human
agaaagcagcagggacccagcac

SEQ ID NO: 403790 - RNA, 18 nt, Human
agaaaggaugaaucccag

SEQ ID NO: 403791 - RNA, 22 nt, Human
agaacaagaccaucucaaaaaa

SEQ ID NO: 403792 - RNA, 18 nt, Human
agaugggaggaucaccug

SEQ ID NO: 403793 - RNA, 21 nt, Human
aggaguucaagaccagccucg

SEQ ID NO: 403794 - RNA, 23 nt, Human
aggaguucaagaccagccucggc

SEQ ID NO: 403795 - RNA, 24 nt, Human
aggaucgucuaaguccaggaguuc

SEQ ID NO: 403796 - RNA, 19 nt, Human
aggcaggaggaucgucuaa

SEQ ID NO: 403797 - RNA, 20 nt, Human
aggcaggaggaucgucuaag

SEQ ID NO: 403798 - RNA, 24 nt, Human
aggcaggaggaucgucuaagucca

SEQ ID NO: 403799 - RNA, 24 nt, Human
aggcugagaugggaggaucaccug

SEQ ID NO: 403800 - RNA, 20 nt, Human
aggcugaggcaggaggaucg

SEQ ID NO: 403801 - RNA, 20 nt, Human
aggcugaggcaggaggaucg

SEQ ID NO: 403802 - RNA, 18 nt, Human
aggcuggggaugagucuu

SEQ ID NO: 403803 - RNA, 20 nt, Human
agguggaggcuggggaugag

SEQ ID NO: 403804 - RNA, 19 nt, Human
aguccaggaguucaagacc

SEQ ID NO: 403805 - RNA, 21 nt, Human
augucgaagacccccccccca

SEQ ID NO: 403806 - RNA, 21 nt, Human
caaaaaaaagaaagaaagaaa

SEQ ID NO: 403807 - RNA, 22 nt, Human
caacuguggucccagcuacucg

SEQ ID NO: 403808 - RNA, 23 nt, Human
caacuguggucccagcuacucga

SEQ ID NO: 403809 - RNA, 22 nt, Human
caaguaucacacaggaggugga

SEQ ID NO: 403810 - RNA, 21 nt, Human
cacacaaauaggcaaauaagu

SEQ ID NO: 403811 - RNA, 18 nt, Human
cagaacaagaccaucuca

SEQ ID NO: 403812 - RNA, 22 nt, Human
cagcaccaggggucuccaugaa

SEQ ID NO: 403813 - RNA, 22 nt, Human
cagcagcagggaccccugccaa

SEQ ID NO: 403814 - RNA, 19 nt, Human
caggagguggaggcugggg

SEQ ID NO: 403815 - RNA, 24 nt, Human
caguugcuugggaggcugaggcag

SEQ ID NO: 403816 - RNA, 23 nt, Human
cauguaaacaaccuuggcaacau

SEQ ID NO: 403817 - RNA, 23 nt, Human
cauucuagccugguugacagaac

SEQ ID NO: 403818 - RNA, 18 nt, Human
ccagcaccaggggucucc

SEQ ID NO: 403819 - RNA, 21 nt, Human
cccaaaacaacuccucuaaaa

SEQ ID NO: 403820 - RNA, 20 nt, Human
ccccaaaacaacuccucuaa

SEQ ID NO: 403821 - RNA, 20 nt, Human
cccccaaaacaacuccucua

SEQ ID NO: 403822 - RNA, 26 nt, Human
cccccaaguaucacacaggaggugga

SEQ ID NO: 403823 - RNA, 25 nt, Human
ccccccccaaaacaacuccucuaaa

SEQ ID NO: 403824 - RNA, 26 nt, Human
ccccccccaaaacaacuccucuaaaa

SEQ ID NO: 403825 - RNA, 19 nt, Human
ccccccccccaaaacaacu

SEQ ID NO: 403826 - RNA, 19 nt, Human
ccgcugcauucuagccugg

SEQ ID NO: 403827 - RNA, 20 nt, Human
ccgcugcauucuagccuggu

SEQ ID NO: 403828 - RNA, 18 nt, Human
ccucgggaggucgaggcu

SEQ ID NO: 403829 - RNA, 19 nt, Human
ccucgggaggucgaggcug

SEQ ID NO: 403830 - RNA, 25 nt, Human
cgcugcauucuagccugguugacag

SEQ ID NO: 403831 - RNA, 19 nt, Human
cuaaguccaggaguucaag

SEQ ID NO: 403832 - RNA, 18 nt, Human
cuggcauguaaacaaccu

SEQ ID NO: 403833 - RNA, 27 nt, Human
gaacaagaccaucucaaaaaaaagaaa

SEQ ID NO: 403834 - RNA, 20 nt, Human
ggaaggagugggugaggagg

SEQ ID NO: 403835 - RNA, 20 nt, Human
ggaggcuggggaugagucuu

SEQ ID NO: 403836 - RNA, 23 nt, Human
ggaucgucuaaguccaggaguuc

SEQ ID NO: 403837 - RNA, 21 nt, Human
gggaaggagugggugaggagg

SEQ ID NO: 403838 - RNA, 23 nt, Human
gggaaggagugggugaggagggu

SEQ ID NO: 403839 - RNA, 19 nt, Human
gggaggucagcagcaggga

SEQ ID NO: 403840 - RNA, 24 nt, Human
ggggaaggagugggugaggagggu

SEQ ID NO: 403841 - RNA, 24 nt, Human
uagccugguugacagaacaagacc

SEQ ID NO: 403842 - RNA, 21 nt, Human
ucaagguccaacuuggggaag

SEQ ID NO: 403843 - RNA, 20 nt, Human
ucaauacacacaaauaggca

SEQ ID NO: 403844 - RNA, 24 nt, Human
ucaccugagccucgggaggucgag

SEQ ID NO: 403845 - RNA, 22 nt, Human
ucacguauuaccauaacucaga

SEQ ID NO: 403846 - RNA, 22 nt, Human
uccucuaaaaaaguccauucac

SEQ ID NO: 403847 - RNA, 22 nt, Human
ucgaagaccccccccccaaaac

SEQ ID NO: 403848 - RNA, 23 nt, Human
ucgaagaccccccccccaaaaca

SEQ ID NO: 403849 - RNA, 23 nt, Human
ucuaaguccaggaguucaagacc

SEQ ID NO: 403850 - RNA, 20 nt, Human
ugagaugggaggaucaccug

SEQ ID NO: 403851 - RNA, 21 nt, Human
ugagaugggaggaucaccuga

SEQ ID NO: 403852 - RNA, 24 nt, Human
ugagaugggaggaucaccugagcc

SEQ ID NO: 403853 - RNA, 18 nt, Human
uggaggcuggggaugagu

SEQ ID NO: 403854 - RNA, 22 nt, Human
uggaggcuggggaugagucuuu

SEQ ID NO: 403855 - RNA, 23 nt, Human
uggaguaggauucggacucuguc

SEQ ID NO: 403856 - RNA, 23 nt, Human
uggcaacauagcaauaccgucuc

SEQ ID NO: 403857 - RNA, 21 nt, Human
uggcacacaacugugguccca

SEQ ID NO: 403858 - RNA, 24 nt, Human
uggcacacaacuguggucccagcu

SEQ ID NO: 403859 - RNA, 21 nt, Human
uggcauguaaacaaccuuggc

SEQ ID NO: 403860 - RNA, 22 nt, Human
ugggaggaucaccugagccucg

SEQ ID NO: 403861 - RNA, 20 nt, Human
ugggaggcugaggcaggagg

SEQ ID NO: 403862 - RNA, 23 nt, Human
ugggaggcugaggcaggaggauc

SEQ ID NO: 403863 - RNA, 24 nt, Human
uggucccagcuacucgagaggcug

SEQ ID NO: 403864 - RNA, 24 nt, Human
uugggaggcugaggcaggaggauc

SEQ ID NO: 403865 - RNA, 22 nt, Human
aaacagcuuauuucuaggcugu

SEQ ID NO: 403866 - RNA, 21 nt, Human
ugaucuggccuucaccagcag

SEQ ID NO: 403867 - RNA, 22 nt, Human
acccccuccccaaccccaggac

SEQ ID NO: 403868 - RNA, 25 nt, Human
accccgacccccuccccaaccccag

SEQ ID NO: 403869 - RNA, 25 nt, Human
acucagcuggaguuggaggcugggc

SEQ ID NO: 403870 - RNA, 21 nt, Human
aggcagcucugggugaagguc

SEQ ID NO: 403871 - RNA, 21 nt, Human
caggcucagguccugggaccc

SEQ ID NO: 403872 - RNA, 21 nt, Human
cccccuccccaaccccaggac

SEQ ID NO: 403873 - RNA, 21 nt, Human
ccccgacccccuccccaaccc

SEQ ID NO: 403874 - RNA, 19 nt, Human
cccgacccccuccccaacc

SEQ ID NO: 403875 - RNA, 23 nt, Human
ccgacccccuccccaaccccagg

SEQ ID NO: 403876 - RNA, 23 nt, Human
ccugggaccccgacccccucccc

SEQ ID NO: 403877 - RNA, 24 nt, Human
ccugggaccccgacccccucccca

SEQ ID NO: 403878 - RNA, 19 nt, Human
cgacccccuccccaacccc

SEQ ID NO: 403879 - RNA, 18 nt, Human
gacccccuccccaacccc

SEQ ID NO: 403880 - RNA, 24 nt, Human
gaccccgacccccuccccaacccc

SEQ ID NO: 403881 - RNA, 18 nt, Human
ggggagggagucggggga

SEQ ID NO: 403882 - RNA, 18 nt, Human
gguugaggacauggccag

SEQ ID NO: 403883 - RNA, 18 nt, Human
uccccaaccccaggacuc

SEQ ID NO: 403884 - RNA, 22 nt, Human
uggaguuggaggcugggcauag

SEQ ID NO: 403885 - RNA, 23 nt, Human
ugggaccccgacccccuccccaa

SEQ ID NO: 403886 - RNA, 18 nt, Human
uggggagggagucggggg

SEQ ID NO: 403887 - RNA, 18 nt, Human
ugggguugaggacauggc

SEQ ID NO: 403888 - RNA, 20 nt, Human
aaggggccgcgccucccugg

SEQ ID NO: 403889 - RNA, 28 nt, Human
caaagacccacaaggggccgcgccuccc

SEQ ID NO: 403890 - RNA, 19 nt, Human
cagacaaagacccacaagg

SEQ ID NO: 403891 - RNA, 20 nt, Human
ccggcagggcggagucuccc

SEQ ID NO: 403892 - RNA, 21 nt, Human
cuguugcaggucgccuccuuu

SEQ ID NO: 403893 - RNA, 21 nt, Human
gggacuccucuguugcagguc

SEQ ID NO: 403894 - RNA, 21 nt, Human
uccagacaaagacccacaagg

SEQ ID NO: 403895 - RNA, 21 nt, Human
ugcacuccaccacccaaagau

SEQ ID NO: 403896 - RNA, 18 nt, Human
uugcaggucgccuccuuu

SEQ ID NO: 403897 - RNA, 21 nt, Human
gagcugggcuggccagugccu

SEQ ID NO: 403898 - RNA, 21 nt, Human
gggcuggccagugccucgccg

SEQ ID NO: 403899 - RNA, 19 nt, Human
aggccagcccucccuggca

SEQ ID NO: 403900 - RNA, 22 nt, Human
aucucccuaguauguucugcug

SEQ ID NO: 403901 - RNA, 21 nt, Human
caggcucugggugcaucuccc

SEQ ID NO: 403902 - RNA, 22 nt, Human
ccagcccucccuggcaggcucu

SEQ ID NO: 403903 - RNA, 18 nt, Human
cucccuggcaggcucugg

SEQ ID NO: 403904 - RNA, 21 nt, Human
cugcugggagccgggcaccgg

SEQ ID NO: 403905 - RNA, 22 nt, Human
gacggugguggugaggccagcc

SEQ ID NO: 403906 - RNA, 23 nt, Human
ugcugggagccgggcaccggggc

SEQ ID NO: 403907 - RNA, 20 nt, Human
aaccaucugggugcugacca

SEQ ID NO: 403908 - RNA, 19 nt, Human
agccccuagucagccacag

SEQ ID NO: 403909 - RNA, 18 nt, Human
caaccugacuuuggaagu

SEQ ID NO: 403910 - RNA, 19 nt, Human
cacaacuugcuuuacuuga

SEQ ID NO: 403911 - RNA, 20 nt, Human
caccccagccccuagucagc

SEQ ID NO: 403912 - RNA, 18 nt, Human
cacccuuuauccuccaaa

SEQ ID NO: 403913 - RNA, 18 nt, Human
cagaaguggaauuuggaa

SEQ ID NO: 403914 - RNA, 24 nt, Human
cagcggguucucauccuacaaccu

SEQ ID NO: 403915 - RNA, 20 nt, Human
ccacagggugccugggaaca

SEQ ID NO: 403916 - RNA, 22 nt, Human
ccauagaaucucagaaauggaa

SEQ ID NO: 403917 - RNA, 20 nt, Human
ccccagccccuagucagccu

SEQ ID NO: 403918 - RNA, 21 nt, Human
ccccuagucagccacagggug

SEQ ID NO: 403919 - RNA, 20 nt, Human
ccuccaaauaucccgggacg

SEQ ID NO: 403920 - RNA, 19 nt, Human
cggguucucauccuacaac

SEQ ID NO: 403921 - RNA, 18 nt, Human
ggguucucauccuacaac

SEQ ID NO: 403922 - RNA, 21 nt, Human
guggcggguacugagugggaa

SEQ ID NO: 403923 - RNA, 19 nt, Human
uaccaacacucccggggug

SEQ ID NO: 403924 - RNA, 24 nt, Human
ucagugucagauccuaggcugggc

SEQ ID NO: 403925 - RNA, 20 nt, Human
ucuagaauucuaggaauaga

SEQ ID NO: 403926 - RNA, 19 nt, Human
ugacuuuggaaguuggaga

SEQ ID NO: 403927 - RNA, 22 nt, Human
uggaauuuggaauucugagaga

SEQ ID NO: 403928 - RNA, 24 nt, Human
ugggcuuagagccucagaagugga

SEQ ID NO: 403929 - RNA, 19 nt, Human
ugguggacacaacuugcuu

SEQ ID NO: 403930 - RNA, 19 nt, Human
uuacuugaaccaucugggu

SEQ ID NO: 403931 - RNA, 18 nt, Human
uugguggacacaacuugc

SEQ ID NO: 403932 - RNA, 21 nt, Human
uuuuuuuuuuugguggacaca

SEQ ID NO: 403933 - RNA, 20 nt, Human
uuuuuuuuuuuuuuggugga

SEQ ID NO: 403934 - RNA, 18 nt, Human
accuaggcugcgucugag

SEQ ID NO: 403935 - RNA, 23 nt, Human
caaacacucccaggcuucccagg

SEQ ID NO: 403936 - RNA, 24 nt, Human
cccccucagcacagcuguccucuu

SEQ ID NO: 403937 - RNA, 20 nt, Human
ccugcccccucagcacagcu

SEQ ID NO: 403938 - RNA, 21 nt, Human
ccugcccccucagcacagcug

SEQ ID NO: 403939 - RNA, 21 nt, Human
cuaccgaugggacaaacacuc

SEQ ID NO: 403940 - RNA, 23 nt, Human
cugcccccucagcacagcugucc

SEQ ID NO: 403941 - RNA, 23 nt, Human
cugcccccucagcacagcugucc

SEQ ID NO: 403942 - RNA, 21 nt, Human
gcggccuugguaggugugguc

SEQ ID NO: 403943 - RNA, 21 nt, Human
gugguccuggcacagccagga

SEQ ID NO: 403944 - RNA, 21 nt, Human
uaccgaugggacaaacacucc

SEQ ID NO: 403945 - RNA, 18 nt, Human
ucccaggugccacugucc

SEQ ID NO: 403946 - RNA, 19 nt, Human
uuuuuuuuuugagugucug

SEQ ID NO: 403947 - RNA, 21 nt, Human
uuuuuuuuuuugagugucuga

SEQ ID NO: 403948 - RNA, 18 nt, Human
uuuuuuuuuuuuuuuuug

SEQ ID NO: 403949 - RNA, 22 nt, Human
aaggagaaaaaagucagugcag

SEQ ID NO: 403950 - RNA, 20 nt, Human
aggagugguggcucccaccu

SEQ ID NO: 403951 - RNA, 21 nt, Human
ccuaggccagcuccccauuuc

SEQ ID NO: 403952 - RNA, 20 nt, Human
gagcugccuggggugcccag

SEQ ID NO: 403953 - RNA, 20 nt, Human
gcaggcaggagugguggcuc

SEQ ID NO: 403954 - RNA, 19 nt, Human
gcaggccggaggcaggugc

SEQ ID NO: 403955 - RNA, 21 nt, Human
gccagcuccccauuuccaaac

SEQ ID NO: 403956 - RNA, 24 nt, Human
gcgaggagcagaucuuuggugaag

SEQ ID NO: 403957 - RNA, 22 nt, Human
ggagcagaucuuuggugaagga

SEQ ID NO: 403958 - RNA, 19 nt, Human
ggugcgagcgaggagcaga

SEQ ID NO: 403959 - RNA, 24 nt, Human
ggugcgagcgaggagcagaucuuu

SEQ ID NO: 403960 - RNA, 19 nt, Human
ggugugggggcaggcagga

SEQ ID NO: 403961 - RNA, 22 nt, Human
guggcuuuuuauuacuggugug

SEQ ID NO: 403962 - RNA, 18 nt, Human
uauuacugguguggagug

SEQ ID NO: 403963 - RNA, 20 nt, Human
ucagugugugguggcuuuuu

SEQ ID NO: 403964 - RNA, 21 nt, Human
uccccauuuccaaacaggagc

SEQ ID NO: 403965 - RNA, 19 nt, Human
ucccuccaaaaggagaaaa

SEQ ID NO: 403966 - RNA, 18 nt, Human
ucugcucucccuccaaaa

SEQ ID NO: 403967 - RNA, 21 nt, Human
ugggggcaggcaggaguggug

SEQ ID NO: 403968 - RNA, 21 nt, Human
aggacacagacgcgggggacg

SEQ ID NO: 403969 - RNA, 21 nt, Human
caaggacacagacgcggggga

SEQ ID NO: 403970 - RNA, 21 nt, Human
ccccaggacgucagggagacc

SEQ ID NO: 403971 - RNA, 22 nt, Human
ccccugacaggauugugggggc

SEQ ID NO: 403972 - RNA, 23 nt, Human
cgcgggggacgccccgggauggc

SEQ ID NO: 403973 - RNA, 21 nt, Human
cuggaggauguggagucccac

SEQ ID NO: 403974 - RNA, 22 nt, Human
gccccaggggaugaaggcagca

SEQ ID NO: 403975 - RNA, 21 nt, Human
gccccgggauggccucucccc

SEQ ID NO: 403976 - RNA, 19 nt, Human
gggaugaaggcagcaagga

SEQ ID NO: 403977 - RNA, 21 nt, Human
ggggguucugcagcuuuauuc

SEQ ID NO: 403978 - RNA, 20 nt, Human
gggguucugcagcuuuauuc

SEQ ID NO: 403979 - RNA, 22 nt, Human
ggguucugcagcuuuauucaca

SEQ ID NO: 403980 - RNA, 22 nt, Human
ucugcagcuuuauucacaggcc

SEQ ID NO: 403981 - RNA, 24 nt, Human
ugugggggcuggaggauguggagu

SEQ ID NO: 403982 - RNA, 18 nt, Human
uucugcagcuuuauucac

SEQ ID NO: 403983 - RNA, 20 nt, Human
ccuucugcuguucuuguugc

SEQ ID NO: 403984 - RNA, 21 nt, Human
gaaaaacagccaacauauaca

SEQ ID NO: 403985 - RNA, 20 nt, Human
gauguuggggaaaaacagcc

SEQ ID NO: 403986 - RNA, 19 nt, Human
ggcaguuccccuucugcug

SEQ ID NO: 403987 - RNA, 19 nt, Human
gucacaacuggcauuugau

SEQ ID NO: 403988 - RNA, 26 nt, Human
gugaagcgcaccagggcagagccccc

SEQ ID NO: 403989 - RNA, 23 nt, Human
uaacaucaggucuccuuggcagu

SEQ ID NO: 403990 - RNA, 23 nt, Human
ucaaaguuuuauugagauguugg

SEQ ID NO: 403991 - RNA, 25 nt, Human
ucaggucuccuuggcaguuccccuu

SEQ ID NO: 403992 - RNA, 20 nt, Human
uccuuggcaguuccccuucu

SEQ ID NO: 403993 - RNA, 25 nt, Human
ucucuggcuuugaucuaacaucuua

SEQ ID NO: 403994 - RNA, 19 nt, Human
ugcuguucuuguugcugcu

SEQ ID NO: 403995 - RNA, 22 nt, Human
uggcaguuccccuucugcuguu

SEQ ID NO: 403996 - RNA, 18 nt, Human
uuguugcugcuuggugcu

SEQ ID NO: 403997 - RNA, 24 nt, Human
aaagcccccuaccccuuacccuca

SEQ ID NO: 403998 - RNA, 24 nt, Human
aggcccccaaaacacauaacaccu

SEQ ID NO: 403999 - RNA, 24 nt, Human
auccuagcauuuucuccuuugggu

SEQ ID NO: 404000 - RNA, 23 nt, Human
auuucugccccugugcaggcccc

SEQ ID NO: 404001 - RNA, 21 nt, Human
caaagcccccuaccccuuacc

SEQ ID NO: 404002 - RNA, 21 nt, Human
caagacaaagcccccuacccc

SEQ ID NO: 404003 - RNA, 20 nt, Human
cagaggcccuggcaggccca

SEQ ID NO: 404004 - RNA, 23 nt, Human
cagaggcccuggcaggcccaccu

SEQ ID NO: 404005 - RNA, 22 nt, Human
cagccaagacaaagcccccuac

SEQ ID NO: 404006 - RNA, 18 nt, Human
cccaggcuggggcagcuc

SEQ ID NO: 404007 - RNA, 18 nt, Human
ccccaaaacacauaacac

SEQ ID NO: 404008 - RNA, 20 nt, Human
cccccuaccccuuacccuca

SEQ ID NO: 404009 - RNA, 21 nt, Human
ccccuuacccucaccccaggc

SEQ ID NO: 404010 - RNA, 23 nt, Human
ccuagcuuuacagaggcccuggc

SEQ ID NO: 404011 - RNA, 20 nt, Human
ccugugcaggcccccaaaac

SEQ ID NO: 404012 - RNA, 19 nt, Human
gacaaagcccccuaccccu

SEQ ID NO: 404013 - RNA, 18 nt, Human
uacaagcuuuaauuagug

SEQ ID NO: 404014 - RNA, 22 nt, Human
uacccuggggauagucccagcu

SEQ ID NO: 404015 - RNA, 21 nt, Human
uagaaaucaccauaguaacau

SEQ ID NO: 404016 - RNA, 18 nt, Human
uaugaugcccaggccaca

SEQ ID NO: 404017 - RNA, 27 nt, Human
uaugaugcccaggccacagggguguga

SEQ ID NO: 404018 - RNA, 20 nt, Human
ucucccagcaggccuagcuu

SEQ ID NO: 404019 - RNA, 26 nt, Human
ugaaacacgcaggaacaagccaagga

SEQ ID NO: 404020 - RNA, 18 nt, Human
ugagggcagggccuccuc

SEQ ID NO: 404021 - RNA, 22 nt, Human
ugagggcagggccuccuccuca

SEQ ID NO: 404022 - RNA, 18 nt, Human
ugcguagaaaucaccaua

SEQ ID NO: 404023 - RNA, 22 nt, Human
ugugcaggcccccaaaacacau

SEQ ID NO: 404024 - RNA, 24 nt, Human
uuacagaggcccuggcaggcccac

SEQ ID NO: 404025 - RNA, 26 nt, Human
uucuuggcauccuacccccauucauu

SEQ ID NO: 404026 - RNA, 21 nt, Human
aaagaaccuggguuguuggga

SEQ ID NO: 404027 - RNA, 21 nt, Human
aacuuccuacuucuccuccuu

SEQ ID NO: 404028 - RNA, 18 nt, Human
aagaaggaagggaggaag

SEQ ID NO: 404029 - RNA, 18 nt, Human
aaggaagggaggaaggaa

SEQ ID NO: 404030 - RNA, 18 nt, Human
acauugcuauuacccucc

SEQ ID NO: 404031 - RNA, 22 nt, Human
agaaaacuuccuacuucuccuc

SEQ ID NO: 404032 - RNA, 20 nt, Human
agaaaauauugguuggcuug

SEQ ID NO: 404033 - RNA, 23 nt, Human
aggaaggaaggaaaagaaccugg

SEQ ID NO: 404034 - RNA, 21 nt, Human
aggaaggaaggaaggaaggaa

SEQ ID NO: 404035 - RNA, 21 nt, Human
aggaagggaggaaggaaggaa

SEQ ID NO: 404036 - RNA, 26 nt, Human
aggcaggaaagaaggaagggggaccc

SEQ ID NO: 404037 - RNA, 21 nt, Human
agggaggaaggaaggaaggaa

SEQ ID NO: 404038 - RNA, 23 nt, Human
auacaaacaaaugacagaaaaua

SEQ ID NO: 404039 - RNA, 24 nt, Human
caaacaaaugacagaaaggaguuc

SEQ ID NO: 404040 - RNA, 20 nt, Human
cacaaauaccuggaaggcaa

SEQ ID NO: 404041 - RNA, 19 nt, Human
cacauugcuauuacccucc

SEQ ID NO: 404042 - RNA, 22 nt, Human
caccauaacaaucugcacccca

SEQ ID NO: 404043 - RNA, 21 nt, Human
cagcggauuccugcgacaucc

SEQ ID NO: 404044 - RNA, 18 nt, Human
cucagaagaaggguagaa

SEQ ID NO: 404045 - RNA, 22 nt, Human
gcugaggcucuuuucucugggc

SEQ ID NO: 404046 - RNA, 24 nt, Human
ggagacugagggucaggcuccagg

SEQ ID NO: 404047 - RNA, 23 nt, Human
uaagaaaacuuccuacuucuccu

SEQ ID NO: 404048 - RNA, 21 nt, Human
uaauauguugcaaaacacauu

SEQ ID NO: 404049 - RNA, 22 nt, Human
uccagggcagcagaaaccaaga

SEQ ID NO: 404050 - RNA, 20 nt, Human
uccuuggugggaaaggaggu

SEQ ID NO: 404051 - RNA, 22 nt, Human
uccuuggugggaaaggagguga

SEQ ID NO: 404052 - RNA, 22 nt, Human
ugacaaaaucacaaauaccugg

SEQ ID NO: 404053 - RNA, 21 nt, Human
ugccugucaccauaacaaucu

SEQ ID NO: 404054 - RNA, 20 nt, Human
ugggaaaggaggugaagguu

SEQ ID NO: 404055 - RNA, 20 nt, Human
uggguaggagggagaaugga

SEQ ID NO: 404056 - RNA, 24 nt, Human
uucauauuauaaaauacaaacaaa

SEQ ID NO: 404057 - RNA, 18 nt, Human
uucucugggccaguguga

SEQ ID NO: 404058 - RNA, 24 nt, Human
uuggcaaaacucucuugcugaggc

SEQ ID NO: 404059 - RNA, 22 nt, Human
uuggugggaaaggaggugaagg

SEQ ID NO: 404060 - RNA, 20 nt, Human
aacaaggcugagagguggga

SEQ ID NO: 404061 - RNA, 21 nt, Human
aagacucaauccccagccccc

SEQ ID NO: 404062 - RNA, 19 nt, Human
aagcaaacaaguucuucca

SEQ ID NO: 404063 - RNA, 19 nt, Human
aagccagacccuaaaacac

SEQ ID NO: 404064 - RNA, 18 nt, Human
aagcuccaggcuucuggc

SEQ ID NO: 404065 - RNA, 22 nt, Human
aaguucuuccacuugauguccc

SEQ ID NO: 404066 - RNA, 24 nt, Human
acagagcuuuuccauucccccaaa

SEQ ID NO: 404067 - RNA, 23 nt, Human
acagcaaagagaccugaggugcc

SEQ ID NO: 404068 - RNA, 18 nt, Human
acauaucucuaccuccuc

SEQ ID NO: 404069 - RNA, 20 nt, Human
acccagggucacuagagugc

SEQ ID NO: 404070 - RNA, 24 nt, Human
acuagagugcaggugcaggcacca

SEQ ID NO: 404071 - RNA, 22 nt, Human
agaaaaagauucucccagcuug

SEQ ID NO: 404072 - RNA, 21 nt, Human
agaauagaacagggcugggca

SEQ ID NO: 404073 - RNA, 25 nt, Human
agacacacacccacacgacaauaua

SEQ ID NO: 404074 - RNA, 19 nt, Human
agacucaauccccagcccc

SEQ ID NO: 404075 - RNA, 23 nt, Human
agcagaaaguagguuccccaggg

SEQ ID NO: 404076 - RNA, 22 nt, Human
agcaguugaguuagggagacag

SEQ ID NO: 404077 - RNA, 25 nt, Human
aggaacgcagggggcagccgguacc

SEQ ID NO: 404078 - RNA, 25 nt, Human
aggcacagcaaagagaccugaggug

SEQ ID NO: 404079 - RNA, 21 nt, Human
aggcagaaagggugacaguga

SEQ ID NO: 404080 - RNA, 22 nt, Human
aggcagaaagggugacagugag

SEQ ID NO: 404081 - RNA, 18 nt, Human
aggcagcagcuguggcug

SEQ ID NO: 404082 - RNA, 19 nt, Human
aggcagcagcuguggcugg

SEQ ID NO: 404083 - RNA, 21 nt, Human
aggcagggagcggggugcaag

SEQ ID NO: 404084 - RNA, 23 nt, Human
aggcuuaagaauggaguccuggu

SEQ ID NO: 404085 - RNA, 18 nt, Human
aggcuuuggcauuguagg

SEQ ID NO: 404086 - RNA, 19 nt, Human
aggggagggaggggguguu

SEQ ID NO: 404087 - RNA, 21 nt, Human
aggggcgguggccaguggcgg

SEQ ID NO: 404088 - RNA, 20 nt, Human
agguuuguuccuucucuuuu

SEQ ID NO: 404089 - RNA, 19 nt, Human
aguccuuaaauggugguca

SEQ ID NO: 404090 - RNA, 19 nt, Human
auucacuucccucucccca

SEQ ID NO: 404091 - RNA, 22 nt, Human
caaaagccagacccuaaaacac

SEQ ID NO: 404092 - RNA, 23 nt, Human
caagaagcugguuucccccagaa

SEQ ID NO: 404093 - RNA, 22 nt, Human
caagacucaauccccagccccc

SEQ ID NO: 404094 - RNA, 18 nt, Human
caauccccagcccccaaa

SEQ ID NO: 404095 - RNA, 18 nt, Human
caaugugugaggaugugg

SEQ ID NO: 404096 - RNA, 22 nt, Human
cacacacccacacgacaauaua

SEQ ID NO: 404097 - RNA, 22 nt, Human
caccaggagagagccucuguca

SEQ ID NO: 404098 - RNA, 24 nt, Human
cacuggcccugggcaaggggcagg

SEQ ID NO: 404099 - RNA, 22 nt, Human
cagacccuaaaacacuuacaga

SEQ ID NO: 404100 - RNA, 22 nt, Human
cagagcuuuuccauucccccaa

SEQ ID NO: 404101 - RNA, 24 nt, Human
cagcaggagcaacuugccuuucuu

SEQ ID NO: 404102 - RNA, 19 nt, Human
cagcaggcccaggagcucu

SEQ ID NO: 404103 - RNA, 19 nt, Human
caggacaggggcgguggcc

SEQ ID NO: 404104 - RNA, 20 nt, Human
cauagcuugguuguuugucc

SEQ ID NO: 404105 - RNA, 23 nt, Human
ccaacacagggacccugcagaau

SEQ ID NO: 404106 - RNA, 21 nt, Human
ccaaggcagaaagggugacag

SEQ ID NO: 404107 - RNA, 22 nt, Human
ccaggcagggagcggggugcaa

SEQ ID NO: 404108 - RNA, 23 nt, Human
ccauggcacuggcccugggcaag

SEQ ID NO: 404109 - RNA, 22 nt, Human
cccacacgacaauauaguggag

SEQ ID NO: 404110 - RNA, 22 nt, Human
cccauggcacuggcccugggca

SEQ ID NO: 404111 - RNA, 19 nt, Human
ccccacaagccccuucccc

SEQ ID NO: 404112 - RNA, 20 nt, Human
ccccacguugcacuuucuuc

SEQ ID NO: 404113 - RNA, 22 nt, Human
ccccagcccccaaaaaggcauc

SEQ ID NO: 404114 - RNA, 20 nt, Human
ccccauggcacuggcccugg

SEQ ID NO: 404115 - RNA, 23 nt, Human
ccccauggcacuggcccugggca

SEQ ID NO: 404116 - RNA, 23 nt, Human
cccccaaaaaauguggauuccca

SEQ ID NO: 404117 - RNA, 23 nt, Human
cccccaaaaaggcaucaugcagg

SEQ ID NO: 404118 - RNA, 20 nt, Human
ccccgagcucaacagcugcc

SEQ ID NO: 404119 - RNA, 22 nt, Human
cccucugcaauucacuucccuc

SEQ ID NO: 404120 - RNA, 18 nt, Human
cccugggcaaggggcagg

SEQ ID NO: 404121 - RNA, 28 nt, Human
ccuccaucuuucucucucuccucugaag

SEQ ID NO: 404122 - RNA, 23 nt, Human
ccuccccacaagccccuucccca

SEQ ID NO: 404123 - RNA, 23 nt, Human
ccuccuucuggguucaagagugg

SEQ ID NO: 404124 - RNA, 25 nt, Human
cucaaaccaaagcuccaggcuucug

SEQ ID NO: 404125 - RNA, 25 nt, Human
cucuccccacguugcacuuucuucu

SEQ ID NO: 404126 - RNA, 23 nt, Human
cucuccuccgaaauuggcccaaa

SEQ ID NO: 404127 - RNA, 23 nt, Human
cucucucucucucucucucuuuu

SEQ ID NO: 404128 - RNA, 27 nt, Human
cugcacugccaccaccaacccuaaucu

SEQ ID NO: 404129 - RNA, 21 nt, Human
cugcugcaugggcagcguggc

SEQ ID NO: 404130 - RNA, 23 nt, Human
cuggcaagaagcugguuuccccc

SEQ ID NO: 404131 - RNA, 20 nt, Human
cuggcccugggcaaggggca

SEQ ID NO: 404132 - RNA, 21 nt, Human
cuugaugucccacgguggcuc

SEQ ID NO: 404133 - RNA, 20 nt, Human
cuugggucugagauacuuuc

SEQ ID NO: 404134 - RNA, 22 nt, Human
gaaaaagauucucccagcuuga

SEQ ID NO: 404135 - RNA, 18 nt, Human
gacccugcagaauagaac

SEQ ID NO: 404136 - RNA, 20 nt, Human
gauucauggguccccucccc

SEQ ID NO: 404137 - RNA, 18 nt, Human
gcacuggcccugggcaag

SEQ ID NO: 404138 - RNA, 20 nt, Human
gcagaaagggugacagugag

SEQ ID NO: 404139 - RNA, 23 nt, Human
gcagacacacacccacacgacaa

SEQ ID NO: 404140 - RNA, 20 nt, Human
gcagaggagccacuaaguca

SEQ ID NO: 404141 - RNA, 18 nt, Human
gcagcgagugagccugug

SEQ ID NO: 404142 - RNA, 20 nt, Human
gccaaggcaggacagggcga

SEQ ID NO: 404143 - RNA, 20 nt, Human
gccaccuuuccugcagagga

SEQ ID NO: 404144 - RNA, 18 nt, Human
ggacuccagguuucuggc

SEQ ID NO: 404145 - RNA, 23 nt, Human
ggagguggggcuggacacucggg

SEQ ID NO: 404146 - RNA, 20 nt, Human
ggcccaaaguccuccuucug

SEQ ID NO: 404147 - RNA, 21 nt, Human
gggccccagcaggagcaacuu

SEQ ID NO: 404148 - RNA, 24 nt, Human
ggugcauucucaguggugaugggc

SEQ ID NO: 404149 - RNA, 20 nt, Human
gugccuugggucugagauac

SEQ ID NO: 404150 - RNA, 22 nt, Human
gugggugcagacacacacccac

SEQ ID NO: 404151 - RNA, 21 nt, Human
guuguuugucccuccccugcu

SEQ ID NO: 404152 - RNA, 18 nt, Human
uaaggcugguccaggggc

SEQ ID NO: 404153 - RNA, 22 nt, Human
uaagucaggugggugucugggc

SEQ ID NO: 404154 - RNA, 23 nt, Human
uacccuacagguggccagaaaaa

SEQ ID NO: 404155 - RNA, 22 nt, Human
uaccuccucaaaccaaagcucc

SEQ ID NO: 404156 - RNA, 20 nt, Human
uacuuucaagcaaacaaguu

SEQ ID NO: 404157 - RNA, 19 nt, Human
uagaagagaagggucuggc

SEQ ID NO: 404158 - RNA, 21 nt, Human
uagcuugguuguuugucccuc

SEQ ID NO: 404159 - RNA, 25 nt, Human
uaguggaggcacagcaaagagaccu

SEQ ID NO: 404160 - RNA, 23 nt, Human
uaucucuaccuccucaaaccaaa

SEQ ID NO: 404161 - RNA, 18 nt, Human
ucaggugggugucugggc

SEQ ID NO: 404162 - RNA, 18 nt, Human
ucaguggugaugggcacc

SEQ ID NO: 404163 - RNA, 21 nt, Human
uccaucuucuuaggggaggga

SEQ ID NO: 404164 - RNA, 21 nt, Human
ucccaaggagguuuguuccuu

SEQ ID NO: 404165 - RNA, 22 nt, Human
ucccaaggagguuuguuccuuc

SEQ ID NO: 404166 - RNA, 18 nt, Human
uccccauggcacuggccc

SEQ ID NO: 404167 - RNA, 21 nt, Human
uccccuccccacaagccccuu

SEQ ID NO: 404168 - RNA, 25 nt, Human
uccuauggauacacauaucucuacc

SEQ ID NO: 404169 - RNA, 19 nt, Human
ucggggugacccuggugga

SEQ ID NO: 404170 - RNA, 21 nt, Human
ucucuaccuccucaaaccaaa

SEQ ID NO: 404171 - RNA, 23 nt, Human
ucucucucuuuucccccuccccu

SEQ ID NO: 404172 - RNA, 20 nt, Human
ucugaugggcuggagguggg

SEQ ID NO: 404173 - RNA, 19 nt, Human
ucugcaauucacuucccuc

SEQ ID NO: 404174 - RNA, 19 nt, Human
ucuggccggagccucacug

SEQ ID NO: 404175 - RNA, 24 nt, Human
ucugggccaagggacucccaggac

SEQ ID NO: 404176 - RNA, 23 nt, Human
ugaaacccaauaacaaggcuggu

SEQ ID NO: 404177 - RNA, 22 nt, Human
ugagcagaaaguagguucccca

SEQ ID NO: 404178 - RNA, 23 nt, Human
ugagccuguguccaggcagggag

SEQ ID NO: 404179 - RNA, 24 nt, Human
ugaggugccuugggucugagauac

SEQ ID NO: 404180 - RNA, 23 nt, Human
ugaguuagggagacagagcuuuu

SEQ ID NO: 404181 - RNA, 25 nt, Human
ugaguuagggagacagagcuuuucc

SEQ ID NO: 404182 - RNA, 21 nt, Human
ugaugggcuggagguggggcu

SEQ ID NO: 404183 - RNA, 20 nt, Human
ugcagacacacacccacacg

SEQ ID NO: 404184 - RNA, 23 nt, Human
ugcaugugugucuacaaacacau

SEQ ID NO: 404185 - RNA, 19 nt, Human
ugccugcaaaagccagacc

SEQ ID NO: 404186 - RNA, 20 nt, Human
ugccuuucuugcugcugagc

SEQ ID NO: 404187 - RNA, 22 nt, Human
uggaguccuggugaauuuucca

SEQ ID NO: 404188 - RNA, 21 nt, Human
uggcaagaagcugguuucccc

SEQ ID NO: 404189 - RNA, 23 nt, Human
uggcaagaagcugguuuccccca

SEQ ID NO: 404190 - RNA, 25 nt, Human
uggcaagaagcugguuuccggaagc

SEQ ID NO: 404191 - RNA, 23 nt, Human
uggccagaaaaagauucucccag

SEQ ID NO: 404192 - RNA, 22 nt, Human
uggcccaagugcaagccuucug

SEQ ID NO: 404193 - RNA, 24 nt, Human
uggcggaggcagcagcuguggcug

SEQ ID NO: 404194 - RNA, 23 nt, Human
uggcucagcuagggaaaccaagg

SEQ ID NO: 404195 - RNA, 18 nt, Human
ugggcuggagguggggcu

SEQ ID NO: 404196 - RNA, 19 nt, Human
uggguucaagaguggucag

SEQ ID NO: 404197 - RNA, 20 nt, Human
ugguuguuugucccuccccu

SEQ ID NO: 404198 - RNA, 19 nt, Human
ugucuacaaacacauggga

SEQ ID NO: 404199 - RNA, 22 nt, Human
uguggugugcaggcagcaggag

SEQ ID NO: 404200 - RNA, 22 nt, Human
ugugucuacaaacacaugggac

SEQ ID NO: 404201 - RNA, 19 nt, Human
uucauggguccccucccca

SEQ ID NO: 404202 - RNA, 19 nt, Human
uuggcccaagugcaagccu

SEQ ID NO: 404203 - RNA, 23 nt, Human
uuguuugucccuccccugcugca

SEQ ID NO: 404204 - RNA, 20 nt, Human
uuuggcccaagugcaagccu

SEQ ID NO: 404205 - RNA, 24 nt, Human
acagugcugcgagaucgcuggcaa

SEQ ID NO: 404206 - RNA, 19 nt, Human
acccuggcucuucucucga

SEQ ID NO: 404207 - RNA, 21 nt, Human
accugcucuguccccaacccc

SEQ ID NO: 404208 - RNA, 20 nt, Human
acuccggccugcccacuccu

SEQ ID NO: 404209 - RNA, 20 nt, Human
agcagcugcagugccucugc

SEQ ID NO: 404210 - RNA, 24 nt, Human
aggagccuguaccacaaaugcagc

SEQ ID NO: 404211 - RNA, 20 nt, Human
aggcucuggccccacccaug

SEQ ID NO: 404212 - RNA, 23 nt, Human
aggcuuggcccaaggcugaggug

SEQ ID NO: 404213 - RNA, 20 nt, Human
agggcgccccacuccggccu

SEQ ID NO: 404214 - RNA, 21 nt, Human
agggcgccccacuccggccug

SEQ ID NO: 404215 - RNA, 19 nt, Human
aggggccucuggggcuaac

SEQ ID NO: 404216 - RNA, 18 nt, Human
caccagccgugccguggu

SEQ ID NO: 404217 - RNA, 21 nt, Human
caccagccgugccguggucag

SEQ ID NO: 404218 - RNA, 19 nt, Human
cagcgacagugaggaggga

SEQ ID NO: 404219 - RNA, 20 nt, Human
cagcgagcucuggaagagga

SEQ ID NO: 404220 - RNA, 22 nt, Human
cagcugcagugccucugcaccu

SEQ ID NO: 404221 - RNA, 24 nt, Human
cagggcaggacagggaagucuccc

SEQ ID NO: 404222 - RNA, 21 nt, Human
cagggcgccccacuccggccu

SEQ ID NO: 404223 - RNA, 22 nt, Human
cagucaucuuugucuucagccc

SEQ ID NO: 404224 - RNA, 24 nt, Human
cagugcugcgagaucgcuggcaga

SEQ ID NO: 404225 - RNA, 22 nt, Human
caguggcagugacggggcagag

SEQ ID NO: 404226 - RNA, 24 nt, Human
ccaaggcugaggugggaaguuuau

SEQ ID NO: 404227 - RNA, 25 nt, Human
cccaugccgggauacauucacugag

SEQ ID NO: 404228 - RNA, 21 nt, Human
ccccacuccggccugcccacu

SEQ ID NO: 404229 - RNA, 27 nt, Human
cccccuguaaacacagugcugcgagau

SEQ ID NO: 404230 - RNA, 23 nt, Human
cccccuuccacaccccggugucc

SEQ ID NO: 404231 - RNA, 19 nt, Human
cccucagugcucggcaguc

SEQ ID NO: 404232 - RNA, 22 nt, Human
cccuucugagagaagcugaggg

SEQ ID NO: 404233 - RNA, 22 nt, Human
ccuccuccuuccuggggacagg

SEQ ID NO: 404234 - RNA, 25 nt, Human
ccuucugagagaagcugagggugga

SEQ ID NO: 404235 - RNA, 23 nt, Human
cgacagcagccccagcgaguaau

SEQ ID NO: 404236 - RNA, 22 nt, Human
cgccccacuccggccugcccac

SEQ ID NO: 404237 - RNA, 19 nt, Human
cggcagcgacagugaggag

SEQ ID NO: 404238 - RNA, 21 nt, Human
cggcagcgacagugaggaggg

SEQ ID NO: 404239 - RNA, 22 nt, Human
cggcagcgacagugaggaggga

SEQ ID NO: 404240 - RNA, 22 nt, Human
cuccagcggcuggguggugaag

SEQ ID NO: 404241 - RNA, 22 nt, Human
cucuucucucggggcgaccccu

SEQ ID NO: 404242 - RNA, 19 nt, Human
cugagagaagcugagggug

SEQ ID NO: 404243 - RNA, 18 nt, Human
cugagccacaaccgacug

SEQ ID NO: 404244 - RNA, 23 nt, Human
cugcaacaggggcugagccacaa

SEQ ID NO: 404245 - RNA, 25 nt, Human
cugcaccugcucuguccccaacccc

SEQ ID NO: 404246 - RNA, 24 nt, Human
cugcagucaucuuugucuucagcc

SEQ ID NO: 404247 - RNA, 23 nt, Human
cuggcaaaucccaccagccgugc

SEQ ID NO: 404248 - RNA, 21 nt, Human
cuggggcugguguguccucuu

SEQ ID NO: 404249 - RNA, 18 nt, Human
cuuccaggcuuggcccaa

SEQ ID NO: 404250 - RNA, 24 nt, Human
cuucugagagaagcugagggugga

SEQ ID NO: 404251 - RNA, 22 nt, Human
gagaaucugagugaggggcgcc

SEQ ID NO: 404252 - RNA, 23 nt, Human
gagcaguggcagugacggggcag

SEQ ID NO: 404253 - RNA, 19 nt, Human
gagccacaaccgacugugg

SEQ ID NO: 404254 - RNA, 22 nt, Human
gcaaccgagcagcugcagugcc

SEQ ID NO: 404255 - RNA, 19 nt, Human
gcagcgacagugaggaggg

SEQ ID NO: 404256 - RNA, 18 nt, Human
gcaguggcagugacgggg

SEQ ID NO: 404257 - RNA, 18 nt, Human
gcccagucagacaaugaa

SEQ ID NO: 404258 - RNA, 20 nt, Human
gccucuggggcuaacucugg

SEQ ID NO: 404259 - RNA, 19 nt, Human
gcgacagugaggagggagu

SEQ ID NO: 404260 - RNA, 21 nt, Human
gcgaguaaugaggagcagugg

SEQ ID NO: 404261 - RNA, 24 nt, Human
gcugcagugccucugcaccugauc

SEQ ID NO: 404262 - RNA, 24 nt, Human
gcugggagauuagagagccccucc

SEQ ID NO: 404263 - RNA, 23 nt, Human
gcuuggcccaaggcugagguggg

SEQ ID NO: 404264 - RNA, 28 nt, Human
ggacaggccagggcgccccacuccggcc

SEQ ID NO: 404265 - RNA, 24 nt, Human
ggagcaguggcagugacggggcag

SEQ ID NO: 404266 - RNA, 23 nt, Human
ggcaaccgagcagcugcagugcc

SEQ ID NO: 404267 - RNA, 18 nt, Human
gggagggcggcgucucag

SEQ ID NO: 404268 - RNA, 22 nt, Human
gggcgccccacuccggccugcc

SEQ ID NO: 404269 - RNA, 24 nt, Human
ggggcucuucaggaggcucagggg

SEQ ID NO: 404270 - RNA, 26 nt, Human
ggggcugguguguccucuucuggggc

SEQ ID NO: 404271 - RNA, 19 nt, Human
guggccucgugacuccugc

SEQ ID NO: 404272 - RNA, 19 nt, Human
guguguccucuucuggggc

SEQ ID NO: 404273 - RNA, 23 nt, Human
uccaggcuuggcccaaggcugag

SEQ ID NO: 404274 - RNA, 24 nt, Human
uccccaaccccgggagggcggcgu

SEQ ID NO: 404275 - RNA, 22 nt, Human
uccccugcaacaggggcugagc

SEQ ID NO: 404276 - RNA, 24 nt, Human
uccugacucauccacggcagggag

SEQ ID NO: 404277 - RNA, 23 nt, Human
uccuuuauugcuccuguacgaac

SEQ ID NO: 404278 - RNA, 24 nt, Human
ucgcuggcagagaaggcuuccucc

SEQ ID NO: 404279 - RNA, 18 nt, Human
ucggggaggcgacagcag

SEQ ID NO: 404280 - RNA, 26 nt, Human
ucugaggugggcaucagcgagcucug

SEQ ID NO: 404281 - RNA, 28 nt, Human
ucuggacaaggccacccuucggggaggc

SEQ ID NO: 404282 - RNA, 20 nt, Human
ucuggacuccuugauggaug

SEQ ID NO: 404283 - RNA, 18 nt, Human
ugacuccugcgagcuccc

SEQ ID NO: 404284 - RNA, 19 nt, Human
ugacuccugcgagcucccu

SEQ ID NO: 404285 - RNA, 18 nt, Human
ugagagaagcugagggug

SEQ ID NO: 404286 - RNA, 18 nt, Human
ugaggguggaacuggcug

SEQ ID NO: 404287 - RNA, 23 nt, Human
ugaggugggaaguuuauaggucc

SEQ ID NO: 404288 - RNA, 20 nt, Human
ugagucaggugcucgcuucc

SEQ ID NO: 404289 - RNA, 19 nt, Human
ugagugaggggcgccaugg

SEQ ID NO: 404290 - RNA, 19 nt, Human
ugcagacuccuccuccuuc

SEQ ID NO: 404291 - RNA, 19 nt, Human
ugcuccauuuuuaucuucc

SEQ ID NO: 404292 - RNA, 19 nt, Human
uggcccaaggcugaggugg

SEQ ID NO: 404293 - RNA, 26 nt, Human
uggcccaaggcugaggugggaaguuu

SEQ ID NO: 404294 - RNA, 19 nt, Human
ugggagaagcccaggggag

SEQ ID NO: 404295 - RNA, 25 nt, Human
uggggcuaacucuggggcuggugug

SEQ ID NO: 404296 - RNA, 23 nt, Human
uggggcugguguguccucuucug

SEQ ID NO: 404297 - RNA, 23 nt, Human
uggggugcgagagaggugggcag

SEQ ID NO: 404298 - RNA, 23 nt, Human
uggguggugaaggacccuggcuc

SEQ ID NO: 404299 - RNA, 24 nt, Human
uguguccccgcucauuuuguuuuc

SEQ ID NO: 404300 - RNA, 24 nt, Human
uuccaggcuuggcccaaggcugag

SEQ ID NO: 404301 - RNA, 19 nt, Human
uuccuggggacaggccagg

SEQ ID NO: 404302 - RNA, 21 nt, Human
uugaagcccacagggcugcag

SEQ ID NO: 404303 - RNA, 19 nt, Human
uugaggugacuggcaaauc

SEQ ID NO: 404304 - RNA, 20 nt, Human
uugaggugacuggcaaaucc

SEQ ID NO: 404305 - RNA, 24 nt, Human
aaaaaaaaaucccccuugggcccg

SEQ ID NO: 404306 - RNA, 24 nt, Human
aaaaaaaauucucaaggaggugaa

SEQ ID NO: 404307 - RNA, 20 nt, Human
aaaaaucccccuugggcccg

SEQ ID NO: 404308 - RNA, 20 nt, Human
aaacccacuuauuagugcca

SEQ ID NO: 404309 - RNA, 23 nt, Human
aaaucuuuaaacuuuuaacagaa

SEQ ID NO: 404310 - RNA, 19 nt, Human
acagucaguauaaaauaac

SEQ ID NO: 404311 - RNA, 22 nt, Human
cacuguaguaaaaagauauaaa

SEQ ID NO: 404312 - RNA, 20 nt, Human
cuuacuauaagcuuaaaaaa

SEQ ID NO: 404313 - RNA, 18 nt, Human
gaagcugcugcugucaca

SEQ ID NO: 404314 - RNA, 19 nt, Human
gacacugacucaaaauacu

SEQ ID NO: 404315 - RNA, 25 nt, Human
uaaaaaaaaaucagccauguccuug

SEQ ID NO: 404316 - RNA, 21 nt, Human
uaaaaagauauaaaugcaaua

SEQ ID NO: 404317 - RNA, 21 nt, Human
uaaacccacuuauuagugcca

SEQ ID NO: 404318 - RNA, 20 nt, Human
uacaauuagaaaagaccaau

SEQ ID NO: 404319 - RNA, 19 nt, Human
uagaaaagaccaauaaacc

SEQ ID NO: 404320 - RNA, 23 nt, Human
uagaaaagaccaauaaacccacu

SEQ ID NO: 404321 - RNA, 20 nt, Human
uauugcacaauauagguaca

SEQ ID NO: 404322 - RNA, 24 nt, Human
uauuuuacaaacuuuguacuaaau

SEQ ID NO: 404323 - RNA, 21 nt, Human
uguaagacacugacucaaaau

SEQ ID NO: 404324 - RNA, 21 nt, Human
uuuaaacuuuuaacagaaaau

SEQ ID NO: 404325 - RNA, 25 nt, Human
uuuaagauggauauuuuacaauuuc

SEQ ID NO: 404326 - RNA, 24 nt, Human
aaaaaaaaaauccaaauuaucagc

SEQ ID NO: 404327 - RNA, 20 nt, Human
aaaaaaaacagucguuaaug

SEQ ID NO: 404328 - RNA, 22 nt, Human
aaacacacacacaggucuaaca

SEQ ID NO: 404329 - RNA, 21 nt, Human
aaguuaaaaaaaaaaaaaucc

SEQ ID NO: 404330 - RNA, 18 nt, Human
aauacaaaaagugagcac

SEQ ID NO: 404331 - RNA, 20 nt, Human
agacaauguggggauaauuc

SEQ ID NO: 404332 - RNA, 20 nt, Human
agcugcagccugccucccuc

SEQ ID NO: 404333 - RNA, 18 nt, Human
aggagcaauuuggugaaa

SEQ ID NO: 404334 - RNA, 19 nt, Human
aguugcaaguugagucuuu

SEQ ID NO: 404335 - RNA, 21 nt, Human
cacacacaggucuaacagcca

SEQ ID NO: 404336 - RNA, 20 nt, Human
cacacaggucuaacagccaa

SEQ ID NO: 404337 - RNA, 23 nt, Human
ccaaaguuaaaaaaaaaaaaauc

SEQ ID NO: 404338 - RNA, 20 nt, Human
ccacaaggggaaagugagau

SEQ ID NO: 404339 - RNA, 24 nt, Human
ccccaacaacuccauucuuuaaaa

SEQ ID NO: 404340 - RNA, 19 nt, Human
cugaagcugcagccugccu

SEQ ID NO: 404341 - RNA, 24 nt, Human
gacagcucaaacagcaauaacaau

SEQ ID NO: 404342 - RNA, 18 nt, Human
gagcacugacuucucuuu

SEQ ID NO: 404343 - RNA, 21 nt, Human
gagucgggugaccagagcugg

SEQ ID NO: 404344 - RNA, 22 nt, Human
gccaaaguuaaaaaaaaaaaaa

SEQ ID NO: 404345 - RNA, 19 nt, Human
gcugcagccugccucccuc

SEQ ID NO: 404346 - RNA, 21 nt, Human
gcugcagccugccucccuccu

SEQ ID NO: 404347 - RNA, 21 nt, Human
uaucagaguggagacagaagu

SEQ ID NO: 404348 - RNA, 19 nt, Human
ucaggggcacaucccuccc

SEQ ID NO: 404349 - RNA, 27 nt, Human
uccauucuuuaaaaaaaaaaaaaaaaa

SEQ ID NO: 404350 - RNA, 19 nt, Human
ucuguggcugaagcugcag

SEQ ID NO: 404351 - RNA, 20 nt, Human
ucuuuaaaaaaaaaaaaaaa

SEQ ID NO: 404352 - RNA, 18 nt, Human
ugccaaaguuaaaaaaaa

SEQ ID NO: 404353 - RNA, 25 nt, Human
ugccaaaguuaaaaaaaaaaaaauc

SEQ ID NO: 404354 - RNA, 18 nt, Human
uggcugaagcugcagccu

SEQ ID NO: 404355 - RNA, 18 nt, Human
ugugcagaggaaaugagc

SEQ ID NO: 404356 - RNA, 24 nt, Human
ugugccaaaguuaaaaaaaaaaaa

SEQ ID NO: 404357 - RNA, 21 nt, Human
uuacacuacagguguaaugca

SEQ ID NO: 404358 - RNA, 18 nt, Human
uugugugcaugucccgcc

SEQ ID NO: 404359 - RNA, 27 nt, Human
uugugugcaugucccgccccaacaacu

SEQ ID NO: 404360 - RNA, 24 nt, Human
uuuucaguuggaaucauuuuuaau

SEQ ID NO: 404361 - RNA, 21 nt, Human
uuuuuuuuuuuuucaguugga

SEQ ID NO: 404362 - RNA, 21 nt, Human
uuuuuuuuuuuuuuuuuucag

SEQ ID NO: 404363 - RNA, 21 nt, Human
aaaaaggaacacucaagucag

SEQ ID NO: 404364 - RNA, 19 nt, Human
aaaacacugccaaagccac

SEQ ID NO: 404365 - RNA, 24 nt, Human
aaaacacugccaaagccacgacug

SEQ ID NO: 404366 - RNA, 23 nt, Human
aaaauaaaaacaaaauucaaaac

SEQ ID NO: 404367 - RNA, 24 nt, Human
aaaaugucuucacauuaaaauucu

SEQ ID NO: 404368 - RNA, 23 nt, Human
aaaggaacacucaagucaggaaa

SEQ ID NO: 404369 - RNA, 21 nt, Human
aaccaaaacacugccaaagcc

SEQ ID NO: 404370 - RNA, 21 nt, Human
aagcggcggugacugugggcc

SEQ ID NO: 404371 - RNA, 19 nt, Human
aaggaugaugggaaaaugg

SEQ ID NO: 404372 - RNA, 19 nt, Human
acagaccccagcaguugug

SEQ ID NO: 404373 - RNA, 19 nt, Human
acuaacaaugccucuaaaa

SEQ ID NO: 404374 - RNA, 22 nt, Human
acuccggaggcucgaggaggcg

SEQ ID NO: 404375 - RNA, 21 nt, Human
agaaacggcugaggcugcuac

SEQ ID NO: 404376 - RNA, 26 nt, Human
agaccccagcaguuguguaacagccu

SEQ ID NO: 404377 - RNA, 19 nt, Human
aggcacgagggcaagugag

SEQ ID NO: 404378 - RNA, 24 nt, Human
auaggacaacuggcucagcucucc

SEQ ID NO: 404379 - RNA, 25 nt, Human
augacaauagagagugacgacucua

SEQ ID NO: 404380 - RNA, 21 nt, Human
auugcaaaacccuaacuguaa

SEQ ID NO: 404381 - RNA, 21 nt, Human
caaaagaaaaaauaaaagccc

SEQ ID NO: 404382 - RNA, 24 nt, Human
caaguuuaaugaaaauugaucccc

SEQ ID NO: 404383 - RNA, 26 nt, Human
cacacuaaacuaacaaugccucuaaa

SEQ ID NO: 404384 - RNA, 21 nt, Human
cacuaaacuaacaaugccucu

SEQ ID NO: 404385 - RNA, 21 nt, Human
caguagcuaagagaauccaaa

SEQ ID NO: 404386 - RNA, 22 nt, Human
caguagcuaagagaauccaaac

SEQ ID NO: 404387 - RNA, 24 nt, Human
cauacaguagcuaagagaauccaa

SEQ ID NO: 404388 - RNA, 20 nt, Human
ccaaaacacugccaaagcca

SEQ ID NO: 404389 - RNA, 21 nt, Human
ccaaaacacugccaaagccac

SEQ ID NO: 404390 - RNA, 23 nt, Human
ccaaaacacugccaaagccacga

SEQ ID NO: 404391 - RNA, 20 nt, Human
ccaaaccacacuguuccucu

SEQ ID NO: 404392 - RNA, 22 nt, Human
ccaugacaauagagagugacga

SEQ ID NO: 404393 - RNA, 22 nt, Human
cccauccacuugcccucuugaa

SEQ ID NO: 404394 - RNA, 20 nt, Human
ccggagggacgagcgcggcg

SEQ ID NO: 404395 - RNA, 24 nt, Human
cgagacuccagaaacggcugaggg

SEQ ID NO: 404396 - RNA, 26 nt, Human
cggcccggagggacgagcgcggcggg

SEQ ID NO: 404397 - RNA, 22 nt, Human
cucagaacaaaggaugauggga

SEQ ID NO: 404398 - RNA, 21 nt, Human
cucgcccuucaucccucccca

SEQ ID NO: 404399 - RNA, 23 nt, Human
cuugcccucuugaaaauaaaaac

SEQ ID NO: 404400 - RNA, 23 nt, Human
cuuucccaaaccacacuguuccu

SEQ ID NO: 404401 - RNA, 22 nt, Human
gaaaugggagagagggaaggga

SEQ ID NO: 404402 - RNA, 20 nt, Human
gacuugcugccucucucccc

SEQ ID NO: 404403 - RNA, 18 nt, Human
gagacgcagacggcgaac

SEQ ID NO: 404404 - RNA, 24 nt, Human
gagcgcggcggcaggcgaggcggc

SEQ ID NO: 404405 - RNA, 28 nt, Human
gaucuuuaagaucaagaaaaagguuuaa

SEQ ID NO: 404406 - RNA, 23 nt, Human
gcccuucaucccuccccaacccc

SEQ ID NO: 404407 - RNA, 20 nt, Human
gcgugggggagacgcagacg

SEQ ID NO: 404408 - RNA, 23 nt, Human
ggagggacgagcgcggcggcagg

SEQ ID NO: 404409 - RNA, 19 nt, Human
ggcaggcgaggcggcgugg

SEQ ID NO: 404410 - RNA, 21 nt, Human
ggcccgagacuccagaaacgg

SEQ ID NO: 404411 - RNA, 22 nt, Human
guagaacgcugacaaauuccca

SEQ ID NO: 404412 - RNA, 20 nt, Human
uaaaagcccuaaaaucuuga

SEQ ID NO: 404413 - RNA, 23 nt, Human
uaaauaaccuacaguugauuaaa

SEQ ID NO: 404414 - RNA, 24 nt, Human
uaagagaauccaaacauuucagug

SEQ ID NO: 404415 - RNA, 18 nt, Human
uacacaauuacaaaagaa

SEQ ID NO: 404416 - RNA, 20 nt, Human
uagaacgcugacaaauuccc

SEQ ID NO: 404417 - RNA, 21 nt, Human
uagaagauacuugaggaaaga

SEQ ID NO: 404418 - RNA, 20 nt, Human
uagcuaagagaauccaaaca

SEQ ID NO: 404419 - RNA, 20 nt, Human
ucaguuuauccaucuuuccc

SEQ ID NO: 404420 - RNA, 19 nt, Human
ucccauccacuugcccucu

SEQ ID NO: 404421 - RNA, 23 nt, Human
ucccccaggcacgagggcaagug

SEQ ID NO: 404422 - RNA, 18 nt, Human
uccucuaaguuuauugac

SEQ ID NO: 404423 - RNA, 22 nt, Human
ucgcccuucaucccuccccaac

SEQ ID NO: 404424 - RNA, 24 nt, Human
ucugaaccaaaacacugccaaagc

SEQ ID NO: 404425 - RNA, 21 nt, Human
ucugcacacacacuaaacuaa

SEQ ID NO: 404426 - RNA, 23 nt, Human
ucugcacacacacuaaacuaaca

SEQ ID NO: 404427 - RNA, 25 nt, Human
ugaaaauaaaaacaaaauucaaaac

SEQ ID NO: 404428 - RNA, 19 nt, Human
ugaaaugggagagagggaa

SEQ ID NO: 404429 - RNA, 18 nt, Human
ugauaaaaauagaagaua

SEQ ID NO: 404430 - RNA, 22 nt, Human
ugcccucuugaaaauaaaaaca

SEQ ID NO: 404431 - RNA, 20 nt, Human
ugccucucucccccaggcac

SEQ ID NO: 404432 - RNA, 20 nt, Human
ugccugguagaacgcugaca

SEQ ID NO: 404433 - RNA, 20 nt, Human
ugcucagaacaaaggaugau

SEQ ID NO: 404434 - RNA, 19 nt, Human
ugugaacaggugucugaac

SEQ ID NO: 404435 - RNA, 22 nt, Human
uuaaauuccugaaaugggagag

SEQ ID NO: 404436 - RNA, 23 nt, Human
uuauccaucuuucccaaaccaca

SEQ ID NO: 404437 - RNA, 20 nt, Human
uucaucccuccccaacccca

SEQ ID NO: 404438 - RNA, 22 nt, Human
uuuauccaucuuucccaaacca

SEQ ID NO: 404439 - RNA, 20 nt, Human
uuuucugugaacaggugucu

SEQ ID NO: 404440 - RNA, 22 nt, Human
uuuuuuguucuacuuaauuuua

SEQ ID NO: 404441 - RNA, 19 nt, Human
aaaauuccccaguacugcu

SEQ ID NO: 404442 - RNA, 20 nt, Human
cacacacacauacaaaagaa

SEQ ID NO: 404443 - RNA, 20 nt, Human
uaauagugaaaaaaacacac

SEQ ID NO: 404444 - RNA, 22 nt, Human
uaauagugaaaaaaacacacac

SEQ ID NO: 404445 - RNA, 22 nt, Human
ugaaaaaaacacacacacauac

SEQ ID NO: 404446 - RNA, 24 nt, Human
ugaaaaaaacacacacacauacaa

SEQ ID NO: 404447 - RNA, 27 nt, Human
ugaaaaaaacacacacacauacaaaag

SEQ ID NO: 404448 - RNA, 19 nt, Human
aaaagaaagcagacucaaa

SEQ ID NO: 404449 - RNA, 30 nt, Human
aaaagaaagcagacucaaaacacagacaaa

SEQ ID NO: 404450 - RNA, 22 nt, Human
aacccugaaagcgacuaaacag

SEQ ID NO: 404451 - RNA, 18 nt, Human
aagaaagcagacucaaaa

SEQ ID NO: 404452 - RNA, 20 nt, Human
aagcagacucaaaacacaga

SEQ ID NO: 404453 - RNA, 24 nt, Human
aagcagagaagaaaacaaugccca

SEQ ID NO: 404454 - RNA, 22 nt, Human
aaguagaaaaggaggaagagga

SEQ ID NO: 404455 - RNA, 21 nt, Human
acaaagcagagaagaaaacaa

SEQ ID NO: 404456 - RNA, 21 nt, Human
acacagacaaagcagagaaga

SEQ ID NO: 404457 - RNA, 23 nt, Human
accccacgagaccacccccgacc

SEQ ID NO: 404458 - RNA, 25 nt, Human
acccccgaccaagccgcuucuccac

SEQ ID NO: 404459 - RNA, 19 nt, Human
acccugaaagcgacuaaac

SEQ ID NO: 404460 - RNA, 22 nt, Human
agaagaaaacaaugcccaugaa

SEQ ID NO: 404461 - RNA, 20 nt, Human
agaagaacuuaaaaaucagg

SEQ ID NO: 404462 - RNA, 18 nt, Human
agacaaaagaaagcagac

SEQ ID NO: 404463 - RNA, 22 nt, Human
agacaaagcagagaagaaaaca

SEQ ID NO: 404464 - RNA, 19 nt, Human
agacucaaaacacagacaa

SEQ ID NO: 404465 - RNA, 21 nt, Human
agaggggaggaaguuaagagc

SEQ ID NO: 404466 - RNA, 18 nt, Human
agaguaucuguacuagaa

SEQ ID NO: 404467 - RNA, 23 nt, Human
agucacacacauauaacaaugua

SEQ ID NO: 404468 - RNA, 21 nt, Human
aucacauaacuacucuaauuu

SEQ ID NO: 404469 - RNA, 23 nt, Human
caaaagaaagcagacucaaaaca

SEQ ID NO: 404470 - RNA, 21 nt, Human
caaauguuguccccgagucuu

SEQ ID NO: 404471 - RNA, 22 nt, Human
caagaacccugaaagcgacuaa

SEQ ID NO: 404472 - RNA, 21 nt, Human
cagacaaagcagagaagaaaa

SEQ ID NO: 404473 - RNA, 23 nt, Human
caggaccccacgagaccaccccc

SEQ ID NO: 404474 - RNA, 19 nt, Human
cagguuuuaaagacaaaag

SEQ ID NO: 404475 - RNA, 21 nt, Human
cauaagaggcugaguguagua

SEQ ID NO: 404476 - RNA, 20 nt, Human
ccccgaccaagccgcuucuc

SEQ ID NO: 404477 - RNA, 21 nt, Human
ccccgaccaagccgcuucucc

SEQ ID NO: 404478 - RNA, 24 nt, Human
cuagaaccauaaaguucuaucuga

SEQ ID NO: 404479 - RNA, 20 nt, Human
cucauugcuuaaagaaaaac

SEQ ID NO: 404480 - RNA, 19 nt, Human
gaccccacgagaccacccc

SEQ ID NO: 404481 - RNA, 26 nt, Human
gacuaaacaggcaggaccccacgaga

SEQ ID NO: 404482 - RNA, 21 nt, Human
gagaccacccccgaccaagcc

SEQ ID NO: 404483 - RNA, 21 nt, Human
gagucuucugcaauccagucc

SEQ ID NO: 404484 - RNA, 24 nt, Human
gguuaggagagcuccacuugaacc

SEQ ID NO: 404485 - RNA, 21 nt, Human
gucgguuaggagagcuccacu

SEQ ID NO: 404486 - RNA, 20 nt, Human
uaaaaacaccuuccccaaac

SEQ ID NO: 404487 - RNA, 23 nt, Human
uaaaaacaccuuccccaaacuaa

SEQ ID NO: 404488 - RNA, 19 nt, Human
uaaacaggcaggaccccac

SEQ ID NO: 404489 - RNA, 19 nt, Human
uaacaauguagacaggucu

SEQ ID NO: 404490 - RNA, 21 nt, Human
uacugaaaguagaaaaggagg

SEQ ID NO: 404491 - RNA, 21 nt, Human
uagcuaauagaaaaacauagu

SEQ ID NO: 404492 - RNA, 21 nt, Human
ucaaguuauagacacagccaa

SEQ ID NO: 404493 - RNA, 24 nt, Human
ucagguuuuaaagacaaaagaaag

SEQ ID NO: 404494 - RNA, 24 nt, Human
uccccaaacuaaauucagagggga

SEQ ID NO: 404495 - RNA, 21 nt, Human
ucuuguacuaaaaacaccuuc

SEQ ID NO: 404496 - RNA, 18 nt, Human
ucuuugggagauucagac

SEQ ID NO: 404497 - RNA, 23 nt, Human
ugaaaguagaaaaggaggaagag

SEQ ID NO: 404498 - RNA, 20 nt, Human
ugacacuuuuaaaucaaacu

SEQ ID NO: 404499 - RNA, 18 nt, Human
ugguuucucucuuuggga

SEQ ID NO: 404500 - RNA, 24 nt, Human
uuggaucaaauguuguccccgagu

SEQ ID NO: 404501 - RNA, 23 nt, Human
uuggcacauaagaggcugagugu

SEQ ID NO: 404502 - RNA, 23 nt, Human
uugguaagauaauuacuuaaaau

SEQ ID NO: 404503 - RNA, 22 nt, Human
uugguuucucucuuugggagau

SEQ ID NO: 404504 - RNA, 22 nt, Human
aaaaaagagcauaaaacuguau

SEQ ID NO: 404505 - RNA, 19 nt, Human
aaagagcauaaaacuguau

SEQ ID NO: 404506 - RNA, 23 nt, Human
aacuguauguguaagaacaaaau

SEQ ID NO: 404507 - RNA, 22 nt, Human
acaaaagucugagacagagaag

SEQ ID NO: 404508 - RNA, 22 nt, Human
agaagacaaaaggacaacacaa

SEQ ID NO: 404509 - RNA, 21 nt, Human
agacaaaaggacaacacaaga

SEQ ID NO: 404510 - RNA, 23 nt, Human
caauaauaaaaaaccgucaauua

SEQ ID NO: 404511 - RNA, 18 nt, Human
cauuucaaaaagcagguc

SEQ ID NO: 404512 - RNA, 20 nt, Human
gacaaaaggacaacacaaga

SEQ ID NO: 404513 - RNA, 21 nt, Human
gagacagagaagacaaaagga

SEQ ID NO: 404514 - RNA, 18 nt, Human
uaaaaaaccgucaauuac

SEQ ID NO: 404515 - RNA, 18 nt, Human
uaaccaugacaauuaaaa

SEQ ID NO: 404516 - RNA, 23 nt, Human
uacaucaucacauuaaaauaagc

SEQ ID NO: 404517 - RNA, 19 nt, Human
uaccacaauaauaaaaaac

SEQ ID NO: 404518 - RNA, 23 nt, Human
ucaucacauuaaaauaagccaga

SEQ ID NO: 404519 - RNA, 20 nt, Human
uguauguguaagaacaaaau

SEQ ID NO: 404520 - RNA, 27 nt, Human
uuaaaauaagccagauguacaaaaguc

SEQ ID NO: 404521 - RNA, 23 nt, Human
aaacacaaaggggacaggucuga

SEQ ID NO: 404522 - RNA, 19 nt, Human
aacuuccgcccgccuucuc

SEQ ID NO: 404523 - RNA, 19 nt, Human
aauucuggauguccuggcu

SEQ ID NO: 404524 - RNA, 21 nt, Human
acaagaaggcccgacuccaaa

SEQ ID NO: 404525 - RNA, 24 nt, Human
acacaaaggggacaggucugagaa

SEQ ID NO: 404526 - RNA, 22 nt, Human
acagugggcuucagcugggacu

SEQ ID NO: 404527 - RNA, 20 nt, Human
accacagccauuuccuugca

SEQ ID NO: 404528 - RNA, 22 nt, Human
accacagccauuuccuugcauu

SEQ ID NO: 404529 - RNA, 19 nt, Human
accagccugcuggccuuug

SEQ ID NO: 404530 - RNA, 18 nt, Human
acugcaccaauccucugc

SEQ ID NO: 404531 - RNA, 27 nt, Human
agagggaaugaagcuucuucugaagga

SEQ ID NO: 404532 - RNA, 23 nt, Human
agcccugggagcuucuuccuuug

SEQ ID NO: 404533 - RNA, 19 nt, Human
aggacgucuaugagaagcc

SEQ ID NO: 404534 - RNA, 26 nt, Human
aggccaacacuguccucuaacagggg

SEQ ID NO: 404535 - RNA, 20 nt, Human
auccuugggggguccgaggg

SEQ ID NO: 404536 - RNA, 24 nt, Human
caaaggccaacacuguccucuaag

SEQ ID NO: 404537 - RNA, 19 nt, Human
caagaaggcccgacuccaa

SEQ ID NO: 404538 - RNA, 19 nt, Human
cacaagaaggcccgacucc

SEQ ID NO: 404539 - RNA, 20 nt, Human
cacaagaaggcccgacucca

SEQ ID NO: 404540 - RNA, 18 nt, Human
cacacagugggcuucagc

SEQ ID NO: 404541 - RNA, 23 nt, Human
caccgaaagggaaccagagccuc

SEQ ID NO: 404542 - RNA, 21 nt, Human
cacguccccaccagccugcug

SEQ ID NO: 404543 - RNA, 23 nt, Human
cacuugguccugguuaacucauu

SEQ ID NO: 404544 - RNA, 21 nt, Human
ccaauccucugcuaacagcaa

SEQ ID NO: 404545 - RNA, 24 nt, Human
cccgugccgcagccgccgccucag

SEQ ID NO: 404546 - RNA, 21 nt, Human
cccugggcagccuggacaggg

SEQ ID NO: 404547 - RNA, 20 nt, Human
cccuuaacacaagaaggccc

SEQ ID NO: 404548 - RNA, 22 nt, Human
ccgcagccgccgccucagcacc

SEQ ID NO: 404549 - RNA, 19 nt, Human
ccgugccgcagccgccgcc

SEQ ID NO: 404550 - RNA, 23 nt, Human
ccucgcgcccggagccgcucccc

SEQ ID NO: 404551 - RNA, 18 nt, Human
ccugggaagagggucacu

SEQ ID NO: 404552 - RNA, 24 nt, Human
ccuugggggguccgagggagcagc

SEQ ID NO: 404553 - RNA, 24 nt, Human
cgagggagcagcugcgugacuuuu

SEQ ID NO: 404554 - RNA, 24 nt, Human
cgcccggagccgcuccccggcugc

SEQ ID NO: 404555 - RNA, 23 nt, Human
cgccucagcaccgaauccaguau

SEQ ID NO: 404556 - RNA, 21 nt, Human
cggcugccggcgcauccuggg

SEQ ID NO: 404557 - RNA, 24 nt, Human
cgucuaugagaagcccugggcagc

SEQ ID NO: 404558 - RNA, 18 nt, Human
cuauggucacuccugagg

SEQ ID NO: 404559 - RNA, 24 nt, Human
cuccaaaggccaacacuguccucu

SEQ ID NO: 404560 - RNA, 21 nt, Human
cugggcagccuggacagggac

SEQ ID NO: 404561 - RNA, 20 nt, Human
gaccuugugccccuuaacac

SEQ ID NO: 404562 - RNA, 18 nt, Human
gacuccaaaggccaacag

SEQ ID NO: 404563 - RNA, 23 nt, Human
gccaacacuguccucuaacaggg

SEQ ID NO: 404564 - RNA, 20 nt, Human
gcccaccgaaagggaaccag

SEQ ID NO: 404565 - RNA, 20 nt, Human
gcugcgugacuuuucagcag

SEQ ID NO: 404566 - RNA, 21 nt, Human
ggaaugaagcuucuucugaag

SEQ ID NO: 404567 - RNA, 18 nt, Human
ggacugccccaugagugc

SEQ ID NO: 404568 - RNA, 18 nt, Human
ggcguucucuacccuacc

SEQ ID NO: 404569 - RNA, 24 nt, Human
gggaagccagagaugaggcucaaa

SEQ ID NO: 404570 - RNA, 22 nt, Human
ggugaaggaagcagcccuggga

SEQ ID NO: 404571 - RNA, 19 nt, Human
uaagagggaaugaagcuuc

SEQ ID NO: 404572 - RNA, 19 nt, Human
uaccacagccauuuccuug

SEQ ID NO: 404573 - RNA, 21 nt, Human
uauuaaagcaaugaauucugg

SEQ ID NO: 404574 - RNA, 20 nt, Human
ucacugagccuuucccgugc

SEQ ID NO: 404575 - RNA, 21 nt, Human
uccagcagagcuggccugcuc

SEQ ID NO: 404576 - RNA, 23 nt, Human
ucuggaccuugugccccuuaaca

SEQ ID NO: 404577 - RNA, 18 nt, Human
ugaaggaagcagcccugg

SEQ ID NO: 404578 - RNA, 22 nt, Human
ugagaaaguggcguucucuacc

SEQ ID NO: 404579 - RNA, 20 nt, Human
ugcgugacuuuucagcagug

SEQ ID NO: 404580 - RNA, 20 nt, Human
ugggcagccuggacagggac

SEQ ID NO: 404581 - RNA, 23 nt, Human
uucccgugccgcagccgccgccu

SEQ ID NO: 404582 - RNA, 24 nt, Human
uuccuugcauuacaccguccuucu

SEQ ID NO: 404583 - RNA, 18 nt, Human
aacaagaaugcagagccc

SEQ ID NO: 404584 - RNA, 22 nt, Human
aagaggcaacaagaaugcagag

SEQ ID NO: 404585 - RNA, 18 nt, Human
acaagaaugcagagcccg

SEQ ID NO: 404586 - RNA, 19 nt, Human
acccuaaagagcuguggga

SEQ ID NO: 404587 - RNA, 22 nt, Human
acccuaaagagcugugggaggg

SEQ ID NO: 404588 - RNA, 22 nt, Human
aggaaacaagccagaaaaaugc

SEQ ID NO: 404589 - RNA, 21 nt, Human
aggcaacaagaaugcagagcc

SEQ ID NO: 404590 - RNA, 24 nt, Human
aucuccaccucccugaacccccac

SEQ ID NO: 404591 - RNA, 21 nt, Human
auggcacugcagccuggguga

SEQ ID NO: 404592 - RNA, 19 nt, Human
cacauggcgggcccaucuc

SEQ ID NO: 404593 - RNA, 26 nt, Human
cacccacagccgcaccgcggaucccc

SEQ ID NO: 404594 - RNA, 24 nt, Human
cacccccgccagggaagaggcaac

SEQ ID NO: 404595 - RNA, 19 nt, Human
cagagcccggcccgggcgc

SEQ ID NO: 404596 - RNA, 24 nt, Human
cagcacagcacuauuaccaaugcu

SEQ ID NO: 404597 - RNA, 19 nt, Human
cauggcacugcagccuggg

SEQ ID NO: 404598 - RNA, 19 nt, Human
cauggcacugcagccuggg

SEQ ID NO: 404599 - RNA, 24 nt, Human
cauggcacugcagccugggugagg

SEQ ID NO: 404600 - RNA, 19 nt, Human
cccacagcaagccccgcgg

SEQ ID NO: 404601 - RNA, 23 nt, Human
cccacagcaagccccgcgggaga

SEQ ID NO: 404602 - RNA, 23 nt, Human
cccccacagcaagccccgcggga

SEQ ID NO: 404603 - RNA, 21 nt, Human
cccgccgcucacccacagccg

SEQ ID NO: 404604 - RNA, 23 nt, Human
cccgccgcucacccacagccgca

SEQ ID NO: 404605 - RNA, 23 nt, Human
cccugaacccccacagcaagccc

SEQ ID NO: 404606 - RNA, 24 nt, Human
cccugaacccccacagcaagcccc

SEQ ID NO: 404607 - RNA, 23 nt, Human
ccgcaccgcggauccccucgugc

SEQ ID NO: 404608 - RNA, 23 nt, Human
ccgggcgcucucccgagcucgcg

SEQ ID NO: 404609 - RNA, 21 nt, Human
ccugcaggcacauggcgggcc

SEQ ID NO: 404610 - RNA, 18 nt, Human
ccugcucccugcaggcac

SEQ ID NO: 404611 - RNA, 23 nt, Human
cgagcucgcggguccuccgccgg

SEQ ID NO: 404612 - RNA, 23 nt, Human
cgcucacccacagccgcaccgcg

SEQ ID NO: 404613 - RNA, 21 nt, Human
cuccaccucccugaaccccca

SEQ ID NO: 404614 - RNA, 19 nt, Human
gcacugcagccugggugag

SEQ ID NO: 404615 - RNA, 19 nt, Human
gcgccugcucccugcaggc

SEQ ID NO: 404616 - RNA, 19 nt, Human
ggcgcucucccgagcucgc

SEQ ID NO: 404617 - RNA, 24 nt, Human
gggaagaggcaacaagaaugcaga

SEQ ID NO: 404618 - RNA, 20 nt, Human
ggggcacuggcaaugaaaaa

SEQ ID NO: 404619 - RNA, 20 nt, Human
uccaguuucggggcacuggc

SEQ ID NO: 404620 - RNA, 20 nt, Human
ucccugaacccccacagcaa

SEQ ID NO: 404621 - RNA, 19 nt, Human
ucccugcaggcacauggcg

SEQ ID NO: 404622 - RNA, 21 nt, Human
ugaacccccacagcaagcccc

SEQ ID NO: 404623 - RNA, 19 nt, Human
ugaggugucugcauggcac

SEQ ID NO: 404624 - RNA, 21 nt, Human
ugcucccugcaggcacauggc

SEQ ID NO: 404625 - RNA, 22 nt, Human
ugggaggguucgaagaagaaaa

SEQ ID NO: 404626 - RNA, 21 nt, Human
ugguacagcagaucucacccu

SEQ ID NO: 404627 - RNA, 21 nt, Human
ugucucgguccuucacacucc

SEQ ID NO: 404628 - RNA, 23 nt, Human
uugaagugccaugaggugucugc

SEQ ID NO: 404629 - RNA, 21 nt, Human
uuuuuuuuuuuuuuuuuuaag

SEQ ID NO: 404630 - RNA, 19 nt, Human
aaaaaaaaaaaaaaagagg

SEQ ID NO: 404631 - RNA, 19 nt, Human
aaaaaaaaaaaaagagggg

SEQ ID NO: 404632 - RNA, 25 nt, Human
aaaaaaccaacauaaaaucugaaug

SEQ ID NO: 404633 - RNA, 27 nt, Human
aaaaaccaacauaaaaucugaaugguc

SEQ ID NO: 404634 - RNA, 18 nt, Human
aaaaccaauggaaaaucc

SEQ ID NO: 404635 - RNA, 19 nt, Human
aaacaacacggcacugugc

SEQ ID NO: 404636 - RNA, 22 nt, Human
aaacacccauuaugaaaaccaa

SEQ ID NO: 404637 - RNA, 24 nt, Human
aaacaccuuccuucccucacaucc

SEQ ID NO: 404638 - RNA, 20 nt, Human
aaagacagcaagaaucucaa

SEQ ID NO: 404639 - RNA, 20 nt, Human
aaagcaauccauggugaaaa

SEQ ID NO: 404640 - RNA, 24 nt, Human
aaagcgcucaacucucccccaagc

SEQ ID NO: 404641 - RNA, 22 nt, Human
aagaaacaauaagacagagcca

SEQ ID NO: 404642 - RNA, 21 nt, Human
aagaagaaaaacaauguccau

SEQ ID NO: 404643 - RNA, 27 nt, Human
aagaagaaaaacaauguccauaaagga

SEQ ID NO: 404644 - RNA, 21 nt, Human
aagaauccucuuggaagaccc

SEQ ID NO: 404645 - RNA, 26 nt, Human
aagaggaaaaaaaaaaaaaaaagagg

SEQ ID NO: 404646 - RNA, 21 nt, Human
aagcugcucauucuccuccca

SEQ ID NO: 404647 - RNA, 22 nt, Human
aagcuguaaacaacacggcacu

SEQ ID NO: 404648 - RNA, 18 nt, Human
aaguaaccuuuuuaagac

SEQ ID NO: 404649 - RNA, 19 nt, Human
aaguguucagcaaaacaag

SEQ ID NO: 404650 - RNA, 24 nt, Human
aauacagacacaguaugaagaaac

SEQ ID NO: 404651 - RNA, 22 nt, Human
acacucucuacccuggucgcac

SEQ ID NO: 404652 - RNA, 21 nt, Human
acagcaaaaaaccaacauaaa

SEQ ID NO: 404653 - RNA, 20 nt, Human
acuguauuugguauugaauu

SEQ ID NO: 404654 - RNA, 20 nt, Human
acuucacagcaaaaaaccaa

SEQ ID NO: 404655 - RNA, 23 nt, Human
acuuguauuuucuaauaaaaugg

SEQ ID NO: 404656 - RNA, 22 nt, Human
agaaaaacaauguccauaaagg

SEQ ID NO: 404657 - RNA, 22 nt, Human
agaaccagcugagaaccaagaa

SEQ ID NO: 404658 - RNA, 20 nt, Human
agacaaacaauaaacuguga

SEQ ID NO: 404659 - RNA, 23 nt, Human
agacagcaagaaucucaauuucu

SEQ ID NO: 404660 - RNA, 24 nt, Human
agaggaaaaaaaaaaaaaaaagag

SEQ ID NO: 404661 - RNA, 22 nt, Human
agcaaaacaagcuuagacggaa

SEQ ID NO: 404662 - RNA, 21 nt, Human
agcaaaaguuaaaacaucaaa

SEQ ID NO: 404663 - RNA, 18 nt, Human
agcaauuuuucugcagua

SEQ ID NO: 404664 - RNA, 23 nt, Human
agcugcucuagaaaagcuguaaa

SEQ ID NO: 404665 - RNA, 21 nt, Human
aggaauucuggaaugaguagu

SEQ ID NO: 404666 - RNA, 22 nt, Human
aguaaaagaaacaccuuccuuc

SEQ ID NO: 404667 - RNA, 23 nt, Human
aguaauuaccuucucaguuuaga

SEQ ID NO: 404668 - RNA, 22 nt, Human
auaaaauggagaacugccuuga

SEQ ID NO: 404669 - RNA, 21 nt, Human
augaaaagcagguuuggcuuu

SEQ ID NO: 404670 - RNA, 22 nt, Human
auggagaacugccuugacugua

SEQ ID NO: 404671 - RNA, 22 nt, Human
caagaaguaaccuuuuuaagac

SEQ ID NO: 404672 - RNA, 20 nt, Human
caagacaggaaaauuagagc

SEQ ID NO: 404673 - RNA, 24 nt, Human
cacaaaaagugauacaaaaaagca

SEQ ID NO: 404674 - RNA, 21 nt, Human
cacaaaagacagcaagaaucu

SEQ ID NO: 404675 - RNA, 23 nt, Human
cacagcaaaaaaccaacauaaaa

SEQ ID NO: 404676 - RNA, 22 nt, Human
cacuucacagcaaaaaaccaac

SEQ ID NO: 404677 - RNA, 23 nt, Human
cacuucacagcaaaaaaccaaca

SEQ ID NO: 404678 - RNA, 22 nt, Human
cagagccauauguaaaaguugu

SEQ ID NO: 404679 - RNA, 24 nt, Human
cagcaaaaaaccaacauaaaaucu

SEQ ID NO: 404680 - RNA, 23 nt, Human
cagcaaaacaagcuuagacggaa

SEQ ID NO: 404681 - RNA, 20 nt, Human
cauaaaaggacuuaaaugac

SEQ ID NO: 404682 - RNA, 22 nt, Human
cauaaauaggcgcaacagguuc

SEQ ID NO: 404683 - RNA, 19 nt, Human
cauauaaacacccauuaug

SEQ ID NO: 404684 - RNA, 21 nt, Human
cauauaaacacccauuaugaa

SEQ ID NO: 404685 - RNA, 19 nt, Human
caucaagccauuuaaaaag

SEQ ID NO: 404686 - RNA, 20 nt, Human
ccaaagaaaugcagaaauaa

SEQ ID NO: 404687 - RNA, 21 nt, Human
ccaagaaagagacaucagcca

SEQ ID NO: 404688 - RNA, 18 nt, Human
cccaagccgcggcgcgca

SEQ ID NO: 404689 - RNA, 21 nt, Human
cccuuucacuucuuccagccc

SEQ ID NO: 404690 - RNA, 20 nt, Human
gaaaaaaaaaaaaaaaagag

SEQ ID NO: 404691 - RNA, 21 nt, Human
gaaaugcagaaauaaggacug

SEQ ID NO: 404692 - RNA, 19 nt, Human
gagccaguuucaauuacaa

SEQ ID NO: 404693 - RNA, 21 nt, Human
gcaaaaguuaaaacaucaaag

SEQ ID NO: 404694 - RNA, 25 nt, Human
guucccuagcaaaucucugguaccu

SEQ ID NO: 404695 - RNA, 24 nt, Human
guuguaauuuagcuguuuccaauc

SEQ ID NO: 404696 - RNA, 24 nt, Human
uaaaaaaauaauaaagaagcauga

SEQ ID NO: 404697 - RNA, 24 nt, Human
uaaaagaaacaccuuccuucccuc

SEQ ID NO: 404698 - RNA, 25 nt, Human
uaaccauuacacaaaaagugauaca

SEQ ID NO: 404699 - RNA, 19 nt, Human
uacaaagcaauccauggug

SEQ ID NO: 404700 - RNA, 25 nt, Human
uacaaagcaauccauggugaaaaca

SEQ ID NO: 404701 - RNA, 18 nt, Human
uacacaaugcauauauuu

SEQ ID NO: 404702 - RNA, 24 nt, Human
uacuuuuuugcggggggcgggggg

SEQ ID NO: 404703 - RNA, 22 nt, Human
uaggcgcaacagguuccauaaa

SEQ ID NO: 404704 - RNA, 23 nt, Human
uauaaacacccauuaugaaaacc

SEQ ID NO: 404705 - RNA, 24 nt, Human
uauaaacacccauuaugaaaacca

SEQ ID NO: 404706 - RNA, 21 nt, Human
ucaaauacuaacaaauuuacu

SEQ ID NO: 404707 - RNA, 21 nt, Human
ucaauaaacuggaaugagcca

SEQ ID NO: 404708 - RNA, 22 nt, Human
ucaguggaaagaagagguguuc

SEQ ID NO: 404709 - RNA, 23 nt, Human
ucauauaaacacccauuaugaaa

SEQ ID NO: 404710 - RNA, 18 nt, Human
ucccaguaauuaccuucu

SEQ ID NO: 404711 - RNA, 23 nt, Human
ucccuuucacuucuuccagcccc

SEQ ID NO: 404712 - RNA, 18 nt, Human
ucccuuuucuuuugcuau

SEQ ID NO: 404713 - RNA, 19 nt, Human
uccuuuucuuuuuccuuuu

SEQ ID NO: 404714 - RNA, 23 nt, Human
ucuaaaauacuaaacagacaaac

SEQ ID NO: 404715 - RNA, 22 nt, Human
ugaaaacacuucccugaauucc

SEQ ID NO: 404716 - RNA, 18 nt, Human
ugaaaagcaugcagcuug

SEQ ID NO: 404717 - RNA, 21 nt, Human
ugaaguaaaaauaugaauguu

SEQ ID NO: 404718 - RNA, 26 nt, Human
ugcaucaaccaaagaaaugcagaaau

SEQ ID NO: 404719 - RNA, 18 nt, Human
ugcggggggcggggggug

SEQ ID NO: 404720 - RNA, 22 nt, Human
uggaagacccaggaauucugga

SEQ ID NO: 404721 - RNA, 23 nt, Human
uggaagacccaggaauucuggaa

SEQ ID NO: 404722 - RNA, 22 nt, Human
ugggaauacuuuuuauuuucaa

SEQ ID NO: 404723 - RNA, 24 nt, Human
ugugaaaucaauaaacuggaauga

SEQ ID NO: 404724 - RNA, 22 nt, Human
uguuuucuuuuauuuacauuug

SEQ ID NO: 404725 - RNA, 18 nt, Human
uuacaauuuagcuacaaa

SEQ ID NO: 404726 - RNA, 21 nt, Human
uuagagcucucagcuacaguc

SEQ ID NO: 404727 - RNA, 20 nt, Human
uuauccgagacaucuacagu

SEQ ID NO: 404728 - RNA, 21 nt, Human
uucaagguuguacaaugccua

SEQ ID NO: 404729 - RNA, 18 nt, Human
uucacagcaaaaaaccaa

SEQ ID NO: 404730 - RNA, 19 nt, Human
uucccuagcaaaucucugg

SEQ ID NO: 404731 - RNA, 23 nt, Human
uucccuuucacuucuuccagccc

SEQ ID NO: 404732 - RNA, 20 nt, Human
uuccugcacaaaccgccugu

SEQ ID NO: 404733 - RNA, 20 nt, Human
uucuuuuuuuaaugugaaag

SEQ ID NO: 404734 - RNA, 24 nt, Human
uugacuguacaaagcaauccaugg

SEQ ID NO: 404735 - RNA, 18 nt, Human
uugcggggggcggggggu

SEQ ID NO: 404736 - RNA, 22 nt, Human
uugugguuuguuuaagaagaag

SEQ ID NO: 404737 - RNA, 18 nt, Human
uuuaaugugaaagcuaug

SEQ ID NO: 404738 - RNA, 22 nt, Human
uuuacaaacuugcuaugacugc

SEQ ID NO: 404739 - RNA, 22 nt, Human
uuuacuuuuuugcggggggcgg

SEQ ID NO: 404740 - RNA, 18 nt, Human
uuuagacuuaaugcaagu

SEQ ID NO: 404741 - RNA, 23 nt, Human
uuuagacuuaaugcaagugaaau

SEQ ID NO: 404742 - RNA, 24 nt, Human
uuugccaauuuaaccccuauugug

SEQ ID NO: 404743 - RNA, 24 nt, Human
uuuucuuuuuuuaaugugaaagcu

SEQ ID NO: 404744 - RNA, 24 nt, Human
uuuugugaaaagcaugcagcuuga

SEQ ID NO: 404745 - RNA, 19 nt, Human
aaaaaaaaaaaaaaaaaga

SEQ ID NO: 404746 - RNA, 19 nt, Human
aaaaaaaaaaaaaagaaaa

SEQ ID NO: 404747 - RNA, 20 nt, Human
aaaaagaaaaaagaaauuga

SEQ ID NO: 404748 - RNA, 26 nt, Human
aaaaccccaaucccaucaaccccugc

SEQ ID NO: 404749 - RNA, 22 nt, Human
aaaaggugguuucaaggccaga

SEQ ID NO: 404750 - RNA, 24 nt, Human
aaacccaaaauggcaggggaggga

SEQ ID NO: 404751 - RNA, 21 nt, Human
aaacuaccaacccaccagcca

SEQ ID NO: 404752 - RNA, 19 nt, Human
aacacugugagaccccauc

SEQ ID NO: 404753 - RNA, 20 nt, Human
aacacugugagaccccaucu

SEQ ID NO: 404754 - RNA, 21 nt, Human
aacacugugagaccccaucuc

SEQ ID NO: 404755 - RNA, 23 nt, Human
aaccccugcgaggcuccuggcac

SEQ ID NO: 404756 - RNA, 24 nt, Human
aaccuguggucccagcuacuccgg

SEQ ID NO: 404757 - RNA, 21 nt, Human
aagaaaaaagaaauugacccu

SEQ ID NO: 404758 - RNA, 25 nt, Human
aagcaaggguucaaagacccaaaac

SEQ ID NO: 404759 - RNA, 18 nt, Human
aaggcugcaguaagccaa

SEQ ID NO: 404760 - RNA, 21 nt, Human
aaggguucaaagacccaaaac

SEQ ID NO: 404761 - RNA, 19 nt, Human
aaugggauauaaaaaggga

SEQ ID NO: 404762 - RNA, 24 nt, Human
acaaagcgagacccagucucaaag

SEQ ID NO: 404763 - RNA, 20 nt, Human
accaacccaccagccaacag

SEQ ID NO: 404764 - RNA, 23 nt, Human
accccauguaauaaaaggugguu

SEQ ID NO: 404765 - RNA, 22 nt, Human
accuguggucccagcuacuccg

SEQ ID NO: 404766 - RNA, 18 nt, Human
acuccacuccagccuggg

SEQ ID NO: 404767 - RNA, 23 nt, Human
acuccacuccagccugggcaaca

SEQ ID NO: 404768 - RNA, 18 nt, Human
acuccggaggcugaggca

SEQ ID NO: 404769 - RNA, 23 nt, Human
agaaaaaaaaaaaaaaaaaagaa

SEQ ID NO: 404770 - RNA, 22 nt, Human
agaaacuaccaacccaccagcc

SEQ ID NO: 404771 - RNA, 19 nt, Human
agcacucugggaggcugag

SEQ ID NO: 404772 - RNA, 22 nt, Human
agccggggaggcaaaggcugca

SEQ ID NO: 404773 - RNA, 19 nt, Human
agcgccagucuugagcaca

SEQ ID NO: 404774 - RNA, 23 nt, Human
agcugguauguccuacuccccau

SEQ ID NO: 404775 - RNA, 20 nt, Human
aggaguuugagaccagccug

SEQ ID NO: 404776 - RNA, 18 nt, Human
agggaagcgugucaccgu

SEQ ID NO: 404777 - RNA, 18 nt, Human
agggagagaugggggugg

SEQ ID NO: 404778 - RNA, 22 nt, Human
agggagagggagagggaacagg

SEQ ID NO: 404779 - RNA, 19 nt, Human
aggguucaaagacccaaaa

SEQ ID NO: 404780 - RNA, 25 nt, Human
auacaagagaugaaauccuccaggg

SEQ ID NO: 404781 - RNA, 24 nt, Human
aucacgccacuccacuccagccug

SEQ ID NO: 404782 - RNA, 26 nt, Human
auggcaggggagggagagaugggggu

SEQ ID NO: 404783 - RNA, 24 nt, Human
augggggugggaggcugucagugg

SEQ ID NO: 404784 - RNA, 25 nt, Human
auuucauuaacccucacaaugcacu

SEQ ID NO: 404785 - RNA, 20 nt, Human
caaagacccaaaacccaaaa

SEQ ID NO: 404786 - RNA, 24 nt, Human
caaaggcugcaguaagccaagauc

SEQ ID NO: 404787 - RNA, 25 nt, Human
caacaaagcgagacccagucucagu

SEQ ID NO: 404788 - RNA, 22 nt, Human
caagaacauuucuuacaucucc

SEQ ID NO: 404789 - RNA, 23 nt, Human
caauuguaaucccagcacucugg

SEQ ID NO: 404790 - RNA, 24 nt, Human
caauuguaaucccagcacucuggg

SEQ ID NO: 404791 - RNA, 21 nt, Human
cacaacaaaacaccagugcag

SEQ ID NO: 404792 - RNA, 24 nt, Human
cacaauuguaaucccagcacucug

SEQ ID NO: 404793 - RNA, 24 nt, Human
cacuccacuccagccugggcaaca

SEQ ID NO: 404794 - RNA, 21 nt, Human
cagaugugcuugcagaaugua

SEQ ID NO: 404795 - RNA, 24 nt, Human
cagcacucugggaggcugagacag

SEQ ID NO: 404796 - RNA, 26 nt, Human
cagcacucugggaggcugagacaggu

SEQ ID NO: 404797 - RNA, 20 nt, Human
caggcacccucaaggggguc

SEQ ID NO: 404798 - RNA, 21 nt, Human
caucauauacaagagaugaaa

SEQ ID NO: 404799 - RNA, 21 nt, Human
cauccuccuccccacaacaaa

SEQ ID NO: 404800 - RNA, 21 nt, Human
cauuucacagauaugggccuu

SEQ ID NO: 404801 - RNA, 27 nt, Human
ccaaacaucccucacaguaaaaaccuu

SEQ ID NO: 404802 - RNA, 18 nt, Human
ccaccagccaacagggag

SEQ ID NO: 404803 - RNA, 21 nt, Human
ccacuccacuccagccugggc

SEQ ID NO: 404804 - RNA, 23 nt, Human
ccacuccacuccagccugggcaa

SEQ ID NO: 404805 - RNA, 24 nt, Human
ccacuccacuccagccugggcaac

SEQ ID NO: 404806 - RNA, 23 nt, Human
ccagcuccacgugguggcucaca

SEQ ID NO: 404807 - RNA, 21 nt, Human
ccagucuugagcacaugggag

SEQ ID NO: 404808 - RNA, 21 nt, Human
ccauccuccuccccacaacaa

SEQ ID NO: 404809 - RNA, 18 nt, Human
cccacaacaaaacaccag

SEQ ID NO: 404810 - RNA, 23 nt, Human
cccaccagccaacagggagaggg

SEQ ID NO: 404811 - RNA, 27 nt, Human
cccagucucaaagaaaaagaaaaaaaa

SEQ ID NO: 404812 - RNA, 18 nt, Human
ccccaaucccaucaaccc

SEQ ID NO: 404813 - RNA, 19 nt, Human
ccccacaacaaaacaccag

SEQ ID NO: 404814 - RNA, 24 nt, Human
ccccggagcccagcagcuaccugc

SEQ ID NO: 404815 - RNA, 21 nt, Human
cccggaaggcagucuggcugc

SEQ ID NO: 404816 - RNA, 19 nt, Human
ccgaacgcaaagugucccc

SEQ ID NO: 404817 - RNA, 26 nt, Human
ccuauugcaagcaaggguucaaagac

SEQ ID NO: 404818 - RNA, 18 nt, Human
ccucaagggggucaaguu

SEQ ID NO: 404819 - RNA, 19 nt, Human
ccuccagggugugggaugg

SEQ ID NO: 404820 - RNA, 20 nt, Human
ccuccagggugugggauggg

SEQ ID NO: 404821 - RNA, 19 nt, Human
ccuccccacaacaaaacac

SEQ ID NO: 404822 - RNA, 22 nt, Human
ccuguggucccagcuacuccgg

SEQ ID NO: 404823 - RNA, 23 nt, Human
ccuguggucccagcuacuccgga

SEQ ID NO: 404824 - RNA, 23 nt, Human
cgagacccagucucaaagaaaaa

SEQ ID NO: 404825 - RNA, 20 nt, Human
cgccacuccacuccagccug

SEQ ID NO: 404826 - RNA, 24 nt, Human
cgccacuccacuccagccugggca

SEQ ID NO: 404827 - RNA, 19 nt, Human
cugguuaguacggugaagu

SEQ ID NO: 404828 - RNA, 20 nt, Human
cuugacaacucccucuaccu

SEQ ID NO: 404829 - RNA, 21 nt, Human
gaaggaggggaaggguggggu

SEQ ID NO: 404830 - RNA, 24 nt, Human
gacuuuugagaagcucaaaacuuu

SEQ ID NO: 404831 - RNA, 20 nt, Human
gaucgauauaaaaaugggau

SEQ ID NO: 404832 - RNA, 24 nt, Human
gaucgccugagcccaggaguuuga

SEQ ID NO: 404833 - RNA, 19 nt, Human
gcaaggguucaaagaccca

SEQ ID NO: 404834 - RNA, 23 nt, Human
gccaacagggagagggagaggga

SEQ ID NO: 404835 - RNA, 22 nt, Human
gccacuccacuccagccugggc

SEQ ID NO: 404836 - RNA, 21 nt, Human
gccagcaagacuugacaacuc

SEQ ID NO: 404837 - RNA, 19 nt, Human
gcccaacuguagaaacuac

SEQ ID NO: 404838 - RNA, 22 nt, Human
gcccaggaguuugagaccagcc

SEQ ID NO: 404839 - RNA, 22 nt, Human
gcccgaacgcaaaguguccccg

SEQ ID NO: 404840 - RNA, 21 nt, Human
ggaaaaccccaaucccaucaa

SEQ ID NO: 404841 - RNA, 24 nt, Human
ggaaaaccccaaucccaucaaccc

SEQ ID NO: 404842 - RNA, 21 nt, Human
ggagaaggaggggaagggugg

SEQ ID NO: 404843 - RNA, 18 nt, Human
ggagccccgggacaaagc

SEQ ID NO: 404844 - RNA, 19 nt, Human
ggagggagagaugggggug

SEQ ID NO: 404845 - RNA, 19 nt, Human
gggaaaaccccaaucccau

SEQ ID NO: 404846 - RNA, 25 nt, Human
gggagagaugggggugggaggcugu

SEQ ID NO: 404847 - RNA, 22 nt, Human
gggagggagagauggggguggg

SEQ ID NO: 404848 - RNA, 19 nt, Human
ggggaaggguggggugaaa

SEQ ID NO: 404849 - RNA, 19 nt, Human
ggggagggagagauggggg

SEQ ID NO: 404850 - RNA, 18 nt, Human
gggggugggaggcuguca

SEQ ID NO: 404851 - RNA, 24 nt, Human
gguggcucacaauuguaaucccag

SEQ ID NO: 404852 - RNA, 19 nt, Human
guggggaacaagaagugga

SEQ ID NO: 404853 - RNA, 19 nt, Human
uaaaaaccuuaaaaucuaa

SEQ ID NO: 404854 - RNA, 18 nt, Human
uacauuauuucauuaacc

SEQ ID NO: 404855 - RNA, 20 nt, Human
uacauuauuucauuaacccu

SEQ ID NO: 404856 - RNA, 20 nt, Human
uaccaacccaccagccaaca

SEQ ID NO: 404857 - RNA, 22 nt, Human
uaccuaccuagaauguggcuga

SEQ ID NO: 404858 - RNA, 20 nt, Human
uaccuagaauguggcugauu

SEQ ID NO: 404859 - RNA, 19 nt, Human
uagaaacuaccaacccacc

SEQ ID NO: 404860 - RNA, 24 nt, Human
uccagccugggcaacaaagcgaga

SEQ ID NO: 404861 - RNA, 21 nt, Human
uccccauccuccuccccacaa

SEQ ID NO: 404862 - RNA, 22 nt, Human
uccccauccuccuccccacaac

SEQ ID NO: 404863 - RNA, 23 nt, Human
ucgccugagcccaggaguuugag

SEQ ID NO: 404864 - RNA, 22 nt, Human
ucucuacaaaacaugcaaaagu

SEQ ID NO: 404865 - RNA, 19 nt, Human
ucuggcugccaauccaggg

SEQ ID NO: 404866 - RNA, 22 nt, Human
ucuuacaucucccaaacauccc

SEQ ID NO: 404867 - RNA, 20 nt, Human
ugagacagguggaucgccug

SEQ ID NO: 404868 - RNA, 21 nt, Human
ugagcccaggaguuugagacc

SEQ ID NO: 404869 - RNA, 23 nt, Human
ugagcccaggaguuugagaccag

SEQ ID NO: 404870 - RNA, 19 nt, Human
ugauuguaaacuaacccuu

SEQ ID NO: 404871 - RNA, 26 nt, Human
ugcaagcaaggguucaaagacccaaa

SEQ ID NO: 404872 - RNA, 22 nt, Human
uggaaagcacgcucccagcccg

SEQ ID NO: 404873 - RNA, 23 nt, Human
uggaucgccugagcccaggaguu

SEQ ID NO: 404874 - RNA, 24 nt, Human
uggaucgccugagcccaggaguuu

SEQ ID NO: 404875 - RNA, 18 nt, Human
uggcacaaagcuggacag

SEQ ID NO: 404876 - RNA, 24 nt, Human
uggcaugaaccuguggucccagcu

SEQ ID NO: 404877 - RNA, 22 nt, Human
uggcucacaauuguaaucccag

SEQ ID NO: 404878 - RNA, 24 nt, Human
uggcucacaauuguaaucccagca

SEQ ID NO: 404879 - RNA, 23 nt, Human
ugggaggcugagacagguggauc

SEQ ID NO: 404880 - RNA, 20 nt, Human
ugggauggggugagauuucc

SEQ ID NO: 404881 - RNA, 22 nt, Human
ugggcaacacugugagacccca

SEQ ID NO: 404882 - RNA, 25 nt, Human
ugggccagcaagacuugacaacucc

SEQ ID NO: 404883 - RNA, 24 nt, Human
ugguggcucacaauuguaauccca

SEQ ID NO: 404884 - RNA, 21 nt, Human
ugguuucaaggccagauguac

SEQ ID NO: 404885 - RNA, 20 nt, Human
uguccccggagcccagcagc

SEQ ID NO: 404886 - RNA, 22 nt, Human
uugacccugagcauaaaacaag

SEQ ID NO: 404887 - RNA, 23 nt, Human
uugcaagcaaggguucaaagacc

SEQ ID NO: 404888 - RNA, 19 nt, Human
aaaaaaaaaaacacgccaa

SEQ ID NO: 404889 - RNA, 20 nt, Human
aaaaaaaaaaacacgccaaa

SEQ ID NO: 404890 - RNA, 24 nt, Human
aaaaaacaaaaaaaaaaacacgcc

SEQ ID NO: 404891 - RNA, 23 nt, Human
aaaacaaaaaaaaaaacacgcca

SEQ ID NO: 404892 - RNA, 23 nt, Human
acaaaaaaaaaaacacgccaaac

SEQ ID NO: 404893 - RNA, 21 nt, Human
agagcacucccagggcccggg

SEQ ID NO: 404894 - RNA, 22 nt, Human
caauacugcgcagccuuccaga

SEQ ID NO: 404895 - RNA, 18 nt, Human
caggacccaggcaggcag

SEQ ID NO: 404896 - RNA, 19 nt, Human
caggcagugacaaaaaaca

SEQ ID NO: 404897 - RNA, 27 nt, Human
caggcagugacaaaaaacaaaaaaaaa

SEQ ID NO: 404898 - RNA, 26 nt, Human
cauucuguccccuccaauacugcgca

SEQ ID NO: 404899 - RNA, 23 nt, Human
cuacaaccaaagagauucaacca

SEQ ID NO: 404900 - RNA, 19 nt, Human
cugguuaaaacacaaucuc

SEQ ID NO: 404901 - RNA, 19 nt, Human
gauagcagggaauaaaacc

SEQ ID NO: 404902 - RNA, 23 nt, Human
gauagcagggaauaaaaccagua

SEQ ID NO: 404903 - RNA, 23 nt, Human
gcaaggaauccaguuacacacaa

SEQ ID NO: 404904 - RNA, 23 nt, Human
ggaauccaguuacacacaagaca

SEQ ID NO: 404905 - RNA, 22 nt, Human
uaaaacacaaucuccacgauag

SEQ ID NO: 404906 - RNA, 20 nt, Human
uacaaccaaagagauucaac

SEQ ID NO: 404907 - RNA, 18 nt, Human
uacaagauccaugcaagg

SEQ ID NO: 404908 - RNA, 21 nt, Human
uacugcgcagccuuccagagc

SEQ ID NO: 404909 - RNA, 24 nt, Human
uagcagggaauaaaaccaguaaga

SEQ ID NO: 404910 - RNA, 21 nt, Human
uccagagcacucccagggccc

SEQ ID NO: 404911 - RNA, 22 nt, Human
ugacaaaaaacaaaaaaaaaaa

SEQ ID NO: 404912 - RNA, 25 nt, Human
ugacaaaaaacaaaaaaaaaaacac

SEQ ID NO: 404913 - RNA, 19 nt, Human
ugcgcagccuuccagagca

SEQ ID NO: 404914 - RNA, 22 nt, Human
aaaagacaauaaauacagauua

SEQ ID NO: 404915 - RNA, 22 nt, Human
aacuucguuccucugacuucca

SEQ ID NO: 404916 - RNA, 19 nt, Human
aagaagcgaacuucguucc

SEQ ID NO: 404917 - RNA, 23 nt, Human
acaagccccgggcucccccgccc

SEQ ID NO: 404918 - RNA, 19 nt, Human
acaugaugaaacucuaucu

SEQ ID NO: 404919 - RNA, 22 nt, Human
accacacuucagccaaauggga

SEQ ID NO: 404920 - RNA, 24 nt, Human
acuguuuuuaaagucagcuaugau

SEQ ID NO: 404921 - RNA, 24 nt, Human
agcacuuugggaggccgaggcagg

SEQ ID NO: 404922 - RNA, 21 nt, Human
agccccgggcucccccgcccc

SEQ ID NO: 404923 - RNA, 20 nt, Human
aggcaggcggaucacaaggu

SEQ ID NO: 404924 - RNA, 24 nt, Human
aggcaggcggaucacaaggucagg

SEQ ID NO: 404925 - RNA, 25 nt, Human
aggcaggcggaucacaaggucagga

SEQ ID NO: 404926 - RNA, 21 nt, Human
aggccgaggcaggcggaucac

SEQ ID NO: 404927 - RNA, 23 nt, Human
aggccgaggcaggcggaucacaa

SEQ ID NO: 404928 - RNA, 24 nt, Human
aggcggaucacaaggucaggagau

SEQ ID NO: 404929 - RNA, 24 nt, Human
aggcggcggcggcggcagcggcgg

SEQ ID NO: 404930 - RNA, 21 nt, Human
auccuggccaacaugaugaaa

SEQ ID NO: 404931 - RNA, 21 nt, Human
augacgaaggaagaagcgaac

SEQ ID NO: 404932 - RNA, 19 nt, Human
auggccugcugacguagau

SEQ ID NO: 404933 - RNA, 21 nt, Human
caaaagacaauaaauacagau

SEQ ID NO: 404934 - RNA, 19 nt, Human
caaccaacuaacguucuuc

SEQ ID NO: 404935 - RNA, 26 nt, Human
caacuaacguucuucacugacaauau

SEQ ID NO: 404936 - RNA, 21 nt, Human
caccaacaagccccgggcucc

SEQ ID NO: 404937 - RNA, 19 nt, Human
caccguucuccuuucuucg

SEQ ID NO: 404938 - RNA, 18 nt, Human
caccuguaauccagcacu

SEQ ID NO: 404939 - RNA, 23 nt, Human
caccuguaauccagcacuuuggg

SEQ ID NO: 404940 - RNA, 26 nt, Human
caccuguaauccagcacuuugggagg

SEQ ID NO: 404941 - RNA, 27 nt, Human
caccuuugccccaacacaguauggccu

SEQ ID NO: 404942 - RNA, 25 nt, Human
cagagccacaccacacuucagccaa

SEQ ID NO: 404943 - RNA, 24 nt, Human
cagcacuuugggaggccgaggcag

SEQ ID NO: 404944 - RNA, 26 nt, Human
cagcacuuugggaggccgaggcaggc

SEQ ID NO: 404945 - RNA, 23 nt, Human
cagccuacaaacaagauucuaca

SEQ ID NO: 404946 - RNA, 18 nt, Human
ccaaggccugcuggugcc

SEQ ID NO: 404947 - RNA, 18 nt, Human
ccaggaacuuuuacacca

SEQ ID NO: 404948 - RNA, 19 nt, Human
ccccaacacaguauggccu

SEQ ID NO: 404949 - RNA, 25 nt, Human
ccccgccccggccgggcccccugac

SEQ ID NO: 404950 - RNA, 18 nt, Human
ccccgggcucccccgccc

SEQ ID NO: 404951 - RNA, 18 nt, Human
ccgccccggccgggcccc

SEQ ID NO: 404952 - RNA, 20 nt, Human
ccuggccaacaugaugaaac

SEQ ID NO: 404953 - RNA, 24 nt, Human
ccuggccaacaugaugaaacucua

SEQ ID NO: 404954 - RNA, 24 nt, Human
cgagaccauccuggccaacaugau

SEQ ID NO: 404955 - RNA, 26 nt, Human
cgaggcaggcggaucacaaggucagg

SEQ ID NO: 404956 - RNA, 18 nt, Human
cgaggccgcccggaccug

SEQ ID NO: 404957 - RNA, 18 nt, Human
cgguaagaaacaucggca

SEQ ID NO: 404958 - RNA, 23 nt, Human
cucacaccuguaauccagcacuu

SEQ ID NO: 404959 - RNA, 22 nt, Human
gaaaacacucaacaggacagag

SEQ ID NO: 404960 - RNA, 19 nt, Human
gacccgaaccgcauggaag

SEQ ID NO: 404961 - RNA, 25 nt, Human
gagagcgaggccgcccggaccuguu

SEQ ID NO: 404962 - RNA, 21 nt, Human
gagccccaaggccugcuggug

SEQ ID NO: 404963 - RNA, 21 nt, Human
gaggcugaucgugguggcuca

SEQ ID NO: 404964 - RNA, 18 nt, Human
gcagcggcggcgcgcggg

SEQ ID NO: 404965 - RNA, 19 nt, Human
gcccggaccuguugcgagg

SEQ ID NO: 404966 - RNA, 24 nt, Human
gcccggaccuguugcgaggcggcg

SEQ ID NO: 404967 - RNA, 22 nt, Human
gcgaggcggcggcggcggcagc

SEQ ID NO: 404968 - RNA, 22 nt, Human
gcggcgcgcggguccgaagggc

SEQ ID NO: 404969 - RNA, 20 nt, Human
gcggcggcggcagcggcggc

SEQ ID NO: 404970 - RNA, 22 nt, Human
gcguucaugacgaaggaagaag

SEQ ID NO: 404971 - RNA, 19 nt, Human
ggcagcggcggcgcgcggg

SEQ ID NO: 404972 - RNA, 19 nt, Human
ggugccggggacaaucaga

SEQ ID NO: 404973 - RNA, 23 nt, Human
gguggcucacaccuguaauccag

SEQ ID NO: 404974 - RNA, 18 nt, Human
gugaagugcugcucauug

SEQ ID NO: 404975 - RNA, 22 nt, Human
uaaagucagcuaugaucuugac

SEQ ID NO: 404976 - RNA, 22 nt, Human
uaggagcagcugcugaaaacac

SEQ ID NO: 404977 - RNA, 18 nt, Human
ucacaaggucaggagauc

SEQ ID NO: 404978 - RNA, 24 nt, Human
ucacaaggucaggagaucgagacc

SEQ ID NO: 404979 - RNA, 24 nt, Human
ucacaccuguaauccagcacuuug

SEQ ID NO: 404980 - RNA, 20 nt, Human
ucagagacagcgaugugacg

SEQ ID NO: 404981 - RNA, 18 nt, Human
ucagugagccccaaggcc

SEQ ID NO: 404982 - RNA, 18 nt, Human
uccgcgcgggcuggggca

SEQ ID NO: 404983 - RNA, 21 nt, Human
uccgcgcgggcuggggcacca

SEQ ID NO: 404984 - RNA, 21 nt, Human
ucguauuacuucuucuuaaca

SEQ ID NO: 404985 - RNA, 21 nt, Human
ucucgccggguucuuugcaca

SEQ ID NO: 404986 - RNA, 24 nt, Human
ucuucuagagacauucuucaucgc

SEQ ID NO: 404987 - RNA, 20 nt, Human
ugaaaacacucaacaggacu

SEQ ID NO: 404988 - RNA, 19 nt, Human
ugaagaacaucaaacauuc

SEQ ID NO: 404989 - RNA, 18 nt, Human
ugacgcggcuuugucucu

SEQ ID NO: 404990 - RNA, 20 nt, Human
ugagccccaaggccugcugg

SEQ ID NO: 404991 - RNA, 24 nt, Human
ugagccccaaggccugcuggugcc

SEQ ID NO: 404992 - RNA, 24 nt, Human
ugccccaacacaguauggccugcu

SEQ ID NO: 404993 - RNA, 18 nt, Human
ugccuucgagccuucagu

SEQ ID NO: 404994 - RNA, 18 nt, Human
ugcgggggaggggagcgg

SEQ ID NO: 404995 - RNA, 19 nt, Human
uggaagcggguggccagac

SEQ ID NO: 404996 - RNA, 23 nt, Human
uggaagcggguggccagacugcg

SEQ ID NO: 404997 - RNA, 21 nt, Human
uggccagacugcggccccggc

SEQ ID NO: 404998 - RNA, 19 nt, Human
uggcucacaccuguaaucc

SEQ ID NO: 404999 - RNA, 23 nt, Human
uggcucacaccuguaauccagca

SEQ ID NO: 405000 - RNA, 20 nt, Human
ugggaggccgaggcaggcgg

SEQ ID NO: 405001 - RNA, 24 nt, Human
ugggaggccgaggcaggcggauca

SEQ ID NO: 405002 - RNA, 19 nt, Human
uggugaauucuucaauccu

SEQ ID NO: 405003 - RNA, 19 nt, Human
uggugaauucuucaauccu

SEQ ID NO: 405004 - RNA, 22 nt, Human
uggugaauucuucaauccuuca

SEQ ID NO: 405005 - RNA, 18 nt, Human
uuaaaauucagccuacaa

SEQ ID NO: 405006 - RNA, 21 nt, Human
uuaagaugcuacaaaaacuca

SEQ ID NO: 405007 - RNA, 20 nt, Human
uucaucacgcuaaauguccu

SEQ ID NO: 405008 - RNA, 26 nt, Human
uucuucgauauucaccaggaacuuuu

SEQ ID NO: 405009 - RNA, 18 nt, Human
uuggauccugagaucuug

SEQ ID NO: 405010 - RNA, 21 nt, Human
uuggauccugagaucuugguu

SEQ ID NO: 405011 - RNA, 25 nt, Human
uugggaggccgaggcaggcggauca

SEQ ID NO: 405012 - RNA, 22 nt, Human
aaaacuuugaaaucaaggacuc

SEQ ID NO: 405013 - RNA, 24 nt, Human
aaaagcccauaacagaaaguacca

SEQ ID NO: 405014 - RNA, 26 nt, Human
aaacaaaaacuuuucaauucuucagc

SEQ ID NO: 405015 - RNA, 21 nt, Human
aaacaaaaagagauuguaggg

SEQ ID NO: 405016 - RNA, 23 nt, Human
aaacaauacucaaugccccccac

SEQ ID NO: 405017 - RNA, 27 nt, Human
aaacgucuccaaacaaaaacuuuucaa

SEQ ID NO: 405018 - RNA, 27 nt, Human
aaagaaacauuuaccaaacaaaagaaa

SEQ ID NO: 405019 - RNA, 22 nt, Human
aaagcugcaugcuuguugcaga

SEQ ID NO: 405020 - RNA, 20 nt, Human
aaaguaccagaagacaagca

SEQ ID NO: 405021 - RNA, 26 nt, Human
aaauaucccuuuaacauucaauaucc

SEQ ID NO: 405022 - RNA, 21 nt, Human
aaaucccacuaucccaagaag

SEQ ID NO: 405023 - RNA, 18 nt, Human
aaaucucugcagcuuaag

SEQ ID NO: 405024 - RNA, 27 nt, Human
aacaaaagaaacauuuaccaaacaaua

SEQ ID NO: 405025 - RNA, 20 nt, Human
aacaauacucaaugcccccc

SEQ ID NO: 405026 - RNA, 20 nt, Human
aacgucuccaaacaaaaacu

SEQ ID NO: 405027 - RNA, 21 nt, Human
aagaaaaaaaaaagguaaaag

SEQ ID NO: 405028 - RNA, 23 nt, Human
aagaaaaaaaaaagguaaaagga

SEQ ID NO: 405029 - RNA, 23 nt, Human
aagaaaaugauacagugaugcaa

SEQ ID NO: 405030 - RNA, 19 nt, Human
aagaagaaaaaaaaaauaa

SEQ ID NO: 405031 - RNA, 21 nt, Human
aagaggaaggggaggagcuag

SEQ ID NO: 405032 - RNA, 23 nt, Human
aagcaacagcagccaugaaagac

SEQ ID NO: 405033 - RNA, 25 nt, Human
aagcugcaugcuuguugcagaaguu

SEQ ID NO: 405034 - RNA, 22 nt, Human
aagggugccucgcuuuggcuag

SEQ ID NO: 405035 - RNA, 28 nt, Human
aaucaccacuccuauuguaaaccuuaga

SEQ ID NO: 405036 - RNA, 22 nt, Human
acaaaagaaacauuuaccaaac

SEQ ID NO: 405037 - RNA, 21 nt, Human
acaauacucaaugccccccac

SEQ ID NO: 405038 - RNA, 20 nt, Human
accagaagacaagcaacuga

SEQ ID NO: 405039 - RNA, 21 nt, Human
agaaaaaaaaaagguaaaagg

SEQ ID NO: 405040 - RNA, 22 nt, Human
agaaaaaaaaaagguaaaagga

SEQ ID NO: 405041 - RNA, 24 nt, Human
agaagaaaaaaaaaauaaucaaaa

SEQ ID NO: 405042 - RNA, 23 nt, Human
agaagacaagcaacugaagcuua

SEQ ID NO: 405043 - RNA, 22 nt, Human
agacaagcaacugaagcuuaaa

SEQ ID NO: 405044 - RNA, 18 nt, Human
agaggaaggggaggagcu

SEQ ID NO: 405045 - RNA, 24 nt, Human
agaggaaggggaggagcuagggag

SEQ ID NO: 405046 - RNA, 18 nt, Human
agauaccuaucaccauac

SEQ ID NO: 405047 - RNA, 18 nt, Human
agcaaaguaagggaagca

SEQ ID NO: 405048 - RNA, 21 nt, Human
agcaaaguaagggaagcaguu

SEQ ID NO: 405049 - RNA, 18 nt, Human
agccauggcagcuacagu

SEQ ID NO: 405050 - RNA, 23 nt, Human
agcuacaguucugcaagcuauag

SEQ ID NO: 405051 - RNA, 18 nt, Human
agcuagggagaaggcuuu

SEQ ID NO: 405052 - RNA, 23 nt, Human
aggagcuagggagaaggcuuuga

SEQ ID NO: 405053 - RNA, 21 nt, Human
agggagauggacgggaaacug

SEQ ID NO: 405054 - RNA, 24 nt, Human
aggggguuacugauaugcucaaau

SEQ ID NO: 405055 - RNA, 19 nt, Human
aguacagacucaacauuuc

SEQ ID NO: 405056 - RNA, 24 nt, Human
aguuacuuuccaacaaacugaaac

SEQ ID NO: 405057 - RNA, 18 nt, Human
aguuuuauagaauaggag

SEQ ID NO: 405058 - RNA, 20 nt, Human
caacaguagcaaauguguaa

SEQ ID NO: 405059 - RNA, 21 nt, Human
caaccaaaaacuaaagaggac

SEQ ID NO: 405060 - RNA, 20 nt, Human
caaccaaaaacuaaagaggg

SEQ ID NO: 405061 - RNA, 21 nt, Human
caagccauccaaaacaaguaa

SEQ ID NO: 405062 - RNA, 24 nt, Human
caaucaauauuguaagauaaggua

SEQ ID NO: 405063 - RNA, 18 nt, Human
cacccaacucuuuuuugc

SEQ ID NO: 405064 - RNA, 22 nt, Human
cagaaucagaauuagaugccag

SEQ ID NO: 405065 - RNA, 23 nt, Human
cagccaugaaagacuuaucucuu

SEQ ID NO: 405066 - RNA, 21 nt, Human
caucgucacucacauguagca

SEQ ID NO: 405067 - RNA, 21 nt, Human
ccacaggaaaaccaaucucau

SEQ ID NO: 405068 - RNA, 21 nt, Human
cccaagaagaaaaaaaaaaua

SEQ ID NO: 405069 - RNA, 25 nt, Human
cccacuaucccaagaagaaaaaaaa

SEQ ID NO: 405070 - RNA, 25 nt, Human
cccccacccaaaaaucuauacugua

SEQ ID NO: 405071 - RNA, 20 nt, Human
ccgguuaaaaaagaaaauga

SEQ ID NO: 405072 - RNA, 20 nt, Human
ccuuaauggguuugcaaagc

SEQ ID NO: 405073 - RNA, 22 nt, Human
cucaaugccccccacccaaaaa

SEQ ID NO: 405074 - RNA, 24 nt, Human
cugaaugauuccuauuuacccuga

SEQ ID NO: 405075 - RNA, 20 nt, Human
cuggauuaaaucaccccaac

SEQ ID NO: 405076 - RNA, 20 nt, Human
cuucuggcuccccaaaagcc

SEQ ID NO: 405077 - RNA, 18 nt, Human
gacacaguacaggaauuu

SEQ ID NO: 405078 - RNA, 20 nt, Human
gaggagcuagggagaaggcu

SEQ ID NO: 405079 - RNA, 24 nt, Human
gaguauagacaagccauccaaaac

SEQ ID NO: 405080 - RNA, 23 nt, Human
gcccacuuucuagugguuucuau

SEQ ID NO: 405081 - RNA, 18 nt, Human
gccccccacccaaaaauc

SEQ ID NO: 405082 - RNA, 19 nt, Human
gccccccacccaaaaaucu

SEQ ID NO: 405083 - RNA, 22 nt, Human
gccccccacccaaaaaucuaua

SEQ ID NO: 405084 - RNA, 23 nt, Human
gcuuaugugcaaugacagcccuu

SEQ ID NO: 405085 - RNA, 19 nt, Human
ggaaggggaggagcuaggg

SEQ ID NO: 405086 - RNA, 21 nt, Human
ggaccaaggaacagcuuucau

SEQ ID NO: 405087 - RNA, 24 nt, Human
gggaggagcuagggagaaggcuuu

SEQ ID NO: 405088 - RNA, 23 nt, Human
ggggauuaccaagaaaaaaaaaa

SEQ ID NO: 405089 - RNA, 19 nt, Human
gguuacugauaugcucaaa

SEQ ID NO: 405090 - RNA, 20 nt, Human
guauuugaguuagucaaucu

SEQ ID NO: 405091 - RNA, 25 nt, Human
uaaaagaaacauuuaccaaacaaaa

SEQ ID NO: 405092 - RNA, 18 nt, Human
uaaacaagccucuacaug

SEQ ID NO: 405093 - RNA, 22 nt, Human
uaaacaauacucaaugcccccc

SEQ ID NO: 405094 - RNA, 21 nt, Human
uaacauguuuucccaaaguuu

SEQ ID NO: 405095 - RNA, 21 nt, Human
uaacuggauuaaaucacccca

SEQ ID NO: 405096 - RNA, 22 nt, Human
uaacuggauuaaaucaccccaa

SEQ ID NO: 405097 - RNA, 21 nt, Human
uaagaaaucagacaagaggaa

SEQ ID NO: 405098 - RNA, 19 nt, Human
uaagcaacagcagccauga

SEQ ID NO: 405099 - RNA, 21 nt, Human
uaagggagauggacgggaaac

SEQ ID NO: 405100 - RNA, 23 nt, Human
uaauggcagcaaauguuuuccca

SEQ ID NO: 405101 - RNA, 20 nt, Human
uaccaagaaaaaaaaaaggu

SEQ ID NO: 405102 - RNA, 21 nt, Human
uaccaagaaaaaaaaaaggua

SEQ ID NO: 405103 - RNA, 20 nt, Human
uaccuagccauggcagcucc

SEQ ID NO: 405104 - RNA, 19 nt, Human
uaccugaauaguacugaca

SEQ ID NO: 405105 - RNA, 24 nt, Human
uacuuuccaacaaacugaaacucu

SEQ ID NO: 405106 - RNA, 19 nt, Human
uagcaaauguguauuugag

SEQ ID NO: 405107 - RNA, 24 nt, Human
uagcauuaagcucuagauaccuau

SEQ ID NO: 405108 - RNA, 23 nt, Human
uaggaagagcucacauggugagg

SEQ ID NO: 405109 - RNA, 23 nt, Human
uauaaacgucuccaaacaaaaac

SEQ ID NO: 405110 - RNA, 24 nt, Human
uauaaacgucuccaaacaaaaacu

SEQ ID NO: 405111 - RNA, 20 nt, Human
uauagaauaggagggucuuu

SEQ ID NO: 405112 - RNA, 18 nt, Human
uauagacaagccauccaa

SEQ ID NO: 405113 - RNA, 19 nt, Human
uaugccacaggaaaaccaa

SEQ ID NO: 405114 - RNA, 20 nt, Human
uauucaaacccucagcaaag

SEQ ID NO: 405115 - RNA, 24 nt, Human
ucaaugccccccacccaaaaaucu

SEQ ID NO: 405116 - RNA, 19 nt, Human
ucagagcucauuugcaugc

SEQ ID NO: 405117 - RNA, 20 nt, Human
uccaaagaacugaaagaauc

SEQ ID NO: 405118 - RNA, 22 nt, Human
uccacacauuaccuuuuagagc

SEQ ID NO: 405119 - RNA, 22 nt, Human
uccccaaaagcccauaacagaa

SEQ ID NO: 405120 - RNA, 21 nt, Human
ucuaugcuucaaaagauuuuu

SEQ ID NO: 405121 - RNA, 23 nt, Human
ucuauggguagucccuaagggag

SEQ ID NO: 405122 - RNA, 25 nt, Human
ucugcagcuuaaggagaccgggguc

SEQ ID NO: 405123 - RNA, 21 nt, Human
ucuggaaaucccacuaucccc

SEQ ID NO: 405124 - RNA, 23 nt, Human
ucuguaauggcagcaaauguuuu

SEQ ID NO: 405125 - RNA, 24 nt, Human
ucuugcucuguggggaccuuucau

SEQ ID NO: 405126 - RNA, 18 nt, Human
ugaaggcuuaaagccaga

SEQ ID NO: 405127 - RNA, 24 nt, Human
ugcaaugacagcccuugaccagaa

SEQ ID NO: 405128 - RNA, 19 nt, Human
ugcaugcaugcaaaaaaau

SEQ ID NO: 405129 - RNA, 23 nt, Human
ugcaugggaagauuucagagcuc

SEQ ID NO: 405130 - RNA, 23 nt, Human
ugccacaggaaaaccaaucucau

SEQ ID NO: 405131 - RNA, 19 nt, Human
uggacgggaaacuggguuc

SEQ ID NO: 405132 - RNA, 24 nt, Human
uggcuucuggcuccccaaaagccc

SEQ ID NO: 405133 - RNA, 18 nt, Human
uguauuuagaauccaaag

SEQ ID NO: 405134 - RNA, 19 nt, Human
ugugcaaugacagcccuug

SEQ ID NO: 405135 - RNA, 23 nt, Human
uguggggaccuuucaugucuaug

SEQ ID NO: 405136 - RNA, 19 nt, Human
ugugguucuggaaauccca

SEQ ID NO: 405137 - RNA, 20 nt, Human
uguuuauaaacgucuccaaa

SEQ ID NO: 405138 - RNA, 24 nt, Human
uuagagccacgcuggcccuuuugc

SEQ ID NO: 405139 - RNA, 24 nt, Human
uuaguacagacucaacauuuccuc

SEQ ID NO: 405140 - RNA, 22 nt, Human
uucacacaaaauauauacacac

SEQ ID NO: 405141 - RNA, 18 nt, Human
uuccaaggcccuaguguu

SEQ ID NO: 405142 - RNA, 22 nt, Human
uucccuucccuccccucuuaaa

SEQ ID NO: 405143 - RNA, 22 nt, Human
uuuaagaauuuuccucauuccc

SEQ ID NO: 405144 - RNA, 22 nt, Human
uuuaagcaacagcagccaugaa

SEQ ID NO: 405145 - RNA, 18 nt, Human
uuuauaaaagucaaugag

SEQ ID NO: 405146 - RNA, 23 nt, Human
uuuucagaggcaauccacacauu

SEQ ID NO: 405147 - RNA, 23 nt, Human
uuuucaugaaaauacaaaaacga

SEQ ID NO: 405148 - RNA, 21 nt, Human
agaggggaggcagcuugggaa

SEQ ID NO: 405149 - RNA, 21 nt, Human
aggaaggagaggggaggcagc

SEQ ID NO: 405150 - RNA, 25 nt, Human
aggagaggggaggcagcuugggucu

SEQ ID NO: 405151 - RNA, 19 nt, Human
cacaggaaggagaggggag

SEQ ID NO: 405152 - RNA, 22 nt, Human
cagcccgaagguccugccuccu

SEQ ID NO: 405153 - RNA, 24 nt, Human
cccgaagguccugccuccugaggc

SEQ ID NO: 405154 - RNA, 21 nt, Human
ccgggcacagcccgaaggucc

SEQ ID NO: 405155 - RNA, 20 nt, Human
ccuggggccugugaggugcc

SEQ ID NO: 405156 - RNA, 23 nt, Human
cugcaggugacucaggcugucca

SEQ ID NO: 405157 - RNA, 22 nt, Human
gaccuugccuuuccccgggcac

SEQ ID NO: 405158 - RNA, 23 nt, Human
gaggcagcuugggucucugggcg

SEQ ID NO: 405159 - RNA, 22 nt, Human
gccugugaggugccuggggaug

SEQ ID NO: 405160 - RNA, 19 nt, Human
ggcggcuucgguggcuggg

SEQ ID NO: 405161 - RNA, 22 nt, Human
ggcgguggcgcaggcugcagcc

SEQ ID NO: 405162 - RNA, 25 nt, Human
gggccugugaggugccuggggaugg

SEQ ID NO: 405163 - RNA, 21 nt, Human
gucgcagccccgggcaucggc

SEQ ID NO: 405164 - RNA, 19 nt, Human
uccccgggcacagcccgaa

SEQ ID NO: 405165 - RNA, 19 nt, Human
uccuggggccugugaggug

SEQ ID NO: 405166 - RNA, 25 nt, Human
ucgguggcugggccuuuccuggggc

SEQ ID NO: 405167 - RNA, 18 nt, Human
ucugcagccgucgcagcc

SEQ ID NO: 405168 - RNA, 19 nt, Human
ugacucaggcuguccacag

SEQ ID NO: 405169 - RNA, 19 nt, Human
ugccuuuccccgggcacag

SEQ ID NO: 405170 - RNA, 19 nt, Human
uggcgcgggccccgguuuc

SEQ ID NO: 405171 - RNA, 23 nt, Human
ugugaggugccuggggaugggcc

SEQ ID NO: 405172 - RNA, 21 nt, Human
uucgguggcugggccuuuccu

SEQ ID NO: 405173 - RNA, 20 nt, Human
aacccuccgcccuguccacu

SEQ ID NO: 405174 - RNA, 19 nt, Human
aacccuggacgaagggcac

SEQ ID NO: 405175 - RNA, 24 nt, Human
aaccugccuucucaccacacccca

SEQ ID NO: 405176 - RNA, 24 nt, Human
acagcaagcaggaggguuggaguc

SEQ ID NO: 405177 - RNA, 18 nt, Human
accccuaggaaggacagc

SEQ ID NO: 405178 - RNA, 19 nt, Human
acccgcacaaccugccuuc

SEQ ID NO: 405179 - RNA, 18 nt, Human
agagccacuaaggcacag

SEQ ID NO: 405180 - RNA, 19 nt, Human
agcagcccuuccccucccg

SEQ ID NO: 405181 - RNA, 21 nt, Human
aggaggaggaagaagucagaa

SEQ ID NO: 405182 - RNA, 20 nt, Human
aggcagcugcugagggucag

SEQ ID NO: 405183 - RNA, 20 nt, Human
agggucaguuuccuuucugg

SEQ ID NO: 405184 - RNA, 21 nt, Human
auucuuucaaacccuccgccc

SEQ ID NO: 405185 - RNA, 18 nt, Human
caaccugccuucucacca

SEQ ID NO: 405186 - RNA, 23 nt, Human
cacacaaugcucacaaccauuaa

SEQ ID NO: 405187 - RNA, 19 nt, Human
caccacaggcaggcccuca

SEQ ID NO: 405188 - RNA, 19 nt, Human
cacugcauuuaaaaaauaa

SEQ ID NO: 405189 - RNA, 19 nt, Human
cagcaagcaggaggguugg

SEQ ID NO: 405190 - RNA, 22 nt, Human
cagcaagcaggaggguuggagu

SEQ ID NO: 405191 - RNA, 23 nt, Human
cagcuugaguccaaagaaauaau

SEQ ID NO: 405192 - RNA, 23 nt, Human
caggccagguguaaaauuccaca

SEQ ID NO: 405193 - RNA, 20 nt, Human
ccacgcaggccagguguaaa

SEQ ID NO: 405194 - RNA, 20 nt, Human
ccacgguugagaagagaagc

SEQ ID NO: 405195 - RNA, 26 nt, Human
ccaggcccaugcaaaggcagcacuga

SEQ ID NO: 405196 - RNA, 18 nt, Human
cccacccuccaccugacc

SEQ ID NO: 405197 - RNA, 19 nt, Human
cccacgccccacccuccac

SEQ ID NO: 405198 - RNA, 22 nt, Human
cccaugcaaaggcagcacugag

SEQ ID NO: 405199 - RNA, 23 nt, Human
cccgcacaaccugccuucucacc

SEQ ID NO: 405200 - RNA, 20 nt, Human
ccgcccuggcuggcugcucc

SEQ ID NO: 405201 - RNA, 27 nt, Human
ccucccauucccagaggcucaagagcc

SEQ ID NO: 405202 - RNA, 18 nt, Human
ccuugagcugagcagccc

SEQ ID NO: 405203 - RNA, 23 nt, Human
cgaaugugagccgggccaggccc

SEQ ID NO: 405204 - RNA, 18 nt, Human
cgagagaggcugcugggg

SEQ ID NO: 405205 - RNA, 25 nt, Human
cgcccuggcuggcugcuccgcugaa

SEQ ID NO: 405206 - RNA, 24 nt, Human
cgcugggcuucccuggccccugca

SEQ ID NO: 405207 - RNA, 22 nt, Human
cggcugugaugcugaggcuggg

SEQ ID NO: 405208 - RNA, 18 nt, Human
cgggagaagcucgccgcg

SEQ ID NO: 405209 - RNA, 19 nt, Human
cugggugauugcauuccuu

SEQ ID NO: 405210 - RNA, 18 nt, Human
cuuagaacucuucaaucc

SEQ ID NO: 405211 - RNA, 19 nt, Human
gagagaggcugcuggggug

SEQ ID NO: 405212 - RNA, 18 nt, Human
gagcagcccuuccccucc

SEQ ID NO: 405213 - RNA, 20 nt, Human
gagcagcccuuccccucccg

SEQ ID NO: 405214 - RNA, 19 nt, Human
gagccgagcgggcggcgcc

SEQ ID NO: 405215 - RNA, 22 nt, Human
gagccgagcgggcggcgccggg

SEQ ID NO: 405216 - RNA, 20 nt, Human
gaggguuggagucacugacg

SEQ ID NO: 405217 - RNA, 19 nt, Human
gccccugcaucucugucgu

SEQ ID NO: 405218 - RNA, 23 nt, Human
gcccuguccacuuccugcacccc

SEQ ID NO: 405219 - RNA, 18 nt, Human
gcgcugggcuucccuggc

SEQ ID NO: 405220 - RNA, 19 nt, Human
ggccagguguaaaauucca

SEQ ID NO: 405221 - RNA, 22 nt, Human
gggcaggacuguccucagggcc

SEQ ID NO: 405222 - RNA, 18 nt, Human
gggucucagaaaauggac

SEQ ID NO: 405223 - RNA, 21 nt, Human
gggugucugaacuguccgggg

SEQ ID NO: 405224 - RNA, 21 nt, Human
ggguuggagucacugacgaau

SEQ ID NO: 405225 - RNA, 20 nt, Human
gucagggaaggaggaggaga

SEQ ID NO: 405226 - RNA, 21 nt, Human
uaaaacaccucaacuggaaga

SEQ ID NO: 405227 - RNA, 20 nt, Human
uaacagguaggacuugcugg

SEQ ID NO: 405228 - RNA, 22 nt, Human
uaacaugauucccaaagggaag

SEQ ID NO: 405229 - RNA, 18 nt, Human
uaggaaggacagcacagu

SEQ ID NO: 405230 - RNA, 19 nt, Human
uaggaaggacagcacagug

SEQ ID NO: 405231 - RNA, 24 nt, Human
uaggagccagcgggagcugccacg

SEQ ID NO: 405232 - RNA, 25 nt, Human
ucaacacccgcacaaccugccuucu

SEQ ID NO: 405233 - RNA, 22 nt, Human
ucagaaaaugccacuuauuuua

SEQ ID NO: 405234 - RNA, 23 nt, Human
ucagggaaggaggaggaggaaga

SEQ ID NO: 405235 - RNA, 22 nt, Human
ucaucccaaguacagcaagcag

SEQ ID NO: 405236 - RNA, 21 nt, Human
uccacacaaugcucacaacca

SEQ ID NO: 405237 - RNA, 18 nt, Human
ucccaaagggagccuggg

SEQ ID NO: 405238 - RNA, 20 nt, Human
ucccaaagggagccugggcu

SEQ ID NO: 405239 - RNA, 21 nt, Human
ucccagaggcucaagagccuc

SEQ ID NO: 405240 - RNA, 23 nt, Human
ugaacagagcugcggcugugaug

SEQ ID NO: 405241 - RNA, 27 nt, Human
ugacauaaaacaccucaacuggaagag

SEQ ID NO: 405242 - RNA, 21 nt, Human
ugagaaggggggcacaguucu

SEQ ID NO: 405243 - RNA, 21 nt, Human
ugagaaggggggcacaguucu

SEQ ID NO: 405244 - RNA, 25 nt, Human
ugagcugagcagcccuuccccuccc

SEQ ID NO: 405245 - RNA, 22 nt, Human
ugaguguaaaacaucuguguac

SEQ ID NO: 405246 - RNA, 18 nt, Human
ugcucugcagcgggugaa

SEQ ID NO: 405247 - RNA, 19 nt, Human
ugcugggugauugcauucc

SEQ ID NO: 405248 - RNA, 21 nt, Human
ugcugggugauugcauuccuu

SEQ ID NO: 405249 - RNA, 20 nt, Human
uggagugccauccccaaggg

SEQ ID NO: 405250 - RNA, 21 nt, Human
ugggggucucagaaaauggac

SEQ ID NO: 405251 - RNA, 18 nt, Human
ugggugauugcauuccuu

SEQ ID NO: 405252 - RNA, 19 nt, Human
uguagcuccugagaaaaag

SEQ ID NO: 405253 - RNA, 19 nt, Human
ugucgcgggcgcuauggga

SEQ ID NO: 405254 - RNA, 18 nt, Human
ugucugaacuguccgggg

SEQ ID NO: 405255 - RNA, 18 nt, Human
uguggagugccaucccca

SEQ ID NO: 405256 - RNA, 18 nt, Human
uuaaagggugcuaaagac

SEQ ID NO: 405257 - RNA, 26 nt, Human
uucaaacccuccgcccuguccacuuc

SEQ ID NO: 405258 - RNA, 20 nt, Human
uucagcuugaguccaaagaa

SEQ ID NO: 405259 - RNA, 21 nt, Human
uuccacacaaugcucacaacc

SEQ ID NO: 405260 - RNA, 18 nt, Human
uuccccucccgggagugg

SEQ ID NO: 405261 - RNA, 19 nt, Human
uuccuuucugggggucuca

SEQ ID NO: 405262 - RNA, 18 nt, Human
uuuccuucucuuggcccc

SEQ ID NO: 405263 - RNA, 21 nt, Human
uuuguagcuccugagaaaaag

SEQ ID NO: 405264 - RNA, 20 nt, Human
uuuuaugcuuagaacucuuc

SEQ ID NO: 405265 - RNA, 22 nt, Human
uuuuccuucucuuggccccucc

SEQ ID NO: 405266 - RNA, 24 nt, Human
aaaaaaaaaaacugagacuaguuc

SEQ ID NO: 405267 - RNA, 19 nt, Human
aaaucccaccacgccuucc

SEQ ID NO: 405268 - RNA, 20 nt, Human
aacaagaaugcucgcgccac

SEQ ID NO: 405269 - RNA, 18 nt, Human
aagaagggagaggauggu

SEQ ID NO: 405270 - RNA, 19 nt, Human
aagaggaauaagcagaccu

SEQ ID NO: 405271 - RNA, 21 nt, Human
aaggagaagccaccuugguga

SEQ ID NO: 405272 - RNA, 22 nt, Human
aaggagcagaugacaccaucag

SEQ ID NO: 405273 - RNA, 21 nt, Human
acagcacagaggcacgggcac

SEQ ID NO: 405274 - RNA, 22 nt, Human
acagcacagaggcacgggcacc

SEQ ID NO: 405275 - RNA, 25 nt, Human
accaugggagagggcagcacuccug

SEQ ID NO: 405276 - RNA, 19 nt, Human
accuaaaaaaaaaaaaaaa

SEQ ID NO: 405277 - RNA, 20 nt, Human
acugggcuucugggcugcuu

SEQ ID NO: 405278 - RNA, 24 nt, Human
agaagccugugauggugaagagga

SEQ ID NO: 405279 - RNA, 23 nt, Human
agacugugggcguggagccggca

SEQ ID NO: 405280 - RNA, 22 nt, Human
agagcuccugagcccccugccc

SEQ ID NO: 405281 - RNA, 18 nt, Human
agcaucagacacaugauc

SEQ ID NO: 405282 - RNA, 25 nt, Human
agcccaauaacuugaaggcccgcaa

SEQ ID NO: 405283 - RNA, 24 nt, Human
agccugugauggugaagaggaagc

SEQ ID NO: 405284 - RNA, 22 nt, Human
aggaagauacaguuuggaugag

SEQ ID NO: 405285 - RNA, 24 nt, Human
aggaagcggacccgccccaccaag

SEQ ID NO: 405286 - RNA, 22 nt, Human
aggcgcugaaggucaggucgcc

SEQ ID NO: 405287 - RNA, 23 nt, Human
aguuacugggcuucugggcugcu

SEQ ID NO: 405288 - RNA, 21 nt, Human
augauccgcaagaacaaguac

SEQ ID NO: 405289 - RNA, 21 nt, Human
auuggccuggucccaaccauu

SEQ ID NO: 405290 - RNA, 19 nt, Human
caaccauuauaguaagugg

SEQ ID NO: 405291 - RNA, 18 nt, Human
caacggacugauucaccg

SEQ ID NO: 405292 - RNA, 19 nt, Human
caacggacugauucaccgc

SEQ ID NO: 405293 - RNA, 23 nt, Human
cacauacacagcacagaggcacg

SEQ ID NO: 405294 - RNA, 25 nt, Human
cacaugauccgcaagaacaaguacc

SEQ ID NO: 405295 - RNA, 21 nt, Human
caccaagagcuccugagcccc

SEQ ID NO: 405296 - RNA, 18 nt, Human
caccaucaacaagaaugc

SEQ ID NO: 405297 - RNA, 18 nt, Human
caccgcaagacugugggc

SEQ ID NO: 405298 - RNA, 18 nt, Human
cagaagccugugauggug

SEQ ID NO: 405299 - RNA, 20 nt, Human
cagaagccugugauggugaa

SEQ ID NO: 405300 - RNA, 18 nt, Human
cagcuggcuuucucaccu

SEQ ID NO: 405301 - RNA, 19 nt, Human
caggagcaaaucccaccac

SEQ ID NO: 405302 - RNA, 20 nt, Human
cagggccagcgccauccugc

SEQ ID NO: 405303 - RNA, 19 nt, Human
caucagacacaugauccgc

SEQ ID NO: 405304 - RNA, 19 nt, Human
ccacgcucagcagcaucag

SEQ ID NO: 405305 - RNA, 22 nt, Human
ccacgcucagcagcaucagaca

SEQ ID NO: 405306 - RNA, 22 nt, Human
ccauccugcgcagccagaagcc

SEQ ID NO: 405307 - RNA, 22 nt, Human
ccccaccaagagcuccugagcc

SEQ ID NO: 405308 - RNA, 19 nt, Human
cccuggcuuggcaggaagg

SEQ ID NO: 405309 - RNA, 21 nt, Human
ccgcaauuccuuccgcuacaa

SEQ ID NO: 405310 - RNA, 24 nt, Human
ccgccccaccaagagcuccugagc

SEQ ID NO: 405311 - RNA, 23 nt, Human
ccgccgccaugucugcgcaucug

SEQ ID NO: 405312 - RNA, 18 nt, Human
ccggccagcggaagccug

SEQ ID NO: 405313 - RNA, 20 nt, Human
ccugagcccccugcccccag

SEQ ID NO: 405314 - RNA, 21 nt, Human
ccugagcccccugcccccaga

SEQ ID NO: 405315 - RNA, 23 nt, Human
cgaccugcgcauggcagccaucc

SEQ ID NO: 405316 - RNA, 19 nt, Human
cgcucagcagcaucagaca

SEQ ID NO: 405317 - RNA, 23 nt, Human
cggacccgccccaccaagagcuc

SEQ ID NO: 405318 - RNA, 24 nt, Human
cggcaaaggugucgugguggucau

SEQ ID NO: 405319 - RNA, 26 nt, Human
cguggagccggcagccgaccaggucu

SEQ ID NO: 405320 - RNA, 18 nt, Human
cugagcccccugccccca

SEQ ID NO: 405321 - RNA, 20 nt, Human
cugagcccccugcccccaga

SEQ ID NO: 405322 - RNA, 20 nt, Human
cugcuccaguuuccugauca

SEQ ID NO: 405323 - RNA, 21 nt, Human
cuuccaucucucagccaagga

SEQ ID NO: 405324 - RNA, 20 nt, Human
gaacccaggagcaaauccca

SEQ ID NO: 405325 - RNA, 25 nt, Human
gagcaaaucccaccacgccuuccau

SEQ ID NO: 405326 - RNA, 23 nt, Human
gagcuccugagcccccugccccc

SEQ ID NO: 405327 - RNA, 20 nt, Human
gcgcagccagaagccuguga

SEQ ID NO: 405328 - RNA, 20 nt, Human
gcuccaguuuccugaucaag

SEQ ID NO: 405329 - RNA, 25 nt, Human
ggagcaaaucccaccacgccuucca

SEQ ID NO: 405330 - RNA, 21 nt, Human
ggccacaggaaggagcagaug

SEQ ID NO: 405331 - RNA, 23 nt, Human
gggcuucugggcugcuuaguccc

SEQ ID NO: 405332 - RNA, 21 nt, Human
gguagggaagauggauggggc

SEQ ID NO: 405333 - RNA, 21 nt, Human
uaaacaguaaaggaagauaca

SEQ ID NO: 405334 - RNA, 20 nt, Human
uaaagucagcuggcuuucuc

SEQ ID NO: 405335 - RNA, 18 nt, Human
uaagaagggagaggaugg

SEQ ID NO: 405336 - RNA, 19 nt, Human
uaagcagaccuacagcacu

SEQ ID NO: 405337 - RNA, 21 nt, Human
uaagcagaccuacagcacuga

SEQ ID NO: 405338 - RNA, 22 nt, Human
ucaccuaaaaaaaaaaaaaaaa

SEQ ID NO: 405339 - RNA, 23 nt, Human
uccgcaagaacaaguaccgcccc

SEQ ID NO: 405340 - RNA, 24 nt, Human
uccgcuacaacggacugauucacc

SEQ ID NO: 405341 - RNA, 19 nt, Human
uccugagcccccugccccc

SEQ ID NO: 405342 - RNA, 23 nt, Human
ucucaccuaaaaaaaaaaaaaaa

SEQ ID NO: 405343 - RNA, 18 nt, Human
ugaagauauaaacaguaa

SEQ ID NO: 405344 - RNA, 19 nt, Human
ugaaggucaggucgccgcu

SEQ ID NO: 405345 - RNA, 22 nt, Human
ugaaggucaggucgccgcugcg

SEQ ID NO: 405346 - RNA, 24 nt, Human
ugaggggaucuuggccucacggug

SEQ ID NO: 405347 - RNA, 23 nt, Human
uggcaggaaggguagggaagaug

SEQ ID NO: 405348 - RNA, 23 nt, Human
uggccuggucccaaccauuacag

SEQ ID NO: 405349 - RNA, 23 nt, Human
ugugauggugaagaggaagcgga

SEQ ID NO: 405350 - RNA, 24 nt, Human
ugugauggugaagaggaagcggac

SEQ ID NO: 405351 - RNA, 18 nt, Human
uuagucccuggcuuggca

SEQ ID NO: 405352 - RNA, 23 nt, Human
uucugaggggaucuuggccucac

SEQ ID NO: 405353 - RNA, 28 nt, Human
uuucucaccuaaaaaaaaaaaaaaaaaa

SEQ ID NO: 405354 - RNA, 23 nt, Human
uuuggaugaggccacaggaagga

SEQ ID NO: 405355 - RNA, 18 nt, Human
uuuuuuuuuuuuuuaccu

SEQ ID NO: 405356 - RNA, 23 nt, Human
aaaacagagaaagguggaaagaa

SEQ ID NO: 405357 - RNA, 20 nt, Human
aaaacaguuacuuucacuuu

SEQ ID NO: 405358 - RNA, 20 nt, Human
aaaaugccacagucacaugg

SEQ ID NO: 405359 - RNA, 21 nt, Human
aaccucagacaccaucagucc

SEQ ID NO: 405360 - RNA, 19 nt, Human
aagauggaaacauagcuaa

SEQ ID NO: 405361 - RNA, 26 nt, Human
aagcagaaaguaaugaaaagggaccc

SEQ ID NO: 405362 - RNA, 20 nt, Human
aaugugugaguagggcucca

SEQ ID NO: 405363 - RNA, 23 nt, Human
acugcuccuuaaaugccacaauc

SEQ ID NO: 405364 - RNA, 22 nt, Human
agaacaugcauucuuugguagc

SEQ ID NO: 405365 - RNA, 19 nt, Human
agguagcccuuguuguuag

SEQ ID NO: 405366 - RNA, 26 nt, Human
aguauccauuuauuaacacugguaac

SEQ ID NO: 405367 - RNA, 24 nt, Human
auagggauuuguguacauaaaaca

SEQ ID NO: 405368 - RNA, 22 nt, Human
auggaaacauagcuaagccuca

SEQ ID NO: 405369 - RNA, 21 nt, Human
caaauuaaaaacaauuuucua

SEQ ID NO: 405370 - RNA, 26 nt, Human
caccaagaagaaaacaguuacuuuca

SEQ ID NO: 405371 - RNA, 18 nt, Human
caccaucaguccaaccgc

SEQ ID NO: 405372 - RNA, 19 nt, Human
cacuacuauaaaauugaga

SEQ ID NO: 405373 - RNA, 22 nt, Human
cacugcuccuuucauucucuac

SEQ ID NO: 405374 - RNA, 21 nt, Human
cagguucuccuucaaucaugg

SEQ ID NO: 405375 - RNA, 24 nt, Human
ccaaagacaguaauaaggucagag

SEQ ID NO: 405376 - RNA, 22 nt, Human
cuaauacuaaaagguacucaga

SEQ ID NO: 405377 - RNA, 19 nt, Human
cuccaagaggaaccucaac

SEQ ID NO: 405378 - RNA, 22 nt, Human
cuggugcacuucuaacacccca

SEQ ID NO: 405379 - RNA, 21 nt, Human
cuuccauuuuacagcuaagga

SEQ ID NO: 405380 - RNA, 22 nt, Human
cuucuggaugaaccaacaguuu

SEQ ID NO: 405381 - RNA, 23 nt, Human
gacuguuacccccucuagacuuu

SEQ ID NO: 405382 - RNA, 21 nt, Human
ggaaccucaacaguuuucucu

SEQ ID NO: 405383 - RNA, 20 nt, Human
gguuccaaccgaauauaaua

SEQ ID NO: 405384 - RNA, 24 nt, Human
gucauagcaccaagaagaaaacag

SEQ ID NO: 405385 - RNA, 24 nt, Human
guccaaccgcuuccauuuuacagc

SEQ ID NO: 405386 - RNA, 22 nt, Human
uaacuagucuucagaaacugaa

SEQ ID NO: 405387 - RNA, 21 nt, Human
uaagacaauaccaaagacagu

SEQ ID NO: 405388 - RNA, 22 nt, Human
uacagaaaacuaauacuaaaag

SEQ ID NO: 405389 - RNA, 19 nt, Human
uaccaaagacaguaauaag

SEQ ID NO: 405390 - RNA, 21 nt, Human
uagcaccaagaagaaaacagu

SEQ ID NO: 405391 - RNA, 19 nt, Human
uaggagccacagacuggag

SEQ ID NO: 405392 - RNA, 22 nt, Human
uauuuagaauuucaguguggga

SEQ ID NO: 405393 - RNA, 21 nt, Human
ucagucuaagguaugucagaa

SEQ ID NO: 405394 - RNA, 23 nt, Human
ucauuuaucuuucacaucauuuc

SEQ ID NO: 405395 - RNA, 24 nt, Human
uccaaccgaauauaauagagcuua

SEQ ID NO: 405396 - RNA, 19 nt, Human
ucuacagacaaccugaguc

SEQ ID NO: 405397 - RNA, 20 nt, Human
ucucacacugucauagcacc

SEQ ID NO: 405398 - RNA, 21 nt, Human
ugaaaagugccgaaaaugccc

SEQ ID NO: 405399 - RNA, 19 nt, Human
uggaaugauucccauuagg

SEQ ID NO: 405400 - RNA, 19 nt, Human
ugugaugaugaugcagacu

SEQ ID NO: 405401 - RNA, 18 nt, Human
uuagguuccaaccgaaua

SEQ ID NO: 405402 - RNA, 18 nt, Human
uucacuuuucuuauagca

SEQ ID NO: 405403 - RNA, 19 nt, Human
uugguuucauaaaacagag

SEQ ID NO: 405404 - RNA, 21 nt, Human
uuuaugcuuaaguuuccucug

SEQ ID NO: 405405 - RNA, 18 nt, Human
uuuuuuuuuuuuuuuucg

SEQ ID NO: 405406 - RNA, 22 nt, Human
aaacaaaacaaaacaaaacaaa

SEQ ID NO: 405407 - RNA, 23 nt, Human
aaacaaaacaaaacaaaaugaaa

SEQ ID NO: 405408 - RNA, 21 nt, Human
aauggcacauuugaaccagga

SEQ ID NO: 405409 - RNA, 22 nt, Human
aauggcacauuugaaccaggau

SEQ ID NO: 405410 - RNA, 21 nt, Human
acaaaacaaaacaaaacaaaa

SEQ ID NO: 405411 - RNA, 23 nt, Human
acaaaacaaaacaaaaugaaaga

SEQ ID NO: 405412 - RNA, 19 nt, Human
acaaaacaaaaugaaagaa

SEQ ID NO: 405413 - RNA, 22 nt, Human
accaauccacaccugauugugu

SEQ ID NO: 405414 - RNA, 21 nt, Human
acuaagcacacuguguugcua

SEQ ID NO: 405415 - RNA, 22 nt, Human
acuucuugagguacaaaaacug

SEQ ID NO: 405416 - RNA, 20 nt, Human
caaaacaaaacaaaaugaaa

SEQ ID NO: 405417 - RNA, 23 nt, Human
caaaaugaaagaauguggucgca

SEQ ID NO: 405418 - RNA, 22 nt, Human
caaaguagcaccaauccacacc

SEQ ID NO: 405419 - RNA, 23 nt, Human
cacacuguguugcuaaacucucu

SEQ ID NO: 405420 - RNA, 22 nt, Human
cacauuugaaccaggaucgccc

SEQ ID NO: 405421 - RNA, 19 nt, Human
cagaggcugagagauccug

SEQ ID NO: 405422 - RNA, 20 nt, Human
cauuugaaccaggaucgccc

SEQ ID NO: 405423 - RNA, 22 nt, Human
ccacaccugauuguguuuccaa

SEQ ID NO: 405424 - RNA, 24 nt, Human
cgagcgcgcggucggcggaggccg

SEQ ID NO: 405425 - RNA, 18 nt, Human
cgcggucggcggaggccg

SEQ ID NO: 405426 - RNA, 20 nt, Human
cucaucuuguaguaaaacuc

SEQ ID NO: 405427 - RNA, 18 nt, Human
gaggggcccuggggcugc

SEQ ID NO: 405428 - RNA, 20 nt, Human
gcggcggcgaggggcccugg

SEQ ID NO: 405429 - RNA, 21 nt, Human
ggcggcgaggggcccuggggc

SEQ ID NO: 405430 - RNA, 24 nt, Human
gguaaaaguaaauaaauugcauuu

SEQ ID NO: 405431 - RNA, 24 nt, Human
uaaaaacaaaacaaaacaaaacaa

SEQ ID NO: 405432 - RNA, 23 nt, Human
uaacacagaggcugagagauccc

SEQ ID NO: 405433 - RNA, 23 nt, Human
uccaacauuaaccuuccuuguug

SEQ ID NO: 405434 - RNA, 20 nt, Human
ugaacaaaagaccacagggg

SEQ ID NO: 405435 - RNA, 21 nt, Human
ugaauggaacuucuccugcuu

SEQ ID NO: 405436 - RNA, 22 nt, Human
ugaccuagcugguaucuugugg

SEQ ID NO: 405437 - RNA, 22 nt, Human
uggcggcggcgaggggcccugg

SEQ ID NO: 405438 - RNA, 23 nt, Human
uggcggcggcgaggggcccuggg

SEQ ID NO: 405439 - RNA, 25 nt, Human
ugguaucuuguggauguuucuguga

SEQ ID NO: 405440 - RNA, 18 nt, Human
uggucgcagcuaaggagg

SEQ ID NO: 405441 - RNA, 23 nt, Human
ugugacagugguaaaaguaaaua

SEQ ID NO: 405442 - RNA, 23 nt, Human
uguuagaaaugcccucgguaaca

SEQ ID NO: 405443 - RNA, 26 nt, Human
uuaaaaacaaaacaaaacaaaacaaa

SEQ ID NO: 405444 - RNA, 22 nt, Human
uuguauguguuuuccccacccc

SEQ ID NO: 405445 - RNA, 20 nt, Human
uuuuccccacccccugaccu

SEQ ID NO: 405446 - RNA, 21 nt, Human
cggcaggcggugaggaccgga

SEQ ID NO: 405447 - RNA, 23 nt, Human
cugggugagcggacugggugcca

SEQ ID NO: 405448 - RNA, 18 nt, Human
gcugggugagcggacugg

SEQ ID NO: 405449 - RNA, 19 nt, Human
ggcugggugagcggacugg

SEQ ID NO: 405450 - RNA, 23 nt, Human
ggcugggugagcggacugggugc

SEQ ID NO: 405451 - RNA, 19 nt, Human
uagccuggcuggggguggg

SEQ ID NO: 405452 - RNA, 22 nt, Human
ugggcugggugagcggacuggg

SEQ ID NO: 405453 - RNA, 20 nt, Human
aaaagaacaucacaucaagg

SEQ ID NO: 405454 - RNA, 23 nt, Human
aaacgcucccggccagggaacaa

SEQ ID NO: 405455 - RNA, 23 nt, Human
aaagcuucuccgauacaaaauau

SEQ ID NO: 405456 - RNA, 22 nt, Human
aaaguguugggauuacaggcga

SEQ ID NO: 405457 - RNA, 20 nt, Human
aaauccucaauuugcuguuc

SEQ ID NO: 405458 - RNA, 22 nt, Human
aagcaaacgcucccggccaggg

SEQ ID NO: 405459 - RNA, 18 nt, Human
aaguguugggauuacagg

SEQ ID NO: 405460 - RNA, 19 nt, Human
aaguguugggauuacaggc

SEQ ID NO: 405461 - RNA, 18 nt, Human
aauaagagagcugaaaaa

SEQ ID NO: 405462 - RNA, 19 nt, Human
acaaaaggaacuucuuaca

SEQ ID NO: 405463 - RNA, 23 nt, Human
acaauagccacccccggcccccc

SEQ ID NO: 405464 - RNA, 24 nt, Human
acaugguuucgccauguuggcugg

SEQ ID NO: 405465 - RNA, 22 nt, Human
acccugccuaccuuaggaauaa

SEQ ID NO: 405466 - RNA, 27 nt, Human
acucugucgaccaggcuggagcgcugu

SEQ ID NO: 405467 - RNA, 21 nt, Human
agaaagacccacggagcucca

SEQ ID NO: 405468 - RNA, 19 nt, Human
agagcugaaaaagcuggug

SEQ ID NO: 405469 - RNA, 24 nt, Human
agcgaagauggcaauaacaaaagg

SEQ ID NO: 405470 - RNA, 18 nt, Human
aguagcugggacuacagg

SEQ ID NO: 405471 - RNA, 19 nt, Human
aguagcugggacuacaggc

SEQ ID NO: 405472 - RNA, 23 nt, Human
aguugacccaaaagguuaugguc

SEQ ID NO: 405473 - RNA, 24 nt, Human
aguugacccaaaagguuauggucu

SEQ ID NO: 405474 - RNA, 24 nt, Human
auuuuuguauuuuuaguagagaca

SEQ ID NO: 405475 - RNA, 23 nt, Human
caaaauauuuggucauguauuca

SEQ ID NO: 405476 - RNA, 22 nt, Human
caaaguguugggauuacaggcg

SEQ ID NO: 405477 - RNA, 21 nt, Human
caagagaagagaaagacccac

SEQ ID NO: 405478 - RNA, 20 nt, Human
caagcgauccuccugccuca

SEQ ID NO: 405479 - RNA, 22 nt, Human
caagcgauccuccugccucagc

SEQ ID NO: 405480 - RNA, 27 nt, Human
caagcgauccuccugccucagccuccc

SEQ ID NO: 405481 - RNA, 18 nt, Human
caauuugcuguucccuga

SEQ ID NO: 405482 - RNA, 22 nt, Human
cacccccggcccccaccagucc

SEQ ID NO: 405483 - RNA, 24 nt, Human
cacucugucgaccaggcuggagcg

SEQ ID NO: 405484 - RNA, 19 nt, Human
caggaaccaaauggccucc

SEQ ID NO: 405485 - RNA, 19 nt, Human
ccaaaguguugggauuaca

SEQ ID NO: 405486 - RNA, 22 nt, Human
ccaaaguguugggauuacaggc

SEQ ID NO: 405487 - RNA, 23 nt, Human
ccaaaguguugggauuacaggcg

SEQ ID NO: 405488 - RNA, 23 nt, Human
ccaccaguccuuuuauuggcucu

SEQ ID NO: 405489 - RNA, 19 nt, Human
ccagcaaagcgaagauggc

SEQ ID NO: 405490 - RNA, 19 nt, Human
ccauguuggcugggcuggu

SEQ ID NO: 405491 - RNA, 22 nt, Human
ccauguuggcugggcuggucuc

SEQ ID NO: 405492 - RNA, 23 nt, Human
ccauguuggcugggcuggucucg

SEQ ID NO: 405493 - RNA, 24 nt, Human
cccacaauagccacccccggcccc

SEQ ID NO: 405494 - RNA, 23 nt, Human
cccgaguagcugggacuacaggc

SEQ ID NO: 405495 - RNA, 24 nt, Human
cccgaguagcugggacuacaggca

SEQ ID NO: 405496 - RNA, 23 nt, Human
ccucaagugaucuguccuggccu

SEQ ID NO: 405497 - RNA, 24 nt, Human
ccuccugccucagccucccgagua

SEQ ID NO: 405498 - RNA, 19 nt, Human
ccugaccucaagugaucug

SEQ ID NO: 405499 - RNA, 23 nt, Human
ccugcaugguggagaguggagaa

SEQ ID NO: 405500 - RNA, 24 nt, Human
ccugccucagccucccgaguagcu

SEQ ID NO: 405501 - RNA, 20 nt, Human
ccuggguucaagcgauccuc

SEQ ID NO: 405502 - RNA, 23 nt, Human
ccuggguucaagcgauccuccug

SEQ ID NO: 405503 - RNA, 18 nt, Human
cgaccaggcuggagcgcu

SEQ ID NO: 405504 - RNA, 21 nt, Human
cgcuguggugcgauaucggcu

SEQ ID NO: 405505 - RNA, 23 nt, Human
cggccagggaacaacuuuagaau

SEQ ID NO: 405506 - RNA, 23 nt, Human
cggcggacgcucggcugggcucc

SEQ ID NO: 405507 - RNA, 24 nt, Human
cucacucugucgaccaggcuggag

SEQ ID NO: 405508 - RNA, 24 nt, Human
cucacugcagucuccacuuccugg

SEQ ID NO: 405509 - RNA, 24 nt, Human
cucagccucccgaguagcugggac

SEQ ID NO: 405510 - RNA, 20 nt, Human
cugagugggucauuacugga

SEQ ID NO: 405511 - RNA, 19 nt, Human
cugcagucuccacuuccug

SEQ ID NO: 405512 - RNA, 20 nt, Human
cuggugccauuugaaaaaaa

SEQ ID NO: 405513 - RNA, 24 nt, Human
cuuccuggguucaagcgauccucc

SEQ ID NO: 405514 - RNA, 26 nt, Human
gaccucaagugaucuguccuggccuc

SEQ ID NO: 405515 - RNA, 27 nt, Human
gaguagcugggacuacaggcaggcguc

SEQ ID NO: 405516 - RNA, 19 nt, Human
gcagcggcggacgcucggc

SEQ ID NO: 405517 - RNA, 20 nt, Human
gccucagccucccgaguagc

SEQ ID NO: 405518 - RNA, 24 nt, Human
gcgauccuccugccucagccuccc

SEQ ID NO: 405519 - RNA, 18 nt, Human
gcggagcgcagaggcgca

SEQ ID NO: 405520 - RNA, 22 nt, Human
gcucccggccagggaacaacuu

SEQ ID NO: 405521 - RNA, 23 nt, Human
gcuggucucgaacuccugaccuc

SEQ ID NO: 405522 - RNA, 23 nt, Human
ggaaauaugcaaaagaacaucac

SEQ ID NO: 405523 - RNA, 19 nt, Human
ggagaagggccaggauucu

SEQ ID NO: 405524 - RNA, 25 nt, Human
ggcaauaacaaaaggaaccgguacc

SEQ ID NO: 405525 - RNA, 20 nt, Human
ggcagcggcggacgcucggc

SEQ ID NO: 405526 - RNA, 24 nt, Human
ggcuggucucgaacuccugaccuc

SEQ ID NO: 405527 - RNA, 21 nt, Human
gggcagcggcggacgcucggc

SEQ ID NO: 405528 - RNA, 24 nt, Human
gggccaggauucuuagguugaucu

SEQ ID NO: 405529 - RNA, 20 nt, Human
gggcuggucucgaacuccug

SEQ ID NO: 405530 - RNA, 19 nt, Human
ggucucgaacuccugaccu

SEQ ID NO: 405531 - RNA, 21 nt, Human
gguuucgccauguuggcuggg

SEQ ID NO: 405532 - RNA, 21 nt, Human
guccuggccucccaaaguguu

SEQ ID NO: 405533 - RNA, 19 nt, Human
gucgaccaggcuggagcgc

SEQ ID NO: 405534 - RNA, 23 nt, Human
uaagagagcugaaaaagcuggug

SEQ ID NO: 405535 - RNA, 24 nt, Human
uaauuuuuguauuuuuaguagaga

SEQ ID NO: 405536 - RNA, 22 nt, Human
uacaggcgaaagcaaacgcucc

SEQ ID NO: 405537 - RNA, 22 nt, Human
uagagacaugguuucgccaugu

SEQ ID NO: 405538 - RNA, 24 nt, Human
uaguagagacaugguuucgccaug

SEQ ID NO: 405539 - RNA, 21 nt, Human
uaguuugaccaacaguugacc

SEQ ID NO: 405540 - RNA, 19 nt, Human
ucaagcgauccuccugccu

SEQ ID NO: 405541 - RNA, 24 nt, Human
ucacugcagucuccacuuccuggg

SEQ ID NO: 405542 - RNA, 23 nt, Human
ucagccucccgaguagcugggac

SEQ ID NO: 405543 - RNA, 22 nt, Human
uccagcaaagcgaagauggcaa

SEQ ID NO: 405544 - RNA, 24 nt, Human
ucccaaaguguugggauuacaggc

SEQ ID NO: 405545 - RNA, 24 nt, Human
ucccgaguagcugggacuacaggc

SEQ ID NO: 405546 - RNA, 21 nt, Human
ucccugaaguauggaaaugaa

SEQ ID NO: 405547 - RNA, 21 nt, Human
uccuggguucaagcgauccuc

SEQ ID NO: 405548 - RNA, 24 nt, Human
uccuggguucaagcgauccuccug

SEQ ID NO: 405549 - RNA, 22 nt, Human
ucgccauguuggcugggcuggu

SEQ ID NO: 405550 - RNA, 24 nt, Human
ucgccauguuggcugggcuggucu

SEQ ID NO: 405551 - RNA, 24 nt, Human
ucucacucugucgaccaggcugga

SEQ ID NO: 405552 - RNA, 21 nt, Human
ucucgaacuccugaccucaag

SEQ ID NO: 405553 - RNA, 18 nt, Human
ugaaaaaaaaagggaagg

SEQ ID NO: 405554 - RNA, 18 nt, Human
ugaaggaaauaugcaaaa

SEQ ID NO: 405555 - RNA, 19 nt, Human
ugaccucaagugaucuguc

SEQ ID NO: 405556 - RNA, 20 nt, Human
ugaccucaagugaucugucc

SEQ ID NO: 405557 - RNA, 21 nt, Human
ugaccucaagugaucuguccu

SEQ ID NO: 405558 - RNA, 22 nt, Human
ugacuucccacaauagccaccc

SEQ ID NO: 405559 - RNA, 24 nt, Human
ugacuucccacaauagccaccccc

SEQ ID NO: 405560 - RNA, 22 nt, Human
ugagauggagucucacucuguc

SEQ ID NO: 405561 - RNA, 23 nt, Human
ugccuauucucccaggaaccaaa

SEQ ID NO: 405562 - RNA, 24 nt, Human
ugccucagccucccgaguagcugg

SEQ ID NO: 405563 - RNA, 24 nt, Human
uggauggaaaaucccuacccaugu

SEQ ID NO: 405564 - RNA, 21 nt, Human
uggcucuggauggaaaauccc

SEQ ID NO: 405565 - RNA, 24 nt, Human
uggcugggcuggucucgaacuccu

SEQ ID NO: 405566 - RNA, 22 nt, Human
ugggacuacaggcaggcgucac

SEQ ID NO: 405567 - RNA, 24 nt, Human
ugggacuacaggcaggcgucacca

SEQ ID NO: 405568 - RNA, 19 nt, Human
ugggauuacaggcgaaagc

SEQ ID NO: 405569 - RNA, 25 nt, Human
ugggccaguuuuuaaucucugcugc

SEQ ID NO: 405570 - RNA, 23 nt, Human
uggguucaagcgauccuccugcc

SEQ ID NO: 405571 - RNA, 24 nt, Human
uggugcgauaucggcucacugcag

SEQ ID NO: 405572 - RNA, 19 nt, Human
uguccugcaugguggagag

SEQ ID NO: 405573 - RNA, 21 nt, Human
ugucgaccaggcuggagcgcu

SEQ ID NO: 405574 - RNA, 20 nt, Human
uguugggauuacaggcgaaa

SEQ ID NO: 405575 - RNA, 20 nt, Human
uuaccaucuauuaauuacua

SEQ ID NO: 405576 - RNA, 24 nt, Human
uuaguagagacaugguuucgccau

SEQ ID NO: 405577 - RNA, 21 nt, Human
uuauuggcucuggauggaaaa

SEQ ID NO: 405578 - RNA, 21 nt, Human
uucaagcgauccuccugccuc

SEQ ID NO: 405579 - RNA, 24 nt, Human
uucaagcgauccuccugccucagc

SEQ ID NO: 405580 - RNA, 22 nt, Human
uucauaauuugcuugacauuuc

SEQ ID NO: 405581 - RNA, 24 nt, Human
uuucgccauguuggcugggcuggu

SEQ ID NO: 405582 - RNA, 27 nt, Human
uuuuauuuuuucuugagauggagucuu

SEQ ID NO: 405583 - RNA, 22 nt, Human
uuuuuaguagagacaugguuuc

SEQ ID NO: 405584 - RNA, 20 nt, Human
uuuuuguauuuuuaguagag

SEQ ID NO: 405585 - RNA, 22 nt, Human
aaacagccaugaauccagcucu

SEQ ID NO: 405586 - RNA, 19 nt, Human
aacauggugaaaccccguc

SEQ ID NO: 405587 - RNA, 20 nt, Human
aacauggugaaaccccgucu

SEQ ID NO: 405588 - RNA, 21 nt, Human
aacauggugaaaccccgucuc

SEQ ID NO: 405589 - RNA, 24 nt, Human
aaccacccgaacccgggaggcaga

SEQ ID NO: 405590 - RNA, 19 nt, Human
aaccuugcauuaacaaccu

SEQ ID NO: 405591 - RNA, 21 nt, Human
aagcagcugggaccacaggca

SEQ ID NO: 405592 - RNA, 24 nt, Human
aagcagcugggaccacaggcacgc

SEQ ID NO: 405593 - RNA, 20 nt, Human
aaucuccucuccaaaggagc

SEQ ID NO: 405594 - RNA, 21 nt, Human
aauggcucauaccuguaaucc

SEQ ID NO: 405595 - RNA, 24 nt, Human
aauggcucauaccuguaauccuag

SEQ ID NO: 405596 - RNA, 20 nt, Human
acaagaacgaaacuccaucu

SEQ ID NO: 405597 - RNA, 21 nt, Human
acaagaacgaaacuccaucuc

SEQ ID NO: 405598 - RNA, 20 nt, Human
acaccugcaaucccagccac

SEQ ID NO: 405599 - RNA, 24 nt, Human
accaacauggugaaaccccgucuc

SEQ ID NO: 405600 - RNA, 22 nt, Human
accacugcacuccagguugggc

SEQ ID NO: 405601 - RNA, 25 nt, Human
accacugcacuccagguugggcaac

SEQ ID NO: 405602 - RNA, 18 nt, Human
accccgucuccacuaaaa

SEQ ID NO: 405603 - RNA, 23 nt, Human
acccugucucuacauaaaaguaa

SEQ ID NO: 405604 - RNA, 18 nt, Human
accuguaauccuagcacu

SEQ ID NO: 405605 - RNA, 21 nt, Human
accuguaauccuagcacuuug

SEQ ID NO: 405606 - RNA, 23 nt, Human
accuguaauccuagcacuuuggg

SEQ ID NO: 405607 - RNA, 26 nt, Human
acgaaacuccaucucaaaaaaauaaa

SEQ ID NO: 405608 - RNA, 19 nt, Human
acugcaaccuccgcccccc

SEQ ID NO: 405609 - RNA, 21 nt, Human
acugcacuccagguugggcaa

SEQ ID NO: 405610 - RNA, 25 nt, Human
acugcacuccagguugggcaacaag

SEQ ID NO: 405611 - RNA, 25 nt, Human
agaagcaagaaucacugugagcaag

SEQ ID NO: 405612 - RNA, 22 nt, Human
agacaggaggacugcuugaggc

SEQ ID NO: 405613 - RNA, 18 nt, Human
agagguugcagugagccg

SEQ ID NO: 405614 - RNA, 24 nt, Human
agagguugcagugagccgagaccg

SEQ ID NO: 405615 - RNA, 24 nt, Human
agcacuuugggaggccgagguggg

SEQ ID NO: 405616 - RNA, 24 nt, Human
agccugaccaacauggugaaaccc

SEQ ID NO: 405617 - RNA, 21 nt, Human
aggcagagguugcagugagcc

SEQ ID NO: 405618 - RNA, 24 nt, Human
aggcagagguugcagugagccgag

SEQ ID NO: 405619 - RNA, 18 nt, Human
aggcaggagaaccacccg

SEQ ID NO: 405620 - RNA, 24 nt, Human
aggcaggagaaccacccgaacccg

SEQ ID NO: 405621 - RNA, 21 nt, Human
aggccgagguggguagaucac

SEQ ID NO: 405622 - RNA, 24 nt, Human
aggugcaguggcucacgccuguaa

SEQ ID NO: 405623 - RNA, 22 nt, Human
agguggguagaucaccugaggu

SEQ ID NO: 405624 - RNA, 19 nt, Human
aguacagaguuauagagga

SEQ ID NO: 405625 - RNA, 24 nt, Human
aguggcucacgccuguaaucccag

SEQ ID NO: 405626 - RNA, 21 nt, Human
auaaaaaacaacaauugccaa

SEQ ID NO: 405627 - RNA, 20 nt, Human
auaaaacaaaauaaaugcca

SEQ ID NO: 405628 - RNA, 26 nt, Human
augcgugcacacacacacguaacucg

SEQ ID NO: 405629 - RNA, 22 nt, Human
caacaaagugagacccugucuc

SEQ ID NO: 405630 - RNA, 24 nt, Human
caacauggugaaaccccgucucca

SEQ ID NO: 405631 - RNA, 24 nt, Human
caaccuccgccccccagguccaag

SEQ ID NO: 405632 - RNA, 25 nt, Human
caagacaggaggacugcuugaggcc

SEQ ID NO: 405633 - RNA, 22 nt, Human
caagugauucucccgccucagc

SEQ ID NO: 405634 - RNA, 27 nt, Human
caagugauucucccgccucagcccccc

SEQ ID NO: 405635 - RNA, 25 nt, Human
cacaaaaaacuagccgggcguggug

SEQ ID NO: 405636 - RNA, 18 nt, Human
cacaccugcaaucccagc

SEQ ID NO: 405637 - RNA, 23 nt, Human
cacaggcacgcgccaccacgccc

SEQ ID NO: 405638 - RNA, 21 nt, Human
cacaucauaaucuccucucca

SEQ ID NO: 405639 - RNA, 24 nt, Human
caccacugcacuccagguugggca

SEQ ID NO: 405640 - RNA, 19 nt, Human
caccuuugucucacaagca

SEQ ID NO: 405641 - RNA, 24 nt, Human
cacgccuguaaucccagcacuuug

SEQ ID NO: 405642 - RNA, 20 nt, Human
cacugcaaccuccgcccccc

SEQ ID NO: 405643 - RNA, 18 nt, Human
cacugcacuccagguugg

SEQ ID NO: 405644 - RNA, 19 nt, Human
cacugcacuccagguuggg

SEQ ID NO: 405645 - RNA, 23 nt, Human
cacugcacuccagguugggcaac

SEQ ID NO: 405646 - RNA, 24 nt, Human
cacugcacuccagguugggcaaca

SEQ ID NO: 405647 - RNA, 24 nt, Human
cagagucuugcucuguugcccagg

SEQ ID NO: 405648 - RNA, 30 nt, Human
cagcacaugugcgugcaugcgugcacacag

SEQ ID NO: 405649 - RNA, 24 nt, Human
cagcacuuugggaggccgaggugg

SEQ ID NO: 405650 - RNA, 24 nt, Human
cagccacucaggaggccgaggcag

SEQ ID NO: 405651 - RNA, 25 nt, Human
cagccaugaauccagcucuaaguac

SEQ ID NO: 405652 - RNA, 18 nt, Human
cagcgugggcaacaaagu

SEQ ID NO: 405653 - RNA, 24 nt, Human
caggaggccgaggcaggagaacca

SEQ ID NO: 405654 - RNA, 21 nt, Human
caguagagacgggguugcuuu

SEQ ID NO: 405655 - RNA, 25 nt, Human
caguagagacgggguugcuuuucua

SEQ ID NO: 405656 - RNA, 24 nt, Human
caguguuaaaggggaccccaaacc

SEQ ID NO: 405657 - RNA, 23 nt, Human
cauaaaaguaaaaucaaaagucu

SEQ ID NO: 405658 - RNA, 22 nt, Human
cauaauaaacagccaugaaucc

SEQ ID NO: 405659 - RNA, 20 nt, Human
caucauaaucuccucuccaa

SEQ ID NO: 405660 - RNA, 19 nt, Human
ccaagugauucucccgccu

SEQ ID NO: 405661 - RNA, 20 nt, Human
ccacugcacuccagguuggg

SEQ ID NO: 405662 - RNA, 21 nt, Human
ccacugcacuccagguugggc

SEQ ID NO: 405663 - RNA, 19 nt, Human
ccccaaaccuugcauuaac

SEQ ID NO: 405664 - RNA, 21 nt, Human
ccccagguccaagugauucuc

SEQ ID NO: 405665 - RNA, 24 nt, Human
ccccccagguccaagugauucucc

SEQ ID NO: 405666 - RNA, 21 nt, Human
cccgucuccacuaaaaacaca

SEQ ID NO: 405667 - RNA, 24 nt, Human
ccgccccccagguccaagugauuc

SEQ ID NO: 405668 - RNA, 23 nt, Human
ccugaccaacauggugaaacccc

SEQ ID NO: 405669 - RNA, 24 nt, Human
ccugaccaacauggugaaaccccg

SEQ ID NO: 405670 - RNA, 24 nt, Human
cgagaucagccugaccaacauggu

SEQ ID NO: 405671 - RNA, 24 nt, Human
cgaggcaggagaaccacccgaacc

SEQ ID NO: 405672 - RNA, 20 nt, Human
cgagguggguagaucaccug

SEQ ID NO: 405673 - RNA, 24 nt, Human
cgagguggguagaucaccugaggu

SEQ ID NO: 405674 - RNA, 26 nt, Human
cgagguggguagaucaccugagguca

SEQ ID NO: 405675 - RNA, 22 nt, Human
cgccccccagguccaagugauu

SEQ ID NO: 405676 - RNA, 21 nt, Human
cgccucagccccccaagcagc

SEQ ID NO: 405677 - RNA, 24 nt, Human
cgccucagccccccaagcagcugg

SEQ ID NO: 405678 - RNA, 23 nt, Human
cgccuguaaucccagcacuuugg

SEQ ID NO: 405679 - RNA, 24 nt, Human
cgccuguaaucccagcacuuuggg

SEQ ID NO: 405680 - RNA, 24 nt, Human
cgggaggcagagguugcagugagc

SEQ ID NO: 405681 - RNA, 22 nt, Human
cuaaaaacacaaaaaacuagcc

SEQ ID NO: 405682 - RNA, 22 nt, Human
cucacgccuguaaucccagcac

SEQ ID NO: 405683 - RNA, 24 nt, Human
cucacgccuguaaucccagcacuu

SEQ ID NO: 405684 - RNA, 24 nt, Human
cucacugcaaccuccgccccccag

SEQ ID NO: 405685 - RNA, 24 nt, Human
cucauaccuguaauccuagcacuu

SEQ ID NO: 405686 - RNA, 22 nt, Human
cucccgccucagccccccaagc

SEQ ID NO: 405687 - RNA, 24 nt, Human
cucccgccucagccccccaagcag

SEQ ID NO: 405688 - RNA, 20 nt, Human
cuccgccccccagguccaag

SEQ ID NO: 405689 - RNA, 26 nt, Human
cuccucuccaaaggagcuacuuuaaa

SEQ ID NO: 405690 - RNA, 23 nt, Human
cugcaaccuccgccccccagguc

SEQ ID NO: 405691 - RNA, 18 nt, Human
gaagcaagaaucacugug

SEQ ID NO: 405692 - RNA, 23 nt, Human
gagaccgcaccacugcacuccag

SEQ ID NO: 405693 - RNA, 22 nt, Human
gagcaggucucagagaagcaag

SEQ ID NO: 405694 - RNA, 20 nt, Human
gaggcaggagaaccacccga

SEQ ID NO: 405695 - RNA, 23 nt, Human
gagguggguagaucaccugaggu

SEQ ID NO: 405696 - RNA, 18 nt, Human
gaucaccugaggucagga

SEQ ID NO: 405697 - RNA, 24 nt, Human
gaucaccugaggucaggagcucga

SEQ ID NO: 405698 - RNA, 22 nt, Human
gcaggagaaccacccgaacccg

SEQ ID NO: 405699 - RNA, 19 nt, Human
gcauaaucuuucacaucau

SEQ ID NO: 405700 - RNA, 18 nt, Human
gccagcgcaauggcucau

SEQ ID NO: 405701 - RNA, 21 nt, Human
gccccccaagcagcugggacc

SEQ ID NO: 405702 - RNA, 20 nt, Human
gccgagaccgcaccacugca

SEQ ID NO: 405703 - RNA, 25 nt, Human
gcucuguugcccaggcuggcgugca

SEQ ID NO: 405704 - RNA, 21 nt, Human
ggagaaccacccgaacccggg

SEQ ID NO: 405705 - RNA, 23 nt, Human
ggagcaggucucagagaagcaag

SEQ ID NO: 405706 - RNA, 27 nt, Human
ggccgaggcaggagaaccacccgaacc

SEQ ID NO: 405707 - RNA, 21 nt, Human
ggcgugguggcgcacaccugc

SEQ ID NO: 405708 - RNA, 21 nt, Human
gguagaucaccugaggucagg

SEQ ID NO: 405709 - RNA, 24 nt, Human
gucuugcucuguugcccaggcugg

SEQ ID NO: 405710 - RNA, 21 nt, Human
gugauucucccgccucagccc

SEQ ID NO: 405711 - RNA, 23 nt, Human
gugcaguggcacgaucucagcuc

SEQ ID NO: 405712 - RNA, 19 nt, Human
guugcagugagccgagacc

SEQ ID NO: 405713 - RNA, 25 nt, Human
uaaaaacacaaaaaacuagccgggc

SEQ ID NO: 405714 - RNA, 22 nt, Human
uaaacagccaugaauccagcuc

SEQ ID NO: 405715 - RNA, 18 nt, Human
uacauggagaaaccaugu

SEQ ID NO: 405716 - RNA, 24 nt, Human
uagaucaccugaggucaggagcuc

SEQ ID NO: 405717 - RNA, 26 nt, Human
uagaucaccugaggucaggagcucga

SEQ ID NO: 405718 - RNA, 20 nt, Human
uagcacuuuggguggccaag

SEQ ID NO: 405719 - RNA, 18 nt, Human
uagccgggcgugguggcg

SEQ ID NO: 405720 - RNA, 23 nt, Human
uauauacauggagaaaccaugug

SEQ ID NO: 405721 - RNA, 19 nt, Human
ucaccugaggucaggagcu

SEQ ID NO: 405722 - RNA, 18 nt, Human
ucacugcaaccuccgccc

SEQ ID NO: 405723 - RNA, 24 nt, Human
ucacugcaaccuccgccccccagg

SEQ ID NO: 405724 - RNA, 27 nt, Human
ucacugcaaccuccgccccccaggucc

SEQ ID NO: 405725 - RNA, 18 nt, Human
ucagccccccaagcagcu

SEQ ID NO: 405726 - RNA, 20 nt, Human
ucagccccccaagcagcugg

SEQ ID NO: 405727 - RNA, 20 nt, Human
ucagccugaccaacauggug

SEQ ID NO: 405728 - RNA, 27 nt, Human
ucagcucacugcaaccuccgcccccca

SEQ ID NO: 405729 - RNA, 26 nt, Human
ucaggccaggugcaguggcucacgcc

SEQ ID NO: 405730 - RNA, 20 nt, Human
ucaguagagacgggguugcu

SEQ ID NO: 405731 - RNA, 23 nt, Human
uccaagugauucucccgccucag

SEQ ID NO: 405732 - RNA, 24 nt, Human
uccaagugauucucccgccucagc

SEQ ID NO: 405733 - RNA, 25 nt, Human
ucucuggagagaauuguguuggucc

SEQ ID NO: 405734 - RNA, 24 nt, Human
ucuguugcccaggcuggcgugcag

SEQ ID NO: 405735 - RNA, 18 nt, Human
ucuugcucuguugcccag

SEQ ID NO: 405736 - RNA, 19 nt, Human
ucuugcucuguugcccagg

SEQ ID NO: 405737 - RNA, 23 nt, Human
ucuugcucuguugcccaggcugg

SEQ ID NO: 405738 - RNA, 27 nt, Human
ucuugcucuguugcccaggcuggcgug

SEQ ID NO: 405739 - RNA, 22 nt, Human
ugaaaccccgucuccacuaaaa

SEQ ID NO: 405740 - RNA, 22 nt, Human
ugacaagacauaucucugggga

SEQ ID NO: 405741 - RNA, 24 nt, Human
ugaccaacauggugaaaccccguc

SEQ ID NO: 405742 - RNA, 18 nt, Human
ugagacagagucuugcuc

SEQ ID NO: 405743 - RNA, 22 nt, Human
ugagacagagucuugcucuguu

SEQ ID NO: 405744 - RNA, 24 nt, Human
ugaguaaaagacaaggguuuauag

SEQ ID NO: 405745 - RNA, 19 nt, Human
ugauacaggcagaguuggg

SEQ ID NO: 405746 - RNA, 21 nt, Human
ugcaugcgugcacacacacac

SEQ ID NO: 405747 - RNA, 21 nt, Human
ugcauugcauuuugaaauauu

SEQ ID NO: 405748 - RNA, 18 nt, Human
ugcccaggcuggcgugca

SEQ ID NO: 405749 - RNA, 26 nt, Human
ugcgugcaugcgugcacacacacacg

SEQ ID NO: 405750 - RNA, 22 nt, Human
ugcucuguugcccaggcuggcg

SEQ ID NO: 405751 - RNA, 19 nt, Human
uggagaaaccaugugaaaa

SEQ ID NO: 405752 - RNA, 24 nt, Human
uggcacgaucucagcucacugcaa

SEQ ID NO: 405753 - RNA, 22 nt, Human
uggcgcacaccugcaaucccag

SEQ ID NO: 405754 - RNA, 24 nt, Human
uggcgugcaguggcacgaucucag

SEQ ID NO: 405755 - RNA, 24 nt, Human
uggcucacgccuguaaucccagca

SEQ ID NO: 405756 - RNA, 19 nt, Human
uggcucauaccuguaaucc

SEQ ID NO: 405757 - RNA, 24 nt, Human
uggcucauaccuguaauccuagca

SEQ ID NO: 405758 - RNA, 20 nt, Human
uggcuucugaagcccacagu

SEQ ID NO: 405759 - RNA, 20 nt, Human
ugggaauguuuguuccauau

SEQ ID NO: 405760 - RNA, 22 nt, Human
ugggaauguuuguuccauauag

SEQ ID NO: 405761 - RNA, 21 nt, Human
ugggaccacaggcacgcgcca

SEQ ID NO: 405762 - RNA, 24 nt, Human
ugggaccacaggcacgcgccacca

SEQ ID NO: 405763 - RNA, 20 nt, Human
ugggaggccgagguggguag

SEQ ID NO: 405764 - RNA, 24 nt, Human
ugggaggccgagguggguagauca

SEQ ID NO: 405765 - RNA, 24 nt, Human
ugggcaacaaagugagacccuguc

SEQ ID NO: 405766 - RNA, 24 nt, Human
uggguagaucaccugaggucagga

SEQ ID NO: 405767 - RNA, 18 nt, Human
uguuggguaguacagagu

SEQ ID NO: 405768 - RNA, 24 nt, Human
uuaguuguuggguaguacagaguu

SEQ ID NO: 405769 - RNA, 25 nt, Human
uucuaaauuucauaaagaaugucag

SEQ ID NO: 405770 - RNA, 18 nt, Human
uucucccgccucagcccc

SEQ ID NO: 405771 - RNA, 21 nt, Human
uugaacccuacugaaauguua

SEQ ID NO: 405772 - RNA, 18 nt, Human
uugcagugagccgagacc

SEQ ID NO: 405773 - RNA, 18 nt, Human
uugcagugagccgagacc

SEQ ID NO: 405774 - RNA, 20 nt, Human
uugcagugagccgagaccgc

SEQ ID NO: 405775 - RNA, 18 nt, Human
uugcccaggcuggcgugc

SEQ ID NO: 405776 - RNA, 25 nt, Human
uugggaggccgagguggguagauca

SEQ ID NO: 405777 - RNA, 21 nt, Human
agcuauaacauuuauucaucc

SEQ ID NO: 405778 - RNA, 24 nt, Human
agcuguucugcaguguccugccac

SEQ ID NO: 405779 - RNA, 19 nt, Human
ucguccugcugauuuccga

SEQ ID NO: 405780 - RNA, 20 nt, Human
uggaaaagagucguacggug

SEQ ID NO: 405781 - RNA, 21 nt, Human
ugggaacaugaagcuguucug

SEQ ID NO: 405782 - RNA, 19 nt, Human
uuugggaacaugaagcugu

SEQ ID NO: 405783 - RNA, 22 nt, Human
aaaaaaaaauucuggaaaugaa

SEQ ID NO: 405784 - RNA, 18 nt, Human
aagaagcuucaauauuca

SEQ ID NO: 405785 - RNA, 24 nt, Human
aauguaaacauuugccaaaaaaaa

SEQ ID NO: 405786 - RNA, 22 nt, Human
acaauaccugauaaagauucag

SEQ ID NO: 405787 - RNA, 19 nt, Human
accucaagaggaugugaaa

SEQ ID NO: 405788 - RNA, 21 nt, Human
auacaauugaaaaaaauuaaa

SEQ ID NO: 405789 - RNA, 21 nt, Human
caaaaccuaucaugcauguca

SEQ ID NO: 405790 - RNA, 24 nt, Human
cauuugccaaaaaaaaaaaaaaaa

SEQ ID NO: 405791 - RNA, 23 nt, Human
ccaaaaaaaaaaaaaaaaaaaaa

SEQ ID NO: 405792 - RNA, 21 nt, Human
ccuaggugcuggcaggcaggg

SEQ ID NO: 405793 - RNA, 24 nt, Human
cuuccaaaaccuaucaugcauguc

SEQ ID NO: 405794 - RNA, 24 nt, Human
gaauguaaacauuugccaaaaaaa

SEQ ID NO: 405795 - RNA, 18 nt, Human
gagcacguuaaaacccug

SEQ ID NO: 405796 - RNA, 21 nt, Human
gccaaaaaaaaaaaaaaaaaa

SEQ ID NO: 405797 - RNA, 21 nt, Human
ggcauuaagaaaacaccauga

SEQ ID NO: 405798 - RNA, 23 nt, Human
ggugcuggcaggcagggcacauc

SEQ ID NO: 405799 - RNA, 23 nt, Human
uaaaaaugccacaaauuuguuuu

SEQ ID NO: 405800 - RNA, 31 nt, Human
uaaacauuugccaaaaaaaaaaaaaaaaaaa

SEQ ID NO: 405801 - RNA, 25 nt, Human
uaagaaaacaccaugaugucagagg

SEQ ID NO: 405802 - RNA, 20 nt, Human
uacacauguauucauagagu

SEQ ID NO: 405803 - RNA, 24 nt, Human
ucauaagcugcaacccaacucgaa

SEQ ID NO: 405804 - RNA, 18 nt, Human
ucuagauuuacauguauu

SEQ ID NO: 405805 - RNA, 27 nt, Human
ugaaaacaugcauuagacuaaaaaugc

SEQ ID NO: 405806 - RNA, 18 nt, Human
ugaauguaaacauuugcc

SEQ ID NO: 405807 - RNA, 21 nt, Human
ugacuugccuguaauuacccc

SEQ ID NO: 405808 - RNA, 19 nt, Human
ugccaaaaaaaaaaaaaaa

SEQ ID NO: 405809 - RNA, 18 nt, Human
uggaugaaaacaugcauu

SEQ ID NO: 405810 - RNA, 24 nt, Human
uggcaggcagggcacauccccucu

SEQ ID NO: 405811 - RNA, 21 nt, Human
ugugaaaaugacuugccugua

SEQ ID NO: 405812 - RNA, 21 nt, Human
uuuaaggccuucauacaauug

SEQ ID NO: 405813 - RNA, 21 nt, Human
aaacagauuugauaaucuuau

SEQ ID NO: 405814 - RNA, 19 nt, Human
aaucgaguccacccucagc

SEQ ID NO: 405815 - RNA, 20 nt, Human
accagcaggacccagacgcc

SEQ ID NO: 405816 - RNA, 18 nt, Human
aucgaguccacccucagc

SEQ ID NO: 405817 - RNA, 24 nt, Human
caacagcaccucaccgcccgcgac

SEQ ID NO: 405818 - RNA, 26 nt, Human
caacagcaccucaccgcccgcgaccg

SEQ ID NO: 405819 - RNA, 28 nt, Human
caacagcaccucaccgcccgcgacuggu

SEQ ID NO: 405820 - RNA, 24 nt, Human
cagcaccucaccgcccgcgaccga

SEQ ID NO: 405821 - RNA, 22 nt, Human
caguggcagcggccgacggggu

SEQ ID NO: 405822 - RNA, 22 nt, Human
cccgagcucagaggcuaucccu

SEQ ID NO: 405823 - RNA, 24 nt, Human
ccgacgggguagaagcggagaaga

SEQ ID NO: 405824 - RNA, 20 nt, Human
ccgccgccucuaucaccucg

SEQ ID NO: 405825 - RNA, 27 nt, Human
ccucgcucgguggcucgcgcgcgcccg

SEQ ID NO: 405826 - RNA, 21 nt, Human
cgccggagacucccgcggcgg

SEQ ID NO: 405827 - RNA, 19 nt, Human
cggcgggacccugggaaau

SEQ ID NO: 405828 - RNA, 24 nt, Human
gagaagaaaggcgaagaccagcag

SEQ ID NO: 405829 - RNA, 18 nt, Human
gcccgccggagacucccg

SEQ ID NO: 405830 - RNA, 21 nt, Human
gcucagaggcuaucccugauc

SEQ ID NO: 405831 - RNA, 23 nt, Human
ggcgaagaccagcaggacccaga

SEQ ID NO: 405832 - RNA, 21 nt, Human
gggaccccaguggcagcggcc

SEQ ID NO: 405833 - RNA, 19 nt, Human
gggacccugggaaaucgag

SEQ ID NO: 405834 - RNA, 20 nt, Human
gggguagaagcggagaagaa

SEQ ID NO: 405835 - RNA, 21 nt, Human
ucgcgcgcgcccgcccgccgg

SEQ ID NO: 405836 - RNA, 22 nt, Human
ugaguauaccaguuuauauaua

SEQ ID NO: 405837 - RNA, 26 nt, Human
uucagcaacagcaccucaccgcccgc

SEQ ID NO: 405838 - RNA, 23 nt, Human
agagagcagggggcuuaggacag

SEQ ID NO: 405839 - RNA, 22 nt, Human
agagcagggggcuuaggacagg

SEQ ID NO: 405840 - RNA, 23 nt, Human
aggacagggaagggggcucagga

SEQ ID NO: 405841 - RNA, 22 nt, Human
aggaggggcuggcucuccagug

SEQ ID NO: 405842 - RNA, 19 nt, Human
aggggagggccggagggcc

SEQ ID NO: 405843 - RNA, 21 nt, Human
agggggcuuaggacaggaagg

SEQ ID NO: 405844 - RNA, 19 nt, Human
caccccaggccugacucac

SEQ ID NO: 405845 - RNA, 21 nt, Human
caccuggguaggaagcagugg

SEQ ID NO: 405846 - RNA, 18 nt, Human
caggacggggcagggaag

SEQ ID NO: 405847 - RNA, 18 nt, Human
caugagucccuccgggug

SEQ ID NO: 405848 - RNA, 18 nt, Human
ccaccaccagcugccugg

SEQ ID NO: 405849 - RNA, 19 nt, Human
ccacgcccgccugcagcca

SEQ ID NO: 405850 - RNA, 21 nt, Human
ccacgcccgccugcagccagg

SEQ ID NO: 405851 - RNA, 23 nt, Human
ccacgcccgccugcagccaggug

SEQ ID NO: 405852 - RNA, 22 nt, Human
cccaccaccagcugccugggca

SEQ ID NO: 405853 - RNA, 19 nt, Human
cccguguaggcgccaaggu

SEQ ID NO: 405854 - RNA, 22 nt, Human
ccucaggacaggggaaggggcu

SEQ ID NO: 405855 - RNA, 22 nt, Human
ccuugcacaccaggggcccucc

SEQ ID NO: 405856 - RNA, 19 nt, Human
cgcccuggcaugagucccu

SEQ ID NO: 405857 - RNA, 22 nt, Human
cuccagugacccagguggacac

SEQ ID NO: 405858 - RNA, 18 nt, Human
gccccagcugaccacgcc

SEQ ID NO: 405859 - RNA, 20 nt, Human
gcuuuuuggggacauagugg

SEQ ID NO: 405860 - RNA, 20 nt, Human
ggcaggggagggccggaggg

SEQ ID NO: 405861 - RNA, 22 nt, Human
gggcagggaagguguggggggc

SEQ ID NO: 405862 - RNA, 18 nt, Human
gggcucagaagagagcag

SEQ ID NO: 405863 - RNA, 18 nt, Human
ggggaaggguccucagga

SEQ ID NO: 405864 - RNA, 21 nt, Human
ggggaccuucaccugcuucag

SEQ ID NO: 405865 - RNA, 25 nt, Human
ggggcagggaagguguggggggcag

SEQ ID NO: 405866 - RNA, 24 nt, Human
gggggcuuaggacaggaaggggca

SEQ ID NO: 405867 - RNA, 24 nt, Human
ggguaggaagcagugguguuuuga

SEQ ID NO: 405868 - RNA, 19 nt, Human
ucagaagagagcagggggc

SEQ ID NO: 405869 - RNA, 24 nt, Human
uccaaguaguaggugacacgggug

SEQ ID NO: 405870 - RNA, 24 nt, Human
ucucccguguaggcgccaaggugg

SEQ ID NO: 405871 - RNA, 21 nt, Human
ugcagccaggugccauucacc

SEQ ID NO: 405872 - RNA, 18 nt, Human
ugccugggcaggggaggg

SEQ ID NO: 405873 - RNA, 20 nt, Human
ugccugggcaggggagggcc

SEQ ID NO: 405874 - RNA, 19 nt, Human
ugggcugggcacagcccuc

SEQ ID NO: 405875 - RNA, 23 nt, Human
agagagcagggggcuuaggacag

SEQ ID NO: 405876 - RNA, 22 nt, Human
agagcagggggcuuaggacagg

SEQ ID NO: 405877 - RNA, 23 nt, Human
aggacagggaagggggcucagga

SEQ ID NO: 405878 - RNA, 21 nt, Human
agggggcuuaggacaggaagg

SEQ ID NO: 405879 - RNA, 21 nt, Human
caccuggguaggaagcagugg

SEQ ID NO: 405880 - RNA, 18 nt, Human
caggacggggcagggaag

SEQ ID NO: 405881 - RNA, 25 nt, Human
ccagugggcucuccccuccccauuu

SEQ ID NO: 405882 - RNA, 22 nt, Human
cccaccaccagcuaucugggca

SEQ ID NO: 405883 - RNA, 22 nt, Human
ccucaggacaggggaaggggcu

SEQ ID NO: 405884 - RNA, 24 nt, Human
gaagggggcucaggauagggaagg

SEQ ID NO: 405885 - RNA, 20 nt, Human
gcuuaggacaggaaggggca

SEQ ID NO: 405886 - RNA, 20 nt, Human
ggcaggggagggcuggaggg

SEQ ID NO: 405887 - RNA, 22 nt, Human
gggcagggaagguguggggggc

SEQ ID NO: 405888 - RNA, 18 nt, Human
gggcucagaagagagcag

SEQ ID NO: 405889 - RNA, 25 nt, Human
ggggcagggaagguguggggggcag

SEQ ID NO: 405890 - RNA, 24 nt, Human
ggguaggaagcagugguguuuugg

SEQ ID NO: 405891 - RNA, 19 nt, Human
ucagaagagagcagggggc

SEQ ID NO: 405892 - RNA, 25 nt, Human
ucccuguuccuucuacccagugggc

SEQ ID NO: 405893 - RNA, 21 nt, Human
uggacagcagggguugguccu

SEQ ID NO: 405894 - RNA, 19 nt, Human
ugguccuccagugacccag

SEQ ID NO: 405895 - RNA, 24 nt, Human
ugguguuuuggacagcagggguug

SEQ ID NO: 405896 - RNA, 19 nt, Human
uuuuggacagcagggguug

SEQ ID NO: 405897 - RNA, 22 nt, Human
aaagauaaccaacaucugggau

SEQ ID NO: 405898 - RNA, 19 nt, Human
aacuucucagaaacaauac

SEQ ID NO: 405899 - RNA, 21 nt, Human
aagcgccggcagcugccagcc

SEQ ID NO: 405900 - RNA, 19 nt, Human
aauccuaggaauuucccuu

SEQ ID NO: 405901 - RNA, 18 nt, Human
agaaaagagaacaagagg

SEQ ID NO: 405902 - RNA, 19 nt, Human
agaaagauaaccaacaucu

SEQ ID NO: 405903 - RNA, 22 nt, Human
agccuggaccggccccgcagag

SEQ ID NO: 405904 - RNA, 20 nt, Human
auaauguaagaaaagagaac

SEQ ID NO: 405905 - RNA, 19 nt, Human
caacuucucagaaacaaua

SEQ ID NO: 405906 - RNA, 26 nt, Human
caacuucucagaaacaauacaaugaa

SEQ ID NO: 405907 - RNA, 19 nt, Human
cacaucaauacacuuaaac

SEQ ID NO: 405908 - RNA, 21 nt, Human
cacaucaauacacuuaaacag

SEQ ID NO: 405909 - RNA, 19 nt, Human
cagcagcgucucccgcggc

SEQ ID NO: 405910 - RNA, 23 nt, Human
caggcacacguguucuacaaaac

SEQ ID NO: 405911 - RNA, 21 nt, Human
ccaaggugcagacgcuccacc

SEQ ID NO: 405912 - RNA, 19 nt, Human
cccaacuucucagaaacaa

SEQ ID NO: 405913 - RNA, 23 nt, Human
cccgcaaccgaagccgccucagc

SEQ ID NO: 405914 - RNA, 25 nt, Human
cccgcaaccgaagccgccucagcag

SEQ ID NO: 405915 - RNA, 23 nt, Human
ccgcccucaccgccaagcgccgg

SEQ ID NO: 405916 - RNA, 20 nt, Human
ccuggacggcauccuggccu

SEQ ID NO: 405917 - RNA, 24 nt, Human
ccuggacggcauccuggccucagc

SEQ ID NO: 405918 - RNA, 18 nt, Human
ccuggccucagccgcugg

SEQ ID NO: 405919 - RNA, 23 nt, Human
ccuggccucagccgcugguccca

SEQ ID NO: 405920 - RNA, 19 nt, Human
ccuucugggcuccuuacug

SEQ ID NO: 405921 - RNA, 22 nt, Human
cgacccgcaaccgaagccgccu

SEQ ID NO: 405922 - RNA, 26 nt, Human
cucaccgccaagcgccggcagcugcc

SEQ ID NO: 405923 - RNA, 23 nt, Human
cugaaaaggcagcaaucuuuccu

SEQ ID NO: 405924 - RNA, 24 nt, Human
gacccgcaaccgaagccgccucag

SEQ ID NO: 405925 - RNA, 24 nt, Human
gcagaucccucacgaggcccaaag

SEQ ID NO: 405926 - RNA, 21 nt, Human
gccuggaccggccccgcagag

SEQ ID NO: 405927 - RNA, 18 nt, Human
gcggacaccuccauccuc

SEQ ID NO: 405928 - RNA, 26 nt, Human
ggaaacacauguuccuucugggcucc

SEQ ID NO: 405929 - RNA, 21 nt, Human
ggccucagccgcuggucccac

SEQ ID NO: 405930 - RNA, 24 nt, Human
uaaacccucuccuugaaaacaaac

SEQ ID NO: 405931 - RNA, 19 nt, Human
uaggaauuucccuucugcu

SEQ ID NO: 405932 - RNA, 21 nt, Human
ucacgaggcccaaagcugugc

SEQ ID NO: 405933 - RNA, 19 nt, Human
uccaccaagcuuggcaggg

SEQ ID NO: 405934 - RNA, 21 nt, Human
ugaaaucgggaucaagagcuc

SEQ ID NO: 405935 - RNA, 20 nt, Human
ugcggacaccuccauccucu

SEQ ID NO: 405936 - RNA, 19 nt, Human
uggcaaaugcacaggcggc

SEQ ID NO: 405937 - RNA, 19 nt, Human
uggcaggggacagccaauc

SEQ ID NO: 405938 - RNA, 20 nt, Human
ugggaggaaacuggcaaaug

SEQ ID NO: 405939 - RNA, 20 nt, Human
uggggggccacucgggagcc

SEQ ID NO: 405940 - RNA, 20 nt, Human
uucacauugaaagcuuuuau

SEQ ID NO: 405941 - RNA, 21 nt, Human
uucaggccauggacagucuac

SEQ ID NO: 405942 - RNA, 20 nt, Human
uuuuuuuuuuuuuuuugcuu

SEQ ID NO: 405943 - RNA, 21 nt, Human
aaagccaccaaggcaguccug

SEQ ID NO: 405944 - RNA, 22 nt, Human
aaagugaggcacaaacaaauga

SEQ ID NO: 405945 - RNA, 19 nt, Human
aacaaagccaccaaggcag

SEQ ID NO: 405946 - RNA, 19 nt, Human
aaguuucaaaagccggacu

SEQ ID NO: 405947 - RNA, 23 nt, Human
acccuggaguguccagagauaga

SEQ ID NO: 405948 - RNA, 21 nt, Human
aguauuuuuuuccucugugaa

SEQ ID NO: 405949 - RNA, 20 nt, Human
caaacaaagccaccaaggca

SEQ ID NO: 405950 - RNA, 27 nt, Human
caagcaauaugcuuggauuagaggucc

SEQ ID NO: 405951 - RNA, 25 nt, Human
ccaaggcaguccugcaaauuaagga

SEQ ID NO: 405952 - RNA, 21 nt, Human
ccagcaaacaaagccaccaag

SEQ ID NO: 405953 - RNA, 23 nt, Human
cccguggcgagacgcggcgaggc

SEQ ID NO: 405954 - RNA, 18 nt, Human
ccugugugccaaggcugu

SEQ ID NO: 405955 - RNA, 19 nt, Human
ccugugugccaaggcuguc

SEQ ID NO: 405956 - RNA, 24 nt, Human
ccuugggcacucucaucucugggc

SEQ ID NO: 405957 - RNA, 22 nt, Human
cuucagcgacagguuagcgggc

SEQ ID NO: 405958 - RNA, 23 nt, Human
cuucuuggcaaugaagucauuug

SEQ ID NO: 405959 - RNA, 24 nt, Human
gaggaggaaucaaagaaagccuca

SEQ ID NO: 405960 - RNA, 18 nt, Human
gaggauggcaaaucuguc

SEQ ID NO: 405961 - RNA, 19 nt, Human
gaggcagccccacgcaccc

SEQ ID NO: 405962 - RNA, 20 nt, Human
gcggcgaggcagccccacgc

SEQ ID NO: 405963 - RNA, 20 nt, Human
ggaggauggcaaaucugucu

SEQ ID NO: 405964 - RNA, 18 nt, Human
ggcaggguaggccuggcc

SEQ ID NO: 405965 - RNA, 22 nt, Human
ggccggaggcaggguaggccug

SEQ ID NO: 405966 - RNA, 22 nt, Human
ggguaggccuggccugagggcc

SEQ ID NO: 405967 - RNA, 20 nt, Human
ucauauauuaaacucuuaaa

SEQ ID NO: 405968 - RNA, 24 nt, Human
ucauucucuacccuggagugucca

SEQ ID NO: 405969 - RNA, 22 nt, Human
ucuacccuggaguguccagaga

SEQ ID NO: 405970 - RNA, 23 nt, Human
ugaggaggaaucaaagaaagccu

SEQ ID NO: 405971 - RNA, 23 nt, Human
ugaggcacaaacaaaugagccuc

SEQ ID NO: 405972 - RNA, 24 nt, Human
ugggcacucucaucucugggcucc

SEQ ID NO: 405973 - RNA, 19 nt, Human
uguaaagugaggcacaaac

SEQ ID NO: 405974 - RNA, 21 nt, Human
ugugaaacuagguagaacuga

SEQ ID NO: 405975 - RNA, 21 nt, Human
uucaaaagccggacuacuucc

SEQ ID NO: 405976 - RNA, 25 nt, Human
uuccauacccuucauucucuacccu

SEQ ID NO: 405977 - RNA, 19 nt, Human
uuggcaaugaagucauuug

SEQ ID NO: 405978 - RNA, 18 nt, Human
aagcaaacaaaguguauu

SEQ ID NO: 405979 - RNA, 22 nt, Human
aagcaaacaaaguguauuccac

SEQ ID NO: 405980 - RNA, 19 nt, Human
acuagaaugacagauucag

SEQ ID NO: 405981 - RNA, 19 nt, Human
cacauauaaccaucaagau

SEQ ID NO: 405982 - RNA, 22 nt, Human
cacauauaaccaucaagauacc

SEQ ID NO: 405983 - RNA, 19 nt, Human
ccacauauaaccaucaaga

SEQ ID NO: 405984 - RNA, 21 nt, Human
ccacauauaaccaucaagaua

SEQ ID NO: 405985 - RNA, 24 nt, Human
cggcagggcggcggcuccgccucu

SEQ ID NO: 405986 - RNA, 23 nt, Human
gaaaaaacuuuugcaauaaaaaa

SEQ ID NO: 405987 - RNA, 23 nt, Human
uaaacaauaccacauauaaccau

SEQ ID NO: 405988 - RNA, 19 nt, Human
uagaaugacagauucaggu

SEQ ID NO: 405989 - RNA, 19 nt, Human
ucuuuaggcacagucuggu

SEQ ID NO: 405990 - RNA, 22 nt, Human
ugaagcaaacaaaguguauucc

SEQ ID NO: 405991 - RNA, 21 nt, Human
ugcacaugaagcaaacaaagu

SEQ ID NO: 405992 - RNA, 23 nt, Human
ugccagaaagaacagaaagaguu

SEQ ID NO: 405993 - RNA, 18 nt, Human
ugcccaucaauaaguuug

SEQ ID NO: 405994 - RNA, 18 nt, Human
uguguaauggccuuacau

SEQ ID NO: 405995 - RNA, 21 nt, Human
uguguaauggccuuacaugug

SEQ ID NO: 405996 - RNA, 24 nt, Human
uuaaaaugauuuuugguuaucugc

SEQ ID NO: 405997 - RNA, 19 nt, Human
aaacaaugccuccacucca

SEQ ID NO: 405998 - RNA, 21 nt, Human
aaacucggagcgagcgcggug

SEQ ID NO: 405999 - RNA, 23 nt, Human
aaauaaaucacagucaaaauaaa

SEQ ID NO: 406000 - RNA, 18 nt, Human
acaugacauguuuuucuu

SEQ ID NO: 406001 - RNA, 21 nt, Human
agcacgagccugaaacucgga

SEQ ID NO: 406002 - RNA, 21 nt, Human
cacgagccugaaacucggagc

SEQ ID NO: 406003 - RNA, 19 nt, Human
cagccggagcggcgcucgg

SEQ ID NO: 406004 - RNA, 19 nt, Human
ccggagcggcgcucggggg

SEQ ID NO: 406005 - RNA, 18 nt, Human
cgcggugcagccggagcg

SEQ ID NO: 406006 - RNA, 22 nt, Human
cucaagaugacaucagucccau

SEQ ID NO: 406007 - RNA, 24 nt, Human
gucccauuugucuuaaguccuggu

SEQ ID NO: 406008 - RNA, 21 nt, Human
uaaaaacaaugccuccacucc

SEQ ID NO: 406009 - RNA, 25 nt, Human
uaaaucacagucaaaauaaaugaag

SEQ ID NO: 406010 - RNA, 24 nt, Human
uaaaugcauuuuauuuuuagacaa

SEQ ID NO: 406011 - RNA, 21 nt, Human
uagauccaaaauaauugccac

SEQ ID NO: 406012 - RNA, 18 nt, Human
ucaaaauaaaugaagagc

SEQ ID NO: 406013 - RNA, 21 nt, Human
ugacaucagucccauuugucu

SEQ ID NO: 406014 - RNA, 19 nt, Human
uuuagacaaccuacaugac

SEQ ID NO: 406015 - RNA, 24 nt, Human
aacucuauacaccagacugcuucc

SEQ ID NO: 406016 - RNA, 18 nt, Human
agaagagccuggggugug

SEQ ID NO: 406017 - RNA, 18 nt, Human
agagccgccggggcgcag

SEQ ID NO: 406018 - RNA, 23 nt, Human
aggcgccgggggucccuagagcc

SEQ ID NO: 406019 - RNA, 21 nt, Human
caccagacugcuuccagagcc

SEQ ID NO: 406020 - RNA, 24 nt, Human
cauguauaaacauauauaaacaua

SEQ ID NO: 406021 - RNA, 19 nt, Human
ccucuggguucacuccuga

SEQ ID NO: 406022 - RNA, 20 nt, Human
cuucaagggaacauuuagga

SEQ ID NO: 406023 - RNA, 20 nt, Human
gagccgccggggcgcagcga

SEQ ID NO: 406024 - RNA, 22 nt, Human
gcugcuagaauaacacaagucu

SEQ ID NO: 406025 - RNA, 21 nt, Human
gcuguugugcccuccccgcgg

SEQ ID NO: 406026 - RNA, 24 nt, Human
gguagcagcuguugugcccucccc

SEQ ID NO: 406027 - RNA, 23 nt, Human
ggucagaagagccuggggugugu

SEQ ID NO: 406028 - RNA, 21 nt, Human
guucagcugcuagaauaacac

SEQ ID NO: 406029 - RNA, 18 nt, Human
uaaguguaggcgccgggg

SEQ ID NO: 406030 - RNA, 18 nt, Human
uacaccagacugcuucca

SEQ ID NO: 406031 - RNA, 19 nt, Human
uagauuuauugaagaacau

SEQ ID NO: 406032 - RNA, 18 nt, Human
ucagaagagccuggggug

SEQ ID NO: 406033 - RNA, 23 nt, Human
ucagguagcagcuguugugcccu

SEQ ID NO: 406034 - RNA, 23 nt, Human
ucuauacaccagacugcuuccag

SEQ ID NO: 406035 - RNA, 18 nt, Human
ucuugugucgucggucca

SEQ ID NO: 406036 - RNA, 19 nt, Human
ucuugugucgucgguccaa

SEQ ID NO: 406037 - RNA, 27 nt, Human
ugccucuggguucacuccugauaauuc

SEQ ID NO: 406038 - RNA, 28 nt, Human
uggaaagaacauaauucuuucccagaag

SEQ ID NO: 406039 - RNA, 18 nt, Human
ugggguguguucagcugc

SEQ ID NO: 406040 - RNA, 23 nt, Human
uggguaacuguugggucagaaac

SEQ ID NO: 406041 - RNA, 22 nt, Human
uugaagaacauguauaaacaua

SEQ ID NO: 406042 - RNA, 20 nt, Human
aaagcuuugaauuuauuguu

SEQ ID NO: 406043 - RNA, 21 nt, Human
acugugcucuuucuugcaggu

SEQ ID NO: 406044 - RNA, 18 nt, Human
agagcacagaccuuccug

SEQ ID NO: 406045 - RNA, 26 nt, Human
auggcaaugauguuacagucuucuuc

SEQ ID NO: 406046 - RNA, 22 nt, Human
caggaaauacguaaugcaccau

SEQ ID NO: 406047 - RNA, 23 nt, Human
ccagagcacagaccuuccugcag

SEQ ID NO: 406048 - RNA, 21 nt, Human
cugcugcgcgccccucucacc

SEQ ID NO: 406049 - RNA, 24 nt, Human
gaucugggggagaagaugcauugc

SEQ ID NO: 406050 - RNA, 25 nt, Human
ggccaugguguauaauuuuauaacc

SEQ ID NO: 406051 - RNA, 25 nt, Human
uaaaucauugccugaaagugauuuc

SEQ ID NO: 406052 - RNA, 19 nt, Human
uaagaucaggaugacaugg

SEQ ID NO: 406053 - RNA, 20 nt, Human
uaagaucaggaugacauggu

SEQ ID NO: 406054 - RNA, 25 nt, Human
uacccuggcuccagagcacagaccu

SEQ ID NO: 406055 - RNA, 24 nt, Human
uauaaccauuuacccuggcuccag

SEQ ID NO: 406056 - RNA, 24 nt, Human
uauccaugcagucuugcacaaugc

SEQ ID NO: 406057 - RNA, 21 nt, Human
ucaggaugacaugguuuuccu

SEQ ID NO: 406058 - RNA, 19 nt, Human
uccaugcagucuugcacaa

SEQ ID NO: 406059 - RNA, 18 nt, Human
uccuaugguuauacaguu

SEQ ID NO: 406060 - RNA, 21 nt, Human
ugaccuaaauccuaugguuau

SEQ ID NO: 406061 - RNA, 21 nt, Human
ugcacaaugcucacuagguaa

SEQ ID NO: 406062 - RNA, 18 nt, Human
ugcuggaaauguugguuu

SEQ ID NO: 406063 - RNA, 24 nt, Human
ugcuggaaauguugguuuucugag

SEQ ID NO: 406064 - RNA, 18 nt, Human
ugguuuucugagcaggau

SEQ ID NO: 406065 - RNA, 27 nt, Human
uuaauggugaaguacugugcucuuucu

SEQ ID NO: 406066 - RNA, 22 nt, Human
uucaaaauccucaaccugauuc

SEQ ID NO: 406067 - RNA, 25 nt, Human
uucaaaauccucaaccugauucagu

SEQ ID NO: 406068 - RNA, 24 nt, Human
uugaaaucaaauuugucacuaaca

SEQ ID NO: 406069 - RNA, 23 nt, Human
uuuuuuuuugcagauguaaagcu

SEQ ID NO: 406070 - RNA, 23 nt, Human
uuuuuuuuuuuuuuuuugcagau

SEQ ID NO: 406071 - RNA, 23 nt, Human
uuuuuuuuuuuuuuuuuuuuggg

SEQ ID NO: 406072 - RNA, 20 nt, Human
aaaccgaaacgcaggcggcu

SEQ ID NO: 406073 - RNA, 18 nt, Human
aacaauagcgaccagaaa

SEQ ID NO: 406074 - RNA, 25 nt, Human
aagaaaagagaugacuaacccuaca

SEQ ID NO: 406075 - RNA, 21 nt, Human
aagcagucccacugcuucucg

SEQ ID NO: 406076 - RNA, 18 nt, Human
aaggaagcagucccacug

SEQ ID NO: 406077 - RNA, 18 nt, Human
acaaggagaacuaaacag

SEQ ID NO: 406078 - RNA, 19 nt, Human
acagcagcccacagacacu

SEQ ID NO: 406079 - RNA, 24 nt, Human
acagcagcccacagacacuguuca

SEQ ID NO: 406080 - RNA, 24 nt, Human
acuuaggugaauggugccacucaa

SEQ ID NO: 406081 - RNA, 22 nt, Human
agaaaagaguucuuucacccga

SEQ ID NO: 406082 - RNA, 19 nt, Human
agaaaagcuaacuuaggug

SEQ ID NO: 406083 - RNA, 19 nt, Human
agaccacaaggcagaugcc

SEQ ID NO: 406084 - RNA, 22 nt, Human
agaguucuuucacccgaguacu

SEQ ID NO: 406085 - RNA, 22 nt, Human
agcccacagcagcccacagaca

SEQ ID NO: 406086 - RNA, 22 nt, Human
agcggcgguugggggcaucgcc

SEQ ID NO: 406087 - RNA, 22 nt, Human
aggaagcagucccacugcuucu

SEQ ID NO: 406088 - RNA, 20 nt, Human
aggcagaugcccacugcugu

SEQ ID NO: 406089 - RNA, 23 nt, Human
auccaaaugcagcccacagcagc

SEQ ID NO: 406090 - RNA, 23 nt, Human
caaaaaagaaaagagaugacuaa

SEQ ID NO: 406091 - RNA, 22 nt, Human
caaggagaacuaaacagcagca

SEQ ID NO: 406092 - RNA, 18 nt, Human
cacaaggcagaugcccac

SEQ ID NO: 406093 - RNA, 18 nt, Human
cacagcagcccacagaca

SEQ ID NO: 406094 - RNA, 19 nt, Human
cacccgaguacuaugggga

SEQ ID NO: 406095 - RNA, 19 nt, Human
cagaaaagcuaacuuaggu

SEQ ID NO: 406096 - RNA, 21 nt, Human
cagagcagcugucaugagcac

SEQ ID NO: 406097 - RNA, 21 nt, Human
cagaugcccacugcuguccuc

SEQ ID NO: 406098 - RNA, 21 nt, Human
ccaccuacaugcacuuuauuc

SEQ ID NO: 406099 - RNA, 19 nt, Human
ccacugcuucucgcuguca

SEQ ID NO: 406100 - RNA, 18 nt, Human
cccaucaucaacuugauc

SEQ ID NO: 406101 - RNA, 19 nt, Human
cccggccgggccugcucac

SEQ ID NO: 406102 - RNA, 20 nt, Human
cgaaacgcaggcggcugcgg

SEQ ID NO: 406103 - RNA, 22 nt, Human
cgacaggcgggcacggcgcccc

SEQ ID NO: 406104 - RNA, 19 nt, Human
cgagagucagccuuggcuc

SEQ ID NO: 406105 - RNA, 19 nt, Human
cgcccgccuuucccggccc

SEQ ID NO: 406106 - RNA, 21 nt, Human
cgcgccccucggacauggccc

SEQ ID NO: 406107 - RNA, 21 nt, Human
cggcccgggcgacugcggcgg

SEQ ID NO: 406108 - RNA, 18 nt, Human
cgggccugcucacaaacc

SEQ ID NO: 406109 - RNA, 23 nt, Human
cugcucacaaaccgaaacgcagg

SEQ ID NO: 406110 - RNA, 25 nt, Human
cuugaacccuggccccaucaucaac

SEQ ID NO: 406111 - RNA, 21 nt, Human
cuugucuacuuucucaucuaa

SEQ ID NO: 406112 - RNA, 26 nt, Human
gagcaugugugaauucuaggcccacu

SEQ ID NO: 406113 - RNA, 22 nt, Human
gaucaaguuccaagacauuaca

SEQ ID NO: 406114 - RNA, 20 nt, Human
gcacaugaaaggccuccaga

SEQ ID NO: 406115 - RNA, 23 nt, Human
gcacaugaaaggccuccagaacc

SEQ ID NO: 406116 - RNA, 19 nt, Human
gcggcugcggcgccgggac

SEQ ID NO: 406117 - RNA, 22 nt, Human
ggcccggccgggccugcucaac

SEQ ID NO: 406118 - RNA, 21 nt, Human
uaaaaacaauagcgaccagaa

SEQ ID NO: 406119 - RNA, 24 nt, Human
uaaaaacaauagcgaccagaaaag

SEQ ID NO: 406120 - RNA, 18 nt, Human
uacuuucucaucuaagug

SEQ ID NO: 406121 - RNA, 23 nt, Human
uagaaaaccacuacuuuauagca

SEQ ID NO: 406122 - RNA, 18 nt, Human
uaugccaaaucuuccuga

SEQ ID NO: 406123 - RNA, 22 nt, Human
uauuucacagauaaauuaguua

SEQ ID NO: 406124 - RNA, 19 nt, Human
ucacagaaacaacaaagca

SEQ ID NO: 406125 - RNA, 18 nt, Human
ucagcaagaccacaaggc

SEQ ID NO: 406126 - RNA, 20 nt, Human
uccaagacauuacauucgac

SEQ ID NO: 406127 - RNA, 22 nt, Human
uccaagcuaaggcgucaaggaa

SEQ ID NO: 406128 - RNA, 22 nt, Human
ucccugaguaacagagcagcug

SEQ ID NO: 406129 - RNA, 19 nt, Human
ucucgcugucagcaagacc

SEQ ID NO: 406130 - RNA, 19 nt, Human
ucuuugagagaaaugagaa

SEQ ID NO: 406131 - RNA, 24 nt, Human
ugacagcacuucuugaacccuggc

SEQ ID NO: 406132 - RNA, 22 nt, Human
ugagagaaaugagaauaugaca

SEQ ID NO: 406133 - RNA, 21 nt, Human
ugagcaugugugaauucuagg

SEQ ID NO: 406134 - RNA, 25 nt, Human
ugccucaaaaaagaaaagagaugac

SEQ ID NO: 406135 - RNA, 18 nt, Human
ugccuggaaaguuugguc

SEQ ID NO: 406136 - RNA, 19 nt, Human
uggggacaguagcucuugc

SEQ ID NO: 406137 - RNA, 18 nt, Human
ugugagggugaagcauga

SEQ ID NO: 406138 - RNA, 18 nt, Human
accuccagccgcgcgguc

SEQ ID NO: 406139 - RNA, 19 nt, Human
agccgccuccaccccccac

SEQ ID NO: 406140 - RNA, 21 nt, Human
agccgccuccaccccccaccc

SEQ ID NO: 406141 - RNA, 19 nt, Human
auccaaaacaagucucucc

SEQ ID NO: 406142 - RNA, 21 nt, Human
augacaagauuuuacaucaag

SEQ ID NO: 406143 - RNA, 21 nt, Human
ccaccccuggguucggauccu

SEQ ID NO: 406144 - RNA, 18 nt, Human
cccaaaaagaaaugaugu

SEQ ID NO: 406145 - RNA, 21 nt, Human
ccgccuccaccccccaccccu

SEQ ID NO: 406146 - RNA, 21 nt, Human
ccuccagccgcgcgguccgcc

SEQ ID NO: 406147 - RNA, 22 nt, Human
cuccaccccccaccccuggguu

SEQ ID NO: 406148 - RNA, 19 nt, Human
gccuccaccccccaccccu

SEQ ID NO: 406149 - RNA, 21 nt, Human
gccuccaccccccaccccugg

SEQ ID NO: 406150 - RNA, 23 nt, Human
ggagccgccuccaccccccaccc

SEQ ID NO: 406151 - RNA, 23 nt, Human
uauacacaugacaagauuuuaca

SEQ ID NO: 406152 - RNA, 25 nt, Human
ucacauucccucuccacacaggauc

SEQ ID NO: 406153 - RNA, 21 nt, Human
uccccuucgaucgcaggagcu

SEQ ID NO: 406154 - RNA, 18 nt, Human
uccucacaccuccagccg

SEQ ID NO: 406155 - RNA, 19 nt, Human
ugggaucuuuuuuauuuuu

SEQ ID NO: 406156 - RNA, 19 nt, Human
uuucacauucccucuccac

SEQ ID NO: 406157 - RNA, 21 nt, Human
acgcugagugugagcuggggg

SEQ ID NO: 406158 - RNA, 26 nt, Human
agaauccccaaugaugcacccccccu

SEQ ID NO: 406159 - RNA, 18 nt, Human
agauaggccaaguggagu

SEQ ID NO: 406160 - RNA, 21 nt, Human
caaaagcuggcugcaccccug

SEQ ID NO: 406161 - RNA, 23 nt, Human
caauagccgcagaaggaacccua

SEQ ID NO: 406162 - RNA, 19 nt, Human
cacacucuaucaaaguacc

SEQ ID NO: 406163 - RNA, 23 nt, Human
caccccacacucuaucaaaguac

SEQ ID NO: 406164 - RNA, 20 nt, Human
cagaaggaacccuaaggcca

SEQ ID NO: 406165 - RNA, 18 nt, Human
cagaauccccaaugaugc

SEQ ID NO: 406166 - RNA, 20 nt, Human
caggacaccaaagaucaagg

SEQ ID NO: 406167 - RNA, 27 nt, Human
caggaugaaguccaggacaccaaagau

SEQ ID NO: 406168 - RNA, 20 nt, Human
cauccagguucuccaaaagc

SEQ ID NO: 406169 - RNA, 19 nt, Human
cauucggggucccacgcug

SEQ ID NO: 406170 - RNA, 22 nt, Human
ccaggaugaaguccaggacacc

SEQ ID NO: 406171 - RNA, 22 nt, Human
cccaaugaugcacccccagugg

SEQ ID NO: 406172 - RNA, 23 nt, Human
cccacgcugagugugagcugggg

SEQ ID NO: 406173 - RNA, 25 nt, Human
cuccaaaagcuggcugcaccccugg

SEQ ID NO: 406174 - RNA, 24 nt, Human
cuccaaagcaggucccccccaccc

SEQ ID NO: 406175 - RNA, 18 nt, Human
cuguaagccccgcuucug

SEQ ID NO: 406176 - RNA, 19 nt, Human
gaauccccaaugaugcacc

SEQ ID NO: 406177 - RNA, 21 nt, Human
gcagaaggaacccuaaggcca

SEQ ID NO: 406178 - RNA, 18 nt, Human
gccucggcggggccuggg

SEQ ID NO: 406179 - RNA, 19 nt, Human
guucccacgcccgccaggc

SEQ ID NO: 406180 - RNA, 20 nt, Human
uaccugaggcagaaucccca

SEQ ID NO: 406181 - RNA, 27 nt, Human
uaccugaggcagaauccccaaugauua

SEQ ID NO: 406182 - RNA, 22 nt, Human
uacuuuauuaucauugcuuaac

SEQ ID NO: 406183 - RNA, 21 nt, Human
uagccgcagaaggaacccuaa

SEQ ID NO: 406184 - RNA, 26 nt, Human
ucacugcaguaucugcagcacccagg

SEQ ID NO: 406185 - RNA, 19 nt, Human
uccaaaagcuggcugcacc

SEQ ID NO: 406186 - RNA, 21 nt, Human
uccaaagcaggucccccccac

SEQ ID NO: 406187 - RNA, 22 nt, Human
uccuguuuuacuucacugcagu

SEQ ID NO: 406188 - RNA, 19 nt, Human
ugaggcugaucuccaaagc

SEQ ID NO: 406189 - RNA, 23 nt, Human
ugcacccccaguggucuggcucc

SEQ ID NO: 406190 - RNA, 23 nt, Human
uggcuguaagccccgcuucuggg

SEQ ID NO: 406191 - RNA, 20 nt, Human
ugggaugggagaaggugagg

SEQ ID NO: 406192 - RNA, 18 nt, Human
uguaagggcuggcuguaa

SEQ ID NO: 406193 - RNA, 18 nt, Human
uuuuuuuuuuuuuuuccg

SEQ ID NO: 406194 - RNA, 21 nt, Human
uuuuuuuuuuuuuuuuuccgu

SEQ ID NO: 406195 - RNA, 24 nt, Human
aaaaagagagcaggccugugucca

SEQ ID NO: 406196 - RNA, 21 nt, Human
aaagucuucaaauccaacccc

SEQ ID NO: 406197 - RNA, 23 nt, Human
aagucgaccccucagucuugcuu

SEQ ID NO: 406198 - RNA, 21 nt, Human
aaucagguguuacgggauucu

SEQ ID NO: 406199 - RNA, 23 nt, Human
agagggccuguuuaaguugcucc

SEQ ID NO: 406200 - RNA, 18 nt, Human
agcccgagagcuucucug

SEQ ID NO: 406201 - RNA, 23 nt, Human
agccuucacccaucuuugugccc

SEQ ID NO: 406202 - RNA, 20 nt, Human
agcucugccugucuccuucu

SEQ ID NO: 406203 - RNA, 19 nt, Human
aggacucaccugggccagg

SEQ ID NO: 406204 - RNA, 19 nt, Human
aggagcugggaggacagga

SEQ ID NO: 406205 - RNA, 18 nt, Human
aggucaguccaguggggg

SEQ ID NO: 406206 - RNA, 18 nt, Human
aggugagugaggagcugg

SEQ ID NO: 406207 - RNA, 19 nt, Human
aggugagugaggagcuggg

SEQ ID NO: 406208 - RNA, 21 nt, Human
caaacuggcaccccaucccuu

SEQ ID NO: 406209 - RNA, 23 nt, Human
caaauccaacccccaauuugaag

SEQ ID NO: 406210 - RNA, 20 nt, Human
caccuccaaugacgagccug

SEQ ID NO: 406211 - RNA, 22 nt, Human
cagcccgaagucgaccccucag

SEQ ID NO: 406212 - RNA, 20 nt, Human
ccagaaccccuguagcucua

SEQ ID NO: 406213 - RNA, 21 nt, Human
ccagaaccccuguagcucuag

SEQ ID NO: 406214 - RNA, 22 nt, Human
ccccucuucuucuugaggugcc

SEQ ID NO: 406215 - RNA, 25 nt, Human
ccccuguagcucuaggacucaccug

SEQ ID NO: 406216 - RNA, 18 nt, Human
cccgagagcuucucugcu

SEQ ID NO: 406217 - RNA, 19 nt, Human
cccucaggagccccgccca

SEQ ID NO: 406218 - RNA, 19 nt, Human
ccucccagugucgcauggu

SEQ ID NO: 406219 - RNA, 22 nt, Human
ccugccauccuaaccagauggc

SEQ ID NO: 406220 - RNA, 25 nt, Human
ccuuccacccgguccuguuucugac

SEQ ID NO: 406221 - RNA, 30 nt, Human
cgagccuggacagacugcauucaaacuggg

SEQ ID NO: 406222 - RNA, 19 nt, Human
cucaguggcuuggaggucc

SEQ ID NO: 406223 - RNA, 20 nt, Human
cuccagggcaggggaccagc

SEQ ID NO: 406224 - RNA, 22 nt, Human
cuccagggcaggggaccagccu

SEQ ID NO: 406225 - RNA, 19 nt, Human
cucugcuuggguccuacgg

SEQ ID NO: 406226 - RNA, 23 nt, Human
cugcaccugggagcucacaguga

SEQ ID NO: 406227 - RNA, 19 nt, Human
cugcagagaucuuccuagc

SEQ ID NO: 406228 - RNA, 18 nt, Human
cuguuucugacccuggag

SEQ ID NO: 406229 - RNA, 19 nt, Human
cuucucauuuggugagagu

SEQ ID NO: 406230 - RNA, 21 nt, Human
gaccccucagucuugcuugga

SEQ ID NO: 406231 - RNA, 19 nt, Human
gagggccuguuuaaguugc

SEQ ID NO: 406232 - RNA, 20 nt, Human
gccagcccgaagucgacccc

SEQ ID NO: 406233 - RNA, 19 nt, Human
gccuagaaugagagacuuu

SEQ ID NO: 406234 - RNA, 20 nt, Human
gcugggugugcuccugcgug

SEQ ID NO: 406235 - RNA, 24 nt, Human
ggaaaacuucgaaagagauucuaa

SEQ ID NO: 406236 - RNA, 24 nt, Human
ggagcucccucaggagccccgccc

SEQ ID NO: 406237 - RNA, 20 nt, Human
ggcagggcaucacaguccuc

SEQ ID NO: 406238 - RNA, 19 nt, Human
ggcccagcccacguccugc

SEQ ID NO: 406239 - RNA, 23 nt, Human
ggcuagcucccuucugaguugga

SEQ ID NO: 406240 - RNA, 19 nt, Human
ggggcugggugugcuccug

SEQ ID NO: 406241 - RNA, 21 nt, Human
guccucuggcuagcucccuuc

SEQ ID NO: 406242 - RNA, 24 nt, Human
uaaaagucuucaaauccaaccccc

SEQ ID NO: 406243 - RNA, 19 nt, Human
uagcugauggaggcacagg

SEQ ID NO: 406244 - RNA, 22 nt, Human
ucccuggcggcccugcagagau

SEQ ID NO: 406245 - RNA, 19 nt, Human
ucccuuccacccgguccug

SEQ ID NO: 406246 - RNA, 23 nt, Human
uccucuggcuagcucccuucuga

SEQ ID NO: 406247 - RNA, 25 nt, Human
ucugggcuggaaggaaaccgggguc

SEQ ID NO: 406248 - RNA, 21 nt, Human
ugaaguccuaguggagcccuc

SEQ ID NO: 406249 - RNA, 18 nt, Human
ugaggagcugggaggaca

SEQ ID NO: 406250 - RNA, 26 nt, Human
ugauggaggcacaggaugugggggcc

SEQ ID NO: 406251 - RNA, 22 nt, Human
ugccaagggcagggcaucacag

SEQ ID NO: 406252 - RNA, 20 nt, Human
ugcccugaggucuugggugc

SEQ ID NO: 406253 - RNA, 21 nt, Human
ugccucaguuaaucagguguu

SEQ ID NO: 406254 - RNA, 18 nt, Human
uggaggcacaggaugugg

SEQ ID NO: 406255 - RNA, 20 nt, Human
uggcaggugcccuguggacc

SEQ ID NO: 406256 - RNA, 19 nt, Human
uggcucacuggccucccag

SEQ ID NO: 406257 - RNA, 20 nt, Human
uggcucacuggccucccagu

SEQ ID NO: 406258 - RNA, 18 nt, Human
ugggcuggaaggaaacuu

SEQ ID NO: 406259 - RNA, 22 nt, Human
uggugagaguccaccucaacau

SEQ ID NO: 406260 - RNA, 18 nt, Human
uguuggggaagcugagcu

SEQ ID NO: 406261 - RNA, 18 nt, Human
uuaaaagucuucaaaucc

SEQ ID NO: 406262 - RNA, 21 nt, Human
uuaaaagucuucaaauccaac

SEQ ID NO: 406263 - RNA, 21 nt, Human
uuccaggcuggccagagggcc

SEQ ID NO: 406264 - RNA, 18 nt, Human
uucucugcuuggguccua

SEQ ID NO: 406265 - RNA, 22 nt, Human
uucuuugggguuauacauugcu

SEQ ID NO: 406266 - RNA, 21 nt, Human
uugcuuguucaccuccaauga

SEQ ID NO: 406267 - RNA, 22 nt, Human
uuuaggaaaacuucgaaagaga

SEQ ID NO: 406268 - RNA, 20 nt, Human
uuugggguuauacauugcuc

SEQ ID NO: 406269 - RNA, 22 nt, Human
aaaacaaacauacagagcaccu

SEQ ID NO: 406270 - RNA, 19 nt, Human
aaacaaacauacagagcac

SEQ ID NO: 406271 - RNA, 20 nt, Human
aaacaaacauacagagcacc

SEQ ID NO: 406272 - RNA, 21 nt, Human
aaacauuuucaacugggauuc

SEQ ID NO: 406273 - RNA, 24 nt, Human
aaacgccccaaaaacuucaagaaa

SEQ ID NO: 406274 - RNA, 19 nt, Human
aaagcaugcuucuauaggg

SEQ ID NO: 406275 - RNA, 23 nt, Human
aaauguaaaaagacagcacuuca

SEQ ID NO: 406276 - RNA, 22 nt, Human
aacaaaaucugaacuuuagcua

SEQ ID NO: 406277 - RNA, 20 nt, Human
aacauggcaaaacuccgucu

SEQ ID NO: 406278 - RNA, 21 nt, Human
aacauggcaaaacuccgucuc

SEQ ID NO: 406279 - RNA, 21 nt, Human
aacuccuaagcaaaccaugcc

SEQ ID NO: 406280 - RNA, 19 nt, Human
aacucugaacuccuaagca

SEQ ID NO: 406281 - RNA, 22 nt, Human
aaucaaaugugcucuccuccac

SEQ ID NO: 406282 - RNA, 24 nt, Human
aaucacuugaauucgggaggcaga

SEQ ID NO: 406283 - RNA, 21 nt, Human
aaugcccauuugcauagcagc

SEQ ID NO: 406284 - RNA, 18 nt, Human
acaaugaaacucugucuc

SEQ ID NO: 406285 - RNA, 22 nt, Human
acaaugaaacucugucucaaaa

SEQ ID NO: 406286 - RNA, 19 nt, Human
acacucauauaaagcaugc

SEQ ID NO: 406287 - RNA, 31 nt, Human
acuacaucacccacuucuuaacuggaacagg

SEQ ID NO: 406288 - RNA, 24 nt, Human
acuccgucucuacuaaaaauacaa

SEQ ID NO: 406289 - RNA, 18 nt, Human
acuguacuccagccuggg

SEQ ID NO: 406290 - RNA, 23 nt, Human
acuguacuccagccugggugaca

SEQ ID NO: 406291 - RNA, 24 nt, Human
acuugaggucaggaguuugagauc

SEQ ID NO: 406292 - RNA, 19 nt, Human
agaguaaaauguaaaaaga

SEQ ID NO: 406293 - RNA, 18 nt, Human
agaguuugcagugagcug

SEQ ID NO: 406294 - RNA, 24 nt, Human
agaguuugcagugagcugagauca

SEQ ID NO: 406295 - RNA, 22 nt, Human
agaucacuugaggucaggaguu

SEQ ID NO: 406296 - RNA, 24 nt, Human
agcacuuugggaggccgaggcggg

SEQ ID NO: 406297 - RNA, 22 nt, Human
agcauuuugaaaaucccacaga

SEQ ID NO: 406298 - RNA, 20 nt, Human
agccugggugacaaugaaac

SEQ ID NO: 406299 - RNA, 22 nt, Human
agccugggugacaaugaaacuc

SEQ ID NO: 406300 - RNA, 24 nt, Human
agcuuggccaacauggcaaaacuc

SEQ ID NO: 406301 - RNA, 23 nt, Human
aggaaaaaggcaaauacaaaugu

SEQ ID NO: 406302 - RNA, 24 nt, Human
aggaagaaugaaaaugcuuacccc

SEQ ID NO: 406303 - RNA, 21 nt, Human
aggaaggggucgggaggaggc

SEQ ID NO: 406304 - RNA, 23 nt, Human
aggaguuugagaucagcuuggcc

SEQ ID NO: 406305 - RNA, 20 nt, Human
aggcagaguuugcagugagc

SEQ ID NO: 406306 - RNA, 24 nt, Human
aggcagaguuugcagugagcugag

SEQ ID NO: 406307 - RNA, 18 nt, Human
aggcaggagaaucacuug

SEQ ID NO: 406308 - RNA, 24 nt, Human
aggcaggagaaucacuugaauucg

SEQ ID NO: 406309 - RNA, 22 nt, Human
aggcgcggcugcugcuccuggc

SEQ ID NO: 406310 - RNA, 22 nt, Human
aggcgggcagaucacuugaggu

SEQ ID NO: 406311 - RNA, 23 nt, Human
aggcgggcagaucacuugagguc

SEQ ID NO: 406312 - RNA, 26 nt, Human
aggcgggcagaucacuugaggucagg

SEQ ID NO: 406313 - RNA, 24 nt, Human
aggcugaggcaggagaaucacuug

SEQ ID NO: 406314 - RNA, 25 nt, Human
auauuaaaaacaaacauacagagca

SEQ ID NO: 406315 - RNA, 20 nt, Human
aucacuugaggucaggaguu

SEQ ID NO: 406316 - RNA, 24 nt, Human
aucaugccacuguacuccagccug

SEQ ID NO: 406317 - RNA, 22 nt, Human
augccacuguacuccagccugg

SEQ ID NO: 406318 - RNA, 19 nt, Human
augccuguaaucucagcac

SEQ ID NO: 406319 - RNA, 21 nt, Human
auguauguguguguguauaua

SEQ ID NO: 406320 - RNA, 24 nt, Human
caacauggcaaaacuccgucucua

SEQ ID NO: 406321 - RNA, 19 nt, Human
cacuguacuccagccuggg

SEQ ID NO: 406322 - RNA, 19 nt, Human
cacuguacuccagccuggg

SEQ ID NO: 406323 - RNA, 21 nt, Human
cacuguacuccagccugggug

SEQ ID NO: 406324 - RNA, 22 nt, Human
cacuguacuccagccuggguga

SEQ ID NO: 406325 - RNA, 23 nt, Human
cacuguacuccagccugggugac

SEQ ID NO: 406326 - RNA, 24 nt, Human
cacuguacuccagccugggugaca

SEQ ID NO: 406327 - RNA, 25 nt, Human
cacuguacuccagccugggugacaa

SEQ ID NO: 406328 - RNA, 23 nt, Human
cacuugaggucaggaguuugaga

SEQ ID NO: 406329 - RNA, 25 nt, Human
cagaguaaaauguaaaaagacagca

SEQ ID NO: 406330 - RNA, 24 nt, Human
cagaucacuugaggucaggaguuu

SEQ ID NO: 406331 - RNA, 27 nt, Human
cagaucacuugaggucaggaguuugag

SEQ ID NO: 406332 - RNA, 24 nt, Human
cagcacuuugggaggccgaggcgg

SEQ ID NO: 406333 - RNA, 24 nt, Human
cagcuacucaggaggcugaggcag

SEQ ID NO: 406334 - RNA, 24 nt, Human
cagcuuggccaacauggcaaaacu

SEQ ID NO: 406335 - RNA, 24 nt, Human
caggaggcugaggcaggagaauca

SEQ ID NO: 406336 - RNA, 23 nt, Human
caguaaaagagaaacgccccaaa

SEQ ID NO: 406337 - RNA, 23 nt, Human
caugccaugacauacuuuauaua

SEQ ID NO: 406338 - RNA, 20 nt, Human
caugccuguaaucucagcac

SEQ ID NO: 406339 - RNA, 24 nt, Human
caugccuguaaucucagcacuuug

SEQ ID NO: 406340 - RNA, 20 nt, Human
ccacuguacuccagccuggg

SEQ ID NO: 406341 - RNA, 20 nt, Human
ccacuguacuccagccuggg

SEQ ID NO: 406342 - RNA, 20 nt, Human
ccacuguacuccagccuggg

SEQ ID NO: 406343 - RNA, 21 nt, Human
ccacuguacuccagccugggu

SEQ ID NO: 406344 - RNA, 21 nt, Human
ccacuguacuccagccugggu

SEQ ID NO: 406345 - RNA, 23 nt, Human
ccacuguacuccagccuggguga

SEQ ID NO: 406346 - RNA, 24 nt, Human
ccacuguacuccagccugggugac

SEQ ID NO: 406347 - RNA, 28 nt, Human
cccauacucauccuugcgugcccagggg

SEQ ID NO: 406348 - RNA, 19 nt, Human
cccauggcccauacucauc

SEQ ID NO: 406349 - RNA, 20 nt, Human
ccccaagaaguccucuuauc

SEQ ID NO: 406350 - RNA, 18 nt, Human
ccggggcgcgggcggagg

SEQ ID NO: 406351 - RNA, 23 nt, Human
ccuaugaaaauaguuuuuuucau

SEQ ID NO: 406352 - RNA, 19 nt, Human
ccuggggcggggccggggc

SEQ ID NO: 406353 - RNA, 21 nt, Human
ccuguaaucccagcuacucag

SEQ ID NO: 406354 - RNA, 22 nt, Human
ccuguaaucucagcacuuuggg

SEQ ID NO: 406355 - RNA, 21 nt, Human
ccuguugugaaccuauuucuu

SEQ ID NO: 406356 - RNA, 24 nt, Human
cgaggcgggcagaucacuugaggu

SEQ ID NO: 406357 - RNA, 26 nt, Human
cgaggcgggcagaucacuugagguca

SEQ ID NO: 406358 - RNA, 24 nt, Human
cgccuguaaucccagcuacucagg

SEQ ID NO: 406359 - RNA, 20 nt, Human
cgggaggaggcugagaccgu

SEQ ID NO: 406360 - RNA, 24 nt, Human
cgggcagaucacuugaggucagga

SEQ ID NO: 406361 - RNA, 24 nt, Human
cggggccggggcgcgggcggaggg

SEQ ID NO: 406362 - RNA, 20 nt, Human
cggggcgcgggcggaggggc

SEQ ID NO: 406363 - RNA, 21 nt, Human
cucaggaagacagagugaacu

SEQ ID NO: 406364 - RNA, 21 nt, Human
cuccuccacaguucuggcccc

SEQ ID NO: 406365 - RNA, 23 nt, Human
cuccuccacaguucuggccccaa

SEQ ID NO: 406366 - RNA, 24 nt, Human
cucugucucaaaaaaaaaguuauc

SEQ ID NO: 406367 - RNA, 24 nt, Human
cucuucccagaagacacucauaua

SEQ ID NO: 406368 - RNA, 20 nt, Human
cugaauuuguccgaggugau

SEQ ID NO: 406369 - RNA, 21 nt, Human
cugcggccggcggcggcggcg

SEQ ID NO: 406370 - RNA, 26 nt, Human
cugcuaauuuuuuaccauuuuugacc

SEQ ID NO: 406371 - RNA, 19 nt, Human
cugcuccuggcugcggccg

SEQ ID NO: 406372 - RNA, 20 nt, Human
cugcugcuccuggcugcggc

SEQ ID NO: 406373 - RNA, 24 nt, Human
cuuggccaacauggcaaaacuccg

SEQ ID NO: 406374 - RNA, 18 nt, Human
cuuuugcagacuuaaggc

SEQ ID NO: 406375 - RNA, 18 nt, Human
gaaguccucuuaucaccc

SEQ ID NO: 406376 - RNA, 21 nt, Human
gacgggcgccuguaaucccag

SEQ ID NO: 406377 - RNA, 23 nt, Human
gagaaucacuugaauucgggagg

SEQ ID NO: 406378 - RNA, 20 nt, Human
gagaucagcuuggccaacau

SEQ ID NO: 406379 - RNA, 24 nt, Human
gaucacuugaggucaggaguuuga

SEQ ID NO: 406380 - RNA, 20 nt, Human
gaugaugaaggaacucugaa

SEQ ID NO: 406381 - RNA, 23 nt, Human
gcaccugggucuggacuuguggg

SEQ ID NO: 406382 - RNA, 23 nt, Human
gcaggagaaucacuugaauucgg

SEQ ID NO: 406383 - RNA, 21 nt, Human
gccaacauggcaaaacuccgu

SEQ ID NO: 406384 - RNA, 19 nt, Human
gccacuguacuccagccug

SEQ ID NO: 406385 - RNA, 24 nt, Human
gccacuguacuccagccuggguga

SEQ ID NO: 406386 - RNA, 20 nt, Human
gcggccggcggcggcggcga

SEQ ID NO: 406387 - RNA, 20 nt, Human
gcggcggcggcgaagcggag

SEQ ID NO: 406388 - RNA, 19 nt, Human
gcggggccggggcgcgggc

SEQ ID NO: 406389 - RNA, 25 nt, Human
gcuaagcaccaguaaaagagaaacg

SEQ ID NO: 406390 - RNA, 18 nt, Human
gcucaggaagacagagug

SEQ ID NO: 406391 - RNA, 19 nt, Human
gcuugcaaacugcugguga

SEQ ID NO: 406392 - RNA, 19 nt, Human
ggaaggggucgggaggagg

SEQ ID NO: 406393 - RNA, 22 nt, Human
ggacgcgcaggaaggggucggg

SEQ ID NO: 406394 - RNA, 25 nt, Human
ggcagaucacuugaggucaggaguu

SEQ ID NO: 406395 - RNA, 24 nt, Human
ggcgaagcggaggcgaggccuggg

SEQ ID NO: 406396 - RNA, 20 nt, Human
gggccggggcgcgggcggaa

SEQ ID NO: 406397 - RNA, 24 nt, Human
gggccggggcgcgggcggaggggc

SEQ ID NO: 406398 - RNA, 18 nt, Human
gggcggaggggcgcgggc

SEQ ID NO: 406399 - RNA, 21 nt, Human
gggucaugccuguaaucucag

SEQ ID NO: 406400 - RNA, 24 nt, Human
ggguguggugacgggcgccuguaa

SEQ ID NO: 406401 - RNA, 19 nt, Human
ggucaggaguuugagauca

SEQ ID NO: 406402 - RNA, 24 nt, Human
ggugacgggcgccuguaaucccag

SEQ ID NO: 406403 - RNA, 23 nt, Human
ggugggucaugccuguaaucuca

SEQ ID NO: 406404 - RNA, 24 nt, Human
ggugggucaugccuguaaucucag

SEQ ID NO: 406405 - RNA, 21 nt, Human
gguguauauguaugugugugu

SEQ ID NO: 406406 - RNA, 18 nt, Human
gguguggugacgggcgcc

SEQ ID NO: 406407 - RNA, 19 nt, Human
guacuccagccugggugac

SEQ ID NO: 406408 - RNA, 25 nt, Human
gucaugccuguaaucucagcacuuu

SEQ ID NO: 406409 - RNA, 22 nt, Human
gugacaaugaaacucugucuca

SEQ ID NO: 406410 - RNA, 23 nt, Human
gugggucaugccuguaaucucag

SEQ ID NO: 406411 - RNA, 18 nt, Human
guguauauguaugugugu

SEQ ID NO: 406412 - RNA, 24 nt, Human
guucuggccccaagaaguccucuu

SEQ ID NO: 406413 - RNA, 26 nt, Human
uaaaaagacagcacuucagaaguuuu

SEQ ID NO: 406414 - RNA, 21 nt, Human
uaacaaaaucugaacuuuagc

SEQ ID NO: 406415 - RNA, 19 nt, Human
uaacuacaucacccacuuc

SEQ ID NO: 406416 - RNA, 21 nt, Human
uaagaauaugaucauuucugu

SEQ ID NO: 406417 - RNA, 19 nt, Human
uaagcagcucuacaggggc

SEQ ID NO: 406418 - RNA, 18 nt, Human
uacuccagccugggugac

SEQ ID NO: 406419 - RNA, 20 nt, Human
uacuccagccugggugacaa

SEQ ID NO: 406420 - RNA, 22 nt, Human
uacuccagccugggugacaaug

SEQ ID NO: 406421 - RNA, 24 nt, Human
uagaaucaauaggccaaacaauaa

SEQ ID NO: 406422 - RNA, 22 nt, Human
uaguagauacuguuuuagccau

SEQ ID NO: 406423 - RNA, 19 nt, Human
uauauagguguauauguau

SEQ ID NO: 406424 - RNA, 20 nt, Human
uauauguaugugugugugua

SEQ ID NO: 406425 - RNA, 25 nt, Human
uauauguauguguguguguauauaa

SEQ ID NO: 406426 - RNA, 20 nt, Human
uauguauguguguguguaua

SEQ ID NO: 406427 - RNA, 18 nt, Human
ucaaaacauuuucaacug

SEQ ID NO: 406428 - RNA, 19 nt, Human
ucaaaacauuuucaacugg

SEQ ID NO: 406429 - RNA, 19 nt, Human
ucacuugaggucaggaguu

SEQ ID NO: 406430 - RNA, 24 nt, Human
ucagaauucugacaagaaacauca

SEQ ID NO: 406431 - RNA, 23 nt, Human
ucaugccacuguacuccagccug

SEQ ID NO: 406432 - RNA, 23 nt, Human
ucaugccuguaaucucagcacuu

SEQ ID NO: 406433 - RNA, 20 nt, Human
uccagccugggugacaauga

SEQ ID NO: 406434 - RNA, 21 nt, Human
ucuagaaucaauaggccaaac

SEQ ID NO: 406435 - RNA, 21 nt, Human
ucucuacuaaaaauacaaaaa

SEQ ID NO: 406436 - RNA, 23 nt, Human
ucugucucaaaaaaaaaguuauc

SEQ ID NO: 406437 - RNA, 20 nt, Human
ucuuaacuggaacagccuac

SEQ ID NO: 406438 - RNA, 23 nt, Human
ucuuuguaacuacaucacccacu

SEQ ID NO: 406439 - RNA, 23 nt, Human
ugaaaaaaagguccaaacugagc

SEQ ID NO: 406440 - RNA, 18 nt, Human
ugaaccuaacaaaaucug

SEQ ID NO: 406441 - RNA, 20 nt, Human
ugacaaugaaacucugucuc

SEQ ID NO: 406442 - RNA, 21 nt, Human
ugacgcggugggucaugccug

SEQ ID NO: 406443 - RNA, 23 nt, Human
ugacgcggugggucaugccugua

SEQ ID NO: 406444 - RNA, 22 nt, Human
ugacgggcgccuguaaucccag

SEQ ID NO: 406445 - RNA, 22 nt, Human
ugagaguacuucugacacccau

SEQ ID NO: 406446 - RNA, 23 nt, Human
ugagaucagcuuggccaacaugg

SEQ ID NO: 406447 - RNA, 22 nt, Human
ugagcugagaucaugccacugu

SEQ ID NO: 406448 - RNA, 20 nt, Human
ugaggcaggagaaucacuug

SEQ ID NO: 406449 - RNA, 24 nt, Human
ugaggcaggagaaucacuugaauu

SEQ ID NO: 406450 - RNA, 25 nt, Human
ugaggcaggagaaucacuugaauuc

SEQ ID NO: 406451 - RNA, 18 nt, Human
ugaggucaggaguuugag

SEQ ID NO: 406452 - RNA, 19 nt, Human
ugccacaguucaccagcag

SEQ ID NO: 406453 - RNA, 18 nt, Human
ugccaugacauacuuuau

SEQ ID NO: 406454 - RNA, 23 nt, Human
ugccuguaaucucagcacuuugg

SEQ ID NO: 406455 - RNA, 23 nt, Human
ugccuguaaucucagcacuuugg

SEQ ID NO: 406456 - RNA, 20 nt, Human
ugcucaggaagacagaguga

SEQ ID NO: 406457 - RNA, 23 nt, Human
uggaacagccuaccuuauaaaga

SEQ ID NO: 406458 - RNA, 18 nt, Human
uggauaaaacacaaaacc

SEQ ID NO: 406459 - RNA, 19 nt, Human
uggauaaaacacaaaacca

SEQ ID NO: 406460 - RNA, 23 nt, Human
uggcauaacaacgcagaagggcu

SEQ ID NO: 406461 - RNA, 21 nt, Human
uggccaacauggcaaaacucc

SEQ ID NO: 406462 - RNA, 20 nt, Human
ugggaggccgaggcgggcag

SEQ ID NO: 406463 - RNA, 24 nt, Human
ugggaggccgaggcgggcagauca

SEQ ID NO: 406464 - RNA, 20 nt, Human
ugggaugauugcugcagugu

SEQ ID NO: 406465 - RNA, 24 nt, Human
ugggucaugccuguaaucucagca

SEQ ID NO: 406466 - RNA, 18 nt, Human
uguauacacacauauaua

SEQ ID NO: 406467 - RNA, 18 nt, Human
uguauacacacauauaua

SEQ ID NO: 406468 - RNA, 29 nt, Human
uguauacacacauauauagguguauaugg

SEQ ID NO: 406469 - RNA, 19 nt, Human
uguggggcucggcgcgcgg

SEQ ID NO: 406470 - RNA, 22 nt, Human
uguguauauauauauuuauuug

SEQ ID NO: 406471 - RNA, 18 nt, Human
uguguguguauauauaua

SEQ ID NO: 406472 - RNA, 18 nt, Human
uguguguguauauauaua

SEQ ID NO: 406473 - RNA, 19 nt, Human
uguguguguauauauauau

SEQ ID NO: 406474 - RNA, 19 nt, Human
uguguugagcaaccgugcc

SEQ ID NO: 406475 - RNA, 29 nt, Human
uguuuguauacacacauauauagguguaa

SEQ ID NO: 406476 - RNA, 22 nt, Human
uuaccuggguguggugacgggc

SEQ ID NO: 406477 - RNA, 24 nt, Human
uuaccuggguguggugacgggcgc

SEQ ID NO: 406478 - RNA, 23 nt, Human
uucacagaguacucagaauucug

SEQ ID NO: 406479 - RNA, 19 nt, Human
uucaugaaaauacuuagag

SEQ ID NO: 406480 - RNA, 20 nt, Human
uugcagugagcugagaucau

SEQ ID NO: 406481 - RNA, 21 nt, Human
uugcagugagcugagaucaug

SEQ ID NO: 406482 - RNA, 25 nt, Human
uugggaggccgaggcgggcagauca

SEQ ID NO: 406483 - RNA, 20 nt, Human
uuguauauacaccuucagac

SEQ ID NO: 406484 - RNA, 22 nt, Human
uuguauauacaccuucagaccc

SEQ ID NO: 406485 - RNA, 19 nt, Human
uuugcagugagcugagauc

SEQ ID NO: 406486 - RNA, 24 nt, Human
uuugcagugagcugagaucaugcc

SEQ ID NO: 406487 - RNA, 27 nt, Human
uuuguauacacacauauauagguguau

SEQ ID NO: 406488 - RNA, 27 nt, Human
uuuuuuuuuuugugaaaaagaggugcu

SEQ ID NO: 406489 - RNA, 18 nt, Human
uuuuuuuuuuuuuuuuug

SEQ ID NO: 406490 - RNA, 21 nt, Human
aaaaucucuaaugcugaaaga

SEQ ID NO: 406491 - RNA, 24 nt, Human
aaagggaaccaaauauuuuccuca

SEQ ID NO: 406492 - RNA, 22 nt, Human
aacaagaugugaacacugaaaa

SEQ ID NO: 406493 - RNA, 24 nt, Human
aaccguacaauagcaaaaaucaaa

SEQ ID NO: 406494 - RNA, 23 nt, Human
aagaacagaaaaaucucuaaugc

SEQ ID NO: 406495 - RNA, 21 nt, Human
aagcagauuucuuuggggaca

SEQ ID NO: 406496 - RNA, 23 nt, Human
aagggaaccaaauauuuuccuca

SEQ ID NO: 406497 - RNA, 22 nt, Human
acaaaaauuccaaaaaauuaga

SEQ ID NO: 406498 - RNA, 25 nt, Human
acaaaaauuccaaaaaauuagagaa

SEQ ID NO: 406499 - RNA, 18 nt, Human
acacaagugagaaauggg

SEQ ID NO: 406500 - RNA, 23 nt, Human
acagagagcuacuacuuuuucca

SEQ ID NO: 406501 - RNA, 23 nt, Human
acccugaaagauaacuuaaaaaa

SEQ ID NO: 406502 - RNA, 26 nt, Human
acucgccgccgccucccccucgugcc

SEQ ID NO: 406503 - RNA, 23 nt, Human
acugaaacuccauaaugcuacag

SEQ ID NO: 406504 - RNA, 23 nt, Human
agaaaaauguucaaaaauaaaaa

SEQ ID NO: 406505 - RNA, 25 nt, Human
agaaagaaaaaggacaauuuccuag

SEQ ID NO: 406506 - RNA, 22 nt, Human
agaacagaaaaaucucuaaugc

SEQ ID NO: 406507 - RNA, 20 nt, Human
agcagauuucuuuggggaca

SEQ ID NO: 406508 - RNA, 22 nt, Human
agcuacuacuuuuuccaggaag

SEQ ID NO: 406509 - RNA, 21 nt, Human
agcuagaaagaaaaaggacaa

SEQ ID NO: 406510 - RNA, 20 nt, Human
agguguaaagucuacaaaaa

SEQ ID NO: 406511 - RNA, 20 nt, Human
agguguaaagucuacaaaaa

SEQ ID NO: 406512 - RNA, 24 nt, Human
aguauugaaaaugcacaagaaaga

SEQ ID NO: 406513 - RNA, 19 nt, Human
auacaaauauauauauaua

SEQ ID NO: 406514 - RNA, 22 nt, Human
auacaaauauauauauauauau

SEQ ID NO: 406515 - RNA, 19 nt, Human
augcuuuuuagagccuuuc

SEQ ID NO: 406516 - RNA, 22 nt, Human
caaaaauuugguuccacugaaa

SEQ ID NO: 406517 - RNA, 18 nt, Human
caccgacucgccgccgcc

SEQ ID NO: 406518 - RNA, 24 nt, Human
cagaaaaaucucuaaugcugaaag

SEQ ID NO: 406519 - RNA, 23 nt, Human
cagcuagaaagaaaaaggacaau

SEQ ID NO: 406520 - RNA, 24 nt, Human
caggugcuccgccccgguucugcu

SEQ ID NO: 406521 - RNA, 19 nt, Human
ccccgguucugcucuuccc

SEQ ID NO: 406522 - RNA, 22 nt, Human
ccgccgccucccccucgugccc

SEQ ID NO: 406523 - RNA, 19 nt, Human
ccgcgccugcaggugcucc

SEQ ID NO: 406524 - RNA, 21 nt, Human
ccugaaagauaacuuaaaaaa

SEQ ID NO: 406525 - RNA, 21 nt, Human
ccugcaggugcuccgccccgg

SEQ ID NO: 406526 - RNA, 24 nt, Human
ccugcaggugcuccgccccgguuc

SEQ ID NO: 406527 - RNA, 23 nt, Human
cuaauaaccacuaccuauaaaau

SEQ ID NO: 406528 - RNA, 22 nt, Human
cuccccucaaaugcccuuuaaa

SEQ ID NO: 406529 - RNA, 22 nt, Human
cuccgccccgguucugcucuuc

SEQ ID NO: 406530 - RNA, 19 nt, Human
cuucuuagaacaggccacu

SEQ ID NO: 406531 - RNA, 23 nt, Human
cuuuauaguauuuccauguuacc

SEQ ID NO: 406532 - RNA, 20 nt, Human
gacucgccgccgccuccccc

SEQ ID NO: 406533 - RNA, 21 nt, Human
gacucgccgccgccucccccu

SEQ ID NO: 406534 - RNA, 21 nt, Human
gaugaauaaaccaaauguagc

SEQ ID NO: 406535 - RNA, 21 nt, Human
gccccgguucugcucuuccca

SEQ ID NO: 406536 - RNA, 19 nt, Human
ggauguaauacuaauaacc

SEQ ID NO: 406537 - RNA, 21 nt, Human
ggggaacaagaugugaacacu

SEQ ID NO: 406538 - RNA, 22 nt, Human
guucugcucuucccagcugcuc

SEQ ID NO: 406539 - RNA, 20 nt, Human
uaaaaaauuggugacagcaa

SEQ ID NO: 406540 - RNA, 22 nt, Human
uaauaaccacuaccuauaaaau

SEQ ID NO: 406541 - RNA, 22 nt, Human
uacaauagcaaaaaucaaagag

SEQ ID NO: 406542 - RNA, 18 nt, Human
uagcaaaaaucaaagagc

SEQ ID NO: 406543 - RNA, 22 nt, Human
uagcaaaaaucaaagagcacag

SEQ ID NO: 406544 - RNA, 23 nt, Human
uagcaaaaaucaaagagcacaga

SEQ ID NO: 406545 - RNA, 18 nt, Human
uauaaaauaaagcacaca

SEQ ID NO: 406546 - RNA, 22 nt, Human
uauuaaacuuauuaugagcccc

SEQ ID NO: 406547 - RNA, 21 nt, Human
uccaaaaaauuagagaacacu

SEQ ID NO: 406548 - RNA, 22 nt, Human
ucccagcugcucaccgacucgc

SEQ ID NO: 406549 - RNA, 21 nt, Human
ucccuaaacuauuuugaaggc

SEQ ID NO: 406550 - RNA, 18 nt, Human
ucgccgccgccucccccu

SEQ ID NO: 406551 - RNA, 22 nt, Human
ucgccgccgccucccccucguc

SEQ ID NO: 406552 - RNA, 19 nt, Human
ucugcuauuauaaaaaauu

SEQ ID NO: 406553 - RNA, 19 nt, Human
ucugcucuucccagcugcu

SEQ ID NO: 406554 - RNA, 23 nt, Human
ugaaaaugcacaagaaagauuuu

SEQ ID NO: 406555 - RNA, 19 nt, Human
ugaaaccguacaauagcaa

SEQ ID NO: 406556 - RNA, 19 nt, Human
ugaaacuccauaaugcuac

SEQ ID NO: 406557 - RNA, 18 nt, Human
ugaaggcagguagcuuag

SEQ ID NO: 406558 - RNA, 22 nt, Human
ugauauguggaauuuuuguaaa

SEQ ID NO: 406559 - RNA, 23 nt, Human
ugcaggugcuccgccccgguucu

SEQ ID NO: 406560 - RNA, 21 nt, Human
ugcuacagagagcuacuacuu

SEQ ID NO: 406561 - RNA, 23 nt, Human
ugcucaccgacucgccgccgccu

SEQ ID NO: 406562 - RNA, 22 nt, Human
uggaauuuuuguaaauaguuuu

SEQ ID NO: 406563 - RNA, 23 nt, Human
uguaauacuaauaaccacuaccu

SEQ ID NO: 406564 - RNA, 21 nt, Human
ugugaaaguaaaaauuuuuau

SEQ ID NO: 406565 - RNA, 22 nt, Human
uuaauaaacauaucaaaaaggg

SEQ ID NO: 406566 - RNA, 21 nt, Human
uuagugcauuaaauguuuucc

SEQ ID NO: 406567 - RNA, 18 nt, Human
uucaagaacagaaaaauc

SEQ ID NO: 406568 - RNA, 21 nt, Human
uuccuagcagcauggcaacuu

SEQ ID NO: 406569 - RNA, 21 nt, Human
uuuuuuuuuuuuuuugugaaa

SEQ ID NO: 406570 - RNA, 19 nt, Human
uuuuuuuuuuuuuuuuugu

SEQ ID NO: 406571 - RNA, 20 nt, Human
uuuuuuuuuuuuuuuuuugg

SEQ ID NO: 406572 - RNA, 25 nt, Human
ggagguggggcugucaucuguggug

SEQ ID NO: 406573 - RNA, 25 nt, Human
aaagaagaaaccgggagacauccug

SEQ ID NO: 406574 - RNA, 22 nt, Human
aagaagaaaccgggagacaucc

SEQ ID NO: 406575 - RNA, 23 nt, Human
acacacacacacacacacacaca

SEQ ID NO: 406576 - RNA, 25 nt, Human
acacacacacacacacacacacagu

SEQ ID NO: 406577 - RNA, 23 nt, Human
acacacacacacacacacacaua

SEQ ID NO: 406578 - RNA, 28 nt, Human
acacacacacacacacauacacacuuug

SEQ ID NO: 406579 - RNA, 24 nt, Human
agaggaaauuuugaaagaagaaac

SEQ ID NO: 406580 - RNA, 33 nt, Human
auacacacaaacacacacacacacacacacagu

SEQ ID NO: 406581 - RNA, 19 nt, Human
auguggagcggaugugagg

SEQ ID NO: 406582 - RNA, 31 nt, Human
cacaaacacacacacacacacacacacacag

SEQ ID NO: 406583 - RNA, 19 nt, Human
cacacaaacacacacacac

SEQ ID NO: 406584 - RNA, 20 nt, Human
cacacacacacacacacaca

SEQ ID NO: 406585 - RNA, 20 nt, Human
cacacacacacacacacaca

SEQ ID NO: 406586 - RNA, 20 nt, Human
cacacacacacacacacaca

SEQ ID NO: 406587 - RNA, 20 nt, Human
cacacacacacacacacaca

SEQ ID NO: 406588 - RNA, 22 nt, Human
cacacacacacacacacacaca

SEQ ID NO: 406589 - RNA, 22 nt, Human
cacacacacacacacacacaca

SEQ ID NO: 406590 - RNA, 26 nt, Human
cacacacacacacacacacacacaca

SEQ ID NO: 406591 - RNA, 25 nt, Human
cacacacacacacacacacacauac

SEQ ID NO: 406592 - RNA, 26 nt, Human
cacacacacacacacacacauacaca

SEQ ID NO: 406593 - RNA, 20 nt, Human
cacacacacacacacacaua

SEQ ID NO: 406594 - RNA, 22 nt, Human
cacacacacacacacacauaca

SEQ ID NO: 406595 - RNA, 27 nt, Human
cacacacacacacacacauacacacuu

SEQ ID NO: 406596 - RNA, 19 nt, Human
cacacacacacacacauac

SEQ ID NO: 406597 - RNA, 24 nt, Human
cagcagauggagaggaaauuuuga

SEQ ID NO: 406598 - RNA, 20 nt, Human
cccagcccccacugcggcca

SEQ ID NO: 406599 - RNA, 22 nt, Human
cccagcccccacugcggccaug

SEQ ID NO: 406600 - RNA, 19 nt, Human
cccuuggaggcgccugggg

SEQ ID NO: 406601 - RNA, 27 nt, Human
ccucaucuuuccucacugcuucccuug

SEQ ID NO: 406602 - RNA, 18 nt, Human
gagucaggagcggggaac

SEQ ID NO: 406603 - RNA, 19 nt, Human
gcgggcgcacacaggggug

SEQ ID NO: 406604 - RNA, 20 nt, Human
gggcgcacacaggggugacc

SEQ ID NO: 406605 - RNA, 25 nt, Human
gggcuggggcgggcgcacacagggg

SEQ ID NO: 406606 - RNA, 21 nt, Human
guggcagcgguggcggccagc

SEQ ID NO: 406607 - RNA, 21 nt, Human
guggcagcgguggcggccagc

SEQ ID NO: 406608 - RNA, 18 nt, Human
uaagacuacuccugggcu

SEQ ID NO: 406609 - RNA, 20 nt, Human
uaagacuacuccugggcugg

SEQ ID NO: 406610 - RNA, 23 nt, Human
uacaaaauacacacaaacacaca

SEQ ID NO: 406611 - RNA, 25 nt, Human
uacacacaaacacacacacacacac

SEQ ID NO: 406612 - RNA, 26 nt, Human
uacacacaaacacacacacacacaca

SEQ ID NO: 406613 - RNA, 24 nt, Human
uccccagcccccacugcggccaug

SEQ ID NO: 406614 - RNA, 21 nt, Human
ugaaagaagaaaccgggagac

SEQ ID NO: 406615 - RNA, 24 nt, Human
ugagcagguggcagcgguggcggc

SEQ ID NO: 406616 - RNA, 25 nt, Human
ugaggcacgaugccucaucuuuccu

SEQ ID NO: 406617 - RNA, 18 nt, Human
uggggcgggcgcacacag

SEQ ID NO: 406618 - RNA, 21 nt, Human
uggggcugcgccaguccccag

SEQ ID NO: 406619 - RNA, 22 nt, Human
uguggagcggaugugaggcacg

SEQ ID NO: 406620 - RNA, 19 nt, Human
aaaugaccuucacugagaa

SEQ ID NO: 406621 - RNA, 19 nt, Human
aacacagugaacuucauua

SEQ ID NO: 406622 - RNA, 21 nt, Human
aacauccauuuuuccuuguuc

SEQ ID NO: 406623 - RNA, 18 nt, Human
aagaaggcaguauaaacc

SEQ ID NO: 406624 - RNA, 28 nt, Human
aagcaagaaggcaguauaaaccuucuag

SEQ ID NO: 406625 - RNA, 23 nt, Human
acucugcaacuacagcuuagcug

SEQ ID NO: 406626 - RNA, 18 nt, Human
acugucccacccaccccc

SEQ ID NO: 406627 - RNA, 23 nt, Human
agagucaaugaaaaauagcaggg

SEQ ID NO: 406628 - RNA, 22 nt, Human
agccccuccccccaagucaaaa

SEQ ID NO: 406629 - RNA, 19 nt, Human
agccgccgccggcgccaca

SEQ ID NO: 406630 - RNA, 22 nt, Human
agccgccgccggcgccacaacc

SEQ ID NO: 406631 - RNA, 20 nt, Human
auaaacacagugaacuucau

SEQ ID NO: 406632 - RNA, 20 nt, Human
aucauccuaaagaguucaau

SEQ ID NO: 406633 - RNA, 20 nt, Human
auggacauuauucccccucu

SEQ ID NO: 406634 - RNA, 19 nt, Human
cacagcagccgccgccggc

SEQ ID NO: 406635 - RNA, 22 nt, Human
cacagcagccgccgccggcgcc

SEQ ID NO: 406636 - RNA, 21 nt, Human
ccacaacccaccauccgccau

SEQ ID NO: 406637 - RNA, 24 nt, Human
ccaugcuuuuaauauucauuuaac

SEQ ID NO: 406638 - RNA, 22 nt, Human
cccaccauccgccauuaccgcc

SEQ ID NO: 406639 - RNA, 33 nt, Human
cccaccauccgccauuaccgccgcuuccgacua

SEQ ID NO: 406640 - RNA, 19 nt, Human
ccccuccccccaagucaaa

SEQ ID NO: 406641 - RNA, 22 nt, Human
ccgccauuaccgccgcuuccga

SEQ ID NO: 406642 - RNA, 18 nt, Human
ccgccgccggcgccacaa

SEQ ID NO: 406643 - RNA, 23 nt, Human
ccggcgccacaacccaccauccg

SEQ ID NO: 406644 - RNA, 24 nt, Human
cugcagcgaaacauccauuuuucc

SEQ ID NO: 406645 - RNA, 29 nt, Human
cuucauuacuguacauguacucugcaacu

SEQ ID NO: 406646 - RNA, 21 nt, Human
gaaaaauagcaggguuauagc

SEQ ID NO: 406647 - RNA, 19 nt, Human
gcuuuaaagcaagaaggca

SEQ ID NO: 406648 - RNA, 19 nt, Human
uaacuuaauccugcagcga

SEQ ID NO: 406649 - RNA, 23 nt, Human
uacagcuuagcuguaaauccucc

SEQ ID NO: 406650 - RNA, 22 nt, Human
uagaccaauugcuuuaaagcaa

SEQ ID NO: 406651 - RNA, 20 nt, Human
uagagucaaugaaaaauagc

SEQ ID NO: 406652 - RNA, 21 nt, Human
uccacacacaaugguauggac

SEQ ID NO: 406653 - RNA, 22 nt, Human
ugaccuucacugagaagauaau

SEQ ID NO: 406654 - RNA, 20 nt, Human
ugacuggaaaaaaaaaaggu

SEQ ID NO: 406655 - RNA, 24 nt, Human
ugcagcgaaacauccauuuuuccu

SEQ ID NO: 406656 - RNA, 19 nt, Human
uguacauguacucugcaac

SEQ ID NO: 406657 - RNA, 21 nt, Human
ugucccacccacccccuuaca

SEQ ID NO: 406658 - RNA, 28 nt, Human
uuauagccccuccccccaagucaaaaca

SEQ ID NO: 406659 - RNA, 28 nt, Human
uuccuuguucuuuucuugcacaguucca

SEQ ID NO: 406660 - RNA, 22 nt, Human
uugaauacuagauacuauaauc

SEQ ID NO: 406661 - RNA, 22 nt, Human
uuguucuuuucuugcacaguuc

SEQ ID NO: 406662 - RNA, 20 nt, Human
uuuguugaaguaauaagaau

SEQ ID NO: 406663 - RNA, 21 nt, Human
uuuucacaaauacugugacug

SEQ ID NO: 406664 - RNA, 24 nt, Human
aaacaggucaccaaagagaccaga

SEQ ID NO: 406665 - RNA, 23 nt, Human
acacaaauuuaaacaggucacca

SEQ ID NO: 406666 - RNA, 23 nt, Human
acuccauuuuggaugaacugaau

SEQ ID NO: 406667 - RNA, 18 nt, Human
agagggcggcggcggcgg

SEQ ID NO: 406668 - RNA, 26 nt, Human
agcaggcggcggaggcagcgauggcc

SEQ ID NO: 406669 - RNA, 19 nt, Human
aggcgggcaacuccgcccc

SEQ ID NO: 406670 - RNA, 20 nt, Human
caacuccgccccugcccucc

SEQ ID NO: 406671 - RNA, 19 nt, Human
cacaguaaacggaaaacca

SEQ ID NO: 406672 - RNA, 18 nt, Human
caggucaccaaagagacc

SEQ ID NO: 406673 - RNA, 22 nt, Human
cauugauacuguuuuugugcuu

SEQ ID NO: 406674 - RNA, 24 nt, Human
ccaaagagaccagaaguaauuaaa

SEQ ID NO: 406675 - RNA, 21 nt, Human
ccccugcccuccuuccucucc

SEQ ID NO: 406676 - RNA, 23 nt, Human
cccggggccgcggccgggggcgg

SEQ ID NO: 406677 - RNA, 19 nt, Human
cccuccuuccucuccuguc

SEQ ID NO: 406678 - RNA, 19 nt, Human
cccugcccuccuuccucuc

SEQ ID NO: 406679 - RNA, 22 nt, Human
cccugcccuccuuccucuccug

SEQ ID NO: 406680 - RNA, 20 nt, Human
ccgcccgcucgcgucccucg

SEQ ID NO: 406681 - RNA, 22 nt, Human
ccgccgcccgcucgcgucccuc

SEQ ID NO: 406682 - RNA, 20 nt, Human
ccgcggccgggggcgggggc

SEQ ID NO: 406683 - RNA, 19 nt, Human
ccgcucgcgucccucgagg

SEQ ID NO: 406684 - RNA, 19 nt, Human
cgcgcggggcagggcccgg

SEQ ID NO: 406685 - RNA, 25 nt, Human
cucacggccagccccgccgcccgcu

SEQ ID NO: 406686 - RNA, 27 nt, Human
cucgagguggagcaggcggcggaggca

SEQ ID NO: 406687 - RNA, 27 nt, Human
gagcaggcggcggaggcagcgauggcc

SEQ ID NO: 406688 - RNA, 25 nt, Human
gcccggggccgcggccgggggcggg

SEQ ID NO: 406689 - RNA, 21 nt, Human
gccgcggccgggggcgggggc

SEQ ID NO: 406690 - RNA, 21 nt, Human
ggaaaaccauucacagauuca

SEQ ID NO: 406691 - RNA, 23 nt, Human
ggccgcggccgggggcgggggcu

SEQ ID NO: 406692 - RNA, 18 nt, Human
gggcagggcccggggccg

SEQ ID NO: 406693 - RNA, 20 nt, Human
gggcagggcccggggccgcg

SEQ ID NO: 406694 - RNA, 19 nt, Human
guggagcaggcggcggagg

SEQ ID NO: 406695 - RNA, 19 nt, Human
uaaggcgggcaacuccgcc

SEQ ID NO: 406696 - RNA, 23 nt, Human
uacacacugaaggugaaggauau

SEQ ID NO: 406697 - RNA, 23 nt, Human
uccgccccugcccuccuuccucu

SEQ ID NO: 406698 - RNA, 18 nt, Human
ucggugggccgggcaggg

SEQ ID NO: 406699 - RNA, 22 nt, Human
ucucacggccagccccgccgcc

SEQ ID NO: 406700 - RNA, 23 nt, Human
ucucacggccagccccgccgccc

SEQ ID NO: 406701 - RNA, 19 nt, Human
uuuuuuuuuuuuuuuguca

SEQ ID NO: 406702 - RNA, 19 nt, Human
uuuuuuuuuuuuuuuuugu

SEQ ID NO: 406703 - RNA, 20 nt, Human
uuuuuuuuuuuuuuuuuugg

SEQ ID NO: 406704 - RNA, 26 nt, Human
aaacacacauaacagauucuugagac

SEQ ID NO: 406705 - RNA, 22 nt, Human
aagcucagagauauuuugagcu

SEQ ID NO: 406706 - RNA, 21 nt, Human
aauacaagcacccccucccac

SEQ ID NO: 406707 - RNA, 21 nt, Human
aauugccugaacuacugugga

SEQ ID NO: 406708 - RNA, 21 nt, Human
agcucuaaaagaguaucacaa

SEQ ID NO: 406709 - RNA, 18 nt, Human
auagugacuggaaauaag

SEQ ID NO: 406710 - RNA, 21 nt, Human
aucauucaagacauaucuuaa

SEQ ID NO: 406711 - RNA, 21 nt, Human
caaagccacaacuaaaauaga

SEQ ID NO: 406712 - RNA, 21 nt, Human
cacaccaggccaaagagcaaa

SEQ ID NO: 406713 - RNA, 19 nt, Human
cacccuuuccguccacacc

SEQ ID NO: 406714 - RNA, 20 nt, Human
ccacaccaggccaaagagca

SEQ ID NO: 406715 - RNA, 20 nt, Human
ccacccuuuccguccacacc

SEQ ID NO: 406716 - RNA, 20 nt, Human
ccgcagcaaacacacauaac

SEQ ID NO: 406717 - RNA, 27 nt, Human
ccguccacaccaggccaaagagcaaaa

SEQ ID NO: 406718 - RNA, 19 nt, Human
gaccugacuaauugaaugg

SEQ ID NO: 406719 - RNA, 21 nt, Human
uaaauacaagcacccccuccc

SEQ ID NO: 406720 - RNA, 21 nt, Human
uaaauacaagcacccccuccc

SEQ ID NO: 406721 - RNA, 18 nt, Human
uaagggucauacaugugu

SEQ ID NO: 406722 - RNA, 22 nt, Human
uaauagcuaacugaagccagga

SEQ ID NO: 406723 - RNA, 23 nt, Human
uagacccuuaaacaugucugcuc

SEQ ID NO: 406724 - RNA, 23 nt, Human
uagcuaacugaagccaggaauuc

SEQ ID NO: 406725 - RNA, 27 nt, Human
uauagugacuggaaauaagauaaauac

SEQ ID NO: 406726 - RNA, 20 nt, Human
ucaagcauuuacucuccacc

SEQ ID NO: 406727 - RNA, 23 nt, Human
ucacucaauccauuuggccaccc

SEQ ID NO: 406728 - RNA, 23 nt, Human
ucacuuuuauauaagcuucccca

SEQ ID NO: 406729 - RNA, 26 nt, Human
ucccaccgcagcaaacagugggaaac

SEQ ID NO: 406730 - RNA, 18 nt, Human
uccguccacaccaggcca

SEQ ID NO: 406731 - RNA, 24 nt, Human
ugacuggaaauaagauaaauacaa

SEQ ID NO: 406732 - RNA, 19 nt, Human
uuagauacccauaugaugc

SEQ ID NO: 406733 - RNA, 22 nt, Human
uuuccacuggacugaauguccu

SEQ ID NO: 406734 - RNA, 19 nt, Human
accuccucccuccucccuu

SEQ ID NO: 406735 - RNA, 18 nt, Human
caccagcgucgaccggcc

SEQ ID NO: 406736 - RNA, 27 nt, Human
cauguuauuaacucccugccuuuuacc

SEQ ID NO: 406737 - RNA, 22 nt, Human
cccugccuuuuaccuccucccu

SEQ ID NO: 406738 - RNA, 19 nt, Human
ccuccucccuuggcacaac

SEQ ID NO: 406739 - RNA, 25 nt, Human
ugccuuuuaccuccucccuccuccc

SEQ ID NO: 406740 - RNA, 19 nt, Human
aaauaugacagucuuggau

SEQ ID NO: 406741 - RNA, 19 nt, Human
cacccuuccccagccaagg

SEQ ID NO: 406742 - RNA, 19 nt, Human
ccacccuuccccagccaag

SEQ ID NO: 406743 - RNA, 18 nt, Human
ccagccaagggcagaagc

SEQ ID NO: 406744 - RNA, 19 nt, Human
cccuggugggacuucuccu

SEQ ID NO: 406745 - RNA, 20 nt, Human
ccuugaacugcagaaaagag

SEQ ID NO: 406746 - RNA, 22 nt, Human
ggaguccugguggccaaguggc

SEQ ID NO: 406747 - RNA, 21 nt, Human
guguucuuaccaccuccccac

SEQ ID NO: 406748 - RNA, 18 nt, Human
uauucagaaguugucagg

SEQ ID NO: 406749 - RNA, 22 nt, Human
uauucagaaguugucagguguu

SEQ ID NO: 406750 - RNA, 21 nt, Human
uccccagccaagggcagaagc

SEQ ID NO: 406751 - RNA, 21 nt, Human
ucuccugggcuuuuccuccca

SEQ ID NO: 406752 - RNA, 18 nt, Human
uggugggacuucuccugg

SEQ ID NO: 406753 - RNA, 19 nt, Human
uuuguaaguguuuaaaaug

SEQ ID NO: 406754 - RNA, 23 nt, Human
aagauccuggguccuggggguga

SEQ ID NO: 406755 - RNA, 23 nt, Human
acacaacgcuucagucccacccc

SEQ ID NO: 406756 - RNA, 23 nt, Human
acagccagacacagcacaacacc

SEQ ID NO: 406757 - RNA, 26 nt, Human
agcacaacaccacaggguaugccccu

SEQ ID NO: 406758 - RNA, 22 nt, Human
aggaaggagcaggccuguggug

SEQ ID NO: 406759 - RNA, 18 nt, Human
aggccugugguggggggg

SEQ ID NO: 406760 - RNA, 22 nt, Human
agggcaaggccaggggcuggga

SEQ ID NO: 406761 - RNA, 18 nt, Human
aggucaugaauggugggg

SEQ ID NO: 406762 - RNA, 23 nt, Human
auggguccgggauccggggacuc

SEQ ID NO: 406763 - RNA, 19 nt, Human
augguggggcacacagggc

SEQ ID NO: 406764 - RNA, 19 nt, Human
cacaacaccacaggguaug

SEQ ID NO: 406765 - RNA, 24 nt, Human
cacacacauuuaucccacagccag

SEQ ID NO: 406766 - RNA, 21 nt, Human
cacagcacaacaccacagggu

SEQ ID NO: 406767 - RNA, 24 nt, Human
cacagccagacacagcacaacacc

SEQ ID NO: 406768 - RNA, 18 nt, Human
cacagggcucaagacauc

SEQ ID NO: 406769 - RNA, 19 nt, Human
caccccacccucacuggcu

SEQ ID NO: 406770 - RNA, 27 nt, Human
caccccacccucacuggcugcccuccc

SEQ ID NO: 406771 - RNA, 19 nt, Human
cagacacagcacaacaccc

SEQ ID NO: 406772 - RNA, 19 nt, Human
cagcacaacaccacagggu

SEQ ID NO: 406773 - RNA, 24 nt, Human
cagcacaacaccacaggguaugcc

SEQ ID NO: 406774 - RNA, 24 nt, Human
cagccagacacagcacaacaccaa

SEQ ID NO: 406775 - RNA, 25 nt, Human
ccacaaacucgacuucagggaaaac

SEQ ID NO: 406776 - RNA, 22 nt, Human
ccacagccagacacagcacaac

SEQ ID NO: 406777 - RNA, 25 nt, Human
ccacagccagacacagcacaacacc

SEQ ID NO: 406778 - RNA, 25 nt, Human
cccacacacauuuaucccacagcca

SEQ ID NO: 406779 - RNA, 25 nt, Human
ccccacccucacuggcugcccuccc

SEQ ID NO: 406780 - RNA, 22 nt, Human
cccuacauaugcuucuccaagc

SEQ ID NO: 406781 - RNA, 18 nt, Human
cucccuguccacuugggg

SEQ ID NO: 406782 - RNA, 23 nt, Human
cugcuaggcugauuuucucacau

SEQ ID NO: 406783 - RNA, 25 nt, Human
gaaaggagaagauccuggguccugg

SEQ ID NO: 406784 - RNA, 20 nt, Human
gaagauccuggguccugggg

SEQ ID NO: 406785 - RNA, 19 nt, Human
gagcaggccuguggugggg

SEQ ID NO: 406786 - RNA, 20 nt, Human
gagcaggccugugguggggg

SEQ ID NO: 406787 - RNA, 22 nt, Human
gcuucagucccaccccacccuc

SEQ ID NO: 406788 - RNA, 18 nt, Human
ggagucuuugcaagacac

SEQ ID NO: 406789 - RNA, 20 nt, Human
ggcugggagggaggggcuca

SEQ ID NO: 406790 - RNA, 18 nt, Human
gggcaaggccaggggcug

SEQ ID NO: 406791 - RNA, 20 nt, Human
ggggcucccuguccacuugg

SEQ ID NO: 406792 - RNA, 24 nt, Human
gggggggugagaggggcucuggga

SEQ ID NO: 406793 - RNA, 19 nt, Human
gguggggggggugagaggg

SEQ ID NO: 406794 - RNA, 23 nt, Human
gugguggggggggugagaggggc

SEQ ID NO: 406795 - RNA, 22 nt, Human
uaacacagcugugggucagggc

SEQ ID NO: 406796 - RNA, 20 nt, Human
uaaguggaggaaaguggggu

SEQ ID NO: 406797 - RNA, 23 nt, Human
uagaggguuauauacaaaccaca

SEQ ID NO: 406798 - RNA, 22 nt, Human
uaucuggaugcagguuuuauua

SEQ ID NO: 406799 - RNA, 24 nt, Human
uccgggauccggggacucgggauc

SEQ ID NO: 406800 - RNA, 24 nt, Human
uccugccagguuggggaggggaug

SEQ ID NO: 406801 - RNA, 20 nt, Human
uccuggguccugggggugaa

SEQ ID NO: 406802 - RNA, 18 nt, Human
ucgacaagggauaggggc

SEQ ID NO: 406803 - RNA, 23 nt, Human
ucugccaggagugggcuccacag

SEQ ID NO: 406804 - RNA, 21 nt, Human
ugcccagaaaggagaagaucc

SEQ ID NO: 406805 - RNA, 22 nt, Human
ugccuaaaggaagagggcaagg

SEQ ID NO: 406806 - RNA, 21 nt, Human
uggggaggggauggaagcugg

SEQ ID NO: 406807 - RNA, 28 nt, Human
ugggucagggcucugcccaaggauuccc

SEQ ID NO: 406808 - RNA, 18 nt, Human
ugguggggggggugagag

SEQ ID NO: 406809 - RNA, 19 nt, Human
ugguggggggggugagagg

SEQ ID NO: 406810 - RNA, 23 nt, Human
ugugaauauggggcugggaggga

SEQ ID NO: 406811 - RNA, 20 nt, Human
ugugguggggggggugagag

SEQ ID NO: 406812 - RNA, 22 nt, Human
ugugguggggggggugagaggg

SEQ ID NO: 406813 - RNA, 27 nt, Human
uugcacacaacgcuucagucccacccc

SEQ ID NO: 406814 - RNA, 25 nt, Human
aaaaaaaauuccucccacauguuaa

SEQ ID NO: 406815 - RNA, 19 nt, Human
aaaaaaaccgguaaagccu

SEQ ID NO: 406816 - RNA, 24 nt, Human
aaaaaauaucccccaaaaccaaaa

SEQ ID NO: 406817 - RNA, 21 nt, Human
aaaaaccgguaaagccugaua

SEQ ID NO: 406818 - RNA, 20 nt, Human
aaaagcccuucaaacucaaa

SEQ ID NO: 406819 - RNA, 23 nt, Human
aaacaaauaaaaaauauccccca

SEQ ID NO: 406820 - RNA, 25 nt, Human
aaacagaacagaaugaaugaaacaa

SEQ ID NO: 406821 - RNA, 22 nt, Human
aaauaaaaaauaucccccaaaa

SEQ ID NO: 406822 - RNA, 18 nt, Human
aacuauaaaagcccuuca

SEQ ID NO: 406823 - RNA, 24 nt, Human
acaaaaacaccaucuuaaugccau

SEQ ID NO: 406824 - RNA, 21 nt, Human
acaaaacaagacauccaccuc

SEQ ID NO: 406825 - RNA, 24 nt, Human
acaaaacaagacauccaccucuaa

SEQ ID NO: 406826 - RNA, 22 nt, Human
acuggcauaaaaggucauuaaa

SEQ ID NO: 406827 - RNA, 21 nt, Human
acuguaacaucaacaugcauc

SEQ ID NO: 406828 - RNA, 18 nt, Human
agacuuaaaagaccaaca

SEQ ID NO: 406829 - RNA, 22 nt, Human
agaggaacacccaguagagaaa

SEQ ID NO: 406830 - RNA, 24 nt, Human
aggaacuuugacagaaaacgaugg

SEQ ID NO: 406831 - RNA, 21 nt, Human
aggaggaaaauacaacuauaa

SEQ ID NO: 406832 - RNA, 24 nt, Human
aggaggaaaauacaacuauaaaaa

SEQ ID NO: 406833 - RNA, 20 nt, Human
agguauugaacauugcacau

SEQ ID NO: 406834 - RNA, 24 nt, Human
auaaaaaauaucccccaaaaccaa

SEQ ID NO: 406835 - RNA, 24 nt, Human
augcaucacuaucauauuuggucc

SEQ ID NO: 406836 - RNA, 23 nt, Human
auuagagcaaaacagacuuaaaa

SEQ ID NO: 406837 - RNA, 21 nt, Human
caaaaacaccaucuuaaugcc

SEQ ID NO: 406838 - RNA, 24 nt, Human
caaaacaagacauccaccucuaau

SEQ ID NO: 406839 - RNA, 21 nt, Human
caaaauucccagguagaacac

SEQ ID NO: 406840 - RNA, 23 nt, Human
caacaugcaucacuaucauauuu

SEQ ID NO: 406841 - RNA, 18 nt, Human
caacuggcauaaaagguc

SEQ ID NO: 406842 - RNA, 25 nt, Human
caagaaguagaugaaaaauucauaa

SEQ ID NO: 406843 - RNA, 18 nt, Human
cacaaaacaagacaucca

SEQ ID NO: 406844 - RNA, 20 nt, Human
cacaacuggcauaaaagguc

SEQ ID NO: 406845 - RNA, 25 nt, Human
cacacagccaugaaaauggcuauuc

SEQ ID NO: 406846 - RNA, 21 nt, Human
cagacaauccaagugcugaaa

SEQ ID NO: 406847 - RNA, 30 nt, Human
cauauacauaugcauacacuaucuauaugg

SEQ ID NO: 406848 - RNA, 25 nt, Human
cauguuaacacugaaaaucuggcca

SEQ ID NO: 406849 - RNA, 22 nt, Human
ccaaaagaaaagcuuuguacau

SEQ ID NO: 406850 - RNA, 18 nt, Human
ccacauguuaacacugaa

SEQ ID NO: 406851 - RNA, 23 nt, Human
ccacuugagguaugcucgcuuaa

SEQ ID NO: 406852 - RNA, 22 nt, Human
cccaaaaccaaaaaauaaaaac

SEQ ID NO: 406853 - RNA, 19 nt, Human
cccauccuagguguaacac

SEQ ID NO: 406854 - RNA, 23 nt, Human
cccccaaaaccaaaaaauaaaaa

SEQ ID NO: 406855 - RNA, 24 nt, Human
ccuccuccuccuccuccuucuucu

SEQ ID NO: 406856 - RNA, 18 nt, Human
ccuccuucuucuucuucc

SEQ ID NO: 406857 - RNA, 21 nt, Human
ccuucuucuucuuccucuuuu

SEQ ID NO: 406858 - RNA, 19 nt, Human
cggcccccuccuccuccuc

SEQ ID NO: 406859 - RNA, 18 nt, Human
cuacugggugagaauacc

SEQ ID NO: 406860 - RNA, 20 nt, Human
cucauaaacuucugaguuga

SEQ ID NO: 406861 - RNA, 20 nt, Human
cuccuccuccuccuccuccu

SEQ ID NO: 406862 - RNA, 20 nt, Human
cuccuccuccuccuccuccu

SEQ ID NO: 406863 - RNA, 20 nt, Human
cuccuccuccuccuccuccu

SEQ ID NO: 406864 - RNA, 20 nt, Human
cuccuccuucuucuucuucc

SEQ ID NO: 406865 - RNA, 29 nt, Human
cuccuucuucuucuuccucuuuuucuucu

SEQ ID NO: 406866 - RNA, 23 nt, Human
cuugaagccuuuugcaacugucc

SEQ ID NO: 406867 - RNA, 20 nt, Human
cuuuuucuucuucuuuuucu

SEQ ID NO: 406868 - RNA, 18 nt, Human
gaagcaucuaagcaacgu

SEQ ID NO: 406869 - RNA, 20 nt, Human
gaauagaccacuguucaaga

SEQ ID NO: 406870 - RNA, 22 nt, Human
gaauaucauuucuguuuuuagu

SEQ ID NO: 406871 - RNA, 28 nt, Human
gacagaaaacgauggcaaaagggacccc

SEQ ID NO: 406872 - RNA, 20 nt, Human
gccuacugggugagaauacc

SEQ ID NO: 406873 - RNA, 21 nt, Human
ggaacacccaguagagaaaca

SEQ ID NO: 406874 - RNA, 20 nt, Human
ggcuaguuucacuugcaaga

SEQ ID NO: 406875 - RNA, 19 nt, Human
guagaacaaaaacaccauc

SEQ ID NO: 406876 - RNA, 21 nt, Human
guuauuuuauucuuuugaaaa

SEQ ID NO: 406877 - RNA, 21 nt, Human
uaaaaaauaucccccaaaacc

SEQ ID NO: 406878 - RNA, 23 nt, Human
uaaaaaauaucccccaaaaccaa

SEQ ID NO: 406879 - RNA, 22 nt, Human
uaaaaagagauaaauuuucuuu

SEQ ID NO: 406880 - RNA, 21 nt, Human
uaaaagaccaacaugcagaga

SEQ ID NO: 406881 - RNA, 24 nt, Human
uaacacaagaaaaggaacuuuuca

SEQ ID NO: 406882 - RNA, 24 nt, Human
uaauucaugacacaaaacaagaca

SEQ ID NO: 406883 - RNA, 22 nt, Human
uacacaacacacagccaugaaa

SEQ ID NO: 406884 - RNA, 21 nt, Human
uacagcugaagcaaucauggc

SEQ ID NO: 406885 - RNA, 18 nt, Human
uaccacuauacuguugag

SEQ ID NO: 406886 - RNA, 18 nt, Human
uacugggugagaauacca

SEQ ID NO: 406887 - RNA, 21 nt, Human
uacugggugagaauaccauuu

SEQ ID NO: 406888 - RNA, 25 nt, Human
uagaacaaaaacaccaucuuaaugc

SEQ ID NO: 406889 - RNA, 22 nt, Human
uagaacacaguugucagugcca

SEQ ID NO: 406890 - RNA, 21 nt, Human
uagagcaaaacagacuuaaaa

SEQ ID NO: 406891 - RNA, 25 nt, Human
uagagcaaaacagacuuaaaagacc

SEQ ID NO: 406892 - RNA, 18 nt, Human
uagcuccucuuuucuacu

SEQ ID NO: 406893 - RNA, 24 nt, Human
uauaacuacguuuuacagauuauu

SEQ ID NO: 406894 - RNA, 27 nt, Human
uauacauaugcauacacuaucuauaug

SEQ ID NO: 406895 - RNA, 20 nt, Human
uaucaugccuauucacauca

SEQ ID NO: 406896 - RNA, 22 nt, Human
uauugaaaaauauguagaacaa

SEQ ID NO: 406897 - RNA, 21 nt, Human
ucaaggccacuaaaauacuga

SEQ ID NO: 406898 - RNA, 20 nt, Human
uccuccuccuccuccuccuu

SEQ ID NO: 406899 - RNA, 20 nt, Human
ucucggcccccuccuccucc

SEQ ID NO: 406900 - RNA, 19 nt, Human
ucuuccucuuuuucuucuu

SEQ ID NO: 406901 - RNA, 21 nt, Human
ucuucucggcccccuccuccu

SEQ ID NO: 406902 - RNA, 19 nt, Human
ucuuuuucuucuucuuuuu

SEQ ID NO: 406903 - RNA, 23 nt, Human
ugaaaaucuggccauuuucuagg

SEQ ID NO: 406904 - RNA, 23 nt, Human
ugaaacaaauaaaaaauaucccc

SEQ ID NO: 406905 - RNA, 22 nt, Human
ugagaauaccauuuaaaaacau

SEQ ID NO: 406906 - RNA, 18 nt, Human
ugagaauaucauuucugu

SEQ ID NO: 406907 - RNA, 19 nt, Human
ugagguauugaacauugca

SEQ ID NO: 406908 - RNA, 21 nt, Human
ugaucugaagacauucuuugu

SEQ ID NO: 406909 - RNA, 23 nt, Human
ugcaucacuaucauauuuggucc

SEQ ID NO: 406910 - RNA, 21 nt, Human
ugcgaagggugagcugcucuu

SEQ ID NO: 406911 - RNA, 22 nt, Human
uguacaacauacuauauacaua

SEQ ID NO: 406912 - RNA, 25 nt, Human
uguacauauacauaugcauacacuu

SEQ ID NO: 406913 - RNA, 24 nt, Human
uguagaacaaaaacaccaucuuaa

SEQ ID NO: 406914 - RNA, 22 nt, Human
ugucaagggcuauuuuaccucu

SEQ ID NO: 406915 - RNA, 18 nt, Human
uguuacacaacacacagc

SEQ ID NO: 406916 - RNA, 22 nt, Human
uuacacaacacacagccaugaa

SEQ ID NO: 406917 - RNA, 24 nt, Human
uucaagaaguagaugaaaaauuca

SEQ ID NO: 406918 - RNA, 27 nt, Human
uucuucuuccucuuuuucuucuucuuu

SEQ ID NO: 406919 - RNA, 23 nt, Human
uucuuucauugcaauacugauug

SEQ ID NO: 406920 - RNA, 18 nt, Human
uugaagcaucuaagcaac

SEQ ID NO: 406921 - RNA, 24 nt, Human
uugaagccuuuugcaacuguccuu

SEQ ID NO: 406922 - RNA, 18 nt, Human
uugcauaaugcccauccu

SEQ ID NO: 406923 - RNA, 21 nt, Human
uuuaaaauaauucuauggcuc

SEQ ID NO: 406924 - RNA, 18 nt, Human
uuugcauaaugcccaucc

SEQ ID NO: 406925 - RNA, 24 nt, Human
uuuuuuuuuuuuuuuaaguagaaa

SEQ ID NO: 406926 - RNA, 19 nt, Human
uuuuuuuuuuuuuuuuuaa

SEQ ID NO: 406927 - RNA, 24 nt, Human
cugaucugcucugucuucacauau

SEQ ID NO: 406928 - RNA, 21 nt, Human
ugacugcacagauucucaauu

SEQ ID NO: 406929 - RNA, 24 nt, Human
uucucaauuucuuugucauccauu

SEQ ID NO: 406930 - RNA, 18 nt, Human
aaaagaaacaacugaugu

SEQ ID NO: 406931 - RNA, 20 nt, Human
aaaauaaaaagaaacaacug

SEQ ID NO: 406932 - RNA, 20 nt, Human
aaacagagagaagacaguga

SEQ ID NO: 406933 - RNA, 19 nt, Human
aacauugucaucucaaccu

SEQ ID NO: 406934 - RNA, 23 nt, Human
aagccaucuucaauaggagccaa

SEQ ID NO: 406935 - RNA, 18 nt, Human
aauccuccuacaaacuuu

SEQ ID NO: 406936 - RNA, 20 nt, Human
agaaaauuauauuacuucuc

SEQ ID NO: 406937 - RNA, 21 nt, Human
agaaaggagaauuaaaaaaaa

SEQ ID NO: 406938 - RNA, 18 nt, Human
agagagaagacagugaag

SEQ ID NO: 406939 - RNA, 21 nt, Human
agcgugacaguaaaacuuauc

SEQ ID NO: 406940 - RNA, 21 nt, Human
augaucaggucaucacccugc

SEQ ID NO: 406941 - RNA, 19 nt, Human
auguacauacauaagcaug

SEQ ID NO: 406942 - RNA, 26 nt, Human
auuaaaaauccuccuacaaacuuuuu

SEQ ID NO: 406943 - RNA, 25 nt, Human
caguaauaaggaaagucuuaacaau

SEQ ID NO: 406944 - RNA, 20 nt, Human
caucacccugcugccaaguc

SEQ ID NO: 406945 - RNA, 21 nt, Human
caucucaaccuugcuuuuugc

SEQ ID NO: 406946 - RNA, 22 nt, Human
caucuuguuuucuuagaagcca

SEQ ID NO: 406947 - RNA, 22 nt, Human
ccuccuacaaacuuuuuuccua

SEQ ID NO: 406948 - RNA, 22 nt, Human
gagaaaggagaauuaaaaaaaa

SEQ ID NO: 406949 - RNA, 19 nt, Human
gagaaaucuuuaucuagcc

SEQ ID NO: 406950 - RNA, 20 nt, Human
gcccagaaaaauauuuagaa

SEQ ID NO: 406951 - RNA, 22 nt, Human
guacauacauaagcaugcccag

SEQ ID NO: 406952 - RNA, 23 nt, Human
uaaaaagaaacaacugauguaca

SEQ ID NO: 406953 - RNA, 22 nt, Human
uaaguaauguguacaaaagaaa

SEQ ID NO: 406954 - RNA, 23 nt, Human
uaauguguacaaaagaaaccaca

SEQ ID NO: 406955 - RNA, 24 nt, Human
uacauacauaagcaugcccagaaa

SEQ ID NO: 406956 - RNA, 19 nt, Human
uaguuaaauauaacaguga

SEQ ID NO: 406957 - RNA, 22 nt, Human
uauaccuuucaaucagaaauuu

SEQ ID NO: 406958 - RNA, 21 nt, Human
uaucuagccauaagacaaaua

SEQ ID NO: 406959 - RNA, 18 nt, Human
uccaagugacuaucucug

SEQ ID NO: 406960 - RNA, 18 nt, Human
ucuccaagugacuaucuc

SEQ ID NO: 406961 - RNA, 21 nt, Human
ugacuggaaagaaaguuuaag

SEQ ID NO: 406962 - RNA, 23 nt, Human
ugagcacauuaauuuuuuacauu

SEQ ID NO: 406963 - RNA, 26 nt, Human
ugaucaggucaucacccugcugccaa

SEQ ID NO: 406964 - RNA, 21 nt, Human
ugccaaguccuucuguguccu

SEQ ID NO: 406965 - RNA, 23 nt, Human
ugggaaaaauacuuuguaagaaa

SEQ ID NO: 406966 - RNA, 25 nt, Human
uuaguaaugcauuuuaauguuuccu

SEQ ID NO: 406967 - RNA, 21 nt, Human
uuuuaagguauuugaaauacu

SEQ ID NO: 406968 - RNA, 24 nt, Human
aaacaggacgcagaaccuucagaa

SEQ ID NO: 406969 - RNA, 18 nt, Human
aaagaagccucccacucc

SEQ ID NO: 406970 - RNA, 21 nt, Human
aaagacuuuucugcaugaaug

SEQ ID NO: 406971 - RNA, 19 nt, Human
aaagcgcugggauuacagg

SEQ ID NO: 406972 - RNA, 24 nt, Human
aaagcgcugggauuacaggcguga

SEQ ID NO: 406973 - RNA, 23 nt, Human
aaagugccauuuuuaacucaaaa

SEQ ID NO: 406974 - RNA, 20 nt, Human
aaaucccuggaaagaagccu

SEQ ID NO: 406975 - RNA, 19 nt, Human
aagcgcugggauuacaggc

SEQ ID NO: 406976 - RNA, 26 nt, Human
aagcgcugggauuacaggcgugagcc

SEQ ID NO: 406977 - RNA, 19 nt, Human
aagcugcccuuccaaagcc

SEQ ID NO: 406978 - RNA, 21 nt, Human
aagucuggaggcugucacgcc

SEQ ID NO: 406979 - RNA, 22 nt, Human
acaaaacaggacgcagaaccuu

SEQ ID NO: 406980 - RNA, 23 nt, Human
acacaaaucccuggaaagaagcc

SEQ ID NO: 406981 - RNA, 22 nt, Human
acaggacgcagaaccuucagaa

SEQ ID NO: 406982 - RNA, 22 nt, Human
accaagcaccuaugaagaugcu

SEQ ID NO: 406983 - RNA, 21 nt, Human
accaaggaagccucauuccug

SEQ ID NO: 406984 - RNA, 21 nt, Human
acccugagcaguauggccugg

SEQ ID NO: 406985 - RNA, 18 nt, Human
accuugugauccacccac

SEQ ID NO: 406986 - RNA, 25 nt, Human
acucuauugcccaggcuggagugca

SEQ ID NO: 406987 - RNA, 24 nt, Human
agaacggagacacaaaucccugga

SEQ ID NO: 406988 - RNA, 24 nt, Human
agacagaagagucaggacuggaug

SEQ ID NO: 406989 - RNA, 24 nt, Human
agacaggucccagauuuguggcuc

SEQ ID NO: 406990 - RNA, 25 nt, Human
agacaggugaaaagacuuuucugca

SEQ ID NO: 406991 - RNA, 21 nt, Human
agcacagaccuggaacucaca

SEQ ID NO: 406992 - RNA, 21 nt, Human
agcagacuuguuuagggccug

SEQ ID NO: 406993 - RNA, 22 nt, Human
agccaccgcgcccagccaggaa

SEQ ID NO: 406994 - RNA, 18 nt, Human
agcgcugggauuacaggc

SEQ ID NO: 406995 - RNA, 19 nt, Human
aggauucggcgaccuuggc

SEQ ID NO: 406996 - RNA, 20 nt, Human
aggcaugcaccaccacgccc

SEQ ID NO: 406997 - RNA, 25 nt, Human
aggcuggagugcaguggugcaaucu

SEQ ID NO: 406998 - RNA, 25 nt, Human
aggcuggagugcaguggugugaucu

SEQ ID NO: 406999 - RNA, 22 nt, Human
agggauuacaggcacaugccau

SEQ ID NO: 407000 - RNA, 23 nt, Human
aguagcagggauuacaggcacau

SEQ ID NO: 407001 - RNA, 21 nt, Human
aguagcugggauuacaggcau

SEQ ID NO: 407002 - RNA, 24 nt, Human
agucuugcucuguccccaggcugg

SEQ ID NO: 407003 - RNA, 28 nt, Human
agugagaaagcagcauaugcagaaggga

SEQ ID NO: 407004 - RNA, 21 nt, Human
agugcaguggugcaaucucag

SEQ ID NO: 407005 - RNA, 19 nt, Human
agugcaguggugugaucuc

SEQ ID NO: 407006 - RNA, 20 nt, Human
agugcaguggugugaucucg

SEQ ID NO: 407007 - RNA, 23 nt, Human
agugcaguggugugaucucggcu

SEQ ID NO: 407008 - RNA, 24 nt, Human
agugcaguggugugaucucggcuc

SEQ ID NO: 407009 - RNA, 20 nt, Human
auaggacaaagcugcccuuc

SEQ ID NO: 407010 - RNA, 21 nt, Human
augaugcugagugagaaagca

SEQ ID NO: 407011 - RNA, 24 nt, Human
augggguuucaccaucuuggccag

SEQ ID NO: 407012 - RNA, 18 nt, Human
auucuccuuccucagccu

SEQ ID NO: 407013 - RNA, 28 nt, Human
caaacuccugaccuugugauccacccac

SEQ ID NO: 407014 - RNA, 24 nt, Human
caaagcgcugggauuacaggcgug

SEQ ID NO: 407015 - RNA, 22 nt, Human
caagcaacucucuugccucagc

SEQ ID NO: 407016 - RNA, 22 nt, Human
caagugauucuccuuccucagc

SEQ ID NO: 407017 - RNA, 23 nt, Human
cacagcacuugguagguagugcu

SEQ ID NO: 407018 - RNA, 22 nt, Human
caccaccacgcccagcuaauuu

SEQ ID NO: 407019 - RNA, 24 nt, Human
caccacgcccagcuaauuuuugua

SEQ ID NO: 407020 - RNA, 19 nt, Human
caccacgcccuuugguugc

SEQ ID NO: 407021 - RNA, 24 nt, Human
caccaucuuggccaggcuagucuc

SEQ ID NO: 407022 - RNA, 24 nt, Human
cacucuauugcccaggcuggagug

SEQ ID NO: 407023 - RNA, 23 nt, Human
cacugcaaucuccgccuccuggg

SEQ ID NO: 407024 - RNA, 23 nt, Human
cagaaccuucagaacggagacac

SEQ ID NO: 407025 - RNA, 21 nt, Human
cagaacggagacacaaauccc

SEQ ID NO: 407026 - RNA, 19 nt, Human
cagcagagagguguggagg

SEQ ID NO: 407027 - RNA, 20 nt, Human
cagccuccugaguagcaggg

SEQ ID NO: 407028 - RNA, 21 nt, Human
cagcugcauucacccugagca

SEQ ID NO: 407029 - RNA, 23 nt, Human
cauaaggccucaucucagacccc

SEQ ID NO: 407030 - RNA, 19 nt, Human
cauaugcagaagggaacau

SEQ ID NO: 407031 - RNA, 23 nt, Human
caugcaccaccacgcccagcuaa

SEQ ID NO: 407032 - RNA, 22 nt, Human
ccaaagcgcugggauuacaggc

SEQ ID NO: 407033 - RNA, 23 nt, Human
ccaaagcgcugggauuacaggcg

SEQ ID NO: 407034 - RNA, 24 nt, Human
ccaaagcgcugggauuacaggcgu

SEQ ID NO: 407035 - RNA, 19 nt, Human
ccacaucggccucccaaag

SEQ ID NO: 407036 - RNA, 18 nt, Human
ccauaaggccucaucuca

SEQ ID NO: 407037 - RNA, 24 nt, Human
cccaagacaguugggaaacaccac

SEQ ID NO: 407038 - RNA, 19 nt, Human
cccacaucggccucccaaa

SEQ ID NO: 407039 - RNA, 19 nt, Human
cccaggcuggagugcagug

SEQ ID NO: 407040 - RNA, 22 nt, Human
cccaggcuggagugcaguggug

SEQ ID NO: 407041 - RNA, 19 nt, Human
ccccaggcuggagugcagu

SEQ ID NO: 407042 - RNA, 24 nt, Human
ccccauuuuauagauggcacugag

SEQ ID NO: 407043 - RNA, 21 nt, Human
ccccucugggccauaaggccu

SEQ ID NO: 407044 - RNA, 19 nt, Human
ccccugcagcugugggucu

SEQ ID NO: 407045 - RNA, 20 nt, Human
cccggguucaagugauucuc

SEQ ID NO: 407046 - RNA, 23 nt, Human
cccggguucaagugauucuccuc

SEQ ID NO: 407047 - RNA, 23 nt, Human
cccuaguagcugggauuacaggc

SEQ ID NO: 407048 - RNA, 18 nt, Human
cccuuugguugcuuagca

SEQ ID NO: 407049 - RNA, 26 nt, Human
ccgccuccuggguucaagcaacucuu

SEQ ID NO: 407050 - RNA, 22 nt, Human
ccggguucaagugauucuccuu

SEQ ID NO: 407051 - RNA, 23 nt, Human
ccuaguagcugggauuacaggca

SEQ ID NO: 407052 - RNA, 24 nt, Human
ccuaguagcugggauuacaggcau

SEQ ID NO: 407053 - RNA, 20 nt, Human
ccucaagagacagaagaguc

SEQ ID NO: 407054 - RNA, 20 nt, Human
ccuccugaguagcagggauu

SEQ ID NO: 407055 - RNA, 22 nt, Human
ccuccuggguucaagcaacucu

SEQ ID NO: 407056 - RNA, 22 nt, Human
ccugaccuugugauccacccac

SEQ ID NO: 407057 - RNA, 19 nt, Human
ccugaguagcagggauuac

SEQ ID NO: 407058 - RNA, 23 nt, Human
ccugaguagcagggauuacaggc

SEQ ID NO: 407059 - RNA, 24 nt, Human
ccugaguagcagggauuacaggca

SEQ ID NO: 407060 - RNA, 20 nt, Human
ccuggguucaagcaacucuc

SEQ ID NO: 407061 - RNA, 22 nt, Human
ccuguuugaaacuagccuagga

SEQ ID NO: 407062 - RNA, 18 nt, Human
ccuugguuagacuuccug

SEQ ID NO: 407063 - RNA, 18 nt, Human
cgagggagaagguuccca

SEQ ID NO: 407064 - RNA, 22 nt, Human
cgcugcccggguucaagugauu

SEQ ID NO: 407065 - RNA, 24 nt, Human
cgcugggauuacaggcgugagcca

SEQ ID NO: 407066 - RNA, 19 nt, Human
cuacuguuuucuaccucug

SEQ ID NO: 407067 - RNA, 22 nt, Human
cuaguagcugggauuacaggca

SEQ ID NO: 407068 - RNA, 19 nt, Human
cucaagagacagaagaguc

SEQ ID NO: 407069 - RNA, 23 nt, Human
cucaagagacagaagagucagga

SEQ ID NO: 407070 - RNA, 24 nt, Human
cucaagagacagaagagucaggac

SEQ ID NO: 407071 - RNA, 20 nt, Human
cucacucuauugcccaggcc

SEQ ID NO: 407072 - RNA, 24 nt, Human
cucacugcaaccuccgcugcccgg

SEQ ID NO: 407073 - RNA, 24 nt, Human
cucacugcaaucuccgccuccugg

SEQ ID NO: 407074 - RNA, 24 nt, Human
cucagccucccuaguagcugggau

SEQ ID NO: 407075 - RNA, 20 nt, Human
cuccccagaugagaucuggc

SEQ ID NO: 407076 - RNA, 18 nt, Human
cuccugaccuugugaucc

SEQ ID NO: 407077 - RNA, 20 nt, Human
cuccuggaagccuuuucaua

SEQ ID NO: 407078 - RNA, 18 nt, Human
cugacuggagagucucua

SEQ ID NO: 407079 - RNA, 18 nt, Human
cugaucuagguagauuag

SEQ ID NO: 407080 - RNA, 24 nt, Human
cugcaaccuccgcugcccggguuc

SEQ ID NO: 407081 - RNA, 21 nt, Human
cugcccggguucaagugauuc

SEQ ID NO: 407082 - RNA, 24 nt, Human
cugcccggguucaagugauucucc

SEQ ID NO: 407083 - RNA, 21 nt, Human
cugccugguauucugcuacau

SEQ ID NO: 407084 - RNA, 18 nt, Human
cugcggcguaccuggagg

SEQ ID NO: 407085 - RNA, 20 nt, Human
cugcugccacauggcagcug

SEQ ID NO: 407086 - RNA, 23 nt, Human
cuggcagcagagagguguggagg

SEQ ID NO: 407087 - RNA, 21 nt, Human
cuggccagagaccagcugcau

SEQ ID NO: 407088 - RNA, 19 nt, Human
cugggccuaagggcugggc

SEQ ID NO: 407089 - RNA, 21 nt, Human
cugggggugggugaacggggc

SEQ ID NO: 407090 - RNA, 20 nt, Human
cugugaggcccgccuaacuc

SEQ ID NO: 407091 - RNA, 21 nt, Human
cugugcugagaauauucuagu

SEQ ID NO: 407092 - RNA, 24 nt, Human
cuugccucagccucccuaguagcu

SEQ ID NO: 407093 - RNA, 24 nt, Human
cuugcucuguccccaggcuggagu

SEQ ID NO: 407094 - RNA, 21 nt, Human
gaaaacuuucuacccucuagg

SEQ ID NO: 407095 - RNA, 18 nt, Human
gaauauaacuucaaaacc

SEQ ID NO: 407096 - RNA, 19 nt, Human
gacaaaacaggacgcagaa

SEQ ID NO: 407097 - RNA, 20 nt, Human
gacaaaacaggacgcagaac

SEQ ID NO: 407098 - RNA, 19 nt, Human
gaccagccacgcugaucua

SEQ ID NO: 407099 - RNA, 22 nt, Human
gaccuugugauccacccacauc

SEQ ID NO: 407100 - RNA, 24 nt, Human
gaccuugugauccacccacaucgg

SEQ ID NO: 407101 - RNA, 24 nt, Human
gaccuugugauccacccacaucgg

SEQ ID NO: 407102 - RNA, 19 nt, Human
gacgcagaaccuucagaac

SEQ ID NO: 407103 - RNA, 18 nt, Human
gagaugggguuucaccau

SEQ ID NO: 407104 - RNA, 24 nt, Human
gagaugggguuucaccaucuuggc

SEQ ID NO: 407105 - RNA, 19 nt, Human
gagggcuuaccuguggggg

SEQ ID NO: 407106 - RNA, 24 nt, Human
gaucacucuaguuuuaggguggaa

SEQ ID NO: 407107 - RNA, 18 nt, Human
gauuacaggcgugagcca

SEQ ID NO: 407108 - RNA, 20 nt, Human
gauuacaggcgugagccacc

SEQ ID NO: 407109 - RNA, 22 nt, Human
gauuacaggcgugagccaccgc

SEQ ID NO: 407110 - RNA, 21 nt, Human
gauucuccuuccucagccucc

SEQ ID NO: 407111 - RNA, 23 nt, Human
gcacugaaagucuauuuaaacca

SEQ ID NO: 407112 - RNA, 21 nt, Human
gcagagaugggguuucaccau

SEQ ID NO: 407113 - RNA, 20 nt, Human
gcagcuucuggagggagcug

SEQ ID NO: 407114 - RNA, 20 nt, Human
gcccagacuccagcuccacc

SEQ ID NO: 407115 - RNA, 20 nt, Human
gcccaggcuggagugcagug

SEQ ID NO: 407116 - RNA, 24 nt, Human
gcccaggcuggagugcaguggugu

SEQ ID NO: 407117 - RNA, 18 nt, Human
gcccggcuaauuuuugua

SEQ ID NO: 407118 - RNA, 22 nt, Human
gcccggcuaauuuuuguauuuu

SEQ ID NO: 407119 - RNA, 19 nt, Human
gcccggguucaagugauuc

SEQ ID NO: 407120 - RNA, 20 nt, Human
gcugagggcuuaccuguggg

SEQ ID NO: 407121 - RNA, 18 nt, Human
gcugggugaccugugagg

SEQ ID NO: 407122 - RNA, 18 nt, Human
gcugggugaccugugagg

SEQ ID NO: 407123 - RNA, 18 nt, Human
gcugucacgccgguccug

SEQ ID NO: 407124 - RNA, 19 nt, Human
ggaauaccaguagucucag

SEQ ID NO: 407125 - RNA, 22 nt, Human
ggacuggaugacucccauucau

SEQ ID NO: 407126 - RNA, 21 nt, Human
ggauuacaggcacaugccaug

SEQ ID NO: 407127 - RNA, 20 nt, Human
ggcagaaauguuggggucaa

SEQ ID NO: 407128 - RNA, 20 nt, Human
ggccagagcaccaggcacug

SEQ ID NO: 407129 - RNA, 22 nt, Human
ggcuggagugcaguggugugau

SEQ ID NO: 407130 - RNA, 18 nt, Human
ggcugggccaggggacag

SEQ ID NO: 407131 - RNA, 18 nt, Human
gggaaacaccacgcccuu

SEQ ID NO: 407132 - RNA, 22 nt, Human
gggagggaaggggcuuucuggg

SEQ ID NO: 407133 - RNA, 18 nt, Human
gggauuacaggcacaugc

SEQ ID NO: 407134 - RNA, 20 nt, Human
gggauuacaggcacaugcca

SEQ ID NO: 407135 - RNA, 18 nt, Human
gggguuucaccaucuugg

SEQ ID NO: 407136 - RNA, 22 nt, Human
gggguuucaccaucuuggccag

SEQ ID NO: 407137 - RNA, 18 nt, Human
guagcugggauuacaggc

SEQ ID NO: 407138 - RNA, 20 nt, Human
guagcugggauuacaggcau

SEQ ID NO: 407139 - RNA, 19 nt, Human
guauuuuuugcagagaugg

SEQ ID NO: 407140 - RNA, 24 nt, Human
gucuugcucuguccccaggcugga

SEQ ID NO: 407141 - RNA, 20 nt, Human
gugacucugggucuccauuu

SEQ ID NO: 407142 - RNA, 24 nt, Human
gugauccacccacaucggccuccc

SEQ ID NO: 407143 - RNA, 18 nt, Human
gugauucuccuuccucag

SEQ ID NO: 407144 - RNA, 20 nt, Human
gugauucuccuuccucagcc

SEQ ID NO: 407145 - RNA, 24 nt, Human
gugauucuccuuccucagccuccu

SEQ ID NO: 407146 - RNA, 19 nt, Human
gugcuggcagcagagaggu

SEQ ID NO: 407147 - RNA, 20 nt, Human
guggaagaugaggacuggga

SEQ ID NO: 407148 - RNA, 23 nt, Human
uaacagaauauaacuucaaaacc

SEQ ID NO: 407149 - RNA, 23 nt, Human
uaagcagguugaaagcugggccu

SEQ ID NO: 407150 - RNA, 23 nt, Human
uaagccugcggaagacugagaca

SEQ ID NO: 407151 - RNA, 21 nt, Human
uaauucacugcuugggaggga

SEQ ID NO: 407152 - RNA, 18 nt, Human
uaauuuccccuuuuucuc

SEQ ID NO: 407153 - RNA, 24 nt, Human
uaauuuuuguauuuuuugcagaga

SEQ ID NO: 407154 - RNA, 24 nt, Human
uacaggcaugcaccaccacgccca

SEQ ID NO: 407155 - RNA, 24 nt, Human
uacaggcgugagccaccgcgccca

SEQ ID NO: 407156 - RNA, 19 nt, Human
uacccuuuuugucccaagg

SEQ ID NO: 407157 - RNA, 22 nt, Human
uaggacuauaguuuuaaggcaa

SEQ ID NO: 407158 - RNA, 27 nt, Human
uaguagcugggauuacaggcaugcacc

SEQ ID NO: 407159 - RNA, 22 nt, Human
uauaggacaaagcugcccuucc

SEQ ID NO: 407160 - RNA, 19 nt, Human
uauugcccaggcuggagug

SEQ ID NO: 407161 - RNA, 23 nt, Human
ucaagucucgcagaguaaccagg

SEQ ID NO: 407162 - RNA, 24 nt, Human
ucacucuauugcccaggcuggagu

SEQ ID NO: 407163 - RNA, 19 nt, Human
ucacugcaaccuccgcugc

SEQ ID NO: 407164 - RNA, 21 nt, Human
ucacugcaaccuccgcugccc

SEQ ID NO: 407165 - RNA, 24 nt, Human
ucacugcaaccuccgcugcccggg

SEQ ID NO: 407166 - RNA, 20 nt, Human
ucacugcaaccuccgcuggg

SEQ ID NO: 407167 - RNA, 23 nt, Human
ucacugcaaccuccgcugggguc

SEQ ID NO: 407168 - RNA, 25 nt, Human
ucacugcaaccuccgcugggguccc

SEQ ID NO: 407169 - RNA, 26 nt, Human
ucacugcaaccuccgcugggguccuc

SEQ ID NO: 407170 - RNA, 23 nt, Human
ucacugcaaucuccgccuccugg

SEQ ID NO: 407171 - RNA, 24 nt, Human
ucacugcaaucuccgccuccuggg

SEQ ID NO: 407172 - RNA, 25 nt, Human
ucacugcaaucuccgccuccugggu

SEQ ID NO: 407173 - RNA, 27 nt, Human
ucacugcaaucuccgccuccuggguuc

SEQ ID NO: 407174 - RNA, 19 nt, Human
ucagaccaggaacugcuaa

SEQ ID NO: 407175 - RNA, 21 nt, Human
ucagcacucggucaguaccgu

SEQ ID NO: 407176 - RNA, 21 nt, Human
uccaccacuagcugugcgacc

SEQ ID NO: 407177 - RNA, 24 nt, Human
ucccaaagcgcugggauuacaggc

SEQ ID NO: 407178 - RNA, 21 nt, Human
ucccaaauuuuugaaucaagu

SEQ ID NO: 407179 - RNA, 19 nt, Human
ucccagauuuguggcucug

SEQ ID NO: 407180 - RNA, 23 nt, Human
uccccaggcuggagugcaguggu

SEQ ID NO: 407181 - RNA, 24 nt, Human
uccccaggcuggagugcaguggug

SEQ ID NO: 407182 - RNA, 24 nt, Human
ucccuaguagcugggauuacaggc

SEQ ID NO: 407183 - RNA, 20 nt, Human
ucccuggaaagaagccuccc

SEQ ID NO: 407184 - RNA, 24 nt, Human
uccgccuccuggguucaagcaacu

SEQ ID NO: 407185 - RNA, 24 nt, Human
uccugaguagcagggauuacaggc

SEQ ID NO: 407186 - RNA, 19 nt, Human
uccuggguucaagcaacuc

SEQ ID NO: 407187 - RNA, 21 nt, Human
uccuggguucaagcaacucuc

SEQ ID NO: 407188 - RNA, 24 nt, Human
uccuggguucaagcaacucucuug

SEQ ID NO: 407189 - RNA, 18 nt, Human
ucuaguagcuccugcugc

SEQ ID NO: 407190 - RNA, 24 nt, Human
ucuauugcccaggcuggagugcag

SEQ ID NO: 407191 - RNA, 23 nt, Human
ucucacucuauugcccaggcugg

SEQ ID NO: 407192 - RNA, 24 nt, Human
ucucacucuauugcccaggcugga

SEQ ID NO: 407193 - RNA, 26 nt, Human
ucucacucuauugcccaggcuggagu

SEQ ID NO: 407194 - RNA, 27 nt, Human
ucucacucuauugcccaggcuggagug

SEQ ID NO: 407195 - RNA, 19 nt, Human
ucucgcagaguaaccaggc

SEQ ID NO: 407196 - RNA, 21 nt, Human
ucucugcuacaugaaucccaa

SEQ ID NO: 407197 - RNA, 23 nt, Human
ucugucaggaacacccucugccu

SEQ ID NO: 407198 - RNA, 23 nt, Human
ucuguccccaggcuggagugcag

SEQ ID NO: 407199 - RNA, 21 nt, Human
ucuucccucugucaggaacac

SEQ ID NO: 407200 - RNA, 21 nt, Human
ucuugcucuguccccaggcug

SEQ ID NO: 407201 - RNA, 21 nt, Human
ucuugcucuguccccaggcug

SEQ ID NO: 407202 - RNA, 22 nt, Human
ucuugcucuguccccaggcugg

SEQ ID NO: 407203 - RNA, 23 nt, Human
ucuugcucuguccccaggcugga

SEQ ID NO: 407204 - RNA, 22 nt, Human
ugaaaagacuuuucugcaugaa

SEQ ID NO: 407205 - RNA, 22 nt, Human
ugaaacggagucucacucuauu

SEQ ID NO: 407206 - RNA, 21 nt, Human
ugaaagagaagaagguaagug

SEQ ID NO: 407207 - RNA, 24 nt, Human
ugaaugugcuggcagcagagaggu

SEQ ID NO: 407208 - RNA, 25 nt, Human
ugaaugugcuggcagcagagaggug

SEQ ID NO: 407209 - RNA, 19 nt, Human
ugacaaaacaggacgcaga

SEQ ID NO: 407210 - RNA, 18 nt, Human
ugagaaagcagcauaugc

SEQ ID NO: 407211 - RNA, 27 nt, Human
ugagaaagcagcauaugcagaagggaa

SEQ ID NO: 407212 - RNA, 23 nt, Human
ugagacaagagucuugcucuguc

SEQ ID NO: 407213 - RNA, 25 nt, Human
ugagagggcagcagcagacuuguuu

SEQ ID NO: 407214 - RNA, 19 nt, Human
ugagauucuuguuccuugg

SEQ ID NO: 407215 - RNA, 21 nt, Human
ugaggacugggagaggguuca

SEQ ID NO: 407216 - RNA, 22 nt, Human
ugaguaagcagguugaaagcug

SEQ ID NO: 407217 - RNA, 23 nt, Human
ugaguagcagggauuacaggcac

SEQ ID NO: 407218 - RNA, 21 nt, Human
ugaugguggggugagggugcg

SEQ ID NO: 407219 - RNA, 20 nt, Human
ugauuccuucccaaaauccc

SEQ ID NO: 407220 - RNA, 22 nt, Human
ugcaguggugcaaucucagcuc

SEQ ID NO: 407221 - RNA, 18 nt, Human
ugcccaggcuggagugca

SEQ ID NO: 407222 - RNA, 21 nt, Human
ugcccaggcuggagugcagug

SEQ ID NO: 407223 - RNA, 24 nt, Human
ugcccaggcuggagugcaguggug

SEQ ID NO: 407224 - RNA, 25 nt, Human
ugcccggcuaauuuuuguauuuuuu

SEQ ID NO: 407225 - RNA, 19 nt, Human
ugcccggguucaagugauu

SEQ ID NO: 407226 - RNA, 24 nt, Human
ugccucagccucccuaguagcugg

SEQ ID NO: 407227 - RNA, 25 nt, Human
ugccugucacaauucaguuugggcc

SEQ ID NO: 407228 - RNA, 21 nt, Human
uggaagaugaggacugggaga

SEQ ID NO: 407229 - RNA, 24 nt, Human
uggaagccuuuucauagcugaggg

SEQ ID NO: 407230 - RNA, 18 nt, Human
uggagugcaguggugcaa

SEQ ID NO: 407231 - RNA, 23 nt, Human
uggagugcaguggugcaaucuca

SEQ ID NO: 407232 - RNA, 24 nt, Human
uggagugcaguggugcaaucucag

SEQ ID NO: 407233 - RNA, 19 nt, Human
uggagugcaguggugugau

SEQ ID NO: 407234 - RNA, 23 nt, Human
uggagugcaguggugugaucucg

SEQ ID NO: 407235 - RNA, 24 nt, Human
uggagugcaguggugugaucucgg

SEQ ID NO: 407236 - RNA, 24 nt, Human
uggccaggcuagucucaaacuccu

SEQ ID NO: 407237 - RNA, 24 nt, Human
uggcgcagguaagccugcggaaga

SEQ ID NO: 407238 - RNA, 25 nt, Human
ugggaaaacuuucuacccucuaggg

SEQ ID NO: 407239 - RNA, 23 nt, Human
ugggaagaggucuuggucaucag

SEQ ID NO: 407240 - RNA, 21 nt, Human
ugggauuacaggcaugcacca

SEQ ID NO: 407241 - RNA, 24 nt, Human
ugggauuacaggcaugcaccacca

SEQ ID NO: 407242 - RNA, 18 nt, Human
ugggauuacaggcgugag

SEQ ID NO: 407243 - RNA, 19 nt, Human
ugggauuacaggcgugagc

SEQ ID NO: 407244 - RNA, 21 nt, Human
ugggauuacaggcgugagcca

SEQ ID NO: 407245 - RNA, 22 nt, Human
ugggauuacaggcgugagccac

SEQ ID NO: 407246 - RNA, 23 nt, Human
ugggauuacaggcgugagccacc

SEQ ID NO: 407247 - RNA, 24 nt, Human
ugggauuacaggcgugagccaccg

SEQ ID NO: 407248 - RNA, 18 nt, Human
uggggcagggagagggcc

SEQ ID NO: 407249 - RNA, 23 nt, Human
uggggcagggagagggcccuaag

SEQ ID NO: 407250 - RNA, 19 nt, Human
ugggggugggugaacgggg

SEQ ID NO: 407251 - RNA, 24 nt, Human
ugggguuucaccaucuuggccagg

SEQ ID NO: 407252 - RNA, 24 nt, Human
uggugcaaucucagcucacugcaa

SEQ ID NO: 407253 - RNA, 18 nt, Human
ugucacgccgguccuggc

SEQ ID NO: 407254 - RNA, 19 nt, Human
ugugcuggcagcagagagg

SEQ ID NO: 407255 - RNA, 20 nt, Human
ugugcuggcagcagagaggu

SEQ ID NO: 407256 - RNA, 22 nt, Human
ugugcuguacgagggagaaggu

SEQ ID NO: 407257 - RNA, 19 nt, Human
uuaaaaauaucugcaagca

SEQ ID NO: 407258 - RNA, 19 nt, Human
uuaaaaauaucugcaagca

SEQ ID NO: 407259 - RNA, 19 nt, Human
uucaaaaccgucuagggaa

SEQ ID NO: 407260 - RNA, 23 nt, Human
uucaagugauucuccuuccucag

SEQ ID NO: 407261 - RNA, 24 nt, Human
uucaagugauucuccuuccucagc

SEQ ID NO: 407262 - RNA, 25 nt, Human
uucacauuuuauuaaaccaaauauu

SEQ ID NO: 407263 - RNA, 25 nt, Human
uucacauuuuauuaaaccaaauauu

SEQ ID NO: 407264 - RNA, 23 nt, Human
uucaggaccucagacuccccaga

SEQ ID NO: 407265 - RNA, 20 nt, Human
uuccaugacauucuggaggc

SEQ ID NO: 407266 - RNA, 20 nt, Human
uuccucagccuccugaguag

SEQ ID NO: 407267 - RNA, 22 nt, Human
uuccuuggcaacaucuggaucu

SEQ ID NO: 407268 - RNA, 18 nt, Human
uuccuugguuagacuucc

SEQ ID NO: 407269 - RNA, 19 nt, Human
uuccuugguuagacuuccu

SEQ ID NO: 407270 - RNA, 22 nt, Human
uugaaagcugggccuaagggcu

SEQ ID NO: 407271 - RNA, 26 nt, Human
uugcagagaugggguuucaccaucuu

SEQ ID NO: 407272 - RNA, 19 nt, Human
uugcagcuucuggagggag

SEQ ID NO: 407273 - RNA, 23 nt, Human
uugcucuguccccaggcuggagu

SEQ ID NO: 407274 - RNA, 24 nt, Human
uugcucuguccccaggcuggagug

SEQ ID NO: 407275 - RNA, 18 nt, Human
uugggcagacuagacaag

SEQ ID NO: 407276 - RNA, 20 nt, Human
uuuacagucuagcucugucu

SEQ ID NO: 407277 - RNA, 24 nt, Human
uuuacagucuagcucugucucugc

SEQ ID NO: 407278 - RNA, 24 nt, Human
uuucaccaucuuggccaggcuagu

SEQ ID NO: 407279 - RNA, 20 nt, Human
uuucucaggauuccugcagc

SEQ ID NO: 407280 - RNA, 20 nt, Human
uuucugacuggagagucucu

SEQ ID NO: 407281 - RNA, 19 nt, Human
uuugcaagguucugucugc

SEQ ID NO: 407282 - RNA, 24 nt, Human
uuugcagagaugggguuucaccau

SEQ ID NO: 407283 - RNA, 24 nt, Human
uuuugggcagacuagacaagccuu

SEQ ID NO: 407284 - RNA, 20 nt, Human
uuuuuguauuuuuugcagag

SEQ ID NO: 407285 - RNA, 23 nt, Human
uuuuuguauuuuuugcagagaug

SEQ ID NO: 407286 - RNA, 24 nt, Human
uuuuuugcagagaugggguuucac

SEQ ID NO: 407287 - RNA, 20 nt, Human
uuuuuuuuuuugaaacggag

SEQ ID NO: 407288 - RNA, 22 nt, Human
uuuuuuuuuuugaaacggaguc

SEQ ID NO: 407289 - RNA, 26 nt, Human
uuuuuuuuuuuugaaacggagucuca

SEQ ID NO: 407290 - RNA, 22 nt, Human
uuuuuuuuuuuuuugaaacgga

SEQ ID NO: 407291 - RNA, 20 nt, Human
uuuuuuuuuuuuuuuuuugg

SEQ ID NO: 407292 - RNA, 22 nt, Human
aauacuuccuauccuccuuaca

SEQ ID NO: 407293 - RNA, 21 nt, Human
acaccauacaucucaaggaug

SEQ ID NO: 407294 - RNA, 22 nt, Human
acacuccacaucugagaugagc

SEQ ID NO: 407295 - RNA, 20 nt, Human
acagugaugcaggcucggca

SEQ ID NO: 407296 - RNA, 22 nt, Human
accuccuugagucucuccacua

SEQ ID NO: 407297 - RNA, 18 nt, Human
acuacucugggagauuuu

SEQ ID NO: 407298 - RNA, 22 nt, Human
acuuaguuuuacacagugaucu

SEQ ID NO: 407299 - RNA, 19 nt, Human
aggaaaaagaaacugagaa

SEQ ID NO: 407300 - RNA, 22 nt, Human
aguucuaaagaagggaaaccac

SEQ ID NO: 407301 - RNA, 21 nt, Human
auacaccauacaucucaagga

SEQ ID NO: 407302 - RNA, 20 nt, Human
caacacacugacauacccuc

SEQ ID NO: 407303 - RNA, 22 nt, Human
caagaaccuuuaguugauguug

SEQ ID NO: 407304 - RNA, 21 nt, Human
cacagagaucucucuucuucc

SEQ ID NO: 407305 - RNA, 23 nt, Human
cacagucuagacucaaggguucu

SEQ ID NO: 407306 - RNA, 19 nt, Human
cacuauguuggccagaugc

SEQ ID NO: 407307 - RNA, 23 nt, Human
cacuauguuggccagaugcugau

SEQ ID NO: 407308 - RNA, 24 nt, Human
cacuauguuggccagaugcugauu

SEQ ID NO: 407309 - RNA, 19 nt, Human
cagagaucucucuucuucc

SEQ ID NO: 407310 - RNA, 22 nt, Human
cagaugggacaggucaccuccu

SEQ ID NO: 407311 - RNA, 19 nt, Human
cagccucugcaaacuuauc

SEQ ID NO: 407312 - RNA, 24 nt, Human
cagcuuccagcuucucagcuuccu

SEQ ID NO: 407313 - RNA, 20 nt, Human
cagcuucucagcuuccuccu

SEQ ID NO: 407314 - RNA, 26 nt, Human
caggcagaugggacaggucaccuccu

SEQ ID NO: 407315 - RNA, 19 nt, Human
caggcucggcagaggcugu

SEQ ID NO: 407316 - RNA, 23 nt, Human
ccaccaaauaacucuaauagcua

SEQ ID NO: 407317 - RNA, 22 nt, Human
ccacugacuccgacacuccaca

SEQ ID NO: 407318 - RNA, 21 nt, Human
ccaggcagaugggacagguca

SEQ ID NO: 407319 - RNA, 23 nt, Human
ccaggcagaugggacaggucacc

SEQ ID NO: 407320 - RNA, 21 nt, Human
ccauugcacugcuucccuggc

SEQ ID NO: 407321 - RNA, 24 nt, Human
cccauacugcugugucuuuaggag

SEQ ID NO: 407322 - RNA, 21 nt, Human
ccuccucuuccuucuucagcc

SEQ ID NO: 407323 - RNA, 23 nt, Human
ccuccuuacagaagaguaggagu

SEQ ID NO: 407324 - RNA, 23 nt, Human
ccuccuugagucucuccacuaug

SEQ ID NO: 407325 - RNA, 19 nt, Human
cucaagccaaauacaccau

SEQ ID NO: 407326 - RNA, 19 nt, Human
cucaagccaaauacaccau

SEQ ID NO: 407327 - RNA, 21 nt, Human
cucugaaaauaugaaaaagag

SEQ ID NO: 407328 - RNA, 21 nt, Human
cucugaugucagcuuccagcu

SEQ ID NO: 407329 - RNA, 19 nt, Human
cuggcuucuucugguccua

SEQ ID NO: 407330 - RNA, 19 nt, Human
cuggcuucuucugguccua

SEQ ID NO: 407331 - RNA, 20 nt, Human
cugguccuaacuccugaggc

SEQ ID NO: 407332 - RNA, 20 nt, Human
cugguccuaacuccugaggc

SEQ ID NO: 407333 - RNA, 24 nt, Human
cuuacagaagaguaggaguuucuc

SEQ ID NO: 407334 - RNA, 25 nt, Human
cuucacucugaauacacauauugcu

SEQ ID NO: 407335 - RNA, 18 nt, Human
cuucugguccuaacuccu

SEQ ID NO: 407336 - RNA, 18 nt, Human
cuucugguccuaacuccu

SEQ ID NO: 407337 - RNA, 21 nt, Human
cuuuucuucuucuuccaaucu

SEQ ID NO: 407338 - RNA, 23 nt, Human
gagaaaguauucaucaugauuag

SEQ ID NO: 407339 - RNA, 18 nt, Human
gauaccacacacaggaca

SEQ ID NO: 407340 - RNA, 22 nt, Human
gauguuauacccauacugcugu

SEQ ID NO: 407341 - RNA, 22 nt, Human
gcacugcuucccuggcuucuuc

SEQ ID NO: 407342 - RNA, 19 nt, Human
gccacagucuagacucaag

SEQ ID NO: 407343 - RNA, 18 nt, Human
gguggcuaacaggcuuug

SEQ ID NO: 407344 - RNA, 25 nt, Human
gugaugcaggcucggcagaggcugu

SEQ ID NO: 407345 - RNA, 22 nt, Human
uaacucaagccaaauacaccau

SEQ ID NO: 407346 - RNA, 20 nt, Human
uaacuccugaggcucuccuc

SEQ ID NO: 407347 - RNA, 20 nt, Human
uaacuccugaggcucuccuc

SEQ ID NO: 407348 - RNA, 23 nt, Human
uacacagugaucuuaauaguuag

SEQ ID NO: 407349 - RNA, 18 nt, Human
uaccacacacaggacagc

SEQ ID NO: 407350 - RNA, 21 nt, Human
uaccacacacaggacagcugc

SEQ ID NO: 407351 - RNA, 23 nt, Human
uaggaugcuucuaagcugaucaa

SEQ ID NO: 407352 - RNA, 18 nt, Human
uaggugaagaaaugagaa

SEQ ID NO: 407353 - RNA, 21 nt, Human
uaggugaagaaaugagaaaau

SEQ ID NO: 407354 - RNA, 18 nt, Human
ucaagccaaauacaccau

SEQ ID NO: 407355 - RNA, 25 nt, Human
ucagccucuugaggacugccuggag

SEQ ID NO: 407356 - RNA, 22 nt, Human
ucaugggggugguuccuaugga

SEQ ID NO: 407357 - RNA, 18 nt, Human
uccaugaugaucacagag

SEQ ID NO: 407358 - RNA, 24 nt, Human
ucccaugcuggucacugccuccuu

SEQ ID NO: 407359 - RNA, 22 nt, Human
uccugaggcucuccucucucuu

SEQ ID NO: 407360 - RNA, 24 nt, Human
uccuugagucucuccacuauguug

SEQ ID NO: 407361 - RNA, 18 nt, Human
ucucucauaacucaagcc

SEQ ID NO: 407362 - RNA, 23 nt, Human
ucucugaaaauaugaaaaagagu

SEQ ID NO: 407363 - RNA, 22 nt, Human
ucugggcucaacuugaccuccu

SEQ ID NO: 407364 - RNA, 19 nt, Human
ugaacuagcucauccucag

SEQ ID NO: 407365 - RNA, 22 nt, Human
ugaauacuuccuauccuccuua

SEQ ID NO: 407366 - RNA, 21 nt, Human
ugaccaccaaauaacucuaau

SEQ ID NO: 407367 - RNA, 22 nt, Human
ugagcucucucaccaacugcuu

SEQ ID NO: 407368 - RNA, 23 nt, Human
ugagcucucucaccaacugcuuc

SEQ ID NO: 407369 - RNA, 18 nt, Human
ugcugugucuuuaggagg

SEQ ID NO: 407370 - RNA, 19 nt, Human
ugguggucauggggguggu

SEQ ID NO: 407371 - RNA, 18 nt, Human
uggugguggucauggggg

SEQ ID NO: 407372 - RNA, 23 nt, Human
ugucugggcucaacuugaccucc

SEQ ID NO: 407373 - RNA, 18 nt, Human
uuauacccauacugcugu

SEQ ID NO: 407374 - RNA, 22 nt, Human
uucaggaaaaagaaacugagaa

SEQ ID NO: 407375 - RNA, 23 nt, Human
uucaggaaaaagaaacugagaaa

SEQ ID NO: 407376 - RNA, 18 nt, Human
uucccuggcuucuucugg

SEQ ID NO: 407377 - RNA, 18 nt, Human
uucccuggcuucuucugg

SEQ ID NO: 407378 - RNA, 22 nt, Human
uuccuccucuuccuucuucagc

SEQ ID NO: 407379 - RNA, 19 nt, Human
uucuucugguccuaacucc

SEQ ID NO: 407380 - RNA, 19 nt, Human
uucuucugguccuaacucc

SEQ ID NO: 407381 - RNA, 23 nt, Human
uugaauacuuccuauccuccuua

SEQ ID NO: 407382 - RNA, 24 nt, Human
uugagcucaaauacucuggacaua

SEQ ID NO: 407383 - RNA, 18 nt, Human
uuuaguugauguuggugg

SEQ ID NO: 407384 - RNA, 20 nt, Human
uuuuccucuccuugauuccu

SEQ ID NO: 407385 - RNA, 19 nt, Human
aaaauacagcagaugagau

SEQ ID NO: 407386 - RNA, 20 nt, Human
aagaaaagggggcuuuaaaa

SEQ ID NO: 407387 - RNA, 20 nt, Human
aaguaaaauacagcagauga

SEQ ID NO: 407388 - RNA, 19 nt, Human
aaucugauuaucugacuga

SEQ ID NO: 407389 - RNA, 19 nt, Human
acagggcagaaucucuucc

SEQ ID NO: 407390 - RNA, 20 nt, Human
acauacuccaaaaaggagau

SEQ ID NO: 407391 - RNA, 23 nt, Human
acugcugucuuagacuaaacugu

SEQ ID NO: 407392 - RNA, 22 nt, Human
acuguuuuucccauguacuacu

SEQ ID NO: 407393 - RNA, 24 nt, Human
acuucaguuauucacauagugucu

SEQ ID NO: 407394 - RNA, 19 nt, Human
agaaaagggggcuuuaaaa

SEQ ID NO: 407395 - RNA, 19 nt, Human
agaagucacacaacagaaa

SEQ ID NO: 407396 - RNA, 23 nt, Human
agagaagauacauacuccaaaaa

SEQ ID NO: 407397 - RNA, 19 nt, Human
agcaaaauucagggucaag

SEQ ID NO: 407398 - RNA, 25 nt, Human
aggcagaaaaaaaugaaaggggacc

SEQ ID NO: 407399 - RNA, 19 nt, Human
agugaacaauauucacuaa

SEQ ID NO: 407400 - RNA, 23 nt, Human
augaaagaaaaccuuauaucaca

SEQ ID NO: 407401 - RNA, 25 nt, Human
caacagaaagauaccaugcgguuga

SEQ ID NO: 407402 - RNA, 20 nt, Human
cacaacagaaagauaccaug

SEQ ID NO: 407403 - RNA, 20 nt, Human
cagcucaaacacaaaugcag

SEQ ID NO: 407404 - RNA, 20 nt, Human
caggagcacaauggcaaagu

SEQ ID NO: 407405 - RNA, 24 nt, Human
caggagcacaauggcaaaguuugg

SEQ ID NO: 407406 - RNA, 19 nt, Human
cagggccaggaacguaaug

SEQ ID NO: 407407 - RNA, 24 nt, Human
caggucgagauaaugaagaaauaa

SEQ ID NO: 407408 - RNA, 18 nt, Human
cauguaagccacugugca

SEQ ID NO: 407409 - RNA, 25 nt, Human
ccaaagacaguagagcaccaaugcc

SEQ ID NO: 407410 - RNA, 22 nt, Human
ccaacaguuuccaaauuacuau

SEQ ID NO: 407411 - RNA, 22 nt, Human
ccaccuuccaacaguuuccaaa

SEQ ID NO: 407412 - RNA, 22 nt, Human
ccuguacuugaacaagugagag

SEQ ID NO: 407413 - RNA, 23 nt, Human
ccuguacuugaacaagugagaga

SEQ ID NO: 407414 - RNA, 24 nt, Human
cgagauaaugaagaaauaagacca

SEQ ID NO: 407415 - RNA, 24 nt, Human
cguauaguaagaggcagaaaaaaa

SEQ ID NO: 407416 - RNA, 28 nt, Human
gaacaaaaguaaacuaugagucacuacc

SEQ ID NO: 407417 - RNA, 21 nt, Human
gaacuguaauuaaaaccccaa

SEQ ID NO: 407418 - RNA, 20 nt, Human
gaccaaaucugauuaucugg

SEQ ID NO: 407419 - RNA, 21 nt, Human
gagaagauacauacuccaaaa

SEQ ID NO: 407420 - RNA, 19 nt, Human
gcaagacaucagacacgga

SEQ ID NO: 407421 - RNA, 18 nt, Human
gcagaaucucuuccaaag

SEQ ID NO: 407422 - RNA, 20 nt, Human
gcaugcagggccuggaggua

SEQ ID NO: 407423 - RNA, 21 nt, Human
uaaaauacagcagaugagaug

SEQ ID NO: 407424 - RNA, 21 nt, Human
uaaauguguugacacugaaau

SEQ ID NO: 407425 - RNA, 20 nt, Human
uaaauuaauagagaacuaca

SEQ ID NO: 407426 - RNA, 20 nt, Human
uaagcucuagccaaagacag

SEQ ID NO: 407427 - RNA, 21 nt, Human
uaaugaaaauaaagaagaaaa

SEQ ID NO: 407428 - RNA, 21 nt, Human
uacacgugucuacagggccag

SEQ ID NO: 407429 - RNA, 24 nt, Human
uacagucguauaguaagaggcaga

SEQ ID NO: 407430 - RNA, 21 nt, Human
uacauacuccaaaaaggagau

SEQ ID NO: 407431 - RNA, 24 nt, Human
uaccaugcgguugaacagugugcc

SEQ ID NO: 407432 - RNA, 21 nt, Human
uagccaaagacaguagagcac

SEQ ID NO: 407433 - RNA, 27 nt, Human
uauaguaagaggcagaaaaaaaugaaa

SEQ ID NO: 407434 - RNA, 23 nt, Human
ucaaacacaaaugcaggagcaca

SEQ ID NO: 407435 - RNA, 21 nt, Human
ucaauguacaacuaaugaaaa

SEQ ID NO: 407436 - RNA, 18 nt, Human
ucuggcaguuaaccagcc

SEQ ID NO: 407437 - RNA, 22 nt, Human
ucuuagacuaaacugugccacc

SEQ ID NO: 407438 - RNA, 21 nt, Human
ugaaagaaaaccuuauaucac

SEQ ID NO: 407439 - RNA, 21 nt, Human
ugaagaaauaagaccaaaucu

SEQ ID NO: 407440 - RNA, 22 nt, Human
ugacaaauuugagcaccaacua

SEQ ID NO: 407441 - RNA, 21 nt, Human
ugauuauuuaaacacaacuaa

SEQ ID NO: 407442 - RNA, 18 nt, Human
ugcaaacuauuuugaaca

SEQ ID NO: 407443 - RNA, 19 nt, Human
ugcaggagcacaauggcag

SEQ ID NO: 407444 - RNA, 25 nt, Human
ugcagggccuggagguacauuuucu

SEQ ID NO: 407445 - RNA, 28 nt, Human
uguaauuuccacaaauauauagcagcuc

SEQ ID NO: 407446 - RNA, 22 nt, Human
uuucacguucauguaagccacu

SEQ ID NO: 407447 - RNA, 25 nt, Human
uuucuggcaguuaaccagccuucug

SEQ ID NO: 407448 - RNA, 21 nt, Human
uuugcuaaauuaauagagaac

SEQ ID NO: 407449 - RNA, 22 nt, Human
aaaaccauccuagaaaccaagg

SEQ ID NO: 407450 - RNA, 22 nt, Human
aacagacaagaaaggaaucucg

SEQ ID NO: 407451 - RNA, 18 nt, Human
aaccagcuccccacccug

SEQ ID NO: 407452 - RNA, 22 nt, Human
acacaaaaccauccuagaaacc

SEQ ID NO: 407453 - RNA, 19 nt, Human
agacaagaaaggaaucucg

SEQ ID NO: 407454 - RNA, 19 nt, Human
agcccaguccuaccucccc

SEQ ID NO: 407455 - RNA, 23 nt, Human
agggguuucuguuuccuccucug

SEQ ID NO: 407456 - RNA, 19 nt, Human
aguccuaccucccccucca

SEQ ID NO: 407457 - RNA, 21 nt, Human
caaaaccauccuagaaaccaa

SEQ ID NO: 407458 - RNA, 19 nt, Human
caagaaaggaaucucgugc

SEQ ID NO: 407459 - RNA, 20 nt, Human
cacaaaaccauccuagaaac

SEQ ID NO: 407460 - RNA, 18 nt, Human
caccccagucauucccac

SEQ ID NO: 407461 - RNA, 23 nt, Human
caccccagucauucccacauccc

SEQ ID NO: 407462 - RNA, 19 nt, Human
cagcaggacacgggaagga

SEQ ID NO: 407463 - RNA, 20 nt, Human
cagcaggacacgggaaggaa

SEQ ID NO: 407464 - RNA, 26 nt, Human
cagcauacuucuccugauccaggcuc

SEQ ID NO: 407465 - RNA, 18 nt, Human
ccagcaggacacgggaag

SEQ ID NO: 407466 - RNA, 19 nt, Human
cccacccugacaguuagga

SEQ ID NO: 407467 - RNA, 21 nt, Human
cccguagcacuugacccugcc

SEQ ID NO: 407468 - RNA, 21 nt, Human
ccuccacacaaaaccauccua

SEQ ID NO: 407469 - RNA, 20 nt, Human
ccuuccuuccugacccgucc

SEQ ID NO: 407470 - RNA, 20 nt, Human
cuccacacaaaaccauccuu

SEQ ID NO: 407471 - RNA, 19 nt, Human
cuccccacccugacaguua

SEQ ID NO: 407472 - RNA, 23 nt, Human
cuccccacccugacaguuaggag

SEQ ID NO: 407473 - RNA, 21 nt, Human
cucuccuuccuuccugacccg

SEQ ID NO: 407474 - RNA, 25 nt, Human
cucuccuuccuuccugacccguccu

SEQ ID NO: 407475 - RNA, 21 nt, Human
cuuucucuuguuagaaagaga

SEQ ID NO: 407476 - RNA, 28 nt, Human
gacccugccucaccccagucauucccac

SEQ ID NO: 407477 - RNA, 24 nt, Human
gcccaguccuaccucccccuccaa

SEQ ID NO: 407478 - RNA, 18 nt, Human
ggaagucacagcugugcu

SEQ ID NO: 407479 - RNA, 23 nt, Human
uaccucccccuccacacaaaacc

SEQ ID NO: 407480 - RNA, 20 nt, Human
uacguuucuaacagacaaga

SEQ ID NO: 407481 - RNA, 18 nt, Human
ucaccccagucauuccca

SEQ ID NO: 407482 - RNA, 18 nt, Human
ucccccuccacacaaaac

SEQ ID NO: 407483 - RNA, 22 nt, Human
uccucugggaaccagcucccca

SEQ ID NO: 407484 - RNA, 18 nt, Human
ucuaccucaagaagcaag

SEQ ID NO: 407485 - RNA, 22 nt, Human
ucuccaagaugauucaggacug

SEQ ID NO: 407486 - RNA, 18 nt, Human
ucuccugauccaggcuca

SEQ ID NO: 407487 - RNA, 22 nt, Human
uggacuucaggguagacaaucc

SEQ ID NO: 407488 - RNA, 19 nt, Human
uguuagaaagagaagcuuc

SEQ ID NO: 407489 - RNA, 24 nt, Human
uugacccugccucaccccagucau

SEQ ID NO: 407490 - RNA, 18 nt, Human
aaaaaggagaaacagaga

SEQ ID NO: 407491 - RNA, 20 nt, Human
aaaacaaaaacaaaagucgc

SEQ ID NO: 407492 - RNA, 21 nt, Human
aaaacaaaauccaaaaggaaa

SEQ ID NO: 407493 - RNA, 19 nt, Human
aaaacaaagccaaaaccaa

SEQ ID NO: 407494 - RNA, 23 nt, Human
aaaaggaaaacaagaggagaaac

SEQ ID NO: 407495 - RNA, 20 nt, Human
aaaaucaaaaacaaagccaa

SEQ ID NO: 407496 - RNA, 27 nt, Human
aaacaaaaacaaaagucgcacaaucua

SEQ ID NO: 407497 - RNA, 28 nt, Human
aaacaaaaacaaaagucgcacaaucuaa

SEQ ID NO: 407498 - RNA, 22 nt, Human
aaacaaaagucgcacaauccua

SEQ ID NO: 407499 - RNA, 21 nt, Human
aaacaaagccaaaaccaaaac

SEQ ID NO: 407500 - RNA, 23 nt, Human
aaacaagaggagaaacaagcccg

SEQ ID NO: 407501 - RNA, 24 nt, Human
aaacaagaggagaaacaagcccgg

SEQ ID NO: 407502 - RNA, 25 nt, Human
aaacaagaggagaaacaaggggacc

SEQ ID NO: 407503 - RNA, 21 nt, Human
aaagccaaaaccaaaacaaaa

SEQ ID NO: 407504 - RNA, 21 nt, Human
aagccaaaaccaaaacaaaau

SEQ ID NO: 407505 - RNA, 18 nt, Human
aaggaaaagaccuggggc

SEQ ID NO: 407506 - RNA, 22 nt, Human
aaggaaaagaccuggggcaaug

SEQ ID NO: 407507 - RNA, 24 nt, Human
aaggacccaacuccgggcagcccc

SEQ ID NO: 407508 - RNA, 22 nt, Human
agaaacagagagagagcucagc

SEQ ID NO: 407509 - RNA, 24 nt, Human
agccaaaaccaaaacaaaauccaa

SEQ ID NO: 407510 - RNA, 18 nt, Human
aggaaaaaaggagaaaca

SEQ ID NO: 407511 - RNA, 18 nt, Human
aggagaaacaagcccggg

SEQ ID NO: 407512 - RNA, 22 nt, Human
aggagauucauaauaaaaaaaa

SEQ ID NO: 407513 - RNA, 25 nt, Human
aggcaaggacccaacuccgggcagc

SEQ ID NO: 407514 - RNA, 22 nt, Human
aggcugaaggugccaaaagcug

SEQ ID NO: 407515 - RNA, 23 nt, Human
agugaucaaacugcccaaaagga

SEQ ID NO: 407516 - RNA, 21 nt, Human
caaaaacaaagccaaaaccaa

SEQ ID NO: 407517 - RNA, 22 nt, Human
caaaaacaaagccaaaaccaaa

SEQ ID NO: 407518 - RNA, 26 nt, Human
caaaaacaaagccaaaaccaaaacaa

SEQ ID NO: 407519 - RNA, 21 nt, Human
caaaaccaaaacaaaauccaa

SEQ ID NO: 407520 - RNA, 18 nt, Human
caacuccgggcagccccu

SEQ ID NO: 407521 - RNA, 23 nt, Human
cagacacuuucccaucuccaggg

SEQ ID NO: 407522 - RNA, 27 nt, Human
caggaaguugcugugucaaaauccagg

SEQ ID NO: 407523 - RNA, 19 nt, Human
ccaaaaccaaaacaaaauc

SEQ ID NO: 407524 - RNA, 21 nt, Human
ccaaaaccaaaacaaaaucca

SEQ ID NO: 407525 - RNA, 21 nt, Human
cccaaaaggaaaacaagagga

SEQ ID NO: 407526 - RNA, 25 nt, Human
cccaaaaggaaaacaagaggagaaa

SEQ ID NO: 407527 - RNA, 27 nt, Human
cccggggcccugggcguuccucccggg

SEQ ID NO: 407528 - RNA, 20 nt, Human
cccugggcguuccucccggg

SEQ ID NO: 407529 - RNA, 19 nt, Human
ccgggggcuggggaggaag

SEQ ID NO: 407530 - RNA, 27 nt, Human
ccucccugcugaccucaacaagggcug

SEQ ID NO: 407531 - RNA, 19 nt, Human
ccuccucccugcugaccuc

SEQ ID NO: 407532 - RNA, 21 nt, Human
ccucgacacagacacuuuccc

SEQ ID NO: 407533 - RNA, 19 nt, Human
ccugccguccuggcccagg

SEQ ID NO: 407534 - RNA, 22 nt, Human
ccuggcccaggccagcucccac

SEQ ID NO: 407535 - RNA, 23 nt, Human
cggggcccugggcguuccucccg

SEQ ID NO: 407536 - RNA, 19 nt, Human
cucccgagcccgggggcug

SEQ ID NO: 407537 - RNA, 21 nt, Human
cugcccaaaaggaaaacaaga

SEQ ID NO: 407538 - RNA, 24 nt, Human
gaacaggaaguccacgauucauac

SEQ ID NO: 407539 - RNA, 20 nt, Human
gaggagaaggaagcaggaga

SEQ ID NO: 407540 - RNA, 18 nt, Human
gaucagugaucaaacugc

SEQ ID NO: 407541 - RNA, 20 nt, Human
gcccggggcccugggcguuc

SEQ ID NO: 407542 - RNA, 25 nt, Human
ggagaaacaagcccggggcccuggg

SEQ ID NO: 407543 - RNA, 23 nt, Human
gggcagccccuccucccugcuga

SEQ ID NO: 407544 - RNA, 18 nt, Human
gggcuggggaggaagauu

SEQ ID NO: 407545 - RNA, 19 nt, Human
gggcuggggaggaagauuc

SEQ ID NO: 407546 - RNA, 25 nt, Human
ggugaggagaaggaagcaggagaaa

SEQ ID NO: 407547 - RNA, 27 nt, Human
uaaaaaaaaaucaaaaacaaagccaaa

SEQ ID NO: 407548 - RNA, 22 nt, Human
uacaaagugcucacuacaggaa

SEQ ID NO: 407549 - RNA, 25 nt, Human
uacagaauaaauaccugcgccuuga

SEQ ID NO: 407550 - RNA, 19 nt, Human
uccccagcgccccgccgcc

SEQ ID NO: 407551 - RNA, 22 nt, Human
uccccagcgccccgccgccugc

SEQ ID NO: 407552 - RNA, 19 nt, Human
ucccgggugggguaagaaa

SEQ ID NO: 407553 - RNA, 24 nt, Human
uccgggcagccccuccucccugcu

SEQ ID NO: 407554 - RNA, 22 nt, Human
ucgacacagacacuuucccauc

SEQ ID NO: 407555 - RNA, 26 nt, Human
ugaggaagaggggaggcgaggaaggu

SEQ ID NO: 407556 - RNA, 19 nt, Human
ugcugaccucaacaagggc

SEQ ID NO: 407557 - RNA, 19 nt, Human
uggaaugaggaagagggga

SEQ ID NO: 407558 - RNA, 18 nt, Human
uggcccaggccagcuccc

SEQ ID NO: 407559 - RNA, 25 nt, Human
ugggacccccaagcuuucagggaaa

SEQ ID NO: 407560 - RNA, 22 nt, Human
uggugaggagaaggaagcagga

SEQ ID NO: 407561 - RNA, 19 nt, Human
ugugucaaaauccaggcaa

SEQ ID NO: 407562 - RNA, 24 nt, Human
uucauaauaaaaaaaaaucaaaaa

SEQ ID NO: 407563 - RNA, 23 nt, Human
uuccuggacauagggguccuguc

SEQ ID NO: 407564 - RNA, 18 nt, Human
uugcugugucaaaaucca

SEQ ID NO: 407565 - RNA, 18 nt, Human
uuuuuuuuuuuuuuuuug

SEQ ID NO: 407566 - RNA, 20 nt, Human
uuuuuuuuuuuuuuuuuggg

SEQ ID NO: 407567 - RNA, 26 nt, Human
aaaaaagaaaaaaacaacaaaacaga

SEQ ID NO: 407568 - RNA, 19 nt, Human
aaaaaccaagacacacaua

SEQ ID NO: 407569 - RNA, 22 nt, Human
aaaaagaagaaaagaaaaaaga

SEQ ID NO: 407570 - RNA, 23 nt, Human
aaaacaacaaaacagaacaaccc

SEQ ID NO: 407571 - RNA, 23 nt, Human
aaaacagaacaaccccaccguga

SEQ ID NO: 407572 - RNA, 20 nt, Human
aaaagaagaaaagaaaaaag

SEQ ID NO: 407573 - RNA, 25 nt, Human
aaaauauaacucaccuacauaaaaa

SEQ ID NO: 407574 - RNA, 25 nt, Human
aaaaucugggagugggaaccaagug

SEQ ID NO: 407575 - RNA, 18 nt, Human
aaacaccaccauaguucu

SEQ ID NO: 407576 - RNA, 19 nt, Human
aaacagcucuagcacccca

SEQ ID NO: 407577 - RNA, 19 nt, Human
aaagaagaaaagaaaaaag

SEQ ID NO: 407578 - RNA, 24 nt, Human
aaagugcugggaugacaggcguga

SEQ ID NO: 407579 - RNA, 21 nt, Human
aaauguuaaaagccucagagg

SEQ ID NO: 407580 - RNA, 24 nt, Human
aacacauucagucauacaaaucca

SEQ ID NO: 407581 - RNA, 25 nt, Human
aaccccgucucuacucacaauacac

SEQ ID NO: 407582 - RNA, 19 nt, Human
aacccgcguggacucuucc

SEQ ID NO: 407583 - RNA, 21 nt, Human
aaccuaggucccacccucaga

SEQ ID NO: 407584 - RNA, 24 nt, Human
aaccucaggugguccgccugccuu

SEQ ID NO: 407585 - RNA, 22 nt, Human
aagaaaaaaacaacaaaacaga

SEQ ID NO: 407586 - RNA, 23 nt, Human
aagaaaaaaacaacaaaacagaa

SEQ ID NO: 407587 - RNA, 26 nt, Human
aagaaaaaaacaacaaaacagaacaa

SEQ ID NO: 407588 - RNA, 18 nt, Human
aagaaaaaccaagacaca

SEQ ID NO: 407589 - RNA, 21 nt, Human
aagaaagaaaauauaacucac

SEQ ID NO: 407590 - RNA, 19 nt, Human
aagaaccuaggucccaccc

SEQ ID NO: 407591 - RNA, 19 nt, Human
aagaagaaaagaaaaaaga

SEQ ID NO: 407592 - RNA, 20 nt, Human
aagagaacuuguuccguuug

SEQ ID NO: 407593 - RNA, 18 nt, Human
aagaggaacuaugagucu

SEQ ID NO: 407594 - RNA, 19 nt, Human
aagcacuguuuucacggcu

SEQ ID NO: 407595 - RNA, 22 nt, Human
aagcaggcaugacagcggagga

SEQ ID NO: 407596 - RNA, 22 nt, Human
aagcauuuuagggugacuggca

SEQ ID NO: 407597 - RNA, 23 nt, Human
aagccauuggaacugccgaugug

SEQ ID NO: 407598 - RNA, 18 nt, Human
aagccgccggcccaagcc

SEQ ID NO: 407599 - RNA, 19 nt, Human
aagcuguagcuaccacauc

SEQ ID NO: 407600 - RNA, 24 nt, Human
aaggccgguggaucaagaggcggu

SEQ ID NO: 407601 - RNA, 30 nt, Human
aauaaauacauacauacauacauacauaca

SEQ ID NO: 407602 - RNA, 18 nt, Human
aaucgcuugaaccuggga

SEQ ID NO: 407603 - RNA, 24 nt, Human
aaucgcuugaaccugggaggcgga

SEQ ID NO: 407604 - RNA, 20 nt, Human
acaagagcgaaacuccgucu

SEQ ID NO: 407605 - RNA, 21 nt, Human
acaagagcgaaacuccgucuc

SEQ ID NO: 407606 - RNA, 20 nt, Human
acagagcgagacuccgucuc

SEQ ID NO: 407607 - RNA, 25 nt, Human
acagagcgagacuccgucuccaaaa

SEQ ID NO: 407608 - RNA, 19 nt, Human
acaggcccucucuaaacag

SEQ ID NO: 407609 - RNA, 23 nt, Human
acaggcgugagccaccgcgccca

SEQ ID NO: 407610 - RNA, 32 nt, Human
acauaaauaaauacauacauacauacauacag

SEQ ID NO: 407611 - RNA, 26 nt, Human
acaucacuguacuccaaaugggaacu

SEQ ID NO: 407612 - RNA, 25 nt, Human
acccagccugggcgacagagcgaga

SEQ ID NO: 407613 - RNA, 24 nt, Human
accccgucucuacucacaauacac

SEQ ID NO: 407614 - RNA, 19 nt, Human
acccucagaacaagcaagu

SEQ ID NO: 407615 - RNA, 22 nt, Human
accuuauauuuguacacaauau

SEQ ID NO: 407616 - RNA, 24 nt, Human
acgguguuuuuccauguuggucag

SEQ ID NO: 407617 - RNA, 22 nt, Human
acuccugccaacucugcacccc

SEQ ID NO: 407618 - RNA, 22 nt, Human
acucugcaccccaccacggcug

SEQ ID NO: 407619 - RNA, 21 nt, Human
acucuuggagggcuuuagcag

SEQ ID NO: 407620 - RNA, 24 nt, Human
acugaaaaauauuuagacaacuaa

SEQ ID NO: 407621 - RNA, 22 nt, Human
acugcagcuuauuuagauuguu

SEQ ID NO: 407622 - RNA, 22 nt, Human
agaaaaaaacaacaaaacagaa

SEQ ID NO: 407623 - RNA, 24 nt, Human
agaaaaaagaaaaaaacaacaaaa

SEQ ID NO: 407624 - RNA, 25 nt, Human
agaaaaaccaagacacacauaaaca

SEQ ID NO: 407625 - RNA, 21 nt, Human
agaaaagaaaaaagaaaaaaa

SEQ ID NO: 407626 - RNA, 18 nt, Human
agaacauucuagcaggua

SEQ ID NO: 407627 - RNA, 23 nt, Human
agaagaaaagaaaaaagaaaaaa

SEQ ID NO: 407628 - RNA, 19 nt, Human
agacaccauaaucuuauga

SEQ ID NO: 407629 - RNA, 18 nt, Human
agacugaagggacuggca

SEQ ID NO: 407630 - RNA, 20 nt, Human
agagacuuuccaauuuuaua

SEQ ID NO: 407631 - RNA, 23 nt, Human
agccaacaggcccucucuaaaca

SEQ ID NO: 407632 - RNA, 24 nt, Human
agccaacaggcccucucuaaacag

SEQ ID NO: 407633 - RNA, 22 nt, Human
agccugggcgacagagcgagac

SEQ ID NO: 407634 - RNA, 24 nt, Human
agccugggcgacagagcgagacuc

SEQ ID NO: 407635 - RNA, 24 nt, Human
agcgauucuccugccucagccucc

SEQ ID NO: 407636 - RNA, 18 nt, Human
aggaagccugaaagaucu

SEQ ID NO: 407637 - RNA, 22 nt, Human
aggcaggagaaucgcuugaacc

SEQ ID NO: 407638 - RNA, 24 nt, Human
aggcaggagaaucgcuugaaccug

SEQ ID NO: 407639 - RNA, 19 nt, Human
aggcaggagaggaacagcg

SEQ ID NO: 407640 - RNA, 23 nt, Human
aggcaggagaggaacagcggcuc

SEQ ID NO: 407641 - RNA, 23 nt, Human
aggccaaggccgguggaucaaga

SEQ ID NO: 407642 - RNA, 24 nt, Human
aggcggagguugcagugagccgag

SEQ ID NO: 407643 - RNA, 24 nt, Human
agggcaauggugcgaucucggcuc

SEQ ID NO: 407644 - RNA, 19 nt, Human
agguagauuugccuugccu

SEQ ID NO: 407645 - RNA, 20 nt, Human
aggucaugugggcauuuucc

SEQ ID NO: 407646 - RNA, 24 nt, Human
aggugguccgccugccuuagccuc

SEQ ID NO: 407647 - RNA, 22 nt, Human
aguacaguuucuuuguuggaag

SEQ ID NO: 407648 - RNA, 21 nt, Human
aguauggugaaaccccgucuc

SEQ ID NO: 407649 - RNA, 22 nt, Human
agucauggaaacacuucaggaa

SEQ ID NO: 407650 - RNA, 19 nt, Human
aguggcagcagguaccaua

SEQ ID NO: 407651 - RNA, 26 nt, Human
aguugcuggucucuuccuguuuggug

SEQ ID NO: 407652 - RNA, 24 nt, Human
auauaagcuccgaagggcagagac

SEQ ID NO: 407653 - RNA, 24 nt, Human
auauuuaaaguauagcuaagaagc

SEQ ID NO: 407654 - RNA, 22 nt, Human
auccccucacuuugggaggcca

SEQ ID NO: 407655 - RNA, 20 nt, Human
auccuaucucuucccuucua

SEQ ID NO: 407656 - RNA, 23 nt, Human
auccuggugcugacggccuccgc

SEQ ID NO: 407657 - RNA, 24 nt, Human
aucgcgccacugcaacccagccug

SEQ ID NO: 407658 - RNA, 18 nt, Human
auggcagcuccacuuuag

SEQ ID NO: 407659 - RNA, 20 nt, Human
auggugaaaccccgucucua

SEQ ID NO: 407660 - RNA, 24 nt, Human
auguuuguacuuuuaguagagacg

SEQ ID NO: 407661 - RNA, 18 nt, Human
auuuugagaaaagaggca

SEQ ID NO: 407662 - RNA, 19 nt, Human
auuuuuagcaucauucuag

SEQ ID NO: 407663 - RNA, 20 nt, Human
caaaaguaaauaauuagcua

SEQ ID NO: 407664 - RNA, 24 nt, Human
caaagugcugggaugacaggcgug

SEQ ID NO: 407665 - RNA, 19 nt, Human
caaauaagaaugcugacau

SEQ ID NO: 407666 - RNA, 19 nt, Human
caacaaaacagaacaaccc

SEQ ID NO: 407667 - RNA, 22 nt, Human
caacaaaacagaacaaccccac

SEQ ID NO: 407668 - RNA, 22 nt, Human
caacaaaauaauuaaaaaguga

SEQ ID NO: 407669 - RNA, 22 nt, Human
caagcgauucuccugccucagc

SEQ ID NO: 407670 - RNA, 28 nt, Human
cacauaccauaggcucucuaaaggcagg

SEQ ID NO: 407671 - RNA, 21 nt, Human
cacccuccgccucccagguuc

SEQ ID NO: 407672 - RNA, 21 nt, Human
caccgcacccuccgccuccca

SEQ ID NO: 407673 - RNA, 24 nt, Human
cacuccagucugagcaacaagagc

SEQ ID NO: 407674 - RNA, 25 nt, Human
cacuccagucugagcaacaagagcg

SEQ ID NO: 407675 - RNA, 23 nt, Human
cacuccugccaacucugcacccc

SEQ ID NO: 407676 - RNA, 24 nt, Human
cacucuuguugcccaggcuagagg

SEQ ID NO: 407677 - RNA, 24 nt, Human
cacugcaacccagccugggcgaca

SEQ ID NO: 407678 - RNA, 25 nt, Human
cacugcaacccagccugggcgacag

SEQ ID NO: 407679 - RNA, 25 nt, Human
cagaacaagcaaguacuacagagua

SEQ ID NO: 407680 - RNA, 21 nt, Human
cagauggcagcuccacuuuag

SEQ ID NO: 407681 - RNA, 18 nt, Human
cagcggcggcggcugugg

SEQ ID NO: 407682 - RNA, 20 nt, Human
cagcgggugccugagcuggc

SEQ ID NO: 407683 - RNA, 20 nt, Human
cagcgggugccugagcuggc

SEQ ID NO: 407684 - RNA, 23 nt, Human
cagcuuuucucuccuccuucucc

SEQ ID NO: 407685 - RNA, 20 nt, Human
caggcuggucucccacuccc

SEQ ID NO: 407686 - RNA, 23 nt, Human
cagggccaguauggugaaacccc

SEQ ID NO: 407687 - RNA, 21 nt, Human
caguccaguaagucaccaaua

SEQ ID NO: 407688 - RNA, 19 nt, Human
caguggccaggguucuggc

SEQ ID NO: 407689 - RNA, 21 nt, Human
caguggccaggguucuggccc

SEQ ID NO: 407690 - RNA, 22 nt, Human
cauacacguacgccucucgccu

SEQ ID NO: 407691 - RNA, 21 nt, Human
cauggugaauuucuuggcuca

SEQ ID NO: 407692 - RNA, 19 nt, Human
cauugagucucauuggaga

SEQ ID NO: 407693 - RNA, 18 nt, Human
cauugcuacaaauuucuc

SEQ ID NO: 407694 - RNA, 22 nt, Human
ccaaagugcugggaugacaggc

SEQ ID NO: 407695 - RNA, 24 nt, Human
ccaaagugcugggaugacaggcgu

SEQ ID NO: 407696 - RNA, 18 nt, Human
ccaacucugcaccccacc

SEQ ID NO: 407697 - RNA, 19 nt, Human
ccaccgugccuggcugaug

SEQ ID NO: 407698 - RNA, 25 nt, Human
ccacuccugccaacucugcacccca

SEQ ID NO: 407699 - RNA, 18 nt, Human
ccacugcaacccagccug

SEQ ID NO: 407700 - RNA, 24 nt, Human
ccacugcaacccagccugggcgac

SEQ ID NO: 407701 - RNA, 20 nt, Human
ccagcggcggcggcuguggu

SEQ ID NO: 407702 - RNA, 18 nt, Human
ccaggagcagccaacagg

SEQ ID NO: 407703 - RNA, 19 nt, Human
ccauguuggucaggcuggu

SEQ ID NO: 407704 - RNA, 23 nt, Human
ccauuugaaacacauucagucau

SEQ ID NO: 407705 - RNA, 20 nt, Human
cccagguucaagcgauucuc

SEQ ID NO: 407706 - RNA, 23 nt, Human
cccagguucaagcgauucuccug

SEQ ID NO: 407707 - RNA, 19 nt, Human
ccccaaagugucagaaugc

SEQ ID NO: 407708 - RNA, 25 nt, Human
cccuggcugggcccgauuguucuuc

SEQ ID NO: 407709 - RNA, 18 nt, Human
ccgcacccuccgccuccc

SEQ ID NO: 407710 - RNA, 21 nt, Human
ccgcacccuccgccucccagg

SEQ ID NO: 407711 - RNA, 21 nt, Human
ccgcacccuccgccucccagg

SEQ ID NO: 407712 - RNA, 24 nt, Human
ccgcacccuccgccucccagguuc

SEQ ID NO: 407713 - RNA, 24 nt, Human
ccgccucccagguucaagcgauuc

SEQ ID NO: 407714 - RNA, 26 nt, Human
ccgccugccuuagccucccaaagugc

SEQ ID NO: 407715 - RNA, 24 nt, Human
ccucccagguucaagcgauucucc

SEQ ID NO: 407716 - RNA, 20 nt, Human
ccucccugguugcccagaca

SEQ ID NO: 407717 - RNA, 23 nt, Human
ccuccugcaggaugaaacgagag

SEQ ID NO: 407718 - RNA, 18 nt, Human
ccuccuucucccacuccu

SEQ ID NO: 407719 - RNA, 24 nt, Human
ccucucgccuuucgaggccucaaa

SEQ ID NO: 407720 - RNA, 24 nt, Human
ccucucuaaacagcucuagcaccc

SEQ ID NO: 407721 - RNA, 22 nt, Human
ccugaucagaaaagaaagaaaa

SEQ ID NO: 407722 - RNA, 23 nt, Human
ccugauuagcugggauuacaggc

SEQ ID NO: 407723 - RNA, 24 nt, Human
ccugauuagcugggauuacaggca

SEQ ID NO: 407724 - RNA, 24 nt, Human
ccugccucagccuccugauuagcu

SEQ ID NO: 407725 - RNA, 24 nt, Human
ccugccuuagccucccaaagugcu

SEQ ID NO: 407726 - RNA, 19 nt, Human
ccugggaggcggagguugc

SEQ ID NO: 407727 - RNA, 22 nt, Human
ccugggcgacagagcgagacuc

SEQ ID NO: 407728 - RNA, 23 nt, Human
ccugucauccccucacuuuggga

SEQ ID NO: 407729 - RNA, 18 nt, Human
ccuuucauccuugcugua

SEQ ID NO: 407730 - RNA, 24 nt, Human
cgaaccaaaucauuaaguccccug

SEQ ID NO: 407731 - RNA, 24 nt, Human
cgagaucgcgccacugcaacccag

SEQ ID NO: 407732 - RNA, 23 nt, Human
cggaagcaggcaugacagcggag

SEQ ID NO: 407733 - RNA, 23 nt, Human
cggcggcggcuguggugguggug

SEQ ID NO: 407734 - RNA, 23 nt, Human
cggcugcagcgggugccugagcu

SEQ ID NO: 407735 - RNA, 23 nt, Human
cggcugcagcgggugccugagcu

SEQ ID NO: 407736 - RNA, 19 nt, Human
cggucugggaggagacagc

SEQ ID NO: 407737 - RNA, 19 nt, Human
cggucugggaggagacagc

SEQ ID NO: 407738 - RNA, 24 nt, Human
cgguguuuuuccauguuggucagg

SEQ ID NO: 407739 - RNA, 20 nt, Human
cgucuccaaaaaaugaaaau

SEQ ID NO: 407740 - RNA, 20 nt, Human
cgucuuguccagcacccugg

SEQ ID NO: 407741 - RNA, 20 nt, Human
cgucuuguccagcacccugg

SEQ ID NO: 407742 - RNA, 18 nt, Human
cuaccacggcccagccau

SEQ ID NO: 407743 - RNA, 21 nt, Human
cucaagaucucccauuacuga

SEQ ID NO: 407744 - RNA, 21 nt, Human
cucauucuucccuaccucccc

SEQ ID NO: 407745 - RNA, 20 nt, Human
cuccuucucccacuccugcc

SEQ ID NO: 407746 - RNA, 22 nt, Human
cucuagcaccccaccacccauu

SEQ ID NO: 407747 - RNA, 19 nt, Human
cucugcaccccaccacggc

SEQ ID NO: 407748 - RNA, 21 nt, Human
cugauuagcugggauuacagg

SEQ ID NO: 407749 - RNA, 24 nt, Human
cugauuagcugggauuacaggcau

SEQ ID NO: 407750 - RNA, 20 nt, Human
cugcaacaguuuuucuguag

SEQ ID NO: 407751 - RNA, 24 nt, Human
cugccuuagccucccaaagugcug

SEQ ID NO: 407752 - RNA, 21 nt, Human
cuggccagcggcggcggcugu

SEQ ID NO: 407753 - RNA, 18 nt, Human
cugggcaaaacuggcaca

SEQ ID NO: 407754 - RNA, 20 nt, Human
cuguaaucccagcuacucgg

SEQ ID NO: 407755 - RNA, 20 nt, Human
cuucuucuucuucuucuucu

SEQ ID NO: 407756 - RNA, 19 nt, Human
cuugaaccugggaggcgga

SEQ ID NO: 407757 - RNA, 23 nt, Human
cuuuccuaaaacuuuaugacaaa

SEQ ID NO: 407758 - RNA, 19 nt, Human
cuuucucuucuucuucuuc

SEQ ID NO: 407759 - RNA, 24 nt, Human
cuuucuuucuuuauuacuuucucu

SEQ ID NO: 407760 - RNA, 21 nt, Human
gaaaaaaacaacaaaacagaa

SEQ ID NO: 407761 - RNA, 21 nt, Human
gaaaaagaagaaaagaaaaaa

SEQ ID NO: 407762 - RNA, 23 nt, Human
gaaaagaaaaaagaaaaaaacaa

SEQ ID NO: 407763 - RNA, 23 nt, Human
gaaaaugacccccaguucuguga

SEQ ID NO: 407764 - RNA, 22 nt, Human
gaaaccccgucucuacucacaa

SEQ ID NO: 407765 - RNA, 19 nt, Human
gaaagggaaaagggcagag

SEQ ID NO: 407766 - RNA, 23 nt, Human
gaacaggcagcuggcgccuccac

SEQ ID NO: 407767 - RNA, 20 nt, Human
gacagcgacggcugcagcgg

SEQ ID NO: 407768 - RNA, 22 nt, Human
gacugcaacucaagaucuccca

SEQ ID NO: 407769 - RNA, 23 nt, Human
gagaaucgcuugaaccugggagg

SEQ ID NO: 407770 - RNA, 19 nt, Human
gagcaagucauggaaacac

SEQ ID NO: 407771 - RNA, 24 nt, Human
gagcugaggcaggagaaucgcuug

SEQ ID NO: 407772 - RNA, 23 nt, Human
gagguugcagugagccgagaucg

SEQ ID NO: 407773 - RNA, 18 nt, Human
gagugggaaccaagugac

SEQ ID NO: 407774 - RNA, 18 nt, Human
gaugacaggcgugagcca

SEQ ID NO: 407775 - RNA, 18 nt, Human
gauuaaaaugacacccca

SEQ ID NO: 407776 - RNA, 23 nt, Human
gauuaaaaugacaccccaaagug

SEQ ID NO: 407777 - RNA, 18 nt, Human
gauuacaggcaugggcca

SEQ ID NO: 407778 - RNA, 21 nt, Human
gauuacaggcaugggccaccg

SEQ ID NO: 407779 - RNA, 24 nt, Human
gauuacaggcaugggccaccgugc

SEQ ID NO: 407780 - RNA, 22 nt, Human
gauuagcugggauuacaggcau

SEQ ID NO: 407781 - RNA, 24 nt, Human
gauuagcugggauuacaggcaugg

SEQ ID NO: 407782 - RNA, 22 nt, Human
gcaggagaggaacagcggcucu

SEQ ID NO: 407783 - RNA, 18 nt, Human
gcauguuuauccugagaa

SEQ ID NO: 407784 - RNA, 21 nt, Human
gccaacucugcaccccaccac

SEQ ID NO: 407785 - RNA, 24 nt, Human
gccacugcaacccagccugggcga

SEQ ID NO: 407786 - RNA, 24 nt, Human
gccaguauggugaaaccccgucuc

SEQ ID NO: 407787 - RNA, 20 nt, Human
gccgagaucgcgccacugca

SEQ ID NO: 407788 - RNA, 23 nt, Human
gccucagagguuauaucuggcca

SEQ ID NO: 407789 - RNA, 24 nt, Human
gcgauucuccugccucagccuccu

SEQ ID NO: 407790 - RNA, 20 nt, Human
gcggcggcggcugugguggu

SEQ ID NO: 407791 - RNA, 20 nt, Human
gcggcggcggcugugguggu

SEQ ID NO: 407792 - RNA, 22 nt, Human
gcggcggcggcugugguggugg

SEQ ID NO: 407793 - RNA, 24 nt, Human
gcggcggcggcuguggugguggug

SEQ ID NO: 407794 - RNA, 24 nt, Human
gcuagcucgcacuccagucugagc

SEQ ID NO: 407795 - RNA, 21 nt, Human
gcuccuugcuguggcucucgc

SEQ ID NO: 407796 - RNA, 20 nt, Human
gcucgcacuccagucugagc

SEQ ID NO: 407797 - RNA, 18 nt, Human
gcugggauuacaggcaug

SEQ ID NO: 407798 - RNA, 23 nt, Human
gcuggucucccacucccaaccuc

SEQ ID NO: 407799 - RNA, 21 nt, Human
gcuguacugucuguaauccca

SEQ ID NO: 407800 - RNA, 21 nt, Human
ggaaucuuugguuugaucaca

SEQ ID NO: 407801 - RNA, 18 nt, Human
ggagaaugggagccugcu

SEQ ID NO: 407802 - RNA, 20 nt, Human
ggagguugcagugagccgag

SEQ ID NO: 407803 - RNA, 22 nt, Human
ggagguugcagugagccgagau

SEQ ID NO: 407804 - RNA, 23 nt, Human
ggagguugcagugagccgagauc

SEQ ID NO: 407805 - RNA, 24 nt, Human
ggagguugcagugagccgagaucg

SEQ ID NO: 407806 - RNA, 24 nt, Human
ggauuacaggcaugggccaccgug

SEQ ID NO: 407807 - RNA, 19 nt, Human
ggccaguauggugaaaccc

SEQ ID NO: 407808 - RNA, 20 nt, Human
ggccaguauggugaaacccc

SEQ ID NO: 407809 - RNA, 20 nt, Human
ggcggcggcugugguggugg

SEQ ID NO: 407810 - RNA, 20 nt, Human
ggcggcggcugugguggugg

SEQ ID NO: 407811 - RNA, 21 nt, Human
ggcggcggcuguggugguggu

SEQ ID NO: 407812 - RNA, 18 nt, Human
gggaaaaagaagaaaaga

SEQ ID NO: 407813 - RNA, 22 nt, Human
gggcaauggugcgaucucggcu

SEQ ID NO: 407814 - RNA, 26 nt, Human
gggcaguggugggguuaccuccgggc

SEQ ID NO: 407815 - RNA, 20 nt, Human
ggucaucccugagagaaggu

SEQ ID NO: 407816 - RNA, 26 nt, Human
ggucugggaggagacagcgacggcug

SEQ ID NO: 407817 - RNA, 26 nt, Human
ggucugggaggagacagcgacggcug

SEQ ID NO: 407818 - RNA, 21 nt, Human
ggugccuucccgcgcagcacu

SEQ ID NO: 407819 - RNA, 21 nt, Human
ggugccuucccgcgcagcacu

SEQ ID NO: 407820 - RNA, 24 nt, Human
gguguuuuuccauguuggucaggc

SEQ ID NO: 407821 - RNA, 18 nt, Human
guacaguuucuuuguugg

SEQ ID NO: 407822 - RNA, 18 nt, Human
gucaucccugagagaagg

SEQ ID NO: 407823 - RNA, 24 nt, Human
gugagccaccgcgcccagccucuc

SEQ ID NO: 407824 - RNA, 22 nt, Human
gugcagcugaaaaggcauugag

SEQ ID NO: 407825 - RNA, 23 nt, Human
guggcucaagccugucauccccu

SEQ ID NO: 407826 - RNA, 24 nt, Human
gugguccgccugccuuagccuccc

SEQ ID NO: 407827 - RNA, 19 nt, Human
guggugguggugccuuccc

SEQ ID NO: 407828 - RNA, 20 nt, Human
guucuucuccuuggucaggg

SEQ ID NO: 407829 - RNA, 19 nt, Human
guugcagugagccgagauc

SEQ ID NO: 407830 - RNA, 21 nt, Human
guugcagugagccgagaucgc

SEQ ID NO: 407831 - RNA, 19 nt, Human
guuuucuuucuuucuuucu

SEQ ID NO: 407832 - RNA, 27 nt, Human
uaaacagcucuagcaccccaccaccca

SEQ ID NO: 407833 - RNA, 22 nt, Human
uaaaguaagcacaaaaguaaau

SEQ ID NO: 407834 - RNA, 20 nt, Human
uaagaugcauuauuauucug

SEQ ID NO: 407835 - RNA, 20 nt, Human
uaagccaggagcagccaaca

SEQ ID NO: 407836 - RNA, 18 nt, Human
uacagaguaauuuagaau

SEQ ID NO: 407837 - RNA, 22 nt, Human
uacaggcaugggccaccgugcc

SEQ ID NO: 407838 - RNA, 26 nt, Human
uacauacauacauacauaaauuaaaa

SEQ ID NO: 407839 - RNA, 22 nt, Human
uacauacauacauacauacaua

SEQ ID NO: 407840 - RNA, 25 nt, Human
uacauacauacauacauacauaaau

SEQ ID NO: 407841 - RNA, 24 nt, Human
uacauacauacauacauacauaca

SEQ ID NO: 407842 - RNA, 21 nt, Human
uaccaagaagggcucugugau

SEQ ID NO: 407843 - RNA, 22 nt, Human
uaccaagaagggcucugugaug

SEQ ID NO: 407844 - RNA, 21 nt, Human
uaccauaggcucucuaaaggc

SEQ ID NO: 407845 - RNA, 24 nt, Human
uagagggcaauggugcgaucucgg

SEQ ID NO: 407846 - RNA, 22 nt, Human
uagcaacauugcuacaaauuuc

SEQ ID NO: 407847 - RNA, 25 nt, Human
uagcaccccaccacccauuugaaac

SEQ ID NO: 407848 - RNA, 22 nt, Human
uagcagcaucagcaaauaagaa

SEQ ID NO: 407849 - RNA, 22 nt, Human
uagcaggagaauuuucuccugg

SEQ ID NO: 407850 - RNA, 22 nt, Human
uagccaagaaaaaccaagacac

SEQ ID NO: 407851 - RNA, 23 nt, Human
uagcucgcacuccagucugagca

SEQ ID NO: 407852 - RNA, 19 nt, Human
uagcugggauuacaggcau

SEQ ID NO: 407853 - RNA, 22 nt, Human
uagcugggauuacaggcauggg

SEQ ID NO: 407854 - RNA, 21 nt, Human
uaggcuuuucuuuguauucag

SEQ ID NO: 407855 - RNA, 24 nt, Human
uaguagagacgguguuuuuccaug

SEQ ID NO: 407856 - RNA, 22 nt, Human
uagugucuugaacagugccugg

SEQ ID NO: 407857 - RNA, 20 nt, Human
uaucauagcagcaucagcaa

SEQ ID NO: 407858 - RNA, 26 nt, Human
uaucauagcagcaucagcaaauaaga

SEQ ID NO: 407859 - RNA, 19 nt, Human
uaugaaacggaggcagucu

SEQ ID NO: 407860 - RNA, 23 nt, Human
ucaaugaguaguaaaacuucuca

SEQ ID NO: 407861 - RNA, 24 nt, Human
ucaccgcacccuccgccucccagg

SEQ ID NO: 407862 - RNA, 23 nt, Human
ucacucuuguugcccaggcuaga

SEQ ID NO: 407863 - RNA, 22 nt, Human
ucacuuugggaggccaaggccg

SEQ ID NO: 407864 - RNA, 18 nt, Human
ucagaaaagaaagaaaau

SEQ ID NO: 407865 - RNA, 19 nt, Human
ucagcaaauaagaaugcug

SEQ ID NO: 407866 - RNA, 21 nt, Human
ucagcucauucuucccuaccu

SEQ ID NO: 407867 - RNA, 21 nt, Human
ucagggguuuccuugucuuuc

SEQ ID NO: 407868 - RNA, 25 nt, Human
ucagugauagauucauucucccaaa

SEQ ID NO: 407869 - RNA, 23 nt, Human
uccaaaaaaugaaaaugaaaaug

SEQ ID NO: 407870 - RNA, 18 nt, Human
uccauguuggucaggcug

SEQ ID NO: 407871 - RNA, 24 nt, Human
ucccaaagugcugggaugacaggc

SEQ ID NO: 407872 - RNA, 21 nt, Human
ucccagguucaagcgauucuc

SEQ ID NO: 407873 - RNA, 24 nt, Human
ucccagguucaagcgauucuccug

SEQ ID NO: 407874 - RNA, 19 nt, Human
ucccauccuaucucuuccc

SEQ ID NO: 407875 - RNA, 22 nt, Human
ucccuaccucccccuacaaccc

SEQ ID NO: 407876 - RNA, 24 nt, Human
uccugauuagcugggauuacaggc

SEQ ID NO: 407877 - RNA, 18 nt, Human
uccugccaacucugcacc

SEQ ID NO: 407878 - RNA, 23 nt, Human
uccugccaacucugcaccccacc

SEQ ID NO: 407879 - RNA, 22 nt, Human
ucgcacuccagucugagcaaca

SEQ ID NO: 407880 - RNA, 24 nt, Human
ucgcuugaaccugggaggcggagg

SEQ ID NO: 407881 - RNA, 23 nt, Human
ucgugcuuucuuguuuucucgau

SEQ ID NO: 407882 - RNA, 18 nt, Human
ucuaccaagaagggcucu

SEQ ID NO: 407883 - RNA, 23 nt, Human
ucuccaaaaaaugaaaaugaaaa

SEQ ID NO: 407884 - RNA, 20 nt, Human
ucucccacucccaaccucag

SEQ ID NO: 407885 - RNA, 23 nt, Human
ucucccauuacugagaauggguc

SEQ ID NO: 407886 - RNA, 22 nt, Human
ucuccccagauguagugaaagc

SEQ ID NO: 407887 - RNA, 20 nt, Human
ucuccuccuucucccacucc

SEQ ID NO: 407888 - RNA, 24 nt, Human
ucuccugccucagccuccugauua

SEQ ID NO: 407889 - RNA, 27 nt, Human
ucucuccuccuucucccacuccucccu

SEQ ID NO: 407890 - RNA, 24 nt, Human
ucuguagccaagaaaaaccaagac

SEQ ID NO: 407891 - RNA, 18 nt, Human
ucuuguugcccaggcuag

SEQ ID NO: 407892 - RNA, 21 nt, Human
ucuuucuuucuuucguuucuu

SEQ ID NO: 407893 - RNA, 18 nt, Human
ucuuucuuucuuucuuuc

SEQ ID NO: 407894 - RNA, 25 nt, Human
ucuuucuuucuuucuuucuuucuuu

SEQ ID NO: 407895 - RNA, 24 nt, Human
ucuuucuuucuuucuuuuguuucu

SEQ ID NO: 407896 - RNA, 24 nt, Human
ucuuucuuucuuucuuuuguuucu

SEQ ID NO: 407897 - RNA, 20 nt, Human
ugaaacacauucagucauac

SEQ ID NO: 407898 - RNA, 24 nt, Human
ugaaccugggaggcggagguugca

SEQ ID NO: 407899 - RNA, 19 nt, Human
ugaagggacuggcaaagau

SEQ ID NO: 407900 - RNA, 22 nt, Human
ugacaacugcuccccaaagcac

SEQ ID NO: 407901 - RNA, 20 nt, Human
ugacauacagucccauguuu

SEQ ID NO: 407902 - RNA, 18 nt, Human
ugaccaaaauauuuaaag

SEQ ID NO: 407903 - RNA, 19 nt, Human
ugacuuggugggcugucua

SEQ ID NO: 407904 - RNA, 23 nt, Human
ugagacagaguuucacucuuguu

SEQ ID NO: 407905 - RNA, 22 nt, Human
ugagccgagaucgcgccacugc

SEQ ID NO: 407906 - RNA, 20 nt, Human
ugaggcaggagaaucgcuug

SEQ ID NO: 407907 - RNA, 24 nt, Human
ugaggcaggagaaucgcuugaacc

SEQ ID NO: 407908 - RNA, 25 nt, Human
ugaggcaggagaaucgcuugaaccu

SEQ ID NO: 407909 - RNA, 19 nt, Human
ugaggugggggggugauuu

SEQ ID NO: 407910 - RNA, 23 nt, Human
ugaguugguacauuucuggugcu

SEQ ID NO: 407911 - RNA, 24 nt, Human
ugaguuucuggggaaaaagaagaa

SEQ ID NO: 407912 - RNA, 24 nt, Human
ugauguuuguacuuuuaguagaga

SEQ ID NO: 407913 - RNA, 23 nt, Human
ugcagagcaagucauggaaacac

SEQ ID NO: 407914 - RNA, 19 nt, Human
ugcagagggaaguuaugga

SEQ ID NO: 407915 - RNA, 20 nt, Human
ugcagcugaaaaggcauuga

SEQ ID NO: 407916 - RNA, 20 nt, Human
ugccaguccaguaagucacc

SEQ ID NO: 407917 - RNA, 22 nt, Human
ugcccagacaaccccgggagac

SEQ ID NO: 407918 - RNA, 21 nt, Human
ugcccaugagucucuuugacc

SEQ ID NO: 407919 - RNA, 24 nt, Human
ugccucagccuccugauuagcugg

SEQ ID NO: 407920 - RNA, 18 nt, Human
ugccugugucuuagagac

SEQ ID NO: 407921 - RNA, 24 nt, Human
ugccuuagccucccaaagugcugg

SEQ ID NO: 407922 - RNA, 23 nt, Human
ugcuuuccuguuuucuuuuucuu

SEQ ID NO: 407923 - RNA, 20 nt, Human
uggaaagaaccuagguccca

SEQ ID NO: 407924 - RNA, 23 nt, Human
uggaagcggaagcaggcaugaca

SEQ ID NO: 407925 - RNA, 21 nt, Human
uggaauagcaucacuuagacu

SEQ ID NO: 407926 - RNA, 21 nt, Human
uggaauauaagcuccgaaggg

SEQ ID NO: 407927 - RNA, 18 nt, Human
uggauuuuuagcaucauu

SEQ ID NO: 407928 - RNA, 20 nt, Human
uggcacaucagaaaugacaa

SEQ ID NO: 407929 - RNA, 20 nt, Human
uggcaccagccacaaauacc

SEQ ID NO: 407930 - RNA, 20 nt, Human
ugggaaaaaaaacaccacca

SEQ ID NO: 407931 - RNA, 24 nt, Human
ugggaaaaaaaacaccaccauagu

SEQ ID NO: 407932 - RNA, 23 nt, Human
ugggaggagacagcgacggcugc

SEQ ID NO: 407933 - RNA, 23 nt, Human
ugggaggagacagcgacggcugc

SEQ ID NO: 407934 - RNA, 24 nt, Human
ugggaggccaaggccgguggauca

SEQ ID NO: 407935 - RNA, 29 nt, Human
ugggaggcggagguugcagugacaacggu

SEQ ID NO: 407936 - RNA, 24 nt, Human
ugggaggcggagguugcagugagc

SEQ ID NO: 407937 - RNA, 19 nt, Human
ugggaugacaggcgugagc

SEQ ID NO: 407938 - RNA, 22 nt, Human
ugggaugacaggcgugagccac

SEQ ID NO: 407939 - RNA, 23 nt, Human
ugggaugacaggcgugagccacc

SEQ ID NO: 407940 - RNA, 24 nt, Human
ugggaugacaggcgugagccaccg

SEQ ID NO: 407941 - RNA, 18 nt, Human
ugggauuacaggcauggg

SEQ ID NO: 407942 - RNA, 21 nt, Human
ugggauuacaggcaugggcca

SEQ ID NO: 407943 - RNA, 22 nt, Human
ugggauuacaggcaugggccac

SEQ ID NO: 407944 - RNA, 23 nt, Human
ugggauuacaggcaugggccacc

SEQ ID NO: 407945 - RNA, 23 nt, Human
ugggauuacaggcaugggccacc

SEQ ID NO: 407946 - RNA, 24 nt, Human
ugggauuacaggcaugggccaccg

SEQ ID NO: 407947 - RNA, 24 nt, Human
ugggccaccgugccuggcugaugu

SEQ ID NO: 407948 - RNA, 21 nt, Human
uggguaagccaggagcagcca

SEQ ID NO: 407949 - RNA, 21 nt, Human
uggucaggcuggucucccacu

SEQ ID NO: 407950 - RNA, 21 nt, Human
uggucucccacucccaaccuc

SEQ ID NO: 407951 - RNA, 19 nt, Human
uggugcugacggccuccgc

SEQ ID NO: 407952 - RNA, 18 nt, Human
uguauucagauacauacc

SEQ ID NO: 407953 - RNA, 23 nt, Human
ugucuguaaucccagcuacucgg

SEQ ID NO: 407954 - RNA, 24 nt, Human
ugucuguaaucccagcuacucggg

SEQ ID NO: 407955 - RNA, 20 nt, Human
ugugaugaguggcagcaggu

SEQ ID NO: 407956 - RNA, 19 nt, Human
ugugcugugcuguacuguc

SEQ ID NO: 407957 - RNA, 20 nt, Human
ugugggaagugggaaaaaaa

SEQ ID NO: 407958 - RNA, 20 nt, Human
uguggugguggugccuuccc

SEQ ID NO: 407959 - RNA, 20 nt, Human
uguggugguggugccuuccc

SEQ ID NO: 407960 - RNA, 20 nt, Human
uguuggacauggaagcggaa

SEQ ID NO: 407961 - RNA, 22 nt, Human
uuagagacuuuccaauuuuaua

SEQ ID NO: 407962 - RNA, 19 nt, Human
uuagcaguuaguaugguau

SEQ ID NO: 407963 - RNA, 18 nt, Human
uuaguagagacgguguuu

SEQ ID NO: 407964 - RNA, 24 nt, Human
uuaguagagacgguguuuuuccau

SEQ ID NO: 407965 - RNA, 20 nt, Human
uuauaauuauuuuauuuuug

SEQ ID NO: 407966 - RNA, 22 nt, Human
uuaugacaaacuaaugaauuuc

SEQ ID NO: 407967 - RNA, 21 nt, Human
uucaagcgauucuccugccuc

SEQ ID NO: 407968 - RNA, 23 nt, Human
uucaagcgauucuccugccucag

SEQ ID NO: 407969 - RNA, 24 nt, Human
uucaagcgauucuccugccucagc

SEQ ID NO: 407970 - RNA, 24 nt, Human
uucacucuuguugcccaggcuaga

SEQ ID NO: 407971 - RNA, 24 nt, Human
uuccauguuggucaggcuggucuc

SEQ ID NO: 407972 - RNA, 18 nt, Human
uucuaccaagaagggcuc

SEQ ID NO: 407973 - RNA, 18 nt, Human
uucuucccuaccuccccc

SEQ ID NO: 407974 - RNA, 18 nt, Human
uucuuguuuuuucauggu

SEQ ID NO: 407975 - RNA, 23 nt, Human
uugaacagugccuggucaauagu

SEQ ID NO: 407976 - RNA, 24 nt, Human
uugaaccugggaggcggagguugc

SEQ ID NO: 407977 - RNA, 18 nt, Human
uugcagugagccgagauc

SEQ ID NO: 407978 - RNA, 19 nt, Human
uugcagugagccgagaucg

SEQ ID NO: 407979 - RNA, 22 nt, Human
uugcagugagccgagaucgcgc

SEQ ID NO: 407980 - RNA, 18 nt, Human
uugcuguaggauucaaaa

SEQ ID NO: 407981 - RNA, 20 nt, Human
uugcuguaggauucaaaauu

SEQ ID NO: 407982 - RNA, 18 nt, Human
uuggaacugccgaugugg

SEQ ID NO: 407983 - RNA, 20 nt, Human
uuuagggugacuggcacaug

SEQ ID NO: 407984 - RNA, 25 nt, Human
uuuauguuauuaucgugauugaugu

SEQ ID NO: 407985 - RNA, 18 nt, Human
uuucauucauaacaggca

SEQ ID NO: 407986 - RNA, 23 nt, Human
uuuccaauuuuauacaguggcca

SEQ ID NO: 407987 - RNA, 22 nt, Human
uuuccggguccuaccuuuccua

SEQ ID NO: 407988 - RNA, 21 nt, Human
uuugauuaaaaugacacccca

SEQ ID NO: 407989 - RNA, 22 nt, Human
uuuggcaccagccacaaauacc

SEQ ID NO: 407990 - RNA, 18 nt, Human
uuuguacuuuuaguagag

SEQ ID NO: 407991 - RNA, 19 nt, Human
uuuguacuuuuaguagaga

SEQ ID NO: 407992 - RNA, 20 nt, Human
uuuugagaaaagaggcaacu

SEQ ID NO: 407993 - RNA, 21 nt, Human
uuuuuagcaucauucuaggaa

SEQ ID NO: 407994 - RNA, 20 nt, Human
uuuuuuuuuuugagacagag

SEQ ID NO: 407995 - RNA, 21 nt, Human
uuuuuuuuuuuuuuuucucuc

SEQ ID NO: 407996 - RNA, 18 nt, Human
uuuuuuuuuuuuuuuuug

SEQ ID NO: 407997 - RNA, 22 nt, Human
aagcauaauugcgaacaaauac

SEQ ID NO: 407998 - RNA, 23 nt, Human
acaugacuuucuccccaaaggcc

SEQ ID NO: 407999 - RNA, 19 nt, Human
acgcagaggccuggccugg

SEQ ID NO: 408000 - RNA, 22 nt, Human
ccaccguccagauugggccacu

SEQ ID NO: 408001 - RNA, 22 nt, Human
cccaaaggccacuuugugauaa

SEQ ID NO: 408002 - RNA, 21 nt, Human
cccacgaauucccaccgucca

SEQ ID NO: 408003 - RNA, 22 nt, Human
cgaccaaauauccuugaacgcc

SEQ ID NO: 408004 - RNA, 20 nt, Human
uacuccugccaacucgacgc

SEQ ID NO: 408005 - RNA, 23 nt, Human
uagaaacgcagaggccuggccug

SEQ ID NO: 408006 - RNA, 22 nt, Human
ucagcucuaaugacuuuccuca

SEQ ID NO: 408007 - RNA, 24 nt, Human
uccccaaaggccacuuugugauaa

SEQ ID NO: 408008 - RNA, 24 nt, Human
uccgaccaaauauccuugaacgcc

SEQ ID NO: 408009 - RNA, 23 nt, Human
uccucaguuccguggguuacucc

SEQ ID NO: 408010 - RNA, 22 nt, Human
ugccuagaaacgcagaggccug

SEQ ID NO: 408011 - RNA, 22 nt, Human
ugugauaaaguacauacauaua

SEQ ID NO: 408012 - RNA, 23 nt, Human
uuacuccugccaacucgacgccg

SEQ ID NO: 408013 - RNA, 21 nt, Human
aaaugucucuuuauaaucugc

SEQ ID NO: 408014 - RNA, 26 nt, Human
aacaagaaggcguaacauguuuccuu

SEQ ID NO: 408015 - RNA, 22 nt, Human
acuaccauucacuaguuaggcc

SEQ ID NO: 408016 - RNA, 23 nt, Human
agaaaucaugauuuguuucuuuu

SEQ ID NO: 408017 - RNA, 18 nt, Human
agcaaagcauguuaaaaa

SEQ ID NO: 408018 - RNA, 21 nt, Human
caacaacguuuuagggccuga

SEQ ID NO: 408019 - RNA, 20 nt, Human
caucccuuuuuuaaauuuca

SEQ ID NO: 408020 - RNA, 23 nt, Human
cccaaagucuccgguccggacuc

SEQ ID NO: 408021 - RNA, 18 nt, Human
cccuuucuagacacuacc

SEQ ID NO: 408022 - RNA, 20 nt, Human
cggcaguaacuuccacuagc

SEQ ID NO: 408023 - RNA, 22 nt, Human
cguaacauguuuccuugacuca

SEQ ID NO: 408024 - RNA, 22 nt, Human
cuccgguccggacucgguggcg

SEQ ID NO: 408025 - RNA, 22 nt, Human
gcaagccguuuuuccuacaaca

SEQ ID NO: 408026 - RNA, 19 nt, Human
ggugauaacauuagaaaag

SEQ ID NO: 408027 - RNA, 21 nt, Human
uaaacaagaacuugcuaaaga

SEQ ID NO: 408028 - RNA, 23 nt, Human
uaaacaagaacuugcuaaagaaa

SEQ ID NO: 408029 - RNA, 23 nt, Human
uaacaggcagacacugcauuucu

SEQ ID NO: 408030 - RNA, 19 nt, Human
uaacauguuuccuugacuc

SEQ ID NO: 408031 - RNA, 22 nt, Human
uaaugaauaucaaccaaauguc

SEQ ID NO: 408032 - RNA, 23 nt, Human
ucgguggcgcggcaguaacuucc

SEQ ID NO: 408033 - RNA, 21 nt, Human
ugcaagccguuuuuccuacaa

SEQ ID NO: 408034 - RNA, 22 nt, Human
ugcacagccacauuuauuguuc

SEQ ID NO: 408035 - RNA, 19 nt, Human
uguaacaggcagacacugc

SEQ ID NO: 408036 - RNA, 22 nt, Human
uguuaaaaacuucacucaucaa

SEQ ID NO: 408037 - RNA, 27 nt, Human
uuaaugaauaucaaccaaaugucucuu

SEQ ID NO: 408038 - RNA, 19 nt, Human
uuaggccccaaagucuccg

SEQ ID NO: 408039 - RNA, 21 nt, Human
uuccagccuggaaaaacaucc

SEQ ID NO: 408040 - RNA, 24 nt, Human
aaagcacuucugccauaacuccag

SEQ ID NO: 408041 - RNA, 21 nt, Human
aagaugucaauacagcauaaa

SEQ ID NO: 408042 - RNA, 18 nt, Human
aaggacgucuguaaaagc

SEQ ID NO: 408043 - RNA, 21 nt, Human
acuacacugcagguacagaaa

SEQ ID NO: 408044 - RNA, 23 nt, Human
acuacacugcagguacagaaaua

SEQ ID NO: 408045 - RNA, 22 nt, Human
agagaauugacauuuugcaaaa

SEQ ID NO: 408046 - RNA, 21 nt, Human
caaaacacaaaccaguugauc

SEQ ID NO: 408047 - RNA, 22 nt, Human
caaaacacaaaccaguugauca

SEQ ID NO: 408048 - RNA, 21 nt, Human
caaaaugcagcaaacauuuua

SEQ ID NO: 408049 - RNA, 18 nt, Human
cagcagcaaaacacaaac

SEQ ID NO: 408050 - RNA, 20 nt, Human
caugagaaaaggaauguuca

SEQ ID NO: 408051 - RNA, 23 nt, Human
cauuuugcaaaaugcagcaaaca

SEQ ID NO: 408052 - RNA, 23 nt, Human
cccaugguauuuugguuuucuuc

SEQ ID NO: 408053 - RNA, 21 nt, Human
cuccaauaauuuucaggacac

SEQ ID NO: 408054 - RNA, 28 nt, Human
gagaaaaggaauguucaaaaggguaugc

SEQ ID NO: 408055 - RNA, 22 nt, Human
uaaaugcagcagcaaaacacaa

SEQ ID NO: 408056 - RNA, 18 nt, Human
uaagugacaguaugccac

SEQ ID NO: 408057 - RNA, 20 nt, Human
uacaugagaaaaggaauguu

SEQ ID NO: 408058 - RNA, 18 nt, Human
uauuuugguuuucuucuu

SEQ ID NO: 408059 - RNA, 21 nt, Human
ucuucuggagauuaaagcugu

SEQ ID NO: 408060 - RNA, 27 nt, Human
ucuucuggagauuaaagcuguuuuucu

SEQ ID NO: 408061 - RNA, 20 nt, Human
ugacaguaugccacuauaau

SEQ ID NO: 408062 - RNA, 24 nt, Human
ugcaaaaugcagcaaacauuuuaa

SEQ ID NO: 408063 - RNA, 19 nt, Human
ugcccaugacaaauuacua

SEQ ID NO: 408064 - RNA, 22 nt, Human
uggagauuaaagcuguuuuucu

SEQ ID NO: 408065 - RNA, 20 nt, Human
ugguauuuugguuuucuucu

SEQ ID NO: 408066 - RNA, 19 nt, Human
uguaaaagcuuguucucug

SEQ ID NO: 408067 - RNA, 23 nt, Human
ugugagagaauuucugcagguaa

SEQ ID NO: 408068 - RNA, 22 nt, Human
uuaaggauuacaucucugcacu

SEQ ID NO: 408069 - RNA, 23 nt, Human
uuucuucuggagauuaaagcugu

SEQ ID NO: 408070 - RNA, 19 nt, Human
uuugccauucccaguucuu

SEQ ID NO: 408071 - RNA, 20 nt, Human
uuugccauucccaguucuuu

SEQ ID NO: 408072 - RNA, 18 nt, Human
uuugguuuucuucuggag

SEQ ID NO: 408073 - RNA, 22 nt, Human
aagcaaacaauaaagcaggaac

SEQ ID NO: 408074 - RNA, 20 nt, Human
aagcaggaacagcaaacaga

SEQ ID NO: 408075 - RNA, 19 nt, Human
aauugcccucaccuuucca

SEQ ID NO: 408076 - RNA, 22 nt, Human
acugcaauuuauuagcgguauc

SEQ ID NO: 408077 - RNA, 19 nt, Human
agaaagcaaacaauaaagc

SEQ ID NO: 408078 - RNA, 26 nt, Human
aggacacuguccucuucuguggucuc

SEQ ID NO: 408079 - RNA, 20 nt, Human
auccaucuuucugggaggcc

SEQ ID NO: 408080 - RNA, 22 nt, Human
cagaaagcaaacaauaaagcag

SEQ ID NO: 408081 - RNA, 21 nt, Human
cagauuuuuccaucacaugac

SEQ ID NO: 408082 - RNA, 20 nt, Human
ccuugugucugagccuaucc

SEQ ID NO: 408083 - RNA, 22 nt, Human
cucccagcucuuguacccaucc

SEQ ID NO: 408084 - RNA, 20 nt, Human
cucuccuugugucugagccu

SEQ ID NO: 408085 - RNA, 30 nt, Human
cuuguacccaucccuguggguccuggcuaa

SEQ ID NO: 408086 - RNA, 20 nt, Human
gccauaacugccuugacugc

SEQ ID NO: 408087 - RNA, 22 nt, Human
uaacaggugagccucgucuucu

SEQ ID NO: 408088 - RNA, 18 nt, Human
uagcgguaucuguaaaca

SEQ ID NO: 408089 - RNA, 22 nt, Human
uaucugaaauagaggcacccua

SEQ ID NO: 408090 - RNA, 23 nt, Human
uaugacagcacacagaaagcaaa

SEQ ID NO: 408091 - RNA, 19 nt, Human
ucucccagcucuuguaccc

SEQ ID NO: 408092 - RNA, 19 nt, Human
ucuccuugugucugagccu

SEQ ID NO: 408093 - RNA, 23 nt, Human
ucugcucucuccaagccucuccu

SEQ ID NO: 408094 - RNA, 24 nt, Human
ugaaaacaaaacaaauaggaacac

SEQ ID NO: 408095 - RNA, 22 nt, Human
ugacagcacacagaaagcaaaa

SEQ ID NO: 408096 - RNA, 20 nt, Human
ugcccucaccuuuccacccu

SEQ ID NO: 408097 - RNA, 23 nt, Human
ugcucucuccaagccucuccuug

SEQ ID NO: 408098 - RNA, 18 nt, Human
uggcuccaugggaaggac

SEQ ID NO: 408099 - RNA, 22 nt, Human
uucuguggucucagucuguaua

SEQ ID NO: 408100 - RNA, 21 nt, Human
accccgaccccgaccccagcc

SEQ ID NO: 408101 - RNA, 21 nt, Human
accggccccgaccccgacccc

SEQ ID NO: 408102 - RNA, 25 nt, Human
cacucgcccuccacugacagcccca

SEQ ID NO: 408103 - RNA, 24 nt, Human
ccacgccccagggcuggaaaaagg

SEQ ID NO: 408104 - RNA, 19 nt, Human
ccccaccggccccgacccc

SEQ ID NO: 408105 - RNA, 21 nt, Human
ccccgaccccgaccccgaccc

SEQ ID NO: 408106 - RNA, 18 nt, Human
ccccggccgagccggucc

SEQ ID NO: 408107 - RNA, 18 nt, Human
ccccggggccagcgaccc

SEQ ID NO: 408108 - RNA, 22 nt, Human
ccccggggccagcgaccccucc

SEQ ID NO: 408109 - RNA, 19 nt, Human
ccccugagaaccagcacuc

SEQ ID NO: 408110 - RNA, 22 nt, Human
ccccugagaaccagcacucgcc

SEQ ID NO: 408111 - RNA, 23 nt, Human
cccgaccccgaccccagccacgc

SEQ ID NO: 408112 - RNA, 25 nt, Human
cccgaccccgaccccgaccccagcc

SEQ ID NO: 408113 - RNA, 26 nt, Human
cccgaccccgaccccgaccccagcca

SEQ ID NO: 408114 - RNA, 22 nt, Human
cccggggccagcgaccccuccc

SEQ ID NO: 408115 - RNA, 20 nt, Human
cccuccacugacagccccaa

SEQ ID NO: 408116 - RNA, 28 nt, Human
ccgaccccgaccccgaccccagccacgc

SEQ ID NO: 408117 - RNA, 19 nt, Human
cgaccccgaccccagccac

SEQ ID NO: 408118 - RNA, 21 nt, Human
cgaggcccguuggcccgaagg

SEQ ID NO: 408119 - RNA, 22 nt, Human
cgccccagggcuggaaaaagga

SEQ ID NO: 408120 - RNA, 19 nt, Human
cggccgagccgguccgcgc

SEQ ID NO: 408121 - RNA, 19 nt, Human
cgggggcggggcccccacc

SEQ ID NO: 408122 - RNA, 21 nt, Human
gaaccagcacucgcccuccac

SEQ ID NO: 408123 - RNA, 18 nt, Human
gaccccgaccccgacccc

SEQ ID NO: 408124 - RNA, 24 nt, Human
gcaggccaggagacgggggcgggg

SEQ ID NO: 408125 - RNA, 24 nt, Human
gcccccaccggccccgaccccgac

SEQ ID NO: 408126 - RNA, 31 nt, Human
gcccccaccggccccgaccccgaccccgacc

SEQ ID NO: 408127 - RNA, 21 nt, Human
gccccgaccccgaccccgacc

SEQ ID NO: 408128 - RNA, 22 nt, Human
gccccgaccccgaccccgaccc

SEQ ID NO: 408129 - RNA, 21 nt, Human
gcggcagccgagcacggggcc

SEQ ID NO: 408130 - RNA, 22 nt, Human
ggcggcgcaugcgcggccccgg

SEQ ID NO: 408131 - RNA, 21 nt, Human
gggccagcgaccccuccccag

SEQ ID NO: 408132 - RNA, 24 nt, Human
guggcggcgcaugcgcggccccgg

SEQ ID NO: 408133 - RNA, 19 nt, Human
uagcccaggaagaggacga

SEQ ID NO: 408134 - RNA, 18 nt, Human
uccccagccgccggcgcc

SEQ ID NO: 408135 - RNA, 23 nt, Human
ucgcccuccacugacagccccaa

SEQ ID NO: 408136 - RNA, 27 nt, Human
uugguggcggcgcaugcgcggccccuu

SEQ ID NO: 408137 - RNA, 22 nt, Human
aaacaagaacaaaaauggagaa

SEQ ID NO: 408138 - RNA, 22 nt, Human
aaacaagaacaaaaauggagaa

SEQ ID NO: 408139 - RNA, 21 nt, Human
aaagcaguuaauuaaaaugaa

SEQ ID NO: 408140 - RNA, 31 nt, Human
aaauaacagaaaccacacuuaucaaaagcuu

SEQ ID NO: 408141 - RNA, 24 nt, Human
aacaagaaaacucaauagccccca

SEQ ID NO: 408142 - RNA, 24 nt, Human
aacacacaaacagaaaaaggaaag

SEQ ID NO: 408143 - RNA, 20 nt, Human
aagaacgaaacaagccacuu

SEQ ID NO: 408144 - RNA, 22 nt, Human
aaggagggaggaaggaagggau

SEQ ID NO: 408145 - RNA, 18 nt, Human
aaucuaaauggauuccua

SEQ ID NO: 408146 - RNA, 20 nt, Human
acaaacagaaaaauaauucg

SEQ ID NO: 408147 - RNA, 24 nt, Human
acacuguagugugaaggagaggga

SEQ ID NO: 408148 - RNA, 18 nt, Human
accugagccccuucaagc

SEQ ID NO: 408149 - RNA, 20 nt, Human
accugagccccuucaagcgc

SEQ ID NO: 408150 - RNA, 22 nt, Human
agaaaagcaaagaggggugggg

SEQ ID NO: 408151 - RNA, 20 nt, Human
agaaaagcaaagcaaaaagg

SEQ ID NO: 408152 - RNA, 22 nt, Human
agaaacaagaaaacucaauagc

SEQ ID NO: 408153 - RNA, 24 nt, Human
agaaggggagagaaaagcaaagag

SEQ ID NO: 408154 - RNA, 20 nt, Human
agagacaaagaugggaaucc

SEQ ID NO: 408155 - RNA, 24 nt, Human
agagggguggggaggggaaaauca

SEQ ID NO: 408156 - RNA, 20 nt, Human
agcaaagagggguggggagg

SEQ ID NO: 408157 - RNA, 25 nt, Human
agcaaagcaaaaagguuaagcaccc

SEQ ID NO: 408158 - RNA, 21 nt, Human
aggaaaccuuugugcuaaugu

SEQ ID NO: 408159 - RNA, 18 nt, Human
aggaaauuacagauuucu

SEQ ID NO: 408160 - RNA, 21 nt, Human
aggaagggauggagagagagg

SEQ ID NO: 408161 - RNA, 20 nt, Human
aggagggaggaaggaaggga

SEQ ID NO: 408162 - RNA, 20 nt, Human
aggagggaggaaggaaggga

SEQ ID NO: 408163 - RNA, 24 nt, Human
agggauggagagagaggggagaga

SEQ ID NO: 408164 - RNA, 18 nt, Human
agggguggggaggggaaa

SEQ ID NO: 408165 - RNA, 25 nt, Human
agggguggggaggggaaaaucaagg

SEQ ID NO: 408166 - RNA, 23 nt, Human
agugugaaggagagggagaagga

SEQ ID NO: 408167 - RNA, 25 nt, Human
auaauaaugaaaguaauaauaaaac

SEQ ID NO: 408168 - RNA, 24 nt, Human
aucggcccuccucaccuuucaccu

SEQ ID NO: 408169 - RNA, 20 nt, Human
auucuucaaaaccuccuccu

SEQ ID NO: 408170 - RNA, 23 nt, Human
caaagcaaaaagguuaagcaccc

SEQ ID NO: 408171 - RNA, 19 nt, Human
caacaagaccagcaaagug

SEQ ID NO: 408172 - RNA, 18 nt, Human
caacccugagcucuuccu

SEQ ID NO: 408173 - RNA, 19 nt, Human
caaggaggcacgcucccuu

SEQ ID NO: 408174 - RNA, 24 nt, Human
cacacaaacagaaaaauaauucgc

SEQ ID NO: 408175 - RNA, 21 nt, Human
cacacauuaggaaacuaacac

SEQ ID NO: 408176 - RNA, 21 nt, Human
cacccugucuccaaaaauguc

SEQ ID NO: 408177 - RNA, 19 nt, Human
cacgcucccuuuauccucc

SEQ ID NO: 408178 - RNA, 22 nt, Human
cacucccuuuacgcagccaguc

SEQ ID NO: 408179 - RNA, 19 nt, Human
cacugaauggcaacaaaga

SEQ ID NO: 408180 - RNA, 21 nt, Human
cagaaaccacaagcugacaau

SEQ ID NO: 408181 - RNA, 20 nt, Human
cagauaugaucaaggaauua

SEQ ID NO: 408182 - RNA, 23 nt, Human
cagcaauaugccauuuuucugau

SEQ ID NO: 408183 - RNA, 19 nt, Human
caguagaauaggacccaac

SEQ ID NO: 408184 - RNA, 21 nt, Human
caguagaauaggacccaacaa

SEQ ID NO: 408185 - RNA, 23 nt, Human
ccaaugucccuacccuguucucc

SEQ ID NO: 408186 - RNA, 22 nt, Human
ccagcaaaguggcaccuggggc

SEQ ID NO: 408187 - RNA, 23 nt, Human
ccagucacacacaauaacagcua

SEQ ID NO: 408188 - RNA, 23 nt, Human
cccccuccauuuugcucuucucc

SEQ ID NO: 408189 - RNA, 21 nt, Human
cccugagcucuuccuuuuccc

SEQ ID NO: 408190 - RNA, 23 nt, Human
cccuuuauccuccccacccuguc

SEQ ID NO: 408191 - RNA, 24 nt, Human
ccugagccccuucaagcgcaccca

SEQ ID NO: 408192 - RNA, 19 nt, Human
ccuggggcuucaaggaagc

SEQ ID NO: 408193 - RNA, 20 nt, Human
cgacugggacagcccggggc

SEQ ID NO: 408194 - RNA, 26 nt, Human
cgcgaaacagcagccgacugggacag

SEQ ID NO: 408195 - RNA, 22 nt, Human
cguagcacugaauggcaacaaa

SEQ ID NO: 408196 - RNA, 24 nt, Human
cuaacacaucuuuaagaaacaaga

SEQ ID NO: 408197 - RNA, 23 nt, Human
cuagagguuucuguccccuucug

SEQ ID NO: 408198 - RNA, 19 nt, Human
cucaccuuucaccuucgcc

SEQ ID NO: 408199 - RNA, 25 nt, Human
cuccuaccuuggcuuccccuuugga

SEQ ID NO: 408200 - RNA, 18 nt, Human
cucuaggacucagaccua

SEQ ID NO: 408201 - RNA, 26 nt, Human
cucuuacacgcacacucaagcuccag

SEQ ID NO: 408202 - RNA, 23 nt, Human
cucuuccuuuucccuucuuucug

SEQ ID NO: 408203 - RNA, 23 nt, Human
cugagccccuucaagcgcaccca

SEQ ID NO: 408204 - RNA, 23 nt, Human
cuggccccucccccuccauuuug

SEQ ID NO: 408205 - RNA, 20 nt, Human
cuuuauuccucccuuugggg

SEQ ID NO: 408206 - RNA, 21 nt, Human
gaaaccuuugugcuaauguug

SEQ ID NO: 408207 - RNA, 21 nt, Human
gacgagcgcaaguacuggcuc

SEQ ID NO: 408208 - RNA, 24 nt, Human
gagaaggggagagaaaagcaaaga

SEQ ID NO: 408209 - RNA, 19 nt, Human
gagagggagaaggagggag

SEQ ID NO: 408210 - RNA, 18 nt, Human
gagcgcaaguacuggcuc

SEQ ID NO: 408211 - RNA, 25 nt, Human
gaggaaaccuuugugcuaauguugg

SEQ ID NO: 408212 - RNA, 18 nt, Human
gaggggaaaaucaaggag

SEQ ID NO: 408213 - RNA, 26 nt, Human
gcaaagagggguggggaggggaaaau

SEQ ID NO: 408214 - RNA, 21 nt, Human
gcccugaaacucuuugcucuu

SEQ ID NO: 408215 - RNA, 20 nt, Human
gcuauaaaagauggugcaaa

SEQ ID NO: 408216 - RNA, 18 nt, Human
gcucccuuuauccucccc

SEQ ID NO: 408217 - RNA, 20 nt, Human
gcuuuauucuucaaaaccuc

SEQ ID NO: 408218 - RNA, 20 nt, Human
ggaaaauggcaugagauucu

SEQ ID NO: 408219 - RNA, 22 nt, Human
ggaaaccuuugugcuaauguug

SEQ ID NO: 408220 - RNA, 21 nt, Human
ggagagaaaagcaaagagggg

SEQ ID NO: 408221 - RNA, 19 nt, Human
ggcaacaaagaugggcagg

SEQ ID NO: 408222 - RNA, 20 nt, Human
guaaagacgagcgcaaguac

SEQ ID NO: 408223 - RNA, 23 nt, Human
guaaagacgagcgcaaguacugg

SEQ ID NO: 408224 - RNA, 20 nt, Human
gugaaggagagggagaagga

SEQ ID NO: 408225 - RNA, 19 nt, Human
gugcaaauaagaguuucac

SEQ ID NO: 408226 - RNA, 23 nt, Human
gugcggcaacaagaccagcaaag

SEQ ID NO: 408227 - RNA, 22 nt, Human
gugggugggcggaugagcacag

SEQ ID NO: 408228 - RNA, 19 nt, Human
uaaaaaaaacagcgugaca

SEQ ID NO: 408229 - RNA, 21 nt, Human
uaaaaaaaacagcgugacacc

SEQ ID NO: 408230 - RNA, 26 nt, Human
uaaaaaggcaaauaauaaugaaagua

SEQ ID NO: 408231 - RNA, 18 nt, Human
uaaaacugcaaccugaau

SEQ ID NO: 408232 - RNA, 19 nt, Human
uaaauaaccacuucagaua

SEQ ID NO: 408233 - RNA, 20 nt, Human
uaacacaucuuuaagaaaca

SEQ ID NO: 408234 - RNA, 22 nt, Human
uaacagaucggcccuccucacc

SEQ ID NO: 408235 - RNA, 21 nt, Human
uaauuccaugaauccacuagg

SEQ ID NO: 408236 - RNA, 23 nt, Human
uacacgcacacucaagcuccagc

SEQ ID NO: 408237 - RNA, 20 nt, Human
uacgcagccagucacacaca

SEQ ID NO: 408238 - RNA, 24 nt, Human
uacuggcuccuaccuuggcuuccc

SEQ ID NO: 408239 - RNA, 26 nt, Human
uagaauaggacccaacaaauaugaca

SEQ ID NO: 408240 - RNA, 24 nt, Human
uagagacaaagaugggaauccauu

SEQ ID NO: 408241 - RNA, 22 nt, Human
uauaaauguagcuuucuuggaa

SEQ ID NO: 408242 - RNA, 21 nt, Human
uauccuccccacccugucucc

SEQ ID NO: 408243 - RNA, 23 nt, Human
uaugagauguagugacuauuggu

SEQ ID NO: 408244 - RNA, 23 nt, Human
uauuucuggccccucccccucca

SEQ ID NO: 408245 - RNA, 19 nt, Human
ucaacaguagaauaggacc

SEQ ID NO: 408246 - RNA, 24 nt, Human
ucaauagcccccacaauaagaagu

SEQ ID NO: 408247 - RNA, 25 nt, Human
uccccuucugcugucguuucuggaa

SEQ ID NO: 408248 - RNA, 21 nt, Human
ucccuacccuguucucccagc

SEQ ID NO: 408249 - RNA, 23 nt, Human
ucccuuugggguggcugcgagcu

SEQ ID NO: 408250 - RNA, 23 nt, Human
uccuccccacccugucuccaaaa

SEQ ID NO: 408251 - RNA, 21 nt, Human
ucuaaacugaggaaaccuuug

SEQ ID NO: 408252 - RNA, 20 nt, Human
ucuccaaaaauguccaaccc

SEQ ID NO: 408253 - RNA, 19 nt, Human
ucuguccccuucugcuguu

SEQ ID NO: 408254 - RNA, 20 nt, Human
ugaaacacacaaacagaaaa

SEQ ID NO: 408255 - RNA, 24 nt, Human
ugaaacacacaaacagaaaaauaa

SEQ ID NO: 408256 - RNA, 27 nt, Human
ugaaacacacaaacagaaaagggaguc

SEQ ID NO: 408257 - RNA, 19 nt, Human
ugaaggagagggagaagga

SEQ ID NO: 408258 - RNA, 21 nt, Human
ugacagucuuagcgacgcagg

SEQ ID NO: 408259 - RNA, 22 nt, Human
ugagagcaaggaaauuacagau

SEQ ID NO: 408260 - RNA, 18 nt, Human
ugaggaaaccuuugugcu

SEQ ID NO: 408261 - RNA, 24 nt, Human
ugaguaaauaaccacuucagauau

SEQ ID NO: 408262 - RNA, 21 nt, Human
ugaugcagcuuuuucacuuga

SEQ ID NO: 408263 - RNA, 23 nt, Human
ugcaaauaagaguuucacucucc

SEQ ID NO: 408264 - RNA, 21 nt, Human
ugcuccuguucuuuauuccuc

SEQ ID NO: 408265 - RNA, 20 nt, Human
ugcugaccacaucccucagc

SEQ ID NO: 408266 - RNA, 19 nt, Human
ugcugucguuucuggaaua

SEQ ID NO: 408267 - RNA, 19 nt, Human
uggaagacaguagaauuug

SEQ ID NO: 408268 - RNA, 18 nt, Human
uggaauaugcuauacaga

SEQ ID NO: 408269 - RNA, 23 nt, Human
uggccccucccccuccauuuugc

SEQ ID NO: 408270 - RNA, 18 nt, Human
uggugcaaauaagaguuu

SEQ ID NO: 408271 - RNA, 24 nt, Human
uguaagauggacuuaguguguaua

SEQ ID NO: 408272 - RNA, 26 nt, Human
uguaagauggacuuaguguguauagg

SEQ ID NO: 408273 - RNA, 24 nt, Human
uguagcccagguucuauuauuauu

SEQ ID NO: 408274 - RNA, 24 nt, Human
uguccccuucugcugucguuucug

SEQ ID NO: 408275 - RNA, 21 nt, Human
ugugcggcaacaagaccagca

SEQ ID NO: 408276 - RNA, 24 nt, Human
ugugcggcaacaagaccagcaaag

SEQ ID NO: 408277 - RNA, 18 nt, Human
uuaaaaaaaacagcguga

SEQ ID NO: 408278 - RNA, 19 nt, Human
uuaagcacccaacugcacc

SEQ ID NO: 408279 - RNA, 21 nt, Human
uuagagucuaaacugaggaaa

SEQ ID NO: 408280 - RNA, 21 nt, Human
uuauccuccccacccugucuc

SEQ ID NO: 408281 - RNA, 21 nt, Human
uucaaaaccuccuccuauuuc

SEQ ID NO: 408282 - RNA, 18 nt, Human
uucccuucuuucugcgcc

SEQ ID NO: 408283 - RNA, 18 nt, Human
uucccuucuuucugcgcc

SEQ ID NO: 408284 - RNA, 23 nt, Human
uucgccagugcccugaaacucuu

SEQ ID NO: 408285 - RNA, 19 nt, Human
uucuggccccucccccucc

SEQ ID NO: 408286 - RNA, 19 nt, Human
uucuggggggcaggggcag

SEQ ID NO: 408287 - RNA, 23 nt, Human
uugacauuaaaaaaaacagcgug

SEQ ID NO: 408288 - RNA, 26 nt, Human
uugacauuaaaaaaaacagcgugaca

SEQ ID NO: 408289 - RNA, 19 nt, Human
uuucccuucuuucugcgcc

SEQ ID NO: 408290 - RNA, 18 nt, Human
uuucuggccccucccccu

SEQ ID NO: 408291 - RNA, 21 nt, Human
uuucuggccccucccccucca

SEQ ID NO: 408292 - RNA, 20 nt, Human
uuucuggggggcaggggcag

SEQ ID NO: 408293 - RNA, 20 nt, Human
uuucuuggaagacaguagaa

SEQ ID NO: 408294 - RNA, 23 nt, Human
uuucuuggaagacaguagaauuu

SEQ ID NO: 408295 - RNA, 24 nt, Human
aaacaagcaccaaacaacugggca

SEQ ID NO: 408296 - RNA, 27 nt, Human
aaacaagcaccaaacaacugggcauaa

SEQ ID NO: 408297 - RNA, 20 nt, Human
aaugacaucaucacaagagu

SEQ ID NO: 408298 - RNA, 18 nt, Human
acacgcacacacacaaaa

SEQ ID NO: 408299 - RNA, 21 nt, Human
acaguguuuguuugggguuuu

SEQ ID NO: 408300 - RNA, 18 nt, Human
accacaguguuuguuugg

SEQ ID NO: 408301 - RNA, 24 nt, Human
accucuugguaaaugcacaugaau

SEQ ID NO: 408302 - RNA, 25 nt, Human
accuuauuuuuccccuuuacauuca

SEQ ID NO: 408303 - RNA, 21 nt, Human
acuuaagggggugcaaagagg

SEQ ID NO: 408304 - RNA, 19 nt, Human
aggaaccugaaauaaacuu

SEQ ID NO: 408305 - RNA, 22 nt, Human
auccaagaaagcaguuuauaaa

SEQ ID NO: 408306 - RNA, 19 nt, Human
aucccccgcacucuccguc

SEQ ID NO: 408307 - RNA, 20 nt, Human
auggucuuugaguaaacauc

SEQ ID NO: 408308 - RNA, 24 nt, Human
auguaagaccauuuuguaugaacg

SEQ ID NO: 408309 - RNA, 18 nt, Human
auuuaaauuaagccaaag

SEQ ID NO: 408310 - RNA, 23 nt, Human
caagggagacggagcugaagagu

SEQ ID NO: 408311 - RNA, 19 nt, Human
cacaguguuuguuuggggu

SEQ ID NO: 408312 - RNA, 21 nt, Human
caccaaacaacugggcauaau

SEQ ID NO: 408313 - RNA, 18 nt, Human
cagcucccgccuucaucc

SEQ ID NO: 408314 - RNA, 20 nt, Human
caggcagacacuacauggca

SEQ ID NO: 408315 - RNA, 23 nt, Human
caucuuuaagaugaaguuaaaga

SEQ ID NO: 408316 - RNA, 18 nt, Human
ccacauuagccacaaacu

SEQ ID NO: 408317 - RNA, 26 nt, Human
cccugaacaauggaguuuaaucacca

SEQ ID NO: 408318 - RNA, 18 nt, Human
ccgggcagagagggcaca

SEQ ID NO: 408319 - RNA, 19 nt, Human
ccucugaaugccaaugguc

SEQ ID NO: 408320 - RNA, 22 nt, Human
cgcacacacacaaaacuggacc

SEQ ID NO: 408321 - RNA, 23 nt, Human
cgcgucagcggccgaacuggacc

SEQ ID NO: 408322 - RNA, 19 nt, Human
cgggggagccgagugggca

SEQ ID NO: 408323 - RNA, 21 nt, Human
cuggaccauguuuccaggguu

SEQ ID NO: 408324 - RNA, 20 nt, Human
cuggaccugggcagaccggu

SEQ ID NO: 408325 - RNA, 18 nt, Human
cuggugguagcgaagcgu

SEQ ID NO: 408326 - RNA, 20 nt, Human
cuucaucccccgcacucucc

SEQ ID NO: 408327 - RNA, 20 nt, Human
gaagcagggggugcagacgc

SEQ ID NO: 408328 - RNA, 20 nt, Human
gacaccacuucacaugauca

SEQ ID NO: 408329 - RNA, 24 nt, Human
gagcugggaguccccagcagggga

SEQ ID NO: 408330 - RNA, 22 nt, Human
gaggaucuugaccugagcaggu

SEQ ID NO: 408331 - RNA, 20 nt, Human
gccccgcucccgggggagcc

SEQ ID NO: 408332 - RNA, 20 nt, Human
gccuucaucccccgcacucu

SEQ ID NO: 408333 - RNA, 20 nt, Human
gcuaaguguggggauucauc

SEQ ID NO: 408334 - RNA, 19 nt, Human
ggaccugggcagaccggug

SEQ ID NO: 408335 - RNA, 18 nt, Human
ggagcuaaacagauuuuc

SEQ ID NO: 408336 - RNA, 22 nt, Human
ggcagagagggcacaggcgggg

SEQ ID NO: 408337 - RNA, 21 nt, Human
ggcaguuccagcggggacccg

SEQ ID NO: 408338 - RNA, 25 nt, Human
ggccugggccccgcucccgggggag

SEQ ID NO: 408339 - RNA, 18 nt, Human
ggcggggccgcugguggu

SEQ ID NO: 408340 - RNA, 18 nt, Human
gggcacaggcggggccgc

SEQ ID NO: 408341 - RNA, 18 nt, Human
gggcaguuccagcgggga

SEQ ID NO: 408342 - RNA, 20 nt, Human
ggggugcagacgcccgccgc

SEQ ID NO: 408343 - RNA, 21 nt, Human
gugaagcagggggugcagacg

SEQ ID NO: 408344 - RNA, 33 nt, Human
guguguacacauuuacacacacgcacacacagu

SEQ ID NO: 408345 - RNA, 25 nt, Human
uaaaacaagcaccaaacaacugggc

SEQ ID NO: 408346 - RNA, 19 nt, Human
uaaaugcucccagaaaugg

SEQ ID NO: 408347 - RNA, 20 nt, Human
uaagacaccacuucacauga

SEQ ID NO: 408348 - RNA, 21 nt, Human
uaagacaccacuucacaugau

SEQ ID NO: 408349 - RNA, 19 nt, Human
uaagccaaaguuggagcua

SEQ ID NO: 408350 - RNA, 19 nt, Human
uacacacacgcacacacac

SEQ ID NO: 408351 - RNA, 21 nt, Human
uacacacacgcacacacacag

SEQ ID NO: 408352 - RNA, 18 nt, Human
uacacauuuacacacacg

SEQ ID NO: 408353 - RNA, 21 nt, Human
uacuaugucaacagagacucu

SEQ ID NO: 408354 - RNA, 20 nt, Human
uauaauggaaccaaacaacc

SEQ ID NO: 408355 - RNA, 22 nt, Human
ucaacagagacucuccagcccu

SEQ ID NO: 408356 - RNA, 18 nt, Human
ucagcucccgccuucauc

SEQ ID NO: 408357 - RNA, 21 nt, Human
ucauuguuaaguguaauguuu

SEQ ID NO: 408358 - RNA, 21 nt, Human
uccacagagcaggcaagaagg

SEQ ID NO: 408359 - RNA, 19 nt, Human
ucuacagccuuuacccuga

SEQ ID NO: 408360 - RNA, 26 nt, Human
ucuuugauuuaaauuaagccaaccaa

SEQ ID NO: 408361 - RNA, 20 nt, Human
ugaaugccaauggucuuuga

SEQ ID NO: 408362 - RNA, 23 nt, Human
ugaauuggaaguagcaguuccaa

SEQ ID NO: 408363 - RNA, 19 nt, Human
ugacaucaucacaagaguu

SEQ ID NO: 408364 - RNA, 20 nt, Human
uggaaccaaacaaccacagu

SEQ ID NO: 408365 - RNA, 21 nt, Human
uggaggaaaaacuuuuuucau

SEQ ID NO: 408366 - RNA, 19 nt, Human
uggcaaugacaucaucaca

SEQ ID NO: 408367 - RNA, 19 nt, Human
uggcucgcccacuggcccg

SEQ ID NO: 408368 - RNA, 22 nt, Human
uggcucgcccacuggcccgggg

SEQ ID NO: 408369 - RNA, 21 nt, Human
uggggaguaacgugggucagc

SEQ ID NO: 408370 - RNA, 24 nt, Human
ugggguuuugauuuuucuccaaua

SEQ ID NO: 408371 - RNA, 21 nt, Human
uguacacauuuacacacacgc

SEQ ID NO: 408372 - RNA, 33 nt, Human
uguguguacacauuuacacacacgcacacagug

SEQ ID NO: 408373 - RNA, 21 nt, Human
uuaaaaggugggcccauuggc

SEQ ID NO: 408374 - RNA, 18 nt, Human
uuaaagcauucuaaaggc

SEQ ID NO: 408375 - RNA, 23 nt, Human
uuacacacacgcacacacacaaa

SEQ ID NO: 408376 - RNA, 27 nt, Human
uuacacacacgcacacacacaaaacug

SEQ ID NO: 408377 - RNA, 23 nt, Human
uucacaugaucaguaaguaacaa

SEQ ID NO: 408378 - RNA, 24 nt, Human
uuguaugaacgguaucaaucaugu

SEQ ID NO: 408379 - RNA, 24 nt, Human
uuuacacacacgcacacacacaaa

SEQ ID NO: 408380 - RNA, 22 nt, Human
aaagauacauucccguuugcaa

SEQ ID NO: 408381 - RNA, 19 nt, Human
aaagugcuaggauuacagg

SEQ ID NO: 408382 - RNA, 24 nt, Human
aaagugcuaggauuacaggcauga

SEQ ID NO: 408383 - RNA, 20 nt, Human
aacugaaaaaacuaagccua

SEQ ID NO: 408384 - RNA, 26 nt, Human
aagugcuaggauuacaggcaugagcc

SEQ ID NO: 408385 - RNA, 23 nt, Human
acccugccacagcaguggaaugg

SEQ ID NO: 408386 - RNA, 22 nt, Human
acuaagccuacuaacauaugcu

SEQ ID NO: 408387 - RNA, 25 nt, Human
acuauguugcccaggcuggucucaa

SEQ ID NO: 408388 - RNA, 23 nt, Human
acugaaaaaacuaagccuacuaa

SEQ ID NO: 408389 - RNA, 23 nt, Human
agcuaucuuucugccuuggccuc

SEQ ID NO: 408390 - RNA, 26 nt, Human
caaaagguuuucucuauccaagauuu

SEQ ID NO: 408391 - RNA, 24 nt, Human
caaagugcuaggauuacaggcaug

SEQ ID NO: 408392 - RNA, 24 nt, Human
caacagaccauuucucaggcugag

SEQ ID NO: 408393 - RNA, 21 nt, Human
caagaugacacccauuagugg

SEQ ID NO: 408394 - RNA, 21 nt, Human
cacagcucaggcucuuucagc

SEQ ID NO: 408395 - RNA, 23 nt, Human
cacagcucaggcucuuucagccu

SEQ ID NO: 408396 - RNA, 25 nt, Human
cacagcucaggcucuuucagccucc

SEQ ID NO: 408397 - RNA, 19 nt, Human
cacuauguugcccaggcug

SEQ ID NO: 408398 - RNA, 24 nt, Human
cacuauguugcccaggcuggucuc

SEQ ID NO: 408399 - RNA, 27 nt, Human
cacuauguugcccaggcuggucucaaa

SEQ ID NO: 408400 - RNA, 19 nt, Human
cacuuucauuugauacuac

SEQ ID NO: 408401 - RNA, 19 nt, Human
ccaaagugcuaggauuaca

SEQ ID NO: 408402 - RNA, 24 nt, Human
ccaaagugcuaggauuacaggcau

SEQ ID NO: 408403 - RNA, 19 nt, Human
ccaccuguuuguuuuccuc

SEQ ID NO: 408404 - RNA, 19 nt, Human
cccuggaauucaagaacuc

SEQ ID NO: 408405 - RNA, 20 nt, Human
ccuggacucaagcuaucuuu

SEQ ID NO: 408406 - RNA, 19 nt, Human
cuaagccuacuaacauaug

SEQ ID NO: 408407 - RNA, 18 nt, Human
cucaagcuaucuuucugc

SEQ ID NO: 408408 - RNA, 20 nt, Human
cucaagcuaucuuucugccu

SEQ ID NO: 408409 - RNA, 23 nt, Human
cugccuuggccucccaaagugcu

SEQ ID NO: 408410 - RNA, 19 nt, Human
gaacuggccacagcaacac

SEQ ID NO: 408411 - RNA, 18 nt, Human
gaauauccgccacccugg

SEQ ID NO: 408412 - RNA, 27 nt, Human
gagucuccaccuguuuguuuuccucuu

SEQ ID NO: 408413 - RNA, 18 nt, Human
gauuacaggcaugagcca

SEQ ID NO: 408414 - RNA, 21 nt, Human
gauuacaggcaugagccacug

SEQ ID NO: 408415 - RNA, 24 nt, Human
gauuacaggcaugagccacugugc

SEQ ID NO: 408416 - RNA, 22 nt, Human
gcaguggaauggagagggcacc

SEQ ID NO: 408417 - RNA, 22 nt, Human
ggauuacaggcaugagccacug

SEQ ID NO: 408418 - RNA, 24 nt, Human
ggauuacaggcaugagccacugug

SEQ ID NO: 408419 - RNA, 23 nt, Human
gggguaucacuauguugcccagg

SEQ ID NO: 408420 - RNA, 22 nt, Human
uaagagaugggguaucacuaug

SEQ ID NO: 408421 - RNA, 24 nt, Human
uacaggcaugagccacugugccca

SEQ ID NO: 408422 - RNA, 23 nt, Human
uacugcaacugaaaaaacuaagc

SEQ ID NO: 408423 - RNA, 21 nt, Human
uaggauuacaggcaugagcca

SEQ ID NO: 408424 - RNA, 22 nt, Human
uaggauuacaggcaugagccac

SEQ ID NO: 408425 - RNA, 22 nt, Human
uaggauuacaggcaugagccac

SEQ ID NO: 408426 - RNA, 24 nt, Human
uaggauuacaggcaugagccacug

SEQ ID NO: 408427 - RNA, 26 nt, Human
uaggauuacaggcaugagccacugug

SEQ ID NO: 408428 - RNA, 23 nt, Human
uauguugcccaggcuggucucaa

SEQ ID NO: 408429 - RNA, 24 nt, Human
uauguugcccaggcuggucucaaa

SEQ ID NO: 408430 - RNA, 21 nt, Human
uccaagauuucugacccugcc

SEQ ID NO: 408431 - RNA, 24 nt, Human
ucccaaagugcuaggauuacaggc

SEQ ID NO: 408432 - RNA, 22 nt, Human
ucccguuugcaaaagguuuucu

SEQ ID NO: 408433 - RNA, 18 nt, Human
uccgccacccuggaauuc

SEQ ID NO: 408434 - RNA, 21 nt, Human
uccuaggcuauuugguggccc

SEQ ID NO: 408435 - RNA, 22 nt, Human
uccuaggcuauuugguggcccu

SEQ ID NO: 408436 - RNA, 20 nt, Human
ucucaggcugagucuccacc

SEQ ID NO: 408437 - RNA, 21 nt, Human
ucugacuguuaaaaaaaaaaa

SEQ ID NO: 408438 - RNA, 21 nt, Human
ucuuaagugaccuaaugguga

SEQ ID NO: 408439 - RNA, 18 nt, Human
ugaacuggccacagcaac

SEQ ID NO: 408440 - RNA, 20 nt, Human
ugacuucagugcucgagggc

SEQ ID NO: 408441 - RNA, 24 nt, Human
ugcccaggcuggucucaaacuccu

SEQ ID NO: 408442 - RNA, 23 nt, Human
ugccuuggccucccaaagugcua

SEQ ID NO: 408443 - RNA, 22 nt, Human
ugcuaggaauuacaaagauaca

SEQ ID NO: 408444 - RNA, 22 nt, Human
uggaauggagagggcacagcuc

SEQ ID NO: 408445 - RNA, 24 nt, Human
ugggguaucacuauguugcccagg

SEQ ID NO: 408446 - RNA, 20 nt, Human
uguuggguagcucugggugu

SEQ ID NO: 408447 - RNA, 23 nt, Human
uguuuagauggccaagaugacac

SEQ ID NO: 408448 - RNA, 18 nt, Human
uuggccucccaaagugcu

SEQ ID NO: 408449 - RNA, 22 nt, Human
uuuugcuggguguugcacuugg

SEQ ID NO: 408450 - RNA, 20 nt, Human
uuuuuuuuuuuuuaagagau

SEQ ID NO: 408451 - RNA, 24 nt, Human
uuuuuuuuuuuuuuuuuuaagaga

SEQ ID NO: 408452 - RNA, 28 nt, Human
uuuuuuuuuuuuuuuuuuaagagauggg

SEQ ID NO: 408453 - RNA, 18 nt, Human
aaagcacagaagagccag

SEQ ID NO: 408454 - RNA, 19 nt, Human
aagggcccagcugcacagg

SEQ ID NO: 408455 - RNA, 21 nt, Human
aagggcccagcugcacaggcc

SEQ ID NO: 408456 - RNA, 23 nt, Human
accagcugccagcgacaugguuu

SEQ ID NO: 408457 - RNA, 19 nt, Human
agaaacuuggggguagggc

SEQ ID NO: 408458 - RNA, 22 nt, Human
agacagaggccuguccagggaa

SEQ ID NO: 408459 - RNA, 20 nt, Human
agacaggaagaugaggcuga

SEQ ID NO: 408460 - RNA, 18 nt, Human
agagaagcccugguuucu

SEQ ID NO: 408461 - RNA, 23 nt, Human
agaggaccuggccacaugcuucc

SEQ ID NO: 408462 - RNA, 25 nt, Human
agaggaccuggccacaugcuuccuc

SEQ ID NO: 408463 - RNA, 23 nt, Human
agaguggcagggccccuuccuca

SEQ ID NO: 408464 - RNA, 18 nt, Human
agaucagagacaggaaga

SEQ ID NO: 408465 - RNA, 24 nt, Human
agccaggaagggaguggacucugg

SEQ ID NO: 408466 - RNA, 22 nt, Human
agccccuggcccuggacguguc

SEQ ID NO: 408467 - RNA, 22 nt, Human
aggaagaugaggcugauguucu

SEQ ID NO: 408468 - RNA, 22 nt, Human
aggaccuggccacaugcuuccu

SEQ ID NO: 408469 - RNA, 20 nt, Human
aggaguucagacagugcccc

SEQ ID NO: 408470 - RNA, 20 nt, Human
aggccaggcaaggcuccaug

SEQ ID NO: 408471 - RNA, 18 nt, Human
agggagcugaugggucag

SEQ ID NO: 408472 - RNA, 24 nt, Human
aggggcacuggguccaccaaaccc

SEQ ID NO: 408473 - RNA, 23 nt, Human
aggggcugcaggacauccacagg

SEQ ID NO: 408474 - RNA, 20 nt, Human
aggggguggcuagagagcuu

SEQ ID NO: 408475 - RNA, 19 nt, Human
agguggaagacagaggccu

SEQ ID NO: 408476 - RNA, 22 nt, Human
agucaggaguucagacagugcc

SEQ ID NO: 408477 - RNA, 23 nt, Human
aguggacucuggccaagggccca

SEQ ID NO: 408478 - RNA, 21 nt, Human
aguggccaggcagccccaggc

SEQ ID NO: 408479 - RNA, 18 nt, Human
caaaccagaaggccccca

SEQ ID NO: 408480 - RNA, 19 nt, Human
caccaaaccagaaggcccc

SEQ ID NO: 408481 - RNA, 22 nt, Human
caccaaaccagaaggcccccac

SEQ ID NO: 408482 - RNA, 19 nt, Human
caccgccagcaccagcugc

SEQ ID NO: 408483 - RNA, 20 nt, Human
caccuugaccccuuccaguu

SEQ ID NO: 408484 - RNA, 21 nt, Human
caccuugaccccuuccaguuc

SEQ ID NO: 408485 - RNA, 19 nt, Human
cagaagagccagccaggcc

SEQ ID NO: 408486 - RNA, 20 nt, Human
cagaaggcccccacgucccc

SEQ ID NO: 408487 - RNA, 18 nt, Human
cagaggagaaacuugggg

SEQ ID NO: 408488 - RNA, 19 nt, Human
cagccgucacacagccccu

SEQ ID NO: 408489 - RNA, 21 nt, Human
cagcugcaaccaggccugcug

SEQ ID NO: 408490 - RNA, 19 nt, Human
caggaacagccugaguccu

SEQ ID NO: 408491 - RNA, 23 nt, Human
cauggccagcacguggcucccag

SEQ ID NO: 408492 - RNA, 21 nt, Human
caugguucacgcuccugugag

SEQ ID NO: 408493 - RNA, 21 nt, Human
ccaaaccagaaggcccccacg

SEQ ID NO: 408494 - RNA, 23 nt, Human
ccaccgccagcaccagcugccag

SEQ ID NO: 408495 - RNA, 18 nt, Human
ccaggccaggcaaggcuc

SEQ ID NO: 408496 - RNA, 22 nt, Human
ccaggccaggcaaggcuccaug

SEQ ID NO: 408497 - RNA, 24 nt, Human
ccaggccaggcaaggcuccauguu

SEQ ID NO: 408498 - RNA, 18 nt, Human
ccagugcucaguggccag

SEQ ID NO: 408499 - RNA, 19 nt, Human
ccccacguccccgccuccu

SEQ ID NO: 408500 - RNA, 23 nt, Human
ccccaggcuccauccggagccuc

SEQ ID NO: 408501 - RNA, 21 nt, Human
cccccacgccagcugcaacca

SEQ ID NO: 408502 - RNA, 22 nt, Human
cccccacguccccgccuccugc

SEQ ID NO: 408503 - RNA, 22 nt, Human
ccccucgccugauggccaaggg

SEQ ID NO: 408504 - RNA, 23 nt, Human
ccgucacacagccccuggcccug

SEQ ID NO: 408505 - RNA, 18 nt, Human
ccucagcucugaguagcc

SEQ ID NO: 408506 - RNA, 18 nt, Human
ccucuuggggagaguggc

SEQ ID NO: 408507 - RNA, 18 nt, Human
ccugguuucuggggggaa

SEQ ID NO: 408508 - RNA, 19 nt, Human
cgccagcaccagcugccag

SEQ ID NO: 408509 - RNA, 23 nt, Human
cuccaccgccagcaccagcugcc

SEQ ID NO: 408510 - RNA, 23 nt, Human
cucuuggggagaguggcagggcc

SEQ ID NO: 408511 - RNA, 21 nt, Human
cugaguccuggccaggcucag

SEQ ID NO: 408512 - RNA, 22 nt, Human
cugcacauguucccagcugcgu

SEQ ID NO: 408513 - RNA, 18 nt, Human
cugcagcagacuugcggc

SEQ ID NO: 408514 - RNA, 18 nt, Human
cugcagggccagagaaag

SEQ ID NO: 408515 - RNA, 18 nt, Human
cugcugcccucaggacag

SEQ ID NO: 408516 - RNA, 24 nt, Human
gagaggaccuggccacaugcuucc

SEQ ID NO: 408517 - RNA, 18 nt, Human
gaggagaaacuugggggu

SEQ ID NO: 408518 - RNA, 23 nt, Human
gcacagggaagucuccaccgcca

SEQ ID NO: 408519 - RNA, 21 nt, Human
gccaaggaggagggcaugugg

SEQ ID NO: 408520 - RNA, 18 nt, Human
gcccagcugcacaggccc

SEQ ID NO: 408521 - RNA, 20 nt, Human
gcccaggccaggcaaggcuc

SEQ ID NO: 408522 - RNA, 22 nt, Human
gcccucaggacaguccucuucc

SEQ ID NO: 408523 - RNA, 23 nt, Human
gcccugucuugagcucuccuccc

SEQ ID NO: 408524 - RNA, 24 nt, Human
gcccugucuugagcucuccucccg

SEQ ID NO: 408525 - RNA, 19 nt, Human
gccugaguccuggccaggc

SEQ ID NO: 408526 - RNA, 22 nt, Human
gccugcauccuggccugguggg

SEQ ID NO: 408527 - RNA, 18 nt, Human
gccugugcccugucuuga

SEQ ID NO: 408528 - RNA, 18 nt, Human
gcucccagggaguaggga

SEQ ID NO: 408529 - RNA, 21 nt, Human
gcugcaaccaggccugcugcc

SEQ ID NO: 408530 - RNA, 21 nt, Human
gcugcgugagaugugucccuu

SEQ ID NO: 408531 - RNA, 18 nt, Human
ggaagggugggcaucacc

SEQ ID NO: 408532 - RNA, 23 nt, Human
ggaccuggccacaugcuuccuca

SEQ ID NO: 408533 - RNA, 20 nt, Human
ggcacuggguccaccaaacc

SEQ ID NO: 408534 - RNA, 18 nt, Human
ggccaggcagccccaggc

SEQ ID NO: 408535 - RNA, 23 nt, Human
gggaagucuccaccgccagcacc

SEQ ID NO: 408536 - RNA, 21 nt, Human
ggggaucgaggagaacuucag

SEQ ID NO: 408537 - RNA, 18 nt, Human
gggguagggcugaggggc

SEQ ID NO: 408538 - RNA, 23 nt, Human
gguagggcugaggggcugcagga

SEQ ID NO: 408539 - RNA, 19 nt, Human
ggugacacagccaggaagg

SEQ ID NO: 408540 - RNA, 22 nt, Human
uacacugggguucuagagacac

SEQ ID NO: 408541 - RNA, 23 nt, Human
uauccugacagucaggaguucag

SEQ ID NO: 408542 - RNA, 23 nt, Human
ucagccugcacauguucccagcu

SEQ ID NO: 408543 - RNA, 23 nt, Human
uccauguugaggcaccucgaaac

SEQ ID NO: 408544 - RNA, 19 nt, Human
ucccgggucaccuugaccc

SEQ ID NO: 408545 - RNA, 19 nt, Human
ucccgggucaccuugaccc

SEQ ID NO: 408546 - RNA, 20 nt, Human
ucccuuggcuggggcccccg

SEQ ID NO: 408547 - RNA, 19 nt, Human
uccucaugugaagcccuca

SEQ ID NO: 408548 - RNA, 18 nt, Human
uccugcucaugccguccc

SEQ ID NO: 408549 - RNA, 22 nt, Human
uccuggccaggcucaggagaga

SEQ ID NO: 408550 - RNA, 21 nt, Human
ucuccggggaacuugccucag

SEQ ID NO: 408551 - RNA, 24 nt, Human
ucuccucccgggucaccuugaccc

SEQ ID NO: 408552 - RNA, 21 nt, Human
ucugcgucucuugacaggccu

SEQ ID NO: 408553 - RNA, 21 nt, Human
ugacaccaaaccagaaggccc

SEQ ID NO: 408554 - RNA, 18 nt, Human
ugcaaccaggccugcugc

SEQ ID NO: 408555 - RNA, 22 nt, Human
uggaaagcacagaagagccagc

SEQ ID NO: 408556 - RNA, 24 nt, Human
uggaaagcacagaagagccagcca

SEQ ID NO: 408557 - RNA, 18 nt, Human
uggaagacagaggccugu

SEQ ID NO: 408558 - RNA, 22 nt, Human
uggacucuggccaagggcccag

SEQ ID NO: 408559 - RNA, 18 nt, Human
uggacuggagccgcccag

SEQ ID NO: 408560 - RNA, 23 nt, Human
ugggcuuggggacgaugcuggag

SEQ ID NO: 408561 - RNA, 19 nt, Human
uggggagaguggcagggcc

SEQ ID NO: 408562 - RNA, 22 nt, Human
ugggguucuagagacacauggg

SEQ ID NO: 408563 - RNA, 20 nt, Human
ugucuugagcucuccucccg

SEQ ID NO: 408564 - RNA, 26 nt, Human
uucauaaugguaacaaccucagguga

SEQ ID NO: 408565 - RNA, 18 nt, Human
uucaucagccugcacaug

SEQ ID NO: 408566 - RNA, 25 nt, Human
uucucuucaucagccugcacauguu

SEQ ID NO: 408567 - RNA, 22 nt, Human
uuuaggaaaaugaagacaggga

SEQ ID NO: 408568 - RNA, 20 nt, Human
aggagcaaaauccccugugg

SEQ ID NO: 408569 - RNA, 24 nt, Human
caaaauccccugugggggcuucuc

SEQ ID NO: 408570 - RNA, 18 nt, Human
cccagggccccggcgcuc

SEQ ID NO: 408571 - RNA, 22 nt, Human
ccccaaggacccugcagccucc

SEQ ID NO: 408572 - RNA, 24 nt, Human
ccccaaggacccugcagccuccag

SEQ ID NO: 408573 - RNA, 24 nt, Human
ccgcaaccuccugcagcccagggc

SEQ ID NO: 408574 - RNA, 25 nt, Human
ccgccgcaaccuccugcagcccagg

SEQ ID NO: 408575 - RNA, 22 nt, Human
ccucaaggacaaggccaccagg

SEQ ID NO: 408576 - RNA, 22 nt, Human
cgccgcaaccuccugcagccca

SEQ ID NO: 408577 - RNA, 23 nt, Human
cgcucccuccgccggcucugcuu

SEQ ID NO: 408578 - RNA, 18 nt, Human
cucaaggacaaggccacc

SEQ ID NO: 408579 - RNA, 19 nt, Human
cucccuccgccggcucugc

SEQ ID NO: 408580 - RNA, 22 nt, Human
gaggagccgggcaugcuguggg

SEQ ID NO: 408581 - RNA, 19 nt, Human
gcccagggccccggcgcuc

SEQ ID NO: 408582 - RNA, 23 nt, Human
gccuuacucuaggagcaaaaucc

SEQ ID NO: 408583 - RNA, 19 nt, Human
ggacugguucugggaggag

SEQ ID NO: 408584 - RNA, 23 nt, Human
ggccgccgcaaccuccugcagcc

SEQ ID NO: 408585 - RNA, 25 nt, Human
ggcgcucccuccgccggcucugcuu

SEQ ID NO: 408586 - RNA, 20 nt, Human
gguucugggaggagccgggc

SEQ ID NO: 408587 - RNA, 20 nt, Human
uaccccaaggacccugcagc

SEQ ID NO: 408588 - RNA, 21 nt, Human
uccccagugugaggaaucugu

SEQ ID NO: 408589 - RNA, 24 nt, Human
ugaggaaucugugaguggugaggg

SEQ ID NO: 408590 - RNA, 20 nt, Human
ugaggggucuguggucccug

SEQ ID NO: 408591 - RNA, 22 nt, Human
ugccgcggccgccgcaaccucc

SEQ ID NO: 408592 - RNA, 22 nt, Human
uggcuuuauuuccccaguguga

SEQ ID NO: 408593 - RNA, 20 nt, Human
uuaccccaaggacccugcag

SEQ ID NO: 408594 - RNA, 24 nt, Human
uuccccagugugaggaaucuguga

SEQ ID NO: 408595 - RNA, 19 nt, Human
uugauccucccaggcuggg

SEQ ID NO: 408596 - RNA, 22 nt, Human
aaaaaaaaaaaaaaaaggccag

SEQ ID NO: 408597 - RNA, 18 nt, Human
aaaagaagaauaacgagg

SEQ ID NO: 408598 - RNA, 20 nt, Human
aaaagagugaaacuccaucu

SEQ ID NO: 408599 - RNA, 19 nt, Human
aaagugcccuggacagagg

SEQ ID NO: 408600 - RNA, 22 nt, Human
aaaucacccaaauuucccgcuu

SEQ ID NO: 408601 - RNA, 19 nt, Human
aacauggugaaaccccauc

SEQ ID NO: 408602 - RNA, 20 nt, Human
aacauggugaaaccccaucu

SEQ ID NO: 408603 - RNA, 20 nt, Human
aacauggugaaaccccaucu

SEQ ID NO: 408604 - RNA, 21 nt, Human
aacauggugaaaccccaucuc

SEQ ID NO: 408605 - RNA, 21 nt, Human
aacccaucgagauuucaccag

SEQ ID NO: 408606 - RNA, 18 nt, Human
aaguuccaagugaccagc

SEQ ID NO: 408607 - RNA, 21 nt, Human
aauaacgaggaucaaauggga

SEQ ID NO: 408608 - RNA, 24 nt, Human
aaugucaggauuaaagauaaaaau

SEQ ID NO: 408609 - RNA, 22 nt, Human
acaagaacaauauucccagcug

SEQ ID NO: 408610 - RNA, 20 nt, Human
acaagaaucgcucaagcccg

SEQ ID NO: 408611 - RNA, 21 nt, Human
acaauaccuuucggcuucagu

SEQ ID NO: 408612 - RNA, 18 nt, Human
acacuacacaguguggcu

SEQ ID NO: 408613 - RNA, 22 nt, Human
acccaaauuucccgcuuuccac

SEQ ID NO: 408614 - RNA, 18 nt, Human
acccaaguaaaaggggaa

SEQ ID NO: 408615 - RNA, 24 nt, Human
accccaucucuacuaaaaauacaa

SEQ ID NO: 408616 - RNA, 18 nt, Human
accuuaggccucacaaac

SEQ ID NO: 408617 - RNA, 25 nt, Human
acuccagccuggguaaaaagaguga

SEQ ID NO: 408618 - RNA, 19 nt, Human
agaaaggagaugcaauagg

SEQ ID NO: 408619 - RNA, 20 nt, Human
agaaaggagaugcaauagga

SEQ ID NO: 408620 - RNA, 23 nt, Human
agacgcugauguaaucaacauca

SEQ ID NO: 408621 - RNA, 27 nt, Human
agagguugcagugagaucgcaucauug

SEQ ID NO: 408622 - RNA, 20 nt, Human
agcaaugagguacacaagaa

SEQ ID NO: 408623 - RNA, 18 nt, Human
agccaggcauaguggugc

SEQ ID NO: 408624 - RNA, 22 nt, Human
agccuggccaacauggugaaac

SEQ ID NO: 408625 - RNA, 24 nt, Human
agccuggccaacauggugaaaccc

SEQ ID NO: 408626 - RNA, 20 nt, Human
aggaguuugagaccagccug

SEQ ID NO: 408627 - RNA, 19 nt, Human
aggcagagguugcagugag

SEQ ID NO: 408628 - RNA, 22 nt, Human
aggcagguggaucaucugaggu

SEQ ID NO: 408629 - RNA, 26 nt, Human
aggcagguggaucaucugaggucagg

SEQ ID NO: 408630 - RNA, 23 nt, Human
aggcauaguggugcacaccugua

SEQ ID NO: 408631 - RNA, 22 nt, Human
aggccaggcgcaguggcucacg

SEQ ID NO: 408632 - RNA, 24 nt, Human
aggcgcaguggcucacgccuguaa

SEQ ID NO: 408633 - RNA, 19 nt, Human
agguagggcaaccaggccc

SEQ ID NO: 408634 - RNA, 19 nt, Human
aggucaggaguuugagacc

SEQ ID NO: 408635 - RNA, 22 nt, Human
agguggaucaucugaggucagg

SEQ ID NO: 408636 - RNA, 24 nt, Human
aguggcucacgccuguaaucccag

SEQ ID NO: 408637 - RNA, 24 nt, Human
aguggugcacaccuguagucccag

SEQ ID NO: 408638 - RNA, 19 nt, Human
auaaaaauauauauauaua

SEQ ID NO: 408639 - RNA, 22 nt, Human
auaaaaauauauauauauauau

SEQ ID NO: 408640 - RNA, 20 nt, Human
auauacauucuuuaugccag

SEQ ID NO: 408641 - RNA, 25 nt, Human
auaugauucacugacaauaucugaa

SEQ ID NO: 408642 - RNA, 19 nt, Human
aucauugcacuccagccug

SEQ ID NO: 408643 - RNA, 22 nt, Human
aucccagcacuuugggaagcca

SEQ ID NO: 408644 - RNA, 24 nt, Human
aucgcaucauugcacuccagccug

SEQ ID NO: 408645 - RNA, 24 nt, Human
aucugaggucaggaguuugagacc

SEQ ID NO: 408646 - RNA, 26 nt, Human
aucugugcaaacccacccuuguucca

SEQ ID NO: 408647 - RNA, 18 nt, Human
auguaucccccccaaccc

SEQ ID NO: 408648 - RNA, 21 nt, Human
auugcacuccagccuggguaa

SEQ ID NO: 408649 - RNA, 25 nt, Human
auugcacuccagccuggguaaaaag

SEQ ID NO: 408650 - RNA, 20 nt, Human
auuuguuuuagguuucccuu

SEQ ID NO: 408651 - RNA, 22 nt, Human
auuuuauauauauaauauauau

SEQ ID NO: 408652 - RNA, 23 nt, Human
caacaaaucacccaaauuucccg

SEQ ID NO: 408653 - RNA, 24 nt, Human
caacauggugaaaccccaucucua

SEQ ID NO: 408654 - RNA, 24 nt, Human
caacuccuaacuaauaguaccccu

SEQ ID NO: 408655 - RNA, 25 nt, Human
caacuccuaacuaauaguaccccuu

SEQ ID NO: 408656 - RNA, 21 nt, Human
caagcaaacucugccucuuuc

SEQ ID NO: 408657 - RNA, 24 nt, Human
caaggcagguggaucaucugaggu

SEQ ID NO: 408658 - RNA, 26 nt, Human
caaggcagguggaucaucugagguca

SEQ ID NO: 408659 - RNA, 18 nt, Human
caagucagcuaaugucag

SEQ ID NO: 408660 - RNA, 21 nt, Human
caaucugugcaaacccacccu

SEQ ID NO: 408661 - RNA, 20 nt, Human
caaucugugggugaggugac

SEQ ID NO: 408662 - RNA, 24 nt, Human
cacaccuguagucccagcuacccg

SEQ ID NO: 408663 - RNA, 21 nt, Human
cacaguguggcugccaggagu

SEQ ID NO: 408664 - RNA, 19 nt, Human
caccaccccaaaacccaag

SEQ ID NO: 408665 - RNA, 23 nt, Human
caccuguagucccagcuacccgg

SEQ ID NO: 408666 - RNA, 24 nt, Human
cacgccuguaaucccagcacuuug

SEQ ID NO: 408667 - RNA, 21 nt, Human
cacuacacaguguggcugcca

SEQ ID NO: 408668 - RNA, 23 nt, Human
cacuccagccuggguaaaaagag

SEQ ID NO: 408669 - RNA, 24 nt, Human
cacuccagccuggguaaaaagagu

SEQ ID NO: 408670 - RNA, 25 nt, Human
cacuccagccuggguaaaaagagug

SEQ ID NO: 408671 - RNA, 20 nt, Human
cacugucaucacagacaucc

SEQ ID NO: 408672 - RNA, 19 nt, Human
cagcacugaggugaguacc

SEQ ID NO: 408673 - RNA, 24 nt, Human
cagcacuuugggaagccaaggcag

SEQ ID NO: 408674 - RNA, 25 nt, Human
cagcacuuugggaagccaaggcagg

SEQ ID NO: 408675 - RNA, 19 nt, Human
caggaaugugcuccaaucu

SEQ ID NO: 408676 - RNA, 18 nt, Human
cagguggaucaucugagg

SEQ ID NO: 408677 - RNA, 24 nt, Human
cagguggaucaucugaggucagga

SEQ ID NO: 408678 - RNA, 23 nt, Human
caucugaggucaggaguuugaga

SEQ ID NO: 408679 - RNA, 18 nt, Human
cauugcacuccagccugg

SEQ ID NO: 408680 - RNA, 19 nt, Human
cauugcacuccagccuggg

SEQ ID NO: 408681 - RNA, 19 nt, Human
cauugcacuccagccuggg

SEQ ID NO: 408682 - RNA, 19 nt, Human
cauugcacuccagccuggg

SEQ ID NO: 408683 - RNA, 20 nt, Human
cauugcacuccagccugggu

SEQ ID NO: 408684 - RNA, 21 nt, Human
cauugcacuccagccugggua

SEQ ID NO: 408685 - RNA, 23 nt, Human
cauugcacuccagccuggguaaa

SEQ ID NO: 408686 - RNA, 18 nt, Human
ccaccaccccaaaaccca

SEQ ID NO: 408687 - RNA, 18 nt, Human
ccaccccaaaacccaagu

SEQ ID NO: 408688 - RNA, 21 nt, Human
ccacugucaucacagacaucc

SEQ ID NO: 408689 - RNA, 22 nt, Human
cccaaauuucccgcuuuccacc

SEQ ID NO: 408690 - RNA, 21 nt, Human
cccagccccacaucucuccuu

SEQ ID NO: 408691 - RNA, 18 nt, Human
cccccccaaccccauccu

SEQ ID NO: 408692 - RNA, 26 nt, Human
cccccccaaccccauccuuuaaugug

SEQ ID NO: 408693 - RNA, 18 nt, Human
cccucaaauacacuacac

SEQ ID NO: 408694 - RNA, 24 nt, Human
ccgcuuuccaccaccccaaaaccc

SEQ ID NO: 408695 - RNA, 23 nt, Human
ccuggccaacauggugaaacccc

SEQ ID NO: 408696 - RNA, 24 nt, Human
ccuggccaacauggugaaacccca

SEQ ID NO: 408697 - RNA, 22 nt, Human
ccuguaaucccagcacuuuggg

SEQ ID NO: 408698 - RNA, 21 nt, Human
ccuguagucccagcuacccgg

SEQ ID NO: 408699 - RNA, 24 nt, Human
ccuguagucccagcuacccggaag

SEQ ID NO: 408700 - RNA, 21 nt, Human
ccugucugagcuuuuaacugu

SEQ ID NO: 408701 - RNA, 23 nt, Human
cgccuguaaucccagcacuuugg

SEQ ID NO: 408702 - RNA, 26 nt, Human
cggaagacugagacacaagaaucgcu

SEQ ID NO: 408703 - RNA, 23 nt, Human
cucacaaaccaaugacauguucu

SEQ ID NO: 408704 - RNA, 22 nt, Human
cucacgccuguaaucccagcac

SEQ ID NO: 408705 - RNA, 24 nt, Human
cucacgccuguaaucccagcacuu

SEQ ID NO: 408706 - RNA, 20 nt, Human
cucccagccccacaucucuc

SEQ ID NO: 408707 - RNA, 22 nt, Human
cucccagccccacaucucuccu

SEQ ID NO: 408708 - RNA, 23 nt, Human
cuggccaacauggugaaacccca

SEQ ID NO: 408709 - RNA, 21 nt, Human
cuuuccaccaccccaaaaccc

SEQ ID NO: 408710 - RNA, 22 nt, Human
gaaaagacagaggaggaaauca

SEQ ID NO: 408711 - RNA, 23 nt, Human
gaaggagaugugaggcucagaag

SEQ ID NO: 408712 - RNA, 20 nt, Human
gacucccagccccacaucuc

SEQ ID NO: 408713 - RNA, 23 nt, Human
gagaucgcaucauugcacuccag

SEQ ID NO: 408714 - RNA, 18 nt, Human
gaggccuuugaacagaag

SEQ ID NO: 408715 - RNA, 24 nt, Human
gaucaucugaggucaggaguuuga

SEQ ID NO: 408716 - RNA, 20 nt, Human
gcagugagaucgcaucauug

SEQ ID NO: 408717 - RNA, 20 nt, Human
gcaucauugcacuccagccu

SEQ ID NO: 408718 - RNA, 24 nt, Human
gccaacauggugaaaccccaucuc

SEQ ID NO: 408719 - RNA, 18 nt, Human
gcccuggacagaggucag

SEQ ID NO: 408720 - RNA, 21 nt, Human
gccuuugaacagaaggagaug

SEQ ID NO: 408721 - RNA, 20 nt, Human
gcgcaguggcucacgccugu

SEQ ID NO: 408722 - RNA, 21 nt, Human
gcugccaggagugcuucaccu

SEQ ID NO: 408723 - RNA, 23 nt, Human
ggaaacccuuucuuaaugauuuc

SEQ ID NO: 408724 - RNA, 21 nt, Human
ggaagcaaacaccugugaaac

SEQ ID NO: 408725 - RNA, 23 nt, Human
ggaauuuuucaaacccaggaggu

SEQ ID NO: 408726 - RNA, 22 nt, Human
ggaucaucugaggucaggaguu

SEQ ID NO: 408727 - RNA, 24 nt, Human
ggcaagcaaacucugccucuuucc

SEQ ID NO: 408728 - RNA, 19 nt, Human
ggucaggaguuugagacca

SEQ ID NO: 408729 - RNA, 23 nt, Human
gugcagcacugaggugaguacca

SEQ ID NO: 408730 - RNA, 23 nt, Human
guguggaacuugaggauggagcu

SEQ ID NO: 408731 - RNA, 20 nt, Human
uaaaaauacaaaauuagcca

SEQ ID NO: 408732 - RNA, 22 nt, Human
uaaaaauacaaaauuagccagg

SEQ ID NO: 408733 - RNA, 23 nt, Human
uaaaaauacaaaauuagccaggc

SEQ ID NO: 408734 - RNA, 22 nt, Human
uaaauguaucccccccaacccc

SEQ ID NO: 408735 - RNA, 24 nt, Human
uaacugccuagaaaagaaggugac

SEQ ID NO: 408736 - RNA, 24 nt, Human
uaauauauauauuccauauauauu

SEQ ID NO: 408737 - RNA, 24 nt, Human
uaguggugcacaccuguaguccca

SEQ ID NO: 408738 - RNA, 23 nt, Human
uauaauauacauauuccauauau

SEQ ID NO: 408739 - RNA, 26 nt, Human
uaucacagaguuccuggcaggcaggg

SEQ ID NO: 408740 - RNA, 23 nt, Human
ucaacaaaucacccaaauuuccc

SEQ ID NO: 408741 - RNA, 21 nt, Human
ucacagaguuccuggcaggca

SEQ ID NO: 408742 - RNA, 19 nt, Human
ucauaugauucacugacaa

SEQ ID NO: 408743 - RNA, 19 nt, Human
ucaucugaggucaggaguu

SEQ ID NO: 408744 - RNA, 21 nt, Human
ucauugcacuccagccugggu

SEQ ID NO: 408745 - RNA, 22 nt, Human
uccaccaccccaaaacccaagu

SEQ ID NO: 408746 - RNA, 19 nt, Human
uccaccuccacacgcugcc

SEQ ID NO: 408747 - RNA, 18 nt, Human
uccauaguugagugcagc

SEQ ID NO: 408748 - RNA, 18 nt, Human
uccccuguaugccuaaga

SEQ ID NO: 408749 - RNA, 19 nt, Human
ucgcaucauugcacuccag

SEQ ID NO: 408750 - RNA, 23 nt, Human
ucgcaucauugcacuccagccug

SEQ ID NO: 408751 - RNA, 23 nt, Human
ucguuuaaaaaaaaaaaaaaaaa

SEQ ID NO: 408752 - RNA, 20 nt, Human
ucucuacuaaaaauacaaaa

SEQ ID NO: 408753 - RNA, 22 nt, Human
ucugaggucaggaguuugagac

SEQ ID NO: 408754 - RNA, 19 nt, Human
ugaaaccccaucucuacua

SEQ ID NO: 408755 - RNA, 24 nt, Human
ugaaauauccaggcaucauaugau

SEQ ID NO: 408756 - RNA, 19 nt, Human
ugaacuggaacagcuuaua

SEQ ID NO: 408757 - RNA, 24 nt, Human
ugacaaauaguaguagggggucca

SEQ ID NO: 408758 - RNA, 18 nt, Human
ugacugaucccucaaaua

SEQ ID NO: 408759 - RNA, 21 nt, Human
ugagaaaauaaaauaaaugua

SEQ ID NO: 408760 - RNA, 23 nt, Human
ugagacacaagaaucgcucaagc

SEQ ID NO: 408761 - RNA, 23 nt, Human
ugagaccagccuggccaacaugg

SEQ ID NO: 408762 - RNA, 24 nt, Human
ugagaccagccuggccaacauggu

SEQ ID NO: 408763 - RNA, 18 nt, Human
ugagaucgcaucauugca

SEQ ID NO: 408764 - RNA, 18 nt, Human
ugaggccuuugaacagaa

SEQ ID NO: 408765 - RNA, 18 nt, Human
ugaggucaggaguuugag

SEQ ID NO: 408766 - RNA, 22 nt, Human
ugcacuccagccuggguaaaaa

SEQ ID NO: 408767 - RNA, 24 nt, Human
ugcuccaaucugugcaaacccacu

SEQ ID NO: 408768 - RNA, 23 nt, Human
uggaaggaagcaaacaccuguga

SEQ ID NO: 408769 - RNA, 20 nt, Human
uggaggcagaaacucugggc

SEQ ID NO: 408770 - RNA, 23 nt, Human
uggaucaucugaggucaggaguu

SEQ ID NO: 408771 - RNA, 24 nt, Human
uggaucaucugaggucaggaguuu

SEQ ID NO: 408772 - RNA, 24 nt, Human
uggccaacauggugaaaccccauc

SEQ ID NO: 408773 - RNA, 21 nt, Human
uggccacugucaucacagaca

SEQ ID NO: 408774 - RNA, 22 nt, Human
uggcucacgccuguaaucccag

SEQ ID NO: 408775 - RNA, 24 nt, Human
uggcucacgccuguaaucccagca

SEQ ID NO: 408776 - RNA, 24 nt, Human
ugggaagccaaggcagguggauca

SEQ ID NO: 408777 - RNA, 24 nt, Human
ugggauggccacugucaucacaga

SEQ ID NO: 408778 - RNA, 23 nt, Human
ugguaguuugugcaggaaugugc

SEQ ID NO: 408779 - RNA, 18 nt, Human
uggugcacaccuguaguc

SEQ ID NO: 408780 - RNA, 18 nt, Human
uguaucccccccaacccc

SEQ ID NO: 408781 - RNA, 27 nt, Human
uguauuuuauauauauaauauauauau

SEQ ID NO: 408782 - RNA, 21 nt, Human
uguggaaaagacagaggagga

SEQ ID NO: 408783 - RNA, 23 nt, Human
uguggaggcagaaacucugggcu

SEQ ID NO: 408784 - RNA, 21 nt, Human
ugugugaaaagcuggugcuug

SEQ ID NO: 408785 - RNA, 24 nt, Human
uguucucguuuaaaaaaaaaaaaa

SEQ ID NO: 408786 - RNA, 27 nt, Human
uuaaagcaagcucacuagcaaguccug

SEQ ID NO: 408787 - RNA, 19 nt, Human
uucacugacaauaucugaa

SEQ ID NO: 408788 - RNA, 22 nt, Human
uucacugacaauaucugaaacc

SEQ ID NO: 408789 - RNA, 21 nt, Human
uuccaccaccccaaaacccaa

SEQ ID NO: 408790 - RNA, 19 nt, Human
uuccauaguugagugcagc

SEQ ID NO: 408791 - RNA, 25 nt, Human
uuccccuguaugccuaagaaugcaa

SEQ ID NO: 408792 - RNA, 24 nt, Human
uugcaggcccugcucccaaagccc

SEQ ID NO: 408793 - RNA, 25 nt, Human
uugcagugagaucgcaucauugcac

SEQ ID NO: 408794 - RNA, 18 nt, Human
uugcugccugugaacugg

SEQ ID NO: 408795 - RNA, 22 nt, Human
uugcugccugugaacuggaaca

SEQ ID NO: 408796 - RNA, 20 nt, Human
uuuccaccaccccaaaaccc

SEQ ID NO: 408797 - RNA, 21 nt, Human
uuuccaccaccccaaaacccc

SEQ ID NO: 408798 - RNA, 22 nt, Human
uuuuaugaacauauauauagac

SEQ ID NO: 408799 - RNA, 19 nt, Human
aaaaaaaaaacuggcucua

SEQ ID NO: 408800 - RNA, 26 nt, Human
aaaagaaaaaaaauuaaagcauaaaa

SEQ ID NO: 408801 - RNA, 23 nt, Human
aaaagaaaaagaaaaaaaaagaa

SEQ ID NO: 408802 - RNA, 22 nt, Human
aaacuggcucuaucuuuaaaua

SEQ ID NO: 408803 - RNA, 22 nt, Human
aaagaaaaaaaaagaaaaaaaa

SEQ ID NO: 408804 - RNA, 25 nt, Human
aaccagugauaucaucacugaacac

SEQ ID NO: 408805 - RNA, 18 nt, Human
aagaaaaaaaaagaaaaa

SEQ ID NO: 408806 - RNA, 19 nt, Human
aagaaaaagaaaaaaaaag

SEQ ID NO: 408807 - RNA, 19 nt, Human
aagcaucuaguugggaacc

SEQ ID NO: 408808 - RNA, 18 nt, Human
aaggaaacaaaagaaaaa

SEQ ID NO: 408809 - RNA, 22 nt, Human
acaaggaacgcccagggaaacc

SEQ ID NO: 408810 - RNA, 22 nt, Human
acauaaugauaauccaacugaa

SEQ ID NO: 408811 - RNA, 24 nt, Human
agaaaaagaaaaaaaaagaaaaaa

SEQ ID NO: 408812 - RNA, 18 nt, Human
aggaaacaaaagaaaaag

SEQ ID NO: 408813 - RNA, 20 nt, Human
aggcggcagcagaggccgcc

SEQ ID NO: 408814 - RNA, 22 nt, Human
aguaccaaggaaacaaaagaaa

SEQ ID NO: 408815 - RNA, 21 nt, Human
agugacuugauaaaacaaugu

SEQ ID NO: 408816 - RNA, 25 nt, Human
aucaauuaccuuuaaaauuucucag

SEQ ID NO: 408817 - RNA, 25 nt, Human
aucacauaaugauaauccaacugaa

SEQ ID NO: 408818 - RNA, 19 nt, Human
auggcaauaaaacagcugc

SEQ ID NO: 408819 - RNA, 24 nt, Human
caaaacaaagucaaaugagauccu

SEQ ID NO: 408820 - RNA, 25 nt, Human
cacaaacagcauucauguucaaaug

SEQ ID NO: 408821 - RNA, 21 nt, Human
cacuuuuucuuucuccccacc

SEQ ID NO: 408822 - RNA, 18 nt, Human
cagggacgcgcccgcgcc

SEQ ID NO: 408823 - RNA, 26 nt, Human
caggucaaaagaauauugaccuuuua

SEQ ID NO: 408824 - RNA, 20 nt, Human
caucuaguugggaaccagug

SEQ ID NO: 408825 - RNA, 26 nt, Human
ccaaggaaacaaaagaaaaagaaaaa

SEQ ID NO: 408826 - RNA, 20 nt, Human
ccaguaucacauaaugauaa

SEQ ID NO: 408827 - RNA, 20 nt, Human
cccguggccaacaagcaucu

SEQ ID NO: 408828 - RNA, 24 nt, Human
cggcagcagaggccgccggacaag

SEQ ID NO: 408829 - RNA, 24 nt, Human
cuagcagcagaagccgagucuuuc

SEQ ID NO: 408830 - RNA, 21 nt, Human
cuccgccggcgacggggcugg

SEQ ID NO: 408831 - RNA, 18 nt, Human
cuuuauacugcucccuuc

SEQ ID NO: 408832 - RNA, 20 nt, Human
gaaacaaaagaaaaagaaaa

SEQ ID NO: 408833 - RNA, 23 nt, Human
gaaccagugauaucaucacugaa

SEQ ID NO: 408834 - RNA, 28 nt, Human
gccaauaaaaucugcauggacaccuacc

SEQ ID NO: 408835 - RNA, 21 nt, Human
gcuuuauacugcucccuucca

SEQ ID NO: 408836 - RNA, 21 nt, Human
ggacgcgcccgcgcccgccuc

SEQ ID NO: 408837 - RNA, 23 nt, Human
ggacuccggaagggcagcaacuc

SEQ ID NO: 408838 - RNA, 20 nt, Human
ggcagcaacuccaccuccuc

SEQ ID NO: 408839 - RNA, 19 nt, Human
gggaaaaaaguacuuuaac

SEQ ID NO: 408840 - RNA, 18 nt, Human
gggaaaagugacacagua

SEQ ID NO: 408841 - RNA, 22 nt, Human
guugcacugcaaucugccagua

SEQ ID NO: 408842 - RNA, 23 nt, Human
uaaaaaacccaauuaacauuuuu

SEQ ID NO: 408843 - RNA, 21 nt, Human
uaaaacaauguuuaaaaaacc

SEQ ID NO: 408844 - RNA, 22 nt, Human
uaaaauuaguaccaaggaaaca

SEQ ID NO: 408845 - RNA, 20 nt, Human
uaaagcauaaaacuuagaug

SEQ ID NO: 408846 - RNA, 26 nt, Human
uaaauauggagccuaacccugauuca

SEQ ID NO: 408847 - RNA, 23 nt, Human
uaaauuacauuuuauuggcauaa

SEQ ID NO: 408848 - RNA, 24 nt, Human
uaacucagcuccggcgcuagcagg

SEQ ID NO: 408849 - RNA, 24 nt, Human
uaccaaggaaacaaaagaaaaaga

SEQ ID NO: 408850 - RNA, 18 nt, Human
uaccacauaagagagagc

SEQ ID NO: 408851 - RNA, 24 nt, Human
uaccgucccucuugaaaauggucu

SEQ ID NO: 408852 - RNA, 18 nt, Human
uaccucugugaaccuaga

SEQ ID NO: 408853 - RNA, 26 nt, Human
uauuuaaaaaaaaaaacuggcucuau

SEQ ID NO: 408854 - RNA, 22 nt, Human
ucagcugccagcucuauccuau

SEQ ID NO: 408855 - RNA, 21 nt, Human
ugauucauaaauaccgucccu

SEQ ID NO: 408856 - RNA, 24 nt, Human
ugccaguaucacauaaugauaauc

SEQ ID NO: 408857 - RNA, 20 nt, Human
ugcuauagauacagauaggg

SEQ ID NO: 408858 - RNA, 21 nt, Human
uggagaaguuuguaaguucug

SEQ ID NO: 408859 - RNA, 19 nt, Human
uuagaugaaaagcuuuucu

SEQ ID NO: 408860 - RNA, 22 nt, Human
uuaguaccaaggaaacaaaaga

SEQ ID NO: 408861 - RNA, 24 nt, Human
uuaguaccaaggaaacaaaagaaa

SEQ ID NO: 408862 - RNA, 19 nt, Human
uugacgagugaguuagguu

SEQ ID NO: 408863 - RNA, 20 nt, Human
uuuaaaaaacccaauuaaca

SEQ ID NO: 408864 - RNA, 21 nt, Human
uuuaaguaauacacuuuuucu

SEQ ID NO: 408865 - RNA, 27 nt, Human
uuucuauauuaccaaacaauuuccucc

SEQ ID NO: 408866 - RNA, 22 nt, Human
uuuguaaguucuggguuguugc

SEQ ID NO: 408867 - RNA, 23 nt, Human
aaaaaaauagacuugaaaaacca

SEQ ID NO: 408868 - RNA, 20 nt, Human
aaaggaaauauucuuccuuu

SEQ ID NO: 408869 - RNA, 22 nt, Human
aaccuuggaaaauuuucccaaa

SEQ ID NO: 408870 - RNA, 18 nt, Human
acacaaggacauagcacc

SEQ ID NO: 408871 - RNA, 18 nt, Human
accauguacccagggguc

SEQ ID NO: 408872 - RNA, 25 nt, Human
acucugucaccccggcuggagugca

SEQ ID NO: 408873 - RNA, 22 nt, Human
aggaaaaaggaggcgguaagaa

SEQ ID NO: 408874 - RNA, 19 nt, Human
aggguuaaauauaauauuu

SEQ ID NO: 408875 - RNA, 27 nt, Human
aguaaaaaggcaucuuuucuccccugg

SEQ ID NO: 408876 - RNA, 21 nt, Human
aguaagauaaucucuccaauu

SEQ ID NO: 408877 - RNA, 22 nt, Human
aguagagaugugguuuugccau

SEQ ID NO: 408878 - RNA, 18 nt, Human
aguagcugggauuacagg

SEQ ID NO: 408879 - RNA, 18 nt, Human
agucggagucucacucug

SEQ ID NO: 408880 - RNA, 23 nt, Human
agugcaguggugcaaucuugguu

SEQ ID NO: 408881 - RNA, 24 nt, Human
agugcaguggugcaaucuugguuc

SEQ ID NO: 408882 - RNA, 22 nt, Human
auacauagaaaaaaaauagacu

SEQ ID NO: 408883 - RNA, 23 nt, Human
auauguaguaugauaacauucug

SEQ ID NO: 408884 - RNA, 21 nt, Human
augaucaacuggagauagccu

SEQ ID NO: 408885 - RNA, 24 nt, Human
augugguuuugccauguuggccag

SEQ ID NO: 408886 - RNA, 21 nt, Human
auucuggagaaacacauaaag

SEQ ID NO: 408887 - RNA, 21 nt, Human
caaaauaacaauacaggagua

SEQ ID NO: 408888 - RNA, 22 nt, Human
caaaauaacaauacaggaguaa

SEQ ID NO: 408889 - RNA, 20 nt, Human
caaagucaguagugccuuuc

SEQ ID NO: 408890 - RNA, 19 nt, Human
caagagagcaagagacugc

SEQ ID NO: 408891 - RNA, 24 nt, Human
cacacuagggugauuuaaaaucau

SEQ ID NO: 408892 - RNA, 19 nt, Human
cacauaauacaaaaaaggg

SEQ ID NO: 408893 - RNA, 18 nt, Human
caccauguacccaggggu

SEQ ID NO: 408894 - RNA, 19 nt, Human
caccauguacccagggguc

SEQ ID NO: 408895 - RNA, 21 nt, Human
caccccggcuggagugcagug

SEQ ID NO: 408896 - RNA, 24 nt, Human
cacucugucaccccggcuggagug

SEQ ID NO: 408897 - RNA, 21 nt, Human
cacugcaaccuccgccuccca

SEQ ID NO: 408898 - RNA, 21 nt, Human
cagcaauucuuguaccucagc

SEQ ID NO: 408899 - RNA, 23 nt, Human
cagguuccagcaauucuuguacc

SEQ ID NO: 408900 - RNA, 22 nt, Human
caucccaaugaucaacuggaga

SEQ ID NO: 408901 - RNA, 24 nt, Human
cauguuggccaggcuggucucgaa

SEQ ID NO: 408902 - RNA, 19 nt, Human
ccacugaguuuauagugua

SEQ ID NO: 408903 - RNA, 23 nt, Human
ccagcaauucuuguaccucagcc

SEQ ID NO: 408904 - RNA, 19 nt, Human
ccauguuggccaggcuggu

SEQ ID NO: 408905 - RNA, 19 nt, Human
ccauucccuucaccaucca

SEQ ID NO: 408906 - RNA, 20 nt, Human
cccaaauacagcaauaggau

SEQ ID NO: 408907 - RNA, 19 nt, Human
cccaaugaucaacuggaga

SEQ ID NO: 408908 - RNA, 23 nt, Human
cccaccauccauaauauuuaaau

SEQ ID NO: 408909 - RNA, 19 nt, Human
cccagacaaaaggaaaaua

SEQ ID NO: 408910 - RNA, 21 nt, Human
cccggcuggagugcaguggug

SEQ ID NO: 408911 - RNA, 22 nt, Human
ccucccagguuccagcaauucu

SEQ ID NO: 408912 - RNA, 19 nt, Human
ccugaccucaagugaucug

SEQ ID NO: 408913 - RNA, 24 nt, Human
ccugaccucaagugaucugcccac

SEQ ID NO: 408914 - RNA, 21 nt, Human
cuacugcccagacaaaaggaa

SEQ ID NO: 408915 - RNA, 22 nt, Human
cucaagugaucugcccaccauc

SEQ ID NO: 408916 - RNA, 24 nt, Human
cucacucugucaccccggcuggag

SEQ ID NO: 408917 - RNA, 24 nt, Human
cucagccuucugaguagcugggau

SEQ ID NO: 408918 - RNA, 23 nt, Human
cugcaaccuccgccucccagguu

SEQ ID NO: 408919 - RNA, 24 nt, Human
cugcaaccuccgccucccagguuc

SEQ ID NO: 408920 - RNA, 25 nt, Human
cuuguaccucagccuucugaguagc

SEQ ID NO: 408921 - RNA, 19 nt, Human
gaaaaagcuuacauaaaaa

SEQ ID NO: 408922 - RNA, 21 nt, Human
gaacaaaauaacaauacagga

SEQ ID NO: 408923 - RNA, 23 nt, Human
gacaaaaggaaaauaaacuuuuu

SEQ ID NO: 408924 - RNA, 22 nt, Human
gaccucaagugaucugcccacc

SEQ ID NO: 408925 - RNA, 24 nt, Human
gaguagcugggauuacaggagugc

SEQ ID NO: 408926 - RNA, 19 nt, Human
gaguccaagagagcaagag

SEQ ID NO: 408927 - RNA, 18 nt, Human
gauuacaggagugcacca

SEQ ID NO: 408928 - RNA, 22 nt, Human
gcaaccuccgccucccagguuc

SEQ ID NO: 408929 - RNA, 20 nt, Human
gccauguuggccaggcuggu

SEQ ID NO: 408930 - RNA, 24 nt, Human
gccauguuggccaggcuggucucg

SEQ ID NO: 408931 - RNA, 23 nt, Human
gcugcagcauguuuuagaaucug

SEQ ID NO: 408932 - RNA, 23 nt, Human
gcuggucucgaacuccugaccuc

SEQ ID NO: 408933 - RNA, 18 nt, Human
ggaaaaguagagaaucaa

SEQ ID NO: 408934 - RNA, 18 nt, Human
ggaguaaagcaugaccag

SEQ ID NO: 408935 - RNA, 21 nt, Human
ggagugcaccaccacacccag

SEQ ID NO: 408936 - RNA, 22 nt, Human
ggcauugagacacagagagaaa

SEQ ID NO: 408937 - RNA, 24 nt, Human
ggcuggucucgaacuccugaccuc

SEQ ID NO: 408938 - RNA, 19 nt, Human
ggucucgaacuccugaccu

SEQ ID NO: 408939 - RNA, 21 nt, Human
gguuuugccauguuggccagg

SEQ ID NO: 408940 - RNA, 23 nt, Human
guagagaugugguuuugccaugu

SEQ ID NO: 408941 - RNA, 20 nt, Human
guagcugggauuacaggagu

SEQ ID NO: 408942 - RNA, 19 nt, Human
guuuugccauguuggccag

SEQ ID NO: 408943 - RNA, 25 nt, Human
uaaaaaggcaucuuuuauuuguguu

SEQ ID NO: 408944 - RNA, 21 nt, Human
uaaaaucauccaccauguacc

SEQ ID NO: 408945 - RNA, 18 nt, Human
uaaccugcaaaaacaucc

SEQ ID NO: 408946 - RNA, 23 nt, Human
uaaccugcaaaaacauccaccag

SEQ ID NO: 408947 - RNA, 22 nt, Human
uaagaacaaagucaguagugcc

SEQ ID NO: 408948 - RNA, 18 nt, Human
uaaucgcuagagguugcc

SEQ ID NO: 408949 - RNA, 23 nt, Human
uaauuuuuuuauuuuuaguagag

SEQ ID NO: 408950 - RNA, 24 nt, Human
uaauuuuuuuauuuuuaguagaga

SEQ ID NO: 408951 - RNA, 24 nt, Human
uacaggagugcaccaccacaccca

SEQ ID NO: 408952 - RNA, 22 nt, Human
uaccucagccuucugaguagcu

SEQ ID NO: 408953 - RNA, 24 nt, Human
uaccucagccuucugaguagcugg

SEQ ID NO: 408954 - RNA, 22 nt, Human
uagagaugugguuuugccaugu

SEQ ID NO: 408955 - RNA, 24 nt, Human
uaguagagaugugguuuugccaug

SEQ ID NO: 408956 - RNA, 19 nt, Human
ucacugcaaccuccgccuc

SEQ ID NO: 408957 - RNA, 24 nt, Human
ucacugcaaccuccgccucccagg

SEQ ID NO: 408958 - RNA, 25 nt, Human
ucacugcaaccuccgccucccaggu

SEQ ID NO: 408959 - RNA, 26 nt, Human
ucacugcaaccuccgccucccagguu

SEQ ID NO: 408960 - RNA, 20 nt, Human
ucagccuucugaguagcugg

SEQ ID NO: 408961 - RNA, 18 nt, Human
ucaguugugcaaaaguac

SEQ ID NO: 408962 - RNA, 18 nt, Human
ucccaaugaucaacugga

SEQ ID NO: 408963 - RNA, 20 nt, Human
ucccagguuccagcaauucu

SEQ ID NO: 408964 - RNA, 22 nt, Human
ucccagguuccagcaauucuug

SEQ ID NO: 408965 - RNA, 18 nt, Human
ucucacucugucaccccg

SEQ ID NO: 408966 - RNA, 24 nt, Human
ucucacucugucaccccggcugga

SEQ ID NO: 408967 - RNA, 21 nt, Human
ucucgaacuccugaccucaag

SEQ ID NO: 408968 - RNA, 20 nt, Human
ucucuccaauucuauaccau

SEQ ID NO: 408969 - RNA, 23 nt, Human
ucugaguagcugggauuacagga

SEQ ID NO: 408970 - RNA, 23 nt, Human
ucuugcugcagcauguuuuagaa

SEQ ID NO: 408971 - RNA, 18 nt, Human
ugaaaaaccauccagaaa

SEQ ID NO: 408972 - RNA, 23 nt, Human
ugaaaaucucucauuuaguaguc

SEQ ID NO: 408973 - RNA, 21 nt, Human
ugaaaccaaucacacacuuua

SEQ ID NO: 408974 - RNA, 27 nt, Human
ugaaagagaauugagacauacauagaa

SEQ ID NO: 408975 - RNA, 23 nt, Human
ugaacacacucauuaaaccaagc

SEQ ID NO: 408976 - RNA, 18 nt, Human
ugaccucaagugaucugc

SEQ ID NO: 408977 - RNA, 22 nt, Human
ugaguaguuauuuucacuacug

SEQ ID NO: 408978 - RNA, 24 nt, Human
ugccauguuggccaggcuggucuc

SEQ ID NO: 408979 - RNA, 26 nt, Human
ugccauguuggccaggcuggucucga

SEQ ID NO: 408980 - RNA, 23 nt, Human
ugcugcagcauguuuuagaaucu

SEQ ID NO: 408981 - RNA, 23 nt, Human
uggagugcaguggugcaaucuug

SEQ ID NO: 408982 - RNA, 24 nt, Human
uggagugcaguggugcaaucuugg

SEQ ID NO: 408983 - RNA, 24 nt, Human
uggccaggcuggucucgaacuccu

SEQ ID NO: 408984 - RNA, 22 nt, Human
ugggauuacaggagugcaccac

SEQ ID NO: 408985 - RNA, 24 nt, Human
ugggauuacaggagugcaccacca

SEQ ID NO: 408986 - RNA, 25 nt, Human
uggguugaaaacauuuaacaguucc

SEQ ID NO: 408987 - RNA, 21 nt, Human
ugucaccccggcuggagugca

SEQ ID NO: 408988 - RNA, 18 nt, Human
ugugguuuugccauguug

SEQ ID NO: 408989 - RNA, 18 nt, Human
uuaguagagaugugguuu

SEQ ID NO: 408990 - RNA, 18 nt, Human
uuaguagagaugugguuu

SEQ ID NO: 408991 - RNA, 24 nt, Human
uuaguagagaugugguuuugccau

SEQ ID NO: 408992 - RNA, 26 nt, Human
uuaguagcuuccuucuaaaauuuccu

SEQ ID NO: 408993 - RNA, 23 nt, Human
uuagucacauaauacaaaaaagg

SEQ ID NO: 408994 - RNA, 18 nt, Human
uuauuuauuuauuuauuu

SEQ ID NO: 408995 - RNA, 18 nt, Human
uuauuuauuuauuuauuu

SEQ ID NO: 408996 - RNA, 18 nt, Human
uuauuuauuuauuuauuu

SEQ ID NO: 408997 - RNA, 19 nt, Human
uuauuuauuuauuuauuua

SEQ ID NO: 408998 - RNA, 25 nt, Human
uuauuuauuuauuuauuuauuuauu

SEQ ID NO: 408999 - RNA, 25 nt, Human
uuauuuauuuauuuauuuauuuauu

SEQ ID NO: 409000 - RNA, 25 nt, Human
uuauuuauuuauuuauuuauuuauu

SEQ ID NO: 409001 - RNA, 25 nt, Human
uuauuuauuuauuuauuuauuuauu

SEQ ID NO: 409002 - RNA, 20 nt, Human
uuauuuauuuauuuauuuuc

SEQ ID NO: 409003 - RNA, 20 nt, Human
uuauuuauuuauuuauuuuc

SEQ ID NO: 409004 - RNA, 21 nt, Human
uucaguaagauaaucucucca

SEQ ID NO: 409005 - RNA, 23 nt, Human
uucagucggagucucacucuguc

SEQ ID NO: 409006 - RNA, 24 nt, Human
uucaugcacaaagaugcucauccc

SEQ ID NO: 409007 - RNA, 20 nt, Human
uuccagagaaagcugggacu

SEQ ID NO: 409008 - RNA, 19 nt, Human
uuccagcaauucuuguacc

SEQ ID NO: 409009 - RNA, 26 nt, Human
uucuccuauauauguguucaucaaga

SEQ ID NO: 409010 - RNA, 24 nt, Human
uugccauguuggccaggcuggucu

SEQ ID NO: 409011 - RNA, 20 nt, Human
uugucaccuccucugacagg

SEQ ID NO: 409012 - RNA, 22 nt, Human
uuuauuuauuuauuuauuuauu

SEQ ID NO: 409013 - RNA, 23 nt, Human
uuuugccauguuggccaggcugg

SEQ ID NO: 409014 - RNA, 24 nt, Human
uuuuuaguagagaugugguuuugc

SEQ ID NO: 409015 - RNA, 20 nt, Human
uuuuuuauuuuuaguagaga

SEQ ID NO: 409016 - RNA, 27 nt, Human
uuuuuuuuuuuuuuuuuuuuuuugggg

SEQ ID NO: 409017 - RNA, 21 nt, Human
aaaaaaaaaaaaaaacagggg

SEQ ID NO: 409018 - RNA, 23 nt, Human
aaaaaaaaaaaaaagaaauagga

SEQ ID NO: 409019 - RNA, 23 nt, Human
aaaaaaaaaaaaguacuuggaau

SEQ ID NO: 409020 - RNA, 23 nt, Human
aaaaaaaaaaagaaauaggaagg

SEQ ID NO: 409021 - RNA, 28 nt, Human
aaaaaaaaaagaaauaggaaggcgagag

SEQ ID NO: 409022 - RNA, 26 nt, Human
aaaaaaaacaggggaaaaccagaauu

SEQ ID NO: 409023 - RNA, 20 nt, Human
aaaaaaacaggggaaaacca

SEQ ID NO: 409024 - RNA, 23 nt, Human
aaaaaaacaggggaaaaccagag

SEQ ID NO: 409025 - RNA, 25 nt, Human
aaaaaccaaaaggaagugcucugca

SEQ ID NO: 409026 - RNA, 22 nt, Human
aaaaagaaacaaaacccaaaca

SEQ ID NO: 409027 - RNA, 22 nt, Human
aaaaagaaacaaaacccaaaca

SEQ ID NO: 409028 - RNA, 25 nt, Human
aaaaagaaacaaaacccaaacaaaa

SEQ ID NO: 409029 - RNA, 20 nt, Human
aaaaauguauuuccucaggc

SEQ ID NO: 409030 - RNA, 19 nt, Human
aaaacaaugauacaaagca

SEQ ID NO: 409031 - RNA, 21 nt, Human
aaaagaaagaauaacaaaaga

SEQ ID NO: 409032 - RNA, 19 nt, Human
aaaaggaagugcucugcaa

SEQ ID NO: 409033 - RNA, 20 nt, Human
aaaaggucuuuccugccucc

SEQ ID NO: 409034 - RNA, 24 nt, Human
aaacaaaacaaugauacaaagcaa

SEQ ID NO: 409035 - RNA, 24 nt, Human
aaacaaaacaaugauacaaagcaa

SEQ ID NO: 409036 - RNA, 20 nt, Human
aaacaaaacccaaacaaaac

SEQ ID NO: 409037 - RNA, 24 nt, Human
aaacagaacaguuuagaacagaac

SEQ ID NO: 409038 - RNA, 20 nt, Human
aaacauggccaaugagagaa

SEQ ID NO: 409039 - RNA, 18 nt, Human
aaagcuccucauuccacu

SEQ ID NO: 409040 - RNA, 21 nt, Human
aaauagagcaaggaugugccc

SEQ ID NO: 409041 - RNA, 21 nt, Human
aacaugugagcccacugucua

SEQ ID NO: 409042 - RNA, 24 nt, Human
aacccaaacaaaacaaugauacaa

SEQ ID NO: 409043 - RNA, 21 nt, Human
aacugcagcacuaucaggaac

SEQ ID NO: 409044 - RNA, 25 nt, Human
aagaacacccucggcagcccgaaag

SEQ ID NO: 409045 - RNA, 22 nt, Human
aagaagggaauuucauguugga

SEQ ID NO: 409046 - RNA, 25 nt, Human
aagauacuuuuuucccuucucauua

SEQ ID NO: 409047 - RNA, 27 nt, Human
aagaugguggcgcggcggccgagucuc

SEQ ID NO: 409048 - RNA, 21 nt, Human
aagcaacugcagcacuaucag

SEQ ID NO: 409049 - RNA, 18 nt, Human
aagcaacugcgaauuaau

SEQ ID NO: 409050 - RNA, 25 nt, Human
aagcauaacaaugugaguuaagagc

SEQ ID NO: 409051 - RNA, 19 nt, Human
aagccuaaccacagcucgc

SEQ ID NO: 409052 - RNA, 20 nt, Human
aauagccauacugagacucu

SEQ ID NO: 409053 - RNA, 19 nt, Human
aauauuuuuggagcuguau

SEQ ID NO: 409054 - RNA, 20 nt, Human
aauuaauguaaaaauggagu

SEQ ID NO: 409055 - RNA, 18 nt, Human
aauucuauuagucaacua

SEQ ID NO: 409056 - RNA, 18 nt, Human
acaaaacccaaacaaaac

SEQ ID NO: 409057 - RNA, 21 nt, Human
acacaagaaagaaauaccugg

SEQ ID NO: 409058 - RNA, 19 nt, Human
acagaacuauuauagccaa

SEQ ID NO: 409059 - RNA, 20 nt, Human
acagcacagaagcagaccac

SEQ ID NO: 409060 - RNA, 20 nt, Human
acaguagcuaaaguugaccu

SEQ ID NO: 409061 - RNA, 24 nt, Human
acauacauccuuguagcaagcauu

SEQ ID NO: 409062 - RNA, 22 nt, Human
accacaggcuucaacaaagagc

SEQ ID NO: 409063 - RNA, 21 nt, Human
accagcuucuuuacuccacau

SEQ ID NO: 409064 - RNA, 28 nt, Human
acccaaacaaaacaaugauacaaagcaa

SEQ ID NO: 409065 - RNA, 19 nt, Human
accgucuucuguuguuugc

SEQ ID NO: 409066 - RNA, 23 nt, Human
accuaacaguaccuaccuuugau

SEQ ID NO: 409067 - RNA, 18 nt, Human
accucagucuccgcgcau

SEQ ID NO: 409068 - RNA, 19 nt, Human
acgcucagaagacacagaa

SEQ ID NO: 409069 - RNA, 21 nt, Human
acuaaauugagagggcgccau

SEQ ID NO: 409070 - RNA, 21 nt, Human
acugcaauuaacugggaugcu

SEQ ID NO: 409071 - RNA, 21 nt, Human
agaaaauaauuauucaauaug

SEQ ID NO: 409072 - RNA, 21 nt, Human
agaaagagaaaggaaauagag

SEQ ID NO: 409073 - RNA, 19 nt, Human
agaaaggaaauagagcaag

SEQ ID NO: 409074 - RNA, 21 nt, Human
agaaaggaaauagagcaagga

SEQ ID NO: 409075 - RNA, 23 nt, Human
agaacacccucggcagcccgaaa

SEQ ID NO: 409076 - RNA, 20 nt, Human
agaacaucacuaucuuaaaa

SEQ ID NO: 409077 - RNA, 18 nt, Human
agacaccaacacuauuaa

SEQ ID NO: 409078 - RNA, 26 nt, Human
agagaaaauuccuaaaucaucaugaa

SEQ ID NO: 409079 - RNA, 18 nt, Human
agagaaaggaaauagagc

SEQ ID NO: 409080 - RNA, 21 nt, Human
agagaacacaugaauguacau

SEQ ID NO: 409081 - RNA, 19 nt, Human
agagagaaagagaaaggaa

SEQ ID NO: 409082 - RNA, 19 nt, Human
agagagagagaaagagaaa

SEQ ID NO: 409083 - RNA, 19 nt, Human
agagagagagagaaagaga

SEQ ID NO: 409084 - RNA, 18 nt, Human
agagagggugugcaugug

SEQ ID NO: 409085 - RNA, 21 nt, Human
agagugagaaaaggaagaaug

SEQ ID NO: 409086 - RNA, 22 nt, Human
agcaagcuuucaccuuacugau

SEQ ID NO: 409087 - RNA, 20 nt, Human
agcagcaccaaaaaagagga

SEQ ID NO: 409088 - RNA, 21 nt, Human
agcagcaccaaaaaagaggac

SEQ ID NO: 409089 - RNA, 20 nt, Human
aggacgcuagagauugcagu

SEQ ID NO: 409090 - RNA, 22 nt, Human
aggcaaaaggcuggcauacagc

SEQ ID NO: 409091 - RNA, 18 nt, Human
aggcaccauuauuugaaa

SEQ ID NO: 409092 - RNA, 21 nt, Human
aggcagagccagaacugacuc

SEQ ID NO: 409093 - RNA, 19 nt, Human
aggggguguuguuuuuugu

SEQ ID NO: 409094 - RNA, 18 nt, Human
agugagaaaaggaagaau

SEQ ID NO: 409095 - RNA, 23 nt, Human
auaacaaugcccuccaaaguccc

SEQ ID NO: 409096 - RNA, 23 nt, Human
auaauaaugaaagcaaaaaauga

SEQ ID NO: 409097 - RNA, 20 nt, Human
auacagcagguuaccuugug

SEQ ID NO: 409098 - RNA, 24 nt, Human
auauauuaauucuagucuggugau

SEQ ID NO: 409099 - RNA, 21 nt, Human
aucuugguaaccuacucauca

SEQ ID NO: 409100 - RNA, 25 nt, Human
augcacacacacacacacaaaagga

SEQ ID NO: 409101 - RNA, 24 nt, Human
auggaauaaaggcuuuaauauguc

SEQ ID NO: 409102 - RNA, 18 nt, Human
auggccaaugagagaaga

SEQ ID NO: 409103 - RNA, 24 nt, Human
auuauaaacauaaugugcuaccac

SEQ ID NO: 409104 - RNA, 22 nt, Human
auuuugagauguuccccccuca

SEQ ID NO: 409105 - RNA, 19 nt, Human
caaaaaagaggacgcuaga

SEQ ID NO: 409106 - RNA, 19 nt, Human
caaacaaaaggacuacuga

SEQ ID NO: 409107 - RNA, 24 nt, Human
caaagccuuaaguauuaaaaguuc

SEQ ID NO: 409108 - RNA, 21 nt, Human
caacacaacaucagaaagaca

SEQ ID NO: 409109 - RNA, 21 nt, Human
caagaacacccucggcagccc

SEQ ID NO: 409110 - RNA, 24 nt, Human
caagcuauugaauucccaucaaga

SEQ ID NO: 409111 - RNA, 19 nt, Human
caaggaugugcccggugcc

SEQ ID NO: 409112 - RNA, 18 nt, Human
cacaacguucugagaugg

SEQ ID NO: 409113 - RNA, 18 nt, Human
cacaggucucaagaccgg

SEQ ID NO: 409114 - RNA, 21 nt, Human
cacccuuauuaaaaaagagag

SEQ ID NO: 409115 - RNA, 26 nt, Human
cacuaaaacagaacaguuuagaacag

SEQ ID NO: 409116 - RNA, 27 nt, Human
cacugugaaaaagaaacaaaacccaaa

SEQ ID NO: 409117 - RNA, 23 nt, Human
cagaaugaauacagaggugagug

SEQ ID NO: 409118 - RNA, 25 nt, Human
cagcacagaagcagaccaccagcuu

SEQ ID NO: 409119 - RNA, 19 nt, Human
cagcaguucacaggucuca

SEQ ID NO: 409120 - RNA, 21 nt, Human
cagcgugccaccaucugucau

SEQ ID NO: 409121 - RNA, 23 nt, Human
caggaacaugugagcccacuguc

SEQ ID NO: 409122 - RNA, 21 nt, Human
caggugaggaaccugaggcac

SEQ ID NO: 409123 - RNA, 19 nt, Human
caguccacauagauaaugu

SEQ ID NO: 409124 - RNA, 22 nt, Human
cauacaugccaaaaauaaagaa

SEQ ID NO: 409125 - RNA, 19 nt, Human
cauauugcccaaguuaacc

SEQ ID NO: 409126 - RNA, 22 nt, Human
ccaaaaaagaggacgcuagaga

SEQ ID NO: 409127 - RNA, 24 nt, Human
ccaaacaaaacaaugauacaaagc

SEQ ID NO: 409128 - RNA, 23 nt, Human
ccaaagccaugaaccgucuucug

SEQ ID NO: 409129 - RNA, 21 nt, Human
ccaagaugguuuugacuuaac

SEQ ID NO: 409130 - RNA, 18 nt, Human
ccagcaacacuuaucaaa

SEQ ID NO: 409131 - RNA, 19 nt, Human
ccauacugagacucuucag

SEQ ID NO: 409132 - RNA, 19 nt, Human
ccauggcucucaaaccaaa

SEQ ID NO: 409133 - RNA, 22 nt, Human
ccccacccuuauuaaaaaagag

SEQ ID NO: 409134 - RNA, 22 nt, Human
ccccccccuuucccucccccac

SEQ ID NO: 409135 - RNA, 20 nt, Human
cccguuaacaaugaaacuga

SEQ ID NO: 409136 - RNA, 24 nt, Human
ccuccaaagucccgacgggcgucc

SEQ ID NO: 409137 - RNA, 20 nt, Human
ccucggcagcccgaaagaug

SEQ ID NO: 409138 - RNA, 21 nt, Human
ccucuagaaaugcauuaauuu

SEQ ID NO: 409139 - RNA, 21 nt, Human
ccugaagauuguuugcauaag

SEQ ID NO: 409140 - RNA, 24 nt, Human
ccugccuccccccccuuucccucc

SEQ ID NO: 409141 - RNA, 19 nt, Human
cgagagagcaaucgagagg

SEQ ID NO: 409142 - RNA, 21 nt, Human
cgagaggacgcgaggucugga

SEQ ID NO: 409143 - RNA, 19 nt, Human
cggcacugugaaaaagaaa

SEQ ID NO: 409144 - RNA, 22 nt, Human
cgugucaacgcuauccaaaaau

SEQ ID NO: 409145 - RNA, 21 nt, Human
cuaaacaaauuaaacccacgg

SEQ ID NO: 409146 - RNA, 21 nt, Human
cuaaaggacaaaaauaucaga

SEQ ID NO: 409147 - RNA, 22 nt, Human
cuacagaaugcaaaaaaaaauc

SEQ ID NO: 409148 - RNA, 22 nt, Human
cuaccuucacuaaaacagaaca

SEQ ID NO: 409149 - RNA, 20 nt, Human
cucaauuuucucuugugccu

SEQ ID NO: 409150 - RNA, 22 nt, Human
cucauauacuuggagucaugua

SEQ ID NO: 409151 - RNA, 23 nt, Human
cuccucauuccacuucuuuauuu

SEQ ID NO: 409152 - RNA, 24 nt, Human
cucucaaaccaaagacaguagcua

SEQ ID NO: 409153 - RNA, 24 nt, Human
cuggagaaaccagcagcaccaaaa

SEQ ID NO: 409154 - RNA, 22 nt, Human
cuggccuuugggaacugacagu

SEQ ID NO: 409155 - RNA, 22 nt, Human
cuggcuaaaaugaaaucacuac

SEQ ID NO: 409156 - RNA, 18 nt, Human
cugguccuggccuaaagu

SEQ ID NO: 409157 - RNA, 19 nt, Human
cuuaagcauaacaauguga

SEQ ID NO: 409158 - RNA, 19 nt, Human
cuuagacgcugccugacca

SEQ ID NO: 409159 - RNA, 19 nt, Human
cuugagagauggaauaaag

SEQ ID NO: 409160 - RNA, 21 nt, Human
cuuucaaaaaagcccaaccuc

SEQ ID NO: 409161 - RNA, 19 nt, Human
gaacaucuaaaggacaaaa

SEQ ID NO: 409162 - RNA, 25 nt, Human
gaauauagacaaauaauuuuaaaau

SEQ ID NO: 409163 - RNA, 20 nt, Human
gagaaagagaaaggaaauag

SEQ ID NO: 409164 - RNA, 21 nt, Human
gagagagagagagaaagagaa

SEQ ID NO: 409165 - RNA, 18 nt, Human
gaggacgcuagagauugc

SEQ ID NO: 409166 - RNA, 26 nt, Human
gcaaauccauacugguucaucacaca

SEQ ID NO: 409167 - RNA, 18 nt, Human
gcacagaagcagaccacc

SEQ ID NO: 409168 - RNA, 20 nt, Human
gcacagaagcagaccaccag

SEQ ID NO: 409169 - RNA, 22 nt, Human
gcagcaccaaaaaagaggacgc

SEQ ID NO: 409170 - RNA, 23 nt, Human
gcagcaguucacaggucucaaga

SEQ ID NO: 409171 - RNA, 18 nt, Human
gcccuuggccgucuuucu

SEQ ID NO: 409172 - RNA, 26 nt, Human
gccuccccccccuuucccucccccac

SEQ ID NO: 409173 - RNA, 18 nt, Human
gcgcggcggccaaagcca

SEQ ID NO: 409174 - RNA, 21 nt, Human
ggaccuucaauuucuccuccu

SEQ ID NO: 409175 - RNA, 19 nt, Human
ggcgagagagcaaucgaga

SEQ ID NO: 409176 - RNA, 18 nt, Human
gggcuggguaaaaacagc

SEQ ID NO: 409177 - RNA, 20 nt, Human
gggugggagaggggaggggg

SEQ ID NO: 409178 - RNA, 21 nt, Human
guagcuaaaguugaccuccuc

SEQ ID NO: 409179 - RNA, 22 nt, Human
gucaacgcuauccaaaaauauu

SEQ ID NO: 409180 - RNA, 18 nt, Human
gucaguuucaagacacca

SEQ ID NO: 409181 - RNA, 19 nt, Human
guccuucuaucuucuucuc

SEQ ID NO: 409182 - RNA, 19 nt, Human
uaaaaacagcgugccacca

SEQ ID NO: 409183 - RNA, 23 nt, Human
uaaaaaggcauacaugccaaaaa

SEQ ID NO: 409184 - RNA, 23 nt, Human
uaaaaaggcauacaugccaaaaa

SEQ ID NO: 409185 - RNA, 20 nt, Human
uaaaaugaaaucacuacaga

SEQ ID NO: 409186 - RNA, 18 nt, Human
uaaacagcuaggcagagc

SEQ ID NO: 409187 - RNA, 20 nt, Human
uaaaggacaaaaauaucaga

SEQ ID NO: 409188 - RNA, 20 nt, Human
uaaaguuauuccugcuuuuc

SEQ ID NO: 409189 - RNA, 21 nt, Human
uaacaaugaaacugaagcaga

SEQ ID NO: 409190 - RNA, 24 nt, Human
uaacagcaccuuuaaccaauuauu

SEQ ID NO: 409191 - RNA, 20 nt, Human
uaacaguaccuaccuuugau

SEQ ID NO: 409192 - RNA, 21 nt, Human
uaagaaauacaccaagaacau

SEQ ID NO: 409193 - RNA, 27 nt, Human
uaagaaauacaccaagaaccggggccc

SEQ ID NO: 409194 - RNA, 22 nt, Human
uaagaacagaacuauuauagcc

SEQ ID NO: 409195 - RNA, 24 nt, Human
uaagaacagaacuauuauagccaa

SEQ ID NO: 409196 - RNA, 21 nt, Human
uaagaauccuauuuaaugcua

SEQ ID NO: 409197 - RNA, 21 nt, Human
uaaggaagauaaauuacauca

SEQ ID NO: 409198 - RNA, 19 nt, Human
uaaggcaaaaggcuggcau

SEQ ID NO: 409199 - RNA, 19 nt, Human
uaaucugacagugcaucca

SEQ ID NO: 409200 - RNA, 20 nt, Human
uacaaacaaguacuacauua

SEQ ID NO: 409201 - RNA, 23 nt, Human
uacaggugaggaaccugaggcac

SEQ ID NO: 409202 - RNA, 24 nt, Human
uaccuaccuuugauuagaauauuu

SEQ ID NO: 409203 - RNA, 22 nt, Human
uacgcgacaggugagaucagaa

SEQ ID NO: 409204 - RNA, 21 nt, Human
uagaagacgcucagaagacac

SEQ ID NO: 409205 - RNA, 22 nt, Human
uagaaggacaauuuucucugau

SEQ ID NO: 409206 - RNA, 24 nt, Human
uagaauauuuaguuugauacucag

SEQ ID NO: 409207 - RNA, 25 nt, Human
uagauaauguugcuuaaggauugcc

SEQ ID NO: 409208 - RNA, 18 nt, Human
uaguugauacuacuaugu

SEQ ID NO: 409209 - RNA, 19 nt, Human
uauaccaacugucagucug

SEQ ID NO: 409210 - RNA, 26 nt, Human
uaugaaaacaaaauaaaauaaaacga

SEQ ID NO: 409211 - RNA, 27 nt, Human
uaugcaaacaaaaaaaugcaaaaauga

SEQ ID NO: 409212 - RNA, 25 nt, Human
uauggaauaagaucuaucgugucaa

SEQ ID NO: 409213 - RNA, 20 nt, Human
uaugucaaaaaaggaguguu

SEQ ID NO: 409214 - RNA, 20 nt, Human
uauuucaguuuaugugaaua

SEQ ID NO: 409215 - RNA, 20 nt, Human
uauuuuucaauuuuacaggu

SEQ ID NO: 409216 - RNA, 24 nt, Human
ucaaaaaagcccaaccucuucucc

SEQ ID NO: 409217 - RNA, 25 nt, Human
ucaaaccaaagacaguagcuaaagu

SEQ ID NO: 409218 - RNA, 20 nt, Human
ucaagaacacccucggcagc

SEQ ID NO: 409219 - RNA, 23 nt, Human
ucacacacaagaaagaaauaccu

SEQ ID NO: 409220 - RNA, 22 nt, Human
ucagagagggugugcauguguu

SEQ ID NO: 409221 - RNA, 22 nt, Human
ucagucuccgcgcauuacguca

SEQ ID NO: 409222 - RNA, 20 nt, Human
ucauaaggcauguggcuuua

SEQ ID NO: 409223 - RNA, 18 nt, Human
ucaugccucccccaaagu

SEQ ID NO: 409224 - RNA, 18 nt, Human
uccaagagagaaaauucc

SEQ ID NO: 409225 - RNA, 23 nt, Human
uccaguagcuuguaauaucuucu

SEQ ID NO: 409226 - RNA, 23 nt, Human
ucccaacuucuuuaaugaaauaa

SEQ ID NO: 409227 - RNA, 24 nt, Human
ucccaucaagaaaaccuauuucua

SEQ ID NO: 409228 - RNA, 21 nt, Human
ucccuuuccuuucaagagaac

SEQ ID NO: 409229 - RNA, 19 nt, Human
uccucugccuaggguuuca

SEQ ID NO: 409230 - RNA, 19 nt, Human
ucgucaagaacacccucgg

SEQ ID NO: 409231 - RNA, 22 nt, Human
ucuaaaccgcaaacaaaaggac

SEQ ID NO: 409232 - RNA, 24 nt, Human
ucuaccuucacuaaaacagaacag

SEQ ID NO: 409233 - RNA, 19 nt, Human
ucuaguauucaaaucagga

SEQ ID NO: 409234 - RNA, 21 nt, Human
ucuaugcuuuugaauugaggg

SEQ ID NO: 409235 - RNA, 18 nt, Human
ucugguguuuugcugauu

SEQ ID NO: 409236 - RNA, 18 nt, Human
ucugucucuugcuuucuc

SEQ ID NO: 409237 - RNA, 22 nt, Human
ucugucugagaaaaaaaaaaaa

SEQ ID NO: 409238 - RNA, 24 nt, Human
ucuucuguuguuugcagaguugau

SEQ ID NO: 409239 - RNA, 23 nt, Human
ugaaaaugacaacacaacaucag

SEQ ID NO: 409240 - RNA, 18 nt, Human
ugaaacauagacaaagca

SEQ ID NO: 409241 - RNA, 19 nt, Human
ugaaacauagacaaagcaa

SEQ ID NO: 409242 - RNA, 19 nt, Human
ugaaacugaagcagaggac

SEQ ID NO: 409243 - RNA, 19 nt, Human
ugaaacugaagcagaggac

SEQ ID NO: 409244 - RNA, 20 nt, Human
ugaacaugcacuaugaaaac

SEQ ID NO: 409245 - RNA, 22 nt, Human
ugacauacuucugcccuagcau

SEQ ID NO: 409246 - RNA, 21 nt, Human
ugagaaaaggaagaaugagaa

SEQ ID NO: 409247 - RNA, 18 nt, Human
ugagacucuucaguuuau

SEQ ID NO: 409248 - RNA, 22 nt, Human
ugagagaaagagugagaaaagg

SEQ ID NO: 409249 - RNA, 22 nt, Human
ugaggcacaaaaagaaaaagug

SEQ ID NO: 409250 - RNA, 23 nt, Human
ugagugaugagagaaagagugag

SEQ ID NO: 409251 - RNA, 23 nt, Human
ugauuucugucucuugcuuucuc

SEQ ID NO: 409252 - RNA, 24 nt, Human
ugcaaacaaaaaaaugcaaaaaug

SEQ ID NO: 409253 - RNA, 24 nt, Human
ugcauaagaaauacaccaagaaca

SEQ ID NO: 409254 - RNA, 20 nt, Human
ugccaaaaauaaagaaccua

SEQ ID NO: 409255 - RNA, 26 nt, Human
ugccgggugggagaggggagggggug

SEQ ID NO: 409256 - RNA, 22 nt, Human
ugccuccccccccuuucccucc

SEQ ID NO: 409257 - RNA, 24 nt, Human
ugccuccccccccuuucccucccc

SEQ ID NO: 409258 - RNA, 21 nt, Human
ugcucuagaaggacaauuuuc

SEQ ID NO: 409259 - RNA, 23 nt, Human
ugcugauuuaagcaguccacaua

SEQ ID NO: 409260 - RNA, 22 nt, Human
ugcuuuacaaacaaguacuaca

SEQ ID NO: 409261 - RNA, 21 nt, Human
uggcaaaaaauaaacuacugg

SEQ ID NO: 409262 - RNA, 18 nt, Human
uggccaguccaguacugc

SEQ ID NO: 409263 - RNA, 21 nt, Human
uggcuaaaaugaaaucacuac

SEQ ID NO: 409264 - RNA, 21 nt, Human
ugggaaaauaacaaugcccuc

SEQ ID NO: 409265 - RNA, 22 nt, Human
uguaacagacaucuuugcugcc

SEQ ID NO: 409266 - RNA, 20 nt, Human
uguaggacagagugaagcuu

SEQ ID NO: 409267 - RNA, 22 nt, Human
ugucauauugcccaaguuaacc

SEQ ID NO: 409268 - RNA, 21 nt, Human
ugugaaaaagaaacaaaaccc

SEQ ID NO: 409269 - RNA, 23 nt, Human
ugugcacaugugcaauuauaaac

SEQ ID NO: 409270 - RNA, 24 nt, Human
uguuccccccucaugccuccccca

SEQ ID NO: 409271 - RNA, 19 nt, Human
uguuguuugcagaguugau

SEQ ID NO: 409272 - RNA, 23 nt, Human
uuaaaaaaaguuccguaccauaa

SEQ ID NO: 409273 - RNA, 23 nt, Human
uuaaauaacccccuuggccacau

SEQ ID NO: 409274 - RNA, 19 nt, Human
uuaauucuagucuggugau

SEQ ID NO: 409275 - RNA, 22 nt, Human
uuaccuuagaaaagaaucccca

SEQ ID NO: 409276 - RNA, 21 nt, Human
uuagaaaagcaaauccauacu

SEQ ID NO: 409277 - RNA, 19 nt, Human
uuagaucuuuaauugucac

SEQ ID NO: 409278 - RNA, 23 nt, Human
uuaucaaaauaauuucugaaaug

SEQ ID NO: 409279 - RNA, 21 nt, Human
uuaucagaaauguuaucgcuu

SEQ ID NO: 409280 - RNA, 21 nt, Human
uucaaccaaggaucucaaagu

SEQ ID NO: 409281 - RNA, 20 nt, Human
uucaccuuacuggcucaccg

SEQ ID NO: 409282 - RNA, 22 nt, Human
uuccucaauuuucucuugugcc

SEQ ID NO: 409283 - RNA, 23 nt, Human
uuccucaauuuucucuugugccu

SEQ ID NO: 409284 - RNA, 22 nt, Human
uuccugccuccccccccuuucc

SEQ ID NO: 409285 - RNA, 19 nt, Human
uuccuggccuuugggaacu

SEQ ID NO: 409286 - RNA, 22 nt, Human
uucuccgguguaggacagagug

SEQ ID NO: 409287 - RNA, 22 nt, Human
uugauuaaucgucaagaacacc

SEQ ID NO: 409288 - RNA, 23 nt, Human
uuguuuaaaaaaaaaaaaaagaa

SEQ ID NO: 409289 - RNA, 18 nt, Human
uuuaaaauggguacaugu

SEQ ID NO: 409290 - RNA, 21 nt, Human
uuuaaccaaaagaaaauaaau

SEQ ID NO: 409291 - RNA, 22 nt, Human
uuuaaugcuacuuaacuaaauc

SEQ ID NO: 409292 - RNA, 21 nt, Human
uuucaaauucuagacaguuuu

SEQ ID NO: 409293 - RNA, 25 nt, Human
uuucaguuuuuaaauggcacacaau

SEQ ID NO: 409294 - RNA, 22 nt, Human
uuuccugccuccccccccuuuc

SEQ ID NO: 409295 - RNA, 18 nt, Human
uuugcagaguugaucuug

SEQ ID NO: 409296 - RNA, 21 nt, Human
uuuggagcuguauuugcauug

SEQ ID NO: 409297 - RNA, 24 nt, Human
uuuggagcuguauuugcauuggau

SEQ ID NO: 409298 - RNA, 21 nt, Human
uuuuucuuucauugcccugga

SEQ ID NO: 409299 - RNA, 28 nt, Human
aaaaaaaaaaaagaauaaaaucaaagaa

SEQ ID NO: 409300 - RNA, 27 nt, Human
aaaaaaaaaagaauaaaaucaaagaag

SEQ ID NO: 409301 - RNA, 23 nt, Human
aaaaaaagaauaaaaucaaagaa

SEQ ID NO: 409302 - RNA, 20 nt, Human
aaaaaaauacaaaaaauuag

SEQ ID NO: 409303 - RNA, 23 nt, Human
aaaauugugccacugcauuccag

SEQ ID NO: 409304 - RNA, 19 nt, Human
aaaucaaagaaaacagccc

SEQ ID NO: 409305 - RNA, 18 nt, Human
aacauggcgaaaccccau

SEQ ID NO: 409306 - RNA, 20 nt, Human
aacauggcgaaaccccauau

SEQ ID NO: 409307 - RNA, 20 nt, Human
aacauggcgaaaccccauau

SEQ ID NO: 409308 - RNA, 21 nt, Human
aacauggcgaaaccccauauc

SEQ ID NO: 409309 - RNA, 21 nt, Human
aacauggcgaaaccccauauc

SEQ ID NO: 409310 - RNA, 19 nt, Human
aacauggugaaaccccguc

SEQ ID NO: 409311 - RNA, 19 nt, Human
aacauggugaaaccccguc

SEQ ID NO: 409312 - RNA, 20 nt, Human
aacauggugaaaccccgucu

SEQ ID NO: 409313 - RNA, 20 nt, Human
aacauggugaaaccccgucu

SEQ ID NO: 409314 - RNA, 21 nt, Human
aacauggugaaaccccgucuc

SEQ ID NO: 409315 - RNA, 21 nt, Human
aacauggugaaaccccgucuc

SEQ ID NO: 409316 - RNA, 25 nt, Human
aaccaaacccagccaacaggaagca

SEQ ID NO: 409317 - RNA, 24 nt, Human
aacuccaacuugcugcugccccca

SEQ ID NO: 409318 - RNA, 23 nt, Human
aacuugcugcugcccccagcccc

SEQ ID NO: 409319 - RNA, 23 nt, Human
aagaaucgcuugaacccgggagg

SEQ ID NO: 409320 - RNA, 23 nt, Human
aagaaucgcuugaacccgggagg

SEQ ID NO: 409321 - RNA, 21 nt, Human
aagaggagcaagcacggcaca

SEQ ID NO: 409322 - RNA, 21 nt, Human
aagaggagcaagcacggcaca

SEQ ID NO: 409323 - RNA, 24 nt, Human
aagcagaagaaucgcuugaacccg

SEQ ID NO: 409324 - RNA, 24 nt, Human
aagcagaagaaucgcuugaacccg

SEQ ID NO: 409325 - RNA, 25 nt, Human
aagcagaagaaucgcuugaacccgg

SEQ ID NO: 409326 - RNA, 25 nt, Human
aagcagaagaaucgcuugaacccgg

SEQ ID NO: 409327 - RNA, 25 nt, Human
aagcaggacugggguuccuagaaau

SEQ ID NO: 409328 - RNA, 21 nt, Human
aagggcccugugaagcagggu

SEQ ID NO: 409329 - RNA, 24 nt, Human
aaucgcuugaacccgggaggcaga

SEQ ID NO: 409330 - RNA, 24 nt, Human
aaucgcuugaacccgggaggcaga

SEQ ID NO: 409331 - RNA, 18 nt, Human
aauuagccagacauggug

SEQ ID NO: 409332 - RNA, 20 nt, Human
acaagagugaaacucugucu

SEQ ID NO: 409333 - RNA, 20 nt, Human
acaagagugaaacucugucu

SEQ ID NO: 409334 - RNA, 21 nt, Human
acaagagugaaacucugucuc

SEQ ID NO: 409335 - RNA, 21 nt, Human
acaagagugaaacucugucuc

SEQ ID NO: 409336 - RNA, 23 nt, Human
acaccaacacccccaaaccaccc

SEQ ID NO: 409337 - RNA, 20 nt, Human
acaccacugcacuccagccu

SEQ ID NO: 409338 - RNA, 20 nt, Human
acaccacugcacuccagccu

SEQ ID NO: 409339 - RNA, 24 nt, Human
acaccacugcacuccagccugggc

SEQ ID NO: 409340 - RNA, 24 nt, Human
acaccacugcacuccagccugggc

SEQ ID NO: 409341 - RNA, 21 nt, Human
acagaacaaggaaaacggccg

SEQ ID NO: 409342 - RNA, 19 nt, Human
acagaagcacugugauacc

SEQ ID NO: 409343 - RNA, 19 nt, Human
acagagcacugguguuccc

SEQ ID NO: 409344 - RNA, 22 nt, Human
acagcaauugagcugaucuucu

SEQ ID NO: 409345 - RNA, 22 nt, Human
acagcaauugagcugaucuucu

SEQ ID NO: 409346 - RNA, 18 nt, Human
acagccucccccaucuuc

SEQ ID NO: 409347 - RNA, 18 nt, Human
acagccucccccaucuuc

SEQ ID NO: 409348 - RNA, 23 nt, Human
accaaacccagccaacaggaagc

SEQ ID NO: 409349 - RNA, 21 nt, Human
accaacacccccaaaccaccc

SEQ ID NO: 409350 - RNA, 22 nt, Human
accaacacccccaaaccacccg

SEQ ID NO: 409351 - RNA, 22 nt, Human
accaacacccccaaaccacccg

SEQ ID NO: 409352 - RNA, 22 nt, Human
accacugcacuccagccugggc

SEQ ID NO: 409353 - RNA, 22 nt, Human
accacugcacuccagccugggc

SEQ ID NO: 409354 - RNA, 22 nt, Human
accccaccugcccuccuugcca

SEQ ID NO: 409355 - RNA, 23 nt, Human
accccaccugcccuccuugccaa

SEQ ID NO: 409356 - RNA, 24 nt, Human
accccgucucuauuaaaaauacaa

SEQ ID NO: 409357 - RNA, 24 nt, Human
accccgucucuauuaaaaauacaa

SEQ ID NO: 409358 - RNA, 24 nt, Human
accugaggucaggaguucgagacc

SEQ ID NO: 409359 - RNA, 20 nt, Human
acgcugaaucuauacugcac

SEQ ID NO: 409360 - RNA, 25 nt, Human
acuccagccugggcaacaagaguga

SEQ ID NO: 409361 - RNA, 25 nt, Human
acuccagccugggcaacaagaguga

SEQ ID NO: 409362 - RNA, 18 nt, Human
acugcacuccagccuggg

SEQ ID NO: 409363 - RNA, 18 nt, Human
acugcacuccagccuggg

SEQ ID NO: 409364 - RNA, 21 nt, Human
acugcacuccagccugggcaa

SEQ ID NO: 409365 - RNA, 21 nt, Human
acugcacuccagccugggcaa

SEQ ID NO: 409366 - RNA, 24 nt, Human
acugcacuccagccugggcaacaa

SEQ ID NO: 409367 - RNA, 24 nt, Human
acugcacuccagccugggcaacaa

SEQ ID NO: 409368 - RNA, 25 nt, Human
acugcacuccagccugggcaacaag

SEQ ID NO: 409369 - RNA, 25 nt, Human
acugcacuccagccugggcaacaag

SEQ ID NO: 409370 - RNA, 18 nt, Human
acugcauuccagccuggg

SEQ ID NO: 409371 - RNA, 18 nt, Human
acugcauuccagccuggg

SEQ ID NO: 409372 - RNA, 22 nt, Human
acugcauuccagccugggugag

SEQ ID NO: 409373 - RNA, 19 nt, Human
agaaggcacugcugcaaca

SEQ ID NO: 409374 - RNA, 22 nt, Human
agaauugcuggaauccaggagg

SEQ ID NO: 409375 - RNA, 24 nt, Human
agacaugguggcacgugccuguaa

SEQ ID NO: 409376 - RNA, 22 nt, Human
agagacucuccaucacacuguc

SEQ ID NO: 409377 - RNA, 20 nt, Human
agaggaagggccucugcauu

SEQ ID NO: 409378 - RNA, 20 nt, Human
agaggaagggccucugcauu

SEQ ID NO: 409379 - RNA, 20 nt, Human
agagguugcagugagccaag

SEQ ID NO: 409380 - RNA, 20 nt, Human
agagguugcagugagccaag

SEQ ID NO: 409381 - RNA, 23 nt, Human
agagguugcagugagccaagauc

SEQ ID NO: 409382 - RNA, 23 nt, Human
agagguugcagugagccaagauc

SEQ ID NO: 409383 - RNA, 24 nt, Human
agagguugcagugagccaagauca

SEQ ID NO: 409384 - RNA, 24 nt, Human
agagguugcagugagccaagauca

SEQ ID NO: 409385 - RNA, 18 nt, Human
agagugaaacucugucuc

SEQ ID NO: 409386 - RNA, 18 nt, Human
agagugaaacucugucuc

SEQ ID NO: 409387 - RNA, 24 nt, Human
agcacuuugggaggccgagguggg

SEQ ID NO: 409388 - RNA, 23 nt, Human
agccagacaugguggcacgugcc

SEQ ID NO: 409389 - RNA, 24 nt, Human
agccuggccaacauggcgaaaccc

SEQ ID NO: 409390 - RNA, 22 nt, Human
agccuggccaacauggugaaac

SEQ ID NO: 409391 - RNA, 22 nt, Human
agccuggccaacauggugaaac

SEQ ID NO: 409392 - RNA, 24 nt, Human
agccuggccaacauggugaaaccc

SEQ ID NO: 409393 - RNA, 24 nt, Human
agccuggccaacauggugaaaccc

SEQ ID NO: 409394 - RNA, 24 nt, Human
agcggcucacaccuguaaucccag

SEQ ID NO: 409395 - RNA, 24 nt, Human
agcggcucacaccuguaaucccag

SEQ ID NO: 409396 - RNA, 23 nt, Human
aggagaauugcuggaauccagga

SEQ ID NO: 409397 - RNA, 20 nt, Human
aggaucucggugaugaggau

SEQ ID NO: 409398 - RNA, 24 nt, Human
aggcagagguugcagugagccaag

SEQ ID NO: 409399 - RNA, 24 nt, Human
aggcagagguugcagugagccaag

SEQ ID NO: 409400 - RNA, 23 nt, Human
aggcaggagaauugcuggaaucc

SEQ ID NO: 409401 - RNA, 23 nt, Human
aggcccccggcucagagccaucu

SEQ ID NO: 409402 - RNA, 22 nt, Human
aggccgagcgcagcggcucaca

SEQ ID NO: 409403 - RNA, 21 nt, Human
aggccgaggugggcggaucac

SEQ ID NO: 409404 - RNA, 19 nt, Human
aggcggagguugcagggag

SEQ ID NO: 409405 - RNA, 21 nt, Human
aggcgggcagaucaccugagg

SEQ ID NO: 409406 - RNA, 21 nt, Human
aggcgggcagaucaccugagg

SEQ ID NO: 409407 - RNA, 26 nt, Human
aggcgggcagaucaccugaggucaag

SEQ ID NO: 409408 - RNA, 26 nt, Human
aggcgggcagaucaccugaggucaag

SEQ ID NO: 409409 - RNA, 24 nt, Human
aggcucacaccuguaaucccagca

SEQ ID NO: 409410 - RNA, 18 nt, Human
agggagagcugggcucgu

SEQ ID NO: 409411 - RNA, 20 nt, Human
agguaccuuugggauguggu

SEQ ID NO: 409412 - RNA, 20 nt, Human
agguaccuuugggauguggu

SEQ ID NO: 409413 - RNA, 19 nt, Human
aggucaggaguucgagacc

SEQ ID NO: 409414 - RNA, 22 nt, Human
aggugggcggaucaccugaggu

SEQ ID NO: 409415 - RNA, 19 nt, Human
agguguggaggcucacacc

SEQ ID NO: 409416 - RNA, 24 nt, Human
agguguggaggcucacaccuguaa

SEQ ID NO: 409417 - RNA, 24 nt, Human
aucacaccacugcacuccagccug

SEQ ID NO: 409418 - RNA, 24 nt, Human
aucacaccacugcacuccagccug

SEQ ID NO: 409419 - RNA, 28 nt, Human
aucacaccacugcacuccagccugggca

SEQ ID NO: 409420 - RNA, 28 nt, Human
aucacaccacugcacuccagccugggca

SEQ ID NO: 409421 - RNA, 24 nt, Human
aucaccugaggucaggaguucgag

SEQ ID NO: 409422 - RNA, 22 nt, Human
aucccagcacuuugggaggcca

SEQ ID NO: 409423 - RNA, 23 nt, Human
auccucuguggcccagugugcaa

SEQ ID NO: 409424 - RNA, 23 nt, Human
auccucuguggcccagugugcaa

SEQ ID NO: 409425 - RNA, 23 nt, Human
auccucuguggcccagugugcaa

SEQ ID NO: 409426 - RNA, 18 nt, Human
augugccauugcggagaa

SEQ ID NO: 409427 - RNA, 18 nt, Human
augugccauugcggagaa

SEQ ID NO: 409428 - RNA, 24 nt, Human
auugugccacugcauuccagccug

SEQ ID NO: 409429 - RNA, 22 nt, Human
caaaacuccaacuugcugcugc

SEQ ID NO: 409430 - RNA, 21 nt, Human
caaagaaggccgagcgcagcg

SEQ ID NO: 409431 - RNA, 21 nt, Human
caaagaaggccgagcgcagcg

SEQ ID NO: 409432 - RNA, 23 nt, Human
caacaagagugaaacucugucuc

SEQ ID NO: 409433 - RNA, 23 nt, Human
caacaagagugaaacucugucuc

SEQ ID NO: 409434 - RNA, 24 nt, Human
caacauggugaaaccccgucucua

SEQ ID NO: 409435 - RNA, 24 nt, Human
caacauggugaaaccccgucucua

SEQ ID NO: 409436 - RNA, 20 nt, Human
caaccaaacccagccaacag

SEQ ID NO: 409437 - RNA, 23 nt, Human
caaccagcuagacgcaggcacac

SEQ ID NO: 409438 - RNA, 24 nt, Human
caaggcgggcagaucaccugaggu

SEQ ID NO: 409439 - RNA, 24 nt, Human
caaggcgggcagaucaccugaggu

SEQ ID NO: 409440 - RNA, 26 nt, Human
caaggcgggcagaucaccugagguca

SEQ ID NO: 409441 - RNA, 26 nt, Human
caaggcgggcagaucaccugagguca

SEQ ID NO: 409442 - RNA, 22 nt, Human
cacacagaacaaggaaaacggc

SEQ ID NO: 409443 - RNA, 21 nt, Human
cacaccacugcacuccagccu

SEQ ID NO: 409444 - RNA, 21 nt, Human
cacaccacugcacuccagccu

SEQ ID NO: 409445 - RNA, 24 nt, Human
cacaccuguaaucccagcacuuug

SEQ ID NO: 409446 - RNA, 24 nt, Human
cacaccuguaaucccagcacuuug

SEQ ID NO: 409447 - RNA, 24 nt, Human
cacaccuguaaucccagcacuuug

SEQ ID NO: 409448 - RNA, 18 nt, Human
cacagaacaaggaaaacg

SEQ ID NO: 409449 - RNA, 24 nt, Human
caccaacacccccaaaccacccgg

SEQ ID NO: 409450 - RNA, 24 nt, Human
caccaacacccccaaaccacccgg

SEQ ID NO: 409451 - RNA, 27 nt, Human
caccccagaggccucagaagguccuuc

SEQ ID NO: 409452 - RNA, 23 nt, Human
caccugaggucaggaguucgaga

SEQ ID NO: 409453 - RNA, 20 nt, Human
caccuguaauccaagcuacu

SEQ ID NO: 409454 - RNA, 23 nt, Human
caccuguaauccaagcuacuugg

SEQ ID NO: 409455 - RNA, 23 nt, Human
caccuguaauccaagcuacuugg

SEQ ID NO: 409456 - RNA, 24 nt, Human
caccuguaauccaagcuacuuggg

SEQ ID NO: 409457 - RNA, 24 nt, Human
caccuguaauccaagcuacuuggg

SEQ ID NO: 409458 - RNA, 19 nt, Human
caccuguaaucccagcacu

SEQ ID NO: 409459 - RNA, 19 nt, Human
caccuguaaucccagcacu

SEQ ID NO: 409460 - RNA, 23 nt, Human
caccuguaaucccagcacuuugg

SEQ ID NO: 409461 - RNA, 23 nt, Human
caccuguaaucccagcacuuugg

SEQ ID NO: 409462 - RNA, 23 nt, Human
caccuguaaucccagcacuuugg

SEQ ID NO: 409463 - RNA, 24 nt, Human
caccuguaaucccagcacuuuggg

SEQ ID NO: 409464 - RNA, 24 nt, Human
caccuguaaucccagcacuuuggg

SEQ ID NO: 409465 - RNA, 24 nt, Human
caccuguaaucccagcacuuuggg

SEQ ID NO: 409466 - RNA, 23 nt, Human
cacuccagccugggcaacaagag

SEQ ID NO: 409467 - RNA, 23 nt, Human
cacuccagccugggcaacaagag

SEQ ID NO: 409468 - RNA, 24 nt, Human
cacuccagccugggcaacaagagu

SEQ ID NO: 409469 - RNA, 24 nt, Human
cacuccagccugggcaacaagagu

SEQ ID NO: 409470 - RNA, 25 nt, Human
cacuccagccugggcaacaagagug

SEQ ID NO: 409471 - RNA, 25 nt, Human
cacuccagccugggcaacaagagug

SEQ ID NO: 409472 - RNA, 18 nt, Human
cacugcacuccagccugg

SEQ ID NO: 409473 - RNA, 18 nt, Human
cacugcacuccagccugg

SEQ ID NO: 409474 - RNA, 19 nt, Human
cacugcacuccagccuggg

SEQ ID NO: 409475 - RNA, 19 nt, Human
cacugcacuccagccuggg

SEQ ID NO: 409476 - RNA, 21 nt, Human
cacugcacuccagccugggca

SEQ ID NO: 409477 - RNA, 21 nt, Human
cacugcacuccagccugggca

SEQ ID NO: 409478 - RNA, 22 nt, Human
cacugcacuccagccugggcaa

SEQ ID NO: 409479 - RNA, 23 nt, Human
cacugcacuccagccugggcaac

SEQ ID NO: 409480 - RNA, 23 nt, Human
cacugcacuccagccugggcaac

SEQ ID NO: 409481 - RNA, 24 nt, Human
cacugcacuccagccugggcaaca

SEQ ID NO: 409482 - RNA, 24 nt, Human
cacugcacuccagccugggcaaca

SEQ ID NO: 409483 - RNA, 25 nt, Human
cacugcacuccagccugggcaacaa

SEQ ID NO: 409484 - RNA, 19 nt, Human
cacugcauuccagccuggg

SEQ ID NO: 409485 - RNA, 19 nt, Human
cacugcauuccagccuggg

SEQ ID NO: 409486 - RNA, 22 nt, Human
cacugcauuccagccuggguga

SEQ ID NO: 409487 - RNA, 22 nt, Human
cacugcauuccagccuggguga

SEQ ID NO: 409488 - RNA, 27 nt, Human
cagaucaccugaggucaagaguucgag

SEQ ID NO: 409489 - RNA, 27 nt, Human
cagaucaccugaggucaagaguucgag

SEQ ID NO: 409490 - RNA, 22 nt, Human
cagcacuuugggaggccaaggc

SEQ ID NO: 409491 - RNA, 24 nt, Human
cagcacuuugggaggccaaggcgg

SEQ ID NO: 409492 - RNA, 24 nt, Human
cagcacuuugggaggccaaggcgg

SEQ ID NO: 409493 - RNA, 21 nt, Human
cagcacuuugggaggccgagg

SEQ ID NO: 409494 - RNA, 24 nt, Human
cagcacuuugggaggccgaggugg

SEQ ID NO: 409495 - RNA, 21 nt, Human
cagccugggugagaagaguga

SEQ ID NO: 409496 - RNA, 20 nt, Human
caggcacaccccaggcccac

SEQ ID NO: 409497 - RNA, 21 nt, Human
caggguaccccaaaacuccaa

SEQ ID NO: 409498 - RNA, 22 nt, Human
caguagagacugaccauccaaa

SEQ ID NO: 409499 - RNA, 20 nt, Human
cagugugcaaccagcuagac

SEQ ID NO: 409500 - RNA, 23 nt, Human
cauggcgaaaccccauaucuauu

SEQ ID NO: 409501 - RNA, 19 nt, Human
caugugccauugcggagaa

SEQ ID NO: 409502 - RNA, 19 nt, Human
caugugccauugcggagaa

SEQ ID NO: 409503 - RNA, 24 nt, Human
cauuccagccugggugagaagagu

SEQ ID NO: 409504 - RNA, 28 nt, Human
ccaaaacuccaacuugcugcugccccca

SEQ ID NO: 409505 - RNA, 20 nt, Human
ccaagcagacugugucccug

SEQ ID NO: 409506 - RNA, 22 nt, Human
ccaagcuacuugggagacugaa

SEQ ID NO: 409507 - RNA, 22 nt, Human
ccaagcuacuugggagacugaa

SEQ ID NO: 409508 - RNA, 20 nt, Human
ccacugcacuccagccuggg

SEQ ID NO: 409509 - RNA, 20 nt, Human
ccacugcacuccagccuggg

SEQ ID NO: 409510 - RNA, 20 nt, Human
ccacugcacuccagccuggg

SEQ ID NO: 409511 - RNA, 21 nt, Human
ccacugcacuccagccugggc

SEQ ID NO: 409512 - RNA, 21 nt, Human
ccacugcacuccagccugggc

SEQ ID NO: 409513 - RNA, 22 nt, Human
ccacugcacuccagccugggca

SEQ ID NO: 409514 - RNA, 22 nt, Human
ccacugcacuccagccugggca

SEQ ID NO: 409515 - RNA, 23 nt, Human
ccacugcacuccagccugggcaa

SEQ ID NO: 409516 - RNA, 23 nt, Human
ccacugcacuccagccugggcaa

SEQ ID NO: 409517 - RNA, 24 nt, Human
ccacugcacuccagccugggcaac

SEQ ID NO: 409518 - RNA, 24 nt, Human
ccacugcacuccagccugggcaac

SEQ ID NO: 409519 - RNA, 20 nt, Human
ccacugcauuccagccuggg

SEQ ID NO: 409520 - RNA, 20 nt, Human
ccacugcauuccagccuggg

SEQ ID NO: 409521 - RNA, 21 nt, Human
ccacugcauuccagccugggu

SEQ ID NO: 409522 - RNA, 21 nt, Human
ccacugcauuccagccugggu

SEQ ID NO: 409523 - RNA, 23 nt, Human
ccacugcauuccagccuggguga

SEQ ID NO: 409524 - RNA, 24 nt, Human
ccacugcauuccagccugggugag

SEQ ID NO: 409525 - RNA, 23 nt, Human
ccagcuagacgcaggcacacccc

SEQ ID NO: 409526 - RNA, 19 nt, Human
ccaggacgggcgaucugac

SEQ ID NO: 409527 - RNA, 19 nt, Human
cccacacagaacaaggaaa

SEQ ID NO: 409528 - RNA, 20 nt, Human
cccaggcaguccugcggcca

SEQ ID NO: 409529 - RNA, 22 nt, Human
ccccagaggccucagaggugag

SEQ ID NO: 409530 - RNA, 21 nt, Human
cccccagcccccuagaacuga

SEQ ID NO: 409531 - RNA, 22 nt, Human
cccccagcccccuagaacugaa

SEQ ID NO: 409532 - RNA, 18 nt, Human
ccccccguggcaacgggg

SEQ ID NO: 409533 - RNA, 19 nt, Human
ccccccguggcaacggggu

SEQ ID NO: 409534 - RNA, 19 nt, Human
cccccggcucagagccauc

SEQ ID NO: 409535 - RNA, 24 nt, Human
cccccguggcaacggggucuccua

SEQ ID NO: 409536 - RNA, 25 nt, Human
cccccguggcaacggggucuccuaa

SEQ ID NO: 409537 - RNA, 24 nt, Human
ccccguggcaacggggucuccuaa

SEQ ID NO: 409538 - RNA, 23 nt, Human
cccggcucagagccaucuguggu

SEQ ID NO: 409539 - RNA, 24 nt, Human
cccguggcaacggggucuccuaag

SEQ ID NO: 409540 - RNA, 19 nt, Human
ccgcgcugccucccucccc

SEQ ID NO: 409541 - RNA, 21 nt, Human
ccucaggugccuccucugcag

SEQ ID NO: 409542 - RNA, 22 nt, Human
ccugaggucaagaguucgagac

SEQ ID NO: 409543 - RNA, 22 nt, Human
ccugaggucaagaguucgagac

SEQ ID NO: 409544 - RNA, 22 nt, Human
ccugaggucaggaguucgagac

SEQ ID NO: 409545 - RNA, 27 nt, Human
ccuggacguggggaacacagggacggu

SEQ ID NO: 409546 - RNA, 28 nt, Human
ccuggacguggggaacacagggacgguu

SEQ ID NO: 409547 - RNA, 24 nt, Human
ccuggccaacauggcgaaacccca

SEQ ID NO: 409548 - RNA, 23 nt, Human
ccuggccaacauggugaaacccc

SEQ ID NO: 409549 - RNA, 23 nt, Human
ccuggccaacauggugaaacccc

SEQ ID NO: 409550 - RNA, 24 nt, Human
ccuggccaacauggugaaaccccg

SEQ ID NO: 409551 - RNA, 24 nt, Human
ccuggccaacauggugaaaccccg

SEQ ID NO: 409552 - RNA, 19 nt, Human
ccugggaggguggacaggc

SEQ ID NO: 409553 - RNA, 18 nt, Human
ccuguaaucccagcuacu

SEQ ID NO: 409554 - RNA, 19 nt, Human
ccuguaaucccagcuacuu

SEQ ID NO: 409555 - RNA, 21 nt, Human
ccuguaaucccagcuacuugg

SEQ ID NO: 409556 - RNA, 22 nt, Human
ccuguaaucccagcuacuuggg

SEQ ID NO: 409557 - RNA, 23 nt, Human
ccugugaagcaggguaccccaaa

SEQ ID NO: 409558 - RNA, 19 nt, Human
ccuuagaccccaccugccc

SEQ ID NO: 409559 - RNA, 22 nt, Human
ccuuagaccccaccugcccucc

SEQ ID NO: 409560 - RNA, 24 nt, Human
cgacaaacgcugaaucuauacugc

SEQ ID NO: 409561 - RNA, 21 nt, Human
cgagaccagccuggccaacau

SEQ ID NO: 409562 - RNA, 24 nt, Human
cgagaccagccuggccaacauggu

SEQ ID NO: 409563 - RNA, 24 nt, Human
cgagaccagccuggccaacauggu

SEQ ID NO: 409564 - RNA, 19 nt, Human
cgaggcaggagaauugcug

SEQ ID NO: 409565 - RNA, 24 nt, Human
cgaggugggcggaucaccugaggu

SEQ ID NO: 409566 - RNA, 26 nt, Human
cgaggugggcggaucaccugagguca

SEQ ID NO: 409567 - RNA, 24 nt, Human
cggaucaccugaggucaggaguuc

SEQ ID NO: 409568 - RNA, 27 nt, Human
cggaucaccugaggucaggaguucgag

SEQ ID NO: 409569 - RNA, 25 nt, Human
cggccgggguggcugucgugggcug

SEQ ID NO: 409570 - RNA, 20 nt, Human
cggccugggaggguggacag

SEQ ID NO: 409571 - RNA, 22 nt, Human
cggcucacaccuguaaucccag

SEQ ID NO: 409572 - RNA, 22 nt, Human
cggcucacaccuguaaucccag

SEQ ID NO: 409573 - RNA, 24 nt, Human
cggcucacaccuguaaucccagca

SEQ ID NO: 409574 - RNA, 24 nt, Human
cggcucacaccuguaaucccagca

SEQ ID NO: 409575 - RNA, 24 nt, Human
cgggaggcagagguugcagugagc

SEQ ID NO: 409576 - RNA, 24 nt, Human
cgggaggcagagguugcagugagc

SEQ ID NO: 409577 - RNA, 24 nt, Human
cgggcagaucaccugaggucaaga

SEQ ID NO: 409578 - RNA, 24 nt, Human
cgggcagaucaccugaggucaaga

SEQ ID NO: 409579 - RNA, 24 nt, Human
cgugccuguaaucccagcuacuug

SEQ ID NO: 409580 - RNA, 20 nt, Human
cguggggaacacagggacgg

SEQ ID NO: 409581 - RNA, 22 nt, Human
cucacaccuguaaucccagcac

SEQ ID NO: 409582 - RNA, 22 nt, Human
cucacaccuguaaucccagcac

SEQ ID NO: 409583 - RNA, 22 nt, Human
cucacaccuguaaucccagcac

SEQ ID NO: 409584 - RNA, 24 nt, Human
cucacaccuguaaucccagcacuu

SEQ ID NO: 409585 - RNA, 24 nt, Human
cucacaccuguaaucccagcacuu

SEQ ID NO: 409586 - RNA, 24 nt, Human
cucacaccuguaaucccagcacuu

SEQ ID NO: 409587 - RNA, 18 nt, Human
cucacagaaaaaaaaaaa

SEQ ID NO: 409588 - RNA, 18 nt, Human
cucacagaaaaaaaaaaa

SEQ ID NO: 409589 - RNA, 23 nt, Human
cucugggccaggccugccugagc

SEQ ID NO: 409590 - RNA, 19 nt, Human
cugcaacagcuugauucuc

SEQ ID NO: 409591 - RNA, 19 nt, Human
cugcaacagcuugauucuc

SEQ ID NO: 409592 - RNA, 18 nt, Human
cugcugcccccagccccc

SEQ ID NO: 409593 - RNA, 23 nt, Human
cuggccaacauggcgaaacccca

SEQ ID NO: 409594 - RNA, 19 nt, Human
cugguguucccucagcagc

SEQ ID NO: 409595 - RNA, 23 nt, Human
cuugcuggauccucuguggccca

SEQ ID NO: 409596 - RNA, 23 nt, Human
cuugcuggauccucuguggccca

SEQ ID NO: 409597 - RNA, 23 nt, Human
cuugcuggauccucuguggccca

SEQ ID NO: 409598 - RNA, 23 nt, Human
cuugcuggauccucuguggccca

SEQ ID NO: 409599 - RNA, 27 nt, Human
gaaaaaaaaaaaagaauaaaaucaaag

SEQ ID NO: 409600 - RNA, 24 nt, Human
gaagagugaaauucugucucaaaa

SEQ ID NO: 409601 - RNA, 26 nt, Human
gaagcaggacugggguuccuagaaau

SEQ ID NO: 409602 - RNA, 26 nt, Human
gaagcaggacugggguuccuagaaau

SEQ ID NO: 409603 - RNA, 24 nt, Human
gaaggccgagcgcagcggcucaca

SEQ ID NO: 409604 - RNA, 22 nt, Human
gaauccaggaggcggagguugc

SEQ ID NO: 409605 - RNA, 18 nt, Human
gaccaggccaggcugcuu

SEQ ID NO: 409606 - RNA, 24 nt, Human
gacgcaggcacaccccaggcccac

SEQ ID NO: 409607 - RNA, 20 nt, Human
gacgucggccugggagggug

SEQ ID NO: 409608 - RNA, 23 nt, Human
gagaauugcuggaauccaggagg

SEQ ID NO: 409609 - RNA, 22 nt, Human
gagagagagagaauacgacugc

SEQ ID NO: 409610 - RNA, 20 nt, Human
gaggaugccaguauggaugg

SEQ ID NO: 409611 - RNA, 20 nt, Human
gaggaugccaguauggaugg

SEQ ID NO: 409612 - RNA, 18 nt, Human
gaggauggcucaguccag

SEQ ID NO: 409613 - RNA, 23 nt, Human
gaggugggcggaucaccugaggu

SEQ ID NO: 409614 - RNA, 25 nt, Human
gaggugggcggaucaccugagguca

SEQ ID NO: 409615 - RNA, 18 nt, Human
gagguugcagggagccaa

SEQ ID NO: 409616 - RNA, 23 nt, Human
gagguugcagggagccaaaauug

SEQ ID NO: 409617 - RNA, 18 nt, Human
gagguugcagugagccaa

SEQ ID NO: 409618 - RNA, 18 nt, Human
gagguugcagugagccaa

SEQ ID NO: 409619 - RNA, 19 nt, Human
gauacugagagagagagag

SEQ ID NO: 409620 - RNA, 24 nt, Human
gaucaccugaggucaagaguucga

SEQ ID NO: 409621 - RNA, 24 nt, Human
gaucaccugaggucaagaguucga

SEQ ID NO: 409622 - RNA, 21 nt, Human
gaucaccugaggucaggaguu

SEQ ID NO: 409623 - RNA, 24 nt, Human
gaucaccugaggucaggaguucga

SEQ ID NO: 409624 - RNA, 18 nt, Human
gcaaccugaacagaagca

SEQ ID NO: 409625 - RNA, 18 nt, Human
gcagggcccaggcagucc

SEQ ID NO: 409626 - RNA, 18 nt, Human
gccaacauggcgaaaccc

SEQ ID NO: 409627 - RNA, 24 nt, Human
gccaacauggugaaaccccgucuc

SEQ ID NO: 409628 - RNA, 24 nt, Human
gccaacauggugaaaccccgucuc

SEQ ID NO: 409629 - RNA, 20 nt, Human
gccaagaucacaccacugca

SEQ ID NO: 409630 - RNA, 20 nt, Human
gccaagaucacaccacugca

SEQ ID NO: 409631 - RNA, 19 nt, Human
gccacugcauuccagccug

SEQ ID NO: 409632 - RNA, 19 nt, Human
gccacugcauuccagccug

SEQ ID NO: 409633 - RNA, 24 nt, Human
gccacugcauuccagccuggguga

SEQ ID NO: 409634 - RNA, 20 nt, Human
gccuguaaucccagcuacuu

SEQ ID NO: 409635 - RNA, 24 nt, Human
ggaggcucacaccuguaaucccag

SEQ ID NO: 409636 - RNA, 22 nt, Human
ggagguugcagggagccaaaau

SEQ ID NO: 409637 - RNA, 24 nt, Human
ggagguugcagggagccaaaauug

SEQ ID NO: 409638 - RNA, 22 nt, Human
ggaucaccugaggucaggaguu

SEQ ID NO: 409639 - RNA, 23 nt, Human
ggaucaccugaggucaggaguuc

SEQ ID NO: 409640 - RNA, 20 nt, Human
ggcacagaccaggccaggcu

SEQ ID NO: 409641 - RNA, 24 nt, Human
ggcacagaccaggccaggcugcuu

SEQ ID NO: 409642 - RNA, 21 nt, Human
ggcacgugccuguaaucccag

SEQ ID NO: 409643 - RNA, 20 nt, Human
ggcgaaaccccauaucuauu

SEQ ID NO: 409644 - RNA, 21 nt, Human
ggcggaucaccugaggucagg

SEQ ID NO: 409645 - RNA, 21 nt, Human
ggcucacaccuguaaucccag

SEQ ID NO: 409646 - RNA, 23 nt, Human
ggcucacaccuguaaucccagca

SEQ ID NO: 409647 - RNA, 23 nt, Human
ggcucacaccuguaaucccagca

SEQ ID NO: 409648 - RNA, 23 nt, Human
ggcucacaccuguaaucccagca

SEQ ID NO: 409649 - RNA, 20 nt, Human
gggaggccgaggugggcgga

SEQ ID NO: 409650 - RNA, 29 nt, Human
gggaggguggacaggcccccggcucagag

SEQ ID NO: 409651 - RNA, 18 nt, Human
gggucuccuaaggcccag

SEQ ID NO: 409652 - RNA, 24 nt, Human
gguggcacgugccuguaaucccag

SEQ ID NO: 409653 - RNA, 19 nt, Human
gugacucugggccaggccu

SEQ ID NO: 409654 - RNA, 23 nt, Human
guggcacgugccuguaaucccag

SEQ ID NO: 409655 - RNA, 21 nt, Human
guugcuacucgaagggagagc

SEQ ID NO: 409656 - RNA, 20 nt, Human
uaagaggagcaagcacggca

SEQ ID NO: 409657 - RNA, 20 nt, Human
uaagaggagcaagcacggca

SEQ ID NO: 409658 - RNA, 26 nt, Human
uaauccaagcuacuugggagacugaa

SEQ ID NO: 409659 - RNA, 26 nt, Human
uaauccaagcuacuugggagacugaa

SEQ ID NO: 409660 - RNA, 25 nt, Human
uaccagguaccuuugggaugugguu

SEQ ID NO: 409661 - RNA, 25 nt, Human
uaccagguaccuuugggaugugguu

SEQ ID NO: 409662 - RNA, 26 nt, Human
uaccagguaccuuugggaugugguuc

SEQ ID NO: 409663 - RNA, 26 nt, Human
uaccagguaccuuugggaugugguuc

SEQ ID NO: 409664 - RNA, 19 nt, Human
uagaccccaccugcccucc

SEQ ID NO: 409665 - RNA, 26 nt, Human
uauggauggaguggaagcaugugcca

SEQ ID NO: 409666 - RNA, 26 nt, Human
uauggauggaguggaagcaugugcca

SEQ ID NO: 409667 - RNA, 23 nt, Human
ucacaccacugcacuccagccug

SEQ ID NO: 409668 - RNA, 23 nt, Human
ucacaccacugcacuccagccug

SEQ ID NO: 409669 - RNA, 31 nt, Human
ucacaccacugcacuccagccugggcaacaa

SEQ ID NO: 409670 - RNA, 19 nt, Human
ucacagaaaaaaaaaaaag

SEQ ID NO: 409671 - RNA, 21 nt, Human
ucacagaaaaaaaaaaaagaa

SEQ ID NO: 409672 - RNA, 20 nt, Human
ucaccugaggucaggaguuc

SEQ ID NO: 409673 - RNA, 20 nt, Human
uccaaacuguuuaguaaagu

SEQ ID NO: 409674 - RNA, 19 nt, Human
uccagaagagccaagcaga

SEQ ID NO: 409675 - RNA, 20 nt, Human
uccagccugggugagaagag

SEQ ID NO: 409676 - RNA, 20 nt, Human
uccagccugggugagaagag

SEQ ID NO: 409677 - RNA, 19 nt, Human
uccaggacugaaccucuca

SEQ ID NO: 409678 - RNA, 22 nt, Human
ucccucagcagccccccguggc

SEQ ID NO: 409679 - RNA, 24 nt, Human
ucccucagcagccccccguggcaa

SEQ ID NO: 409680 - RNA, 18 nt, Human
ucccuccccacacagaac

SEQ ID NO: 409681 - RNA, 22 nt, Human
uccucuguggcccagugugcaa

SEQ ID NO: 409682 - RNA, 18 nt, Human
uccuuagaccccaccugc

SEQ ID NO: 409683 - RNA, 18 nt, Human
ucgcuugaacccgggagg

SEQ ID NO: 409684 - RNA, 18 nt, Human
ucgcuugaacccgggagg

SEQ ID NO: 409685 - RNA, 24 nt, Human
ucggugaugaggauggcucagucc

SEQ ID NO: 409686 - RNA, 20 nt, Human
ucuacggccuggacgugggg

SEQ ID NO: 409687 - RNA, 22 nt, Human
ucuauuaaaaaaauacaaaaaa

SEQ ID NO: 409688 - RNA, 24 nt, Human
ucuauuaaaaaaauacaaaaaauu

SEQ ID NO: 409689 - RNA, 21 nt, Human
ucucuauuaaaaauacaaaaa

SEQ ID NO: 409690 - RNA, 21 nt, Human
ucucuauuaaaaauacaaaaa

SEQ ID NO: 409691 - RNA, 23 nt, Human
ucucuauuaaaaauacaaaaauu

SEQ ID NO: 409692 - RNA, 21 nt, Human
ucucugggccucaggugccuc

SEQ ID NO: 409693 - RNA, 21 nt, Human
ucuguaguuuuaaccugcaca

SEQ ID NO: 409694 - RNA, 21 nt, Human
ucuguaguuuuaaccugcaca

SEQ ID NO: 409695 - RNA, 24 nt, Human
ucugucucacagaaaaaaaaaaaa

SEQ ID NO: 409696 - RNA, 25 nt, Human
ucugucucacagaaaaaaaaaaaaa

SEQ ID NO: 409697 - RNA, 25 nt, Human
ucuucuggagacugugauugaucgu

SEQ ID NO: 409698 - RNA, 25 nt, Human
ucuucuggagacugugauugaucgu

SEQ ID NO: 409699 - RNA, 26 nt, Human
ugaaauucugucucaaaaaaaagaau

SEQ ID NO: 409700 - RNA, 22 nt, Human
ugaagaaggcacugcugcaaca

SEQ ID NO: 409701 - RNA, 22 nt, Human
ugaagaaggcacugcugcaaca

SEQ ID NO: 409702 - RNA, 20 nt, Human
ugaagcagaagaaucgcuug

SEQ ID NO: 409703 - RNA, 20 nt, Human
ugaagcagaagaaucgcuug

SEQ ID NO: 409704 - RNA, 24 nt, Human
ugaagcagaagaaucgcuugaacc

SEQ ID NO: 409705 - RNA, 24 nt, Human
ugaagcagaagaaucgcuugaacc

SEQ ID NO: 409706 - RNA, 24 nt, Human
ugaaguguuuccaggacugaaccu

SEQ ID NO: 409707 - RNA, 19 nt, Human
ugacagugcugucugcgug

SEQ ID NO: 409708 - RNA, 18 nt, Human
ugacucugggccaggccu

SEQ ID NO: 409709 - RNA, 19 nt, Human
ugagaagagugaaauucug

SEQ ID NO: 409710 - RNA, 20 nt, Human
ugagcugaucuucuggagac

SEQ ID NO: 409711 - RNA, 20 nt, Human
ugagcugaucuucuggagac

SEQ ID NO: 409712 - RNA, 21 nt, Human
ugaucuucuggagacugugau

SEQ ID NO: 409713 - RNA, 19 nt, Human
ugauucugccagagcuggg

SEQ ID NO: 409714 - RNA, 19 nt, Human
ugauucugccagagcuggg

SEQ ID NO: 409715 - RNA, 21 nt, Human
ugccaagggcccugugaagca

SEQ ID NO: 409716 - RNA, 22 nt, Human
ugccaagggcccugugaagcag

SEQ ID NO: 409717 - RNA, 23 nt, Human
ugccuguaaucccagcuacuugg

SEQ ID NO: 409718 - RNA, 24 nt, Human
ugccuguaaucccagcuacuuggg

SEQ ID NO: 409719 - RNA, 24 nt, Human
ugccuuuuccucugacggguccca

SEQ ID NO: 409720 - RNA, 24 nt, Human
uggaagaucuuucaaacauucuua

SEQ ID NO: 409721 - RNA, 24 nt, Human
uggaagaucuuucaaacauucuua

SEQ ID NO: 409722 - RNA, 24 nt, Human
uggaauccaggaggcggagguugc

SEQ ID NO: 409723 - RNA, 24 nt, Human
uggaggcucacaccuguaauccca

SEQ ID NO: 409724 - RNA, 21 nt, Human
uggcacgugccuguaauccca

SEQ ID NO: 409725 - RNA, 22 nt, Human
uggcacgugccuguaaucccag

SEQ ID NO: 409726 - RNA, 24 nt, Human
uggccaacauggugaaaccccguc

SEQ ID NO: 409727 - RNA, 24 nt, Human
uggccaacauggugaaaccccguc

SEQ ID NO: 409728 - RNA, 26 nt, Human
ugggagacugaagcagaagaaucgcu

SEQ ID NO: 409729 - RNA, 26 nt, Human
ugggagacugaagcagaagaaucgcu

SEQ ID NO: 409730 - RNA, 27 nt, Human
ugggagacugaagcagaagaaucgcuu

SEQ ID NO: 409731 - RNA, 24 nt, Human
ugggaggccaaggcgggcagauca

SEQ ID NO: 409732 - RNA, 24 nt, Human
ugggaggccaaggcgggcagauca

SEQ ID NO: 409733 - RNA, 19 nt, Human
ugggaggccgaggugggcg

SEQ ID NO: 409734 - RNA, 24 nt, Human
ugggaggccgaggugggcggauca

SEQ ID NO: 409735 - RNA, 22 nt, Human
ugggcaggcacagaccaggcca

SEQ ID NO: 409736 - RNA, 24 nt, Human
ugggcggaucaccugaggucagga

SEQ ID NO: 409737 - RNA, 20 nt, Human
ugggcugaauucagggagga

SEQ ID NO: 409738 - RNA, 24 nt, Human
ugguggcacgugccuguaauccca

SEQ ID NO: 409739 - RNA, 20 nt, Human
ugguguucccucagcagccc

SEQ ID NO: 409740 - RNA, 18 nt, Human
ugguucuggguuagaccc

SEQ ID NO: 409741 - RNA, 24 nt, Human
ugugaagcaggguaccccaaaacu

SEQ ID NO: 409742 - RNA, 22 nt, Human
uuaaaaaaauacaaaaaauuag

SEQ ID NO: 409743 - RNA, 19 nt, Human
uuagccgggcgugguagug

SEQ ID NO: 409744 - RNA, 20 nt, Human
uuagccgggcgugguagugc

SEQ ID NO: 409745 - RNA, 20 nt, Human
uuagccgggcgugguagugc

SEQ ID NO: 409746 - RNA, 25 nt, Human
uucccucagcagccccccguggcaa

SEQ ID NO: 409747 - RNA, 22 nt, Human
uucuccagggaggaaacaccaa

SEQ ID NO: 409748 - RNA, 22 nt, Human
uucuccagggaggaaacaccaa

SEQ ID NO: 409749 - RNA, 19 nt, Human
uucuguaguuuuaaccugc

SEQ ID NO: 409750 - RNA, 19 nt, Human
uucuguaguuuuaaccugc

SEQ ID NO: 409751 - RNA, 22 nt, Human
uugcagggagccaaaauugugc

SEQ ID NO: 409752 - RNA, 20 nt, Human
uugcagugagccaagaucac

SEQ ID NO: 409753 - RNA, 20 nt, Human
uugcagugagccaagaucac

SEQ ID NO: 409754 - RNA, 23 nt, Human
uugccuuuuccucugacgggucc

SEQ ID NO: 409755 - RNA, 24 nt, Human
uugcuggaauccaggaggcggagg

SEQ ID NO: 409756 - RNA, 24 nt, Human
uugggagacugaagcagaagaauc

SEQ ID NO: 409757 - RNA, 24 nt, Human
uugggagacugaagcagaagaauc

SEQ ID NO: 409758 - RNA, 25 nt, Human
uugggaggccgaggugggcggauca

SEQ ID NO: 409759 - RNA, 23 nt, Human
uugucagcggcguugccuuuucc

SEQ ID NO: 409760 - RNA, 23 nt, Human
uugugccacugcauuccagccug

SEQ ID NO: 409761 - RNA, 20 nt, Human
aaccucccuccccagcucug

SEQ ID NO: 409762 - RNA, 20 nt, Human
accagaauucacugggaccu

SEQ ID NO: 409763 - RNA, 21 nt, Human
agcagaugugguuggaaagau

SEQ ID NO: 409764 - RNA, 20 nt, Human
agccggcacgguggagaacg

SEQ ID NO: 409765 - RNA, 23 nt, Human
aguagcaggggcugcgggaggaa

SEQ ID NO: 409766 - RNA, 19 nt, Human
agugaagccgggaggggcu

SEQ ID NO: 409767 - RNA, 22 nt, Human
auucacugggaccccagagcca

SEQ ID NO: 409768 - RNA, 24 nt, Human
cagaggagcggcggaaccucccuc

SEQ ID NO: 409769 - RNA, 21 nt, Human
cagcaagcagguucuggucuc

SEQ ID NO: 409770 - RNA, 24 nt, Human
cagcagaugugguuggaaagaucc

SEQ ID NO: 409771 - RNA, 19 nt, Human
caguagcaggggcugcggg

SEQ ID NO: 409772 - RNA, 18 nt, Human
ccaccuggccagccggca

SEQ ID NO: 409773 - RNA, 18 nt, Human
ccucagcccaccuggcca

SEQ ID NO: 409774 - RNA, 21 nt, Human
ccucccuccccagcucugagc

SEQ ID NO: 409775 - RNA, 20 nt, Human
ccuccugcugcaucugggcc

SEQ ID NO: 409776 - RNA, 18 nt, Human
ccucugugcagauggaga

SEQ ID NO: 409777 - RNA, 20 nt, Human
cggcggaaccucccucccca

SEQ ID NO: 409778 - RNA, 18 nt, Human
cgggaggggcugccggcg

SEQ ID NO: 409779 - RNA, 22 nt, Human
cugucaggacaggcuagccacc

SEQ ID NO: 409780 - RNA, 18 nt, Human
gaagugaagccgggaggg

SEQ ID NO: 409781 - RNA, 27 nt, Human
gacaggcuagccaccagagccucgugc

SEQ ID NO: 409782 - RNA, 18 nt, Human
gaggaggaggcugcucgg

SEQ ID NO: 409783 - RNA, 18 nt, Human
gaggaggcugcucggucc

SEQ ID NO: 409784 - RNA, 22 nt, Human
gcagaugugguuggaaagaucc

SEQ ID NO: 409785 - RNA, 22 nt, Human
gcucugagcacuaagcuccagc

SEQ ID NO: 409786 - RNA, 23 nt, Human
ggaagugaagccgggaggggcug

SEQ ID NO: 409787 - RNA, 22 nt, Human
ggaggaagugaagccgggaggg

SEQ ID NO: 409788 - RNA, 22 nt, Human
ggaggggcugccggcgcugaca

SEQ ID NO: 409789 - RNA, 18 nt, Human
gggagcuuaacucucccc

SEQ ID NO: 409790 - RNA, 23 nt, Human
gggaggaagugaagccgggaggg

SEQ ID NO: 409791 - RNA, 24 nt, Human
ugcgggaggaagugaagccgggag

SEQ ID NO: 409792 - RNA, 24 nt, Human
ugugcagauggagaugucaagggu

SEQ ID NO: 409793 - RNA, 21 nt, Human
aaaacccuguguuaauucugc

SEQ ID NO: 409794 - RNA, 23 nt, Human
aaaacccuguguuaauucugcua

SEQ ID NO: 409795 - RNA, 21 nt, Human
aaccagaggcuucacccggga

SEQ ID NO: 409796 - RNA, 21 nt, Human
accuccgucccccgcacacuc

SEQ ID NO: 409797 - RNA, 24 nt, Human
agacacccacugagcacugagcac

SEQ ID NO: 409798 - RNA, 19 nt, Human
agagaugguacaaugugug

SEQ ID NO: 409799 - RNA, 23 nt, Human
augguacaaugugugggcugggg

SEQ ID NO: 409800 - RNA, 19 nt, Human
caacugccccucaguucag

SEQ ID NO: 409801 - RNA, 21 nt, Human
cacccacugagcacugagcac

SEQ ID NO: 409802 - RNA, 20 nt, Human
cacccgggacuucaggaggc

SEQ ID NO: 409803 - RNA, 24 nt, Human
cacugagcacugagcacgagggug

SEQ ID NO: 409804 - RNA, 24 nt, Human
cagacacccacugagcacugagca

SEQ ID NO: 409805 - RNA, 22 nt, Human
caggaggcucccaggcuccaga

SEQ ID NO: 409806 - RNA, 28 nt, Human
ccaagccgaccugcaauugguaaaacca

SEQ ID NO: 409807 - RNA, 19 nt, Human
cccacaaauucaggcaacc

SEQ ID NO: 409808 - RNA, 21 nt, Human
ccccgaaggguuccggaaggg

SEQ ID NO: 409809 - RNA, 22 nt, Human
ccgaccugcaauugguaaaacc

SEQ ID NO: 409810 - RNA, 21 nt, Human
ccgggucuucguuaaggaagg

SEQ ID NO: 409811 - RNA, 19 nt, Human
ccucaagacugcugccccu

SEQ ID NO: 409812 - RNA, 20 nt, Human
ccuggaagaaucuuggauuu

SEQ ID NO: 409813 - RNA, 23 nt, Human
cgugcgucuuccauucaguccac

SEQ ID NO: 409814 - RNA, 21 nt, Human
cucucccagccaagccgaccu

SEQ ID NO: 409815 - RNA, 24 nt, Human
cugagcacgagggugcacucugcu

SEQ ID NO: 409816 - RNA, 18 nt, Human
cugcugccccuuucccgc

SEQ ID NO: 409817 - RNA, 23 nt, Human
gaccugcaauugguaaaaccaga

SEQ ID NO: 409818 - RNA, 21 nt, Human
gagguucuggguggucguggc

SEQ ID NO: 409819 - RNA, 22 nt, Human
gagugguuuugcuguuguuccu

SEQ ID NO: 409820 - RNA, 24 nt, Human
gagugguuuugcuguuguuccugg

SEQ ID NO: 409821 - RNA, 21 nt, Human
gcagcgccagacagcgcacgc

SEQ ID NO: 409822 - RNA, 18 nt, Human
ggcugggguuggggcuga

SEQ ID NO: 409823 - RNA, 22 nt, Human
ggcugggguuggggcugacggg

SEQ ID NO: 409824 - RNA, 19 nt, Human
gggggaagcuggcaggagg

SEQ ID NO: 409825 - RNA, 19 nt, Human
gggguuggggcugacgggg

SEQ ID NO: 409826 - RNA, 21 nt, Human
gggguuggggcugacggggga

SEQ ID NO: 409827 - RNA, 21 nt, Human
guucagacacccacugagcac

SEQ ID NO: 409828 - RNA, 21 nt, Human
uccagcuuaccuccguccccc

SEQ ID NO: 409829 - RNA, 20 nt, Human
ucccccgcacacucugggau

SEQ ID NO: 409830 - RNA, 23 nt, Human
uccucaagacugcugccccuuuc

SEQ ID NO: 409831 - RNA, 22 nt, Human
ucucucagcuugagacaguuug

SEQ ID NO: 409832 - RNA, 19 nt, Human
ugccaaguaacaaaaucca

SEQ ID NO: 409833 - RNA, 18 nt, Human
ugcccugagaucaccgca

SEQ ID NO: 409834 - RNA, 21 nt, Human
uggcaacccuugcccugagau

SEQ ID NO: 409835 - RNA, 20 nt, Human
ugggaucacgggucucccac

SEQ ID NO: 409836 - RNA, 18 nt, Human
uggggcugacgggggaag

SEQ ID NO: 409837 - RNA, 22 nt, Human
uggggcugacgggggaagcugg

SEQ ID NO: 409838 - RNA, 19 nt, Human
ugugugggcugggguuggg

SEQ ID NO: 409839 - RNA, 24 nt, Human
uguuccuggaagaaucuuggauuu

SEQ ID NO: 409840 - RNA, 22 nt, Human
uuaauucugcuacuaaaaacau

SEQ ID NO: 409841 - RNA, 21 nt, Human
uuccggaaggguguuuccaga

SEQ ID NO: 409842 - RNA, 24 nt, Human
uuccuggaagaaucuuggauuuug

SEQ ID NO: 409843 - RNA, 21 nt, Human
uugcaaguuaaaacccugugu

SEQ ID NO: 409844 - RNA, 23 nt, Human
aaaugguggcgcaugcagcucag

SEQ ID NO: 409845 - RNA, 23 nt, Human
acacuacagaacacacagaaggc

SEQ ID NO: 409846 - RNA, 26 nt, Human
acagaacacacagaaggcauggcccc

SEQ ID NO: 409847 - RNA, 23 nt, Human
acugcucagccugcaagggaaug

SEQ ID NO: 409848 - RNA, 20 nt, Human
agaggcaggggcuggggccu

SEQ ID NO: 409849 - RNA, 19 nt, Human
aggcacugcugaaaugcgg

SEQ ID NO: 409850 - RNA, 24 nt, Human
aggcaggggcuggggccugaggug

SEQ ID NO: 409851 - RNA, 18 nt, Human
aggcugaggcuggggcuu

SEQ ID NO: 409852 - RNA, 24 nt, Human
aggguggggaggcagagccagggg

SEQ ID NO: 409853 - RNA, 22 nt, Human
agucaggcagaacccggccagg

SEQ ID NO: 409854 - RNA, 23 nt, Human
auaaauaauggagaggcaggggc

SEQ ID NO: 409855 - RNA, 21 nt, Human
caaaucccagacacuacagaa

SEQ ID NO: 409856 - RNA, 23 nt, Human
caaaucccagacacuacagaaca

SEQ ID NO: 409857 - RNA, 20 nt, Human
caagacagguggccgggagc

SEQ ID NO: 409858 - RNA, 22 nt, Human
caccccagaaggcacugcugaa

SEQ ID NO: 409859 - RNA, 19 nt, Human
cacgccgagggccccagcc

SEQ ID NO: 409860 - RNA, 20 nt, Human
cacugcucagccugcaaggg

SEQ ID NO: 409861 - RNA, 19 nt, Human
cacugcugaaaugcggcug

SEQ ID NO: 409862 - RNA, 19 nt, Human
ccacaggguccuggggccu

SEQ ID NO: 409863 - RNA, 18 nt, Human
ccacuggucccucgccuc

SEQ ID NO: 409864 - RNA, 18 nt, Human
cccagccccuugcaaagc

SEQ ID NO: 409865 - RNA, 25 nt, Human
cgccgagggccccagccccuugcaa

SEQ ID NO: 409866 - RNA, 22 nt, Human
cuuccugagagcagagcaaaua

SEQ ID NO: 409867 - RNA, 21 nt, Human
gacuccauaggagcaagacag

SEQ ID NO: 409868 - RNA, 22 nt, Human
gcaaaucccagacacuacagaa

SEQ ID NO: 409869 - RNA, 21 nt, Human
gccaggggcgggggcuccagg

SEQ ID NO: 409870 - RNA, 21 nt, Human
gccucuggggccaaagcaggg

SEQ ID NO: 409871 - RNA, 21 nt, Human
gcucaggcgcaggcugaggcu

SEQ ID NO: 409872 - RNA, 20 nt, Human
ggaccacaggguccuggggc

SEQ ID NO: 409873 - RNA, 23 nt, Human
ggccgggagcccccaccccaggg

SEQ ID NO: 409874 - RNA, 18 nt, Human
ggccugagguggaggggc

SEQ ID NO: 409875 - RNA, 24 nt, Human
ggcuggggccugagguggaggggc

SEQ ID NO: 409876 - RNA, 24 nt, Human
gggccaaagcagggugugggggga

SEQ ID NO: 409877 - RNA, 24 nt, Human
gggcuggggccugagguggagggg

SEQ ID NO: 409878 - RNA, 21 nt, Human
gguggggaggcagagccaggg

SEQ ID NO: 409879 - RNA, 24 nt, Human
ucaaugaauaaacauuuauugagc

SEQ ID NO: 409880 - RNA, 25 nt, Human
ucaggcgcaggcugaggcuggggcu

SEQ ID NO: 409881 - RNA, 18 nt, Human
ucugccagguuccagcug

SEQ ID NO: 409882 - RNA, 21 nt, Human
ugaauaaacauuuauugagca

SEQ ID NO: 409883 - RNA, 22 nt, Human
ugaggcuggggcuuggccgggc

SEQ ID NO: 409884 - RNA, 19 nt, Human
ugagguggaggggcucugg

SEQ ID NO: 409885 - RNA, 20 nt, Human
ugcaagggaaugaaagggga

SEQ ID NO: 409886 - RNA, 22 nt, Human
ugccagguuccagcuggggcag

SEQ ID NO: 409887 - RNA, 26 nt, Human
uggaacgggguccuaaggccucugcc

SEQ ID NO: 409888 - RNA, 18 nt, Human
uggagaggcaggggcugg

SEQ ID NO: 409889 - RNA, 20 nt, Human
uggccgggagcccccacccc

SEQ ID NO: 409890 - RNA, 21 nt, Human
ugggcagagaagcuggggcug

SEQ ID NO: 409891 - RNA, 21 nt, Human
uggggccaaagcagggugugg

SEQ ID NO: 409892 - RNA, 25 nt, Human
aaaaagcacaggagccgccugcaga

SEQ ID NO: 409893 - RNA, 19 nt, Human
aaaaaggacucacucagaa

SEQ ID NO: 409894 - RNA, 21 nt, Human
aagagaaaaguaucaggucca

SEQ ID NO: 409895 - RNA, 26 nt, Human
aagcggcagcacccgccgaccgagca

SEQ ID NO: 409896 - RNA, 26 nt, Human
accagccccgaccucggcggcccggc

SEQ ID NO: 409897 - RNA, 22 nt, Human
acccagugaaacuauggggcuu

SEQ ID NO: 409898 - RNA, 23 nt, Human
accccggcgacccccagccgagc

SEQ ID NO: 409899 - RNA, 23 nt, Human
accgcaacccagugaaacuaugg

SEQ ID NO: 409900 - RNA, 18 nt, Human
acuccuguuucucaaaca

SEQ ID NO: 409901 - RNA, 23 nt, Human
acuuugugcucagagaaaaacca

SEQ ID NO: 409902 - RNA, 19 nt, Human
agaaaaaccagcaugaugg

SEQ ID NO: 409903 - RNA, 19 nt, Human
agaaaaaccagcaugaugg

SEQ ID NO: 409904 - RNA, 23 nt, Human
agaaagacuaaagcuagcgaagg

SEQ ID NO: 409905 - RNA, 23 nt, Human
agacauccgaagagccagaaaua

SEQ ID NO: 409906 - RNA, 20 nt, Human
agagaaaaaccagcaugaug

SEQ ID NO: 409907 - RNA, 22 nt, Human
agcgaaggaacguacauuucug

SEQ ID NO: 409908 - RNA, 18 nt, Human
auccgaagagccagaaau

SEQ ID NO: 409909 - RNA, 18 nt, Human
caaaagcacgaagcugcu

SEQ ID NO: 409910 - RNA, 20 nt, Human
caccauaaaaaaaggacuca

SEQ ID NO: 409911 - RNA, 22 nt, Human
caccauaaaaaaaggacucacu

SEQ ID NO: 409912 - RNA, 20 nt, Human
cagaaagacuaaagcuagcg

SEQ ID NO: 409913 - RNA, 20 nt, Human
cagagcccggagcgcccuuc

SEQ ID NO: 409914 - RNA, 19 nt, Human
cagccgagcccucgucgca

SEQ ID NO: 409915 - RNA, 20 nt, Human
cagccuaaaacuuugugcuu

SEQ ID NO: 409916 - RNA, 23 nt, Human
caggcccggcccgcgaccccggc

SEQ ID NO: 409917 - RNA, 21 nt, Human
cccgcaggguggccuggcccc

SEQ ID NO: 409918 - RNA, 19 nt, Human
cccgcgugccguggcggcc

SEQ ID NO: 409919 - RNA, 21 nt, Human
cccgcgugccguggcggccac

SEQ ID NO: 409920 - RNA, 30 nt, Human
cccggcccgcgaccccggcgacccccagcc

SEQ ID NO: 409921 - RNA, 18 nt, Human
ccgccugcagacucucag

SEQ ID NO: 409922 - RNA, 19 nt, Human
ccgcgcgcagucccgcccc

SEQ ID NO: 409923 - RNA, 18 nt, Human
ccucggcggcccggcucc

SEQ ID NO: 409924 - RNA, 25 nt, Human
ccugcagacucucagaguucugucc

SEQ ID NO: 409925 - RNA, 22 nt, Human
ccugcaggcccggcccgcgacc

SEQ ID NO: 409926 - RNA, 19 nt, Human
ccuggccccguggauccac

SEQ ID NO: 409927 - RNA, 22 nt, Human
cuagaagacauccgaagagcca

SEQ ID NO: 409928 - RNA, 23 nt, Human
cuauauucucccuuucuuacacg

SEQ ID NO: 409929 - RNA, 25 nt, Human
cuguacauucacagagggaggacac

SEQ ID NO: 409930 - RNA, 21 nt, Human
gaacagaaagacuaaagcuag

SEQ ID NO: 409931 - RNA, 22 nt, Human
gaagacauccgaagagccagaa

SEQ ID NO: 409932 - RNA, 21 nt, Human
gaccccggcgacccccagccg

SEQ ID NO: 409933 - RNA, 18 nt, Human
gaccgagcaccaggcccc

SEQ ID NO: 409934 - RNA, 20 nt, Human
gaguucaaccagccccgacc

SEQ ID NO: 409935 - RNA, 19 nt, Human
gcccggcccgcgaccccgg

SEQ ID NO: 409936 - RNA, 20 nt, Human
gcucagagcccggagcgccc

SEQ ID NO: 409937 - RNA, 18 nt, Human
gcuguguacagccuaaaa

SEQ ID NO: 409938 - RNA, 18 nt, Human
gggaacagaaagacuaaa

SEQ ID NO: 409939 - RNA, 20 nt, Human
gucuguacaaaagcacgaag

SEQ ID NO: 409940 - RNA, 19 nt, Human
guguggccucccgcagggu

SEQ ID NO: 409941 - RNA, 26 nt, Human
uaaaagauuauuuugaaagcuuggaa

SEQ ID NO: 409942 - RNA, 18 nt, Human
uaaagcggcagcacccgc

SEQ ID NO: 409943 - RNA, 23 nt, Human
uaaagcuagcgaaggaacguaca

SEQ ID NO: 409944 - RNA, 21 nt, Human
uaccaggaaaauaaccgcaac

SEQ ID NO: 409945 - RNA, 24 nt, Human
uagcgaaggaacguacauuucugu

SEQ ID NO: 409946 - RNA, 24 nt, Human
ucaagagaaaaguaucagguccau

SEQ ID NO: 409947 - RNA, 23 nt, Human
ucuguacacuuguuacaaagguu

SEQ ID NO: 409948 - RNA, 19 nt, Human
ugagguguuauuuccgaaa

SEQ ID NO: 409949 - RNA, 22 nt, Human
ugauuuuuucuucaggugcagu

SEQ ID NO: 409950 - RNA, 19 nt, Human
ugcucagagaaaaaccagc

SEQ ID NO: 409951 - RNA, 19 nt, Human
uggaagggagcuguucgua

SEQ ID NO: 409952 - RNA, 25 nt, Human
uggauccacgccgaacgcucaacga

SEQ ID NO: 409953 - RNA, 24 nt, Human
ugguuugcuucucaagagaaaagu

SEQ ID NO: 409954 - RNA, 18 nt, Human
ugugcucagagaaaaacc

SEQ ID NO: 409955 - RNA, 21 nt, Human
uguguacagccuaaaacuuug

SEQ ID NO: 409956 - RNA, 21 nt, Human
uuacacgcaaacuaccaggaa

SEQ ID NO: 409957 - RNA, 21 nt, Human
uucacagagggaggacaccau

SEQ ID NO: 409958 - RNA, 20 nt, Human
aaaaacagcgaagucccaca

SEQ ID NO: 409959 - RNA, 19 nt, Human
aacaaaccuuuuuuuuuuu

SEQ ID NO: 409960 - RNA, 19 nt, Human
acauaccauacccuacaag

SEQ ID NO: 409961 - RNA, 24 nt, Human
acauaccauacccuacaagacaca

SEQ ID NO: 409962 - RNA, 19 nt, Human
accauacccuacaagacac

SEQ ID NO: 409963 - RNA, 19 nt, Human
agaggcuguccgccgggcc

SEQ ID NO: 409964 - RNA, 27 nt, Human
auuaacaaaccuuuuuuuuuuuuuuuu

SEQ ID NO: 409965 - RNA, 19 nt, Human
cccaugcacacgcuggccg

SEQ ID NO: 409966 - RNA, 19 nt, Human
ccugggcugcuccagcuac

SEQ ID NO: 409967 - RNA, 26 nt, Human
ccuuuuuuuuuuuuuuuuauuggaga

SEQ ID NO: 409968 - RNA, 24 nt, Human
cgugcaucuuggucucaaugucga

SEQ ID NO: 409969 - RNA, 18 nt, Human
gaggcggccccauugcaa

SEQ ID NO: 409970 - RNA, 22 nt, Human
gccaugguuuccauguuaagga

SEQ ID NO: 409971 - RNA, 21 nt, Human
gcggagguggcggugggucag

SEQ ID NO: 409972 - RNA, 23 nt, Human
ggccugggcugcuccagcuacgc

SEQ ID NO: 409973 - RNA, 18 nt, Human
ucccacauaccauacccu

SEQ ID NO: 409974 - RNA, 23 nt, Human
uccgccgggccugggcugcucca

SEQ ID NO: 409975 - RNA, 18 nt, Human
ucuuuuuuuuuuuuuuuu

SEQ ID NO: 409976 - RNA, 18 nt, Human
ucuuuuuuuuuuuuuuuu

SEQ ID NO: 409977 - RNA, 21 nt, Human
ugccagaucuucaggaagucc

SEQ ID NO: 409978 - RNA, 22 nt, Human
ugccagaucuucaggaaguccu

SEQ ID NO: 409979 - RNA, 20 nt, Human
ugggcugcuccagcuacgcg

SEQ ID NO: 409980 - RNA, 27 nt, Human
uuuaauuaacaaaccuuuuuuuuuuuu

SEQ ID NO: 409981 - RNA, 25 nt, Human
uuuuuuuuuuuuuuuuuuucuuuuu

SEQ ID NO: 409982 - RNA, 25 nt, Human
uuuuuuuuuuuuuuuuuuucuuuuu

SEQ ID NO: 409983 - RNA, 19 nt, Human
ccaaggccagugcaggagg

SEQ ID NO: 409984 - RNA, 18 nt, Human
gccucuaugucugugcac

SEQ ID NO: 409985 - RNA, 24 nt, Human
auucucggucugaagagguuuggg

SEQ ID NO: 409986 - RNA, 19 nt, Human
ccugggccaaaagucucug

SEQ ID NO: 409987 - RNA, 23 nt, Human
ccugggccaaaagucucuggaac

SEQ ID NO: 409988 - RNA, 24 nt, Human
cuagccgcgauaaacacccucccc

SEQ ID NO: 409989 - RNA, 22 nt, Human
cuccugggccaaaagucucugg

SEQ ID NO: 409990 - RNA, 18 nt, Human
gcgauaaacacccucccc

SEQ ID NO: 409991 - RNA, 24 nt, Human
guaaauauuccuccugggccaaaa

SEQ ID NO: 409992 - RNA, 19 nt, Human
ucugaagagguuugggaaa

SEQ ID NO: 409993 - RNA, 18 nt, Human
uuuuuuuuuuuuuuuuug

SEQ ID NO: 409994 - RNA, 19 nt, Human
uuuuuuuuuuuuuuuuugu

SEQ ID NO: 409995 - RNA, 24 nt, Human
aaaaucaguaagaacaguuauaua

SEQ ID NO: 409996 - RNA, 26 nt, Human
aaaauuuaaugaagaccuaaaaaaug

SEQ ID NO: 409997 - RNA, 21 nt, Human
aaacaaugugguuuaagaaau

SEQ ID NO: 409998 - RNA, 20 nt, Human
aaacaucacuccacucacag

SEQ ID NO: 409999 - RNA, 18 nt, Human
aaacaugcgccacggucc

SEQ ID NO: 410000 - RNA, 18 nt, Human
aaagcaaaaaccuuuugg

SEQ ID NO: 410001 - RNA, 22 nt, Human
aacacacacacaaacaucacuc

SEQ ID NO: 410002 - RNA, 18 nt, Human
aagaaaaggagacccuaa

SEQ ID NO: 410003 - RNA, 25 nt, Human
aagaaacuuauuccaaagucuuuac

SEQ ID NO: 410004 - RNA, 23 nt, Human
aaggaucuuuuauauauggcuuu

SEQ ID NO: 410005 - RNA, 22 nt, Human
acacugcuuugucuuggcuaag

SEQ ID NO: 410006 - RNA, 19 nt, Human
accaggguacaagcuguuu

SEQ ID NO: 410007 - RNA, 21 nt, Human
acccucauaaaucagaaaaaa

SEQ ID NO: 410008 - RNA, 18 nt, Human
acccugaaaaucuuggua

SEQ ID NO: 410009 - RNA, 27 nt, Human
accuagugcuuuaaaaaucugguuaua

SEQ ID NO: 410010 - RNA, 18 nt, Human
acuggcucagccuccccu

SEQ ID NO: 410011 - RNA, 19 nt, Human
agaaaaggagacccuaaug

SEQ ID NO: 410012 - RNA, 21 nt, Human
agaaacgcuuuugcuugcuaa

SEQ ID NO: 410013 - RNA, 18 nt, Human
agauacaaccaacagacu

SEQ ID NO: 410014 - RNA, 22 nt, Human
agcaggagacugcagauuccuu

SEQ ID NO: 410015 - RNA, 19 nt, Human
agccgucugcugaaaaaca

SEQ ID NO: 410016 - RNA, 18 nt, Human
aggaagaaaaggagaccc

SEQ ID NO: 410017 - RNA, 24 nt, Human
aggaagaaaaggagacccuaaugu

SEQ ID NO: 410018 - RNA, 20 nt, Human
aguugcuuugguuugcauuu

SEQ ID NO: 410019 - RNA, 25 nt, Human
augaagaccuaaaaaaugauaaaug

SEQ ID NO: 410020 - RNA, 19 nt, Human
auuaaaaaagaaaaaagaa

SEQ ID NO: 410021 - RNA, 21 nt, Human
caaacccucauaaaucagaaa

SEQ ID NO: 410022 - RNA, 23 nt, Human
caagauacaaccaacagacuuac

SEQ ID NO: 410023 - RNA, 18 nt, Human
caccauuucccuaccagg

SEQ ID NO: 410024 - RNA, 22 nt, Human
cacugccuaugucagcacuuug

SEQ ID NO: 410025 - RNA, 23 nt, Human
cagaaaaaccugcuaacaagcac

SEQ ID NO: 410026 - RNA, 24 nt, Human
cagcacuuugggcaggggaaaugg

SEQ ID NO: 410027 - RNA, 21 nt, Human
cagcgacaccauuucccuacc

SEQ ID NO: 410028 - RNA, 22 nt, Human
caucaacaugcuucugcuaaca

SEQ ID NO: 410029 - RNA, 24 nt, Human
cauuugauuuggcaccacuauugu

SEQ ID NO: 410030 - RNA, 19 nt, Human
ccaccccuagauccccgcc

SEQ ID NO: 410031 - RNA, 19 nt, Human
ccacggucccgcgaagucg

SEQ ID NO: 410032 - RNA, 23 nt, Human
ccagcagugcauuuaaagcaauu

SEQ ID NO: 410033 - RNA, 18 nt, Human
cccagcauuuucacccug

SEQ ID NO: 410034 - RNA, 22 nt, Human
cccgcgaagucgcccaccccua

SEQ ID NO: 410035 - RNA, 20 nt, Human
ccgccgggucggccgagccc

SEQ ID NO: 410036 - RNA, 18 nt, Human
ccugaaaaucuugguaaa

SEQ ID NO: 410037 - RNA, 28 nt, Human
cuaauuauuuacaccagcagugcauuua

SEQ ID NO: 410038 - RNA, 19 nt, Human
cucaugaagaaggggagcu

SEQ ID NO: 410039 - RNA, 20 nt, Human
cucuagguggagucugauuu

SEQ ID NO: 410040 - RNA, 20 nt, Human
cugaaaaacagcagaguuga

SEQ ID NO: 410041 - RNA, 25 nt, Human
cugcgcaccugcuucucauaugacc

SEQ ID NO: 410042 - RNA, 20 nt, Human
cuuugggcaggggaaaugga

SEQ ID NO: 410043 - RNA, 19 nt, Human
gaaaaacagcagaguugaa

SEQ ID NO: 410044 - RNA, 20 nt, Human
gaagggcacauaguaucuuu

SEQ ID NO: 410045 - RNA, 22 nt, Human
gagguauuccuaaaaaguugcu

SEQ ID NO: 410046 - RNA, 22 nt, Human
ggaauucucugcgcaccugcuu

SEQ ID NO: 410047 - RNA, 27 nt, Human
ggcaauaaaaucaguaagaacaguuau

SEQ ID NO: 410048 - RNA, 21 nt, Human
uaaaaaccucagaucuuucaa

SEQ ID NO: 410049 - RNA, 22 nt, Human
uaaaaagaacauuauauccaga

SEQ ID NO: 410050 - RNA, 20 nt, Human
uaaaauggauaaaacaaggc

SEQ ID NO: 410051 - RNA, 21 nt, Human
uaaaauggauaaaacaaggca

SEQ ID NO: 410052 - RNA, 20 nt, Human
uaaagagguauuccuaaaaa

SEQ ID NO: 410053 - RNA, 26 nt, Human
uaacaagcacaagucuuacuauaaga

SEQ ID NO: 410054 - RNA, 27 nt, Human
uacaaaauaugaacauagaggacauac

SEQ ID NO: 410055 - RNA, 18 nt, Human
uacaaaauguguccaaga

SEQ ID NO: 410056 - RNA, 21 nt, Human
uacagaugcucaugaagaagg

SEQ ID NO: 410057 - RNA, 23 nt, Human
uacauaaacacagaauagauuuu

SEQ ID NO: 410058 - RNA, 18 nt, Human
uaccugaagucacagaaa

SEQ ID NO: 410059 - RNA, 18 nt, Human
uaucagagugguauauca

SEQ ID NO: 410060 - RNA, 22 nt, Human
uaugggggaaaaacuaacagaa

SEQ ID NO: 410061 - RNA, 21 nt, Human
ucacaucaacaugcuucugcu

SEQ ID NO: 410062 - RNA, 21 nt, Human
uccacucacaguaggaaauga

SEQ ID NO: 410063 - RNA, 18 nt, Human
ucccaucagccgucugcu

SEQ ID NO: 410064 - RNA, 23 nt, Human
ucccuagugcucuuuaagcuggu

SEQ ID NO: 410065 - RNA, 18 nt, Human
uccuggugcucuaggugg

SEQ ID NO: 410066 - RNA, 24 nt, Human
ucucgcacuggcucagccuccccc

SEQ ID NO: 410067 - RNA, 23 nt, Human
ucugcuaacacuuucaaagcaaa

SEQ ID NO: 410068 - RNA, 20 nt, Human
ucuugaauauuuacuuucaa

SEQ ID NO: 410069 - RNA, 20 nt, Human
ucuuuacaacuuaacuuacu

SEQ ID NO: 410070 - RNA, 23 nt, Human
ugaaaaacagcagaguugaacug

SEQ ID NO: 410071 - RNA, 18 nt, Human
ugaaagagcagaaaaggu

SEQ ID NO: 410072 - RNA, 21 nt, Human
ugaaauacauuauaaaacugg

SEQ ID NO: 410073 - RNA, 18 nt, Human
ugacugaaaaacagcaga

SEQ ID NO: 410074 - RNA, 21 nt, Human
ugcgcaccugcuucucauaug

SEQ ID NO: 410075 - RNA, 18 nt, Human
ugcuuuaaaaaucugguu

SEQ ID NO: 410076 - RNA, 19 nt, Human
uggaauuuuagaaaucaca

SEQ ID NO: 410077 - RNA, 23 nt, Human
uggaauuuuagaaaucacauguc

SEQ ID NO: 410078 - RNA, 23 nt, Human
uggagugaacaucaucuugaaua

SEQ ID NO: 410079 - RNA, 22 nt, Human
uggauaaaacaaggcacaauga

SEQ ID NO: 410080 - RNA, 18 nt, Human
uggcuuuuaugauaccca

SEQ ID NO: 410081 - RNA, 20 nt, Human
uggcuuuuaugauacccacu

SEQ ID NO: 410082 - RNA, 18 nt, Human
ugggcaggggaaauggaa

SEQ ID NO: 410083 - RNA, 19 nt, Human
ugggcaggggaaauggaag

SEQ ID NO: 410084 - RNA, 23 nt, Human
ugguaaagauucuucaucacugc

SEQ ID NO: 410085 - RNA, 23 nt, Human
ugucagcacuuugggcaggggaa

SEQ ID NO: 410086 - RNA, 22 nt, Human
uguuaaaaaccucagaucuuuc

SEQ ID NO: 410087 - RNA, 18 nt, Human
uguuaugggggaaaaacu

SEQ ID NO: 410088 - RNA, 24 nt, Human
uuacuaaguugcuuugguuugcau

SEQ ID NO: 410089 - RNA, 21 nt, Human
uuauuaaaaaagaaaaaagaa

SEQ ID NO: 410090 - RNA, 25 nt, Human
uucaaggaauucucugcgcaccugc

SEQ ID NO: 410091 - RNA, 24 nt, Human
uucaugcuuuaagauugagauuuu

SEQ ID NO: 410092 - RNA, 19 nt, Human
uuccugucccaucagccgu

SEQ ID NO: 410093 - RNA, 23 nt, Human
uucucauaugaccaaaguuguac

SEQ ID NO: 410094 - RNA, 24 nt, Human
uugaauagagauuuuaaaauuuca

SEQ ID NO: 410095 - RNA, 24 nt, Human
uuuaaaaagaacauuauauccaga

SEQ ID NO: 410096 - RNA, 19 nt, Human
uuuaaccaggcuaucaacu

SEQ ID NO: 410097 - RNA, 19 nt, Human
aaacaacaggaagucggca

SEQ ID NO: 410098 - RNA, 19 nt, Human
acccccaacccggccucaa

SEQ ID NO: 410099 - RNA, 22 nt, Human
acccccaacccggccucaaaca

SEQ ID NO: 410100 - RNA, 23 nt, Human
acggccgccuggcgacucccuuc

SEQ ID NO: 410101 - RNA, 19 nt, Human
aggaagucggcaccacuac

SEQ ID NO: 410102 - RNA, 22 nt, Human
auaaaagccagucuuuaccaaa

SEQ ID NO: 410103 - RNA, 21 nt, Human
caacccggccucaaacaacag

SEQ ID NO: 410104 - RNA, 22 nt, Human
cagucccaacauucagcacaaa

SEQ ID NO: 410105 - RNA, 21 nt, Human
ccaacccggccucaaacaaca

SEQ ID NO: 410106 - RNA, 20 nt, Human
cccacacaaucgcacacccc

SEQ ID NO: 410107 - RNA, 22 nt, Human
cccacacaaucgcacaccccca

SEQ ID NO: 410108 - RNA, 18 nt, Human
ccggccucaaacaacagg

SEQ ID NO: 410109 - RNA, 26 nt, Human
cugcugggcugccccagaccguccca

SEQ ID NO: 410110 - RNA, 25 nt, Human
ggauagaaagugcauuaauaaaagc

SEQ ID NO: 410111 - RNA, 21 nt, Human
uaagaagagcucaaccuccag

SEQ ID NO: 410112 - RNA, 21 nt, Human
uagaaagugcauuaauaaaag

SEQ ID NO: 410113 - RNA, 19 nt, Human
ucccacacaaucgcacacc

SEQ ID NO: 410114 - RNA, 22 nt, Human
ucccacacaaucgcacacccuu

SEQ ID NO: 410115 - RNA, 20 nt, Human
ugccccagaccgucccacac

SEQ ID NO: 410116 - RNA, 21 nt, Human
uggcgacucccuuccccgcag

SEQ ID NO: 410117 - RNA, 23 nt, Human
uuccccgcaggcagagggucagc

SEQ ID NO: 410118 - RNA, 24 nt, Human
aagggccuuuucuaucacaaaggu

SEQ ID NO: 410119 - RNA, 19 nt, Human
aagucaucucagaucacug

SEQ ID NO: 410120 - RNA, 19 nt, Human
accuccuuacuauccaaga

SEQ ID NO: 410121 - RNA, 19 nt, Human
agaacagagauucagagac

SEQ ID NO: 410122 - RNA, 19 nt, Human
agaacagagauucagagac

SEQ ID NO: 410123 - RNA, 18 nt, Human
agacacaaaguuaauaaa

SEQ ID NO: 410124 - RNA, 21 nt, Human
aggaaaaaaaaauuagaccca

SEQ ID NO: 410125 - RNA, 19 nt, Human
auagaaagagccauauaca

SEQ ID NO: 410126 - RNA, 18 nt, Human
caagucuagaaggagauu

SEQ ID NO: 410127 - RNA, 19 nt, Human
caccuccuuacuauccaag

SEQ ID NO: 410128 - RNA, 21 nt, Human
cauugccaagcauuuaaaaga

SEQ ID NO: 410129 - RNA, 23 nt, Human
cccacuaucaaaccaucaaugga

SEQ ID NO: 410130 - RNA, 26 nt, Human
cucauguagcaaaaaaaaaaaaaauc

SEQ ID NO: 410131 - RNA, 18 nt, Human
gacaaaggaaucaagucu

SEQ ID NO: 410132 - RNA, 21 nt, Human
uagaaagagccauauacauuu

SEQ ID NO: 410133 - RNA, 23 nt, Human
uauuuugugcuuuuucaguaucu

SEQ ID NO: 410134 - RNA, 20 nt, Human
ucaggaacuauauuaaauuc

SEQ ID NO: 410135 - RNA, 22 nt, Human
ucaguuuguaacuuugaccuuu

SEQ ID NO: 410136 - RNA, 23 nt, Human
ucauguagcaaaaaaaaaaaaaa

SEQ ID NO: 410137 - RNA, 22 nt, Human
ucuacuugacugcuuaccaccu

SEQ ID NO: 410138 - RNA, 22 nt, Human
uggaugaagaaaagggccuuuu

SEQ ID NO: 410139 - RNA, 22 nt, Human
uguagcaaaaaaaaaaaaaauc

SEQ ID NO: 410140 - RNA, 24 nt, Human
uuaaaucaucuacuugacugcuua

SEQ ID NO: 410141 - RNA, 21 nt, Human
uucucaaauguugagcuucac

SEQ ID NO: 410142 - RNA, 23 nt, Human
uugccaagcauuuaaaagauaaa

SEQ ID NO: 410143 - RNA, 22 nt, Human
uuuauaagucaucucagaucac

SEQ ID NO: 410144 - RNA, 18 nt, Human
uuugcuggcaaaugagau

SEQ ID NO: 410145 - RNA, 19 nt, Human
caaaaggagacccgggagc

SEQ ID NO: 410146 - RNA, 25 nt, Human
cccaggccaaaaggagacccgggag

SEQ ID NO: 410147 - RNA, 27 nt, Human
ccccaggccaaaaggagacccgggagc

SEQ ID NO: 410148 - RNA, 23 nt, Human
cucggguuaccccaggccaaaag

SEQ ID NO: 410149 - RNA, 22 nt, Human
uaccccaggccaaaaggagacu

SEQ ID NO: 410150 - RNA, 19 nt, Human
uucucagcucugcaccucg

SEQ ID NO: 410151 - RNA, 22 nt, Human
uuuguaaguuccccuaccauug

SEQ ID NO: 410152 - RNA, 22 nt, Human
uuuguaaguuccccuaccauug

SEQ ID NO: 410153 - RNA, 23 nt, Human
uuuguaaguuccccuaccauugu

SEQ ID NO: 410154 - RNA, 19 nt, Human
aaagaugauuuauuuuggu

SEQ ID NO: 410155 - RNA, 24 nt, Human
aauacuuucacaauacuuugcuug

SEQ ID NO: 410156 - RNA, 23 nt, Human
aauauuuuuccuuuuucagggaa

SEQ ID NO: 410157 - RNA, 21 nt, Human
acccaauuccaccccaguuuc

SEQ ID NO: 410158 - RNA, 21 nt, Human
aggcggcaaaguuuacgagaa

SEQ ID NO: 410159 - RNA, 23 nt, Human
agucagagagaagaggucagggu

SEQ ID NO: 410160 - RNA, 20 nt, Human
augcuccagagcuuucuggc

SEQ ID NO: 410161 - RNA, 21 nt, Human
auuuaaaacuuggcuuagaau

SEQ ID NO: 410162 - RNA, 18 nt, Human
cacuaaacucuucccacc

SEQ ID NO: 410163 - RNA, 25 nt, Human
cacuuucuucucuuguaaauuuuua

SEQ ID NO: 410164 - RNA, 20 nt, Human
ccaauuccaccccaguuuca

SEQ ID NO: 410165 - RNA, 24 nt, Human
ccaauuccaccccaguuucacacu

SEQ ID NO: 410166 - RNA, 24 nt, Human
ccaauuccaccccaguuucacacu

SEQ ID NO: 410167 - RNA, 18 nt, Human
cgagaaaaggagaaaaca

SEQ ID NO: 410168 - RNA, 25 nt, Human
cgagaaaaggagaaaacaccagaga

SEQ ID NO: 410169 - RNA, 20 nt, Human
gagaaaacaccagagagaga

SEQ ID NO: 410170 - RNA, 26 nt, Human
gcgcagccggcggugggauugaaggu

SEQ ID NO: 410171 - RNA, 20 nt, Human
gcugugaaauaugaccauaa

SEQ ID NO: 410172 - RNA, 19 nt, Human
ggagcggggaacacaaguc

SEQ ID NO: 410173 - RNA, 22 nt, Human
guugccuuaaguuggagucucc

SEQ ID NO: 410174 - RNA, 18 nt, Human
uaacacaagaagugucau

SEQ ID NO: 410175 - RNA, 21 nt, Human
uaagaaauauauagugucaau

SEQ ID NO: 410176 - RNA, 23 nt, Human
uacacaauaaaaacuuacaaaag

SEQ ID NO: 410177 - RNA, 24 nt, Human
ucaauguuauggaagcuucccuca

SEQ ID NO: 410178 - RNA, 18 nt, Human
ugaaaggggaggggagga

SEQ ID NO: 410179 - RNA, 21 nt, Human
ugaagguuaggcucuggauuu

SEQ ID NO: 410180 - RNA, 18 nt, Human
ugaccauaauaaagaugg

SEQ ID NO: 410181 - RNA, 23 nt, Human
ugagcaaugcuuaugcaacuaca

SEQ ID NO: 410182 - RNA, 21 nt, Human
ugagugaaaggggaggggagg

SEQ ID NO: 410183 - RNA, 20 nt, Human
ugcacuuuuggauuuuccuc

SEQ ID NO: 410184 - RNA, 24 nt, Human
ugccuuaaguuggagucucccuga

SEQ ID NO: 410185 - RNA, 22 nt, Human
ugcuuucacuuucuucucuugu

SEQ ID NO: 410186 - RNA, 18 nt, Human
uguaacaaagguacuucu

SEQ ID NO: 410187 - RNA, 21 nt, Human
ugugaaauaugaccauaauaa

SEQ ID NO: 410188 - RNA, 20 nt, Human
uguggucuucuuugucacag

SEQ ID NO: 410189 - RNA, 21 nt, Human
uuaaaacuuggcuuagaauac

SEQ ID NO: 410190 - RNA, 19 nt, Human
uucuauaauuuauauguau

SEQ ID NO: 410191 - RNA, 21 nt, Human
uucuauaauuuauauguauau

SEQ ID NO: 410192 - RNA, 19 nt, Human
uucucaggaucuacuugua

SEQ ID NO: 410193 - RNA, 19 nt, Human
uuuuuccuuuuucagggaa

SEQ ID NO: 410194 - RNA, 23 nt, Human
aaaaaaaauucuguccauguaaa

SEQ ID NO: 410195 - RNA, 21 nt, Human
aaaacacugccaaagcuuucc

SEQ ID NO: 410196 - RNA, 24 nt, Human
aaaagaccaaaaaaauuuuauugc

SEQ ID NO: 410197 - RNA, 24 nt, Human
aaacacauuaccaaaucccacuga

SEQ ID NO: 410198 - RNA, 26 nt, Human
aaauuggggcguguggggaagaccac

SEQ ID NO: 410199 - RNA, 26 nt, Human
aacaagccagcaacaaaccggacccc

SEQ ID NO: 410200 - RNA, 24 nt, Human
aacuucuggcaaguacuucaauau

SEQ ID NO: 410201 - RNA, 25 nt, Human
aagaaaaggugacacuuuuagauac

SEQ ID NO: 410202 - RNA, 23 nt, Human
aagcaagaaaaggacuuuaccaa

SEQ ID NO: 410203 - RNA, 25 nt, Human
aagcaagaaaaggacuuuaccaaga

SEQ ID NO: 410204 - RNA, 25 nt, Human
aagcagucccccugccucggccucc

SEQ ID NO: 410205 - RNA, 22 nt, Human
aagccagcaacaaacacaacug

SEQ ID NO: 410206 - RNA, 21 nt, Human
aagcccuacucccugccuggu

SEQ ID NO: 410207 - RNA, 26 nt, Human
acacuaagcccuacucccugccuggu

SEQ ID NO: 410208 - RNA, 22 nt, Human
accaccaacaguauuuacauga

SEQ ID NO: 410209 - RNA, 20 nt, Human
accacgcccggccugacuua

SEQ ID NO: 410210 - RNA, 21 nt, Human
accgccgcguccccccggucu

SEQ ID NO: 410211 - RNA, 24 nt, Human
acuuuguugcccaggcuggucucg

SEQ ID NO: 410212 - RNA, 25 nt, Human
acuuuguugcccaggcuggucucga

SEQ ID NO: 410213 - RNA, 18 nt, Human
agagcugucacaagaaaa

SEQ ID NO: 410214 - RNA, 23 nt, Human
agcaacugagcauccuaacuacc

SEQ ID NO: 410215 - RNA, 22 nt, Human
agcaagaaaaggacuuuaccaa

SEQ ID NO: 410216 - RNA, 19 nt, Human
agccaguguagcaagggcg

SEQ ID NO: 410217 - RNA, 25 nt, Human
aggcaagaaaaggugacacuuuuag

SEQ ID NO: 410218 - RNA, 19 nt, Human
aguacuaccugaaaauugg

SEQ ID NO: 410219 - RNA, 20 nt, Human
agugggugcaaaauaacuac

SEQ ID NO: 410220 - RNA, 23 nt, Human
auaaaagcugugaaagguaugcc

SEQ ID NO: 410221 - RNA, 21 nt, Human
auagagauggagucucacuuu

SEQ ID NO: 410222 - RNA, 21 nt, Human
auuguugaucaggcaagaaaa

SEQ ID NO: 410223 - RNA, 19 nt, Human
caaacuguacauuuaaaac

SEQ ID NO: 410224 - RNA, 22 nt, Human
caaauggccccuuguacaaaca

SEQ ID NO: 410225 - RNA, 28 nt, Human
caagcagucccccugccucggccuccca

SEQ ID NO: 410226 - RNA, 19 nt, Human
cacucacuuacaaaaagac

SEQ ID NO: 410227 - RNA, 19 nt, Human
cacuuuguugcccaggcug

SEQ ID NO: 410228 - RNA, 24 nt, Human
cacuuuguugcccaggcuggucuc

SEQ ID NO: 410229 - RNA, 22 nt, Human
cagcaacaaacacaacugaaua

SEQ ID NO: 410230 - RNA, 26 nt, Human
cagcaguaucugcuugucaccccggu

SEQ ID NO: 410231 - RNA, 25 nt, Human
cagcaguaucugcuugucggcgucg

SEQ ID NO: 410232 - RNA, 20 nt, Human
cagucccccugccucggccu

SEQ ID NO: 410233 - RNA, 22 nt, Human
cagugugcugggauuacaggug

SEQ ID NO: 410234 - RNA, 24 nt, Human
cauaagacaguguccccuaauuca

SEQ ID NO: 410235 - RNA, 19 nt, Human
caucuggaagaaucacaaa

SEQ ID NO: 410236 - RNA, 18 nt, Human
caugcuugauccuggcag

SEQ ID NO: 410237 - RNA, 22 nt, Human
ccaacaaccugaaauuucuuac

SEQ ID NO: 410238 - RNA, 21 nt, Human
ccaccaacaguauuuacauga

SEQ ID NO: 410239 - RNA, 25 nt, Human
ccacgcccggccugacuuauuuaua

SEQ ID NO: 410240 - RNA, 20 nt, Human
ccagcaacaaacacaacuga

SEQ ID NO: 410241 - RNA, 21 nt, Human
ccagugugcugggauuacagg

SEQ ID NO: 410242 - RNA, 24 nt, Human
ccagugugcugggauuacaggugu

SEQ ID NO: 410243 - RNA, 21 nt, Human
cccaaugcacaguaacucaug

SEQ ID NO: 410244 - RNA, 26 nt, Human
cccccugccucggccucccagugugc

SEQ ID NO: 410245 - RNA, 19 nt, Human
cccugccucggccucccag

SEQ ID NO: 410246 - RNA, 26 nt, Human
ccgccgcgcugccugaggcgccgucc

SEQ ID NO: 410247 - RNA, 26 nt, Human
ccgccgcuaccgccgcguccccccgg

SEQ ID NO: 410248 - RNA, 18 nt, Human
ccgcugaggucagcaagg

SEQ ID NO: 410249 - RNA, 23 nt, Human
ccucauuucaacugcuuuccuca

SEQ ID NO: 410250 - RNA, 27 nt, Human
ccucggccucccaguguugcgaccucg

SEQ ID NO: 410251 - RNA, 20 nt, Human
ccugagcucaagcagucccc

SEQ ID NO: 410252 - RNA, 21 nt, Human
ccugccucggccucccagugu

SEQ ID NO: 410253 - RNA, 22 nt, Human
ccuggguguggauggcuaacuc

SEQ ID NO: 410254 - RNA, 25 nt, Human
cgaacuccugagcucaagcaguccc

SEQ ID NO: 410255 - RNA, 20 nt, Human
cgccgcuaccgccgcguccc

SEQ ID NO: 410256 - RNA, 24 nt, Human
cgcggcgcgccggaggacgggcug

SEQ ID NO: 410257 - RNA, 23 nt, Human
cuaaauccucaaauggaauucca

SEQ ID NO: 410258 - RNA, 23 nt, Human
cuaacuucacaaaaagagcuguc

SEQ ID NO: 410259 - RNA, 19 nt, Human
cucacaccacaacugguua

SEQ ID NO: 410260 - RNA, 25 nt, Human
cugaaauacacugaauuacaggcau

SEQ ID NO: 410261 - RNA, 18 nt, Human
cugaguggcuggugucuu

SEQ ID NO: 410262 - RNA, 23 nt, Human
cugccucggccucccagugugcu

SEQ ID NO: 410263 - RNA, 18 nt, Human
cugccugguggaaaacaa

SEQ ID NO: 410264 - RNA, 26 nt, Human
cugguucucuucuuauaaaugaaucc

SEQ ID NO: 410265 - RNA, 22 nt, Human
cuuacagcagcacacucacuua

SEQ ID NO: 410266 - RNA, 18 nt, Human
cuuccuggcaaccgcuga

SEQ ID NO: 410267 - RNA, 19 nt, Human
gaaagcacuuuccuuucag

SEQ ID NO: 410268 - RNA, 25 nt, Human
gaaccugcagcuauaauucccuugg

SEQ ID NO: 410269 - RNA, 22 nt, Human
gaauccauaagacagugucccc

SEQ ID NO: 410270 - RNA, 21 nt, Human
gaauuacaggcauauucacug

SEQ ID NO: 410271 - RNA, 22 nt, Human
gagacaaugaacuucucaauca

SEQ ID NO: 410272 - RNA, 18 nt, Human
gauuacaggugugagcca

SEQ ID NO: 410273 - RNA, 21 nt, Human
gauuacaggugugagccacca

SEQ ID NO: 410274 - RNA, 22 nt, Human
gauuacaggugugagccaccac

SEQ ID NO: 410275 - RNA, 19 nt, Human
gcaaaucuccccaagugua

SEQ ID NO: 410276 - RNA, 18 nt, Human
gcaaucaaucgcaacggc

SEQ ID NO: 410277 - RNA, 21 nt, Human
gcucgcggcgcgccggaggac

SEQ ID NO: 410278 - RNA, 18 nt, Human
ggacgggcuguccgccgc

SEQ ID NO: 410279 - RNA, 20 nt, Human
ggcuaugccuggguguggau

SEQ ID NO: 410280 - RNA, 21 nt, Human
gggcggccaaggaaguggacg

SEQ ID NO: 410281 - RNA, 21 nt, Human
gugcugggauuacagguguga

SEQ ID NO: 410282 - RNA, 19 nt, Human
uaaaacacauuaccaaauc

SEQ ID NO: 410283 - RNA, 21 nt, Human
uaaaaccagagcccagguuuc

SEQ ID NO: 410284 - RNA, 19 nt, Human
uaacuucacaaaaagagcu

SEQ ID NO: 410285 - RNA, 21 nt, Human
uaacuuggccugauaaaagcu

SEQ ID NO: 410286 - RNA, 21 nt, Human
uaaguucucaaaacacugcca

SEQ ID NO: 410287 - RNA, 20 nt, Human
uacaaaaagaccaaaaaaau

SEQ ID NO: 410288 - RNA, 22 nt, Human
uacaacaagccagcaacaaaca

SEQ ID NO: 410289 - RNA, 23 nt, Human
uacaacaagccagcaacaaacac

SEQ ID NO: 410290 - RNA, 23 nt, Human
uacaggcauauucacugaaacaa

SEQ ID NO: 410291 - RNA, 23 nt, Human
uacaggugugagccaccacgccc

SEQ ID NO: 410292 - RNA, 26 nt, Human
uaccaagaaacuaacauuuacacuuu

SEQ ID NO: 410293 - RNA, 23 nt, Human
uaccugaaaauuggggcgugugg

SEQ ID NO: 410294 - RNA, 18 nt, Human
uacuucaauauucucaag

SEQ ID NO: 410295 - RNA, 22 nt, Human
uauuaaggcaacaucagaaagc

SEQ ID NO: 410296 - RNA, 22 nt, Human
ucaaauggaauuccaagaccag

SEQ ID NO: 410297 - RNA, 18 nt, Human
ucaagguaagcaagaaaa

SEQ ID NO: 410298 - RNA, 19 nt, Human
ucaagguauaacacacaaa

SEQ ID NO: 410299 - RNA, 21 nt, Human
ucacaaacgagacaaugaacu

SEQ ID NO: 410300 - RNA, 23 nt, Human
ucagccuuuaacuuggccugaua

SEQ ID NO: 410301 - RNA, 23 nt, Human
ucccagugugcugggauuacagg

SEQ ID NO: 410302 - RNA, 24 nt, Human
ucccagugugcugggauuacaggu

SEQ ID NO: 410303 - RNA, 26 nt, Human
ucccagugugcugggauuacaggugu

SEQ ID NO: 410304 - RNA, 24 nt, Human
uccccaaguguauauggcugguuc

SEQ ID NO: 410305 - RNA, 19 nt, Human
ucccccugccucggccucc

SEQ ID NO: 410306 - RNA, 22 nt, Human
ucccccugccucggccucccag

SEQ ID NO: 410307 - RNA, 21 nt, Human
ucccuuggcaaaagaauucaa

SEQ ID NO: 410308 - RNA, 22 nt, Human
ucccuuggcaaaagaauucaac

SEQ ID NO: 410309 - RNA, 20 nt, Human
uccgccgcgcugccugaggc

SEQ ID NO: 410310 - RNA, 21 nt, Human
uccgccgcgcugccugaggcg

SEQ ID NO: 410311 - RNA, 19 nt, Human
ucucacuuuguugcccagg

SEQ ID NO: 410312 - RNA, 22 nt, Human
ucucacuuuguugcccaggcug

SEQ ID NO: 410313 - RNA, 23 nt, Human
ucucacuuuguugcccaggcugg

SEQ ID NO: 410314 - RNA, 26 nt, Human
ucucacuuuguugcccaggcuggucu

SEQ ID NO: 410315 - RNA, 27 nt, Human
ucucacuuuguugcccaggcuggucuc

SEQ ID NO: 410316 - RNA, 24 nt, Human
ucucgaacuccugagcucaagcag

SEQ ID NO: 410317 - RNA, 21 nt, Human
ucuuacgccacgaccgucgcu

SEQ ID NO: 410318 - RNA, 20 nt, Human
ugaaacaacaaaaaaaauuc

SEQ ID NO: 410319 - RNA, 22 nt, Human
ugacuacuaggaaaaagguuuc

SEQ ID NO: 410320 - RNA, 24 nt, Human
ugcaauagcagaauauuaaggcaa

SEQ ID NO: 410321 - RNA, 19 nt, Human
ugccaaagcuuuccuucuc

SEQ ID NO: 410322 - RNA, 24 nt, Human
ugcccaggcuggucucgaacuccu

SEQ ID NO: 410323 - RNA, 28 nt, Human
ugcccaggcuggucucgaacuccugagc

SEQ ID NO: 410324 - RNA, 21 nt, Human
ugccucggccucccagugugc

SEQ ID NO: 410325 - RNA, 24 nt, Human
ugccucggccucccagugugcugg

SEQ ID NO: 410326 - RNA, 24 nt, Human
ugcugggauuacaggugugagcca

SEQ ID NO: 410327 - RNA, 18 nt, Human
uggaagaaucacaaacga

SEQ ID NO: 410328 - RNA, 24 nt, Human
uggagucucacuuuguugcccagg

SEQ ID NO: 410329 - RNA, 18 nt, Human
ugggauuacaggugugag

SEQ ID NO: 410330 - RNA, 19 nt, Human
ugggauuacaggugugagc

SEQ ID NO: 410331 - RNA, 22 nt, Human
ugggauuacaggugugagccac

SEQ ID NO: 410332 - RNA, 23 nt, Human
ugggauuacaggugugagccacc

SEQ ID NO: 410333 - RNA, 24 nt, Human
ugggauuacaggugugagccacca

SEQ ID NO: 410334 - RNA, 20 nt, Human
uguagcaagggcggccaagg

SEQ ID NO: 410335 - RNA, 21 nt, Human
ugugagccaccacgcccggcc

SEQ ID NO: 410336 - RNA, 21 nt, Human
uguggggaagaccaccaacag

SEQ ID NO: 410337 - RNA, 22 nt, Human
uguugcccaggcuggucucgaa

SEQ ID NO: 410338 - RNA, 20 nt, Human
uuaaaacugaaauccacaac

SEQ ID NO: 410339 - RNA, 24 nt, Human
uuaaucaucucaauucaauagcaa

SEQ ID NO: 410340 - RNA, 23 nt, Human
uuacaacaagccagcaacaaaca

SEQ ID NO: 410341 - RNA, 23 nt, Human
uuagccucaaaaaauauucagaa

SEQ ID NO: 410342 - RNA, 23 nt, Human
uucaacugcuuuccucaugauga

SEQ ID NO: 410343 - RNA, 26 nt, Human
uucaauucugauacucacaccacaac

SEQ ID NO: 410344 - RNA, 19 nt, Human
uucuggaaagcacuuuccu

SEQ ID NO: 410345 - RNA, 21 nt, Human
uugacuucgcaguuuaaucuu

SEQ ID NO: 410346 - RNA, 19 nt, Human
uuuccuggcacauacucuu

SEQ ID NO: 410347 - RNA, 25 nt, Human
uuucuuacagcagcacacucacuua

SEQ ID NO: 410348 - RNA, 24 nt, Human
uuuguugcccaggcuggucucgaa

SEQ ID NO: 410349 - RNA, 22 nt, Human
aaaaaaaacaaaaaauaaaugg

SEQ ID NO: 410350 - RNA, 19 nt, Human
aaaaauaaaacccaguauc

SEQ ID NO: 410351 - RNA, 19 nt, Human
aaaaauaaauggagaaagc

SEQ ID NO: 410352 - RNA, 19 nt, Human
aaaaccaacuggaaauguc

SEQ ID NO: 410353 - RNA, 23 nt, Human
aaaauaaauggagaaagcaacau

SEQ ID NO: 410354 - RNA, 20 nt, Human
aaacagagcuaaucuuucaa

SEQ ID NO: 410355 - RNA, 24 nt, Human
aaagugcugggauuacaggcguga

SEQ ID NO: 410356 - RNA, 21 nt, Human
aaaugcuagaauaggaaagcc

SEQ ID NO: 410357 - RNA, 22 nt, Human
aaauuacaaauugcuuccacua

SEQ ID NO: 410358 - RNA, 21 nt, Human
aacuuaguauuucaaaacuuc

SEQ ID NO: 410359 - RNA, 24 nt, Human
aaguagcugggauuacaggcacau

SEQ ID NO: 410360 - RNA, 25 nt, Human
aaguagcugggauuacaggcacaua

SEQ ID NO: 410361 - RNA, 19 nt, Human
aagugcugggauuacaggc

SEQ ID NO: 410362 - RNA, 19 nt, Human
aagugcugggauuacaggc

SEQ ID NO: 410363 - RNA, 26 nt, Human
aagugcugggauuacaggcgugagcc

SEQ ID NO: 410364 - RNA, 21 nt, Human
aauaggaaagccuccaaacau

SEQ ID NO: 410365 - RNA, 24 nt, Human
acaaauugcuuccacuaaaaauua

SEQ ID NO: 410366 - RNA, 20 nt, Human
acccaggcuggagugcagug

SEQ ID NO: 410367 - RNA, 18 nt, Human
acgagguuucgccacguu

SEQ ID NO: 410368 - RNA, 20 nt, Human
acgagguuucgccacguugg

SEQ ID NO: 410369 - RNA, 24 nt, Human
acgagguuucgccacguuggucag

SEQ ID NO: 410370 - RNA, 19 nt, Human
agcaagaggagugcgcgag

SEQ ID NO: 410371 - RNA, 21 nt, Human
agccaccacgcccagccuaaa

SEQ ID NO: 410372 - RNA, 24 nt, Human
agcggagacugaaggaccuggagc

SEQ ID NO: 410373 - RNA, 20 nt, Human
aggcacauaccaccauaucc

SEQ ID NO: 410374 - RNA, 25 nt, Human
aggcuggagugcaguggcgcaaucu

SEQ ID NO: 410375 - RNA, 21 nt, Human
agggaaccugggaaaacagcc

SEQ ID NO: 410376 - RNA, 20 nt, Human
agugcaguggcgcaaucucg

SEQ ID NO: 410377 - RNA, 24 nt, Human
agugcaguggcgcaaucucggcuc

SEQ ID NO: 410378 - RNA, 18 nt, Human
agugcugggauuacaggc

SEQ ID NO: 410379 - RNA, 22 nt, Human
aucuucuuuggcaacuuuauua

SEQ ID NO: 410380 - RNA, 22 nt, Human
auuaccauuguuauucucaacu

SEQ ID NO: 410381 - RNA, 23 nt, Human
caaaaaauaaauggagaaagcaa

SEQ ID NO: 410382 - RNA, 28 nt, Human
caaaagguacacucugaagccggggccc

SEQ ID NO: 410383 - RNA, 24 nt, Human
caaagugcugggauuacaggcgug

SEQ ID NO: 410384 - RNA, 25 nt, Human
caacuuuaccaacaaaaauauuaua

SEQ ID NO: 410385 - RNA, 26 nt, Human
caacuuuauuaacaccaugggacaac

SEQ ID NO: 410386 - RNA, 20 nt, Human
caagaggagugcgcgaggua

SEQ ID NO: 410387 - RNA, 22 nt, Human
caagcgagucuccugccucagc

SEQ ID NO: 410388 - RNA, 22 nt, Human
cacaauaaaguuaaaugaaaua

SEQ ID NO: 410389 - RNA, 24 nt, Human
caccauauccagcuaauuuuugua

SEQ ID NO: 410390 - RNA, 18 nt, Human
cacugcaaccucugccuc

SEQ ID NO: 410391 - RNA, 21 nt, Human
cacugcaaccucugccuccca

SEQ ID NO: 410392 - RNA, 21 nt, Human
cagcaaaaauucaaaaaggca

SEQ ID NO: 410393 - RNA, 24 nt, Human
cauaccaccauauccagcuaauuu

SEQ ID NO: 410394 - RNA, 22 nt, Human
cauggaauaagccuauuuuuga

SEQ ID NO: 410395 - RNA, 20 nt, Human
ccaaagugcugggauuacag

SEQ ID NO: 410396 - RNA, 22 nt, Human
ccaaagugcugggauuacaggc

SEQ ID NO: 410397 - RNA, 22 nt, Human
ccaaagugcugggauuacaggc

SEQ ID NO: 410398 - RNA, 24 nt, Human
ccaaagugcugggauuacaggcgu

SEQ ID NO: 410399 - RNA, 22 nt, Human
ccaacuggaaaugucugguugu

SEQ ID NO: 410400 - RNA, 23 nt, Human
ccaaguagcugggauuacaggca

SEQ ID NO: 410401 - RNA, 21 nt, Human
ccaauucuaaauauuacuaac

SEQ ID NO: 410402 - RNA, 22 nt, Human
ccacgcccagccuaaacuugua

SEQ ID NO: 410403 - RNA, 19 nt, Human
ccacguuggucaggcuggu

SEQ ID NO: 410404 - RNA, 21 nt, Human
ccacguuggucaggcuggucu

SEQ ID NO: 410405 - RNA, 23 nt, Human
cccaaguagcugggauuacaggc

SEQ ID NO: 410406 - RNA, 24 nt, Human
cccaaguagcugggauuacaggca

SEQ ID NO: 410407 - RNA, 23 nt, Human
cccagguucaagcgagucucccc

SEQ ID NO: 410408 - RNA, 23 nt, Human
cccagguucaagcgagucuccug

SEQ ID NO: 410409 - RNA, 23 nt, Human
ccuacggugagacgagcggagac

SEQ ID NO: 410410 - RNA, 21 nt, Human
ccucccagguucaagcgaguc

SEQ ID NO: 410411 - RNA, 24 nt, Human
ccucccagguucaagcgagucucc

SEQ ID NO: 410412 - RNA, 23 nt, Human
ccugccucagccucccaaguagc

SEQ ID NO: 410413 - RNA, 24 nt, Human
ccugccucagccucccaaguagcu

SEQ ID NO: 410414 - RNA, 24 nt, Human
cgagguuucgccacguuggucagg

SEQ ID NO: 410415 - RNA, 23 nt, Human
cgauauuaacaagaaauuuaaac

SEQ ID NO: 410416 - RNA, 22 nt, Human
cuaaaaauuaucacuccaaacu

SEQ ID NO: 410417 - RNA, 24 nt, Human
cucacugcaaccucugccucccag

SEQ ID NO: 410418 - RNA, 24 nt, Human
cucacugcaaccucugccucccag

SEQ ID NO: 410419 - RNA, 24 nt, Human
cucagccucccaaguagcugggau

SEQ ID NO: 410420 - RNA, 22 nt, Human
cucuugaccucgugaucugccu

SEQ ID NO: 410421 - RNA, 23 nt, Human
cugcaaccucugccucccagguu

SEQ ID NO: 410422 - RNA, 24 nt, Human
cugcaaccucugccucccagguuc

SEQ ID NO: 410423 - RNA, 23 nt, Human
cuggagcaagaggagugcgcgag

SEQ ID NO: 410424 - RNA, 24 nt, Human
cuggagcaagaggagugcgcgagg

SEQ ID NO: 410425 - RNA, 26 nt, Human
cugugauuaaaaaaaaaccggggucc

SEQ ID NO: 410426 - RNA, 19 nt, Human
cuuacaaaaccaacuggaa

SEQ ID NO: 410427 - RNA, 21 nt, Human
cuugcucuguuacccaggcug

SEQ ID NO: 410428 - RNA, 24 nt, Human
cuugcucuguuacccaggcuggag

SEQ ID NO: 410429 - RNA, 21 nt, Human
cuuucaaaaaauaaaacccag

SEQ ID NO: 410430 - RNA, 18 nt, Human
cuuucuuucuuuuuuuga

SEQ ID NO: 410431 - RNA, 26 nt, Human
gaaucagcccuuacaaacagagcuaa

SEQ ID NO: 410432 - RNA, 22 nt, Human
gaccucgugaucugccuaccuc

SEQ ID NO: 410433 - RNA, 22 nt, Human
gaccucgugaucugccuaccuc

SEQ ID NO: 410434 - RNA, 24 nt, Human
gaccucgugaucugccuaccucgg

SEQ ID NO: 410435 - RNA, 20 nt, Human
gaccuggagcaagaggagug

SEQ ID NO: 410436 - RNA, 21 nt, Human
gacgcucauguccagaaguuu

SEQ ID NO: 410437 - RNA, 24 nt, Human
gauuacaggcacauaccaccauau

SEQ ID NO: 410438 - RNA, 18 nt, Human
gauuacaggcgugagcca

SEQ ID NO: 410439 - RNA, 21 nt, Human
gauuacaggcgugagccacca

SEQ ID NO: 410440 - RNA, 22 nt, Human
gauuacaggcgugagccaccac

SEQ ID NO: 410441 - RNA, 24 nt, Human
gccacguuggucaggcuggucuug

SEQ ID NO: 410442 - RNA, 24 nt, Human
gcgagucuccugccucagccuccc

SEQ ID NO: 410443 - RNA, 25 nt, Human
gcucuguuacccaggcuggagugca

SEQ ID NO: 410444 - RNA, 19 nt, Human
gcuggagugcaguggcgca

SEQ ID NO: 410445 - RNA, 21 nt, Human
ggaaagccuccaaacaugccu

SEQ ID NO: 410446 - RNA, 19 nt, Human
ggauuacaggcgugagcca

SEQ ID NO: 410447 - RNA, 18 nt, Human
guagcugggauuacaggc

SEQ ID NO: 410448 - RNA, 23 nt, Human
uaaagguuaaccagcaaaaauuc

SEQ ID NO: 410449 - RNA, 23 nt, Human
uaacaaaaacaaaaauugcuaaa

SEQ ID NO: 410450 - RNA, 18 nt, Human
uaacaccaugggacaacu

SEQ ID NO: 410451 - RNA, 21 nt, Human
uaacaccaugggacaacuaaa

SEQ ID NO: 410452 - RNA, 24 nt, Human
uaauuuuuguauuucuaguagaga

SEQ ID NO: 410453 - RNA, 21 nt, Human
uacaaacagagcuaaucuuuc

SEQ ID NO: 410454 - RNA, 24 nt, Human
uacaggcgugagccaccacgccca

SEQ ID NO: 410455 - RNA, 21 nt, Human
uacccaggcuggagugcagug

SEQ ID NO: 410456 - RNA, 24 nt, Human
uacccaggcuggagugcaguggcg

SEQ ID NO: 410457 - RNA, 24 nt, Human
uaccucggccucccaaagugcugg

SEQ ID NO: 410458 - RNA, 19 nt, Human
uacuaggcauguccauguu

SEQ ID NO: 410459 - RNA, 24 nt, Human
uaguagagacgagguuucgccacg

SEQ ID NO: 410460 - RNA, 22 nt, Human
uauaugcaaacaucuguaugca

SEQ ID NO: 410461 - RNA, 20 nt, Human
uauguaaaagccacaauaaa

SEQ ID NO: 410462 - RNA, 21 nt, Human
uauuucaaaacuucauuauaa

SEQ ID NO: 410463 - RNA, 20 nt, Human
uauuuucuuuagguguuuuu

SEQ ID NO: 410464 - RNA, 19 nt, Human
ucacugcaaccucugccuc

SEQ ID NO: 410465 - RNA, 24 nt, Human
ucacugcaaccucugccucccagg

SEQ ID NO: 410466 - RNA, 25 nt, Human
ucacugcaaccucugccucccaggu

SEQ ID NO: 410467 - RNA, 18 nt, Human
ucagccagaaugcgaauu

SEQ ID NO: 410468 - RNA, 18 nt, Human
ucagccucccaaguagcu

SEQ ID NO: 410469 - RNA, 18 nt, Human
ucaguaggcaaauuccaa

SEQ ID NO: 410470 - RNA, 22 nt, Human
uccacuaaaaauuaucacucca

SEQ ID NO: 410471 - RNA, 22 nt, Human
uccauggaauaagccuauuuuu

SEQ ID NO: 410472 - RNA, 24 nt, Human
ucccaaagugcugggauuacaggc

SEQ ID NO: 410473 - RNA, 24 nt, Human
ucccaaguagcugggauuacaggc

SEQ ID NO: 410474 - RNA, 21 nt, Human
ucccagguucaagcgagucuc

SEQ ID NO: 410475 - RNA, 24 nt, Human
ucccagguucaagcgagucuccug

SEQ ID NO: 410476 - RNA, 18 nt, Human
ucggccucccaaagugcu

SEQ ID NO: 410477 - RNA, 21 nt, Human
ucuaucagaccuacugugaag

SEQ ID NO: 410478 - RNA, 23 nt, Human
ucuaucagaccuacugugauuaa

SEQ ID NO: 410479 - RNA, 21 nt, Human
ucucaaaacuuacaaaaccaa

SEQ ID NO: 410480 - RNA, 26 nt, Human
ucuccugccucagccucccaaguagc

SEQ ID NO: 410481 - RNA, 21 nt, Human
ucugguugucaugcucaauuc

SEQ ID NO: 410482 - RNA, 24 nt, Human
ucuguuacccaggcuggagugcag

SEQ ID NO: 410483 - RNA, 23 nt, Human
ucuugcucuguuacccaggcugg

SEQ ID NO: 410484 - RNA, 24 nt, Human
ucuugcucuguuacccaggcugga

SEQ ID NO: 410485 - RNA, 24 nt, Human
ucuuucuuucuuuuuuugagaugg

SEQ ID NO: 410486 - RNA, 20 nt, Human
ugaauuguucauaauacauc

SEQ ID NO: 410487 - RNA, 22 nt, Human
ugagacgagcggagacugaagg

SEQ ID NO: 410488 - RNA, 22 nt, Human
ugagauggagucuugcucuguu

SEQ ID NO: 410489 - RNA, 24 nt, Human
ugaucugccuaccucggccuccca

SEQ ID NO: 410490 - RNA, 22 nt, Human
ugcaguggcgcaaucucggcuc

SEQ ID NO: 410491 - RNA, 23 nt, Human
ugcaguggcgcaaucucggcuca

SEQ ID NO: 410492 - RNA, 19 nt, Human
ugccuaauauaacaaaaac

SEQ ID NO: 410493 - RNA, 24 nt, Human
ugccucagccucccaaguagcugg

SEQ ID NO: 410494 - RNA, 23 nt, Human
ugcuagaauaggaaagccuccaa

SEQ ID NO: 410495 - RNA, 24 nt, Human
ugcucuguuacccaggcuggagug

SEQ ID NO: 410496 - RNA, 24 nt, Human
ugcugggauuacaggcgugagcca

SEQ ID NO: 410497 - RNA, 19 nt, Human
uggagaaagcaacaucugg

SEQ ID NO: 410498 - RNA, 23 nt, Human
uggagugcaguggcgcaaucucg

SEQ ID NO: 410499 - RNA, 24 nt, Human
uggagugcaguggcgcaaucucgg

SEQ ID NO: 410500 - RNA, 20 nt, Human
uggccggaagucuccucucc

SEQ ID NO: 410501 - RNA, 22 nt, Human
ugggaaaacagccugcagaaaa

SEQ ID NO: 410502 - RNA, 21 nt, Human
ugggauuacaggcacauacca

SEQ ID NO: 410503 - RNA, 22 nt, Human
ugggauuacaggcacauaccac

SEQ ID NO: 410504 - RNA, 24 nt, Human
ugggauuacaggcacauaccacca

SEQ ID NO: 410505 - RNA, 25 nt, Human
ugggauuacaggcacauaccaccau

SEQ ID NO: 410506 - RNA, 18 nt, Human
ugggauuacaggcgugag

SEQ ID NO: 410507 - RNA, 19 nt, Human
ugggauuacaggcgugagc

SEQ ID NO: 410508 - RNA, 22 nt, Human
ugggauuacaggcgugagccac

SEQ ID NO: 410509 - RNA, 23 nt, Human
ugggauuacaggcgugagccacc

SEQ ID NO: 410510 - RNA, 24 nt, Human
ugggauuacaggcgugagccacca

SEQ ID NO: 410511 - RNA, 24 nt, Human
uggucaggcuggucuugaucucuu

SEQ ID NO: 410512 - RNA, 21 nt, Human
uguuacccaggcuggagugca

SEQ ID NO: 410513 - RNA, 24 nt, Human
uugcucuguuacccaggcuggagu

SEQ ID NO: 410514 - RNA, 23 nt, Human
uugcugaauuguucauaauacau

SEQ ID NO: 410515 - RNA, 20 nt, Human
uuucacaucacaaguaauca

SEQ ID NO: 410516 - RNA, 21 nt, Human
uuucgccacguuggucaggcu

SEQ ID NO: 410517 - RNA, 24 nt, Human
uuucuaguagagacgagguuucgc

SEQ ID NO: 410518 - RNA, 24 nt, Human
uuuuugagauggagucuugcucug

SEQ ID NO: 410519 - RNA, 20 nt, Human
uuuuuguauuucuaguagag

SEQ ID NO: 410520 - RNA, 23 nt, Human
uuuuuguauuucuaguagagacg

SEQ ID NO: 410521 - RNA, 23 nt, Human
uuuuuuuuuuuuuuuuuacuagg

SEQ ID NO: 410522 - RNA, 23 nt, Human
uuuuuuuuuuuuuuuuuuacuag

SEQ ID NO: 410523 - RNA, 26 nt, Human
aaaaccucuuccgcucugaggcacuc

SEQ ID NO: 410524 - RNA, 22 nt, Human
aauuauuucccuuacccucccc

SEQ ID NO: 410525 - RNA, 24 nt, Human
acaccaaggccugugcugcccgac

SEQ ID NO: 410526 - RNA, 22 nt, Human
agccacacugguccguggcaac

SEQ ID NO: 410527 - RNA, 21 nt, Human
aggagcaacagggaagaaggc

SEQ ID NO: 410528 - RNA, 24 nt, Human
auggggaggcgcgauuugcagaga

SEQ ID NO: 410529 - RNA, 21 nt, Human
auguaugaucuccuuucgccu

SEQ ID NO: 410530 - RNA, 22 nt, Human
caaagagucacaucgacgccga

SEQ ID NO: 410531 - RNA, 22 nt, Human
cacacucccuuaaaaauagcuu

SEQ ID NO: 410532 - RNA, 23 nt, Human
cacauuuacccccucuuccugaa

SEQ ID NO: 410533 - RNA, 24 nt, Human
caccugucaggacaagguggagaa

SEQ ID NO: 410534 - RNA, 20 nt, Human
cacugguccguggcaacucc

SEQ ID NO: 410535 - RNA, 22 nt, Human
cagcaaucacacucccuuaaaa

SEQ ID NO: 410536 - RNA, 23 nt, Human
cauuccauacaauccacauuuac

SEQ ID NO: 410537 - RNA, 26 nt, Human
ccacuacccauccugggagccaccug

SEQ ID NO: 410538 - RNA, 21 nt, Human
cccaaagagucacaucgacgc

SEQ ID NO: 410539 - RNA, 22 nt, Human
ccccaaacgucugcugcucggc

SEQ ID NO: 410540 - RNA, 23 nt, Human
ccccaaagagucacaucgacgcc

SEQ ID NO: 410541 - RNA, 23 nt, Human
cccccgcuaaacccucuagcccc

SEQ ID NO: 410542 - RNA, 22 nt, Human
cccgcuaaacccucuagcccca

SEQ ID NO: 410543 - RNA, 23 nt, Human
cccguuggcaaugauccacccac

SEQ ID NO: 410544 - RNA, 26 nt, Human
cccucuagccccagucuuccuggccu

SEQ ID NO: 410545 - RNA, 22 nt, Human
cccuuaaaaauagcuucauuca

SEQ ID NO: 410546 - RNA, 23 nt, Human
ccguggcaacuccccuuuguucc

SEQ ID NO: 410547 - RNA, 19 nt, Human
ccuccccguccccguaaac

SEQ ID NO: 410548 - RNA, 23 nt, Human
ccuggccucaccuccaggcugac

SEQ ID NO: 410549 - RNA, 24 nt, Human
ccuguauucuacagagacaggagu

SEQ ID NO: 410550 - RNA, 25 nt, Human
ccuuccacuacccauccugggagcc

SEQ ID NO: 410551 - RNA, 23 nt, Human
cgauggaagggaaagcgaggagc

SEQ ID NO: 410552 - RNA, 25 nt, Human
cggcaucaccaaggguuucucugcc

SEQ ID NO: 410553 - RNA, 19 nt, Human
cuaagagcacccagaggcu

SEQ ID NO: 410554 - RNA, 20 nt, Human
cugaaggcggugcccuccuu

SEQ ID NO: 410555 - RNA, 21 nt, Human
cugcccgacccacgccacaga

SEQ ID NO: 410556 - RNA, 21 nt, Human
cuuccuggccucaccuccagg

SEQ ID NO: 410557 - RNA, 18 nt, Human
cuuuauucuggaaguagg

SEQ ID NO: 410558 - RNA, 18 nt, Human
cuuuccacagccacacug

SEQ ID NO: 410559 - RNA, 24 nt, Human
gaaagaacaacaugaucuugcaga

SEQ ID NO: 410560 - RNA, 18 nt, Human
gaaugaauuauuucccuu

SEQ ID NO: 410561 - RNA, 21 nt, Human
gagcacccagaggcuggggua

SEQ ID NO: 410562 - RNA, 21 nt, Human
gagcugcccaucggucacuua

SEQ ID NO: 410563 - RNA, 19 nt, Human
gcagagacuugcugguguc

SEQ ID NO: 410564 - RNA, 19 nt, Human
gcuuauagccgaagacgcc

SEQ ID NO: 410565 - RNA, 18 nt, Human
ggagccaccugucaccug

SEQ ID NO: 410566 - RNA, 21 nt, Human
ggcuggaucccguuggcaaug

SEQ ID NO: 410567 - RNA, 25 nt, Human
gggaaagcgaggagcaaccgguacc

SEQ ID NO: 410568 - RNA, 18 nt, Human
uaagagcacccagaggcu

SEQ ID NO: 410569 - RNA, 19 nt, Human
uaagagcacccagaggcug

SEQ ID NO: 410570 - RNA, 24 nt, Human
uagcaaggggcagcaaucacacuc

SEQ ID NO: 410571 - RNA, 18 nt, Human
uaggggauuucucagauc

SEQ ID NO: 410572 - RNA, 23 nt, Human
uauuucccuuacccucccccgcu

SEQ ID NO: 410573 - RNA, 22 nt, Human
ucaaaaagaugccccaaacguc

SEQ ID NO: 410574 - RNA, 23 nt, Human
ucaaagagacuuuacacacgaug

SEQ ID NO: 410575 - RNA, 24 nt, Human
uccacuucauaauccggauaccac

SEQ ID NO: 410576 - RNA, 23 nt, Human
uccauacaauccacauuuacccc

SEQ ID NO: 410577 - RNA, 25 nt, Human
uccauacaauccacauuuacccccu

SEQ ID NO: 410578 - RNA, 27 nt, Human
uccuugguaaucacuuuauucuggaag

SEQ ID NO: 410579 - RNA, 19 nt, Human
ucucugccgcaugcaggac

SEQ ID NO: 410580 - RNA, 25 nt, Human
ucucuuuuuccuuuaguuccugugc

SEQ ID NO: 410581 - RNA, 18 nt, Human
ucugauuuaggucaaaga

SEQ ID NO: 410582 - RNA, 22 nt, Human
ucugcuuauagccgaagacgcc

SEQ ID NO: 410583 - RNA, 24 nt, Human
ucuuccuggccucaccuccaggcu

SEQ ID NO: 410584 - RNA, 23 nt, Human
ucuugcuuacaggaaugaauuau

SEQ ID NO: 410585 - RNA, 21 nt, Human
ugacucgaucucuuuuuccuu

SEQ ID NO: 410586 - RNA, 22 nt, Human
ugauccacccaccaucuuccuu

SEQ ID NO: 410587 - RNA, 20 nt, Human
ugaucuccuuucgccucccc

SEQ ID NO: 410588 - RNA, 22 nt, Human
ugcugaguacugccguccugca

SEQ ID NO: 410589 - RNA, 20 nt, Human
ugggaagggggcuggauccc

SEQ ID NO: 410590 - RNA, 21 nt, Human
ugggagccaccugucaccugu

SEQ ID NO: 410591 - RNA, 21 nt, Human
ugguccguggcaacuccccuu

SEQ ID NO: 410592 - RNA, 21 nt, Human
uuccccgagagcaccucucca

SEQ ID NO: 410593 - RNA, 21 nt, Human
uucccuuacccucccccgcua

SEQ ID NO: 410594 - RNA, 25 nt, Human
uuccuugguaaucacuuuauucugg

SEQ ID NO: 410595 - RNA, 19 nt, Human
uuuccacagccacacuggu

SEQ ID NO: 410596 - RNA, 23 nt, Human
uuuugugggaagggggcuggauc

SEQ ID NO: 410597 - RNA, 19 nt, Human
agaaaagcaaacuggccaa

SEQ ID NO: 410598 - RNA, 24 nt, Human
agacuauaaaauaugugacuacaa

SEQ ID NO: 410599 - RNA, 23 nt, Human
agauauuagauaguccaauaacu

SEQ ID NO: 410600 - RNA, 22 nt, Human
auucauucaaagccgguuccca

SEQ ID NO: 410601 - RNA, 25 nt, Human
auuuauucauucaaagccgguuccc

SEQ ID NO: 410602 - RNA, 21 nt, Human
cacagugaugcaaaaacaaga

SEQ ID NO: 410603 - RNA, 24 nt, Human
cacccucccagcaggagucucacu

SEQ ID NO: 410604 - RNA, 22 nt, Human
cagcguauggcccgcggcgggc

SEQ ID NO: 410605 - RNA, 23 nt, Human
ccagcgccuuucacaccagcccc

SEQ ID NO: 410606 - RNA, 22 nt, Human
cccagcgccuuucacaccagcc

SEQ ID NO: 410607 - RNA, 23 nt, Human
ccucgguccgacucguccagcgu

SEQ ID NO: 410608 - RNA, 21 nt, Human
ccugcccgcccauuccugggc

SEQ ID NO: 410609 - RNA, 26 nt, Human
cgaaauaaauacauagauauuagaua

SEQ ID NO: 410610 - RNA, 21 nt, Human
cgccggccacguccuagccuc

SEQ ID NO: 410611 - RNA, 18 nt, Human
cgcgggacugggagcggc

SEQ ID NO: 410612 - RNA, 24 nt, Human
cgggcggugacggcgccggcucuu

SEQ ID NO: 410613 - RNA, 25 nt, Human
cuccacccucccagcaggagucuca

SEQ ID NO: 410614 - RNA, 18 nt, Human
cugagccacagccggaug

SEQ ID NO: 410615 - RNA, 19 nt, Human
cuucugcugcagggcugga

SEQ ID NO: 410616 - RNA, 20 nt, Human
gccggccacguccuagccuc

SEQ ID NO: 410617 - RNA, 25 nt, Human
gcgcacgggaaguucuucugcugca

SEQ ID NO: 410618 - RNA, 20 nt, Human
ggaugguagaaaagcaaacu

SEQ ID NO: 410619 - RNA, 19 nt, Human
ggcacagugaugcaaaaac

SEQ ID NO: 410620 - RNA, 24 nt, Human
ggccaagugauuuauuugcaaugg

SEQ ID NO: 410621 - RNA, 20 nt, Human
gggagcggcaaugcgggcgg

SEQ ID NO: 410622 - RNA, 18 nt, Human
gucgugccgagcgcggga

SEQ ID NO: 410623 - RNA, 22 nt, Human
uaaaauaugugacuacaaagaa

SEQ ID NO: 410624 - RNA, 22 nt, Human
uaaauacauagauauuagauag

SEQ ID NO: 410625 - RNA, 21 nt, Human
uccugggccuccacccuccca

SEQ ID NO: 410626 - RNA, 28 nt, Human
ugacuacaaagaaccagcgaaauaaaua

SEQ ID NO: 410627 - RNA, 19 nt, Human
ugggccuccacccucccag

SEQ ID NO: 410628 - RNA, 19 nt, Human
ugguagaaaagcaaacugg

SEQ ID NO: 410629 - RNA, 19 nt, Human
uuccugggccuccacccuc

SEQ ID NO: 410630 - RNA, 19 nt, Human
acaccccacaccccaggag

SEQ ID NO: 410631 - RNA, 22 nt, Human
acaggcguggucgucucaggcc

SEQ ID NO: 410632 - RNA, 24 nt, Human
accccacaccccaggagcuucagc

SEQ ID NO: 410633 - RNA, 25 nt, Human
accccacaccccaggagcuucagca

SEQ ID NO: 410634 - RNA, 20 nt, Human
aggcguggucgucucaggcc

SEQ ID NO: 410635 - RNA, 25 nt, Human
caccggugccaccugcaggcuuccu

SEQ ID NO: 410636 - RNA, 20 nt, Human
cacugggaaggcagcaggau

SEQ ID NO: 410637 - RNA, 21 nt, Human
cagaacugcagccagggccac

SEQ ID NO: 410638 - RNA, 18 nt, Human
cagcccacaccccacacc

SEQ ID NO: 410639 - RNA, 20 nt, Human
cagcccacaccccacacccc

SEQ ID NO: 410640 - RNA, 25 nt, Human
cagccccacugggaaggcagcagga

SEQ ID NO: 410641 - RNA, 19 nt, Human
caggagcuucagcaagguc

SEQ ID NO: 410642 - RNA, 23 nt, Human
caggagcuucagcaaggucucug

SEQ ID NO: 410643 - RNA, 19 nt, Human
caguggccaggcugccccc

SEQ ID NO: 410644 - RNA, 18 nt, Human
ccacgccacaccucucuu

SEQ ID NO: 410645 - RNA, 19 nt, Human
ccagcccacaccccacacc

SEQ ID NO: 410646 - RNA, 21 nt, Human
cccaaaaccuuuauugucccu

SEQ ID NO: 410647 - RNA, 22 nt, Human
cccacaccccacaccccaggag

SEQ ID NO: 410648 - RNA, 23 nt, Human
cccacaccccacaccccaggagc

SEQ ID NO: 410649 - RNA, 19 nt, Human
ccccagggccacgccacac

SEQ ID NO: 410650 - RNA, 25 nt, Human
ccccagggccacgccacaccucucu

SEQ ID NO: 410651 - RNA, 23 nt, Human
cucaggccucggagugccccggc

SEQ ID NO: 410652 - RNA, 22 nt, Human
cucggagugccccggcauggcc

SEQ ID NO: 410653 - RNA, 26 nt, Human
cucugcuugggaggaugcugcccaga

SEQ ID NO: 410654 - RNA, 23 nt, Human
cugcagccagggccaccggugcc

SEQ ID NO: 410655 - RNA, 24 nt, Human
cuuccagcccacaccccacacccc

SEQ ID NO: 410656 - RNA, 22 nt, Human
gacccaaaaccuuuauuguccc

SEQ ID NO: 410657 - RNA, 19 nt, Human
gcaguggccagugggguca

SEQ ID NO: 410658 - RNA, 19 nt, Human
ggauggcaguggccagugg

SEQ ID NO: 410659 - RNA, 22 nt, Human
ucagcaaggucucugcuuggga

SEQ ID NO: 410660 - RNA, 20 nt, Human
ugccccggcauggccucugu

SEQ ID NO: 410661 - RNA, 19 nt, Human
ugcuuccagcccacacccc

SEQ ID NO: 410662 - RNA, 18 nt, Human
uggacagccaagcgggcc

SEQ ID NO: 410663 - RNA, 19 nt, Human
uggccucuguucagcugcu

SEQ ID NO: 410664 - RNA, 22 nt, Human
ugggugccagugguugacacug

SEQ ID NO: 410665 - RNA, 23 nt, Human
uuggcugcugggugccagugguu

SEQ ID NO: 410666 - RNA, 24 nt, Human
uuuuucagaaagacccaaaaccuu

SEQ ID NO: 410667 - RNA, 23 nt, Human
uuuuuuuuuuuuuuuuuuuucag

SEQ ID NO: 410668 - RNA, 19 nt, Human
aaaaacaugucaucuccuu

SEQ ID NO: 410669 - RNA, 21 nt, Human
ccaguguugacagagagaggg

SEQ ID NO: 410670 - RNA, 24 nt, Human
ccgcgcuggcgcucgccccccucg

SEQ ID NO: 410671 - RNA, 23 nt, Human
cgccgcgcuggcgcucgcccccc

SEQ ID NO: 410672 - RNA, 20 nt, Human
cgcuggcgcucgccccccuc

SEQ ID NO: 410673 - RNA, 26 nt, Human
cuaaaaacaugucaucuccuucaccu

SEQ ID NO: 410674 - RNA, 24 nt, Human
cuccuucaccuaagagguaagaac

SEQ ID NO: 410675 - RNA, 21 nt, Human
gcgcuggcgcucgccccccuc

SEQ ID NO: 410676 - RNA, 22 nt, Human
uacaguaagcagaagaggucac

SEQ ID NO: 410677 - RNA, 23 nt, Human
uuccaguguugacagagagaggg

SEQ ID NO: 410678 - RNA, 21 nt, Human
uuuuuuuuuuucagaaaaggc

SEQ ID NO: 410679 - RNA, 22 nt, Human
uuuuuuuuuuuuuuuuuuucag

SEQ ID NO: 410680 - RNA, 22 nt, Human
agcggauggaaugcaggcccag

SEQ ID NO: 410681 - RNA, 21 nt, Human
aggcccagguugcuggguggu

SEQ ID NO: 410682 - RNA, 18 nt, Human
caaagcgccgggccugcc

SEQ ID NO: 410683 - RNA, 20 nt, Human
caaagcgccgggccugcccc

SEQ ID NO: 410684 - RNA, 22 nt, Human
cccagggagugggaugcaggau

SEQ ID NO: 410685 - RNA, 22 nt, Human
ccggacccugguuucccugagg

SEQ ID NO: 410686 - RNA, 21 nt, Human
gacccugguuucccugaggac

SEQ ID NO: 410687 - RNA, 19 nt, Human
gcaggcccagguugcuggg

SEQ ID NO: 410688 - RNA, 21 nt, Human
gcaggcccagguugcugggug

SEQ ID NO: 410689 - RNA, 19 nt, Human
ggggagcaaagcgccgggc

SEQ ID NO: 410690 - RNA, 20 nt, Human
gugggaugcaggaucagagu

SEQ ID NO: 410691 - RNA, 25 nt, Human
ugccagccgaugguccgcuggcacc

SEQ ID NO: 410692 - RNA, 20 nt, Human
ugcuggguggugcccucagc

SEQ ID NO: 410693 - RNA, 23 nt, Human
uggaaagaugcuuggggcugcag

SEQ ID NO: 410694 - RNA, 22 nt, Human
uggaaugcaggcccagguugcu

SEQ ID NO: 410695 - RNA, 21 nt, Human
uggcaggguugacggguggug

SEQ ID NO: 410696 - RNA, 18 nt, Human
uggccgcugggcucugcc

SEQ ID NO: 410697 - RNA, 24 nt, Human
ugggaugcaggaucagaguggaca

SEQ ID NO: 410698 - RNA, 26 nt, Human
aaaugcuggaggcagccucguuagcu

SEQ ID NO: 410699 - RNA, 23 nt, Human
aacagguuuguuugguucaggag

SEQ ID NO: 410700 - RNA, 22 nt, Human
acaccagcugcacagacaccac

SEQ ID NO: 410701 - RNA, 24 nt, Human
agaggaaaucaggaaaugcuggag

SEQ ID NO: 410702 - RNA, 19 nt, Human
agccagaaucggggacacc

SEQ ID NO: 410703 - RNA, 21 nt, Human
agggaggggacagcaggcggg

SEQ ID NO: 410704 - RNA, 19 nt, Human
caacaaaugggcuucuucc

SEQ ID NO: 410705 - RNA, 19 nt, Human
caagcagcacacaauucca

SEQ ID NO: 410706 - RNA, 19 nt, Human
cacacaauuccaagucagc

SEQ ID NO: 410707 - RNA, 23 nt, Human
cacagacaccaccuuaaaaugga

SEQ ID NO: 410708 - RNA, 18 nt, Human
cagcaagcagcacacaau

SEQ ID NO: 410709 - RNA, 23 nt, Human
ccagugagggaggugacgcuaaa

SEQ ID NO: 410710 - RNA, 20 nt, Human
cccgucaucaaucaugucug

SEQ ID NO: 410711 - RNA, 21 nt, Human
cuagcuaacagcaagcagcac

SEQ ID NO: 410712 - RNA, 23 nt, Human
cucccaaccaacagguuuguuug

SEQ ID NO: 410713 - RNA, 23 nt, Human
cugcacagacaccaccuuaaaau

SEQ ID NO: 410714 - RNA, 25 nt, Human
gaaaugcuggaggcagccucguuag

SEQ ID NO: 410715 - RNA, 28 nt, Human
gacauaggacagccagaaucggggacac

SEQ ID NO: 410716 - RNA, 24 nt, Human
gaggaaaucaggaaaugcuggagg

SEQ ID NO: 410717 - RNA, 21 nt, Human
gcuguguguguguaugaucag

SEQ ID NO: 410718 - RNA, 21 nt, Human
ggacaccagcugcacagacac

SEQ ID NO: 410719 - RNA, 22 nt, Human
ggcagccucguuagcuguguga

SEQ ID NO: 410720 - RNA, 23 nt, Human
gggaacccgucaucaaucauguc

SEQ ID NO: 410721 - RNA, 21 nt, Human
uaaaauggaaaucaaauuagg

SEQ ID NO: 410722 - RNA, 21 nt, Human
uaggacagccagaaucgggga

SEQ ID NO: 410723 - RNA, 18 nt, Human
ucagccucaacaaauggg

SEQ ID NO: 410724 - RNA, 24 nt, Human
ucagggaggggacagcaggcggga

SEQ ID NO: 410725 - RNA, 18 nt, Human
ugcacagacaccaccuua

SEQ ID NO: 410726 - RNA, 18 nt, Human
ugggcuguguguguguau

SEQ ID NO: 410727 - RNA, 21 nt, Human
ugucugggcagucucccaacc

SEQ ID NO: 410728 - RNA, 27 nt, Human
uuaaaauggaaaucaaauuagguucau

SEQ ID NO: 410729 - RNA, 25 nt, Human
uucacccugaucauaaaagagggac

SEQ ID NO: 410730 - RNA, 23 nt, Human
aaaaaugcaccauuuuauuacuu

SEQ ID NO: 410731 - RNA, 19 nt, Human
aaaaggaaaaaacccucac

SEQ ID NO: 410732 - RNA, 26 nt, Human
aaaaggggaacaaacguggggaacaa

SEQ ID NO: 410733 - RNA, 23 nt, Human
aaaaucagauuacaucuauaaaa

SEQ ID NO: 410734 - RNA, 20 nt, Human
aaacagaaaaggggaacaaa

SEQ ID NO: 410735 - RNA, 25 nt, Human
aaacagaaaaggggaacaaacgugg

SEQ ID NO: 410736 - RNA, 21 nt, Human
aaagaagccacccaccucaaa

SEQ ID NO: 410737 - RNA, 20 nt, Human
aagaagccacccaccucaaa

SEQ ID NO: 410738 - RNA, 19 nt, Human
aagacaucagaacucacag

SEQ ID NO: 410739 - RNA, 21 nt, Human
aaggagacaacacaaacucaa

SEQ ID NO: 410740 - RNA, 19 nt, Human
aaucauuugagauaacaga

SEQ ID NO: 410741 - RNA, 19 nt, Human
accaaauguuuuacaugca

SEQ ID NO: 410742 - RNA, 20 nt, Human
acuuguaccuaucacuucac

SEQ ID NO: 410743 - RNA, 18 nt, Human
agaaaaggggaacaaacg

SEQ ID NO: 410744 - RNA, 21 nt, Human
agaacacugagcuccgaaaga

SEQ ID NO: 410745 - RNA, 24 nt, Human
agaacacugagcuccgaaagauuc

SEQ ID NO: 410746 - RNA, 19 nt, Human
agaggaucaucaagggcau

SEQ ID NO: 410747 - RNA, 22 nt, Human
aggaaauaacuccuaucagaac

SEQ ID NO: 410748 - RNA, 22 nt, Human
auaauaacaaucuuccuagcaa

SEQ ID NO: 410749 - RNA, 21 nt, Human
aucaucaccagcgcaucauaa

SEQ ID NO: 410750 - RNA, 24 nt, Human
aucgcaaaaaggaaaaaacccuca

SEQ ID NO: 410751 - RNA, 21 nt, Human
auuacuucuagcucuugccca

SEQ ID NO: 410752 - RNA, 19 nt, Human
caaaagccauguuuuaaaa

SEQ ID NO: 410753 - RNA, 25 nt, Human
caaacacagaacgauuguaacacag

SEQ ID NO: 410754 - RNA, 21 nt, Human
caaagagcccugcgcagcccc

SEQ ID NO: 410755 - RNA, 19 nt, Human
caaagcaagaacacuacca

SEQ ID NO: 410756 - RNA, 23 nt, Human
caaagcaagaacacuaccagucc

SEQ ID NO: 410757 - RNA, 21 nt, Human
caacacaaacucaagucagua

SEQ ID NO: 410758 - RNA, 25 nt, Human
caaggcggcauccagaccuuccauc

SEQ ID NO: 410759 - RNA, 21 nt, Human
caaucagcacugcuaaaucgc

SEQ ID NO: 410760 - RNA, 24 nt, Human
cacaaagaggagauuuggggggcc

SEQ ID NO: 410761 - RNA, 23 nt, Human
cacaauaucacaagugaagaaua

SEQ ID NO: 410762 - RNA, 22 nt, Human
cacagauaccucaggguugucu

SEQ ID NO: 410763 - RNA, 22 nt, Human
cacauauucaccaucucuacuc

SEQ ID NO: 410764 - RNA, 19 nt, Human
caccagugguagaaaauug

SEQ ID NO: 410765 - RNA, 23 nt, Human
cacccaccucaaagagcccugcg

SEQ ID NO: 410766 - RNA, 19 nt, Human
cacccauagcgcucaauuc

SEQ ID NO: 410767 - RNA, 18 nt, Human
cacugcuaaaucgcaaaa

SEQ ID NO: 410768 - RNA, 20 nt, Human
cacuguacagaugggaaaau

SEQ ID NO: 410769 - RNA, 21 nt, Human
cagaagcugcuaaggaaggca

SEQ ID NO: 410770 - RNA, 21 nt, Human
cagcucauaaacucaugacuc

SEQ ID NO: 410771 - RNA, 23 nt, Human
cagugaacaaaggcagaggaagg

SEQ ID NO: 410772 - RNA, 25 nt, Human
cauaaacacuauuacuuguaccuau

SEQ ID NO: 410773 - RNA, 18 nt, Human
caugcacguuaacaccca

SEQ ID NO: 410774 - RNA, 20 nt, Human
caugcacguuaacacccaua

SEQ ID NO: 410775 - RNA, 27 nt, Human
cauuuuauuacuucuagcucuugccca

SEQ ID NO: 410776 - RNA, 22 nt, Human
ccaaaagaagccacccaccuca

SEQ ID NO: 410777 - RNA, 20 nt, Human
ccaaaucagcucauaaacuc

SEQ ID NO: 410778 - RNA, 28 nt, Human
cccaaggaaauaacuccuaucagaacac

SEQ ID NO: 410779 - RNA, 21 nt, Human
ccccaaggcggcauccagacc

SEQ ID NO: 410780 - RNA, 23 nt, Human
ccuggccuaaccuaaauccugac

SEQ ID NO: 410781 - RNA, 18 nt, Human
cgaaagauucucgucccc

SEQ ID NO: 410782 - RNA, 19 nt, Human
cgagacguucauaguacuu

SEQ ID NO: 410783 - RNA, 22 nt, Human
cgcaaaaaggaaaaaacccuca

SEQ ID NO: 410784 - RNA, 22 nt, Human
cggcauccagaccuuccauccu

SEQ ID NO: 410785 - RNA, 23 nt, Human
cucacagugaacaaaggcagagg

SEQ ID NO: 410786 - RNA, 22 nt, Human
cucaugcacguuaacacccaua

SEQ ID NO: 410787 - RNA, 19 nt, Human
cucuaaguuaaccuguuua

SEQ ID NO: 410788 - RNA, 25 nt, Human
cugacuccacugagaacuuuccuau

SEQ ID NO: 410789 - RNA, 20 nt, Human
cugcaaacugauccucaugc

SEQ ID NO: 410790 - RNA, 20 nt, Human
cugcucucaaacacucucuu

SEQ ID NO: 410791 - RNA, 18 nt, Human
gaaagauucucgucccca

SEQ ID NO: 410792 - RNA, 18 nt, Human
gaagaggacagaagcugc

SEQ ID NO: 410793 - RNA, 25 nt, Human
gaaucuguuucaaacuaaggcguga

SEQ ID NO: 410794 - RNA, 19 nt, Human
gacacacagccucgauucc

SEQ ID NO: 410795 - RNA, 22 nt, Human
gaggacagaagcugcuaaggaa

SEQ ID NO: 410796 - RNA, 23 nt, Human
gcaaaaaggaaaaaacccucaca

SEQ ID NO: 410797 - RNA, 23 nt, Human
gcacugcuaaaucgcaaaaagga

SEQ ID NO: 410798 - RNA, 27 nt, Human
gccaaucuccuaacuccccaaggcggc

SEQ ID NO: 410799 - RNA, 23 nt, Human
gcgcagccccagugacccaugag

SEQ ID NO: 410800 - RNA, 23 nt, Human
ggaaaaaacccucacauuaucaa

SEQ ID NO: 410801 - RNA, 21 nt, Human
gggauuggugcuaaaguuuca

SEQ ID NO: 410802 - RNA, 20 nt, Human
gggcaagggggauuggugcu

SEQ ID NO: 410803 - RNA, 18 nt, Human
gucacguuucaagaucac

SEQ ID NO: 410804 - RNA, 19 nt, Human
guggaacaaagaacacauu

SEQ ID NO: 410805 - RNA, 19 nt, Human
uaaaaugcagaaucuuuga

SEQ ID NO: 410806 - RNA, 21 nt, Human
uaaaaugcagaaucuuugagg

SEQ ID NO: 410807 - RNA, 20 nt, Human
uaagacaucagaacucacag

SEQ ID NO: 410808 - RNA, 24 nt, Human
uaaggagacaacacaaacucaagu

SEQ ID NO: 410809 - RNA, 21 nt, Human
uaaggguuuuuuuuuccugaa

SEQ ID NO: 410810 - RNA, 20 nt, Human
uaccacugucuaaaagucac

SEQ ID NO: 410811 - RNA, 18 nt, Human
uacugcuucgagacguuc

SEQ ID NO: 410812 - RNA, 19 nt, Human
uaucagaacacugagcucc

SEQ ID NO: 410813 - RNA, 21 nt, Human
uaucaucaccagcgcaucaua

SEQ ID NO: 410814 - RNA, 25 nt, Human
uauucugacaguuguuggacaaaua

SEQ ID NO: 410815 - RNA, 20 nt, Human
ucaaacagaaaaggggaaca

SEQ ID NO: 410816 - RNA, 18 nt, Human
ucaagaucacuggcaacu

SEQ ID NO: 410817 - RNA, 20 nt, Human
ucaauggggggcaaggggga

SEQ ID NO: 410818 - RNA, 22 nt, Human
ucaauggggggcaagggggauu

SEQ ID NO: 410819 - RNA, 22 nt, Human
ucaccuauuuaucucuugguua

SEQ ID NO: 410820 - RNA, 19 nt, Human
ucagccaauauuuuaacau

SEQ ID NO: 410821 - RNA, 18 nt, Human
ucaucaaaguauucacuc

SEQ ID NO: 410822 - RNA, 22 nt, Human
ucaugcacguuaacacccauag

SEQ ID NO: 410823 - RNA, 21 nt, Human
ucauugucaccuauuuaucuc

SEQ ID NO: 410824 - RNA, 19 nt, Human
uccaaagcaagaacacuac

SEQ ID NO: 410825 - RNA, 22 nt, Human
uccacacacagccuguugugug

SEQ ID NO: 410826 - RNA, 21 nt, Human
uccauccuccuaucgacugcu

SEQ ID NO: 410827 - RNA, 26 nt, Human
uccccaaggcggcauccagaccuucc

SEQ ID NO: 410828 - RNA, 21 nt, Human
uccuuuuguacuugcugcugc

SEQ ID NO: 410829 - RNA, 21 nt, Human
ucuauauuuaccacugucuaa

SEQ ID NO: 410830 - RNA, 25 nt, Human
ucuccuggccuaaccuaaauccuga

SEQ ID NO: 410831 - RNA, 19 nt, Human
ucuucggauucaacacacu

SEQ ID NO: 410832 - RNA, 24 nt, Human
ucuuguggagcuaccagaacaggu

SEQ ID NO: 410833 - RNA, 21 nt, Human
ucuuugaggaaaaauauaggc

SEQ ID NO: 410834 - RNA, 24 nt, Human
ugcagaugggauuucacaaagagg

SEQ ID NO: 410835 - RNA, 19 nt, Human
ugcauuauuucacuaaucu

SEQ ID NO: 410836 - RNA, 21 nt, Human
ugcucauauucuccuauccau

SEQ ID NO: 410837 - RNA, 23 nt, Human
uggaaugugaccagaauucaugg

SEQ ID NO: 410838 - RNA, 21 nt, Human
ugggaaaaugcucacuuaaau

SEQ ID NO: 410839 - RNA, 23 nt, Human
ugggauuucacaaagaggagauu

SEQ ID NO: 410840 - RNA, 22 nt, Human
uggggaccaccguggagaaucu

SEQ ID NO: 410841 - RNA, 27 nt, Human
uguaacacagauaccucaggguugucu

SEQ ID NO: 410842 - RNA, 23 nt, Human
uguacaaaacacacucauucaac

SEQ ID NO: 410843 - RNA, 19 nt, Human
ugucuaaagacacagcuuc

SEQ ID NO: 410844 - RNA, 18 nt, Human
uguuggacaaauauaagg

SEQ ID NO: 410845 - RNA, 23 nt, Human
uguugugugcucagcacggcugg

SEQ ID NO: 410846 - RNA, 21 nt, Human
uguuucugucuugggcaaagg

SEQ ID NO: 410847 - RNA, 23 nt, Human
uuaaucuauuucuuccuuuccuc

SEQ ID NO: 410848 - RNA, 19 nt, Human
uuacaugcauuauuucacu

SEQ ID NO: 410849 - RNA, 26 nt, Human
uuagaaaaauacuuggaaccuaugcc

SEQ ID NO: 410850 - RNA, 20 nt, Human
uucucuuuuugugguggggu

SEQ ID NO: 410851 - RNA, 22 nt, Human
uuuccacacacagccuguugug

SEQ ID NO: 410852 - RNA, 26 nt, Human
accgccaccuuucucccaacccccaa

SEQ ID NO: 410853 - RNA, 23 nt, Human
cgaaagcaccgccaccuuucucc

SEQ ID NO: 410854 - RNA, 19 nt, Human
cuccuucuccuuuuuugcc

SEQ ID NO: 410855 - RNA, 24 nt, Human
gagcguguacucuggcuccuucuc

SEQ ID NO: 410856 - RNA, 23 nt, Human
ggagcguguacucuggcuccuuc

SEQ ID NO: 410857 - RNA, 22 nt, Human
uccccuggccauauuauucugg

SEQ ID NO: 410858 - RNA, 25 nt, Human
ucuggcuccuucuccuuuuuugccu

SEQ ID NO: 410859 - RNA, 24 nt, Human
uugacuauggguuuuguuuucuuu

SEQ ID NO: 410860 - RNA, 22 nt, Human
uucgcuggguccccucugccuu

SEQ ID NO: 410861 - RNA, 21 nt, Human
agaaagcaguaccaguaaacg

SEQ ID NO: 410862 - RNA, 18 nt, Human
auugaagggaaggaagag

SEQ ID NO: 410863 - RNA, 21 nt, Human
cacucagauaaucuauaccau

SEQ ID NO: 410864 - RNA, 20 nt, Human
cagaagcaaccuuggucugc

SEQ ID NO: 410865 - RNA, 19 nt, Human
cugcaguuacaaauccaua

SEQ ID NO: 410866 - RNA, 20 nt, Human
gaaggcaaauuauuacuaua

SEQ ID NO: 410867 - RNA, 19 nt, Human
gccagcuggguuuaaccca

SEQ ID NO: 410868 - RNA, 21 nt, Human
uaaaacaguauuuagaaagca

SEQ ID NO: 410869 - RNA, 24 nt, Human
uacaagagaaaacggguaaaacag

SEQ ID NO: 410870 - RNA, 25 nt, Human
uacaagagaaaacggguaaaacagu

SEQ ID NO: 410871 - RNA, 18 nt, Human
uagaaugugcaagaguca

SEQ ID NO: 410872 - RNA, 22 nt, Human
uagaaugugcaagagucaaagg

SEQ ID NO: 410873 - RNA, 21 nt, Human
ucagaagcaaccuuggucugc

SEQ ID NO: 410874 - RNA, 21 nt, Human
ucuuccuuguugagauccuga

SEQ ID NO: 410875 - RNA, 19 nt, Human
ugaagggaaggaagaggca

SEQ ID NO: 410876 - RNA, 24 nt, Human
ugacauacaacuguggaacacuca

SEQ ID NO: 410877 - RNA, 20 nt, Human
ugauuuguuccuggaagggu

SEQ ID NO: 410878 - RNA, 26 nt, Human
ugcuccuggcuuugguagagugaccu

SEQ ID NO: 410879 - RNA, 19 nt, Human
ugguagagugaccuucucu

SEQ ID NO: 410880 - RNA, 24 nt, Human
uguaaucaaauauauuacuaaugg

SEQ ID NO: 410881 - RNA, 22 nt, Human
ugugcaagagucaaaggauaaa

SEQ ID NO: 410882 - RNA, 21 nt, Human
uguuaauacagcuauggauua

SEQ ID NO: 410883 - RNA, 22 nt, Human
uuaaaugugcaugacuuaaaug

SEQ ID NO: 410884 - RNA, 24 nt, Human
uuccagagggugccagcuggguuu

SEQ ID NO: 410885 - RNA, 22 nt, Human
uuccuggaaggguggggcccug

SEQ ID NO: 410886 - RNA, 21 nt, Human
uuugguagagugaccuucucu

SEQ ID NO: 410887 - RNA, 24 nt, Human
uuuuaagauagucuucugcaguua

SEQ ID NO: 410888 - RNA, 22 nt, Human
aaaugaaaagauggaacccaaa

SEQ ID NO: 410889 - RNA, 20 nt, Human
aagagcauaaaacagagaaa

SEQ ID NO: 410890 - RNA, 19 nt, Human
acaagagcauaaaacagag

SEQ ID NO: 410891 - RNA, 20 nt, Human
acagagaaaacaagucuaca

SEQ ID NO: 410892 - RNA, 18 nt, Human
agaguaaaaugaugucaa

SEQ ID NO: 410893 - RNA, 22 nt, Human
auaaaacagagaaaacaagucu

SEQ ID NO: 410894 - RNA, 22 nt, Human
auaaaacagagaaaacaagucu

SEQ ID NO: 410895 - RNA, 25 nt, Human
caaguagauuacacaagagcauaaa

SEQ ID NO: 410896 - RNA, 20 nt, Human
cccacuauuccaagaguaaa

SEQ ID NO: 410897 - RNA, 23 nt, Human
cuuaaauccucggauuccauuuc

SEQ ID NO: 410898 - RNA, 23 nt, Human
uaaaacagagaaaacaagucuac

SEQ ID NO: 410899 - RNA, 20 nt, Human
uacacaagagcauaaaacag

SEQ ID NO: 410900 - RNA, 18 nt, Human
ugaaaagauggaacccaa

SEQ ID NO: 410901 - RNA, 19 nt, Human
aagaaacuuucuccuacca

SEQ ID NO: 410902 - RNA, 23 nt, Human
aagagugccuaaaaaggguggga

SEQ ID NO: 410903 - RNA, 23 nt, Human
aagcacucagaucaaugcuaaua

SEQ ID NO: 410904 - RNA, 24 nt, Human
aauaaaugguacaaaacuuuauaa

SEQ ID NO: 410905 - RNA, 21 nt, Human
aauuuagaacuaccacacaaa

SEQ ID NO: 410906 - RNA, 18 nt, Human
accaaugccuuacauuuc

SEQ ID NO: 410907 - RNA, 22 nt, Human
acccacugaggcauacuuagac

SEQ ID NO: 410908 - RNA, 25 nt, Human
agagaaaauguaagacguuaaagug

SEQ ID NO: 410909 - RNA, 20 nt, Human
aggcacuaaaacauuacauu

SEQ ID NO: 410910 - RNA, 19 nt, Human
augaauucaaauauggugg

SEQ ID NO: 410911 - RNA, 20 nt, Human
auuuagaacuaccacacaaa

SEQ ID NO: 410912 - RNA, 19 nt, Human
cacaguucagauaacaaaa

SEQ ID NO: 410913 - RNA, 22 nt, Human
caccaaugccuuacauuucuga

SEQ ID NO: 410914 - RNA, 18 nt, Human
caugucacuagcaaaugu

SEQ ID NO: 410915 - RNA, 20 nt, Human
ccacugaggcauacuuagac

SEQ ID NO: 410916 - RNA, 22 nt, Human
ccacugaggcauacuuagacau

SEQ ID NO: 410917 - RNA, 20 nt, Human
ccucuaauccuaaaaacaaa

SEQ ID NO: 410918 - RNA, 22 nt, Human
cgaggcgaggcugggaaugcac

SEQ ID NO: 410919 - RNA, 19 nt, Human
cuaauccuaaaaacaaaac

SEQ ID NO: 410920 - RNA, 25 nt, Human
cuaauccuaaaaacaaaacuacaca

SEQ ID NO: 410921 - RNA, 20 nt, Human
cuaccacacaaaggcauugg

SEQ ID NO: 410922 - RNA, 25 nt, Human
cuauauacaguauguacaugucacu

SEQ ID NO: 410923 - RNA, 21 nt, Human
cugcacucugggaccuccaag

SEQ ID NO: 410924 - RNA, 23 nt, Human
cugcacucugggaccuccaagag

SEQ ID NO: 410925 - RNA, 20 nt, Human
gaaacuuucuccuaccaaca

SEQ ID NO: 410926 - RNA, 21 nt, Human
gaaacuuucuccuaccaacag

SEQ ID NO: 410927 - RNA, 20 nt, Human
gaucaaugcuaauaauuacu

SEQ ID NO: 410928 - RNA, 20 nt, Human
gcaucauucucuuuuaggug

SEQ ID NO: 410929 - RNA, 21 nt, Human
gccucuaauccuaaaaacaaa

SEQ ID NO: 410930 - RNA, 21 nt, Human
gggauuuucucaacccacuga

SEQ ID NO: 410931 - RNA, 23 nt, Human
uaaaaacaaaacuacacagucaa

SEQ ID NO: 410932 - RNA, 27 nt, Human
uaaaaacaaaacuacacagucaagacu

SEQ ID NO: 410933 - RNA, 20 nt, Human
uaaaaagggugggacuaagc

SEQ ID NO: 410934 - RNA, 23 nt, Human
uaaaugcaaacaucaccaaugcc

SEQ ID NO: 410935 - RNA, 22 nt, Human
uaaaugguacaaaacuuuauaa

SEQ ID NO: 410936 - RNA, 19 nt, Human
uaagaaacuuucuccuacc

SEQ ID NO: 410937 - RNA, 23 nt, Human
uaccacacaaaggcauuggcugc

SEQ ID NO: 410938 - RNA, 24 nt, Human
uacuugaauagcuugguuaaauga

SEQ ID NO: 410939 - RNA, 19 nt, Human
uagagauuauuucuuuagg

SEQ ID NO: 410940 - RNA, 21 nt, Human
uaucucaaggagguccaacaa

SEQ ID NO: 410941 - RNA, 20 nt, Human
uauuacacagcaugauugac

SEQ ID NO: 410942 - RNA, 22 nt, Human
uauuucuuuaggggucuccaag

SEQ ID NO: 410943 - RNA, 25 nt, Human
uauuuuguuguuacuaucucaagga

SEQ ID NO: 410944 - RNA, 22 nt, Human
ucaacaguauguugaggcacaa

SEQ ID NO: 410945 - RNA, 18 nt, Human
ucccuacacccgaggcga

SEQ ID NO: 410946 - RNA, 19 nt, Human
ugaaaagaacuacaucaaa

SEQ ID NO: 410947 - RNA, 19 nt, Human
ugacacaagugaugauucc

SEQ ID NO: 410948 - RNA, 18 nt, Human
ugauaugcacagcaucau

SEQ ID NO: 410949 - RNA, 19 nt, Human
ugauaugcacagcaucauu

SEQ ID NO: 410950 - RNA, 21 nt, Human
ugcaaucccuacacccgaggc

SEQ ID NO: 410951 - RNA, 18 nt, Human
ugccuaaaaaggguggga

SEQ ID NO: 410952 - RNA, 20 nt, Human
uggaaguuuauuagauccac

SEQ ID NO: 410953 - RNA, 21 nt, Human
ugguggaccuguuuggaaguu

SEQ ID NO: 410954 - RNA, 24 nt, Human
uguaagacguuaaaguguugcuua

SEQ ID NO: 410955 - RNA, 19 nt, Human
ugucagagacagcguaaaa

SEQ ID NO: 410956 - RNA, 24 nt, Human
uuacaaagaugagauuucuacaua

SEQ ID NO: 410957 - RNA, 21 nt, Human
uuauuuuguuguuacuaucuc

SEQ ID NO: 410958 - RNA, 24 nt, Human
uugacacaagugaugauuccacag

SEQ ID NO: 410959 - RNA, 18 nt, Human
uuuauuagauccacauaa

SEQ ID NO: 410960 - RNA, 23 nt, Human
uuuucucaacccacugaggcaua

SEQ ID NO: 410961 - RNA, 20 nt, Human
aaaaguagagaaaaaagcau

SEQ ID NO: 410962 - RNA, 18 nt, Human
aaaaucuuuccaaacacc

SEQ ID NO: 410963 - RNA, 22 nt, Human
aaaguucaggcaagcauuaguu

SEQ ID NO: 410964 - RNA, 22 nt, Human
acuucaaaaguagagaaaaaag

SEQ ID NO: 410965 - RNA, 22 nt, Human
agagaaaaaagcauuuaaaaag

SEQ ID NO: 410966 - RNA, 21 nt, Human
ccaaacaccuguguugcucau

SEQ ID NO: 410967 - RNA, 18 nt, Human
cuagaaacauacaaagau

SEQ ID NO: 410968 - RNA, 22 nt, Human
gagaaaaaagcauuuaaaaagu

SEQ ID NO: 410969 - RNA, 20 nt, Human
uacuucaaaaguagagaaaa

SEQ ID NO: 410970 - RNA, 22 nt, Human
ucauucauuuaaccagguugga

SEQ ID NO: 410971 - RNA, 21 nt, Human
uccaaacaccuguguugcuca

SEQ ID NO: 410972 - RNA, 27 nt, Human
uucaaaaguagagaaaaaagcauuuaa

SEQ ID NO: 410973 - RNA, 27 nt, Human
uuuagcaauaacuuucauguucucuuc

SEQ ID NO: 410974 - RNA, 22 nt, Human
agguccacuggaggagaagucc

SEQ ID NO: 410975 - RNA, 19 nt, Human
aucccaucccucguccuuc

SEQ ID NO: 410976 - RNA, 18 nt, Human
gguccacuggaggagaag

SEQ ID NO: 410977 - RNA, 27 nt, Human
uaguaaaaauggaauacucuugguuac

SEQ ID NO: 410978 - RNA, 23 nt, Human
uccuucagguccacuggaggaga

SEQ ID NO: 410979 - RNA, 21 nt, Human
ucuugguuacaugaaauccca

SEQ ID NO: 410980 - RNA, 21 nt, Human
ugaggugaaaacagugcuuua

SEQ ID NO: 410981 - RNA, 21 nt, Human
ugccaagaaugaguggacuuc

SEQ ID NO: 410982 - RNA, 19 nt, Human
uggacuucuaacauagcau

SEQ ID NO: 410983 - RNA, 21 nt, Human
uuacaugaaaucccaucccuc

SEQ ID NO: 410984 - RNA, 24 nt, Human
acucccaaggccaaggacagaaau

SEQ ID NO: 410985 - RNA, 22 nt, Human
agagcagggaggcgguccugug

SEQ ID NO: 410986 - RNA, 21 nt, Human
aggccaaggacagaaauggga

SEQ ID NO: 410987 - RNA, 18 nt, Human
aggggcagcagggggacu

SEQ ID NO: 410988 - RNA, 20 nt, Human
agggggucagagcccacugg

SEQ ID NO: 410989 - RNA, 21 nt, Human
caagagcagggaggcgguccu

SEQ ID NO: 410990 - RNA, 22 nt, Human
caggcuccaguccagccgggag

SEQ ID NO: 410991 - RNA, 18 nt, Human
cgaggcgaggcugucugc

SEQ ID NO: 410992 - RNA, 18 nt, Human
cucauguccccaccccca

SEQ ID NO: 410993 - RNA, 21 nt, Human
cuccccugccagcccuacucc

SEQ ID NO: 410994 - RNA, 19 nt, Human
cugcccccucagcuacucc

SEQ ID NO: 410995 - RNA, 20 nt, Human
cugcccccuccccugccagc

SEQ ID NO: 410996 - RNA, 23 nt, Human
gagccaggcuccaguccagccgg

SEQ ID NO: 410997 - RNA, 24 nt, Human
gaugggaccggcagccagggauga

SEQ ID NO: 410998 - RNA, 19 nt, Human
gccaagagcagggaggcgg

SEQ ID NO: 410999 - RNA, 21 nt, Human
gcccccgggggagggggcagc

SEQ ID NO: 411000 - RNA, 20 nt, Human
ggacucauguccccaccccc

SEQ ID NO: 411001 - RNA, 18 nt, Human
gggagggggcagcggggc

SEQ ID NO: 411002 - RNA, 19 nt, Human
ggggagggggcagcggggc

SEQ ID NO: 411003 - RNA, 21 nt, Human
ggggagggggcagcggggcgg

SEQ ID NO: 411004 - RNA, 19 nt, Human
gggggagggggcagcgggg

SEQ ID NO: 411005 - RNA, 20 nt, Human
gggggagggggcagcggggc

SEQ ID NO: 411006 - RNA, 20 nt, Human
uacucccaaggccaaggaca

SEQ ID NO: 411007 - RNA, 25 nt, Human
uagucugcccccucagcuacuccca

SEQ ID NO: 411008 - RNA, 23 nt, Human
ugggauguggcaggggcagcagg

SEQ ID NO: 411009 - RNA, 25 nt, Human
ugggauguggcaggggcagcagggg

SEQ ID NO: 411010 - RNA, 23 nt, Human
ugucugcccccuccccugccagc

SEQ ID NO: 411011 - RNA, 27 nt, Human
ugucugcccccuccccugccagcccua

SEQ ID NO: 411012 - RNA, 21 nt, Human
uguggcaggggcagcaggggg

SEQ ID NO: 411013 - RNA, 22 nt, Human
aaagcagccacgcugggggugg

SEQ ID NO: 411014 - RNA, 22 nt, Human
caacgcuacuacuugaccucaa

SEQ ID NO: 411015 - RNA, 19 nt, Human
caguggaguggagaaccca

SEQ ID NO: 411016 - RNA, 23 nt, Human
caguggaguggagaacccaccac

SEQ ID NO: 411017 - RNA, 20 nt, Human
ccgcagcccaacgcuacuac

SEQ ID NO: 411018 - RNA, 20 nt, Human
cuccgcugccgcagcccaac

SEQ ID NO: 411019 - RNA, 21 nt, Human
ggaguggagaacccaccacac

SEQ ID NO: 411020 - RNA, 22 nt, Human
uccuccgcugccgcagcccaac

SEQ ID NO: 411021 - RNA, 22 nt, Human
uggaguggagaacccaccacac

SEQ ID NO: 411022 - RNA, 24 nt, Human
uggcaguggaguggagaacccacc

SEQ ID NO: 411023 - RNA, 18 nt, Human
uuaauugcaaagaacuug

SEQ ID NO: 411024 - RNA, 24 nt, Human
uuuuuuuuuuuuuuuuuuauacag

SEQ ID NO: 411025 - RNA, 19 nt, Human
aagacagggaauacuuuau

SEQ ID NO: 411026 - RNA, 21 nt, Human
aggcggucgauguaagagaac

SEQ ID NO: 411027 - RNA, 24 nt, Human
agggaauacuuuauucaaaaccca

SEQ ID NO: 411028 - RNA, 22 nt, Human
cugauggcggagacgaagagga

SEQ ID NO: 411029 - RNA, 25 nt, Human
gggaauacuuuauucaaaacccauc

SEQ ID NO: 411030 - RNA, 20 nt, Human
ggucuguaacaaagcauuca

SEQ ID NO: 411031 - RNA, 19 nt, Human
uaugagagcauacacugcu

SEQ ID NO: 411032 - RNA, 20 nt, Human
ucccuguaaaagcagcaccu

SEQ ID NO: 411033 - RNA, 21 nt, Human
ugccgagcugauggcggagac

SEQ ID NO: 411034 - RNA, 21 nt, Human
uuacagcgcgacucuuaggcg

SEQ ID NO: 411035 - RNA, 18 nt, Human
uuuuuuuuuuaagacagg

SEQ ID NO: 411036 - RNA, 23 nt, Human
uuuuuuuuuuuuuuaagacaggg

SEQ ID NO: 411037 - RNA, 21 nt, Human
agaggcaaaacugagcaccau

SEQ ID NO: 411038 - RNA, 18 nt, Human
agcggguggcgcuggccc

SEQ ID NO: 411039 - RNA, 20 nt, Human
auaguuuacaaguagaaaga

SEQ ID NO: 411040 - RNA, 18 nt, Human
cggcugcggagcgggugg

SEQ ID NO: 411041 - RNA, 18 nt, Human
gaauuucuaacagaggca

SEQ ID NO: 411042 - RNA, 21 nt, Human
gauaccuucacagacaauacu

SEQ ID NO: 411043 - RNA, 23 nt, Human
gugaauuucuaacagaggcaaaa

SEQ ID NO: 411044 - RNA, 23 nt, Human
uaacagaggcaaaacugagcacc

SEQ ID NO: 411045 - RNA, 21 nt, Human
uugaggacaacagaaguucac

SEQ ID NO: 411046 - RNA, 22 nt, Human
agagaguccauguauaugagaa

SEQ ID NO: 411047 - RNA, 20 nt, Human
agaugagggucccuguccug

SEQ ID NO: 411048 - RNA, 21 nt, Human
agaugagggucccuguccugg

SEQ ID NO: 411049 - RNA, 18 nt, Human
agggcuugggccaaccag

SEQ ID NO: 411050 - RNA, 22 nt, Human
aggggguggucagucaggcagg

SEQ ID NO: 411051 - RNA, 20 nt, Human
caggccaacagagaguccau

SEQ ID NO: 411052 - RNA, 26 nt, Human
uaugagaaagagaugcgugagguccc

SEQ ID NO: 411053 - RNA, 30 nt, Human
aaaaaaagaaaaccaugaugaccugcaggg

SEQ ID NO: 411054 - RNA, 18 nt, Human
aacaguuuucccgguuuc

SEQ ID NO: 411055 - RNA, 23 nt, Human
aagagagaagaaacaggcagagg

SEQ ID NO: 411056 - RNA, 21 nt, Human
aagccgagguggguggaucac

SEQ ID NO: 411057 - RNA, 24 nt, Human
aaucgcuuaaauccgggaggcaga

SEQ ID NO: 411058 - RNA, 24 nt, Human
acagagugagacucugucucagaa

SEQ ID NO: 411059 - RNA, 24 nt, Human
accaccaauaacuuagcaaaauaa

SEQ ID NO: 411060 - RNA, 19 nt, Human
accccaaagccucagggaa

SEQ ID NO: 411061 - RNA, 24 nt, Human
accccaucucuacuaaaaauacaa

SEQ ID NO: 411062 - RNA, 21 nt, Human
accccgcugucuggcuccaac

SEQ ID NO: 411063 - RNA, 24 nt, Human
acuccagccugggugacagaguga

SEQ ID NO: 411064 - RNA, 19 nt, Human
acugcaagagaaggcuaua

SEQ ID NO: 411065 - RNA, 18 nt, Human
acugcacuccagccuggg

SEQ ID NO: 411066 - RNA, 18 nt, Human
acugcacuccagccuggg

SEQ ID NO: 411067 - RNA, 18 nt, Human
acugcacuccagccuggg

SEQ ID NO: 411068 - RNA, 19 nt, Human
acugcacuccagccugggu

SEQ ID NO: 411069 - RNA, 21 nt, Human
acugcacuccagccuggguga

SEQ ID NO: 411070 - RNA, 22 nt, Human
acugcacuccagccugggugac

SEQ ID NO: 411071 - RNA, 24 nt, Human
acugcacuccagccugggugacag

SEQ ID NO: 411072 - RNA, 26 nt, Human
acugcacuccagccugggugacagag

SEQ ID NO: 411073 - RNA, 27 nt, Human
acuucauucccccaggacauucuccaa

SEQ ID NO: 411074 - RNA, 25 nt, Human
agaaaaaaaaaaacaauaaaaaaag

SEQ ID NO: 411075 - RNA, 26 nt, Human
agaaaaaaaaaaacaauaaaaaaaga

SEQ ID NO: 411076 - RNA, 18 nt, Human
agaaagacaaggccaccc

SEQ ID NO: 411077 - RNA, 23 nt, Human
agacaaggccacccagucaaagc

SEQ ID NO: 411078 - RNA, 21 nt, Human
agagaagaaacaggcagagga

SEQ ID NO: 411079 - RNA, 23 nt, Human
agagaagaaacaggcagaggaaa

SEQ ID NO: 411080 - RNA, 21 nt, Human
agagcaaguuugaaggagaaa

SEQ ID NO: 411081 - RNA, 23 nt, Human
agaggauuuugcugggacuggug

SEQ ID NO: 411082 - RNA, 22 nt, Human
agagguugcagugagcugagau

SEQ ID NO: 411083 - RNA, 23 nt, Human
agagguugcagugagcugagauc

SEQ ID NO: 411084 - RNA, 24 nt, Human
agagguugcagugagcugagaucg

SEQ ID NO: 411085 - RNA, 20 nt, Human
agcacuuugggaagccgagg

SEQ ID NO: 411086 - RNA, 24 nt, Human
agcacuuugggaagccgagguggg

SEQ ID NO: 411087 - RNA, 20 nt, Human
agccaggcgugguggcacac

SEQ ID NO: 411088 - RNA, 24 nt, Human
agccuagccaguauggugaaaccc

SEQ ID NO: 411089 - RNA, 24 nt, Human
agccugggugacagagugagacuc

SEQ ID NO: 411090 - RNA, 19 nt, Human
aggaagagcccuaaagaaa

SEQ ID NO: 411091 - RNA, 26 nt, Human
aggaggccagggcagcguagugggca

SEQ ID NO: 411092 - RNA, 24 nt, Human
aggcagaagaaucgcuuaaauccg

SEQ ID NO: 411093 - RNA, 23 nt, Human
aggcagaggcagcagcaauggca

SEQ ID NO: 411094 - RNA, 20 nt, Human
aggcagagguugcagugagc

SEQ ID NO: 411095 - RNA, 24 nt, Human
aggcagagguugcagugagcugag

SEQ ID NO: 411096 - RNA, 22 nt, Human
aggcagcagcaauggcagcaac

SEQ ID NO: 411097 - RNA, 19 nt, Human
aggcugcagauggagcaag

SEQ ID NO: 411098 - RNA, 22 nt, Human
agguggguggaucaccugaggu

SEQ ID NO: 411099 - RNA, 24 nt, Human
aguagcucaagccuauaauccuag

SEQ ID NO: 411100 - RNA, 20 nt, Human
aguauggugaaaccccaucu

SEQ ID NO: 411101 - RNA, 23 nt, Human
aucaugagauguaagcaaaacca

SEQ ID NO: 411102 - RNA, 24 nt, Human
aucgcgcuacugcacuccagccug

SEQ ID NO: 411103 - RNA, 20 nt, Human
auggugaaaccccaucucua

SEQ ID NO: 411104 - RNA, 24 nt, Human
caaaauaaauacaaagaggauuuu

SEQ ID NO: 411105 - RNA, 18 nt, Human
caacaggggcagugggcu

SEQ ID NO: 411106 - RNA, 19 nt, Human
cacaccuguagucccagcu

SEQ ID NO: 411107 - RNA, 22 nt, Human
caccaugggccgggcacaguag

SEQ ID NO: 411108 - RNA, 23 nt, Human
caccaugggccgggcacaguagc

SEQ ID NO: 411109 - RNA, 20 nt, Human
caccugaggucaggaauucg

SEQ ID NO: 411110 - RNA, 23 nt, Human
caccuguagucccagcuacucgg

SEQ ID NO: 411111 - RNA, 24 nt, Human
caccuguagucccagcuacucggg

SEQ ID NO: 411112 - RNA, 22 nt, Human
cacuccagccugggugacagag

SEQ ID NO: 411113 - RNA, 22 nt, Human
cacuccagccugggugacagag

SEQ ID NO: 411114 - RNA, 24 nt, Human
cacuccagccugggugacagagug

SEQ ID NO: 411115 - RNA, 31 nt, Human
cagaaaaaaaaaaacaauaaaaaaagaaaaa

SEQ ID NO: 411116 - RNA, 19 nt, Human
cagaaagacaaggccaccc

SEQ ID NO: 411117 - RNA, 19 nt, Human
cagaguccagucuacaaca

SEQ ID NO: 411118 - RNA, 20 nt, Human
cagcagagagaagucacaca

SEQ ID NO: 411119 - RNA, 21 nt, Human
cagcagcaauggcagcaacca

SEQ ID NO: 411120 - RNA, 24 nt, Human
cagcuacucgggaggcugaggcag

SEQ ID NO: 411121 - RNA, 22 nt, Human
cagcuuuuagggcugaggcaaa

SEQ ID NO: 411122 - RNA, 23 nt, Human
caggagcccgaaguccugggugc

SEQ ID NO: 411123 - RNA, 23 nt, Human
caggcgugguggcacaccuguag

SEQ ID NO: 411124 - RNA, 24 nt, Human
caguauggugaaaccccaucucua

SEQ ID NO: 411125 - RNA, 21 nt, Human
caugagauguaagcaaaacca

SEQ ID NO: 411126 - RNA, 20 nt, Human
ccaaagggcugcagugccuu

SEQ ID NO: 411127 - RNA, 21 nt, Human
ccacagacaacaauaucagaa

SEQ ID NO: 411128 - RNA, 21 nt, Human
ccagaaagacaaggccaccca

SEQ ID NO: 411129 - RNA, 18 nt, Human
ccagcuuagaguggccag

SEQ ID NO: 411130 - RNA, 20 nt, Human
ccaggacauucuccaaucac

SEQ ID NO: 411131 - RNA, 21 nt, Human
cccagaagaguccugauugcc

SEQ ID NO: 411132 - RNA, 24 nt, Human
ccccaaagccucagggaaaguaga

SEQ ID NO: 411133 - RNA, 20 nt, Human
cccuaaagaaaaacaccaug

SEQ ID NO: 411134 - RNA, 21 nt, Human
ccgguuucaagcaaauccaaa

SEQ ID NO: 411135 - RNA, 24 nt, Human
ccuagccaguauggugaaacccca

SEQ ID NO: 411136 - RNA, 20 nt, Human
ccuauaauccuagcacuuug

SEQ ID NO: 411137 - RNA, 22 nt, Human
ccugaggucaggaauucgagac

SEQ ID NO: 411138 - RNA, 22 nt, Human
ccugggugacagagugagacuc

SEQ ID NO: 411139 - RNA, 24 nt, Human
ccugggugcagccaggggacaguc

SEQ ID NO: 411140 - RNA, 21 nt, Human
ccuguagucccagcuacucgg

SEQ ID NO: 411141 - RNA, 24 nt, Human
cgagaccagccuagccaguauggu

SEQ ID NO: 411142 - RNA, 24 nt, Human
cgagguggguggaucaccugaggu

SEQ ID NO: 411143 - RNA, 26 nt, Human
cgagguggguggaucaccugagguca

SEQ ID NO: 411144 - RNA, 24 nt, Human
cgggaggcagagguugcagugagc

SEQ ID NO: 411145 - RNA, 21 nt, Human
cuaaagagacucugggaguuu

SEQ ID NO: 411146 - RNA, 21 nt, Human
cuacugcacuccagccugggu

SEQ ID NO: 411147 - RNA, 24 nt, Human
cuacugcacuccagccugggugac

SEQ ID NO: 411148 - RNA, 24 nt, Human
cucaagccuauaauccuagcacuu

SEQ ID NO: 411149 - RNA, 22 nt, Human
cucccaaucugaugaaggccug

SEQ ID NO: 411150 - RNA, 24 nt, Human
cuccccagaaagacaaggccaccc

SEQ ID NO: 411151 - RNA, 18 nt, Human
cucgugcuccgucugccc

SEQ ID NO: 411152 - RNA, 18 nt, Human
cucucaccaggccuugcc

SEQ ID NO: 411153 - RNA, 20 nt, Human
cugaauguacauucccuccu

SEQ ID NO: 411154 - RNA, 21 nt, Human
cugaccccaaagccucaggga

SEQ ID NO: 411155 - RNA, 20 nt, Human
cugggucaagaagacugagg

SEQ ID NO: 411156 - RNA, 24 nt, Human
gacacauuaauauaauuuauuaaa

SEQ ID NO: 411157 - RNA, 24 nt, Human
gacagagugagacucugucucaga

SEQ ID NO: 411158 - RNA, 18 nt, Human
gacucugucucagaaaaa

SEQ ID NO: 411159 - RNA, 20 nt, Human
gagaaagagagaagaaacag

SEQ ID NO: 411160 - RNA, 23 nt, Human
gagaucgcgcuacugcacuccag

SEQ ID NO: 411161 - RNA, 18 nt, Human
gaucaccugaggucagga

SEQ ID NO: 411162 - RNA, 24 nt, Human
gaucaccugaggucaggaauucga

SEQ ID NO: 411163 - RNA, 23 nt, Human
gcacuccagccugggugacagag

SEQ ID NO: 411164 - RNA, 21 nt, Human
gcagagcaaguuugaaggaga

SEQ ID NO: 411165 - RNA, 22 nt, Human
gccacagacaacaauaucagaa

SEQ ID NO: 411166 - RNA, 24 nt, Human
gccaguauggugaaaccccaucuc

SEQ ID NO: 411167 - RNA, 19 nt, Human
gcuacugcacuccagccug

SEQ ID NO: 411168 - RNA, 24 nt, Human
gcuacugcacuccagccuggguga

SEQ ID NO: 411169 - RNA, 19 nt, Human
ggagaaagagagaagaaac

SEQ ID NO: 411170 - RNA, 22 nt, Human
ggcagcagcaauggcagcaacc

SEQ ID NO: 411171 - RNA, 20 nt, Human
gggaagccgaggugggugga

SEQ ID NO: 411172 - RNA, 24 nt, Human
gggaggcugaggcagaagaaucgc

SEQ ID NO: 411173 - RNA, 21 nt, Human
gguggaucaccugaggucagg

SEQ ID NO: 411174 - RNA, 21 nt, Human
guccugauugcccucuuucuc

SEQ ID NO: 411175 - RNA, 24 nt, Human
gugacagagugagacucugucuca

SEQ ID NO: 411176 - RNA, 19 nt, Human
guggaacccagugaaaaca

SEQ ID NO: 411177 - RNA, 22 nt, Human
guggaaggaacuucauuccccc

SEQ ID NO: 411178 - RNA, 24 nt, Human
gugguggcacaccuguagucccag

SEQ ID NO: 411179 - RNA, 19 nt, Human
guugcagugagcugagauc

SEQ ID NO: 411180 - RNA, 24 nt, Human
uaaaaaaagaaaaccaugaugacc

SEQ ID NO: 411181 - RNA, 21 nt, Human
uaaaaauacaaaaaucagcca

SEQ ID NO: 411182 - RNA, 22 nt, Human
uacaaaugagggaacucccuga

SEQ ID NO: 411183 - RNA, 21 nt, Human
uacugcaagagaaggcuauag

SEQ ID NO: 411184 - RNA, 21 nt, Human
uacugcacuccagccugggug

SEQ ID NO: 411185 - RNA, 23 nt, Human
uacugcacuccagccugggugac

SEQ ID NO: 411186 - RNA, 24 nt, Human
uacugcacuccagccugggugaca

SEQ ID NO: 411187 - RNA, 25 nt, Human
uacugcacuccagccugggugacag

SEQ ID NO: 411188 - RNA, 26 nt, Human
uagaguggccaggggcuugggaaugg

SEQ ID NO: 411189 - RNA, 23 nt, Human
uagcaaaauaaauacaaagagga

SEQ ID NO: 411190 - RNA, 24 nt, Human
uagcacuuugggaagccgaggugg

SEQ ID NO: 411191 - RNA, 21 nt, Human
uaggcugcagauggagcaaag

SEQ ID NO: 411192 - RNA, 21 nt, Human
uaucuacuucucaaggcugua

SEQ ID NO: 411193 - RNA, 22 nt, Human
uauugcccuggcuccugcuugc

SEQ ID NO: 411194 - RNA, 22 nt, Human
ucaaagagacacauuaauauaa

SEQ ID NO: 411195 - RNA, 22 nt, Human
ucaagcaaauccaaauacugca

SEQ ID NO: 411196 - RNA, 19 nt, Human
ucaaucaugagauguaagc

SEQ ID NO: 411197 - RNA, 21 nt, Human
ucacuggcucucaccaggccu

SEQ ID NO: 411198 - RNA, 22 nt, Human
ucagaaagggaagaaacaugga

SEQ ID NO: 411199 - RNA, 18 nt, Human
ucagagccaggauaaaag

SEQ ID NO: 411200 - RNA, 21 nt, Human
ucagccaggcgugguggcaca

SEQ ID NO: 411201 - RNA, 21 nt, Human
ucagccaggcgugguggcaca

SEQ ID NO: 411202 - RNA, 23 nt, Human
uccacauuuguuuugaauuuuuc

SEQ ID NO: 411203 - RNA, 23 nt, Human
uccagccugggugacagagugag

SEQ ID NO: 411204 - RNA, 24 nt, Human
uccagccugggugacagagugaga

SEQ ID NO: 411205 - RNA, 24 nt, Human
ucccccaggacauucuccaaucac

SEQ ID NO: 411206 - RNA, 19 nt, Human
ucccgguuucaagcaaauc

SEQ ID NO: 411207 - RNA, 19 nt, Human
ucccuaaagagacucuggg

SEQ ID NO: 411208 - RNA, 21 nt, Human
ucccuaaagagacucugggag

SEQ ID NO: 411209 - RNA, 18 nt, Human
ucccuccuccccagaaag

SEQ ID NO: 411210 - RNA, 26 nt, Human
ucccugaauguacauucccuccuccc

SEQ ID NO: 411211 - RNA, 21 nt, Human
uccgcaaaaggcuacucccug

SEQ ID NO: 411212 - RNA, 23 nt, Human
uccgcaaaaggcuacucccugaa

SEQ ID NO: 411213 - RNA, 21 nt, Human
uccgggaggcagagguugcag

SEQ ID NO: 411214 - RNA, 19 nt, Human
uccuccccagaaagacaaa

SEQ ID NO: 411215 - RNA, 23 nt, Human
ucgcgcuacugcacuccagccug

SEQ ID NO: 411216 - RNA, 24 nt, Human
ucgggaggcugaggcagaagaauc

SEQ ID NO: 411217 - RNA, 22 nt, Human
ucuccaaacaacauauacucug

SEQ ID NO: 411218 - RNA, 23 nt, Human
ucuccagcuuuuagggcugaggc

SEQ ID NO: 411219 - RNA, 21 nt, Human
ucucuacuaaaaauacaaaaa

SEQ ID NO: 411220 - RNA, 19 nt, Human
ugaaaccccaucucuacua

SEQ ID NO: 411221 - RNA, 24 nt, Human
ugacauuaacaagccuaaugggaa

SEQ ID NO: 411222 - RNA, 23 nt, Human
ugagauguaagcaaaaccaccaa

SEQ ID NO: 411223 - RNA, 22 nt, Human
ugagcugagaucgcgcuacugc

SEQ ID NO: 411224 - RNA, 25 nt, Human
ugaggcagaagaaucgcuuaaaucc

SEQ ID NO: 411225 - RNA, 23 nt, Human
ugcagccaggggacagucaggaa

SEQ ID NO: 411226 - RNA, 21 nt, Human
ugccagguaaccccacuaucu

SEQ ID NO: 411227 - RNA, 19 nt, Human
ugcgugagccacauagagc

SEQ ID NO: 411228 - RNA, 19 nt, Human
uggacaucugugucuccag

SEQ ID NO: 411229 - RNA, 24 nt, Human
uggaucaccugaggucaggaauuc

SEQ ID NO: 411230 - RNA, 27 nt, Human
uggaucaccugaggucaggaauucgag

SEQ ID NO: 411231 - RNA, 20 nt, Human
uggcacaccuguagucccag

SEQ ID NO: 411232 - RNA, 23 nt, Human
ugggaagccgagguggguggauc

SEQ ID NO: 411233 - RNA, 24 nt, Human
ugggaagccgagguggguggauca

SEQ ID NO: 411234 - RNA, 19 nt, Human
ugggaauggugagacacag

SEQ ID NO: 411235 - RNA, 24 nt, Human
ugggccgggcacaguagcucaagc

SEQ ID NO: 411236 - RNA, 21 nt, Human
ugggugacagagugagacucu

SEQ ID NO: 411237 - RNA, 24 nt, Human
uggguggaucaccugaggucagga

SEQ ID NO: 411238 - RNA, 22 nt, Human
ugguggcacaccuguaguccca

SEQ ID NO: 411239 - RNA, 18 nt, Human
uguaagcaaaaccaccaa

SEQ ID NO: 411240 - RNA, 25 nt, Human
ugucuuccaaagggcugcagugccu

SEQ ID NO: 411241 - RNA, 24 nt, Human
uguggaaggaacuucauuccccca

SEQ ID NO: 411242 - RNA, 20 nt, Human
uguugcuaagaacugagcug

SEQ ID NO: 411243 - RNA, 21 nt, Human
uguuuugaauuuuucugauuc

SEQ ID NO: 411244 - RNA, 20 nt, Human
uuaaggauucuggcugcgug

SEQ ID NO: 411245 - RNA, 18 nt, Human
uugcagugagcugagauc

SEQ ID NO: 411246 - RNA, 19 nt, Human
uugcagugagcugagaucg

SEQ ID NO: 411247 - RNA, 20 nt, Human
uugcagugagcugagaucgc

SEQ ID NO: 411248 - RNA, 22 nt, Human
uugcagugagcugagaucgcgc

SEQ ID NO: 411249 - RNA, 18 nt, Human
uuugaaggagaaagagag

SEQ ID NO: 411250 - RNA, 26 nt, Human
uuuucaggcucugggucaagaagacu

SEQ ID NO: 411251 - RNA, 22 nt, Human
uuuuuuuuuuuucaaagagaca

SEQ ID NO: 411252 - RNA, 19 nt, Human
uuuuuuuuuuuuuuuucaa

SEQ ID NO: 411253 - RNA, 19 nt, Human
aaacaacaaugacuacugc

SEQ ID NO: 411254 - RNA, 26 nt, Human
acuccagauguucuucaucuccgucc

SEQ ID NO: 411255 - RNA, 19 nt, Human
acuggggcgcggggaggag

SEQ ID NO: 411256 - RNA, 22 nt, Human
agauguucuucaucuccguccu

SEQ ID NO: 411257 - RNA, 24 nt, Human
aggaggggggcacagcggcgcagg

SEQ ID NO: 411258 - RNA, 19 nt, Human
aggcgaacuccgaaaccag

SEQ ID NO: 411259 - RNA, 18 nt, Human
agugagaggucagccccg

SEQ ID NO: 411260 - RNA, 22 nt, Human
cagcggcgcaggcgaacuccga

SEQ ID NO: 411261 - RNA, 19 nt, Human
ccccaucaccuacccccuc

SEQ ID NO: 411262 - RNA, 22 nt, Human
cccgccguccgggcuccuccug

SEQ ID NO: 411263 - RNA, 24 nt, Human
ccgggcuccuccugccucggccug

SEQ ID NO: 411264 - RNA, 18 nt, Human
ccuacccgccguccgggc

SEQ ID NO: 411265 - RNA, 25 nt, Human
ccuccugccucggccugugccaggc

SEQ ID NO: 411266 - RNA, 22 nt, Human
ccugugccaggcuggggagagg

SEQ ID NO: 411267 - RNA, 22 nt, Human
cgacacaggagcaguuuuccgc

SEQ ID NO: 411268 - RNA, 22 nt, Human
cgccccagcuccucggagcccu

SEQ ID NO: 411269 - RNA, 22 nt, Human
cuccuagcccgccccagcuccc

SEQ ID NO: 411270 - RNA, 24 nt, Human
cuggagggacccugccagccucca

SEQ ID NO: 411271 - RNA, 22 nt, Human
cuuugcuggagggacccugcca

SEQ ID NO: 411272 - RNA, 20 nt, Human
gcgaacuccgaaaccagaug

SEQ ID NO: 411273 - RNA, 18 nt, Human
ggaggaggggggcacagc

SEQ ID NO: 411274 - RNA, 19 nt, Human
ggcuccuccugccucggcc

SEQ ID NO: 411275 - RNA, 22 nt, Human
gggaugugggugccuggcccuc

SEQ ID NO: 411276 - RNA, 21 nt, Human
gggcgcggggaggaggggggc

SEQ ID NO: 411277 - RNA, 19 nt, Human
ggggcgcggggaggagggg

SEQ ID NO: 411278 - RNA, 23 nt, Human
gggggcacagcggcgcaggcggc

SEQ ID NO: 411279 - RNA, 25 nt, Human
uacccccuccuccuagcccgcccca

SEQ ID NO: 411280 - RNA, 19 nt, Human
uacugcucccggacaggaa

SEQ ID NO: 411281 - RNA, 19 nt, Human
ucaccuacccccuccuccu

SEQ ID NO: 411282 - RNA, 22 nt, Human
uccaacuccagauguucuucau

SEQ ID NO: 411283 - RNA, 21 nt, Human
uccacugaauccuuuccccca

SEQ ID NO: 411284 - RNA, 19 nt, Human
uccgcgggagcuuugcugg

SEQ ID NO: 411285 - RNA, 23 nt, Human
uccgcgggagcuuugcuggaggg

SEQ ID NO: 411286 - RNA, 23 nt, Human
uccuacccgccguccgggcuccu

SEQ ID NO: 411287 - RNA, 18 nt, Human
uccuccuagcccgcccca

SEQ ID NO: 411288 - RNA, 19 nt, Human
ugacuggggcgcggggagg

SEQ ID NO: 411289 - RNA, 20 nt, Human
uggggaugugggugccuggc

SEQ ID NO: 411290 - RNA, 20 nt, Human
agaagaaagacggcucagag

SEQ ID NO: 411291 - RNA, 23 nt, Human
aggagaagaaagacggcucagag

SEQ ID NO: 411292 - RNA, 18 nt, Human
gaaauagggaggagaaga

SEQ ID NO: 411293 - RNA, 24 nt, Human
gaggagaagaaagacggcucagag

SEQ ID NO: 411294 - RNA, 19 nt, Human
gauccucucuuuggaagcu

SEQ ID NO: 411295 - RNA, 21 nt, Human
gcucagagggagggaggauuc

SEQ ID NO: 411296 - RNA, 22 nt, Human
ggaggagaagaaagacggcuca

SEQ ID NO: 411297 - RNA, 28 nt, Human
gggaggagaagaaagacggcucagaggg

SEQ ID NO: 411298 - RNA, 21 nt, Human
ugcuggcaaggguaugguauu

SEQ ID NO: 411299 - RNA, 18 nt, Human
uuuuuuuuuuuuuuuuug

SEQ ID NO: 411300 - RNA, 20 nt, Human
uuuuuuuuuuuuuuuuugcu

SEQ ID NO: 411301 - RNA, 22 nt, Human
uuuuuuuuuuuuuuuuugcugg

SEQ ID NO: 411302 - RNA, 23 nt, Human
uuuuuuuuuuuuuuuuuugcugg

SEQ ID NO: 411303 - RNA, 20 nt, Human
cacguacacacucuuccccg

SEQ ID NO: 411304 - RNA, 21 nt, Human
ccugaaagcucuguggggaga

SEQ ID NO: 411305 - RNA, 23 nt, Human
cucuuccccgccgucgcuagagu

SEQ ID NO: 411306 - RNA, 24 nt, Human
gaagcccccaccacguacacacuc

SEQ ID NO: 411307 - RNA, 23 nt, Human
gccaccgaggaagcccccaccac

SEQ ID NO: 411308 - RNA, 23 nt, Human
ggcagggaggggaaggggaggcc

SEQ ID NO: 411309 - RNA, 23 nt, Human
ggcuaggcuggcacgccgccgcg

SEQ ID NO: 411310 - RNA, 24 nt, Human
gggcagggaggggaaggggaggcc

SEQ ID NO: 411311 - RNA, 25 nt, Human
gggcagggaggggaaggggaggcca

SEQ ID NO: 411312 - RNA, 19 nt, Human
ggggaaggggaggccacug

SEQ ID NO: 411313 - RNA, 18 nt, Human
uccuggggcagggagggg

SEQ ID NO: 411314 - RNA, 19 nt, Human
ucuguggggagaagggcuc

SEQ ID NO: 411315 - RNA, 23 nt, Human
ucuguggggagaagggcucccug

SEQ ID NO: 411316 - RNA, 20 nt, Human
uuaaguccuggggcagggag

SEQ ID NO: 411317 - RNA, 25 nt, Human
aaaaaaaaaaacacaaacaacuguu

SEQ ID NO: 411318 - RNA, 19 nt, Human
aaaaaaaaaacacaaacaa

SEQ ID NO: 411319 - RNA, 24 nt, Human
aaaaaaaaaacacaaacaacuguu

SEQ ID NO: 411320 - RNA, 21 nt, Human
aaaaaacacaaacaacuguuc

SEQ ID NO: 411321 - RNA, 19 nt, Human
aaaagugcgccccacgccc

SEQ ID NO: 411322 - RNA, 19 nt, Human
aaacaacuguucagacuuc

SEQ ID NO: 411323 - RNA, 22 nt, Human
aaaguccauagugaugccuuuc

SEQ ID NO: 411324 - RNA, 23 nt, Human
aaguuuuuuuuuguuuuuccccu

SEQ ID NO: 411325 - RNA, 21 nt, Human
aaugcagaggugugaggaugg

SEQ ID NO: 411326 - RNA, 31 nt, Human
acauucuucgucaaaaaaaaaaaaaaaaaaa

SEQ ID NO: 411327 - RNA, 23 nt, Human
accggaucuauuugcauuuuacc

SEQ ID NO: 411328 - RNA, 23 nt, Human
acgcccuguuucuuugaauuugg

SEQ ID NO: 411329 - RNA, 18 nt, Human
cagaaaaauauacaaaga

SEQ ID NO: 411330 - RNA, 21 nt, Human
cagcccgccagcuucccccgc

SEQ ID NO: 411331 - RNA, 23 nt, Human
caguggcugauuggcacgaccuc

SEQ ID NO: 411332 - RNA, 20 nt, Human
ccccucagaggaaggaugaa

SEQ ID NO: 411333 - RNA, 22 nt, Human
ccccucagaggaaggaugaaaa

SEQ ID NO: 411334 - RNA, 22 nt, Human
ccucagcccgccagcuuccccc

SEQ ID NO: 411335 - RNA, 21 nt, Human
cgcguggccucgcgggcccgg

SEQ ID NO: 411336 - RNA, 22 nt, Human
cggcgacgcguggccucgcggg

SEQ ID NO: 411337 - RNA, 18 nt, Human
cgucugggaaucacuguc

SEQ ID NO: 411338 - RNA, 18 nt, Human
gaaggaugaaaaaaagaa

SEQ ID NO: 411339 - RNA, 22 nt, Human
gaggaaggaugaaaaaaagaau

SEQ ID NO: 411340 - RNA, 18 nt, Human
gaggagaagagcggggcg

SEQ ID NO: 411341 - RNA, 22 nt, Human
gauuuugcucuucuaauuucca

SEQ ID NO: 411342 - RNA, 25 nt, Human
gcuccagagucucuagacuguccau

SEQ ID NO: 411343 - RNA, 20 nt, Human
gcugaggggguggggggcuc

SEQ ID NO: 411344 - RNA, 21 nt, Human
gucaaaaaaaaaaaaaaaaaa

SEQ ID NO: 411345 - RNA, 21 nt, Human
uaggucuccggcccugcugag

SEQ ID NO: 411346 - RNA, 23 nt, Human
uaucagaaugcagaggugugagg

SEQ ID NO: 411347 - RNA, 22 nt, Human
ucagacuucuaucagaaugcag

SEQ ID NO: 411348 - RNA, 21 nt, Human
ucagcccgccagcuucccccg

SEQ ID NO: 411349 - RNA, 21 nt, Human
uccagagucucuagacugucc

SEQ ID NO: 411350 - RNA, 26 nt, Human
uccucugauuguuaccauuuuaaaau

SEQ ID NO: 411351 - RNA, 23 nt, Human
ucuucgucaaaaaaaaaaaaaaa

SEQ ID NO: 411352 - RNA, 22 nt, Human
ugacaucuaggucuccggcccu

SEQ ID NO: 411353 - RNA, 18 nt, Human
ugacuaugguuuugcagg

SEQ ID NO: 411354 - RNA, 19 nt, Human
ugcagaaaaauauacaaag

SEQ ID NO: 411355 - RNA, 24 nt, Human
uucucuggaaacaaugacaucuag

SEQ ID NO: 411356 - RNA, 25 nt, Human
uuguuuuuccccucagaggaaggau

SEQ ID NO: 411357 - RNA, 23 nt, Human
uuuugcucuucuaauuuccaaga

SEQ ID NO: 411358 - RNA, 23 nt, Human
uuuuuauuuuuaguuauccagcu

SEQ ID NO: 411359 - RNA, 20 nt, Human
uuuuuuguuuuuccccucag

SEQ ID NO: 411360 - RNA, 21 nt, Human
aaaaacacaucuuucaacuga

SEQ ID NO: 411361 - RNA, 20 nt, Human
aacuuuuaaaaacugugauc

SEQ ID NO: 411362 - RNA, 24 nt, Human
aagaaggaagcacucucagccuug

SEQ ID NO: 411363 - RNA, 23 nt, Human
aagugaccccauauggugaagau

SEQ ID NO: 411364 - RNA, 18 nt, Human
aauaaggccucugaaacu

SEQ ID NO: 411365 - RNA, 18 nt, Human
aaugaagacugcugcgaa

SEQ ID NO: 411366 - RNA, 20 nt, Human
acaaaaacacaucuuucaac

SEQ ID NO: 411367 - RNA, 21 nt, Human
acaacagucuucaguucuucu

SEQ ID NO: 411368 - RNA, 24 nt, Human
acauguaaaaaguguaaaaucaca

SEQ ID NO: 411369 - RNA, 21 nt, Human
acucgaaugcaaaaaaacugg

SEQ ID NO: 411370 - RNA, 23 nt, Human
acucucagccuugugaagaagaa

SEQ ID NO: 411371 - RNA, 24 nt, Human
aggguuccuggggcuaugaucaug

SEQ ID NO: 411372 - RNA, 25 nt, Human
auggagcuugaugucacauuuggcu

SEQ ID NO: 411373 - RNA, 22 nt, Human
caaaaacacaucuuucaacuga

SEQ ID NO: 411374 - RNA, 20 nt, Human
cacauguaaaaaguguaaaa

SEQ ID NO: 411375 - RNA, 20 nt, Human
caggagacacuuaguaugac

SEQ ID NO: 411376 - RNA, 18 nt, Human
cagguuccggauuuuccu

SEQ ID NO: 411377 - RNA, 23 nt, Human
caugaagagcaccacaaugaaga

SEQ ID NO: 411378 - RNA, 24 nt, Human
ccccuuuaucccaugaguuggaag

SEQ ID NO: 411379 - RNA, 18 nt, Human
cgaaugcaaaaaaacugc

SEQ ID NO: 411380 - RNA, 22 nt, Human
cuauacagcccaaaaacaugaa

SEQ ID NO: 411381 - RNA, 19 nt, Human
cucacacauagaaaaacga

SEQ ID NO: 411382 - RNA, 23 nt, Human
cugaagaaagauauucaccauaa

SEQ ID NO: 411383 - RNA, 18 nt, Human
cuuugcacuguuuucaag

SEQ ID NO: 411384 - RNA, 18 nt, Human
gaagagcaccacaaugaa

SEQ ID NO: 411385 - RNA, 22 nt, Human
gccucugaaacuguccaaucuc

SEQ ID NO: 411386 - RNA, 22 nt, Human
gggaugugaaauauuuuacaga

SEQ ID NO: 411387 - RNA, 19 nt, Human
ggggagcacacaacagucu

SEQ ID NO: 411388 - RNA, 22 nt, Human
guguuuaaaacucgaaugcaaa

SEQ ID NO: 411389 - RNA, 21 nt, Human
uaaagagcuauacagcccaaa

SEQ ID NO: 411390 - RNA, 24 nt, Human
uaaagagcuauacagcccaaaaac

SEQ ID NO: 411391 - RNA, 21 nt, Human
uaacaaaagacauuuccagaa

SEQ ID NO: 411392 - RNA, 19 nt, Human
uaagugaccccauauggug

SEQ ID NO: 411393 - RNA, 21 nt, Human
uacagcccaaaaacaugaaag

SEQ ID NO: 411394 - RNA, 18 nt, Human
uaugacaaaauaaggccu

SEQ ID NO: 411395 - RNA, 21 nt, Human
ucaccgggaucuguucaaagg

SEQ ID NO: 411396 - RNA, 24 nt, Human
ucuucaguucuucugcggugcucu

SEQ ID NO: 411397 - RNA, 23 nt, Human
ugaguuggaagaauuuauuuuca

SEQ ID NO: 411398 - RNA, 21 nt, Human
ugcucuacucacaaaaacaca

SEQ ID NO: 411399 - RNA, 22 nt, Human
ugcuuuugucuccucuucugga

SEQ ID NO: 411400 - RNA, 24 nt, Human
uggauuuccgaaacaauggagcuu

SEQ ID NO: 411401 - RNA, 22 nt, Human
ugugaagaagaaccucaagggu

SEQ ID NO: 411402 - RNA, 23 nt, Human
ugugaagaagaaccucaaggguu

SEQ ID NO: 411403 - RNA, 24 nt, Human
ugugaagaagaaccucaaggguuc

SEQ ID NO: 411404 - RNA, 25 nt, Human
ugugaagaagaaccucaaggguucc

SEQ ID NO: 411405 - RNA, 23 nt, Human
uuaaauuuuuaaaacuuuuaaaa

SEQ ID NO: 411406 - RNA, 20 nt, Human
uucaagggaguccccuuuau

SEQ ID NO: 411407 - RNA, 18 nt, Human
uuuacagaaaaauaagag

SEQ ID NO: 411408 - RNA, 21 nt, Human
uuuuacagaaaaauaagagug

SEQ ID NO: 411409 - RNA, 27 nt, Human
aaggaccgauggaaauggauccaaagc

SEQ ID NO: 411410 - RNA, 21 nt, Human
aaaaagaaacaaguagguaaa

SEQ ID NO: 411411 - RNA, 22 nt, Human
aaaauggcuuuuaagaccuuug

SEQ ID NO: 411412 - RNA, 20 nt, Human
aaaccaaccaucuucagccc

SEQ ID NO: 411413 - RNA, 19 nt, Human
aagugcuggcagcugcagu

SEQ ID NO: 411414 - RNA, 24 nt, Human
acaccccuguaucacaacaugggc

SEQ ID NO: 411415 - RNA, 18 nt, Human
acagggaaagcucucucc

SEQ ID NO: 411416 - RNA, 20 nt, Human
acaguagaccaguuucagcu

SEQ ID NO: 411417 - RNA, 24 nt, Human
accaguuucagcuuacauuuaaga

SEQ ID NO: 411418 - RNA, 19 nt, Human
agaaaaaaaaagcuccaaa

SEQ ID NO: 411419 - RNA, 18 nt, Human
agacaaaaagaaacaagu

SEQ ID NO: 411420 - RNA, 23 nt, Human
agaccaguuucagcuuacauuua

SEQ ID NO: 411421 - RNA, 20 nt, Human
agaggcuaagguggacccaa

SEQ ID NO: 411422 - RNA, 19 nt, Human
agccuccaaaaaaccuuga

SEQ ID NO: 411423 - RNA, 20 nt, Human
aggaaggggguucaaagggc

SEQ ID NO: 411424 - RNA, 21 nt, Human
aggaauuaaagugcuaagaac

SEQ ID NO: 411425 - RNA, 18 nt, Human
aggggguucaaagggcuu

SEQ ID NO: 411426 - RNA, 23 nt, Human
caaaaagccuccaaaaaaccuug

SEQ ID NO: 411427 - RNA, 24 nt, Human
caacaaacaccccuguaucacaac

SEQ ID NO: 411428 - RNA, 21 nt, Human
caaggcugacagcagcaaccc

SEQ ID NO: 411429 - RNA, 18 nt, Human
cagcccacacuuucuggc

SEQ ID NO: 411430 - RNA, 22 nt, Human
caggaagagagacaaaaagaaa

SEQ ID NO: 411431 - RNA, 22 nt, Human
caggagauugccugcugaccac

SEQ ID NO: 411432 - RNA, 20 nt, Human
cagugggcaaggcugacagc

SEQ ID NO: 411433 - RNA, 18 nt, Human
caguuacuacugcuuuaa

SEQ ID NO: 411434 - RNA, 25 nt, Human
ccauccaacaaacaccccuguauca

SEQ ID NO: 411435 - RNA, 25 nt, Human
ccauccaacaaacaccccuguauca

SEQ ID NO: 411436 - RNA, 18 nt, Human
ccauuuuuaccugacccg

SEQ ID NO: 411437 - RNA, 18 nt, Human
cccaggagauugccugcu

SEQ ID NO: 411438 - RNA, 20 nt, Human
cccuagagacacaguagacc

SEQ ID NO: 411439 - RNA, 23 nt, Human
ccuccaaaaaaccuugaaaagcu

SEQ ID NO: 411440 - RNA, 21 nt, Human
cgaaacuaucgaaaaggccuc

SEQ ID NO: 411441 - RNA, 18 nt, Human
cucauggcaguauuugga

SEQ ID NO: 411442 - RNA, 24 nt, Human
cugaccaagugcuggcagcugcag

SEQ ID NO: 411443 - RNA, 25 nt, Human
cugcagugaggggccaauaucccua

SEQ ID NO: 411444 - RNA, 25 nt, Human
cuuacauuuaagauggcagaagggg

SEQ ID NO: 411445 - RNA, 23 nt, Human
gaaaccaaccaucuucagcccac

SEQ ID NO: 411446 - RNA, 18 nt, Human
gagcagcuagcuuccuuu

SEQ ID NO: 411447 - RNA, 20 nt, Human
gaucacaggguugggcaucu

SEQ ID NO: 411448 - RNA, 19 nt, Human
gcccacacuuucuggcugu

SEQ ID NO: 411449 - RNA, 24 nt, Human
gcuuuuaugaacaccugcccucua

SEQ ID NO: 411450 - RNA, 19 nt, Human
gggcaaggcugacagcagc

SEQ ID NO: 411451 - RNA, 18 nt, Human
guagagcagcuagcuucc

SEQ ID NO: 411452 - RNA, 27 nt, Human
uaagauggcagaaggggagaacaacga

SEQ ID NO: 411453 - RNA, 26 nt, Human
uaagcaaagaugaccguaaucaacgg

SEQ ID NO: 411454 - RNA, 22 nt, Human
uaagguggacccacacuccauu

SEQ ID NO: 411455 - RNA, 22 nt, Human
uacaaaaagccuccaaaaaacc

SEQ ID NO: 411456 - RNA, 21 nt, Human
uacaugaagagaaaaccaucc

SEQ ID NO: 411457 - RNA, 22 nt, Human
uagaccaguuucagcuuacauu

SEQ ID NO: 411458 - RNA, 27 nt, Human
ucacaauuuacaaaaagccuccaaaaa

SEQ ID NO: 411459 - RNA, 19 nt, Human
ucagcccacacuuucuggc

SEQ ID NO: 411460 - RNA, 20 nt, Human
ucagcccacacuuucuggcu

SEQ ID NO: 411461 - RNA, 19 nt, Human
ucccaaaguuuuggccaca

SEQ ID NO: 411462 - RNA, 22 nt, Human
ucgaaaaggccucaauuuucaa

SEQ ID NO: 411463 - RNA, 19 nt, Human
ucgaaaaggcgccuaaaaa

SEQ ID NO: 411464 - RNA, 19 nt, Human
ucugacacaggacagugaa

SEQ ID NO: 411465 - RNA, 19 nt, Human
ucuuuuggcuuaacccuag

SEQ ID NO: 411466 - RNA, 20 nt, Human
ucuuuuggcuuaacccuaga

SEQ ID NO: 411467 - RNA, 25 nt, Human
ugaacaccugcccucuaguuucuca

SEQ ID NO: 411468 - RNA, 23 nt, Human
ugaagagaaaaccauccucccau

SEQ ID NO: 411469 - RNA, 20 nt, Human
ugaagucacagugggcaagg

SEQ ID NO: 411470 - RNA, 23 nt, Human
ugacaggaauuaaagugcuaaga

SEQ ID NO: 411471 - RNA, 18 nt, Human
ugaguguccaggaagaga

SEQ ID NO: 411472 - RNA, 24 nt, Human
ugcaauaggcuccaaaaauggcuu

SEQ ID NO: 411473 - RNA, 23 nt, Human
uggaagaaaaaaaaagcuccaaa

SEQ ID NO: 411474 - RNA, 24 nt, Human
uggaagaaaaaaaaagcuccaaau

SEQ ID NO: 411475 - RNA, 23 nt, Human
uggcaguauuuggagguucugau

SEQ ID NO: 411476 - RNA, 21 nt, Human
ugggcaaggcugacagcagca

SEQ ID NO: 411477 - RNA, 19 nt, Human
uuaugaacaccugcccucu

SEQ ID NO: 411478 - RNA, 19 nt, Human
uucaaggagaucugagaaa

SEQ ID NO: 411479 - RNA, 20 nt, Human
uucacuuuaaggaauuaagg

SEQ ID NO: 411480 - RNA, 26 nt, Human
uuuaagaaccuccuuuucccaaaguu

SEQ ID NO: 411481 - RNA, 25 nt, Human
uuuacaaaaagccuccaaaaaaccc

SEQ ID NO: 411482 - RNA, 26 nt, Human
aaagaaaaaaauucaacccuagaaaa

SEQ ID NO: 411483 - RNA, 24 nt, Human
aaagauauguacuguuucuccccc

SEQ ID NO: 411484 - RNA, 21 nt, Human
aacagcauccacacuggggcu

SEQ ID NO: 411485 - RNA, 18 nt, Human
aacauuccacuccacuaa

SEQ ID NO: 411486 - RNA, 25 nt, Human
aacccuagaaaacuugacaacgaga

SEQ ID NO: 411487 - RNA, 23 nt, Human
aagaaaaaaauucaacccuagaa

SEQ ID NO: 411488 - RNA, 23 nt, Human
aagaacccucuagaaaacuucgc

SEQ ID NO: 411489 - RNA, 23 nt, Human
acaaggaaaggucaugcuaaaac

SEQ ID NO: 411490 - RNA, 23 nt, Human
acaaggcacaguuguucauucaa

SEQ ID NO: 411491 - RNA, 19 nt, Human
acaguuguucauucaacag

SEQ ID NO: 411492 - RNA, 22 nt, Human
accgggucgaaaccgcacacgc

SEQ ID NO: 411493 - RNA, 23 nt, Human
acucagugcugcaacugagaaau

SEQ ID NO: 411494 - RNA, 18 nt, Human
acuucauggaugcauccc

SEQ ID NO: 411495 - RNA, 23 nt, Human
agaaagaaauagauacccaaugu

SEQ ID NO: 411496 - RNA, 20 nt, Human
agaacauuccacuccacuaa

SEQ ID NO: 411497 - RNA, 22 nt, Human
agaauaagaaaauccacaagga

SEQ ID NO: 411498 - RNA, 22 nt, Human
agcccaagaacccucuagaaaa

SEQ ID NO: 411499 - RNA, 25 nt, Human
agcuaccagaaaaacuuuuaaacaa

SEQ ID NO: 411500 - RNA, 22 nt, Human
agcuugcuuagaccagcacaca

SEQ ID NO: 411501 - RNA, 21 nt, Human
aggacacgcaggugccaagag

SEQ ID NO: 411502 - RNA, 21 nt, Human
aggacgugaggcagagccugu

SEQ ID NO: 411503 - RNA, 22 nt, Human
aggugccaagagcccaagaacc

SEQ ID NO: 411504 - RNA, 23 nt, Human
auggagaaaaaagaaaaaaauuc

SEQ ID NO: 411505 - RNA, 26 nt, Human
auuaaugccuuuuaauuuuaauguuu

SEQ ID NO: 411506 - RNA, 25 nt, Human
auuccacuccacuaagaaaagagaa

SEQ ID NO: 411507 - RNA, 22 nt, Human
caaagcauaaacacuucugcaa

SEQ ID NO: 411508 - RNA, 21 nt, Human
caacagaaaaagucaaaacca

SEQ ID NO: 411509 - RNA, 22 nt, Human
caaccuacacaguuagaaaaga

SEQ ID NO: 411510 - RNA, 21 nt, Human
caagccuacauagccuccaag

SEQ ID NO: 411511 - RNA, 24 nt, Human
cacacaauaaacuaaagacagaaa

SEQ ID NO: 411512 - RNA, 19 nt, Human
cacaugggcuugagacugg

SEQ ID NO: 411513 - RNA, 23 nt, Human
cagcacacaauaaacuaaagaca

SEQ ID NO: 411514 - RNA, 20 nt, Human
cagcugagauagaauccuca

SEQ ID NO: 411515 - RNA, 21 nt, Human
caggcagaugcauggguuccc

SEQ ID NO: 411516 - RNA, 18 nt, Human
cagggcccgaccguccuc

SEQ ID NO: 411517 - RNA, 18 nt, Human
caggggcucugcugccua

SEQ ID NO: 411518 - RNA, 20 nt, Human
caggugccaagagcccaaga

SEQ ID NO: 411519 - RNA, 20 nt, Human
cagugaccccagugugaugc

SEQ ID NO: 411520 - RNA, 23 nt, Human
cauacuauacuaccaaaugccag

SEQ ID NO: 411521 - RNA, 22 nt, Human
caucaggcccuccuucaggacu

SEQ ID NO: 411522 - RNA, 18 nt, Human
caucauguagcacacagg

SEQ ID NO: 411523 - RNA, 21 nt, Human
caucauguagcacacaggggc

SEQ ID NO: 411524 - RNA, 27 nt, Human
cauggaacuuaguauauguuucaauaa

SEQ ID NO: 411525 - RNA, 19 nt, Human
cauggaugcaucccuucga

SEQ ID NO: 411526 - RNA, 20 nt, Human
cauugcaaaugaucucagcu

SEQ ID NO: 411527 - RNA, 24 nt, Human
ccacuccacuaagaaaagagaauc

SEQ ID NO: 411528 - RNA, 22 nt, Human
ccagcacacaauaaacuaaaga

SEQ ID NO: 411529 - RNA, 22 nt, Human
ccccauuucugguguaugucug

SEQ ID NO: 411530 - RNA, 26 nt, Human
cccgaccguccucacaugacaugcug

SEQ ID NO: 411531 - RNA, 22 nt, Human
cccuuccuaaacagaccuuaaa

SEQ ID NO: 411532 - RNA, 18 nt, Human
ccgccuacuguucuaauu

SEQ ID NO: 411533 - RNA, 21 nt, Human
ccugccaaaugucagcuucaa

SEQ ID NO: 411534 - RNA, 24 nt, Human
ccugugggggacggucaggggcuc

SEQ ID NO: 411535 - RNA, 23 nt, Human
cgacgcagagcuuacaagaauuu

SEQ ID NO: 411536 - RNA, 21 nt, Human
cgccacgaagcugccuggguu

SEQ ID NO: 411537 - RNA, 23 nt, Human
cguguucaaaacucaaccuacac

SEQ ID NO: 411538 - RNA, 19 nt, Human
cuccuuuucccuuuuccca

SEQ ID NO: 411539 - RNA, 19 nt, Human
cugcugcacccaggcgcaa

SEQ ID NO: 411540 - RNA, 20 nt, Human
cuuaaaauaucuucccuucc

SEQ ID NO: 411541 - RNA, 21 nt, Human
cuuaaaauaucuucccuuccc

SEQ ID NO: 411542 - RNA, 23 nt, Human
cuucaagaacugcuggcaggagg

SEQ ID NO: 411543 - RNA, 24 nt, Human
cuucacauccaccuguguucaaaa

SEQ ID NO: 411544 - RNA, 21 nt, Human
gaaaauccuucacauccaccu

SEQ ID NO: 411545 - RNA, 22 nt, Human
gacaacgagaauaagaaaaucc

SEQ ID NO: 411546 - RNA, 22 nt, Human
gaccauggccgccuaucuuucu

SEQ ID NO: 411547 - RNA, 19 nt, Human
gagaagaaacugcugagca

SEQ ID NO: 411548 - RNA, 23 nt, Human
gagaagaaacugcugagcagguc

SEQ ID NO: 411549 - RNA, 23 nt, Human
gagauagaauccucagccaguac

SEQ ID NO: 411550 - RNA, 18 nt, Human
gagcccaagaacccucua

SEQ ID NO: 411551 - RNA, 21 nt, Human
gaggacgugaggcagagccug

SEQ ID NO: 411552 - RNA, 20 nt, Human
gcagagccugugggggacgg

SEQ ID NO: 411553 - RNA, 23 nt, Human
gcccagaaauguauuuugaccac

SEQ ID NO: 411554 - RNA, 27 nt, Human
gccugccuucuauucaccaacuccuau

SEQ ID NO: 411555 - RNA, 22 nt, Human
ggacgugaggcagagccugugg

SEQ ID NO: 411556 - RNA, 19 nt, Human
guaaagaacaguccauuuc

SEQ ID NO: 411557 - RNA, 22 nt, Human
guguucaaaacucaaccuacac

SEQ ID NO: 411558 - RNA, 23 nt, Human
guucauucaacagaaaaagucaa

SEQ ID NO: 411559 - RNA, 18 nt, Human
guuucucccccauuucug

SEQ ID NO: 411560 - RNA, 23 nt, Human
uaaaaagcaauuaccacaaaaca

SEQ ID NO: 411561 - RNA, 22 nt, Human
uaaauaaaacugaauaugguca

SEQ ID NO: 411562 - RNA, 20 nt, Human
uaagaaaagagaaucacaac

SEQ ID NO: 411563 - RNA, 19 nt, Human
uaagaaaauccacaaggaa

SEQ ID NO: 411564 - RNA, 22 nt, Human
uacagaaucugaacaagacaag

SEQ ID NO: 411565 - RNA, 23 nt, Human
uacuaccaaaugccaggcaaugg

SEQ ID NO: 411566 - RNA, 19 nt, Human
uacuauacuaccaaaugcc

SEQ ID NO: 411567 - RNA, 20 nt, Human
uagaaaagacagcugagaua

SEQ ID NO: 411568 - RNA, 18 nt, Human
uagaguagcaggaaugaa

SEQ ID NO: 411569 - RNA, 18 nt, Human
uagcaggaaugaaaaaga

SEQ ID NO: 411570 - RNA, 26 nt, Human
uagcaggaaugaaaaagaagcuucaa

SEQ ID NO: 411571 - RNA, 21 nt, Human
uagcauaaagcuaaagcuacc

SEQ ID NO: 411572 - RNA, 22 nt, Human
ucaacugccucaauugcucucu

SEQ ID NO: 411573 - RNA, 26 nt, Human
ucauggaugcaucccuucgaugcccu

SEQ ID NO: 411574 - RNA, 20 nt, Human
uccaagggggccuugggcgg

SEQ ID NO: 411575 - RNA, 19 nt, Human
uccacaagcacguguucaa

SEQ ID NO: 411576 - RNA, 22 nt, Human
uccacuaagaaaagagaaucac

SEQ ID NO: 411577 - RNA, 19 nt, Human
ugaagcuuugugugaccgg

SEQ ID NO: 411578 - RNA, 20 nt, Human
ugacuucauggaugcauccc

SEQ ID NO: 411579 - RNA, 18 nt, Human
ugagaaauacagguagag

SEQ ID NO: 411580 - RNA, 19 nt, Human
ugagauagaauccucagcc

SEQ ID NO: 411581 - RNA, 23 nt, Human
ugagcaggucaguaaagaacagu

SEQ ID NO: 411582 - RNA, 22 nt, Human
ugaggcagagccugugggggac

SEQ ID NO: 411583 - RNA, 20 nt, Human
ugcaaaaauuccacaaggca

SEQ ID NO: 411584 - RNA, 20 nt, Human
ugcagucuuggcaacagcau

SEQ ID NO: 411585 - RNA, 21 nt, Human
ugccuaaaugccaggcagaug

SEQ ID NO: 411586 - RNA, 19 nt, Human
ugcucccaucccugggcuc

SEQ ID NO: 411587 - RNA, 22 nt, Human
ugcugagcaggucaguaaagaa

SEQ ID NO: 411588 - RNA, 18 nt, Human
uggaaaagccuccccguc

SEQ ID NO: 411589 - RNA, 19 nt, Human
uggaccauggccgccuauc

SEQ ID NO: 411590 - RNA, 22 nt, Human
uggagaaaaaaacaaauuaaaa

SEQ ID NO: 411591 - RNA, 18 nt, Human
uggauacucuagccauga

SEQ ID NO: 411592 - RNA, 22 nt, Human
ugggcuugagacuggugacuuc

SEQ ID NO: 411593 - RNA, 26 nt, Human
uuaguagcuuuugaagucugcccucc

SEQ ID NO: 411594 - RNA, 19 nt, Human
uucaagucugucagugacc

SEQ ID NO: 411595 - RNA, 21 nt, Human
uucaucucuaauaucauuaac

SEQ ID NO: 411596 - RNA, 22 nt, Human
uugacaaacacauaacugaggc

SEQ ID NO: 411597 - RNA, 19 nt, Human
uuucccuuuucccauuucu

SEQ ID NO: 411598 - RNA, 19 nt, Human
accggggccgaaugcggcc

SEQ ID NO: 411599 - RNA, 21 nt, Human
agaaaugccagggggcucgga

SEQ ID NO: 411600 - RNA, 24 nt, Human
agaccggggccgaaugcggccgga

SEQ ID NO: 411601 - RNA, 21 nt, Human
agccauccugggucuggccuc

SEQ ID NO: 411602 - RNA, 18 nt, Human
aggugcaggggugaggug

SEQ ID NO: 411603 - RNA, 18 nt, Human
cauccugggucuggccuc

SEQ ID NO: 411604 - RNA, 19 nt, Human
ccaggagccuggggggggg

SEQ ID NO: 411605 - RNA, 24 nt, Human
ccagucccgggcgggccgucgcgg

SEQ ID NO: 411606 - RNA, 18 nt, Human
cccaaaccuggccugcag

SEQ ID NO: 411607 - RNA, 21 nt, Human
cccaaaccuggccugcagcca

SEQ ID NO: 411608 - RNA, 19 nt, Human
ccccugagccaucccugug

SEQ ID NO: 411609 - RNA, 18 nt, Human
cccgccgcgcugccugcg

SEQ ID NO: 411610 - RNA, 21 nt, Human
cccgccgcgcugccugcgccg

SEQ ID NO: 411611 - RNA, 19 nt, Human
cccgggcgggccgucgcgg

SEQ ID NO: 411612 - RNA, 19 nt, Human
ccgccgcgcugccugcgcc

SEQ ID NO: 411613 - RNA, 18 nt, Human
ccugcagccauccugggu

SEQ ID NO: 411614 - RNA, 21 nt, Human
ccugcagccauccugggucug

SEQ ID NO: 411615 - RNA, 18 nt, Human
ccugcgccggaccggggc

SEQ ID NO: 411616 - RNA, 19 nt, Human
ccugggggggggugcccgg

SEQ ID NO: 411617 - RNA, 19 nt, Human
ccugggucuggccuccgag

SEQ ID NO: 411618 - RNA, 19 nt, Human
cggcagaggcugagaggug

SEQ ID NO: 411619 - RNA, 22 nt, Human
cgggagaggugagagcgcuggc

SEQ ID NO: 411620 - RNA, 22 nt, Human
cggggcggguccagucccgggc

SEQ ID NO: 411621 - RNA, 19 nt, Human
cuucuggggcagcuagggc

SEQ ID NO: 411622 - RNA, 19 nt, Human
gcgggcgcaccgugugccc

SEQ ID NO: 411623 - RNA, 19 nt, Human
gcggguccagucccgggcg

SEQ ID NO: 411624 - RNA, 20 nt, Human
gggggggggugcccggcggc

SEQ ID NO: 411625 - RNA, 23 nt, Human
ggggggugcccggcggcagaggc

SEQ ID NO: 411626 - RNA, 20 nt, Human
ucagaaaaaguacccucuuu

SEQ ID NO: 411627 - RNA, 22 nt, Human
ucagaaaaaguacccucuuuau

SEQ ID NO: 411628 - RNA, 24 nt, Human
ugagguggacaguccccugagcca

SEQ ID NO: 411629 - RNA, 21 nt, Human
ugcagccauccugggucuggc

SEQ ID NO: 411630 - RNA, 25 nt, Human
uuuuuuuuuuuuuuuuuuuuaucag

SEQ ID NO: 411631 - RNA, 20 nt, Human
aagggcuggauuagugcccc

SEQ ID NO: 411632 - RNA, 20 nt, Human
acagacccgggcaucggagc

SEQ ID NO: 411633 - RNA, 21 nt, Human
accaggugcucccauccaagu

SEQ ID NO: 411634 - RNA, 18 nt, Human
agggagguccucagggug

SEQ ID NO: 411635 - RNA, 25 nt, Human
agggugaguccuggagcucccugug

SEQ ID NO: 411636 - RNA, 21 nt, Human
agugccccuacaaauguuggg

SEQ ID NO: 411637 - RNA, 20 nt, Human
caagcaagccacuuagcaau

SEQ ID NO: 411638 - RNA, 24 nt, Human
caauucugggccucaguuucccca

SEQ ID NO: 411639 - RNA, 20 nt, Human
caggaguaaggcacacggug

SEQ ID NO: 411640 - RNA, 23 nt, Human
caggugcucccauccaagugcag

SEQ ID NO: 411641 - RNA, 23 nt, Human
ccaagaaagaaaaauaaguucac

SEQ ID NO: 411642 - RNA, 20 nt, Human
cccggaccccuccccgcucc

SEQ ID NO: 411643 - RNA, 22 nt, Human
cccucugcagccacugccuggu

SEQ ID NO: 411644 - RNA, 19 nt, Human
ccgcgcccgcguccagacu

SEQ ID NO: 411645 - RNA, 20 nt, Human
ccgcggcuucuuccugagga

SEQ ID NO: 411646 - RNA, 24 nt, Human
ccucaagaucaugguuaggcucac

SEQ ID NO: 411647 - RNA, 23 nt, Human
ccucugcagccacugccuggucc

SEQ ID NO: 411648 - RNA, 22 nt, Human
cgcccgcguccagacucacccu

SEQ ID NO: 411649 - RNA, 21 nt, Human
cggcagguggcucagcugagg

SEQ ID NO: 411650 - RNA, 19 nt, Human
cuggagcucccugugucaa

SEQ ID NO: 411651 - RNA, 23 nt, Human
cugggccucaguuuccccaucug

SEQ ID NO: 411652 - RNA, 21 nt, Human
gcagccaguccccgcggcuuc

SEQ ID NO: 411653 - RNA, 24 nt, Human
gccccuacaaauguugggucccuc

SEQ ID NO: 411654 - RNA, 22 nt, Human
ggaacacaagcucgaacccgga

SEQ ID NO: 411655 - RNA, 24 nt, Human
gguccaguccucccaggcagggcu

SEQ ID NO: 411656 - RNA, 19 nt, Human
ggucccucaagaucauggu

SEQ ID NO: 411657 - RNA, 21 nt, Human
guaaggcacacggugugggug

SEQ ID NO: 411658 - RNA, 21 nt, Human
gugaggcugacaucccccucu

SEQ ID NO: 411659 - RNA, 18 nt, Human
uaccagaugguggagaug

SEQ ID NO: 411660 - RNA, 23 nt, Human
ucaaaagaugguuguaauguuuc

SEQ ID NO: 411661 - RNA, 22 nt, Human
uccugaggaccuccggccgcgc

SEQ ID NO: 411662 - RNA, 21 nt, Human
ucugcagccacugccugguug

SEQ ID NO: 411663 - RNA, 19 nt, Human
ugaggcugacaucccccuc

SEQ ID NO: 411664 - RNA, 18 nt, Human
ugggggauuuaagggcug

SEQ ID NO: 411665 - RNA, 24 nt, Human
uuaccagaugguggagaugguggg

SEQ ID NO: 411666 - RNA, 23 nt, Human
uucacagagguggggucucuaga

SEQ ID NO: 411667 - RNA, 28 nt, Human
agcaagacaaagacaggugucgcggacc

SEQ ID NO: 411668 - RNA, 21 nt, Human
cagcagauauucucugggaac

SEQ ID NO: 411669 - RNA, 23 nt, Human
gaaaauguuaaaagggcugagug

SEQ ID NO: 411670 - RNA, 29 nt, Human
gacagguguguucuaccugaguuggaagg

SEQ ID NO: 411671 - RNA, 24 nt, Human
guucuaccugaguuggaagaaggc

SEQ ID NO: 411672 - RNA, 20 nt, Human
ucacaaggucugcaggaacu

SEQ ID NO: 411673 - RNA, 19 nt, Human
ucacagauuucucuuucca

SEQ ID NO: 411674 - RNA, 18 nt, Human
ugaaaacagcaagacaaa

SEQ ID NO: 411675 - RNA, 20 nt, Human
ugaaaacagcaagacaaaga

SEQ ID NO: 411676 - RNA, 22 nt, Human
ugaaaacagcaagacaaagaca

SEQ ID NO: 411677 - RNA, 19 nt, Human
uggaagaaggcuacacuuu

SEQ ID NO: 411678 - RNA, 24 nt, Human
uguauuagguuacaauuuugcaaa

SEQ ID NO: 411679 - RNA, 21 nt, Human
uuaaaagggcugagugaaaac

SEQ ID NO: 411680 - RNA, 21 nt, Human
uuacuuugaguuagagugagg

SEQ ID NO: 411681 - RNA, 25 nt, Human
uucacauacaaauaacaguuccuca

SEQ ID NO: 411682 - RNA, 18 nt, Human
uuuacagaaaaauaccag

SEQ ID NO: 411683 - RNA, 21 nt, Human
uuuacagaaaaauaccagcag

SEQ ID NO: 411684 - RNA, 23 nt, Human
aaagauggugaagauucagaccu

SEQ ID NO: 411685 - RNA, 24 nt, Human
aaccacuaguuuucaaaaaaaucc

SEQ ID NO: 411686 - RNA, 21 nt, Human
aaccaggacuggcccacuucc

SEQ ID NO: 411687 - RNA, 20 nt, Human
aaccccuuaccaacccucac

SEQ ID NO: 411688 - RNA, 24 nt, Human
aagcaugcuccccucaacuucucc

SEQ ID NO: 411689 - RNA, 19 nt, Human
acccucaccuaaaagggaa

SEQ ID NO: 411690 - RNA, 22 nt, Human
agcaggaggguagggcccacag

SEQ ID NO: 411691 - RNA, 19 nt, Human
aggaauucccccucaucag

SEQ ID NO: 411692 - RNA, 20 nt, Human
aggagggaggagggcggggc

SEQ ID NO: 411693 - RNA, 21 nt, Human
aggagggaggagggcggggcc

SEQ ID NO: 411694 - RNA, 21 nt, Human
agggagccuuuaauguuugug

SEQ ID NO: 411695 - RNA, 20 nt, Human
agggaggagggcggggcccu

SEQ ID NO: 411696 - RNA, 19 nt, Human
caaauggccccgaugcccu

SEQ ID NO: 411697 - RNA, 22 nt, Human
caaccccuuaccaacccucacc

SEQ ID NO: 411698 - RNA, 27 nt, Human
cacccaugguaaccauggaaacauaac

SEQ ID NO: 411699 - RNA, 23 nt, Human
caccccuuccucuugcuggcucg

SEQ ID NO: 411700 - RNA, 23 nt, Human
cacuugcuccugggcaagccuca

SEQ ID NO: 411701 - RNA, 24 nt, Human
cagagugguugcaggaagaacugg

SEQ ID NO: 411702 - RNA, 21 nt, Human
cagcaccccuuccucuugcug

SEQ ID NO: 411703 - RNA, 21 nt, Human
cagcuaggacccgccccaugc

SEQ ID NO: 411704 - RNA, 18 nt, Human
cagcucaguggccaccag

SEQ ID NO: 411705 - RNA, 22 nt, Human
caggaagaacugggauugggug

SEQ ID NO: 411706 - RNA, 24 nt, Human
caggaauucccccucaucaggccu

SEQ ID NO: 411707 - RNA, 24 nt, Human
cauucuuaucuucuuuugugaagg

SEQ ID NO: 411708 - RNA, 22 nt, Human
ccaaauggccccgaugcccucu

SEQ ID NO: 411709 - RNA, 22 nt, Human
ccaacccucaccuaaaagggaa

SEQ ID NO: 411710 - RNA, 23 nt, Human
ccacagagcuggaccugcccucc

SEQ ID NO: 411711 - RNA, 25 nt, Human
ccagaggcucccccaccaaggcugg

SEQ ID NO: 411712 - RNA, 18 nt, Human
ccaugccgggcccggccc

SEQ ID NO: 411713 - RNA, 22 nt, Human
cccacacugccauccacaccca

SEQ ID NO: 411714 - RNA, 18 nt, Human
cccacuccugccagcugc

SEQ ID NO: 411715 - RNA, 18 nt, Human
cccaugcauuccagaggc

SEQ ID NO: 411716 - RNA, 21 nt, Human
ccccacacugccauccacacc

SEQ ID NO: 411717 - RNA, 23 nt, Human
cccccaccaaggcugggguccag

SEQ ID NO: 411718 - RNA, 22 nt, Human
ccggccaaauggccccgaugcc

SEQ ID NO: 411719 - RNA, 18 nt, Human
ccuugcugucugggcugg

SEQ ID NO: 411720 - RNA, 21 nt, Human
cggccaaauggccccgaugcc

SEQ ID NO: 411721 - RNA, 23 nt, Human
cggccaaauggccccgaugcccu

SEQ ID NO: 411722 - RNA, 23 nt, Human
cuaacagcuuggaaaugucccua

SEQ ID NO: 411723 - RNA, 20 nt, Human
cucccccaccaaggcugggg

SEQ ID NO: 411724 - RNA, 19 nt, Human
cuccggccucacuugcucc

SEQ ID NO: 411725 - RNA, 22 nt, Human
cugggcuggggucagacggggc

SEQ ID NO: 411726 - RNA, 24 nt, Human
cugggguccagguuccaggaauuc

SEQ ID NO: 411727 - RNA, 21 nt, Human
cuuaagcagcaggggcagcuc

SEQ ID NO: 411728 - RNA, 25 nt, Human
cuuaucuucuuuugugaagguucug

SEQ ID NO: 411729 - RNA, 22 nt, Human
cuuccaucaagccaaggccuaa

SEQ ID NO: 411730 - RNA, 22 nt, Human
gaccugcccuccccacacugcc

SEQ ID NO: 411731 - RNA, 28 nt, Human
gaccugcccuccccacacugccauccac

SEQ ID NO: 411732 - RNA, 19 nt, Human
gacuugggacagaagaggc

SEQ ID NO: 411733 - RNA, 26 nt, Human
gaggagggcggggcccuuucauucuu

SEQ ID NO: 411734 - RNA, 19 nt, Human
gccccgaugcccucugccu

SEQ ID NO: 411735 - RNA, 23 nt, Human
gcggaaucagaaagauggugaag

SEQ ID NO: 411736 - RNA, 21 nt, Human
gcggcgacgccgcaccaugcc

SEQ ID NO: 411737 - RNA, 22 nt, Human
gcugggguccagguuccaggaa

SEQ ID NO: 411738 - RNA, 22 nt, Human
ggaauucccccucaucaggccu

SEQ ID NO: 411739 - RNA, 18 nt, Human
ggcacuaaaggucaccgu

SEQ ID NO: 411740 - RNA, 23 nt, Human
ggcuuagucagccagcucagugg

SEQ ID NO: 411741 - RNA, 21 nt, Human
gggacagaagaggcuguccag

SEQ ID NO: 411742 - RNA, 24 nt, Human
ggggcagcucagcaggaggguagg

SEQ ID NO: 411743 - RNA, 24 nt, Human
ggguugggcucagacacagcugcc

SEQ ID NO: 411744 - RNA, 19 nt, Human
gguagggcccacagagcug

SEQ ID NO: 411745 - RNA, 18 nt, Human
gguugcaggaagaacugg

SEQ ID NO: 411746 - RNA, 24 nt, Human
uaacagcuaggacccgccccaugc

SEQ ID NO: 411747 - RNA, 23 nt, Human
uaaccauggaaacauaaccaccc

SEQ ID NO: 411748 - RNA, 20 nt, Human
uaaguaaauaggugugaggu

SEQ ID NO: 411749 - RNA, 20 nt, Human
uaauagcugggccaccaggc

SEQ ID NO: 411750 - RNA, 25 nt, Human
uaccaacccucaccuaaaagggaau

SEQ ID NO: 411751 - RNA, 23 nt, Human
uaggcagggugcggaaucagaaa

SEQ ID NO: 411752 - RNA, 21 nt, Human
uaggucuuuagucuucaauuu

SEQ ID NO: 411753 - RNA, 23 nt, Human
uauuacaaggacaucucuuucug

SEQ ID NO: 411754 - RNA, 18 nt, Human
ucagcaggaggguagggc

SEQ ID NO: 411755 - RNA, 18 nt, Human
ucaggagcacgguacaag

SEQ ID NO: 411756 - RNA, 20 nt, Human
ucaguggccaccagagccgg

SEQ ID NO: 411757 - RNA, 21 nt, Human
uccacacccaugguaaccaug

SEQ ID NO: 411758 - RNA, 18 nt, Human
uccaggaauucccccuca

SEQ ID NO: 411759 - RNA, 19 nt, Human
uccaucaagccaaggccua

SEQ ID NO: 411760 - RNA, 23 nt, Human
uccucuugcuggcucggcacgcu

SEQ ID NO: 411761 - RNA, 22 nt, Human
uccugaacuccucuccggccuc

SEQ ID NO: 411762 - RNA, 23 nt, Human
ucugggcuggggucagacggggc

SEQ ID NO: 411763 - RNA, 18 nt, Human
ugacccggucagcugcag

SEQ ID NO: 411764 - RNA, 18 nt, Human
ugccaggcuggccacaga

SEQ ID NO: 411765 - RNA, 21 nt, Human
ugccaggcuggccacagagug

SEQ ID NO: 411766 - RNA, 20 nt, Human
ugccuuuggaagaggggcac

SEQ ID NO: 411767 - RNA, 18 nt, Human
uggaagaggggcaccuga

SEQ ID NO: 411768 - RNA, 18 nt, Human
uggaagaggggcaccuga

SEQ ID NO: 411769 - RNA, 19 nt, Human
uggcacuaaaggucaccgu

SEQ ID NO: 411770 - RNA, 23 nt, Human
ugggcuggggucagacggggcuu

SEQ ID NO: 411771 - RNA, 23 nt, Human
ugucccuaacagcuaggacccgc

SEQ ID NO: 411772 - RNA, 20 nt, Human
ugucugggcuggggucagac

SEQ ID NO: 411773 - RNA, 25 nt, Human
ugucugggcuggggucagacggggc

SEQ ID NO: 411774 - RNA, 25 nt, Human
uugggugauuuggucaguccgggcu

SEQ ID NO: 411775 - RNA, 21 nt, Human
uuuagaaggguugggcucaga

SEQ ID NO: 411776 - RNA, 22 nt, Human
uuuguuagucuuaggauauuuu

SEQ ID NO: 411777 - RNA, 24 nt, Human
uuuuaucuuuuucuuguggaugac

SEQ ID NO: 411778 - RNA, 19 nt, Human
ccggaugcugcuggacacc

SEQ ID NO: 411779 - RNA, 23 nt, Human
gcagggugggcuucaggaauggc

SEQ ID NO: 411780 - RNA, 19 nt, Human
ggagaguauuggggagcgg

SEQ ID NO: 411781 - RNA, 22 nt, Human
gggauguggcgcagcgcggacg

SEQ ID NO: 411782 - RNA, 18 nt, Human
uaggaguuggaaugaggu

SEQ ID NO: 411783 - RNA, 20 nt, Human
uaucauguugcugacuguca

SEQ ID NO: 411784 - RNA, 23 nt, Human
ucucagggauggcacucuguggg

SEQ ID NO: 411785 - RNA, 23 nt, Human
uggaaugaggugcagggugggcu

SEQ ID NO: 411786 - RNA, 21 nt, Human
uugcugacugucaugauucgg

SEQ ID NO: 411787 - RNA, 21 nt, Human
uuggggagcggucuggucucu

SEQ ID NO: 411788 - RNA, 23 nt, Human
uuuuuuuuuuugugcuucauguu

SEQ ID NO: 411789 - RNA, 24 nt, Human
uuuuuuuuuuuuuuuuuugugcuu

SEQ ID NO: 411790 - RNA, 27 nt, Human
uuuuuuuuuuuuuuuuuuuuuuugggg

SEQ ID NO: 411791 - RNA, 19 nt, Human
aaaaagaagaccaaugaaa

SEQ ID NO: 411792 - RNA, 22 nt, Human
aaaaagaagaccaaugaaauaa

SEQ ID NO: 411793 - RNA, 24 nt, Human
aaaggcugauaaaugauaagauaa

SEQ ID NO: 411794 - RNA, 25 nt, Human
aagaagguaauaaagugaaagaaaa

SEQ ID NO: 411795 - RNA, 23 nt, Human
aagagugcaaaacaaagaccugg

SEQ ID NO: 411796 - RNA, 18 nt, Human
aagaucaaaaagagaaaa

SEQ ID NO: 411797 - RNA, 28 nt, Human
aagugaagauuuucccucuccaaaguuu

SEQ ID NO: 411798 - RNA, 23 nt, Human
accugguuugcagcucuuugugu

SEQ ID NO: 411799 - RNA, 23 nt, Human
agagcaguauaaaacauguucuc

SEQ ID NO: 411800 - RNA, 22 nt, Human
aggaaaauccagcucacaaucc

SEQ ID NO: 411801 - RNA, 22 nt, Human
auaauauguuaauauuuuacuu

SEQ ID NO: 411802 - RNA, 22 nt, Human
cagauaaaaaagaagaccaaug

SEQ ID NO: 411803 - RNA, 21 nt, Human
cagcgaauugagaggcaggga

SEQ ID NO: 411804 - RNA, 22 nt, Human
cauaaaaggcugauaaaugaua

SEQ ID NO: 411805 - RNA, 20 nt, Human
caugccaaagaucuucacac

SEQ ID NO: 411806 - RNA, 26 nt, Human
ccaaagaucuucacacuauccuuaag

SEQ ID NO: 411807 - RNA, 18 nt, Human
ccagauaaaaaagaagac

SEQ ID NO: 411808 - RNA, 25 nt, Human
ccagauaaaaaagaagaccaaugaa

SEQ ID NO: 411809 - RNA, 18 nt, Human
ccauggaccucuaagaug

SEQ ID NO: 411810 - RNA, 19 nt, Human
cuagaacuuuaaugcuaac

SEQ ID NO: 411811 - RNA, 19 nt, Human
cuccaaaguuugacaaaga

SEQ ID NO: 411812 - RNA, 22 nt, Human
cuccaaaguuugacaaagaugg

SEQ ID NO: 411813 - RNA, 24 nt, Human
cuuggaaaauacauaaaaggcugg

SEQ ID NO: 411814 - RNA, 21 nt, Human
gagaggcagggaaacacagug

SEQ ID NO: 411815 - RNA, 24 nt, Human
gaucaaaaagagaaaauauauuuc

SEQ ID NO: 411816 - RNA, 21 nt, Human
gcuuugaaaaguaugccuaga

SEQ ID NO: 411817 - RNA, 19 nt, Human
uaaaaaagaagaccaauga

SEQ ID NO: 411818 - RNA, 22 nt, Human
uaaaacauguucuccauaugcc

SEQ ID NO: 411819 - RNA, 22 nt, Human
uagcacaagaucaaaaagagaa

SEQ ID NO: 411820 - RNA, 18 nt, Human
uaucaaacauuauuuucc

SEQ ID NO: 411821 - RNA, 23 nt, Human
uaugaccaccuuauacaguucuu

SEQ ID NO: 411822 - RNA, 26 nt, Human
uaugcuuguauuagaaagaagguaau

SEQ ID NO: 411823 - RNA, 23 nt, Human
ucacacuauccuuaaauaucaug

SEQ ID NO: 411824 - RNA, 27 nt, Human
ucacauacucaaccuuuaaaucaugcc

SEQ ID NO: 411825 - RNA, 22 nt, Human
ugaaaauuaaaacccauugaaa

SEQ ID NO: 411826 - RNA, 19 nt, Human
ugaaagaaaauacaguuaa

SEQ ID NO: 411827 - RNA, 23 nt, Human
ugccuagaacuuuaaugcuaaca

SEQ ID NO: 411828 - RNA, 24 nt, Human
ugcuugaaauaagagugcaaaaca

SEQ ID NO: 411829 - RNA, 21 nt, Human
uggaccucuaagauguuagaa

SEQ ID NO: 411830 - RNA, 22 nt, Human
uggcaaacacaggcaauaucca

SEQ ID NO: 411831 - RNA, 20 nt, Human
uguagccuugaaccugagac

SEQ ID NO: 411832 - RNA, 20 nt, Human
uuguuguagccuugaaccug

SEQ ID NO: 411833 - RNA, 21 nt, Human
uuuaaguggacauuuacuauc

SEQ ID NO: 411834 - RNA, 22 nt, Human
aaccuucgcuccugcacacuuc

SEQ ID NO: 411835 - RNA, 21 nt, Human
agcagcggugccaggucagaa

SEQ ID NO: 411836 - RNA, 22 nt, Human
cagaggcucuaagaggaagucc

SEQ ID NO: 411837 - RNA, 23 nt, Human
caguagcauucagugguaugguu

SEQ ID NO: 411838 - RNA, 27 nt, Human
caucucauuucaagccucauuuggagg

SEQ ID NO: 411839 - RNA, 20 nt, Human
ccugcacacuucaguguccu

SEQ ID NO: 411840 - RNA, 19 nt, Human
ccuggggcgcuucuggggc

SEQ ID NO: 411841 - RNA, 20 nt, Human
gggcucgcuggccugggcuu

SEQ ID NO: 411842 - RNA, 19 nt, Human
gguugaaaggggagggagg

SEQ ID NO: 411843 - RNA, 26 nt, Human
gugaagaugaaaugacgugacgaaua

SEQ ID NO: 411844 - RNA, 19 nt, Human
uaggccgccguagcagcgg

SEQ ID NO: 411845 - RNA, 21 nt, Human
ucagugguaugguuguuucuu

SEQ ID NO: 411846 - RNA, 19 nt, Human
uccacagugugagguccau

SEQ ID NO: 411847 - RNA, 21 nt, Human
uccacagugugagguccaugg

SEQ ID NO: 411848 - RNA, 18 nt, Human
ucgcuggccugggcuucu

SEQ ID NO: 411849 - RNA, 24 nt, Human
ugaaaggggagggaggaacaucuc

SEQ ID NO: 411850 - RNA, 21 nt, Human
ugccaggucagaagccgagcc

SEQ ID NO: 411851 - RNA, 26 nt, Human
uggcuuggguaccuaacucagaggcu

SEQ ID NO: 411852 - RNA, 20 nt, Human
ugguuguuucuuagagauga

SEQ ID NO: 411853 - RNA, 30 nt, Human
uuauggugaugagaucgacaaucuccccuu

SEQ ID NO: 411854 - RNA, 21 nt, Human
uugaaaggggagggaggaaca

SEQ ID NO: 411855 - RNA, 20 nt, Human
uuuggaggugggggugaaga

SEQ ID NO: 411856 - RNA, 19 nt, Human
aaauuccccuuaugaacug

SEQ ID NO: 411857 - RNA, 19 nt, Human
agacauaagguaaaaaugg

SEQ ID NO: 411858 - RNA, 28 nt, Human
cccacccgccgccgccgcugccgucgac

SEQ ID NO: 411859 - RNA, 20 nt, Human
ccccuuaugaacugguuugg

SEQ ID NO: 411860 - RNA, 18 nt, Human
ccgccgccgccgcugccg

SEQ ID NO: 411861 - RNA, 19 nt, Human
ccgccgccgcugccgucga

SEQ ID NO: 411862 - RNA, 18 nt, Human
cuagcagacauaagguaa

SEQ ID NO: 411863 - RNA, 24 nt, Human
ucccacccgccgccgccgcugccg

SEQ ID NO: 411864 - RNA, 18 nt, Human
gccugaccccucagacau

SEQ ID NO: 411865 - RNA, 19 nt, Human
uuauugaggcuccagggcc

SEQ ID NO: 411866 - RNA, 19 nt, Human
aagaaaaaacgauugggaa

SEQ ID NO: 411867 - RNA, 22 nt, Human
acagcagcaucucccagccucu

SEQ ID NO: 411868 - RNA, 18 nt, Human
aggcgaaagccggaggga

SEQ ID NO: 411869 - RNA, 19 nt, Human
agugauggacccagaaaaa

SEQ ID NO: 411870 - RNA, 18 nt, Human
cacaugguuucugccucu

SEQ ID NO: 411871 - RNA, 22 nt, Human
cacucgguguacaugcugcagg

SEQ ID NO: 411872 - RNA, 22 nt, Human
cacucgguguacaugcugcagg

SEQ ID NO: 411873 - RNA, 25 nt, Human
cagaaaaagaaaaaacgauugggaa

SEQ ID NO: 411874 - RNA, 23 nt, Human
cagccucugcacaugguuucugc

SEQ ID NO: 411875 - RNA, 19 nt, Human
ccagaaaaagaaaaaacga

SEQ ID NO: 411876 - RNA, 25 nt, Human
ccagaaaaagaaaaaacgauuggga

SEQ ID NO: 411877 - RNA, 26 nt, Human
ccagaaaaagaaaaaacgauugggaa

SEQ ID NO: 411878 - RNA, 20 nt, Human
ccagccaccugcccugugcu

SEQ ID NO: 411879 - RNA, 18 nt, Human
cccagaaaaagaaaaaac

SEQ ID NO: 411880 - RNA, 24 nt, Human
cccauguggauauggcuaaagagu

SEQ ID NO: 411881 - RNA, 19 nt, Human
cccgcagcugggcuggugg

SEQ ID NO: 411882 - RNA, 18 nt, Human
cgccucuggaaacagcag

SEQ ID NO: 411883 - RNA, 23 nt, Human
cuccacucugagguuaugacaac

SEQ ID NO: 411884 - RNA, 19 nt, Human
cugcacaugguuucugccu

SEQ ID NO: 411885 - RNA, 23 nt, Human
gccaccugcccugugcuccccgc

SEQ ID NO: 411886 - RNA, 26 nt, Human
gcccugugcuccccgcagcugggcug

SEQ ID NO: 411887 - RNA, 21 nt, Human
ucccgggcaguugugucccca

SEQ ID NO: 411888 - RNA, 26 nt, Human
uccuucguguguggugagucuuuaau

SEQ ID NO: 411889 - RNA, 24 nt, Human
ucucccagccucugcacaugguuu

SEQ ID NO: 411890 - RNA, 19 nt, Human
ugagacuaagacgccucug

SEQ ID NO: 411891 - RNA, 21 nt, Human
ugcagacacucgguguacaug

SEQ ID NO: 411892 - RNA, 18 nt, Human
uguguccccagcugcaga

SEQ ID NO: 411893 - RNA, 21 nt, Human
uuccugcccuuaggccaagaa

SEQ ID NO: 411894 - RNA, 26 nt, Human
aagcucacccaacaaagccaaccgcc

SEQ ID NO: 411895 - RNA, 21 nt, Human
acccaacaaagccaaccgccc

SEQ ID NO: 411896 - RNA, 22 nt, Human
cacaaacaagcucacccaacag

SEQ ID NO: 411897 - RNA, 21 nt, Human
cacccaacaaagccaaccgcc

SEQ ID NO: 411898 - RNA, 18 nt, Human
ccaacaaagccaaccgcc

SEQ ID NO: 411899 - RNA, 22 nt, Human
ccaaucaccaaccacguccacc

SEQ ID NO: 411900 - RNA, 22 nt, Human
ccacccacagggacacaaacaa

SEQ ID NO: 411901 - RNA, 23 nt, Human
ccacccacagggacacaaacaag

SEQ ID NO: 411902 - RNA, 20 nt, Human
gccaaucaccaaccacgucc

SEQ ID NO: 411903 - RNA, 19 nt, Human
guccacccacagggacaca

SEQ ID NO: 411904 - RNA, 19 nt, Human
ugaaacuuguaauuucuaa

SEQ ID NO: 411905 - RNA, 26 nt, Human
aaaaaaaaaaaaaaaacaccaauugg

SEQ ID NO: 411906 - RNA, 26 nt, Human
aaaaaaaaaaaaaacaccaauuggga

SEQ ID NO: 411907 - RNA, 28 nt, Human
aaaaaacuucacaaaacacacucgccaa

SEQ ID NO: 411908 - RNA, 27 nt, Human
aaaaagccaaaaacggccagaauuuag

SEQ ID NO: 411909 - RNA, 24 nt, Human
aaaacaccaauugggaaugcaaca

SEQ ID NO: 411910 - RNA, 19 nt, Human
aaacggccagaauuuagcg

SEQ ID NO: 411911 - RNA, 23 nt, Human
aagccaaaaacggccagaauuua

SEQ ID NO: 411912 - RNA, 22 nt, Human
acaaaaaagccaaaaacggcca

SEQ ID NO: 411913 - RNA, 25 nt, Human
acaaaaaagccaaaaacggccagaa

SEQ ID NO: 411914 - RNA, 22 nt, Human
caaaaacggccagaauuuagcg

SEQ ID NO: 411915 - RNA, 31 nt, Human
caaaauaaacuuaaaaaaaaaaaaaaaaaaa

SEQ ID NO: 411916 - RNA, 24 nt, Human
caacuuuauugaaaggaaagugca

SEQ ID NO: 411917 - RNA, 18 nt, Human
guugaaaccuuaaaaggg

SEQ ID NO: 411918 - RNA, 23 nt, Human
uaaacuuaaaaaaaaaaaaaaag

SEQ ID NO: 411919 - RNA, 25 nt, Human
uaacacugaaaauuacauauugacc

SEQ ID NO: 411920 - RNA, 20 nt, Human
ucaaaaggugccuaaaaaaa

SEQ ID NO: 411921 - RNA, 20 nt, Human
uuaaaaaaaaaaaaaaaaaa

SEQ ID NO: 411922 - RNA, 20 nt, Human
uucaaaaggugccuaaaaaa

SEQ ID NO: 411923 - RNA, 18 nt, Human
uugacccaaaugauuaca

SEQ ID NO: 411924 - RNA, 21 nt, Human
uuuacuagucuaacacugaaa

SEQ ID NO: 411925 - RNA, 21 nt, Human
uuuguugaaaccuuaaaaggg

SEQ ID NO: 411926 - RNA, 18 nt, Human
accccauccccagggugg

SEQ ID NO: 411927 - RNA, 18 nt, Human
caacaccccauccccagg

SEQ ID NO: 411928 - RNA, 24 nt, Human
ccaaaucuuacucuacucaucuca

SEQ ID NO: 411929 - RNA, 22 nt, Human
ccacccaaaucuuacucuacuc

SEQ ID NO: 411930 - RNA, 18 nt, Human
cccacccaaaucuuacuc

SEQ ID NO: 411931 - RNA, 20 nt, Human
cccaucccacccaaaucuua

SEQ ID NO: 411932 - RNA, 21 nt, Human
ccugccaacaccccaucccca

SEQ ID NO: 411933 - RNA, 22 nt, Human
ggaaaucaucagaagauguguu

SEQ ID NO: 411934 - RNA, 26 nt, Human
ggcaauauacuucauccccugaaagg

SEQ ID NO: 411935 - RNA, 19 nt, Human
ugaccccugccaacacccc

SEQ ID NO: 411936 - RNA, 23 nt, Human
ugccaacaccccauccccagggu

SEQ ID NO: 411937 - RNA, 21 nt, Human
uguguuagaaucaaagaaaca

SEQ ID NO: 411938 - RNA, 26 nt, Human
agccaaaugggaacccugggcuggaa

SEQ ID NO: 411939 - RNA, 24 nt, Human
aggcaguggcaagagggguucagg

SEQ ID NO: 411940 - RNA, 21 nt, Human
agguagaaggcaguggcaaga

SEQ ID NO: 411941 - RNA, 20 nt, Human
gaugaugagggaacaccaga

SEQ ID NO: 411942 - RNA, 21 nt, Human
ggaacccugggcuggaagggg

SEQ ID NO: 411943 - RNA, 18 nt, Human
ggguguggagaggggugg

SEQ ID NO: 411944 - RNA, 23 nt, Human
uaguugggccacugccagaagcc

SEQ ID NO: 411945 - RNA, 24 nt, Human
ugagggaacaccagacuuggcuag

SEQ ID NO: 411946 - RNA, 19 nt, Human
uggcuaguugggccacugc

SEQ ID NO: 411947 - RNA, 19 nt, Human
uucaaacaagguagaaggc

SEQ ID NO: 411948 - RNA, 22 nt, Human
uucagguagggggaugaugagg

SEQ ID NO: 411949 - RNA, 24 nt, Human
uuuuugggaguuauuaauucuuua

SEQ ID NO: 411950 - RNA, 19 nt, Human
aaaauaacugccugaaaac

SEQ ID NO: 411951 - RNA, 20 nt, Human
aaacacauucacuucuaaau

SEQ ID NO: 411952 - RNA, 33 nt, Human
aaacacuucagcaaucauuuuguuaaaaauagu

SEQ ID NO: 411953 - RNA, 19 nt, Human
aaacccagaagaccaauag

SEQ ID NO: 411954 - RNA, 25 nt, Human
aaacuggaaaugaaauacaacagaa

SEQ ID NO: 411955 - RNA, 23 nt, Human
aagcaccucuuguauaacaauuc

SEQ ID NO: 411956 - RNA, 22 nt, Human
aaggaccagccaggaugaaaca

SEQ ID NO: 411957 - RNA, 20 nt, Human
acaauaauaaaaauaacugc

SEQ ID NO: 411958 - RNA, 23 nt, Human
acacaagugaaggaccagccagg

SEQ ID NO: 411959 - RNA, 19 nt, Human
acagauaugcuaugcuccc

SEQ ID NO: 411960 - RNA, 21 nt, Human
acguuguaauucauaugacug

SEQ ID NO: 411961 - RNA, 22 nt, Human
agaagaccaauaauucugaaac

SEQ ID NO: 411962 - RNA, 23 nt, Human
agaaggggaggcggaagcaccca

SEQ ID NO: 411963 - RNA, 21 nt, Human
aggaagauggaaacagcacaa

SEQ ID NO: 411964 - RNA, 24 nt, Human
aggaggccgaagaggcuggagaag

SEQ ID NO: 411965 - RNA, 18 nt, Human
aggcuggagaagcaggag

SEQ ID NO: 411966 - RNA, 22 nt, Human
aggggaggcggaagcacccaga

SEQ ID NO: 411967 - RNA, 25 nt, Human
aguacaauaauaaaaauaacugccu

SEQ ID NO: 411968 - RNA, 18 nt, Human
auggccagcuucuuuaaa

SEQ ID NO: 411969 - RNA, 21 nt, Human
auuugaguggaaaauaguuug

SEQ ID NO: 411970 - RNA, 19 nt, Human
caaaaacccagaagaccaa

SEQ ID NO: 411971 - RNA, 18 nt, Human
caacagaaaaacugaagc

SEQ ID NO: 411972 - RNA, 23 nt, Human
caacagaaaaacugaagcauuag

SEQ ID NO: 411973 - RNA, 22 nt, Human
caaggaagauggaaacagcaca

SEQ ID NO: 411974 - RNA, 21 nt, Human
caauugcuguacuccuuuagc

SEQ ID NO: 411975 - RNA, 22 nt, Human
cacaccucuuuuaaaaagcaaa

SEQ ID NO: 411976 - RNA, 19 nt, Human
cacuuagggcagcacugau

SEQ ID NO: 411977 - RNA, 22 nt, Human
cagaaaaacugaagcauuagua

SEQ ID NO: 411978 - RNA, 19 nt, Human
cagaagaccaauaauucug

SEQ ID NO: 411979 - RNA, 19 nt, Human
cagcagcuugcaaagagag

SEQ ID NO: 411980 - RNA, 20 nt, Human
cauuccucugcucccacacc

SEQ ID NO: 411981 - RNA, 24 nt, Human
ccacaccucuuuuaaaaagcaaaa

SEQ ID NO: 411982 - RNA, 24 nt, Human
ccagccaggaugaaacacuucagc

SEQ ID NO: 411983 - RNA, 22 nt, Human
ccauauuccaaacacauucacu

SEQ ID NO: 411984 - RNA, 20 nt, Human
cccauacugcuacuuaaagg

SEQ ID NO: 411985 - RNA, 22 nt, Human
ccucugcucccacaccucuuuu

SEQ ID NO: 411986 - RNA, 20 nt, Human
cgaggaggccgaagaggcug

SEQ ID NO: 411987 - RNA, 25 nt, Human
cuggagaagcaggagaaggggaggc

SEQ ID NO: 411988 - RNA, 20 nt, Human
cuggucaucaagcuaagcau

SEQ ID NO: 411989 - RNA, 19 nt, Human
cuuggcaaggaagauggaa

SEQ ID NO: 411990 - RNA, 22 nt, Human
cuuuuaaaaagcaaaaacccag

SEQ ID NO: 411991 - RNA, 20 nt, Human
gaagggguaggaaaacuugg

SEQ ID NO: 411992 - RNA, 23 nt, Human
gcgagcggggucagggguggggc

SEQ ID NO: 411993 - RNA, 18 nt, Human
gcuggagaagcaggagaa

SEQ ID NO: 411994 - RNA, 19 nt, Human
gcuuuaagguucucagaug

SEQ ID NO: 411995 - RNA, 20 nt, Human
ggagaagcaggagaagggga

SEQ ID NO: 411996 - RNA, 25 nt, Human
ggaggccgaagaggcuggagaagca

SEQ ID NO: 411997 - RNA, 20 nt, Human
ggaggcggaagcacccagag

SEQ ID NO: 411998 - RNA, 22 nt, Human
ggaggcggaagcacccagagga

SEQ ID NO: 411999 - RNA, 22 nt, Human
gggaggcggaagcacccagagg

SEQ ID NO: 412000 - RNA, 20 nt, Human
ggggcauacacuggggucuc

SEQ ID NO: 412001 - RNA, 22 nt, Human
uaaaaagcaaaaacccagaaga

SEQ ID NO: 412002 - RNA, 18 nt, Human
uagcucaaaaacucacga

SEQ ID NO: 412003 - RNA, 20 nt, Human
uagcugaguccuucaacuuu

SEQ ID NO: 412004 - RNA, 19 nt, Human
uaucacaggauuuuuagcu

SEQ ID NO: 412005 - RNA, 25 nt, Human
uauccaaaaaaagaucgcagacauu

SEQ ID NO: 412006 - RNA, 23 nt, Human
ucacgauuguuuccauuccucug

SEQ ID NO: 412007 - RNA, 19 nt, Human
ucagaugcugaaagggaag

SEQ ID NO: 412008 - RNA, 24 nt, Human
ucagcagcuugcaaagagaggaug

SEQ ID NO: 412009 - RNA, 25 nt, Human
ucagggguggggcauacacuggggu

SEQ ID NO: 412010 - RNA, 19 nt, Human
ucaucaagcuaagcauaag

SEQ ID NO: 412011 - RNA, 20 nt, Human
uccaaaaaaagaucgcagac

SEQ ID NO: 412012 - RNA, 22 nt, Human
uccaaacacauucacuucuaaa

SEQ ID NO: 412013 - RNA, 25 nt, Human
ucccacaccucuuuuaaaaagcaaa

SEQ ID NO: 412014 - RNA, 22 nt, Human
ucuaaaaguauaaauauccaaa

SEQ ID NO: 412015 - RNA, 21 nt, Human
ugaaauacaacagaaaaacug

SEQ ID NO: 412016 - RNA, 23 nt, Human
ugacugagaucuuaguaucacag

SEQ ID NO: 412017 - RNA, 22 nt, Human
ugcaaagagaggaugugucagu

SEQ ID NO: 412018 - RNA, 19 nt, Human
ugccacagauaugcuaugc

SEQ ID NO: 412019 - RNA, 21 nt, Human
ugccaguaaauacuacguugu

SEQ ID NO: 412020 - RNA, 28 nt, Human
ugcuguacuccuuuagcugaguccuuca

SEQ ID NO: 412021 - RNA, 23 nt, Human
uguaaugacaggaguagggaggu

SEQ ID NO: 412022 - RNA, 23 nt, Human
uucuuauggccagcuucuuuaaa

SEQ ID NO: 412023 - RNA, 21 nt, Human
uugcuguacuccuuuagcuga

SEQ ID NO: 412024 - RNA, 22 nt, Human
aaaaaagucccgcgcagccccc

SEQ ID NO: 412025 - RNA, 20 nt, Human
aaaaacuuuaagugcuuuuc

SEQ ID NO: 412026 - RNA, 22 nt, Human
aaacacuaucccgucucccucc

SEQ ID NO: 412027 - RNA, 19 nt, Human
aaacagauaugcauugcau

SEQ ID NO: 412028 - RNA, 20 nt, Human
aaagucccgcgcagcccccc

SEQ ID NO: 412029 - RNA, 25 nt, Human
aaagucccgcgcagcccccccaccc

SEQ ID NO: 412030 - RNA, 19 nt, Human
aaagugcugggacuacagg

SEQ ID NO: 412031 - RNA, 21 nt, Human
aaagugcugggacuacaggug

SEQ ID NO: 412032 - RNA, 22 nt, Human
aaagugcugggacuacaggugg

SEQ ID NO: 412033 - RNA, 24 nt, Human
aaagugcugggacuacagguggga

SEQ ID NO: 412034 - RNA, 23 nt, Human
aaauaaaguuggagauuauaauc

SEQ ID NO: 412035 - RNA, 20 nt, Human
aacacuaucccgucucccuc

SEQ ID NO: 412036 - RNA, 20 nt, Human
aacucagcaggcccuggcau

SEQ ID NO: 412037 - RNA, 22 nt, Human
aagaaacucuugggguuacuaa

SEQ ID NO: 412038 - RNA, 21 nt, Human
aagaagcaacucagcaggccc

SEQ ID NO: 412039 - RNA, 21 nt, Human
aagauacacaagcuuuuguag

SEQ ID NO: 412040 - RNA, 26 nt, Human
aaguagcugagacuacaggcaagugc

SEQ ID NO: 412041 - RNA, 19 nt, Human
aagugcugggacuacaggu

SEQ ID NO: 412042 - RNA, 26 nt, Human
aagugcugggacuacaggugggagcc

SEQ ID NO: 412043 - RNA, 25 nt, Human
aauccuuaaaaccuguggcacuuaa

SEQ ID NO: 412044 - RNA, 18 nt, Human
acagcucacugcagccuc

SEQ ID NO: 412045 - RNA, 24 nt, Human
acccaggcuggagugcaauggcau

SEQ ID NO: 412046 - RNA, 23 nt, Human
accucagccuccuaaguagcuga

SEQ ID NO: 412047 - RNA, 18 nt, Human
accuggcccagccuauaa

SEQ ID NO: 412048 - RNA, 18 nt, Human
acuaguuuaggcucggcg

SEQ ID NO: 412049 - RNA, 18 nt, Human
acugcagccucaaccucc

SEQ ID NO: 412050 - RNA, 23 nt, Human
agaaacacuaucccgucucccuc

SEQ ID NO: 412051 - RNA, 25 nt, Human
agugauccucccgccuuugccuccc

SEQ ID NO: 412052 - RNA, 23 nt, Human
agugcaauggcauaaucacagcu

SEQ ID NO: 412053 - RNA, 24 nt, Human
auccucccgccuuugccucccaaa

SEQ ID NO: 412054 - RNA, 21 nt, Human
auggauaugagaagaaacucu

SEQ ID NO: 412055 - RNA, 20 nt, Human
auguugcccuggcuggucuc

SEQ ID NO: 412056 - RNA, 18 nt, Human
auugcucugucacccagg

SEQ ID NO: 412057 - RNA, 20 nt, Human
auuuuuggcaauguuuaugg

SEQ ID NO: 412058 - RNA, 27 nt, Human
caaagugcugggacuacaggugggagc

SEQ ID NO: 412059 - RNA, 28 nt, Human
caagugauccucccgccuuugccuccca

SEQ ID NO: 412060 - RNA, 24 nt, Human
caaugacgucucccuccgccgccu

SEQ ID NO: 412061 - RNA, 21 nt, Human
cacaggugguucaacagaauu

SEQ ID NO: 412062 - RNA, 19 nt, Human
cacugcagccucaaccucc

SEQ ID NO: 412063 - RNA, 19 nt, Human
cacuuggaaaaaaauacaa

SEQ ID NO: 412064 - RNA, 24 nt, Human
cacuuggaaaaaaauacaaacagg

SEQ ID NO: 412065 - RNA, 19 nt, Human
cagcaaaacaagucgcauc

SEQ ID NO: 412066 - RNA, 21 nt, Human
cagccuauaagcauuuaucca

SEQ ID NO: 412067 - RNA, 24 nt, Human
cagccucaaccuccuaggcauaag

SEQ ID NO: 412068 - RNA, 20 nt, Human
cagcggggcgcgguuccccc

SEQ ID NO: 412069 - RNA, 22 nt, Human
cagugugagugcugggggagga

SEQ ID NO: 412070 - RNA, 24 nt, Human
cauaaugaauagaagcuguagaua

SEQ ID NO: 412071 - RNA, 21 nt, Human
ccaaagugcugggacuacagg

SEQ ID NO: 412072 - RNA, 22 nt, Human
ccaaagugcugggacuacaggu

SEQ ID NO: 412073 - RNA, 19 nt, Human
ccacccccggcggcgcggc

SEQ ID NO: 412074 - RNA, 24 nt, Human
cccaaagugcugggacuacaggug

SEQ ID NO: 412075 - RNA, 19 nt, Human
ccccgagcccuucagcggg

SEQ ID NO: 412076 - RNA, 20 nt, Human
ccccugggcuuccugaagua

SEQ ID NO: 412077 - RNA, 19 nt, Human
cccgcgcagcccccccacc

SEQ ID NO: 412078 - RNA, 19 nt, Human
cccgcgcagcccccccacc

SEQ ID NO: 412079 - RNA, 19 nt, Human
cccuccgccgccuccggau

SEQ ID NO: 412080 - RNA, 19 nt, Human
cccuccgccgcuaccacag

SEQ ID NO: 412081 - RNA, 23 nt, Human
ccgccgagacugacaaacaaccc

SEQ ID NO: 412082 - RNA, 23 nt, Human
ccgccgccgagacugacaaacaa

SEQ ID NO: 412083 - RNA, 18 nt, Human
ccgccgccgccgccgccg

SEQ ID NO: 412084 - RNA, 18 nt, Human
ccgccgccgccgccgccg

SEQ ID NO: 412085 - RNA, 18 nt, Human
ccgccgccgccgccgccg

SEQ ID NO: 412086 - RNA, 18 nt, Human
ccgccgccgccgccgccg

SEQ ID NO: 412087 - RNA, 19 nt, Human
ccgccgccgccgccgccga

SEQ ID NO: 412088 - RNA, 23 nt, Human
ccgccgccgccgccgccgccgag

SEQ ID NO: 412089 - RNA, 24 nt, Human
ccgccgccgccgccgccgccgccg

SEQ ID NO: 412090 - RNA, 24 nt, Human
ccgccgccgccgccgccgccgccg

SEQ ID NO: 412091 - RNA, 24 nt, Human
ccgccgccgccgccgccgccgccg

SEQ ID NO: 412092 - RNA, 24 nt, Human
ccgccgccgccgccgccgccgccg

SEQ ID NO: 412093 - RNA, 25 nt, Human
ccgccgccgccgccgccgccgccga

SEQ ID NO: 412094 - RNA, 23 nt, Human
ccgccuccggaucccuccgcccu

SEQ ID NO: 412095 - RNA, 24 nt, Human
ccgccuuugccucccaaagugcug

SEQ ID NO: 412096 - RNA, 24 nt, Human
ccuaaguagcugagacuacaggca

SEQ ID NO: 412097 - RNA, 22 nt, Human
ccucccgccuuugccucccaaa

SEQ ID NO: 412098 - RNA, 26 nt, Human
ccucccgccuuugccucccaaagugc

SEQ ID NO: 412099 - RNA, 18 nt, Human
ccuggccucaagugaucc

SEQ ID NO: 412100 - RNA, 22 nt, Human
ccuggccucaagugauccuccc

SEQ ID NO: 412101 - RNA, 22 nt, Human
ccuggccucaagugauccuccc

SEQ ID NO: 412102 - RNA, 20 nt, Human
ccuuaaaaccuguggcacuu

SEQ ID NO: 412103 - RNA, 29 nt, Human
cgccgagacugacaaacaacccugcaaca

SEQ ID NO: 412104 - RNA, 23 nt, Human
cgccgccgagacugacaaacaac

SEQ ID NO: 412105 - RNA, 22 nt, Human
cggggcgcgguucccccugggc

SEQ ID NO: 412106 - RNA, 19 nt, Human
cuaaagaauucaaaaauaa

SEQ ID NO: 412107 - RNA, 24 nt, Human
cucaagugauccucccgccuuugc

SEQ ID NO: 412108 - RNA, 21 nt, Human
cuccaauaugugccuuucuca

SEQ ID NO: 412109 - RNA, 23 nt, Human
cuccacaccaacauuauacacuu

SEQ ID NO: 412110 - RNA, 21 nt, Human
cuccuaaguagcugagacuac

SEQ ID NO: 412111 - RNA, 22 nt, Human
cugcagccucaaccuccuaggc

SEQ ID NO: 412112 - RNA, 20 nt, Human
cuuuuuuuucugcagaaucc

SEQ ID NO: 412113 - RNA, 18 nt, Human
gaagugccaacugugaaa

SEQ ID NO: 412114 - RNA, 22 nt, Human
gccgagacugacaaacaacccu

SEQ ID NO: 412115 - RNA, 21 nt, Human
gccuuccccgagcccuucagc

SEQ ID NO: 412116 - RNA, 22 nt, Human
gccuuugccucccaaagugcug

SEQ ID NO: 412117 - RNA, 20 nt, Human
gcucugucacccaggcugga

SEQ ID NO: 412118 - RNA, 27 nt, Human
gcucugucacccaggcuggagugcaau

SEQ ID NO: 412119 - RNA, 24 nt, Human
gcugccccgcggucagucugaaaa

SEQ ID NO: 412120 - RNA, 19 nt, Human
gcuggagugcaauggcaua

SEQ ID NO: 412121 - RNA, 19 nt, Human
gcuuuuauuuuuaaagaca

SEQ ID NO: 412122 - RNA, 20 nt, Human
ggaaaaaaauacaaacagga

SEQ ID NO: 412123 - RNA, 21 nt, Human
ggacuacaggugggagccacc

SEQ ID NO: 412124 - RNA, 23 nt, Human
ggacuacaggugggagccaccug

SEQ ID NO: 412125 - RNA, 18 nt, Human
ggauaugagaagaaacuc

SEQ ID NO: 412126 - RNA, 18 nt, Human
ggcaagugccacuaugcc

SEQ ID NO: 412127 - RNA, 24 nt, Human
ggccucaagugauccucccgccuu

SEQ ID NO: 412128 - RNA, 22 nt, Human
ggcucggcgggguggagaaaga

SEQ ID NO: 412129 - RNA, 22 nt, Human
gggggaggagggggcgggacgc

SEQ ID NO: 412130 - RNA, 21 nt, Human
ggucagucugaaaaaaaaaaa

SEQ ID NO: 412131 - RNA, 22 nt, Human
gugagugcugggggaggagggg

SEQ ID NO: 412132 - RNA, 25 nt, Human
uaaaaaaaaaaucuccacaagaaga

SEQ ID NO: 412133 - RNA, 22 nt, Human
uaacuuaguucacaccaugcaa

SEQ ID NO: 412134 - RNA, 22 nt, Human
uacaggcaagugccacuaugcc

SEQ ID NO: 412135 - RNA, 24 nt, Human
uacaggcaagugccacuaugccca

SEQ ID NO: 412136 - RNA, 22 nt, Human
uagauggagagcuagagacuua

SEQ ID NO: 412137 - RNA, 22 nt, Human
uaucccgucucccuccccguca

SEQ ID NO: 412138 - RNA, 24 nt, Human
uaucccgucucccuccccgucacu

SEQ ID NO: 412139 - RNA, 22 nt, Human
uaugucuagaauuacucaauug

SEQ ID NO: 412140 - RNA, 24 nt, Human
uaugugccuuucucaaaccaauuc

SEQ ID NO: 412141 - RNA, 24 nt, Human
uauguugcccuggcuggucucaaa

SEQ ID NO: 412142 - RNA, 23 nt, Human
uauugcucugucacccaggcugg

SEQ ID NO: 412143 - RNA, 24 nt, Human
uauugcucugucacccaggcugga

SEQ ID NO: 412144 - RNA, 22 nt, Human
ucacaccaugcaauaaaaagua

SEQ ID NO: 412145 - RNA, 18 nt, Human
ucacccaggcuggagugc

SEQ ID NO: 412146 - RNA, 19 nt, Human
ucacugcagccucaaccuc

SEQ ID NO: 412147 - RNA, 23 nt, Human
ucacugcagccucaaccuccuag

SEQ ID NO: 412148 - RNA, 24 nt, Human
ucacugcagccucaaccuccuagg

SEQ ID NO: 412149 - RNA, 25 nt, Human
ucacuguggaucgccgccgccgccg

SEQ ID NO: 412150 - RNA, 26 nt, Human
ucauuaaucaaaaaauuuuuuaaagu

SEQ ID NO: 412151 - RNA, 21 nt, Human
uccacaccaacauuauacacu

SEQ ID NO: 412152 - RNA, 23 nt, Human
ucccaaagugcugggacuacagg

SEQ ID NO: 412153 - RNA, 20 nt, Human
ucccgucucccuccccguca

SEQ ID NO: 412154 - RNA, 18 nt, Human
uccgcagcugccccgcgg

SEQ ID NO: 412155 - RNA, 24 nt, Human
uccuaaguagcugagacuacaggc

SEQ ID NO: 412156 - RNA, 25 nt, Human
ucgccgccgccgccgccgccgccgg

SEQ ID NO: 412157 - RNA, 23 nt, Human
ucgccgccgccgccgccgccggg

SEQ ID NO: 412158 - RNA, 21 nt, Human
ucucccuccgccgccuccgga

SEQ ID NO: 412159 - RNA, 27 nt, Human
ucucuguguucagacuagagguugugg

SEQ ID NO: 412160 - RNA, 24 nt, Human
ucugucacccaggcuggagugcaa

SEQ ID NO: 412161 - RNA, 21 nt, Human
ugagacuacaggcaagugcca

SEQ ID NO: 412162 - RNA, 24 nt, Human
ugagacuacaggcaagugccacua

SEQ ID NO: 412163 - RNA, 20 nt, Human
ugcuaauacuggggcaugaa

SEQ ID NO: 412164 - RNA, 20 nt, Human
ugcucauggcagaagugcca

SEQ ID NO: 412165 - RNA, 24 nt, Human
ugcucugucacccaggcuggagug

SEQ ID NO: 412166 - RNA, 24 nt, Human
ugcugggacuacaggugggagcca

SEQ ID NO: 412167 - RNA, 19 nt, Human
ugcugggggaggagggggc

SEQ ID NO: 412168 - RNA, 20 nt, Human
ugcugggggaggagggggcc

SEQ ID NO: 412169 - RNA, 21 nt, Human
uggaaaaaaauacaaacagga

SEQ ID NO: 412170 - RNA, 20 nt, Human
uggacagagucaaaccaguu

SEQ ID NO: 412171 - RNA, 21 nt, Human
uggagugcaauggcauaauca

SEQ ID NO: 412172 - RNA, 23 nt, Human
uggcauaaucacagcucacugca

SEQ ID NO: 412173 - RNA, 18 nt, Human
uggccucaagugauccuc

SEQ ID NO: 412174 - RNA, 24 nt, Human
uggccucaagugauccucccgccu

SEQ ID NO: 412175 - RNA, 21 nt, Human
ugggacuacaggugggagcca

SEQ ID NO: 412176 - RNA, 22 nt, Human
ugggacuacaggugggagccac

SEQ ID NO: 412177 - RNA, 20 nt, Human
ugucacccaggcuggagugc

SEQ ID NO: 412178 - RNA, 22 nt, Human
ugucaugaaaacuccacaccaa

SEQ ID NO: 412179 - RNA, 20 nt, Human
uuaaccccuccuacacacau

SEQ ID NO: 412180 - RNA, 21 nt, Human
uuacaccaagauuucccucca

SEQ ID NO: 412181 - RNA, 18 nt, Human
uuccccgagcccuucagc

SEQ ID NO: 412182 - RNA, 21 nt, Human
uugcucugucacccaggcugg

SEQ ID NO: 412183 - RNA, 22 nt, Human
uugcucugucacccaggcugga

SEQ ID NO: 412184 - RNA, 24 nt, Human
uugcucugucacccaggcuggagu

SEQ ID NO: 412185 - RNA, 23 nt, Human
uuuaaagugcuaccaagcagcaa

SEQ ID NO: 412186 - RNA, 18 nt, Human
uuuaugguuuuacuuucu

SEQ ID NO: 412187 - RNA, 23 nt, Human
uuuaugguuuuacuuucuucauu

SEQ ID NO: 412188 - RNA, 19 nt, Human
uuuguagguucuaaacuga

SEQ ID NO: 412189 - RNA, 21 nt, Human
uuuucugcagaauccuuaaaa

SEQ ID NO: 412190 - RNA, 20 nt, Human
uuuuucugcagaauccuuaa

SEQ ID NO: 412191 - RNA, 18 nt, Human
aaagaagcaagacuugca

SEQ ID NO: 412192 - RNA, 23 nt, Human
aacugacaaagguaaaagguaaa

SEQ ID NO: 412193 - RNA, 20 nt, Human
aagcaagacuugcaaguagg

SEQ ID NO: 412194 - RNA, 26 nt, Human
acaaaggguaaaaggaaauccucuca

SEQ ID NO: 412195 - RNA, 21 nt, Human
acacugcauacaaauuaugug

SEQ ID NO: 412196 - RNA, 25 nt, Human
acagcaugaaccacauacucagagg

SEQ ID NO: 412197 - RNA, 23 nt, Human
agaaaaaaacccuuccuuaagga

SEQ ID NO: 412198 - RNA, 20 nt, Human
agaaguccguauuguaaagg

SEQ ID NO: 412199 - RNA, 21 nt, Human
agcuacaaaggguaaaaggaa

SEQ ID NO: 412200 - RNA, 20 nt, Human
aggauaaaagcagaguagaa

SEQ ID NO: 412201 - RNA, 28 nt, Human
caaacugacaaagguaaaagguaaaaca

SEQ ID NO: 412202 - RNA, 27 nt, Human
cacaacagcaugaaccacauacucaga

SEQ ID NO: 412203 - RNA, 20 nt, Human
caggcuccaaaggauaaaag

SEQ ID NO: 412204 - RNA, 22 nt, Human
cauaacuaaucuacagcuacaa

SEQ ID NO: 412205 - RNA, 20 nt, Human
cauuuugauaucccaaagaa

SEQ ID NO: 412206 - RNA, 23 nt, Human
cccaggcuccaaaggauaaaaaa

SEQ ID NO: 412207 - RNA, 24 nt, Human
cugagcuacaaaggguaaaaggaa

SEQ ID NO: 412208 - RNA, 21 nt, Human
ggaaaacucggccgcccgccc

SEQ ID NO: 412209 - RNA, 20 nt, Human
ggagggagagagaaaaaaac

SEQ ID NO: 412210 - RNA, 18 nt, Human
ggugugggggagggagag

SEQ ID NO: 412211 - RNA, 19 nt, Human
uaaaaggaaauccucucau

SEQ ID NO: 412212 - RNA, 18 nt, Human
uacaucaggugcucucug

SEQ ID NO: 412213 - RNA, 22 nt, Human
uaggcuaaaaugcacuauaaua

SEQ ID NO: 412214 - RNA, 22 nt, Human
uauaacauauacacagaagucc

SEQ ID NO: 412215 - RNA, 21 nt, Human
ucccaaagaagcaagacuugc

SEQ ID NO: 412216 - RNA, 20 nt, Human
uccuucaggagcauguuuau

SEQ ID NO: 412217 - RNA, 23 nt, Human
ucucauuacaaacugacaaaggu

SEQ ID NO: 412218 - RNA, 20 nt, Human
ucucuuggaaaacucggccg

SEQ ID NO: 412219 - RNA, 20 nt, Human
uggggagucucccaggcucc

SEQ ID NO: 412220 - RNA, 24 nt, Human
uuaguacaucacaaaauacauuuu

SEQ ID NO: 412221 - RNA, 19 nt, Human
aaagagcugggauuacagg

SEQ ID NO: 412222 - RNA, 24 nt, Human
aaagugcugggauugcaggcguga

SEQ ID NO: 412223 - RNA, 22 nt, Human
aacagcugcgccgagcgaccuc

SEQ ID NO: 412224 - RNA, 22 nt, Human
aagaccucaccugcaccugcuc

SEQ ID NO: 412225 - RNA, 18 nt, Human
aagagcugggauuacagg

SEQ ID NO: 412226 - RNA, 23 nt, Human
aaguaggaaagguuugaaaaaaa

SEQ ID NO: 412227 - RNA, 19 nt, Human
aagugcugggauugcaggc

SEQ ID NO: 412228 - RNA, 19 nt, Human
aagugcugggauugcaggc

SEQ ID NO: 412229 - RNA, 26 nt, Human
aagugcugggauugcaggcgugagcc

SEQ ID NO: 412230 - RNA, 22 nt, Human
aauggacuccucauggggccca

SEQ ID NO: 412231 - RNA, 20 nt, Human
acagaagccuccaggcaauu

SEQ ID NO: 412232 - RNA, 23 nt, Human
acaggcgcccgccaccacgcccg

SEQ ID NO: 412233 - RNA, 18 nt, Human
acaggguuucacuguuag

SEQ ID NO: 412234 - RNA, 23 nt, Human
acaggguuucacuguuagccagg

SEQ ID NO: 412235 - RNA, 22 nt, Human
acccccucaacacuccagggag

SEQ ID NO: 412236 - RNA, 24 nt, Human
accuugugaucuaccugccuuggc

SEQ ID NO: 412237 - RNA, 25 nt, Human
acucuguugcccaggcuggagugca

SEQ ID NO: 412238 - RNA, 18 nt, Human
acugcaagcuccgccucc

SEQ ID NO: 412239 - RNA, 30 nt, Human
agaaggaaaagaaucugcuguccacagaaa

SEQ ID NO: 412240 - RNA, 18 nt, Human
agagcugggauuacaggc

SEQ ID NO: 412241 - RNA, 20 nt, Human
agccccuugugagaaggaaa

SEQ ID NO: 412242 - RNA, 24 nt, Human
agcgauucuccugccucagccucc

SEQ ID NO: 412243 - RNA, 20 nt, Human
agcguucuggguauuccauc

SEQ ID NO: 412244 - RNA, 18 nt, Human
agcuccgccuccuggguu

SEQ ID NO: 412245 - RNA, 20 nt, Human
aggaagaaaggaaguaaugg

SEQ ID NO: 412246 - RNA, 20 nt, Human
aggcgcccgccaccacgccc

SEQ ID NO: 412247 - RNA, 21 nt, Human
aggcguggagcuacuucaacc

SEQ ID NO: 412248 - RNA, 18 nt, Human
aggcuggagugcaguggc

SEQ ID NO: 412249 - RNA, 25 nt, Human
aggcuggagugcaguggcgugaucu

SEQ ID NO: 412250 - RNA, 18 nt, Human
aguagcugggacuacagg

SEQ ID NO: 412251 - RNA, 23 nt, Human
aguagcugggacuacaggcgccc

SEQ ID NO: 412252 - RNA, 18 nt, Human
agugcaguggcgggacuu

SEQ ID NO: 412253 - RNA, 23 nt, Human
agugcaguggcgggacuucagcu

SEQ ID NO: 412254 - RNA, 19 nt, Human
agugcaguggcgugaucuc

SEQ ID NO: 412255 - RNA, 21 nt, Human
agugcaguggcgugaucucag

SEQ ID NO: 412256 - RNA, 23 nt, Human
agugcaguggcgugaucucagcu

SEQ ID NO: 412257 - RNA, 24 nt, Human
agugcaguggcgugaucucagcuc

SEQ ID NO: 412258 - RNA, 24 nt, Human
aguggcgugaucucagcucacugc

SEQ ID NO: 412259 - RNA, 19 nt, Human
aucuaccugccuuggccuc

SEQ ID NO: 412260 - RNA, 24 nt, Human
augauccgcccgccucagucuccc

SEQ ID NO: 412261 - RNA, 20 nt, Human
augggguuucacuguauuag

SEQ ID NO: 412262 - RNA, 19 nt, Human
caaaaacccuagaauuucc

SEQ ID NO: 412263 - RNA, 24 nt, Human
caaagagcugggauuacaggcacg

SEQ ID NO: 412264 - RNA, 24 nt, Human
caaagugcugggauugcaggcgug

SEQ ID NO: 412265 - RNA, 22 nt, Human
caaaucuacuguaugccucaua

SEQ ID NO: 412266 - RNA, 24 nt, Human
caacagucauuagguuccaccaca

SEQ ID NO: 412267 - RNA, 20 nt, Human
caagcgauucuccugccuca

SEQ ID NO: 412268 - RNA, 22 nt, Human
caagcgauucuccugccucagc

SEQ ID NO: 412269 - RNA, 18 nt, Human
cacacuucaaaaaagcau

SEQ ID NO: 412270 - RNA, 19 nt, Human
cacagaagccuccaggcaa

SEQ ID NO: 412271 - RNA, 22 nt, Human
caccaccacgcccagcuaauuu

SEQ ID NO: 412272 - RNA, 21 nt, Human
cacgccauucuccugccucag

SEQ ID NO: 412273 - RNA, 24 nt, Human
cacucuguugcccaggcuggagug

SEQ ID NO: 412274 - RNA, 23 nt, Human
cacugcuaccucugccucccggg

SEQ ID NO: 412275 - RNA, 18 nt, Human
cacuguauuagccaggau

SEQ ID NO: 412276 - RNA, 19 nt, Human
cacuguauuagccaggauc

SEQ ID NO: 412277 - RNA, 24 nt, Human
cacuguauuagccaggauggucuc

SEQ ID NO: 412278 - RNA, 24 nt, Human
cacuucaaaaaagcauuuccugga

SEQ ID NO: 412279 - RNA, 18 nt, Human
cagaagccaggcguggag

SEQ ID NO: 412280 - RNA, 24 nt, Human
cagagucucacucuguugcccagg

SEQ ID NO: 412281 - RNA, 20 nt, Human
cagcacccagccuccaaauu

SEQ ID NO: 412282 - RNA, 20 nt, Human
cagccuccugaguagcugag

SEQ ID NO: 412283 - RNA, 24 nt, Human
caggaaggacccagaaagggugcc

SEQ ID NO: 412284 - RNA, 21 nt, Human
caggcgcccgccaccacgccc

SEQ ID NO: 412285 - RNA, 22 nt, Human
caggcgugagccacagcaccca

SEQ ID NO: 412286 - RNA, 22 nt, Human
cagggacaccaugggauuguuu

SEQ ID NO: 412287 - RNA, 22 nt, Human
cagggcagggaaaacacagaac

SEQ ID NO: 412288 - RNA, 24 nt, Human
caugauccgcccgccucagucucc

SEQ ID NO: 412289 - RNA, 19 nt, Human
ccaaagagcugggauuaca

SEQ ID NO: 412290 - RNA, 23 nt, Human
ccaaagagcugggauuacaggca

SEQ ID NO: 412291 - RNA, 24 nt, Human
ccaaagagcugggauuacaggcac

SEQ ID NO: 412292 - RNA, 20 nt, Human
ccaaagugcugggauugcag

SEQ ID NO: 412293 - RNA, 22 nt, Human
ccaaagugcugggauugcaggc

SEQ ID NO: 412294 - RNA, 24 nt, Human
ccaaagugcugggauugcaggcgu

SEQ ID NO: 412295 - RNA, 24 nt, Human
cccaaagagcugggauuacaggca

SEQ ID NO: 412296 - RNA, 18 nt, Human
cccacaugcccaccucca

SEQ ID NO: 412297 - RNA, 20 nt, Human
cccacaugcccaccuccaca

SEQ ID NO: 412298 - RNA, 25 nt, Human
cccacaugcccaccuccacagccca

SEQ ID NO: 412299 - RNA, 21 nt, Human
cccaggcuggagugcaguggc

SEQ ID NO: 412300 - RNA, 22 nt, Human
cccaggcuggagugcaguggcg

SEQ ID NO: 412301 - RNA, 22 nt, Human
cccaggcuggagugcaguggcg

SEQ ID NO: 412302 - RNA, 19 nt, Human
ccccuggaagucuggcagg

SEQ ID NO: 412303 - RNA, 20 nt, Human
cccggguucaagcgauucuc

SEQ ID NO: 412304 - RNA, 23 nt, Human
cccggguucaagcgauucuccug

SEQ ID NO: 412305 - RNA, 24 nt, Human
ccgccucagucucccaaagugcug

SEQ ID NO: 412306 - RNA, 22 nt, Human
ccgggggagaaugcugagcugc

SEQ ID NO: 412307 - RNA, 22 nt, Human
ccucauagaccaucccuuauuu

SEQ ID NO: 412308 - RNA, 24 nt, Human
ccucccggguucaagcgauucucc

SEQ ID NO: 412309 - RNA, 19 nt, Human
ccuccuggccugugcugcu

SEQ ID NO: 412310 - RNA, 21 nt, Human
ccucuccucccucucccgauc

SEQ ID NO: 412311 - RNA, 21 nt, Human
ccugaccuugugaucuaccug

SEQ ID NO: 412312 - RNA, 19 nt, Human
ccugaguagcugagacuac

SEQ ID NO: 412313 - RNA, 24 nt, Human
ccugaguagcugagacuacaggcg

SEQ ID NO: 412314 - RNA, 23 nt, Human
ccugccucagccuccugaguagc

SEQ ID NO: 412315 - RNA, 24 nt, Human
ccugccucagccuccugaguagcu

SEQ ID NO: 412316 - RNA, 24 nt, Human
ccugccucagucuucagaguagcu

SEQ ID NO: 412317 - RNA, 20 nt, Human
ccugugcugcagcuacaggg

SEQ ID NO: 412318 - RNA, 24 nt, Human
cgccucagucucccaaagugcugg

SEQ ID NO: 412319 - RNA, 19 nt, Human
cgccuccuggguucacgcc

SEQ ID NO: 412320 - RNA, 24 nt, Human
cgcucuguugcccaggcuggagug

SEQ ID NO: 412321 - RNA, 23 nt, Human
cgugcaccaccacgcccagcuaa

SEQ ID NO: 412322 - RNA, 19 nt, Human
cucacagaagccuccaggc

SEQ ID NO: 412323 - RNA, 24 nt, Human
cucacucuguugcccaggcuggag

SEQ ID NO: 412324 - RNA, 24 nt, Human
cucacugcuaccucugccucccgg

SEQ ID NO: 412325 - RNA, 24 nt, Human
cucagucuucagaguagcugggac

SEQ ID NO: 412326 - RNA, 18 nt, Human
cucaugauccgcccgccu

SEQ ID NO: 412327 - RNA, 22 nt, Human
cuccugccucagccuccugagu

SEQ ID NO: 412328 - RNA, 21 nt, Human
cuccuggguucacgccauucu

SEQ ID NO: 412329 - RNA, 22 nt, Human
cuccuuucccccaucuccuucc

SEQ ID NO: 412330 - RNA, 21 nt, Human
cucgcucuguugcccaggcug

SEQ ID NO: 412331 - RNA, 24 nt, Human
cucgcucuguugcccaggcuggag

SEQ ID NO: 412332 - RNA, 23 nt, Human
cugccuuggccucccaaagagcu

SEQ ID NO: 412333 - RNA, 24 nt, Human
cuggagugcaguggcgugaucuca

SEQ ID NO: 412334 - RNA, 23 nt, Human
cuuccccugugcugcagcuacag

SEQ ID NO: 412335 - RNA, 24 nt, Human
cuuggccucccaaagagcugggau

SEQ ID NO: 412336 - RNA, 21 nt, Human
gaaaagaaucugcuguccaca

SEQ ID NO: 412337 - RNA, 23 nt, Human
gaauccacaggaagccaugaacu

SEQ ID NO: 412338 - RNA, 22 nt, Human
gaccucaugauccgcccgccuc

SEQ ID NO: 412339 - RNA, 21 nt, Human
gaccuugugaucuaccugccu

SEQ ID NO: 412340 - RNA, 24 nt, Human
gaccuugugaucuaccugccuugg

SEQ ID NO: 412341 - RNA, 24 nt, Human
gaguagcugagacuacaggcgugc

SEQ ID NO: 412342 - RNA, 20 nt, Human
gaguagcugggacuacaggc

SEQ ID NO: 412343 - RNA, 18 nt, Human
gauugcaggcgugagcca

SEQ ID NO: 412344 - RNA, 23 nt, Human
gauugcaggcgugagccacagca

SEQ ID NO: 412345 - RNA, 19 nt, Human
gcccaggcuggagugcagu

SEQ ID NO: 412346 - RNA, 18 nt, Human
gcccagucaagugugggg

SEQ ID NO: 412347 - RNA, 23 nt, Human
gcccggcuaauuuuuuguauuuu

SEQ ID NO: 412348 - RNA, 19 nt, Human
gccgagcgaccucgccuca

SEQ ID NO: 412349 - RNA, 24 nt, Human
gccucagucucccaaagugcuggg

SEQ ID NO: 412350 - RNA, 19 nt, Human
gccucccaaagagcuggga

SEQ ID NO: 412351 - RNA, 25 nt, Human
gccuccuggguucacgccauucucc

SEQ ID NO: 412352 - RNA, 23 nt, Human
gcgauucuccugccucagccucc

SEQ ID NO: 412353 - RNA, 25 nt, Human
gcucuguugcccaggcuggagugca

SEQ ID NO: 412354 - RNA, 18 nt, Human
gcugcucagcuggcccug

SEQ ID NO: 412355 - RNA, 19 nt, Human
gcuggagugcaguggcgug

SEQ ID NO: 412356 - RNA, 23 nt, Human
ggaaagguuugaaaaaaaaaaaa

SEQ ID NO: 412357 - RNA, 20 nt, Human
ggaagggagggagaaaagga

SEQ ID NO: 412358 - RNA, 24 nt, Human
ggauggucgcgaucuccugaccuc

SEQ ID NO: 412359 - RNA, 22 nt, Human
ggcuggagugcaguggcgugau

SEQ ID NO: 412360 - RNA, 20 nt, Human
ggggcccacagggaaccagg

SEQ ID NO: 412361 - RNA, 18 nt, Human
gggguuucacuguauuag

SEQ ID NO: 412362 - RNA, 20 nt, Human
gguagugcugacagcucuga

SEQ ID NO: 412363 - RNA, 19 nt, Human
ggucucaauuuccugaccu

SEQ ID NO: 412364 - RNA, 21 nt, Human
gugcugcagcuacagggcccc

SEQ ID NO: 412365 - RNA, 24 nt, Human
uaaauucccagugcauccaaaaug

SEQ ID NO: 412366 - RNA, 18 nt, Human
uaagucacaaaacaaggg

SEQ ID NO: 412367 - RNA, 19 nt, Human
uaauuuuuuguaauuuuag

SEQ ID NO: 412368 - RNA, 24 nt, Human
uaauuuuuuguauuuuuaguggag

SEQ ID NO: 412369 - RNA, 25 nt, Human
uaauuuuuuguauuuuuaguggaga

SEQ ID NO: 412370 - RNA, 21 nt, Human
uacaaaaacccuagaauuucc

SEQ ID NO: 412371 - RNA, 23 nt, Human
uacaggcgcccgccaccacgccc

SEQ ID NO: 412372 - RNA, 24 nt, Human
uacaggcgugcaccaccacgccca

SEQ ID NO: 412373 - RNA, 19 nt, Human
uacuguaaaacugcaguaa

SEQ ID NO: 412374 - RNA, 23 nt, Human
uagcagacaugggguuucacugu

SEQ ID NO: 412375 - RNA, 25 nt, Human
uaggaaagguuugaaaaaaaaaaaa

SEQ ID NO: 412376 - RNA, 20 nt, Human
uaguggagacaggguuucac

SEQ ID NO: 412377 - RNA, 22 nt, Human
uaguggagacaggguuucacug

SEQ ID NO: 412378 - RNA, 22 nt, Human
ucaaaaaagcauuuccuggaag

SEQ ID NO: 412379 - RNA, 24 nt, Human
ucaaaaaagcauuuccuggaagua

SEQ ID NO: 412380 - RNA, 24 nt, Human
ucaaccagaaacugucacccauga

SEQ ID NO: 412381 - RNA, 24 nt, Human
ucaagagacugccucuccucccuc

SEQ ID NO: 412382 - RNA, 18 nt, Human
ucaccugcaccugcucua

SEQ ID NO: 412383 - RNA, 24 nt, Human
ucacucuguugcccaggcuggagu

SEQ ID NO: 412384 - RNA, 18 nt, Human
ucacugcaagcuccgccu

SEQ ID NO: 412385 - RNA, 23 nt, Human
ucacugcaagcuccgccuccugg

SEQ ID NO: 412386 - RNA, 24 nt, Human
ucacugcaagcuccgccuccuggg

SEQ ID NO: 412387 - RNA, 24 nt, Human
ucacugcuaccucugccucccggg

SEQ ID NO: 412388 - RNA, 24 nt, Human
ucacuguauuagccaggauggucu

SEQ ID NO: 412389 - RNA, 23 nt, Human
ucagaguagcugggacuacaggc

SEQ ID NO: 412390 - RNA, 24 nt, Human
ucagaguagcugggacuacaggcg

SEQ ID NO: 412391 - RNA, 19 nt, Human
ucagcucacugcaagcucc

SEQ ID NO: 412392 - RNA, 23 nt, Human
ucagucuucagaguagcugggac

SEQ ID NO: 412393 - RNA, 19 nt, Human
ucccaaagagcugggauua

SEQ ID NO: 412394 - RNA, 23 nt, Human
ucccaaagagcugggauuacagg

SEQ ID NO: 412395 - RNA, 24 nt, Human
ucccaaagagcugggauuacaggc

SEQ ID NO: 412396 - RNA, 24 nt, Human
ucccaaagugcugggauugcaggc

SEQ ID NO: 412397 - RNA, 19 nt, Human
uccccagccugggcccagg

SEQ ID NO: 412398 - RNA, 26 nt, Human
uccccagccugggcccaggggcccac

SEQ ID NO: 412399 - RNA, 21 nt, Human
uccccuggaagucuggcaggu

SEQ ID NO: 412400 - RNA, 21 nt, Human
ucccggguucaagcgauucuc

SEQ ID NO: 412401 - RNA, 24 nt, Human
ucccggguucaagcgauucuccug

SEQ ID NO: 412402 - RNA, 21 nt, Human
uccgcccgccucagucuccca

SEQ ID NO: 412403 - RNA, 24 nt, Human
uccuaagucacaaaacaagggcuc

SEQ ID NO: 412404 - RNA, 24 nt, Human
uccugaguagcugagacuacaggc

SEQ ID NO: 412405 - RNA, 24 nt, Human
uccuggguucacgccauucuccug

SEQ ID NO: 412406 - RNA, 24 nt, Human
ucgcucuguugcccaggcuggagu

SEQ ID NO: 412407 - RNA, 25 nt, Human
ucuaguaaugcacuaguuacuaaua

SEQ ID NO: 412408 - RNA, 23 nt, Human
ucucacucuguugcccaggcugg

SEQ ID NO: 412409 - RNA, 24 nt, Human
ucucacucuguugcccaggcugga

SEQ ID NO: 412410 - RNA, 26 nt, Human
ucucacucuguugcccaggcuggagu

SEQ ID NO: 412411 - RNA, 27 nt, Human
ucucacucuguugcccaggcuggagug

SEQ ID NO: 412412 - RNA, 25 nt, Human
ucuccugaccucaugauccgcccgc

SEQ ID NO: 412413 - RNA, 19 nt, Human
ucucgcucuguugcccagg

SEQ ID NO: 412414 - RNA, 23 nt, Human
ucucgcucuguugcccaggcugg

SEQ ID NO: 412415 - RNA, 24 nt, Human
ucucgcucuguugcccaggcugga

SEQ ID NO: 412416 - RNA, 26 nt, Human
ucucgcucuguugcccaggcuggagu

SEQ ID NO: 412417 - RNA, 27 nt, Human
ucucgcucuguugcccaggcuggagug

SEQ ID NO: 412418 - RNA, 19 nt, Human
ucugauaaucuaccugaag

SEQ ID NO: 412419 - RNA, 18 nt, Human
ucuguugcccaggcugga

SEQ ID NO: 412420 - RNA, 24 nt, Human
ucuguugcccaggcuggagugcag

SEQ ID NO: 412421 - RNA, 24 nt, Human
ucuguugcccaggcuggagugcag

SEQ ID NO: 412422 - RNA, 21 nt, Human
ugaaaaaaaaaaaagaugcca

SEQ ID NO: 412423 - RNA, 21 nt, Human
ugagaaggaaaagaaucugcu

SEQ ID NO: 412424 - RNA, 18 nt, Human
ugagacagagucucacuc

SEQ ID NO: 412425 - RNA, 22 nt, Human
ugagacagagucucacucuguu

SEQ ID NO: 412426 - RNA, 21 nt, Human
ugagacuacaggcgugcacca

SEQ ID NO: 412427 - RNA, 24 nt, Human
ugagacuacaggcgugcaccacca

SEQ ID NO: 412428 - RNA, 21 nt, Human
ugagucucgcucuguugccca

SEQ ID NO: 412429 - RNA, 23 nt, Human
ugcacaaaugacucuucuuuaca

SEQ ID NO: 412430 - RNA, 18 nt, Human
ugcccaggcuggagugca

SEQ ID NO: 412431 - RNA, 18 nt, Human
ugcccaggcuggagugca

SEQ ID NO: 412432 - RNA, 21 nt, Human
ugcccaggcuggagugcagug

SEQ ID NO: 412433 - RNA, 21 nt, Human
ugcccaggcuggagugcagug

SEQ ID NO: 412434 - RNA, 22 nt, Human
ugcccaggcuggagugcagugg

SEQ ID NO: 412435 - RNA, 22 nt, Human
ugcccaggcuggagugcagugg

SEQ ID NO: 412436 - RNA, 24 nt, Human
ugccucagccuccugaguagcuga

SEQ ID NO: 412437 - RNA, 21 nt, Human
ugccucagucuucagaguagc

SEQ ID NO: 412438 - RNA, 24 nt, Human
ugccucagucuucagaguagcugg

SEQ ID NO: 412439 - RNA, 20 nt, Human
ugccucauagaccaucccuu

SEQ ID NO: 412440 - RNA, 18 nt, Human
ugccuguaaaauaugaag

SEQ ID NO: 412441 - RNA, 23 nt, Human
ugccuguaaaauaugaaggaaga

SEQ ID NO: 412442 - RNA, 25 nt, Human
ugcguuccauuuuuuuuuuuuuuuu

SEQ ID NO: 412443 - RNA, 19 nt, Human
uggagugcaguggcgggac

SEQ ID NO: 412444 - RNA, 28 nt, Human
uggagugcaguggcgggacggcucuagc

SEQ ID NO: 412445 - RNA, 21 nt, Human
uggagugcaguggcgggacuu

SEQ ID NO: 412446 - RNA, 23 nt, Human
uggagugcaguggcgggacuuca

SEQ ID NO: 412447 - RNA, 19 nt, Human
uggagugcaguggcgugau

SEQ ID NO: 412448 - RNA, 24 nt, Human
uggagugcaguggcgugaucucag

SEQ ID NO: 412449 - RNA, 27 nt, Human
uggcagguacaacccccucaacacucc

SEQ ID NO: 412450 - RNA, 20 nt, Human
uggccucccaaagagcuggg

SEQ ID NO: 412451 - RNA, 18 nt, Human
uggccuccuggccugugc

SEQ ID NO: 412452 - RNA, 24 nt, Human
uggcgugaucucagcucacugcaa

SEQ ID NO: 412453 - RNA, 21 nt, Human
ugggacuacaggcgcccgcca

SEQ ID NO: 412454 - RNA, 22 nt, Human
ugggacuacaggcgcccgccac

SEQ ID NO: 412455 - RNA, 24 nt, Human
ugggacuacaggcgcccgccacca

SEQ ID NO: 412456 - RNA, 21 nt, Human
ugggauuacaggcacgaacca

SEQ ID NO: 412457 - RNA, 23 nt, Human
ugggauuacaggcacgaaccacc

SEQ ID NO: 412458 - RNA, 24 nt, Human
ugggauuacaggcacgaaccaccg

SEQ ID NO: 412459 - RNA, 24 nt, Human
ugggauuacaggcacgaaccaccg

SEQ ID NO: 412460 - RNA, 18 nt, Human
ugggauugcaggcgugag

SEQ ID NO: 412461 - RNA, 19 nt, Human
ugggauugcaggcgugagc

SEQ ID NO: 412462 - RNA, 21 nt, Human
ugggauugcaggcgugagcca

SEQ ID NO: 412463 - RNA, 22 nt, Human
ugggauugcaggcgugagccac

SEQ ID NO: 412464 - RNA, 23 nt, Human
ugggauugcaggcgugagccaca

SEQ ID NO: 412465 - RNA, 24 nt, Human
ugggauugcaggcgugagccacag

SEQ ID NO: 412466 - RNA, 24 nt, Human
ugggguuucacuguauuagccagg

SEQ ID NO: 412467 - RNA, 20 nt, Human
uggguucacgccauucuccu

SEQ ID NO: 412468 - RNA, 23 nt, Human
uguaaaauaugaaggaagaaagg

SEQ ID NO: 412469 - RNA, 23 nt, Human
uguacaaaaacccuagaauuucc

SEQ ID NO: 412470 - RNA, 20 nt, Human
ugugcugcucagcuggcccu

SEQ ID NO: 412471 - RNA, 19 nt, Human
ugugugccccuccagggcc

SEQ ID NO: 412472 - RNA, 21 nt, Human
uuagcagacaugggguuucac

SEQ ID NO: 412473 - RNA, 24 nt, Human
uuagcagacaugggguuucacugu

SEQ ID NO: 412474 - RNA, 21 nt, Human
uuaguggagacaggguuucac

SEQ ID NO: 412475 - RNA, 24 nt, Human
uuaguggagacaggguuucacugu

SEQ ID NO: 412476 - RNA, 19 nt, Human
uucaaccagaaacugucac

SEQ ID NO: 412477 - RNA, 21 nt, Human
uucaagcgauucuccugccuc

SEQ ID NO: 412478 - RNA, 23 nt, Human
uucaagcgauucuccugccucag

SEQ ID NO: 412479 - RNA, 24 nt, Human
uucaagcgauucuccugccucagc

SEQ ID NO: 412480 - RNA, 20 nt, Human
uucccagugcauccaaaaug

SEQ ID NO: 412481 - RNA, 24 nt, Human
uuccugaccuugugaucuaccugc

SEQ ID NO: 412482 - RNA, 24 nt, Human
uugcccaggcuggagugcaguggc

SEQ ID NO: 412483 - RNA, 24 nt, Human
uugcccaggcuggagugcaguggc

SEQ ID NO: 412484 - RNA, 21 nt, Human
uuuucuguagauccagaagaa

SEQ ID NO: 412485 - RNA, 24 nt, Human
uuuuuaguggagacaggguuucac

SEQ ID NO: 412486 - RNA, 21 nt, Human
uuuuuguauuuuuaguggaga

SEQ ID NO: 412487 - RNA, 18 nt, Human
uuuuuuguaauuuuagca

SEQ ID NO: 412488 - RNA, 20 nt, Human
uuuuuuguaauuuuagcaga

SEQ ID NO: 412489 - RNA, 24 nt, Human
uuuuuuguauuuuuaguggagaca

SEQ ID NO: 412490 - RNA, 20 nt, Human
uuuuuuuuuuugagacagag

SEQ ID NO: 412491 - RNA, 18 nt, Human
uuuuuuuuuuuuuuuuug

SEQ ID NO: 412492 - RNA, 24 nt, Human
aaaaagaacugguucagaaaacac

SEQ ID NO: 412493 - RNA, 21 nt, Human
aaaaauaacccccccagaaac

SEQ ID NO: 412494 - RNA, 18 nt, Human
aaagaacugguucagaaa

SEQ ID NO: 412495 - RNA, 21 nt, Human
aaauaacccccccagaaacac

SEQ ID NO: 412496 - RNA, 23 nt, Human
aagaaaucaagaucuaaagggug

SEQ ID NO: 412497 - RNA, 18 nt, Human
aaugcaugcauucagacc

SEQ ID NO: 412498 - RNA, 21 nt, Human
acaauacacacacacacacac

SEQ ID NO: 412499 - RNA, 24 nt, Human
acaauacacacacacacacaccaa

SEQ ID NO: 412500 - RNA, 21 nt, Human
acacacacaccaaaaaaauaa

SEQ ID NO: 412501 - RNA, 23 nt, Human
acagaagacauagggccaccuag

SEQ ID NO: 412502 - RNA, 21 nt, Human
acaucuaccuaucagagcggc

SEQ ID NO: 412503 - RNA, 19 nt, Human
auuagcucccugcuuuaua

SEQ ID NO: 412504 - RNA, 19 nt, Human
caaaaaaauaaccccccca

SEQ ID NO: 412505 - RNA, 24 nt, Human
cacaauacacacacacacacacca

SEQ ID NO: 412506 - RNA, 24 nt, Human
cacaggaaggagcagcucugauuc

SEQ ID NO: 412507 - RNA, 24 nt, Human
caccaaaaaaauaacccccccaga

SEQ ID NO: 412508 - RNA, 23 nt, Human
cacgcucuaccccaagaaaaaga

SEQ ID NO: 412509 - RNA, 18 nt, Human
cagcaggccucuuccucc

SEQ ID NO: 412510 - RNA, 26 nt, Human
cagcaggccucuuccuccccaaguuu

SEQ ID NO: 412511 - RNA, 25 nt, Human
caggaaggagcagcucugauucuua

SEQ ID NO: 412512 - RNA, 18 nt, Human
cagguugagaaaugacca

SEQ ID NO: 412513 - RNA, 18 nt, Human
cagucacuuuucuccucc

SEQ ID NO: 412514 - RNA, 19 nt, Human
ccaaaaaaauaaccccccc

SEQ ID NO: 412515 - RNA, 23 nt, Human
ccaaacacuaggaugaggaugug

SEQ ID NO: 412516 - RNA, 21 nt, Human
ccacagaagacauagggccac

SEQ ID NO: 412517 - RNA, 22 nt, Human
ccagucacuuuucuccuccugu

SEQ ID NO: 412518 - RNA, 19 nt, Human
ccccaaguuuuuccucucc

SEQ ID NO: 412519 - RNA, 19 nt, Human
cccccacagcaggccucuu

SEQ ID NO: 412520 - RNA, 22 nt, Human
cccccagaaacacaacccucau

SEQ ID NO: 412521 - RNA, 20 nt, Human
ccccccagaaacacaacccu

SEQ ID NO: 412522 - RNA, 19 nt, Human
ccgccucucucccuuccuc

SEQ ID NO: 412523 - RNA, 20 nt, Human
cuaaagggugauauauaaua

SEQ ID NO: 412524 - RNA, 24 nt, Human
cucagguugagaaaugaccaagaa

SEQ ID NO: 412525 - RNA, 18 nt, Human
cuccacagaagacauagg

SEQ ID NO: 412526 - RNA, 22 nt, Human
cuccccaaguuuuuccucucca

SEQ ID NO: 412527 - RNA, 19 nt, Human
cucccuuccucugccggcc

SEQ ID NO: 412528 - RNA, 21 nt, Human
cuccugugcuguccuuucaaa

SEQ ID NO: 412529 - RNA, 22 nt, Human
gaaaaagaacugguucagaaag

SEQ ID NO: 412530 - RNA, 22 nt, Human
gcacaauacacacacacacaca

SEQ ID NO: 412531 - RNA, 18 nt, Human
gggaauaugcuaugcacc

SEQ ID NO: 412532 - RNA, 23 nt, Human
gguaggugaagaugaaaucugca

SEQ ID NO: 412533 - RNA, 20 nt, Human
gugaagggcagcaacugaca

SEQ ID NO: 412534 - RNA, 18 nt, Human
uaacccccccagaaacac

SEQ ID NO: 412535 - RNA, 23 nt, Human
uaacccccccagaaacacaaccc

SEQ ID NO: 412536 - RNA, 23 nt, Human
uaacuccacagaagacauagggc

SEQ ID NO: 412537 - RNA, 24 nt, Human
uaacuccacagaagacauagggcc

SEQ ID NO: 412538 - RNA, 22 nt, Human
uacuguaacuccacagaagaca

SEQ ID NO: 412539 - RNA, 19 nt, Human
uaguaauaaaaaaaauugc

SEQ ID NO: 412540 - RNA, 21 nt, Human
ucagguugagaaaugaccaag

SEQ ID NO: 412541 - RNA, 19 nt, Human
uccacagaagacauagggc

SEQ ID NO: 412542 - RNA, 22 nt, Human
uccacagaagacauagggccac

SEQ ID NO: 412543 - RNA, 19 nt, Human
uccucuccauuucaaaaaa

SEQ ID NO: 412544 - RNA, 27 nt, Human
ucgccgccgccucucucccuuccucug

SEQ ID NO: 412545 - RNA, 21 nt, Human
ucucaaacugccaaacacuag

SEQ ID NO: 412546 - RNA, 23 nt, Human
ucuucacauccaagagcugguug

SEQ ID NO: 412547 - RNA, 19 nt, Human
ugaaaagcaggugcuuuuu

SEQ ID NO: 412548 - RNA, 22 nt, Human
ugaaaucugcaaccuuucuaag

SEQ ID NO: 412549 - RNA, 18 nt, Human
ugagaaaugaccaagaaa

SEQ ID NO: 412550 - RNA, 22 nt, Human
ugagaaaugaccaagaaaucaa

SEQ ID NO: 412551 - RNA, 21 nt, Human
ugcaugcauucagaccgcaua

SEQ ID NO: 412552 - RNA, 18 nt, Human
uggaaugugggaauaugc

SEQ ID NO: 412553 - RNA, 19 nt, Human
uggaaugugggaauaugcu

SEQ ID NO: 412554 - RNA, 21 nt, Human
ugggaauaugcuaugcaccuc

SEQ ID NO: 412555 - RNA, 24 nt, Human
uguuuaguaauaaaaaaaauugcu

SEQ ID NO: 412556 - RNA, 23 nt, Human
uuaauacucuuaauuagcucccu

SEQ ID NO: 412557 - RNA, 18 nt, Human
uucacaggaaggagcagc

SEQ ID NO: 412558 - RNA, 25 nt, Human
uuccccaaguuucuccaacagaaca

SEQ ID NO: 412559 - RNA, 19 nt, Human
uuuccuguucuuuuuacuc

SEQ ID NO: 412560 - RNA, 19 nt, Human
aaaaagcaggcgaaggaac

SEQ ID NO: 412561 - RNA, 23 nt, Human
aaagucccucgcagccgcagaaa

SEQ ID NO: 412562 - RNA, 23 nt, Human
aagaagccaaggcagguccagug

SEQ ID NO: 412563 - RNA, 22 nt, Human
aagcagcacagcccagguucua

SEQ ID NO: 412564 - RNA, 22 nt, Human
aagcaugccugcaucccagagc

SEQ ID NO: 412565 - RNA, 18 nt, Human
aaggcugucucgcacugg

SEQ ID NO: 412566 - RNA, 21 nt, Human
aaguucuugccaaaccaaucc

SEQ ID NO: 412567 - RNA, 24 nt, Human
aauacaaaagaccgaaggaagaga

SEQ ID NO: 412568 - RNA, 25 nt, Human
acagacaaaacgccauauaaacaca

SEQ ID NO: 412569 - RNA, 21 nt, Human
acagcaacacagacaaaacgc

SEQ ID NO: 412570 - RNA, 20 nt, Human
accguuugcccuuccccgug

SEQ ID NO: 412571 - RNA, 20 nt, Human
accuggcacucgccagggag

SEQ ID NO: 412572 - RNA, 19 nt, Human
acguuccuccacccuccac

SEQ ID NO: 412573 - RNA, 21 nt, Human
agaaaucgggggugggguugg

SEQ ID NO: 412574 - RNA, 19 nt, Human
agaagcaugccugcauccc

SEQ ID NO: 412575 - RNA, 24 nt, Human
agacacaggcccgggcuggaggca

SEQ ID NO: 412576 - RNA, 18 nt, Human
agguucuggguggcacga

SEQ ID NO: 412577 - RNA, 28 nt, Human
augcugcccuggggucugauggucaacc

SEQ ID NO: 412578 - RNA, 24 nt, Human
cacagacaaaacgccauauaaacc

SEQ ID NO: 412579 - RNA, 25 nt, Human
cacagcccagguucuagagaggagc

SEQ ID NO: 412580 - RNA, 21 nt, Human
cacagcuagggucaggcaggg

SEQ ID NO: 412581 - RNA, 18 nt, Human
caccaggauguccuuccc

SEQ ID NO: 412582 - RNA, 21 nt, Human
cacccuccacucccacguggc

SEQ ID NO: 412583 - RNA, 23 nt, Human
cacugggcuggacuccgaaacuc

SEQ ID NO: 412584 - RNA, 19 nt, Human
cagcaguugaaauacugac

SEQ ID NO: 412585 - RNA, 21 nt, Human
caggugaauuuggcuccuuuu

SEQ ID NO: 412586 - RNA, 19 nt, Human
ccagggagacaaggcccag

SEQ ID NO: 412587 - RNA, 22 nt, Human
ccagguccacgacuaaguccaa

SEQ ID NO: 412588 - RNA, 21 nt, Human
ccagucagcagagcagaaauc

SEQ ID NO: 412589 - RNA, 21 nt, Human
cccaacccccccaggugacua

SEQ ID NO: 412590 - RNA, 22 nt, Human
cccaccaggauguccuucccca

SEQ ID NO: 412591 - RNA, 21 nt, Human
cccaguccccggcagacccac

SEQ ID NO: 412592 - RNA, 21 nt, Human
cccgcccaacccccccaggug

SEQ ID NO: 412593 - RNA, 22 nt, Human
cccgcccaacccccccagguga

SEQ ID NO: 412594 - RNA, 19 nt, Human
ccgcagccucaccuggcac

SEQ ID NO: 412595 - RNA, 20 nt, Human
ccucuaagugagggggcggg

SEQ ID NO: 412596 - RNA, 19 nt, Human
ccuuccccacgcccuccuc

SEQ ID NO: 412597 - RNA, 19 nt, Human
cggcaauggaagauggcgc

SEQ ID NO: 412598 - RNA, 23 nt, Human
cuccacacguuccuccacccucc

SEQ ID NO: 412599 - RNA, 20 nt, Human
cucuggaccguuugcccuuc

SEQ ID NO: 412600 - RNA, 21 nt, Human
cugaagcugcuagagccgccu

SEQ ID NO: 412601 - RNA, 24 nt, Human
cugaggcucaaaagcagcacagcc

SEQ ID NO: 412602 - RNA, 18 nt, Human
cugcccuggggucugagg

SEQ ID NO: 412603 - RNA, 19 nt, Human
gaaaaagcaggcgaaggaa

SEQ ID NO: 412604 - RNA, 25 nt, Human
gaaaaagcaggcgaaggaaccuggg

SEQ ID NO: 412605 - RNA, 24 nt, Human
gaaacuccacacguuccuccaccc

SEQ ID NO: 412606 - RNA, 24 nt, Human
gaagauggcgcccgcccaaccccc

SEQ ID NO: 412607 - RNA, 20 nt, Human
gagaagcaugccugcauccc

SEQ ID NO: 412608 - RNA, 25 nt, Human
gagcccgcagccgcccgcccucugg

SEQ ID NO: 412609 - RNA, 21 nt, Human
gagcgcccgccaaccacgguu

SEQ ID NO: 412610 - RNA, 18 nt, Human
gcacugggcuggacuccg

SEQ ID NO: 412611 - RNA, 23 nt, Human
gcagaaaucgggggugggguugg

SEQ ID NO: 412612 - RNA, 20 nt, Human
gcagccgcagaaaggggccg

SEQ ID NO: 412613 - RNA, 20 nt, Human
gcggcggcaauggaagaugg

SEQ ID NO: 412614 - RNA, 20 nt, Human
gcugcccuggggucugaggc

SEQ ID NO: 412615 - RNA, 18 nt, Human
ggaagagacccuguaugg

SEQ ID NO: 412616 - RNA, 19 nt, Human
ggaccguuugcccuucccc

SEQ ID NO: 412617 - RNA, 19 nt, Human
ggagacaaggcccaguccc

SEQ ID NO: 412618 - RNA, 20 nt, Human
ggcccaguccccggcagacc

SEQ ID NO: 412619 - RNA, 27 nt, Human
gggcacagcuagggucaggcaggguuc

SEQ ID NO: 412620 - RNA, 20 nt, Human
ggucaggcaggguucgagcc

SEQ ID NO: 412621 - RNA, 21 nt, Human
ggugacagggccagccgggca

SEQ ID NO: 412622 - RNA, 18 nt, Human
guggagcgcccgccaacc

SEQ ID NO: 412623 - RNA, 22 nt, Human
guuccuccacccuccacuccca

SEQ ID NO: 412624 - RNA, 21 nt, Human
guucuggguggcacgaugacu

SEQ ID NO: 412625 - RNA, 20 nt, Human
uaaaauaaaagcgaguuuua

SEQ ID NO: 412626 - RNA, 21 nt, Human
uaaacagcaacacagacaaaa

SEQ ID NO: 412627 - RNA, 21 nt, Human
ucagcagagcagaaaucgggg

SEQ ID NO: 412628 - RNA, 22 nt, Human
uccauacagccagcugaggcca

SEQ ID NO: 412629 - RNA, 18 nt, Human
ucccagagcgaggaacuc

SEQ ID NO: 412630 - RNA, 19 nt, Human
uccccacgcccuccucaca

SEQ ID NO: 412631 - RNA, 23 nt, Human
uccccagucagcagagcagaaau

SEQ ID NO: 412632 - RNA, 19 nt, Human
uccccggcagacccacgga

SEQ ID NO: 412633 - RNA, 22 nt, Human
ucgccugggggacuuacccaag

SEQ ID NO: 412634 - RNA, 21 nt, Human
ucucgcacugggcuggacucc

SEQ ID NO: 412635 - RNA, 20 nt, Human
ucuggguggcacgaugacuu

SEQ ID NO: 412636 - RNA, 21 nt, Human
ugagaagcaugccugcauccc

SEQ ID NO: 412637 - RNA, 19 nt, Human
ugagaggcccgcacucagg

SEQ ID NO: 412638 - RNA, 19 nt, Human
ugagaggcccgcacucagg

SEQ ID NO: 412639 - RNA, 24 nt, Human
ugaggccaagugcagcucugcacg

SEQ ID NO: 412640 - RNA, 19 nt, Human
ugccaaaccaaucccuucc

SEQ ID NO: 412641 - RNA, 21 nt, Human
ugcugcccuggggucugaggc

SEQ ID NO: 412642 - RNA, 21 nt, Human
uggcaggcccagcugcgacuu

SEQ ID NO: 412643 - RNA, 20 nt, Human
uggccuccagguccacgacu

SEQ ID NO: 412644 - RNA, 19 nt, Human
uggcgcccgcccaaccccc

SEQ ID NO: 412645 - RNA, 21 nt, Human
uguaaacaaguucuugccaaa

SEQ ID NO: 412646 - RNA, 22 nt, Human
ugucucgcacugggcuggacuc

SEQ ID NO: 412647 - RNA, 19 nt, Human
uuaaaauaaaagcgaguuu

SEQ ID NO: 412648 - RNA, 19 nt, Human
uuccuccacccuccacucc

SEQ ID NO: 412649 - RNA, 21 nt, Human
uugcccuuccccgugcccucc

SEQ ID NO: 412650 - RNA, 22 nt, Human
aaaacaauauaaaacacauuga

SEQ ID NO: 412651 - RNA, 21 nt, Human
aaaagaagccgaguucgugua

SEQ ID NO: 412652 - RNA, 29 nt, Human
aaacaaaaagcaaaguuuaaggggacccc

SEQ ID NO: 412653 - RNA, 26 nt, Human
aaacaaaaagcaaaguuuaagucauc

SEQ ID NO: 412654 - RNA, 19 nt, Human
aaacuguagaaaguuagua

SEQ ID NO: 412655 - RNA, 19 nt, Human
aaagccaagccucugcuga

SEQ ID NO: 412656 - RNA, 22 nt, Human
aacaaagagagcagaacuagaa

SEQ ID NO: 412657 - RNA, 21 nt, Human
aaccacaaccguuuuuuuucc

SEQ ID NO: 412658 - RNA, 19 nt, Human
aagccgcccaggcccaaag

SEQ ID NO: 412659 - RNA, 18 nt, Human
aaggacccagcacacuuc

SEQ ID NO: 412660 - RNA, 23 nt, Human
acacagugugcacagcauccucc

SEQ ID NO: 412661 - RNA, 24 nt, Human
acacagugugcacagcauccuccu

SEQ ID NO: 412662 - RNA, 19 nt, Human
acaggaucuaguccccccc

SEQ ID NO: 412663 - RNA, 19 nt, Human
accaacucccacacugggc

SEQ ID NO: 412664 - RNA, 26 nt, Human
acccugaaggcauggcuggcaggagc

SEQ ID NO: 412665 - RNA, 19 nt, Human
accuaggacaaaagaagcc

SEQ ID NO: 412666 - RNA, 19 nt, Human
acuggaggagggguguggc

SEQ ID NO: 412667 - RNA, 21 nt, Human
agaagggaagccgccaguggc

SEQ ID NO: 412668 - RNA, 23 nt, Human
agcaaugggacaguuuccaagaa

SEQ ID NO: 412669 - RNA, 20 nt, Human
agcccggggucuggggaagg

SEQ ID NO: 412670 - RNA, 21 nt, Human
agggagggcuguggcagggcc

SEQ ID NO: 412671 - RNA, 22 nt, Human
agggagucuccagaaaccugcc

SEQ ID NO: 412672 - RNA, 18 nt, Human
aguaaguaagugaaaaau

SEQ ID NO: 412673 - RNA, 21 nt, Human
aguggcaaggguagggaagaa

SEQ ID NO: 412674 - RNA, 22 nt, Human
aguggguggcugcuccacagcu

SEQ ID NO: 412675 - RNA, 21 nt, Human
augaagacagauguggaaacg

SEQ ID NO: 412676 - RNA, 18 nt, Human
caaccguuuuuuuuccuu

SEQ ID NO: 412677 - RNA, 22 nt, Human
cacagaccagaccaagcugucu

SEQ ID NO: 412678 - RNA, 20 nt, Human
cacagcauccuccugacuag

SEQ ID NO: 412679 - RNA, 22 nt, Human
cacagcucgccccuccuccaga

SEQ ID NO: 412680 - RNA, 21 nt, Human
cacagugugcacagcauccuc

SEQ ID NO: 412681 - RNA, 20 nt, Human
caccaggaccgccagggcag

SEQ ID NO: 412682 - RNA, 20 nt, Human
cagaacgggaucgcagcauc

SEQ ID NO: 412683 - RNA, 20 nt, Human
cagcacacuucaagaaacca

SEQ ID NO: 412684 - RNA, 18 nt, Human
cagcagaacgggaucgca

SEQ ID NO: 412685 - RNA, 19 nt, Human
cagcaguggguggcugcuc

SEQ ID NO: 412686 - RNA, 19 nt, Human
cagcucgccccuccuccag

SEQ ID NO: 412687 - RNA, 19 nt, Human
ccacagcucgccccuccuc

SEQ ID NO: 412688 - RNA, 22 nt, Human
ccagaccaagcugucuuacacg

SEQ ID NO: 412689 - RNA, 20 nt, Human
ccagagaagcaacaagaaca

SEQ ID NO: 412690 - RNA, 19 nt, Human
ccagcccggugcccuugcc

SEQ ID NO: 412691 - RNA, 23 nt, Human
ccaggcccaaaggagagacaccc

SEQ ID NO: 412692 - RNA, 20 nt, Human
ccagggcagucucuucuccu

SEQ ID NO: 412693 - RNA, 22 nt, Human
ccccacuucugcacagaccaga

SEQ ID NO: 412694 - RNA, 18 nt, Human
cccgggcugggcuggcug

SEQ ID NO: 412695 - RNA, 18 nt, Human
ccugcccaucacucccca

SEQ ID NO: 412696 - RNA, 23 nt, Human
cgaguccugcuaauuccaauccu

SEQ ID NO: 412697 - RNA, 18 nt, Human
cgcagcaucuuagaaagc

SEQ ID NO: 412698 - RNA, 24 nt, Human
cuagucccccccaagagccaagaa

SEQ ID NO: 412699 - RNA, 18 nt, Human
cuccccacuucugcacag

SEQ ID NO: 412700 - RNA, 22 nt, Human
cuccccacuucugcacagacca

SEQ ID NO: 412701 - RNA, 21 nt, Human
cuccuccagaggacccagcuu

SEQ ID NO: 412702 - RNA, 18 nt, Human
cucugugcaggccaggcc

SEQ ID NO: 412703 - RNA, 23 nt, Human
cugaaggcauggcuggcaggagc

SEQ ID NO: 412704 - RNA, 22 nt, Human
cuggauccagagaagcaacaag

SEQ ID NO: 412705 - RNA, 22 nt, Human
cuucaaguggagcuugacucug

SEQ ID NO: 412706 - RNA, 20 nt, Human
cuucugcacagaccagacca

SEQ ID NO: 412707 - RNA, 22 nt, Human
cuuugcggggugucugaaugca

SEQ ID NO: 412708 - RNA, 20 nt, Human
gaaaggauauuacugaguga

SEQ ID NO: 412709 - RNA, 20 nt, Human
gaacaauguuaggcugccga

SEQ ID NO: 412710 - RNA, 18 nt, Human
gaccagaccaagcugucu

SEQ ID NO: 412711 - RNA, 21 nt, Human
gagacacccacuggcucgaaa

SEQ ID NO: 412712 - RNA, 18 nt, Human
gauccagagaagcaacaa

SEQ ID NO: 412713 - RNA, 21 nt, Human
gcaagccgcccaggcccaaag

SEQ ID NO: 412714 - RNA, 20 nt, Human
gcacacuucaagaaaccagg

SEQ ID NO: 412715 - RNA, 19 nt, Human
gcucuggaggaggggguca

SEQ ID NO: 412716 - RNA, 20 nt, Human
ggacuggaggaggggugugg

SEQ ID NO: 412717 - RNA, 21 nt, Human
ggacuggaggagggguguggc

SEQ ID NO: 412718 - RNA, 21 nt, Human
ggacuggaggagggguguggc

SEQ ID NO: 412719 - RNA, 20 nt, Human
ggagaaggacuggaggaggg

SEQ ID NO: 412720 - RNA, 25 nt, Human
ggagagacacccacuggcucggcuu

SEQ ID NO: 412721 - RNA, 18 nt, Human
ggaguagggagcagaggg

SEQ ID NO: 412722 - RNA, 25 nt, Human
ggcaggagcaagccgcccaggccca

SEQ ID NO: 412723 - RNA, 19 nt, Human
ggccaacccuggggugcca

SEQ ID NO: 412724 - RNA, 26 nt, Human
ggcugcagggagaagugccaaccugg

SEQ ID NO: 412725 - RNA, 20 nt, Human
ggcuucucugugcaggccag

SEQ ID NO: 412726 - RNA, 23 nt, Human
gggcagcaguggguggcugcucc

SEQ ID NO: 412727 - RNA, 18 nt, Human
gguagggaagaaagggaa

SEQ ID NO: 412728 - RNA, 18 nt, Human
ggucucugcucacacuug

SEQ ID NO: 412729 - RNA, 23 nt, Human
gucuuguucccgggcugggcugg

SEQ ID NO: 412730 - RNA, 20 nt, Human
gugaaauaaaauccaucauc

SEQ ID NO: 412731 - RNA, 24 nt, Human
guggagagcaagcuccguggcaca

SEQ ID NO: 412732 - RNA, 20 nt, Human
guggguggcugcuccacagc

SEQ ID NO: 412733 - RNA, 25 nt, Human
guguacacaccgcaggggccaugcg

SEQ ID NO: 412734 - RNA, 25 nt, Human
uaacugccacaagcgaacgccaggc

SEQ ID NO: 412735 - RNA, 24 nt, Human
uaagaaaagccaccaggaccgcca

SEQ ID NO: 412736 - RNA, 24 nt, Human
uacaaaaaaaggcagucaaaacaa

SEQ ID NO: 412737 - RNA, 25 nt, Human
uacaaaaaaaggcagucaaaacaau

SEQ ID NO: 412738 - RNA, 20 nt, Human
uaccuagaccacuuuugauu

SEQ ID NO: 412739 - RNA, 21 nt, Human
uaccuagaccacuuuugauua

SEQ ID NO: 412740 - RNA, 24 nt, Human
uagcaggccccccauuucggggcc

SEQ ID NO: 412741 - RNA, 18 nt, Human
ucaaagugugccgaggga

SEQ ID NO: 412742 - RNA, 23 nt, Human
uccacaggaucuaguccccccca

SEQ ID NO: 412743 - RNA, 26 nt, Human
uccacaggaucuagucccccccaaga

SEQ ID NO: 412744 - RNA, 18 nt, Human
ucccacacugggcaacag

SEQ ID NO: 412745 - RNA, 21 nt, Human
ucccgggcacaagggagucuc

SEQ ID NO: 412746 - RNA, 20 nt, Human
ucccugaggggcugccggga

SEQ ID NO: 412747 - RNA, 24 nt, Human
ucucugugcaggccaggccagagg

SEQ ID NO: 412748 - RNA, 18 nt, Human
ucugacgauaaauucuaa

SEQ ID NO: 412749 - RNA, 22 nt, Human
ucugcucacacuugcuggaacc

SEQ ID NO: 412750 - RNA, 21 nt, Human
ugaaaaauaaacucggugcca

SEQ ID NO: 412751 - RNA, 19 nt, Human
ugaaaggauauuacugagu

SEQ ID NO: 412752 - RNA, 21 nt, Human
ugaggagaaggacuggaggag

SEQ ID NO: 412753 - RNA, 18 nt, Human
ugcaaaggcugugagucc

SEQ ID NO: 412754 - RNA, 23 nt, Human
ugccaaccugggaccucaggagc

SEQ ID NO: 412755 - RNA, 19 nt, Human
ugccagggcugagaguccc

SEQ ID NO: 412756 - RNA, 21 nt, Human
ugcccuugccaucccgggcac

SEQ ID NO: 412757 - RNA, 18 nt, Human
ugccgagggagggcugug

SEQ ID NO: 412758 - RNA, 23 nt, Human
ugccgagggagggcuguggcagg

SEQ ID NO: 412759 - RNA, 23 nt, Human
ugcucagagccuacccugaaggc

SEQ ID NO: 412760 - RNA, 23 nt, Human
uggacaagaaaagaaacaccauu

SEQ ID NO: 412761 - RNA, 18 nt, Human
uggaggagggggucagca

SEQ ID NO: 412762 - RNA, 22 nt, Human
uggagugugagugaaauaaaau

SEQ ID NO: 412763 - RNA, 20 nt, Human
uggcagaaauacgaagcaau

SEQ ID NO: 412764 - RNA, 22 nt, Human
uggcagaaauacgaagcaaugg

SEQ ID NO: 412765 - RNA, 24 nt, Human
uggcagaaauacgaagcaauggga

SEQ ID NO: 412766 - RNA, 26 nt, Human
uggcagaagcgggguugaccggaacg

SEQ ID NO: 412767 - RNA, 18 nt, Human
uggcagaagcgggguugg

SEQ ID NO: 412768 - RNA, 21 nt, Human
uggcagaagcgggguugguga

SEQ ID NO: 412769 - RNA, 18 nt, Human
uggcugcagggagaagug

SEQ ID NO: 412770 - RNA, 22 nt, Human
uggggcagcaguggguggcugc

SEQ ID NO: 412771 - RNA, 19 nt, Human
ugguaacaucagcuggagu

SEQ ID NO: 412772 - RNA, 24 nt, Human
uguacacaccgcaggggccaugcg

SEQ ID NO: 412773 - RNA, 22 nt, Human
ugucugaaugcacugcacgggg

SEQ ID NO: 412774 - RNA, 22 nt, Human
ugugagugaaauaaaauccauc

SEQ ID NO: 412775 - RNA, 19 nt, Human
uuaagaaaacuguagaaag

SEQ ID NO: 412776 - RNA, 25 nt, Human
uuccacagaguccugcuuugcgggg

SEQ ID NO: 412777 - RNA, 19 nt, Human
uuccugagugagcuugggg

SEQ ID NO: 412778 - RNA, 21 nt, Human
uuccugagugagcuuggggca

SEQ ID NO: 412779 - RNA, 19 nt, Human
uuccuuggggugucagagc

SEQ ID NO: 412780 - RNA, 23 nt, Human
uugaaaggauauuacugagugag

SEQ ID NO: 412781 - RNA, 23 nt, Human
uugaagcagugauuuuuaaaaca

SEQ ID NO: 412782 - RNA, 24 nt, Human
uuggcguaccuaggacaaaagaag

SEQ ID NO: 412783 - RNA, 19 nt, Human
uuggggcagcagugggugg

SEQ ID NO: 412784 - RNA, 21 nt, Human
uuuauuucuacaaaaaaaggc

SEQ ID NO: 412785 - RNA, 19 nt, Human
uuugguuuuggagcagcca

SEQ ID NO: 412786 - RNA, 24 nt, Human
aaaaaugaauggggaaugggccgg

SEQ ID NO: 412787 - RNA, 18 nt, Human
aagcaggccugcaaggug

SEQ ID NO: 412788 - RNA, 20 nt, Human
aauggggaaugggccacagg

SEQ ID NO: 412789 - RNA, 24 nt, Human
acaacacacacacucauagcuccc

SEQ ID NO: 412790 - RNA, 23 nt, Human
acccauaugcuccacugucccca

SEQ ID NO: 412791 - RNA, 22 nt, Human
agcucccuucccuccaccacac

SEQ ID NO: 412792 - RNA, 23 nt, Human
aggccugcaaggugaccugucuc

SEQ ID NO: 412793 - RNA, 20 nt, Human
caaacuuaaacucccuuggc

SEQ ID NO: 412794 - RNA, 23 nt, Human
cacacacaaacuaaugacuaaca

SEQ ID NO: 412795 - RNA, 20 nt, Human
cacagucugaggccuggucc

SEQ ID NO: 412796 - RNA, 22 nt, Human
cacagucugaggccugguccca

SEQ ID NO: 412797 - RNA, 22 nt, Human
cacccguggccuccagcaggac

SEQ ID NO: 412798 - RNA, 19 nt, Human
caccuguggccaggugaac

SEQ ID NO: 412799 - RNA, 20 nt, Human
caccuguggccaggugaacc

SEQ ID NO: 412800 - RNA, 23 nt, Human
ccacccauaugcuccacuguccc

SEQ ID NO: 412801 - RNA, 26 nt, Human
ccauaugcuccacuguccccaggccc

SEQ ID NO: 412802 - RNA, 18 nt, Human
cccacccauaugcuccac

SEQ ID NO: 412803 - RNA, 19 nt, Human
cccauaugcuccacugucc

SEQ ID NO: 412804 - RNA, 24 nt, Human
ccccaggcccucagugccugagcc

SEQ ID NO: 412805 - RNA, 25 nt, Human
ccccaggcccucagugccugagccc

SEQ ID NO: 412806 - RNA, 23 nt, Human
ccugagcccuagggggauucgag

SEQ ID NO: 412807 - RNA, 21 nt, Human
cgggaccgaguguguggcacc

SEQ ID NO: 412808 - RNA, 21 nt, Human
cuccaccacacacacacacaa

SEQ ID NO: 412809 - RNA, 23 nt, Human
cucuaagauggagagcuggagaa

SEQ ID NO: 412810 - RNA, 24 nt, Human
cucucuaagauggagagcuggaga

SEQ ID NO: 412811 - RNA, 21 nt, Human
cugaggccuggucccaggaac

SEQ ID NO: 412812 - RNA, 20 nt, Human
cuggggaauguaaagggugu

SEQ ID NO: 412813 - RNA, 19 nt, Human
ggccuggucccaggaacug

SEQ ID NO: 412814 - RNA, 20 nt, Human
gggaaugggccacagggggc

SEQ ID NO: 412815 - RNA, 20 nt, Human
gggggcucuggccucagucc

SEQ ID NO: 412816 - RNA, 18 nt, Human
ggguacccuccaucuguc

SEQ ID NO: 412817 - RNA, 20 nt, Human
uaaauaggguacccuccauc

SEQ ID NO: 412818 - RNA, 21 nt, Human
uaagauggagagcuggagaac

SEQ ID NO: 412819 - RNA, 23 nt, Human
uaggguacccuccaucugucucc

SEQ ID NO: 412820 - RNA, 24 nt, Human
uauagauuuucaggauggaaguuu

SEQ ID NO: 412821 - RNA, 20 nt, Human
ucaguccaugaggugugucc

SEQ ID NO: 412822 - RNA, 19 nt, Human
uccaccacacacacacaca

SEQ ID NO: 412823 - RNA, 21 nt, Human
uccaccacacacacacacaaa

SEQ ID NO: 412824 - RNA, 19 nt, Human
uccauacacaacacacaca

SEQ ID NO: 412825 - RNA, 18 nt, Human
uccccaggcccucagugc

SEQ ID NO: 412826 - RNA, 23 nt, Human
uccugcaagcaggccugcaaggu

SEQ ID NO: 412827 - RNA, 21 nt, Human
ucuaacaggauggcaaguggu

SEQ ID NO: 412828 - RNA, 20 nt, Human
ucucccacccauaugcucca

SEQ ID NO: 412829 - RNA, 18 nt, Human
ugacucaguuguaaauag

SEQ ID NO: 412830 - RNA, 22 nt, Human
ugacucauccguggaaaauaaa

SEQ ID NO: 412831 - RNA, 23 nt, Human
ugaggccuggucccaggaacugg

SEQ ID NO: 412832 - RNA, 20 nt, Human
uggagagcuggagaacuggc

SEQ ID NO: 412833 - RNA, 23 nt, Human
uggagagcuggagaacuggccug

SEQ ID NO: 412834 - RNA, 21 nt, Human
uggcugcuggauucauuuccu

SEQ ID NO: 412835 - RNA, 21 nt, Human
uggggaaugggccacaggggg

SEQ ID NO: 412836 - RNA, 19 nt, Human
uguaacugcaaacuuaaac

SEQ ID NO: 412837 - RNA, 21 nt, Human
uguaacugcaaacuuaaacuc

SEQ ID NO: 412838 - RNA, 19 nt, Human
uucacagucugaggccugg

SEQ ID NO: 412839 - RNA, 26 nt, Human
uucccuccaccacacacacacacaaa

SEQ ID NO: 412840 - RNA, 21 nt, Human
uuccguggcucccccuggacu

SEQ ID NO: 412841 - RNA, 18 nt, Human
aaaaccaaggcaugcacc

SEQ ID NO: 412842 - RNA, 18 nt, Human
aaaaccaaggcaugcacc

SEQ ID NO: 412843 - RNA, 18 nt, Human
aacuagacccccaaugga

SEQ ID NO: 412844 - RNA, 21 nt, Human
aagaaaccaggggugcaggcg

SEQ ID NO: 412845 - RNA, 24 nt, Human
aagaaaccaggggugcaggcgaaa

SEQ ID NO: 412846 - RNA, 19 nt, Human
aagcagcagcagcaccaaa

SEQ ID NO: 412847 - RNA, 19 nt, Human
aagcagcagcagcaccaaa

SEQ ID NO: 412848 - RNA, 21 nt, Human
aagcagcagcagcaccaaaac

SEQ ID NO: 412849 - RNA, 21 nt, Human
aagcagcagcagcaccaaaac

SEQ ID NO: 412850 - RNA, 24 nt, Human
aagcagcagcagcaccaaaaccaa

SEQ ID NO: 412851 - RNA, 24 nt, Human
aagcagcagcagcaccaaaaccaa

SEQ ID NO: 412852 - RNA, 21 nt, Human
aaggaaccaggggugcaggcg

SEQ ID NO: 412853 - RNA, 19 nt, Human
aaguucaaccaccaaggac

SEQ ID NO: 412854 - RNA, 20 nt, Human
aauuaaaaaaaaaaaaaaaa

SEQ ID NO: 412855 - RNA, 21 nt, Human
aauuuuuaaaagcaaaagcag

SEQ ID NO: 412856 - RNA, 23 nt, Human
acaauaaaaaggcugcuuaugga

SEQ ID NO: 412857 - RNA, 23 nt, Human
acaauaaaaaggcugcuuaugga

SEQ ID NO: 412858 - RNA, 20 nt, Human
acacaccuagcaguaguccc

SEQ ID NO: 412859 - RNA, 18 nt, Human
acaggcugcgaccugaaa

SEQ ID NO: 412860 - RNA, 18 nt, Human
acaggcugcgaccugaag

SEQ ID NO: 412861 - RNA, 24 nt, Human
accccaggccguguaaucagcagc

SEQ ID NO: 412862 - RNA, 23 nt, Human
acggugcaaaaaggaacuugagg

SEQ ID NO: 412863 - RNA, 19 nt, Human
acucaguuugcuuugugac

SEQ ID NO: 412864 - RNA, 22 nt, Human
agacuuaaagaaaccaggggug

SEQ ID NO: 412865 - RNA, 22 nt, Human
agacuuaaaggaaccaggggug

SEQ ID NO: 412866 - RNA, 24 nt, Human
agagaccccaggccguguaaucag

SEQ ID NO: 412867 - RNA, 18 nt, Human
agagcuggcaggucugag

SEQ ID NO: 412868 - RNA, 21 nt, Human
agcaaguggaaagacgcagca

SEQ ID NO: 412869 - RNA, 22 nt, Human
agcaaguggaaagacgcagcaa

SEQ ID NO: 412870 - RNA, 24 nt, Human
agcggcagcagugucaccaggcag

SEQ ID NO: 412871 - RNA, 18 nt, Human
aggaacuugaggaggagg

SEQ ID NO: 412872 - RNA, 24 nt, Human
aggguaaggggagaaggcagagac

SEQ ID NO: 412873 - RNA, 21 nt, Human
aggugauugugugaugugucu

SEQ ID NO: 412874 - RNA, 18 nt, Human
agugguuacacuugacag

SEQ ID NO: 412875 - RNA, 23 nt, Human
auaaaaaggcugcuuauggaaua

SEQ ID NO: 412876 - RNA, 23 nt, Human
auaaaaaggcugcuuauggaaua

SEQ ID NO: 412877 - RNA, 23 nt, Human
augcaccggauucaagguucuuu

SEQ ID NO: 412878 - RNA, 22 nt, Human
auuaaaaaaaaaaaaaaaaccu

SEQ ID NO: 412879 - RNA, 22 nt, Human
auuaaaaaaaaaaaaaaaaccu

SEQ ID NO: 412880 - RNA, 18 nt, Human
caaccaccaaggacuccg

SEQ ID NO: 412881 - RNA, 18 nt, Human
caagccccccaggcuaga

SEQ ID NO: 412882 - RNA, 21 nt, Human
cacacaccuagcaguaguccc

SEQ ID NO: 412883 - RNA, 22 nt, Human
cacaccuagcaguagucccaca

SEQ ID NO: 412884 - RNA, 24 nt, Human
caccaaaaccaaggcaugcaccgg

SEQ ID NO: 412885 - RNA, 24 nt, Human
caccaaaaccaaggcaugcaccgg

SEQ ID NO: 412886 - RNA, 22 nt, Human
cagcaccaaaaccaaggcaugc

SEQ ID NO: 412887 - RNA, 22 nt, Human
cagcaccaaaaccaaggcaugc

SEQ ID NO: 412888 - RNA, 18 nt, Human
cagcagcaccaaaaccaa

SEQ ID NO: 412889 - RNA, 18 nt, Human
cagcagcaccaaaaccaa

SEQ ID NO: 412890 - RNA, 21 nt, Human
cagcagcagcaccaaaaccaa

SEQ ID NO: 412891 - RNA, 21 nt, Human
cagcagcagcaccaaaaccaa

SEQ ID NO: 412892 - RNA, 22 nt, Human
cagcagcagcaccaaaaccaag

SEQ ID NO: 412893 - RNA, 22 nt, Human
cagcagcagcaccaaaaccaag

SEQ ID NO: 412894 - RNA, 24 nt, Human
caggcgaaacaccccacacaccua

SEQ ID NO: 412895 - RNA, 24 nt, Human
cagguaagacgcuugaaccucucc

SEQ ID NO: 412896 - RNA, 21 nt, Human
ccaaguucaaccaccaaggac

SEQ ID NO: 412897 - RNA, 24 nt, Human
cccacacaccuagcaguaguccca

SEQ ID NO: 412898 - RNA, 22 nt, Human
cccacaggcugcgaccugaaac

SEQ ID NO: 412899 - RNA, 22 nt, Human
cccacaggcugcgaccugaagc

SEQ ID NO: 412900 - RNA, 22 nt, Human
cccaccaauuucggggaucugc

SEQ ID NO: 412901 - RNA, 22 nt, Human
cccaccaauuucggggaucugc

SEQ ID NO: 412902 - RNA, 21 nt, Human
cccagaaaaagauuaauggaa

SEQ ID NO: 412903 - RNA, 21 nt, Human
cccagaaaaagauuaauggaa

SEQ ID NO: 412904 - RNA, 19 nt, Human
ccccaggcuagagggcugu

SEQ ID NO: 412905 - RNA, 18 nt, Human
cccccaggcuagagggcu

SEQ ID NO: 412906 - RNA, 20 nt, Human
ccccccaggcuagagggcug

SEQ ID NO: 412907 - RNA, 18 nt, Human
ccggguucaagguucuuu

SEQ ID NO: 412908 - RNA, 18 nt, Human
ccuagcaguagucccaca

SEQ ID NO: 412909 - RNA, 18 nt, Human
ccugaacagcaaguggaa

SEQ ID NO: 412910 - RNA, 18 nt, Human
ccugaacagcaaguggaa

SEQ ID NO: 412911 - RNA, 22 nt, Human
cgaccugaaaccuucacaucua

SEQ ID NO: 412912 - RNA, 22 nt, Human
cgaccugaagccuucacaucua

SEQ ID NO: 412913 - RNA, 22 nt, Human
cuaaauuaaaaaaaaaaaaaaa

SEQ ID NO: 412914 - RNA, 22 nt, Human
cuaaauuaaaaaaaaaaaaaaa

SEQ ID NO: 412915 - RNA, 23 nt, Human
cuaaauuaaaaaaaaaaaaaaaa

SEQ ID NO: 412916 - RNA, 23 nt, Human
cuaaauuaaaaaaaaaaaaaaaa

SEQ ID NO: 412917 - RNA, 24 nt, Human
cuagaccccaauggauugcaagga

SEQ ID NO: 412918 - RNA, 25 nt, Human
cuagacccccaauggauugcaagga

SEQ ID NO: 412919 - RNA, 21 nt, Human
cucuaacaagccccccaggcu

SEQ ID NO: 412920 - RNA, 23 nt, Human
cugguggagagugagugaguaug

SEQ ID NO: 412921 - RNA, 24 nt, Human
cuugaggaggagggagaaaaagca

SEQ ID NO: 412922 - RNA, 23 nt, Human
gaaaaagauuaauggaaacauca

SEQ ID NO: 412923 - RNA, 23 nt, Human
gaaaaagauuaauggaaacauca

SEQ ID NO: 412924 - RNA, 18 nt, Human
gaaacaccccacacaccu

SEQ ID NO: 412925 - RNA, 19 nt, Human
gaagguguuggguggugac

SEQ ID NO: 412926 - RNA, 20 nt, Human
gaagguguuggguggugacg

SEQ ID NO: 412927 - RNA, 18 nt, Human
gacaggaugaugguuugg

SEQ ID NO: 412928 - RNA, 21 nt, Human
gaccugaaaccuucacaucua

SEQ ID NO: 412929 - RNA, 21 nt, Human
gaggucagaggcucuuuccaa

SEQ ID NO: 412930 - RNA, 23 nt, Human
gcagcaccaaaaccaaggcaugc

SEQ ID NO: 412931 - RNA, 23 nt, Human
gcagcaccaaaaccaaggcaugc

SEQ ID NO: 412932 - RNA, 26 nt, Human
gcagcggcagcagugucaccaggcag

SEQ ID NO: 412933 - RNA, 20 nt, Human
gcuugaaccucuccuggcau

SEQ ID NO: 412934 - RNA, 24 nt, Human
ggaaagcccugaauuccucaccga

SEQ ID NO: 412935 - RNA, 24 nt, Human
ggaaagcccugaauuccucaccga

SEQ ID NO: 412936 - RNA, 18 nt, Human
ggcaugcaccggauucaa

SEQ ID NO: 412937 - RNA, 18 nt, Human
ggcaugcaccggguucaa

SEQ ID NO: 412938 - RNA, 21 nt, Human
gggaaucaauuuaaauagacu

SEQ ID NO: 412939 - RNA, 23 nt, Human
gggaguggagggguuacaaucua

SEQ ID NO: 412940 - RNA, 18 nt, Human
ggggaguggagggguuac

SEQ ID NO: 412941 - RNA, 18 nt, Human
gggggaaggggaagggcc

SEQ ID NO: 412942 - RNA, 21 nt, Human
ggggggaaggggaagggccug

SEQ ID NO: 412943 - RNA, 23 nt, Human
ggggugcaggcgaaacaccccac

SEQ ID NO: 412944 - RNA, 18 nt, Human
gggugcaggcgaaacacc

SEQ ID NO: 412945 - RNA, 19 nt, Human
ggugacggugcaaaaagga

SEQ ID NO: 412946 - RNA, 24 nt, Human
gugguccugaacagcaaguggaaa

SEQ ID NO: 412947 - RNA, 24 nt, Human
gugguccugaacagcaaguggaaa

SEQ ID NO: 412948 - RNA, 20 nt, Human
guugcugcuucaaaaggugg

SEQ ID NO: 412949 - RNA, 20 nt, Human
guugcugcuucaaaaggugg

SEQ ID NO: 412950 - RNA, 26 nt, Human
uaaauuaaaaaaaaaaaaaaaaccuu

SEQ ID NO: 412951 - RNA, 26 nt, Human
uaaauuaaaaaaaaaaaaaaaaccuu

SEQ ID NO: 412952 - RNA, 20 nt, Human
uaagacgcuugaaccucucc

SEQ ID NO: 412953 - RNA, 19 nt, Human
uacaguaucuuaagauaaa

SEQ ID NO: 412954 - RNA, 23 nt, Human
uagaccccaauggauugcaagga

SEQ ID NO: 412955 - RNA, 28 nt, Human
uagcaguagucccacaggcugcgacugg

SEQ ID NO: 412956 - RNA, 29 nt, Human
uagcaguagucccacaggcugcgacuggu

SEQ ID NO: 412957 - RNA, 18 nt, Human
uaguaucaaccucauagg

SEQ ID NO: 412958 - RNA, 22 nt, Human
ucacaucuacucuaacaagccc

SEQ ID NO: 412959 - RNA, 19 nt, Human
ucaccuuaucaaaaccuga

SEQ ID NO: 412960 - RNA, 24 nt, Human
ucagauuccaaacuagacccccaa

SEQ ID NO: 412961 - RNA, 22 nt, Human
uccaaacuagaccccaauggau

SEQ ID NO: 412962 - RNA, 23 nt, Human
uccaaacuagacccccaauggau

SEQ ID NO: 412963 - RNA, 18 nt, Human
ucuaugcuucggccaagg

SEQ ID NO: 412964 - RNA, 18 nt, Human
ugacuucagguaagacgc

SEQ ID NO: 412965 - RNA, 20 nt, Human
ugagcuaaaaacaaugcauc

SEQ ID NO: 412966 - RNA, 21 nt, Human
ugagcuaaaaacaaugcauca

SEQ ID NO: 412967 - RNA, 21 nt, Human
ugaggaggagggagaaaaagc

SEQ ID NO: 412968 - RNA, 24 nt, Human
ugaggaucuugggaagcagcagca

SEQ ID NO: 412969 - RNA, 24 nt, Human
ugaggaucuugggaagcagcagca

SEQ ID NO: 412970 - RNA, 24 nt, Human
ugauaguugcugcuucaaaaggug

SEQ ID NO: 412971 - RNA, 24 nt, Human
ugauaguugcugcuucaaaaggug

SEQ ID NO: 412972 - RNA, 19 nt, Human
ugaugguuuggaaggggca

SEQ ID NO: 412973 - RNA, 23 nt, Human
uggcaggucugaguaacccuggu

SEQ ID NO: 412974 - RNA, 23 nt, Human
uggggaaagcccugaauuccuca

SEQ ID NO: 412975 - RNA, 23 nt, Human
uggggaaagcccugaauuccuca

SEQ ID NO: 412976 - RNA, 20 nt, Human
ugggggagagaagauauggg

SEQ ID NO: 412977 - RNA, 25 nt, Human
uggggggaaggggaagggccugugg

SEQ ID NO: 412978 - RNA, 20 nt, Human
uggucugacaauaaaaaggc

SEQ ID NO: 412979 - RNA, 20 nt, Human
uggucugacaauaaaaaggc

SEQ ID NO: 412980 - RNA, 22 nt, Human
uguuauguuaaacuucacuuac

SEQ ID NO: 412981 - RNA, 22 nt, Human
uguuauguuaaacuucacuuac

SEQ ID NO: 412982 - RNA, 20 nt, Human
uguuggguggugacggugca

SEQ ID NO: 412983 - RNA, 20 nt, Human
uuaauggaaacaucaauugc

SEQ ID NO: 412984 - RNA, 20 nt, Human
uuaauggaaacaucaauugc

SEQ ID NO: 412985 - RNA, 20 nt, Human
uuacaguaucuuaagauaaa

SEQ ID NO: 412986 - RNA, 19 nt, Human
uuaccugauggcuucuggc

SEQ ID NO: 412987 - RNA, 22 nt, Human
uuagaacuaagguuuucccccc

SEQ ID NO: 412988 - RNA, 22 nt, Human
uuagaacuaagguuuucccccc

SEQ ID NO: 412989 - RNA, 21 nt, Human
uucacaguugaguuagaugug

SEQ ID NO: 412990 - RNA, 23 nt, Human
uugaggaggagggagaaaaagca

SEQ ID NO: 412991 - RNA, 23 nt, Human
uugucagauuccaaacuagaccc

SEQ ID NO: 412992 - RNA, 23 nt, Human
uugucagauuccaaacuagaccc

SEQ ID NO: 412993 - RNA, 21 nt, Human
uuucccaggcugguggagagu

SEQ ID NO: 412994 - RNA, 20 nt, Human
uuucggggaucugcugugcc

SEQ ID NO: 412995 - RNA, 20 nt, Human
uuucggggaucugcugugcc

SEQ ID NO: 412996 - RNA, 20 nt, Human
uuuuuuuuuuuuuuauuaac

SEQ ID NO: 412997 - RNA, 23 nt, Human
uuuuuuuuuuuuuuuuauuaacg

SEQ ID NO: 412998 - RNA, 18 nt, Human
aaaacaacaacgagaaca

SEQ ID NO: 412999 - RNA, 23 nt, Human
aaaacauuccaauuucucccuuc

SEQ ID NO: 413000 - RNA, 21 nt, Human
aaaacgaggccgggaaaggga

SEQ ID NO: 413001 - RNA, 20 nt, Human
aaacaaacaacaaacuuccu

SEQ ID NO: 413002 - RNA, 23 nt, Human
aaaggccccgucgucuccuguag

SEQ ID NO: 413003 - RNA, 19 nt, Human
aaagugccacaguuuuauu

SEQ ID NO: 413004 - RNA, 20 nt, Human
aacaaaaaucccuguccuuu

SEQ ID NO: 413005 - RNA, 19 nt, Human
aacaacaucacauacacag

SEQ ID NO: 413006 - RNA, 21 nt, Human
aacaacaucacauacacagaa

SEQ ID NO: 413007 - RNA, 20 nt, Human
aacaacgagaacaacaagaa

SEQ ID NO: 413008 - RNA, 25 nt, Human
aacaacgagaacaacaagaacaaaa

SEQ ID NO: 413009 - RNA, 22 nt, Human
aacgagaacaacaagaacaaaa

SEQ ID NO: 413010 - RNA, 24 nt, Human
aagaacaaaaaucccuguccuuuc

SEQ ID NO: 413011 - RNA, 18 nt, Human
aagacauccuuuuucucc

SEQ ID NO: 413012 - RNA, 26 nt, Human
aaucaccaaggcacaagcucagcacc

SEQ ID NO: 413013 - RNA, 21 nt, Human
aauggcugauucaacaagaug

SEQ ID NO: 413014 - RNA, 19 nt, Human
acaaaaaucccuguccuuu

SEQ ID NO: 413015 - RNA, 20 nt, Human
accaaggcacaagcucagca

SEQ ID NO: 413016 - RNA, 18 nt, Human
accccgagcccagcgcca

SEQ ID NO: 413017 - RNA, 19 nt, Human
accccgagcccagcgccac

SEQ ID NO: 413018 - RNA, 22 nt, Human
accgccucguucucuuucgcug

SEQ ID NO: 413019 - RNA, 21 nt, Human
acgagaacaacaagaacaaaa

SEQ ID NO: 413020 - RNA, 19 nt, Human
acgaggccgggaaagggag

SEQ ID NO: 413021 - RNA, 21 nt, Human
acucuuugggggcuagaacag

SEQ ID NO: 413022 - RNA, 19 nt, Human
acuucugaggagcugguga

SEQ ID NO: 413023 - RNA, 19 nt, Human
agaaaaaccccauguuacc

SEQ ID NO: 413024 - RNA, 23 nt, Human
agauuuuuaaccugucgucgccc

SEQ ID NO: 413025 - RNA, 18 nt, Human
agcaaaagugauuuaacc

SEQ ID NO: 413026 - RNA, 21 nt, Human
agcuucaaugucgucagacug

SEQ ID NO: 413027 - RNA, 23 nt, Human
aggaaaggggaaacuacuuacug

SEQ ID NO: 413028 - RNA, 20 nt, Human
aggaggagccgaaggaggcg

SEQ ID NO: 413029 - RNA, 20 nt, Human
aggcuggcccagaaaaaccc

SEQ ID NO: 413030 - RNA, 20 nt, Human
agggcugcaguuaaaacauu

SEQ ID NO: 413031 - RNA, 24 nt, Human
aggugaagcguaaguaggcggcgg

SEQ ID NO: 413032 - RNA, 19 nt, Human
aguaauaaacacaagcaaa

SEQ ID NO: 413033 - RNA, 20 nt, Human
aguaauaaacacaagcaaaa

SEQ ID NO: 413034 - RNA, 19 nt, Human
aguuaaaaauacauaaucc

SEQ ID NO: 413035 - RNA, 21 nt, Human
caacaacgagaacaacaagaa

SEQ ID NO: 413036 - RNA, 23 nt, Human
caacgagaacaacaagaacaaaa

SEQ ID NO: 413037 - RNA, 20 nt, Human
caagaacaaaaaucccuguc

SEQ ID NO: 413038 - RNA, 25 nt, Human
caagaacaaaaaucccuguccuuuc

SEQ ID NO: 413039 - RNA, 20 nt, Human
caauaaagaagggaggcaca

SEQ ID NO: 413040 - RNA, 23 nt, Human
caauauggaaagcauugucuucu

SEQ ID NO: 413041 - RNA, 23 nt, Human
caaucaaucaccaaggcacaagc

SEQ ID NO: 413042 - RNA, 24 nt, Human
caaucaccaaggcacaagcucagc

SEQ ID NO: 413043 - RNA, 18 nt, Human
cacacuguuuucaagacu

SEQ ID NO: 413044 - RNA, 20 nt, Human
cagccgccgcugccugucca

SEQ ID NO: 413045 - RNA, 21 nt, Human
cagggacaaaaaaguagcaca

SEQ ID NO: 413046 - RNA, 21 nt, Human
caguaauaaacacaagcaaaa

SEQ ID NO: 413047 - RNA, 18 nt, Human
ccagcgccaccaucuugg

SEQ ID NO: 413048 - RNA, 25 nt, Human
ccaguaaacuuaaaacaacaacgag

SEQ ID NO: 413049 - RNA, 26 nt, Human
cccaguaaacuuaaaacaacaacgag

SEQ ID NO: 413050 - RNA, 23 nt, Human
ccgcccgcagccgagcgcgccgg

SEQ ID NO: 413051 - RNA, 23 nt, Human
ccgcugccuguccacaccggggg

SEQ ID NO: 413052 - RNA, 21 nt, Human
ccucaagcaguaauaaacaca

SEQ ID NO: 413053 - RNA, 18 nt, Human
ccuccgcccgccaccgcc

SEQ ID NO: 413054 - RNA, 21 nt, Human
ccuccgcccgccaccgccucg

SEQ ID NO: 413055 - RNA, 21 nt, Human
ccucgcccgccgccuccgccc

SEQ ID NO: 413056 - RNA, 21 nt, Human
ccuggcgaagggaaaaggccc

SEQ ID NO: 413057 - RNA, 19 nt, Human
ccuuccuuccaucuuucuu

SEQ ID NO: 413058 - RNA, 22 nt, Human
cgagaacaacaagaacaaaaau

SEQ ID NO: 413059 - RNA, 20 nt, Human
cgcccgccgccuccgcccgg

SEQ ID NO: 413060 - RNA, 20 nt, Human
cgccgcugccuguccacacc

SEQ ID NO: 413061 - RNA, 20 nt, Human
cgcgagcgagcgaagccugg

SEQ ID NO: 413062 - RNA, 20 nt, Human
cgucgccagccgccgcugcc

SEQ ID NO: 413063 - RNA, 20 nt, Human
cuaacaguguucuaaaggcu

SEQ ID NO: 413064 - RNA, 18 nt, Human
cuaccuugaucugagcgu

SEQ ID NO: 413065 - RNA, 24 nt, Human
cuaucuuacagccuuuuuguacug

SEQ ID NO: 413066 - RNA, 18 nt, Human
cuccugccaggggcuaca

SEQ ID NO: 413067 - RNA, 21 nt, Human
cucuuucgcugccgccaccgc

SEQ ID NO: 413068 - RNA, 27 nt, Human
cuuaaaauaaauauucagaaaaaccuc

SEQ ID NO: 413069 - RNA, 23 nt, Human
cuugacuaccauuucauuuggcc

SEQ ID NO: 413070 - RNA, 22 nt, Human
gaaaacgaggccgggaaaggga

SEQ ID NO: 413071 - RNA, 26 nt, Human
gacacuaucaccaccaaaaauuuauc

SEQ ID NO: 413072 - RNA, 19 nt, Human
gagaacaacaagaacaaaa

SEQ ID NO: 413073 - RNA, 18 nt, Human
gcacuuuccccaguaaac

SEQ ID NO: 413074 - RNA, 24 nt, Human
gcugcuaccuugaucugagcguag

SEQ ID NO: 413075 - RNA, 18 nt, Human
gcuggcccagaaaaaccc

SEQ ID NO: 413076 - RNA, 22 nt, Human
gcuuaauaacucauauuucgcc

SEQ ID NO: 413077 - RNA, 23 nt, Human
ggaaacuacuuacuucuggaaau

SEQ ID NO: 413078 - RNA, 25 nt, Human
gggaaacuacuuacuucuggaaauc

SEQ ID NO: 413079 - RNA, 24 nt, Human
uaaaacauuccaauuucucccuuc

SEQ ID NO: 413080 - RNA, 21 nt, Human
uaaacaaacaacaaacuuccu

SEQ ID NO: 413081 - RNA, 18 nt, Human
uaaacuuaaaacaacaac

SEQ ID NO: 413082 - RNA, 20 nt, Human
uaaaggauuuguucauauau

SEQ ID NO: 413083 - RNA, 23 nt, Human
uaagaugacuacaguugcacgaa

SEQ ID NO: 413084 - RNA, 24 nt, Human
uaauaaacaaacaacaaacuuccu

SEQ ID NO: 413085 - RNA, 18 nt, Human
uacacauuaagaagcaca

SEQ ID NO: 413086 - RNA, 19 nt, Human
uacacauuaagaagcacag

SEQ ID NO: 413087 - RNA, 18 nt, Human
uacaggccgcgagcuauu

SEQ ID NO: 413088 - RNA, 18 nt, Human
uacaguaaucaguuaaaa

SEQ ID NO: 413089 - RNA, 21 nt, Human
uacaguaaucaguuaaaacaa

SEQ ID NO: 413090 - RNA, 25 nt, Human
uacugaaacaguucauugcaagaca

SEQ ID NO: 413091 - RNA, 20 nt, Human
uagcauuaugguacauaaca

SEQ ID NO: 413092 - RNA, 19 nt, Human
uagccaucuuuuucauuau

SEQ ID NO: 413093 - RNA, 20 nt, Human
uaggaaaggggaaacuacuu

SEQ ID NO: 413094 - RNA, 19 nt, Human
uagucgcccucgcccgccg

SEQ ID NO: 413095 - RNA, 24 nt, Human
ucaaccucaagcaguaauaaacac

SEQ ID NO: 413096 - RNA, 22 nt, Human
ucaagcaguaauaaacacaagc

SEQ ID NO: 413097 - RNA, 22 nt, Human
ucacauacacagaagacuagga

SEQ ID NO: 413098 - RNA, 24 nt, Human
ucaccuuaguuaaaaauacauaau

SEQ ID NO: 413099 - RNA, 19 nt, Human
uccagcccacaugucccca

SEQ ID NO: 413100 - RNA, 20 nt, Human
ucccuuccuuccaucuuucu

SEQ ID NO: 413101 - RNA, 19 nt, Human
uccgcccgccaccgccucg

SEQ ID NO: 413102 - RNA, 24 nt, Human
ucgcccccgcgccugggcugcggc

SEQ ID NO: 413103 - RNA, 19 nt, Human
ucgcugccgccaccgccgg

SEQ ID NO: 413104 - RNA, 25 nt, Human
ucgcugccgccaccgccggggcuca

SEQ ID NO: 413105 - RNA, 19 nt, Human
ucggguccuggcgaaggga

SEQ ID NO: 413106 - RNA, 20 nt, Human
ucggguccuggcgaagggaa

SEQ ID NO: 413107 - RNA, 23 nt, Human
ucucaauuaugaaaaaaauuaau

SEQ ID NO: 413108 - RNA, 19 nt, Human
ucuuaagugcacuuucaca

SEQ ID NO: 413109 - RNA, 26 nt, Human
ucuuucgcugccgccaccgccggggc

SEQ ID NO: 413110 - RNA, 22 nt, Human
ugaaacaguucauugcaagaca

SEQ ID NO: 413111 - RNA, 22 nt, Human
ugaaagaauauguaacacuuuc

SEQ ID NO: 413112 - RNA, 24 nt, Human
ugaaagacauccuuuuucuccccc

SEQ ID NO: 413113 - RNA, 23 nt, Human
ugaaagcugcauuuuuccugcca

SEQ ID NO: 413114 - RNA, 22 nt, Human
ugaagguuacguggucuacaaa

SEQ ID NO: 413115 - RNA, 18 nt, Human
ugaguuguuuuuguuuuu

SEQ ID NO: 413116 - RNA, 21 nt, Human
ugccaauuucaaacaaacaaa

SEQ ID NO: 413117 - RNA, 18 nt, Human
ugccuguccacaccgggg

SEQ ID NO: 413118 - RNA, 23 nt, Human
uggaaagcauugucuucuuuuuc

SEQ ID NO: 413119 - RNA, 22 nt, Human
uggcccagaaaaaccccauguu

SEQ ID NO: 413120 - RNA, 30 nt, Human
uguggcaugaguuguuuuuguuuuuaauuu

SEQ ID NO: 413121 - RNA, 23 nt, Human
uuaaauacucaaaaggcucaacc

SEQ ID NO: 413122 - RNA, 25 nt, Human
uuccaauuucucccuuccuuccauc

SEQ ID NO: 413123 - RNA, 25 nt, Human
uuccuugggagaguaguucuguugg

SEQ ID NO: 413124 - RNA, 23 nt, Human
uucgucgccagccgccgcugccu

SEQ ID NO: 413125 - RNA, 18 nt, Human
uuuaacauguuuugaauu

SEQ ID NO: 413126 - RNA, 25 nt, Human
uuuguucauauauguagcugaaauc

SEQ ID NO: 413127 - RNA, 19 nt, Human
uuuuccauaguacaugaaa

SEQ ID NO: 413128 - RNA, 19 nt, Human
aaaaaaaaaaaaaagaaaa

SEQ ID NO: 413129 - RNA, 19 nt, Human
aaaaaaaaaaagaaaaaga

SEQ ID NO: 413130 - RNA, 24 nt, Human
aaaaaaaaaagaaaaagaaaagaa

SEQ ID NO: 413131 - RNA, 26 nt, Human
aaaaaaagaagaaaagcuugccagaa

SEQ ID NO: 413132 - RNA, 21 nt, Human
aaaaacaaaacccagacugcu

SEQ ID NO: 413133 - RNA, 23 nt, Human
aaaaaccuuuaacauuuccuuca

SEQ ID NO: 413134 - RNA, 25 nt, Human
aaaagaaaaagaaaagaagaaagaa

SEQ ID NO: 413135 - RNA, 23 nt, Human
aaaagaagaaaagcuugccagaa

SEQ ID NO: 413136 - RNA, 25 nt, Human
aaaagaagaaagaaaaggaacagaa

SEQ ID NO: 413137 - RNA, 22 nt, Human
aaaaggaagaagaauaugaaga

SEQ ID NO: 413138 - RNA, 23 nt, Human
aaacaaauccugucaacccaugc

SEQ ID NO: 413139 - RNA, 23 nt, Human
aaacauggccacauacugcauac

SEQ ID NO: 413140 - RNA, 19 nt, Human
aaaccaacaaaaaagcaca

SEQ ID NO: 413141 - RNA, 23 nt, Human
aaagaagaaaagcuugccagaaa

SEQ ID NO: 413142 - RNA, 24 nt, Human
aaagaagaaaagcuugccagaaaa

SEQ ID NO: 413143 - RNA, 18 nt, Human
aaagcagcacucaccaag

SEQ ID NO: 413144 - RNA, 22 nt, Human
aaaggaagaagaauaugaagag

SEQ ID NO: 413145 - RNA, 25 nt, Human
aacacagaaaagggguuaagucuag

SEQ ID NO: 413146 - RNA, 22 nt, Human
aaccacaaacaauuguuuaucu

SEQ ID NO: 413147 - RNA, 22 nt, Human
aagaaaaagaaaagaagaaaga

SEQ ID NO: 413148 - RNA, 20 nt, Human
aagaaaagaagaaagaaaag

SEQ ID NO: 413149 - RNA, 20 nt, Human
aagaaagaaaaggaacagaa

SEQ ID NO: 413150 - RNA, 20 nt, Human
aagaagaaagaaaaggaaca

SEQ ID NO: 413151 - RNA, 20 nt, Human
aagaagaaagaaaaggaaca

SEQ ID NO: 413152 - RNA, 19 nt, Human
aagcagugacacccauuuc

SEQ ID NO: 413153 - RNA, 18 nt, Human
aagcuuccaaguguauau

SEQ ID NO: 413154 - RNA, 23 nt, Human
aagguauccuccauccagaccua

SEQ ID NO: 413155 - RNA, 20 nt, Human
aaguuccagacaaaacaccu

SEQ ID NO: 413156 - RNA, 23 nt, Human
aauaugaagagacaacagagggu

SEQ ID NO: 413157 - RNA, 23 nt, Human
aauugaguagugagcucaaguuc

SEQ ID NO: 413158 - RNA, 22 nt, Human
aauuuugugaagaaugaguaug

SEQ ID NO: 413159 - RNA, 21 nt, Human
acacugccaggcaaguuugac

SEQ ID NO: 413160 - RNA, 23 nt, Human
acagaaaagggguuaagucuaga

SEQ ID NO: 413161 - RNA, 19 nt, Human
acuugguuuccuuaccagu

SEQ ID NO: 413162 - RNA, 21 nt, Human
agaaaagaagaaagaaaagga

SEQ ID NO: 413163 - RNA, 20 nt, Human
agaaagaaaaaaggcacaga

SEQ ID NO: 413164 - RNA, 23 nt, Human
agaaagaaaaaaggcacagagga

SEQ ID NO: 413165 - RNA, 23 nt, Human
agaaagaaaaggaacagaaccag

SEQ ID NO: 413166 - RNA, 20 nt, Human
agaaccagaaagagagaaac

SEQ ID NO: 413167 - RNA, 19 nt, Human
agccaauacacaaaacuag

SEQ ID NO: 413168 - RNA, 24 nt, Human
agcugcugggaauagcugccuucu

SEQ ID NO: 413169 - RNA, 22 nt, Human
aggaaaagaguuuaaaaaaaga

SEQ ID NO: 413170 - RNA, 19 nt, Human
aggaagaagaauaugaaga

SEQ ID NO: 413171 - RNA, 18 nt, Human
aggcagaagcuuauuuua

SEQ ID NO: 413172 - RNA, 25 nt, Human
aggcagagccugaagugccagcagc

SEQ ID NO: 413173 - RNA, 20 nt, Human
agguauccuccauccagacc

SEQ ID NO: 413174 - RNA, 27 nt, Human
agguauccuccauccagaccuaguggg

SEQ ID NO: 413175 - RNA, 18 nt, Human
aguucauucucagagagg

SEQ ID NO: 413176 - RNA, 20 nt, Human
auaggcagaagcuuauuuua

SEQ ID NO: 413177 - RNA, 18 nt, Human
auuuugcuaucauacucc

SEQ ID NO: 413178 - RNA, 19 nt, Human
caaagccaauacacaaaac

SEQ ID NO: 413179 - RNA, 27 nt, Human
caaauccugucaacccaugccauaaag

SEQ ID NO: 413180 - RNA, 22 nt, Human
caaaugaagcagugacacccau

SEQ ID NO: 413181 - RNA, 23 nt, Human
caccauuaaaaaaccuuuaacau

SEQ ID NO: 413182 - RNA, 23 nt, Human
cacccauuucuugauccuaucac

SEQ ID NO: 413183 - RNA, 21 nt, Human
cacucugggguugguuuuggu

SEQ ID NO: 413184 - RNA, 24 nt, Human
cagaagaauacagacaaagacugg

SEQ ID NO: 413185 - RNA, 22 nt, Human
cagcugaugcaaucaaaaaccc

SEQ ID NO: 413186 - RNA, 20 nt, Human
ccaacagucuccucaccccc

SEQ ID NO: 413187 - RNA, 23 nt, Human
ccaccaucaaauaaaguaaugaa

SEQ ID NO: 413188 - RNA, 21 nt, Human
ccauaggggaaugucccuagu

SEQ ID NO: 413189 - RNA, 23 nt, Human
cccaugccauaaaggcccaggga

SEQ ID NO: 413190 - RNA, 20 nt, Human
ccucacaugacaucaacagu

SEQ ID NO: 413191 - RNA, 24 nt, Human
cuaaaccaacaaaaaagcacaugg

SEQ ID NO: 413192 - RNA, 24 nt, Human
cucaaacaaauauuaacuauauac

SEQ ID NO: 413193 - RNA, 22 nt, Human
cucugggguugguuuugguuug

SEQ ID NO: 413194 - RNA, 21 nt, Human
cugcugggaauagcugccuuc

SEQ ID NO: 413195 - RNA, 22 nt, Human
cuuuuccccucguuuuuaaaau

SEQ ID NO: 413196 - RNA, 21 nt, Human
gaaaauaaacaaauccuguca

SEQ ID NO: 413197 - RNA, 24 nt, Human
gaaagaaaaggaacagaaccagaa

SEQ ID NO: 413198 - RNA, 18 nt, Human
gaagaagaauaugaagag

SEQ ID NO: 413199 - RNA, 19 nt, Human
gaaguagcucuuagaaguc

SEQ ID NO: 413200 - RNA, 18 nt, Human
gacuggaggcagcauggg

SEQ ID NO: 413201 - RNA, 22 nt, Human
gggaaaggaggaugauaaauau

SEQ ID NO: 413202 - RNA, 22 nt, Human
gguacucaguuuacacuaaacc

SEQ ID NO: 413203 - RNA, 20 nt, Human
gugaugauuucuaaacuugg

SEQ ID NO: 413204 - RNA, 22 nt, Human
uaaaaaaagaagaaaagcuugc

SEQ ID NO: 413205 - RNA, 28 nt, Human
uaaaaaaagaagaaaagcuugccagaaa

SEQ ID NO: 413206 - RNA, 21 nt, Human
uaaaaaaccuuuaacauuucc

SEQ ID NO: 413207 - RNA, 23 nt, Human
uaaaagcagcacucaccaaaaau

SEQ ID NO: 413208 - RNA, 20 nt, Human
uaaaccaacaaaaaagcaca

SEQ ID NO: 413209 - RNA, 23 nt, Human
uaaauacagaagaauacagacaa

SEQ ID NO: 413210 - RNA, 19 nt, Human
uaaaugcaaauaggcagaa

SEQ ID NO: 413211 - RNA, 19 nt, Human
uaagcacagcaauaggcaa

SEQ ID NO: 413212 - RNA, 18 nt, Human
uaaguauaauuuccugca

SEQ ID NO: 413213 - RNA, 23 nt, Human
uaagucuagaucaugaggacuag

SEQ ID NO: 413214 - RNA, 24 nt, Human
uacacuaaaccaacaaaaaagcac

SEQ ID NO: 413215 - RNA, 19 nt, Human
uacauaguucauucucaga

SEQ ID NO: 413216 - RNA, 24 nt, Human
uagaaagacagugauauaaagaua

SEQ ID NO: 413217 - RNA, 19 nt, Human
uagcaaccaccaucaaaua

SEQ ID NO: 413218 - RNA, 21 nt, Human
uaguucauucucagagaggga

SEQ ID NO: 413219 - RNA, 24 nt, Human
uauaauaaguauaauuuccugcaa

SEQ ID NO: 413220 - RNA, 21 nt, Human
uauaucucacacacugagaua

SEQ ID NO: 413221 - RNA, 23 nt, Human
uauauuaaaaaacaaaacccaga

SEQ ID NO: 413222 - RNA, 21 nt, Human
uaugugaaguuacucuguaac

SEQ ID NO: 413223 - RNA, 23 nt, Human
uauguguauuuauauaucucaca

SEQ ID NO: 413224 - RNA, 23 nt, Human
ucauuuaggaaaaggaagaagaa

SEQ ID NO: 413225 - RNA, 21 nt, Human
uccagaccuagugggagaggc

SEQ ID NO: 413226 - RNA, 22 nt, Human
uccagcaaagccaauacacaaa

SEQ ID NO: 413227 - RNA, 33 nt, Human
ucuaauuuaguaaaaaaaaaaaaaaaaagaaaa

SEQ ID NO: 413228 - RNA, 18 nt, Human
ucuccugaaaaacucugg

SEQ ID NO: 413229 - RNA, 18 nt, Human
ugaaaaacucuggucuuu

SEQ ID NO: 413230 - RNA, 23 nt, Human
ugaacaguaauuggaagagaaau

SEQ ID NO: 413231 - RNA, 21 nt, Human
ugaugcaaucaaaaacccauc

SEQ ID NO: 413232 - RNA, 18 nt, Human
ugcagcaucagccucugg

SEQ ID NO: 413233 - RNA, 20 nt, Human
ugccagaaaaggcuuacaau

SEQ ID NO: 413234 - RNA, 19 nt, Human
ugccauaaaggcccaggga

SEQ ID NO: 413235 - RNA, 22 nt, Human
ugccuucugaguuuuugugccc

SEQ ID NO: 413236 - RNA, 22 nt, Human
uggcauuugcaaaaguguccuc

SEQ ID NO: 413237 - RNA, 18 nt, Human
ugggaauagcugccuucu

SEQ ID NO: 413238 - RNA, 22 nt, Human
ugggagaggcagagccugaagu

SEQ ID NO: 413239 - RNA, 19 nt, Human
uguaaaggcacccaguaga

SEQ ID NO: 413240 - RNA, 19 nt, Human
uuacaagcucaaacaaaua

SEQ ID NO: 413241 - RNA, 23 nt, Human
uuagaaaauaaacaaauccuguc

SEQ ID NO: 413242 - RNA, 23 nt, Human
uuaugagcaauaccagagcugag

SEQ ID NO: 413243 - RNA, 22 nt, Human
uucaaaauacagucgcguugau

SEQ ID NO: 413244 - RNA, 24 nt, Human
uucacagaaagaaaaaaggcacag

SEQ ID NO: 413245 - RNA, 19 nt, Human
uuccuggaauguuucaaaa

SEQ ID NO: 413246 - RNA, 18 nt, Human
uucuccugaaaaacucug

SEQ ID NO: 413247 - RNA, 21 nt, Human
uucuugauccuaucacuuuuc

SEQ ID NO: 413248 - RNA, 22 nt, Human
uugaucaaguuuuauuucaauc

SEQ ID NO: 413249 - RNA, 20 nt, Human
uuuaaagauauucagcagca

SEQ ID NO: 413250 - RNA, 19 nt, Human
uuuaggaaaaggaagaaga

SEQ ID NO: 413251 - RNA, 22 nt, Human
uuuuccccucguuuuuaaaaug

SEQ ID NO: 413252 - RNA, 23 nt, Human
aaaaaaggauugagggaaaagaa

SEQ ID NO: 413253 - RNA, 22 nt, Human
aaaaaggauugagggaaaagaa

SEQ ID NO: 413254 - RNA, 23 nt, Human
aaaacccauaucccaggccaaaa

SEQ ID NO: 413255 - RNA, 22 nt, Human
aaaaguacaaauaaaaucaaaa

SEQ ID NO: 413256 - RNA, 20 nt, Human
aaacccauaucccaggccaa

SEQ ID NO: 413257 - RNA, 20 nt, Human
aaagagcaguguucuguugu

SEQ ID NO: 413258 - RNA, 23 nt, Human
aaauccuucucccuuccccacag

SEQ ID NO: 413259 - RNA, 23 nt, Human
aacaaacaauaaugaauaaugag

SEQ ID NO: 413260 - RNA, 21 nt, Human
aauaaaaaaggauugagggaa

SEQ ID NO: 413261 - RNA, 24 nt, Human
aaucaaaaagagcaguguucuguu

SEQ ID NO: 413262 - RNA, 20 nt, Human
aaugaagcugguacagacaa

SEQ ID NO: 413263 - RNA, 21 nt, Human
acaauaaugaauaaugagcac

SEQ ID NO: 413264 - RNA, 22 nt, Human
acagacaauguccauuuaaaac

SEQ ID NO: 413265 - RNA, 23 nt, Human
aggagaggguaauaugaagggga

SEQ ID NO: 413266 - RNA, 24 nt, Human
aggagaggguaauaugaaggggac

SEQ ID NO: 413267 - RNA, 19 nt, Human
aucacaugcuagaacauca

SEQ ID NO: 413268 - RNA, 23 nt, Human
aucuuaaaaugccuuuucuucag

SEQ ID NO: 413269 - RNA, 23 nt, Human
augaaaacaaacaauaaugaaua

SEQ ID NO: 413270 - RNA, 18 nt, Human
augcuagaacaucagggc

SEQ ID NO: 413271 - RNA, 18 nt, Human
caaaaagagcaguguucu

SEQ ID NO: 413272 - RNA, 19 nt, Human
caaaaagagcaguguucug

SEQ ID NO: 413273 - RNA, 24 nt, Human
caaacaauaaugaauaaugagcac

SEQ ID NO: 413274 - RNA, 23 nt, Human
caaacaauaaugaauaaugagcc

SEQ ID NO: 413275 - RNA, 19 nt, Human
caccacauuacaaaagaac

SEQ ID NO: 413276 - RNA, 23 nt, Human
cagacaauguccauuuaaaaccc

SEQ ID NO: 413277 - RNA, 22 nt, Human
cagcacaaugaaaacaaacuuc

SEQ ID NO: 413278 - RNA, 20 nt, Human
caguguucuguuguauucau

SEQ ID NO: 413279 - RNA, 26 nt, Human
cccauaucccaggccaaaaaguacaa

SEQ ID NO: 413280 - RNA, 26 nt, Human
cgggguuuacaaauccuucucccuuc

SEQ ID NO: 413281 - RNA, 21 nt, Human
cucggguaagcagaaccucgc

SEQ ID NO: 413282 - RNA, 25 nt, Human
cugaaaaacuuccaucucccacuga

SEQ ID NO: 413283 - RNA, 27 nt, Human
cugaaaaacuuccaucucccacugaaa

SEQ ID NO: 413284 - RNA, 19 nt, Human
gaaaaacuuccaucuccca

SEQ ID NO: 413285 - RNA, 22 nt, Human
gaaaagaaaaaaaaauaaaaag

SEQ ID NO: 413286 - RNA, 24 nt, Human
gaaaagaaaaaaaaauaaaaagaa

SEQ ID NO: 413287 - RNA, 22 nt, Human
gacaagauuuuuaaaaaaucuu

SEQ ID NO: 413288 - RNA, 21 nt, Human
gaucaccaaaaaucagcacaa

SEQ ID NO: 413289 - RNA, 25 nt, Human
ggaaaagaaaaaaaaauaaaaagaa

SEQ ID NO: 413290 - RNA, 20 nt, Human
ggccaaaaaguacaaauaaa

SEQ ID NO: 413291 - RNA, 21 nt, Human
ggguaagcagaaccucgcucc

SEQ ID NO: 413292 - RNA, 22 nt, Human
uaaugagcacuagaauucaaau

SEQ ID NO: 413293 - RNA, 19 nt, Human
uacaaauaaaaucaaaaag

SEQ ID NO: 413294 - RNA, 18 nt, Human
uauagcuuuauuaauugc

SEQ ID NO: 413295 - RNA, 25 nt, Human
ucaauuccguuuugaacaccacauu

SEQ ID NO: 413296 - RNA, 18 nt, Human
ucaccaaaaaucagcaca

SEQ ID NO: 413297 - RNA, 21 nt, Human
ucaccaaaaaucagcacaaug

SEQ ID NO: 413298 - RNA, 21 nt, Human
ucaccacaagccugaaaaugc

SEQ ID NO: 413299 - RNA, 25 nt, Human
uccccacagcacaacaccgcggcug

SEQ ID NO: 413300 - RNA, 20 nt, Human
ucuccgcacagcagcggccu

SEQ ID NO: 413301 - RNA, 19 nt, Human
ucucugugcacacguaauu

SEQ ID NO: 413302 - RNA, 24 nt, Human
ugcuaaugaaaauuagaacuuuuc

SEQ ID NO: 413303 - RNA, 26 nt, Human
ugguacagacaauguccauuuaaaac

SEQ ID NO: 413304 - RNA, 22 nt, Human
uguauucauuucugcauguaua

SEQ ID NO: 413305 - RNA, 23 nt, Human
uuaaggaaaggucauuuuuccac

SEQ ID NO: 413306 - RNA, 19 nt, Human
uucaaagagauggggugcc

SEQ ID NO: 413307 - RNA, 19 nt, Human
uuccccacagcacaacacc

SEQ ID NO: 413308 - RNA, 20 nt, Human
uuccccacagcacaacaccg

SEQ ID NO: 413309 - RNA, 22 nt, Human
uugaucaccaaaaaucagcacu

SEQ ID NO: 413310 - RNA, 20 nt, Human
uuuaaaaaggagaggguaau

SEQ ID NO: 413311 - RNA, 18 nt, Human
uuuuuuuuuuuuuuuuug

SEQ ID NO: 413312 - RNA, 25 nt, Human
uuuuuuuuuuuuuuuuuugauuuuu

SEQ ID NO: 413313 - RNA, 18 nt, Human
aaaaaaacaaacaaagaa

SEQ ID NO: 413314 - RNA, 28 nt, Human
aaaaaaacaaacaaagaaaaaagagcag

SEQ ID NO: 413315 - RNA, 22 nt, Human
aaaaaagagcagaagucuucac

SEQ ID NO: 413316 - RNA, 25 nt, Human
aaaaaccaauagagaauuauuuuua

SEQ ID NO: 413317 - RNA, 21 nt, Human
aaaaagagcagaagucuucac

SEQ ID NO: 413318 - RNA, 23 nt, Human
aaaacaaacaaagaaaaaagagc

SEQ ID NO: 413319 - RNA, 20 nt, Human
aaaaugguuucugcuacgaa

SEQ ID NO: 413320 - RNA, 23 nt, Human
aaacaaacaaagaaaaaagagca

SEQ ID NO: 413321 - RNA, 20 nt, Human
aaacaacgcugaccauuuga

SEQ ID NO: 413322 - RNA, 20 nt, Human
aaauauauaaucugagaaca

SEQ ID NO: 413323 - RNA, 18 nt, Human
aacaaaauuaguacuaug

SEQ ID NO: 413324 - RNA, 27 nt, Human
aacacuugauuuauuaguucugaugau

SEQ ID NO: 413325 - RNA, 21 nt, Human
aaguagccuuggauaugagga

SEQ ID NO: 413326 - RNA, 24 nt, Human
aauacaagaaauaaaaaaucagag

SEQ ID NO: 413327 - RNA, 25 nt, Human
acacagaaaaauauauugaaaaacc

SEQ ID NO: 413328 - RNA, 23 nt, Human
acccagauguuuacgaaaaaaac

SEQ ID NO: 413329 - RNA, 19 nt, Human
acgaaaaaaacaaacaaag

SEQ ID NO: 413330 - RNA, 21 nt, Human
acgaaaaaaacaaacaaagaa

SEQ ID NO: 413331 - RNA, 23 nt, Human
acgaaaaaaacaaacaaagaaaa

SEQ ID NO: 413332 - RNA, 19 nt, Human
acugcauucaaaaaccaau

SEQ ID NO: 413333 - RNA, 20 nt, Human
agacaugcugagguuuuaau

SEQ ID NO: 413334 - RNA, 22 nt, Human
agggagacaugcugagguuuua

SEQ ID NO: 413335 - RNA, 20 nt, Human
agguauuaaaaauaauuacc

SEQ ID NO: 413336 - RNA, 21 nt, Human
agugaaaaaauauaaaaaucu

SEQ ID NO: 413337 - RNA, 22 nt, Human
agugaaaaauguucuugguucu

SEQ ID NO: 413338 - RNA, 20 nt, Human
aguuuacaggaagaaucugu

SEQ ID NO: 413339 - RNA, 21 nt, Human
aucacaucacacuaggcagac

SEQ ID NO: 413340 - RNA, 20 nt, Human
augagugacugaaacuaccc

SEQ ID NO: 413341 - RNA, 21 nt, Human
caaacucuaaauugagggaaa

SEQ ID NO: 413342 - RNA, 20 nt, Human
cagagggaucuucaaaagua

SEQ ID NO: 413343 - RNA, 19 nt, Human
cagcagcaugaaagacaaa

SEQ ID NO: 413344 - RNA, 22 nt, Human
caugaaagacaaagacuauauc

SEQ ID NO: 413345 - RNA, 18 nt, Human
caugacacuggauguggu

SEQ ID NO: 413346 - RNA, 19 nt, Human
caugagaaaagaugacagu

SEQ ID NO: 413347 - RNA, 22 nt, Human
cccacauuaaggcuaggagacc

SEQ ID NO: 413348 - RNA, 21 nt, Human
cccagcagcaugaaagacaaa

SEQ ID NO: 413349 - RNA, 19 nt, Human
ccccaaaacaacaacagaa

SEQ ID NO: 413350 - RNA, 19 nt, Human
cuguccacaaauuaaccag

SEQ ID NO: 413351 - RNA, 21 nt, Human
gaaaaaaacaaacaaagaaaa

SEQ ID NO: 413352 - RNA, 21 nt, Human
gaaagcaaauaguucagauca

SEQ ID NO: 413353 - RNA, 26 nt, Human
gaccauuugaaaccauuuacauuuaa

SEQ ID NO: 413354 - RNA, 22 nt, Human
gagugcuuuaaacaggcacauu

SEQ ID NO: 413355 - RNA, 19 nt, Human
gauagucuuuaacuuaaaa

SEQ ID NO: 413356 - RNA, 19 nt, Human
gaugagugacugaaacuac

SEQ ID NO: 413357 - RNA, 20 nt, Human
gccaaucuauauuuuaaguc

SEQ ID NO: 413358 - RNA, 21 nt, Human
gcucaacaaaaaauacaagaa

SEQ ID NO: 413359 - RNA, 18 nt, Human
ggacauaggcucaucauu

SEQ ID NO: 413360 - RNA, 22 nt, Human
ggagacgcacucucaccccuuc

SEQ ID NO: 413361 - RNA, 22 nt, Human
gggaaauauauaaucugagaac

SEQ ID NO: 413362 - RNA, 23 nt, Human
guagcucaugcuuuagugcugug

SEQ ID NO: 413363 - RNA, 20 nt, Human
gugacugaaacuacccuccc

SEQ ID NO: 413364 - RNA, 19 nt, Human
guuuacaggcagacuguuc

SEQ ID NO: 413365 - RNA, 20 nt, Human
uaaaaaaagaguaaucagaa

SEQ ID NO: 413366 - RNA, 20 nt, Human
uaaaaaaucagagugaaaaa

SEQ ID NO: 413367 - RNA, 25 nt, Human
uaaaauacaacuuaucuugaagaga

SEQ ID NO: 413368 - RNA, 24 nt, Human
uaaaauuaccaccaaaaugcacua

SEQ ID NO: 413369 - RNA, 20 nt, Human
uaacuuguuaacuuuucccc

SEQ ID NO: 413370 - RNA, 25 nt, Human
uacaaaauagagccauaaauuguuu

SEQ ID NO: 413371 - RNA, 20 nt, Human
uacaagaaauaaaaaaucag

SEQ ID NO: 413372 - RNA, 25 nt, Human
uacauugggaauacuccccaaaaca

SEQ ID NO: 413373 - RNA, 23 nt, Human
uacgaaaaaaacaaacaaagaaa

SEQ ID NO: 413374 - RNA, 23 nt, Human
uagucaacacuaacagaauucac

SEQ ID NO: 413375 - RNA, 20 nt, Human
uaucacaucacacuaggcag

SEQ ID NO: 413376 - RNA, 21 nt, Human
uaugaggaaacuucauuuaac

SEQ ID NO: 413377 - RNA, 20 nt, Human
uaugauauuagguauuaagc

SEQ ID NO: 413378 - RNA, 24 nt, Human
uauguacauuacuggaucuaugca

SEQ ID NO: 413379 - RNA, 19 nt, Human
ucagcuagucaacaaagca

SEQ ID NO: 413380 - RNA, 23 nt, Human
uccaugguaaaauacaacuuauc

SEQ ID NO: 413381 - RNA, 22 nt, Human
ucccagugaaaaaauauaaaaa

SEQ ID NO: 413382 - RNA, 18 nt, Human
ucuauccauuguugugac

SEQ ID NO: 413383 - RNA, 22 nt, Human
ucugaacucuaaggaguaagca

SEQ ID NO: 413384 - RNA, 20 nt, Human
ucugcacaauaaugaaagcc

SEQ ID NO: 413385 - RNA, 28 nt, Human
ugagaacacacagaaaaauuggagaccc

SEQ ID NO: 413386 - RNA, 18 nt, Human
ugagacaccagcguuagg

SEQ ID NO: 413387 - RNA, 21 nt, Human
ugaggaaaauaaugccaaucu

SEQ ID NO: 413388 - RNA, 23 nt, Human
ugccauaaaaaucagcuuuugac

SEQ ID NO: 413389 - RNA, 19 nt, Human
ugcccaauuaagcaacuac

SEQ ID NO: 413390 - RNA, 24 nt, Human
ugcuacgaaagauaacuuguuaac

SEQ ID NO: 413391 - RNA, 22 nt, Human
ugguaaaauacaacuuaucuug

SEQ ID NO: 413392 - RNA, 23 nt, Human
ugucccagcagcaugaaagacaa

SEQ ID NO: 413393 - RNA, 24 nt, Human
ugucccagcagcaugaaagacaaa

SEQ ID NO: 413394 - RNA, 23 nt, Human
uguuauaaauucugcugaugagg

SEQ ID NO: 413395 - RNA, 18 nt, Human
uuaagaaaugaaaguaga

SEQ ID NO: 413396 - RNA, 24 nt, Human
uuaguuucuuuuccauuuuuuccu

SEQ ID NO: 413397 - RNA, 23 nt, Human
uucacccaacauuuuaguuucuu

SEQ ID NO: 413398 - RNA, 22 nt, Human
uucaucaaagcauuaacaauga

SEQ ID NO: 413399 - RNA, 25 nt, Human
uuuacgaaaaaaacaaacaaagaaa

SEQ ID NO: 413400 - RNA, 18 nt, Human
uuuagguaaaagagauga

SEQ ID NO: 413401 - RNA, 23 nt, Human
uuuguuuuacaaaauagagccau

SEQ ID NO: 413402 - RNA, 23 nt, Human
uuuuaauuuuaagaauucaucug

SEQ ID NO: 413403 - RNA, 20 nt, Human
uuuuccucucaaguuggccc

SEQ ID NO: 413404 - RNA, 18 nt, Human
uuuuuagugcaaauugua

SEQ ID NO: 413405 - RNA, 23 nt, Human
uuuuuccaugguaaaauacaacu

SEQ ID NO: 413406 - RNA, 20 nt, Human
cagugugggggaugaggaug

SEQ ID NO: 413407 - RNA, 18 nt, Human
gggaugaggaugggagag

SEQ ID NO: 413408 - RNA, 21 nt, Human
ggggcaggaagaugaggauuc

SEQ ID NO: 413409 - RNA, 24 nt, Human
uacaaacaagcaucuaucccagug

SEQ ID NO: 413410 - RNA, 24 nt, Human
ucgaaccugccgacgccaccagcu

SEQ ID NO: 413411 - RNA, 19 nt, Human
ugugggggaugaggauggg

SEQ ID NO: 413412 - RNA, 26 nt, Human
aaaaauacagaaaaacccacacaucu

SEQ ID NO: 413413 - RNA, 22 nt, Human
aaagaaaaauacagaaaaaccc

SEQ ID NO: 413414 - RNA, 20 nt, Human
aaauaaacuggacagaugca

SEQ ID NO: 413415 - RNA, 23 nt, Human
aacaaaccugacuaaccggcacu

SEQ ID NO: 413416 - RNA, 18 nt, Human
aaucuggucacccaacua

SEQ ID NO: 413417 - RNA, 24 nt, Human
aaugaaauaaagcagguauuuuaa

SEQ ID NO: 413418 - RNA, 24 nt, Human
aaugcagucccaaaugugcauacu

SEQ ID NO: 413419 - RNA, 26 nt, Human
acccacacaucuuacuguacuccacc

SEQ ID NO: 413420 - RNA, 23 nt, Human
accuuaaaaugcaucauauuggg

SEQ ID NO: 413421 - RNA, 23 nt, Human
agaaaaacccacacaucuuacug

SEQ ID NO: 413422 - RNA, 21 nt, Human
agaaaaauacagaaaaaccca

SEQ ID NO: 413423 - RNA, 21 nt, Human
agaaaagaaaaauacagaaaa

SEQ ID NO: 413424 - RNA, 26 nt, Human
agagccggcaggccuggacagcgaag

SEQ ID NO: 413425 - RNA, 22 nt, Human
aggagccagcagacaccagagc

SEQ ID NO: 413426 - RNA, 20 nt, Human
aggcgagcaaggaggagccg

SEQ ID NO: 413427 - RNA, 21 nt, Human
auacuacaguguuccuucagu

SEQ ID NO: 413428 - RNA, 23 nt, Human
augcaguagccuuaauucccacu

SEQ ID NO: 413429 - RNA, 26 nt, Human
caaaaugaaauaaagcagguaguggg

SEQ ID NO: 413430 - RNA, 18 nt, Human
caaaugauuugcuucuuu

SEQ ID NO: 413431 - RNA, 18 nt, Human
caagauacagaaaugcug

SEQ ID NO: 413432 - RNA, 19 nt, Human
caccagagccggcaggccu

SEQ ID NO: 413433 - RNA, 19 nt, Human
caccguagcgggugugggg

SEQ ID NO: 413434 - RNA, 20 nt, Human
cagaagugaugcaugcagua

SEQ ID NO: 413435 - RNA, 21 nt, Human
caguaguauaaaucuuacagc

SEQ ID NO: 413436 - RNA, 23 nt, Human
ccgcagcagccaccgcuuccucc

SEQ ID NO: 413437 - RNA, 20 nt, Human
cggcggcggcggcggugacu

SEQ ID NO: 413438 - RNA, 24 nt, Human
cgggucaggcgcucggcagccgcc

SEQ ID NO: 413439 - RNA, 21 nt, Human
cuguggcggcggcggcggcuu

SEQ ID NO: 413440 - RNA, 20 nt, Human
gaaaaauacagaaaaaccca

SEQ ID NO: 413441 - RNA, 23 nt, Human
gagccagcagacaccagagccgg

SEQ ID NO: 413442 - RNA, 27 nt, Human
gagccggcaggccuggacagcgaagaa

SEQ ID NO: 413443 - RNA, 22 nt, Human
gaggagccagcagacaccagag

SEQ ID NO: 413444 - RNA, 18 nt, Human
gcaaaaaugcaugccaaa

SEQ ID NO: 413445 - RNA, 19 nt, Human
gcaaggaggagccagcaga

SEQ ID NO: 413446 - RNA, 23 nt, Human
gcggcggcggcggugacucaggc

SEQ ID NO: 413447 - RNA, 24 nt, Human
gcggcggcggcggugacucaggca

SEQ ID NO: 413448 - RNA, 21 nt, Human
ggagaagcugagaaguccuag

SEQ ID NO: 413449 - RNA, 26 nt, Human
ggagauguuugucaaagaugcuguaa

SEQ ID NO: 413450 - RNA, 21 nt, Human
ggcuaauguuuaaaaagcaaa

SEQ ID NO: 413451 - RNA, 23 nt, Human
ggcuguggcggcggcggcggcgg

SEQ ID NO: 413452 - RNA, 19 nt, Human
guggcggcggcggcggcgg

SEQ ID NO: 413453 - RNA, 22 nt, Human
guggcggcggcggcggcgguga

SEQ ID NO: 413454 - RNA, 19 nt, Human
guuuccagaaaugcagucc

SEQ ID NO: 413455 - RNA, 21 nt, Human
uaaaaagcaaauaaacuggac

SEQ ID NO: 413456 - RNA, 22 nt, Human
uaaaaagcaaauaaacuggaca

SEQ ID NO: 413457 - RNA, 19 nt, Human
uaaaaugcaucauauuggg

SEQ ID NO: 413458 - RNA, 19 nt, Human
uaaaaugcaucauauuggg

SEQ ID NO: 413459 - RNA, 24 nt, Human
uaaacuaccuaugggagaagcuga

SEQ ID NO: 413460 - RNA, 22 nt, Human
uaaacuggacagaugcaggaca

SEQ ID NO: 413461 - RNA, 21 nt, Human
uaacagcacagaauuccaaga

SEQ ID NO: 413462 - RNA, 22 nt, Human
uacuguacuccaccuuaaaaug

SEQ ID NO: 413463 - RNA, 23 nt, Human
uauacaaauaaaacaaaauuauc

SEQ ID NO: 413464 - RNA, 24 nt, Human
uaucaguaguauaaaucuuacagc

SEQ ID NO: 413465 - RNA, 18 nt, Human
ucaaagaugcuguaagau

SEQ ID NO: 413466 - RNA, 18 nt, Human
ucaguagcaacgggcgca

SEQ ID NO: 413467 - RNA, 24 nt, Human
uccagaaaagaaaaauacagaaaa

SEQ ID NO: 413468 - RNA, 25 nt, Human
uccagaaaagaaaaauacagaaaaa

SEQ ID NO: 413469 - RNA, 19 nt, Human
uccgcagcagccaccgcuu

SEQ ID NO: 413470 - RNA, 24 nt, Human
uccgcagcagccaccgcuuccucc

SEQ ID NO: 413471 - RNA, 18 nt, Human
ugcaugccaaagucacaa

SEQ ID NO: 413472 - RNA, 18 nt, Human
ugccaaagucacaauaag

SEQ ID NO: 413473 - RNA, 22 nt, Human
ugcucagagagccuauugcagu

SEQ ID NO: 413474 - RNA, 24 nt, Human
uggacagcgaagaaugcagagcac

SEQ ID NO: 413475 - RNA, 23 nt, Human
uggcggcggcggcggcggugacu

SEQ ID NO: 413476 - RNA, 18 nt, Human
ugggagaagcugagaagu

SEQ ID NO: 413477 - RNA, 20 nt, Human
ugggagaagcugagaagucc

SEQ ID NO: 413478 - RNA, 22 nt, Human
ugggagaagcugagaaguccua

SEQ ID NO: 413479 - RNA, 24 nt, Human
ugggagaagcugagaaguccuagg

SEQ ID NO: 413480 - RNA, 20 nt, Human
ugggagauguuugucaaaga

SEQ ID NO: 413481 - RNA, 18 nt, Human
uggggccccggagcucgg

SEQ ID NO: 413482 - RNA, 18 nt, Human
uguggcggcggcggcggc

SEQ ID NO: 413483 - RNA, 21 nt, Human
uguggggccccggagcucggu

SEQ ID NO: 413484 - RNA, 18 nt, Human
uguuccagaaaagaaaaa

SEQ ID NO: 413485 - RNA, 18 nt, Human
uuaaaaagcaaauaaacu

SEQ ID NO: 413486 - RNA, 22 nt, Human
uuaaugccuguuaaacuaccua

SEQ ID NO: 413487 - RNA, 22 nt, Human
uuacuguacuccaccuuaaaau

SEQ ID NO: 413488 - RNA, 20 nt, Human
uugcuucuuuuuaaugcuuu

SEQ ID NO: 413489 - RNA, 23 nt, Human
uuuugcugggagauguuugucaa

SEQ ID NO: 413490 - RNA, 18 nt, Human
uuuuuuuuuuuuuuuuug

SEQ ID NO: 413491 - RNA, 21 nt, Human
aaggaaggaaggaaacaaaga

SEQ ID NO: 413492 - RNA, 19 nt, Human
aaggagaaagggagugagg

SEQ ID NO: 413493 - RNA, 25 nt, Human
acaaaucaaaaugcauauuaggguc

SEQ ID NO: 413494 - RNA, 21 nt, Human
acagauuuaaaagaaucaaaa

SEQ ID NO: 413495 - RNA, 20 nt, Human
acugauccuucaggcugcac

SEQ ID NO: 413496 - RNA, 19 nt, Human
agaggaagggaagguagga

SEQ ID NO: 413497 - RNA, 19 nt, Human
agagggagggaguggggag

SEQ ID NO: 413498 - RNA, 18 nt, Human
agcgcgagggaaggagga

SEQ ID NO: 413499 - RNA, 21 nt, Human
aggaaggaaggaaacaaagag

SEQ ID NO: 413500 - RNA, 21 nt, Human
aggaaggaaggaaacaaagag

SEQ ID NO: 413501 - RNA, 24 nt, Human
aggaaggaaggaggcaccgccgca

SEQ ID NO: 413502 - RNA, 18 nt, Human
aggagaaagggagugagg

SEQ ID NO: 413503 - RNA, 18 nt, Human
aggaggaaggaaggaggc

SEQ ID NO: 413504 - RNA, 24 nt, Human
aggcgggcagggaaggcgcgggcg

SEQ ID NO: 413505 - RNA, 18 nt, Human
agggagggaguggggaga

SEQ ID NO: 413506 - RNA, 19 nt, Human
agugagggaaguaggaggg

SEQ ID NO: 413507 - RNA, 22 nt, Human
auacaaauauagcaaaaaagau

SEQ ID NO: 413508 - RNA, 22 nt, Human
augaagucaaaagacacacuuu

SEQ ID NO: 413509 - RNA, 19 nt, Human
caaaucaaaaugcauauua

SEQ ID NO: 413510 - RNA, 21 nt, Human
caaugguauaaaucuuacagc

SEQ ID NO: 413511 - RNA, 24 nt, Human
cauuucuuguauucuuucucauuu

SEQ ID NO: 413512 - RNA, 18 nt, Human
ccaccacucaaaacggcu

SEQ ID NO: 413513 - RNA, 19 nt, Human
ccuguuuccaaaaaucaca

SEQ ID NO: 413514 - RNA, 22 nt, Human
cgcgagggaaggaggaaggaag

SEQ ID NO: 413515 - RNA, 24 nt, Human
cgggcagggaaggcgcgggcgggc

SEQ ID NO: 413516 - RNA, 21 nt, Human
cuagcaaaaauacaugccaaa

SEQ ID NO: 413517 - RNA, 19 nt, Human
cuucaaauaauuugcuucu

SEQ ID NO: 413518 - RNA, 19 nt, Human
gaaggaaacuaaaggaaau

SEQ ID NO: 413519 - RNA, 19 nt, Human
gaaggaaggaaacaaagag

SEQ ID NO: 413520 - RNA, 21 nt, Human
gaguggggagacaagaggaag

SEQ ID NO: 413521 - RNA, 24 nt, Human
gaucaaugguauaaaucuuacagc

SEQ ID NO: 413522 - RNA, 21 nt, Human
gaugaagucaaaagacacacu

SEQ ID NO: 413523 - RNA, 24 nt, Human
gcacaagagaaauaacugaugaag

SEQ ID NO: 413524 - RNA, 19 nt, Human
gcgcgggcgggcgaaagag

SEQ ID NO: 413525 - RNA, 21 nt, Human
ggaaggaaacaaagagggagg

SEQ ID NO: 413526 - RNA, 18 nt, Human
ggaaggaggaaggaagga

SEQ ID NO: 413527 - RNA, 23 nt, Human
ggagggaguggggagacaagagg

SEQ ID NO: 413528 - RNA, 18 nt, Human
ggccgggucaggcgggga

SEQ ID NO: 413529 - RNA, 21 nt, Human
ggcgcgggcgggcgaaagaga

SEQ ID NO: 413530 - RNA, 20 nt, Human
gggaaguaggagggagggac

SEQ ID NO: 413531 - RNA, 22 nt, Human
gggcagggaaggcgcgggcggg

SEQ ID NO: 413532 - RNA, 18 nt, Human
gggcugggccgggucagg

SEQ ID NO: 413533 - RNA, 19 nt, Human
guaaaaagcacuuuccugg

SEQ ID NO: 413534 - RNA, 25 nt, Human
guaaugcaaacaucacaugacaccg

SEQ ID NO: 413535 - RNA, 22 nt, Human
gucauuuuuaaugcauuuuucu

SEQ ID NO: 413536 - RNA, 20 nt, Human
uaaaaagcacuuuccuggca

SEQ ID NO: 413537 - RNA, 23 nt, Human
uaaaaaugcaaauaaauuggaca

SEQ ID NO: 413538 - RNA, 22 nt, Human
uaaaagaaucaaaaugaaagua

SEQ ID NO: 413539 - RNA, 18 nt, Human
uaaaaugcaucauauuag

SEQ ID NO: 413540 - RNA, 18 nt, Human
uaaauguauacuuagaga

SEQ ID NO: 413541 - RNA, 23 nt, Human
uacauagcaguuaaaaguaaugc

SEQ ID NO: 413542 - RNA, 18 nt, Human
uacaugccaaagucacaa

SEQ ID NO: 413543 - RNA, 20 nt, Human
uaccaggauaaacauuucua

SEQ ID NO: 413544 - RNA, 19 nt, Human
uagcaaaaauacaugccaa

SEQ ID NO: 413545 - RNA, 19 nt, Human
uagcaguuaaaaguaaugc

SEQ ID NO: 413546 - RNA, 22 nt, Human
uauacaaauauagcaaaaaaga

SEQ ID NO: 413547 - RNA, 18 nt, Human
uauuagggucucuuuaug

SEQ ID NO: 413548 - RNA, 21 nt, Human
ugagaaguuuaucaaagaugc

SEQ ID NO: 413549 - RNA, 23 nt, Human
ugagacauaacuagcuccagaaa

SEQ ID NO: 413550 - RNA, 19 nt, Human
ugagggaaguaggagggag

SEQ ID NO: 413551 - RNA, 23 nt, Human
ugcacaagagaaauaacugauga

SEQ ID NO: 413552 - RNA, 20 nt, Human
ugcgguucccugguccuccg

SEQ ID NO: 413553 - RNA, 18 nt, Human
ugggagaagcugagaagg

SEQ ID NO: 413554 - RNA, 19 nt, Human
ugggagaagcugagaagga

SEQ ID NO: 413555 - RNA, 26 nt, Human
ugggagaagcugagaaggaagucuua

SEQ ID NO: 413556 - RNA, 22 nt, Human
uggggagacaagaggaagggaa

SEQ ID NO: 413557 - RNA, 27 nt, Human
uuacuacacugauccuucaggcugcac

SEQ ID NO: 413558 - RNA, 23 nt, Human
uucucauuuugguuacacauauu

SEQ ID NO: 413559 - RNA, 23 nt, Human
uugcuucuguuuuuaauaucuuc

SEQ ID NO: 413560 - RNA, 22 nt, Human
uuuccuggcauuacuacacuga

SEQ ID NO: 413561 - RNA, 24 nt, Human
uuuuuuuuuuuuuuuuucauuuuu

SEQ ID NO: 413562 - RNA, 19 nt, Human
aacaacauugccuccacag

SEQ ID NO: 413563 - RNA, 25 nt, Human
acacagcaccuccacuauguuuugg

SEQ ID NO: 413564 - RNA, 18 nt, Human
acagaggaaaacguaugg

SEQ ID NO: 413565 - RNA, 18 nt, Human
accuccacuauguuuugg

SEQ ID NO: 413566 - RNA, 18 nt, Human
agaucuguggggacacag

SEQ ID NO: 413567 - RNA, 19 nt, Human
augcagggcuccaaaccuc

SEQ ID NO: 413568 - RNA, 19 nt, Human
cacagcagucagcuguggu

SEQ ID NO: 413569 - RNA, 20 nt, Human
cagcuguggucccguccuuc

SEQ ID NO: 413570 - RNA, 22 nt, Human
cagcuguggucccguccuucuc

SEQ ID NO: 413571 - RNA, 19 nt, Human
ccagugguauagugguaca

SEQ ID NO: 413572 - RNA, 24 nt, Human
ccccccagugguauagugguacaa

SEQ ID NO: 413573 - RNA, 18 nt, Human
ccuccacuauguuuuggc

SEQ ID NO: 413574 - RNA, 24 nt, Human
cucacacacagcaccuccacuaug

SEQ ID NO: 413575 - RNA, 23 nt, Human
gagcuuagacuggggccccccag

SEQ ID NO: 413576 - RNA, 18 nt, Human
gcuguauucaaaaauggg

SEQ ID NO: 413577 - RNA, 25 nt, Human
gggaaaaaggcacagaggaaaacgu

SEQ ID NO: 413578 - RNA, 24 nt, Human
guccuucucuuuaugcagggcucc

SEQ ID NO: 413579 - RNA, 20 nt, Human
ucaaaaaugggagagcuagg

SEQ ID NO: 413580 - RNA, 23 nt, Human
ucagcuguggucccguccuucuc

SEQ ID NO: 413581 - RNA, 19 nt, Human
uccacagcaaaggacuuca

SEQ ID NO: 413582 - RNA, 20 nt, Human
uggcagcaggaggcccagau

SEQ ID NO: 413583 - RNA, 21 nt, Human
ugguugacucacacacagcac

SEQ ID NO: 413584 - RNA, 20 nt, Human
uguggucccguccuucucuu

SEQ ID NO: 413585 - RNA, 18 nt, Human
uuggccauuagucuuccu

SEQ ID NO: 413586 - RNA, 19 nt, Human
aaaaaacacuucugccccc

SEQ ID NO: 413587 - RNA, 19 nt, Human
aaaacacuucugcccccuc

SEQ ID NO: 413588 - RNA, 24 nt, Human
aaaacacuucugcccccuccccca

SEQ ID NO: 413589 - RNA, 19 nt, Human
aaacacuucugcccccucc

SEQ ID NO: 413590 - RNA, 18 nt, Human
aagaaagugggggaggcc

SEQ ID NO: 413591 - RNA, 21 nt, Human
aagaaagugggggaggccagg

SEQ ID NO: 413592 - RNA, 22 nt, Human
aagaaagugggggaggccaggg

SEQ ID NO: 413593 - RNA, 19 nt, Human
aaggcaccgacccuccucc

SEQ ID NO: 413594 - RNA, 23 nt, Human
aaggcaccgacccuccuccuccc

SEQ ID NO: 413595 - RNA, 19 nt, Human
aauauauacacauauauaa

SEQ ID NO: 413596 - RNA, 18 nt, Human
acacauauauaaaaaaca

SEQ ID NO: 413597 - RNA, 20 nt, Human
accgacccuccuccucccca

SEQ ID NO: 413598 - RNA, 25 nt, Human
agaaagaaagugggggaggccaggg

SEQ ID NO: 413599 - RNA, 20 nt, Human
aggcagcuccuuccugcagg

SEQ ID NO: 413600 - RNA, 19 nt, Human
aggcugguccggugcuggc

SEQ ID NO: 413601 - RNA, 22 nt, Human
agggacagaacaugggggagaa

SEQ ID NO: 413602 - RNA, 24 nt, Human
auaaaaaacacuucugcccccucc

SEQ ID NO: 413603 - RNA, 24 nt, Human
caaacucuuugggaccccccaccc

SEQ ID NO: 413604 - RNA, 22 nt, Human
caaagguggucaguuggggagg

SEQ ID NO: 413605 - RNA, 19 nt, Human
cagcuccuuccugcagggg

SEQ ID NO: 413606 - RNA, 21 nt, Human
caggccccucugggaaggaau

SEQ ID NO: 413607 - RNA, 25 nt, Human
ccaccguauuuuuuuuuuuuuuuuu

SEQ ID NO: 413608 - RNA, 22 nt, Human
ccagggcagugccuguuuucuu

SEQ ID NO: 413609 - RNA, 19 nt, Human
ccaggggggcaagggacag

SEQ ID NO: 413610 - RNA, 18 nt, Human
cccauguucccugccucc

SEQ ID NO: 413611 - RNA, 22 nt, Human
ccccaagcuuccaccccaccuu

SEQ ID NO: 413612 - RNA, 19 nt, Human
ccccaagggcugaugucuc

SEQ ID NO: 413613 - RNA, 20 nt, Human
ccccaagggcugaugucucu

SEQ ID NO: 413614 - RNA, 23 nt, Human
ccccacccccacucuccggucca

SEQ ID NO: 413615 - RNA, 19 nt, Human
ccccaugaacggguccagg

SEQ ID NO: 413616 - RNA, 20 nt, Human
ccccauguucccugccucca

SEQ ID NO: 413617 - RNA, 18 nt, Human
cccccacucuccggucca

SEQ ID NO: 413618 - RNA, 19 nt, Human
ccccccacccccacucucc

SEQ ID NO: 413619 - RNA, 19 nt, Human
ccccccacccccacucucc

SEQ ID NO: 413620 - RNA, 23 nt, Human
cccccucccccaugaacgggucc

SEQ ID NO: 413621 - RNA, 21 nt, Human
cccuccuccuccccauguucc

SEQ ID NO: 413622 - RNA, 25 nt, Human
ccuccagcuguccagccaccuccuc

SEQ ID NO: 413623 - RNA, 24 nt, Human
ccuccaguuccaaugcaggggucc

SEQ ID NO: 413624 - RNA, 18 nt, Human
ccugggguggggcugagc

SEQ ID NO: 413625 - RNA, 18 nt, Human
cggggucaaagccaccuc

SEQ ID NO: 413626 - RNA, 24 nt, Human
cucagagcuuaaaaaaaaauauau

SEQ ID NO: 413627 - RNA, 21 nt, Human
cuccagcccccuacccccacc

SEQ ID NO: 413628 - RNA, 24 nt, Human
cuccagcccccuacccccaccgua

SEQ ID NO: 413629 - RNA, 21 nt, Human
cucccccaugaacggguccag

SEQ ID NO: 413630 - RNA, 21 nt, Human
cuccgguccauuguccaugcc

SEQ ID NO: 413631 - RNA, 20 nt, Human
cuccuuccugcagggggcag

SEQ ID NO: 413632 - RNA, 22 nt, Human
cuuccccaagcuuccaccccac

SEQ ID NO: 413633 - RNA, 21 nt, Human
gaaugggucuuccccaagcuu

SEQ ID NO: 413634 - RNA, 23 nt, Human
gacccuccuccuccccauguucc

SEQ ID NO: 413635 - RNA, 19 nt, Human
gaggccaggggggcaaggg

SEQ ID NO: 413636 - RNA, 23 nt, Human
gcagaaguggguggggugggcca

SEQ ID NO: 413637 - RNA, 22 nt, Human
gcagaguccuggccugggcucc

SEQ ID NO: 413638 - RNA, 18 nt, Human
gcugcagaguccuggccu

SEQ ID NO: 413639 - RNA, 18 nt, Human
ggaaccgcaagugcagaa

SEQ ID NO: 413640 - RNA, 25 nt, Human
gggcaggggagagggccaccagggc

SEQ ID NO: 413641 - RNA, 22 nt, Human
gggccaggcugguccggugcug

SEQ ID NO: 413642 - RNA, 22 nt, Human
gggcucgccauuagccgucgcu

SEQ ID NO: 413643 - RNA, 18 nt, Human
gggggaggccaggggggc

SEQ ID NO: 413644 - RNA, 24 nt, Human
gguggucaguuggggaggggagcu

SEQ ID NO: 413645 - RNA, 21 nt, Human
gguguggagggccucaucaaa

SEQ ID NO: 413646 - RNA, 22 nt, Human
guccagccaccuccucggucgu

SEQ ID NO: 413647 - RNA, 21 nt, Human
gucccuggaggaggaccccca

SEQ ID NO: 413648 - RNA, 23 nt, Human
gucccuggaggaggacccccaag

SEQ ID NO: 413649 - RNA, 24 nt, Human
gugcuggccgggcaacccgggguc

SEQ ID NO: 413650 - RNA, 22 nt, Human
gugggccaggcugguccggugc

SEQ ID NO: 413651 - RNA, 22 nt, Human
guggguggggugggccaggcug

SEQ ID NO: 413652 - RNA, 25 nt, Human
guggucaguuggggaggggagcucc

SEQ ID NO: 413653 - RNA, 24 nt, Human
guugcugucccuggaggaggaccc

SEQ ID NO: 413654 - RNA, 21 nt, Human
uaaagaaagaaagaaaguggg

SEQ ID NO: 413655 - RNA, 20 nt, Human
uccaaugcagggguccaggu

SEQ ID NO: 413656 - RNA, 26 nt, Human
uccaccccaccuuggauugggccgca

SEQ ID NO: 413657 - RNA, 20 nt, Human
uccccaagcuuccaccccac

SEQ ID NO: 413658 - RNA, 19 nt, Human
uccccauguucccugccuc

SEQ ID NO: 413659 - RNA, 22 nt, Human
ucccccaugaacggguccaggc

SEQ ID NO: 413660 - RNA, 22 nt, Human
ucccuggaggaggacccccaag

SEQ ID NO: 413661 - RNA, 26 nt, Human
ugaaggcaccgacccuccuccucccc

SEQ ID NO: 413662 - RNA, 20 nt, Human
ugaggcugcagaguccuggc

SEQ ID NO: 413663 - RNA, 19 nt, Human
ugccggaaccgcaagugca

SEQ ID NO: 413664 - RNA, 26 nt, Human
ugccuccaguuccaaugcaggggucc

SEQ ID NO: 413665 - RNA, 18 nt, Human
ugggaaggaaugggucuu

SEQ ID NO: 413666 - RNA, 18 nt, Human
ugggcuccuccagccccc

SEQ ID NO: 413667 - RNA, 23 nt, Human
ugggggaggccaggggggcaagg

SEQ ID NO: 413668 - RNA, 24 nt, Human
uggggugggccaggcugguccggu

SEQ ID NO: 413669 - RNA, 18 nt, Human
uggucaguuggggagggg

SEQ ID NO: 413670 - RNA, 24 nt, Human
uucgccaucucgggcuuugucugg

SEQ ID NO: 413671 - RNA, 21 nt, Human
uugaaggcaccgacccuccuc

SEQ ID NO: 413672 - RNA, 21 nt, Human
uuggggaggggagcuccuggg

SEQ ID NO: 413673 - RNA, 18 nt, Human
uuuuuuuaaagaaagaaa

SEQ ID NO: 413674 - RNA, 19 nt, Human
uuuuuuuuuuuuuuuuuaa

SEQ ID NO: 413675 - RNA, 21 nt, Human
aaaacaaaaccaaagaaaaac

SEQ ID NO: 413676 - RNA, 24 nt, Human
aaacagaaugggaaaguucucuga

SEQ ID NO: 413677 - RNA, 24 nt, Human
aaagugcugggauuacaggcguga

SEQ ID NO: 413678 - RNA, 18 nt, Human
aaauaaccuccuacauca

SEQ ID NO: 413679 - RNA, 21 nt, Human
aaaugguucucaaacagccuu

SEQ ID NO: 413680 - RNA, 23 nt, Human
aacagaaugggaaaguucucuga

SEQ ID NO: 413681 - RNA, 22 nt, Human
aacauggguuuguauuuuagaa

SEQ ID NO: 413682 - RNA, 18 nt, Human
aaccuccuacaucaucaa

SEQ ID NO: 413683 - RNA, 19 nt, Human
aagugcugggauuacaggc

SEQ ID NO: 413684 - RNA, 19 nt, Human
aagugcugggauuacaggc

SEQ ID NO: 413685 - RNA, 26 nt, Human
aagugcugggauuacaggcgugagcc

SEQ ID NO: 413686 - RNA, 20 nt, Human
aaguuucacuuuccuugguu

SEQ ID NO: 413687 - RNA, 23 nt, Human
aauuagccaccucgauauauuua

SEQ ID NO: 413688 - RNA, 22 nt, Human
acaaaaccaaagaaaaacacaa

SEQ ID NO: 413689 - RNA, 20 nt, Human
acaaacgccuaguaaacauc

SEQ ID NO: 413690 - RNA, 22 nt, Human
acaaccuccaccuuccggguuc

SEQ ID NO: 413691 - RNA, 24 nt, Human
accaugcuggucaggcuggucucg

SEQ ID NO: 413692 - RNA, 20 nt, Human
acccuuugauaugacugccu

SEQ ID NO: 413693 - RNA, 21 nt, Human
acuccuguugcccaggcugga

SEQ ID NO: 413694 - RNA, 22 nt, Human
acuccuguugcccaggcuggag

SEQ ID NO: 413695 - RNA, 18 nt, Human
acucuugacucaggcaug

SEQ ID NO: 413696 - RNA, 24 nt, Human
agaaaaacacaaucuguguuugga

SEQ ID NO: 413697 - RNA, 20 nt, Human
agaagaucccauagugaaga

SEQ ID NO: 413698 - RNA, 23 nt, Human
agaagaucccauagugaagaaaa

SEQ ID NO: 413699 - RNA, 23 nt, Human
aggcgugagccaccgugccuggc

SEQ ID NO: 413700 - RNA, 23 nt, Human
aguagcugggauuacaggcaugu

SEQ ID NO: 413701 - RNA, 26 nt, Human
agugaagaaaacaaaaccaaagaaaa

SEQ ID NO: 413702 - RNA, 27 nt, Human
agugaagaaaacaaaaccaaagaaaaa

SEQ ID NO: 413703 - RNA, 18 nt, Human
agugcugggauuacaggc

SEQ ID NO: 413704 - RNA, 21 nt, Human
auguaucaguacugucgucag

SEQ ID NO: 413705 - RNA, 20 nt, Human
caaacuaaauugagauaaua

SEQ ID NO: 413706 - RNA, 24 nt, Human
caaagugcugggauuacaggcgug

SEQ ID NO: 413707 - RNA, 21 nt, Human
caccaugcuggucaggcuggu

SEQ ID NO: 413708 - RNA, 23 nt, Human
caccaugcuggucaggcuggucu

SEQ ID NO: 413709 - RNA, 24 nt, Human
caccaugcuggucaggcuggucuc

SEQ ID NO: 413710 - RNA, 19 nt, Human
cagaagaucccauagugaa

SEQ ID NO: 413711 - RNA, 24 nt, Human
cagaagaucccauagugaagaaaa

SEQ ID NO: 413712 - RNA, 24 nt, Human
cagaagaucccauagugaagaaaa

SEQ ID NO: 413713 - RNA, 20 nt, Human
cagccuccugaguagcuggg

SEQ ID NO: 413714 - RNA, 21 nt, Human
cauaaucuuaauuuaagcgca

SEQ ID NO: 413715 - RNA, 22 nt, Human
cauagugaagaaaacaaaacca

SEQ ID NO: 413716 - RNA, 20 nt, Human
ccaaagugcugggauuacag

SEQ ID NO: 413717 - RNA, 22 nt, Human
ccaaagugcugggauuacaggc

SEQ ID NO: 413718 - RNA, 22 nt, Human
ccaaagugcugggauuacaggc

SEQ ID NO: 413719 - RNA, 24 nt, Human
ccaaagugcugggauuacaggcgu

SEQ ID NO: 413720 - RNA, 20 nt, Human
ccaccacgcccggcuaauuu

SEQ ID NO: 413721 - RNA, 26 nt, Human
ccaccuuccggguucaagcaauucuu

SEQ ID NO: 413722 - RNA, 18 nt, Human
cccaggcuggagugcaau

SEQ ID NO: 413723 - RNA, 24 nt, Human
cccgaccucaggugauccacccac

SEQ ID NO: 413724 - RNA, 23 nt, Human
ccgccucagccuccugaguagcu

SEQ ID NO: 413725 - RNA, 19 nt, Human
ccggguucaagcaauucuc

SEQ ID NO: 413726 - RNA, 19 nt, Human
ccucccaucuuucuuuacc

SEQ ID NO: 413727 - RNA, 23 nt, Human
ccugaguagcugggauuacaggc

SEQ ID NO: 413728 - RNA, 24 nt, Human
ccugaguagcugggauuacaggca

SEQ ID NO: 413729 - RNA, 24 nt, Human
ccuguugcccaggcuggagugcaa

SEQ ID NO: 413730 - RNA, 24 nt, Human
ccuuccggguucaagcaauucucc

SEQ ID NO: 413731 - RNA, 18 nt, Human
ccuuuaaauaguuuaugc

SEQ ID NO: 413732 - RNA, 24 nt, Human
cgccucagccuccugaguagcugg

SEQ ID NO: 413733 - RNA, 25 nt, Human
cucaaacagccuucccucuuccugc

SEQ ID NO: 413734 - RNA, 24 nt, Human
cucagccuccugaguagcugggau

SEQ ID NO: 413735 - RNA, 24 nt, Human
cuccgccucagccuccugaguagc

SEQ ID NO: 413736 - RNA, 18 nt, Human
cugaagccauugagaccc

SEQ ID NO: 413737 - RNA, 23 nt, Human
cugaguagcugggauuacaggca

SEQ ID NO: 413738 - RNA, 24 nt, Human
cugaguagcugggauuacaggcau

SEQ ID NO: 413739 - RNA, 19 nt, Human
cuggccgggguauuuuuau

SEQ ID NO: 413740 - RNA, 22 nt, Human
cuuacacuugggaaguuucuuc

SEQ ID NO: 413741 - RNA, 19 nt, Human
cuucuagaguuccuuuugg

SEQ ID NO: 413742 - RNA, 22 nt, Human
gaacaaacauugaaagccugga

SEQ ID NO: 413743 - RNA, 23 nt, Human
gaagaaaacaaaaccaaagaaaa

SEQ ID NO: 413744 - RNA, 24 nt, Human
gaccucaggugauccacccaccuc

SEQ ID NO: 413745 - RNA, 18 nt, Human
gagacagaaacacaugug

SEQ ID NO: 413746 - RNA, 22 nt, Human
gagcaagaaacacgacaaagga

SEQ ID NO: 413747 - RNA, 23 nt, Human
gaggccaaugauagagucagaaa

SEQ ID NO: 413748 - RNA, 22 nt, Human
gaguagcugggauuacaggcau

SEQ ID NO: 413749 - RNA, 25 nt, Human
gaguagcugggauuacaggcaugug

SEQ ID NO: 413750 - RNA, 18 nt, Human
gauuacaggcaugugcca

SEQ ID NO: 413751 - RNA, 18 nt, Human
gauuacaggcgugagcca

SEQ ID NO: 413752 - RNA, 21 nt, Human
gauuacaggcgugagccaccg

SEQ ID NO: 413753 - RNA, 24 nt, Human
gauuacaggcgugagccaccgugc

SEQ ID NO: 413754 - RNA, 23 nt, Human
gcccggcuaauuuuuuguguuuu

SEQ ID NO: 413755 - RNA, 21 nt, Human
gccuaguaaacaucuauagaa

SEQ ID NO: 413756 - RNA, 20 nt, Human
gcugggcacagaagauccca

SEQ ID NO: 413757 - RNA, 23 nt, Human
gcuggucucgaacucccgaccuc

SEQ ID NO: 413758 - RNA, 19 nt, Human
ggauuacaggcaugugcca

SEQ ID NO: 413759 - RNA, 18 nt, Human
guagcugggauuacaggc

SEQ ID NO: 413760 - RNA, 20 nt, Human
guagcugggauuacaggcau

SEQ ID NO: 413761 - RNA, 21 nt, Human
uaaagcaccaccauuuccaag

SEQ ID NO: 413762 - RNA, 19 nt, Human
uaaucuuaauuuaagcgca

SEQ ID NO: 413763 - RNA, 24 nt, Human
uaauuuuuuguguuuuuaguagag

SEQ ID NO: 413764 - RNA, 23 nt, Human
uacaggcaugugccaccacgccc

SEQ ID NO: 413765 - RNA, 22 nt, Human
uacaggcgugagccaccgugcc

SEQ ID NO: 413766 - RNA, 22 nt, Human
uacaggcgugagccaccgugcc

SEQ ID NO: 413767 - RNA, 23 nt, Human
uacaggcgugagccaccgugccu

SEQ ID NO: 413768 - RNA, 24 nt, Human
uacuccuguugcccaggcuggagu

SEQ ID NO: 413769 - RNA, 25 nt, Human
uaguagagauggggguuccaccaug

SEQ ID NO: 413770 - RNA, 18 nt, Human
uagugaaguuugagagug

SEQ ID NO: 413771 - RNA, 24 nt, Human
uagugcaaucucagcucaccgcaa

SEQ ID NO: 413772 - RNA, 21 nt, Human
uauuaccaaaguggaagggag

SEQ ID NO: 413773 - RNA, 21 nt, Human
ucaaacagccuucccucuucc

SEQ ID NO: 413774 - RNA, 21 nt, Human
ucaccgcaacaaccuccaccu

SEQ ID NO: 413775 - RNA, 27 nt, Human
ucaccgcaacaaccuccaccuuccggg

SEQ ID NO: 413776 - RNA, 20 nt, Human
ucagccuccugaguagcugg

SEQ ID NO: 413777 - RNA, 20 nt, Human
ucaggugauccacccaccuc

SEQ ID NO: 413778 - RNA, 18 nt, Human
ucaguacugucgucagug

SEQ ID NO: 413779 - RNA, 23 nt, Human
uccacccaccucccaaagugcug

SEQ ID NO: 413780 - RNA, 24 nt, Human
ucccaaagugcugggauuacaggc

SEQ ID NO: 413781 - RNA, 25 nt, Human
uccuacaucaucaaauucuuuucau

SEQ ID NO: 413782 - RNA, 24 nt, Human
uccugaguagcugggauuacaggc

SEQ ID NO: 413783 - RNA, 23 nt, Human
ucugguauuaccaaaguggaagg

SEQ ID NO: 413784 - RNA, 24 nt, Human
ugaaauaaccuccuacaucaucaa

SEQ ID NO: 413785 - RNA, 19 nt, Human
ugaagaaaacaaaaccaaa

SEQ ID NO: 413786 - RNA, 21 nt, Human
ugaagaaaacaaaaccaaaga

SEQ ID NO: 413787 - RNA, 23 nt, Human
ugaagaaaacaaaaccaaagaaa

SEQ ID NO: 413788 - RNA, 18 nt, Human
ugacuaauggagagacag

SEQ ID NO: 413789 - RNA, 19 nt, Human
ugauccacccaccucccaa

SEQ ID NO: 413790 - RNA, 21 nt, Human
ugcaaacauauuguuugugca

SEQ ID NO: 413791 - RNA, 23 nt, Human
ugcaauagugcaaucucagcucc

SEQ ID NO: 413792 - RNA, 18 nt, Human
ugcccaggcuggagugca

SEQ ID NO: 413793 - RNA, 24 nt, Human
ugcccaggcuggagugcaauagug

SEQ ID NO: 413794 - RNA, 24 nt, Human
ugcugggauuacaggcgugagcca

SEQ ID NO: 413795 - RNA, 18 nt, Human
ugcuggucaggcuggucu

SEQ ID NO: 413796 - RNA, 18 nt, Human
ugggauuacaggcaugug

SEQ ID NO: 413797 - RNA, 21 nt, Human
ugggauuacaggcaugugcca

SEQ ID NO: 413798 - RNA, 22 nt, Human
ugggauuacaggcaugugccac

SEQ ID NO: 413799 - RNA, 24 nt, Human
ugggauuacaggcaugugccacca

SEQ ID NO: 413800 - RNA, 18 nt, Human
ugggauuacaggcgugag

SEQ ID NO: 413801 - RNA, 21 nt, Human
ugggauuacaggcgugagcca

SEQ ID NO: 413802 - RNA, 22 nt, Human
ugggauuacaggcgugagccac

SEQ ID NO: 413803 - RNA, 23 nt, Human
ugggauuacaggcgugagccacc

SEQ ID NO: 413804 - RNA, 23 nt, Human
ugggauuacaggcgugagccacc

SEQ ID NO: 413805 - RNA, 24 nt, Human
ugggauuacaggcgugagccaccg

SEQ ID NO: 413806 - RNA, 23 nt, Human
uggucaggcuggucucgaacucc

SEQ ID NO: 413807 - RNA, 19 nt, Human
uggucucgaacucccgacc

SEQ ID NO: 413808 - RNA, 19 nt, Human
uguagcaauagaagaauaa

SEQ ID NO: 413809 - RNA, 21 nt, Human
uguguuuuuaguagagauggg

SEQ ID NO: 413810 - RNA, 28 nt, Human
uguucuauagauccaaacagaaugggaa

SEQ ID NO: 413811 - RNA, 20 nt, Human
uguugcccaggcuggagugc

SEQ ID NO: 413812 - RNA, 23 nt, Human
uuacuccuguugcccaggcugga

SEQ ID NO: 413813 - RNA, 24 nt, Human
uuacugaguuuuccucccaucuuu

SEQ ID NO: 413814 - RNA, 25 nt, Human
uuaguagagauggggguuccaccau

SEQ ID NO: 413815 - RNA, 23 nt, Human
uuccggguucaagcaauucuccg

SEQ ID NO: 413816 - RNA, 23 nt, Human
uucuagaguuccuuuuggaaaga

SEQ ID NO: 413817 - RNA, 19 nt, Human
uugaaguuggaaugguuca

SEQ ID NO: 413818 - RNA, 18 nt, Human
uugcccaggcuggagugc

SEQ ID NO: 413819 - RNA, 24 nt, Human
uuguguuuuuaguagagauggggg

SEQ ID NO: 413820 - RNA, 24 nt, Human
uuuacuccuguugcccaggcugga

SEQ ID NO: 413821 - RNA, 18 nt, Human
uuucuacuuugcaaacag

SEQ ID NO: 413822 - RNA, 24 nt, Human
uuuuacuccuguugcccaggcugg

SEQ ID NO: 413823 - RNA, 18 nt, Human
uuuuuaguagagaugggg

SEQ ID NO: 413824 - RNA, 18 nt, Human
uuuuuauauaacaaacgc

SEQ ID NO: 413825 - RNA, 21 nt, Human
uuuuuguguuuuuaguagaga

SEQ ID NO: 413826 - RNA, 24 nt, Human
uuuuuuguguuuuuaguagagaug

SEQ ID NO: 413827 - RNA, 22 nt, Human
aaacaauuaaaccacauccaag

SEQ ID NO: 413828 - RNA, 22 nt, Human
aacuuacagacagaaaccaaag

SEQ ID NO: 413829 - RNA, 22 nt, Human
aagcucacaccacaauggcccc

SEQ ID NO: 413830 - RNA, 25 nt, Human
acaccacaauggcccaguggacagc

SEQ ID NO: 413831 - RNA, 20 nt, Human
agacagaaaccaaaguagcc

SEQ ID NO: 413832 - RNA, 20 nt, Human
agacagaaaccaaaguagcc

SEQ ID NO: 413833 - RNA, 22 nt, Human
agacauacacuggggagaaugc

SEQ ID NO: 413834 - RNA, 19 nt, Human
caaaguagccauuuaaagc

SEQ ID NO: 413835 - RNA, 26 nt, Human
cacaaguacugaagcauuuuagacug

SEQ ID NO: 413836 - RNA, 27 nt, Human
cagaaaccaaaguagccauuuaaagcg

SEQ ID NO: 413837 - RNA, 22 nt, Human
cagaagaacagcuguguuucac

SEQ ID NO: 413838 - RNA, 20 nt, Human
cagcaaagucccucccacag

SEQ ID NO: 413839 - RNA, 21 nt, Human
ccacauccaaggucuuaacuu

SEQ ID NO: 413840 - RNA, 25 nt, Human
cucacaccacaauggcccaguggac

SEQ ID NO: 413841 - RNA, 21 nt, Human
cucugcuugugcuuaagugcc

SEQ ID NO: 413842 - RNA, 25 nt, Human
cucugcuugugcuuaagugccuggg

SEQ ID NO: 413843 - RNA, 22 nt, Human
cugaagcucacaccacaauggc

SEQ ID NO: 413844 - RNA, 20 nt, Human
gccuggguguggcugagggg

SEQ ID NO: 413845 - RNA, 21 nt, Human
gcggagcgcccggcagaaaua

SEQ ID NO: 413846 - RNA, 20 nt, Human
ggcccaguggacagcugugc

SEQ ID NO: 413847 - RNA, 23 nt, Human
guacugaagcauuuuagacugca

SEQ ID NO: 413848 - RNA, 21 nt, Human
guagccauuuaaagcguuaga

SEQ ID NO: 413849 - RNA, 20 nt, Human
uaacuuacagacagaaacca

SEQ ID NO: 413850 - RNA, 19 nt, Human
uaagugccuggguguggcu

SEQ ID NO: 413851 - RNA, 22 nt, Human
uagggaagacgaaaaacagcua

SEQ ID NO: 413852 - RNA, 24 nt, Human
ucugcagaacagaagaacagcugu

SEQ ID NO: 413853 - RNA, 19 nt, Human
ugcagaacagaagaacagc

SEQ ID NO: 413854 - RNA, 19 nt, Human
uggggagaaugcuucacca

SEQ ID NO: 413855 - RNA, 18 nt, Human
uuacagacagaaaccaaa

SEQ ID NO: 413856 - RNA, 23 nt, Human
uucaccaucugaagcucacacca

SEQ ID NO: 413857 - RNA, 21 nt, Human
uuuagacugcaugggggggua

SEQ ID NO: 413858 - RNA, 22 nt, Human
uuuuuuuuuuuuuuuuuaucuu

SEQ ID NO: 413859 - RNA, 22 nt, Human
acucuggggugggggaaagggg

SEQ ID NO: 413860 - RNA, 19 nt, Human
cuggggugggggaaagggg

SEQ ID NO: 413861 - RNA, 19 nt, Human
ggaacacagggucuguccc

SEQ ID NO: 413862 - RNA, 19 nt, Human
guggcucugccccgcaucc

SEQ ID NO: 413863 - RNA, 21 nt, Human
ucaacguuuucgcagccccaa

SEQ ID NO: 413864 - RNA, 21 nt, Human
ucccucggggcaggcugaaga

SEQ ID NO: 413865 - RNA, 19 nt, Human
ucuggggugggggaaaggg

SEQ ID NO: 413866 - RNA, 18 nt, Human
uggggugggggaaagggg

SEQ ID NO: 413867 - RNA, 23 nt, Human
ugguggcucugccccgcauccca

SEQ ID NO: 413868 - RNA, 20 nt, Human
uucaguacuuuuauuaaaaa

SEQ ID NO: 413869 - RNA, 21 nt, Human
uucgcagccccaaaccgggcc

SEQ ID NO: 413870 - RNA, 24 nt, Human
ccgaagguggaggaaguuccuuuc

SEQ ID NO: 413871 - RNA, 18 nt, Human
cuugcucuucacgccugu

SEQ ID NO: 413872 - RNA, 20 nt, Human
gcuccagccccgaaggugga

SEQ ID NO: 413873 - RNA, 18 nt, Human
ucagagacuggagaugca

SEQ ID NO: 413874 - RNA, 24 nt, Human
uccgccgggcagcaaacccgauuu

SEQ ID NO: 413875 - RNA, 19 nt, Human
uugcucuucacgccugucc

SEQ ID NO: 413876 - RNA, 25 nt, Human
aaaaggaaagcauggcccggcuaga

SEQ ID NO: 413877 - RNA, 19 nt, Human
agaaagaaggaagaaaagg

SEQ ID NO: 413878 - RNA, 20 nt, Human
agcaacaagacgagauagag

SEQ ID NO: 413879 - RNA, 23 nt, Human
agcaacaagacgagauagaggaa

SEQ ID NO: 413880 - RNA, 21 nt, Human
aggaagagguggggaaagagg

SEQ ID NO: 413881 - RNA, 26 nt, Human
aguagaugagaauguagaaagaggga

SEQ ID NO: 413882 - RNA, 21 nt, Human
caaaugucaacuccaccagca

SEQ ID NO: 413883 - RNA, 24 nt, Human
caacuccaccagcacugagacaau

SEQ ID NO: 413884 - RNA, 19 nt, Human
cacggcagugcgugcggcu

SEQ ID NO: 413885 - RNA, 22 nt, Human
cacggcagugcgugcggcugug

SEQ ID NO: 413886 - RNA, 21 nt, Human
cauggcccggcuagagacaaa

SEQ ID NO: 413887 - RNA, 20 nt, Human
cccaggagauggagaaaaac

SEQ ID NO: 413888 - RNA, 19 nt, Human
ccgggcgagcguggacagu

SEQ ID NO: 413889 - RNA, 22 nt, Human
cgagauagaggaacucugccgg

SEQ ID NO: 413890 - RNA, 20 nt, Human
cggcagugcgugcggcugug

SEQ ID NO: 413891 - RNA, 22 nt, Human
cuaaaggugucccguucuucaa

SEQ ID NO: 413892 - RNA, 21 nt, Human
gaaagagggaaggagagaagg

SEQ ID NO: 413893 - RNA, 21 nt, Human
gaagagaaagaaggaagaaaa

SEQ ID NO: 413894 - RNA, 18 nt, Human
gaagggaaggagggaaga

SEQ ID NO: 413895 - RNA, 22 nt, Human
gaaggugguagguaaaggagcg

SEQ ID NO: 413896 - RNA, 20 nt, Human
gacgaagauucuggcugaac

SEQ ID NO: 413897 - RNA, 19 nt, Human
gagaaaaacuggagacagg

SEQ ID NO: 413898 - RNA, 21 nt, Human
gagaagggaaggagggaagag

SEQ ID NO: 413899 - RNA, 20 nt, Human
gagccgcagggagaacacgg

SEQ ID NO: 413900 - RNA, 19 nt, Human
gcugggcugucgggggcag

SEQ ID NO: 413901 - RNA, 19 nt, Human
gcugguacgaggccuccca

SEQ ID NO: 413902 - RNA, 19 nt, Human
gcuugggauccuggcuggu

SEQ ID NO: 413903 - RNA, 20 nt, Human
ggaugacaagugggcuaggc

SEQ ID NO: 413904 - RNA, 21 nt, Human
ggcuagagacaaagccagagg

SEQ ID NO: 413905 - RNA, 24 nt, Human
gggaaagagggaaggagagaaggg

SEQ ID NO: 413906 - RNA, 21 nt, Human
gggaaggagagaagggaagga

SEQ ID NO: 413907 - RNA, 21 nt, Human
gggaaggugguagguaaagga

SEQ ID NO: 413908 - RNA, 20 nt, Human
gggcuaggcugggcugucgg

SEQ ID NO: 413909 - RNA, 23 nt, Human
uaaggucucacggugaggccucc

SEQ ID NO: 413910 - RNA, 18 nt, Human
uccugcuacgucccagga

SEQ ID NO: 413911 - RNA, 19 nt, Human
ugagcuugcuuuauggaug

SEQ ID NO: 413912 - RNA, 22 nt, Human
uggcccggcuagagacaaagcc

SEQ ID NO: 413913 - RNA, 23 nt, Human
ugucccguucuucaaagcugcca

SEQ ID NO: 413914 - RNA, 18 nt, Human
uuccaagggacgggacgc

SEQ ID NO: 413915 - RNA, 19 nt, Human
uuccaagggacgggacgcu

SEQ ID NO: 413916 - RNA, 19 nt, Human
aaacaacaguucuguaaac

SEQ ID NO: 413917 - RNA, 19 nt, Human
aaagaagccccuguucucu

SEQ ID NO: 413918 - RNA, 20 nt, Human
acauucgaaaagaaagaagc

SEQ ID NO: 413919 - RNA, 22 nt, Human
accucuuuucccccaagcccaa

SEQ ID NO: 413920 - RNA, 21 nt, Human
agaaucccuccuccucuucua

SEQ ID NO: 413921 - RNA, 24 nt, Human
agaggcugcuccacagcccugggc

SEQ ID NO: 413922 - RNA, 22 nt, Human
aggcauggcagugaagaccaga

SEQ ID NO: 413923 - RNA, 22 nt, Human
aggcugcuccacagcccugggc

SEQ ID NO: 413924 - RNA, 19 nt, Human
cacaugggcccagcagggc

SEQ ID NO: 413925 - RNA, 22 nt, Human
caccgcuacaucccagguugac

SEQ ID NO: 413926 - RNA, 23 nt, Human
caccucuuuucccccaagcccaa

SEQ ID NO: 413927 - RNA, 18 nt, Human
cacguuagcuaccagugg

SEQ ID NO: 413928 - RNA, 20 nt, Human
cagaaucccuccuccucuuc

SEQ ID NO: 413929 - RNA, 26 nt, Human
cagcagggcuucuuuagcacaggcuc

SEQ ID NO: 413930 - RNA, 18 nt, Human
caggggcucccuagggcu

SEQ ID NO: 413931 - RNA, 23 nt, Human
cagugcaaaacaaagguguucuu

SEQ ID NO: 413932 - RNA, 18 nt, Human
caguggccuucuugucuu

SEQ ID NO: 413933 - RNA, 20 nt, Human
ccaaaggacucucuguggca

SEQ ID NO: 413934 - RNA, 21 nt, Human
ccaaaggacucucuguggcag

SEQ ID NO: 413935 - RNA, 28 nt, Human
ccaagcccaacaauccuuugagguacuu

SEQ ID NO: 413936 - RNA, 20 nt, Human
ccacauucgaaaagaaagaa

SEQ ID NO: 413937 - RNA, 23 nt, Human
ccaggaauccaccucuuuucccc

SEQ ID NO: 413938 - RNA, 18 nt, Human
ccagguugacccacggua

SEQ ID NO: 413939 - RNA, 23 nt, Human
ccagguugacccacgguagccac

SEQ ID NO: 413940 - RNA, 18 nt, Human
ccccagccucacaugggc

SEQ ID NO: 413941 - RNA, 18 nt, Human
ccccuccuugucauucac

SEQ ID NO: 413942 - RNA, 18 nt, Human
cccuccauuuuguaggaa

SEQ ID NO: 413943 - RNA, 21 nt, Human
cccuguucucugggagggagu

SEQ ID NO: 413944 - RNA, 19 nt, Human
ccguggcugaucucccacc

SEQ ID NO: 413945 - RNA, 20 nt, Human
ccucacaugggcccagcagg

SEQ ID NO: 413946 - RNA, 25 nt, Human
ccucacaugggcccagcagggcuuc

SEQ ID NO: 413947 - RNA, 21 nt, Human
ccucugguccccaagucucug

SEQ ID NO: 413948 - RNA, 18 nt, Human
cgagaggagguccaagga

SEQ ID NO: 413949 - RNA, 23 nt, Human
cgugguggggggggguggggaag

SEQ ID NO: 413950 - RNA, 25 nt, Human
cguuagcuaccaguggccuucuugu

SEQ ID NO: 413951 - RNA, 20 nt, Human
cuagaaucccaaaggacucu

SEQ ID NO: 413952 - RNA, 21 nt, Human
cuccaaccuuccauuuugucc

SEQ ID NO: 413953 - RNA, 18 nt, Human
cugguccccaagucucug

SEQ ID NO: 413954 - RNA, 20 nt, Human
cuuguaguuagauuuacaca

SEQ ID NO: 413955 - RNA, 18 nt, Human
gacagggaagggauggcu

SEQ ID NO: 413956 - RNA, 19 nt, Human
gagaggcugcuccacagcc

SEQ ID NO: 413957 - RNA, 23 nt, Human
gagguggcagcagggauuggaug

SEQ ID NO: 413958 - RNA, 18 nt, Human
gagugcuggaggcaggag

SEQ ID NO: 413959 - RNA, 21 nt, Human
gccccuguucucugggaggga

SEQ ID NO: 413960 - RNA, 19 nt, Human
gcguggugggggggggugg

SEQ ID NO: 413961 - RNA, 24 nt, Human
gcuccuguggcuucacgucaucca

SEQ ID NO: 413962 - RNA, 18 nt, Human
gcucuguguugcugggug

SEQ ID NO: 413963 - RNA, 18 nt, Human
ggaaggcucugcccaguc

SEQ ID NO: 413964 - RNA, 18 nt, Human
ggcauggcagugaagacc

SEQ ID NO: 413965 - RNA, 22 nt, Human
ggcugaugaugcaugugugaug

SEQ ID NO: 413966 - RNA, 21 nt, Human
ggggaagaggcugcauggggg

SEQ ID NO: 413967 - RNA, 23 nt, Human
ggggauacacgucuccaaccuuc

SEQ ID NO: 413968 - RNA, 24 nt, Human
ggggcugugaguccugccacggca

SEQ ID NO: 413969 - RNA, 27 nt, Human
gggggguggggaagaggcugcaugggg

SEQ ID NO: 413970 - RNA, 22 nt, Human
ggggguggggaagaggcugcau

SEQ ID NO: 413971 - RNA, 23 nt, Human
gucagggaauauuuacgagcccc

SEQ ID NO: 413972 - RNA, 20 nt, Human
gugcagcugcagucgccagc

SEQ ID NO: 413973 - RNA, 30 nt, Human
guggcagcagggauuggauggccccuccuu

SEQ ID NO: 413974 - RNA, 23 nt, Human
guggggggggguggggaagaggc

SEQ ID NO: 413975 - RNA, 22 nt, Human
guuuuuuaaacuucuucuuugu

SEQ ID NO: 413976 - RNA, 21 nt, Human
uaaacaacaguucuguaaaca

SEQ ID NO: 413977 - RNA, 24 nt, Human
uagguucuugcccaggaauccacc

SEQ ID NO: 413978 - RNA, 24 nt, Human
uaguuagauuuacacagagcuuuu

SEQ ID NO: 413979 - RNA, 22 nt, Human
uaucuugguuuauuuucucuug

SEQ ID NO: 413980 - RNA, 23 nt, Human
ucacuugcaugucauagcacccc

SEQ ID NO: 413981 - RNA, 20 nt, Human
ucagugcagcgguggggcug

SEQ ID NO: 413982 - RNA, 24 nt, Human
ucaugauugagcgcgugguggggg

SEQ ID NO: 413983 - RNA, 23 nt, Human
uccaaauggaucuaucuugguuu

SEQ ID NO: 413984 - RNA, 23 nt, Human
ucccacuccauugugggccccuc

SEQ ID NO: 413985 - RNA, 27 nt, Human
ucccagguugacccacgguagccacau

SEQ ID NO: 413986 - RNA, 25 nt, Human
ucccuagggcuccaucccaggaggu

SEQ ID NO: 413987 - RNA, 20 nt, Human
ucccuccaggcuccguggcu

SEQ ID NO: 413988 - RNA, 21 nt, Human
uccuagaaucccaaaggacuc

SEQ ID NO: 413989 - RNA, 24 nt, Human
uccuguggcuucacgucauccacu

SEQ ID NO: 413990 - RNA, 23 nt, Human
uccuuuggucucaccucuagaca

SEQ ID NO: 413991 - RNA, 22 nt, Human
ugaggcauggcagugaagacca

SEQ ID NO: 413992 - RNA, 23 nt, Human
ugaguccugccacggcaggggca

SEQ ID NO: 413993 - RNA, 22 nt, Human
ugcaaaacaaagguguucuuga

SEQ ID NO: 413994 - RNA, 19 nt, Human
ugcauggggguggggcucc

SEQ ID NO: 413995 - RNA, 18 nt, Human
uggauggccccuccuuuc

SEQ ID NO: 413996 - RNA, 23 nt, Human
uggcaacuccucucugucccgac

SEQ ID NO: 413997 - RNA, 21 nt, Human
ugggagggagugcuggaggca

SEQ ID NO: 413998 - RNA, 22 nt, Human
uggggggggguggggaagaggc

SEQ ID NO: 413999 - RNA, 20 nt, Human
uggggguggggcuccugugg

SEQ ID NO: 414000 - RNA, 24 nt, Human
ugggucuguguccaugugugcgug

SEQ ID NO: 414001 - RNA, 21 nt, Human
uggugagguggacagggaagg

SEQ ID NO: 414002 - RNA, 22 nt, Human
ugucauagcaccccuggugagg

SEQ ID NO: 414003 - RNA, 21 nt, Human
ugucccgacaaaaucucuccc

SEQ ID NO: 414004 - RNA, 19 nt, Human
ugugggccccuccuguccc

SEQ ID NO: 414005 - RNA, 18 nt, Human
uguguccaugugugcgug

SEQ ID NO: 414006 - RNA, 23 nt, Human
ugugugcguggaugcaccguuuu

SEQ ID NO: 414007 - RNA, 21 nt, Human
ugugugggucuguguccaugu

SEQ ID NO: 414008 - RNA, 24 nt, Human
uucaaaccuucuucccuggcaacu

SEQ ID NO: 414009 - RNA, 20 nt, Human
uucacgucauccacugucac

SEQ ID NO: 414010 - RNA, 23 nt, Human
uuccuuggguuuccuagaauccc

SEQ ID NO: 414011 - RNA, 20 nt, Human
uucuuuagcacaggcucuag

SEQ ID NO: 414012 - RNA, 19 nt, Human
uugagcgcguggugggggg

SEQ ID NO: 414013 - RNA, 21 nt, Human
uugcuggguggcaucccucca

SEQ ID NO: 414014 - RNA, 22 nt, Human
uuggauggccccuccuuucaaa

SEQ ID NO: 414015 - RNA, 26 nt, Human
uuucuugaaucagcaacaaguaaaca

SEQ ID NO: 414016 - RNA, 22 nt, Human
aaaagccaagauguugcaaaug

SEQ ID NO: 414017 - RNA, 24 nt, Human
aaaugauucuuuuauuauuuucca

SEQ ID NO: 414018 - RNA, 19 nt, Human
aaccccgccgaccgcucuc

SEQ ID NO: 414019 - RNA, 24 nt, Human
aagaaaccccgccgaccgcucucc

SEQ ID NO: 414020 - RNA, 22 nt, Human
aagccuuuuuuuaggccaaaga

SEQ ID NO: 414021 - RNA, 22 nt, Human
agaaagaacacuucauguuaga

SEQ ID NO: 414022 - RNA, 21 nt, Human
agaaaggauaaaugaagaaaa

SEQ ID NO: 414023 - RNA, 23 nt, Human
aggauaaaugaagaaaaagaaag

SEQ ID NO: 414024 - RNA, 18 nt, Human
agguucuucugaguggug

SEQ ID NO: 414025 - RNA, 18 nt, Human
agugggagcuccccucaa

SEQ ID NO: 414026 - RNA, 22 nt, Human
auaaaugaagaaaaagaaagaa

SEQ ID NO: 414027 - RNA, 23 nt, Human
augaggcucgucccugucagugc

SEQ ID NO: 414028 - RNA, 22 nt, Human
caaaucaagcauacaacuacaa

SEQ ID NO: 414029 - RNA, 22 nt, Human
cagccacaguagugggacagcc

SEQ ID NO: 414030 - RNA, 24 nt, Human
caggcaaugcaacgaagaaacccc

SEQ ID NO: 414031 - RNA, 20 nt, Human
cauguuugcuucuccaugga

SEQ ID NO: 414032 - RNA, 18 nt, Human
ccaagauguugcaaauga

SEQ ID NO: 414033 - RNA, 18 nt, Human
ccaguaacuaaaagccaa

SEQ ID NO: 414034 - RNA, 19 nt, Human
ccccgccgaccgcucuccc

SEQ ID NO: 414035 - RNA, 23 nt, Human
ccgccgaccgcucucccagccgc

SEQ ID NO: 414036 - RNA, 18 nt, Human
ccgcugccgcugccgccg

SEQ ID NO: 414037 - RNA, 20 nt, Human
ccgcugccgcugccgccgcg

SEQ ID NO: 414038 - RNA, 20 nt, Human
ccuggcagacuccgcuccuc

SEQ ID NO: 414039 - RNA, 25 nt, Human
ccuuuuuuuaggccaaagacugaca

SEQ ID NO: 414040 - RNA, 24 nt, Human
cgccgcgccaagccgguacgcccc

SEQ ID NO: 414041 - RNA, 21 nt, Human
cucaagcugaaagcgugaaga

SEQ ID NO: 414042 - RNA, 22 nt, Human
cucaggcaaugcaacgaagaaa

SEQ ID NO: 414043 - RNA, 18 nt, Human
cucccagccgccgcugcc

SEQ ID NO: 414044 - RNA, 18 nt, Human
cuccucucaggcaaugca

SEQ ID NO: 414045 - RNA, 18 nt, Human
cugccgcugccgccgcgc

SEQ ID NO: 414046 - RNA, 19 nt, Human
cugcugaggcagugggagc

SEQ ID NO: 414047 - RNA, 18 nt, Human
gaagaaaaagaaagaaca

SEQ ID NO: 414048 - RNA, 19 nt, Human
gcaacgaagaaaccccgcc

SEQ ID NO: 414049 - RNA, 21 nt, Human
gcaacgaagaaaccccgccga

SEQ ID NO: 414050 - RNA, 19 nt, Human
gcagugggagcuccccuca

SEQ ID NO: 414051 - RNA, 23 nt, Human
gccgccgcugccgcugccgccgg

SEQ ID NO: 414052 - RNA, 23 nt, Human
gccgcugccgccgcgccaagccg

SEQ ID NO: 414053 - RNA, 26 nt, Human
ggaaaagaaaggauaaaugaagaaaa

SEQ ID NO: 414054 - RNA, 22 nt, Human
ggaggcagcuaucuacaggccc

SEQ ID NO: 414055 - RNA, 26 nt, Human
uaaaauugggaguuggggaguaggga

SEQ ID NO: 414056 - RNA, 24 nt, Human
uacaaaguccugcugcuccacuuc

SEQ ID NO: 414057 - RNA, 23 nt, Human
uagaacacaugucuauuuaaagc

SEQ ID NO: 414058 - RNA, 22 nt, Human
uauagaacacaugucuauuuaa

SEQ ID NO: 414059 - RNA, 25 nt, Human
uauguaaaauaaaaauagaaacauu

SEQ ID NO: 414060 - RNA, 19 nt, Human
ucacauguuugcuucucca

SEQ ID NO: 414061 - RNA, 20 nt, Human
ucacauguuugcuucuccau

SEQ ID NO: 414062 - RNA, 21 nt, Human
ucacuaaggagccaguuaugu

SEQ ID NO: 414063 - RNA, 23 nt, Human
ucauucagaucagguucuucuga

SEQ ID NO: 414064 - RNA, 25 nt, Human
ucccagccgccgcugccgcugccgg

SEQ ID NO: 414065 - RNA, 20 nt, Human
uccugcugcuccacuuccaa

SEQ ID NO: 414066 - RNA, 25 nt, Human
ugaggaggcagcuaucuacaggccc

SEQ ID NO: 414067 - RNA, 21 nt, Human
ugcaacgaagaaaccccgccg

SEQ ID NO: 414068 - RNA, 23 nt, Human
ugcaacgaagaaaccccgccgac

SEQ ID NO: 414069 - RNA, 20 nt, Human
ugggaguuggggaguaggga

SEQ ID NO: 414070 - RNA, 21 nt, Human
uggggaguagggaagaaggag

SEQ ID NO: 414071 - RNA, 22 nt, Human
uguucauucuaacauucacaug

SEQ ID NO: 414072 - RNA, 21 nt, Human
aaagggcggaggggggugggg

SEQ ID NO: 414073 - RNA, 21 nt, Human
auacuucucuuuuuuccuuua

SEQ ID NO: 414074 - RNA, 22 nt, Human
cagauaccaaaacauacaugug

SEQ ID NO: 414075 - RNA, 22 nt, Human
ccgcaggaggaggacagggugg

SEQ ID NO: 414076 - RNA, 21 nt, Human
ccggcccgccggaccggcccg

SEQ ID NO: 414077 - RNA, 22 nt, Human
ccggcccggcccgcugcggccg

SEQ ID NO: 414078 - RNA, 18 nt, Human
ccggugcgggggcgcggg

SEQ ID NO: 414079 - RNA, 23 nt, Human
cgagaggaagguggggagaggaa

SEQ ID NO: 414080 - RNA, 22 nt, Human
cggccgccaacacggacaacgc

SEQ ID NO: 414081 - RNA, 20 nt, Human
gcccggugcgggggcgcggg

SEQ ID NO: 414082 - RNA, 21 nt, Human
gcccggugcgggggcgcggga

SEQ ID NO: 414083 - RNA, 23 nt, Human
gcgcgcccccgcccgcgcgcucu

SEQ ID NO: 414084 - RNA, 19 nt, Human
ggaggaggacagggugggc

SEQ ID NO: 414085 - RNA, 23 nt, Human
ggcgagaggaagguggggagagg

SEQ ID NO: 414086 - RNA, 20 nt, Human
gggguggggacggaaggggc

SEQ ID NO: 414087 - RNA, 19 nt, Human
gguggggagaggaaagggc

SEQ ID NO: 414088 - RNA, 24 nt, Human
gguggggagaggaaagggcggagg

SEQ ID NO: 414089 - RNA, 19 nt, Human
uacagaagguagauuuuua

SEQ ID NO: 414090 - RNA, 19 nt, Human
uacagucacaaagcuguag

SEQ ID NO: 414091 - RNA, 27 nt, Human
ugcaaaaauaaauuaaagaacagauac

SEQ ID NO: 414092 - RNA, 19 nt, Human
ugcugcggucucccggcuc

SEQ ID NO: 414093 - RNA, 18 nt, Human
uggggacggaaggggcgg

SEQ ID NO: 414094 - RNA, 18 nt, Human
uggucggggcgaccgcgg

SEQ ID NO: 414095 - RNA, 20 nt, Human
uucacagaugcaagugccau

SEQ ID NO: 414096 - RNA, 21 nt, Human
aaaaaaaaaaaaaaucacaaa

SEQ ID NO: 414097 - RNA, 25 nt, Human
aaaaaaaaaaaaaaucacaaauaaa

SEQ ID NO: 414098 - RNA, 23 nt, Human
aaaaaaaaaaagauuagugagga

SEQ ID NO: 414099 - RNA, 21 nt, Human
aaaaaaaaaaucacaaauaaa

SEQ ID NO: 414100 - RNA, 24 nt, Human
aaaaaaaaaucuuuuaaccauauu

SEQ ID NO: 414101 - RNA, 21 nt, Human
aaaaaaaacaaaaaaaaacac

SEQ ID NO: 414102 - RNA, 23 nt, Human
aaaaaaaagauuagugaggaaaa

SEQ ID NO: 414103 - RNA, 18 nt, Human
aaaaaaaucacaaauaaa

SEQ ID NO: 414104 - RNA, 23 nt, Human
aaaaacacuugguucaugggccc

SEQ ID NO: 414105 - RNA, 25 nt, Human
aaaaagcagacagaaaacaaaaaaa

SEQ ID NO: 414106 - RNA, 26 nt, Human
aaaacacuugguucaugggcccaggc

SEQ ID NO: 414107 - RNA, 25 nt, Human
aaaagauuagugaggaaaaccaaua

SEQ ID NO: 414108 - RNA, 20 nt, Human
aaaauacaaaaaauuagccc

SEQ ID NO: 414109 - RNA, 20 nt, Human
aaaauuacaauuaagaaugg

SEQ ID NO: 414110 - RNA, 30 nt, Human
aaagauuagugaggaaaaccaauaaauaaa

SEQ ID NO: 414111 - RNA, 23 nt, Human
aaauaaccacugaaaauauaaaa

SEQ ID NO: 414112 - RNA, 24 nt, Human
aaauaaccacugaaaauauaaaac

SEQ ID NO: 414113 - RNA, 22 nt, Human
aacuguacauucucagcagagc

SEQ ID NO: 414114 - RNA, 23 nt, Human
aagaaaaaaauuacaauuaagaa

SEQ ID NO: 414115 - RNA, 21 nt, Human
aagaaaaaagcagacagaaaa

SEQ ID NO: 414116 - RNA, 19 nt, Human
aagcaaaaauaaccacuga

SEQ ID NO: 414117 - RNA, 22 nt, Human
aagcaaaaauaaccacugaaaa

SEQ ID NO: 414118 - RNA, 24 nt, Human
aagcaaaaauaaccacugaaaaua

SEQ ID NO: 414119 - RNA, 26 nt, Human
aagcagacagaaaacaaaaaaaauuc

SEQ ID NO: 414120 - RNA, 21 nt, Human
aagcagagcuugcagugagcc

SEQ ID NO: 414121 - RNA, 23 nt, Human
aaggaacaaaggaacuuuaacca

SEQ ID NO: 414122 - RNA, 31 nt, Human
aaugacaaacaaaccaauaaccaggaggaaa

SEQ ID NO: 414123 - RNA, 20 nt, Human
acagaaaacaaaaaaaauuc

SEQ ID NO: 414124 - RNA, 18 nt, Human
acauggugaaacccuguc

SEQ ID NO: 414125 - RNA, 19 nt, Human
acauggugaaacccugucu

SEQ ID NO: 414126 - RNA, 20 nt, Human
acauggugaaacccugucuc

SEQ ID NO: 414127 - RNA, 22 nt, Human
acauggugaaacccugucucua

SEQ ID NO: 414128 - RNA, 20 nt, Human
accacugaaaauauaaaacu

SEQ ID NO: 414129 - RNA, 22 nt, Human
accacugcacuccagccugggc

SEQ ID NO: 414130 - RNA, 24 nt, Human
acccugucucuacuaaaaauacaa

SEQ ID NO: 414131 - RNA, 22 nt, Human
acuccagccugggcaacaguga

SEQ ID NO: 414132 - RNA, 24 nt, Human
acugcacuccagccugggcaacag

SEQ ID NO: 414133 - RNA, 25 nt, Human
agaaaaaagcagacagaaaacaaaa

SEQ ID NO: 414134 - RNA, 24 nt, Human
agacgggugguucacaaggucagg

SEQ ID NO: 414135 - RNA, 24 nt, Human
agagcuugcagugagccgagauug

SEQ ID NO: 414136 - RNA, 22 nt, Human
agcaagcgcagggaccgcuccu

SEQ ID NO: 414137 - RNA, 24 nt, Human
agcacuuugggaggccgagacggg

SEQ ID NO: 414138 - RNA, 24 nt, Human
agccaggagaauggcgugaaccug

SEQ ID NO: 414139 - RNA, 22 nt, Human
agccugggcaacagugagacuc

SEQ ID NO: 414140 - RNA, 21 nt, Human
aggccgagacgggugguucac

SEQ ID NO: 414141 - RNA, 24 nt, Human
aggcgugguggcucacaccuguaa

SEQ ID NO: 414142 - RNA, 20 nt, Human
aucacaaauaaaaauggcaa

SEQ ID NO: 414143 - RNA, 19 nt, Human
auccaauaacugagcuaac

SEQ ID NO: 414144 - RNA, 20 nt, Human
auuacaauuaagaauggaaa

SEQ ID NO: 414145 - RNA, 24 nt, Human
auugcaccacugcacuccagccug

SEQ ID NO: 414146 - RNA, 28 nt, Human
auugcaccacugcacuccagccugggca

SEQ ID NO: 414147 - RNA, 22 nt, Human
caaaauuccugaaggaugagac

SEQ ID NO: 414148 - RNA, 24 nt, Human
caacagugagacucugucucaaaa

SEQ ID NO: 414149 - RNA, 21 nt, Human
caagagacauaagaaaaaagc

SEQ ID NO: 414150 - RNA, 24 nt, Human
cacaccuguaaucccagcacuuug

SEQ ID NO: 414151 - RNA, 21 nt, Human
cacauggugaaacccugucuc

SEQ ID NO: 414152 - RNA, 19 nt, Human
caccuguaaucccagcacu

SEQ ID NO: 414153 - RNA, 24 nt, Human
caccuguaaucccagcacuuuggg

SEQ ID NO: 414154 - RNA, 20 nt, Human
cacuccagccugggcaacag

SEQ ID NO: 414155 - RNA, 21 nt, Human
cacuccagccugggcaacagu

SEQ ID NO: 414156 - RNA, 22 nt, Human
cacuccagccugggcaacagug

SEQ ID NO: 414157 - RNA, 19 nt, Human
cacugcacuccagccuggg

SEQ ID NO: 414158 - RNA, 21 nt, Human
cacugcacuccagccugggca

SEQ ID NO: 414159 - RNA, 22 nt, Human
cacugcacuccagccugggcaa

SEQ ID NO: 414160 - RNA, 23 nt, Human
cacugcacuccagccugggcaac

SEQ ID NO: 414161 - RNA, 24 nt, Human
cacugcacuccagccugggcaaca

SEQ ID NO: 414162 - RNA, 25 nt, Human
cacugcacuccagccugggcaacaa

SEQ ID NO: 414163 - RNA, 26 nt, Human
cacugcacuccagccugggcaacagu

SEQ ID NO: 414164 - RNA, 22 nt, Human
cacuguggcgggugccuguagu

SEQ ID NO: 414165 - RNA, 23 nt, Human
cagacagaaaacaaaaaaaauuc

SEQ ID NO: 414166 - RNA, 24 nt, Human
cagacagaaaacaaaaaaaauucu

SEQ ID NO: 414167 - RNA, 24 nt, Human
cagcacuuugggaggccgagacgg

SEQ ID NO: 414168 - RNA, 26 nt, Human
cagcacuuugggaggccgagacgggu

SEQ ID NO: 414169 - RNA, 25 nt, Human
cagcagagcacaaguaucaaaggga

SEQ ID NO: 414170 - RNA, 20 nt, Human
ccacugcacuccagccuggg

SEQ ID NO: 414171 - RNA, 21 nt, Human
ccacugcacuccagccugggc

SEQ ID NO: 414172 - RNA, 23 nt, Human
ccacugcacuccagccugggcaa

SEQ ID NO: 414173 - RNA, 24 nt, Human
ccacugcacuccagccugggcaac

SEQ ID NO: 414174 - RNA, 19 nt, Human
cccgaucgaucggacagca

SEQ ID NO: 414175 - RNA, 21 nt, Human
ccugaaggaugagaccuggga

SEQ ID NO: 414176 - RNA, 26 nt, Human
ccugaaguaccaaaaaaaaaaaaaaa

SEQ ID NO: 414177 - RNA, 22 nt, Human
ccuggcucacauggugaaaccc

SEQ ID NO: 414178 - RNA, 22 nt, Human
ccuggcucacauggugaaaccc

SEQ ID NO: 414179 - RNA, 24 nt, Human
ccuggcucacauggugaaacccug

SEQ ID NO: 414180 - RNA, 20 nt, Human
ccugggcaacagugagacuc

SEQ ID NO: 414181 - RNA, 21 nt, Human
ccuguagucccagcuacuugg

SEQ ID NO: 414182 - RNA, 22 nt, Human
ccuguagucccagcuacuuggg

SEQ ID NO: 414183 - RNA, 22 nt, Human
cgggugguucacaaggucagga

SEQ ID NO: 414184 - RNA, 22 nt, Human
cucacaccuguaaucccagcac

SEQ ID NO: 414185 - RNA, 24 nt, Human
cucacaccuguaaucccagcacuu

SEQ ID NO: 414186 - RNA, 24 nt, Human
cucccucuucucauugaacugcaa

SEQ ID NO: 414187 - RNA, 23 nt, Human
cucugucucaaaaaaaaaacaaa

SEQ ID NO: 414188 - RNA, 24 nt, Human
cuggcucacauggugaaacccugu

SEQ ID NO: 414189 - RNA, 22 nt, Human
cugucucaaaaaaaaaacaaaa

SEQ ID NO: 414190 - RNA, 19 nt, Human
cuugcagugagccgagauu

SEQ ID NO: 414191 - RNA, 21 nt, Human
cuugcagugagccgagauugc

SEQ ID NO: 414192 - RNA, 19 nt, Human
gaaacccugucucuacuaa

SEQ ID NO: 414193 - RNA, 20 nt, Human
gaaccugggaagcagagcuu

SEQ ID NO: 414194 - RNA, 23 nt, Human
gagaccauccuggcucacauggu

SEQ ID NO: 414195 - RNA, 23 nt, Human
gagacgggugguucacaagguca

SEQ ID NO: 414196 - RNA, 24 nt, Human
gagaugcuucuguccucaucuuua

SEQ ID NO: 414197 - RNA, 23 nt, Human
gagauugcaccacugcacuccag

SEQ ID NO: 414198 - RNA, 18 nt, Human
gagcuugcagugagccga

SEQ ID NO: 414199 - RNA, 18 nt, Human
gagcuugcagugagccga

SEQ ID NO: 414200 - RNA, 22 nt, Human
gcaacagugagacucugucuca

SEQ ID NO: 414201 - RNA, 24 nt, Human
gcaacagugagacucugucucaaa

SEQ ID NO: 414202 - RNA, 19 nt, Human
gcagagcacaaguaucaaa

SEQ ID NO: 414203 - RNA, 24 nt, Human
gcucacauggugaaacccugucuc

SEQ ID NO: 414204 - RNA, 22 nt, Human
gcugagccaggagaauggcgug

SEQ ID NO: 414205 - RNA, 21 nt, Human
ggcucacaccuguaaucccag

SEQ ID NO: 414206 - RNA, 23 nt, Human
ggcuuuuggacuaaaaaaaaaaa

SEQ ID NO: 414207 - RNA, 24 nt, Human
gggcaacagugagacucugucuca

SEQ ID NO: 414208 - RNA, 21 nt, Human
gggcccaggcgugguggcuca

SEQ ID NO: 414209 - RNA, 20 nt, Human
ggugguucacaaggucagga

SEQ ID NO: 414210 - RNA, 21 nt, Human
ggugguucacaaggucaggag

SEQ ID NO: 414211 - RNA, 24 nt, Human
guaccaaaaaaaaaaaaaaauccu

SEQ ID NO: 414212 - RNA, 22 nt, Human
guggcgggugccuguaguccca

SEQ ID NO: 414213 - RNA, 23 nt, Human
guggcucacaccuguaaucccag

SEQ ID NO: 414214 - RNA, 21 nt, Human
uaaaaauacaaaaaauuagcc

SEQ ID NO: 414215 - RNA, 22 nt, Human
uaaaaauacaaaaaauuagccc

SEQ ID NO: 414216 - RNA, 18 nt, Human
uaaagaaaaaaauuacaa

SEQ ID NO: 414217 - RNA, 19 nt, Human
uaaagaaaaaaauuacaau

SEQ ID NO: 414218 - RNA, 18 nt, Human
uaaccauauuugggguga

SEQ ID NO: 414219 - RNA, 20 nt, Human
uagcccaggcacuguggcgg

SEQ ID NO: 414220 - RNA, 23 nt, Human
uauaaaacucaacaagagacaua

SEQ ID NO: 414221 - RNA, 21 nt, Human
uauuugucucccucuucucau

SEQ ID NO: 414222 - RNA, 24 nt, Human
ucacaaggucaggagauugagacc

SEQ ID NO: 414223 - RNA, 20 nt, Human
ucauuuaccauuuaauagca

SEQ ID NO: 414224 - RNA, 22 nt, Human
uccagccugggcaacagugaga

SEQ ID NO: 414225 - RNA, 25 nt, Human
ucccagcagcaagcgcaggguaccc

SEQ ID NO: 414226 - RNA, 22 nt, Human
ucucuacuaaaaauacaaaaaa

SEQ ID NO: 414227 - RNA, 23 nt, Human
ugacaaacaaaccaauaaccagg

SEQ ID NO: 414228 - RNA, 28 nt, Human
ugacacauuuuauuaaaacaaaaggaac

SEQ ID NO: 414229 - RNA, 23 nt, Human
ugagccaggagaauggcgugaac

SEQ ID NO: 414230 - RNA, 24 nt, Human
ugagccaggagaauggcgugaacc

SEQ ID NO: 414231 - RNA, 22 nt, Human
ugagccgagauugcaccacugc

SEQ ID NO: 414232 - RNA, 20 nt, Human
ugauuaucuuucacucaucc

SEQ ID NO: 414233 - RNA, 21 nt, Human
ugcaccacugcacuccagccu

SEQ ID NO: 414234 - RNA, 23 nt, Human
ugccuguagucccagcuacuugg

SEQ ID NO: 414235 - RNA, 24 nt, Human
ugccuguagucccagcuacuuggg

SEQ ID NO: 414236 - RNA, 24 nt, Human
uggcgggugccuguagucccagcu

SEQ ID NO: 414237 - RNA, 21 nt, Human
uggcucacaccuguaauccca

SEQ ID NO: 414238 - RNA, 22 nt, Human
uggcucacaccuguaaucccag

SEQ ID NO: 414239 - RNA, 24 nt, Human
uggcucacaccuguaaucccagca

SEQ ID NO: 414240 - RNA, 19 nt, Human
ugggaggccgagacgggug

SEQ ID NO: 414241 - RNA, 24 nt, Human
ugggcccaggcgugguggcucaca

SEQ ID NO: 414242 - RNA, 24 nt, Human
ugguggcucacaccuguaauccca

SEQ ID NO: 414243 - RNA, 23 nt, Human
uugcaccacugcacuccagccug

SEQ ID NO: 414244 - RNA, 18 nt, Human
uugcagugagccgagauu

SEQ ID NO: 414245 - RNA, 19 nt, Human
uugcagugagccgagauug

SEQ ID NO: 414246 - RNA, 22 nt, Human
uugcagugagccgagauugcac

SEQ ID NO: 414247 - RNA, 21 nt, Human
caacacugcaggguacaguaa

SEQ ID NO: 414248 - RNA, 24 nt, Human
cauaguaaaguaccuuuuagugcc

SEQ ID NO: 414249 - RNA, 18 nt, Human
cuuagacuaaaagcauac

SEQ ID NO: 414250 - RNA, 19 nt, Human
gcuuuuuuuuuuuuuuucu

SEQ ID NO: 414251 - RNA, 23 nt, Human
ggcuuaguaaaauacuccggcuu

SEQ ID NO: 414252 - RNA, 18 nt, Human
uaacuaacuuugggaucu

SEQ ID NO: 414253 - RNA, 21 nt, Human
ugccuaaauccuagagaacau

SEQ ID NO: 414254 - RNA, 18 nt, Human
ugggaucucuucaaagaa

SEQ ID NO: 414255 - RNA, 23 nt, Human
uguaagaaacuagcccauuauuu

SEQ ID NO: 414256 - RNA, 21 nt, Human
uuagacuaaaagcauacugca

SEQ ID NO: 414257 - RNA, 24 nt, Human
uucaaagaaggaaaguauugcacc

SEQ ID NO: 414258 - RNA, 20 nt, Human
uuuuaaaaaucaacacugca

SEQ ID NO: 414259 - RNA, 21 nt, Human
uuuuuuuuuucuagaggaguc

SEQ ID NO: 414260 - RNA, 22 nt, Human
uuuuuuuuuuuuuuucuagagg

SEQ ID NO: 414261 - RNA, 19 nt, Human
aaaaauggcacaugucauc

SEQ ID NO: 414262 - RNA, 23 nt, Human
aaauacaccacccaccaauuuca

SEQ ID NO: 414263 - RNA, 18 nt, Human
aagcacucuggggcugau

SEQ ID NO: 414264 - RNA, 24 nt, Human
aagcaggacagagaugaggacuga

SEQ ID NO: 414265 - RNA, 23 nt, Human
acaaagcuucccuucuuuaaaca

SEQ ID NO: 414266 - RNA, 21 nt, Human
accuuauuucccacccacuuc

SEQ ID NO: 414267 - RNA, 18 nt, Human
caaagacaccggaggggg

SEQ ID NO: 414268 - RNA, 25 nt, Human
cacucccaaacaggccauguuucag

SEQ ID NO: 414269 - RNA, 23 nt, Human
cagcuccauuugacauaagcaau

SEQ ID NO: 414270 - RNA, 24 nt, Human
cagcuccauuugacauaagcaaug

SEQ ID NO: 414271 - RNA, 20 nt, Human
cauaugcuguucucagugca

SEQ ID NO: 414272 - RNA, 20 nt, Human
ccagccugucugcacguccu

SEQ ID NO: 414273 - RNA, 18 nt, Human
cccaaagcaagaaaucau

SEQ ID NO: 414274 - RNA, 24 nt, Human
ccuaugaagcaggacagagaugag

SEQ ID NO: 414275 - RNA, 19 nt, Human
cugcagaagccaaaagaua

SEQ ID NO: 414276 - RNA, 22 nt, Human
cuucucaaauacaccacccacc

SEQ ID NO: 414277 - RNA, 20 nt, Human
gcagaagccaaaagauaaga

SEQ ID NO: 414278 - RNA, 23 nt, Human
gcagcggugggaccaccuuugaa

SEQ ID NO: 414279 - RNA, 23 nt, Human
uaaacacacaagguggcaccuau

SEQ ID NO: 414280 - RNA, 23 nt, Human
uaauuuaugcaaaguauuuccuu

SEQ ID NO: 414281 - RNA, 23 nt, Human
uaugcuguucucagugcacucca

SEQ ID NO: 414282 - RNA, 21 nt, Human
uauuuuggguuuuuaucaaau

SEQ ID NO: 414283 - RNA, 24 nt, Human
ucaaagacaccggagggggcacga

SEQ ID NO: 414284 - RNA, 21 nt, Human
ucauccugaucaaagacaccg

SEQ ID NO: 414285 - RNA, 23 nt, Human
uggguuuuuaucaaauucagcuc

SEQ ID NO: 414286 - RNA, 24 nt, Human
uuaauuuaugcaaaguauuuccuu

SEQ ID NO: 414287 - RNA, 19 nt, Human
uuggaaaugacuagggaau

SEQ ID NO: 414288 - RNA, 19 nt, Human
aaaaauggcacaugucauc

SEQ ID NO: 414289 - RNA, 23 nt, Human
aaauacaccacccaccaauuuca

SEQ ID NO: 414290 - RNA, 18 nt, Human
aagcacucuggggcugau

SEQ ID NO: 414291 - RNA, 24 nt, Human
aagcaggacagagaugaggacuga

SEQ ID NO: 414292 - RNA, 23 nt, Human
acaaagcuucccuucuuuaaaca

SEQ ID NO: 414293 - RNA, 18 nt, Human
caaagacaccggaggggg

SEQ ID NO: 414294 - RNA, 25 nt, Human
cacucccaaacaggccauguuucag

SEQ ID NO: 414295 - RNA, 23 nt, Human
cagcuccauuugacauaagcaau

SEQ ID NO: 414296 - RNA, 24 nt, Human
cagcuccauuugacauaagcaaug

SEQ ID NO: 414297 - RNA, 20 nt, Human
cauaugcuguucucagugca

SEQ ID NO: 414298 - RNA, 20 nt, Human
cauccugaucaaagacaccg

SEQ ID NO: 414299 - RNA, 20 nt, Human
ccagccugucugcacguccu

SEQ ID NO: 414300 - RNA, 18 nt, Human
cccaaagcaagaaaucau

SEQ ID NO: 414301 - RNA, 24 nt, Human
ccuaugaagcaggacagagaugag

SEQ ID NO: 414302 - RNA, 19 nt, Human
cugcagaagccaaaagaua

SEQ ID NO: 414303 - RNA, 23 nt, Human
gcagcggugggaccaccuuugaa

SEQ ID NO: 414304 - RNA, 23 nt, Human
uaaacacacaagguggcaccuau

SEQ ID NO: 414305 - RNA, 23 nt, Human
uaauuuaugcaaaguauuuccuu

SEQ ID NO: 414306 - RNA, 22 nt, Human
uaccuuauuucccacccacuuc

SEQ ID NO: 414307 - RNA, 23 nt, Human
uaugcuguucucagugcacucca

SEQ ID NO: 414308 - RNA, 21 nt, Human
uauuuuggguuuuuaucaaau

SEQ ID NO: 414309 - RNA, 24 nt, Human
ucaaagacaccggagggggcacga

SEQ ID NO: 414310 - RNA, 23 nt, Human
ucugcagaagccaaaagauaaga

SEQ ID NO: 414311 - RNA, 23 nt, Human
uggguuuuuaucaaauucagcuc

SEQ ID NO: 414312 - RNA, 24 nt, Human
uuaauuuaugcaaaguauuuccuu

SEQ ID NO: 414313 - RNA, 21 nt, Human
uucucaaauacaccacccacc

SEQ ID NO: 414314 - RNA, 19 nt, Human
uuggaaaugacuagggaau

SEQ ID NO: 414315 - RNA, 21 nt, Human
uuuaucaaauucagcuccauu

SEQ ID NO: 414316 - RNA, 19 nt, Human
aaaaauggcacaugucauc

SEQ ID NO: 414317 - RNA, 23 nt, Human
aaauacaccacccaccaauuuca

SEQ ID NO: 414318 - RNA, 18 nt, Human
aagcacucuggggcugau

SEQ ID NO: 414319 - RNA, 24 nt, Human
aagcaggacagagaugaggacuga

SEQ ID NO: 414320 - RNA, 23 nt, Human
acaaagcuucccuucuuuaaaca

SEQ ID NO: 414321 - RNA, 18 nt, Human
caaagacaccggaggggg

SEQ ID NO: 414322 - RNA, 25 nt, Human
cacucccaaacaggccauguuucag

SEQ ID NO: 414323 - RNA, 23 nt, Human
cagcuccauuugacauaagcaau

SEQ ID NO: 414324 - RNA, 24 nt, Human
cagcuccauuugacauaagcaaug

SEQ ID NO: 414325 - RNA, 20 nt, Human
cauaugcuguucucagugca

SEQ ID NO: 414326 - RNA, 20 nt, Human
ccagccugucugcacguccu

SEQ ID NO: 414327 - RNA, 18 nt, Human
cccaaagcaagaaaucau

SEQ ID NO: 414328 - RNA, 24 nt, Human
ccuaugaagcaggacagagaugag

SEQ ID NO: 414329 - RNA, 27 nt, Human
ccuaugaagcaggacagagaugaggac

SEQ ID NO: 414330 - RNA, 19 nt, Human
cugcagaagccaaaagaua

SEQ ID NO: 414331 - RNA, 22 nt, Human
cuucucaaauacaccacccacc

SEQ ID NO: 414332 - RNA, 23 nt, Human
gcagcggugggaccaccuuugaa

SEQ ID NO: 414333 - RNA, 23 nt, Human
uaaacacacaagguggcaccuau

SEQ ID NO: 414334 - RNA, 23 nt, Human
uaauuuaugcaaaguauuuccuu

SEQ ID NO: 414335 - RNA, 22 nt, Human
uaccuuauuucccacccacuuc

SEQ ID NO: 414336 - RNA, 23 nt, Human
uaugcuguucucagugcacucca

SEQ ID NO: 414337 - RNA, 21 nt, Human
uauuuuggguuuuuaucaaau

SEQ ID NO: 414338 - RNA, 24 nt, Human
ucaaagacaccggagggggcacga

SEQ ID NO: 414339 - RNA, 21 nt, Human
ucauccugaucaaagacaccg

SEQ ID NO: 414340 - RNA, 23 nt, Human
ucugcagaagccaaaagauaaga

SEQ ID NO: 414341 - RNA, 23 nt, Human
uggguuuuuaucaaauucagcuc

SEQ ID NO: 414342 - RNA, 24 nt, Human
uuaauuuaugcaaaguauuuccuu

SEQ ID NO: 414343 - RNA, 19 nt, Human
uuggaaaugacuagggaau

SEQ ID NO: 414344 - RNA, 21 nt, Human
uuuaucaaauucagcuccauu

SEQ ID NO: 414345 - RNA, 20 nt, Human
caggauuuugccaaacuuaa

SEQ ID NO: 414346 - RNA, 20 nt, Human
uugaugcagaagauuugaug

SEQ ID NO: 414347 - RNA, 22 nt, Human
cuugcauaacaaucuuuucuuu

SEQ ID NO: 414348 - RNA, 21 nt, Human
ucuugcuggaauaaacugaag

SEQ ID NO: 414349 - RNA, 23 nt, Human
uguccuaucuaucugguuuucca

SEQ ID NO: 414350 - RNA, 23 nt, Human
uuuuuuuuuuuuuugucacagga

SEQ ID NO: 414351 - RNA, 24 nt, Human
uuuuuuuuuuuuuuuugucacagg

SEQ ID NO: 414352 - RNA, 19 nt, Human
uuuuuuuuuuuuuuuuugu

SEQ ID NO: 414353 - RNA, 20 nt, Human
uuuuuuuuuuuuuuuuuugg

SEQ ID NO: 414354 - RNA, 22 nt, Human
acaggaaaaaggaaauccucca

SEQ ID NO: 414355 - RNA, 18 nt, Human
acccuccaugcugaaaua

SEQ ID NO: 414356 - RNA, 21 nt, Human
aggaaaaaggaaauccuccau

SEQ ID NO: 414357 - RNA, 24 nt, Human
aggaaauccuccauuuaaaacccu

SEQ ID NO: 414358 - RNA, 21 nt, Human
aggaggagucccaucuuucag

SEQ ID NO: 414359 - RNA, 23 nt, Human
cauccaguaacucgucauuuaac

SEQ ID NO: 414360 - RNA, 18 nt, Human
ccccccauuguauuuuuc

SEQ ID NO: 414361 - RNA, 23 nt, Human
cccuccaugcugaaauaaaggag

SEQ ID NO: 414362 - RNA, 22 nt, Human
ccuccauuuaaaacccuccaug

SEQ ID NO: 414363 - RNA, 24 nt, Human
cuccaaaugcuauccuucccccca

SEQ ID NO: 414364 - RNA, 21 nt, Human
gaguuguauuuuuuuuuuuuu

SEQ ID NO: 414365 - RNA, 25 nt, Human
gcugaaauaaaggaggagucccagu

SEQ ID NO: 414366 - RNA, 26 nt, Human
guauuuuuuuuuuuuugcuuuuuuua

SEQ ID NO: 414367 - RNA, 18 nt, Human
uaaguugugaaaagaugu

SEQ ID NO: 414368 - RNA, 21 nt, Human
uauuuuuuuuuuuuugcuuuu

SEQ ID NO: 414369 - RNA, 18 nt, Human
uccaugcugaaauaaagg

SEQ ID NO: 414370 - RNA, 23 nt, Human
ucuccaaaugcuauccuuccccc

SEQ ID NO: 414371 - RNA, 19 nt, Human
ugcagguuagcuacauaug

SEQ ID NO: 414372 - RNA, 18 nt, Human
uggaugacacuuuauuuu

SEQ ID NO: 414373 - RNA, 25 nt, Human
uuucagucauuccacuucaggcuuu

SEQ ID NO: 414374 - RNA, 23 nt, Human
uuucauagcuuaaaaaucauuga

SEQ ID NO: 414375 - RNA, 22 nt, Human
cuugcauaacaaucuuuucuuu

SEQ ID NO: 414376 - RNA, 25 nt, Human
gcuggaauaaacugaugucaaccca

SEQ ID NO: 414377 - RNA, 21 nt, Human
uaccugggugguaaaucucug

SEQ ID NO: 414378 - RNA, 20 nt, Human
ugccacagaauauuucuaac

SEQ ID NO: 414379 - RNA, 30 nt, Human
uucauugccacagaauauuucuaaccauuu

SEQ ID NO: 414380 - RNA, 29 nt, Human
uucuucauugccacagaauauuucuaacu

SEQ ID NO: 414381 - RNA, 18 nt, Human
uuuuuuuuuuuuuuuuug

SEQ ID NO: 414382 - RNA, 24 nt, Human
uuuuuuuuuuuuuuuuuuggcuuu

SEQ ID NO: 414383 - RNA, 22 nt, Human
uuuuuuuuuuuuuuuuuuuggc

SEQ ID NO: 414384 - RNA, 18 nt, Human
acaacacaauccugcaug

SEQ ID NO: 414385 - RNA, 23 nt, Human
caacaacaguuaaaacaacacaa

SEQ ID NO: 414386 - RNA, 24 nt, Human
caauccugcaugaaauggauccaa

SEQ ID NO: 414387 - RNA, 21 nt, Human
cacaauccugcaugaaaugga

SEQ ID NO: 414388 - RNA, 18 nt, Human
cccuaauguuuuccuccu

SEQ ID NO: 414389 - RNA, 22 nt, Human
cucaacaacaguuaaaacaaca

SEQ ID NO: 414390 - RNA, 21 nt, Human
gauacugucaguggacuucuu

SEQ ID NO: 414391 - RNA, 20 nt, Human
ggaacaauaaauuucaauau

SEQ ID NO: 414392 - RNA, 19 nt, Human
uaaaacaacacaauccugc

SEQ ID NO: 414393 - RNA, 24 nt, Human
uaaaacaacacaauccugcaugaa

SEQ ID NO: 414394 - RNA, 25 nt, Human
uaguaaauuuuuuuucauguaaccu

SEQ ID NO: 414395 - RNA, 27 nt, Human
ucaguggacuucuuaauguucuuguuu

SEQ ID NO: 414396 - RNA, 18 nt, Human
uccauguacaauguguga

SEQ ID NO: 414397 - RNA, 19 nt, Human
ucccagcuuccagccucag

SEQ ID NO: 414398 - RNA, 21 nt, Human
ucccuaauguuuuccuccuug

SEQ ID NO: 414399 - RNA, 19 nt, Human
ugaaauggauccaaaguau

SEQ ID NO: 414400 - RNA, 22 nt, Human
ugaaauggauccaaaguaugcu

SEQ ID NO: 414401 - RNA, 24 nt, Human
ugaaauggauccaaaguaugcuga

SEQ ID NO: 414402 - RNA, 18 nt, Human
ugaugcaaugcaaugcuu

SEQ ID NO: 414403 - RNA, 19 nt, Human
ugcugaguauuugcaaaac

SEQ ID NO: 414404 - RNA, 24 nt, Human
uguuuucccuaauguuuuccuccu

SEQ ID NO: 414405 - RNA, 21 nt, Human
uguuuugucacaagaagaaag

SEQ ID NO: 414406 - RNA, 24 nt, Human
uucccuaauguuuuccuccuugac

SEQ ID NO: 414407 - RNA, 24 nt, Human
uuguaauaaacuaaaggaguucau

SEQ ID NO: 414408 - RNA, 21 nt, Human
uuuaauuauuuauuagcuucc

SEQ ID NO: 414409 - RNA, 24 nt, Human
uuuaauuauuuauuagcuuccuca

SEQ ID NO: 414410 - RNA, 18 nt, Human
uuuauuggguuucccagc

SEQ ID NO: 414411 - RNA, 18 nt, Human
uuuccauguacaaugugu

SEQ ID NO: 414412 - RNA, 22 nt, Human
uuuguuuucccuaauguuuucc

SEQ ID NO: 414413 - RNA, 25 nt, Human
uuuuucauguaaccugugaauugga

SEQ ID NO: 414414 - RNA, 23 nt, Human
cacaaucuuucuugcuggaauaa

SEQ ID NO: 414415 - RNA, 25 nt, Human
caucacaaucuuucuugcuggaaua

SEQ ID NO: 414416 - RNA, 22 nt, Human
cauugccacaaaauauuucuaa

SEQ ID NO: 414417 - RNA, 19 nt, Human
cguaguguuuucuucauug

SEQ ID NO: 414418 - RNA, 25 nt, Human
guaguguuuucuucauugccacaaa

SEQ ID NO: 414419 - RNA, 26 nt, Human
guaguguuuucuucauugccacaaaa

SEQ ID NO: 414420 - RNA, 21 nt, Human
ucuugcuggaauaaacugaag

SEQ ID NO: 414421 - RNA, 23 nt, Human
ucuuuuuuuuuuuuuugucucag

SEQ ID NO: 414422 - RNA, 22 nt, Human
ugaacugggugguaaaucucug

SEQ ID NO: 414423 - RNA, 22 nt, Human
ugucucaggaagaaagaaaucu

SEQ ID NO: 414424 - RNA, 29 nt, Human
uucuucauugccacaaaauauuucuaacu

SEQ ID NO: 414425 - RNA, 24 nt, Human
uugccacaaaauauuucuaaccau

SEQ ID NO: 414426 - RNA, 20 nt, Human
uuucuuuuuuuuuuuuuugu

SEQ ID NO: 414427 - RNA, 24 nt, Human
uuucuuuuuuuuuuuuuugucuca

SEQ ID NO: 414428 - RNA, 27 nt, Human
uuuuuuuucuuuuuuuuuuuuuugggg

SEQ ID NO: 414429 - RNA, 21 nt, Human
uuuuuuuuuuuuuugucucag

SEQ ID NO: 414430 - RNA, 22 nt, Human
uuuuuuuuuuuuuugucucagg

SEQ ID NO: 414431 - RNA, 23 nt, Human
aaccugucacucuaaaggacucu

SEQ ID NO: 414432 - RNA, 25 nt, Human
aagaaagagaucaucauucaaagaa

SEQ ID NO: 414433 - RNA, 20 nt, Human
acacggaaagaauccccaga

SEQ ID NO: 414434 - RNA, 25 nt, Human
acagaacaauaaauuacuaaaggaa

SEQ ID NO: 414435 - RNA, 22 nt, Human
agacuugauggaaggagagccu

SEQ ID NO: 414436 - RNA, 22 nt, Human
agcuauuggguccaugauguca

SEQ ID NO: 414437 - RNA, 22 nt, Human
auuugcaagaaagagaucauca

SEQ ID NO: 414438 - RNA, 23 nt, Human
caaacaaaaagagaagaaagaaa

SEQ ID NO: 414439 - RNA, 21 nt, Human
caaagaaguacuugauuuucc

SEQ ID NO: 414440 - RNA, 22 nt, Human
caccaagagaaaauugcauaau

SEQ ID NO: 414441 - RNA, 23 nt, Human
caccaagagaaaauugcauaaua

SEQ ID NO: 414442 - RNA, 21 nt, Human
caggagccuuuugguaucagc

SEQ ID NO: 414443 - RNA, 22 nt, Human
caucauucaaagaaguacuuga

SEQ ID NO: 414444 - RNA, 24 nt, Human
cauuugcaagaaagagaucaucau

SEQ ID NO: 414445 - RNA, 22 nt, Human
cuggaggccacuggacauacac

SEQ ID NO: 414446 - RNA, 20 nt, Human
gaagaugaaucaccucaagg

SEQ ID NO: 414447 - RNA, 19 nt, Human
gauuuuccaaacaaaaaga

SEQ ID NO: 414448 - RNA, 23 nt, Human
gcagugaaugagcuauugggucc

SEQ ID NO: 414449 - RNA, 23 nt, Human
uaaaggaaacaaucauuaauaua

SEQ ID NO: 414450 - RNA, 18 nt, Human
uacaccguaggucguggg

SEQ ID NO: 414451 - RNA, 27 nt, Human
uacagaacaauaaauuacuaaaggaaa

SEQ ID NO: 414452 - RNA, 22 nt, Human
uaggucgugggcagcuggccag

SEQ ID NO: 414453 - RNA, 18 nt, Human
ucaaagaaguacuugauu

SEQ ID NO: 414454 - RNA, 19 nt, Human
ucaaggcagugaaugagcu

SEQ ID NO: 414455 - RNA, 24 nt, Human
ugggaaauagaacucuuuauuuaa

SEQ ID NO: 414456 - RNA, 25 nt, Human
uuaaaaauucucuuucaggacacgg

SEQ ID NO: 414457 - RNA, 26 nt, Human
uucaggacacggaaagaauccccaga

SEQ ID NO: 414458 - RNA, 21 nt, Human
uuuuuuuuuuuuuuuuuuggg

SEQ ID NO: 414459 - RNA, 18 nt, Human
aaaagaaggcaggcugaa

SEQ ID NO: 414460 - RNA, 26 nt, Human
aaaagaaggcaggcugaacaaagcau

SEQ ID NO: 414461 - RNA, 19 nt, Human
aaaagcagcauuuaaagac

SEQ ID NO: 414462 - RNA, 18 nt, Human
aaagacacaggcuguuuc

SEQ ID NO: 414463 - RNA, 18 nt, Human
aaggagaugggggccuca

SEQ ID NO: 414464 - RNA, 19 nt, Human
acagggcuuuccgcuguca

SEQ ID NO: 414465 - RNA, 24 nt, Human
accgucacaagucccauuuugaga

SEQ ID NO: 414466 - RNA, 20 nt, Human
agccauggagcacagggcuu

SEQ ID NO: 414467 - RNA, 23 nt, Human
agggagaaaagaaggcaggcuga

SEQ ID NO: 414468 - RNA, 19 nt, Human
auggagcacagggcuuucc

SEQ ID NO: 414469 - RNA, 19 nt, Human
caggcugaacaaagcauga

SEQ ID NO: 414470 - RNA, 18 nt, Human
cccgcaucaugcccccug

SEQ ID NO: 414471 - RNA, 21 nt, Human
cgcaucaugcccccugcccag

SEQ ID NO: 414472 - RNA, 24 nt, Human
cuuucugcucuucccgcuacuuca

SEQ ID NO: 414473 - RNA, 24 nt, Human
cuuuucuguggcuggagcacuggc

SEQ ID NO: 414474 - RNA, 22 nt, Human
uagauagcaccugcccaaagga

SEQ ID NO: 414475 - RNA, 21 nt, Human
ucugucucugaugucuggugu

SEQ ID NO: 414476 - RNA, 19 nt, Human
ucuguggcuggagcacugg

SEQ ID NO: 414477 - RNA, 18 nt, Human
ugaauuuuucucucuguc

SEQ ID NO: 414478 - RNA, 23 nt, Human
uggcagccauggagcacagggcu

SEQ ID NO: 414479 - RNA, 21 nt, Human
uuucuguggcuggagcacugg

SEQ ID NO: 414480 - RNA, 21 nt, Human
aaaagaaaaaaaaaaucaaag

SEQ ID NO: 414481 - RNA, 21 nt, Human
aaagaaaaaaaaaaucaaagg

SEQ ID NO: 414482 - RNA, 18 nt, Human
agcagugccuccugaccc

SEQ ID NO: 414483 - RNA, 20 nt, Human
agcucagggucaaguucugu

SEQ ID NO: 414484 - RNA, 26 nt, Human
auuuaagcucagggucaaguucuguu

SEQ ID NO: 414485 - RNA, 20 nt, Human
cacgcuccccgcccgcgccc

SEQ ID NO: 414486 - RNA, 19 nt, Human
cagaugagcagugccuccu

SEQ ID NO: 414487 - RNA, 24 nt, Human
cagaugagcagugccuccugaccc

SEQ ID NO: 414488 - RNA, 23 nt, Human
cagccgccgcugggcgcugccgg

SEQ ID NO: 414489 - RNA, 24 nt, Human
ccaguaguaguuggcacaguuuuu

SEQ ID NO: 414490 - RNA, 22 nt, Human
ccgcgcccgcgucggacucccc

SEQ ID NO: 414491 - RNA, 23 nt, Human
ccggugacggggcuggguuuccc

SEQ ID NO: 414492 - RNA, 19 nt, Human
ccuccugaccccuccucug

SEQ ID NO: 414493 - RNA, 20 nt, Human
ccugaccccuccucugucuc

SEQ ID NO: 414494 - RNA, 21 nt, Human
cgcacgcuccccgcccgcgcc

SEQ ID NO: 414495 - RNA, 20 nt, Human
cgccccuccucccgcugccu

SEQ ID NO: 414496 - RNA, 23 nt, Human
cgcccgcgucggacucccuccgc

SEQ ID NO: 414497 - RNA, 21 nt, Human
cgccgcugggcgcugccgggg

SEQ ID NO: 414498 - RNA, 22 nt, Human
cgcucggagcccggugacgggg

SEQ ID NO: 414499 - RNA, 18 nt, Human
cuccccgcccgcgcccgc

SEQ ID NO: 414500 - RNA, 22 nt, Human
cuuuccgcagccgccgcugggc

SEQ ID NO: 414501 - RNA, 21 nt, Human
gagcagugccuccugaccccu

SEQ ID NO: 414502 - RNA, 18 nt, Human
gcccggugacggggcugg

SEQ ID NO: 414503 - RNA, 22 nt, Human
guacaaaaagaaaaaaaaaauc

SEQ ID NO: 414504 - RNA, 18 nt, Human
guuauuuaagcucagggu

SEQ ID NO: 414505 - RNA, 21 nt, Human
uacagaugagcagugccuccc

SEQ ID NO: 414506 - RNA, 20 nt, Human
uccaaaguacaaaaagaaaa

SEQ ID NO: 414507 - RNA, 24 nt, Human
uccaaaguacaaaaagaaaaaaaa

SEQ ID NO: 414508 - RNA, 25 nt, Human
uccaaaguacaaaaagaaaaaaaaa

SEQ ID NO: 414509 - RNA, 28 nt, Human
uccaaaguacaaaaagaaaaaaaaaauc

SEQ ID NO: 414510 - RNA, 20 nt, Human
uccgcagccgccgcugggcg

SEQ ID NO: 414511 - RNA, 22 nt, Human
uccucugucucuuggagauagg

SEQ ID NO: 414512 - RNA, 18 nt, Human
ugaccccuccucugucuc

SEQ ID NO: 414513 - RNA, 18 nt, Human
ugccggggcugaggccgc

SEQ ID NO: 414514 - RNA, 19 nt, Human
uuugucguuccaaaguaca

SEQ ID NO: 414515 - RNA, 21 nt, Human
aaagaccaugagaacuccaga

SEQ ID NO: 414516 - RNA, 24 nt, Human
aacagagugagauccugucucgaa

SEQ ID NO: 414517 - RNA, 20 nt, Human
aacauggcaagaccucaucu

SEQ ID NO: 414518 - RNA, 24 nt, Human
aagcugaggugggaggaucaccug

SEQ ID NO: 414519 - RNA, 24 nt, Human
acagagugagauccugucucgaaa

SEQ ID NO: 414520 - RNA, 18 nt, Human
accagcuaaucuggaagc

SEQ ID NO: 414521 - RNA, 20 nt, Human
acccauucuuacacaggccc

SEQ ID NO: 414522 - RNA, 24 nt, Human
accugggaggucgaggcugcaaug

SEQ ID NO: 414523 - RNA, 18 nt, Human
acugcacuccauccuggg

SEQ ID NO: 414524 - RNA, 24 nt, Human
acugcacuccauccugggcaacag

SEQ ID NO: 414525 - RNA, 23 nt, Human
acuuugagagacugaggcaggag

SEQ ID NO: 414526 - RNA, 24 nt, Human
agaaugaacuuauuauaguaucaa

SEQ ID NO: 414527 - RNA, 24 nt, Human
agacugaggcaggaggaucgcuug

SEQ ID NO: 414528 - RNA, 23 nt, Human
agccuggguaacauggcaagacc

SEQ ID NO: 414529 - RNA, 24 nt, Human
agccuggguaacauggcaagaccu

SEQ ID NO: 414530 - RNA, 22 nt, Human
aggaaggauccucaaaugugga

SEQ ID NO: 414531 - RNA, 23 nt, Human
aggcaggaggaucgcuugagccc

SEQ ID NO: 414532 - RNA, 24 nt, Human
aggcaggaggaucgcuugagccca

SEQ ID NO: 414533 - RNA, 22 nt, Human
aggucgaggcugcaaugagccg

SEQ ID NO: 414534 - RNA, 18 nt, Human
aggugggaggaucaccug

SEQ ID NO: 414535 - RNA, 24 nt, Human
aggugggaggaucaccugggaggu

SEQ ID NO: 414536 - RNA, 24 nt, Human
aguggcucacaccuguaaucccag

SEQ ID NO: 414537 - RNA, 21 nt, Human
caaacaccagucucaaaaaaa

SEQ ID NO: 414538 - RNA, 21 nt, Human
caaauguggaagacccuaacc

SEQ ID NO: 414539 - RNA, 22 nt, Human
caacagagugagauccugucuc

SEQ ID NO: 414540 - RNA, 24 nt, Human
cacaccuguaaucccagcacuuug

SEQ ID NO: 414541 - RNA, 24 nt, Human
caccacugcacuccauccugggca

SEQ ID NO: 414542 - RNA, 18 nt, Human
caccuguaaucccagcac

SEQ ID NO: 414543 - RNA, 19 nt, Human
caccuguaaucccagcacu

SEQ ID NO: 414544 - RNA, 22 nt, Human
cacuccauccugggcaacagag

SEQ ID NO: 414545 - RNA, 23 nt, Human
cacuccauccugggcaacagagu

SEQ ID NO: 414546 - RNA, 23 nt, Human
cacugcacuccauccugggcaac

SEQ ID NO: 414547 - RNA, 24 nt, Human
cacugcacuccauccugggcaaca

SEQ ID NO: 414548 - RNA, 24 nt, Human
cagcacuuugagagacugaggcag

SEQ ID NO: 414549 - RNA, 25 nt, Human
cauggcaagaccucaucucuacaaa

SEQ ID NO: 414550 - RNA, 21 nt, Human
ccacugcacuccauccugggc

SEQ ID NO: 414551 - RNA, 23 nt, Human
ccacugcacuccauccugggcaa

SEQ ID NO: 414552 - RNA, 24 nt, Human
ccacugcacuccauccugggcaac

SEQ ID NO: 414553 - RNA, 24 nt, Human
ccuggguaacauggcaagaccuca

SEQ ID NO: 414554 - RNA, 18 nt, Human
cgcccgcgaagucccgcc

SEQ ID NO: 414555 - RNA, 22 nt, Human
cucacaccuguaaucccagcac

SEQ ID NO: 414556 - RNA, 24 nt, Human
cucacaccuguaaucccagcacuu

SEQ ID NO: 414557 - RNA, 23 nt, Human
cuuucaggaggaccacauaucuu

SEQ ID NO: 414558 - RNA, 22 nt, Human
gaagucccgccucucccugccu

SEQ ID NO: 414559 - RNA, 18 nt, Human
gacgugguggugcaugcc

SEQ ID NO: 414560 - RNA, 24 nt, Human
gaucgcuugagcccaggaguugag

SEQ ID NO: 414561 - RNA, 20 nt, Human
gcugggcacaguggcucaca

SEQ ID NO: 414562 - RNA, 20 nt, Human
ggaguugagaccagccuggg

SEQ ID NO: 414563 - RNA, 23 nt, Human
ggcacaguggcucacaccuguaa

SEQ ID NO: 414564 - RNA, 18 nt, Human
ggcugucuaacaaacacc

SEQ ID NO: 414565 - RNA, 21 nt, Human
ggugcaugccuauagcaccag

SEQ ID NO: 414566 - RNA, 23 nt, Human
ggugcaugccuauagcaccagcu

SEQ ID NO: 414567 - RNA, 21 nt, Human
gugcaugccuauagcaccagc

SEQ ID NO: 414568 - RNA, 22 nt, Human
uaagaaugaacuuauuauagua

SEQ ID NO: 414569 - RNA, 24 nt, Human
uacacaggcccuguggaagaaucc

SEQ ID NO: 414570 - RNA, 19 nt, Human
uauagcaccagcuaaucug

SEQ ID NO: 414571 - RNA, 18 nt, Human
ucaggaggaccacauauc

SEQ ID NO: 414572 - RNA, 19 nt, Human
ucccaggcgccccggcguc

SEQ ID NO: 414573 - RNA, 22 nt, Human
ucccaggcgccccggcguccgg

SEQ ID NO: 414574 - RNA, 20 nt, Human
uccucaaauguggaagaccc

SEQ ID NO: 414575 - RNA, 19 nt, Human
ucgcccgcgaagucccgcc

SEQ ID NO: 414576 - RNA, 20 nt, Human
ucgcuugagcccaggaguug

SEQ ID NO: 414577 - RNA, 20 nt, Human
ucugaaaaauguaucugaag

SEQ ID NO: 414578 - RNA, 22 nt, Human
ugagcccaggaguugagaccag

SEQ ID NO: 414579 - RNA, 24 nt, Human
ugaggcaggaggaucgcuugagcc

SEQ ID NO: 414580 - RNA, 25 nt, Human
ugaggcaggaggaucgcuugagccc

SEQ ID NO: 414581 - RNA, 20 nt, Human
ugaggugggaggaucaccug

SEQ ID NO: 414582 - RNA, 26 nt, Human
ugaggugggaggaucaccugggaggu

SEQ ID NO: 414583 - RNA, 28 nt, Human
ugaggugggaggaucaccugggaggucg

SEQ ID NO: 414584 - RNA, 22 nt, Human
ugcaaugagccgugaucucacc

SEQ ID NO: 414585 - RNA, 25 nt, Human
ugcacuccauccugggcaacagagu

SEQ ID NO: 414586 - RNA, 21 nt, Human
uggaagacccuaacccagaca

SEQ ID NO: 414587 - RNA, 21 nt, Human
uggcucacaccuguaauccca

SEQ ID NO: 414588 - RNA, 24 nt, Human
uggcucacaccuguaaucccagca

SEQ ID NO: 414589 - RNA, 21 nt, Human
ugggcaacagagugagauccu

SEQ ID NO: 414590 - RNA, 24 nt, Human
uuagauggacgugguggugcaugc

SEQ ID NO: 414591 - RNA, 24 nt, Human
uuaggcugggcacaguggcucaca

SEQ ID NO: 414592 - RNA, 20 nt, Human
uucaaacucccaggcgcccc

SEQ ID NO: 414593 - RNA, 20 nt, Human
uucaaugucuucacauugua

SEQ ID NO: 414594 - RNA, 19 nt, Human
uuuccuaaagaccaugaga

SEQ ID NO: 414595 - RNA, 21 nt, Human
aagcugucagacugggucuca

SEQ ID NO: 414596 - RNA, 21 nt, Human
accagguacccuuccucccaa

SEQ ID NO: 414597 - RNA, 21 nt, Human
accagguacccuuccucccaa

SEQ ID NO: 414598 - RNA, 23 nt, Human
acugcaggggcuucaggacuggg

SEQ ID NO: 414599 - RNA, 21 nt, Human
acugggguacagggacagcca

SEQ ID NO: 414600 - RNA, 18 nt, Human
agaacuggagccuccugg

SEQ ID NO: 414601 - RNA, 18 nt, Human
agaacuggagccuccugg

SEQ ID NO: 414602 - RNA, 22 nt, Human
agacguggaggcaaacagccuc

SEQ ID NO: 414603 - RNA, 22 nt, Human
agacguggaggcaaacagccuc

SEQ ID NO: 414604 - RNA, 19 nt, Human
agaggacuugggguugagg

SEQ ID NO: 414605 - RNA, 19 nt, Human
agaggacuugggguugagg

SEQ ID NO: 414606 - RNA, 22 nt, Human
agaggacuugggguugaggggu

SEQ ID NO: 414607 - RNA, 22 nt, Human
agaggacuugggguugaggggu

SEQ ID NO: 414608 - RNA, 23 nt, Human
agccguggggucagggugucccg

SEQ ID NO: 414609 - RNA, 21 nt, Human
agccuccuggggucagggcag

SEQ ID NO: 414610 - RNA, 21 nt, Human
agccuccuggggucagggcag

SEQ ID NO: 414611 - RNA, 22 nt, Human
agccugaaauauccccagccuc

SEQ ID NO: 414612 - RNA, 23 nt, Human
aggcaaacagccucccuacgacc

SEQ ID NO: 414613 - RNA, 23 nt, Human
aggcaaacagccucccuacgacc

SEQ ID NO: 414614 - RNA, 31 nt, Human
aggcccagccaggccgggcaaaggucaggaa

SEQ ID NO: 414615 - RNA, 24 nt, Human
agggcccagacucccuuggguggc

SEQ ID NO: 414616 - RNA, 24 nt, Human
agggcccagacucccuuggguggc

SEQ ID NO: 414617 - RNA, 18 nt, Human
auccccagccucuuucuc

SEQ ID NO: 414618 - RNA, 19 nt, Human
caagucccucucccucccc

SEQ ID NO: 414619 - RNA, 23 nt, Human
caagucccucucccucccgcagc

SEQ ID NO: 414620 - RNA, 22 nt, Human
cacagccuugauaggggaacac

SEQ ID NO: 414621 - RNA, 18 nt, Human
caccagguacccuuccuc

SEQ ID NO: 414622 - RNA, 18 nt, Human
caccagguacccuuccuc

SEQ ID NO: 414623 - RNA, 21 nt, Human
cagaccacagaagagccccag

SEQ ID NO: 414624 - RNA, 21 nt, Human
cagccaaacagccugaaauau

SEQ ID NO: 414625 - RNA, 25 nt, Human
cagccaaacagccugaaauaucccc

SEQ ID NO: 414626 - RNA, 24 nt, Human
caggguccggagcuccuggagaac

SEQ ID NO: 414627 - RNA, 24 nt, Human
caggguccggagcuccuggagaac

SEQ ID NO: 414628 - RNA, 22 nt, Human
ccagcuaaguuguccggaaguc

SEQ ID NO: 414629 - RNA, 22 nt, Human
ccagcuaaguuguccggaaguc

SEQ ID NO: 414630 - RNA, 21 nt, Human
ccaggguggggagaaauggga

SEQ ID NO: 414631 - RNA, 21 nt, Human
ccaugggcugcaaucucagcc

SEQ ID NO: 414632 - RNA, 21 nt, Human
ccaugggcugcaaucucagcc

SEQ ID NO: 414633 - RNA, 26 nt, Human
cccaagcagaggacuugggguugagg

SEQ ID NO: 414634 - RNA, 26 nt, Human
cccaagcagaggacuugggguugagg

SEQ ID NO: 414635 - RNA, 21 nt, Human
cccagcuaaguuguccggaag

SEQ ID NO: 414636 - RNA, 21 nt, Human
cccagcuaaguuguccggaag

SEQ ID NO: 414637 - RNA, 22 nt, Human
cccaggguggggagaaauggga

SEQ ID NO: 414638 - RNA, 22 nt, Human
ccccaggguggggagaaauggg

SEQ ID NO: 414639 - RNA, 25 nt, Human
ccccucauggggagggauggggcua

SEQ ID NO: 414640 - RNA, 26 nt, Human
ccccucauggggagggauggggcuag

SEQ ID NO: 414641 - RNA, 21 nt, Human
ccucccuacgaccccacccca

SEQ ID NO: 414642 - RNA, 21 nt, Human
ccucccuacgaccccacccca

SEQ ID NO: 414643 - RNA, 22 nt, Human
ccucucacaggccuuccuagac

SEQ ID NO: 414644 - RNA, 22 nt, Human
ccucucacaggccuuccuagac

SEQ ID NO: 414645 - RNA, 19 nt, Human
ccugcugcugccgccgcug

SEQ ID NO: 414646 - RNA, 20 nt, Human
ccugcugcugccgccgcugc

SEQ ID NO: 414647 - RNA, 18 nt, Human
ccuggggucagggcagcc

SEQ ID NO: 414648 - RNA, 18 nt, Human
ccuggggucagggcagcc

SEQ ID NO: 414649 - RNA, 21 nt, Human
ccuuaggcagugucuuggccc

SEQ ID NO: 414650 - RNA, 21 nt, Human
ccuuaggcagugucuuggccc

SEQ ID NO: 414651 - RNA, 23 nt, Human
cgccugcugcugccgccgcugcc

SEQ ID NO: 414652 - RNA, 19 nt, Human
cgggcaaaggucaggagcu

SEQ ID NO: 414653 - RNA, 22 nt, Human
cgggcaaaggucaggagcuuga

SEQ ID NO: 414654 - RNA, 21 nt, Human
cucgccugcugcugccgccgc

SEQ ID NO: 414655 - RNA, 19 nt, Human
cugacugcuccucucacag

SEQ ID NO: 414656 - RNA, 19 nt, Human
cugacugcuccucucacag

SEQ ID NO: 414657 - RNA, 19 nt, Human
cugccgccgcugccugcgc

SEQ ID NO: 414658 - RNA, 22 nt, Human
cuggggucagggcagccguggg

SEQ ID NO: 414659 - RNA, 22 nt, Human
cuggggucagggcagccguggg

SEQ ID NO: 414660 - RNA, 22 nt, Human
gaacuggagccuccugggguca

SEQ ID NO: 414661 - RNA, 21 nt, Human
gacguggaggcaaacagccuc

SEQ ID NO: 414662 - RNA, 21 nt, Human
gacguggaggcaaacagccuc

SEQ ID NO: 414663 - RNA, 19 nt, Human
gagcuccuggagaacuccc

SEQ ID NO: 414664 - RNA, 19 nt, Human
gagcuccuggagaacuccc

SEQ ID NO: 414665 - RNA, 20 nt, Human
gagcuugagucccgccacug

SEQ ID NO: 414666 - RNA, 20 nt, Human
gaggggugagcguuggggag

SEQ ID NO: 414667 - RNA, 20 nt, Human
gaggggugagcguuggggag

SEQ ID NO: 414668 - RNA, 19 nt, Human
gccguggggucaggguguc

SEQ ID NO: 414669 - RNA, 21 nt, Human
gccugaaauauccccagccuc

SEQ ID NO: 414670 - RNA, 21 nt, Human
gccugcugcugccgccgcugc

SEQ ID NO: 414671 - RNA, 19 nt, Human
gccuugauaggggaacacu

SEQ ID NO: 414672 - RNA, 19 nt, Human
gccuugauaggggaacacu

SEQ ID NO: 414673 - RNA, 22 nt, Human
gcugccgccgcugccugcgccg

SEQ ID NO: 414674 - RNA, 18 nt, Human
gcugcugccgccgcugcc

SEQ ID NO: 414675 - RNA, 23 nt, Human
ggaacacuauucugaaacuuggg

SEQ ID NO: 414676 - RNA, 23 nt, Human
ggaacacuauucugaaacuuggg

SEQ ID NO: 414677 - RNA, 24 nt, Human
ggacagccaaacagccugaaauau

SEQ ID NO: 414678 - RNA, 19 nt, Human
ggcagccguggggucaggg

SEQ ID NO: 414679 - RNA, 18 nt, Human
ggcaggggacagggaaug

SEQ ID NO: 414680 - RNA, 18 nt, Human
ggcaggggacagggaaug

SEQ ID NO: 414681 - RNA, 25 nt, Human
gguacagggacagccaaacagccug

SEQ ID NO: 414682 - RNA, 21 nt, Human
gucagggugucccgcuguagg

SEQ ID NO: 414683 - RNA, 19 nt, Human
guccggaaguccugacugc

SEQ ID NO: 414684 - RNA, 21 nt, Human
guccggaaguccugacugcuc

SEQ ID NO: 414685 - RNA, 21 nt, Human
guccggaaguccugacugcuc

SEQ ID NO: 414686 - RNA, 19 nt, Human
gugggcaggggacagggaa

SEQ ID NO: 414687 - RNA, 19 nt, Human
gugggcaggggacagggaa

SEQ ID NO: 414688 - RNA, 18 nt, Human
uaacagaaaaggaaaaaa

SEQ ID NO: 414689 - RNA, 23 nt, Human
ucacagccuugauaggggaacac

SEQ ID NO: 414690 - RNA, 26 nt, Human
ucagacccacaagucccucucccucc

SEQ ID NO: 414691 - RNA, 19 nt, Human
ucauccacgaaguagaagc

SEQ ID NO: 414692 - RNA, 21 nt, Human
ucccuuggguggcuuggcagc

SEQ ID NO: 414693 - RNA, 21 nt, Human
ucccuuggguggcuuggcagc

SEQ ID NO: 414694 - RNA, 21 nt, Human
uccggagcuccuggagaacuc

SEQ ID NO: 414695 - RNA, 21 nt, Human
uccggagcuccuggagaacuc

SEQ ID NO: 414696 - RNA, 20 nt, Human
ucgccugcugcugccgccgc

SEQ ID NO: 414697 - RNA, 25 nt, Human
ucgccugcugcugccgccgcugccu

SEQ ID NO: 414698 - RNA, 18 nt, Human
ucuacggaugauauggga

SEQ ID NO: 414699 - RNA, 20 nt, Human
ucucagccagucccucccac

SEQ ID NO: 414700 - RNA, 20 nt, Human
ucucagccagucccucccac

SEQ ID NO: 414701 - RNA, 22 nt, Human
ucucuacggaugauaugggaau

SEQ ID NO: 414702 - RNA, 18 nt, Human
ugaaauauccccagccuc

SEQ ID NO: 414703 - RNA, 19 nt, Human
ugacuggggacaccaggua

SEQ ID NO: 414704 - RNA, 19 nt, Human
ugacuggggacaccaggua

SEQ ID NO: 414705 - RNA, 21 nt, Human
ugacuggggacaccagguacc

SEQ ID NO: 414706 - RNA, 21 nt, Human
ugacuggggacaccagguacc

SEQ ID NO: 414707 - RNA, 19 nt, Human
ugccugaucuagucacagc

SEQ ID NO: 414708 - RNA, 19 nt, Human
ugccugaucuagucacagc

SEQ ID NO: 414709 - RNA, 22 nt, Human
uggagccuccuggggucagggc

SEQ ID NO: 414710 - RNA, 22 nt, Human
uggagccuccuggggucagggc

SEQ ID NO: 414711 - RNA, 25 nt, Human
uugaacagaaaaggaaaaaguuuau

SEQ ID NO: 414712 - RNA, 20 nt, Human
uugguccagcuccuaccaug

SEQ ID NO: 414713 - RNA, 20 nt, Human
uugguccagcuccuaccaug

SEQ ID NO: 414714 - RNA, 23 nt, Human
uuguaaauuuacaacucuaaaug

SEQ ID NO: 414715 - RNA, 23 nt, Human
uuguaaauuuacaacucuaaaug

SEQ ID NO: 414716 - RNA, 21 nt, Human
uuguccggaaguccugacugc

SEQ ID NO: 414717 - RNA, 20 nt, Human
uuuuuuuugaacagaaaagg

SEQ ID NO: 414718 - RNA, 23 nt, Human
uuuuuuuuuuuuuuuuuuaacag

SEQ ID NO: 414719 - RNA, 18 nt, Human
aagccucugccgcgcccc

SEQ ID NO: 414720 - RNA, 18 nt, Human
acagcaaagaugcuuggu

SEQ ID NO: 414721 - RNA, 23 nt, Human
acagcaaagaugcuugguuucuu

SEQ ID NO: 414722 - RNA, 21 nt, Human
agaaggcaguggccacagaug

SEQ ID NO: 414723 - RNA, 23 nt, Human
agaggaaauccaagaaccauguc

SEQ ID NO: 414724 - RNA, 20 nt, Human
agccaggcacaaguuccaca

SEQ ID NO: 414725 - RNA, 20 nt, Human
agccccuaguaccacagucc

SEQ ID NO: 414726 - RNA, 19 nt, Human
aggcagggagacucccagg

SEQ ID NO: 414727 - RNA, 20 nt, Human
aggcucagcugacuacccag

SEQ ID NO: 414728 - RNA, 18 nt, Human
aggguugaauaucagagg

SEQ ID NO: 414729 - RNA, 19 nt, Human
caagccucugccgcgcccc

SEQ ID NO: 414730 - RNA, 21 nt, Human
cacaucccagccccuaguacc

SEQ ID NO: 414731 - RNA, 19 nt, Human
caccgucugagcgaacucc

SEQ ID NO: 414732 - RNA, 22 nt, Human
cagccccuaguaccacaguccu

SEQ ID NO: 414733 - RNA, 19 nt, Human
cagcuaacucccacuggcc

SEQ ID NO: 414734 - RNA, 19 nt, Human
caggcucagcugacuaccc

SEQ ID NO: 414735 - RNA, 20 nt, Human
ccaggcacaaguuccacacc

SEQ ID NO: 414736 - RNA, 23 nt, Human
cccaaauuuuuccuuaaauaucu

SEQ ID NO: 414737 - RNA, 25 nt, Human
cccaaauuuuuccuuaaauaucuuu

SEQ ID NO: 414738 - RNA, 24 nt, Human
cccaagaagaaaauacuccuggau

SEQ ID NO: 414739 - RNA, 18 nt, Human
cccagccccuaguaccac

SEQ ID NO: 414740 - RNA, 21 nt, Human
ccccacaucccagccccuagu

SEQ ID NO: 414741 - RNA, 22 nt, Human
ccccacaucccagccccuagua

SEQ ID NO: 414742 - RNA, 18 nt, Human
ccccuaguaccacagucc

SEQ ID NO: 414743 - RNA, 19 nt, Human
cccgccccaaaucucaccg

SEQ ID NO: 414744 - RNA, 23 nt, Human
ccgccgcugccucggacccgccc

SEQ ID NO: 414745 - RNA, 19 nt, Human
ccgucugagcgaacuccgg

SEQ ID NO: 414746 - RNA, 21 nt, Human
ccucaggaaguccaggaggcu

SEQ ID NO: 414747 - RNA, 19 nt, Human
ccucauggucccggucgca

SEQ ID NO: 414748 - RNA, 24 nt, Human
ccugaagcaucacuccccugccua

SEQ ID NO: 414749 - RNA, 25 nt, Human
cggccccacgggucuggcagcuccu

SEQ ID NO: 414750 - RNA, 21 nt, Human
cuaagccgguuacacagcuaa

SEQ ID NO: 414751 - RNA, 19 nt, Human
cuagaaggcaguggccaca

SEQ ID NO: 414752 - RNA, 18 nt, Human
cucucguuaccggcccca

SEQ ID NO: 414753 - RNA, 18 nt, Human
cugccgcgccccagccgc

SEQ ID NO: 414754 - RNA, 20 nt, Human
cuuaauggaaaaucucucca

SEQ ID NO: 414755 - RNA, 21 nt, Human
gaaacaguuugucucugaccu

SEQ ID NO: 414756 - RNA, 23 nt, Human
gaaacaguuugucucugaccucc

SEQ ID NO: 414757 - RNA, 20 nt, Human
gaggaguggagaggugucua

SEQ ID NO: 414758 - RNA, 21 nt, Human
gaggaguggagaggugucuac

SEQ ID NO: 414759 - RNA, 23 nt, Human
gcacaaguuccacaccuucuaaa

SEQ ID NO: 414760 - RNA, 21 nt, Human
gcauggagauggguagaggug

SEQ ID NO: 414761 - RNA, 22 nt, Human
gccauauuaucaccaccccaaa

SEQ ID NO: 414762 - RNA, 24 nt, Human
gccucugccgcgccccagccgcgc

SEQ ID NO: 414763 - RNA, 18 nt, Human
ggagauggguagaggugg

SEQ ID NO: 414764 - RNA, 20 nt, Human
ggcaagccucugccgcgccc

SEQ ID NO: 414765 - RNA, 25 nt, Human
ggccagggcuucaugacccuuucug

SEQ ID NO: 414766 - RNA, 21 nt, Human
guaugugucuaacuggauaag

SEQ ID NO: 414767 - RNA, 20 nt, Human
guccugaagcaucacucccc

SEQ ID NO: 414768 - RNA, 22 nt, Human
uaccaagaauggcugacacucu

SEQ ID NO: 414769 - RNA, 19 nt, Human
uacuccuggauccuucaac

SEQ ID NO: 414770 - RNA, 18 nt, Human
uagaaggcaguggccaca

SEQ ID NO: 414771 - RNA, 24 nt, Human
uauaauaauuaacaacagcaaaga

SEQ ID NO: 414772 - RNA, 18 nt, Human
ucaggaaguccaggaggc

SEQ ID NO: 414773 - RNA, 23 nt, Human
ucaggcccacccaagaagaaaau

SEQ ID NO: 414774 - RNA, 21 nt, Human
uccaggaggcugcuacagagg

SEQ ID NO: 414775 - RNA, 19 nt, Human
uccaggcuccuucuauagg

SEQ ID NO: 414776 - RNA, 25 nt, Human
ucccagccccuaguaccacaguccu

SEQ ID NO: 414777 - RNA, 20 nt, Human
ucccaggcagguggccccua

SEQ ID NO: 414778 - RNA, 21 nt, Human
ucccucuuuccucucagcagg

SEQ ID NO: 414779 - RNA, 19 nt, Human
uccugaagcaucacucccc

SEQ ID NO: 414780 - RNA, 22 nt, Human
uccuguaacaauggcacauaua

SEQ ID NO: 414781 - RNA, 22 nt, Human
ucucagaaauguuuguccuacu

SEQ ID NO: 414782 - RNA, 20 nt, Human
ucugaccucccaggaagugu

SEQ ID NO: 414783 - RNA, 21 nt, Human
ugaaaagccauauuaucacca

SEQ ID NO: 414784 - RNA, 21 nt, Human
ugacccuuucugugaaaagcc

SEQ ID NO: 414785 - RNA, 18 nt, Human
ugagagagagagagacca

SEQ ID NO: 414786 - RNA, 18 nt, Human
ugagagagagagagacca

SEQ ID NO: 414787 - RNA, 24 nt, Human
ugagcaggacuuuuucuagacugg

SEQ ID NO: 414788 - RNA, 23 nt, Human
ugcaagguggaggacggcuagaa

SEQ ID NO: 414789 - RNA, 20 nt, Human
ugccuagaggagugaggcag

SEQ ID NO: 414790 - RNA, 25 nt, Human
ugccucggacccgccccaaaucuca

SEQ ID NO: 414791 - RNA, 18 nt, Human
uggagccacagaaaauca

SEQ ID NO: 414792 - RNA, 22 nt, Human
ugggaugaggaguggagaggug

SEQ ID NO: 414793 - RNA, 19 nt, Human
uguacagagggaucagagu

SEQ ID NO: 414794 - RNA, 24 nt, Human
uuacacagcuaacucccacuggcc

SEQ ID NO: 414795 - RNA, 21 nt, Human
uuguucaguuucaaagccuug

SEQ ID NO: 414796 - RNA, 25 nt, Human
uuuuuggcuuuuguucaggcccacc

SEQ ID NO: 414797 - RNA, 18 nt, Human
uuuuuuuuuuuuuuuuug

SEQ ID NO: 414798 - RNA, 20 nt, Human
uuuuuuuuuuuuuuuuugcu

SEQ ID NO: 414799 - RNA, 24 nt, Human
uuuuuuuuuuuuuuuuugcuauaa

SEQ ID NO: 414800 - RNA, 18 nt, Human
acacaauuuuucuuaacu

SEQ ID NO: 414801 - RNA, 20 nt, Human
acagaacacugaugggagga

SEQ ID NO: 414802 - RNA, 21 nt, Human
aguuguaucuguuuuccuucu

SEQ ID NO: 414803 - RNA, 18 nt, Human
caaaccguccacagcuuc

SEQ ID NO: 414804 - RNA, 22 nt, Human
caaccaagcgccacacuccacu

SEQ ID NO: 414805 - RNA, 20 nt, Human
caccuggacggccacagacu

SEQ ID NO: 414806 - RNA, 20 nt, Human
cauguacaugggcaguugua

SEQ ID NO: 414807 - RNA, 20 nt, Human
cauucuugccugugaagugg

SEQ ID NO: 414808 - RNA, 18 nt, Human
ccguccacagcuucaacu

SEQ ID NO: 414809 - RNA, 19 nt, Human
ccuggacggccacagacuc

SEQ ID NO: 414810 - RNA, 19 nt, Human
cuccacuucccugauacaa

SEQ ID NO: 414811 - RNA, 24 nt, Human
cugggcagaagcugaauccgugca

SEQ ID NO: 414812 - RNA, 23 nt, Human
gaacaaaaauagaacgagccaug

SEQ ID NO: 414813 - RNA, 22 nt, Human
gaggggagggggacagagagac

SEQ ID NO: 414814 - RNA, 20 nt, Human
gaugggaggauuaucugaga

SEQ ID NO: 414815 - RNA, 23 nt, Human
gcaaacagcugaaagccccacug

SEQ ID NO: 414816 - RNA, 23 nt, Human
gcagaagcugaauccgugcaccg

SEQ ID NO: 414817 - RNA, 21 nt, Human
gcuacagcuuuauucccaaag

SEQ ID NO: 414818 - RNA, 19 nt, Human
uaaaaagcguuuccuagga

SEQ ID NO: 414819 - RNA, 19 nt, Human
uaacucccgugaugaucuc

SEQ ID NO: 414820 - RNA, 24 nt, Human
uacagcuuuauucccaaagggcac

SEQ ID NO: 414821 - RNA, 19 nt, Human
uaccacacagcauacagcc

SEQ ID NO: 414822 - RNA, 23 nt, Human
uagacacaacaaaccguccacag

SEQ ID NO: 414823 - RNA, 24 nt, Human
ucaccuggacggccacagacuccc

SEQ ID NO: 414824 - RNA, 25 nt, Human
ucaucuggauuuccuccucagcugu

SEQ ID NO: 414825 - RNA, 20 nt, Human
uccaauuugauguaaacaac

SEQ ID NO: 414826 - RNA, 18 nt, Human
uccauauaucuggauagc

SEQ ID NO: 414827 - RNA, 20 nt, Human
ucccuccaaggaauaggagu

SEQ ID NO: 414828 - RNA, 18 nt, Human
ugaagugcauuggucuca

SEQ ID NO: 414829 - RNA, 20 nt, Human
ugccugugaagugcauuggu

SEQ ID NO: 414830 - RNA, 18 nt, Human
uugauagcuaaauucaag

SEQ ID NO: 414831 - RNA, 23 nt, Human
uuguagaaauuggguuuguuaag

SEQ ID NO: 414832 - RNA, 19 nt, Human
uuguaucuguuuuccuucu

SEQ ID NO: 414833 - RNA, 19 nt, Human
uuugaacaaaaauagaacg

SEQ ID NO: 414834 - RNA, 23 nt, Human
uuuuguccuucauuuccccuucc

SEQ ID NO: 414835 - RNA, 24 nt, Human
aaaaaccccaacuggacauaaccc

SEQ ID NO: 414836 - RNA, 23 nt, Human
aaaacauccuuaugcugcgaggg

SEQ ID NO: 414837 - RNA, 19 nt, Human
aaagagagccaacugagua

SEQ ID NO: 414838 - RNA, 20 nt, Human
aaagcggacaguaagagccc

SEQ ID NO: 414839 - RNA, 21 nt, Human
aaaggcaagggagauaaagag

SEQ ID NO: 414840 - RNA, 23 nt, Human
aaaucaccccaccccauaaagac

SEQ ID NO: 414841 - RNA, 24 nt, Human
aagcaaaaacaccccaaccagcuc

SEQ ID NO: 414842 - RNA, 19 nt, Human
aagcggacaguaagagccc

SEQ ID NO: 414843 - RNA, 24 nt, Human
aagcggacaguaagagcccagggc

SEQ ID NO: 414844 - RNA, 20 nt, Human
aagggagauaaagagagcca

SEQ ID NO: 414845 - RNA, 18 nt, Human
acccaauaaagaccgucu

SEQ ID NO: 414846 - RNA, 21 nt, Human
agaaaaucaccccaccccaua

SEQ ID NO: 414847 - RNA, 22 nt, Human
agacaaggggaccuuucuaagc

SEQ ID NO: 414848 - RNA, 22 nt, Human
agccaacugaguauuugaccuc

SEQ ID NO: 414849 - RNA, 19 nt, Human
aggaauaacaagacccagc

SEQ ID NO: 414850 - RNA, 18 nt, Human
aggcaaaaccaaggagca

SEQ ID NO: 414851 - RNA, 24 nt, Human
aggccgaagccauguugcagagaa

SEQ ID NO: 414852 - RNA, 20 nt, Human
agggagauaaagagagccaa

SEQ ID NO: 414853 - RNA, 21 nt, Human
agucuaaccaggcaaaaccaa

SEQ ID NO: 414854 - RNA, 23 nt, Human
auucccuuuucuccucuuccuug

SEQ ID NO: 414855 - RNA, 20 nt, Human
caaaauucccuuuucuccuc

SEQ ID NO: 414856 - RNA, 18 nt, Human
caagaucaaggauggagg

SEQ ID NO: 414857 - RNA, 21 nt, Human
caagggagauaaagagagcca

SEQ ID NO: 414858 - RNA, 26 nt, Human
cacccaaggaauaacaagacccagcu

SEQ ID NO: 414859 - RNA, 21 nt, Human
caccccaccccauaaagacaa

SEQ ID NO: 414860 - RNA, 18 nt, Human
caccccauaaagacaaaa

SEQ ID NO: 414861 - RNA, 23 nt, Human
cagcaaaaacagcauugcuaaca

SEQ ID NO: 414862 - RNA, 23 nt, Human
cagcagcuucucaaaggccaccc

SEQ ID NO: 414863 - RNA, 20 nt, Human
cagcuucucaaaggccaccc

SEQ ID NO: 414864 - RNA, 22 nt, Human
cagcuucucaaaggccaccccu

SEQ ID NO: 414865 - RNA, 18 nt, Human
cauaacccuaggagaaaa

SEQ ID NO: 414866 - RNA, 23 nt, Human
cauaacccuaggagaaaaucacc

SEQ ID NO: 414867 - RNA, 22 nt, Human
ccaacacccaaggaauaacaag

SEQ ID NO: 414868 - RNA, 18 nt, Human
ccaaggaauaacaagacc

SEQ ID NO: 414869 - RNA, 18 nt, Human
ccacccgggaaccggcga

SEQ ID NO: 414870 - RNA, 19 nt, Human
cccaaggaauaacaagacc

SEQ ID NO: 414871 - RNA, 20 nt, Human
cccuaggagaaaaucacccc

SEQ ID NO: 414872 - RNA, 19 nt, Human
ccucaucugucuucugcau

SEQ ID NO: 414873 - RNA, 25 nt, Human
ccuuaaaaaccccaacuggacauaa

SEQ ID NO: 414874 - RNA, 21 nt, Human
cgacuaacagcaaaaacagca

SEQ ID NO: 414875 - RNA, 18 nt, Human
cgccacccgggaaccggc

SEQ ID NO: 414876 - RNA, 25 nt, Human
cgcgcgccacccgggaaccggcgag

SEQ ID NO: 414877 - RNA, 19 nt, Human
cuaacccgacuaacagcaa

SEQ ID NO: 414878 - RNA, 22 nt, Human
cuaacccgacuaacagcaaaaa

SEQ ID NO: 414879 - RNA, 23 nt, Human
cucaaaggccaccccucagcuga

SEQ ID NO: 414880 - RNA, 23 nt, Human
cucacagcaaucuuaaccucuac

SEQ ID NO: 414881 - RNA, 27 nt, Human
cugccuuaaaaaccccaacuggacaua

SEQ ID NO: 414882 - RNA, 19 nt, Human
gacuaacagcaaaaacagc

SEQ ID NO: 414883 - RNA, 22 nt, Human
gagccaacucuaacccgacuaa

SEQ ID NO: 414884 - RNA, 21 nt, Human
gaggcuagcccuggcuguggc

SEQ ID NO: 414885 - RNA, 22 nt, Human
gauggaggugcagacccaauaa

SEQ ID NO: 414886 - RNA, 18 nt, Human
gcuagcccuggcuguggc

SEQ ID NO: 414887 - RNA, 20 nt, Human
ggaacuggcagagacuggca

SEQ ID NO: 414888 - RNA, 18 nt, Human
ggcugggaggcgcccuau

SEQ ID NO: 414889 - RNA, 21 nt, Human
gggcugggcccgguccgggaa

SEQ ID NO: 414890 - RNA, 25 nt, Human
guaagagcccagggcugggcccggu

SEQ ID NO: 414891 - RNA, 19 nt, Human
uaaaaaaaacaguacuugg

SEQ ID NO: 414892 - RNA, 24 nt, Human
uaaaaaaaggacugggaaaaauau

SEQ ID NO: 414893 - RNA, 19 nt, Human
uaaaaaccccaacuggaca

SEQ ID NO: 414894 - RNA, 24 nt, Human
uaaaaaccccaacuggacauaacc

SEQ ID NO: 414895 - RNA, 20 nt, Human
uaaagagagccaacugagua

SEQ ID NO: 414896 - RNA, 22 nt, Human
uaacaaaccucgcguagagcca

SEQ ID NO: 414897 - RNA, 18 nt, Human
uaacccgacuaacagcaa

SEQ ID NO: 414898 - RNA, 21 nt, Human
uaacccgacuaacagcaaaaa

SEQ ID NO: 414899 - RNA, 25 nt, Human
uaagcaaaaacaccccaaucaacgg

SEQ ID NO: 414900 - RNA, 18 nt, Human
uagagccaacucuaaccc

SEQ ID NO: 414901 - RNA, 25 nt, Human
uaggccgaagccauguugcagagaa

SEQ ID NO: 414902 - RNA, 18 nt, Human
ucaaaggguagccuuugu

SEQ ID NO: 414903 - RNA, 19 nt, Human
ucccccuuaugcagaguac

SEQ ID NO: 414904 - RNA, 21 nt, Human
uccuggacagccugguucaug

SEQ ID NO: 414905 - RNA, 20 nt, Human
ucuaaacuggagcggggaga

SEQ ID NO: 414906 - RNA, 19 nt, Human
ucugucuucugcauauuuu

SEQ ID NO: 414907 - RNA, 19 nt, Human
ugaaagucuaaccaggcaa

SEQ ID NO: 414908 - RNA, 19 nt, Human
ugagacaaggggaccuuuc

SEQ ID NO: 414909 - RNA, 24 nt, Human
ugcgaggggccugaggacuccuuc

SEQ ID NO: 414910 - RNA, 19 nt, Human
ugcugccuuaaaaacccca

SEQ ID NO: 414911 - RNA, 20 nt, Human
uggucaaaggguagccuuug

SEQ ID NO: 414912 - RNA, 21 nt, Human
uucaccauaaaggcaagggag

SEQ ID NO: 414913 - RNA, 22 nt, Human
uuccuggacagccugguucaug

SEQ ID NO: 414914 - RNA, 20 nt, Human
uugugguuggauacagcugc

SEQ ID NO: 414915 - RNA, 24 nt, Human
uuuuuuuuuuuuuuaaacuuuuaa

SEQ ID NO: 414916 - RNA, 20 nt, Human
aaagaagggcaauccggugg

SEQ ID NO: 414917 - RNA, 18 nt, Human
aacucuggaaggcugaug

SEQ ID NO: 414918 - RNA, 21 nt, Human
aauuggauguuggcuuguaua

SEQ ID NO: 414919 - RNA, 19 nt, Human
acaacugaagcaaaaaaag

SEQ ID NO: 414920 - RNA, 21 nt, Human
aggaaaagaagggcaauccgg

SEQ ID NO: 414921 - RNA, 19 nt, Human
aggaaaguaggggaugggg

SEQ ID NO: 414922 - RNA, 18 nt, Human
aggcccccgcccugacac

SEQ ID NO: 414923 - RNA, 19 nt, Human
agggaaagggagggaggga

SEQ ID NO: 414924 - RNA, 19 nt, Human
agggagggaggaaaguagg

SEQ ID NO: 414925 - RNA, 20 nt, Human
aggggugagggaggggucag

SEQ ID NO: 414926 - RNA, 23 nt, Human
agucgacgagggagggaaaggga

SEQ ID NO: 414927 - RNA, 20 nt, Human
caacaggaaaagaagggcaa

SEQ ID NO: 414928 - RNA, 19 nt, Human
cacuagggcugggcugggc

SEQ ID NO: 414929 - RNA, 20 nt, Human
cauaaacagcuacaagaacc

SEQ ID NO: 414930 - RNA, 22 nt, Human
cauucugcuuuaagaucagaaa

SEQ ID NO: 414931 - RNA, 19 nt, Human
ccacgauucacagcgucca

SEQ ID NO: 414932 - RNA, 19 nt, Human
cugaagcaaaaaaagaaaa

SEQ ID NO: 414933 - RNA, 18 nt, Human
gagggagggaggaaagua

SEQ ID NO: 414934 - RNA, 22 nt, Human
gccucgggcugcuccaggcccc

SEQ ID NO: 414935 - RNA, 20 nt, Human
gcugggcaacaggaaaagaa

SEQ ID NO: 414936 - RNA, 22 nt, Human
gggagggagggaggaaaguagg

SEQ ID NO: 414937 - RNA, 21 nt, Human
gggcugggcaacaggaaaaga

SEQ ID NO: 414938 - RNA, 23 nt, Human
gggcugggcugggcaacaggaaa

SEQ ID NO: 414939 - RNA, 23 nt, Human
uaacauaaacagcuacaagaacc

SEQ ID NO: 414940 - RNA, 19 nt, Human
uaacugcaacauaugauug

SEQ ID NO: 414941 - RNA, 22 nt, Human
uaagaggauaacuccaccuccc

SEQ ID NO: 414942 - RNA, 22 nt, Human
uaagaucagaaaaaaaucagcc

SEQ ID NO: 414943 - RNA, 22 nt, Human
uagggaggggugagggaggggu

SEQ ID NO: 414944 - RNA, 25 nt, Human
uaucauguauucccucuucuuuaca

SEQ ID NO: 414945 - RNA, 18 nt, Human
ucagaaaaaaaucagcca

SEQ ID NO: 414946 - RNA, 19 nt, Human
uccaggcccccgcccugac

SEQ ID NO: 414947 - RNA, 24 nt, Human
ucuccauauuaacauaaacagcua

SEQ ID NO: 414948 - RNA, 21 nt, Human
ucuucuuuacaacugaagcaa

SEQ ID NO: 414949 - RNA, 22 nt, Human
ugaagcaaaaaaagaaaaggca

SEQ ID NO: 414950 - RNA, 21 nt, Human
ugccucgggcugcuccaggcc

SEQ ID NO: 414951 - RNA, 20 nt, Human
ugccuuaagcagacaguaac

SEQ ID NO: 414952 - RNA, 21 nt, Human
ugcgaccagcaagaaacaguc

SEQ ID NO: 414953 - RNA, 25 nt, Human
uuacaacugaagcaaaaaaagaaaa

SEQ ID NO: 414954 - RNA, 20 nt, Human
uuagucaguuguauacuaac

SEQ ID NO: 414955 - RNA, 23 nt, Human
uuaguuguuccagcacuggagcu

SEQ ID NO: 414956 - RNA, 18 nt, Human
uuucugccuuaagcagac

SEQ ID NO: 414957 - RNA, 20 nt, Human
uuuuuuuuuuuuuuguuuua

SEQ ID NO: 414958 - RNA, 18 nt, Human
uuuuuuuuuuuuuuuuug

SEQ ID NO: 414959 - RNA, 24 nt, Human
uuuuuuuuuuuuuuuuuuuguuuu

SEQ ID NO: 414960 - RNA, 25 nt, Human
aaacaacaaauacuaguuuauaaca

SEQ ID NO: 414961 - RNA, 18 nt, Human
aaaccacaaacacaucca

SEQ ID NO: 414962 - RNA, 22 nt, Human
aaacucaaaaacaggcucugua

SEQ ID NO: 414963 - RNA, 22 nt, Human
aaagggcaauaguugaagcugu

SEQ ID NO: 414964 - RNA, 22 nt, Human
aacaaacaagaacuacucuuca

SEQ ID NO: 414965 - RNA, 20 nt, Human
aacaggaaugguaaaaucug

SEQ ID NO: 414966 - RNA, 21 nt, Human
aaccguaaugguuacaaaccc

SEQ ID NO: 414967 - RNA, 23 nt, Human
aauaaaguaucuaaaacucaaaa

SEQ ID NO: 414968 - RNA, 19 nt, Human
acaaaccacaaacacaucc

SEQ ID NO: 414969 - RNA, 21 nt, Human
acaaagguuguaacaaacaag

SEQ ID NO: 414970 - RNA, 21 nt, Human
acuacucuucacucgacacca

SEQ ID NO: 414971 - RNA, 22 nt, Human
auaaaguaucuaaaacucaaaa

SEQ ID NO: 414972 - RNA, 24 nt, Human
cacaaacacauccauccagagacu

SEQ ID NO: 414973 - RNA, 22 nt, Human
cacaaagguuguaacaaacaag

SEQ ID NO: 414974 - RNA, 23 nt, Human
caccauggcucagaggccaccga

SEQ ID NO: 414975 - RNA, 19 nt, Human
cagaggccaccgagaagca

SEQ ID NO: 414976 - RNA, 23 nt, Human
cauggaggccaggugcgugcagu

SEQ ID NO: 414977 - RNA, 24 nt, Human
ccgagccgcagccgccagcccccg

SEQ ID NO: 414978 - RNA, 23 nt, Human
cgagccgcagccgccagcccccg

SEQ ID NO: 414979 - RNA, 20 nt, Human
cucuccgccgagccgcagcc

SEQ ID NO: 414980 - RNA, 25 nt, Human
cuguaugcuauaucuaguuuauccc

SEQ ID NO: 414981 - RNA, 22 nt, Human
gaauaaguucuccuucccaguc

SEQ ID NO: 414982 - RNA, 22 nt, Human
ggaaugguaaaaucugugagaa

SEQ ID NO: 414983 - RNA, 19 nt, Human
ggaggccaggugcgugcag

SEQ ID NO: 414984 - RNA, 20 nt, Human
uaaaacacagcacgcuuugc

SEQ ID NO: 414985 - RNA, 18 nt, Human
uaaaacucaaaaacaggc

SEQ ID NO: 414986 - RNA, 21 nt, Human
uaaaguaucuaaaacucaaaa

SEQ ID NO: 414987 - RNA, 23 nt, Human
uaacaggaaugguaaaaucugug

SEQ ID NO: 414988 - RNA, 21 nt, Human
uaaggaauaaguucuccuucc

SEQ ID NO: 414989 - RNA, 18 nt, Human
uaccaggacuaaaacaca

SEQ ID NO: 414990 - RNA, 19 nt, Human
uaccaggacuaaaacacag

SEQ ID NO: 414991 - RNA, 22 nt, Human
uccuaccaggacuaaaacacag

SEQ ID NO: 414992 - RNA, 23 nt, Human
ucugcucaauuuaauacaagauc

SEQ ID NO: 414993 - RNA, 23 nt, Human
ucugcuuacaaacgaaugaaacc

SEQ ID NO: 414994 - RNA, 21 nt, Human
ugaaacccaaaguggaugucg

SEQ ID NO: 414995 - RNA, 19 nt, Human
ugacugacagcuccucugc

SEQ ID NO: 414996 - RNA, 19 nt, Human
ugccaaaaauacauugaca

SEQ ID NO: 414997 - RNA, 21 nt, Human
uggcuaaacaacaaauacuag

SEQ ID NO: 414998 - RNA, 21 nt, Human
uggcucagaggccaccgagaa

SEQ ID NO: 414999 - RNA, 19 nt, Human
ugggaugcccuugcucguc

SEQ ID NO: 415000 - RNA, 20 nt, Human
uguuggguuuuauauagugu

SEQ ID NO: 415001 - RNA, 23 nt, Human
uucaggacucacacugauccaau

SEQ ID NO: 415002 - RNA, 23 nt, Human
aacagcuuuugauuuuagaacca

SEQ ID NO: 415003 - RNA, 19 nt, Human
aagaugcugaugacaaaac

SEQ ID NO: 415004 - RNA, 21 nt, Human
aagcaaacaaaaaacuaaaac

SEQ ID NO: 415005 - RNA, 19 nt, Human
aagcaaugaaauuguacuu

SEQ ID NO: 415006 - RNA, 25 nt, Human
acagucaggacaccuaaggccaucu

SEQ ID NO: 415007 - RNA, 23 nt, Human
accccgggcacaaacggcucccg

SEQ ID NO: 415008 - RNA, 20 nt, Human
acggcucccgggaagcuccc

SEQ ID NO: 415009 - RNA, 24 nt, Human
agauuccugcuuugacacaagacu

SEQ ID NO: 415010 - RNA, 18 nt, Human
aggacacuggauacagaa

SEQ ID NO: 415011 - RNA, 22 nt, Human
caaaagcaaugaaauuguacuu

SEQ ID NO: 415012 - RNA, 20 nt, Human
caaggacaugcuuguugcuu

SEQ ID NO: 415013 - RNA, 25 nt, Human
caaugucaacacuuaucaucaacaa

SEQ ID NO: 415014 - RNA, 18 nt, Human
cagcacagcggcucccuu

SEQ ID NO: 415015 - RNA, 21 nt, Human
cagcacagcggcucccuuucu

SEQ ID NO: 415016 - RNA, 23 nt, Human
cagcggcucccuuucucucuauu

SEQ ID NO: 415017 - RNA, 19 nt, Human
cggaacaaggcuucaaagc

SEQ ID NO: 415018 - RNA, 19 nt, Human
cucagaucaugagaccuaa

SEQ ID NO: 415019 - RNA, 22 nt, Human
cucauauaagcaaacaaaaaac

SEQ ID NO: 415020 - RNA, 24 nt, Human
cuuggccggaacgggguuaccccg

SEQ ID NO: 415021 - RNA, 26 nt, Human
gacagucaggacaccuaaggccaucu

SEQ ID NO: 415022 - RNA, 21 nt, Human
gcgacucugcuccacccaaau

SEQ ID NO: 415023 - RNA, 24 nt, Human
gcucccuuucucucuauucuuugc

SEQ ID NO: 415024 - RNA, 24 nt, Human
guugcuucuacacuacccaauguc

SEQ ID NO: 415025 - RNA, 18 nt, Human
uaacgugugcucuuuggc

SEQ ID NO: 415026 - RNA, 20 nt, Human
uaacgugugcucuuuggcuu

SEQ ID NO: 415027 - RNA, 18 nt, Human
uacaaggacaugcuuguu

SEQ ID NO: 415028 - RNA, 21 nt, Human
uaccccgggcacaaacggcuc

SEQ ID NO: 415029 - RNA, 23 nt, Human
uagaaccagcucuuacuuuucuc

SEQ ID NO: 415030 - RNA, 19 nt, Human
uagaucggaacaaggcuuc

SEQ ID NO: 415031 - RNA, 21 nt, Human
ucaaagcgacucugcuccacc

SEQ ID NO: 415032 - RNA, 22 nt, Human
ucaacaauacaauagaauuaga

SEQ ID NO: 415033 - RNA, 20 nt, Human
ugacaaaacacgaaguuuaa

SEQ ID NO: 415034 - RNA, 25 nt, Human
ugacaaaacacgaaguuuaaaaaua

SEQ ID NO: 415035 - RNA, 26 nt, Human
uguccuugccgucaccuuuuucugac

SEQ ID NO: 415036 - RNA, 21 nt, Human
ugugaugaaguccucacuuga

SEQ ID NO: 415037 - RNA, 23 nt, Human
uucacuguaccuguacuacaagg

SEQ ID NO: 415038 - RNA, 19 nt, Human
uucagaaaauucaauucag

SEQ ID NO: 415039 - RNA, 21 nt, Human
aaacacauacuucaagguaug

SEQ ID NO: 415040 - RNA, 24 nt, Human
aaagugcugggauuacaggcauga

SEQ ID NO: 415041 - RNA, 21 nt, Human
aacguggaauauuaggagaga

SEQ ID NO: 415042 - RNA, 24 nt, Human
aagaauuuccuucaggaccacaaa

SEQ ID NO: 415043 - RNA, 21 nt, Human
aaggagguaugguggcaacac

SEQ ID NO: 415044 - RNA, 19 nt, Human
aaguagcuaggauuacagg

SEQ ID NO: 415045 - RNA, 23 nt, Human
aaguaguuauuaugcauuuuuca

SEQ ID NO: 415046 - RNA, 19 nt, Human
aagugcugggauuacaggc

SEQ ID NO: 415047 - RNA, 21 nt, Human
aagugcugggauuacaggcau

SEQ ID NO: 415048 - RNA, 26 nt, Human
aagugcugggauuacaggcaugagcc

SEQ ID NO: 415049 - RNA, 22 nt, Human
acaaauguugaguuauaagaau

SEQ ID NO: 415050 - RNA, 19 nt, Human
acaagcugaaggcaagcgc

SEQ ID NO: 415051 - RNA, 21 nt, Human
acaggcaccuugucugucccc

SEQ ID NO: 415052 - RNA, 24 nt, Human
accauguuggccaggcuggucuug

SEQ ID NO: 415053 - RNA, 23 nt, Human
accucggccucccaaagugcugg

SEQ ID NO: 415054 - RNA, 18 nt, Human
acgggguuucaccauguu

SEQ ID NO: 415055 - RNA, 23 nt, Human
acgggguuucaccauguuggcca

SEQ ID NO: 415056 - RNA, 24 nt, Human
acgggguuucaccauguuggccag

SEQ ID NO: 415057 - RNA, 22 nt, Human
agaauuuccuucaggaccacaa

SEQ ID NO: 415058 - RNA, 24 nt, Human
aggugaucugcccaccucggccuc

SEQ ID NO: 415059 - RNA, 23 nt, Human
aguagcuaggauuacaggcaccu

SEQ ID NO: 415060 - RNA, 23 nt, Human
auacaggcagauugcuagccaaa

SEQ ID NO: 415061 - RNA, 25 nt, Human
auuaaaaauaagcagggauggaagu

SEQ ID NO: 415062 - RNA, 24 nt, Human
caaagugcugggauuacaggcaug

SEQ ID NO: 415063 - RNA, 22 nt, Human
caagugauucuccugcguuagc

SEQ ID NO: 415064 - RNA, 20 nt, Human
cacacuuuuaauuaauggaa

SEQ ID NO: 415065 - RNA, 21 nt, Human
caccauguuggccaggcuggu

SEQ ID NO: 415066 - RNA, 23 nt, Human
caccauguuggccaggcuggucu

SEQ ID NO: 415067 - RNA, 24 nt, Human
caccauguuggccaggcuggucuu

SEQ ID NO: 415068 - RNA, 27 nt, Human
caccauguuggccaggcuggucuugaa

SEQ ID NO: 415069 - RNA, 21 nt, Human
cacgccuggcuaauuuuugua

SEQ ID NO: 415070 - RNA, 18 nt, Human
cacugcaaccucugucuc

SEQ ID NO: 415071 - RNA, 21 nt, Human
caggcaccugccaucacgccu

SEQ ID NO: 415072 - RNA, 19 nt, Human
caggcaccuugucuguccc

SEQ ID NO: 415073 - RNA, 24 nt, Human
cauguuggccaggcuggucuugaa

SEQ ID NO: 415074 - RNA, 23 nt, Human
ccaaagugcugggauuacaggca

SEQ ID NO: 415075 - RNA, 24 nt, Human
ccaaagugcugggauuacaggcau

SEQ ID NO: 415076 - RNA, 21 nt, Human
ccaaguagcuaggauuacagg

SEQ ID NO: 415077 - RNA, 23 nt, Human
ccaaguagcuaggauuacaggca

SEQ ID NO: 415078 - RNA, 24 nt, Human
cccaaagugcugggauuacaggca

SEQ ID NO: 415079 - RNA, 19 nt, Human
cccacaagcugaaggcaag

SEQ ID NO: 415080 - RNA, 24 nt, Human
ccugaccucaggugaucugcccac

SEQ ID NO: 415081 - RNA, 21 nt, Human
cggggaaggagguaugguggc

SEQ ID NO: 415082 - RNA, 24 nt, Human
cgggguuucaccauguuggccagg

SEQ ID NO: 415083 - RNA, 24 nt, Human
cucacugcaaccucugucucccgg

SEQ ID NO: 415084 - RNA, 22 nt, Human
cugcaaccucugucucccgguc

SEQ ID NO: 415085 - RNA, 21 nt, Human
cuucucuccaguuugaaaugg

SEQ ID NO: 415086 - RNA, 21 nt, Human
gaccacaaauggaaacauagu

SEQ ID NO: 415087 - RNA, 24 nt, Human
gaccucaggugaucugcccaccuc

SEQ ID NO: 415088 - RNA, 24 nt, Human
gagacgggguuucaccauguuggc

SEQ ID NO: 415089 - RNA, 22 nt, Human
gauaauagugagagauacaggc

SEQ ID NO: 415090 - RNA, 18 nt, Human
gauuacaggcaugagccc

SEQ ID NO: 415091 - RNA, 19 nt, Human
gauuacaggcaugagcccc

SEQ ID NO: 415092 - RNA, 20 nt, Human
gcaaccucugucucccgguc

SEQ ID NO: 415093 - RNA, 24 nt, Human
gcaugagcccccacgcccagccca

SEQ ID NO: 415094 - RNA, 23 nt, Human
gcuggucuugaacuccugaccuc

SEQ ID NO: 415095 - RNA, 19 nt, Human
ggagagagcugguuccagc

SEQ ID NO: 415096 - RNA, 19 nt, Human
ggauuacaggcaugagccc

SEQ ID NO: 415097 - RNA, 21 nt, Human
ggcagauugcuagccaaauac

SEQ ID NO: 415098 - RNA, 24 nt, Human
ggcuggucuugaacuccugaccuc

SEQ ID NO: 415099 - RNA, 18 nt, Human
ggggaaggagguauggug

SEQ ID NO: 415100 - RNA, 23 nt, Human
gggguuucaccauguuggccagg

SEQ ID NO: 415101 - RNA, 23 nt, Human
gguacgaucucagcucacugcaa

SEQ ID NO: 415102 - RNA, 19 nt, Human
ggucuugaacuccugaccu

SEQ ID NO: 415103 - RNA, 18 nt, Human
guagagacgggguuucac

SEQ ID NO: 415104 - RNA, 21 nt, Human
guagagacgggguuucaccau

SEQ ID NO: 415105 - RNA, 22 nt, Human
guagagacgggguuucaccaug

SEQ ID NO: 415106 - RNA, 23 nt, Human
gucucccggucaagugauucucc

SEQ ID NO: 415107 - RNA, 24 nt, Human
gugaucugcccaccucggccuccc

SEQ ID NO: 415108 - RNA, 21 nt, Human
uaaaaggaucugaagguggca

SEQ ID NO: 415109 - RNA, 22 nt, Human
uaagacacacacguuagugugg

SEQ ID NO: 415110 - RNA, 23 nt, Human
uaauuuuuguauuuuuguagaga

SEQ ID NO: 415111 - RNA, 22 nt, Human
uacaggcaccugccaucacgcc

SEQ ID NO: 415112 - RNA, 24 nt, Human
uacaggcaugagcccccacgccca

SEQ ID NO: 415113 - RNA, 24 nt, Human
uacugagaucaacagaagcauugg

SEQ ID NO: 415114 - RNA, 22 nt, Human
uacugugauaacacagguuccu

SEQ ID NO: 415115 - RNA, 21 nt, Human
uagagacgggguuucaccaug

SEQ ID NO: 415116 - RNA, 22 nt, Human
uagagacgggguuucaccaugu

SEQ ID NO: 415117 - RNA, 21 nt, Human
uaggauuacaggcaccugcca

SEQ ID NO: 415118 - RNA, 21 nt, Human
uaggauuacaggcaccugcca

SEQ ID NO: 415119 - RNA, 22 nt, Human
uaggauuacaggcaccugccau

SEQ ID NO: 415120 - RNA, 24 nt, Human
uaggauuacaggcaccugccauca

SEQ ID NO: 415121 - RNA, 19 nt, Human
uauauaaauguugcagaau

SEQ ID NO: 415122 - RNA, 19 nt, Human
uaugguggcaacacuuuau

SEQ ID NO: 415123 - RNA, 19 nt, Human
ucacugcaaccucugucuc

SEQ ID NO: 415124 - RNA, 23 nt, Human
ucacugcaaccucugucucccgg

SEQ ID NO: 415125 - RNA, 25 nt, Human
ucaguaaucuuuucccaacuucucu

SEQ ID NO: 415126 - RNA, 24 nt, Human
uccauauaugggagcuacucuaga

SEQ ID NO: 415127 - RNA, 24 nt, Human
ucccaaagugcugggauuacaggc

SEQ ID NO: 415128 - RNA, 24 nt, Human
ucccacaagcugaaggcaagcgcc

SEQ ID NO: 415129 - RNA, 22 nt, Human
ucccggucaagugauucuccug

SEQ ID NO: 415130 - RNA, 21 nt, Human
ucccuguaaaucaccccauuc

SEQ ID NO: 415131 - RNA, 18 nt, Human
ucggccucccaaagugcu

SEQ ID NO: 415132 - RNA, 21 nt, Human
ucgggauuucccacaagcuga

SEQ ID NO: 415133 - RNA, 24 nt, Human
ucuggcucuuucauccaggaugga

SEQ ID NO: 415134 - RNA, 23 nt, Human
ucuugaacuccugaccucaggug

SEQ ID NO: 415135 - RNA, 22 nt, Human
ugaaaggaaauuugaaccacug

SEQ ID NO: 415136 - RNA, 20 nt, Human
ugaagguggcaucaagagaa

SEQ ID NO: 415137 - RNA, 18 nt, Human
ugaccucaggugaucugc

SEQ ID NO: 415138 - RNA, 20 nt, Human
ugaccucaggugaucugccc

SEQ ID NO: 415139 - RNA, 21 nt, Human
ugaccucaggugaucugccca

SEQ ID NO: 415140 - RNA, 24 nt, Human
ugaccucaggugaucugcccaccu

SEQ ID NO: 415141 - RNA, 22 nt, Human
ugagacagagucuggcucuuuc

SEQ ID NO: 415142 - RNA, 19 nt, Human
ugagauccuaaaggaaguc

SEQ ID NO: 415143 - RNA, 19 nt, Human
ugagcccccacgcccagcc

SEQ ID NO: 415144 - RNA, 24 nt, Human
ugaucugcccaccucggccuccca

SEQ ID NO: 415145 - RNA, 20 nt, Human
ugauucuccugcguuagccu

SEQ ID NO: 415146 - RNA, 21 nt, Human
ugcagaugagaaauauuuuga

SEQ ID NO: 415147 - RNA, 20 nt, Human
ugcugggauuacaggcauga

SEQ ID NO: 415148 - RNA, 24 nt, Human
uggaaguaguuauuaugcauuuuu

SEQ ID NO: 415149 - RNA, 21 nt, Human
uggagugcaauagguacgauc

SEQ ID NO: 415150 - RNA, 18 nt, Human
uggcaucaagagaaucac

SEQ ID NO: 415151 - RNA, 24 nt, Human
uggccaggcuggucuugaacuccu

SEQ ID NO: 415152 - RNA, 18 nt, Human
ugggauuacaggcaugag

SEQ ID NO: 415153 - RNA, 19 nt, Human
ugggauuacaggcaugagc

SEQ ID NO: 415154 - RNA, 22 nt, Human
ugggauuacaggcaugagcccc

SEQ ID NO: 415155 - RNA, 23 nt, Human
ugggauuacaggcaugagccccc

SEQ ID NO: 415156 - RNA, 24 nt, Human
ugggauuacaggcaugagccccca

SEQ ID NO: 415157 - RNA, 24 nt, Human
uguagagacgggguuucaccaugu

SEQ ID NO: 415158 - RNA, 21 nt, Human
uuaauggagaauugaggcuac

SEQ ID NO: 415159 - RNA, 19 nt, Human
uuacaggcaccugccauca

SEQ ID NO: 415160 - RNA, 19 nt, Human
uuacaggcaugagccccca

SEQ ID NO: 415161 - RNA, 23 nt, Human
uucaguaaucuuuucccaacuuc

SEQ ID NO: 415162 - RNA, 21 nt, Human
uucucuguuccccugacaaua

SEQ ID NO: 415163 - RNA, 20 nt, Human
uugaguuauaagaauuuccu

SEQ ID NO: 415164 - RNA, 24 nt, Human
uuguagagacgggguuucaccaug

SEQ ID NO: 415165 - RNA, 24 nt, Human
uuucaccauguuggccaggcuggu

SEQ ID NO: 415166 - RNA, 18 nt, Human
uuuguagagacgggguuu

SEQ ID NO: 415167 - RNA, 24 nt, Human
uuuguagagacgggguuucaccau

SEQ ID NO: 415168 - RNA, 21 nt, Human
uuuuuguauuuuuguagagac

SEQ ID NO: 415169 - RNA, 22 nt, Human
aacagcugcauccacagacuuc

SEQ ID NO: 415170 - RNA, 21 nt, Human
aaccagugaggaaaacugaua

SEQ ID NO: 415171 - RNA, 24 nt, Human
aaccaucuucauaacagcugcauc

SEQ ID NO: 415172 - RNA, 20 nt, Human
aaguaaaacaucuucagacc

SEQ ID NO: 415173 - RNA, 22 nt, Human
agcugcauccacagacuucaac

SEQ ID NO: 415174 - RNA, 19 nt, Human
aggaugcaaaaucaaaucu

SEQ ID NO: 415175 - RNA, 25 nt, Human
aucuucauaacagcugcauccacca

SEQ ID NO: 415176 - RNA, 21 nt, Human
caauagacauuuauuuaaagu

SEQ ID NO: 415177 - RNA, 24 nt, Human
cagaccaaauaauucuuaaaauug

SEQ ID NO: 415178 - RNA, 22 nt, Human
cuccaaguagcaguuaaacaca

SEQ ID NO: 415179 - RNA, 20 nt, Human
cuugaaaguuuggaaaaaaa

SEQ ID NO: 415180 - RNA, 21 nt, Human
gaagaggcuauuucucaaucu

SEQ ID NO: 415181 - RNA, 20 nt, Human
ggaauucaaaaacuccagcc

SEQ ID NO: 415182 - RNA, 21 nt, Human
guaaaacaucuucagaccaaa

SEQ ID NO: 415183 - RNA, 19 nt, Human
uaaaguaaaacaucuucag

SEQ ID NO: 415184 - RNA, 18 nt, Human
uaaccaucuucauaacag

SEQ ID NO: 415185 - RNA, 21 nt, Human
uaacuuacggaaguuauaucc

SEQ ID NO: 415186 - RNA, 23 nt, Human
uaacuuacggaaguuauauccuu

SEQ ID NO: 415187 - RNA, 20 nt, Human
uagcaguuaaacacaacuaa

SEQ ID NO: 415188 - RNA, 22 nt, Human
ucaaaaacuccagccauuacaa

SEQ ID NO: 415189 - RNA, 23 nt, Human
uccauaaggauguaacuuacgga

SEQ ID NO: 415190 - RNA, 20 nt, Human
ugaggaaaacugauaaagug

SEQ ID NO: 415191 - RNA, 18 nt, Human
ugcauccacagacuucaa

SEQ ID NO: 415192 - RNA, 22 nt, Human
ugcauccacagacuucaacuac

SEQ ID NO: 415193 - RNA, 21 nt, Human
ugccuauguuggggugcagac

SEQ ID NO: 415194 - RNA, 19 nt, Human
uggcuucugagcuccaagu

SEQ ID NO: 415195 - RNA, 23 nt, Human
uuuaacaguaaagggauucagua

SEQ ID NO: 415196 - RNA, 21 nt, Human
uuuuugauuugucuuuauacu

SEQ ID NO: 415197 - RNA, 18 nt, Human
uuuuuuuuuuuuuuuuug

SEQ ID NO: 415198 - RNA, 19 nt, Human
uuuuuuuuuuuuuuuuuug

SEQ ID NO: 415199 - RNA, 20 nt, Human
agggcuaaaguaccagcgug

SEQ ID NO: 415200 - RNA, 21 nt, Human
caaaccccggcccugcccucu

SEQ ID NO: 415201 - RNA, 18 nt, Human
ccgcagguucgagcccag

SEQ ID NO: 415202 - RNA, 18 nt, Human
cggcgcaggcgcaguacc

SEQ ID NO: 415203 - RNA, 25 nt, Human
cuaaaguaccagcguggaaacuuac

SEQ ID NO: 415204 - RNA, 26 nt, Human
cugcccucuugcuuacauaggcuucc

SEQ ID NO: 415205 - RNA, 23 nt, Human
guacaguuggugcucggccgccu

SEQ ID NO: 415206 - RNA, 18 nt, Human
guccaucuccccauucca

SEQ ID NO: 415207 - RNA, 20 nt, Human
ucagcccgagcagguccgcc

SEQ ID NO: 415208 - RNA, 21 nt, Human
uccacgcguggaagucagagu

SEQ ID NO: 415209 - RNA, 22 nt, Human
uccgcagguucgagcccagggc

SEQ ID NO: 415210 - RNA, 19 nt, Human
ucgagcccagggcuaaagu

SEQ ID NO: 415211 - RNA, 24 nt, Human
ucgagcccagggcuaaaguaccag

SEQ ID NO: 415212 - RNA, 22 nt, Human
uggcacagguuagaggagccga

SEQ ID NO: 415213 - RNA, 23 nt, Human
uggcugacuggcucugaccgcgc

SEQ ID NO: 415214 - RNA, 20 nt, Human
uuguggugggggggggaccc

SEQ ID NO: 415215 - RNA, 18 nt, Human
aaaaaagacaaaugauau

SEQ ID NO: 415216 - RNA, 18 nt, Human
caaaugauauauuagaga

SEQ ID NO: 415217 - RNA, 22 nt, Human
uaccucacuggaaaaaagacaa

SEQ ID NO: 415218 - RNA, 18 nt, Human
uguuugcugcucuggguc

SEQ ID NO: 415219 - RNA, 25 nt, Human
uuaccucacuggaaaaaagacaaau

SEQ ID NO: 415220 - RNA, 19 nt, Human
aaagaagccuaugacuuga

SEQ ID NO: 415221 - RNA, 18 nt, Human
aggaggcgcgggacgcgu

SEQ ID NO: 415222 - RNA, 26 nt, Human
cagaaggcuuccucucaaauaagucu

SEQ ID NO: 415223 - RNA, 22 nt, Human
uaagugaaugccugaaaguauu

SEQ ID NO: 415224 - RNA, 26 nt, Human
uccaaccacggugcaggcgcgaggag

SEQ ID NO: 415225 - RNA, 21 nt, Human
ucuccugaggugacauaaaga

SEQ ID NO: 415226 - RNA, 24 nt, Human
ugacauaaagacugaaagaagccu

SEQ ID NO: 415227 - RNA, 20 nt, Human
uuaacagugucuuuauuaag

SEQ ID NO: 415228 - RNA, 24 nt, Human
uugcaaauacaucaucaauucuua

SEQ ID NO: 415229 - RNA, 25 nt, Human
uuugcaaauacaucaucaauucuua

SEQ ID NO: 415230 - RNA, 23 nt, Human
uaagaagaacugaggauaugggc

SEQ ID NO: 415231 - RNA, 24 nt, Human
uucaacuccgaaacuuuuauuguc

SEQ ID NO: 415232 - RNA, 20 nt, Human
aacaggggcggaagcccccc

SEQ ID NO: 415233 - RNA, 21 nt, Human
aagcuggcuuccacagagggc

SEQ ID NO: 415234 - RNA, 21 nt, Human
agcccccuccccacgcagccc

SEQ ID NO: 415235 - RNA, 20 nt, Human
agcccgaggggccgcggcag

SEQ ID NO: 415236 - RNA, 24 nt, Human
aggcaggagucugacggcagcagc

SEQ ID NO: 415237 - RNA, 22 nt, Human
cagccacccgcgcugggcccca

SEQ ID NO: 415238 - RNA, 19 nt, Human
caggaagcucucacagggc

SEQ ID NO: 415239 - RNA, 26 nt, Human
caggagcaaugacaacaggggcggaa

SEQ ID NO: 415240 - RNA, 21 nt, Human
caggugcuuccacucaggcuu

SEQ ID NO: 415241 - RNA, 19 nt, Human
ccccacgcagcccgagggg

SEQ ID NO: 415242 - RNA, 18 nt, Human
ccccuccccacgcagccc

SEQ ID NO: 415243 - RNA, 20 nt, Human
cucgcgggaccgugcccagg

SEQ ID NO: 415244 - RNA, 21 nt, Human
gcaaugacaacaggggcggaa

SEQ ID NO: 415245 - RNA, 20 nt, Human
gccgcggcagccacccgcgc

SEQ ID NO: 415246 - RNA, 23 nt, Human
gccugaggccagccccaggucag

SEQ ID NO: 415247 - RNA, 20 nt, Human
ggcacccggucggggggcgg

SEQ ID NO: 415248 - RNA, 18 nt, Human
ggcagucacgugcacgug

SEQ ID NO: 415249 - RNA, 22 nt, Human
ggcuaggguuuaagcuggcuuc

SEQ ID NO: 415250 - RNA, 24 nt, Human
ggcuaggguuuaagcuggcuucca

SEQ ID NO: 415251 - RNA, 22 nt, Human
guccuuauagggcacucgcggg

SEQ ID NO: 415252 - RNA, 18 nt, Human
uccacagagggcagucac

SEQ ID NO: 415253 - RNA, 23 nt, Human
uccuuccugcugggcacaggaag

SEQ ID NO: 415254 - RNA, 19 nt, Human
ugaggcaggagucugacgg

SEQ ID NO: 415255 - RNA, 20 nt, Human
ugaggcaggagucugacggc

SEQ ID NO: 415256 - RNA, 23 nt, Human
ugcaggagcaaugacaacagggg

SEQ ID NO: 415257 - RNA, 20 nt, Human
uggcaguccuuauagggcac

SEQ ID NO: 415258 - RNA, 25 nt, Human
ugggcacaggaagcucucacagggc

SEQ ID NO: 415259 - RNA, 20 nt, Human
aaacacacacacacaccccc

SEQ ID NO: 415260 - RNA, 19 nt, Human
aagaaaauuaaaacacaca

SEQ ID NO: 415261 - RNA, 20 nt, Human
acacacccccaaaggggagc

SEQ ID NO: 415262 - RNA, 24 nt, Human
acacacccccaaaggggagcaggg

SEQ ID NO: 415263 - RNA, 22 nt, Human
acccccaaaggggagcagggac

SEQ ID NO: 415264 - RNA, 18 nt, Human
acuguauccacagaaaug

SEQ ID NO: 415265 - RNA, 18 nt, Human
aggcuccccuccuuccca

SEQ ID NO: 415266 - RNA, 19 nt, Human
agguccaggccccgggugg

SEQ ID NO: 415267 - RNA, 19 nt, Human
cacacccccaaaggggagc

SEQ ID NO: 415268 - RNA, 22 nt, Human
cacacccccaaaggggagcagg

SEQ ID NO: 415269 - RNA, 23 nt, Human
cagaaacaagaggugggguggga

SEQ ID NO: 415270 - RNA, 22 nt, Human
cagaggccggcgugggcggcgg

SEQ ID NO: 415271 - RNA, 24 nt, Human
cagcagaggccggcgugggcggcg

SEQ ID NO: 415272 - RNA, 26 nt, Human
caggccccggguggcccccccaaagg

SEQ ID NO: 415273 - RNA, 20 nt, Human
cagggacccagaaacaagag

SEQ ID NO: 415274 - RNA, 18 nt, Human
ccaaguggaggagggcgg

SEQ ID NO: 415275 - RNA, 22 nt, Human
ccccaaaggcuccccuccuucc

SEQ ID NO: 415276 - RNA, 21 nt, Human
ccccaaaggggagcagggacc

SEQ ID NO: 415277 - RNA, 19 nt, Human
cccccaaaggggagcaggg

SEQ ID NO: 415278 - RNA, 18 nt, Human
ccccccaaaggcuccccu

SEQ ID NO: 415279 - RNA, 19 nt, Human
ccccccaaaggcuccccuc

SEQ ID NO: 415280 - RNA, 22 nt, Human
ccccuccuucccaucagcaccc

SEQ ID NO: 415281 - RNA, 24 nt, Human
ccucucugugcuaagggcugggga

SEQ ID NO: 415282 - RNA, 20 nt, Human
cgugggcggcggcggcugcg

SEQ ID NO: 415283 - RNA, 21 nt, Human
cucaguaccuccagagagcag

SEQ ID NO: 415284 - RNA, 23 nt, Human
cucucucuauuuuuuuuuuguca

SEQ ID NO: 415285 - RNA, 25 nt, Human
cuguacccucccucuugccuccagg

SEQ ID NO: 415286 - RNA, 22 nt, Human
gccggggcuuagcgagggccgg

SEQ ID NO: 415287 - RNA, 18 nt, Human
gccuccaggugagaccac

SEQ ID NO: 415288 - RNA, 21 nt, Human
gcggugggcacuguauccaca

SEQ ID NO: 415289 - RNA, 22 nt, Human
ggaggcaccagcgggacguugg

SEQ ID NO: 415290 - RNA, 23 nt, Human
ggaugggcagggaggauaccguu

SEQ ID NO: 415291 - RNA, 18 nt, Human
ggcacuguauccacagaa

SEQ ID NO: 415292 - RNA, 26 nt, Human
ggcagcagaggccggcgugggcggcg

SEQ ID NO: 415293 - RNA, 23 nt, Human
ggcccccccaaaggcuccccucc

SEQ ID NO: 415294 - RNA, 18 nt, Human
ggccggcgugggcggcgg

SEQ ID NO: 415295 - RNA, 22 nt, Human
ggccggcgugggcggcggcggc

SEQ ID NO: 415296 - RNA, 25 nt, Human
gggcagcagaggccggcgugggcga

SEQ ID NO: 415297 - RNA, 25 nt, Human
ggguggcccccccaaaggcuccccu

SEQ ID NO: 415298 - RNA, 21 nt, Human
guacccucccucuugccucca

SEQ ID NO: 415299 - RNA, 21 nt, Human
gugcuaagggcuggggaaggg

SEQ ID NO: 415300 - RNA, 18 nt, Human
gugggcggcggcggcugc

SEQ ID NO: 415301 - RNA, 21 nt, Human
uaaaacacacacacacacccc

SEQ ID NO: 415302 - RNA, 27 nt, Human
uacccucccucuugccuccaggugaga

SEQ ID NO: 415303 - RNA, 19 nt, Human
uccaggccccggguggccc

SEQ ID NO: 415304 - RNA, 19 nt, Human
ugcauagguccaggccccg

SEQ ID NO: 415305 - RNA, 23 nt, Human
ugggcagggaggauaccguuucc

SEQ ID NO: 415306 - RNA, 21 nt, Human
ugggggaggggcauguguccc

SEQ ID NO: 415307 - RNA, 18 nt, Human
uggggugggacguggccc

SEQ ID NO: 415308 - RNA, 20 nt, Human
aaaaagaagaaggaaacagc

SEQ ID NO: 415309 - RNA, 24 nt, Human
aaaaagaagaaggaaacagcaaga

SEQ ID NO: 415310 - RNA, 18 nt, Human
aaaaagacaaauacaaag

SEQ ID NO: 415311 - RNA, 20 nt, Human
aaaaagacaaauacaaagca

SEQ ID NO: 415312 - RNA, 24 nt, Human
aaaaagcauucuccuccugauaaa

SEQ ID NO: 415313 - RNA, 24 nt, Human
aaaagaagaaggaaacagcaagag

SEQ ID NO: 415314 - RNA, 26 nt, Human
aaaagaagaaggaaacagcaagagaa

SEQ ID NO: 415315 - RNA, 22 nt, Human
aaacaaucaggcaaaagcuauc

SEQ ID NO: 415316 - RNA, 23 nt, Human
aaagcauucuccuccugauaaag

SEQ ID NO: 415317 - RNA, 18 nt, Human
aaauaaauaaucaggccc

SEQ ID NO: 415318 - RNA, 19 nt, Human
aagaagaaggaaacagcaa

SEQ ID NO: 415319 - RNA, 21 nt, Human
aagaaggaaacagcaagagaa

SEQ ID NO: 415320 - RNA, 22 nt, Human
aagaaggaaacagcaagagaaa

SEQ ID NO: 415321 - RNA, 23 nt, Human
aagaaggaaacagcaagagaaag

SEQ ID NO: 415322 - RNA, 20 nt, Human
aauggcucuucaacaggacu

SEQ ID NO: 415323 - RNA, 19 nt, Human
accccugguuacucagcaa

SEQ ID NO: 415324 - RNA, 22 nt, Human
acgcugcuguaaccccugguua

SEQ ID NO: 415325 - RNA, 19 nt, Human
acuuuaagugauguugcga

SEQ ID NO: 415326 - RNA, 27 nt, Human
agaaaaagaaaacauuacaucaaauau

SEQ ID NO: 415327 - RNA, 23 nt, Human
agaaucuccaauagcaugagggc

SEQ ID NO: 415328 - RNA, 23 nt, Human
agcagcaggaaugcuggaaggaa

SEQ ID NO: 415329 - RNA, 25 nt, Human
aggaaugcuggaaggaagacuuggg

SEQ ID NO: 415330 - RNA, 18 nt, Human
aggugcaucagcagccag

SEQ ID NO: 415331 - RNA, 19 nt, Human
aguaaaaauaaaacaauac

SEQ ID NO: 415332 - RNA, 23 nt, Human
aguuuuuuagugccuuuaaauuu

SEQ ID NO: 415333 - RNA, 19 nt, Human
auacaaagcacauacuuug

SEQ ID NO: 415334 - RNA, 22 nt, Human
caaaaaagcauucuccuccuga

SEQ ID NO: 415335 - RNA, 21 nt, Human
caaaaagacaaauacaaagca

SEQ ID NO: 415336 - RNA, 22 nt, Human
caaaaagacaaauacaaagcac

SEQ ID NO: 415337 - RNA, 20 nt, Human
caacaggaccgcugucccuc

SEQ ID NO: 415338 - RNA, 20 nt, Human
cacaauguucuucauagaac

SEQ ID NO: 415339 - RNA, 30 nt, Human
cagcaauacuuugaagcaggguacuuuaaa

SEQ ID NO: 415340 - RNA, 24 nt, Human
cagccagucucaaugaaaagcaaa

SEQ ID NO: 415341 - RNA, 22 nt, Human
cauuuugcaaacucauuugcuc

SEQ ID NO: 415342 - RNA, 21 nt, Human
ccaguccccucagugugacaa

SEQ ID NO: 415343 - RNA, 21 nt, Human
ccccucagugugacaaauggc

SEQ ID NO: 415344 - RNA, 24 nt, Human
cuguaaccccugguuacucagcaa

SEQ ID NO: 415345 - RNA, 23 nt, Human
gcccacgccacuugccagcaaua

SEQ ID NO: 415346 - RNA, 21 nt, Human
ggaaacugcagacacguucuc

SEQ ID NO: 415347 - RNA, 24 nt, Human
ggcuguagcagcaggaaugcugga

SEQ ID NO: 415348 - RNA, 22 nt, Human
guaaaguauucugcagagcaaa

SEQ ID NO: 415349 - RNA, 19 nt, Human
uacuuugauccaauaaggc

SEQ ID NO: 415350 - RNA, 24 nt, Human
uagcucaaugguucaauuucuaau

SEQ ID NO: 415351 - RNA, 20 nt, Human
uagcuuucuuacaaugcuuu

SEQ ID NO: 415352 - RNA, 22 nt, Human
uagcuuucuuacaaugcuuuuu

SEQ ID NO: 415353 - RNA, 22 nt, Human
ucaaauaucuguuaggcaugau

SEQ ID NO: 415354 - RNA, 18 nt, Human
ucacagugaaaaaaagaa

SEQ ID NO: 415355 - RNA, 21 nt, Human
ucacagugaaaaaaagaagaa

SEQ ID NO: 415356 - RNA, 23 nt, Human
ucacuugcuuuaccauaguccug

SEQ ID NO: 415357 - RNA, 19 nt, Human
ucaggcccacgccacuugc

SEQ ID NO: 415358 - RNA, 22 nt, Human
ucagugugacaaauggcucuuc

SEQ ID NO: 415359 - RNA, 25 nt, Human
ucaguuagaauauaaucaugauuca

SEQ ID NO: 415360 - RNA, 22 nt, Human
ucauggaugauuaaaugaacau

SEQ ID NO: 415361 - RNA, 22 nt, Human
uccaaaaugacuuucucaugga

SEQ ID NO: 415362 - RNA, 23 nt, Human
ucucauggaugauuaaaugaaca

SEQ ID NO: 415363 - RNA, 20 nt, Human
ugaaacaaucaggcaaaagc

SEQ ID NO: 415364 - RNA, 21 nt, Human
ugaagcaggguacuuuaagug

SEQ ID NO: 415365 - RNA, 20 nt, Human
ugaccgaaacaagagccuca

SEQ ID NO: 415366 - RNA, 18 nt, Human
ugauccaauaaggcugcu

SEQ ID NO: 415367 - RNA, 23 nt, Human
uggaugauuaaaugaacaucuuu

SEQ ID NO: 415368 - RNA, 25 nt, Human
ugggacuuccaaaauauugcgguac

SEQ ID NO: 415369 - RNA, 21 nt, Human
ugguacagaguucaaucuguc

SEQ ID NO: 415370 - RNA, 19 nt, Human
uguaaagggauaugaaaau

SEQ ID NO: 415371 - RNA, 19 nt, Human
uuaacacugaguuuuuuag

SEQ ID NO: 415372 - RNA, 18 nt, Human
uuaccaaggugcaucagc

SEQ ID NO: 415373 - RNA, 27 nt, Human
uuagagaaguuaucuuuucccugggaa

SEQ ID NO: 415374 - RNA, 25 nt, Human
uucacaaaaagacaaauacaaagca

SEQ ID NO: 415375 - RNA, 18 nt, Human
uugauccaauaaggcugc

SEQ ID NO: 415376 - RNA, 19 nt, Human
uugcgauacuccauuuucu

SEQ ID NO: 415377 - RNA, 20 nt, Human
uugcuccaaaaugacuuucu

SEQ ID NO: 415378 - RNA, 21 nt, Human
uuuacauaauaauauauaucu

SEQ ID NO: 415379 - RNA, 26 nt, Human
uuuuacagcuauauugaaaucaugcu

SEQ ID NO: 415380 - RNA, 18 nt, Human
uuuuccuuuccuucacuu

SEQ ID NO: 415381 - RNA, 24 nt, Human
uuuuuuuuuuuuuuuuugccauuu

SEQ ID NO: 415382 - RNA, 28 nt, Human
uuuuuuuuuuuuuuuuuugccauuuuaa

SEQ ID NO: 415383 - RNA, 20 nt, Human
uuuuuuuuuuuuuuuuuugg

SEQ ID NO: 415384 - RNA, 24 nt, Human
aaaaaaaaauccccuuuguggcua

SEQ ID NO: 415385 - RNA, 21 nt, Human
aaaaaaaauccccuuuguggc

SEQ ID NO: 415386 - RNA, 19 nt, Human
aagaaaauagccugcauca

SEQ ID NO: 415387 - RNA, 24 nt, Human
aagcacaacugaggcaggaaugag

SEQ ID NO: 415388 - RNA, 23 nt, Human
aagggaaacaguguuuuauuuua

SEQ ID NO: 415389 - RNA, 23 nt, Human
aauagcgaauugacaccagagca

SEQ ID NO: 415390 - RNA, 21 nt, Human
aaucacccuuuaaagaucuac

SEQ ID NO: 415391 - RNA, 20 nt, Human
acagcacuaaagcagccagc

SEQ ID NO: 415392 - RNA, 22 nt, Human
acggaacagagaacgauuggag

SEQ ID NO: 415393 - RNA, 22 nt, Human
acuccaagaagacagagaggaa

SEQ ID NO: 415394 - RNA, 22 nt, Human
aucacccuuuaaagaucuacag

SEQ ID NO: 415395 - RNA, 18 nt, Human
auuuaaggggaaaaacca

SEQ ID NO: 415396 - RNA, 25 nt, Human
caaccaacuccucacgcaggagacg

SEQ ID NO: 415397 - RNA, 22 nt, Human
caagaaaauagccugcaucaac

SEQ ID NO: 415398 - RNA, 22 nt, Human
cagaaagaacuuuccagggaaa

SEQ ID NO: 415399 - RNA, 21 nt, Human
cagcuaaagacuuacagaacu

SEQ ID NO: 415400 - RNA, 20 nt, Human
cagcugguuccugcacucgu

SEQ ID NO: 415401 - RNA, 19 nt, Human
cagggaaaagaagcacaac

SEQ ID NO: 415402 - RNA, 22 nt, Human
cagggaaaagaagcacaacuga

SEQ ID NO: 415403 - RNA, 19 nt, Human
cagugcaguggagccuggu

SEQ ID NO: 415404 - RNA, 21 nt, Human
cagugcuuuuguacuggacca

SEQ ID NO: 415405 - RNA, 21 nt, Human
caguggagccuggugaauggu

SEQ ID NO: 415406 - RNA, 24 nt, Human
caucaacaacaagauaguuucaga

SEQ ID NO: 415407 - RNA, 18 nt, Human
cauucucugcuuuuuccu

SEQ ID NO: 415408 - RNA, 19 nt, Human
ccucauuagauuuuucagc

SEQ ID NO: 415409 - RNA, 25 nt, Human
ccuccugcaagagguugagcagggc

SEQ ID NO: 415410 - RNA, 19 nt, Human
ccugcaucaacaacaagau

SEQ ID NO: 415411 - RNA, 26 nt, Human
cuagugaucuguuugcugucauucuc

SEQ ID NO: 415412 - RNA, 19 nt, Human
cuccaagaagacagagagg

SEQ ID NO: 415413 - RNA, 18 nt, Human
cugguuccugcacucguu

SEQ ID NO: 415414 - RNA, 20 nt, Human
cugguuccugcacucguuca

SEQ ID NO: 415415 - RNA, 22 nt, Human
cuguuaccaaaaaaaaaaaauc

SEQ ID NO: 415416 - RNA, 20 nt, Human
cuuggugcuuucuggaggac

SEQ ID NO: 415417 - RNA, 21 nt, Human
gaauccaauaagagugcaggg

SEQ ID NO: 415418 - RNA, 18 nt, Human
gagccagugcaguggagc

SEQ ID NO: 415419 - RNA, 21 nt, Human
gcugguuccugcacucguuca

SEQ ID NO: 415420 - RNA, 21 nt, Human
ggaaaaaccagcaucuggagg

SEQ ID NO: 415421 - RNA, 19 nt, Human
ggaccuccaaccaacuccu

SEQ ID NO: 415422 - RNA, 21 nt, Human
ggagccuggugaauggugggg

SEQ ID NO: 415423 - RNA, 23 nt, Human
ggagccuggugaaugguggggag

SEQ ID NO: 415424 - RNA, 18 nt, Human
ggaguuuuucaaaacucc

SEQ ID NO: 415425 - RNA, 21 nt, Human
guccuuguccuccuagcccac

SEQ ID NO: 415426 - RNA, 18 nt, Human
gugaaacgagcugacacc

SEQ ID NO: 415427 - RNA, 24 nt, Human
gugugcucccuccugcaagagguu

SEQ ID NO: 415428 - RNA, 18 nt, Human
uaaagcagccagcugguu

SEQ ID NO: 415429 - RNA, 20 nt, Human
uacucagcaccuguggucag

SEQ ID NO: 415430 - RNA, 21 nt, Human
uacuggaccauuucagcuaaa

SEQ ID NO: 415431 - RNA, 24 nt, Human
uacuggaccauuucagcuaaagac

SEQ ID NO: 415432 - RNA, 20 nt, Human
ucagcagcugcuccagguuu

SEQ ID NO: 415433 - RNA, 23 nt, Human
ucauuagauuuuucagcagcugc

SEQ ID NO: 415434 - RNA, 18 nt, Human
uccuuggugcuuucugga

SEQ ID NO: 415435 - RNA, 23 nt, Human
uccuuguccuccuagcccacuca

SEQ ID NO: 415436 - RNA, 20 nt, Human
ucgguguguucugaugucug

SEQ ID NO: 415437 - RNA, 18 nt, Human
ucucugaguggaugggca

SEQ ID NO: 415438 - RNA, 23 nt, Human
ugaaacgagcugacaccugaaug

SEQ ID NO: 415439 - RNA, 23 nt, Human
ugagcagggcaggcugaguaaau

SEQ ID NO: 415440 - RNA, 20 nt, Human
ugagggcugcugaguacuca

SEQ ID NO: 415441 - RNA, 24 nt, Human
ugaucucugaguggaugggcaugg

SEQ ID NO: 415442 - RNA, 21 nt, Human
uggaggacagcagguugagga

SEQ ID NO: 415443 - RNA, 20 nt, Human
uggcgaauagcgaauugaca

SEQ ID NO: 415444 - RNA, 21 nt, Human
ugggcucuagccuguuaccaa

SEQ ID NO: 415445 - RNA, 18 nt, Human
uggggaccuccaaccaac

SEQ ID NO: 415446 - RNA, 22 nt, Human
uggucaggaaagugaaacgagc

SEQ ID NO: 415447 - RNA, 22 nt, Human
ugguguucgaaggaguuuuuca

SEQ ID NO: 415448 - RNA, 19 nt, Human
uguacuggaccauuucagc

SEQ ID NO: 415449 - RNA, 25 nt, Human
uguacuggaccauuucagcuaaaga

SEQ ID NO: 415450 - RNA, 19 nt, Human
uguuaccaaaaaaaaaaaa

SEQ ID NO: 415451 - RNA, 21 nt, Human
uguugggagucccaugaaggg

SEQ ID NO: 415452 - RNA, 24 nt, Human
uguugggagucccaugaagggguc

SEQ ID NO: 415453 - RNA, 25 nt, Human
uguuucauccuuguaaauaguucca

SEQ ID NO: 415454 - RNA, 18 nt, Human
uuccuuggugcuuucugg

SEQ ID NO: 415455 - RNA, 21 nt, Human
uuggugcuuucuggaggacag

SEQ ID NO: 415456 - RNA, 21 nt, Human
uuguccagguguauuuccuga

SEQ ID NO: 415457 - RNA, 21 nt, Human
uuugccucuuaguuccucauu

SEQ ID NO: 415458 - RNA, 18 nt, Human
uuuguacuggaccauuuc

SEQ ID NO: 415459 - RNA, 23 nt, Human
uuuucuaaagaaaaaagccuggu

SEQ ID NO: 415460 - RNA, 23 nt, Human
uuuuguacuggaccauuucagcu

SEQ ID NO: 415461 - RNA, 23 nt, Human
aaaaagcaaacacaaaagacugg

SEQ ID NO: 415462 - RNA, 18 nt, Human
aaaaccuagagagaccaa

SEQ ID NO: 415463 - RNA, 18 nt, Human
aaaagacugguguaaauc

SEQ ID NO: 415464 - RNA, 18 nt, Human
aaaagcaaacacaaaaga

SEQ ID NO: 415465 - RNA, 19 nt, Human
aaacacaaaagacuggugg

SEQ ID NO: 415466 - RNA, 22 nt, Human
aaacagauacaaauuaguccau

SEQ ID NO: 415467 - RNA, 19 nt, Human
aaaccuagagagaccaaua

SEQ ID NO: 415468 - RNA, 25 nt, Human
aaagacugguguaaauccaaguguu

SEQ ID NO: 415469 - RNA, 18 nt, Human
acaaggaaaauacacuca

SEQ ID NO: 415470 - RNA, 23 nt, Human
acacaaaagacugguguaaaucc

SEQ ID NO: 415471 - RNA, 21 nt, Human
accgauacaaguuuguuccca

SEQ ID NO: 415472 - RNA, 26 nt, Human
acugguguaaauccaaguguuuaaau

SEQ ID NO: 415473 - RNA, 21 nt, Human
agauauacuaggguacagaau

SEQ ID NO: 415474 - RNA, 22 nt, Human
agcccgccggguccccggcccc

SEQ ID NO: 415475 - RNA, 22 nt, Human
agcuucaaaagauaagcuaaag

SEQ ID NO: 415476 - RNA, 21 nt, Human
auaauuacuccaaaauaugga

SEQ ID NO: 415477 - RNA, 23 nt, Human
caaaucccaaggagugucaagag

SEQ ID NO: 415478 - RNA, 24 nt, Human
cauggcccaaagcgaaguccgcgg

SEQ ID NO: 415479 - RNA, 24 nt, Human
ccaaaaagauauacuaggguacag

SEQ ID NO: 415480 - RNA, 21 nt, Human
ccauccgcucccaagagcggg

SEQ ID NO: 415481 - RNA, 23 nt, Human
cccaaaaagauauacuaggguac

SEQ ID NO: 415482 - RNA, 22 nt, Human
ccccgagcccgccggguccccg

SEQ ID NO: 415483 - RNA, 21 nt, Human
cccgccggguccccggcccca

SEQ ID NO: 415484 - RNA, 19 nt, Human
cccugccccgagcccgccg

SEQ ID NO: 415485 - RNA, 18 nt, Human
ccgccggguccccggccc

SEQ ID NO: 415486 - RNA, 21 nt, Human
cgacaggugagucccugcccc

SEQ ID NO: 415487 - RNA, 21 nt, Human
cuucaaaagauaagcuaaaga

SEQ ID NO: 415488 - RNA, 22 nt, Human
cuucaugacucuuauaaaacua

SEQ ID NO: 415489 - RNA, 18 nt, Human
uaaaaaccuagagagacc

SEQ ID NO: 415490 - RNA, 18 nt, Human
uaaaaaccuagagagacc

SEQ ID NO: 415491 - RNA, 23 nt, Human
uaaaaagcaaacacaaaagacug

SEQ ID NO: 415492 - RNA, 21 nt, Human
uacacaaggaaaauacacuca

SEQ ID NO: 415493 - RNA, 20 nt, Human
uacauacaccauugugaaua

SEQ ID NO: 415494 - RNA, 20 nt, Human
uagucucuacugaggaaaau

SEQ ID NO: 415495 - RNA, 22 nt, Human
uccaugcccaaaaagauauacu

SEQ ID NO: 415496 - RNA, 22 nt, Human
ucccagaagcuaaugcaucacu

SEQ ID NO: 415497 - RNA, 20 nt, Human
uccccggccccaggaaaauc

SEQ ID NO: 415498 - RNA, 22 nt, Human
ugaaaaaccacaggaacuauaa

SEQ ID NO: 415499 - RNA, 23 nt, Human
ugaaugagauucugcuucuuggg

SEQ ID NO: 415500 - RNA, 18 nt, Human
ugagauucugcuucuugg

SEQ ID NO: 415501 - RNA, 23 nt, Human
ugagauucugcuucuugggugaa

SEQ ID NO: 415502 - RNA, 22 nt, Human
ugcccaaaaagauauacuaggg

SEQ ID NO: 415503 - RNA, 26 nt, Human
uggcccaaagcgaaguccgcggcggg

SEQ ID NO: 415504 - RNA, 23 nt, Human
ugggugaaaaaccacaggaacua

SEQ ID NO: 415505 - RNA, 21 nt, Human
ugucaagaguuaauuuauaga

SEQ ID NO: 415506 - RNA, 22 nt, Human
uucaaaucccaaggagugucaa

SEQ ID NO: 415507 - RNA, 22 nt, Human
uucaguaauucagauuucacua

SEQ ID NO: 415508 - RNA, 21 nt, Human
uuguauggguguguuuaauau

SEQ ID NO: 415509 - RNA, 18 nt, Human
uuuuuuuuuuuuuuuguc

SEQ ID NO: 415510 - RNA, 18 nt, Human
uuuuuuuuuuuuuuuuug

SEQ ID NO: 415511 - RNA, 19 nt, Human
uuuuuuuuuuuuuuuuugu

SEQ ID NO: 415512 - RNA, 26 nt, Human
aaccgugaugugugugucauacaacc

SEQ ID NO: 415513 - RNA, 25 nt, Human
aagcggggcggacacgagaagcgag

SEQ ID NO: 415514 - RNA, 18 nt, Human
accagugcuucuccacaa

SEQ ID NO: 415515 - RNA, 24 nt, Human
accagugcuucuccacaaggaacc

SEQ ID NO: 415516 - RNA, 23 nt, Human
accuugcguucaauggguggcug

SEQ ID NO: 415517 - RNA, 24 nt, Human
acgacuaagccugcaaugccuggc

SEQ ID NO: 415518 - RNA, 21 nt, Human
acucugggcugaggagaggga

SEQ ID NO: 415519 - RNA, 20 nt, Human
agaacacucugggcugagga

SEQ ID NO: 415520 - RNA, 18 nt, Human
agaagggagggucacugc

SEQ ID NO: 415521 - RNA, 26 nt, Human
agagagggcuuuuuuuuuuuuuuuuc

SEQ ID NO: 415522 - RNA, 21 nt, Human
agcacauaauccucgccuucc

SEQ ID NO: 415523 - RNA, 18 nt, Human
agugucuuccuggggcuc

SEQ ID NO: 415524 - RNA, 19 nt, Human
caauggguggcuggccaug

SEQ ID NO: 415525 - RNA, 21 nt, Human
caauggguggcuggccaugcu

SEQ ID NO: 415526 - RNA, 22 nt, Human
cacauaauccucgccuuccacc

SEQ ID NO: 415527 - RNA, 23 nt, Human
cacugcuaggaggagacacgacc

SEQ ID NO: 415528 - RNA, 18 nt, Human
cagaacacucugggcuga

SEQ ID NO: 415529 - RNA, 22 nt, Human
caguagccacgacuaagccugc

SEQ ID NO: 415530 - RNA, 18 nt, Human
ccaaagagccuucugagu

SEQ ID NO: 415531 - RNA, 21 nt, Human
cccgugccgccgccauagccg

SEQ ID NO: 415532 - RNA, 23 nt, Human
cccgugccgccgccauagccgcc

SEQ ID NO: 415533 - RNA, 24 nt, Human
cccgugccgccgccauagccgccg

SEQ ID NO: 415534 - RNA, 21 nt, Human
ccgggagagagcgaugcagcg

SEQ ID NO: 415535 - RNA, 18 nt, Human
ccucgugcuguggcucuc

SEQ ID NO: 415536 - RNA, 25 nt, Human
ccugguccccucccugguccccugg

SEQ ID NO: 415537 - RNA, 22 nt, Human
ccuuccaccaguccuccuugag

SEQ ID NO: 415538 - RNA, 24 nt, Human
cgccauagccgccgcagcagcagc

SEQ ID NO: 415539 - RNA, 20 nt, Human
cucaguccaccgcccgugcc

SEQ ID NO: 415540 - RNA, 19 nt, Human
cugcaguaugccucccacu

SEQ ID NO: 415541 - RNA, 24 nt, Human
gagaaccgugaugugugugucaua

SEQ ID NO: 415542 - RNA, 24 nt, Human
gagaagcgagauugcagagagggc

SEQ ID NO: 415543 - RNA, 27 nt, Human
gagagggcuuuuuuuuuuuuuuuuccu

SEQ ID NO: 415544 - RNA, 22 nt, Human
gcagagagggcuuuuuuuuuuu

SEQ ID NO: 415545 - RNA, 24 nt, Human
gcagcagcagcuguagaagcggaa

SEQ ID NO: 415546 - RNA, 19 nt, Human
gcagcuguagaagcggaau

SEQ ID NO: 415547 - RNA, 19 nt, Human
gccgccgccauagccgccg

SEQ ID NO: 415548 - RNA, 19 nt, Human
ggaagggcaaacacaggcg

SEQ ID NO: 415549 - RNA, 20 nt, Human
guugaugcagccagggaagg

SEQ ID NO: 415550 - RNA, 19 nt, Human
uaagaaaauacacucugug

SEQ ID NO: 415551 - RNA, 19 nt, Human
uaaugccaagcacgugcug

SEQ ID NO: 415552 - RNA, 18 nt, Human
uacacuucgaccuucugg

SEQ ID NO: 415553 - RNA, 20 nt, Human
uaccagugcuucuccacaag

SEQ ID NO: 415554 - RNA, 24 nt, Human
uauauacacacacacagcagaagg

SEQ ID NO: 415555 - RNA, 22 nt, Human
uauauauacacacacacagcag

SEQ ID NO: 415556 - RNA, 19 nt, Human
ucaguccaccgcccgugcc

SEQ ID NO: 415557 - RNA, 19 nt, Human
uccaccaguccuccuugag

SEQ ID NO: 415558 - RNA, 23 nt, Human
ucccugcaguaugccucccacug

SEQ ID NO: 415559 - RNA, 21 nt, Human
ucugaguucuuggcccaaagc

SEQ ID NO: 415560 - RNA, 19 nt, Human
ucuguggcaggacccaggg

SEQ ID NO: 415561 - RNA, 18 nt, Human
ugaacccccaucaccacc

SEQ ID NO: 415562 - RNA, 26 nt, Human
ugaacugaacagugugagauuugccc

SEQ ID NO: 415563 - RNA, 25 nt, Human
ugaccagguaaugccaagcacgugc

SEQ ID NO: 415564 - RNA, 20 nt, Human
ugcagagagggcuuuuuuuu

SEQ ID NO: 415565 - RNA, 28 nt, Human
ugcagagagggcuuuuuuuuuuuuuuuu

SEQ ID NO: 415566 - RNA, 28 nt, Human
ugcagcggcacaggagaacaguagccac

SEQ ID NO: 415567 - RNA, 21 nt, Human
ugccggacaagcagcaguucu

SEQ ID NO: 415568 - RNA, 22 nt, Human
ugccuggcgggggcaccuaaca

SEQ ID NO: 415569 - RNA, 19 nt, Human
ugcuaggaggagacacgac

SEQ ID NO: 415570 - RNA, 21 nt, Human
ugcuaggaggagacacgaccu

SEQ ID NO: 415571 - RNA, 19 nt, Human
ugugccggacaagcagcag

SEQ ID NO: 415572 - RNA, 18 nt, Human
uguggcaggacccagggc

SEQ ID NO: 415573 - RNA, 19 nt, Human
uugugccggacaagcagca

SEQ ID NO: 415574 - RNA, 23 nt, Human
uuguugaugcagccagggaaggu

SEQ ID NO: 415575 - RNA, 23 nt, Human
uuuucuaucuggccgcacuggcu

SEQ ID NO: 415576 - RNA, 23 nt, Human
uuuuuuuuuggggagcagacugg

SEQ ID NO: 415577 - RNA, 19 nt, Human
uuuuuuuuuuuuuuucugu

SEQ ID NO: 415578 - RNA, 21 nt, Human
uuuuuuuuuuuuuuucugugg

SEQ ID NO: 415579 - RNA, 26 nt, Human
cggagccggagcgcggggucugccgg

SEQ ID NO: 415580 - RNA, 18 nt, Human
cggcgcgcaccggagccg

SEQ ID NO: 415581 - RNA, 19 nt, Human
cugccggcggcggcggcgc

SEQ ID NO: 415582 - RNA, 19 nt, Human
gagccgagcgagccgagcc

SEQ ID NO: 415583 - RNA, 20 nt, Human
gagccggagccggagcgcgg

SEQ ID NO: 415584 - RNA, 22 nt, Human
gagcgagccgagccggagccgg

SEQ ID NO: 415585 - RNA, 22 nt, Human
gagcgcggggucugccggcggc

SEQ ID NO: 415586 - RNA, 22 nt, Human
gcaccggagccgagcgagccga

SEQ ID NO: 415587 - RNA, 18 nt, Human
gccggagcgcggggucug

SEQ ID NO: 415588 - RNA, 21 nt, Human
ggggucugccggcggcggcgg

SEQ ID NO: 415589 - RNA, 26 nt, Human
ggggucugccggcggcggcggcgacg

SEQ ID NO: 415590 - RNA, 18 nt, Human
ucugccggcggcggcggc

SEQ ID NO: 415591 - RNA, 19 nt, Human
ugccggcggcggcggcgcg

SEQ ID NO: 415592 - RNA, 24 nt, Human
uuaaaaaggcguauggcuucuuuu

SEQ ID NO: 415593 - RNA, 24 nt, Human
aaagugcugggauuacaggcguga

SEQ ID NO: 415594 - RNA, 25 nt, Human
aagcaauucucccaccucagccucc

SEQ ID NO: 415595 - RNA, 18 nt, Human
aaggauggguggcuacag

SEQ ID NO: 415596 - RNA, 19 nt, Human
aaguagcugggaucacagg

SEQ ID NO: 415597 - RNA, 24 nt, Human
aaguagcugggaucacaggugugc

SEQ ID NO: 415598 - RNA, 19 nt, Human
aagugcugggauuacaggc

SEQ ID NO: 415599 - RNA, 19 nt, Human
aagugcugggauuacaggc

SEQ ID NO: 415600 - RNA, 26 nt, Human
aagugcugggauuacaggcgugagcc

SEQ ID NO: 415601 - RNA, 21 nt, Human
aaugagagcaacacuuccuuu

SEQ ID NO: 415602 - RNA, 19 nt, Human
acaggguuucaccaugugg

SEQ ID NO: 415603 - RNA, 23 nt, Human
acaggguuucaccauguggccag

SEQ ID NO: 415604 - RNA, 23 nt, Human
accauguggccaggcuggucucg

SEQ ID NO: 415605 - RNA, 23 nt, Human
acccaggcuggagugcaguggug

SEQ ID NO: 415606 - RNA, 21 nt, Human
agaaaggaaauacaaacacaa

SEQ ID NO: 415607 - RNA, 22 nt, Human
agacaaaagacuugaggucaaa

SEQ ID NO: 415608 - RNA, 20 nt, Human
agacaggguuucaccaugug

SEQ ID NO: 415609 - RNA, 26 nt, Human
agcaagaaaaaugaccacagaaggaa

SEQ ID NO: 415610 - RNA, 24 nt, Human
aggagagcugggccugacgagggc

SEQ ID NO: 415611 - RNA, 23 nt, Human
aggcggaggcgcggugguggcgg

SEQ ID NO: 415612 - RNA, 25 nt, Human
aggcuggagugcaguggugugaucu

SEQ ID NO: 415613 - RNA, 19 nt, Human
agguaauaggugugcagua

SEQ ID NO: 415614 - RNA, 24 nt, Human
agucucucugucacccaggcugga

SEQ ID NO: 415615 - RNA, 19 nt, Human
agugcaguggugugaucuc

SEQ ID NO: 415616 - RNA, 21 nt, Human
agugcaguggugugaucucag

SEQ ID NO: 415617 - RNA, 23 nt, Human
agugcaguggugugaucucagcu

SEQ ID NO: 415618 - RNA, 24 nt, Human
agugcaguggugugaucucagcuc

SEQ ID NO: 415619 - RNA, 24 nt, Human
aguggugugaucucagcucacugc

SEQ ID NO: 415620 - RNA, 21 nt, Human
auagggcagcacaauccaaag

SEQ ID NO: 415621 - RNA, 23 nt, Human
augaggugaaacauaaacccacc

SEQ ID NO: 415622 - RNA, 27 nt, Human
auuaaucccuuuuuuuuuauuauuauu

SEQ ID NO: 415623 - RNA, 19 nt, Human
caaacacaacugagccaag

SEQ ID NO: 415624 - RNA, 24 nt, Human
caaagugcugggauuacaggcgug

SEQ ID NO: 415625 - RNA, 21 nt, Human
caacacucagaagacaaaaga

SEQ ID NO: 415626 - RNA, 24 nt, Human
caagaacagcaaauaauagguaau

SEQ ID NO: 415627 - RNA, 27 nt, Human
caagcaauucucccaccucagccuccc

SEQ ID NO: 415628 - RNA, 24 nt, Human
cacaggugugcaccaccacaucca

SEQ ID NO: 415629 - RNA, 20 nt, Human
caccauguggccaggcuggu

SEQ ID NO: 415630 - RNA, 23 nt, Human
caccauguggccaggcuggucuc

SEQ ID NO: 415631 - RNA, 21 nt, Human
cacccaggcuggagugcagug

SEQ ID NO: 415632 - RNA, 19 nt, Human
caccgugcccagccaagau

SEQ ID NO: 415633 - RNA, 24 nt, Human
caccucagccucccaaguagcugg

SEQ ID NO: 415634 - RNA, 23 nt, Human
caccugccucagccucccaaagu

SEQ ID NO: 415635 - RNA, 18 nt, Human
cagcacaauccaaagaua

SEQ ID NO: 415636 - RNA, 18 nt, Human
caggaaaagccugcaaua

SEQ ID NO: 415637 - RNA, 19 nt, Human
caggaaaagccugcaauag

SEQ ID NO: 415638 - RNA, 20 nt, Human
caggagcagcugcggcggcg

SEQ ID NO: 415639 - RNA, 18 nt, Human
caggguuucaccaugugg

SEQ ID NO: 415640 - RNA, 23 nt, Human
caggguuucaccauguggccagg

SEQ ID NO: 415641 - RNA, 19 nt, Human
caucagagagagacacaau

SEQ ID NO: 415642 - RNA, 22 nt, Human
ccaaagugcugggauuacaggc

SEQ ID NO: 415643 - RNA, 22 nt, Human
ccaaagugcugggauuacaggc

SEQ ID NO: 415644 - RNA, 24 nt, Human
ccaaagugcugggauuacaggcgu

SEQ ID NO: 415645 - RNA, 26 nt, Human
ccaccugccucagccucccaaagugc

SEQ ID NO: 415646 - RNA, 22 nt, Human
ccagagcuugucaacauuuucu

SEQ ID NO: 415647 - RNA, 19 nt, Human
ccagguucaagcaauucuc

SEQ ID NO: 415648 - RNA, 21 nt, Human
ccagguucaagcaauucuccc

SEQ ID NO: 415649 - RNA, 19 nt, Human
cccaaguagcugggaucac

SEQ ID NO: 415650 - RNA, 23 nt, Human
cccaccucagccucccaaguagc

SEQ ID NO: 415651 - RNA, 20 nt, Human
cccaggcuggagugcagugg

SEQ ID NO: 415652 - RNA, 20 nt, Human
ccucauuuucuaaaaauaag

SEQ ID NO: 415653 - RNA, 23 nt, Human
ccucuaaagcucuggauuauaga

SEQ ID NO: 415654 - RNA, 24 nt, Human
ccugccucagccucccaaagugcu

SEQ ID NO: 415655 - RNA, 24 nt, Human
ccuuccagguucaagcaauucucc

SEQ ID NO: 415656 - RNA, 23 nt, Human
cgaggcggaggcgcggugguggc

SEQ ID NO: 415657 - RNA, 24 nt, Human
cgcggugguggcggcggcuucggu

SEQ ID NO: 415658 - RNA, 20 nt, Human
cggccgaggcggaggcgcgg

SEQ ID NO: 415659 - RNA, 25 nt, Human
cuaaagcucuggauuauagaaauga

SEQ ID NO: 415660 - RNA, 24 nt, Human
cucacugcaacuucugccuuccag

SEQ ID NO: 415661 - RNA, 24 nt, Human
cucagccucccaaguagcugggau

SEQ ID NO: 415662 - RNA, 20 nt, Human
cucugucacccaggcuggag

SEQ ID NO: 415663 - RNA, 24 nt, Human
cugcaacuucugccuuccagguuc

SEQ ID NO: 415664 - RNA, 24 nt, Human
cugccucagccucccaaagugcug

SEQ ID NO: 415665 - RNA, 24 nt, Human
cugcggcggcggccgaggcggagg

SEQ ID NO: 415666 - RNA, 21 nt, Human
cuucuguccucuuuuguucca

SEQ ID NO: 415667 - RNA, 19 nt, Human
gaaauacaaacacaacuga

SEQ ID NO: 415668 - RNA, 22 nt, Human
gagagacacaauaauaaaugua

SEQ ID NO: 415669 - RNA, 18 nt, Human
gagcuugucaacauuuuc

SEQ ID NO: 415670 - RNA, 21 nt, Human
gagugcaguggugugaucuca

SEQ ID NO: 415671 - RNA, 18 nt, Human
gauuacaggcgugagcca

SEQ ID NO: 415672 - RNA, 21 nt, Human
gauuacaggcgugagccaccg

SEQ ID NO: 415673 - RNA, 24 nt, Human
gauuacaggcgugagccaccgugc

SEQ ID NO: 415674 - RNA, 24 nt, Human
gcagcaagaaaaaugaccacagag

SEQ ID NO: 415675 - RNA, 22 nt, Human
gccaagcuccaacacucagaag

SEQ ID NO: 415676 - RNA, 22 nt, Human
gcggaggcgcggugguggcggc

SEQ ID NO: 415677 - RNA, 26 nt, Human
gcggcgcaggagagcugggccugacg

SEQ ID NO: 415678 - RNA, 24 nt, Human
gcggcggcgcaggagagcugggcc

SEQ ID NO: 415679 - RNA, 22 nt, Human
ggaaauacaaacacaacugagc

SEQ ID NO: 415680 - RNA, 24 nt, Human
ggaaauacaaacacaacugagcca

SEQ ID NO: 415681 - RNA, 22 nt, Human
ggaccaggagcagcugcggcgg

SEQ ID NO: 415682 - RNA, 22 nt, Human
ggaggcgcggugguggcggcgg

SEQ ID NO: 415683 - RNA, 21 nt, Human
ggcaaagaagauaacaaauau

SEQ ID NO: 415684 - RNA, 18 nt, Human
ggcgcggcgggaggcggc

SEQ ID NO: 415685 - RNA, 20 nt, Human
ggcggcgcaggagagcuggg

SEQ ID NO: 415686 - RNA, 22 nt, Human
ggcuggagugcaguggugugau

SEQ ID NO: 415687 - RNA, 18 nt, Human
gggaccaggagcagcugc

SEQ ID NO: 415688 - RNA, 22 nt, Human
ggggcgcggcgggaggcggcgg

SEQ ID NO: 415689 - RNA, 23 nt, Human
ggugaaaaaggcagcaagaaaaa

SEQ ID NO: 415690 - RNA, 23 nt, Human
gucucucugucacccaggcugga

SEQ ID NO: 415691 - RNA, 24 nt, Human
gugaaccaccugccucagccuccc

SEQ ID NO: 415692 - RNA, 19 nt, Human
gugguggcggcggcuucgg

SEQ ID NO: 415693 - RNA, 24 nt, Human
uaaaauacaggcaggcaaagaaga

SEQ ID NO: 415694 - RNA, 18 nt, Human
uaaauguccucauuuucu

SEQ ID NO: 415695 - RNA, 23 nt, Human
uaagacugauuauuacaaagcca

SEQ ID NO: 415696 - RNA, 24 nt, Human
uaauuuuuauaucuuuaguagaga

SEQ ID NO: 415697 - RNA, 21 nt, Human
uacaaacacaacugagccaag

SEQ ID NO: 415698 - RNA, 24 nt, Human
uacaggcgugagccaccgugccca

SEQ ID NO: 415699 - RNA, 22 nt, Human
uagagacaggguuucaccaugu

SEQ ID NO: 415700 - RNA, 24 nt, Human
uaguagagacaggguuucaccaug

SEQ ID NO: 415701 - RNA, 25 nt, Human
uaguagagacaggguuucaccaugu

SEQ ID NO: 415702 - RNA, 19 nt, Human
uauagaaaugaucaacaaa

SEQ ID NO: 415703 - RNA, 24 nt, Human
uauuaaauguccucauuuucuaaa

SEQ ID NO: 415704 - RNA, 22 nt, Human
ucacccaggcuggagugcagug

SEQ ID NO: 415705 - RNA, 18 nt, Human
ucacugcaacuucugccu

SEQ ID NO: 415706 - RNA, 24 nt, Human
ucacugcaacuucugccuuccagg

SEQ ID NO: 415707 - RNA, 22 nt, Human
ucagcauccaaagaaauccauu

SEQ ID NO: 415708 - RNA, 18 nt, Human
ucagccucccaaguagcu

SEQ ID NO: 415709 - RNA, 20 nt, Human
ucagccucccaaguagcugg

SEQ ID NO: 415710 - RNA, 22 nt, Human
uccaugggauggacagcagcac

SEQ ID NO: 415711 - RNA, 24 nt, Human
ucccaaagugcugggauuacaggc

SEQ ID NO: 415712 - RNA, 23 nt, Human
ucccaaguagcugggaucacagg

SEQ ID NO: 415713 - RNA, 24 nt, Human
ucuaagcauaaauacuaaaaugaa

SEQ ID NO: 415714 - RNA, 23 nt, Human
ucucccaccucagccucccaagu

SEQ ID NO: 415715 - RNA, 26 nt, Human
ucucccaccucagccucccaaguagc

SEQ ID NO: 415716 - RNA, 22 nt, Human
ucucucugucacccaggcugga

SEQ ID NO: 415717 - RNA, 23 nt, Human
ucucucugucacccaggcuggag

SEQ ID NO: 415718 - RNA, 24 nt, Human
ucucucugucacccaggcuggagu

SEQ ID NO: 415719 - RNA, 25 nt, Human
ucucugucacccaggcuggagugca

SEQ ID NO: 415720 - RNA, 24 nt, Human
ucugucacccaggcuggagugcag

SEQ ID NO: 415721 - RNA, 24 nt, Human
ucuuuaguagagacaggguuucac

SEQ ID NO: 415722 - RNA, 20 nt, Human
ugaaaaaggcagcaagaaaa

SEQ ID NO: 415723 - RNA, 19 nt, Human
ugagacagagucucucugu

SEQ ID NO: 415724 - RNA, 24 nt, Human
ugagacagagucucucugucaccc

SEQ ID NO: 415725 - RNA, 23 nt, Human
ugcaacuucugccuuccagguuc

SEQ ID NO: 415726 - RNA, 24 nt, Human
ugccucagccucccaaagugcugg

SEQ ID NO: 415727 - RNA, 24 nt, Human
ugcugggauuacaggcgugagcca

SEQ ID NO: 415728 - RNA, 19 nt, Human
uggagugcaguggugugau

SEQ ID NO: 415729 - RNA, 24 nt, Human
uggagugcaguggugugaucucag

SEQ ID NO: 415730 - RNA, 23 nt, Human
uggaugcuuaacagcacaguguu

SEQ ID NO: 415731 - RNA, 22 nt, Human
uggccaggcuggucucgaacuc

SEQ ID NO: 415732 - RNA, 21 nt, Human
ugggaucacaggugugcacca

SEQ ID NO: 415733 - RNA, 22 nt, Human
ugggaucacaggugugcaccac

SEQ ID NO: 415734 - RNA, 24 nt, Human
ugggaucacaggugugcaccacca

SEQ ID NO: 415735 - RNA, 18 nt, Human
ugggauuacaggcgugag

SEQ ID NO: 415736 - RNA, 21 nt, Human
ugggauuacaggcgugagcca

SEQ ID NO: 415737 - RNA, 22 nt, Human
ugggauuacaggcgugagccac

SEQ ID NO: 415738 - RNA, 23 nt, Human
ugggauuacaggcgugagccacc

SEQ ID NO: 415739 - RNA, 23 nt, Human
ugggauuacaggcgugagccacc

SEQ ID NO: 415740 - RNA, 24 nt, Human
ugggauuacaggcgugagccaccg

SEQ ID NO: 415741 - RNA, 24 nt, Human
uggugugaucucagcucacugcaa

SEQ ID NO: 415742 - RNA, 21 nt, Human
ugucuucagccaagcuccaac

SEQ ID NO: 415743 - RNA, 18 nt, Human
ugugcaccaccacaucca

SEQ ID NO: 415744 - RNA, 24 nt, Human
uuaguagagacaggguuucaccau

SEQ ID NO: 415745 - RNA, 24 nt, Human
uucaagcaauucucccaccucagc

SEQ ID NO: 415746 - RNA, 24 nt, Human
uucagcauccaaagaaauccauuu

SEQ ID NO: 415747 - RNA, 23 nt, Human
uuccaugggauggacagcagcac

SEQ ID NO: 415748 - RNA, 24 nt, Human
uuuaaaaaugucuuucugccaccu

SEQ ID NO: 415749 - RNA, 20 nt, Human
uuucaccauguggccaggcu

SEQ ID NO: 415750 - RNA, 22 nt, Human
uuugaaccaugcaagaacagca

SEQ ID NO: 415751 - RNA, 22 nt, Human
uuuuauaucuuuaguagagaca

SEQ ID NO: 415752 - RNA, 19 nt, Human
uuuuguuccaaaugaggug

SEQ ID NO: 415753 - RNA, 20 nt, Human
uuuuuauaucuuuaguagag

SEQ ID NO: 415754 - RNA, 20 nt, Human
uuuuuuuuuuugagacagag

SEQ ID NO: 415755 - RNA, 20 nt, Human
uuuuuuuuuuuuuuuuuugg

SEQ ID NO: 415756 - RNA, 18 nt, Human
aaaauuacaaacagcacu

SEQ ID NO: 415757 - RNA, 20 nt, Human
aaaauuacaaacagcacuga

SEQ ID NO: 415758 - RNA, 26 nt, Human
acggaaauggaaaaugacagcguguc

SEQ ID NO: 415759 - RNA, 22 nt, Human
acuccguagauccaggaacgga

SEQ ID NO: 415760 - RNA, 20 nt, Human
agaugaucaauaaauauuug

SEQ ID NO: 415761 - RNA, 25 nt, Human
agaugccucccacugccacugcucu

SEQ ID NO: 415762 - RNA, 22 nt, Human
agcagccacauggccgggucug

SEQ ID NO: 415763 - RNA, 22 nt, Human
agcaguuguauaauacugaaau

SEQ ID NO: 415764 - RNA, 21 nt, Human
auacugaaauacccccugcca

SEQ ID NO: 415765 - RNA, 18 nt, Human
caaaacccccaggccgca

SEQ ID NO: 415766 - RNA, 18 nt, Human
cacccaggaccgagcagc

SEQ ID NO: 415767 - RNA, 21 nt, Human
cacugggaaccccugaaguuc

SEQ ID NO: 415768 - RNA, 18 nt, Human
cagcugccuggcccgcgu

SEQ ID NO: 415769 - RNA, 20 nt, Human
cagcugccuggcccgcguuc

SEQ ID NO: 415770 - RNA, 19 nt, Human
caggacagcacgacuucac

SEQ ID NO: 415771 - RNA, 21 nt, Human
caugcaagcguccagccuccg

SEQ ID NO: 415772 - RNA, 20 nt, Human
ccaaaacccccaggccgcag

SEQ ID NO: 415773 - RNA, 22 nt, Human
cccacugccacugcucucccca

SEQ ID NO: 415774 - RNA, 26 nt, Human
cccacugggaaccccugaaguuccca

SEQ ID NO: 415775 - RNA, 21 nt, Human
cccccagaugccucccacugc

SEQ ID NO: 415776 - RNA, 24 nt, Human
cccccagaugccucccacugccac

SEQ ID NO: 415777 - RNA, 25 nt, Human
cccccaggccgcagcugccuggccc

SEQ ID NO: 415778 - RNA, 19 nt, Human
ccccugaaguucccacagg

SEQ ID NO: 415779 - RNA, 19 nt, Human
cccgcguucaggacagcac

SEQ ID NO: 415780 - RNA, 21 nt, Human
cccgcguucaggacagcacga

SEQ ID NO: 415781 - RNA, 19 nt, Human
cccugaaguucccacaggc

SEQ ID NO: 415782 - RNA, 20 nt, Human
ccucauugcaaaaucucuua

SEQ ID NO: 415783 - RNA, 22 nt, Human
ccucccacugccacugcucucc

SEQ ID NO: 415784 - RNA, 22 nt, Human
cgugaucacuccaaaaccccca

SEQ ID NO: 415785 - RNA, 18 nt, Human
cuccccacugggaacccc

SEQ ID NO: 415786 - RNA, 22 nt, Human
cuccccacugggaaccccugaa

SEQ ID NO: 415787 - RNA, 18 nt, Human
cucuccccacugggaacc

SEQ ID NO: 415788 - RNA, 19 nt, Human
cugccacugcucuccccac

SEQ ID NO: 415789 - RNA, 20 nt, Human
cugccacugcucuccccacu

SEQ ID NO: 415790 - RNA, 19 nt, Human
cugggaaccccugaaguuc

SEQ ID NO: 415791 - RNA, 19 nt, Human
cuuauggagaagagaugau

SEQ ID NO: 415792 - RNA, 18 nt, Human
gaauagcaguuacaaaac

SEQ ID NO: 415793 - RNA, 27 nt, Human
gccucccacugccacugcucuccccac

SEQ ID NO: 415794 - RNA, 19 nt, Human
ggaaucucucaagcgccau

SEQ ID NO: 415795 - RNA, 21 nt, Human
gggaaccccugaaguucccac

SEQ ID NO: 415796 - RNA, 24 nt, Human
guuauauaguuugaaaacaaugcu

SEQ ID NO: 415797 - RNA, 20 nt, Human
uacccccugccacugaccuu

SEQ ID NO: 415798 - RNA, 24 nt, Human
uaucacacuaucuuauggagaaga

SEQ ID NO: 415799 - RNA, 23 nt, Human
ucccacugccacugcucucccca

SEQ ID NO: 415800 - RNA, 18 nt, Human
ucuuagaagacuccguag

SEQ ID NO: 415801 - RNA, 21 nt, Human
ucuugcacagcagcgagcacc

SEQ ID NO: 415802 - RNA, 24 nt, Human
ugaaauacccccugccacugaccu

SEQ ID NO: 415803 - RNA, 25 nt, Human
ugaaauacccccugccacugaccuu

SEQ ID NO: 415804 - RNA, 19 nt, Human
uggcccccagaugccuccc

SEQ ID NO: 415805 - RNA, 19 nt, Human
aaaaaauaauggagcuaca

SEQ ID NO: 415806 - RNA, 21 nt, Human
aaaaaauaauggagcuacaac

SEQ ID NO: 415807 - RNA, 19 nt, Human
aaagacacaaaaauagacg

SEQ ID NO: 415808 - RNA, 19 nt, Human
aauuuauucacaaaaagug

SEQ ID NO: 415809 - RNA, 18 nt, Human
acccccuccccccucccc

SEQ ID NO: 415810 - RNA, 24 nt, Human
aggccagccagggccaggccccag

SEQ ID NO: 415811 - RNA, 21 nt, Human
cacaggcuggaccuguccccc

SEQ ID NO: 415812 - RNA, 24 nt, Human
caccacaggcuggaccuguccccc

SEQ ID NO: 415813 - RNA, 19 nt, Human
cacccccuccccccucccc

SEQ ID NO: 415814 - RNA, 22 nt, Human
cagggccaggccccaguucagg

SEQ ID NO: 415815 - RNA, 18 nt, Human
caggggcuuggugagcuu

SEQ ID NO: 415816 - RNA, 27 nt, Human
ccacccccuccccccuccccgauuaaa

SEQ ID NO: 415817 - RNA, 23 nt, Human
ccagggccaggccccaguucagg

SEQ ID NO: 415818 - RNA, 21 nt, Human
ccgauuaaaaagacacaaaaa

SEQ ID NO: 415819 - RNA, 24 nt, Human
cggcgggagaggccagccagggcc

SEQ ID NO: 415820 - RNA, 25 nt, Human
cgggagaggccagccagggccaggc

SEQ ID NO: 415821 - RNA, 23 nt, Human
gcuuggugagcuuuguacauggg

SEQ ID NO: 415822 - RNA, 21 nt, Human
ggagccuggggcuuaagggug

SEQ ID NO: 415823 - RNA, 24 nt, Human
gggagaggccagccagggccaggc

SEQ ID NO: 415824 - RNA, 22 nt, Human
gggcaggggcuuggugagcuuu

SEQ ID NO: 415825 - RNA, 24 nt, Human
ggggcuguacaugggcaggggcuu

SEQ ID NO: 415826 - RNA, 22 nt, Human
gggggcuguacaugggcagggg

SEQ ID NO: 415827 - RNA, 18 nt, Human
uaaaaagacacaaaaaua

SEQ ID NO: 415828 - RNA, 20 nt, Human
uaaaaagacacaaaaauaga

SEQ ID NO: 415829 - RNA, 24 nt, Human
uaaaaagacacaaaaauagacguu

SEQ ID NO: 415830 - RNA, 27 nt, Human
uacaaccacccccuccccccuccccga

SEQ ID NO: 415831 - RNA, 23 nt, Human
uccccccuccccgauuaaaaaga

SEQ ID NO: 415832 - RNA, 20 nt, Human
ugagcuuuguacauggggcu

SEQ ID NO: 415833 - RNA, 19 nt, Human
ugaggcggcgggagaggcc

SEQ ID NO: 415834 - RNA, 21 nt, Human
ugaggcggcgggagaggccag

SEQ ID NO: 415835 - RNA, 24 nt, Human
ugagguaaacggggagccuggggc

SEQ ID NO: 415836 - RNA, 20 nt, Human
uggggcugggagacaaggga

SEQ ID NO: 415837 - RNA, 20 nt, Human
uggugagcuuuguacauggg

SEQ ID NO: 415838 - RNA, 21 nt, Human
ugucccccagugaggcggcgg

SEQ ID NO: 415839 - RNA, 21 nt, Human
uuuaaagggcuucacaggugc

SEQ ID NO: 415840 - RNA, 21 nt, Human
agaacacuagcagucugcaga

SEQ ID NO: 415841 - RNA, 19 nt, Human
agcagucugcagaguguca

SEQ ID NO: 415842 - RNA, 19 nt, Human
cagaacacuagcagucugc

SEQ ID NO: 415843 - RNA, 21 nt, Human
cagaacacuagcagucugcag

SEQ ID NO: 415844 - RNA, 19 nt, Human
cuagguaaacggucuucuu

SEQ ID NO: 415845 - RNA, 23 nt, Human
uacaggguggcaggaucguggag

SEQ ID NO: 415846 - RNA, 21 nt, Human
aaaaggguacagagcagaggg

SEQ ID NO: 415847 - RNA, 24 nt, Human
aaagggggaggggaggcacaggug

SEQ ID NO: 415848 - RNA, 18 nt, Human
aacaaagggggaggggag

SEQ ID NO: 415849 - RNA, 18 nt, Human
aacaaagucuccuuacag

SEQ ID NO: 415850 - RNA, 21 nt, Human
acaaagucuccuuacagacag

SEQ ID NO: 415851 - RNA, 22 nt, Human
agaaggacaaggaagagacagg

SEQ ID NO: 415852 - RNA, 20 nt, Human
agacugaggcaggagggcaa

SEQ ID NO: 415853 - RNA, 21 nt, Human
agacugaggcaggagggcaag

SEQ ID NO: 415854 - RNA, 21 nt, Human
agagaagcagagcacugugga

SEQ ID NO: 415855 - RNA, 21 nt, Human
agagacagggugggggaaaga

SEQ ID NO: 415856 - RNA, 20 nt, Human
aggaagagacaggguggggg

SEQ ID NO: 415857 - RNA, 21 nt, Human
aggaagagacaggguggggga

SEQ ID NO: 415858 - RNA, 21 nt, Human
aggcaggagggcaagucgggg

SEQ ID NO: 415859 - RNA, 24 nt, Human
aggcaggagggcaagucggggggu

SEQ ID NO: 415860 - RNA, 22 nt, Human
aggggcaaacaaagggggaggg

SEQ ID NO: 415861 - RNA, 18 nt, Human
agggggaggggaggcaca

SEQ ID NO: 415862 - RNA, 19 nt, Human
agggggaggggaggcacag

SEQ ID NO: 415863 - RNA, 18 nt, Human
caaagucuccuuacagac

SEQ ID NO: 415864 - RNA, 22 nt, Human
caaccacacaggggcaaacaaa

SEQ ID NO: 415865 - RNA, 25 nt, Human
caccggcagcagcuucuccgcggcc

SEQ ID NO: 415866 - RNA, 21 nt, Human
cagagucuaucgcugccccuc

SEQ ID NO: 415867 - RNA, 20 nt, Human
cagccauucucccacggccu

SEQ ID NO: 415868 - RNA, 19 nt, Human
cagcuucuucccugcugcc

SEQ ID NO: 415869 - RNA, 23 nt, Human
cagcuucuucccugcugccgggg

SEQ ID NO: 415870 - RNA, 20 nt, Human
ccacgcgcacaaacgagacc

SEQ ID NO: 415871 - RNA, 19 nt, Human
cccacgcgcacaaacgaga

SEQ ID NO: 415872 - RNA, 20 nt, Human
cccagagucuaucgcugccc

SEQ ID NO: 415873 - RNA, 25 nt, Human
ccccagagucuaucgcugccccucu

SEQ ID NO: 415874 - RNA, 20 nt, Human
cccuauuucccucacauccc

SEQ ID NO: 415875 - RNA, 20 nt, Human
cccucccuccacaccagggg

SEQ ID NO: 415876 - RNA, 22 nt, Human
cccucugcucugcccagccauu

SEQ ID NO: 415877 - RNA, 26 nt, Human
ccggggacaaaaggaaaaaggguaca

SEQ ID NO: 415878 - RNA, 20 nt, Human
ccucaugccagguggucuuc

SEQ ID NO: 415879 - RNA, 26 nt, Human
ccuccagcuucuucccugcugccggg

SEQ ID NO: 415880 - RNA, 19 nt, Human
cgagaccccucccuccaca

SEQ ID NO: 415881 - RNA, 27 nt, Human
cggccccucccguccccguccugcucc

SEQ ID NO: 415882 - RNA, 23 nt, Human
cggggcgacacagagaagcagag

SEQ ID NO: 415883 - RNA, 24 nt, Human
cucacaucccuccuugaccaacca

SEQ ID NO: 415884 - RNA, 22 nt, Human
cucaugccagguggucuucccc

SEQ ID NO: 415885 - RNA, 20 nt, Human
cuccuuacagacagguggcu

SEQ ID NO: 415886 - RNA, 19 nt, Human
cugccccucugcucugccc

SEQ ID NO: 415887 - RNA, 22 nt, Human
cugcugccggggacaaaaggaa

SEQ ID NO: 415888 - RNA, 19 nt, Human
cuuccccugcccucauugg

SEQ ID NO: 415889 - RNA, 20 nt, Human
gaaagacugaggcaggaggg

SEQ ID NO: 415890 - RNA, 21 nt, Human
gaaagacugaggcaggagggc

SEQ ID NO: 415891 - RNA, 20 nt, Human
gagaccccucccuccacacc

SEQ ID NO: 415892 - RNA, 19 nt, Human
gcagagcacuguggauucc

SEQ ID NO: 415893 - RNA, 18 nt, Human
gggaggggaggcacaggu

SEQ ID NO: 415894 - RNA, 20 nt, Human
ggggaggggaggcacaggug

SEQ ID NO: 415895 - RNA, 22 nt, Human
ggggcugggcggggcgacacag

SEQ ID NO: 415896 - RNA, 21 nt, Human
gggggaggggaagcaacaaag

SEQ ID NO: 415897 - RNA, 22 nt, Human
ggugggggaaagacugaggcag

SEQ ID NO: 415898 - RNA, 20 nt, Human
gucuuccccugcccucauug

SEQ ID NO: 415899 - RNA, 25 nt, Human
uccauccccagagucuaucgcugcc

SEQ ID NO: 415900 - RNA, 22 nt, Human
uccccagagucuaucgcugccc

SEQ ID NO: 415901 - RNA, 20 nt, Human
uccccguccugcuccauccc

SEQ ID NO: 415902 - RNA, 21 nt, Human
ucccucagccccucucccuca

SEQ ID NO: 415903 - RNA, 24 nt, Human
uccuugaccaaccacacaggggca

SEQ ID NO: 415904 - RNA, 25 nt, Human
ugaccaaccacacaggggcaaacaa

SEQ ID NO: 415905 - RNA, 24 nt, Human
ugccagguggucuuccccugcccu

SEQ ID NO: 415906 - RNA, 23 nt, Human
ugcucugcccagccauucuccca

SEQ ID NO: 415907 - RNA, 22 nt, Human
uucuccgcggccgcggauccga

SEQ ID NO: 415908 - RNA, 23 nt, Human
uugaccaaccacacaggggcaaa

SEQ ID NO: 415909 - RNA, 22 nt, Human
uuguacuuuuauucacaucgug

SEQ ID NO: 415910 - RNA, 19 nt, Human
uuuuggcauuuccagagaa

SEQ ID NO: 415911 - RNA, 22 nt, Human
aaaaaaugaaguaagcaaagaa

SEQ ID NO: 415912 - RNA, 27 nt, Human
aaaacaaacacagaaaagaauaaccac

SEQ ID NO: 415913 - RNA, 21 nt, Human
aaacaaagcaaaacuaaaguu

SEQ ID NO: 415914 - RNA, 25 nt, Human
aaagaaacauaacuuucaaugacua

SEQ ID NO: 415915 - RNA, 20 nt, Human
aaauacacgucccacaggcg

SEQ ID NO: 415916 - RNA, 24 nt, Human
aaauacacgucccacaggcgcagg

SEQ ID NO: 415917 - RNA, 19 nt, Human
aaauauuggcaacugcucc

SEQ ID NO: 415918 - RNA, 26 nt, Human
aagcaagaaaaagaaaggguaugggg

SEQ ID NO: 415919 - RNA, 22 nt, Human
aagcaagaaaaagagggacccc

SEQ ID NO: 415920 - RNA, 20 nt, Human
aagcugucuagcagccagag

SEQ ID NO: 415921 - RNA, 22 nt, Human
aaggcaacccaggcagagcuga

SEQ ID NO: 415922 - RNA, 24 nt, Human
aauucuaccucaaauaaauaauau

SEQ ID NO: 415923 - RNA, 26 nt, Human
acaaagaccaaaaauaaggugaaaca

SEQ ID NO: 415924 - RNA, 19 nt, Human
acaaggagucaucucccuc

SEQ ID NO: 415925 - RNA, 26 nt, Human
acacaauggcaaaaacaaaaagcaag

SEQ ID NO: 415926 - RNA, 24 nt, Human
acaugcaaacaaagcaaaacuaaa

SEQ ID NO: 415927 - RNA, 24 nt, Human
acccccagaaaggacuggaguuac

SEQ ID NO: 415928 - RNA, 26 nt, Human
agaaaagaauaaccacuaauugugaa

SEQ ID NO: 415929 - RNA, 21 nt, Human
agaaaggacuggcucuguccc

SEQ ID NO: 415930 - RNA, 18 nt, Human
agcacauagaggcaacca

SEQ ID NO: 415931 - RNA, 25 nt, Human
aggaagaaaggguaauggaaucugg

SEQ ID NO: 415932 - RNA, 18 nt, Human
aggaggaacaaggcggug

SEQ ID NO: 415933 - RNA, 19 nt, Human
aggcagcuccgucucacug

SEQ ID NO: 415934 - RNA, 27 nt, Human
aggccccuuguccucuggcagcccagg

SEQ ID NO: 415935 - RNA, 18 nt, Human
aggcggugauguggcuca

SEQ ID NO: 415936 - RNA, 19 nt, Human
agggaaaaaaugaaguaag

SEQ ID NO: 415937 - RNA, 21 nt, Human
agggugaagagccugugaugg

SEQ ID NO: 415938 - RNA, 21 nt, Human
agguuccggagaaggcagccu

SEQ ID NO: 415939 - RNA, 24 nt, Human
auacaguucauauuucaguacauc

SEQ ID NO: 415940 - RNA, 18 nt, Human
auagcccuuagagccauc

SEQ ID NO: 415941 - RNA, 22 nt, Human
auaucaaaauaaaaaaaccagu

SEQ ID NO: 415942 - RNA, 21 nt, Human
aucaaaauaaaaaaaccagug

SEQ ID NO: 415943 - RNA, 18 nt, Human
auuuccauccacuugcuc

SEQ ID NO: 415944 - RNA, 22 nt, Human
caaaaugccaaaacgaucaaug

SEQ ID NO: 415945 - RNA, 23 nt, Human
caaacacagaaaagaauaaccac

SEQ ID NO: 415946 - RNA, 24 nt, Human
caaagaccaaaaauaaggugaaac

SEQ ID NO: 415947 - RNA, 21 nt, Human
caacauuaguagauugugcua

SEQ ID NO: 415948 - RNA, 18 nt, Human
cacuggccagcagcugca

SEQ ID NO: 415949 - RNA, 19 nt, Human
cagauaaacagguacaccc

SEQ ID NO: 415950 - RNA, 18 nt, Human
cagcccgggagaaggcac

SEQ ID NO: 415951 - RNA, 22 nt, Human
cagcuacaaggagucaucuccc

SEQ ID NO: 415952 - RNA, 19 nt, Human
cagcugcaccagugcccag

SEQ ID NO: 415953 - RNA, 19 nt, Human
caggaggcagcuccgucuc

SEQ ID NO: 415954 - RNA, 22 nt, Human
caggcagagcugaggacgugca

SEQ ID NO: 415955 - RNA, 19 nt, Human
caggccccuuguccucugg

SEQ ID NO: 415956 - RNA, 19 nt, Human
caggguucagacuggcugg

SEQ ID NO: 415957 - RNA, 23 nt, Human
caguauaacacaaaucacacaac

SEQ ID NO: 415958 - RNA, 19 nt, Human
cauggcccagguaucgaag

SEQ ID NO: 415959 - RNA, 20 nt, Human
cauuaguagauugugcuacc

SEQ ID NO: 415960 - RNA, 21 nt, Human
ccaaucuuaaauaauuagagg

SEQ ID NO: 415961 - RNA, 18 nt, Human
ccacaggccacaccugga

SEQ ID NO: 415962 - RNA, 18 nt, Human
ccacaggccacaccugga

SEQ ID NO: 415963 - RNA, 23 nt, Human
ccacaguauuuaauuuguuugga

SEQ ID NO: 415964 - RNA, 23 nt, Human
ccagugcccagaaugcguccucc

SEQ ID NO: 415965 - RNA, 21 nt, Human
cccacaggcgcagggugagcc

SEQ ID NO: 415966 - RNA, 21 nt, Human
cccaggaggggcaucacugca

SEQ ID NO: 415967 - RNA, 21 nt, Human
ccccagaaaggacuggcucug

SEQ ID NO: 415968 - RNA, 22 nt, Human
ccccuuguccucuggcagccca

SEQ ID NO: 415969 - RNA, 22 nt, Human
cccgcauagaccuuccuugucc

SEQ ID NO: 415970 - RNA, 23 nt, Human
cccgcauagaccuuccuuguccu

SEQ ID NO: 415971 - RNA, 21 nt, Human
cccgccgaauuuucuucgccu

SEQ ID NO: 415972 - RNA, 19 nt, Human
ccucucagggagaaaaccu

SEQ ID NO: 415973 - RNA, 20 nt, Human
ccucuugccccucuccuuca

SEQ ID NO: 415974 - RNA, 22 nt, Human
ccugccaagggugaagagccug

SEQ ID NO: 415975 - RNA, 22 nt, Human
cggccuccugggauguucaggg

SEQ ID NO: 415976 - RNA, 22 nt, Human
cgggagaaggcacagggaaggg

SEQ ID NO: 415977 - RNA, 22 nt, Human
cguaaacacaauggcaaaaaca

SEQ ID NO: 415978 - RNA, 19 nt, Human
cgugaucuagcuccgaugc

SEQ ID NO: 415979 - RNA, 21 nt, Human
cgugcacagggccuggagccg

SEQ ID NO: 415980 - RNA, 19 nt, Human
cguucgugucaucucccgc

SEQ ID NO: 415981 - RNA, 22 nt, Human
cuaaagucagugcauugucaac

SEQ ID NO: 415982 - RNA, 22 nt, Human
cuaaaugaauaaacaaagacca

SEQ ID NO: 415983 - RNA, 21 nt, Human
cuaccauguccauccugcccc

SEQ ID NO: 415984 - RNA, 18 nt, Human
cucaggccccuuguccuc

SEQ ID NO: 415985 - RNA, 20 nt, Human
cucucacuggccagcagcug

SEQ ID NO: 415986 - RNA, 23 nt, Human
cucuuguugcaacaugugcaugu

SEQ ID NO: 415987 - RNA, 21 nt, Human
cugcaaacuaucugcauucuc

SEQ ID NO: 415988 - RNA, 20 nt, Human
cugcauucucuaccaugucc

SEQ ID NO: 415989 - RNA, 24 nt, Human
cuggcaaugagaaucaacuugcag

SEQ ID NO: 415990 - RNA, 19 nt, Human
cuggccucagauaucagaa

SEQ ID NO: 415991 - RNA, 24 nt, Human
cuggugccacaccuuuuguuuaca

SEQ ID NO: 415992 - RNA, 23 nt, Human
cuguaaggcaacccaggcagagc

SEQ ID NO: 415993 - RNA, 23 nt, Human
cuucaugaggcgcuucugcugaa

SEQ ID NO: 415994 - RNA, 20 nt, Human
gaaaaagaaaggguauggaa

SEQ ID NO: 415995 - RNA, 26 nt, Human
gacaacauuauaauuguuuguuuuuu

SEQ ID NO: 415996 - RNA, 23 nt, Human
gacaauuuaggccacuccuaccu

SEQ ID NO: 415997 - RNA, 18 nt, Human
gacagcuuguaugagacu

SEQ ID NO: 415998 - RNA, 25 nt, Human
gcaaacuaucugcauucucuaccau

SEQ ID NO: 415999 - RNA, 18 nt, Human
gccaagggugaagagccu

SEQ ID NO: 416000 - RNA, 19 nt, Human
gccucucacuggccagcag

SEQ ID NO: 416001 - RNA, 22 nt, Human
ggacaagcacaauucaauucuu

SEQ ID NO: 416002 - RNA, 20 nt, Human
ggagaaaaccuuugagucca

SEQ ID NO: 416003 - RNA, 24 nt, Human
ggagaaaaccuuugaguccacaaa

SEQ ID NO: 416004 - RNA, 20 nt, Human
ggagaaggcagccuaacgag

SEQ ID NO: 416005 - RNA, 20 nt, Human
ggaucugccugaaaguucuc

SEQ ID NO: 416006 - RNA, 24 nt, Human
ggcgcagggugagcccgagagaga

SEQ ID NO: 416007 - RNA, 23 nt, Human
ggcuggugccacaccuuuuguuu

SEQ ID NO: 416008 - RNA, 18 nt, Human
gggccuggagccgcccaa

SEQ ID NO: 416009 - RNA, 22 nt, Human
guaaggcaacccaggcagagcu

SEQ ID NO: 416010 - RNA, 18 nt, Human
gugaucuagcuccgaugc

SEQ ID NO: 416011 - RNA, 18 nt, Human
guggcuccugggacugcc

SEQ ID NO: 416012 - RNA, 19 nt, Human
uaaaaaaaccaguggacau

SEQ ID NO: 416013 - RNA, 22 nt, Human
uaaaaaaaccaguggacaugca

SEQ ID NO: 416014 - RNA, 23 nt, Human
uaaaaaaaccaguggacaugcaa

SEQ ID NO: 416015 - RNA, 24 nt, Human
uaaaaaaagacaaauaucaaaaua

SEQ ID NO: 416016 - RNA, 22 nt, Human
uaaacacaauggcaaaaacaaa

SEQ ID NO: 416017 - RNA, 24 nt, Human
uaaaugaauaaacaaagaccaaaa

SEQ ID NO: 416018 - RNA, 26 nt, Human
uacacacaagcaaguucauuugcaug

SEQ ID NO: 416019 - RNA, 20 nt, Human
uacaggcuaauggugggauc

SEQ ID NO: 416020 - RNA, 23 nt, Human
uacaugaaaaaaauucuaccuca

SEQ ID NO: 416021 - RNA, 22 nt, Human
uaccacaugcuccuguuggucu

SEQ ID NO: 416022 - RNA, 22 nt, Human
uaccauguccauccugccccgg

SEQ ID NO: 416023 - RNA, 24 nt, Human
uaucaugucgucccuagacaacau

SEQ ID NO: 416024 - RNA, 19 nt, Human
uaucuggacaagcacaauu

SEQ ID NO: 416025 - RNA, 22 nt, Human
ucaaauacacacaagcaaguuc

SEQ ID NO: 416026 - RNA, 23 nt, Human
ucaaauacacacaagcaaguuca

SEQ ID NO: 416027 - RNA, 21 nt, Human
ucaaugcugcuguugauucca

SEQ ID NO: 416028 - RNA, 20 nt, Human
ucacugcaaaaugccaaaac

SEQ ID NO: 416029 - RNA, 23 nt, Human
ucacuguaaggcaacccaggcag

SEQ ID NO: 416030 - RNA, 18 nt, Human
ucagaacacaaaugcuua

SEQ ID NO: 416031 - RNA, 23 nt, Human
ucagauaucagaacacaaaugcu

SEQ ID NO: 416032 - RNA, 18 nt, Human
ucaggaggacugaccaca

SEQ ID NO: 416033 - RNA, 23 nt, Human
ucagguuccggagaaggcagccu

SEQ ID NO: 416034 - RNA, 20 nt, Human
uccccuugcuuccuuguuag

SEQ ID NO: 416035 - RNA, 18 nt, Human
ucccugcaguagcccacc

SEQ ID NO: 416036 - RNA, 18 nt, Human
ucccuuguacacucgauc

SEQ ID NO: 416037 - RNA, 22 nt, Human
uccuguggcucugacucccagg

SEQ ID NO: 416038 - RNA, 22 nt, Human
uccuguuggucuuggagccccu

SEQ ID NO: 416039 - RNA, 23 nt, Human
uccuguuggucuuggagccccug

SEQ ID NO: 416040 - RNA, 24 nt, Human
ucucccauucucccagcauuucca

SEQ ID NO: 416041 - RNA, 23 nt, Human
ucuuaagagagccucccuuucag

SEQ ID NO: 416042 - RNA, 21 nt, Human
ucuuucagugacacuuuugcc

SEQ ID NO: 416043 - RNA, 26 nt, Human
ugaaucagcuggccugggucggaucc

SEQ ID NO: 416044 - RNA, 24 nt, Human
ugacuccaaggaaaucuuuaauau

SEQ ID NO: 416045 - RNA, 24 nt, Human
ugacuuccuaaaaccaccaauuuc

SEQ ID NO: 416046 - RNA, 26 nt, Human
ugacuuccuaaaaccaccaauuucau

SEQ ID NO: 416047 - RNA, 18 nt, Human
ugagaaucaacuugcagg

SEQ ID NO: 416048 - RNA, 23 nt, Human
ugaggaaaaacagcacauagagg

SEQ ID NO: 416049 - RNA, 18 nt, Human
ugaggacgugcacagggc

SEQ ID NO: 416050 - RNA, 23 nt, Human
ugcccagaaugcguccuccucag

SEQ ID NO: 416051 - RNA, 18 nt, Human
ugcuuucuccaucuuguc

SEQ ID NO: 416052 - RNA, 25 nt, Human
uggacaugcaaacaaagcaaaacua

SEQ ID NO: 416053 - RNA, 23 nt, Human
uggaugucuucaugaggcgcuuc

SEQ ID NO: 416054 - RNA, 19 nt, Human
uggauguguucagaugacc

SEQ ID NO: 416055 - RNA, 18 nt, Human
uggcaaaaacaaaaagca

SEQ ID NO: 416056 - RNA, 19 nt, Human
uggcaaaaacaaaaagcaa

SEQ ID NO: 416057 - RNA, 18 nt, Human
uggcucaggucccugcag

SEQ ID NO: 416058 - RNA, 22 nt, Human
uggcucaggucccugcaguagc

SEQ ID NO: 416059 - RNA, 23 nt, Human
uggcucaggucccugcaguagcc

SEQ ID NO: 416060 - RNA, 20 nt, Human
uggcuccugggacugccccc

SEQ ID NO: 416061 - RNA, 19 nt, Human
ugggcuguggaauccuggc

SEQ ID NO: 416062 - RNA, 18 nt, Human
uggggguggcaggucccc

SEQ ID NO: 416063 - RNA, 21 nt, Human
uguaaagaaauuauuuaaaau

SEQ ID NO: 416064 - RNA, 22 nt, Human
uguaaggcaacccaggcagagc

SEQ ID NO: 416065 - RNA, 22 nt, Human
uguccugaugccacauggucuu

SEQ ID NO: 416066 - RNA, 20 nt, Human
uguuuaaauaaaacaucugu

SEQ ID NO: 416067 - RNA, 22 nt, Human
uuaguuacauugguaauuacua

SEQ ID NO: 416068 - RNA, 18 nt, Human
uucguagaggcccuaaga

SEQ ID NO: 416069 - RNA, 23 nt, Human
uugaaguagccuaaauguaagau

SEQ ID NO: 416070 - RNA, 19 nt, Human
uugauuccaacgggcucag

SEQ ID NO: 416071 - RNA, 24 nt, Human
uugguuccgcagacgugcccacag

SEQ ID NO: 416072 - RNA, 18 nt, Human
uuugcacaccuucaugau

SEQ ID NO: 416073 - RNA, 20 nt, Human
aaaaacaucuucauuuugcu

SEQ ID NO: 416074 - RNA, 22 nt, Human
acagcccagagaccuugagcca

SEQ ID NO: 416075 - RNA, 24 nt, Human
accguccucgccuugaacacacca

SEQ ID NO: 416076 - RNA, 20 nt, Human
agagaagccaaacugaacag

SEQ ID NO: 416077 - RNA, 18 nt, Human
auuaacaccagcagcgaa

SEQ ID NO: 416078 - RNA, 21 nt, Human
cacgggaccccaggaaggcag

SEQ ID NO: 416079 - RNA, 24 nt, Human
cagagaccuugagccagggacccc

SEQ ID NO: 416080 - RNA, 25 nt, Human
cagcgaauccucuugcugaagacuu

SEQ ID NO: 416081 - RNA, 21 nt, Human
caggaaggcagccgagccacu

SEQ ID NO: 416082 - RNA, 23 nt, Human
cagggacccccgauccacuaacu

SEQ ID NO: 416083 - RNA, 21 nt, Human
ccacucgugcccacuagggac

SEQ ID NO: 416084 - RNA, 21 nt, Human
ccggggcggcggcggcggcuu

SEQ ID NO: 416085 - RNA, 18 nt, Human
ccuaaacacaagacuugc

SEQ ID NO: 416086 - RNA, 25 nt, Human
cgagccuaaacacaagacuugcuag

SEQ ID NO: 416087 - RNA, 22 nt, Human
cggcccgcggcgggcggcggcg

SEQ ID NO: 416088 - RNA, 23 nt, Human
cggcgacggcggccccggggcgg

SEQ ID NO: 416089 - RNA, 19 nt, Human
cggcggcggcggcggggcg

SEQ ID NO: 416090 - RNA, 24 nt, Human
cgggaccccaggaaggcagccgag

SEQ ID NO: 416091 - RNA, 22 nt, Human
cggggcugcgagcccggcgggc

SEQ ID NO: 416092 - RNA, 24 nt, Human
cucucauuggcauccaagcuuuau

SEQ ID NO: 416093 - RNA, 22 nt, Human
gaagccaaacugaacagccuca

SEQ ID NO: 416094 - RNA, 21 nt, Human
gacccccgauccacuaaccuc

SEQ ID NO: 416095 - RNA, 20 nt, Human
gagcccggcgggcgggcggc

SEQ ID NO: 416096 - RNA, 23 nt, Human
gagggcacgugcaccaaaguucu

SEQ ID NO: 416097 - RNA, 21 nt, Human
gauccacuaaccucuucuccc

SEQ ID NO: 416098 - RNA, 19 nt, Human
gccacucgugcccacuagg

SEQ ID NO: 416099 - RNA, 22 nt, Human
gcggcggcagggagacgcgcac

SEQ ID NO: 416100 - RNA, 27 nt, Human
gcggcggcgagccggggcggcggcggc

SEQ ID NO: 416101 - RNA, 20 nt, Human
gcggcggcggcggcggcggc

SEQ ID NO: 416102 - RNA, 20 nt, Human
gcggcggcggcggcggcggc

SEQ ID NO: 416103 - RNA, 23 nt, Human
gcggcggcggcggcggcggcggc

SEQ ID NO: 416104 - RNA, 22 nt, Human
gcggcggcggcggcggcggggc

SEQ ID NO: 416105 - RNA, 19 nt, Human
gcggcggcggcggcggggc

SEQ ID NO: 416106 - RNA, 19 nt, Human
gcggcgggcggcggcggcg

SEQ ID NO: 416107 - RNA, 22 nt, Human
gcggcgggcggcggcggcggca

SEQ ID NO: 416108 - RNA, 20 nt, Human
gcugcgagcccggcgggcgg

SEQ ID NO: 416109 - RNA, 18 nt, Human
ggccgggggccggggcug

SEQ ID NO: 416110 - RNA, 20 nt, Human
ggccgggggccggggcugcg

SEQ ID NO: 416111 - RNA, 23 nt, Human
ggcggcggcggcggcggcggcgg

SEQ ID NO: 416112 - RNA, 29 nt, Human
ggcgggcggcggcgagccggggcggcggg

SEQ ID NO: 416113 - RNA, 29 nt, Human
gggcggcggcgagccggggcggcggcgac

SEQ ID NO: 416114 - RNA, 28 nt, Human
gggcggcggcgagccggggcggcggcgg

SEQ ID NO: 416115 - RNA, 18 nt, Human
gggcggcggcggcggcag

SEQ ID NO: 416116 - RNA, 19 nt, Human
gggcggcggcggcggcggc

SEQ ID NO: 416117 - RNA, 24 nt, Human
gggcggcggcggcggcggcggcgg

SEQ ID NO: 416118 - RNA, 22 nt, Human
ggggcggcccgcggcgggcggc

SEQ ID NO: 416119 - RNA, 20 nt, Human
ggggcggcggcggcggcggc

SEQ ID NO: 416120 - RNA, 20 nt, Human
uaacagaugcacaaaagguc

SEQ ID NO: 416121 - RNA, 19 nt, Human
uagcugcagggcuggugca

SEQ ID NO: 416122 - RNA, 25 nt, Human
ucgucggcgacggcggccccggggc

SEQ ID NO: 416123 - RNA, 20 nt, Human
ugcagggcuggugcacggga

SEQ ID NO: 416124 - RNA, 19 nt, Human
uuaacaccagcagcgaauc

SEQ ID NO: 416125 - RNA, 24 nt, Human
uuaacaccagcagcgaauccucuu

SEQ ID NO: 416126 - RNA, 20 nt, Human
uuagguugugaguuucucug

SEQ ID NO: 416127 - RNA, 19 nt, Human
aaggagcugauccaacugc

SEQ ID NO: 416128 - RNA, 19 nt, Human
cgacacagggcagaucuuu

SEQ ID NO: 416129 - RNA, 19 nt, Human
gcuuauguaguugucuuga

SEQ ID NO: 416130 - RNA, 18 nt, Human
uaacaagaaaauuaacuu

SEQ ID NO: 416131 - RNA, 20 nt, Human
uaaggccugggugcacaguc

SEQ ID NO: 416132 - RNA, 19 nt, Human
uacuauauacaccuuugcc

SEQ ID NO: 416133 - RNA, 23 nt, Human
uauuagccagacacagaaaaagg

SEQ ID NO: 416134 - RNA, 23 nt, Human
ucugcagauaagacagugaauaa

SEQ ID NO: 416135 - RNA, 19 nt, Human
uuggacuguaaggccuggg

SEQ ID NO: 416136 - RNA, 20 nt, Human
uuuccacugcaggcggguua

SEQ ID NO: 416137 - RNA, 22 nt, Human
uuuuucuuuuuuguaaaggagc

SEQ ID NO: 416138 - RNA, 20 nt, Human
uuuuuuuuuuucuuuuuugg

SEQ ID NO: 416139 - RNA, 20 nt, Human
uuuuuuuuuuucuuuuuugu

SEQ ID NO: 416140 - RNA, 19 nt, Human
aaagucuuuccacaccauc

SEQ ID NO: 416141 - RNA, 22 nt, Human
aaccagugaauaugcucuuuac

SEQ ID NO: 416142 - RNA, 22 nt, Human
aacugcucaaagcaggcaauau

SEQ ID NO: 416143 - RNA, 24 nt, Human
aagaaacuauugguguaaacugac

SEQ ID NO: 416144 - RNA, 18 nt, Human
aaggaaaaaaucugacuu

SEQ ID NO: 416145 - RNA, 21 nt, Human
aauacaauucauaagcugccc

SEQ ID NO: 416146 - RNA, 24 nt, Human
aauaccacaguuuuuaagaccagc

SEQ ID NO: 416147 - RNA, 19 nt, Human
aauagcuuuaaagugguua

SEQ ID NO: 416148 - RNA, 27 nt, Human
aaucacuuaugacccagucucauucaa

SEQ ID NO: 416149 - RNA, 21 nt, Human
aaucugcuaauugguagaaaa

SEQ ID NO: 416150 - RNA, 20 nt, Human
aauggaauuaccacugcaaa

SEQ ID NO: 416151 - RNA, 19 nt, Human
aauggcaaaucuaaguuuc

SEQ ID NO: 416152 - RNA, 22 nt, Human
accacaguuuuuaagaccagca

SEQ ID NO: 416153 - RNA, 18 nt, Human
accacugcaaaaauaugg

SEQ ID NO: 416154 - RNA, 18 nt, Human
acuugaaaucacuuauga

SEQ ID NO: 416155 - RNA, 23 nt, Human
agcaggcaauaucaauugcacaa

SEQ ID NO: 416156 - RNA, 19 nt, Human
agcaguuuaucuaguuuuc

SEQ ID NO: 416157 - RNA, 25 nt, Human
agucagacauuaacauaguauauau

SEQ ID NO: 416158 - RNA, 24 nt, Human
auaccacaguuuuuaagaccagca

SEQ ID NO: 416159 - RNA, 18 nt, Human
aucaugaguaaaugaaua

SEQ ID NO: 416160 - RNA, 22 nt, Human
caauacuagccagacacagaga

SEQ ID NO: 416161 - RNA, 18 nt, Human
cacaauguagugaacaca

SEQ ID NO: 416162 - RNA, 20 nt, Human
cacagccaccagaauuaucu

SEQ ID NO: 416163 - RNA, 22 nt, Human
caccucugagcccagaaaaguc

SEQ ID NO: 416164 - RNA, 23 nt, Human
caccucugagcccagaaaagucu

SEQ ID NO: 416165 - RNA, 25 nt, Human
cagaauaaaaagguaaugaaaagua

SEQ ID NO: 416166 - RNA, 27 nt, Human
cagcauaagaauagcuuuaaagugguu

SEQ ID NO: 416167 - RNA, 22 nt, Human
cauauaauucaaaaguuaccac

SEQ ID NO: 416168 - RNA, 23 nt, Human
cauauaauucaaaaguuaccacc

SEQ ID NO: 416169 - RNA, 20 nt, Human
ccaggaaagaaggauuaaca

SEQ ID NO: 416170 - RNA, 20 nt, Human
cuagagccuuaaaaguggag

SEQ ID NO: 416171 - RNA, 24 nt, Human
cuccacacagccaccagaauuauc

SEQ ID NO: 416172 - RNA, 18 nt, Human
cuccaguggaaguaucug

SEQ ID NO: 416173 - RNA, 18 nt, Human
cucucugcaaaacaaaaa

SEQ ID NO: 416174 - RNA, 19 nt, Human
cucugagcccagaaaaguc

SEQ ID NO: 416175 - RNA, 22 nt, Human
gacccagucucauucaaaccag

SEQ ID NO: 416176 - RNA, 22 nt, Human
gagcaguuuaucuaguuuucaa

SEQ ID NO: 416177 - RNA, 22 nt, Human
gaucugacuuguuuucaucaaa

SEQ ID NO: 416178 - RNA, 18 nt, Human
gccuuauauauccaggaa

SEQ ID NO: 416179 - RNA, 24 nt, Human
gugugacuguguagaucugacuug

SEQ ID NO: 416180 - RNA, 22 nt, Human
guugaccaaacugcucaaagca

SEQ ID NO: 416181 - RNA, 21 nt, Human
uaaaaauaaaaucucagugcc

SEQ ID NO: 416182 - RNA, 21 nt, Human
uaaucacuacacucucucagu

SEQ ID NO: 416183 - RNA, 18 nt, Human
uacaauucauaagcugcc

SEQ ID NO: 416184 - RNA, 21 nt, Human
uacaauucauaagcugcccag

SEQ ID NO: 416185 - RNA, 19 nt, Human
uacacugacaaauugcaaa

SEQ ID NO: 416186 - RNA, 19 nt, Human
uagaaaagcuacaauggca

SEQ ID NO: 416187 - RNA, 21 nt, Human
uagaaaagcuacaauggcaaa

SEQ ID NO: 416188 - RNA, 20 nt, Human
uagugaacacaacaaaaaau

SEQ ID NO: 416189 - RNA, 21 nt, Human
uauaagaccuuagugcauagu

SEQ ID NO: 416190 - RNA, 21 nt, Human
uaugauuuucuucaccucuuc

SEQ ID NO: 416191 - RNA, 19 nt, Human
ucaaagcaggcaauaucaa

SEQ ID NO: 416192 - RNA, 23 nt, Human
ucaagcucgcuaauucccuccua

SEQ ID NO: 416193 - RNA, 26 nt, Human
ucagacauuaacauaguauauauacc

SEQ ID NO: 416194 - RNA, 18 nt, Human
ucagucagucagaaaugc

SEQ ID NO: 416195 - RNA, 24 nt, Human
ucagucagucagaaaugcugcuga

SEQ ID NO: 416196 - RNA, 25 nt, Human
uccacacagccaccagaauuaucuc

SEQ ID NO: 416197 - RNA, 18 nt, Human
uccacaccaucuauaaaa

SEQ ID NO: 416198 - RNA, 22 nt, Human
uccacaucaaccauauaauuca

SEQ ID NO: 416199 - RNA, 25 nt, Human
ucuucaccucuucuacuauuccaca

SEQ ID NO: 416200 - RNA, 25 nt, Human
ucuuuuuucuuuuuuuugucucuuu

SEQ ID NO: 416201 - RNA, 19 nt, Human
ucuuuuuuuugucucuuua

SEQ ID NO: 416202 - RNA, 20 nt, Human
ugacccagucucauucaaac

SEQ ID NO: 416203 - RNA, 20 nt, Human
ugaguuaaacaaucugcuaa

SEQ ID NO: 416204 - RNA, 19 nt, Human
ugcaaaaauauggagaaau

SEQ ID NO: 416205 - RNA, 22 nt, Human
ugcaaaacaaaaagcagauuuc

SEQ ID NO: 416206 - RNA, 27 nt, Human
ugcaaaacaaaaagcaggacggggucg

SEQ ID NO: 416207 - RNA, 23 nt, Human
ugccaauuuuccacaucaaccau

SEQ ID NO: 416208 - RNA, 19 nt, Human
uggaaucaccaaaauacca

SEQ ID NO: 416209 - RNA, 20 nt, Human
uggaaucaccaaaauaccac

SEQ ID NO: 416210 - RNA, 25 nt, Human
uggaauuaccacugcaaaaggucac

SEQ ID NO: 416211 - RNA, 20 nt, Human
ugguaaguugaccaaacugc

SEQ ID NO: 416212 - RNA, 22 nt, Human
ugugaaaauuuaauaccuccaa

SEQ ID NO: 416213 - RNA, 23 nt, Human
uucauguaauucuguccucuugg

SEQ ID NO: 416214 - RNA, 26 nt, Human
uuccacaucaaccauauaauucaaaa

SEQ ID NO: 416215 - RNA, 24 nt, Human
uugguuuggagcaguuuaucuagu

SEQ ID NO: 416216 - RNA, 21 nt, Human
aggcagcaggagggucagggc

SEQ ID NO: 416217 - RNA, 19 nt, Human
agggucagggcggagggcc

SEQ ID NO: 416218 - RNA, 20 nt, Human
ccuuuuauugaacguaccca

SEQ ID NO: 416219 - RNA, 21 nt, Human
gaaaacaauccuuuuauugaa

SEQ ID NO: 416220 - RNA, 22 nt, Human
gccuggagaggggagacugccc

SEQ ID NO: 416221 - RNA, 20 nt, Human
gcggagggccucggccugga

SEQ ID NO: 416222 - RNA, 19 nt, Human
gggucagggcggagggccu

SEQ ID NO: 416223 - RNA, 19 nt, Human
uuucuaggaaaacaauccu

SEQ ID NO: 416224 - RNA, 23 nt, Human
uuuuuuuuuuuuuuuuuucuagg

SEQ ID NO: 416225 - RNA, 24 nt, Human
uuuuuuuuuuuuuuuuuuuuucuu

SEQ ID NO: 416226 - RNA, 20 nt, Human
aaguuguuucauggcaucuu

SEQ ID NO: 416227 - RNA, 20 nt, Human
acgcagcgaauucacaacuc

SEQ ID NO: 416228 - RNA, 25 nt, Human
cacaacuccaacgccgacacccccc

SEQ ID NO: 416229 - RNA, 18 nt, Human
ugaaugguaagugaauac

SEQ ID NO: 416230 - RNA, 23 nt, Human
ugguaagugaauacuggcaaugu

SEQ ID NO: 416231 - RNA, 23 nt, Human
aaaacacacaaaaacauaaagca

SEQ ID NO: 416232 - RNA, 18 nt, Human
aaacagcuacaaaaccag

SEQ ID NO: 416233 - RNA, 22 nt, Human
aaacagcuacaaaaccaguggu

SEQ ID NO: 416234 - RNA, 19 nt, Human
aaagagguuaucauucuga

SEQ ID NO: 416235 - RNA, 20 nt, Human
aaccauguuguacaagcagg

SEQ ID NO: 416236 - RNA, 20 nt, Human
aacccuuuaaacauuuaaca

SEQ ID NO: 416237 - RNA, 19 nt, Human
aagaaacucuuaauuauaa

SEQ ID NO: 416238 - RNA, 21 nt, Human
aagcucgcagugcuggagagc

SEQ ID NO: 416239 - RNA, 19 nt, Human
aaucuaggcgacugauucg

SEQ ID NO: 416240 - RNA, 20 nt, Human
acacacaaaaacauaaagca

SEQ ID NO: 416241 - RNA, 24 nt, Human
acacacacauauaaaauacauaua

SEQ ID NO: 416242 - RNA, 19 nt, Human
acacauacacacacauaua

SEQ ID NO: 416243 - RNA, 24 nt, Human
acacauacacacacauauaaaaua

SEQ ID NO: 416244 - RNA, 18 nt, Human
acgcagccgccgcgaccu

SEQ ID NO: 416245 - RNA, 23 nt, Human
acuacaacuuaauaaaucacacu

SEQ ID NO: 416246 - RNA, 24 nt, Human
agaaacauaaaaaaggccgguacc

SEQ ID NO: 416247 - RNA, 19 nt, Human
agagagcgaugggaagggc

SEQ ID NO: 416248 - RNA, 19 nt, Human
agcaggacaguauagcauu

SEQ ID NO: 416249 - RNA, 22 nt, Human
agcugcgcaggcccuaaaccuu

SEQ ID NO: 416250 - RNA, 19 nt, Human
agcuuuuagucaacaguuu

SEQ ID NO: 416251 - RNA, 20 nt, Human
aggcauaauaucuuaugacc

SEQ ID NO: 416252 - RNA, 21 nt, Human
aggcccuagggaaucaacgug

SEQ ID NO: 416253 - RNA, 22 nt, Human
agucucugggauggaacaaccu

SEQ ID NO: 416254 - RNA, 30 nt, Human
auacauguguguacacauacacacacauag

SEQ ID NO: 416255 - RNA, 20 nt, Human
aucuagcuuuaaaaaaauaa

SEQ ID NO: 416256 - RNA, 22 nt, Human
caaaacacacaaaaacauaaag

SEQ ID NO: 416257 - RNA, 21 nt, Human
caaaugaauauuaauucauca

SEQ ID NO: 416258 - RNA, 20 nt, Human
caaauguaaucaucauggcc

SEQ ID NO: 416259 - RNA, 22 nt, Human
caacguggcaacugcauuuauc

SEQ ID NO: 416260 - RNA, 23 nt, Human
caagacuuuuggcccuaaggccu

SEQ ID NO: 416261 - RNA, 21 nt, Human
caaggaccuaggaacaugaca

SEQ ID NO: 416262 - RNA, 22 nt, Human
caaguuuagaaacaaaaaucac

SEQ ID NO: 416263 - RNA, 20 nt, Human
cacacaaaaacauaaagcag

SEQ ID NO: 416264 - RNA, 22 nt, Human
cacugaccaagucuaaagagaa

SEQ ID NO: 416265 - RNA, 18 nt, Human
cacugucacaagccuugc

SEQ ID NO: 416266 - RNA, 21 nt, Human
caggcccuaaaccuucacccu

SEQ ID NO: 416267 - RNA, 21 nt, Human
cauaaaaaaggcuaucuucaa

SEQ ID NO: 416268 - RNA, 26 nt, Human
cauuccauucacaaauauuuucaggc

SEQ ID NO: 416269 - RNA, 22 nt, Human
ccagccaguucgccaaggaccu

SEQ ID NO: 416270 - RNA, 22 nt, Human
cccacgcagccgccgcgaccuc

SEQ ID NO: 416271 - RNA, 23 nt, Human
cccacgcagccgccgcgaccucc

SEQ ID NO: 416272 - RNA, 24 nt, Human
cccacgcagccgccgcgaccuccc

SEQ ID NO: 416273 - RNA, 22 nt, Human
cccacugucacaagccuugcga

SEQ ID NO: 416274 - RNA, 23 nt, Human
ccccgcucccaaccacuuaguug

SEQ ID NO: 416275 - RNA, 21 nt, Human
cccuaaaccuucacccucaag

SEQ ID NO: 416276 - RNA, 22 nt, Human
cccuaaaccuucacccucaaga

SEQ ID NO: 416277 - RNA, 18 nt, Human
ccgccgcgaccuccccgc

SEQ ID NO: 416278 - RNA, 20 nt, Human
ccgccgcgaccuccccgcuc

SEQ ID NO: 416279 - RNA, 18 nt, Human
ccuugcggggcauggcag

SEQ ID NO: 416280 - RNA, 23 nt, Human
cgcccagccaguucgccaaggac

SEQ ID NO: 416281 - RNA, 24 nt, Human
cgcccagccaguucgccaaggacc

SEQ ID NO: 416282 - RNA, 24 nt, Human
cgcgaccuccccgcucccaaccac

SEQ ID NO: 416283 - RNA, 23 nt, Human
cgucuggaaaaaaacaacauucc

SEQ ID NO: 416284 - RNA, 30 nt, Human
cuagcgauauagauuuuuuaauacuuuccu

SEQ ID NO: 416285 - RNA, 19 nt, Human
cuauggugacuacaacuua

SEQ ID NO: 416286 - RNA, 18 nt, Human
cugaaguacagcuggauc

SEQ ID NO: 416287 - RNA, 20 nt, Human
cugaggcaaagacuuaagcu

SEQ ID NO: 416288 - RNA, 21 nt, Human
cuuaugaagaaaugaccagcu

SEQ ID NO: 416289 - RNA, 25 nt, Human
gaacaaaaaguggauuuuuucagaa

SEQ ID NO: 416290 - RNA, 19 nt, Human
gaggcagcacuguguccag

SEQ ID NO: 416291 - RNA, 18 nt, Human
gcagaauuucuuaaaauc

SEQ ID NO: 416292 - RNA, 23 nt, Human
gcauaauaucuuaugaccucagu

SEQ ID NO: 416293 - RNA, 18 nt, Human
gcccuaaaccuucacccu

SEQ ID NO: 416294 - RNA, 24 nt, Human
gccgcgaccuccccgcucccaacc

SEQ ID NO: 416295 - RNA, 19 nt, Human
gcugcugggaccccgccca

SEQ ID NO: 416296 - RNA, 24 nt, Human
ggaaacuacagggaaggcagaagc

SEQ ID NO: 416297 - RNA, 19 nt, Human
ggaaccacaaauguaauca

SEQ ID NO: 416298 - RNA, 21 nt, Human
gggaaggcagaagcucgcagu

SEQ ID NO: 416299 - RNA, 20 nt, Human
guccaguugcuugacauacc

SEQ ID NO: 416300 - RNA, 18 nt, Human
gugcagaaauuuccugaa

SEQ ID NO: 416301 - RNA, 22 nt, Human
gugcuaguuaaaugcauuaaga

SEQ ID NO: 416302 - RNA, 21 nt, Human
guggugcagaaauuuccugaa

SEQ ID NO: 416303 - RNA, 24 nt, Human
guuguagccaaucuaggcgacuga

SEQ ID NO: 416304 - RNA, 24 nt, Human
uaaaaaaggcuaucuucaaaucag

SEQ ID NO: 416305 - RNA, 21 nt, Human
uaaaauacaauuuuccagcaa

SEQ ID NO: 416306 - RNA, 26 nt, Human
uaaaaucacaaacuuugccagcacca

SEQ ID NO: 416307 - RNA, 21 nt, Human
uaagcuaccgaagcacgggca

SEQ ID NO: 416308 - RNA, 21 nt, Human
uaaguccugaagcagaggcag

SEQ ID NO: 416309 - RNA, 18 nt, Human
uaauaggaguaguguuua

SEQ ID NO: 416310 - RNA, 24 nt, Human
uacacauacacacacauauaaaau

SEQ ID NO: 416311 - RNA, 19 nt, Human
uacacauuuuuuaaaagcu

SEQ ID NO: 416312 - RNA, 20 nt, Human
uaccuggaucacaucuggga

SEQ ID NO: 416313 - RNA, 19 nt, Human
uacgcuugaaggggaagag

SEQ ID NO: 416314 - RNA, 25 nt, Human
uacgcuugaaggggaagagagcgau

SEQ ID NO: 416315 - RNA, 21 nt, Human
uagaaaauggagugucugugc

SEQ ID NO: 416316 - RNA, 21 nt, Human
uaguugaaaagacgccuucaa

SEQ ID NO: 416317 - RNA, 21 nt, Human
uauaaaauacaauuuuccagc

SEQ ID NO: 416318 - RNA, 20 nt, Human
uauacauguguguacacaua

SEQ ID NO: 416319 - RNA, 20 nt, Human
uaucuuaugaagaaaugacc

SEQ ID NO: 416320 - RNA, 21 nt, Human
uaugaaacagcuacaaaacca

SEQ ID NO: 416321 - RNA, 20 nt, Human
uauuacaauuuacuagcgau

SEQ ID NO: 416322 - RNA, 24 nt, Human
ucaaaacacacaaaaacauaaagc

SEQ ID NO: 416323 - RNA, 21 nt, Human
ucaacaguuuuaugaaacagc

SEQ ID NO: 416324 - RNA, 18 nt, Human
ucaccuccauaggcuggu

SEQ ID NO: 416325 - RNA, 18 nt, Human
ucagcauguuaaguccug

SEQ ID NO: 416326 - RNA, 19 nt, Human
ucagcauguuaaguccugg

SEQ ID NO: 416327 - RNA, 22 nt, Human
ucaggcauugcuccacuguacu

SEQ ID NO: 416328 - RNA, 19 nt, Human
uccuaggcugcugggaccc

SEQ ID NO: 416329 - RNA, 21 nt, Human
ucuauggagaaaaggguaguc

SEQ ID NO: 416330 - RNA, 22 nt, Human
ucuguauauauuauacaugugu

SEQ ID NO: 416331 - RNA, 25 nt, Human
ucuguauauauuauacaugugugua

SEQ ID NO: 416332 - RNA, 20 nt, Human
ugaaacagcuacaaaaccag

SEQ ID NO: 416333 - RNA, 20 nt, Human
ugacagaggcugacugauuc

SEQ ID NO: 416334 - RNA, 18 nt, Human
ugcaaggaaaaaagcuga

SEQ ID NO: 416335 - RNA, 21 nt, Human
ugcaaggaaaaaagcugaggc

SEQ ID NO: 416336 - RNA, 24 nt, Human
ugcuccacuguacuccuaggcugc

SEQ ID NO: 416337 - RNA, 19 nt, Human
uggaaaaaaacaacauucc

SEQ ID NO: 416338 - RNA, 20 nt, Human
uggaaccacaaauguaauca

SEQ ID NO: 416339 - RNA, 22 nt, Human
uggaaccacaaauguaaucauc

SEQ ID NO: 416340 - RNA, 18 nt, Human
ugggaagggcggcaucgg

SEQ ID NO: 416341 - RNA, 21 nt, Human
ugggaagggcggcaucgggca

SEQ ID NO: 416342 - RNA, 23 nt, Human
ugggaccccgcccagccaguucg

SEQ ID NO: 416343 - RNA, 19 nt, Human
ugggauggaacaaccugua

SEQ ID NO: 416344 - RNA, 22 nt, Human
uguacacauacacacacauaua

SEQ ID NO: 416345 - RNA, 26 nt, Human
uguacacauacacacacauauaaaau

SEQ ID NO: 416346 - RNA, 23 nt, Human
uguauauauuauacaugugugua

SEQ ID NO: 416347 - RNA, 21 nt, Human
ugucugugcuggguguuuuug

SEQ ID NO: 416348 - RNA, 18 nt, Human
uuaagauagaaaauggag

SEQ ID NO: 416349 - RNA, 21 nt, Human
uucagaaagucuuuuuuaaac

SEQ ID NO: 416350 - RNA, 24 nt, Human
uuggaaccacaaauguaaucaacc

SEQ ID NO: 416351 - RNA, 24 nt, Human
uuuaaaaacagcaaacuuccguaa

SEQ ID NO: 416352 - RNA, 22 nt, Human
uuuaaaauauuuacuucacuga

SEQ ID NO: 416353 - RNA, 23 nt, Human
uuuaaacucaaacauugggaaac

SEQ ID NO: 416354 - RNA, 23 nt, Human
uuuaucaguucaugauauuaucu

SEQ ID NO: 416355 - RNA, 19 nt, Human
uuugcccauuuccucucca

SEQ ID NO: 416356 - RNA, 20 nt, Human
uuuucagaaagucuuuuuua

SEQ ID NO: 416357 - RNA, 19 nt, Human
uuuuuaacuaaggaaaauu

SEQ ID NO: 416358 - RNA, 19 nt, Human
aaaaacuuuggcccccaca

SEQ ID NO: 416359 - RNA, 25 nt, Human
aauaaaaagcagacaaauagcuaaa

SEQ ID NO: 416360 - RNA, 21 nt, Human
acagaccuuucaguacauggc

SEQ ID NO: 416361 - RNA, 18 nt, Human
acagcaaaugaaaucuga

SEQ ID NO: 416362 - RNA, 25 nt, Human
accaagccccugcagccuagaaacc

SEQ ID NO: 416363 - RNA, 22 nt, Human
accccaacucucuacauacauu

SEQ ID NO: 416364 - RNA, 21 nt, Human
acggagaagauggggcgacag

SEQ ID NO: 416365 - RNA, 31 nt, Human
acgucacagcuacuggguuacagaaccaguu

SEQ ID NO: 416366 - RNA, 19 nt, Human
agagcuucugccccagucc

SEQ ID NO: 416367 - RNA, 18 nt, Human
agagggugauuuuugcuu

SEQ ID NO: 416368 - RNA, 24 nt, Human
aguaaccucgagguccuugagggu

SEQ ID NO: 416369 - RNA, 24 nt, Human
auacaaggguaaauaaaaagcaga

SEQ ID NO: 416370 - RNA, 19 nt, Human
auccugagucccuccuuca

SEQ ID NO: 416371 - RNA, 23 nt, Human
auuuuugcuuuaaaaucaucagg

SEQ ID NO: 416372 - RNA, 18 nt, Human
caagcggcggggcgggca

SEQ ID NO: 416373 - RNA, 21 nt, Human
caccaccuaccaagccccugc

SEQ ID NO: 416374 - RNA, 22 nt, Human
caccaggagcaaguuuuucauc

SEQ ID NO: 416375 - RNA, 20 nt, Human
cacuucauuuuaggcagagc

SEQ ID NO: 416376 - RNA, 18 nt, Human
cagccuagaaacccgcca

SEQ ID NO: 416377 - RNA, 18 nt, Human
caggggccgccaagcggc

SEQ ID NO: 416378 - RNA, 23 nt, Human
cauaaaaacuuuggcccccacag

SEQ ID NO: 416379 - RNA, 22 nt, Human
cccacauaaaaacuuuggcccc

SEQ ID NO: 416380 - RNA, 27 nt, Human
ccccugcagccuagaaacccgccaccc

SEQ ID NO: 416381 - RNA, 24 nt, Human
ccccuugccaccaccuaccaagcc

SEQ ID NO: 416382 - RNA, 25 nt, Human
ccccuugccaccaccuaccaagccc

SEQ ID NO: 416383 - RNA, 22 nt, Human
cccgccacccgagaggcacuac

SEQ ID NO: 416384 - RNA, 19 nt, Human
cccugcagccuagaaaccc

SEQ ID NO: 416385 - RNA, 19 nt, Human
ccgccgcccccuugccacc

SEQ ID NO: 416386 - RNA, 22 nt, Human
ccgccgcccccuugccaccacc

SEQ ID NO: 416387 - RNA, 24 nt, Human
ccgccgcccccuugccaccaccua

SEQ ID NO: 416388 - RNA, 18 nt, Human
ccgccgccgcccccuugc

SEQ ID NO: 416389 - RNA, 18 nt, Human
ccgccgccgcugccgccg

SEQ ID NO: 416390 - RNA, 24 nt, Human
ccgccgccgcugccgccgcugccg

SEQ ID NO: 416391 - RNA, 24 nt, Human
ccgccgcugccgccgcugccgccg

SEQ ID NO: 416392 - RNA, 24 nt, Human
ccgccgcugccgccguugccgccg

SEQ ID NO: 416393 - RNA, 21 nt, Human
ccgcugccgccgcugccgccg

SEQ ID NO: 416394 - RNA, 21 nt, Human
ccgcugccgccgcugccgccg

SEQ ID NO: 416395 - RNA, 21 nt, Human
ccgcugccgccguugccgccg

SEQ ID NO: 416396 - RNA, 24 nt, Human
ccgcugccgccguugccgccgcug

SEQ ID NO: 416397 - RNA, 19 nt, Human
ccggcauccgccgccgccc

SEQ ID NO: 416398 - RNA, 27 nt, Human
ccuaccaagccccugcagccuagaaac

SEQ ID NO: 416399 - RNA, 19 nt, Human
ccuagaaacccgccacccg

SEQ ID NO: 416400 - RNA, 27 nt, Human
ccuagaaacccgccacccgagaggcac

SEQ ID NO: 416401 - RNA, 28 nt, Human
ccucugaggauaacauacaaggguaaag

SEQ ID NO: 416402 - RNA, 24 nt, Human
cgagaggcacuacugcucagccca

SEQ ID NO: 416403 - RNA, 22 nt, Human
cguauaaagcaacagcaaauga

SEQ ID NO: 416404 - RNA, 18 nt, Human
cugaaugcgggaaugaca

SEQ ID NO: 416405 - RNA, 23 nt, Human
cugccgccguugccgccgcuggc

SEQ ID NO: 416406 - RNA, 27 nt, Human
gagaagauggggcgacaguagggucua

SEQ ID NO: 416407 - RNA, 19 nt, Human
gcccacauaaaaacuuugg

SEQ ID NO: 416408 - RNA, 23 nt, Human
gcccccacaggggaugagauggc

SEQ ID NO: 416409 - RNA, 23 nt, Human
gccccugcagccuagaaacccgc

SEQ ID NO: 416410 - RNA, 24 nt, Human
gcccgaaaagcaaaucuugaaagc

SEQ ID NO: 416411 - RNA, 20 nt, Human
gccgccgccgcugccgccgc

SEQ ID NO: 416412 - RNA, 22 nt, Human
gccgccgcugccgccguugccg

SEQ ID NO: 416413 - RNA, 19 nt, Human
ggagaagauggggcgacag

SEQ ID NO: 416414 - RNA, 21 nt, Human
guaagcucuuucaacuagagg

SEQ ID NO: 416415 - RNA, 19 nt, Human
uaaaaagcagacaaauagc

SEQ ID NO: 416416 - RNA, 19 nt, Human
uaaaaagcagacaaauagc

SEQ ID NO: 416417 - RNA, 20 nt, Human
uaaaaagcagacaaauagcu

SEQ ID NO: 416418 - RNA, 22 nt, Human
uaaaaagcagacaaauagcuaa

SEQ ID NO: 416419 - RNA, 20 nt, Human
uaaauuuuccuuuaaagagu

SEQ ID NO: 416420 - RNA, 21 nt, Human
uagaaacccgccacccgagag

SEQ ID NO: 416421 - RNA, 21 nt, Human
uagaagagauggaacgucaca

SEQ ID NO: 416422 - RNA, 18 nt, Human
uagccucuuaauccaacu

SEQ ID NO: 416423 - RNA, 24 nt, Human
uaucucaacugccuugcaguuugc

SEQ ID NO: 416424 - RNA, 23 nt, Human
uauuccguuuucccaaaguuuua

SEQ ID NO: 416425 - RNA, 20 nt, Human
ucaagggauuuuugucuggu

SEQ ID NO: 416426 - RNA, 21 nt, Human
ucagcccagacaguagccgcc

SEQ ID NO: 416427 - RNA, 23 nt, Human
uccaacuaucucaacugccuugc

SEQ ID NO: 416428 - RNA, 23 nt, Human
ucccuugggauccaccaggagca

SEQ ID NO: 416429 - RNA, 19 nt, Human
ucucaacugccuugcaguu

SEQ ID NO: 416430 - RNA, 23 nt, Human
ucuuccggcauccgccgccgccc

SEQ ID NO: 416431 - RNA, 18 nt, Human
ugagaaacuaagggugug

SEQ ID NO: 416432 - RNA, 21 nt, Human
ugagucccuccuucauuccca

SEQ ID NO: 416433 - RNA, 23 nt, Human
ugccagaaagcaugccuaguucc

SEQ ID NO: 416434 - RNA, 19 nt, Human
ugcucagcccagacaguag

SEQ ID NO: 416435 - RNA, 21 nt, Human
uggcagaggaggggaaggcca

SEQ ID NO: 416436 - RNA, 19 nt, Human
ugggauuuacaucaaggga

SEQ ID NO: 416437 - RNA, 24 nt, Human
ugucucgucuagccucuuaaucca

SEQ ID NO: 416438 - RNA, 18 nt, Human
ugugguacccgggggcag

SEQ ID NO: 416439 - RNA, 22 nt, Human
uucgaaacauaauuuaauauuc

SEQ ID NO: 416440 - RNA, 20 nt, Human
uugccagaaagcaugccuag

SEQ ID NO: 416441 - RNA, 20 nt, Human
augauaaauagcugaauucc

SEQ ID NO: 416442 - RNA, 22 nt, Human
uaacaguauccaugacuuucau

SEQ ID NO: 416443 - RNA, 23 nt, Human
uaguaguuaauauuuccuaaauc

SEQ ID NO: 416444 - RNA, 25 nt, Human
ucuaaagaauucccuuuuuaaacuu

SEQ ID NO: 416445 - RNA, 24 nt, Human
ugguauuagaucuuccuggacaag

SEQ ID NO: 416446 - RNA, 27 nt, Human
acaucgaggacaguggugguucuucuc

SEQ ID NO: 416447 - RNA, 19 nt, Human
accuggugagccucagagg

SEQ ID NO: 416448 - RNA, 24 nt, Human
aggagaguggagaccuucgagggg

SEQ ID NO: 416449 - RNA, 23 nt, Human
cagcggugacccccugcauuagg

SEQ ID NO: 416450 - RNA, 24 nt, Human
cccaaagaacaaggccaacuacac

SEQ ID NO: 416451 - RNA, 18 nt, Human
ccccaaagaacaaggcca

SEQ ID NO: 416452 - RNA, 22 nt, Human
cccccaaagaacaaggccaacu

SEQ ID NO: 416453 - RNA, 18 nt, Human
ccugugauagggcuggga

SEQ ID NO: 416454 - RNA, 26 nt, Human
cuaauacccccaaagaacaaggccaa

SEQ ID NO: 416455 - RNA, 22 nt, Human
cugcggcugaaguggacggaac

SEQ ID NO: 416456 - RNA, 22 nt, Human
cugcggcugaaguggacggaac

SEQ ID NO: 416457 - RNA, 20 nt, Human
cuucauuugacugcaaaguc

SEQ ID NO: 416458 - RNA, 19 nt, Human
gaggagcccagaggagagu

SEQ ID NO: 416459 - RNA, 20 nt, Human
gcaaggaggagcccagagga

SEQ ID NO: 416460 - RNA, 22 nt, Human
gggucuguuccucuccggaggc

SEQ ID NO: 416461 - RNA, 22 nt, Human
gggucuguuccucuccggaggc

SEQ ID NO: 416462 - RNA, 22 nt, Human
gguacagggugggugagaaaga

SEQ ID NO: 416463 - RNA, 21 nt, Human
uccugugauagggcugggaga

SEQ ID NO: 416464 - RNA, 18 nt, Human
ugacagagagagugaggg

SEQ ID NO: 416465 - RNA, 18 nt, Human
ugacagagagagugaggg

SEQ ID NO: 416466 - RNA, 19 nt, Human
ugagaaagaaaguagaagg

SEQ ID NO: 416467 - RNA, 20 nt, Human
uggagaccuucgaggggggc

SEQ ID NO: 416468 - RNA, 18 nt, Human
ugggagagccaagaggac

SEQ ID NO: 416469 - RNA, 21 nt, Human
ugggaggaaagggggauagca

SEQ ID NO: 416470 - RNA, 22 nt, Human
uggguggugggaggaaaggggg

SEQ ID NO: 416471 - RNA, 23 nt, Human
aaugcaggggugcacauguuggg

SEQ ID NO: 416472 - RNA, 18 nt, Human
agguccucuggagaccag

SEQ ID NO: 416473 - RNA, 20 nt, Human
cacauguuggggcugcccuu

SEQ ID NO: 416474 - RNA, 23 nt, Human
cagcauggccaguacagcaggcu

SEQ ID NO: 416475 - RNA, 18 nt, Human
ccagguggggcuggccca

SEQ ID NO: 416476 - RNA, 18 nt, Human
ccgccgccucgcccgcuc

SEQ ID NO: 416477 - RNA, 23 nt, Human
ccucgcccgcucccggcuucucu

SEQ ID NO: 416478 - RNA, 18 nt, Human
ccuucaggaccagcuggg

SEQ ID NO: 416479 - RNA, 26 nt, Human
ccuuuggcacucacugggguggguca

SEQ ID NO: 416480 - RNA, 19 nt, Human
cgcugcugccgccgccgcc

SEQ ID NO: 416481 - RNA, 19 nt, Human
cgcugcugccgccgccgcc

SEQ ID NO: 416482 - RNA, 18 nt, Human
cuccagguggggcuggcc

SEQ ID NO: 416483 - RNA, 21 nt, Human
gagcuccagguggggcuggcc

SEQ ID NO: 416484 - RNA, 18 nt, Human
ucacuggggugggucaag

SEQ ID NO: 416485 - RNA, 19 nt, Human
ucacuggggugggucaagg

SEQ ID NO: 416486 - RNA, 20 nt, Human
uggggcuggcccagcauggc

SEQ ID NO: 416487 - RNA, 24 nt, Human
uggggugggucaagggagagcaaa

SEQ ID NO: 416488 - RNA, 19 nt, Human
aaggacccaagaaaugcag

SEQ ID NO: 416489 - RNA, 19 nt, Human
acucuaaggacccaagaaa

SEQ ID NO: 416490 - RNA, 24 nt, Human
agacaggaaaggagacccucuugg

SEQ ID NO: 416491 - RNA, 21 nt, Human
aggaggaccgagcagcauucu

SEQ ID NO: 416492 - RNA, 18 nt, Human
augcugggcccucuaggu

SEQ ID NO: 416493 - RNA, 23 nt, Human
cacacauuuauggaggguugucc

SEQ ID NO: 416494 - RNA, 22 nt, Human
cagcauucucuguagaggaaga

SEQ ID NO: 416495 - RNA, 18 nt, Human
cagccacaguccaucucu

SEQ ID NO: 416496 - RNA, 24 nt, Human
cagccacaguccaucucucuuuuu

SEQ ID NO: 416497 - RNA, 20 nt, Human
ccugaaaagaagggcaggug

SEQ ID NO: 416498 - RNA, 18 nt, Human
cucucuuuuuucucuccu

SEQ ID NO: 416499 - RNA, 19 nt, Human
cuggccaccaacaguuucc

SEQ ID NO: 416500 - RNA, 21 nt, Human
gagcagcccaggccggucagu

SEQ ID NO: 416501 - RNA, 19 nt, Human
uaaggacccaagaaaugca

SEQ ID NO: 416502 - RNA, 20 nt, Human
uaaggacccaagaaaugcag

SEQ ID NO: 416503 - RNA, 23 nt, Human
uacccacuggccaccaacaguuu

SEQ ID NO: 416504 - RNA, 18 nt, Human
uaggaggaccgagcagca

SEQ ID NO: 416505 - RNA, 19 nt, Human
ucccagccacaugcugggc

SEQ ID NO: 416506 - RNA, 20 nt, Human
ucccugaaaagaagggcagg

SEQ ID NO: 416507 - RNA, 18 nt, Human
ucuuuuuucucuccuucc

SEQ ID NO: 416508 - RNA, 18 nt, Human
uggaggguugucccugaa

SEQ ID NO: 416509 - RNA, 23 nt, Human
uguagaggaagacaggaaaggag

SEQ ID NO: 416510 - RNA, 21 nt, Human
uuuauggaggguugucccuga

SEQ ID NO: 416511 - RNA, 18 nt, Human
uuuuuuuuuuuuagggau

SEQ ID NO: 416512 - RNA, 25 nt, Human
uuuuuuuuuuuuuuuuuuuuagggg

SEQ ID NO: 416513 - RNA, 21 nt, Human
aaaaaagacaaagauaccaca

SEQ ID NO: 416514 - RNA, 26 nt, Human
aaaagaccaaaaugcuagugggcacc

SEQ ID NO: 416515 - RNA, 18 nt, Human
aaagagacagacccccag

SEQ ID NO: 416516 - RNA, 21 nt, Human
aaagagaugaggcaacagguc

SEQ ID NO: 416517 - RNA, 22 nt, Human
aaagguccuccauguggauccu

SEQ ID NO: 416518 - RNA, 24 nt, Human
aaauccuuucccucucccccaccc

SEQ ID NO: 416519 - RNA, 19 nt, Human
aagaagaagaaggguggca

SEQ ID NO: 416520 - RNA, 21 nt, Human
aagagacagacccccagaaca

SEQ ID NO: 416521 - RNA, 23 nt, Human
aagagggaaauaagaaaaaacaa

SEQ ID NO: 416522 - RNA, 19 nt, Human
aagcagaggacaaacacau

SEQ ID NO: 416523 - RNA, 19 nt, Human
aaggggaaugaaaaaaaaa

SEQ ID NO: 416524 - RNA, 22 nt, Human
aagguaccuuccccuaaguccc

SEQ ID NO: 416525 - RNA, 24 nt, Human
aagguaccuuccccuaagucccug

SEQ ID NO: 416526 - RNA, 21 nt, Human
aauccuuucccucucccccac

SEQ ID NO: 416527 - RNA, 19 nt, Human
acaaagagagcacaaagac

SEQ ID NO: 416528 - RNA, 18 nt, Human
acacaaaguuuuugaaga

SEQ ID NO: 416529 - RNA, 18 nt, Human
acaccacagaggaacagg

SEQ ID NO: 416530 - RNA, 20 nt, Human
acagcaguucacagcaugga

SEQ ID NO: 416531 - RNA, 23 nt, Human
acagcauggagacaacuucccac

SEQ ID NO: 416532 - RNA, 21 nt, Human
acaggucucuggagucgagag

SEQ ID NO: 416533 - RNA, 20 nt, Human
acaguggcagaguggcgagg

SEQ ID NO: 416534 - RNA, 23 nt, Human
acauuagguggagauuucuggga

SEQ ID NO: 416535 - RNA, 19 nt, Human
accccacccccccaaaaaa

SEQ ID NO: 416536 - RNA, 19 nt, Human
acggacugacagacaccac

SEQ ID NO: 416537 - RNA, 20 nt, Human
acugcaaacuguagaaacaa

SEQ ID NO: 416538 - RNA, 23 nt, Human
acuguugacagcaggauggucuc

SEQ ID NO: 416539 - RNA, 24 nt, Human
acuuggaagggacucaaaaagccc

SEQ ID NO: 416540 - RNA, 19 nt, Human
agaaaaaacaaagagagca

SEQ ID NO: 416541 - RNA, 24 nt, Human
agaaaaaacaaagagagcacaaag

SEQ ID NO: 416542 - RNA, 23 nt, Human
agaaaagagacagacccccagaa

SEQ ID NO: 416543 - RNA, 18 nt, Human
agaaaggaccaaugggga

SEQ ID NO: 416544 - RNA, 23 nt, Human
agaaccaagcccccucccacccc

SEQ ID NO: 416545 - RNA, 18 nt, Human
agaagaagaaggguggca

SEQ ID NO: 416546 - RNA, 19 nt, Human
agaagaagaaggguggcag

SEQ ID NO: 416547 - RNA, 25 nt, Human
agaaggugggggugcguuaacaacg

SEQ ID NO: 416548 - RNA, 26 nt, Human
agacaagagggaaauaagagggaccc

SEQ ID NO: 416549 - RNA, 27 nt, Human
agaccacaccacacuccauccugucca

SEQ ID NO: 416550 - RNA, 24 nt, Human
agagaaacccuguugggccacuga

SEQ ID NO: 416551 - RNA, 21 nt, Human
agaggaacaggggaguuagcc

SEQ ID NO: 416552 - RNA, 23 nt, Human
agaggaacaggggaguuagccug

SEQ ID NO: 416553 - RNA, 23 nt, Human
agcaaaagaccaaaaugcuacca

SEQ ID NO: 416554 - RNA, 20 nt, Human
agcagggcccugugcccuuu

SEQ ID NO: 416555 - RNA, 19 nt, Human
agccccuaaccuagggcag

SEQ ID NO: 416556 - RNA, 19 nt, Human
agcuccacaacccaccccu

SEQ ID NO: 416557 - RNA, 19 nt, Human
aggagagaaggugggggug

SEQ ID NO: 416558 - RNA, 19 nt, Human
aggagucagugaugggggu

SEQ ID NO: 416559 - RNA, 23 nt, Human
aggcagggagaaaaggggugggg

SEQ ID NO: 416560 - RNA, 21 nt, Human
aggcaggggaugaggaggagc

SEQ ID NO: 416561 - RNA, 22 nt, Human
aggcccagccacagcagcccua

SEQ ID NO: 416562 - RNA, 18 nt, Human
agggaaagaagagggaga

SEQ ID NO: 416563 - RNA, 21 nt, Human
aggggaugaggaggagcugcc

SEQ ID NO: 416564 - RNA, 20 nt, Human
aggguuugccauuggaauac

SEQ ID NO: 416565 - RNA, 19 nt, Human
agguaggugaaggacugag

SEQ ID NO: 416566 - RNA, 22 nt, Human
aguaaaaaaaaaagagcaagaa

SEQ ID NO: 416567 - RNA, 19 nt, Human
agugcuggugaggcccagc

SEQ ID NO: 416568 - RNA, 22 nt, Human
augaaaaaagacaaagauacca

SEQ ID NO: 416569 - RNA, 22 nt, Human
caaaaugcuaccauucucaggc

SEQ ID NO: 416570 - RNA, 24 nt, Human
caaaaugcuaccauucucaggcac

SEQ ID NO: 416571 - RNA, 19 nt, Human
caaccugcuccucagacca

SEQ ID NO: 416572 - RNA, 23 nt, Human
caagaagaagaaggguggcagga

SEQ ID NO: 416573 - RNA, 20 nt, Human
caagcccccucccacccccu

SEQ ID NO: 416574 - RNA, 21 nt, Human
caagcccccucccacccccuc

SEQ ID NO: 416575 - RNA, 22 nt, Human
caaggucucagcucuguaaccc

SEQ ID NO: 416576 - RNA, 22 nt, Human
cacaccccacagcaguucacag

SEQ ID NO: 416577 - RNA, 18 nt, Human
cacaguucugaagcaaaa

SEQ ID NO: 416578 - RNA, 28 nt, Human
cacauggccauaugucugacaauucauc

SEQ ID NO: 416579 - RNA, 23 nt, Human
caccacacuccauccuguccaca

SEQ ID NO: 416580 - RNA, 20 nt, Human
cacuaggcuccaucauuccc

SEQ ID NO: 416581 - RNA, 22 nt, Human
cacuccauccuguccacaaagg

SEQ ID NO: 416582 - RNA, 20 nt, Human
cacugcaaacuguagaaaca

SEQ ID NO: 416583 - RNA, 22 nt, Human
cagacccccagaacaggacaua

SEQ ID NO: 416584 - RNA, 21 nt, Human
cagaggacaaacacauggcca

SEQ ID NO: 416585 - RNA, 18 nt, Human
cagauuuauauugaaaau

SEQ ID NO: 416586 - RNA, 21 nt, Human
cagcaacuaagaucccaaauc

SEQ ID NO: 416587 - RNA, 21 nt, Human
cagcucuguaaccccaccccc

SEQ ID NO: 416588 - RNA, 23 nt, Human
caggccuaucucauaacccuggc

SEQ ID NO: 416589 - RNA, 22 nt, Human
caggggcugccuaggaagacac

SEQ ID NO: 416590 - RNA, 19 nt, Human
caggguuuguuguggcugg

SEQ ID NO: 416591 - RNA, 24 nt, Human
caguaauccuugccccucaaccca

SEQ ID NO: 416592 - RNA, 25 nt, Human
cauaacccuggccccagccagaggc

SEQ ID NO: 416593 - RNA, 19 nt, Human
cauacaggccuaucucaua

SEQ ID NO: 416594 - RNA, 19 nt, Human
ccacccccucaggaccccc

SEQ ID NO: 416595 - RNA, 22 nt, Human
cccacagccaccuccuucagca

SEQ ID NO: 416596 - RNA, 19 nt, Human
cccacccccccaaaaaaaa

SEQ ID NO: 416597 - RNA, 22 nt, Human
cccagaacaggacauauuucau

SEQ ID NO: 416598 - RNA, 18 nt, Human
cccagaguuucccacucc

SEQ ID NO: 416599 - RNA, 23 nt, Human
cccagccccuaaccuagggcagc

SEQ ID NO: 416600 - RNA, 24 nt, Human
cccaggguuuguuguggcuggggu

SEQ ID NO: 416601 - RNA, 21 nt, Human
ccccaccccaaccugcuccuc

SEQ ID NO: 416602 - RNA, 21 nt, Human
cccccaaaaaaaaggaaaaaa

SEQ ID NO: 416603 - RNA, 21 nt, Human
ccccccaaaaaaaaggaaaaa

SEQ ID NO: 416604 - RNA, 21 nt, Human
cccccccaaaaaaaaggaaaa

SEQ ID NO: 416605 - RNA, 20 nt, Human
cccccucaggaccccccaga

SEQ ID NO: 416606 - RNA, 23 nt, Human
cccccucccacccccucaggacc

SEQ ID NO: 416607 - RNA, 18 nt, Human
ccccucaacccaauacag

SEQ ID NO: 416608 - RNA, 24 nt, Human
cccuaagucccuggaaaagugguc

SEQ ID NO: 416609 - RNA, 24 nt, Human
cccugcccuagaacccaggguuug

SEQ ID NO: 416610 - RNA, 22 nt, Human
cccuggccccagccagaggccc

SEQ ID NO: 416611 - RNA, 18 nt, Human
cccugggaaaaagacgug

SEQ ID NO: 416612 - RNA, 21 nt, Human
ccucuuggggggccccacagc

SEQ ID NO: 416613 - RNA, 22 nt, Human
cgagaccccugaggcaaagaac

SEQ ID NO: 416614 - RNA, 18 nt, Human
cggggacgaaagugaggg

SEQ ID NO: 416615 - RNA, 20 nt, Human
cuaauucuacucuccuuggc

SEQ ID NO: 416616 - RNA, 22 nt, Human
cuagaacccaggguuuguugug

SEQ ID NO: 416617 - RNA, 22 nt, Human
cuagucauugcagccaucagaa

SEQ ID NO: 416618 - RNA, 25 nt, Human
cucagaccacaccacacuccauccu

SEQ ID NO: 416619 - RNA, 22 nt, Human
cuccaucauucccagggcuggu

SEQ ID NO: 416620 - RNA, 20 nt, Human
cucccacccccucaggaccc

SEQ ID NO: 416621 - RNA, 22 nt, Human
cucccccaccccaaccugcucc

SEQ ID NO: 416622 - RNA, 21 nt, Human
cuccuuggcaaaaaugucuga

SEQ ID NO: 416623 - RNA, 19 nt, Human
cucuguaaccccacccccc

SEQ ID NO: 416624 - RNA, 21 nt, Human
cucuguaaccccaccccccca

SEQ ID NO: 416625 - RNA, 21 nt, Human
cugacagacaccacagaggaa

SEQ ID NO: 416626 - RNA, 23 nt, Human
cugcacaccccacagcaguucac

SEQ ID NO: 416627 - RNA, 19 nt, Human
cuguacaggagucuacaua

SEQ ID NO: 416628 - RNA, 24 nt, Human
cuuaaaauaaacacuccccagccc

SEQ ID NO: 416629 - RNA, 21 nt, Human
cuuaaggcaggggaugaggag

SEQ ID NO: 416630 - RNA, 22 nt, Human
cuuccccuaagucccuggaaaa

SEQ ID NO: 416631 - RNA, 24 nt, Human
gaacaaaucacaacaaucacacac

SEQ ID NO: 416632 - RNA, 20 nt, Human
gacagcaggagaaaccccga

SEQ ID NO: 416633 - RNA, 21 nt, Human
gacagcaggagaaaccccgau

SEQ ID NO: 416634 - RNA, 23 nt, Human
gagaaacccuguugggccacuga

SEQ ID NO: 416635 - RNA, 19 nt, Human
gagaagacagacggacuga

SEQ ID NO: 416636 - RNA, 19 nt, Human
gagagcacaaagaccaguu

SEQ ID NO: 416637 - RNA, 24 nt, Human
gagccucccaggggagacacuggg

SEQ ID NO: 416638 - RNA, 24 nt, Human
gagcuccacaacccaccccuuugg

SEQ ID NO: 416639 - RNA, 20 nt, Human
gaggaguuuggcacuguggc

SEQ ID NO: 416640 - RNA, 24 nt, Human
gagggccaguugcugcccuggagg

SEQ ID NO: 416641 - RNA, 18 nt, Human
gaguggagaugggaaaga

SEQ ID NO: 416642 - RNA, 19 nt, Human
gaucuauucagcccuccuc

SEQ ID NO: 416643 - RNA, 18 nt, Human
gcaaacuguagaaacaag

SEQ ID NO: 416644 - RNA, 21 nt, Human
gcaccggcuucuuuaggccaa

SEQ ID NO: 416645 - RNA, 25 nt, Human
gcccccucccacccccucaggaccc

SEQ ID NO: 416646 - RNA, 24 nt, Human
gcccugccuaagugagcuccacaa

SEQ ID NO: 416647 - RNA, 22 nt, Human
gcucagagggacugagucagcu

SEQ ID NO: 416648 - RNA, 21 nt, Human
ggaaaagaagggccuacaaaa

SEQ ID NO: 416649 - RNA, 21 nt, Human
ggaaaagaagggccuacaaaa

SEQ ID NO: 416650 - RNA, 19 nt, Human
ggaaagaagagggagagag

SEQ ID NO: 416651 - RNA, 21 nt, Human
ggaaaguacaaucagcagggc

SEQ ID NO: 416652 - RNA, 20 nt, Human
ggacugaauccaucagcaga

SEQ ID NO: 416653 - RNA, 19 nt, Human
ggagacaacuucccacagg

SEQ ID NO: 416654 - RNA, 24 nt, Human
ggcaaagaacuggacuuaaggcaa

SEQ ID NO: 416655 - RNA, 23 nt, Human
ggcaggacagggguggcugguga

SEQ ID NO: 416656 - RNA, 18 nt, Human
ggcaggggaugaggagga

SEQ ID NO: 416657 - RNA, 19 nt, Human
gggacagacacagugggga

SEQ ID NO: 416658 - RNA, 21 nt, Human
gggcuggugcuacacagaggg

SEQ ID NO: 416659 - RNA, 20 nt, Human
ggguggggacccuggaaggc

SEQ ID NO: 416660 - RNA, 23 nt, Human
guccacaaaggcaaugaccccag

SEQ ID NO: 416661 - RNA, 20 nt, Human
gucugacaauucauccugac

SEQ ID NO: 416662 - RNA, 23 nt, Human
gugcguuaauucaaguaaaaaaa

SEQ ID NO: 416663 - RNA, 18 nt, Human
gugcuuagagaguuggag

SEQ ID NO: 416664 - RNA, 20 nt, Human
uaacucgggcuguguggcag

SEQ ID NO: 416665 - RNA, 22 nt, Human
uaagaaaaaacaaagagagcac

SEQ ID NO: 416666 - RNA, 24 nt, Human
uaagaaaaaacaaagagagcacaa

SEQ ID NO: 416667 - RNA, 25 nt, Human
uaagaaaaaacaaagagagcacaaa

SEQ ID NO: 416668 - RNA, 18 nt, Human
uaagugagcuccacaacc

SEQ ID NO: 416669 - RNA, 18 nt, Human
uagagaguuggaggcaaa

SEQ ID NO: 416670 - RNA, 21 nt, Human
uagggcagcaacuaagauccc

SEQ ID NO: 416671 - RNA, 28 nt, Human
ucaaguaaaaaaaaaagagcaagaagaa

SEQ ID NO: 416672 - RNA, 27 nt, Human
ucacagaggguuuccacguggcgcgag

SEQ ID NO: 416673 - RNA, 24 nt, Human
ucagcucuguaaccccaccccccc

SEQ ID NO: 416674 - RNA, 22 nt, Human
ucaggaccccccagaguuuccc

SEQ ID NO: 416675 - RNA, 23 nt, Human
ucaggaggggaaaguacaaucag

SEQ ID NO: 416676 - RNA, 21 nt, Human
ucaggcacagcccuuagugcu

SEQ ID NO: 416677 - RNA, 19 nt, Human
ucauaacccuggccccagc

SEQ ID NO: 416678 - RNA, 20 nt, Human
ucauugcagccaucagaaag

SEQ ID NO: 416679 - RNA, 19 nt, Human
uccacugcaaacuguagaa

SEQ ID NO: 416680 - RNA, 21 nt, Human
uccagggccgcaggcuggggc

SEQ ID NO: 416681 - RNA, 21 nt, Human
uccauguggauccuggcugga

SEQ ID NO: 416682 - RNA, 22 nt, Human
ucccacccccucaggacccccc

SEQ ID NO: 416683 - RNA, 24 nt, Human
ucccacccccucaggaccccccag

SEQ ID NO: 416684 - RNA, 22 nt, Human
uccccagccccuaaccuagggc

SEQ ID NO: 416685 - RNA, 27 nt, Human
ucccccaccccaaccugcuccucagac

SEQ ID NO: 416686 - RNA, 19 nt, Human
ucccucucccccaccccaa

SEQ ID NO: 416687 - RNA, 24 nt, Human
ucccuggaaaaguggucacagagg

SEQ ID NO: 416688 - RNA, 21 nt, Human
uccggagaguccgaugucuca

SEQ ID NO: 416689 - RNA, 22 nt, Human
uccucagaccacaccacacucc

SEQ ID NO: 416690 - RNA, 19 nt, Human
uccucaggggcugccuagg

SEQ ID NO: 416691 - RNA, 23 nt, Human
uccuucacugggaagagcgggga

SEQ ID NO: 416692 - RNA, 19 nt, Human
ucuauucagcccuccuccu

SEQ ID NO: 416693 - RNA, 18 nt, Human
ucucccccaccccaaccu

SEQ ID NO: 416694 - RNA, 18 nt, Human
ucugaacgccgcgccuug

SEQ ID NO: 416695 - RNA, 18 nt, Human
ucugacaauucauccuga

SEQ ID NO: 416696 - RNA, 21 nt, Human
ucugcaagccacuaugucugu

SEQ ID NO: 416697 - RNA, 18 nt, Human
ucuggagucgagagaagg

SEQ ID NO: 416698 - RNA, 19 nt, Human
ucuguacaggagucuacau

SEQ ID NO: 416699 - RNA, 20 nt, Human
ugaaaugggaggggaauggg

SEQ ID NO: 416700 - RNA, 23 nt, Human
ugacaaaaauaaaaacauuuguc

SEQ ID NO: 416701 - RNA, 24 nt, Human
ugacaaaaauaaaaacauuugucu

SEQ ID NO: 416702 - RNA, 23 nt, Human
ugacacaaaguuuuugaagagaa

SEQ ID NO: 416703 - RNA, 23 nt, Human
ugaccauacaaaccaaaaacauu

SEQ ID NO: 416704 - RNA, 21 nt, Human
ugagcuccacaacccaccccu

SEQ ID NO: 416705 - RNA, 20 nt, Human
ugaggcaaagaacuggacuu

SEQ ID NO: 416706 - RNA, 22 nt, Human
ugaguggagaugggaaagagaa

SEQ ID NO: 416707 - RNA, 21 nt, Human
ugcccuggaggaguuuggcac

SEQ ID NO: 416708 - RNA, 19 nt, Human
ugccuaagugagcuccaca

SEQ ID NO: 416709 - RNA, 19 nt, Human
ugccuaagugagcuccaca

SEQ ID NO: 416710 - RNA, 22 nt, Human
ugcuccucagaccacaccacac

SEQ ID NO: 416711 - RNA, 20 nt, Human
ugcuggugaggcccagccac

SEQ ID NO: 416712 - RNA, 20 nt, Human
uggaaaauucuacauuuaca

SEQ ID NO: 416713 - RNA, 19 nt, Human
uggcagaguggcgagguag

SEQ ID NO: 416714 - RNA, 20 nt, Human
uggcaggaauguggcugggc

SEQ ID NO: 416715 - RNA, 20 nt, Human
uggccaaugagcuccucucu

SEQ ID NO: 416716 - RNA, 18 nt, Human
uggggaaacugcucagag

SEQ ID NO: 416717 - RNA, 21 nt, Human
ugggggucucuccaaaaccuc

SEQ ID NO: 416718 - RNA, 21 nt, Human
uggggugagggacaggagggc

SEQ ID NO: 416719 - RNA, 18 nt, Human
ugggucagggucugcaag

SEQ ID NO: 416720 - RNA, 22 nt, Human
ugguugccuauggucacgugac

SEQ ID NO: 416721 - RNA, 22 nt, Human
uguaaccccacccccccaaaaa

SEQ ID NO: 416722 - RNA, 20 nt, Human
ugucaaggggguaagaggug

SEQ ID NO: 416723 - RNA, 22 nt, Human
ugucuguacaggagucuacaua

SEQ ID NO: 416724 - RNA, 19 nt, Human
uguggcaggaguaucccug

SEQ ID NO: 416725 - RNA, 18 nt, Human
uguggcuggggugaggga

SEQ ID NO: 416726 - RNA, 21 nt, Human
uguuggugaggugggaguccu

SEQ ID NO: 416727 - RNA, 21 nt, Human
uuagagggccagcaaauuuug

SEQ ID NO: 416728 - RNA, 23 nt, Human
uucccucucccccaccccaaccu

SEQ ID NO: 416729 - RNA, 19 nt, Human
uuugcagaaaggacagcag

SEQ ID NO: 416730 - RNA, 25 nt, Human
aaaaaaaaaaagaaacagcacucug

SEQ ID NO: 416731 - RNA, 18 nt, Human
aaacaaagaacaauucuu

SEQ ID NO: 416732 - RNA, 21 nt, Human
aagaggcaccauuuccccaag

SEQ ID NO: 416733 - RNA, 19 nt, Human
aaugugcaacugacaucug

SEQ ID NO: 416734 - RNA, 20 nt, Human
agagaaaaaaaaaaagaaac

SEQ ID NO: 416735 - RNA, 19 nt, Human
agaucauuaaaggcaaagc

SEQ ID NO: 416736 - RNA, 21 nt, Human
aggcaaagccuauaugacgcu

SEQ ID NO: 416737 - RNA, 22 nt, Human
cauaaaggacucaaugugcaac

SEQ ID NO: 416738 - RNA, 21 nt, Human
ccccaaggaauaccucuuggc

SEQ ID NO: 416739 - RNA, 18 nt, Human
ccucuuggcauuuccuga

SEQ ID NO: 416740 - RNA, 22 nt, Human
cuguacacacaaaaaaaugguc

SEQ ID NO: 416741 - RNA, 21 nt, Human
cuguccaguagccgaacaguu

SEQ ID NO: 416742 - RNA, 18 nt, Human
gaaaaaaaaaaagaaaca

SEQ ID NO: 416743 - RNA, 21 nt, Human
gaaaaacucauucaacaacug

SEQ ID NO: 416744 - RNA, 20 nt, Human
uaaaaccacaaacaaagaac

SEQ ID NO: 416745 - RNA, 20 nt, Human
uaaaaccacaaacaaagaac

SEQ ID NO: 416746 - RNA, 21 nt, Human
uaaaaccacaaacaaagaaca

SEQ ID NO: 416747 - RNA, 22 nt, Human
uaaaaccacaaacaaagaacaa

SEQ ID NO: 416748 - RNA, 25 nt, Human
uaaacaaaucuuuuucuggucaaga

SEQ ID NO: 416749 - RNA, 21 nt, Human
uaaauaaaucauauuucaaga

SEQ ID NO: 416750 - RNA, 18 nt, Human
uaaauaccaugggacagg

SEQ ID NO: 416751 - RNA, 19 nt, Human
uaagaggcaccauuucccc

SEQ ID NO: 416752 - RNA, 21 nt, Human
uacuaccaaugaaaugguagg

SEQ ID NO: 416753 - RNA, 24 nt, Human
uagcaaucuaaauaaaucauauuu

SEQ ID NO: 416754 - RNA, 23 nt, Human
uaucgagcaagaaucuguuaaca

SEQ ID NO: 416755 - RNA, 22 nt, Human
ucaagagaaaaaaaaaaagaaa

SEQ ID NO: 416756 - RNA, 23 nt, Human
ucauuaaaggcaaagccuauaug

SEQ ID NO: 416757 - RNA, 24 nt, Human
ucugccaugauauuacaaagguug

SEQ ID NO: 416758 - RNA, 24 nt, Human
ugcuagugaugaucugguaauaua

SEQ ID NO: 416759 - RNA, 24 nt, Human
uguccaguagccgaacaguuuguu

SEQ ID NO: 416760 - RNA, 18 nt, Human
uguuaacaguuuuauuuu

SEQ ID NO: 416761 - RNA, 25 nt, Human
uuagcaaucuaaauaaaucauauuu

SEQ ID NO: 416762 - RNA, 22 nt, Human
uucaagagguaacagcaacaga

SEQ ID NO: 416763 - RNA, 21 nt, Human
aaaaaacacuuccuggcagcu

SEQ ID NO: 416764 - RNA, 21 nt, Human
aagaaaacaugagaugaaaua

SEQ ID NO: 416765 - RNA, 22 nt, Human
aaggagcugauggcuuggacag

SEQ ID NO: 416766 - RNA, 24 nt, Human
aaggagcugauggcuuggacagaa

SEQ ID NO: 416767 - RNA, 20 nt, Human
acaauaugccauuguggcau

SEQ ID NO: 416768 - RNA, 21 nt, Human
accaauguuuaaaaugacauu

SEQ ID NO: 416769 - RNA, 18 nt, Human
agacacggaaagcagccu

SEQ ID NO: 416770 - RNA, 21 nt, Human
agaguuucucucuucccuugc

SEQ ID NO: 416771 - RNA, 23 nt, Human
agcacgcagcauuaacuguacuc

SEQ ID NO: 416772 - RNA, 21 nt, Human
agcccacagcccuccagcagc

SEQ ID NO: 416773 - RNA, 20 nt, Human
augacgaguacgucugauga

SEQ ID NO: 416774 - RNA, 26 nt, Human
caaagcgcugggucaaucagucaaca

SEQ ID NO: 416775 - RNA, 23 nt, Human
cacccacaacugcuggugcccuc

SEQ ID NO: 416776 - RNA, 22 nt, Human
cacuacaugaaccaauacaaau

SEQ ID NO: 416777 - RNA, 19 nt, Human
cagagacagaggagcccac

SEQ ID NO: 416778 - RNA, 24 nt, Human
cagcagcaauaccaguucacccaa

SEQ ID NO: 416779 - RNA, 19 nt, Human
caguucacccaacagaguu

SEQ ID NO: 416780 - RNA, 22 nt, Human
ccagaaaaaacacuuccuggca

SEQ ID NO: 416781 - RNA, 18 nt, Human
ccagcaccaacaggcgag

SEQ ID NO: 416782 - RNA, 20 nt, Human
cccaauaaaccccaccucca

SEQ ID NO: 416783 - RNA, 26 nt, Human
cccacagcccuccagcagcaauacca

SEQ ID NO: 416784 - RNA, 21 nt, Human
ccccaccuccacaugaccaga

SEQ ID NO: 416785 - RNA, 20 nt, Human
cccgauccauuuguccugac

SEQ ID NO: 416786 - RNA, 26 nt, Human
ccuccagcagcaauaccaguucaccc

SEQ ID NO: 416787 - RNA, 18 nt, Human
cggucggggcacgggcgg

SEQ ID NO: 416788 - RNA, 19 nt, Human
cguuacauuauauuugugu

SEQ ID NO: 416789 - RNA, 24 nt, Human
cuacucuucauuaaaaaagguaac

SEQ ID NO: 416790 - RNA, 21 nt, Human
cuagguccccaaggggagguc

SEQ ID NO: 416791 - RNA, 19 nt, Human
cuccagagacagaggagcc

SEQ ID NO: 416792 - RNA, 20 nt, Human
cuccagcaucccaauaaacc

SEQ ID NO: 416793 - RNA, 24 nt, Human
cuccccagcaugcugggcuccagc

SEQ ID NO: 416794 - RNA, 25 nt, Human
cugccacagugcaauuccuuugggc

SEQ ID NO: 416795 - RNA, 19 nt, Human
cugcuggugcccucgcuuc

SEQ ID NO: 416796 - RNA, 20 nt, Human
cugggcuccagcuccccaag

SEQ ID NO: 416797 - RNA, 20 nt, Human
cugggcuccagcuccccaag

SEQ ID NO: 416798 - RNA, 21 nt, Human
cuguacucuugugacaauaag

SEQ ID NO: 416799 - RNA, 24 nt, Human
cuugugacaauaagaaaacaugag

SEQ ID NO: 416800 - RNA, 24 nt, Human
gccacagugcaauuccuuugggcu

SEQ ID NO: 416801 - RNA, 23 nt, Human
gcgcugggucaaucagucaacac

SEQ ID NO: 416802 - RNA, 18 nt, Human
gcggggguccucuaccgg

SEQ ID NO: 416803 - RNA, 21 nt, Human
ggagggguaauuuaaaggcaa

SEQ ID NO: 416804 - RNA, 19 nt, Human
ggagugggccacgugggga

SEQ ID NO: 416805 - RNA, 23 nt, Human
ggcuuggacagaacugaagacac

SEQ ID NO: 416806 - RNA, 21 nt, Human
gggagggguaauuuaaaggca

SEQ ID NO: 416807 - RNA, 24 nt, Human
gggccagcaccaacaggcgaggaa

SEQ ID NO: 416808 - RNA, 23 nt, Human
gggccgggagugggccacguggg

SEQ ID NO: 416809 - RNA, 22 nt, Human
gggcuccagcuccccaagggcc

SEQ ID NO: 416810 - RNA, 20 nt, Human
gguauaagaacaaucuagaa

SEQ ID NO: 416811 - RNA, 21 nt, Human
gucaaacucucaacuaguacu

SEQ ID NO: 416812 - RNA, 20 nt, Human
gugacaauaagaaaacauga

SEQ ID NO: 416813 - RNA, 19 nt, Human
uaaaccccaccuccacaug

SEQ ID NO: 416814 - RNA, 21 nt, Human
uaacccuuugcagcccgaucc

SEQ ID NO: 416815 - RNA, 28 nt, Human
uaagaaaacaugagaugaaauacauuaa

SEQ ID NO: 416816 - RNA, 23 nt, Human
uaagaacaaucuagaagacugac

SEQ ID NO: 416817 - RNA, 19 nt, Human
uaagagagguaauccagca

SEQ ID NO: 416818 - RNA, 23 nt, Human
uaauccagcaucauguaccaaga

SEQ ID NO: 416819 - RNA, 24 nt, Human
uaccaaggccuaccaauguuuaaa

SEQ ID NO: 416820 - RNA, 18 nt, Human
uacuguguggagcugacc

SEQ ID NO: 416821 - RNA, 23 nt, Human
uaugacgaguacgucugaugcug

SEQ ID NO: 416822 - RNA, 24 nt, Human
uauuuguguguguguaucugugua

SEQ ID NO: 416823 - RNA, 19 nt, Human
uccagcaucccaauaaacc

SEQ ID NO: 416824 - RNA, 22 nt, Human
ucccaauaaaccccaccuccac

SEQ ID NO: 416825 - RNA, 19 nt, Human
uccccaagggccagcacca

SEQ ID NO: 416826 - RNA, 18 nt, Human
uccccagcaugcugggcu

SEQ ID NO: 416827 - RNA, 21 nt, Human
ucccuugucauuaauaaagau

SEQ ID NO: 416828 - RNA, 23 nt, Human
ucuccagagacagaggagcccac

SEQ ID NO: 416829 - RNA, 22 nt, Human
ucucugaauaacaguuugacuu

SEQ ID NO: 416830 - RNA, 18 nt, Human
ugaccagacucuccagag

SEQ ID NO: 416831 - RNA, 21 nt, Human
ugacccagaaaaaacacuucc

SEQ ID NO: 416832 - RNA, 24 nt, Human
ugacgaguacgucugaugcugcca

SEQ ID NO: 416833 - RNA, 19 nt, Human
ugacuccaggcuagguccc

SEQ ID NO: 416834 - RNA, 21 nt, Human
ugacuccaggcuaggucccca

SEQ ID NO: 416835 - RNA, 21 nt, Human
ugagaugucaucauacauuaa

SEQ ID NO: 416836 - RNA, 22 nt, Human
uggaagugugaguaaugguuga

SEQ ID NO: 416837 - RNA, 19 nt, Human
uggacagaacugaagacac

SEQ ID NO: 416838 - RNA, 24 nt, Human
uggcggggagaccccugagagguc

SEQ ID NO: 416839 - RNA, 19 nt, Human
uggguuggucuuuuauggc

SEQ ID NO: 416840 - RNA, 20 nt, Human
uguguguaucuguguaugug

SEQ ID NO: 416841 - RNA, 21 nt, Human
uguguguguaucuguguaugu

SEQ ID NO: 416842 - RNA, 19 nt, Human
uguguguguguaucugugu

SEQ ID NO: 416843 - RNA, 21 nt, Human
uguguguguguaucuguguau

SEQ ID NO: 416844 - RNA, 20 nt, Human
uuaacuguacucuugugaca

SEQ ID NO: 416845 - RNA, 24 nt, Human
uuaaugcugcgcccgcuuuaaguu

SEQ ID NO: 416846 - RNA, 19 nt, Human
uuagcggcggagcaccuuu

SEQ ID NO: 416847 - RNA, 21 nt, Human
uucccugccuaugacaguugu

SEQ ID NO: 416848 - RNA, 21 nt, Human
uuuguguguguguaucugugu

SEQ ID NO: 416849 - RNA, 22 nt, Human
caccucacagccaggcgccggc

SEQ ID NO: 416850 - RNA, 21 nt, Human
cagacugggccgggaauccac

SEQ ID NO: 416851 - RNA, 22 nt, Human
cagacugggccgggaauccacc

SEQ ID NO: 416852 - RNA, 18 nt, Human
cccauggugagccgcugg

SEQ ID NO: 416853 - RNA, 21 nt, Human
cccauggugagccgcuggggg

SEQ ID NO: 416854 - RNA, 18 nt, Human
ggcccgggcggaggaguc

SEQ ID NO: 416855 - RNA, 24 nt, Human
ggugaggggugaagcuggguggug

SEQ ID NO: 416856 - RNA, 21 nt, Human
guggaaaaacuggagggagau

SEQ ID NO: 416857 - RNA, 18 nt, Human
uaugagaagguccgaacg

SEQ ID NO: 416858 - RNA, 23 nt, Human
uauuuuauugcugccauccccau

SEQ ID NO: 416859 - RNA, 27 nt, Human
uccaccucacagccaggcgccggccgc

SEQ ID NO: 416860 - RNA, 19 nt, Human
ucuccaggugacccuaguu

SEQ ID NO: 416861 - RNA, 21 nt, Human
ugagaagguccgaacgaagug

SEQ ID NO: 416862 - RNA, 21 nt, Human
ugagccgcugggggugagggg

SEQ ID NO: 416863 - RNA, 21 nt, Human
uggagggagauggucagacug

SEQ ID NO: 416864 - RNA, 24 nt, Human
uggagggagauggucagacugggc

SEQ ID NO: 416865 - RNA, 27 nt, Human
uggagggagauggucagacugggccgg

SEQ ID NO: 416866 - RNA, 23 nt, Human
ugggggugaggggugaagcuggg

SEQ ID NO: 416867 - RNA, 21 nt, Human
uuauugcugccauccccaugg

SEQ ID NO: 416868 - RNA, 18 nt, Human
uugcugccauccccaugg

SEQ ID NO: 416869 - RNA, 23 nt, Human
aaaaaaccaaaacuuugaaggca

SEQ ID NO: 416870 - RNA, 21 nt, Human
aaauggccuggaccccaaaac

SEQ ID NO: 416871 - RNA, 24 nt, Human
aagcgggucuucugggucccugug

SEQ ID NO: 416872 - RNA, 24 nt, Human
aagcuaaaggugaaggugggaggg

SEQ ID NO: 416873 - RNA, 18 nt, Human
aagggguaaaaaaaaugg

SEQ ID NO: 416874 - RNA, 20 nt, Human
aagggguaaaaaaaauggcc

SEQ ID NO: 416875 - RNA, 27 nt, Human
acuuugaaggcauuaagcguuaaaggg

SEQ ID NO: 416876 - RNA, 20 nt, Human
agcagaaaggggaugcccca

SEQ ID NO: 416877 - RNA, 21 nt, Human
aggcucccccagggucccgcc

SEQ ID NO: 416878 - RNA, 21 nt, Human
agggaaggggagucccugggg

SEQ ID NO: 416879 - RNA, 21 nt, Human
cagaaaggggaugccccaaug

SEQ ID NO: 416880 - RNA, 22 nt, Human
cagcagaaaggggaugccccaa

SEQ ID NO: 416881 - RNA, 27 nt, Human
cauccccuccccuuaaauagcugcccc

SEQ ID NO: 416882 - RNA, 23 nt, Human
ccaaagggagaaaagggcggggg

SEQ ID NO: 416883 - RNA, 20 nt, Human
ccaagugggauggggagugg

SEQ ID NO: 416884 - RNA, 19 nt, Human
ccagagggaaggggagucc

SEQ ID NO: 416885 - RNA, 19 nt, Human
ccagcccggugagacaucc

SEQ ID NO: 416886 - RNA, 21 nt, Human
ccauuuucaagaagcuaaagg

SEQ ID NO: 416887 - RNA, 18 nt, Human
cccaaugaaccccacagg

SEQ ID NO: 416888 - RNA, 19 nt, Human
cccaaugaaccccacagga

SEQ ID NO: 416889 - RNA, 18 nt, Human
ccccaaaaccuacccaaa

SEQ ID NO: 416890 - RNA, 18 nt, Human
ccccaaaaccuacccaaa

SEQ ID NO: 416891 - RNA, 22 nt, Human
ccccaaggggauggcagagggg

SEQ ID NO: 416892 - RNA, 20 nt, Human
ccccaaugaaccccacagga

SEQ ID NO: 416893 - RNA, 22 nt, Human
ccggccccaaggggauggcaga

SEQ ID NO: 416894 - RNA, 21 nt, Human
ccuacccaaauaaaaaaucaa

SEQ ID NO: 416895 - RNA, 20 nt, Human
ccucaucuuauuuccuccaa

SEQ ID NO: 416896 - RNA, 19 nt, Human
ccuccccuucuccuuucuc

SEQ ID NO: 416897 - RNA, 20 nt, Human
ccuccccuucuccuuucucc

SEQ ID NO: 416898 - RNA, 21 nt, Human
ccuggaccccaaaaccuaccc

SEQ ID NO: 416899 - RNA, 23 nt, Human
ccuggaccccaaaaccuacccaa

SEQ ID NO: 416900 - RNA, 24 nt, Human
ccuggaccccaaaaccuacccaaa

SEQ ID NO: 416901 - RNA, 18 nt, Human
ccuuccuucccccuuccu

SEQ ID NO: 416902 - RNA, 23 nt, Human
cgccgcuucccucaggcggucug

SEQ ID NO: 416903 - RNA, 22 nt, Human
cggggcuggcuccgggcucggc

SEQ ID NO: 416904 - RNA, 19 nt, Human
cuccaagggguaaaaaaaa

SEQ ID NO: 416905 - RNA, 22 nt, Human
cucccucaucuuauuuccucca

SEQ ID NO: 416906 - RNA, 19 nt, Human
cuggaccccaaaaccuacc

SEQ ID NO: 416907 - RNA, 20 nt, Human
cuggaccccaaaaccuaccc

SEQ ID NO: 416908 - RNA, 22 nt, Human
cuggcugcucccggggcgcccc

SEQ ID NO: 416909 - RNA, 22 nt, Human
cuuccugugggguucauuggug

SEQ ID NO: 416910 - RNA, 22 nt, Human
cuuggaguuuuccaagugggau

SEQ ID NO: 416911 - RNA, 19 nt, Human
ggccccaaggggauggcag

SEQ ID NO: 416912 - RNA, 23 nt, Human
gggaaggagccagagggaagggg

SEQ ID NO: 416913 - RNA, 24 nt, Human
gggagaauguggaccgggccgggg

SEQ ID NO: 416914 - RNA, 22 nt, Human
gggagucccuggggugggggga

SEQ ID NO: 416915 - RNA, 18 nt, Human
ggggauggcagaggggaa

SEQ ID NO: 416916 - RNA, 21 nt, Human
ggggauggcagaggggaagga

SEQ ID NO: 416917 - RNA, 18 nt, Human
ggggcgccccuggcugga

SEQ ID NO: 416918 - RNA, 18 nt, Human
gugcggaaaggagaagcg

SEQ ID NO: 416919 - RNA, 20 nt, Human
guucagggguucggggcugg

SEQ ID NO: 416920 - RNA, 25 nt, Human
uaaaaaaaauggccuggaccccaaa

SEQ ID NO: 416921 - RNA, 23 nt, Human
uaaaaaaaccaaaacuuugaagg

SEQ ID NO: 416922 - RNA, 25 nt, Human
uaaaaaaaccaaaacuuugaaggca

SEQ ID NO: 416923 - RNA, 24 nt, Human
uaaaaaaucaaaaaacugagguuc

SEQ ID NO: 416924 - RNA, 22 nt, Human
uagcauuuaaaaacucccacau

SEQ ID NO: 416925 - RNA, 24 nt, Human
ucaaaaaacugagguuccaaaaag

SEQ ID NO: 416926 - RNA, 19 nt, Human
ucaaaaccaaagagaaaaa

SEQ ID NO: 416927 - RNA, 22 nt, Human
ucaaaaccaaagagaaaaaaaa

SEQ ID NO: 416928 - RNA, 22 nt, Human
uccaagggguaaaaaaaauggc

SEQ ID NO: 416929 - RNA, 28 nt, Human
ucccacaucccauuuuaucaaaaccaaa

SEQ ID NO: 416930 - RNA, 19 nt, Human
uccccuucuccuuucuccc

SEQ ID NO: 416931 - RNA, 22 nt, Human
uccccuucuccuuucucccuca

SEQ ID NO: 416932 - RNA, 20 nt, Human
uccuccaagggguaaaaaaa

SEQ ID NO: 416933 - RNA, 25 nt, Human
uccugugucuucagccaauuccaag

SEQ ID NO: 416934 - RNA, 20 nt, Human
uccuuccuucccccuuccuc

SEQ ID NO: 416935 - RNA, 20 nt, Human
ugccccaaugaaccccacag

SEQ ID NO: 416936 - RNA, 21 nt, Human
uggaccccaaaaccuacccaa

SEQ ID NO: 416937 - RNA, 20 nt, Human
uggaccgggccggggcgggu

SEQ ID NO: 416938 - RNA, 19 nt, Human
uggcuggagguucaggggu

SEQ ID NO: 416939 - RNA, 22 nt, Human
ugugaaauucccuccuuccuuc

SEQ ID NO: 416940 - RNA, 27 nt, Human
uuaaaaacucccacaucccauuuuauc

SEQ ID NO: 416941 - RNA, 19 nt, Human
uucaagaagcuaaagguga

SEQ ID NO: 416942 - RNA, 20 nt, Human
uucaagaagcuaaaggugaa

SEQ ID NO: 416943 - RNA, 21 nt, Human
uuggaguuuuccaagugggau

SEQ ID NO: 416944 - RNA, 24 nt, Human
uuuaaaaacucccacaucccauuu

SEQ ID NO: 416945 - RNA, 25 nt, Human
uuuaaaaacucccacaucccauuuu

SEQ ID NO: 416946 - RNA, 22 nt, Human
uuucccuuuucccccaaaaccc

SEQ ID NO: 416947 - RNA, 19 nt, Human
uuucucccucaucuuauuu

SEQ ID NO: 416948 - RNA, 21 nt, Human
uuucucccucaucuuauuucc

SEQ ID NO: 416949 - RNA, 18 nt, Human
uuucuuaaaaaaaccaaa

SEQ ID NO: 416950 - RNA, 20 nt, Human
aaacaggauccucccucccc

SEQ ID NO: 416951 - RNA, 22 nt, Human
aacuucucccuucgcuggucuc

SEQ ID NO: 416952 - RNA, 18 nt, Human
aagaggcagccuugguua

SEQ ID NO: 416953 - RNA, 20 nt, Human
aagaggcagccuugguuaag

SEQ ID NO: 416954 - RNA, 23 nt, Human
acaaaagcagcacagcaggcccg

SEQ ID NO: 416955 - RNA, 24 nt, Human
acagacagcacugccuuucagagc

SEQ ID NO: 416956 - RNA, 19 nt, Human
acucagugaaggguggggg

SEQ ID NO: 416957 - RNA, 18 nt, Human
acucuguacuucccugcu

SEQ ID NO: 416958 - RNA, 21 nt, Human
aggcagaggugaaagcacaug

SEQ ID NO: 416959 - RNA, 24 nt, Human
aggcugaagggacacuagggagag

SEQ ID NO: 416960 - RNA, 20 nt, Human
agucugguggccaacagaac

SEQ ID NO: 416961 - RNA, 21 nt, Human
auccaaauggucacuucccaa

SEQ ID NO: 416962 - RNA, 22 nt, Human
auugcaaugguuggggcaauaa

SEQ ID NO: 416963 - RNA, 21 nt, Human
caaaagcagcacagcaggccc

SEQ ID NO: 416964 - RNA, 21 nt, Human
caacagaacguagcuucccaa

SEQ ID NO: 416965 - RNA, 26 nt, Human
caauaacccucccuaauccuagcuca

SEQ ID NO: 416966 - RNA, 19 nt, Human
cacacacacaagcacaggu

SEQ ID NO: 416967 - RNA, 26 nt, Human
cagcuccaccagaacaaggaaggcac

SEQ ID NO: 416968 - RNA, 22 nt, Human
caggaagcagccggccucccuc

SEQ ID NO: 416969 - RNA, 23 nt, Human
caggaagcagccggccucccucu

SEQ ID NO: 416970 - RNA, 25 nt, Human
ccaauggcacauacacagauuuuug

SEQ ID NO: 416971 - RNA, 23 nt, Human
ccauagagacgggacauggcaca

SEQ ID NO: 416972 - RNA, 20 nt, Human
cccacccauguaaacagagu

SEQ ID NO: 416973 - RNA, 25 nt, Human
ccgccgccacacacacacaagcaca

SEQ ID NO: 416974 - RNA, 21 nt, Human
ccugcuccaucuccccaccca

SEQ ID NO: 416975 - RNA, 18 nt, Human
ccugucccuccaccuccc

SEQ ID NO: 416976 - RNA, 21 nt, Human
cgccacacacacacaagcaca

SEQ ID NO: 416977 - RNA, 19 nt, Human
cggggaaagggugggggca

SEQ ID NO: 416978 - RNA, 18 nt, Human
cuccaccagaacaaggaa

SEQ ID NO: 416979 - RNA, 19 nt, Human
cuccccaggaggcuugggg

SEQ ID NO: 416980 - RNA, 24 nt, Human
cuuggcagggcccagacauccaaa

SEQ ID NO: 416981 - RNA, 23 nt, Human
gaagaagcccaauugugcuuaag

SEQ ID NO: 416982 - RNA, 21 nt, Human
gaccacgaugagggcaccugg

SEQ ID NO: 416983 - RNA, 24 nt, Human
gacuggggaggagagaaaccccag

SEQ ID NO: 416984 - RNA, 22 nt, Human
gauccucccuccccgccgccac

SEQ ID NO: 416985 - RNA, 24 nt, Human
gcacagaccacgaugagggcaccu

SEQ ID NO: 416986 - RNA, 23 nt, Human
gcagcacagcaggcccggggaaa

SEQ ID NO: 416987 - RNA, 21 nt, Human
gcagcugugguaauggggugg

SEQ ID NO: 416988 - RNA, 24 nt, Human
gccucccucugacccucccugucg

SEQ ID NO: 416989 - RNA, 21 nt, Human
ggaggagagaaaccccagcuc

SEQ ID NO: 416990 - RNA, 18 nt, Human
ggaggggcaggggagagc

SEQ ID NO: 416991 - RNA, 18 nt, Human
ggauggagagugcacagc

SEQ ID NO: 416992 - RNA, 23 nt, Human
ggcacugagaacaaauccagaga

SEQ ID NO: 416993 - RNA, 18 nt, Human
ggccucccucugacccuc

SEQ ID NO: 416994 - RNA, 18 nt, Human
gggaaagggugggggcag

SEQ ID NO: 416995 - RNA, 22 nt, Human
gggacagaggacgagauuggga

SEQ ID NO: 416996 - RNA, 21 nt, Human
gggcaggggagagcggucauc

SEQ ID NO: 416997 - RNA, 22 nt, Human
ggggaaagggugggggcaggaa

SEQ ID NO: 416998 - RNA, 20 nt, Human
ggggaggagaaggagguggg

SEQ ID NO: 416999 - RNA, 19 nt, Human
gggggagggagggcagagc

SEQ ID NO: 417000 - RNA, 23 nt, Human
gguggcggggcagggacgggagg

SEQ ID NO: 417001 - RNA, 22 nt, Human
guagggccuccccuaacugcaa

SEQ ID NO: 417002 - RNA, 20 nt, Human
gugaagggugggggcucugu

SEQ ID NO: 417003 - RNA, 22 nt, Human
gugaagggugggggcucuguaa

SEQ ID NO: 417004 - RNA, 23 nt, Human
gugggggcucuguauccuuccca

SEQ ID NO: 417005 - RNA, 20 nt, Human
uaaaugccacacauaucugg

SEQ ID NO: 417006 - RNA, 21 nt, Human
uaaggcacugagaacaaaucc

SEQ ID NO: 417007 - RNA, 19 nt, Human
uacaugcuggacucacaga

SEQ ID NO: 417008 - RNA, 19 nt, Human
uagcuucccaacuucuccc

SEQ ID NO: 417009 - RNA, 22 nt, Human
uaucugcaaggcugaggaagcu

SEQ ID NO: 417010 - RNA, 20 nt, Human
ucagugaagggugggggcuc

SEQ ID NO: 417011 - RNA, 18 nt, Human
ucccaacuucucccuucg

SEQ ID NO: 417012 - RNA, 21 nt, Human
uccccaggaggcuuggggcug

SEQ ID NO: 417013 - RNA, 24 nt, Human
ucccucugacccucccugucgccu

SEQ ID NO: 417014 - RNA, 18 nt, Human
uccucaaccaccauagag

SEQ ID NO: 417015 - RNA, 25 nt, Human
ugaggaagcuuccccgccuuucucc

SEQ ID NO: 417016 - RNA, 20 nt, Human
ugauaagcugccucucugcu

SEQ ID NO: 417017 - RNA, 19 nt, Human
ugcuuggauuuuuacuuug

SEQ ID NO: 417018 - RNA, 21 nt, Human
ugcuuugagaaggcaguaggg

SEQ ID NO: 417019 - RNA, 19 nt, Human
uggaagaagcccaauugug

SEQ ID NO: 417020 - RNA, 21 nt, Human
uggaagaagcccaauugugcu

SEQ ID NO: 417021 - RNA, 22 nt, Human
uggcacaaaagcagcacagcag

SEQ ID NO: 417022 - RNA, 19 nt, Human
uggcagaaaaccuggagau

SEQ ID NO: 417023 - RNA, 25 nt, Human
uggccaacagaacguagcuucccaa

SEQ ID NO: 417024 - RNA, 27 nt, Human
uggcuaaccuuggcacaaaagcagcac

SEQ ID NO: 417025 - RNA, 24 nt, Human
ugggaacuggucaagcccagaggc

SEQ ID NO: 417026 - RNA, 18 nt, Human
uggucacuucccaaccuc

SEQ ID NO: 417027 - RNA, 22 nt, Human
ugguugcaauggcccagguccu

SEQ ID NO: 417028 - RNA, 20 nt, Human
uuggaagaggcagccuuggu

SEQ ID NO: 417029 - RNA, 23 nt, Human
uuggcagggcccagacauccaaa

SEQ ID NO: 417030 - RNA, 21 nt, Human
uugguugcaauggcccagguc

SEQ ID NO: 417031 - RNA, 21 nt, Human
uugugggacuggggaggagag

SEQ ID NO: 417032 - RNA, 22 nt, Human
uuuuuuuuuucccaggguuugg

SEQ ID NO: 417033 - RNA, 21 nt, Human
uuuuuuuuuuuuuuuucccag

SEQ ID NO: 417034 - RNA, 25 nt, Human
uuuuuuuuuuuuuuuuucccagggg

SEQ ID NO: 417035 - RNA, 24 nt, Human
agccuggaguuucucgucucucug

SEQ ID NO: 417036 - RNA, 20 nt, Human
auuaaccaugucagggcaca

SEQ ID NO: 417037 - RNA, 21 nt, Human
cagccccuggcuccgcugccu

SEQ ID NO: 417038 - RNA, 26 nt, Human
caucccaaagucuccacccgccggga

SEQ ID NO: 417039 - RNA, 22 nt, Human
ccacccgcccgcacgccugccc

SEQ ID NO: 417040 - RNA, 23 nt, Human
ccaucccaaagucuccacccgcc

SEQ ID NO: 417041 - RNA, 21 nt, Human
cccgcacgccugcccugcucg

SEQ ID NO: 417042 - RNA, 28 nt, Human
cccucgcagccuccaccacccacccgcc

SEQ ID NO: 417043 - RNA, 23 nt, Human
ccuccaguccaucccaaagucuc

SEQ ID NO: 417044 - RNA, 23 nt, Human
ccugcccacgccgggcucagagc

SEQ ID NO: 417045 - RNA, 19 nt, Human
ccuggcuccgcugccugcc

SEQ ID NO: 417046 - RNA, 19 nt, Human
cgcugcgcuccuccagucc

SEQ ID NO: 417047 - RNA, 25 nt, Human
cgcugcgcuccuccaguccauccca

SEQ ID NO: 417048 - RNA, 20 nt, Human
cuccgcugccugcccacgcc

SEQ ID NO: 417049 - RNA, 23 nt, Human
cuugagccccgucugcuugaggg

SEQ ID NO: 417050 - RNA, 18 nt, Human
cuugaggggacccaagag

SEQ ID NO: 417051 - RNA, 18 nt, Human
ggagcugucacagccccu

SEQ ID NO: 417052 - RNA, 20 nt, Human
uaaauuaaccaugucagggc

SEQ ID NO: 417053 - RNA, 19 nt, Human
ucccaaagucuccacccgc

SEQ ID NO: 417054 - RNA, 19 nt, Human
ucgcagccuccaccaccca

SEQ ID NO: 417055 - RNA, 21 nt, Human
ugcccugcucgccuguggagc

SEQ ID NO: 417056 - RNA, 27 nt, Human
ugcccugcucgccuguggagcgacagc

SEQ ID NO: 417057 - RNA, 21 nt, Human
caagaaaaucugcgagucuug

SEQ ID NO: 417058 - RNA, 20 nt, Human
gaaaaucugcgagucuuguc

SEQ ID NO: 417059 - RNA, 18 nt, Human
ugagucacagaggagcua

SEQ ID NO: 417060 - RNA, 22 nt, Human
uucagggcuggagugacucucc

SEQ ID NO: 417061 - RNA, 22 nt, Human
agacacacacacucacacugca

SEQ ID NO: 417062 - RNA, 18 nt, Human
aguguguggcugcagccc

SEQ ID NO: 417063 - RNA, 24 nt, Human
ccuucuugucauuguuuuccuuuu

SEQ ID NO: 417064 - RNA, 21 nt, Human
cuccggggccugcucagugcc

SEQ ID NO: 417065 - RNA, 18 nt, Human
cugcagccccuccucucc

SEQ ID NO: 417066 - RNA, 19 nt, Human
cugcagccccuccucuccg

SEQ ID NO: 417067 - RNA, 23 nt, Human
ucauuguuuuccuuuuauuucag

SEQ ID NO: 417068 - RNA, 26 nt, Human
ucccuucuugucauuguuuuccuuuu

SEQ ID NO: 417069 - RNA, 18 nt, Human
ucuugucauuguuuuccu

SEQ ID NO: 417070 - RNA, 19 nt, Human
ugagagacacacacacuca

SEQ ID NO: 417071 - RNA, 19 nt, Human
ugagagacacacacacuca

SEQ ID NO: 417072 - RNA, 23 nt, Human
ugcacucacgcacacaagcugcg

SEQ ID NO: 417073 - RNA, 19 nt, Human
uguccgcuuggggcacagg

SEQ ID NO: 417074 - RNA, 22 nt, Human
uuuuuuuuuuuuuuuuucccuu

SEQ ID NO: 417075 - RNA, 23 nt, Human
aaacuccacuuauagaagacaau

SEQ ID NO: 417076 - RNA, 18 nt, Human
aaccuguaaggauaaagg

SEQ ID NO: 417077 - RNA, 18 nt, Human
aagaacuacaaaaucacc

SEQ ID NO: 417078 - RNA, 22 nt, Human
aauguguagcaaggcaaauuac

SEQ ID NO: 417079 - RNA, 18 nt, Human
acugccucccgggccgcc

SEQ ID NO: 417080 - RNA, 19 nt, Human
auagaagacaauagcaaca

SEQ ID NO: 417081 - RNA, 19 nt, Human
cacugcacuuaucugaggu

SEQ ID NO: 417082 - RNA, 24 nt, Human
caggcaaaaauaaugauuaaaaua

SEQ ID NO: 417083 - RNA, 18 nt, Human
caucaagugagaguaaca

SEQ ID NO: 417084 - RNA, 22 nt, Human
caugaaauacaaguacaaaaca

SEQ ID NO: 417085 - RNA, 22 nt, Human
caugcacauucauuggugcgca

SEQ ID NO: 417086 - RNA, 18 nt, Human
ccucccgggccgccggcc

SEQ ID NO: 417087 - RNA, 22 nt, Human
cuaaaccacauuuuuaauugcc

SEQ ID NO: 417088 - RNA, 22 nt, Human
cuaaguccuaaauauaccaaag

SEQ ID NO: 417089 - RNA, 22 nt, Human
cucuaggugcugauuggcugcg

SEQ ID NO: 417090 - RNA, 22 nt, Human
cuuaauagcccucuuaaugugu

SEQ ID NO: 417091 - RNA, 20 nt, Human
cuugcaggcccgccucucca

SEQ ID NO: 417092 - RNA, 18 nt, Human
gaaauacaaguacaaaac

SEQ ID NO: 417093 - RNA, 19 nt, Human
gaaauacaaguacaaaaca

SEQ ID NO: 417094 - RNA, 21 nt, Human
gagcgcgcgacugccucccgg

SEQ ID NO: 417095 - RNA, 26 nt, Human
gcaacagaggaccacuaaguccuaaa

SEQ ID NO: 417096 - RNA, 19 nt, Human
ggagcgucccccacaaguc

SEQ ID NO: 417097 - RNA, 21 nt, Human
ggagcgucccccacaaguccc

SEQ ID NO: 417098 - RNA, 21 nt, Human
uaaaauaccauuagcuuugcu

SEQ ID NO: 417099 - RNA, 24 nt, Human
uaaaaugguuuaaccacaucaagu

SEQ ID NO: 417100 - RNA, 18 nt, Human
uaaaauguccagaauauc

SEQ ID NO: 417101 - RNA, 23 nt, Human
uaaccacaucaagugagaguaac

SEQ ID NO: 417102 - RNA, 22 nt, Human
uaaguccuaaauauaccaaaga

SEQ ID NO: 417103 - RNA, 22 nt, Human
uaauguguagcaaggcaaauua

SEQ ID NO: 417104 - RNA, 19 nt, Human
uaccaaagaaaaacaaguu

SEQ ID NO: 417105 - RNA, 26 nt, Human
uaccaaagaaaaacaaguuuacaaau

SEQ ID NO: 417106 - RNA, 22 nt, Human
uagcuuuccacagggauuuuuu

SEQ ID NO: 417107 - RNA, 23 nt, Human
uaucagaaucuguaucacccagc

SEQ ID NO: 417108 - RNA, 24 nt, Human
ucagccauugcagauucacauuua

SEQ ID NO: 417109 - RNA, 24 nt, Human
ucagcuuccauagcaugucucaca

SEQ ID NO: 417110 - RNA, 23 nt, Human
ucgcacuugcaggcccgccucuc

SEQ ID NO: 417111 - RNA, 20 nt, Human
ucucacaguuuucggccauu

SEQ ID NO: 417112 - RNA, 21 nt, Human
uggcauugcaaagacacugca

SEQ ID NO: 417113 - RNA, 20 nt, Human
uuaagaacuacaaaaucacc

SEQ ID NO: 417114 - RNA, 24 nt, Human
uuaauagcccucuuaauguguagc

SEQ ID NO: 417115 - RNA, 19 nt, Human
uuggggaugcgagcgcgcg

SEQ ID NO: 417116 - RNA, 23 nt, Human
uuucuuaugacaggcaaaaauug

SEQ ID NO: 417117 - RNA, 19 nt, Human
aaaaaaaccuaaacauuua

SEQ ID NO: 417118 - RNA, 21 nt, Human
aacccuuauuugugucccacc

SEQ ID NO: 417119 - RNA, 20 nt, Human
auagaugggcauuucuuucc

SEQ ID NO: 417120 - RNA, 21 nt, Human
cauagaugggcauuucuuucc

SEQ ID NO: 417121 - RNA, 19 nt, Human
cauugggaaaguugcacag

SEQ ID NO: 417122 - RNA, 22 nt, Human
cugaagccagugaggcccgaug

SEQ ID NO: 417123 - RNA, 23 nt, Human
cugaagccagugaggcccgaugc

SEQ ID NO: 417124 - RNA, 19 nt, Human
gaaagggaauaaaauagaa

SEQ ID NO: 417125 - RNA, 20 nt, Human
gaaaguugcacaggagucug

SEQ ID NO: 417126 - RNA, 18 nt, Human
ggaacuccuccaguucuc

SEQ ID NO: 417127 - RNA, 19 nt, Human
uaaaaauauaaaacccggc

SEQ ID NO: 417128 - RNA, 25 nt, Human
uaaaauagaagaaagaugacaaagg

SEQ ID NO: 417129 - RNA, 23 nt, Human
uacaaaaccugaaauuauuguca

SEQ ID NO: 417130 - RNA, 28 nt, Human
uacagagaaacccagucaaccauuauac

SEQ ID NO: 417131 - RNA, 19 nt, Human
uauuuuacauauguacaaa

SEQ ID NO: 417132 - RNA, 23 nt, Human
uccaaaacccuuauuuguguccc

SEQ ID NO: 417133 - RNA, 22 nt, Human
ugaaacaucuccguaccaugcc

SEQ ID NO: 417134 - RNA, 21 nt, Human
ugagguauuuaguaccugaaa

SEQ ID NO: 417135 - RNA, 18 nt, Human
ugcacaggagucugauga

SEQ ID NO: 417136 - RNA, 18 nt, Human
ugucagcaaauauuaaug

SEQ ID NO: 417137 - RNA, 25 nt, Human
uuuacaaaaccugaaauuauuguca

SEQ ID NO: 417138 - RNA, 18 nt, Human
uuugacuucuugcucaca

SEQ ID NO: 417139 - RNA, 23 nt, Human
uuuuuuuuuuuuuuuuucuaauu

SEQ ID NO: 417140 - RNA, 19 nt, Human
aaaaaccaggauauaggag

SEQ ID NO: 417141 - RNA, 25 nt, Human
aaaaaggaucuuuuagaguuacaga

SEQ ID NO: 417142 - RNA, 24 nt, Human
aaaaggacccagguagcacagccc

SEQ ID NO: 417143 - RNA, 26 nt, Human
aaaaugcagcauuucagcucaaaaug

SEQ ID NO: 417144 - RNA, 21 nt, Human
aaacugaggaagggcaggaaa

SEQ ID NO: 417145 - RNA, 21 nt, Human
aaaggaaacacugcccucuca

SEQ ID NO: 417146 - RNA, 24 nt, Human
aaccacuggaagaaccgggagagc

SEQ ID NO: 417147 - RNA, 26 nt, Human
aaccacuggaagaaccgggagagcaa

SEQ ID NO: 417148 - RNA, 21 nt, Human
aacuguguuugagaauacagg

SEQ ID NO: 417149 - RNA, 23 nt, Human
aacuguguuugagaauacaggaa

SEQ ID NO: 417150 - RNA, 24 nt, Human
aagcagaaucauaugauucugugg

SEQ ID NO: 417151 - RNA, 19 nt, Human
aaugaacaauuaagagcua

SEQ ID NO: 417152 - RNA, 18 nt, Human
acacauuucaaagugucc

SEQ ID NO: 417153 - RNA, 18 nt, Human
acagaggccaccuucccc

SEQ ID NO: 417154 - RNA, 23 nt, Human
acccuggcuacucugcccuucca

SEQ ID NO: 417155 - RNA, 18 nt, Human
agcacagacauugcucag

SEQ ID NO: 417156 - RNA, 22 nt, Human
agcgaugggugggaaggaagga

SEQ ID NO: 417157 - RNA, 18 nt, Human
aggaaagagaaacagagg

SEQ ID NO: 417158 - RNA, 19 nt, Human
aggcaagguucuuacuccu

SEQ ID NO: 417159 - RNA, 21 nt, Human
aggcagugacuaagcauggag

SEQ ID NO: 417160 - RNA, 25 nt, Human
aggcagugacuaagcauggagugcc

SEQ ID NO: 417161 - RNA, 18 nt, Human
agggaacaagggcagagc

SEQ ID NO: 417162 - RNA, 19 nt, Human
agggaacaagggcagagca

SEQ ID NO: 417163 - RNA, 21 nt, Human
aguaauaaguaccaaaaagga

SEQ ID NO: 417164 - RNA, 19 nt, Human
aguagagguuucugugcca

SEQ ID NO: 417165 - RNA, 23 nt, Human
agugaaugggagccaaggaaaga

SEQ ID NO: 417166 - RNA, 20 nt, Human
aguggcccugcugggaagau

SEQ ID NO: 417167 - RNA, 28 nt, Human
aucauuuuccuucuuuuuaaccuucagg

SEQ ID NO: 417168 - RNA, 25 nt, Human
aucuucagcagcacuagaauucuag

SEQ ID NO: 417169 - RNA, 21 nt, Human
auggcagggccacacccuggc

SEQ ID NO: 417170 - RNA, 22 nt, Human
auuuuccuucuuuuuaguagag

SEQ ID NO: 417171 - RNA, 21 nt, Human
caaaaaccaggauauaggaga

SEQ ID NO: 417172 - RNA, 20 nt, Human
caacauggaaagcucaaaac

SEQ ID NO: 417173 - RNA, 21 nt, Human
caacauggaaagcucaaaaca

SEQ ID NO: 417174 - RNA, 18 nt, Human
caacucugggcagcuccu

SEQ ID NO: 417175 - RNA, 24 nt, Human
caaggaaagagaaacagagggaag

SEQ ID NO: 417176 - RNA, 18 nt, Human
cacaaguguaacuguguu

SEQ ID NO: 417177 - RNA, 21 nt, Human
cagagagcuugguuguaguug

SEQ ID NO: 417178 - RNA, 21 nt, Human
cagcucaaaaugaacaauuaa

SEQ ID NO: 417179 - RNA, 18 nt, Human
cagcucccagcaacucug

SEQ ID NO: 417180 - RNA, 21 nt, Human
caggacacaguguguucaugg

SEQ ID NO: 417181 - RNA, 23 nt, Human
caggaugugauuuuucagcuccc

SEQ ID NO: 417182 - RNA, 21 nt, Human
cauggagugccgggaguggcc

SEQ ID NO: 417183 - RNA, 19 nt, Human
ccacagaggccaccuuccc

SEQ ID NO: 417184 - RNA, 20 nt, Human
ccacagaggccaccuucccc

SEQ ID NO: 417185 - RNA, 23 nt, Human
ccaggccaggaugugauuuuuca

SEQ ID NO: 417186 - RNA, 18 nt, Human
ccccuguagcagcaaagc

SEQ ID NO: 417187 - RNA, 20 nt, Human
ccccuguagcagcaaagcuc

SEQ ID NO: 417188 - RNA, 24 nt, Human
ccccuguagcagcaaagcucacuu

SEQ ID NO: 417189 - RNA, 20 nt, Human
cccuggcuacucugcccuuc

SEQ ID NO: 417190 - RNA, 21 nt, Human
ccugggcccugggucuuggga

SEQ ID NO: 417191 - RNA, 22 nt, Human
ccuugaaaauaaucauccucau

SEQ ID NO: 417192 - RNA, 23 nt, Human
cuagcacagacauugcucagggg

SEQ ID NO: 417193 - RNA, 22 nt, Human
cucaaaaugaacaauuaagagc

SEQ ID NO: 417194 - RNA, 19 nt, Human
cuccacagaggccaccuuc

SEQ ID NO: 417195 - RNA, 21 nt, Human
cuccacagaggccaccuuccc

SEQ ID NO: 417196 - RNA, 20 nt, Human
cucucuugaaccccauacuu

SEQ ID NO: 417197 - RNA, 18 nt, Human
gaaagccugaguguaaag

SEQ ID NO: 417198 - RNA, 20 nt, Human
gaagaggcccccauuccuuu

SEQ ID NO: 417199 - RNA, 19 nt, Human
gaaggcuacaaaaaccagg

SEQ ID NO: 417200 - RNA, 19 nt, Human
gacucagaucauuuuccuu

SEQ ID NO: 417201 - RNA, 21 nt, Human
gagggaaguguccccuaggga

SEQ ID NO: 417202 - RNA, 20 nt, Human
gauucugagcuuaugugaag

SEQ ID NO: 417203 - RNA, 23 nt, Human
gcacagacauugcucaggggcau

SEQ ID NO: 417204 - RNA, 22 nt, Human
gcauggagugccgggaguggcc

SEQ ID NO: 417205 - RNA, 23 nt, Human
gcccccauaugcuggggcuccac

SEQ ID NO: 417206 - RNA, 21 nt, Human
ggacccagguagcacagccca

SEQ ID NO: 417207 - RNA, 18 nt, Human
ggcagagagcaccaggac

SEQ ID NO: 417208 - RNA, 18 nt, Human
ggcgacagagaaguagga

SEQ ID NO: 417209 - RNA, 18 nt, Human
ggcuacaaaaaccaggau

SEQ ID NO: 417210 - RNA, 22 nt, Human
gggccgggaaccggcgaagaga

SEQ ID NO: 417211 - RNA, 18 nt, Human
gggcggcgaaccgcgggc

SEQ ID NO: 417212 - RNA, 19 nt, Human
gucuggcuaguguucacuu

SEQ ID NO: 417213 - RNA, 21 nt, Human
uaaaaaggaucuuuuagaguu

SEQ ID NO: 417214 - RNA, 21 nt, Human
uaaaaugcagcauuucagcuc

SEQ ID NO: 417215 - RNA, 22 nt, Human
uaaaaugcagcauuucagcuca

SEQ ID NO: 417216 - RNA, 18 nt, Human
uaaaggaccaacuuaagu

SEQ ID NO: 417217 - RNA, 23 nt, Human
uaccaaaaaggaaacacugcccu

SEQ ID NO: 417218 - RNA, 20 nt, Human
uagaaaggauguggaggaag

SEQ ID NO: 417219 - RNA, 19 nt, Human
uaugcuggggcuccacaga

SEQ ID NO: 417220 - RNA, 21 nt, Human
ucaaaacaauuuugggaggca

SEQ ID NO: 417221 - RNA, 21 nt, Human
uccacagaggccaccuucccc

SEQ ID NO: 417222 - RNA, 21 nt, Human
uccaguggcagagagcaccag

SEQ ID NO: 417223 - RNA, 19 nt, Human
ucccagcaacucugggcag

SEQ ID NO: 417224 - RNA, 18 nt, Human
ucccauugauucaucuuc

SEQ ID NO: 417225 - RNA, 18 nt, Human
ucuggcuaguguucacuu

SEQ ID NO: 417226 - RNA, 24 nt, Human
ucuucagcagcacuagaauucuag

SEQ ID NO: 417227 - RNA, 22 nt, Human
ugagggccuugaaaauaaucau

SEQ ID NO: 417228 - RNA, 22 nt, Human
ugcagggagguaggaauuacag

SEQ ID NO: 417229 - RNA, 18 nt, Human
ugcugggaagauggcagg

SEQ ID NO: 417230 - RNA, 23 nt, Human
ugcugggaagauggcagggccac

SEQ ID NO: 417231 - RNA, 21 nt, Human
ugcuggggcuccacagaggcc

SEQ ID NO: 417232 - RNA, 20 nt, Human
uggaagagugaaugggagcc

SEQ ID NO: 417233 - RNA, 25 nt, Human
uggagugccgggaguggcccugcug

SEQ ID NO: 417234 - RNA, 18 nt, Human
uggcagagagcaccagga

SEQ ID NO: 417235 - RNA, 18 nt, Human
ugggaaggaaggauguuc

SEQ ID NO: 417236 - RNA, 18 nt, Human
ugggagccaaggaaagag

SEQ ID NO: 417237 - RNA, 18 nt, Human
ugggauagagggugcaca

SEQ ID NO: 417238 - RNA, 25 nt, Human
ugggauagagggugcacaaguguaa

SEQ ID NO: 417239 - RNA, 19 nt, Human
ugggauucuggaagaguga

SEQ ID NO: 417240 - RNA, 19 nt, Human
ugugggaaacuagaaggau

SEQ ID NO: 417241 - RNA, 20 nt, Human
ugugggaaacuagaaggauu

SEQ ID NO: 417242 - RNA, 18 nt, Human
uucaaaguguccaugaaa

SEQ ID NO: 417243 - RNA, 22 nt, Human
uucaucuucagcagcacuagaa

SEQ ID NO: 417244 - RNA, 25 nt, Human
uucaugggauggcuaccuuggcggg

SEQ ID NO: 417245 - RNA, 20 nt, Human
uugaaaauaaucauccucau

SEQ ID NO: 417246 - RNA, 19 nt, Human
uugguuguaguugguugca

SEQ ID NO: 417247 - RNA, 20 nt, Human
uuugaagaggcccccauucc

SEQ ID NO: 417248 - RNA, 21 nt, Human
aacagaaauggcauaggccca

SEQ ID NO: 417249 - RNA, 21 nt, Human
aacccgcaagcggcuucccuc

SEQ ID NO: 417250 - RNA, 25 nt, Human
aagcgcccccacccccagggaacaa

SEQ ID NO: 417251 - RNA, 18 nt, Human
acaacagaaauggcauag

SEQ ID NO: 417252 - RNA, 20 nt, Human
acagaaacccccuguccaga

SEQ ID NO: 417253 - RNA, 24 nt, Human
acugccccaaacuacaacagaaaa

SEQ ID NO: 417254 - RNA, 23 nt, Human
agaaacccccuguccagagucag

SEQ ID NO: 417255 - RNA, 19 nt, Human
aggcggugggcgagcagcg

SEQ ID NO: 417256 - RNA, 26 nt, Human
auggagcaggcugugggcgcaccccc

SEQ ID NO: 417257 - RNA, 19 nt, Human
caacagaaauggcauaggc

SEQ ID NO: 417258 - RNA, 21 nt, Human
caacagaaauggcauaggccc

SEQ ID NO: 417259 - RNA, 20 nt, Human
caacauuaacucaaaagcaa

SEQ ID NO: 417260 - RNA, 23 nt, Human
caagcgcccccacccccagggaa

SEQ ID NO: 417261 - RNA, 22 nt, Human
caccccacacagguccccugca

SEQ ID NO: 417262 - RNA, 19 nt, Human
cagguccccugcacugccc

SEQ ID NO: 417263 - RNA, 26 nt, Human
cauccagcaacuguggccccuaccca

SEQ ID NO: 417264 - RNA, 18 nt, Human
ccacccccagggaacaag

SEQ ID NO: 417265 - RNA, 18 nt, Human
cccaaacuacaacagaaa

SEQ ID NO: 417266 - RNA, 24 nt, Human
cccaaacuacaacagaaauggcau

SEQ ID NO: 417267 - RNA, 20 nt, Human
cccccagggaacaaggucca

SEQ ID NO: 417268 - RNA, 20 nt, Human
ccccuacccaccuacccagg

SEQ ID NO: 417269 - RNA, 20 nt, Human
ccccuguccagagucagacu

SEQ ID NO: 417270 - RNA, 19 nt, Human
ccgccuaccaaaugaaaau

SEQ ID NO: 417271 - RNA, 23 nt, Human
ccggcagcgaggcgucgggcgaa

SEQ ID NO: 417272 - RNA, 19 nt, Human
ccucccaccggcagcgagg

SEQ ID NO: 417273 - RNA, 26 nt, Human
cgacaaacccgcaagcggcuucccuc

SEQ ID NO: 417274 - RNA, 18 nt, Human
cggcggcuguggcggccc

SEQ ID NO: 417275 - RNA, 22 nt, Human
cggcuucccucucgcuuccucc

SEQ ID NO: 417276 - RNA, 21 nt, Human
cgggcgaacaacgcuggcucc

SEQ ID NO: 417277 - RNA, 18 nt, Human
cucccggccggcggcugu

SEQ ID NO: 417278 - RNA, 24 nt, Human
cuccugauccgcgagguggcagug

SEQ ID NO: 417279 - RNA, 20 nt, Human
cuccugggcaagcgccccca

SEQ ID NO: 417280 - RNA, 21 nt, Human
cugccccaaacuacaacagaa

SEQ ID NO: 417281 - RNA, 23 nt, Human
cuguccagagucagacuguagcu

SEQ ID NO: 417282 - RNA, 22 nt, Human
cugugggcgcaccccugguccc

SEQ ID NO: 417283 - RNA, 19 nt, Human
gaacaacgcuggcuccuga

SEQ ID NO: 417284 - RNA, 25 nt, Human
gagaauggagcaggcugugggcgca

SEQ ID NO: 417285 - RNA, 20 nt, Human
gccccaaacuacaacagaaa

SEQ ID NO: 417286 - RNA, 21 nt, Human
ggccccuacccaccuacccag

SEQ ID NO: 417287 - RNA, 22 nt, Human
ggccggcggcuguggcggcccg

SEQ ID NO: 417288 - RNA, 23 nt, Human
ggccggcggcuguggcggcccgc

SEQ ID NO: 417289 - RNA, 22 nt, Human
ggccggggcucggcucuuccag

SEQ ID NO: 417290 - RNA, 19 nt, Human
ggcggugggcgagcagcgg

SEQ ID NO: 417291 - RNA, 20 nt, Human
gggcaagcgcccccaccccc

SEQ ID NO: 417292 - RNA, 18 nt, Human
ggggaagggagggcucgg

SEQ ID NO: 417293 - RNA, 19 nt, Human
gugggcgagcagcggcgac

SEQ ID NO: 417294 - RNA, 23 nt, Human
uacccaccuacccagguuggaua

SEQ ID NO: 417295 - RNA, 18 nt, Human
uauauaaacauccagcaa

SEQ ID NO: 417296 - RNA, 20 nt, Human
uauuguccuuuuacaacaug

SEQ ID NO: 417297 - RNA, 21 nt, Human
ucauuuuuugguuuagaaacu

SEQ ID NO: 417298 - RNA, 19 nt, Human
ucggcucuuccaggcggug

SEQ ID NO: 417299 - RNA, 22 nt, Human
ucuccgccuaccaaaugaaaau

SEQ ID NO: 417300 - RNA, 25 nt, Human
ucucuauauaaacauccagcaacug

SEQ ID NO: 417301 - RNA, 21 nt, Human
ugccccaaacuacaacagaaa

SEQ ID NO: 417302 - RNA, 24 nt, Human
ugggcgagcagcggcgacaaaccc

SEQ ID NO: 417303 - RNA, 22 nt, Human
uguggcagguggcaguagugcc

SEQ ID NO: 417304 - RNA, 22 nt, Human
uguggcggcccgcggguaacgg

SEQ ID NO: 417305 - RNA, 21 nt, Human
uuggauagggggaagggaggg

SEQ ID NO: 417306 - RNA, 22 nt, Human
uuuauuguccuuuuacaacaug

SEQ ID NO: 417307 - RNA, 19 nt, Human
acuccacuacccagccaau

SEQ ID NO: 417308 - RNA, 23 nt, Human
aggaccauucacuucuuggaugc

SEQ ID NO: 417309 - RNA, 19 nt, Human
aucaaagaacuuuuccauc

SEQ ID NO: 417310 - RNA, 18 nt, Human
aucucacuuccuucuccc

SEQ ID NO: 417311 - RNA, 23 nt, Human
caacacuccacuacccagccaau

SEQ ID NO: 417312 - RNA, 22 nt, Human
cacuacccagccaaugguagcc

SEQ ID NO: 417313 - RNA, 20 nt, Human
cacuccacuacccagccaau

SEQ ID NO: 417314 - RNA, 22 nt, Human
cacuuccuucucccagugucca

SEQ ID NO: 417315 - RNA, 21 nt, Human
caucucacuuccuucucccag

SEQ ID NO: 417316 - RNA, 19 nt, Human
ccagccaaugguagcccuu

SEQ ID NO: 417317 - RNA, 23 nt, Human
ccucccuguauauaccccucucg

SEQ ID NO: 417318 - RNA, 18 nt, Human
ccuucucccaguguccac

SEQ ID NO: 417319 - RNA, 19 nt, Human
cgacuaacuccaggcugcc

SEQ ID NO: 417320 - RNA, 25 nt, Human
cuguauauaccccucucgcgauccc

SEQ ID NO: 417321 - RNA, 26 nt, Human
cuguauauaccccucucgcgauccca

SEQ ID NO: 417322 - RNA, 21 nt, Human
ggacgagacaaucacgccccu

SEQ ID NO: 417323 - RNA, 18 nt, Human
cgacuaacuccaggcugc

SEQ ID NO: 417324 - RNA, 19 nt, Human
cgacuaacuccaggcugcc

SEQ ID NO: 417325 - RNA, 19 nt, Human
ugagaucucugaggucugg

SEQ ID NO: 417326 - RNA, 19 nt, Human
uggugagaucucugagguc

SEQ ID NO: 417327 - RNA, 21 nt, Human
aaaaaaaaacacaacacaaga

SEQ ID NO: 417328 - RNA, 18 nt, Human
aaaaaaacacaacacaag

SEQ ID NO: 417329 - RNA, 23 nt, Human
aaaaaaacacaacacaagaagga

SEQ ID NO: 417330 - RNA, 23 nt, Human
aaagcugaaucaacuuuaaccug

SEQ ID NO: 417331 - RNA, 21 nt, Human
aaauagguuucuucuguaccu

SEQ ID NO: 417332 - RNA, 20 nt, Human
aagaaaccuggcaucucaaa

SEQ ID NO: 417333 - RNA, 20 nt, Human
aaguucuccccgagucuacc

SEQ ID NO: 417334 - RNA, 27 nt, Human
acaaaauggaagacucuaaaauguacc

SEQ ID NO: 417335 - RNA, 21 nt, Human
accccaaaauggcacaaaaga

SEQ ID NO: 417336 - RNA, 23 nt, Human
accccaaaauggcacaaaagaaa

SEQ ID NO: 417337 - RNA, 19 nt, Human
aucacauccaccuucucca

SEQ ID NO: 417338 - RNA, 22 nt, Human
aucacauccaccuucuccaccc

SEQ ID NO: 417339 - RNA, 19 nt, Human
auccaccuucuccacccca

SEQ ID NO: 417340 - RNA, 18 nt, Human
caaaaaaaaacacaacac

SEQ ID NO: 417341 - RNA, 22 nt, Human
caaaauggaagacucuaaaaug

SEQ ID NO: 417342 - RNA, 21 nt, Human
caaaauggcacaaaagaaaca

SEQ ID NO: 417343 - RNA, 21 nt, Human
caacaaaauggaagacucuaa

SEQ ID NO: 417344 - RNA, 18 nt, Human
caacauuaaaagauacac

SEQ ID NO: 417345 - RNA, 22 nt, Human
cacaaaagaaacaguuaccaca

SEQ ID NO: 417346 - RNA, 25 nt, Human
cacauccaccuucuccaccccaaaa

SEQ ID NO: 417347 - RNA, 20 nt, Human
caccaaguucuccccgaguc

SEQ ID NO: 417348 - RNA, 21 nt, Human
caccaaguucuccccgagucu

SEQ ID NO: 417349 - RNA, 18 nt, Human
caccuucuccaccccaaa

SEQ ID NO: 417350 - RNA, 21 nt, Human
caucaagcagcgagccucuca

SEQ ID NO: 417351 - RNA, 28 nt, Human
caucacauccaccuucuccaccccaaaa

SEQ ID NO: 417352 - RNA, 23 nt, Human
cccaaaauggcacaaaagaaaca

SEQ ID NO: 417353 - RNA, 21 nt, Human
ccccaaaauggcacaaaagaa

SEQ ID NO: 417354 - RNA, 20 nt, Human
cuagauaaaaaagaaaccug

SEQ ID NO: 417355 - RNA, 20 nt, Human
cuccccgagucuaccacuga

SEQ ID NO: 417356 - RNA, 20 nt, Human
cuccuggaagcuauuucaua

SEQ ID NO: 417357 - RNA, 21 nt, Human
cuggugcaagggccaaaaaaa

SEQ ID NO: 417358 - RNA, 26 nt, Human
gaaucaacuuuaaccuggagggcuaa

SEQ ID NO: 417359 - RNA, 23 nt, Human
gggcucggaggcggcuacggcgg

SEQ ID NO: 417360 - RNA, 22 nt, Human
gguguaaaagagaugaugauga

SEQ ID NO: 417361 - RNA, 19 nt, Human
gugauuacaaucacacaga

SEQ ID NO: 417362 - RNA, 19 nt, Human
uaaaaaacaaauugagugg

SEQ ID NO: 417363 - RNA, 19 nt, Human
uaaaaaagaaaccuggcau

SEQ ID NO: 417364 - RNA, 20 nt, Human
uaaaagauacacuaaauucu

SEQ ID NO: 417365 - RNA, 18 nt, Human
uaaacugcuaaaaaacaa

SEQ ID NO: 417366 - RNA, 19 nt, Human
uagcaauacuugcauccca

SEQ ID NO: 417367 - RNA, 19 nt, Human
uagcuggagcuccuggaag

SEQ ID NO: 417368 - RNA, 21 nt, Human
uagcuggagcuccuggaagcu

SEQ ID NO: 417369 - RNA, 22 nt, Human
uauagcuggagcuccuggaagc

SEQ ID NO: 417370 - RNA, 21 nt, Human
uccaccuucuccaccccaaaa

SEQ ID NO: 417371 - RNA, 25 nt, Human
uccccgagucuaccacugaaaggac

SEQ ID NO: 417372 - RNA, 23 nt, Human
ugaaaggaccuuuuuuggaaaua

SEQ ID NO: 417373 - RNA, 19 nt, Human
uggcacaaaagaaacaguu

SEQ ID NO: 417374 - RNA, 23 nt, Human
uuauuggcuucaucacauccacc

SEQ ID NO: 417375 - RNA, 18 nt, Human
uucuagauaaaaaagaaa

SEQ ID NO: 417376 - RNA, 21 nt, Human
uuguuaauuacagcauuugaa

SEQ ID NO: 417377 - RNA, 19 nt, Human
aaccucaucuuaauaucca

SEQ ID NO: 417378 - RNA, 20 nt, Human
aacuagaaaccagcuaacaa

SEQ ID NO: 417379 - RNA, 23 nt, Human
aagccugcugcuggucacaaugg

SEQ ID NO: 417380 - RNA, 18 nt, Human
aaggaacauaaaaacaaa

SEQ ID NO: 417381 - RNA, 20 nt, Human
aaggaacauaaaaacaaaca

SEQ ID NO: 417382 - RNA, 24 nt, Human
auaaaaacaaacaugcacacaauu

SEQ ID NO: 417383 - RNA, 24 nt, Human
caaaaguaauaauggcugaacuua

SEQ ID NO: 417384 - RNA, 24 nt, Human
ccaaaaguaauaauggcugaacuu

SEQ ID NO: 417385 - RNA, 20 nt, Human
ccuccagcugcugcagcugc

SEQ ID NO: 417386 - RNA, 24 nt, Human
cgcccuccagcugcugcagcugca

SEQ ID NO: 417387 - RNA, 21 nt, Human
uaaaaacaaacaugcacacaa

SEQ ID NO: 417388 - RNA, 25 nt, Human
ucaaugguaacagucaauguuuucu

SEQ ID NO: 417389 - RNA, 18 nt, Human
uccagcugcugcagcugc

SEQ ID NO: 417390 - RNA, 19 nt, Human
ucccaaagguuucuuucag

SEQ ID NO: 417391 - RNA, 21 nt, Human
ucuugggggaaaaaagccugc

SEQ ID NO: 417392 - RNA, 21 nt, Human
ucuuguugagaucauccuuug

SEQ ID NO: 417393 - RNA, 18 nt, Human
ugagaucauccuuuguuu

SEQ ID NO: 417394 - RNA, 19 nt, Human
ugucuccuucacuucgccc

SEQ ID NO: 417395 - RNA, 26 nt, Human
uucaaugguaacagucaauguuuucu

SEQ ID NO: 417396 - RNA, 25 nt, Human
uucauaauuugucauguucugggau

SEQ ID NO: 417397 - RNA, 19 nt, Human
aaacaaacagcaacuccuc

SEQ ID NO: 417398 - RNA, 20 nt, Human
aaacugcugggauuacaggc

SEQ ID NO: 417399 - RNA, 24 nt, Human
aaacugcugggauuacaggcguga

SEQ ID NO: 417400 - RNA, 22 nt, Human
aaaucugccacacauuccugcc

SEQ ID NO: 417401 - RNA, 21 nt, Human
aacacucucucugacuagcca

SEQ ID NO: 417402 - RNA, 23 nt, Human
aacagcauuauccaaggccugag

SEQ ID NO: 417403 - RNA, 21 nt, Human
aagaagccucugugauccacc

SEQ ID NO: 417404 - RNA, 22 nt, Human
aagcuggaccaauacaguucug

SEQ ID NO: 417405 - RNA, 21 nt, Human
aaggaacguggcuuucagaug

SEQ ID NO: 417406 - RNA, 19 nt, Human
aaggacaccggaccaugac

SEQ ID NO: 417407 - RNA, 21 nt, Human
aaguguuuuucucccacugaa

SEQ ID NO: 417408 - RNA, 24 nt, Human
acaggguuucuccauguuggucag

SEQ ID NO: 417409 - RNA, 21 nt, Human
accucgaccucccaaacugcu

SEQ ID NO: 417410 - RNA, 24 nt, Human
acgcccuccucugucaguuuuccu

SEQ ID NO: 417411 - RNA, 19 nt, Human
acuagccacccgagacugc

SEQ ID NO: 417412 - RNA, 21 nt, Human
acucauuuuccccucuuuucu

SEQ ID NO: 417413 - RNA, 20 nt, Human
agaaaacccaccucaccaca

SEQ ID NO: 417414 - RNA, 18 nt, Human
agaaucgaugaugaccuu

SEQ ID NO: 417415 - RNA, 21 nt, Human
agaaugggcuggguggauagg

SEQ ID NO: 417416 - RNA, 18 nt, Human
agacaggguuucuccaug

SEQ ID NO: 417417 - RNA, 21 nt, Human
agagggagagcugggaaggug

SEQ ID NO: 417418 - RNA, 21 nt, Human
agauguuuuuccaccugaaga

SEQ ID NO: 417419 - RNA, 18 nt, Human
agcggccuugcaaccaca

SEQ ID NO: 417420 - RNA, 25 nt, Human
agcggccuugcaaccacauugaggc

SEQ ID NO: 417421 - RNA, 21 nt, Human
aggagagggagaccccacuag

SEQ ID NO: 417422 - RNA, 21 nt, Human
agggaaggaaggaaagggucc

SEQ ID NO: 417423 - RNA, 19 nt, Human
agggaccggggaaaagccc

SEQ ID NO: 417424 - RNA, 24 nt, Human
agggacugggucagccaccugggg

SEQ ID NO: 417425 - RNA, 18 nt, Human
agguggcagaggaggggc

SEQ ID NO: 417426 - RNA, 21 nt, Human
aggugguggggcccagggcug

SEQ ID NO: 417427 - RNA, 18 nt, Human
agguuggacaggagagag

SEQ ID NO: 417428 - RNA, 22 nt, Human
aguaaacggacagacgcuuccc

SEQ ID NO: 417429 - RNA, 19 nt, Human
aguagcugggauuacaggc

SEQ ID NO: 417430 - RNA, 19 nt, Human
agugaugggaagaaaaccc

SEQ ID NO: 417431 - RNA, 18 nt, Human
augcauuucuccugucug

SEQ ID NO: 417432 - RNA, 23 nt, Human
auuuuggggcaccuucuccuuca

SEQ ID NO: 417433 - RNA, 23 nt, Human
caaacaugguguagugaaaagga

SEQ ID NO: 417434 - RNA, 24 nt, Human
caaacugcugggauuacaggcgug

SEQ ID NO: 417435 - RNA, 23 nt, Human
caaccuccaccuccuggguucaa

SEQ ID NO: 417436 - RNA, 21 nt, Human
caaggccugagguggagagcc

SEQ ID NO: 417437 - RNA, 19 nt, Human
caauucuucugccucagcc

SEQ ID NO: 417438 - RNA, 22 nt, Human
cacagacacuucagacccaaag

SEQ ID NO: 417439 - RNA, 24 nt, Human
cacagacacuucagacccaaaggc

SEQ ID NO: 417440 - RNA, 19 nt, Human
cacaucguggugggguagg

SEQ ID NO: 417441 - RNA, 20 nt, Human
caccacagcuacugcccgug

SEQ ID NO: 417442 - RNA, 18 nt, Human
cacccaggcaccgcacag

SEQ ID NO: 417443 - RNA, 21 nt, Human
cacccaggcaccgcacaggcu

SEQ ID NO: 417444 - RNA, 18 nt, Human
caccggaccaugacucca

SEQ ID NO: 417445 - RNA, 24 nt, Human
caccucaccacagcuacugcccgu

SEQ ID NO: 417446 - RNA, 19 nt, Human
cacguggcccuggaggagc

SEQ ID NO: 417447 - RNA, 22 nt, Human
cacucucacaaagacccaccuu

SEQ ID NO: 417448 - RNA, 21 nt, Human
cacugcaaccuccaccuccug

SEQ ID NO: 417449 - RNA, 23 nt, Human
cacugcaaccuccaccuccuggg

SEQ ID NO: 417450 - RNA, 20 nt, Human
cagacacuucagacccaaag

SEQ ID NO: 417451 - RNA, 23 nt, Human
cagcaacuccucauggcugaggu

SEQ ID NO: 417452 - RNA, 25 nt, Human
cagcagccagggcacaucgugguga

SEQ ID NO: 417453 - RNA, 22 nt, Human
cagcaggcacuguuuacauccu

SEQ ID NO: 417454 - RNA, 19 nt, Human
cagcaguacuugcaaacaa

SEQ ID NO: 417455 - RNA, 22 nt, Human
cagcaguacuugcaaacaaagu

SEQ ID NO: 417456 - RNA, 20 nt, Human
cagccuccugaguagcuggg

SEQ ID NO: 417457 - RNA, 18 nt, Human
cagccucugcccucugcc

SEQ ID NO: 417458 - RNA, 19 nt, Human
cagcuacugcccgugagaa

SEQ ID NO: 417459 - RNA, 19 nt, Human
cagcuuccaggaguugggg

SEQ ID NO: 417460 - RNA, 19 nt, Human
caggagagggagaccccac

SEQ ID NO: 417461 - RNA, 23 nt, Human
caggcaccgcacaggcuguccua

SEQ ID NO: 417462 - RNA, 24 nt, Human
caggguuucuccauguuggucagg

SEQ ID NO: 417463 - RNA, 24 nt, Human
caucacggaacccccaaacacucu

SEQ ID NO: 417464 - RNA, 22 nt, Human
ccaaacugcugggauuacaggc

SEQ ID NO: 417465 - RNA, 22 nt, Human
ccaaacugcugggauuacaggc

SEQ ID NO: 417466 - RNA, 24 nt, Human
ccaaacugcugggauuacaggcgu

SEQ ID NO: 417467 - RNA, 20 nt, Human
ccaccgcgcccggccugucc

SEQ ID NO: 417468 - RNA, 20 nt, Human
ccaccgcgcccggccugucc

SEQ ID NO: 417469 - RNA, 23 nt, Human
ccaccuaccucgaccucccaaac

SEQ ID NO: 417470 - RNA, 20 nt, Human
ccaccuccuggguucaauuc

SEQ ID NO: 417471 - RNA, 19 nt, Human
ccacuuaggcagcgguggg

SEQ ID NO: 417472 - RNA, 19 nt, Human
ccagggcaaugggauguug

SEQ ID NO: 417473 - RNA, 19 nt, Human
ccauguuggucagguuggu

SEQ ID NO: 417474 - RNA, 22 nt, Human
ccauguuggucagguuggucuc

SEQ ID NO: 417475 - RNA, 23 nt, Human
ccauguuggucagguuggucucg

SEQ ID NO: 417476 - RNA, 22 nt, Human
cccauaaaaacucauuuucccc

SEQ ID NO: 417477 - RNA, 22 nt, Human
cccccaaacacucucucugacu

SEQ ID NO: 417478 - RNA, 23 nt, Human
cccccauaaauaucuccaaauca

SEQ ID NO: 417479 - RNA, 24 nt, Human
ccccuggggaggggguggggcgcg

SEQ ID NO: 417480 - RNA, 25 nt, Human
ccccuggggaggggguggggcgcug

SEQ ID NO: 417481 - RNA, 24 nt, Human
cccgaccucaggugauccaccuac

SEQ ID NO: 417482 - RNA, 20 nt, Human
cccuccucugucaguuuucc

SEQ ID NO: 417483 - RNA, 21 nt, Human
cccuggggaggggguggggga

SEQ ID NO: 417484 - RNA, 23 nt, Human
ccgccccugccucacaggcacug

SEQ ID NO: 417485 - RNA, 19 nt, Human
ccuaccucgaccucccaaa

SEQ ID NO: 417486 - RNA, 21 nt, Human
ccuccaccuccuggguucaau

SEQ ID NO: 417487 - RNA, 23 nt, Human
ccuccagccucugcccucugccc

SEQ ID NO: 417488 - RNA, 21 nt, Human
ccucccagcuccuagacuucc

SEQ ID NO: 417489 - RNA, 23 nt, Human
ccuccucugucaguuuuccugaa

SEQ ID NO: 417490 - RNA, 19 nt, Human
ccucucuggguuuucaggg

SEQ ID NO: 417491 - RNA, 23 nt, Human
ccugaguagcugggauuacaggc

SEQ ID NO: 417492 - RNA, 24 nt, Human
ccugaguagcugggauuacaggcu

SEQ ID NO: 417493 - RNA, 24 nt, Human
ccuggcacguggcccuggaggagc

SEQ ID NO: 417494 - RNA, 23 nt, Human
ccuggguucaauucuucugccuc

SEQ ID NO: 417495 - RNA, 20 nt, Human
cgaccucaggugauccaccu

SEQ ID NO: 417496 - RNA, 27 nt, Human
cgcugccauaucucuagccgggugucc

SEQ ID NO: 417497 - RNA, 24 nt, Human
cuacagcucacucucacaaagacc

SEQ ID NO: 417498 - RNA, 21 nt, Human
cuaguuauauauggcuugggu

SEQ ID NO: 417499 - RNA, 22 nt, Human
cucacucucacaaagacccacc

SEQ ID NO: 417500 - RNA, 24 nt, Human
cucacugcaaccuccaccuccugg

SEQ ID NO: 417501 - RNA, 26 nt, Human
cucacugcaaccuccaccuccugggu

SEQ ID NO: 417502 - RNA, 23 nt, Human
cucagccuccugaguagcuggga

SEQ ID NO: 417503 - RNA, 21 nt, Human
cuccaaaucagugguaccugc

SEQ ID NO: 417504 - RNA, 21 nt, Human
cuccagccucugcccucugcc

SEQ ID NO: 417505 - RNA, 21 nt, Human
cucccaaacugcugggauuac

SEQ ID NO: 417506 - RNA, 24 nt, Human
cucccuagacccuuguaaaauaac

SEQ ID NO: 417507 - RNA, 21 nt, Human
cuccuccaucccacccugcca

SEQ ID NO: 417508 - RNA, 21 nt, Human
cucuuucugaaauccagggcu

SEQ ID NO: 417509 - RNA, 21 nt, Human
cugaaggagcagggggcaggu

SEQ ID NO: 417510 - RNA, 23 nt, Human
cugcaaccuccaccuccuggguu

SEQ ID NO: 417511 - RNA, 24 nt, Human
cugcaaccuccaccuccuggguuc

SEQ ID NO: 417512 - RNA, 23 nt, Human
cugccucagccuccugaguagcu

SEQ ID NO: 417513 - RNA, 20 nt, Human
cuggcucuccugggcaggag

SEQ ID NO: 417514 - RNA, 20 nt, Human
cugggucagccaccugggga

SEQ ID NO: 417515 - RNA, 22 nt, Human
cuugcauuuuggggcaccuucu

SEQ ID NO: 417516 - RNA, 24 nt, Human
cuuguggaaaaucuugcauuuugg

SEQ ID NO: 417517 - RNA, 23 nt, Human
cuuuucugcaaacuggggacaau

SEQ ID NO: 417518 - RNA, 19 nt, Human
gaaaagcccgcaggaaagg

SEQ ID NO: 417519 - RNA, 21 nt, Human
gacagacgcuucccaccagcu

SEQ ID NO: 417520 - RNA, 26 nt, Human
gacccuuguaaaauaacaacagcaau

SEQ ID NO: 417521 - RNA, 18 nt, Human
gaccucaggugauccacc

SEQ ID NO: 417522 - RNA, 24 nt, Human
gaccucaggugauccaccuaccuc

SEQ ID NO: 417523 - RNA, 20 nt, Human
gacucagccgcuggggucug

SEQ ID NO: 417524 - RNA, 18 nt, Human
gacugccccgcucucccu

SEQ ID NO: 417525 - RNA, 20 nt, Human
gagacaggguuucuccaugu

SEQ ID NO: 417526 - RNA, 21 nt, Human
gagacaggguuucuccauguu

SEQ ID NO: 417527 - RNA, 21 nt, Human
gagagcugggaagguggugac

SEQ ID NO: 417528 - RNA, 19 nt, Human
gagcccaggggugcucuuc

SEQ ID NO: 417529 - RNA, 24 nt, Human
gaguagcugggauuacaggcuugc

SEQ ID NO: 417530 - RNA, 25 nt, Human
gaguggccuaggugguggggcccag

SEQ ID NO: 417531 - RNA, 18 nt, Human
gauuacaggcgugagcca

SEQ ID NO: 417532 - RNA, 22 nt, Human
gauuacaggcgugagccaccgc

SEQ ID NO: 417533 - RNA, 22 nt, Human
gauuacaggcgugagccaccgc

SEQ ID NO: 417534 - RNA, 24 nt, Human
gauuacaggcuugcgccaccaugc

SEQ ID NO: 417535 - RNA, 18 nt, Human
gcaggaaagggguuaggu

SEQ ID NO: 417536 - RNA, 18 nt, Human
gccaccaugcccggcuau

SEQ ID NO: 417537 - RNA, 19 nt, Human
gccccacccaggcaccgca

SEQ ID NO: 417538 - RNA, 20 nt, Human
gccccgcucucccuucccac

SEQ ID NO: 417539 - RNA, 20 nt, Human
gccuccagccucugcccucu

SEQ ID NO: 417540 - RNA, 18 nt, Human
gccugagguggagagccc

SEQ ID NO: 417541 - RNA, 21 nt, Human
gcuguuuuugucuguuuuucc

SEQ ID NO: 417542 - RNA, 18 nt, Human
gcuuccaccucaaccaac

SEQ ID NO: 417543 - RNA, 23 nt, Human
ggacacagcuuccaggaguuggg

SEQ ID NO: 417544 - RNA, 18 nt, Human
ggacagcugucauauucu

SEQ ID NO: 417545 - RNA, 27 nt, Human
ggagcugugggccgauuaacgaccgac

SEQ ID NO: 417546 - RNA, 23 nt, Human
ggcacgaucucagcucacugcaa

SEQ ID NO: 417547 - RNA, 23 nt, Human
ggcuugguggaguuacaagccag

SEQ ID NO: 417548 - RNA, 22 nt, Human
gggcagguaaguggagcccagg

SEQ ID NO: 417549 - RNA, 20 nt, Human
gggccagagggagagcuggg

SEQ ID NO: 417550 - RNA, 24 nt, Human
gggggagcaggcucucggcuacuc

SEQ ID NO: 417551 - RNA, 23 nt, Human
ggggguggggugggagcuguggg

SEQ ID NO: 417552 - RNA, 23 nt, Human
gguggggugggagcugugggccg

SEQ ID NO: 417553 - RNA, 22 nt, Human
guagcugggauuacaggcuugc

SEQ ID NO: 417554 - RNA, 24 nt, Human
gugauccaccuaccucgaccuccc

SEQ ID NO: 417555 - RNA, 23 nt, Human
gugauccaccucgaagaacgccu

SEQ ID NO: 417556 - RNA, 21 nt, Human
guggagcccaggggugcucuu

SEQ ID NO: 417557 - RNA, 19 nt, Human
uacagcucacucucacaaa

SEQ ID NO: 417558 - RNA, 23 nt, Human
uacaggcgugagccaccgcgccc

SEQ ID NO: 417559 - RNA, 18 nt, Human
uacauggauccguggaag

SEQ ID NO: 417560 - RNA, 18 nt, Human
uacccuacaucacggaac

SEQ ID NO: 417561 - RNA, 24 nt, Human
uaccucgaccucccaaacugcugg

SEQ ID NO: 417562 - RNA, 22 nt, Human
uagagacaggguuucuccaugu

SEQ ID NO: 417563 - RNA, 21 nt, Human
uagccacccgagacugcccuu

SEQ ID NO: 417564 - RNA, 22 nt, Human
uauaccuuaaaaguuuuacauu

SEQ ID NO: 417565 - RNA, 20 nt, Human
uaucgugaguaaggcaggag

SEQ ID NO: 417566 - RNA, 21 nt, Human
ucacaaagacccaccuuggag

SEQ ID NO: 417567 - RNA, 22 nt, Human
ucacagacacuucagacccaaa

SEQ ID NO: 417568 - RNA, 23 nt, Human
ucacugcaaccuccaccuccugg

SEQ ID NO: 417569 - RNA, 24 nt, Human
ucacugcaaccuccaccuccuggg

SEQ ID NO: 417570 - RNA, 25 nt, Human
ucacugcaaccuccaccuccugggu

SEQ ID NO: 417571 - RNA, 20 nt, Human
ucagccuccugaguagcugg

SEQ ID NO: 417572 - RNA, 23 nt, Human
uccaaggccugagguggagagga

SEQ ID NO: 417573 - RNA, 24 nt, Human
ucccaaacugcugggauuacaggc

SEQ ID NO: 417574 - RNA, 21 nt, Human
ucccagauccagacuuggcuc

SEQ ID NO: 417575 - RNA, 19 nt, Human
ucccagcuccuagacuucc

SEQ ID NO: 417576 - RNA, 18 nt, Human
ucccuucccacacucugg

SEQ ID NO: 417577 - RNA, 24 nt, Human
uccugaguagcugggauuacaggc

SEQ ID NO: 417578 - RNA, 24 nt, Human
uccuuuggaggaguggccuaggug

SEQ ID NO: 417579 - RNA, 22 nt, Human
ucgcucuuguuguccagguugg

SEQ ID NO: 417580 - RNA, 24 nt, Human
ucguuuagcaacuuacaaguguuu

SEQ ID NO: 417581 - RNA, 21 nt, Human
ucuccauguuggucagguugg

SEQ ID NO: 417582 - RNA, 18 nt, Human
ucucccuucccacacucu

SEQ ID NO: 417583 - RNA, 21 nt, Human
ucucccuucccacacucuggg

SEQ ID NO: 417584 - RNA, 22 nt, Human
ucucucagcagguggguucgug

SEQ ID NO: 417585 - RNA, 22 nt, Human
ucucugacuagccacccgagac

SEQ ID NO: 417586 - RNA, 22 nt, Human
ucugaaaauucuucuccuccau

SEQ ID NO: 417587 - RNA, 19 nt, Human
ucugagucugaaaacaacu

SEQ ID NO: 417588 - RNA, 27 nt, Human
ucugcagcuaaaaucaaaccggggucc

SEQ ID NO: 417589 - RNA, 18 nt, Human
ucugcccucugcccccac

SEQ ID NO: 417590 - RNA, 21 nt, Human
ucuggcaaacuuuuuuucucu

SEQ ID NO: 417591 - RNA, 20 nt, Human
ucugucaguuuuccugaaug

SEQ ID NO: 417592 - RNA, 23 nt, Human
ucugucccugaggaauggaugca

SEQ ID NO: 417593 - RNA, 23 nt, Human
ucuucugugaggcuguuuuuguc

SEQ ID NO: 417594 - RNA, 23 nt, Human
ugaaauccagggcuucccccagg

SEQ ID NO: 417595 - RNA, 19 nt, Human
ugaagggggugggguggga

SEQ ID NO: 417596 - RNA, 18 nt, Human
ugagagugggggucugag

SEQ ID NO: 417597 - RNA, 18 nt, Human
ugaggcaacagcauuauc

SEQ ID NO: 417598 - RNA, 21 nt, Human
ugaggucucaagggaccgggg

SEQ ID NO: 417599 - RNA, 24 nt, Human
ugauccaccuaccucgaccuccca

SEQ ID NO: 417600 - RNA, 19 nt, Human
ugccccgcucucccuuccc

SEQ ID NO: 417601 - RNA, 24 nt, Human
ugccucagccuccugaguagcugg

SEQ ID NO: 417602 - RNA, 24 nt, Human
ugcugggauuacaggcgugagcca

SEQ ID NO: 417603 - RNA, 18 nt, Human
uggaaggagggcuuccac

SEQ ID NO: 417604 - RNA, 22 nt, Human
uggcaaacuuuuuuucucuuug

SEQ ID NO: 417605 - RNA, 24 nt, Human
uggcacguggcccuggaggagcag

SEQ ID NO: 417606 - RNA, 21 nt, Human
uggcagggggaggacgagguc

SEQ ID NO: 417607 - RNA, 22 nt, Human
uggcagggggaggacgaggucg

SEQ ID NO: 417608 - RNA, 21 nt, Human
ugggaagaaaacccaccucac

SEQ ID NO: 417609 - RNA, 19 nt, Human
ugggauuacaggcgugagc

SEQ ID NO: 417610 - RNA, 21 nt, Human
ugggauuacaggcgugagcca

SEQ ID NO: 417611 - RNA, 22 nt, Human
ugggauuacaggcgugagccac

SEQ ID NO: 417612 - RNA, 23 nt, Human
ugggauuacaggcgugagccacc

SEQ ID NO: 417613 - RNA, 24 nt, Human
ugggauuacaggcgugagccaccg

SEQ ID NO: 417614 - RNA, 18 nt, Human
ugggauuacaggcuugcg

SEQ ID NO: 417615 - RNA, 24 nt, Human
ugggauuacaggcuugcgccacca

SEQ ID NO: 417616 - RNA, 25 nt, Human
ugggauuacaggcuugcgccaccau

SEQ ID NO: 417617 - RNA, 19 nt, Human
ugggcaggagguaaggcac

SEQ ID NO: 417618 - RNA, 23 nt, Human
ugggcuggguggauaggggaggu

SEQ ID NO: 417619 - RNA, 19 nt, Human
uggggagggggugggggag

SEQ ID NO: 417620 - RNA, 18 nt, Human
uggggccagguggacacc

SEQ ID NO: 417621 - RNA, 18 nt, Human
uggguggauaggggaggu

SEQ ID NO: 417622 - RNA, 23 nt, Human
uggucagguuggucucgaacucc

SEQ ID NO: 417623 - RNA, 19 nt, Human
uggucucgaacucccgacc

SEQ ID NO: 417624 - RNA, 20 nt, Human
uggugaacagcggccuugca

SEQ ID NO: 417625 - RNA, 18 nt, Human
ugguggggcccagggcug

SEQ ID NO: 417626 - RNA, 22 nt, Human
ugugaggcuguuuuugucuguu

SEQ ID NO: 417627 - RNA, 23 nt, Human
uguuuuugucuguuuuuccuccu

SEQ ID NO: 417628 - RNA, 19 nt, Human
uuaacauuccuggugacuc

SEQ ID NO: 417629 - RNA, 24 nt, Human
uuaauagagacaggguuucuccau

SEQ ID NO: 417630 - RNA, 24 nt, Human
uuacagcaguacuugcaaacaaag

SEQ ID NO: 417631 - RNA, 26 nt, Human
uuacccuacaucacggaacccccaaa

SEQ ID NO: 417632 - RNA, 21 nt, Human
uuagccagccagaggauuuuc

SEQ ID NO: 417633 - RNA, 19 nt, Human
uuaggcagcgguggaggca

SEQ ID NO: 417634 - RNA, 20 nt, Human
uuauagaugaggcaacagca

SEQ ID NO: 417635 - RNA, 18 nt, Human
uuccaggaguuggggcag

SEQ ID NO: 417636 - RNA, 19 nt, Human
uuccccucuuuucuuuucc

SEQ ID NO: 417637 - RNA, 18 nt, Human
uucuccccguucagcccc

SEQ ID NO: 417638 - RNA, 18 nt, Human
uucugguccggccggcgg

SEQ ID NO: 417639 - RNA, 22 nt, Human
uugaucugaagaagccucugug

SEQ ID NO: 417640 - RNA, 22 nt, Human
uuggacaggagagagaaugggc

SEQ ID NO: 417641 - RNA, 21 nt, Human
uuggauucuccuacaugcuuc

SEQ ID NO: 417642 - RNA, 21 nt, Human
uuggggcaccuucuccuucag

SEQ ID NO: 417643 - RNA, 20 nt, Human
uuggugggcacugaaggggg

SEQ ID NO: 417644 - RNA, 20 nt, Human
uuuacauuuacaaaugucua

SEQ ID NO: 417645 - RNA, 24 nt, Human
uuucgcucuuguuguccagguugg

SEQ ID NO: 417646 - RNA, 19 nt, Human
uuucuccauguuggucagg

SEQ ID NO: 417647 - RNA, 20 nt, Human
uuucuccauguuggucaggu

SEQ ID NO: 417648 - RNA, 19 nt, Human
uuugucuguuuuuccuccu

SEQ ID NO: 417649 - RNA, 20 nt, Human
uuuugggugguggagugaga

SEQ ID NO: 417650 - RNA, 24 nt, Human
uuuuuuguauuuuuaauagagaca

SEQ ID NO: 417651 - RNA, 25 nt, Human
aaaaggagagagauuuaguauguag

SEQ ID NO: 417652 - RNA, 21 nt, Human
aaacagaauagcgauguuuau

SEQ ID NO: 417653 - RNA, 21 nt, Human
aaauacauccagugaagacac

SEQ ID NO: 417654 - RNA, 22 nt, Human
aaccaagaauacugaaaaaaaa

SEQ ID NO: 417655 - RNA, 25 nt, Human
aaccaagaauacugaaaaaaaaccc

SEQ ID NO: 417656 - RNA, 23 nt, Human
aaccacucacacacacacaacca

SEQ ID NO: 417657 - RNA, 22 nt, Human
aaccgguacaaauaagagagca

SEQ ID NO: 417658 - RNA, 21 nt, Human
aacugcacuagagacaaagac

SEQ ID NO: 417659 - RNA, 20 nt, Human
aagugggacaaaaaaaagaa

SEQ ID NO: 417660 - RNA, 22 nt, Human
acacaaauacaaguugcccaau

SEQ ID NO: 417661 - RNA, 19 nt, Human
acacacaaccagguuuccu

SEQ ID NO: 417662 - RNA, 27 nt, Human
acaccgccgccucacccguccaugagc

SEQ ID NO: 417663 - RNA, 22 nt, Human
acauccagugaagacaccaaua

SEQ ID NO: 417664 - RNA, 20 nt, Human
accaagugggacaaaaaaaa

SEQ ID NO: 417665 - RNA, 18 nt, Human
acccucuuucaaaggaau

SEQ ID NO: 417666 - RNA, 18 nt, Human
acggaauaucucgaaaaa

SEQ ID NO: 417667 - RNA, 23 nt, Human
acguggauccugcccugucucuc

SEQ ID NO: 417668 - RNA, 18 nt, Human
acuagagacaaagacgug

SEQ ID NO: 417669 - RNA, 21 nt, Human
acugcacuagagacaaagacg

SEQ ID NO: 417670 - RNA, 20 nt, Human
acugcggcccccucuccucu

SEQ ID NO: 417671 - RNA, 21 nt, Human
agauauaucuguauuucuuug

SEQ ID NO: 417672 - RNA, 20 nt, Human
agauguauauugaaacccuc

SEQ ID NO: 417673 - RNA, 23 nt, Human
agcaggaagaggaugagggcgag

SEQ ID NO: 417674 - RNA, 20 nt, Human
aggaagaggaugagggcgag

SEQ ID NO: 417675 - RNA, 22 nt, Human
aggaaggggagcaggaagagga

SEQ ID NO: 417676 - RNA, 23 nt, Human
aggaaggggagcaggaagaggau

SEQ ID NO: 417677 - RNA, 19 nt, Human
aggcagugccccugggggc

SEQ ID NO: 417678 - RNA, 21 nt, Human
aggccgggccagggcugggga

SEQ ID NO: 417679 - RNA, 22 nt, Human
agggaagggaaggaccagggga

SEQ ID NO: 417680 - RNA, 24 nt, Human
agggaagggaaggaccaggggaug

SEQ ID NO: 417681 - RNA, 24 nt, Human
agggcuggggagcgcgcgcgcugg

SEQ ID NO: 417682 - RNA, 22 nt, Human
aggggaucggggagggcagagc

SEQ ID NO: 417683 - RNA, 19 nt, Human
auaagagagcaagagagag

SEQ ID NO: 417684 - RNA, 22 nt, Human
auacaaaaaccgguacaaauaa

SEQ ID NO: 417685 - RNA, 20 nt, Human
auccagugaagacaccaaua

SEQ ID NO: 417686 - RNA, 19 nt, Human
aucccaagggggagggcuc

SEQ ID NO: 417687 - RNA, 22 nt, Human
aucuccuccucuucccugucag

SEQ ID NO: 417688 - RNA, 23 nt, Human
caaauacauccagugaagacacc

SEQ ID NO: 417689 - RNA, 19 nt, Human
caacucaaguccacagcag

SEQ ID NO: 417690 - RNA, 20 nt, Human
cacacaaauacaaguugccc

SEQ ID NO: 417691 - RNA, 20 nt, Human
cacccccaaaagcaggucac

SEQ ID NO: 417692 - RNA, 23 nt, Human
cacuguccgccgccggccgggga

SEQ ID NO: 417693 - RNA, 19 nt, Human
cagcaauguccugaagcuc

SEQ ID NO: 417694 - RNA, 23 nt, Human
caggaaggggagcaggaagagga

SEQ ID NO: 417695 - RNA, 18 nt, Human
cauaaacauauauauaua

SEQ ID NO: 417696 - RNA, 23 nt, Human
cauaaacauauauauauauauau

SEQ ID NO: 417697 - RNA, 22 nt, Human
cauauaaaaaacagaauagcga

SEQ ID NO: 417698 - RNA, 21 nt, Human
ccacaaugggcacguggaucc

SEQ ID NO: 417699 - RNA, 22 nt, Human
ccaccccgccuccgggggcggg

SEQ ID NO: 417700 - RNA, 28 nt, Human
ccacugcggcccccucuccucuuccuuc

SEQ ID NO: 417701 - RNA, 27 nt, Human
cccaugcccuggccuugcaccgguucc

SEQ ID NO: 417702 - RNA, 26 nt, Human
ccccaccaagugggacaaaaaaaaga

SEQ ID NO: 417703 - RNA, 19 nt, Human
cccccuccaccccgccucc

SEQ ID NO: 417704 - RNA, 18 nt, Human
cccccucuccucuuccuu

SEQ ID NO: 417705 - RNA, 20 nt, Human
cccccucuccucuuccuucu

SEQ ID NO: 417706 - RNA, 23 nt, Human
ccccgcgcggaccacggcuccuc

SEQ ID NO: 417707 - RNA, 23 nt, Human
ccccuccaccccgccuccggggg

SEQ ID NO: 417708 - RNA, 19 nt, Human
ccccugucgcuuucgcugc

SEQ ID NO: 417709 - RNA, 21 nt, Human
ccccugucgcuuucgcugcuc

SEQ ID NO: 417710 - RNA, 18 nt, Human
cccgaggccgggccaggg

SEQ ID NO: 417711 - RNA, 19 nt, Human
cccugagggaggcuccuuc

SEQ ID NO: 417712 - RNA, 24 nt, Human
ccgaagcgagaacagcccagaagu

SEQ ID NO: 417713 - RNA, 19 nt, Human
ccgacccccuccaccccgc

SEQ ID NO: 417714 - RNA, 20 nt, Human
ccgccggagucucgcccucc

SEQ ID NO: 417715 - RNA, 23 nt, Human
ccuccgggggcgggcuccggccc

SEQ ID NO: 417716 - RNA, 19 nt, Human
ccucggcgccucggcgagc

SEQ ID NO: 417717 - RNA, 29 nt, Human
ccucuccucuuccuucucuucuuccuccc

SEQ ID NO: 417718 - RNA, 23 nt, Human
ccucuuccuucucuucuuccucc

SEQ ID NO: 417719 - RNA, 21 nt, Human
ccuucucuucuuccuccuccc

SEQ ID NO: 417720 - RNA, 19 nt, Human
cgccgagucgccacugcgg

SEQ ID NO: 417721 - RNA, 18 nt, Human
cgccgggacaucugccag

SEQ ID NO: 417722 - RNA, 21 nt, Human
cgccgggacaucugccagugg

SEQ ID NO: 417723 - RNA, 19 nt, Human
cggcucgggcuguggggcg

SEQ ID NO: 417724 - RNA, 21 nt, Human
cgggggcgggcuccggccccu

SEQ ID NO: 417725 - RNA, 19 nt, Human
cuccuccggcugcggcucc

SEQ ID NO: 417726 - RNA, 25 nt, Human
cucgcacgcccgcgcgcucucucug

SEQ ID NO: 417727 - RNA, 19 nt, Human
cucugcgcagagucuccuc

SEQ ID NO: 417728 - RNA, 20 nt, Human
cugaaaaaaaacccuacucu

SEQ ID NO: 417729 - RNA, 18 nt, Human
cugcggcccccucuccuc

SEQ ID NO: 417730 - RNA, 20 nt, Human
cuuccaggcagugccccugg

SEQ ID NO: 417731 - RNA, 19 nt, Human
cuuccgccggagucucgcc

SEQ ID NO: 417732 - RNA, 20 nt, Human
cuuccuucucuucuuccucc

SEQ ID NO: 417733 - RNA, 24 nt, Human
cuuccuucucuucuuccuccuccc

SEQ ID NO: 417734 - RNA, 18 nt, Human
cuucuuccuccucccccu

SEQ ID NO: 417735 - RNA, 22 nt, Human
gaaaaacugcacuagagacaaa

SEQ ID NO: 417736 - RNA, 18 nt, Human
gaaggccgcccaggcucc

SEQ ID NO: 417737 - RNA, 22 nt, Human
gacaaaaaaaagaucaugccag

SEQ ID NO: 417738 - RNA, 22 nt, Human
gacauagguccuuuuaggcugc

SEQ ID NO: 417739 - RNA, 18 nt, Human
gaccugggguagagaggc

SEQ ID NO: 417740 - RNA, 24 nt, Human
gagcaggaagaggaugagggcgag

SEQ ID NO: 417741 - RNA, 21 nt, Human
gaggaugagggcgagucccag

SEQ ID NO: 417742 - RNA, 22 nt, Human
gagggaccgugcugggucaccc

SEQ ID NO: 417743 - RNA, 19 nt, Human
gaucggggagggcagagcu

SEQ ID NO: 417744 - RNA, 20 nt, Human
gcccugucucucugugccuc

SEQ ID NO: 417745 - RNA, 21 nt, Human
gcccugucucucugugccucg

SEQ ID NO: 417746 - RNA, 19 nt, Human
gccucacccguccaugagc

SEQ ID NO: 417747 - RNA, 20 nt, Human
gccuccacaaugggcacgug

SEQ ID NO: 417748 - RNA, 22 nt, Human
gcgagcuccgacccccuccacc

SEQ ID NO: 417749 - RNA, 23 nt, Human
gcgagcuccgacccccuccaccc

SEQ ID NO: 417750 - RNA, 22 nt, Human
gcgcacaccgccgccucacccg

SEQ ID NO: 417751 - RNA, 19 nt, Human
gcgcuggagcacugucugc

SEQ ID NO: 417752 - RNA, 18 nt, Human
gcucacgccgcgcuccgg

SEQ ID NO: 417753 - RNA, 21 nt, Human
gcugggucacccgcccgggaa

SEQ ID NO: 417754 - RNA, 18 nt, Human
ggaaggggcgcugucaug

SEQ ID NO: 417755 - RNA, 23 nt, Human
ggacauagguccuuuuaggcugc

SEQ ID NO: 417756 - RNA, 18 nt, Human
ggaccaggggauggagga

SEQ ID NO: 417757 - RNA, 21 nt, Human
ggaggcuccuuccuccugccc

SEQ ID NO: 417758 - RNA, 21 nt, Human
ggcgggcuccggccccugccc

SEQ ID NO: 417759 - RNA, 20 nt, Human
ggcucacgccgcgcuccggc

SEQ ID NO: 417760 - RNA, 23 nt, Human
gggaauccccaaagcacagcaau

SEQ ID NO: 417761 - RNA, 26 nt, Human
gggaauccccaaagcacagcaauguc

SEQ ID NO: 417762 - RNA, 20 nt, Human
gggaggaggugguaacuggg

SEQ ID NO: 417763 - RNA, 22 nt, Human
gggcaggggagaggacccuggc

SEQ ID NO: 417764 - RNA, 21 nt, Human
gggcucacgccgcgcuccggc

SEQ ID NO: 417765 - RNA, 20 nt, Human
gggcuggggagcgcgcgcgc

SEQ ID NO: 417766 - RNA, 19 nt, Human
ggggagcgcgcgcgcugga

SEQ ID NO: 417767 - RNA, 26 nt, Human
ggggcgcugucaugggcugcuucuuc

SEQ ID NO: 417768 - RNA, 19 nt, Human
ggggcgggcuccggccccu

SEQ ID NO: 417769 - RNA, 21 nt, Human
guucuguaucagucuuuccug

SEQ ID NO: 417770 - RNA, 20 nt, Human
guucugucgauggugauggu

SEQ ID NO: 417771 - RNA, 20 nt, Human
uaaaaaaggagagagauuua

SEQ ID NO: 417772 - RNA, 20 nt, Human
uacauaaacauauauauaua

SEQ ID NO: 417773 - RNA, 20 nt, Human
uacauaaacauauauauaua

SEQ ID NO: 417774 - RNA, 25 nt, Human
uacauaaacauauauauauauauau

SEQ ID NO: 417775 - RNA, 20 nt, Human
uaguauguagauguauauug

SEQ ID NO: 417776 - RNA, 25 nt, Human
uauacauaaacauauauauauauau

SEQ ID NO: 417777 - RNA, 20 nt, Human
uauauaauauauauauauau

SEQ ID NO: 417778 - RNA, 18 nt, Human
uauauacacacaaauaca

SEQ ID NO: 417779 - RNA, 22 nt, Human
uauauacauaaacauauauaua

SEQ ID NO: 417780 - RNA, 21 nt, Human
uauauauaauauauauauaua

SEQ ID NO: 417781 - RNA, 21 nt, Human
uauauauaauauauauauaua

SEQ ID NO: 417782 - RNA, 23 nt, Human
uauauauaauauauauauauaua

SEQ ID NO: 417783 - RNA, 22 nt, Human
uauauauacacacaaauacaag

SEQ ID NO: 417784 - RNA, 24 nt, Human
uauauauauauacacacaaauaca

SEQ ID NO: 417785 - RNA, 24 nt, Human
uauauauauauauaaauguaugua

SEQ ID NO: 417786 - RNA, 18 nt, Human
uauauauauauauauaca

SEQ ID NO: 417787 - RNA, 23 nt, Human
uaugugggugggugugucuacag

SEQ ID NO: 417788 - RNA, 21 nt, Human
ucaaaggaaugugugcugggg

SEQ ID NO: 417789 - RNA, 20 nt, Human
ucagaagcaggugagaguaa

SEQ ID NO: 417790 - RNA, 19 nt, Human
ucagggagagagagauugg

SEQ ID NO: 417791 - RNA, 24 nt, Human
uccacuguccgccgccggccgggg

SEQ ID NO: 417792 - RNA, 18 nt, Human
uccaugagcccggcuucc

SEQ ID NO: 417793 - RNA, 18 nt, Human
ucccagaaauaaaacucu

SEQ ID NO: 417794 - RNA, 22 nt, Human
uccccaaacuccuggucagagc

SEQ ID NO: 417795 - RNA, 22 nt, Human
uccuccggcugcggcuccuccc

SEQ ID NO: 417796 - RNA, 22 nt, Human
uccugcccugucucucugugcc

SEQ ID NO: 417797 - RNA, 28 nt, Human
ucgccgccgcguccacuguccgccgccg

SEQ ID NO: 417798 - RNA, 19 nt, Human
ucuccuccucuucccuguc

SEQ ID NO: 417799 - RNA, 23 nt, Human
ucuccucuuccuucucuucuucc

SEQ ID NO: 417800 - RNA, 20 nt, Human
ucucgcccuccggacccaaa

SEQ ID NO: 417801 - RNA, 18 nt, Human
ucucucaucuccuccucu

SEQ ID NO: 417802 - RNA, 18 nt, Human
ucucuuuucucugccucc

SEQ ID NO: 417803 - RNA, 21 nt, Human
ucugaccugggguagagaggc

SEQ ID NO: 417804 - RNA, 25 nt, Human
ucuuccaggcagugccccugggggc

SEQ ID NO: 417805 - RNA, 22 nt, Human
ucuucuuccuccucccccuccu

SEQ ID NO: 417806 - RNA, 23 nt, Human
ugaaaaaaaacccuacucuuuaa

SEQ ID NO: 417807 - RNA, 22 nt, Human
ugaagacaccaauaacauuagc

SEQ ID NO: 417808 - RNA, 26 nt, Human
ugaagacaccaauaacauuagcacug

SEQ ID NO: 417809 - RNA, 21 nt, Human
ugaccccgucucucucuuccu

SEQ ID NO: 417810 - RNA, 22 nt, Human
ugagaguaagcgaaggccgccc

SEQ ID NO: 417811 - RNA, 20 nt, Human
ugagugggaacauuccccuc

SEQ ID NO: 417812 - RNA, 23 nt, Human
ugccagagucucucaucuccucc

SEQ ID NO: 417813 - RNA, 20 nt, Human
ugcccugucucucugugccu

SEQ ID NO: 417814 - RNA, 19 nt, Human
ugcggcuccucccggcccg

SEQ ID NO: 417815 - RNA, 22 nt, Human
ugcugggucacccgcccgggaa

SEQ ID NO: 417816 - RNA, 24 nt, Human
ugggaacauuccccucccaacuca

SEQ ID NO: 417817 - RNA, 22 nt, Human
ugggcaggggagaggacccugg

SEQ ID NO: 417818 - RNA, 20 nt, Human
ugggggcggugucugucucc

SEQ ID NO: 417819 - RNA, 23 nt, Human
ugguggcggcagcgugguuucug

SEQ ID NO: 417820 - RNA, 23 nt, Human
uggugugguggcggcagcguggu

SEQ ID NO: 417821 - RNA, 19 nt, Human
uguccugaagcuccccaaa

SEQ ID NO: 417822 - RNA, 23 nt, Human
ugucgauggugaugguguggugg

SEQ ID NO: 417823 - RNA, 23 nt, Human
ugucuacaggaaucccagaaaua

SEQ ID NO: 417824 - RNA, 21 nt, Human
ugugauuugucuuucuguccg

SEQ ID NO: 417825 - RNA, 20 nt, Human
uguggggcggcccgcucucc

SEQ ID NO: 417826 - RNA, 20 nt, Human
ugugucucuucucuucgccg

SEQ ID NO: 417827 - RNA, 22 nt, Human
ugugucucuucucuucgccggg

SEQ ID NO: 417828 - RNA, 21 nt, Human
uguucaagauaagcuagugac

SEQ ID NO: 417829 - RNA, 22 nt, Human
uuaaauauuaaccaagaauacu

SEQ ID NO: 417830 - RNA, 19 nt, Human
uucgccgggacaucugcca

SEQ ID NO: 417831 - RNA, 22 nt, Human
uuuagcagcaagaaaaauaaaa

SEQ ID NO: 417832 - RNA, 21 nt, Human
uuuccuggggggacagaacua

SEQ ID NO: 417833 - RNA, 23 nt, Human
acccugcugagucugaaaagcca

SEQ ID NO: 417834 - RNA, 19 nt, Human
acuccauucuccccugagc

SEQ ID NO: 417835 - RNA, 24 nt, Human
aggcaagucacccugcugagucug

SEQ ID NO: 417836 - RNA, 23 nt, Human
aggcuccucuuuguucccccacu

SEQ ID NO: 417837 - RNA, 21 nt, Human
aggguugggggucacaguucu

SEQ ID NO: 417838 - RNA, 18 nt, Human
cagcuuccggcaccugca

SEQ ID NO: 417839 - RNA, 21 nt, Human
caucucuuuuaucaggguugg

SEQ ID NO: 417840 - RNA, 23 nt, Human
ccaaagcccaaaucccauuaugc

SEQ ID NO: 417841 - RNA, 21 nt, Human
ccaggcuccucuuuguucccc

SEQ ID NO: 417842 - RNA, 22 nt, Human
ccccucuugcugccucccaguc

SEQ ID NO: 417843 - RNA, 22 nt, Human
cccugagcugguaugugacccc

SEQ ID NO: 417844 - RNA, 19 nt, Human
ccucugagaggcccagguc

SEQ ID NO: 417845 - RNA, 22 nt, Human
ccugggcugaggucuugggggc

SEQ ID NO: 417846 - RNA, 23 nt, Human
cgccggggccgcccgccgggggc

SEQ ID NO: 417847 - RNA, 20 nt, Human
cucccagucuccucuuccaa

SEQ ID NO: 417848 - RNA, 21 nt, Human
cucuuuuaucaggguuggggg

SEQ ID NO: 417849 - RNA, 23 nt, Human
cugccugggcugaggucuugggg

SEQ ID NO: 417850 - RNA, 23 nt, Human
cugcugagucugaaaagccaugu

SEQ ID NO: 417851 - RNA, 20 nt, Human
cuucgcagcuuccggcaccu

SEQ ID NO: 417852 - RNA, 18 nt, Human
gaggaagagccaguugua

SEQ ID NO: 417853 - RNA, 19 nt, Human
gaggcccagguccuagagc

SEQ ID NO: 417854 - RNA, 24 nt, Human
gcccgccggggccgcccgccgggg

SEQ ID NO: 417855 - RNA, 19 nt, Human
gcugguaugugaccccucu

SEQ ID NO: 417856 - RNA, 18 nt, Human
ggagacaagggauggcag

SEQ ID NO: 417857 - RNA, 20 nt, Human
ggggcuuggcuguuuuuuac

SEQ ID NO: 417858 - RNA, 21 nt, Human
ggggucacaguucuuguacca

SEQ ID NO: 417859 - RNA, 18 nt, Human
gugcccgccggggccgcc

SEQ ID NO: 417860 - RNA, 21 nt, Human
gugucaccuucgcagcuuccg

SEQ ID NO: 417861 - RNA, 21 nt, Human
uaccaggcuccucuuuguucc

SEQ ID NO: 417862 - RNA, 23 nt, Human
uagccucugaggcaagucacccu

SEQ ID NO: 417863 - RNA, 21 nt, Human
uauagccucugaggcaaguca

SEQ ID NO: 417864 - RNA, 22 nt, Human
ucagggagacaagggauggcag

SEQ ID NO: 417865 - RNA, 24 nt, Human
ucccagucuccucuuccaacucug

SEQ ID NO: 417866 - RNA, 20 nt, Human
uccucuuuguucccccacug

SEQ ID NO: 417867 - RNA, 20 nt, Human
ucgcagcuuccggcaccuga

SEQ ID NO: 417868 - RNA, 18 nt, Human
ucuguccuguuugaugau

SEQ ID NO: 417869 - RNA, 22 nt, Human
ugccucccagucuccucuucca

SEQ ID NO: 417870 - RNA, 24 nt, Human
ugccugggcugaggucuugggggc

SEQ ID NO: 417871 - RNA, 27 nt, Human
ugccugggcugaggucuugggggcuug

SEQ ID NO: 417872 - RNA, 22 nt, Human
ugggcugaggucuugggggcuu

SEQ ID NO: 417873 - RNA, 21 nt, Human
uucgcagcuuccggcaccugc

SEQ ID NO: 417874 - RNA, 28 nt, Human
uuuaccaggcuccucuuuguucccccaa

SEQ ID NO: 417875 - RNA, 21 nt, Human
uuuuuccuuccaucucuuuua

SEQ ID NO: 417876 - RNA, 24 nt, Human
uuuuuuuuuccuuccaucucuuuu

SEQ ID NO: 417877 - RNA, 27 nt, Human
aaagcccuacccaugacaagcccacuu

SEQ ID NO: 417878 - RNA, 18 nt, Human
aacagaacaacugagucc

SEQ ID NO: 417879 - RNA, 18 nt, Human
aacauggugaaaccccau

SEQ ID NO: 417880 - RNA, 19 nt, Human
aacauggugaaaccccauu

SEQ ID NO: 417881 - RNA, 20 nt, Human
aacauggugaaaccccauuu

SEQ ID NO: 417882 - RNA, 21 nt, Human
aacauggugaaaccccauuuc

SEQ ID NO: 417883 - RNA, 21 nt, Human
aacauggugaaaccccauuuc

SEQ ID NO: 417884 - RNA, 20 nt, Human
aauugcuugaacccaggagg

SEQ ID NO: 417885 - RNA, 24 nt, Human
aauugcuugaacccaggaggcgga

SEQ ID NO: 417886 - RNA, 19 nt, Human
acacacacacauauaugua

SEQ ID NO: 417887 - RNA, 24 nt, Human
acagagcaacacuccgucucaaaa

SEQ ID NO: 417888 - RNA, 24 nt, Human
acccaggaggcggagguugcagug

SEQ ID NO: 417889 - RNA, 21 nt, Human
acccaguagccccuguccagc

SEQ ID NO: 417890 - RNA, 18 nt, Human
accccauuucuacuaaaa

SEQ ID NO: 417891 - RNA, 19 nt, Human
accccuuuuaaaaaacaaa

SEQ ID NO: 417892 - RNA, 23 nt, Human
acgcacagccuagagcgcacugc

SEQ ID NO: 417893 - RNA, 19 nt, Human
agcacguguuggagggugg

SEQ ID NO: 417894 - RNA, 24 nt, Human
agcacuuugggaggccgaggcggg

SEQ ID NO: 417895 - RNA, 22 nt, Human
agccuggcuaacauggugaaac

SEQ ID NO: 417896 - RNA, 24 nt, Human
agccuggcuaacauggugaaaccc

SEQ ID NO: 417897 - RNA, 24 nt, Human
agccugggugacagagcaacacuc

SEQ ID NO: 417898 - RNA, 22 nt, Human
agcgcacugcagggccccagca

SEQ ID NO: 417899 - RNA, 22 nt, Human
aggaauugcacuugucucaggu

SEQ ID NO: 417900 - RNA, 19 nt, Human
aggacgauguacagcagcu

SEQ ID NO: 417901 - RNA, 20 nt, Human
aggaguuugagaccagccug

SEQ ID NO: 417902 - RNA, 21 nt, Human
aggccgaggcgggcggaucac

SEQ ID NO: 417903 - RNA, 21 nt, Human
aggcggagguugcagugagcc

SEQ ID NO: 417904 - RNA, 24 nt, Human
aggcggagguugcagugagccgag

SEQ ID NO: 417905 - RNA, 24 nt, Human
aggcgggcggaucacagggucagg

SEQ ID NO: 417906 - RNA, 24 nt, Human
aggcugaggcuggagaauugcuug

SEQ ID NO: 417907 - RNA, 23 nt, Human
aggcuggagaauugcuugaaccc

SEQ ID NO: 417908 - RNA, 23 nt, Human
aggcuucugucacauugucacuc

SEQ ID NO: 417909 - RNA, 27 nt, Human
agguaggagccaggugcgaucagcaag

SEQ ID NO: 417910 - RNA, 24 nt, Human
aguggcucaugcccguaaucccag

SEQ ID NO: 417911 - RNA, 22 nt, Human
auacacacacacauauauguau

SEQ ID NO: 417912 - RNA, 27 nt, Human
auauauauauacacacacacauauaug

SEQ ID NO: 417913 - RNA, 19 nt, Human
auauauauauauauauaua

SEQ ID NO: 417914 - RNA, 19 nt, Human
auauauauauauauauaua

SEQ ID NO: 417915 - RNA, 19 nt, Human
auauauauauauauauaua

SEQ ID NO: 417916 - RNA, 21 nt, Human
auauauguauauauauauuua

SEQ ID NO: 417917 - RNA, 23 nt, Human
auauucuccaguaaucuccagaa

SEQ ID NO: 417918 - RNA, 19 nt, Human
augcccguaaucccagcac

SEQ ID NO: 417919 - RNA, 21 nt, Human
auugcacuccagccuggguga

SEQ ID NO: 417920 - RNA, 24 nt, Human
auugcacuccagccugggugacag

SEQ ID NO: 417921 - RNA, 22 nt, Human
auuugacucuguucacugaccc

SEQ ID NO: 417922 - RNA, 23 nt, Human
caacacuccgucucaaaaaaaaa

SEQ ID NO: 417923 - RNA, 18 nt, Human
cacacacacauauaugua

SEQ ID NO: 417924 - RNA, 20 nt, Human
cacacacauauauguauaua

SEQ ID NO: 417925 - RNA, 24 nt, Human
cacagccgcaggucccggcugccc

SEQ ID NO: 417926 - RNA, 24 nt, Human
cacagggucaggaguuugagacca

SEQ ID NO: 417927 - RNA, 19 nt, Human
cacauugucacucgccagg

SEQ ID NO: 417928 - RNA, 22 nt, Human
cacuccagccugggugacagag

SEQ ID NO: 417929 - RNA, 23 nt, Human
cacuccagccugggugacagagc

SEQ ID NO: 417930 - RNA, 18 nt, Human
cacucuggggcgacaugg

SEQ ID NO: 417931 - RNA, 21 nt, Human
cacuuacaacaagggagaaac

SEQ ID NO: 417932 - RNA, 22 nt, Human
cagcaagaccgcgaguguggga

SEQ ID NO: 417933 - RNA, 24 nt, Human
cagcacuuugggaggccgaggcgg

SEQ ID NO: 417934 - RNA, 18 nt, Human
cagcugcugcccuccgag

SEQ ID NO: 417935 - RNA, 21 nt, Human
caggccaaacccaguagcccc

SEQ ID NO: 417936 - RNA, 23 nt, Human
caggccaaacccaguagccccug

SEQ ID NO: 417937 - RNA, 19 nt, Human
cauauauacguacauauau

SEQ ID NO: 417938 - RNA, 18 nt, Human
cauauauguauauauaua

SEQ ID NO: 417939 - RNA, 21 nt, Human
caugacaagcccacuucugca

SEQ ID NO: 417940 - RNA, 21 nt, Human
caugcacgcagucaggagucu

SEQ ID NO: 417941 - RNA, 19 nt, Human
cauugcacuccagccuggg

SEQ ID NO: 417942 - RNA, 19 nt, Human
cauugcacuccagccuggg

SEQ ID NO: 417943 - RNA, 19 nt, Human
cauugcacuccagccuggg

SEQ ID NO: 417944 - RNA, 20 nt, Human
cauugcacuccagccugggu

SEQ ID NO: 417945 - RNA, 21 nt, Human
cauugcacuccagccugggug

SEQ ID NO: 417946 - RNA, 22 nt, Human
cauugcacuccagccuggguga

SEQ ID NO: 417947 - RNA, 23 nt, Human
cauugcacuccagccugggugac

SEQ ID NO: 417948 - RNA, 24 nt, Human
cauugcacuccagccugggugaca

SEQ ID NO: 417949 - RNA, 24 nt, Human
cauugcacuccagccugggugaca

SEQ ID NO: 417950 - RNA, 20 nt, Human
ccacaacgcuauaaacacac

SEQ ID NO: 417951 - RNA, 18 nt, Human
ccacuucugcauuugacu

SEQ ID NO: 417952 - RNA, 23 nt, Human
ccaggccaaacccaguagccccu

SEQ ID NO: 417953 - RNA, 19 nt, Human
cccaagaagagcagcccuc

SEQ ID NO: 417954 - RNA, 18 nt, Human
cccauccacauccacaaa

SEQ ID NO: 417955 - RNA, 22 nt, Human
cccggcugcccugcuuucccug

SEQ ID NO: 417956 - RNA, 20 nt, Human
cccguaaucccagcacuuug

SEQ ID NO: 417957 - RNA, 22 nt, Human
cccguaaucccagcacuuuggg

SEQ ID NO: 417958 - RNA, 19 nt, Human
ccgcaggucccggcugccc

SEQ ID NO: 417959 - RNA, 22 nt, Human
ccgcaggucccggcugcccugc

SEQ ID NO: 417960 - RNA, 23 nt, Human
ccggguggguuucacaggucgcc

SEQ ID NO: 417961 - RNA, 18 nt, Human
ccuccagguaggagccag

SEQ ID NO: 417962 - RNA, 18 nt, Human
ccuccugggcacucuggg

SEQ ID NO: 417963 - RNA, 20 nt, Human
ccugcgggacagcuucaguc

SEQ ID NO: 417964 - RNA, 23 nt, Human
ccuggcuaacauggugaaacccc

SEQ ID NO: 417965 - RNA, 24 nt, Human
ccuggcuaacauggugaaacccca

SEQ ID NO: 417966 - RNA, 22 nt, Human
ccugggugacagagcaacacuc

SEQ ID NO: 417967 - RNA, 23 nt, Human
ccuuuuaucguacgccgaaagcc

SEQ ID NO: 417968 - RNA, 21 nt, Human
cgacauggaaggaauugcacu

SEQ ID NO: 417969 - RNA, 22 nt, Human
cgaggcgggcggaucacagggu

SEQ ID NO: 417970 - RNA, 24 nt, Human
cgaggcgggcggaucacaggguca

SEQ ID NO: 417971 - RNA, 24 nt, Human
cgcagccgcaggaccacgcuucug

SEQ ID NO: 417972 - RNA, 19 nt, Human
cgcuggggacgcagccgca

SEQ ID NO: 417973 - RNA, 21 nt, Human
cggaucacagggucaggaguu

SEQ ID NO: 417974 - RNA, 22 nt, Human
cgggcggaucacagggucagga

SEQ ID NO: 417975 - RNA, 25 nt, Human
cguacauauauauauuuauauauau

SEQ ID NO: 417976 - RNA, 20 nt, Human
cgucauugcacuccagccug

SEQ ID NO: 417977 - RNA, 22 nt, Human
cuagagcgcacugcagggcccc

SEQ ID NO: 417978 - RNA, 18 nt, Human
cucaaaaaaaaaaaaaaa

SEQ ID NO: 417979 - RNA, 24 nt, Human
cucaugcccguaaucccagcacuu

SEQ ID NO: 417980 - RNA, 20 nt, Human
cuccccgggaggggcuuccg

SEQ ID NO: 417981 - RNA, 19 nt, Human
cuccgucucaaaaaaaaaa

SEQ ID NO: 417982 - RNA, 20 nt, Human
cugacccuucguuuccuucc

SEQ ID NO: 417983 - RNA, 22 nt, Human
cuggcccaagaagagcagcccu

SEQ ID NO: 417984 - RNA, 23 nt, Human
cuggcuaacauggugaaacccca

SEQ ID NO: 417985 - RNA, 21 nt, Human
cuguaauccuagcuacuuggg

SEQ ID NO: 417986 - RNA, 25 nt, Human
cuuacaaccuuuacuguuuccaacu

SEQ ID NO: 417987 - RNA, 23 nt, Human
cuugaaccacaacgcuauaaaca

SEQ ID NO: 417988 - RNA, 19 nt, Human
cuuucgguaacuuucagug

SEQ ID NO: 417989 - RNA, 18 nt, Human
gacaacgugcccccaucc

SEQ ID NO: 417990 - RNA, 24 nt, Human
gacagagcaacacuccgucucaaa

SEQ ID NO: 417991 - RNA, 23 nt, Human
gagauugcgucauugcacuccag

SEQ ID NO: 417992 - RNA, 18 nt, Human
gaggcugaggcuggagaa

SEQ ID NO: 417993 - RNA, 24 nt, Human
gaggcuggagaauugcuugaaccc

SEQ ID NO: 417994 - RNA, 23 nt, Human
gagguugcagugagccgagauug

SEQ ID NO: 417995 - RNA, 18 nt, Human
gaucacagggucaggagu

SEQ ID NO: 417996 - RNA, 21 nt, Human
gaucacagggucaggaguuug

SEQ ID NO: 417997 - RNA, 21 nt, Human
gaucacagggucaggaguuug

SEQ ID NO: 417998 - RNA, 22 nt, Human
gaucacagggucaggaguuuga

SEQ ID NO: 417999 - RNA, 24 nt, Human
gaucacagggucaggaguuugaga

SEQ ID NO: 418000 - RNA, 24 nt, Human
gcacuccagccugggugacagagc

SEQ ID NO: 418001 - RNA, 18 nt, Human
gcacugccugccuccugg

SEQ ID NO: 418002 - RNA, 21 nt, Human
gccaggacgauguacagcagc

SEQ ID NO: 418003 - RNA, 24 nt, Human
gcccguaaucccagcacuuuggga

SEQ ID NO: 418004 - RNA, 23 nt, Human
gcggaucacagggucaggaguuu

SEQ ID NO: 418005 - RNA, 24 nt, Human
gcuaacauggugaaaccccauuuc

SEQ ID NO: 418006 - RNA, 21 nt, Human
gcuacuugggaggcugaggcu

SEQ ID NO: 418007 - RNA, 24 nt, Human
ggacgauguacagcagcuguuccc

SEQ ID NO: 418008 - RNA, 22 nt, Human
ggaggcggagguugcagugagc

SEQ ID NO: 418009 - RNA, 22 nt, Human
ggagguugcagugagccgagau

SEQ ID NO: 418010 - RNA, 24 nt, Human
ggagguugcagugagccgagauug

SEQ ID NO: 418011 - RNA, 20 nt, Human
ggaucacagggucaggaguu

SEQ ID NO: 418012 - RNA, 23 nt, Human
ggaucacagggucaggaguuuga

SEQ ID NO: 418013 - RNA, 18 nt, Human
ggccgggugcaguggcuc

SEQ ID NO: 418014 - RNA, 21 nt, Human
ggccgggugcaguggcucaug

SEQ ID NO: 418015 - RNA, 23 nt, Human
ggccgggugcaguggcucaugcc

SEQ ID NO: 418016 - RNA, 23 nt, Human
ggcggaucacagggucaggaguu

SEQ ID NO: 418017 - RNA, 23 nt, Human
ggugcaguggcucaugcccguaa

SEQ ID NO: 418018 - RNA, 24 nt, Human
ggugucuguaauccuagcuacuug

SEQ ID NO: 418019 - RNA, 22 nt, Human
guacauauauauauuuauauau

SEQ ID NO: 418020 - RNA, 20 nt, Human
guauauauauauuuauauau

SEQ ID NO: 418021 - RNA, 18 nt, Human
gucacauugucacucgcc

SEQ ID NO: 418022 - RNA, 24 nt, Human
gucauugcacuccagccuggguga

SEQ ID NO: 418023 - RNA, 19 nt, Human
gugcccggguggguuucac

SEQ ID NO: 418024 - RNA, 25 nt, Human
guucacugacccuucguuuccuucc

SEQ ID NO: 418025 - RNA, 19 nt, Human
guugcagugagccgagauu

SEQ ID NO: 418026 - RNA, 24 nt, Human
uaaaagcacaugccaguuguaaac

SEQ ID NO: 418027 - RNA, 19 nt, Human
uaacauggugaaaccccau

SEQ ID NO: 418028 - RNA, 21 nt, Human
uaacauggugaaaccccauuu

SEQ ID NO: 418029 - RNA, 24 nt, Human
uaacauggugaaaccccauuucua

SEQ ID NO: 418030 - RNA, 23 nt, Human
uaagagggacuugaaccacaacg

SEQ ID NO: 418031 - RNA, 18 nt, Human
uacacacaaagcuuacaa

SEQ ID NO: 418032 - RNA, 20 nt, Human
uacauauauacguacauaua

SEQ ID NO: 418033 - RNA, 24 nt, Human
uacguacauauauauauuuauaua

SEQ ID NO: 418034 - RNA, 18 nt, Human
uacuugggaggcugaggc

SEQ ID NO: 418035 - RNA, 25 nt, Human
uagaaaaaauuagccgggcguggug

SEQ ID NO: 418036 - RNA, 21 nt, Human
uagccgggcgugguggcgggu

SEQ ID NO: 418037 - RNA, 18 nt, Human
uauacguacauauauaua

SEQ ID NO: 418038 - RNA, 24 nt, Human
uauauacacacacacauauaugua

SEQ ID NO: 418039 - RNA, 25 nt, Human
uauauacacacacacauauauguag

SEQ ID NO: 418040 - RNA, 18 nt, Human
uauauacguacauauaua

SEQ ID NO: 418041 - RNA, 19 nt, Human
uauauacguacauauauau

SEQ ID NO: 418042 - RNA, 18 nt, Human
uauauauauauauauaca

SEQ ID NO: 418043 - RNA, 19 nt, Human
uauauauauauauauauau

SEQ ID NO: 418044 - RNA, 21 nt, Human
uauauauauauuuauauauac

SEQ ID NO: 418045 - RNA, 28 nt, Human
uauauauauuuauauauacguauaugug

SEQ ID NO: 418046 - RNA, 21 nt, Human
uauauuuauauauacguauau

SEQ ID NO: 418047 - RNA, 22 nt, Human
uauguauauauauauuuauaua

SEQ ID NO: 418048 - RNA, 22 nt, Human
uauguauauauauauuuauaua

SEQ ID NO: 418049 - RNA, 25 nt, Human
uauguauauauauauuuauauauac

SEQ ID NO: 418050 - RNA, 21 nt, Human
uauguguauuuacauauauac

SEQ ID NO: 418051 - RNA, 24 nt, Human
uauuuacauauauacguacauaua

SEQ ID NO: 418052 - RNA, 21 nt, Human
ucaaaaaaaaaaaaaaaaaaa

SEQ ID NO: 418053 - RNA, 22 nt, Human
ucaaaaaaaaaaaaaaaaaaaa

SEQ ID NO: 418054 - RNA, 21 nt, Human
ucaacgcgggaguccuccccg

SEQ ID NO: 418055 - RNA, 24 nt, Human
ucacagggucaggaguuugagacc

SEQ ID NO: 418056 - RNA, 21 nt, Human
ucaggagucugcaccaagaac

SEQ ID NO: 418057 - RNA, 19 nt, Human
ucagggccgggugcagugg

SEQ ID NO: 418058 - RNA, 20 nt, Human
ucaguccaggcacagccgca

SEQ ID NO: 418059 - RNA, 22 nt, Human
ucaugcccguaaucccagcacu

SEQ ID NO: 418060 - RNA, 18 nt, Human
ucauugcacuccagccug

SEQ ID NO: 418061 - RNA, 20 nt, Human
ucauugcacuccagccuggg

SEQ ID NO: 418062 - RNA, 21 nt, Human
ucauugcacuccagccugggu

SEQ ID NO: 418063 - RNA, 24 nt, Human
ucauugcacuccagccugggugac

SEQ ID NO: 418064 - RNA, 23 nt, Human
uccaaccccuuuuaaaaaacaaa

SEQ ID NO: 418065 - RNA, 18 nt, Human
uccagccugggugacaga

SEQ ID NO: 418066 - RNA, 19 nt, Human
ucccggcugcccugcuuuc

SEQ ID NO: 418067 - RNA, 19 nt, Human
uccgagggccucgcccagg

SEQ ID NO: 418068 - RNA, 22 nt, Human
uccgagggccucgcccaggcuu

SEQ ID NO: 418069 - RNA, 23 nt, Human
uccgucucaaaaaaaaaaaaaaa

SEQ ID NO: 418070 - RNA, 23 nt, Human
uccuugagucauuguuuuguccc

SEQ ID NO: 418071 - RNA, 18 nt, Human
ucucagggccgggugcag

SEQ ID NO: 418072 - RNA, 21 nt, Human
ucucagggccgggugcagugg

SEQ ID NO: 418073 - RNA, 21 nt, Human
ugaaacucgcuggggacgcag

SEQ ID NO: 418074 - RNA, 20 nt, Human
ugaagagguggcuuuaauaa

SEQ ID NO: 418075 - RNA, 23 nt, Human
ugagaccagccuggcuaacaugg

SEQ ID NO: 418076 - RNA, 22 nt, Human
ugagccgagauugcgucauugc

SEQ ID NO: 418077 - RNA, 24 nt, Human
ugaggcuggagaauugcuugaacc

SEQ ID NO: 418078 - RNA, 22 nt, Human
ugcacuccagccugggugacag

SEQ ID NO: 418079 - RNA, 24 nt, Human
ugcacuccagccugggugacagag

SEQ ID NO: 418080 - RNA, 25 nt, Human
ugcauuugacucuguucacugaccc

SEQ ID NO: 418081 - RNA, 24 nt, Human
ugccaccaggauguaaacagaaca

SEQ ID NO: 418082 - RNA, 22 nt, Human
ugcccccauccacauccacaaa

SEQ ID NO: 418083 - RNA, 23 nt, Human
ugcccguaaucccagcacuuugg

SEQ ID NO: 418084 - RNA, 19 nt, Human
uggaggguggggaccugcg

SEQ ID NO: 418085 - RNA, 21 nt, Human
uggcccaagaagagcagcccu

SEQ ID NO: 418086 - RNA, 24 nt, Human
uggcucaugcccguaaucccagca

SEQ ID NO: 418087 - RNA, 19 nt, Human
ugggaggccgaggcgggcg

SEQ ID NO: 418088 - RNA, 24 nt, Human
ugggaggccgaggcgggcggauca

SEQ ID NO: 418089 - RNA, 24 nt, Human
ugggaggcugaggcuggagaauug

SEQ ID NO: 418090 - RNA, 23 nt, Human
ugggcaccccgcacugccugccu

SEQ ID NO: 418091 - RNA, 24 nt, Human
ugggcaccccgcacugccugccuc

SEQ ID NO: 418092 - RNA, 22 nt, Human
ugguggcgggugucuguaaucc

SEQ ID NO: 418093 - RNA, 23 nt, Human
ugguggcgggugucuguaauccu

SEQ ID NO: 418094 - RNA, 19 nt, Human
uguacacacaaagcuuaca

SEQ ID NO: 418095 - RNA, 19 nt, Human
ugucccgaggcugcugcga

SEQ ID NO: 418096 - RNA, 24 nt, Human
ugucuguaauccuagcuacuuggg

SEQ ID NO: 418097 - RNA, 19 nt, Human
uguguauuuacauauauac

SEQ ID NO: 418098 - RNA, 20 nt, Human
uguguauuuacauauauacg

SEQ ID NO: 418099 - RNA, 22 nt, Human
uguucaccuuuguucccuccug

SEQ ID NO: 418100 - RNA, 19 nt, Human
uuagccgggcgugguggcg

SEQ ID NO: 418101 - RNA, 23 nt, Human
uuagccgggcgugguggcgggug

SEQ ID NO: 418102 - RNA, 24 nt, Human
uuagccgggcgugguggcgggugu

SEQ ID NO: 418103 - RNA, 23 nt, Human
uuaucguacgccgaaagcccuac

SEQ ID NO: 418104 - RNA, 22 nt, Human
uuccuaaaccgacucuuucggu

SEQ ID NO: 418105 - RNA, 21 nt, Human
uucuacuaaaaauagaaaaaa

SEQ ID NO: 418106 - RNA, 20 nt, Human
uucugcauuugacucuguuc

SEQ ID NO: 418107 - RNA, 20 nt, Human
uucugggcacuuccagaccu

SEQ ID NO: 418108 - RNA, 24 nt, Human
uugaacccaggaggcggagguugc

SEQ ID NO: 418109 - RNA, 18 nt, Human
uugcagugagccgagauu

SEQ ID NO: 418110 - RNA, 19 nt, Human
uugcagugagccgagauug

SEQ ID NO: 418111 - RNA, 20 nt, Human
uugcagugagccgagauugc

SEQ ID NO: 418112 - RNA, 22 nt, Human
uugcagugagccgagauugcgu

SEQ ID NO: 418113 - RNA, 23 nt, Human
uugcgucauugcacuccagccug

SEQ ID NO: 418114 - RNA, 24 nt, Human
uugcuugaacccaggaggcggagg

SEQ ID NO: 418115 - RNA, 25 nt, Human
uugggaggccgaggcgggcggauca

SEQ ID NO: 418116 - RNA, 23 nt, Human
uugggaggcugaggcuggagaau

SEQ ID NO: 418117 - RNA, 25 nt, Human
uugggaggcugaggcuggagaauug

SEQ ID NO: 418118 - RNA, 19 nt, Human
uuguucccuccugcuuucc

SEQ ID NO: 418119 - RNA, 22 nt, Human
uuucuacuaaaaauagaaaaaa

SEQ ID NO: 418120 - RNA, 21 nt, Human
uuuuuuuuuugugaggggcac

SEQ ID NO: 418121 - RNA, 21 nt, Human
uuuuuuuuuuuugugaggggc

SEQ ID NO: 418122 - RNA, 24 nt, Human
uuuuuuuuuuuuuuuuugugaggg

SEQ ID NO: 418123 - RNA, 20 nt, Human
acagagaaaggaaagaaggg

SEQ ID NO: 418124 - RNA, 21 nt, Human
caacacggaggggggcgccgg

SEQ ID NO: 418125 - RNA, 19 nt, Human
cacaaaccacccgcccucc

SEQ ID NO: 418126 - RNA, 20 nt, Human
cagcccggggacaggggcag

SEQ ID NO: 418127 - RNA, 23 nt, Human
caggucccgacgcagcccgggga

SEQ ID NO: 418128 - RNA, 21 nt, Human
ccccagagggacuugaugggg

SEQ ID NO: 418129 - RNA, 20 nt, Human
ccuccugggcuggcccccgg

SEQ ID NO: 418130 - RNA, 24 nt, Human
ccuccugggcuggcccccggucac

SEQ ID NO: 418131 - RNA, 21 nt, Human
cgaagggcuggagacagacac

SEQ ID NO: 418132 - RNA, 21 nt, Human
cgcacaaaccacccgcccucc

SEQ ID NO: 418133 - RNA, 21 nt, Human
cgcgcggcgggggcgcgcggg

SEQ ID NO: 418134 - RNA, 22 nt, Human
cggggacguccccagagggacu

SEQ ID NO: 418135 - RNA, 20 nt, Human
cuccggcuucagcacgcuga

SEQ ID NO: 418136 - RNA, 21 nt, Human
cucgcacaaaccacccgcccu

SEQ ID NO: 418137 - RNA, 20 nt, Human
gacaggggcagggccaaggg

SEQ ID NO: 418138 - RNA, 24 nt, Human
gagggggagcgggcaacacggagg

SEQ ID NO: 418139 - RNA, 19 nt, Human
gcgcggcgggggcgcgcgg

SEQ ID NO: 418140 - RNA, 25 nt, Human
gcgcggcuccgggcggcuagcucgc

SEQ ID NO: 418141 - RNA, 24 nt, Human
ggacccgggaggggggucuggcag

SEQ ID NO: 418142 - RNA, 24 nt, Human
ggcuggaggggcucgugggaggcc

SEQ ID NO: 418143 - RNA, 21 nt, Human
gggacaggggcagggccaagg

SEQ ID NO: 418144 - RNA, 23 nt, Human
gggacaggggcagggccaagggg

SEQ ID NO: 418145 - RNA, 22 nt, Human
gggcagggccggggcgcaugca

SEQ ID NO: 418146 - RNA, 20 nt, Human
gggcugggcucagcuggguc

SEQ ID NO: 418147 - RNA, 27 nt, Human
ggggccggggccccgcguggcaaggga

SEQ ID NO: 418148 - RNA, 21 nt, Human
gguggagaggagggucggggc

SEQ ID NO: 418149 - RNA, 19 nt, Human
uacaacagagaaaggaaag

SEQ ID NO: 418150 - RNA, 19 nt, Human
ucacuuuuauuucuuagca

SEQ ID NO: 418151 - RNA, 22 nt, Human
uggaggggcucgugggaggccc

SEQ ID NO: 418152 - RNA, 19 nt, Human
uggcaagggaacucgcaca

SEQ ID NO: 418153 - RNA, 25 nt, Human
uggcaggucccgacgcagcccgggg

SEQ ID NO: 418154 - RNA, 19 nt, Human
ugggcugggcucagcuggg

SEQ ID NO: 418155 - RNA, 24 nt, Human
aaaaaaacuugaaauaggaacuuc

SEQ ID NO: 418156 - RNA, 23 nt, Human
aaaaaccaaccaaaaucugcccu

SEQ ID NO: 418157 - RNA, 20 nt, Human
aaaaaugcuauuaucacaac

SEQ ID NO: 418158 - RNA, 24 nt, Human
aaaacaaaacaaaacaaaaaaaac

SEQ ID NO: 418159 - RNA, 25 nt, Human
aaaacaacaacaacaaaaaaacccc

SEQ ID NO: 418160 - RNA, 24 nt, Human
aaaacaccacacaacacacccugc

SEQ ID NO: 418161 - RNA, 21 nt, Human
aaaaugcuauuaucacaacug

SEQ ID NO: 418162 - RNA, 24 nt, Human
aaaaugcugggauuacaggcauga

SEQ ID NO: 418163 - RNA, 18 nt, Human
aaacaaaacaaaacaaaa

SEQ ID NO: 418164 - RNA, 19 nt, Human
aaacaaaacaaaacaaaaa

SEQ ID NO: 418165 - RNA, 23 nt, Human
aaacaaaacaaaacaacaacaaa

SEQ ID NO: 418166 - RNA, 23 nt, Human
aaacaaaacaaaacaacaacaac

SEQ ID NO: 418167 - RNA, 25 nt, Human
aaacaaaacaaaacaacaacaacaa

SEQ ID NO: 418168 - RNA, 18 nt, Human
aaacaaaacaacaacaac

SEQ ID NO: 418169 - RNA, 23 nt, Human
aaacaacaacaacaaaaaaaccc

SEQ ID NO: 418170 - RNA, 21 nt, Human
aaacaucacaaugccuaguga

SEQ ID NO: 418171 - RNA, 19 nt, Human
aaaguacugggauuacagg

SEQ ID NO: 418172 - RNA, 20 nt, Human
aaaguacugggauuacaggc

SEQ ID NO: 418173 - RNA, 22 nt, Human
aaaguacugggauuacaggcgg

SEQ ID NO: 418174 - RNA, 24 nt, Human
aaaguacugggauuacaggcggga

SEQ ID NO: 418175 - RNA, 24 nt, Human
aaagugcugagauuacaggcguga

SEQ ID NO: 418176 - RNA, 24 nt, Human
aaagugcugggauuacaggcauga

SEQ ID NO: 418177 - RNA, 24 nt, Human
aaagugcugggauuacaggcguga

SEQ ID NO: 418178 - RNA, 27 nt, Human
aacaaaacaaaacaaaacaacaacaac

SEQ ID NO: 418179 - RNA, 22 nt, Human
aacaacaacaaaaaaacccaaa

SEQ ID NO: 418180 - RNA, 20 nt, Human
aacagagggagacuccaucc

SEQ ID NO: 418181 - RNA, 20 nt, Human
aacauggcgaaacacugucu

SEQ ID NO: 418182 - RNA, 21 nt, Human
aacauggcgaaacacugucuc

SEQ ID NO: 418183 - RNA, 19 nt, Human
aacauggugaaaccccguc

SEQ ID NO: 418184 - RNA, 20 nt, Human
aacauggugaaaccccgucu

SEQ ID NO: 418185 - RNA, 21 nt, Human
aacauggugaaaccccgucuc

SEQ ID NO: 418186 - RNA, 22 nt, Human
aagacuugucccugccucacgg

SEQ ID NO: 418187 - RNA, 25 nt, Human
aagcaauccucuuaccuuggcuucc

SEQ ID NO: 418188 - RNA, 27 nt, Human
aagcaauccucuuaccuuggcuuccca

SEQ ID NO: 418189 - RNA, 18 nt, Human
aaguacugggauuacagg

SEQ ID NO: 418190 - RNA, 19 nt, Human
aaguagcuaggauuacaga

SEQ ID NO: 418191 - RNA, 26 nt, Human
aaguagcuaggauuacagaugugugc

SEQ ID NO: 418192 - RNA, 19 nt, Human
aagugcugggauuacaggc

SEQ ID NO: 418193 - RNA, 19 nt, Human
aagugcugggauuacaggc

SEQ ID NO: 418194 - RNA, 19 nt, Human
aagugcugggauuacaggc

SEQ ID NO: 418195 - RNA, 21 nt, Human
aagugcugggauuacaggcau

SEQ ID NO: 418196 - RNA, 24 nt, Human
aaguggagaugagguuucaccaug

SEQ ID NO: 418197 - RNA, 19 nt, Human
aaguuuugguuuuuguuuu

SEQ ID NO: 418198 - RNA, 24 nt, Human
aaucacuugaacucgggaggcaga

SEQ ID NO: 418199 - RNA, 18 nt, Human
aauuagccaggcauggug

SEQ ID NO: 418200 - RNA, 19 nt, Human
acaaaaaaacccaaaucaa

SEQ ID NO: 418201 - RNA, 25 nt, Human
acaaaaaugcuauuaucacaacugu

SEQ ID NO: 418202 - RNA, 25 nt, Human
acaaaacaaaacaaaacaacaacaa

SEQ ID NO: 418203 - RNA, 23 nt, Human
acaaaacaaaacaacaacaacaa

SEQ ID NO: 418204 - RNA, 28 nt, Human
acaaaacaacaacaacaaaaaaacccaa

SEQ ID NO: 418205 - RNA, 24 nt, Human
acaacaaaaaaacccaaaucaauc

SEQ ID NO: 418206 - RNA, 21 nt, Human
acaacaacaacaaaaaaaccc

SEQ ID NO: 418207 - RNA, 19 nt, Human
acacaccuguaaucccacc

SEQ ID NO: 418208 - RNA, 21 nt, Human
acaccacacaacacacccugc

SEQ ID NO: 418209 - RNA, 24 nt, Human
accauguuagccaggcuggucuug

SEQ ID NO: 418210 - RNA, 18 nt, Human
accauguuggccaggcug

SEQ ID NO: 418211 - RNA, 20 nt, Human
accauguuggccaggcuggu

SEQ ID NO: 418212 - RNA, 23 nt, Human
accauguuggccaggcuggucuc

SEQ ID NO: 418213 - RNA, 24 nt, Human
accauguuggccaggcuggucucg

SEQ ID NO: 418214 - RNA, 18 nt, Human
accccgucuccacuaaaa

SEQ ID NO: 418215 - RNA, 24 nt, Human
acccguguuagccaggauggucuc

SEQ ID NO: 418216 - RNA, 25 nt, Human
acccugccuauuuccuuuacucagc

SEQ ID NO: 418217 - RNA, 23 nt, Human
accucagccugccaaguagcuag

SEQ ID NO: 418218 - RNA, 24 nt, Human
accucgccuggccuuauucucaac

SEQ ID NO: 418219 - RNA, 25 nt, Human
accuuccagguucaugccauucucc

SEQ ID NO: 418220 - RNA, 19 nt, Human
acgggguuucacccguguu

SEQ ID NO: 418221 - RNA, 21 nt, Human
acgggguuucacccguguuag

SEQ ID NO: 418222 - RNA, 26 nt, Human
acuaaaaguacaaaaauuggccaguc

SEQ ID NO: 418223 - RNA, 24 nt, Human
acucaggaggcagagguugcagug

SEQ ID NO: 418224 - RNA, 25 nt, Human
acucugucgcccagguuagagugca

SEQ ID NO: 418225 - RNA, 22 nt, Human
acucuuguuucccaggcuggag

SEQ ID NO: 418226 - RNA, 22 nt, Human
agaaucacuugaacucgggagg

SEQ ID NO: 418227 - RNA, 18 nt, Human
agacuuggaaugaggcug

SEQ ID NO: 418228 - RNA, 24 nt, Human
agagaucgcaccucugcacuccag

SEQ ID NO: 418229 - RNA, 19 nt, Human
agaggcagaaccucuaagc

SEQ ID NO: 418230 - RNA, 19 nt, Human
agaggcagaaccucuaagc

SEQ ID NO: 418231 - RNA, 18 nt, Human
agagguugcagugagccg

SEQ ID NO: 418232 - RNA, 22 nt, Human
agagguugcagugagccgagau

SEQ ID NO: 418233 - RNA, 24 nt, Human
agagguugcagugagccgagaugg

SEQ ID NO: 418234 - RNA, 24 nt, Human
agaugaucugccugcccuggccuc

SEQ ID NO: 418235 - RNA, 21 nt, Human
agauuacaggcgugagccacc

SEQ ID NO: 418236 - RNA, 18 nt, Human
agccaggagaaucacuug

SEQ ID NO: 418237 - RNA, 24 nt, Human
agccaggagaaucacuugaacucg

SEQ ID NO: 418238 - RNA, 23 nt, Human
agccaggcaugguggcaggcgcc

SEQ ID NO: 418239 - RNA, 18 nt, Human
agccuccugaguagcuag

SEQ ID NO: 418240 - RNA, 24 nt, Human
agccugggcaacagagggagacuc

SEQ ID NO: 418241 - RNA, 23 nt, Human
agcgugguggcaggcaccuguaa

SEQ ID NO: 418242 - RNA, 26 nt, Human
aggcacgguggcccacacaccuguaa

SEQ ID NO: 418243 - RNA, 20 nt, Human
aggcagagcuuguagugagc

SEQ ID NO: 418244 - RNA, 21 nt, Human
aggcagagguugcagugagcc

SEQ ID NO: 418245 - RNA, 24 nt, Human
aggcagagguugcagugagccgag

SEQ ID NO: 418246 - RNA, 21 nt, Human
aggcagggucuugcucugucc

SEQ ID NO: 418247 - RNA, 23 nt, Human
aggcaugagccacugugcucggc

SEQ ID NO: 418248 - RNA, 24 nt, Human
aggcaugguggcaggcgccuguaa

SEQ ID NO: 418249 - RNA, 19 nt, Human
aggcgugaaccaccauucc

SEQ ID NO: 418250 - RNA, 24 nt, Human
aggcugaggugggcggaucaccug

SEQ ID NO: 418251 - RNA, 19 nt, Human
aggcugagguggguggauc

SEQ ID NO: 418252 - RNA, 19 nt, Human
aggcuggagguggaagucc

SEQ ID NO: 418253 - RNA, 23 nt, Human
aggguuucaccauguuggccagg

SEQ ID NO: 418254 - RNA, 24 nt, Human
aggugauccauccgccuuggucuc

SEQ ID NO: 418255 - RNA, 22 nt, Human
aggugggcggaucaccugaggu

SEQ ID NO: 418256 - RNA, 24 nt, Human
agguggguggaucacaaggucagg

SEQ ID NO: 418257 - RNA, 22 nt, Human
aguagaaaugggguuuuaccau

SEQ ID NO: 418258 - RNA, 21 nt, Human
aguagcuaggauuacaggcau

SEQ ID NO: 418259 - RNA, 19 nt, Human
aguagcugggacuacaggc

SEQ ID NO: 418260 - RNA, 19 nt, Human
aguagcugggacuacaggc

SEQ ID NO: 418261 - RNA, 24 nt, Human
agugauucuccugccucagccucc

SEQ ID NO: 418262 - RNA, 23 nt, Human
agugcaauggugugaucuuggcu

SEQ ID NO: 418263 - RNA, 24 nt, Human
agugcaauggugugaucuuggcuc

SEQ ID NO: 418264 - RNA, 24 nt, Human
agugcaguggcaccaucucagcuc

SEQ ID NO: 418265 - RNA, 18 nt, Human
agugcugggauuacaggc

SEQ ID NO: 418266 - RNA, 18 nt, Human
agugcugggauuacaggc

SEQ ID NO: 418267 - RNA, 22 nt, Human
aguggagaugagguuucaccau

SEQ ID NO: 418268 - RNA, 23 nt, Human
aguggagaugagguuucaccaug

SEQ ID NO: 418269 - RNA, 24 nt, Human
aguucugggcucaagcaauccucu

SEQ ID NO: 418270 - RNA, 21 nt, Human
auaaagcuaaaagaaacaaug

SEQ ID NO: 418271 - RNA, 18 nt, Human
auaggguuucaccauguu

SEQ ID NO: 418272 - RNA, 23 nt, Human
auaggguuucaccauguuggcca

SEQ ID NO: 418273 - RNA, 24 nt, Human
auaggguuucaccauguuggccag

SEQ ID NO: 418274 - RNA, 18 nt, Human
aucaagaccauccuggac

SEQ ID NO: 418275 - RNA, 20 nt, Human
aucaccugaggucaggaguu

SEQ ID NO: 418276 - RNA, 24 nt, Human
aucccaaaaaaacaaaacaaaaca

SEQ ID NO: 418277 - RNA, 22 nt, Human
auccccaaaaaaaaaaaaaaaa

SEQ ID NO: 418278 - RNA, 24 nt, Human
aucgcaccucugcacuccagccug

SEQ ID NO: 418279 - RNA, 20 nt, Human
augagguuucaccauguuag

SEQ ID NO: 418280 - RNA, 23 nt, Human
augccaagaaauacccacaaaca

SEQ ID NO: 418281 - RNA, 19 nt, Human
augcgccaccacacccagc

SEQ ID NO: 418282 - RNA, 18 nt, Human
augggguuuuaccauguu

SEQ ID NO: 418283 - RNA, 24 nt, Human
caaaaaaacccaaaucaaucagga

SEQ ID NO: 418284 - RNA, 24 nt, Human
caaaaauagaggcagaaccucuaa

SEQ ID NO: 418285 - RNA, 21 nt, Human
caaaaaugauucccuuuaaga

SEQ ID NO: 418286 - RNA, 18 nt, Human
caaaaaugcuauuaucac

SEQ ID NO: 418287 - RNA, 23 nt, Human
caaaacaaaacaaaaaaaacuug

SEQ ID NO: 418288 - RNA, 25 nt, Human
caaaacaaaacaacaacaacaaaaa

SEQ ID NO: 418289 - RNA, 25 nt, Human
caaaacaacaacaacaaaaaaaccc

SEQ ID NO: 418290 - RNA, 23 nt, Human
caaagcaggaggcagacaaguca

SEQ ID NO: 418291 - RNA, 19 nt, Human
caacaaaaauagaggcaga

SEQ ID NO: 418292 - RNA, 22 nt, Human
caacacacccugccuauuuccu

SEQ ID NO: 418293 - RNA, 22 nt, Human
caacauggugaaaccccgucuc

SEQ ID NO: 418294 - RNA, 24 nt, Human
caacauggugaaaccccgucucca

SEQ ID NO: 418295 - RNA, 20 nt, Human
caaccuccgccucccggguu

SEQ ID NO: 418296 - RNA, 24 nt, Human
caagaccauccuggacaacauggu

SEQ ID NO: 418297 - RNA, 20 nt, Human
caagugauucuccugccuca

SEQ ID NO: 418298 - RNA, 22 nt, Human
caagugauucuccugccucagc

SEQ ID NO: 418299 - RNA, 25 nt, Human
caaguuacaaaaaugcuauuaucac

SEQ ID NO: 418300 - RNA, 24 nt, Human
caauuuuuguauuuuaaguggaga

SEQ ID NO: 418301 - RNA, 24 nt, Human
cacaagauucgaaaugaaaacaaa

SEQ ID NO: 418302 - RNA, 24 nt, Human
cacaccuguaaucccaccacuuug

SEQ ID NO: 418303 - RNA, 24 nt, Human
cacaccuguaaucccaccauuuug

SEQ ID NO: 418304 - RNA, 20 nt, Human
caccacacaacacacccugc

SEQ ID NO: 418305 - RNA, 21 nt, Human
caccacacaacacacccugcc

SEQ ID NO: 418306 - RNA, 19 nt, Human
caccacacccagcuaauuc

SEQ ID NO: 418307 - RNA, 24 nt, Human
caccacuuugggaggcugaggugg

SEQ ID NO: 418308 - RNA, 22 nt, Human
caccauguuagccaggcugguc

SEQ ID NO: 418309 - RNA, 23 nt, Human
caccauguuagccaggcuggucu

SEQ ID NO: 418310 - RNA, 24 nt, Human
caccauguuagccaggcuggucuu

SEQ ID NO: 418311 - RNA, 21 nt, Human
caccauguuggccaggcuggu

SEQ ID NO: 418312 - RNA, 24 nt, Human
caccauguuggccaggcuggucuc

SEQ ID NO: 418313 - RNA, 27 nt, Human
caccauguuggccaggcuggucucaaa

SEQ ID NO: 418314 - RNA, 24 nt, Human
caccauuuugggaggcugaggugg

SEQ ID NO: 418315 - RNA, 23 nt, Human
caccccccaacaaaaauagaggc

SEQ ID NO: 418316 - RNA, 23 nt, Human
cacccgccuaggccucccaaagu

SEQ ID NO: 418317 - RNA, 24 nt, Human
cacccguguuagccaggauggucu

SEQ ID NO: 418318 - RNA, 24 nt, Human
caccucgaccccccaaagugcugg

SEQ ID NO: 418319 - RNA, 19 nt, Human
caccuguaaucccaccacu

SEQ ID NO: 418320 - RNA, 24 nt, Human
caccuguaaucccaccacuuuggg

SEQ ID NO: 418321 - RNA, 23 nt, Human
caccuguaaucccaccauuuugg

SEQ ID NO: 418322 - RNA, 24 nt, Human
caccuguaaucccaccauuuuggg

SEQ ID NO: 418323 - RNA, 21 nt, Human
caccuguaaucccagcuacuc

SEQ ID NO: 418324 - RNA, 24 nt, Human
caccuguaaucccagcuacucagg

SEQ ID NO: 418325 - RNA, 24 nt, Human
cacucugucgcccagguuagagug

SEQ ID NO: 418326 - RNA, 21 nt, Human
cacugcaaccuccgccucccg

SEQ ID NO: 418327 - RNA, 23 nt, Human
cacugcaaccuccgccucccggg

SEQ ID NO: 418328 - RNA, 19 nt, Human
cacugcaagcuccaccuuc

SEQ ID NO: 418329 - RNA, 21 nt, Human
cacugcaaucuucgccuccug

SEQ ID NO: 418330 - RNA, 23 nt, Human
cacugcaaucuucgccuccuggg

SEQ ID NO: 418331 - RNA, 22 nt, Human
cacuuugggaggcugagguggg

SEQ ID NO: 418332 - RNA, 18 nt, Human
cagaaccucuaagcacuu

SEQ ID NO: 418333 - RNA, 19 nt, Human
cagccuccugaguagcuag

SEQ ID NO: 418334 - RNA, 19 nt, Human
caggguuggaaagagaaga

SEQ ID NO: 418335 - RNA, 19 nt, Human
caguacaaucucaacuaug

SEQ ID NO: 418336 - RNA, 24 nt, Human
caucccaaaaaaacaaaacaaaac

SEQ ID NO: 418337 - RNA, 20 nt, Human
caugcgccaccacacccagc

SEQ ID NO: 418338 - RNA, 23 nt, Human
cauguuagccaggcuggucuuga

SEQ ID NO: 418339 - RNA, 24 nt, Human
cauguuagccaggcuggucuugag

SEQ ID NO: 418340 - RNA, 24 nt, Human
cauguuggccaggcuggucucaaa

SEQ ID NO: 418341 - RNA, 24 nt, Human
cauguuggccaggcuggucucgaa

SEQ ID NO: 418342 - RNA, 22 nt, Human
cauuuugggaggcugagguggg

SEQ ID NO: 418343 - RNA, 23 nt, Human
ccaaaaaaacaaaacaaaacaaa

SEQ ID NO: 418344 - RNA, 23 nt, Human
ccaaaaugcugggauuacaggca

SEQ ID NO: 418345 - RNA, 24 nt, Human
ccaaaaugcugggauuacaggcau

SEQ ID NO: 418346 - RNA, 23 nt, Human
ccaaaguacugggauuacaggcg

SEQ ID NO: 418347 - RNA, 22 nt, Human
ccaaagugcugagauuacaggc

SEQ ID NO: 418348 - RNA, 22 nt, Human
ccaaagugcugagauuacaggc

SEQ ID NO: 418349 - RNA, 24 nt, Human
ccaaagugcugagauuacaggcgu

SEQ ID NO: 418350 - RNA, 20 nt, Human
ccaaagugcugggauuacag

SEQ ID NO: 418351 - RNA, 22 nt, Human
ccaaagugcugggauuacaggc

SEQ ID NO: 418352 - RNA, 22 nt, Human
ccaaagugcugggauuacaggc

SEQ ID NO: 418353 - RNA, 23 nt, Human
ccaaagugcugggauuacaggca

SEQ ID NO: 418354 - RNA, 24 nt, Human
ccaaagugcugggauuacaggcau

SEQ ID NO: 418355 - RNA, 24 nt, Human
ccaaagugcugggauuacaggcgu

SEQ ID NO: 418356 - RNA, 24 nt, Human
ccaaguagcuaggauuacagaugu

SEQ ID NO: 418357 - RNA, 19 nt, Human
ccagguucaugccauucuc

SEQ ID NO: 418358 - RNA, 22 nt, Human
ccagguucaugccauucuccug

SEQ ID NO: 418359 - RNA, 24 nt, Human
cccaaaaugcugggauuacaggca

SEQ ID NO: 418360 - RNA, 24 nt, Human
cccaaagugcugggauuacaggca

SEQ ID NO: 418361 - RNA, 18 nt, Human
cccaccgccacaccugga

SEQ ID NO: 418362 - RNA, 25 nt, Human
cccaccgccacaccuggaagguuuc

SEQ ID NO: 418363 - RNA, 19 nt, Human
cccaccucgaccccccaaa

SEQ ID NO: 418364 - RNA, 19 nt, Human
cccaggcuggagugcaaug

SEQ ID NO: 418365 - RNA, 24 nt, Human
ccccaaagugcugggauuacaggc

SEQ ID NO: 418366 - RNA, 24 nt, Human
ccccaggcuggagugcagcggcau

SEQ ID NO: 418367 - RNA, 23 nt, Human
cccggguucaagagauucgccug

SEQ ID NO: 418368 - RNA, 24 nt, Human
ccgccuuggucucccaaaaugcug

SEQ ID NO: 418369 - RNA, 19 nt, Human
ccucacggaugccucaguc

SEQ ID NO: 418370 - RNA, 24 nt, Human
ccuccuggggucaagugauucucc

SEQ ID NO: 418371 - RNA, 20 nt, Human
ccucugcacuccagccuggg

SEQ ID NO: 418372 - RNA, 21 nt, Human
ccucugcacuccagccugggc

SEQ ID NO: 418373 - RNA, 24 nt, Human
ccucugcacuccagccugggcaac

SEQ ID NO: 418374 - RNA, 21 nt, Human
ccugaccucagaugaucugcc

SEQ ID NO: 418375 - RNA, 23 nt, Human
ccugaccucagaugaucugccug

SEQ ID NO: 418376 - RNA, 19 nt, Human
ccugaccucaggugaucca

SEQ ID NO: 418377 - RNA, 22 nt, Human
ccugaccucaggugauccaucc

SEQ ID NO: 418378 - RNA, 24 nt, Human
ccugaccucaggugaucugcccac

SEQ ID NO: 418379 - RNA, 20 nt, Human
ccugacgucgugauccaccc

SEQ ID NO: 418380 - RNA, 23 nt, Human
ccugaguagcuaggauuacaggc

SEQ ID NO: 418381 - RNA, 24 nt, Human
ccugaguagcuaggauuacaggca

SEQ ID NO: 418382 - RNA, 22 nt, Human
ccuggacaacauggugaaaccc

SEQ ID NO: 418383 - RNA, 23 nt, Human
ccuggacaacauggugaaacccc

SEQ ID NO: 418384 - RNA, 24 nt, Human
ccuggacaacauggugaaaccccg

SEQ ID NO: 418385 - RNA, 19 nt, Human
ccuggauaaguuuugguuu

SEQ ID NO: 418386 - RNA, 20 nt, Human
ccuggccaacauggcgaaac

SEQ ID NO: 418387 - RNA, 24 nt, Human
ccuggccaacauggcgaaacacug

SEQ ID NO: 418388 - RNA, 21 nt, Human
ccuguaaucccagcuacucag

SEQ ID NO: 418389 - RNA, 19 nt, Human
ccuguaaucccagcucagg

SEQ ID NO: 418390 - RNA, 21 nt, Human
ccuuccagguucaugccauuc

SEQ ID NO: 418391 - RNA, 24 nt, Human
cggaucaccugaggucaggaguuu

SEQ ID NO: 418392 - RNA, 27 nt, Human
cggaucaccugaggucaggaguuugaa

SEQ ID NO: 418393 - RNA, 22 nt, Human
cgggagccaccaugccagccgu

SEQ ID NO: 418394 - RNA, 25 nt, Human
cgggguuucacccguguuagccagg

SEQ ID NO: 418395 - RNA, 23 nt, Human
cuaaaagaaacaauguuaaauaa

SEQ ID NO: 418396 - RNA, 18 nt, Human
cuaggaagcaaaaaugcc

SEQ ID NO: 418397 - RNA, 21 nt, Human
cuaggccucccaaagugcugg

SEQ ID NO: 418398 - RNA, 20 nt, Human
cuauguaaaaaccaaccaaa

SEQ ID NO: 418399 - RNA, 22 nt, Human
cucaacauaauugcuggugaaa

SEQ ID NO: 418400 - RNA, 24 nt, Human
cucaagcaauccucuuaccuuggc

SEQ ID NO: 418401 - RNA, 22 nt, Human
cucacaccuguaaucccaccac

SEQ ID NO: 418402 - RNA, 24 nt, Human
cucacaccuguaaucccaccacuu

SEQ ID NO: 418403 - RNA, 21 nt, Human
cucacaggcgcccaccgccac

SEQ ID NO: 418404 - RNA, 23 nt, Human
cucacggaugccucagucuuccc

SEQ ID NO: 418405 - RNA, 24 nt, Human
cucacugcaaccuccgccucccgg

SEQ ID NO: 418406 - RNA, 24 nt, Human
cucacugcaaucuucgccuccugg

SEQ ID NO: 418407 - RNA, 21 nt, Human
cucacugccgccuccaauucc

SEQ ID NO: 418408 - RNA, 24 nt, Human
cucaggugauccauccgccuuggu

SEQ ID NO: 418409 - RNA, 21 nt, Human
cucccaaagugcugagauuac

SEQ ID NO: 418410 - RNA, 26 nt, Human
cuccgcgauccagaccacccgggccg

SEQ ID NO: 418411 - RNA, 26 nt, Human
cuccugaccucagaugaucugccugc

SEQ ID NO: 418412 - RNA, 24 nt, Human
cuccugaguagcuaggauuacagg

SEQ ID NO: 418413 - RNA, 20 nt, Human
cuccuggggucaagugauuc

SEQ ID NO: 418414 - RNA, 24 nt, Human
cucgaguagcugggacuacaggcg

SEQ ID NO: 418415 - RNA, 25 nt, Human
cucgaguagcugggacuacaggcgc

SEQ ID NO: 418416 - RNA, 18 nt, Human
cucuuguuucccaggcug

SEQ ID NO: 418417 - RNA, 18 nt, Human
cucuuguuucccaggcug

SEQ ID NO: 418418 - RNA, 19 nt, Human
cucuuguuucccaggcugg

SEQ ID NO: 418419 - RNA, 22 nt, Human
cucuuguuucccaggcuggagu

SEQ ID NO: 418420 - RNA, 24 nt, Human
cugaguagcuaggauuacaggcau

SEQ ID NO: 418421 - RNA, 24 nt, Human
cugcaaccuccgccucccggguuc

SEQ ID NO: 418422 - RNA, 24 nt, Human
cugcaagcuccaccuuccagguuc

SEQ ID NO: 418423 - RNA, 23 nt, Human
cugcacuccagccugggcaacag

SEQ ID NO: 418424 - RNA, 23 nt, Human
cugcacuccagccugggcaacag

SEQ ID NO: 418425 - RNA, 19 nt, Human
cugccgccuccaauuccua

SEQ ID NO: 418426 - RNA, 23 nt, Human
cugccucagccuccugaguagcu

SEQ ID NO: 418427 - RNA, 23 nt, Human
cugccucaggcucucgaguagcu

SEQ ID NO: 418428 - RNA, 21 nt, Human
cuguaaucccagcuacucagg

SEQ ID NO: 418429 - RNA, 18 nt, Human
cugucccccaggcuggag

SEQ ID NO: 418430 - RNA, 21 nt, Human
cuuguagugagcagagaucgc

SEQ ID NO: 418431 - RNA, 20 nt, Human
gaacucgggaggcagagcuu

SEQ ID NO: 418432 - RNA, 18 nt, Human
gaaggaaauagcucaaaa

SEQ ID NO: 418433 - RNA, 18 nt, Human
gaccccccaaagugcugg

SEQ ID NO: 418434 - RNA, 18 nt, Human
gaccucagaugaucugcc

SEQ ID NO: 418435 - RNA, 23 nt, Human
gaccucaggugauccauccgccu

SEQ ID NO: 418436 - RNA, 24 nt, Human
gaccucaggugaucugcccaccuc

SEQ ID NO: 418437 - RNA, 23 nt, Human
gacgcgguggcucacaccuguaa

SEQ ID NO: 418438 - RNA, 20 nt, Human
gacgucgugauccacccgcc

SEQ ID NO: 418439 - RNA, 21 nt, Human
gacuuggaaugaggcuggugg

SEQ ID NO: 418440 - RNA, 21 nt, Human
gacuugucccugccucacgga

SEQ ID NO: 418441 - RNA, 24 nt, Human
gagaagcgccuaguuaaaacacca

SEQ ID NO: 418442 - RNA, 25 nt, Human
gagacgggguuucacccguguuagc

SEQ ID NO: 418443 - RNA, 23 nt, Human
gagauggcgccacugcacuccag

SEQ ID NO: 418444 - RNA, 21 nt, Human
gaggcagagguugcagugagc

SEQ ID NO: 418445 - RNA, 23 nt, Human
gaggugggcggaucaccugaggu

SEQ ID NO: 418446 - RNA, 22 nt, Human
gagguggguggaucacaagguc

SEQ ID NO: 418447 - RNA, 18 nt, Human
gagguuucaccauguuag

SEQ ID NO: 418448 - RNA, 22 nt, Human
gaguagcuaggauuacaggcau

SEQ ID NO: 418449 - RNA, 24 nt, Human
gaguagcuaggauuacaggcaugc

SEQ ID NO: 418450 - RNA, 25 nt, Human
gaguagcugggacuacaggcgcuca

SEQ ID NO: 418451 - RNA, 19 nt, Human
gagugcaauggugugaucu

SEQ ID NO: 418452 - RNA, 21 nt, Human
gaucaccugaggucaggaguu

SEQ ID NO: 418453 - RNA, 24 nt, Human
gaucaccugaggucaggaguuuga

SEQ ID NO: 418454 - RNA, 18 nt, Human
gauuacagaugugugccg

SEQ ID NO: 418455 - RNA, 24 nt, Human
gauuacagaugugugccgccaugc

SEQ ID NO: 418456 - RNA, 18 nt, Human
gauuacaggcaugagcca

SEQ ID NO: 418457 - RNA, 21 nt, Human
gauuacaggcaugagccacug

SEQ ID NO: 418458 - RNA, 24 nt, Human
gauuacaggcaugagccacugugc

SEQ ID NO: 418459 - RNA, 22 nt, Human
gauuacaggcaugagccgccgc

SEQ ID NO: 418460 - RNA, 22 nt, Human
gauuacaggcaugagccgccgc

SEQ ID NO: 418461 - RNA, 18 nt, Human
gauuacaggcaugcgcca

SEQ ID NO: 418462 - RNA, 18 nt, Human
gauuacaggcgggagcca

SEQ ID NO: 418463 - RNA, 22 nt, Human
gauuacaggcgggagccaccau

SEQ ID NO: 418464 - RNA, 21 nt, Human
gauuacaggcgugaaccacca

SEQ ID NO: 418465 - RNA, 18 nt, Human
gauuacaggcgugagcca

SEQ ID NO: 418466 - RNA, 24 nt, Human
gauuacaggcgugagccaccucgc

SEQ ID NO: 418467 - RNA, 22 nt, Human
gcaagcuccaccuuccagguuc

SEQ ID NO: 418468 - RNA, 19 nt, Human
gcagaaccucuaagcacuu

SEQ ID NO: 418469 - RNA, 24 nt, Human
gccaacauggcgaaacacugucuc

SEQ ID NO: 418470 - RNA, 21 nt, Human
gccacugugcucggccugcag

SEQ ID NO: 418471 - RNA, 19 nt, Human
gcccaggcucaucuugaag

SEQ ID NO: 418472 - RNA, 22 nt, Human
gcccuggccucccaaagugcug

SEQ ID NO: 418473 - RNA, 22 nt, Human
gccucagucuucccaaagcagg

SEQ ID NO: 418474 - RNA, 24 nt, Human
gccuuggucucccaaaaugcuggg

SEQ ID NO: 418475 - RNA, 21 nt, Human
gcgcucaccaccacgcccgcc

SEQ ID NO: 418476 - RNA, 20 nt, Human
gcucugucacacaggcugga

SEQ ID NO: 418477 - RNA, 30 nt, Human; identical to SEQ ID NO: 340167

SEQ ID NO: 418478 - RNA, 19 nt, Human
gcuggagugcagcggcaua

SEQ ID NO: 418479 - RNA, 23 nt, Human
gcuggucucaaacuccugaccuc

SEQ ID NO: 418480 - RNA, 23 nt, Human
gcuggucucgaacuccugaccuc

SEQ ID NO: 418481 - RNA, 23 nt, Human
gcuggucuugagcuccugaccuc

SEQ ID NO: 418482 - RNA, 20 nt, Human
ggagcaugaacuaucauuuu

SEQ ID NO: 418483 - RNA, 19 nt, Human
ggaguagaaggaaaacugg

SEQ ID NO: 418484 - RNA, 22 nt, Human
ggaucaccugaggucaggaguu

SEQ ID NO: 418485 - RNA, 18 nt, Human
ggauuacagaugugugcc

SEQ ID NO: 418486 - RNA, 24 nt, Human
ggauuacaggcaugagccacugug

SEQ ID NO: 418487 - RNA, 19 nt, Human
ggauuacaggcaugagccg

SEQ ID NO: 418488 - RNA, 19 nt, Human
ggauuacaggcaugcgcca

SEQ ID NO: 418489 - RNA, 22 nt, Human
ggauuacaggcaugcgccacca

SEQ ID NO: 418490 - RNA, 24 nt, Human
ggauuacaggcgggagccaccaug

SEQ ID NO: 418491 - RNA, 19 nt, Human
ggauuacaggcgugaacca

SEQ ID NO: 418492 - RNA, 19 nt, Human
ggcaccuguaaucccagcu

SEQ ID NO: 418493 - RNA, 21 nt, Human
ggcaggcgccuguaaucccag

SEQ ID NO: 418494 - RNA, 21 nt, Human
ggcggaucaccugaggucagg

SEQ ID NO: 418495 - RNA, 21 nt, Human
ggcuggacgcgguggcucaca

SEQ ID NO: 418496 - RNA, 22 nt, Human
ggcuggagugcaauggugugau

SEQ ID NO: 418497 - RNA, 24 nt, Human
ggcuggucucaaacuccugaccuc

SEQ ID NO: 418498 - RNA, 24 nt, Human
ggcuggucucgaacuccugaccuc

SEQ ID NO: 418499 - RNA, 24 nt, Human
ggcuggucuugagcuccugaccuc

SEQ ID NO: 418500 - RNA, 20 nt, Human
gggaggcugaggugggcgga

SEQ ID NO: 418501 - RNA, 22 nt, Human
gggcucaagcaauccucuuacc

SEQ ID NO: 418502 - RNA, 22 nt, Human
gggguuuuaccauguuggccag

SEQ ID NO: 418503 - RNA, 24 nt, Human
ggguggaucacaaggucaggagau

SEQ ID NO: 418504 - RNA, 21 nt, Human
ggguuucaccauguuggccag

SEQ ID NO: 418505 - RNA, 22 nt, Human
ggguuucaccauguuggccagg

SEQ ID NO: 418506 - RNA, 18 nt, Human
ggguuuuaccauguuggc

SEQ ID NO: 418507 - RNA, 19 nt, Human
ggucucgaacuccugaccu

SEQ ID NO: 418508 - RNA, 24 nt, Human
gguggcaggcaccuguaaucccag

SEQ ID NO: 418509 - RNA, 23 nt, Human
gguggcucacaccuguaauccca

SEQ ID NO: 418510 - RNA, 20 nt, Human
guagcuaggauuacaggcau

SEQ ID NO: 418511 - RNA, 23 nt, Human
gucaagugauucuccugccucag

SEQ ID NO: 418512 - RNA, 19 nt, Human
gucucuacuaaaaguacaa

SEQ ID NO: 418513 - RNA, 24 nt, Human
gugauccacccgccuaggccuccc

SEQ ID NO: 418514 - RNA, 24 nt, Human
gugauccauccgccuuggucuccc

SEQ ID NO: 418515 - RNA, 21 nt, Human
gugaucugcccaccucgaccc

SEQ ID NO: 418516 - RNA, 24 nt, Human
gugauucuccugccucagccuccu

SEQ ID NO: 418517 - RNA, 23 nt, Human
guggcaggcgccuguaaucccag

SEQ ID NO: 418518 - RNA, 25 nt, Human
guucugggcucaagcaauccucuua

SEQ ID NO: 418519 - RNA, 24 nt, Human
guugcagugagccgagauggcgcc

SEQ ID NO: 418520 - RNA, 20 nt, Human
uaaaaaacagcuuaaaaaca

SEQ ID NO: 418521 - RNA, 27 nt, Human
uaaaaaacagcuuaaaaacaaaacaaa

SEQ ID NO: 418522 - RNA, 20 nt, Human
uaaaaacacaaaauuagcca

SEQ ID NO: 418523 - RNA, 22 nt, Human
uaaaaacacaaaauuagccagg

SEQ ID NO: 418524 - RNA, 23 nt, Human
uaaaaacacaaaauuagccaggc

SEQ ID NO: 418525 - RNA, 23 nt, Human
uaaaacaccacacaacacacccu

SEQ ID NO: 418526 - RNA, 24 nt, Human
uaaguggagaugagguuucaccau

SEQ ID NO: 418527 - RNA, 18 nt, Human
uaaguuucaacagaaauc

SEQ ID NO: 418528 - RNA, 21 nt, Human
uaauagagacgggguuucacc

SEQ ID NO: 418529 - RNA, 25 nt, Human
uaauagagacgggguuucacccgug

SEQ ID NO: 418530 - RNA, 23 nt, Human
uaauucuuguauuuuuuaguaga

SEQ ID NO: 418531 - RNA, 22 nt, Human
uaauugcuggugaaauacuaac

SEQ ID NO: 418532 - RNA, 25 nt, Human
uaauuuuuucuauuuuuuaauagag

SEQ ID NO: 418533 - RNA, 23 nt, Human
uacaggcaugagccgccgcggcc

SEQ ID NO: 418534 - RNA, 24 nt, Human
uacaggcaugcgccaccacaccca

SEQ ID NO: 418535 - RNA, 18 nt, Human
uacaggcgugagccaccu

SEQ ID NO: 418536 - RNA, 21 nt, Human
uaccauguuggccaggcuggu

SEQ ID NO: 418537 - RNA, 24 nt, Human
uaccauguuggccaggcuggucuc

SEQ ID NO: 418538 - RNA, 27 nt, Human
uaccauguuggccaggcuggucucgaa

SEQ ID NO: 418539 - RNA, 24 nt, Human
uacugggauuacaggcgggagcca

SEQ ID NO: 418540 - RNA, 22 nt, Human
uagaaaugggguuuuaccaugu

SEQ ID NO: 418541 - RNA, 25 nt, Human
uagaaggaaaacuggagugucucau

SEQ ID NO: 418542 - RNA, 22 nt, Human
uagagauaggguuucaccaugu

SEQ ID NO: 418543 - RNA, 23 nt, Human
uagagugcaguggcaccaucuca

SEQ ID NO: 418544 - RNA, 24 nt, Human
uagccaggcuggucuugagcuccu

SEQ ID NO: 418545 - RNA, 18 nt, Human
uagccuauaagaauuugu

SEQ ID NO: 418546 - RNA, 24 nt, Human
uaggauuacagaugugugccgcca

SEQ ID NO: 418547 - RNA, 22 nt, Human
uaggauuacaggcaugcgccac

SEQ ID NO: 418548 - RNA, 24 nt, Human
uaggauuacaggcaugcgccacca

SEQ ID NO: 418549 - RNA, 21 nt, Human
uagggaaggaguagaacaaaa

SEQ ID NO: 418550 - RNA, 24 nt, Human
uaggguuucaccauguuggccagg

SEQ ID NO: 418551 - RNA, 24 nt, Human
uaguagaaaugggguuuuaccaug

SEQ ID NO: 418552 - RNA, 24 nt, Human
uaguagagauaggguuucaccaug

SEQ ID NO: 418553 - RNA, 18 nt, Human
uauaaaguuaaaugaaaa

SEQ ID NO: 418554 - RNA, 20 nt, Human
uauguaaaaaccaaccaaaa

SEQ ID NO: 418555 - RNA, 24 nt, Human
uauugcucugucacacaggcugga

SEQ ID NO: 418556 - RNA, 19 nt, Human
ucaagugauucuccugccu

SEQ ID NO: 418557 - RNA, 21 nt, Human
ucacaagauucgaaaugaaaa

SEQ ID NO: 418558 - RNA, 18 nt, Human
ucacaaggucaggagauc

SEQ ID NO: 418559 - RNA, 24 nt, Human
ucacaaggucaggagaucaagacc

SEQ ID NO: 418560 - RNA, 22 nt, Human
ucacucuuguuucccaggcugg

SEQ ID NO: 418561 - RNA, 23 nt, Human
ucacucuuguuucccaggcugga

SEQ ID NO: 418562 - RNA, 23 nt, Human
ucacugcaaccuccgccucccgg

SEQ ID NO: 418563 - RNA, 24 nt, Human
ucacugcaaccuccgccucccggg

SEQ ID NO: 418564 - RNA, 25 nt, Human
ucacugcaaccuccgccucccgggu

SEQ ID NO: 418565 - RNA, 27 nt, Human
ucacugcaaccuccgccucccggguuc

SEQ ID NO: 418566 - RNA, 18 nt, Human
ucacugcaagcuccaccu

SEQ ID NO: 418567 - RNA, 19 nt, Human
ucacugcaagcuccaccuu

SEQ ID NO: 418568 - RNA, 24 nt, Human
ucacugcaagcuccaccuuccagg

SEQ ID NO: 418569 - RNA, 23 nt, Human
ucacugcaaucuucgccuccugg

SEQ ID NO: 418570 - RNA, 24 nt, Human
ucacugcaaucuucgccuccuggg

SEQ ID NO: 418571 - RNA, 23 nt, Human
ucagccaggcacgguggcccaca

SEQ ID NO: 418572 - RNA, 24 nt, Human
ucauucacuucacucugauuugaa

SEQ ID NO: 418573 - RNA, 20 nt, Human
uccagguucaugccauucuc

SEQ ID NO: 418574 - RNA, 22 nt, Human
uccaucccaaaaaaacaaaaca

SEQ ID NO: 418575 - RNA, 23 nt, Human
uccaucccaaaaaaacaaaacaa

SEQ ID NO: 418576 - RNA, 25 nt, Human
uccaucccaaaaaaacaaaacaaaa

SEQ ID NO: 418577 - RNA, 24 nt, Human
uccauccccaaaaaaaaaaaaaaa

SEQ ID NO: 418578 - RNA, 24 nt, Human
ucccaaaaugcugggauuacaggc

SEQ ID NO: 418579 - RNA, 24 nt, Human
ucccaaaguacugggauuacaggc

SEQ ID NO: 418580 - RNA, 24 nt, Human
ucccaaagugcugagauuacaggc

SEQ ID NO: 418581 - RNA, 24 nt, Human
ucccaaagugcugggauuacaggc

SEQ ID NO: 418582 - RNA, 18 nt, Human
ucccaccacuuugggagg

SEQ ID NO: 418583 - RNA, 21 nt, Human
ucccaggcuggagugcaaugg

SEQ ID NO: 418584 - RNA, 18 nt, Human
ucccccaggcuggagugc

SEQ ID NO: 418585 - RNA, 24 nt, Human
uccccucucccaccccccaacaaa

SEQ ID NO: 418586 - RNA, 21 nt, Human
uccccugguuuguuccucuga

SEQ ID NO: 418587 - RNA, 19 nt, Human
ucccggguucaagagauuc

SEQ ID NO: 418588 - RNA, 24 nt, Human
ucccggguucaagagauucgccug

SEQ ID NO: 418589 - RNA, 19 nt, Human
uccugaguagcuaggauua

SEQ ID NO: 418590 - RNA, 24 nt, Human
uccugaguagcuaggauuacaggc

SEQ ID NO: 418591 - RNA, 24 nt, Human
uccuggggucaagugauucuccug

SEQ ID NO: 418592 - RNA, 24 nt, Human
uccuuggacaacaccaaaaacaca

SEQ ID NO: 418593 - RNA, 27 nt, Human
ucgcaccucugcacuccagccugggca

SEQ ID NO: 418594 - RNA, 31 nt, Human
ucgcaccucugcacuccagccugggcaacaa

SEQ ID NO: 418595 - RNA, 18 nt, Human
ucgcccagguuagagugc

SEQ ID NO: 418596 - RNA, 18 nt, Human
ucucacucugucgcccag

SEQ ID NO: 418597 - RNA, 19 nt, Human
ucucacucugucgcccagg

SEQ ID NO: 418598 - RNA, 23 nt, Human
ucucacucugucgcccagguuag

SEQ ID NO: 418599 - RNA, 24 nt, Human
ucucacucugucgcccagguuaga

SEQ ID NO: 418600 - RNA, 24 nt, Human
ucuccugccucagccuccugagua

SEQ ID NO: 418601 - RNA, 23 nt, Human
ucucgaacuccugaccucaggug

SEQ ID NO: 418602 - RNA, 24 nt, Human
ucucgaguagcugggacuacaggc

SEQ ID NO: 418603 - RNA, 21 nt, Human
ucucuacuaaaaguacaaaaa

SEQ ID NO: 418604 - RNA, 24 nt, Human
ucugcacuccagccugggcaacag

SEQ ID NO: 418605 - RNA, 19 nt, Human
ucugcccuaaaaaggcugg

SEQ ID NO: 418606 - RNA, 24 nt, Human
ucugucccccaggcuggagugcag

SEQ ID NO: 418607 - RNA, 21 nt, Human
ucuugaaguucugggcucaag

SEQ ID NO: 418608 - RNA, 21 nt, Human
ucuugagcuccugaccucagg

SEQ ID NO: 418609 - RNA, 19 nt, Human
ucuugcucugucccccagg

SEQ ID NO: 418610 - RNA, 23 nt, Human
ucuugcucugucccccaggcugg

SEQ ID NO: 418611 - RNA, 24 nt, Human
ucuugcucugucccccaggcugga

SEQ ID NO: 418612 - RNA, 19 nt, Human
ucuuguuucccaggcugga

SEQ ID NO: 418613 - RNA, 22 nt, Human
ugaaaccccgucuccacuaaaa

SEQ ID NO: 418614 - RNA, 21 nt, Human
ugaaacuaaggaaggaaccag

SEQ ID NO: 418615 - RNA, 19 nt, Human
ugaaaggaggagcuaaaau

SEQ ID NO: 418616 - RNA, 20 nt, Human
ugacacaaagacagcuuaaa

SEQ ID NO: 418617 - RNA, 18 nt, Human
ugaccucagaugaucugc

SEQ ID NO: 418618 - RNA, 19 nt, Human
ugaccucagaugaucugcc

SEQ ID NO: 418619 - RNA, 19 nt, Human
ugaccucaggugauccauc

SEQ ID NO: 418620 - RNA, 24 nt, Human
ugaccucaggugauccauccgccu

SEQ ID NO: 418621 - RNA, 18 nt, Human
ugaccucaggugaucugc

SEQ ID NO: 418622 - RNA, 20 nt, Human
ugaccucaggugaucugccc

SEQ ID NO: 418623 - RNA, 21 nt, Human
ugaccucaggugaucugccca

SEQ ID NO: 418624 - RNA, 24 nt, Human
ugaccucaggugaucugcccaccu

SEQ ID NO: 418625 - RNA, 24 nt, Human
ugacucacugccgccuccaauucc

SEQ ID NO: 418626 - RNA, 24 nt, Human
ugagauggaauuucacucuuguuu

SEQ ID NO: 418627 - RNA, 18 nt, Human
ugagauuacaggcgugag

SEQ ID NO: 418628 - RNA, 19 nt, Human
ugagauuacaggcgugagc

SEQ ID NO: 418629 - RNA, 21 nt, Human
ugagauuacaggcgugagcca

SEQ ID NO: 418630 - RNA, 22 nt, Human
ugagauuacaggcgugagccac

SEQ ID NO: 418631 - RNA, 23 nt, Human
ugagauuacaggcgugagccacc

SEQ ID NO: 418632 - RNA, 24 nt, Human
ugagauuacaggcgugagccaccu

SEQ ID NO: 418633 - RNA, 27 nt, Human
ugagauuacaggcgugagccaccucgc

SEQ ID NO: 418634 - RNA, 20 nt, Human
ugagccaggagaaucacuug

SEQ ID NO: 418635 - RNA, 23 nt, Human
ugagccaggagaaucacuugaac

SEQ ID NO: 418636 - RNA, 22 nt, Human
ugagccgagauggcgccacugc

SEQ ID NO: 418637 - RNA, 18 nt, Human
ugaggucaggaguuugaa

SEQ ID NO: 418638 - RNA, 23 nt, Human
ugaggucaggaguuugaaaccag

SEQ ID NO: 418639 - RNA, 20 nt, Human
ugaggugggcggaucaccug

SEQ ID NO: 418640 - RNA, 24 nt, Human
ugaggugggcggaucaccugaggu

SEQ ID NO: 418641 - RNA, 26 nt, Human
ugaggugggcggaucaccugagguca

SEQ ID NO: 418642 - RNA, 19 nt, Human
ugagguggguggaucacaa

SEQ ID NO: 418643 - RNA, 21 nt, Human
ugagguggguggaucacaagg

SEQ ID NO: 418644 - RNA, 24 nt, Human
ugagguggguggaucacaagguca

SEQ ID NO: 418645 - RNA, 26 nt, Human
ugagguggguggaucacaaggucagg

SEQ ID NO: 418646 - RNA, 23 nt, Human
ugagguggguggaucacaagguu

SEQ ID NO: 418647 - RNA, 24 nt, Human
ugagguuucaccauguuagccagg

SEQ ID NO: 418648 - RNA, 24 nt, Human
ugaucugcccaccucgacccccca

SEQ ID NO: 418649 - RNA, 20 nt, Human
ugauucuccugccucagccu

SEQ ID NO: 418650 - RNA, 19 nt, Human
ugcaagcuccaccuuccag

SEQ ID NO: 418651 - RNA, 18 nt, Human
ugccaagaaauacccacc

SEQ ID NO: 418652 - RNA, 21 nt, Human
ugcccaccucgaccccccaaa

SEQ ID NO: 418653 - RNA, 24 nt, Human
ugccucagccuccugaguagcuag

SEQ ID NO: 418654 - RNA, 21 nt, Human
ugccucaggcucucgaguagc

SEQ ID NO: 418655 - RNA, 24 nt, Human
ugccucaggcucucgaguagcugg

SEQ ID NO: 418656 - RNA, 20 nt, Human
ugccucagucuucccaaagc

SEQ ID NO: 418657 - RNA, 24 nt, Human
ugcucugucccccaggcuggagug

SEQ ID NO: 418658 - RNA, 24 nt, Human
ugcugagauuacaggcgugagcca

SEQ ID NO: 418659 - RNA, 20 nt, Human
ugcugggauuacaggcauga

SEQ ID NO: 418660 - RNA, 23 nt, Human
ugcugggauuacaggcgugaacc

SEQ ID NO: 418661 - RNA, 21 nt, Human
uggagaugagguuucaccaug

SEQ ID NO: 418662 - RNA, 19 nt, Human
uggagugcaauggugugau

SEQ ID NO: 418663 - RNA, 24 nt, Human
uggagugcaauggugugaucuugg

SEQ ID NO: 418664 - RNA, 19 nt, Human
uggcaccaucucagcucac

SEQ ID NO: 418665 - RNA, 24 nt, Human
uggcaccaucucagcucacugcaa

SEQ ID NO: 418666 - RNA, 22 nt, Human
uggcaggcaccuguaaucccag

SEQ ID NO: 418667 - RNA, 22 nt, Human
uggcaggcgccuguaaucccag

SEQ ID NO: 418668 - RNA, 24 nt, Human
uggccaggcuggucucaaacuccu

SEQ ID NO: 418669 - RNA, 24 nt, Human
uggccaggcuggucucgaacuccu

SEQ ID NO: 418670 - RNA, 21 nt, Human
uggcucacaccuguaauccca

SEQ ID NO: 418671 - RNA, 19 nt, Human
ugggacuacaggcgcucac

SEQ ID NO: 418672 - RNA, 21 nt, Human
ugggacuacaggcgcucacca

SEQ ID NO: 418673 - RNA, 24 nt, Human
ugggacuacaggcgcucaccacca

SEQ ID NO: 418674 - RNA, 19 nt, Human
ugggaggcugaggugggcg

SEQ ID NO: 418675 - RNA, 24 nt, Human
ugggaggcugaggugggcggauca

SEQ ID NO: 418676 - RNA, 23 nt, Human
ugggaggcugagguggguggauc

SEQ ID NO: 418677 - RNA, 24 nt, Human
ugggaggcugagguggguggauca

SEQ ID NO: 418678 - RNA, 19 nt, Human
ugggauuacaggcaugagc

SEQ ID NO: 418679 - RNA, 20 nt, Human
ugggauuacaggcaugagcc

SEQ ID NO: 418680 - RNA, 20 nt, Human
ugggauuacaggcaugagcc

SEQ ID NO: 418681 - RNA, 21 nt, Human
ugggauuacaggcaugagcca

SEQ ID NO: 418682 - RNA, 22 nt, Human
ugggauuacaggcaugagccac

SEQ ID NO: 418683 - RNA, 22 nt, Human
ugggauuacaggcaugagccac

SEQ ID NO: 418684 - RNA, 22 nt, Human
ugggauuacaggcaugagccac

SEQ ID NO: 418685 - RNA, 23 nt, Human
ugggauuacaggcaugagccacu

SEQ ID NO: 418686 - RNA, 24 nt, Human
ugggauuacaggcaugagccacug

SEQ ID NO: 418687 - RNA, 26 nt, Human
ugggauuacaggcaugagccacugug

SEQ ID NO: 418688 - RNA, 21 nt, Human
ugggauuacaggcaugagccg

SEQ ID NO: 418689 - RNA, 22 nt, Human
ugggauuacaggcaugagccgc

SEQ ID NO: 418690 - RNA, 23 nt, Human
ugggauuacaggcaugagccgcc

SEQ ID NO: 418691 - RNA, 24 nt, Human
ugggauuacaggcaugagccgccg

SEQ ID NO: 418692 - RNA, 18 nt, Human
ugggauuacaggcgggag

SEQ ID NO: 418693 - RNA, 21 nt, Human
ugggauuacaggcgggagcca

SEQ ID NO: 418694 - RNA, 22 nt, Human
ugggauuacaggcgggagccac

SEQ ID NO: 418695 - RNA, 24 nt, Human
ugggauuacaggcgggagccacca

SEQ ID NO: 418696 - RNA, 25 nt, Human
ugggauuacaggcgggagccaccau

SEQ ID NO: 418697 - RNA, 19 nt, Human
ugggauuacaggcgugaac

SEQ ID NO: 418698 - RNA, 22 nt, Human
ugggauuacaggcgugaaccac

SEQ ID NO: 418699 - RNA, 23 nt, Human
ugggauuacaggcgugaaccacc

SEQ ID NO: 418700 - RNA, 24 nt, Human
ugggauuacaggcgugaaccacca

SEQ ID NO: 418701 - RNA, 25 nt, Human
ugggauuacaggcgugaaccaccau

SEQ ID NO: 418702 - RNA, 24 nt, Human
ugggcggaucaccugaggucagga

SEQ ID NO: 418703 - RNA, 23 nt, Human
uggggucaagugauucuccugcc

SEQ ID NO: 418704 - RNA, 24 nt, Human
ugggguuuuaccauguuggccagg

SEQ ID NO: 418705 - RNA, 19 nt, Human
uggguucuguuuucauggg

SEQ ID NO: 418706 - RNA, 24 nt, Human
uggugcgauaucagcucacugcaa

SEQ ID NO: 418707 - RNA, 24 nt, Human
ugguggcaggcaccuguaauccca

SEQ ID NO: 418708 - RNA, 24 nt, Human
ugguggcaggcgccuguaauccca

SEQ ID NO: 418709 - RNA, 20 nt, Human
ugguggcuuauguuuggauc

SEQ ID NO: 418710 - RNA, 25 nt, Human
uguaaucccagcuacucaggaggau

SEQ ID NO: 418711 - RNA, 21 nt, Human
ugucgcccagguuagagugca

SEQ ID NO: 418712 - RNA, 22 nt, Human
ugugauguuugccccuaaacau

SEQ ID NO: 418713 - RNA, 19 nt, Human
uguuugccccuaaacauca

SEQ ID NO: 418714 - RNA, 21 nt, Human
uuaaaaaacagcuuaaaaaca

SEQ ID NO: 418715 - RNA, 26 nt, Human
uuaaaaacaaaacaaaacaaaaaaaa

SEQ ID NO: 418716 - RNA, 25 nt, Human
uuaauagagacgggguuucacccgu

SEQ ID NO: 418717 - RNA, 18 nt, Human
uuaguagaaaugggguuu

SEQ ID NO: 418718 - RNA, 22 nt, Human
uuaguagaaaugggguuuuacc

SEQ ID NO: 418719 - RNA, 24 nt, Human
uuaguagaaaugggguuuuaccau

SEQ ID NO: 418720 - RNA, 18 nt, Human
uuaguagagauaggguuu

SEQ ID NO: 418721 - RNA, 22 nt, Human
uuaguagagauaggguuucacc

SEQ ID NO: 418722 - RNA, 24 nt, Human
uuaguagagauaggguuucaccau

SEQ ID NO: 418723 - RNA, 26 nt, Human
uuaguuuucugucuuuuccaaauguu

SEQ ID NO: 418724 - RNA, 24 nt, Human
uucacucuuguuucccaggcugga

SEQ ID NO: 418725 - RNA, 19 nt, Human
uucaugccauucuccugcc

SEQ ID NO: 418726 - RNA, 24 nt, Human
uuccagguucaugccauucuccug

SEQ ID NO: 418727 - RNA, 24 nt, Human
uuccugacgucgugauccacccgc

SEQ ID NO: 418728 - RNA, 18 nt, Human
uugcagugagccgagaug

SEQ ID NO: 418729 - RNA, 22 nt, Human
uugcagugagccgagauggcgc

SEQ ID NO: 418730 - RNA, 20 nt, Human
uugcucugucacacaggcug

SEQ ID NO: 418731 - RNA, 22 nt, Human
uugcucugucacacaggcugga

SEQ ID NO: 418732 - RNA, 24 nt, Human
uugcucugucccccaggcuggagu

SEQ ID NO: 418733 - RNA, 27 nt, Human
uuggccagcgugguggcaggcaccugu

SEQ ID NO: 418734 - RNA, 25 nt, Human
uugggaggcugaggugggcggauca

SEQ ID NO: 418735 - RNA, 25 nt, Human
uugggaggcugagguggguggauca

SEQ ID NO: 418736 - RNA, 21 nt, Human
uuguccauuaauacuauaauc

SEQ ID NO: 418737 - RNA, 21 nt, Human
uugucccugccucacggaugc

SEQ ID NO: 418738 - RNA, 23 nt, Human
uuguuucccaggcuggagugcaa

SEQ ID NO: 418739 - RNA, 19 nt, Human
uuguuuuuuuuuuugagac

SEQ ID NO: 418740 - RNA, 23 nt, Human
uuuaagguccccucucccacccc

SEQ ID NO: 418741 - RNA, 18 nt, Human
uuuaauuuuuaguagaga

SEQ ID NO: 418742 - RNA, 22 nt, Human
uuuauaagaaaaauaaagcuaa

SEQ ID NO: 418743 - RNA, 21 nt, Human
uuucaccauguuagccaggcu

SEQ ID NO: 418744 - RNA, 24 nt, Human
uuucaccauguuggccaggcuggu

SEQ ID NO: 418745 - RNA, 22 nt, Human
uuugccccuaaacaucacaaug

SEQ ID NO: 418746 - RNA, 24 nt, Human
uuuuaaguggagaugagguuucac

SEQ ID NO: 418747 - RNA, 24 nt, Human
uuuuuaauagagacgggguuucac

SEQ ID NO: 418748 - RNA, 24 nt, Human
uuuuuaguagaaaugggguuuuac

SEQ ID NO: 418749 - RNA, 24 nt, Human
uuuuuaguagagauaggguuucac

SEQ ID NO: 418750 - RNA, 23 nt, Human
uuuuuguauuuuaaguggagaug

SEQ ID NO: 418751 - RNA, 19 nt, Human
uuuuuuaaaaagcuauuag

SEQ ID NO: 418752 - RNA, 20 nt, Human
uuuuuuuugaggcagggucu

SEQ ID NO: 418753 - RNA, 23 nt, Human
uuuuuuuuuuugagacggagucu

SEQ ID NO: 418754 - RNA, 22 nt, Human
cugcaaaauuucacuucaauug

SEQ ID NO: 418755 - RNA, 22 nt, Human
cugcaaaauuucacuucaauug

SEQ ID NO: 418756 - RNA, 21 nt, Human
uuuuuuuuuuuugggguauca

SEQ ID NO: 418757 - RNA, 23 nt, Human
aaaaaaaaaaaaacaaaaaaaaa

SEQ ID NO: 418758 - RNA, 23 nt, Human
aaaaaaaacaaaaaaaaaaaucc

SEQ ID NO: 418759 - RNA, 18 nt, Human
aaaaauccaaguguccuc

SEQ ID NO: 418760 - RNA, 24 nt, Human
aaaagguaacaaaauauacagaac

SEQ ID NO: 418761 - RNA, 24 nt, Human
aaaauuaaaagugugcauagucca

SEQ ID NO: 418762 - RNA, 19 nt, Human
aaacaaacaaacacaagca

SEQ ID NO: 418763 - RNA, 23 nt, Human
aaacaaacaaacacaagcaaaca

SEQ ID NO: 418764 - RNA, 24 nt, Human
aaacaaacaaacacaagcaaacag

SEQ ID NO: 418765 - RNA, 25 nt, Human
aaacaaacaaacacaagcaaacaga

SEQ ID NO: 418766 - RNA, 23 nt, Human
aaacacgacuauccagcagcagc

SEQ ID NO: 418767 - RNA, 22 nt, Human
aaauuaaaagugugcauagucc

SEQ ID NO: 418768 - RNA, 19 nt, Human
aacugcuuucuaaaggaac

SEQ ID NO: 418769 - RNA, 24 nt, Human
aagcaaaaaaaaaaaaaacaaaaa

SEQ ID NO: 418770 - RNA, 19 nt, Human
aagcaaacagagucucuuc

SEQ ID NO: 418771 - RNA, 21 nt, Human
aagcucauaguggcaugugug

SEQ ID NO: 418772 - RNA, 19 nt, Human
aagcugccuuccagcagcc

SEQ ID NO: 418773 - RNA, 20 nt, Human
aagcugccuuccagcagccu

SEQ ID NO: 418774 - RNA, 19 nt, Human
aagguaacaaaauauacag

SEQ ID NO: 418775 - RNA, 19 nt, Human
acagcuggagucugaaagc

SEQ ID NO: 418776 - RNA, 18 nt, Human
accacugcccuccugcca

SEQ ID NO: 418777 - RNA, 24 nt, Human
agcaaaaaaaaaaaaaacaaaaaa

SEQ ID NO: 418778 - RNA, 22 nt, Human
aggagaaagcagugcacgagaa

SEQ ID NO: 418779 - RNA, 21 nt, Human
auaaaacacuaauaauaaucc

SEQ ID NO: 418780 - RNA, 22 nt, Human
caaaaaaaaaaaaaacaaaaaa

SEQ ID NO: 418781 - RNA, 22 nt, Human
caaguguccuccuccaccacuc

SEQ ID NO: 418782 - RNA, 23 nt, Human
cacugcccuccugccacaucaca

SEQ ID NO: 418783 - RNA, 18 nt, Human
cacugugugugcgagagu

SEQ ID NO: 418784 - RNA, 18 nt, Human
cagaacaaaacuuucccu

SEQ ID NO: 418785 - RNA, 18 nt, Human
cagcagcagcgaagacgc

SEQ ID NO: 418786 - RNA, 19 nt, Human
cagcagcagcgaagacgcu

SEQ ID NO: 418787 - RNA, 20 nt, Human
cagcaggcagguccagcucc

SEQ ID NO: 418788 - RNA, 21 nt, Human
cagccugccaaggccauggca

SEQ ID NO: 418789 - RNA, 19 nt, Human
caucaagugccaugguuua

SEQ ID NO: 418790 - RNA, 26 nt, Human
ccaacggccuccacaagcugccuucc

SEQ ID NO: 418791 - RNA, 18 nt, Human
ccccucugcccuuggucc

SEQ ID NO: 418792 - RNA, 20 nt, Human
ccccucugcccuugguccug

SEQ ID NO: 418793 - RNA, 19 nt, Human
cccgaaaacacgacuaucc

SEQ ID NO: 418794 - RNA, 20 nt, Human
ccugccacaucacaucaagu

SEQ ID NO: 418795 - RNA, 28 nt, Human
ccuggagucagagcagaacccuuagagc

SEQ ID NO: 418796 - RNA, 20 nt, Human
ccugguucccagcccagaau

SEQ ID NO: 418797 - RNA, 20 nt, Human
cgagaaggaaugagugggcg

SEQ ID NO: 418798 - RNA, 27 nt, Human
cugcaaacaaacaaacacaagcaaaca

SEQ ID NO: 418799 - RNA, 20 nt, Human
cugcagcaggcagguccagc

SEQ ID NO: 418800 - RNA, 22 nt, Human
cuuagcugugaaggagaaagca

SEQ ID NO: 418801 - RNA, 21 nt, Human
gaaguccugccacguuuccuu

SEQ ID NO: 418802 - RNA, 21 nt, Human
gcaggcagguccagcuccacc

SEQ ID NO: 418803 - RNA, 18 nt, Human
gcccugccucguccuccu

SEQ ID NO: 418804 - RNA, 19 nt, Human
gcccugccucguccuccug

SEQ ID NO: 418805 - RNA, 18 nt, Human
ggccauggcagagagaga

SEQ ID NO: 418806 - RNA, 20 nt, Human
gggaaaacaaaccagggcgc

SEQ ID NO: 418807 - RNA, 24 nt, Human
uaacaaaauauacagaacaaaacu

SEQ ID NO: 418808 - RNA, 23 nt, Human
uaacugcuuucuaaaggaacugg

SEQ ID NO: 418809 - RNA, 24 nt, Human
uaauucaaucaguccugcucccag

SEQ ID NO: 418810 - RNA, 18 nt, Human
uacacgugacugcagcag

SEQ ID NO: 418811 - RNA, 24 nt, Human
uacagaacaaaacuuucccuuuuu

SEQ ID NO: 418812 - RNA, 20 nt, Human
uauggcacagauggaagucc

SEQ ID NO: 418813 - RNA, 24 nt, Human
uccccgaaaacacgacuauccagc

SEQ ID NO: 418814 - RNA, 23 nt, Human
ugacugcagcaggcagguccagc

SEQ ID NO: 418815 - RNA, 18 nt, Human
ugaguauccucgaucccc

SEQ ID NO: 418816 - RNA, 21 nt, Human
ugcaaacaaacaaacacaagc

SEQ ID NO: 418817 - RNA, 21 nt, Human
ugcagcaggcagguccagcuc

SEQ ID NO: 418818 - RNA, 18 nt, Human
uggcacagauggaagucc

SEQ ID NO: 418819 - RNA, 24 nt, Human
uguccuccuccaccacucacgcug

SEQ ID NO: 418820 - RNA, 18 nt, Human
ugugugcgagagugcuuc

SEQ ID NO: 418821 - RNA, 23 nt, Human
uguuaagcaaaaaaaaaaaaaac

SEQ ID NO: 418822 - RNA, 19 nt, Human
uucuuacucagacuuuaca

SEQ ID NO: 418823 - RNA, 18 nt, Human
uuuuuuuuuuuuuuuucg

SEQ ID NO: 418824 - RNA, 25 nt, Human
uuuuuuuuuuuuuuuucgugccuuu

SEQ ID NO: 418825 - RNA, 20 nt, Human
uuuuuuuuuuuuuuuuucgu

SEQ ID NO: 418826 - RNA, 24 nt, Human
aaaaaaaagcaguuuuaaugguaa

SEQ ID NO: 418827 - RNA, 20 nt, Human
aagcagaaccaaguugguug

SEQ ID NO: 418828 - RNA, 25 nt, Human
agggcgcgguggguguggguggugg

SEQ ID NO: 418829 - RNA, 23 nt, Human
auggccugggcggcggcgguggc

SEQ ID NO: 418830 - RNA, 20 nt, Human
ccugggcggcggcgguggcg

SEQ ID NO: 418831 - RNA, 25 nt, Human
cugggcggcggcgguggcgcggacu

SEQ ID NO: 418832 - RNA, 24 nt, Human
cuguaaacuagauuauguuguaaa

SEQ ID NO: 418833 - RNA, 18 nt, Human
gcgaacgagggcgcggug

SEQ ID NO: 418834 - RNA, 21 nt, Human
gcgcuccugaaaaacugcaga

SEQ ID NO: 418835 - RNA, 20 nt, Human
ggccugggcggcggcggugg

SEQ ID NO: 418836 - RNA, 20 nt, Human
ggcgauggccugggcggcgg

SEQ ID NO: 418837 - RNA, 23 nt, Human
ggcggcggcgguggcgcggacug

SEQ ID NO: 418838 - RNA, 18 nt, Human
gggcggcggcgguggcgc

SEQ ID NO: 418839 - RNA, 19 nt, Human
gggcggcggcgguggcgcg

SEQ ID NO: 418840 - RNA, 18 nt, Human
ggguguggguggugggag

SEQ ID NO: 418841 - RNA, 24 nt, Human
guggguggugggagcgcggcugcg

SEQ ID NO: 418842 - RNA, 23 nt, Human
ucgguuguuaagaacuagagcuu

SEQ ID NO: 418843 - RNA, 24 nt, Human
ucgguuguuaagaacuagagcuua

SEQ ID NO: 418844 - RNA, 24 nt, Human
ucuagcacaagauuuuucuguaaa

SEQ ID NO: 418845 - RNA, 24 nt, Human
ucuugcgcuccugaaaaacugcag

SEQ ID NO: 418846 - RNA, 19 nt, Human
ugcagaaaggcacuugaaa

SEQ ID NO: 418847 - RNA, 19 nt, Human
ugcugcacugagugugugc

SEQ ID NO: 418848 - RNA, 21 nt, Human
ugggcggcggcgguggcgcgg

SEQ ID NO: 418849 - RNA, 22 nt, Human
uggguguggguggugggagcgc

SEQ ID NO: 418850 - RNA, 24 nt, Human
uguaaacuagauuauguuguaaac

SEQ ID NO: 418851 - RNA, 19 nt, Human
uuccaaagauuuauugaag

SEQ ID NO: 418852 - RNA, 24 nt, Human
uugguuggauacuugcuggaaaaa

SEQ ID NO: 418853 - RNA, 19 nt, Human
aagcagaaagggaaguuuc

SEQ ID NO: 418854 - RNA, 21 nt, Human
aagcagaaagggaaguuucag

SEQ ID NO: 418855 - RNA, 18 nt, Human
acacagcauuccaucugc

SEQ ID NO: 418856 - RNA, 25 nt, Human
acaccauuaaaaauaaaaggugagc

SEQ ID NO: 418857 - RNA, 24 nt, Human
acaucacaacauucacaacacaau

SEQ ID NO: 418858 - RNA, 23 nt, Human
agaaaggauauacagcauaugaa

SEQ ID NO: 418859 - RNA, 19 nt, Human
aucacaacauucacaacac

SEQ ID NO: 418860 - RNA, 24 nt, Human
caaauuuagacacacugauuaucu

SEQ ID NO: 418861 - RNA, 23 nt, Human
cacaacauucacaacacaauauu

SEQ ID NO: 418862 - RNA, 22 nt, Human
cacugauuaucuguucuacucu

SEQ ID NO: 418863 - RNA, 19 nt, Human
caggagagagccuuuggug

SEQ ID NO: 418864 - RNA, 27 nt, Human
cauuuuccuucaagaauucacugggaa

SEQ ID NO: 418865 - RNA, 26 nt, Human
ccaucugcuuaacauucaaauuuaga

SEQ ID NO: 418866 - RNA, 25 nt, Human
cuccaaaauguauuucacagaagga

SEQ ID NO: 418867 - RNA, 24 nt, Human
cuguucuacucuccugaauaguua

SEQ ID NO: 418868 - RNA, 21 nt, Human
cuucaagaauucacugggaag

SEQ ID NO: 418869 - RNA, 22 nt, Human
cuucacaguuauuacauuagcu

SEQ ID NO: 418870 - RNA, 23 nt, Human
gagccuuuggugauuagcaaucc

SEQ ID NO: 418871 - RNA, 18 nt, Human
gagcuggccguuccggau

SEQ ID NO: 418872 - RNA, 20 nt, Human
guuccggauuguuuuggagc

SEQ ID NO: 418873 - RNA, 20 nt, Human
uacacauacuuaacacaagc

SEQ ID NO: 418874 - RNA, 20 nt, Human
uacacucuauaaauaaacac

SEQ ID NO: 418875 - RNA, 21 nt, Human
uacagcauaugaaauugcagg

SEQ ID NO: 418876 - RNA, 22 nt, Human
uagaacucucaaauacuauuua

SEQ ID NO: 418877 - RNA, 25 nt, Human
uaucuucauuguuacuaucuuagac

SEQ ID NO: 418878 - RNA, 23 nt, Human
uauguugcguaucauuuuccuuc

SEQ ID NO: 418879 - RNA, 22 nt, Human
ucuauuacuacucuuccaaaaa

SEQ ID NO: 418880 - RNA, 18 nt, Human
ugccuauaaaauauggaa

SEQ ID NO: 418881 - RNA, 21 nt, Human
ugcucuauuacuacucuucca

SEQ ID NO: 418882 - RNA, 19 nt, Human
uggaaaaauaguugugucc

SEQ ID NO: 418883 - RNA, 19 nt, Human
ugugccucucgcccagucg

SEQ ID NO: 418884 - RNA, 27 nt, Human
uguucuacucuccugaauaguuaagua

SEQ ID NO: 418885 - RNA, 24 nt, Human
uuacacauacuuaacacaagcaga

SEQ ID NO: 418886 - RNA, 20 nt, Human
uuagaacucucaaauacuaa

SEQ ID NO: 418887 - RNA, 23 nt, Human
uucaagaauucacugggaaguug

SEQ ID NO: 418888 - RNA, 22 nt, Human
uucucucuuugauuucuuaaaa

SEQ ID NO: 418889 - RNA, 22 nt, Human
aaacaaaaacuccagaauaacc

SEQ ID NO: 418890 - RNA, 20 nt, Human
aaaguuagcaguaagagucc

SEQ ID NO: 418891 - RNA, 19 nt, Human
aaauaaccaagaggaucug

SEQ ID NO: 418892 - RNA, 24 nt, Human
aaauaaccaagaggaucuggcugg

SEQ ID NO: 418893 - RNA, 24 nt, Human
aagaggaucuggcugguuacgaua

SEQ ID NO: 418894 - RNA, 18 nt, Human
acagaucccacuugacag

SEQ ID NO: 418895 - RNA, 20 nt, Human
acaugagauggaggccuccu

SEQ ID NO: 418896 - RNA, 18 nt, Human
agacuuggagagcaggua

SEQ ID NO: 418897 - RNA, 26 nt, Human
agagauaaguauggcuggugugacag

SEQ ID NO: 418898 - RNA, 26 nt, Human
agagccagcagggggcagagucagga

SEQ ID NO: 418899 - RNA, 23 nt, Human
agagcuggcgggcggcgcaccag

SEQ ID NO: 418900 - RNA, 20 nt, Human
agagucccucaguccuuggg

SEQ ID NO: 418901 - RNA, 24 nt, Human
aggaagcugaguggccacuggggu

SEQ ID NO: 418902 - RNA, 24 nt, Human
aggaggcugugaccagcaggcucc

SEQ ID NO: 418903 - RNA, 18 nt, Human
agggccggggcuggccgc

SEQ ID NO: 418904 - RNA, 22 nt, Human
aggggccgccuugggccccugg

SEQ ID NO: 418905 - RNA, 21 nt, Human
agguaucugcuuucugucaga

SEQ ID NO: 418906 - RNA, 21 nt, Human
augaagccacugagacuugga

SEQ ID NO: 418907 - RNA, 22 nt, Human
caaaaacuccagaauaacccac

SEQ ID NO: 418908 - RNA, 21 nt, Human
caaacaaaaacuccagaauaa

SEQ ID NO: 418909 - RNA, 25 nt, Human
caaacaaaaacuccagaauaaccca

SEQ ID NO: 418910 - RNA, 20 nt, Human
cacaagccuguugcaguccu

SEQ ID NO: 418911 - RNA, 19 nt, Human
cacagcacagagagauaag

SEQ ID NO: 418912 - RNA, 19 nt, Human
caccagacugacccagggg

SEQ ID NO: 418913 - RNA, 18 nt, Human
cacuggggugaagggcag

SEQ ID NO: 418914 - RNA, 21 nt, Human
cagacagaggaggcugugacc

SEQ ID NO: 418915 - RNA, 19 nt, Human
cagcaggcuccuauccaga

SEQ ID NO: 418916 - RNA, 20 nt, Human
cagcaggcuccuauccagau

SEQ ID NO: 418917 - RNA, 20 nt, Human
cagccuccgagcccagggcc

SEQ ID NO: 418918 - RNA, 18 nt, Human
ccaccgguugcuuuccuc

SEQ ID NO: 418919 - RNA, 22 nt, Human
ccacugagacuuggagagcagg

SEQ ID NO: 418920 - RNA, 20 nt, Human
ccagacugacccaggggcca

SEQ ID NO: 418921 - RNA, 21 nt, Human
cccaccagacugacccagggg

SEQ ID NO: 418922 - RNA, 19 nt, Human
ccccgcgcgggcaaagagc

SEQ ID NO: 418923 - RNA, 27 nt, Human
ccccgcgcgggcaaagagcuggcgggc

SEQ ID NO: 418924 - RNA, 18 nt, Human
ccccugggauccuggugg

SEQ ID NO: 418925 - RNA, 19 nt, Human
cccgcggcgggcggccccg

SEQ ID NO: 418926 - RNA, 23 nt, Human
cccugagcccgcggcgggcggcc

SEQ ID NO: 418927 - RNA, 23 nt, Human
ccguccucccaccagacugaccc

SEQ ID NO: 418928 - RNA, 22 nt, Human
ccugagugguaaugcuuaaccc

SEQ ID NO: 418929 - RNA, 18 nt, Human
ccuguauguguagcaggg

SEQ ID NO: 418930 - RNA, 21 nt, Human
cggcgggcggccccgcgcggg

SEQ ID NO: 418931 - RNA, 22 nt, Human
cgggcagaaccuuucugcccuc

SEQ ID NO: 418932 - RNA, 22 nt, Human
cucaggucacaccaguguuguu

SEQ ID NO: 418933 - RNA, 21 nt, Human
cugccggggugagugggaagg

SEQ ID NO: 418934 - RNA, 18 nt, Human
cuguauguguagcagggu

SEQ ID NO: 418935 - RNA, 18 nt, Human
cuugcuagaaacgcucca

SEQ ID NO: 418936 - RNA, 19 nt, Human
gaagagccagcagggggca

SEQ ID NO: 418937 - RNA, 21 nt, Human
gaagcugaguggccacugggg

SEQ ID NO: 418938 - RNA, 18 nt, Human
gagaccagggggccgggg

SEQ ID NO: 418939 - RNA, 24 nt, Human
gagccuaguuacaacaguuggcac

SEQ ID NO: 418940 - RNA, 20 nt, Human
gagcucccaucucucucacu

SEQ ID NO: 418941 - RNA, 22 nt, Human
gauaacuaagcguaaagagaga

SEQ ID NO: 418942 - RNA, 21 nt, Human
gauccaccgguugcuuuccuc

SEQ ID NO: 418943 - RNA, 26 nt, Human
gcaaagagcuggcgggcggcgcacca

SEQ ID NO: 418944 - RNA, 21 nt, Human
gcccaugggugcacaucucug

SEQ ID NO: 418945 - RNA, 19 nt, Human
ggccuuuggaggaggaguc

SEQ ID NO: 418946 - RNA, 22 nt, Human
gggcaaagagcuggcgggcggc

SEQ ID NO: 418947 - RNA, 21 nt, Human
gggcagaagagccagcagggg

SEQ ID NO: 418948 - RNA, 19 nt, Human
gggcagagucaggaugaaa

SEQ ID NO: 418949 - RNA, 19 nt, Human
gggcgggaggggccgccuu

SEQ ID NO: 418950 - RNA, 18 nt, Human
ggggugagugggaagggg

SEQ ID NO: 418951 - RNA, 20 nt, Human
ggguggacaaggagggcagc

SEQ ID NO: 418952 - RNA, 18 nt, Human
ggugcacaucucugagcc

SEQ ID NO: 418953 - RNA, 21 nt, Human
uaacccaaaggaacuugacag

SEQ ID NO: 418954 - RNA, 22 nt, Human
uaccgugguguuggugcuggug

SEQ ID NO: 418955 - RNA, 22 nt, Human
uccaccugcaauccuccaggag

SEQ ID NO: 418956 - RNA, 21 nt, Human
uccccgggcagaaccuuucug

SEQ ID NO: 418957 - RNA, 22 nt, Human
uccggaccagagaccagggggc

SEQ ID NO: 418958 - RNA, 22 nt, Human
uccuccaggagaggagcuccca

SEQ ID NO: 418959 - RNA, 24 nt, Human
uccuuggguugcaccguccuccca

SEQ ID NO: 418960 - RNA, 21 nt, Human
ucucauuucccagaggcuuca

SEQ ID NO: 418961 - RNA, 22 nt, Human
ucucuaggaguguccggaccag

SEQ ID NO: 418962 - RNA, 23 nt, Human
ugacagcaauggugaaauuucag

SEQ ID NO: 418963 - RNA, 23 nt, Human
ugaggggaucuucuggcagaggu

SEQ ID NO: 418964 - RNA, 20 nt, Human
ugcaccguccucccaccaga

SEQ ID NO: 418965 - RNA, 20 nt, Human
uggacaaggagggcagcucu

SEQ ID NO: 418966 - RNA, 18 nt, Human
uggagagcagguaggcuu

SEQ ID NO: 418967 - RNA, 19 nt, Human
uggcagaguggcgcuggcc

SEQ ID NO: 418968 - RNA, 21 nt, Human
uggcgggcggcgcaccaggcg

SEQ ID NO: 418969 - RNA, 20 nt, Human
uggguaggaagcugaguggc

SEQ ID NO: 418970 - RNA, 24 nt, Human
uggguugcaccguccucccaccag

SEQ ID NO: 418971 - RNA, 21 nt, Human
uguccggaccagagaccaggg

SEQ ID NO: 418972 - RNA, 23 nt, Human
uuccacagcacagagagauaagu

SEQ ID NO: 418973 - RNA, 26 nt, Human
uuccccgggcagaaccuuucugcccu

SEQ ID NO: 418974 - RNA, 18 nt, Human
uucgcugguggcugccuu

SEQ ID NO: 418975 - RNA, 21 nt, Human
uucgcugguggcugccuucuc

SEQ ID NO: 418976 - RNA, 23 nt, Human
uugauuggcguagggggccuuug

SEQ ID NO: 418977 - RNA, 22 nt, Human
aaacagcccuguggaguugggu

SEQ ID NO: 418978 - RNA, 19 nt, Human
aacauggugaaacccuguc

SEQ ID NO: 418979 - RNA, 20 nt, Human
aacauggugaaacccugucu

SEQ ID NO: 418980 - RNA, 21 nt, Human
aacauggugaaacccugucuc

SEQ ID NO: 418981 - RNA, 18 nt, Human
aaccaccgaccaucaaca

SEQ ID NO: 418982 - RNA, 26 nt, Human
aaccagugccugguaaccaccugaca

SEQ ID NO: 418983 - RNA, 22 nt, Human
aacccuacaggggaggaacagc

SEQ ID NO: 418984 - RNA, 20 nt, Human
aagagagaggacgggcugcc

SEQ ID NO: 418985 - RNA, 22 nt, Human
aaggagcagccgcuagggcugc

SEQ ID NO: 418986 - RNA, 24 nt, Human
acacaaugacaguuaaagacaccu

SEQ ID NO: 418987 - RNA, 20 nt, Human
acagagcaagacuccgucuc

SEQ ID NO: 418988 - RNA, 24 nt, Human
acagagcaagacuccgucucaaaa

SEQ ID NO: 418989 - RNA, 22 nt, Human
acagccgaggggccgcacugaa

SEQ ID NO: 418990 - RNA, 18 nt, Human
acagccggcccucuacca

SEQ ID NO: 418991 - RNA, 21 nt, Human
acccaacaccuucaguuacca

SEQ ID NO: 418992 - RNA, 20 nt, Human
accccaucaccaggggcccg

SEQ ID NO: 418993 - RNA, 24 nt, Human
acccugucucuacuaaaaauacaa

SEQ ID NO: 418994 - RNA, 18 nt, Human
accugcccgacacggugc

SEQ ID NO: 418995 - RNA, 25 nt, Human
acugacccaacaccuucaguuacca

SEQ ID NO: 418996 - RNA, 24 nt, Human
acugcacuccagccugggcgacag

SEQ ID NO: 418997 - RNA, 26 nt, Human
acugcacuccagccugggcgacagag

SEQ ID NO: 418998 - RNA, 24 nt, Human
agagaucaggccacugcacuccag

SEQ ID NO: 418999 - RNA, 22 nt, Human
agcaacguccccagacacccuc

SEQ ID NO: 419000 - RNA, 24 nt, Human
agcacuuugggaggccgaggcggg

SEQ ID NO: 419001 - RNA, 19 nt, Human
agccagagcugcugagggu

SEQ ID NO: 419002 - RNA, 21 nt, Human
agccccgaaccgugggccucc

SEQ ID NO: 419003 - RNA, 22 nt, Human
agccgaggggccgcacugaacc

SEQ ID NO: 419004 - RNA, 24 nt, Human
agccugggcgacagagcaagacuc

SEQ ID NO: 419005 - RNA, 18 nt, Human
agcucuggggaggagggc

SEQ ID NO: 419006 - RNA, 21 nt, Human
aggcaggagaauggcgugaac

SEQ ID NO: 419007 - RNA, 24 nt, Human
aggcaggagaauggcgugaacccg

SEQ ID NO: 419008 - RNA, 21 nt, Human
aggccgaggcgggcccaucac

SEQ ID NO: 419009 - RNA, 19 nt, Human
aggcggagcuugcagggag

SEQ ID NO: 419010 - RNA, 24 nt, Human
aggcgggcccaucacgaggucagg

SEQ ID NO: 419011 - RNA, 24 nt, Human
aggcguguuggcgggcgccuguag

SEQ ID NO: 419012 - RNA, 18 nt, Human
aggcugaggcaggagaau

SEQ ID NO: 419013 - RNA, 20 nt, Human
agggugugcaggacagggug

SEQ ID NO: 419014 - RNA, 21 nt, Human
aguaggugggggaugcucccu

SEQ ID NO: 419015 - RNA, 21 nt, Human
agugcgcggagaccucgggcc

SEQ ID NO: 419016 - RNA, 23 nt, Human
aguggcucacgccuuaaucccag

SEQ ID NO: 419017 - RNA, 24 nt, Human
aucaggccacugcacuccagccug

SEQ ID NO: 419018 - RNA, 20 nt, Human
auccucugcggcccccagaa

SEQ ID NO: 419019 - RNA, 22 nt, Human
caaaccacccuucgccugaagg

SEQ ID NO: 419020 - RNA, 24 nt, Human
caaccaccgaccaucaacaaccag

SEQ ID NO: 419021 - RNA, 21 nt, Human
caaccagcuugacggagucag

SEQ ID NO: 419022 - RNA, 21 nt, Human
caaccucggguucauucuccc

SEQ ID NO: 419023 - RNA, 21 nt, Human
caagacuccgucucaaaaaaa

SEQ ID NO: 419024 - RNA, 23 nt, Human
cacaaugacaguuaaagacaccu

SEQ ID NO: 419025 - RNA, 21 nt, Human
cacagucggggcaccugggcc

SEQ ID NO: 419026 - RNA, 18 nt, Human
cacaucugcaaaccaccc

SEQ ID NO: 419027 - RNA, 22 nt, Human
cacauuuugcacaagauuaucu

SEQ ID NO: 419028 - RNA, 22 nt, Human
cacccuccccacaucugcaaag

SEQ ID NO: 419029 - RNA, 23 nt, Human
caccugaugacugaugacugccc

SEQ ID NO: 419030 - RNA, 19 nt, Human
caccuggccacugacccaa

SEQ ID NO: 419031 - RNA, 20 nt, Human
caccugggccagggcugggc

SEQ ID NO: 419032 - RNA, 25 nt, Human
caccugucuccccaaaccaaccucg

SEQ ID NO: 419033 - RNA, 19 nt, Human
cacugcacuccagccuggg

SEQ ID NO: 419034 - RNA, 20 nt, Human
cacugcacuccagccugggc

SEQ ID NO: 419035 - RNA, 22 nt, Human
cacugcacuccagccugggcga

SEQ ID NO: 419036 - RNA, 23 nt, Human
cacugcacuccagccugggcgac

SEQ ID NO: 419037 - RNA, 24 nt, Human
cacugcacuccagccugggcgaca

SEQ ID NO: 419038 - RNA, 27 nt, Human
cacugcacuccagccugggcgacagag

SEQ ID NO: 419039 - RNA, 20 nt, Human
cacugcacuccagccugggg

SEQ ID NO: 419040 - RNA, 22 nt, Human
cagcacuuugggaggccgaggc

SEQ ID NO: 419041 - RNA, 24 nt, Human
cagcacuuugggaggccgaggcgg

SEQ ID NO: 419042 - RNA, 20 nt, Human
cagcagagggguguggccgg

SEQ ID NO: 419043 - RNA, 22 nt, Human
cagcgcccgccgccuccguccu

SEQ ID NO: 419044 - RNA, 21 nt, Human
cagcguccaccugccucccuc

SEQ ID NO: 419045 - RNA, 23 nt, Human
cagcgugccgggggccgcccagc

SEQ ID NO: 419046 - RNA, 23 nt, Human
cagcuaugggaggcugaggcagg

SEQ ID NO: 419047 - RNA, 24 nt, Human
cagcucagcaacguccccagacac

SEQ ID NO: 419048 - RNA, 18 nt, Human
cagucggggcaccugggc

SEQ ID NO: 419049 - RNA, 24 nt, Human
caguggcucacgccuuaaucccag

SEQ ID NO: 419050 - RNA, 22 nt, Human
ccaaccgccucaccugucuccc

SEQ ID NO: 419051 - RNA, 20 nt, Human
ccaccgaccaucaacaacca

SEQ ID NO: 419052 - RNA, 24 nt, Human
ccacucagcuguaucccgcacccc

SEQ ID NO: 419053 - RNA, 20 nt, Human
ccacugcacuccagccuggg

SEQ ID NO: 419054 - RNA, 21 nt, Human
ccacugcacuccagccugggc

SEQ ID NO: 419055 - RNA, 21 nt, Human
ccacugcacuccagccugggc

SEQ ID NO: 419056 - RNA, 23 nt, Human
ccacugcacuccagccugggcga

SEQ ID NO: 419057 - RNA, 24 nt, Human
ccacugcacuccagccugggcgac

SEQ ID NO: 419058 - RNA, 23 nt, Human
ccagcuaugggaggcugaggcag

SEQ ID NO: 419059 - RNA, 21 nt, Human
ccaggcucgugcugggccacc

SEQ ID NO: 419060 - RNA, 21 nt, Human
cccaaccaccgaccaucaaca

SEQ ID NO: 419061 - RNA, 19 nt, Human
cccacacccaaccaccgac

SEQ ID NO: 419062 - RNA, 20 nt, Human
cccacacccaaccaccgacc

SEQ ID NO: 419063 - RNA, 23 nt, Human
cccacacccaaccaccgaccauc

SEQ ID NO: 419064 - RNA, 22 nt, Human
cccacagucggggcaccugggc

SEQ ID NO: 419065 - RNA, 25 nt, Human
cccacagucggggcaccugggccag

SEQ ID NO: 419066 - RNA, 21 nt, Human
ccccaagagagaggacgggcu

SEQ ID NO: 419067 - RNA, 20 nt, Human
ccccacguaaccccaucacc

SEQ ID NO: 419068 - RNA, 22 nt, Human
ccccacguaaccccaucaccag

SEQ ID NO: 419069 - RNA, 21 nt, Human
cccccagaaaugguggguugu

SEQ ID NO: 419070 - RNA, 26 nt, Human
cccgaccuuugacaucgcgccccagc

SEQ ID NO: 419071 - RNA, 19 nt, Human
cccgcaccccacguaaccc

SEQ ID NO: 419072 - RNA, 23 nt, Human
cccgcaccccacguaaccccauu

SEQ ID NO: 419073 - RNA, 21 nt, Human
cccuguggaguuggguggggc

SEQ ID NO: 419074 - RNA, 21 nt, Human
cccuguggcugccucccggca

SEQ ID NO: 419075 - RNA, 18 nt, Human
ccgcagaagccccgaacc

SEQ ID NO: 419076 - RNA, 24 nt, Human
ccgcagcuguagccgagcgccccg

SEQ ID NO: 419077 - RNA, 20 nt, Human
ccgcccagcgcccgccgccu

SEQ ID NO: 419078 - RNA, 23 nt, Human
ccgccucaccugucuccccaaac

SEQ ID NO: 419079 - RNA, 22 nt, Human
ccgccuccguccuagguccccg

SEQ ID NO: 419080 - RNA, 21 nt, Human
ccuccagcaugggccgggagc

SEQ ID NO: 419081 - RNA, 22 nt, Human
ccucccggcacagcugucccga

SEQ ID NO: 419082 - RNA, 21 nt, Human
ccuggccgcagcuggccuggg

SEQ ID NO: 419083 - RNA, 22 nt, Human
ccuggcuaacauggugaaaccc

SEQ ID NO: 419084 - RNA, 22 nt, Human
ccuggcuaacauggugaaaccc

SEQ ID NO: 419085 - RNA, 24 nt, Human
ccuggcuaacauggugaaacccug

SEQ ID NO: 419086 - RNA, 19 nt, Human
ccugggcaccuggccuggg

SEQ ID NO: 419087 - RNA, 22 nt, Human
ccugggcaccuggccugggccg

SEQ ID NO: 419088 - RNA, 22 nt, Human
ccugggcgacagagcaagacuc

SEQ ID NO: 419089 - RNA, 26 nt, Human
ccugguccuaacguccgggggggccc

SEQ ID NO: 419090 - RNA, 20 nt, Human
cgaccaucaacaaccagugc

SEQ ID NO: 419091 - RNA, 24 nt, Human
cgagaccauccuggcuaacauggu

SEQ ID NO: 419092 - RNA, 21 nt, Human
cgagcgcgggggccgcccccu

SEQ ID NO: 419093 - RNA, 18 nt, Human
cgcccagcgcccgccgcc

SEQ ID NO: 419094 - RNA, 21 nt, Human
cgccuguagucccagcuaugg

SEQ ID NO: 419095 - RNA, 22 nt, Human
cgccuguagucccagcuauggg

SEQ ID NO: 419096 - RNA, 21 nt, Human
cgccuuaaucccagcacuuug

SEQ ID NO: 419097 - RNA, 23 nt, Human
cgccuuaaucccagcacuuuggg

SEQ ID NO: 419098 - RNA, 19 nt, Human
cgggggccgcccagcgccc

SEQ ID NO: 419099 - RNA, 23 nt, Human
cgggggccgcccagcgcccgccg

SEQ ID NO: 419100 - RNA, 20 nt, Human
cgguugaggggagauugucc

SEQ ID NO: 419101 - RNA, 23 nt, Human
cgugcugggccacacaacugcgu

SEQ ID NO: 419102 - RNA, 21 nt, Human
cucacgccuuaaucccagcac

SEQ ID NO: 419103 - RNA, 23 nt, Human
cucacgccuuaaucccagcacuu

SEQ ID NO: 419104 - RNA, 23 nt, Human
cuccccuauucucuugggccggg

SEQ ID NO: 419105 - RNA, 19 nt, Human
cuccgucucaaaaaaaaaa

SEQ ID NO: 419106 - RNA, 21 nt, Human
cuccugguccuaacguccggg

SEQ ID NO: 419107 - RNA, 21 nt, Human
cugaugacugcccacacccaa

SEQ ID NO: 419108 - RNA, 24 nt, Human
cuggcuaacauggugaaacccugu

SEQ ID NO: 419109 - RNA, 19 nt, Human
cuucaugaccuugcucucc

SEQ ID NO: 419110 - RNA, 21 nt, Human
cuuggcuccccuauucucuug

SEQ ID NO: 419111 - RNA, 21 nt, Human
gaaaccagucagcuccgcuga

SEQ ID NO: 419112 - RNA, 19 nt, Human
gaaagcugggcaaggcugg

SEQ ID NO: 419113 - RNA, 24 nt, Human
gacagagcaagacuccgucucaaa

SEQ ID NO: 419114 - RNA, 20 nt, Human
gaccuugcucuccugaucug

SEQ ID NO: 419115 - RNA, 21 nt, Human
gacugcccacacccaaccacc

SEQ ID NO: 419116 - RNA, 19 nt, Human
gagcagccgcuagggcugc

SEQ ID NO: 419117 - RNA, 23 nt, Human
gagccagagcugcugaggguccc

SEQ ID NO: 419118 - RNA, 24 nt, Human
gauauccccacccuucugcagcca

SEQ ID NO: 419119 - RNA, 24 nt, Human
gcacuccagccugggcgacagagc

SEQ ID NO: 419120 - RNA, 22 nt, Human
gccacugcacuccagccugggc

SEQ ID NO: 419121 - RNA, 24 nt, Human
gccacugcacuccagccugggcga

SEQ ID NO: 419122 - RNA, 18 nt, Human
gccccgcagaagccccga

SEQ ID NO: 419123 - RNA, 19 nt, Human
gcccugauauccccacccu

SEQ ID NO: 419124 - RNA, 19 nt, Human
gcccuguggaguugggugg

SEQ ID NO: 419125 - RNA, 19 nt, Human
gccucaccugucuccccaa

SEQ ID NO: 419126 - RNA, 23 nt, Human
gccucaccugucuccccaaacca

SEQ ID NO: 419127 - RNA, 23 nt, Human
gccuggccgcagcuggccugggg

SEQ ID NO: 419128 - RNA, 22 nt, Human
gcgcugugggggccagggcuug

SEQ ID NO: 419129 - RNA, 24 nt, Human
gcuaacauggugaaacccugucuc

SEQ ID NO: 419130 - RNA, 22 nt, Human
gcucccuuuuguccuuugaaag

SEQ ID NO: 419131 - RNA, 20 nt, Human
gcucgugcugggccacacaa

SEQ ID NO: 419132 - RNA, 22 nt, Human
gcugaggcaggagaauggcgug

SEQ ID NO: 419133 - RNA, 21 nt, Human
gcugcugagcgccagcucugg

SEQ ID NO: 419134 - RNA, 18 nt, Human
gcugugggggccagggcu

SEQ ID NO: 419135 - RNA, 24 nt, Human
ggaccugggaggccgcccugaugu

SEQ ID NO: 419136 - RNA, 22 nt, Human
ggagaaaccagucagcuccgcu

SEQ ID NO: 419137 - RNA, 25 nt, Human
ggagucaggaccgcgcugaccugcc

SEQ ID NO: 419138 - RNA, 21 nt, Human
ggcagggcucagccgggccgg

SEQ ID NO: 419139 - RNA, 23 nt, Human
ggccggcguggcccagggugugc

SEQ ID NO: 419140 - RNA, 21 nt, Human
ggccgggcgcaguggcucacg

SEQ ID NO: 419141 - RNA, 19 nt, Human
ggcgcaguggcucacgccu

SEQ ID NO: 419142 - RNA, 25 nt, Human
gggccagggcugggcagcuugcuga

SEQ ID NO: 419143 - RNA, 24 nt, Human
gggccgggagcgagugcgcggaga

SEQ ID NO: 419144 - RNA, 23 nt, Human
gggcgccccaagagagaggacgg

SEQ ID NO: 419145 - RNA, 23 nt, Human
gggcucagccgggccgggugggc

SEQ ID NO: 419146 - RNA, 19 nt, Human
ggguccugcuuccccugcu

SEQ ID NO: 419147 - RNA, 21 nt, Human
gguccugcuuccccugcucac

SEQ ID NO: 419148 - RNA, 23 nt, Human
gguuuugcaaaccaaggugacac

SEQ ID NO: 419149 - RNA, 21 nt, Human
guccgacaggcaggggugggg

SEQ ID NO: 419150 - RNA, 24 nt, Human
gucugcagcguccaccugccuccc

SEQ ID NO: 419151 - RNA, 21 nt, Human
gugaaacccugucucuacuaa

SEQ ID NO: 419152 - RNA, 23 nt, Human
guggaggagucugcgacauucca

SEQ ID NO: 419153 - RNA, 21 nt, Human
guggccggcguggcccagggu

SEQ ID NO: 419154 - RNA, 24 nt, Human
guuggcgggcgccuguagucccag

SEQ ID NO: 419155 - RNA, 22 nt, Human
uaacauggugaaacccugucuc

SEQ ID NO: 419156 - RNA, 24 nt, Human
uaacauggugaaacccugucucua

SEQ ID NO: 419157 - RNA, 20 nt, Human
ucaaaaaaaaaaaaaaaaaa

SEQ ID NO: 419158 - RNA, 22 nt, Human
ucaaaaaaaaaaaaaaaaaaaa

SEQ ID NO: 419159 - RNA, 18 nt, Human
ucacgaggucaggagauc

SEQ ID NO: 419160 - RNA, 24 nt, Human
ucacgaggucaggagaucgagacc

SEQ ID NO: 419161 - RNA, 24 nt, Human
ucacgccuuaaucccagcacuuug

SEQ ID NO: 419162 - RNA, 20 nt, Human
uccacauuuccuccuuggcu

SEQ ID NO: 419163 - RNA, 24 nt, Human
uccagccugggcgacagagcaaga

SEQ ID NO: 419164 - RNA, 22 nt, Human
uccagggaugagcuuguugcag

SEQ ID NO: 419165 - RNA, 24 nt, Human
uccccaaaccaaccucggguucau

SEQ ID NO: 419166 - RNA, 18 nt, Human
uccccagacacccucccc

SEQ ID NO: 419167 - RNA, 19 nt, Human
uccccagacacccucccca

SEQ ID NO: 419168 - RNA, 20 nt, Human
uccccgcgguuccgccgccu

SEQ ID NO: 419169 - RNA, 20 nt, Human
ucccuguggcugccucccgg

SEQ ID NO: 419170 - RNA, 19 nt, Human
ucccuuuuguccuuugaaa

SEQ ID NO: 419171 - RNA, 23 nt, Human
uccgucucaaaaaaaaaaaaaaa

SEQ ID NO: 419172 - RNA, 20 nt, Human
uccucagcguccccucuggg

SEQ ID NO: 419173 - RNA, 23 nt, Human
uccucagcguccccucuggguca

SEQ ID NO: 419174 - RNA, 21 nt, Human
uccugaucugguugucuccuc

SEQ ID NO: 419175 - RNA, 19 nt, Human
ucgccugaaggagcagccg

SEQ ID NO: 419176 - RNA, 23 nt, Human
ucggggcaccugggccagggcug

SEQ ID NO: 419177 - RNA, 22 nt, Human
ucgugcugggccacacaacugc

SEQ ID NO: 419178 - RNA, 22 nt, Human
ucucuacuaaaaauacaaaaaa

SEQ ID NO: 419179 - RNA, 18 nt, Human
ucucuggacacugcugcu

SEQ ID NO: 419180 - RNA, 21 nt, Human
ucugcaaaccacccuucgccu

SEQ ID NO: 419181 - RNA, 24 nt, Human
ucugcaaaccacccuucgccugaa

SEQ ID NO: 419182 - RNA, 24 nt, Human
ucugcggcccccagaaaugguggg

SEQ ID NO: 419183 - RNA, 20 nt, Human
ucugguugucuccucagccc

SEQ ID NO: 419184 - RNA, 23 nt, Human
ugacaggaugugugagcuucccu

SEQ ID NO: 419185 - RNA, 19 nt, Human
ugacaguuaaagacaccug

SEQ ID NO: 419186 - RNA, 20 nt, Human
ugacauguccacucacgccc

SEQ ID NO: 419187 - RNA, 24 nt, Human
ugaccacuggguccugcuuccccu

SEQ ID NO: 419188 - RNA, 23 nt, Human
ugacugaugacugcccacaccca

SEQ ID NO: 419189 - RNA, 21 nt, Human
ugaggcagagccagagcugcu

SEQ ID NO: 419190 - RNA, 24 nt, Human
ugaggcaggagaauggcgugaacc

SEQ ID NO: 419191 - RNA, 25 nt, Human
ugaggcaggagaauggcgugaaccc

SEQ ID NO: 419192 - RNA, 18 nt, Human
ugaggggagauugucccc

SEQ ID NO: 419193 - RNA, 22 nt, Human
ugagguccaucgagcgcugugg

SEQ ID NO: 419194 - RNA, 18 nt, Human
ugaucugguugucuccuc

SEQ ID NO: 419195 - RNA, 20 nt, Human
ugcacaggaacaagacauuc

SEQ ID NO: 419196 - RNA, 21 nt, Human
ugcgcggagaccucgggcccc

SEQ ID NO: 419197 - RNA, 19 nt, Human
ugcucgggcaucuggaagg

SEQ ID NO: 419198 - RNA, 24 nt, Human
ugcugggccacacaacugcguuuc

SEQ ID NO: 419199 - RNA, 22 nt, Human
uggcccagggugugcaggacag

SEQ ID NO: 419200 - RNA, 19 nt, Human
uggccgcagcuggccuggg

SEQ ID NO: 419201 - RNA, 18 nt, Human
uggccuggggcugagcgu

SEQ ID NO: 419202 - RNA, 21 nt, Human
uggcgggcgccuguaguccca

SEQ ID NO: 419203 - RNA, 20 nt, Human
uggcucacgccuuaauccca

SEQ ID NO: 419204 - RNA, 23 nt, Human
uggcucacgccuuaaucccagca

SEQ ID NO: 419205 - RNA, 24 nt, Human
ugggaggccgaggcgggcccauca

SEQ ID NO: 419206 - RNA, 20 nt, Human
ugggaggccgcccugaugug

SEQ ID NO: 419207 - RNA, 18 nt, Human
ugggaggcugaggcagga

SEQ ID NO: 419208 - RNA, 24 nt, Human
ugggaggcugaggcaggagaaugg

SEQ ID NO: 419209 - RNA, 20 nt, Human
ugggccucccgccgcguccg

SEQ ID NO: 419210 - RNA, 21 nt, Human
uggggaggagggcuugaaaca

SEQ ID NO: 419211 - RNA, 23 nt, Human
uggggaggagggcuugaaacagu

SEQ ID NO: 419212 - RNA, 19 nt, Human
uggggucugugaugccacc

SEQ ID NO: 419213 - RNA, 18 nt, Human
ugucaggauacagccggc

SEQ ID NO: 419214 - RNA, 18 nt, Human
uguccccugagcacaccu

SEQ ID NO: 419215 - RNA, 25 nt, Human
ugugcaggacagggugcggggaacc

SEQ ID NO: 419216 - RNA, 19 nt, Human
ugugggggccagggcuugg

SEQ ID NO: 419217 - RNA, 20 nt, Human
ugugggggccagggcuuggc

SEQ ID NO: 419218 - RNA, 22 nt, Human
uguuaaaaagagaauagguuuc

SEQ ID NO: 419219 - RNA, 22 nt, Human
uguugcagcagagggguguggc

SEQ ID NO: 419220 - RNA, 21 nt, Human
uuaaagacaccuguugaccac

SEQ ID NO: 419221 - RNA, 21 nt, Human
uuccacauuuccuccuuggcu

SEQ ID NO: 419222 - RNA, 18 nt, Human
uucccuguggcugccucc

SEQ ID NO: 419223 - RNA, 19 nt, Human
uuccuccuuggcuccccua

SEQ ID NO: 419224 - RNA, 18 nt, Human
uugaaagcugggcaaggc

SEQ ID NO: 419225 - RNA, 26 nt, Human
uuggcuccccuauucucuugggcccc

SEQ ID NO: 419226 - RNA, 22 nt, Human
uuuccugggcaccuggccuggg

SEQ ID NO: 419227 - RNA, 18 nt, Human
uuuuuuuuuuuuuuuuug

SEQ ID NO: 419228 - RNA, 18 nt, Human
acucgguaaccacaucca

SEQ ID NO: 419229 - RNA, 21 nt, Human
agaaaaagagacuucagcugc

SEQ ID NO: 419230 - RNA, 20 nt, Human
aucuugauguucuuccagcc

SEQ ID NO: 419231 - RNA, 18 nt, Human
auugucccaaccauugaa

SEQ ID NO: 419232 - RNA, 21 nt, Human
cacauccaaagcugaaguaga

SEQ ID NO: 419233 - RNA, 18 nt, Human
cagauggccuauacaaug

SEQ ID NO: 419234 - RNA, 24 nt, Human
ccuauugccauugucccaaccauu

SEQ ID NO: 419235 - RNA, 26 nt, Human
cguuuuguccuauugccauuguccca

SEQ ID NO: 419236 - RNA, 20 nt, Human
cuagggaaagugcauauuug

SEQ ID NO: 419237 - RNA, 25 nt, Human
cucaaaggucaacauuugucacaga

SEQ ID NO: 419238 - RNA, 23 nt, Human
gauguucuuccagccgagaggaa

SEQ ID NO: 419239 - RNA, 21 nt, Human
gcuuaagaauagugauuguuc

SEQ ID NO: 419240 - RNA, 24 nt, Human
ggacaagaauauuuacaaaaguaa

SEQ ID NO: 419241 - RNA, 22 nt, Human
guacacaagcuugauccacgca

SEQ ID NO: 419242 - RNA, 25 nt, Human
uagaauguggacaagaauauuuaca

SEQ ID NO: 419243 - RNA, 26 nt, Human
uagaauguggacaagaauauuuacaa

SEQ ID NO: 419244 - RNA, 24 nt, Human
uagcacuugaaaaaaaauguacag

SEQ ID NO: 419245 - RNA, 19 nt, Human
uccaaagcugaaguagaau

SEQ ID NO: 419246 - RNA, 21 nt, Human
ugaaguagaauguggacaaga

SEQ ID NO: 419247 - RNA, 22 nt, Human
ugcaaaccuccauugaggucaa

SEQ ID NO: 419248 - RNA, 21 nt, Human
uggccagagguggcaauacug

SEQ ID NO: 419249 - RNA, 22 nt, Human
uguucucugggauauuuacaga

SEQ ID NO: 419250 - RNA, 22 nt, Human
uuaagaauagugauuguucucu

SEQ ID NO: 419251 - RNA, 24 nt, Human
uuguccuauugccauugucccaac

SEQ ID NO: 419252 - RNA, 21 nt, Human
aaacugacuccaccuuucuua

SEQ ID NO: 419253 - RNA, 22 nt, Human
auuaaucauccaguacaauuca

SEQ ID NO: 419254 - RNA, 19 nt, Human
auuacuuucauuaaacaau

SEQ ID NO: 419255 - RNA, 19 nt, Human
cacacacccucgcucugcc

SEQ ID NO: 419256 - RNA, 19 nt, Human
cauuaaacaauguuagcca

SEQ ID NO: 419257 - RNA, 22 nt, Human
ccggcgguccccgccggcccuc

SEQ ID NO: 419258 - RNA, 22 nt, Human
cugauacaaacugacuccaccu

SEQ ID NO: 419259 - RNA, 21 nt, Human
gaauaugaacauccuauuaac

SEQ ID NO: 419260 - RNA, 19 nt, Human
gccggcccuccacacaccc

SEQ ID NO: 419261 - RNA, 18 nt, Human
gcugauacaaauaugaaa

SEQ ID NO: 419262 - RNA, 22 nt, Human
uaaaaaaacaacuaauauccuu

SEQ ID NO: 419263 - RNA, 24 nt, Human
uaaaaaaacaacuaauauccuugg

SEQ ID NO: 419264 - RNA, 24 nt, Human
uacaaacugacuccaccuuucuua

SEQ ID NO: 419265 - RNA, 23 nt, Human
uagcacaaaagcugauacaaaua

SEQ ID NO: 419266 - RNA, 18 nt, Human
ucaggucacauacaauca

SEQ ID NO: 419267 - RNA, 27 nt, Human
uccacacacccucgcucugccucugac

SEQ ID NO: 419268 - RNA, 18 nt, Human
uccaccuuucuuauagca

SEQ ID NO: 419269 - RNA, 20 nt, Human
uccaccuuucuuauagcagu

SEQ ID NO: 419270 - RNA, 21 nt, Human
ugacucccguccguacuccuu

SEQ ID NO: 419271 - RNA, 20 nt, Human
aaaggcauuaaaggcugaag

SEQ ID NO: 419272 - RNA, 22 nt, Human
acuaagguguggcugucuugga

SEQ ID NO: 419273 - RNA, 20 nt, Human
aggcagugggcugcagcagg

SEQ ID NO: 419274 - RNA, 24 nt, Human
aggcauuaaaggcugaaguagucu

SEQ ID NO: 419275 - RNA, 18 nt, Human
aggugggguuccaggugg

SEQ ID NO: 419276 - RNA, 19 nt, Human
ccacagaaggucuggcgac

SEQ ID NO: 419277 - RNA, 21 nt, Human
gggcaguauacuaaggugugg

SEQ ID NO: 419278 - RNA, 20 nt, Human
gggucaggugggguuccagg

SEQ ID NO: 419279 - RNA, 21 nt, Human
gucaggugggguuccaggugg

SEQ ID NO: 419280 - RNA, 19 nt, Human
ugggguuccaggugggucc

SEQ ID NO: 419281 - RNA, 19 nt, Human
aaaagugguaacaagagca

SEQ ID NO: 419282 - RNA, 24 nt, Human
aaacaauagaaauuuauuucucau

SEQ ID NO: 419283 - RNA, 19 nt, Human
aaacaucugccacaaaaau

SEQ ID NO: 419284 - RNA, 18 nt, Human
aagccuuuuguugaagcu

SEQ ID NO: 419285 - RNA, 24 nt, Human
acccugucuccaaauacagucaca

SEQ ID NO: 419286 - RNA, 18 nt, Human
acguccaagaaagaccaa

SEQ ID NO: 419287 - RNA, 21 nt, Human
acuaaaagagcaaacaaacaa

SEQ ID NO: 419288 - RNA, 20 nt, Human
aggaacaggaaugggucuuu

SEQ ID NO: 419289 - RNA, 19 nt, Human
aguaccauggacuggguga

SEQ ID NO: 419290 - RNA, 19 nt, Human
agugguggggagaggaaca

SEQ ID NO: 419291 - RNA, 21 nt, Human
aucugguguguguguguuugu

SEQ ID NO: 419292 - RNA, 21 nt, Human
auucugcuguuacuaaaauag

SEQ ID NO: 419293 - RNA, 22 nt, Human
caaaugucaguuaaugucaccc

SEQ ID NO: 419294 - RNA, 21 nt, Human
caagaaagaccaauguucaaa

SEQ ID NO: 419295 - RNA, 18 nt, Human
caagguguuggcaggguu

SEQ ID NO: 419296 - RNA, 20 nt, Human
caagguguuggcaggguugg

SEQ ID NO: 419297 - RNA, 26 nt, Human
cacacaaugcuauauuaaauaucuaa

SEQ ID NO: 419298 - RNA, 23 nt, Human
cagcagagcugaauaagugauac

SEQ ID NO: 419299 - RNA, 21 nt, Human
cccagaccagcugaauauucu

SEQ ID NO: 419300 - RNA, 22 nt, Human
ccuucuuuaagagugucuauug

SEQ ID NO: 419301 - RNA, 24 nt, Human
cuggaaguccaagaucaagguguu

SEQ ID NO: 419302 - RNA, 21 nt, Human
gaaauuuucagcagagcugaa

SEQ ID NO: 419303 - RNA, 24 nt, Human
gccuguugugcccuacucgccucu

SEQ ID NO: 419304 - RNA, 23 nt, Human
ggguugguuucuucugaggcccu

SEQ ID NO: 419305 - RNA, 19 nt, Human
gguuucuucugaggcccuc

SEQ ID NO: 419306 - RNA, 24 nt, Human
uaaaaaacuaaaagagcaaacaaa

SEQ ID NO: 419307 - RNA, 18 nt, Human
uaaaagagcaaacaaaca

SEQ ID NO: 419308 - RNA, 24 nt, Human
uaaaagagcaaacaaacaaaguca

SEQ ID NO: 419309 - RNA, 23 nt, Human
uaagagugucuauuggagucuug

SEQ ID NO: 419310 - RNA, 21 nt, Human
uacagagaauugcucugagga

SEQ ID NO: 419311 - RNA, 20 nt, Human
uacuagaggauaauauuaac

SEQ ID NO: 419312 - RNA, 22 nt, Human
uagaaaacaguaguggugggga

SEQ ID NO: 419313 - RNA, 22 nt, Human
uaggaaaaacaucugccacaaa

SEQ ID NO: 419314 - RNA, 23 nt, Human
uauaauaaaagugguaacaagaa

SEQ ID NO: 419315 - RNA, 21 nt, Human
uauauuaucuggugugugugu

SEQ ID NO: 419316 - RNA, 22 nt, Human
uauuuuaccucuuuaaagaccc

SEQ ID NO: 419317 - RNA, 18 nt, Human
ucagcagagcugaauaag

SEQ ID NO: 419318 - RNA, 26 nt, Human
ucauccaucauuuuuuaaauuauccc

SEQ ID NO: 419319 - RNA, 20 nt, Human
uccucugugucuccuuaugg

SEQ ID NO: 419320 - RNA, 20 nt, Human
ucucugguuuucuaauucca

SEQ ID NO: 419321 - RNA, 23 nt, Human
ucucugguuuucuaauuccagag

SEQ ID NO: 419322 - RNA, 22 nt, Human
ucugguuuucuaauuccagagg

SEQ ID NO: 419323 - RNA, 20 nt, Human
ucuuucuuuucucauccauc

SEQ ID NO: 419324 - RNA, 18 nt, Human
ugcacagugcauggcugu

SEQ ID NO: 419325 - RNA, 19 nt, Human
ugcagaagggcaugcuuug

SEQ ID NO: 419326 - RNA, 19 nt, Human
ugccuaacaaaguaccaug

SEQ ID NO: 419327 - RNA, 27 nt, Human
ugccuugcucuccugugcagaagggca

SEQ ID NO: 419328 - RNA, 21 nt, Human
ugcucugaggauuccuguuuc

SEQ ID NO: 419329 - RNA, 21 nt, Human
uggaaauuuucagcagagcug

SEQ ID NO: 419330 - RNA, 21 nt, Human
uguguaaugucaagagauucu

SEQ ID NO: 419331 - RNA, 21 nt, Human
uguguguguguuugucuaaau

SEQ ID NO: 419332 - RNA, 24 nt, Human
uguuugucuaaauaaagagaaacu

SEQ ID NO: 419333 - RNA, 25 nt, Human
uuacauugaaauuauaugagaauac

SEQ ID NO: 419334 - RNA, 21 nt, Human
uugaaauuauaugagaauaca

SEQ ID NO: 419335 - RNA, 23 nt, Human
uuggaaauuuucagcagagcuga

SEQ ID NO: 419336 - RNA, 18 nt, Human
aaacuugggaagccgaua

SEQ ID NO: 419337 - RNA, 22 nt, Human
aagcaaaugaggcuggagcugg

SEQ ID NO: 419338 - RNA, 24 nt, Human
acuggucuauacuacugaaauagc

SEQ ID NO: 419339 - RNA, 23 nt, Human
auagucuuuaaugucaaagggaa

SEQ ID NO: 419340 - RNA, 23 nt, Human
caagcauaugaugcagaagcuga

SEQ ID NO: 419341 - RNA, 23 nt, Human
cacaaagucucaagcaaaugagg

SEQ ID NO: 419342 - RNA, 19 nt, Human
cacccaggcucuuuccauu

SEQ ID NO: 419343 - RNA, 24 nt, Human
cagcugcuuuccuuuccaaggccu

SEQ ID NO: 419344 - RNA, 23 nt, Human
cauuacuauucucuucaagggcc

SEQ ID NO: 419345 - RNA, 23 nt, Human
ccacacugcaacauuucagagua

SEQ ID NO: 419346 - RNA, 18 nt, Human
ccauacauacaagucccc

SEQ ID NO: 419347 - RNA, 18 nt, Human
cccaaacacccaggcucu

SEQ ID NO: 419348 - RNA, 24 nt, Human
cccauacacacaaagucucaagca

SEQ ID NO: 419349 - RNA, 25 nt, Human
ccccauacacacaaagucucaagca

SEQ ID NO: 419350 - RNA, 19 nt, Human
ccgauaaacacauucagcc

SEQ ID NO: 419351 - RNA, 27 nt, Human
ccucuggaucucagcugcuuuccuuuc

SEQ ID NO: 419352 - RNA, 18 nt, Human
cgauaaacacauucagcc

SEQ ID NO: 419353 - RNA, 27 nt, Human
cucacucccauacauacaaguccccca

SEQ ID NO: 419354 - RNA, 22 nt, Human
cucccauacauacaaguccccc

SEQ ID NO: 419355 - RNA, 20 nt, Human
gcccugaaacuccucacucc

SEQ ID NO: 419356 - RNA, 22 nt, Human
gcccugaaacuccucacucccu

SEQ ID NO: 419357 - RNA, 22 nt, Human
ggcacagcuauguuugcaaugg

SEQ ID NO: 419358 - RNA, 23 nt, Human
guagccaaaaaaauggacaacau

SEQ ID NO: 419359 - RNA, 22 nt, Human
uagccaaaaaaauggacaacau

SEQ ID NO: 419360 - RNA, 21 nt, Human
uauguuugcaauggcccugaa

SEQ ID NO: 419361 - RNA, 22 nt, Human
uccacacugcaacauuucagag

SEQ ID NO: 419362 - RNA, 21 nt, Human
ucccauacauacaaguccccc

SEQ ID NO: 419363 - RNA, 23 nt, Human
ucccaucauuacuauucucuuca

SEQ ID NO: 419364 - RNA, 19 nt, Human
ucccccauacacacaaagu

SEQ ID NO: 419365 - RNA, 24 nt, Human
ucccccauacacacaaagucucaa

SEQ ID NO: 419366 - RNA, 18 nt, Human
uccucuggaucucagcug

SEQ ID NO: 419367 - RNA, 22 nt, Human
uuaggacucacuggucuauacu

SEQ ID NO: 419368 - RNA, 19 nt, Human
uucagaguagccaaaaaaa

SEQ ID NO: 419369 - RNA, 18 nt, Human
uuccaaggccugugcucc

SEQ ID NO: 419370 - RNA, 24 nt, Human
uugaugagaaaaaauauuuaggac

SEQ ID NO: 419371 - RNA, 18 nt, Human
uuuuuuuuuuuuuuuuug

SEQ ID NO: 419372 - RNA, 27 nt, Human
uuuuuuuuuuuuuuuuuuuuuuugggg

SEQ ID NO: 419373 - RNA, 19 nt, Human
aaucaaacaccacaucagu

SEQ ID NO: 419374 - RNA, 20 nt, Human
cacuggcauugcauggcuuc

SEQ ID NO: 419375 - RNA, 18 nt, Human
ccaucagggggacacuga

SEQ ID NO: 419376 - RNA, 30 nt, Human
cuuaugguagcgugccaacaguuuucccuu

SEQ ID NO: 419377 - RNA, 19 nt, Human
cuuguccccaauauuagcc

SEQ ID NO: 419378 - RNA, 24 nt, Human
uagcgugccaacaguuuucccuga

SEQ ID NO: 419379 - RNA, 20 nt, Human
uauugguaacggccaucagg

SEQ ID NO: 419380 - RNA, 27 nt, Human
uauuuuagugauuuaucacucagcuag

SEQ ID NO: 419381 - RNA, 21 nt, Human
ucaaacaccacaucaguguug

SEQ ID NO: 419382 - RNA, 22 nt, Human
ucacuggcauugcauggcuucc

SEQ ID NO: 419383 - RNA, 22 nt, Human
ucagauucuuacguuuuguuuc

SEQ ID NO: 419384 - RNA, 21 nt, Human
ucccagaaguagggcuuccuu

SEQ ID NO: 419385 - RNA, 19 nt, Human
ucucuuuuuuuucuuccuu

SEQ ID NO: 419386 - RNA, 20 nt, Human
ugaaaaacaaacucagauuc

SEQ ID NO: 419387 - RNA, 23 nt, Human
ugaaaaacaaacucagauucuua

SEQ ID NO: 419388 - RNA, 20 nt, Human
uuagccaggcuaauccuaaa

SEQ ID NO: 419389 - RNA, 25 nt, Human
uugccgaaucuaauucaauagacau

SEQ ID NO: 419390 - RNA, 23 nt, Human
uuucuuagccaggcuaauccuaa

SEQ ID NO: 419391 - RNA, 20 nt, Human
uuuuuuuuuuuuuugcuuuu

SEQ ID NO: 419392 - RNA, 24 nt, Human
uuuuuuuuuuuuuuuuuugcuuuu

SEQ ID NO: 419393 - RNA, 21 nt, Human
uuuuuuuuuuuuuuuuuuugg

SEQ ID NO: 419394 - RNA, 21 nt, Human
acagcaacacugcaggaccag

SEQ ID NO: 419395 - RNA, 20 nt, Human
cagacaugcagagcucugac

SEQ ID NO: 419396 - RNA, 23 nt, Human
cucuuccaugacagucucuccaa

SEQ ID NO: 419397 - RNA, 25 nt, Human
ggagaugcugaguggcucagccucc

SEQ ID NO: 419398 - RNA, 20 nt, Human
ggugcagacaugcagagcuc

SEQ ID NO: 419399 - RNA, 24 nt, Human
ucgggcggcggcuccacccucuuc

SEQ ID NO: 419400 - RNA, 19 nt, Human
ugccucugcugucuucagu

SEQ ID NO: 419401 - RNA, 20 nt, Human
acccaucucacaccccaccc

SEQ ID NO: 419402 - RNA, 22 nt, Human
aggcacccaucucacaccccac

SEQ ID NO: 419403 - RNA, 27 nt, Human
aggcaggcaaguagaaguucugcaagg

SEQ ID NO: 419404 - RNA, 20 nt, Human
aggcagggaggcaggcaagu

SEQ ID NO: 419405 - RNA, 18 nt, Human
agggaggcaggcaaguag

SEQ ID NO: 419406 - RNA, 22 nt, Human
caggggcagaaaugggaggcag

SEQ ID NO: 419407 - RNA, 27 nt, Human
caggggcagaaaugggaggcagagggg

SEQ ID NO: 419408 - RNA, 20 nt, Human
ggacccaaggucaggggcag

SEQ ID NO: 419409 - RNA, 24 nt, Human
gggaggcacccaucucacacccca

SEQ ID NO: 419410 - RNA, 20 nt, Human
ugggaggcagaggggaggca

SEQ ID NO: 419411 - RNA, 21 nt, Human
aaaaaaaggcagcuuaacaaa

SEQ ID NO: 419412 - RNA, 18 nt, Human
aaaaggcagcuuaacaaa

SEQ ID NO: 419413 - RNA, 19 nt, Human
aaaauuacaaauaccagcc

SEQ ID NO: 419414 - RNA, 23 nt, Human
aaacaaauguaguucucaaaaau

SEQ ID NO: 419415 - RNA, 23 nt, Human
aaacaugaaauuacccagaucua

SEQ ID NO: 419416 - RNA, 21 nt, Human
aaaucucugcaggacacaaga

SEQ ID NO: 419417 - RNA, 23 nt, Human
aaaugaccaugaaaauauuuggc

SEQ ID NO: 419418 - RNA, 20 nt, Human
aagucaacuccacauugcag

SEQ ID NO: 419419 - RNA, 18 nt, Human
aaucuucuuuuuuagaga

SEQ ID NO: 419420 - RNA, 19 nt, Human
acuacaugcaaaugaccau

SEQ ID NO: 419421 - RNA, 19 nt, Human
acucccagccccggcuccc

SEQ ID NO: 419422 - RNA, 24 nt, Human
agaaagaaagcaaaauuacaaaua

SEQ ID NO: 419423 - RNA, 21 nt, Human
aggcacuuacaugaaggaaaa

SEQ ID NO: 419424 - RNA, 18 nt, Human
aguuuccauacagcaggu

SEQ ID NO: 419425 - RNA, 24 nt, Human
auaauauuugcauacacauggcaa

SEQ ID NO: 419426 - RNA, 19 nt, Human
aucaugguugcacaauuug

SEQ ID NO: 419427 - RNA, 23 nt, Human
auucauagcacagaagaccucaa

SEQ ID NO: 419428 - RNA, 23 nt, Human
caaaaaaaagaaggccauaauga

SEQ ID NO: 419429 - RNA, 25 nt, Human
caaaaaaaagaaggccauaaugacc

SEQ ID NO: 419430 - RNA, 22 nt, Human
caaaaagauuccuuaaauugaa

SEQ ID NO: 419431 - RNA, 19 nt, Human
caaaaauauugagaugcca

SEQ ID NO: 419432 - RNA, 23 nt, Human
caagcuaagucaacuccacauug

SEQ ID NO: 419433 - RNA, 18 nt, Human
cacaacgguacuacugga

SEQ ID NO: 419434 - RNA, 21 nt, Human
cacauugcagaaaacacacaa

SEQ ID NO: 419435 - RNA, 21 nt, Human
cacuccucuucccucaggaga

SEQ ID NO: 419436 - RNA, 22 nt, Human
cagcugcaaccaucuuuaaccu

SEQ ID NO: 419437 - RNA, 26 nt, Human
cagcuuaacaaaguuccaguguuuca

SEQ ID NO: 419438 - RNA, 23 nt, Human
ccaucccaaaauuuuccccugaa

SEQ ID NO: 419439 - RNA, 18 nt, Human
cccagccccggcucccuc

SEQ ID NO: 419440 - RNA, 19 nt, Human
ccccccuacuccacuccuc

SEQ ID NO: 419441 - RNA, 20 nt, Human
cccuacuccacuccucuucc

SEQ ID NO: 419442 - RNA, 21 nt, Human
ccgcccccuccagcugcaacc

SEQ ID NO: 419443 - RNA, 21 nt, Human
cguccccccuacuccacuccu

SEQ ID NO: 419444 - RNA, 22 nt, Human
cuacuccacuccucuucccuca

SEQ ID NO: 419445 - RNA, 25 nt, Human
cucaaacacauauguuaaaaacaaa

SEQ ID NO: 419446 - RNA, 21 nt, Human
cuccacauugcagaaaacaca

SEQ ID NO: 419447 - RNA, 27 nt, Human
gaaaagaaaaugaauguaugaagaaaa

SEQ ID NO: 419448 - RNA, 22 nt, Human
gaaauuacccagaucuagauaa

SEQ ID NO: 419449 - RNA, 21 nt, Human
gaacagaugcuccagcacaug

SEQ ID NO: 419450 - RNA, 21 nt, Human
gacuuaaaacaaaugacuuga

SEQ ID NO: 419451 - RNA, 21 nt, Human
gagguaaucauuagccugaaa

SEQ ID NO: 419452 - RNA, 18 nt, Human
gcaaaugaccaugaaaau

SEQ ID NO: 419453 - RNA, 23 nt, Human
gcuccagcacauggugguacaug

SEQ ID NO: 419454 - RNA, 21 nt, Human
gcugcaaccaucuuuaaccug

SEQ ID NO: 419455 - RNA, 24 nt, Human
ggauaaaauucuggaagccaugga

SEQ ID NO: 419456 - RNA, 20 nt, Human
uaaaauucuggaagccaugg

SEQ ID NO: 419457 - RNA, 19 nt, Human
uaacuagccaaaguucgag

SEQ ID NO: 419458 - RNA, 21 nt, Human
uaauaaacaugaaauuaccca

SEQ ID NO: 419459 - RNA, 18 nt, Human
uacauggacccuuuugcc

SEQ ID NO: 419460 - RNA, 24 nt, Human
uaugcuuuucucaaacacauaugu

SEQ ID NO: 419461 - RNA, 24 nt, Human
ucaaaaucucuuugaauauuuucu

SEQ ID NO: 419462 - RNA, 26 nt, Human
ucaacgccgccgccgcguccccccua

SEQ ID NO: 419463 - RNA, 20 nt, Human
uccacauguagaacagaugc

SEQ ID NO: 419464 - RNA, 19 nt, Human
uccagcugcaaccaucuuu

SEQ ID NO: 419465 - RNA, 20 nt, Human
ucccaaaauuuuccccugaa

SEQ ID NO: 419466 - RNA, 22 nt, Human
ucccagccccggcucccuccgc

SEQ ID NO: 419467 - RNA, 18 nt, Human
ucccucaggagaacuccc

SEQ ID NO: 419468 - RNA, 24 nt, Human
ucccucaggagaacucccagcccc

SEQ ID NO: 419469 - RNA, 19 nt, Human
ucccuuggggaaagaaauc

SEQ ID NO: 419470 - RNA, 22 nt, Human
uccugagucccccaucccaaaa

SEQ ID NO: 419471 - RNA, 19 nt, Human
ugaauaggcacuuacauga

SEQ ID NO: 419472 - RNA, 19 nt, Human
ugacaagacuugcacugaa

SEQ ID NO: 419473 - RNA, 22 nt, Human
ugacaagacuugcacugaagug

SEQ ID NO: 419474 - RNA, 20 nt, Human
ugaccugccacauaaucccu

SEQ ID NO: 419475 - RNA, 19 nt, Human
ugagaugccauguuuuaaa

SEQ ID NO: 419476 - RNA, 23 nt, Human
ugagucccccaucccaaaauuuu

SEQ ID NO: 419477 - RNA, 19 nt, Human
ugcaggacacaagaggcca

SEQ ID NO: 419478 - RNA, 21 nt, Human
ugcauacacauggcaaaaaga

SEQ ID NO: 419479 - RNA, 22 nt, Human
uggccaaaaaaaagaaggccau

SEQ ID NO: 419480 - RNA, 21 nt, Human
uggccaaaaaaaagaaggccc

SEQ ID NO: 419481 - RNA, 23 nt, Human
uuaaaaauguauauacaugaacg

SEQ ID NO: 419482 - RNA, 20 nt, Human
uuaaagaaauguaauuuggg

SEQ ID NO: 419483 - RNA, 24 nt, Human
uuaauaaacaugaaauuacccaga

SEQ ID NO: 419484 - RNA, 24 nt, Human
uucauguuuacgcugauauauauc

SEQ ID NO: 419485 - RNA, 20 nt, Human
uuccaguguuucaaagaaaa

SEQ ID NO: 419486 - RNA, 23 nt, Human
uuggccuuuuuccgcccccucca

SEQ ID NO: 419487 - RNA, 20 nt, Human
uuucauguuuacgcugauau

SEQ ID NO: 419488 - RNA, 18 nt, Human
aaaaaagccaaacccaga

SEQ ID NO: 419489 - RNA, 24 nt, Human
aaaaaagccaaacccagaaugcaa

SEQ ID NO: 419490 - RNA, 25 nt, Human
aaaaaagccaaacccagaaugcaag

SEQ ID NO: 419491 - RNA, 21 nt, Human
aaaacuagcaguguagcagaa

SEQ ID NO: 419492 - RNA, 25 nt, Human
aaaagaaaaaacaauuggguaagaa

SEQ ID NO: 419493 - RNA, 21 nt, Human
aaaauauucacuauggacccc

SEQ ID NO: 419494 - RNA, 21 nt, Human
aaacaaauaaauaacaaaaua

SEQ ID NO: 419495 - RNA, 22 nt, Human
aaagaaugagccaaacaaauaa

SEQ ID NO: 419496 - RNA, 24 nt, Human
aaagcccugggauuacgggcguga

SEQ ID NO: 419497 - RNA, 22 nt, Human
aaagccuuucauacuucagcuu

SEQ ID NO: 419498 - RNA, 20 nt, Human
aacaugugauuaguaaacau

SEQ ID NO: 419499 - RNA, 18 nt, Human
aaccauaguugaugacac

SEQ ID NO: 419500 - RNA, 28 nt, Human
aagaaaaaacaauuggguaagaacaaaa

SEQ ID NO: 419501 - RNA, 23 nt, Human
aagcaaaaugacuucacugaaau

SEQ ID NO: 419502 - RNA, 23 nt, Human
aagccaaacccagaaugcaagaa

SEQ ID NO: 419503 - RNA, 21 nt, Human
aagcgcucagacucgaaggug

SEQ ID NO: 419504 - RNA, 18 nt, Human
aaguauuugugacuaaca

SEQ ID NO: 419505 - RNA, 18 nt, Human
aaguugcagguagcagcu

SEQ ID NO: 419506 - RNA, 23 nt, Human
aauauucacuauggaccccaaaa

SEQ ID NO: 419507 - RNA, 21 nt, Human
aaugagugacaauuuguacaa

SEQ ID NO: 419508 - RNA, 21 nt, Human
aaugccuauuuagaggauaac

SEQ ID NO: 419509 - RNA, 21 nt, Human
acacagaaaaaagccaaaccc

SEQ ID NO: 419510 - RNA, 20 nt, Human
acagaaaaaagccaaaccca

SEQ ID NO: 419511 - RNA, 21 nt, Human
acagaaaaaagccaaacccag

SEQ ID NO: 419512 - RNA, 22 nt, Human
acagaaaaaagccaaacccaga

SEQ ID NO: 419513 - RNA, 18 nt, Human
acaggaauagaugaagaa

SEQ ID NO: 419514 - RNA, 20 nt, Human
accucugugaccucaacaac

SEQ ID NO: 419515 - RNA, 18 nt, Human
acuagcacccuguccuuu

SEQ ID NO: 419516 - RNA, 26 nt, Human
acugaaucuguaaauugguaauguug

SEQ ID NO: 419517 - RNA, 24 nt, Human
agaaaaaagccaaacccagaaugc

SEQ ID NO: 419518 - RNA, 22 nt, Human
agaaaagacauucuaaggaacg

SEQ ID NO: 419519 - RNA, 20 nt, Human
agaaucguagccagcagagc

SEQ ID NO: 419520 - RNA, 19 nt, Human
aggaacgaaagcuaguguu

SEQ ID NO: 419521 - RNA, 22 nt, Human
aggcaagaggaaacaucauuag

SEQ ID NO: 419522 - RNA, 23 nt, Human
aggugucaucaaaugagugacaa

SEQ ID NO: 419523 - RNA, 22 nt, Human
aguagagaugggguuucuccau

SEQ ID NO: 419524 - RNA, 23 nt, Human
aguagcugggauuacaggcaugu

SEQ ID NO: 419525 - RNA, 28 nt, Human
aguauaauauaaacauaaacaaaucucc

SEQ ID NO: 419526 - RNA, 21 nt, Human
agugcaauggcgcgaucucag

SEQ ID NO: 419527 - RNA, 22 nt, Human
aguguccgccauggccagauac

SEQ ID NO: 419528 - RNA, 22 nt, Human
auauucacuauggaccccaaaa

SEQ ID NO: 419529 - RNA, 20 nt, Human
augggguuucuccauguugg

SEQ ID NO: 419530 - RNA, 24 nt, Human
augggguuucuccauguuggucag

SEQ ID NO: 419531 - RNA, 22 nt, Human
auggugcaggacaucagccugc

SEQ ID NO: 419532 - RNA, 25 nt, Human
caaaaacagucucaaaaagaguggu

SEQ ID NO: 419533 - RNA, 26 nt, Human
caaaaacagucucaaaaagaguggug

SEQ ID NO: 419534 - RNA, 24 nt, Human
caaagcccugggauuacgggcgug

SEQ ID NO: 419535 - RNA, 21 nt, Human
caacaucucuacauuuugcuu

SEQ ID NO: 419536 - RNA, 22 nt, Human
caagugauucuccugccucagc

SEQ ID NO: 419537 - RNA, 20 nt, Human
cacacagaacaugugauuag

SEQ ID NO: 419538 - RNA, 19 nt, Human
cacagaaaaaagccaaacc

SEQ ID NO: 419539 - RNA, 20 nt, Human
cacagaaaaaagccaaaccc

SEQ ID NO: 419540 - RNA, 23 nt, Human
cacagaaaaaagccaaacccaga

SEQ ID NO: 419541 - RNA, 21 nt, Human
caccacaaccuacgucuccug

SEQ ID NO: 419542 - RNA, 20 nt, Human
cacccuguccuuuccccaaa

SEQ ID NO: 419543 - RNA, 24 nt, Human
cacccuguccuuuccccaaaaaga

SEQ ID NO: 419544 - RNA, 20 nt, Human
cagccuccugaguagcuggg

SEQ ID NO: 419545 - RNA, 18 nt, Human
caggugauccaccugcca

SEQ ID NO: 419546 - RNA, 22 nt, Human
cagucaccucugugaccucaac

SEQ ID NO: 419547 - RNA, 19 nt, Human
caguuuucagggucacugg

SEQ ID NO: 419548 - RNA, 23 nt, Human
ccaaacaaauaaauaacaaaaua

SEQ ID NO: 419549 - RNA, 22 nt, Human
ccaaagcccugggauuacgggc

SEQ ID NO: 419550 - RNA, 24 nt, Human
ccaaagcccugggauuacgggcgu

SEQ ID NO: 419551 - RNA, 19 nt, Human
ccauguuggucaggcuggu

SEQ ID NO: 419552 - RNA, 22 nt, Human
ccauguuggucaggcuggucuc

SEQ ID NO: 419553 - RNA, 23 nt, Human
ccauguuggucaggcuggucucg

SEQ ID NO: 419554 - RNA, 23 nt, Human
ccugaguagcugggauuacaggc

SEQ ID NO: 419555 - RNA, 24 nt, Human
ccugaguagcugggauuacaggca

SEQ ID NO: 419556 - RNA, 23 nt, Human
ccugccucagccuccugaguagc

SEQ ID NO: 419557 - RNA, 24 nt, Human
ccugccucagccuccugaguagcu

SEQ ID NO: 419558 - RNA, 18 nt, Human
ccuguccuuuccccaaaa

SEQ ID NO: 419559 - RNA, 21 nt, Human
ccuucugaaguauuucaguua

SEQ ID NO: 419560 - RNA, 20 nt, Human
cgaucucaggugauccaccu

SEQ ID NO: 419561 - RNA, 25 nt, Human
cuagguuuaucagaucuucuuccug

SEQ ID NO: 419562 - RNA, 27 nt, Human
cucacuagcacccuguccuuuccccaa

SEQ ID NO: 419563 - RNA, 24 nt, Human
cucagccuccugaguagcugggau

SEQ ID NO: 419564 - RNA, 23 nt, Human
cuccuggggucaagugauucucc

SEQ ID NO: 419565 - RNA, 23 nt, Human
cucuuaacagcacgagugucaac

SEQ ID NO: 419566 - RNA, 23 nt, Human
cugaaaacuagcaguguagcaga

SEQ ID NO: 419567 - RNA, 26 nt, Human
cugaaauuagcaaauccuauugauga

SEQ ID NO: 419568 - RNA, 23 nt, Human
cugaguagcugggauuacaggca

SEQ ID NO: 419569 - RNA, 24 nt, Human
cugaguagcugggauuacaggcau

SEQ ID NO: 419570 - RNA, 18 nt, Human
cugcuccugaggcacccu

SEQ ID NO: 419571 - RNA, 25 nt, Human
cugcuccugaggcacccucaguuuu

SEQ ID NO: 419572 - RNA, 24 nt, Human
cuuguugcccaggcuggagugcaa

SEQ ID NO: 419573 - RNA, 23 nt, Human
gaaaaaacaauuggguaagaaca

SEQ ID NO: 419574 - RNA, 21 nt, Human
gaacaaaacugaaaacuagca

SEQ ID NO: 419575 - RNA, 23 nt, Human
gaagagagccccaaauucucugu

SEQ ID NO: 419576 - RNA, 21 nt, Human
gaauuuuccaguguguuacag

SEQ ID NO: 419577 - RNA, 22 nt, Human
gaccccaaaauuucaaggcaug

SEQ ID NO: 419578 - RNA, 24 nt, Human
gagaugggguuucuccauguuggu

SEQ ID NO: 419579 - RNA, 25 nt, Human
gaggauaaccauaguugaugacacc

SEQ ID NO: 419580 - RNA, 22 nt, Human
gaguagcugggauuacaggcau

SEQ ID NO: 419581 - RNA, 25 nt, Human
gaguagcugggauuacaggcaugua

SEQ ID NO: 419582 - RNA, 19 nt, Human
gaguguccgccauggccag

SEQ ID NO: 419583 - RNA, 18 nt, Human
gaucucaggugauccacc

SEQ ID NO: 419584 - RNA, 22 nt, Human
gaucucaggugauccaccugcc

SEQ ID NO: 419585 - RNA, 18 nt, Human
gauuacgggcgugagcca

SEQ ID NO: 419586 - RNA, 21 nt, Human
gauuacgggcgugagccacca

SEQ ID NO: 419587 - RNA, 22 nt, Human
gauuacgggcgugagccaccau

SEQ ID NO: 419588 - RNA, 21 nt, Human
gauucuccugccucagccucc

SEQ ID NO: 419589 - RNA, 19 nt, Human
gcaugaagagagccccaaa

SEQ ID NO: 419590 - RNA, 21 nt, Human
gccacgggagagucaccugac

SEQ ID NO: 419591 - RNA, 19 nt, Human
gcccaggcuggagugcaau

SEQ ID NO: 419592 - RNA, 20 nt, Human
gcgaucucaggugauccacc

SEQ ID NO: 419593 - RNA, 19 nt, Human
gcgugagccaccaugcccg

SEQ ID NO: 419594 - RNA, 24 nt, Human
gcuaauuuguguuuuuaguagaga

SEQ ID NO: 419595 - RNA, 20 nt, Human
gcucuuguugcccaggcugg

SEQ ID NO: 419596 - RNA, 21 nt, Human
gcucuuguugcccaggcugga

SEQ ID NO: 419597 - RNA, 24 nt, Human
gcucuuguugcccaggcuggagug

SEQ ID NO: 419598 - RNA, 19 nt, Human
gcuggagugcaauggcgcg

SEQ ID NO: 419599 - RNA, 24 nt, Human
ggauuacgggcgugagccaccaug

SEQ ID NO: 419600 - RNA, 18 nt, Human
ggcaauggaggcaccaga

SEQ ID NO: 419601 - RNA, 26 nt, Human
ggcaauggaggcaccagagaaggcaa

SEQ ID NO: 419602 - RNA, 23 nt, Human
ggcaccagagaaggcaagaggaa

SEQ ID NO: 419603 - RNA, 21 nt, Human
gggaauggcugggugacuucg

SEQ ID NO: 419604 - RNA, 18 nt, Human
gggcaauggaggcaccag

SEQ ID NO: 419605 - RNA, 22 nt, Human
gggguuucuccauguuggucag

SEQ ID NO: 419606 - RNA, 22 nt, Human
gggucaagugauucuccugccu

SEQ ID NO: 419607 - RNA, 27 nt, Human
ggugacaaggagacugacaaggagaaa

SEQ ID NO: 419608 - RNA, 20 nt, Human
ggugcaggacaucagccugc

SEQ ID NO: 419609 - RNA, 20 nt, Human
guagcugggauuacaggcau

SEQ ID NO: 419610 - RNA, 26 nt, Human
guauuugugacuaacaacaacaaaaa

SEQ ID NO: 419611 - RNA, 23 nt, Human
gucaagugauucuccugccucag

SEQ ID NO: 419612 - RNA, 24 nt, Human
gucccacugcuccugaggcacccu

SEQ ID NO: 419613 - RNA, 24 nt, Human
gugauccaccugccaaggccuccc

SEQ ID NO: 419614 - RNA, 23 nt, Human
gugauucuccugccucagccucc

SEQ ID NO: 419615 - RNA, 19 nt, Human
guggugacaaggagacuga

SEQ ID NO: 419616 - RNA, 21 nt, Human
guuugacuuuucucccucuau

SEQ ID NO: 419617 - RNA, 18 nt, Human
uaaaugccuauuuagagg

SEQ ID NO: 419618 - RNA, 19 nt, Human
uaacaaaauauucacuaug

SEQ ID NO: 419619 - RNA, 20 nt, Human
uaaggaaaugcugagaaggc

SEQ ID NO: 419620 - RNA, 22 nt, Human
uaaggaaaugcugagaaggcug

SEQ ID NO: 419621 - RNA, 24 nt, Human
uaauuuguguuuuuaguagagaug

SEQ ID NO: 419622 - RNA, 22 nt, Human
uacaggcauguaccaccacgcc

SEQ ID NO: 419623 - RNA, 22 nt, Human
uaccaccacgccuggcuaauuu

SEQ ID NO: 419624 - RNA, 24 nt, Human
uacgggcgugagccaccaugcccg

SEQ ID NO: 419625 - RNA, 23 nt, Human
uagcaguguagcagaaagcacac

SEQ ID NO: 419626 - RNA, 24 nt, Human
uagccagcagagcacguggaaaca

SEQ ID NO: 419627 - RNA, 24 nt, Human
uaguagagaugggguuucuccaug

SEQ ID NO: 419628 - RNA, 19 nt, Human
ucaagugauucuccugccu

SEQ ID NO: 419629 - RNA, 24 nt, Human
ucaccacaaccuacgucuccuggg

SEQ ID NO: 419630 - RNA, 21 nt, Human
ucacugguuuccucccuccug

SEQ ID NO: 419631 - RNA, 20 nt, Human
ucagccuccugaguagcugg

SEQ ID NO: 419632 - RNA, 19 nt, Human
uccaugagggcaauggagg

SEQ ID NO: 419633 - RNA, 24 nt, Human
ucccaaagcccugggauuacgggc

SEQ ID NO: 419634 - RNA, 23 nt, Human
uccccaaaaagaaagaagcagaa

SEQ ID NO: 419635 - RNA, 24 nt, Human
uccugaguagcugggauuacaggc

SEQ ID NO: 419636 - RNA, 24 nt, Human
uccuggggucaagugauucuccug

SEQ ID NO: 419637 - RNA, 18 nt, Human
ucguagccagcagagcac

SEQ ID NO: 419638 - RNA, 24 nt, Human
ucuaaugugaagauauguucugug

SEQ ID NO: 419639 - RNA, 24 nt, Human
ucuccugccucagccuccugagua

SEQ ID NO: 419640 - RNA, 21 nt, Human
ucuccuggggucaagugauuc

SEQ ID NO: 419641 - RNA, 21 nt, Human
ucucugugaacugcaaagaga

SEQ ID NO: 419642 - RNA, 22 nt, Human
ucuuguugcccaggcuggagug

SEQ ID NO: 419643 - RNA, 24 nt, Human
ugaagagagccccaaauucucugu

SEQ ID NO: 419644 - RNA, 21 nt, Human
ugacacagaaaaaagccaaac

SEQ ID NO: 419645 - RNA, 22 nt, Human
ugacacagaaaaaagccaaacc

SEQ ID NO: 419646 - RNA, 23 nt, Human
ugacacagaaaaaagccaaaccc

SEQ ID NO: 419647 - RNA, 23 nt, Human
ugaccucaacaacaucucuacau

SEQ ID NO: 419648 - RNA, 18 nt, Human
ugacuucgguagcuggca

SEQ ID NO: 419649 - RNA, 21 nt, Human
ugagaaggcugagggguacau

SEQ ID NO: 419650 - RNA, 24 nt, Human
ugaguauaauauaaacauaaacaa

SEQ ID NO: 419651 - RNA, 30 nt, Human
ugaguauaauauaaacauaaacaaaucucc

SEQ ID NO: 419652 - RNA, 22 nt, Human
ugaugacacagaaaaaagccaa

SEQ ID NO: 419653 - RNA, 20 nt, Human
ugauucuccugccucagccu

SEQ ID NO: 419654 - RNA, 19 nt, Human
ugcaaagagaaaccauuag

SEQ ID NO: 419655 - RNA, 18 nt, Human
ugcccaggcuggagugca

SEQ ID NO: 419656 - RNA, 21 nt, Human
ugcccaggcuggagugcaaug

SEQ ID NO: 419657 - RNA, 21 nt, Human
ugcccaggcuggagugcaaug

SEQ ID NO: 419658 - RNA, 24 nt, Human
ugcccaggcuggagugcaauggcg

SEQ ID NO: 419659 - RNA, 24 nt, Human
ugccucagccuccugaguagcugg

SEQ ID NO: 419660 - RNA, 24 nt, Human
ugcucuuguugcccaggcuggagu

SEQ ID NO: 419661 - RNA, 23 nt, Human
ugcugucaguacucacuagcacc

SEQ ID NO: 419662 - RNA, 24 nt, Human
uggaccccaaaauuucaaggcaug

SEQ ID NO: 419663 - RNA, 18 nt, Human
uggaggcaccagagaagg

SEQ ID NO: 419664 - RNA, 23 nt, Human
uggagugcaauggcgcgaucuca

SEQ ID NO: 419665 - RNA, 24 nt, Human
uggagugcaauggcgcgaucucag

SEQ ID NO: 419666 - RNA, 24 nt, Human
uggcgcgaucucagcucaccacaa

SEQ ID NO: 419667 - RNA, 21 nt, Human
ugggauuacaggcauguacca

SEQ ID NO: 419668 - RNA, 24 nt, Human
ugggauuacaggcauguaccacca

SEQ ID NO: 419669 - RNA, 18 nt, Human
ugggauuacgggcgugag

SEQ ID NO: 419670 - RNA, 22 nt, Human
ugggauuacgggcgugagccac

SEQ ID NO: 419671 - RNA, 23 nt, Human
ugggauuacgggcgugagccacc

SEQ ID NO: 419672 - RNA, 24 nt, Human
ugggauuacgggcgugagccacca

SEQ ID NO: 419673 - RNA, 25 nt, Human
ugggauuacgggcgugagccaccau

SEQ ID NO: 419674 - RNA, 23 nt, Human
uggggucaagugauucuccugcc

SEQ ID NO: 419675 - RNA, 24 nt, Human
ugggguuucuccauguuggucagg

SEQ ID NO: 419676 - RNA, 22 nt, Human
uggguaagaacaaaacugaaaa

SEQ ID NO: 419677 - RNA, 22 nt, Human
uggucaggcuggucucgaacgu

SEQ ID NO: 419678 - RNA, 20 nt, Human
uguugcccaggcuggagugc

SEQ ID NO: 419679 - RNA, 18 nt, Human
uuaguagagaugggguuu

SEQ ID NO: 419680 - RNA, 24 nt, Human
uuaguagagaugggguuucuccau

SEQ ID NO: 419681 - RNA, 21 nt, Human
uuccuggcgacgcugugacaa

SEQ ID NO: 419682 - RNA, 18 nt, Human
uugcccaggcuggagugc

SEQ ID NO: 419683 - RNA, 23 nt, Human
uugcucuuguugcccaggcugga

SEQ ID NO: 419684 - RNA, 24 nt, Human
uuuaucuguaaaccuagguuuauc

SEQ ID NO: 419685 - RNA, 21 nt, Human
uuucuccauguuggucaggcu

SEQ ID NO: 419686 - RNA, 19 nt, Human
uuucucccucuaugauaug

SEQ ID NO: 419687 - RNA, 24 nt, Human
uuugcucuuguugcccaggcugga

SEQ ID NO: 419688 - RNA, 18 nt, Human
uuuguguuuuuaguagag

SEQ ID NO: 419689 - RNA, 19 nt, Human
uuuguguuuuuaguagaga

SEQ ID NO: 419690 - RNA, 24 nt, Human
uuuguguuuuuaguagagaugggg

SEQ ID NO: 419691 - RNA, 23 nt, Human
uuuuaugguuaaaugguuuuacu

SEQ ID NO: 419692 - RNA, 21 nt, Human
uuuucucccucuaugauaugc

SEQ ID NO: 419693 - RNA, 23 nt, Human
uuuugcucuuguugcccaggcug

SEQ ID NO: 419694 - RNA, 24 nt, Human
uuuugcucuuguugcccaggcugg

SEQ ID NO: 419695 - RNA, 22 nt, Human
uuuuuaguagagaugggguuuc

SEQ ID NO: 419696 - RNA, 23 nt, Human
aaaaaagucaaaagaaaacaaag

SEQ ID NO: 419697 - RNA, 21 nt, Human
aaaagaaaacaaagaaaagga

SEQ ID NO: 419698 - RNA, 25 nt, Human
aacagaaaaggagaaaaaagucaaa

SEQ ID NO: 419699 - RNA, 21 nt, Human
aagaaaaggaaaucugguuca

SEQ ID NO: 419700 - RNA, 22 nt, Human
accuaagccgcagacccgucgc

SEQ ID NO: 419701 - RNA, 32 nt, Human
acucugagaaauguacaaugauuagaaaaggg

SEQ ID NO: 419702 - RNA, 24 nt, Human
aggaaaucugguucacagcaucug

SEQ ID NO: 419703 - RNA, 21 nt, Human
aggagaaaaaagucaaaagaa

SEQ ID NO: 419704 - RNA, 22 nt, Human
auaaaacaguucuaacagaaaa

SEQ ID NO: 419705 - RNA, 23 nt, Human
auaacuuaaggaguauaaccuga

SEQ ID NO: 419706 - RNA, 25 nt, Human
caaaacaucacaaacacacggcuuu

SEQ ID NO: 419707 - RNA, 22 nt, Human
caaaagaaaacaaagaaaagga

SEQ ID NO: 419708 - RNA, 22 nt, Human
cagaaaaggagaaaaaagucaa

SEQ ID NO: 419709 - RNA, 20 nt, Human
ccaaaacaucacaaacacac

SEQ ID NO: 419710 - RNA, 20 nt, Human
cucacaggaaaauaaaacag

SEQ ID NO: 419711 - RNA, 21 nt, Human
cucgcaagacucacaggaaaa

SEQ ID NO: 419712 - RNA, 26 nt, Human
cuucccgccgcuuucgccgacucgua

SEQ ID NO: 419713 - RNA, 21 nt, Human
gaacacaugaguauuuaauca

SEQ ID NO: 419714 - RNA, 18 nt, Human
guacuccaaaacaucaca

SEQ ID NO: 419715 - RNA, 22 nt, Human
uaaaacaguucuaacagaaaag

SEQ ID NO: 419716 - RNA, 18 nt, Human
uaacagaaaaggagaaaa

SEQ ID NO: 419717 - RNA, 20 nt, Human
uacaaugauuagaaaagugc

SEQ ID NO: 419718 - RNA, 23 nt, Human
uacuccaaaacaucacaaacaca

SEQ ID NO: 419719 - RNA, 22 nt, Human
ucacaaacacacggcuuuggga

SEQ ID NO: 419720 - RNA, 24 nt, Human
ugagaaauguacaaugauuagaaa

SEQ ID NO: 419721 - RNA, 19 nt, Human
accugccuaacuucucucc

SEQ ID NO: 419722 - RNA, 20 nt, Human
accugccuaacuucucucca

SEQ ID NO: 419723 - RNA, 22 nt, Human
accuuaaaaaugucuggaagga

SEQ ID NO: 419724 - RNA, 25 nt, Human
accuuaaaaaugucuggaaggaaac

SEQ ID NO: 419725 - RNA, 20 nt, Human
agcacucgagccugcccucc

SEQ ID NO: 419726 - RNA, 25 nt, Human
aggaaacacugaaauaagaauacaa

SEQ ID NO: 419727 - RNA, 19 nt, Human
aggcggagcccccgggccu

SEQ ID NO: 419728 - RNA, 22 nt, Human
cauuucggugaagagcuggaaa

SEQ ID NO: 419729 - RNA, 18 nt, Human
ccagcacucgagccugcc

SEQ ID NO: 419730 - RNA, 23 nt, Human
cccagcacucgagccugcccucc

SEQ ID NO: 419731 - RNA, 23 nt, Human
cccccgggccuacagucccgcgg

SEQ ID NO: 419732 - RNA, 23 nt, Human
ccuacagucccgcggggaggcgg

SEQ ID NO: 419733 - RNA, 24 nt, Human
ccugccuaacuucucuccagcugc

SEQ ID NO: 419734 - RNA, 18 nt, Human
cgagccugcccucccuag

SEQ ID NO: 419735 - RNA, 18 nt, Human
gaagagcuggaaacuuaa

SEQ ID NO: 419736 - RNA, 21 nt, Human
gagcccccgggccuacagucc

SEQ ID NO: 419737 - RNA, 22 nt, Human
gagcccccgggccuacaguccc

SEQ ID NO: 419738 - RNA, 20 nt, Human
ucccuaggaccugccuaacu

SEQ ID NO: 419739 - RNA, 21 nt, Human
ucccuaggaccugccuaacuu

SEQ ID NO: 419740 - RNA, 21 nt, Human
ucuccagcugcgucggccucg

SEQ ID NO: 419741 - RNA, 21 nt, Human
aaaaggcaugcaaauguagua

SEQ ID NO: 419742 - RNA, 21 nt, Human
aaaucccucuuggaucgcgcc

SEQ ID NO: 419743 - RNA, 24 nt, Human
agcaauauuugugugugugugugu

SEQ ID NO: 419744 - RNA, 24 nt, Human
agcacauuucugcccaggcuuuuu

SEQ ID NO: 419745 - RNA, 20 nt, Human
aggaggguagugacauagcu

SEQ ID NO: 419746 - RNA, 22 nt, Human
aggcuuuggaggaagagggauu

SEQ ID NO: 419747 - RNA, 19 nt, Human
aguguuucaaacacaagaa

SEQ ID NO: 419748 - RNA, 23 nt, Human
caaaacagcucuuuccagaucga

SEQ ID NO: 419749 - RNA, 22 nt, Human
caaacagaaaccaauacacuuc

SEQ ID NO: 419750 - RNA, 20 nt, Human
caaacccaaaaggcaugcaa

SEQ ID NO: 419751 - RNA, 21 nt, Human
caagcccagccgcugccgcaa

SEQ ID NO: 419752 - RNA, 21 nt, Human
cacauaucacauuguggcagg

SEQ ID NO: 419753 - RNA, 19 nt, Human
cagaaaccaauacacuucc

SEQ ID NO: 419754 - RNA, 23 nt, Human
cauuucugcccaggcuuuggagg

SEQ ID NO: 419755 - RNA, 20 nt, Human
gcucucuuuuucucuggagc

SEQ ID NO: 419756 - RNA, 20 nt, Human
gcuuuggaggaagagggauu

SEQ ID NO: 419757 - RNA, 19 nt, Human
ggcagguuguuuguuuugu

SEQ ID NO: 419758 - RNA, 19 nt, Human
guguggaccagacacagga

SEQ ID NO: 419759 - RNA, 21 nt, Human
gugugugugugugugugugug

SEQ ID NO: 419760 - RNA, 21 nt, Human
gugugugugugugugugugug

SEQ ID NO: 419761 - RNA, 21 nt, Human
gugugugugugugugugugug

SEQ ID NO: 419762 - RNA, 18 nt, Human
uaaaauaagaauuagggg

SEQ ID NO: 419763 - RNA, 18 nt, Human
uacaggaggguagugaca

SEQ ID NO: 419764 - RNA, 20 nt, Human
uagcaaaacaugaacaagaa

SEQ ID NO: 419765 - RNA, 22 nt, Human
uagcugcagacugaauggaaca

SEQ ID NO: 419766 - RNA, 22 nt, Human
uauauguauauauagauagaua

SEQ ID NO: 419767 - RNA, 19 nt, Human
uauuugugugugugugugu

SEQ ID NO: 419768 - RNA, 24 nt, Human
uauuugugugugugugugugugug

SEQ ID NO: 419769 - RNA, 28 nt, Human
ucaaacagaaaccaauacaacgucaccg

SEQ ID NO: 419770 - RNA, 22 nt, Human
ucacugauaauacaagcuucug

SEQ ID NO: 419771 - RNA, 19 nt, Human
ucggaaugaacaaaucugu

SEQ ID NO: 419772 - RNA, 24 nt, Human
ucugugguguguggaccagacaca

SEQ ID NO: 419773 - RNA, 19 nt, Human
ugaaaaguuggaaaguugc

SEQ ID NO: 419774 - RNA, 21 nt, Human
ugaauagcugcagacugaaug

SEQ ID NO: 419775 - RNA, 23 nt, Human
ugaauggaacauugagacuuuug

SEQ ID NO: 419776 - RNA, 24 nt, Human
ugagguaagaauuaaggcaaaccc

SEQ ID NO: 419777 - RNA, 20 nt, Human
ugugguguguggaccagaca

SEQ ID NO: 419778 - RNA, 18 nt, Human
uguguauauguauauaua

SEQ ID NO: 419779 - RNA, 18 nt, Human
uguguauauguauauaua

SEQ ID NO: 419780 - RNA, 24 nt, Human
uguguauauguauauauagauaga

SEQ ID NO: 419781 - RNA, 26 nt, Human
ugugugaauagcugcagacugaaugg

SEQ ID NO: 419782 - RNA, 18 nt, Human
ugugugugugugugugug

SEQ ID NO: 419783 - RNA, 18 nt, Human
ugugugugugugugugug

SEQ ID NO: 419784 - RNA, 18 nt, Human
ugugugugugugugugug

SEQ ID NO: 419785 - RNA, 18 nt, Human
ugugugugugugugugug

SEQ ID NO: 419786 - RNA, 18 nt, Human
ugugugugugugugugug

SEQ ID NO: 419787 - RNA, 18 nt, Human
ugugugugugugugugug

SEQ ID NO: 419788 - RNA, 18 nt, Human
ugugugugugugugugug

SEQ ID NO: 419789 - RNA, 18 nt, Human
ugugugugugugugugug

SEQ ID NO: 419790 - RNA, 18 nt, Human
ugugugugugugugugug

SEQ ID NO: 419791 - RNA, 18 nt, Human
ugugugugugugugugug

SEQ ID NO: 419792 - RNA, 18 nt, Human
ugugugugugugugugug

SEQ ID NO: 419793 - RNA, 18 nt, Human
ugugugugugugugugug

SEQ ID NO: 419794 - RNA, 18 nt, Human
ugugugugugugugugug

SEQ ID NO: 419795 - RNA, 18 nt, Human
ugugugugugugugugug

SEQ ID NO: 419796 - RNA, 18 nt, Human
ugugugugugugugugug

SEQ ID NO: 419797 - RNA, 18 nt, Human
ugugugugugugugugug

SEQ ID NO: 419798 - RNA, 20 nt, Human
ugugugugugugugugugug

SEQ ID NO: 419799 - RNA, 21 nt, Human
ugugugugugugugugugugu

SEQ ID NO: 419800 - RNA, 21 nt, Human
ugugugugugugugugugugu

SEQ ID NO: 419801 - RNA, 21 nt, Human
ugugugugugugugugugugu

SEQ ID NO: 419802 - RNA, 21 nt, Human
ugugugugugugugugugugu

SEQ ID NO: 419803 - RNA, 21 nt, Human
ugugugugugugugugugugu

SEQ ID NO: 419804 - RNA, 21 nt, Human
ugugugugugugugugugugu

SEQ ID NO: 419805 - RNA, 21 nt, Human
ugugugugugugugugugugu

SEQ ID NO: 419806 - RNA, 21 nt, Human
ugugugugugugugugugugu

SEQ ID NO: 419807 - RNA, 21 nt, Human
ugugugugugugugugugugu

SEQ ID NO: 419808 - RNA, 21 nt, Human
ugugugugugugugugugugu

SEQ ID NO: 419809 - RNA, 21 nt, Human
ugugugugugugugugugugu

SEQ ID NO: 419810 - RNA, 21 nt, Human
ugugugugugugugugugugu

SEQ ID NO: 419811 - RNA, 21 nt, Human
ugugugugugugugugugugu

SEQ ID NO: 419812 - RNA, 21 nt, Human
ugugugugugugugugugugu

SEQ ID NO: 419813 - RNA, 21 nt, Human
ugugugugugugugugugugu

SEQ ID NO: 419814 - RNA, 21 nt, Human
ugugugugugugugugugugu

SEQ ID NO: 419815 - RNA, 21 nt, Human
ugugugugugugugugugugu

SEQ ID NO: 419816 - RNA, 21 nt, Human
ugugugugugugugugugugu

SEQ ID NO: 419817 - RNA, 21 nt, Human
ugugugugugugugugugugu

SEQ ID NO: 419818 - RNA, 21 nt, Human
ugugugugugugugugugugu

SEQ ID NO: 419819 - RNA, 21 nt, Human
ugugugugugugugugugugu

SEQ ID NO: 419820 - RNA, 21 nt, Human
ugugugugugugugugugugu

SEQ ID NO: 419821 - RNA, 21 nt, Human
ugugugugugugugugugugu

SEQ ID NO: 419822 - RNA, 21 nt, Human
ugugugugugugugugugugu

SEQ ID NO: 419823 - RNA, 21 nt, Human
ugugugugugugugugugugu

SEQ ID NO: 419824 - RNA, 21 nt, Human
ugugugugugugugugugugu

SEQ ID NO: 419825 - RNA, 21 nt, Human
ugugugugugugugugugugu

SEQ ID NO: 419826 - RNA, 21 nt, Human
ugugugugugugugugugugu

SEQ ID NO: 419827 - RNA, 21 nt, Human
ugugugugugugugugugugu

SEQ ID NO: 419828 - RNA, 22 nt, Human
ugugugugugugugugugugug

SEQ ID NO: 419829 - RNA, 22 nt, Human
ugugugugugugugugugugug

SEQ ID NO: 419830 - RNA, 22 nt, Human
ugugugugugugugugugugug

SEQ ID NO: 419831 - RNA, 22 nt, Human
ugugugugugugugugugugug

SEQ ID NO: 419832 - RNA, 22 nt, Human
ugugugugugugugugugugug

SEQ ID NO: 419833 - RNA, 22 nt, Human
ugugugugugugugugugugug

SEQ ID NO: 419834 - RNA, 22 nt, Human
ugugugugugugugugugugug

SEQ ID NO: 419835 - RNA, 22 nt, Human
ugugugugugugugugugugug

SEQ ID NO: 419836 - RNA, 22 nt, Human
ugugugugugugugugugugug

SEQ ID NO: 419837 - RNA, 22 nt, Human
ugugugugugugugugugugug

SEQ ID NO: 419838 - RNA, 22 nt, Human
ugugugugugugugugugugug

SEQ ID NO: 419839 - RNA, 19 nt, Human
uguuuuguuuuauauaugc

SEQ ID NO: 419840 - RNA, 19 nt, Human
uugcagcacauuucugccc

SEQ ID NO: 419841 - RNA, 21 nt, Human
uuuacaggaggguagugacau

SEQ ID NO: 419842 - RNA, 23 nt, Human
uuuguguauauguauauauagau

SEQ ID NO: 419843 - RNA, 24 nt, Human
uuuguguauauguauauauagaua

SEQ ID NO: 419844 - RNA, 24 nt, Human
uuugugugugugugugugugugug

SEQ ID NO: 419845 - RNA, 22 nt, Human
uuuugugcaguccauagcauug

SEQ ID NO: 419846 - RNA, 21 nt, Human
uuuuuuuuuuuuuuuuccacu

SEQ ID NO: 419847 - RNA, 22 nt, Human
uuuuuuuuuuuuuuuuccacug

SEQ ID NO: 419848 - RNA, 23 nt, Human
uuuuuuuuuuuuuuuuccacuga

SEQ ID NO: 419849 - RNA, 23 nt, Human
aaagacaauauaauucauucaug

SEQ ID NO: 419850 - RNA, 19 nt, Human
aaaugaugcccagcaguga

SEQ ID NO: 419851 - RNA, 21 nt, Human
aagaauaaauaaauggcaaag

SEQ ID NO: 419852 - RNA, 26 nt, Human
agagaaucaaaaguuuugcaccaagu

SEQ ID NO: 419853 - RNA, 18 nt, Human
agcuacaaaagagaauca

SEQ ID NO: 419854 - RNA, 20 nt, Human
auagaauuuucccuagguca

SEQ ID NO: 419855 - RNA, 22 nt, Human
auagaauuuucccuaggucacu

SEQ ID NO: 419856 - RNA, 24 nt, Human
aucacaaauuuugaaaggccaaaa

SEQ ID NO: 419857 - RNA, 26 nt, Human
caaacugagaguacaugucuuggaca

SEQ ID NO: 419858 - RNA, 24 nt, Human
caaauuuugaaaggccaaaagccu

SEQ ID NO: 419859 - RNA, 19 nt, Human
caucuguccucuuaaagca

SEQ ID NO: 419860 - RNA, 21 nt, Human
cauuuuaucuugacauuguca

SEQ ID NO: 419861 - RNA, 18 nt, Human
ccaaaagccuggucugac

SEQ ID NO: 419862 - RNA, 22 nt, Human
ccuaucaagugacacucaagaa

SEQ ID NO: 419863 - RNA, 23 nt, Human
ccucccugcucaagcuacaaaag

SEQ ID NO: 419864 - RNA, 18 nt, Human
ccucuuaaagcaaguggc

SEQ ID NO: 419865 - RNA, 23 nt, Human
cuaaaaacacuguuuccagcuau

SEQ ID NO: 419866 - RNA, 20 nt, Human
cucccuaacaagaaaacuga

SEQ ID NO: 419867 - RNA, 19 nt, Human
gaguacaugucuuggacaa

SEQ ID NO: 419868 - RNA, 23 nt, Human
ggcaaaggaaacgcaggaaagga

SEQ ID NO: 419869 - RNA, 21 nt, Human
uaaagaauaaauaaauggcaa

SEQ ID NO: 419870 - RNA, 20 nt, Human
uaaauggcaaaggaaacgca

SEQ ID NO: 419871 - RNA, 18 nt, Human
uacaaaagagaaucaaaa

SEQ ID NO: 419872 - RNA, 24 nt, Human
uacaguacauugaaccacacaucu

SEQ ID NO: 419873 - RNA, 24 nt, Human
uaucaagugacacucaagaaaaca

SEQ ID NO: 419874 - RNA, 27 nt, Human
ucaaaaguuuugcaccaaguuaacugg

SEQ ID NO: 419875 - RNA, 25 nt, Human
ucaagguaaagacaauauaauucau

SEQ ID NO: 419876 - RNA, 19 nt, Human
ucagaccuaaccuauucau

SEQ ID NO: 419877 - RNA, 24 nt, Human
ugaaaggccaaaagccuggucuga

SEQ ID NO: 419878 - RNA, 18 nt, Human
ugacagugggaccugugg

SEQ ID NO: 419879 - RNA, 19 nt, Human
ugacagugggaccuguggg

SEQ ID NO: 419880 - RNA, 27 nt, Human
ugaccuaaaaacacuguuuccagcuau

SEQ ID NO: 419881 - RNA, 18 nt, Human
ugcuuucaaucacaaauu

SEQ ID NO: 419882 - RNA, 18 nt, Human
uggaaaaugccagugagg

SEQ ID NO: 419883 - RNA, 25 nt, Human
uggcaaaggaaacgcaggaaaggaa

SEQ ID NO: 419884 - RNA, 20 nt, Human
uggucugaccuaaaaacacu

SEQ ID NO: 419885 - RNA, 21 nt, Human
uguauggagucuucacuauga

SEQ ID NO: 419886 - RNA, 19 nt, Human
uugacauugucagaagaaa

SEQ ID NO: 419887 - RNA, 18 nt, Human
uuuuuuuuuuuuuuuuug

SEQ ID NO: 419888 - RNA, 21 nt, Human
acaaauuccuucuccaaacau

SEQ ID NO: 419889 - RNA, 21 nt, Human
acagggaaggagggcacugga

SEQ ID NO: 419890 - RNA, 18 nt, Human
agacaaaaugcccaguag

SEQ ID NO: 419891 - RNA, 21 nt, Human
agagggcccggccaugugggc

SEQ ID NO: 419892 - RNA, 27 nt, Human
agaugggaggagggagcuacagagggc

SEQ ID NO: 419893 - RNA, 24 nt, Human
agcccauccccucugcccccucca

SEQ ID NO: 419894 - RNA, 22 nt, Human
agcucagugccuggcaagcugg

SEQ ID NO: 419895 - RNA, 18 nt, Human
aggagggagcuacagagg

SEQ ID NO: 419896 - RNA, 19 nt, Human
agggcccggccaugugggc

SEQ ID NO: 419897 - RNA, 18 nt, Human
auccccucugcccccucc

SEQ ID NO: 419898 - RNA, 21 nt, Human
augaacuggaccagacaaaau

SEQ ID NO: 419899 - RNA, 20 nt, Human
caaccuccagcccauccccu

SEQ ID NO: 419900 - RNA, 19 nt, Human
cagcggcugcugcagcaaa

SEQ ID NO: 419901 - RNA, 25 nt, Human
cagggaaggagggcacuggagaaga

SEQ ID NO: 419902 - RNA, 22 nt, Human
cagggcuucuagcucagugccu

SEQ ID NO: 419903 - RNA, 19 nt, Human
caguaaaauaggauuaaca

SEQ ID NO: 419904 - RNA, 22 nt, Human
caugaacuggaccagacaaaau

SEQ ID NO: 419905 - RNA, 19 nt, Human
ccagcccauccccucugcc

SEQ ID NO: 419906 - RNA, 23 nt, Human
cccauccccucugcccccuccag

SEQ ID NO: 419907 - RNA, 21 nt, Human
ccuccagcccauccccucugc

SEQ ID NO: 419908 - RNA, 23 nt, Human
ccuccagcccauccccucugccc

SEQ ID NO: 419909 - RNA, 24 nt, Human
ccuggaacacugggccugggcgag

SEQ ID NO: 419910 - RNA, 22 nt, Human
ccuucuccaaacauagcuauug

SEQ ID NO: 419911 - RNA, 18 nt, Human
cucaaccuccagcccauc

SEQ ID NO: 419912 - RNA, 19 nt, Human
cuccagcggcugcugcagc

SEQ ID NO: 419913 - RNA, 23 nt, Human
cucuggucucccugaagucuccg

SEQ ID NO: 419914 - RNA, 24 nt, Human
cuggagcagccacaaauuccuucu

SEQ ID NO: 419915 - RNA, 18 nt, Human
gaaggagaugggaggagg

SEQ ID NO: 419916 - RNA, 18 nt, Human
gaccagacaaaaugccca

SEQ ID NO: 419917 - RNA, 22 nt, Human
gagaggcagagacagggaagga

SEQ ID NO: 419918 - RNA, 23 nt, Human
gagggcacuggagaagaggaacu

SEQ ID NO: 419919 - RNA, 22 nt, Human
gcagccacaaauuccuucucca

SEQ ID NO: 419920 - RNA, 21 nt, Human
gccacaaauuccuucuccaaa

SEQ ID NO: 419921 - RNA, 19 nt, Human
gcucagugccuggcaagcu

SEQ ID NO: 419922 - RNA, 19 nt, Human
gcugggggaaggagauggg

SEQ ID NO: 419923 - RNA, 19 nt, Human
ggaaggagaugggaggagg

SEQ ID NO: 419924 - RNA, 20 nt, Human
ggaggagggagcuacagagg

SEQ ID NO: 419925 - RNA, 20 nt, Human
gggaaggagaugggaggagg

SEQ ID NO: 419926 - RNA, 21 nt, Human
gggaaggagaugggaggaggg

SEQ ID NO: 419927 - RNA, 21 nt, Human
gggcuaagggaccuuuauugg

SEQ ID NO: 419928 - RNA, 18 nt, Human
gggcugggggaaggagau

SEQ ID NO: 419929 - RNA, 18 nt, Human
uagcucagugccuggcaa

SEQ ID NO: 419930 - RNA, 24 nt, Human
uccagcccauccccucugcccccu

SEQ ID NO: 419931 - RNA, 23 nt, Human
ucuccaaacauagcuauugaucc

SEQ ID NO: 419932 - RNA, 21 nt, Human
ucucugagucuuaguucauuu

SEQ ID NO: 419933 - RNA, 25 nt, Human
ucucugagucuuaguucauuuucag

SEQ ID NO: 419934 - RNA, 18 nt, Human
uggcaagcugggcucugg

SEQ ID NO: 419935 - RNA, 26 nt, Human
uggcaagcugggcucuggucucccug

SEQ ID NO: 419936 - RNA, 20 nt, Human
ugggcgagcugggagauaag

SEQ ID NO: 419937 - RNA, 18 nt, Human
ugggcugggggaaggaga

SEQ ID NO: 419938 - RNA, 21 nt, Human
uuucugcugcucuguuugcuc

SEQ ID NO: 419939 - RNA, 24 nt, Human
uuuucugcugcucuguuugcucaa

SEQ ID NO: 419940 - RNA, 22 nt, Human
aaccacccucccuuucccacca

SEQ ID NO: 419941 - RNA, 20 nt, Human
aagcugugacauccaccaac

SEQ ID NO: 419942 - RNA, 22 nt, Human
aaggcaggcagcagcaggcacc

SEQ ID NO: 419943 - RNA, 24 nt, Human
accaaccacccucccuuucccacc

SEQ ID NO: 419944 - RNA, 19 nt, Human
acuggcagcacucuggccu

SEQ ID NO: 419945 - RNA, 19 nt, Human
agagcagaacaugcagagg

SEQ ID NO: 419946 - RNA, 21 nt, Human
aggccaaggcaggcagcagca

SEQ ID NO: 419947 - RNA, 26 nt, Human
augcagcaagauaagagcucagccuu

SEQ ID NO: 419948 - RNA, 20 nt, Human
cacccucccuuucccaccac

SEQ ID NO: 419949 - RNA, 21 nt, Human
cacccucccuuucccaccaca

SEQ ID NO: 419950 - RNA, 18 nt, Human
cagaagggcacaagagca

SEQ ID NO: 419951 - RNA, 18 nt, Human
cagaagggcacaagagca

SEQ ID NO: 419952 - RNA, 19 nt, Human
caggccaaggcaggcagca

SEQ ID NO: 419953 - RNA, 22 nt, Human
caggccaaggcaggcagcagca

SEQ ID NO: 419954 - RNA, 18 nt, Human
caucaggccaaggcaggc

SEQ ID NO: 419955 - RNA, 18 nt, Human
caugcagcugcagcagcc

SEQ ID NO: 419956 - RNA, 20 nt, Human
cccucccuuucccaccacaa

SEQ ID NO: 419957 - RNA, 23 nt, Human
ccuaggccaugcucucagcugcu

SEQ ID NO: 419958 - RNA, 18 nt, Human
cugcaaaugagggcugcg

SEQ ID NO: 419959 - RNA, 21 nt, Human
cuggacaauggugccuucccc

SEQ ID NO: 419960 - RNA, 23 nt, Human
cuguggaguccccacugcugggg

SEQ ID NO: 419961 - RNA, 22 nt, Human
gcaaaggcucaaucaggucugc

SEQ ID NO: 419962 - RNA, 22 nt, Human
ggagauaaagcccaagcuguga

SEQ ID NO: 419963 - RNA, 19 nt, Human
ucagaagggcacaagagca

SEQ ID NO: 419964 - RNA, 19 nt, Human
ucagaagggcacaagagca

SEQ ID NO: 419965 - RNA, 24 nt, Human
ucaggucugcuacagcuccggacu

SEQ ID NO: 419966 - RNA, 19 nt, Human
uccccugcaaaugagggcu

SEQ ID NO: 419967 - RNA, 19 nt, Human
ucccugggaaacucagcug

SEQ ID NO: 419968 - RNA, 19 nt, Human
ucccugggaaacucagcug

SEQ ID NO: 419969 - RNA, 18 nt, Human
ucucagcugcugcaaagg

SEQ ID NO: 419970 - RNA, 20 nt, Human
uggcagcacucuggccuggc

SEQ ID NO: 419971 - RNA, 21 nt, Human
uggcagcacucuggccuggcc

SEQ ID NO: 419972 - RNA, 21 nt, Human
ugggggagauaaagcccaagc

SEQ ID NO: 419973 - RNA, 24 nt, Human
ugugacauccaccaaccacccucc

SEQ ID NO: 419974 - RNA, 26 nt, Human
uuccccugcaaaugagggcugcggcu

SEQ ID NO: 419975 - RNA, 18 nt, Human
aaaaugaagcaucugcgg

SEQ ID NO: 419976 - RNA, 19 nt, Human
aaccaaggacuucccugag

SEQ ID NO: 419977 - RNA, 25 nt, Human
aagccuacagguggcggugcuuuga

SEQ ID NO: 419978 - RNA, 22 nt, Human
aaguccacccguccagggacac

SEQ ID NO: 419979 - RNA, 23 nt, Human
aauaauggaacucacaggaagaa

SEQ ID NO: 419980 - RNA, 20 nt, Human
acuguggggcugcuuugggg

SEQ ID NO: 419981 - RNA, 20 nt, Human
acuuggaacccucggagucc

SEQ ID NO: 419982 - RNA, 21 nt, Human
agacagaagccuacagguggc

SEQ ID NO: 419983 - RNA, 19 nt, Human
agaccagguuguggaagac

SEQ ID NO: 419984 - RNA, 22 nt, Human
agugcuccagaggagacccaga

SEQ ID NO: 419985 - RNA, 27 nt, Human
aguuuauuuacucuacugggugaaaca

SEQ ID NO: 419986 - RNA, 19 nt, Human
auacucuuccccucuuucu

SEQ ID NO: 419987 - RNA, 18 nt, Human
auuuacucuacuggguga

SEQ ID NO: 419988 - RNA, 24 nt, Human
caaccaaggacuucccugagauuu

SEQ ID NO: 419989 - RNA, 22 nt, Human
caagaacaggguggcccaugga

SEQ ID NO: 419990 - RNA, 23 nt, Human
cacagucaggggaaaagccaccc

SEQ ID NO: 419991 - RNA, 18 nt, Human
cacccccaagucuuaauu

SEQ ID NO: 419992 - RNA, 21 nt, Human
cagaggagacccagauacauc

SEQ ID NO: 419993 - RNA, 22 nt, Human
cagcagacgagucaagaccagg

SEQ ID NO: 419994 - RNA, 18 nt, Human
cagguggcggugcuuuga

SEQ ID NO: 419995 - RNA, 24 nt, Human
ccacccguccagggacacagccag

SEQ ID NO: 419996 - RNA, 23 nt, Human
ccccacaucaauauuucaaagca

SEQ ID NO: 419997 - RNA, 19 nt, Human
cccguccagggacacagcc

SEQ ID NO: 419998 - RNA, 20 nt, Human
cccguccagggacacagcca

SEQ ID NO: 419999 - RNA, 20 nt, Human
ccuccauggacaagaacagg

SEQ ID NO: 420000 - RNA, 23 nt, Human
ccuccauggacaagaacagggug

SEQ ID NO: 420001 - RNA, 19 nt, Human
ccucgagggcugcugccuc

SEQ ID NO: 420002 - RNA, 19 nt, Human
cgaccaugcaauguuagcc

SEQ ID NO: 420003 - RNA, 21 nt, Human
cgcugggcaguugagcugcug

SEQ ID NO: 420004 - RNA, 23 nt, Human
cucgagggcugcugccucgacuu

SEQ ID NO: 420005 - RNA, 22 nt, Human
cuguggggcugcuuuggggaga

SEQ ID NO: 420006 - RNA, 23 nt, Human
cuuccacugcagccaagggucaa

SEQ ID NO: 420007 - RNA, 26 nt, Human
gaaauacaucuugugcucaauaaacc

SEQ ID NO: 420008 - RNA, 20 nt, Human
gaacucacaggaagaaacag

SEQ ID NO: 420009 - RNA, 23 nt, Human
gaagacacugcagagguggccac

SEQ ID NO: 420010 - RNA, 18 nt, Human
gagggucuagggucauuu

SEQ ID NO: 420011 - RNA, 24 nt, Human
gagucaagaccagguuguggaaga

SEQ ID NO: 420012 - RNA, 18 nt, Human
gcccauggacuuccagcc

SEQ ID NO: 420013 - RNA, 21 nt, Human
gccucgagggcugcugccucg

SEQ ID NO: 420014 - RNA, 25 nt, Human
ggaaaagccacccugacucugcagg

SEQ ID NO: 420015 - RNA, 18 nt, Human
ggaagcgagcaugauuuc

SEQ ID NO: 420016 - RNA, 22 nt, Human
ggagacccagauacaucaacca

SEQ ID NO: 420017 - RNA, 21 nt, Human
ggcaggagaacacuggugugc

SEQ ID NO: 420018 - RNA, 21 nt, Human
ggcccaguaauuaccaugaga

SEQ ID NO: 420019 - RNA, 19 nt, Human
gggaagcgagcaugauuuc

SEQ ID NO: 420020 - RNA, 20 nt, Human
gggugacaggagggcagagu

SEQ ID NO: 420021 - RNA, 20 nt, Human
uaaguccacccguccaggga

SEQ ID NO: 420022 - RNA, 18 nt, Human
uacacaggcuuacagagg

SEQ ID NO: 420023 - RNA, 19 nt, Human
uacucuuccccucuuucuu

SEQ ID NO: 420024 - RNA, 23 nt, Human
uauacgcauacauagaauauaua

SEQ ID NO: 420025 - RNA, 24 nt, Human
ucaaaauugcugaacucuguucaa

SEQ ID NO: 420026 - RNA, 20 nt, Human
uccacugcagccaaggguca

SEQ ID NO: 420027 - RNA, 18 nt, Human
uccauauacgcauacaua

SEQ ID NO: 420028 - RNA, 18 nt, Human
uccuccauggacaagaac

SEQ ID NO: 420029 - RNA, 19 nt, Human
uccuccauggacaagaaca

SEQ ID NO: 420030 - RNA, 20 nt, Human
ucggaguccuccauggacaa

SEQ ID NO: 420031 - RNA, 21 nt, Human
ucucccuagcuaaguccaccc

SEQ ID NO: 420032 - RNA, 22 nt, Human
ucugugcugacuuccacugcag

SEQ ID NO: 420033 - RNA, 19 nt, Human
ucuugugcucaauaaaccu

SEQ ID NO: 420034 - RNA, 19 nt, Human
ugacaggagggcagagugc

SEQ ID NO: 420035 - RNA, 23 nt, Human
ugacugggcugggauuauugaua

SEQ ID NO: 420036 - RNA, 18 nt, Human
ugagagugcccugcccag

SEQ ID NO: 420037 - RNA, 21 nt, Human
ugccuagacaucugugagggc

SEQ ID NO: 420038 - RNA, 22 nt, Human
uggaacccucggaguccuccau

SEQ ID NO: 420039 - RNA, 19 nt, Human
uggcccauggacuuccagc

SEQ ID NO: 420040 - RNA, 20 nt, Human
ugggagggggcaugggcuga

SEQ ID NO: 420041 - RNA, 22 nt, Human
ugggauuauugauacauuacug

SEQ ID NO: 420042 - RNA, 22 nt, Human
ugggugacaggagggcagagug

SEQ ID NO: 420043 - RNA, 22 nt, Human
ugugcucaauaaaccuccccac

SEQ ID NO: 420044 - RNA, 22 nt, Human
uuaauacucuuccccucuuucu

SEQ ID NO: 420045 - RNA, 21 nt, Human
uucccugagauuuggcuuugc

SEQ ID NO: 420046 - RNA, 26 nt, Human
uugauacauuacugauacaucacuuc

SEQ ID NO: 420047 - RNA, 20 nt, Human
uuggcaggagaacacuggug

SEQ ID NO: 420048 - RNA, 19 nt, Human
uugggagggggcaugggcu

SEQ ID NO: 420049 - RNA, 23 nt, Human
uuugacugggcugggauuauuga

SEQ ID NO: 420050 - RNA, 22 nt, Human
auuuuuuguuguuguuguucac

SEQ ID NO: 420051 - RNA, 19 nt, Human
cacugucguauuucaaagc

SEQ ID NO: 420052 - RNA, 21 nt, Human
ucagaaugcauggagugcaag

SEQ ID NO: 420053 - RNA, 20 nt, Human
ugcaaggcacaaaagccuug

SEQ ID NO: 420054 - RNA, 20 nt, Human
ugcaaggcacaaaagccuug

SEQ ID NO: 420055 - RNA, 19 nt, Human
uggaacacugucguauuuc

SEQ ID NO: 420056 - RNA, 19 nt, Human
uggagugcaaggcacaaaa

SEQ ID NO: 420057 - RNA, 24 nt, Human
uggagugcaaggcacaaaagccuu

SEQ ID NO: 420058 - RNA, 22 nt, Human
uuuuguuguuguuguucacagc

SEQ ID NO: 420059 - RNA, 25 nt, Human
uuuuuuguuguuguuguucacagca

SEQ ID NO: 420060 - RNA, 20 nt, Human
uuuuuuuuuuuuuuuugcua

SEQ ID NO: 420061 - RNA, 18 nt, Human
uuuuuuuuuuuuuuuuug

SEQ ID NO: 420062 - RNA, 20 nt, Human
uuuuuuuuuuuuuuuuugcu

SEQ ID NO: 420063 - RNA, 21 nt, Human
acagggcagcaaguaacucag

SEQ ID NO: 420064 - RNA, 26 nt, Human
agaguggagggugggcacagagcagg

SEQ ID NO: 420065 - RNA, 20 nt, Human
agggauaacagcauuggagg

SEQ ID NO: 420066 - RNA, 21 nt, Human
agggguugguggggaagaaau

SEQ ID NO: 420067 - RNA, 26 nt, Human
agggguugguggggaagaaauggggg

SEQ ID NO: 420068 - RNA, 22 nt, Human
cagcauuggagggguugguggg

SEQ ID NO: 420069 - RNA, 23 nt, Human
cagcauuggagggguuggugggg

SEQ ID NO: 420070 - RNA, 19 nt, Human
ccuugggauuguuggguga

SEQ ID NO: 420071 - RNA, 19 nt, Human
cugcggggaggagcacagg

SEQ ID NO: 420072 - RNA, 18 nt, Human
gaagaaaugggggguugg

SEQ ID NO: 420073 - RNA, 18 nt, Human
gagaguggagggugggca

SEQ ID NO: 420074 - RNA, 20 nt, Human
gagaguggagggugggcaca

SEQ ID NO: 420075 - RNA, 18 nt, Human
ggaagaaaugggggguug

SEQ ID NO: 420076 - RNA, 20 nt, Human
ggagggugggcacagagcag

SEQ ID NO: 420077 - RNA, 24 nt, Human
ggcagggauaacagcauuggaggg

SEQ ID NO: 420078 - RNA, 20 nt, Human
ggcccuggaagaggagagug

SEQ ID NO: 420079 - RNA, 20 nt, Human
ggugagugugaggaccaggc

SEQ ID NO: 420080 - RNA, 24 nt, Human
gugggcacagagcagguggagggg

SEQ ID NO: 420081 - RNA, 24 nt, Human
uaaaaagggccuugggauuguuuc

SEQ ID NO: 420082 - RNA, 21 nt, Human
uggaagaggagaguggagggu

SEQ ID NO: 420083 - RNA, 18 nt, Human
uguugggugagugugagg

SEQ ID NO: 420084 - RNA, 21 nt, Human
uugggggcccuggaagaggag

SEQ ID NO: 420085 - RNA, 22 nt, Human
aaaaaacugaaucugcuacucu

SEQ ID NO: 420086 - RNA, 21 nt, Human
aaaagaaagcaaaacacuaga

SEQ ID NO: 420087 - RNA, 21 nt, Human
aaacaauaaaacaauaaugaa

SEQ ID NO: 420088 - RNA, 23 nt, Human
accacaaaggacauuugcauuca

SEQ ID NO: 420089 - RNA, 24 nt, Human
agauauaucaaaaaacugaaucug

SEQ ID NO: 420090 - RNA, 24 nt, Human
auaaaacaauaaugaaaaaauuca

SEQ ID NO: 420091 - RNA, 22 nt, Human
auacagcugcccucaagauuuc

SEQ ID NO: 420092 - RNA, 23 nt, Human
caaaacacuagaaugaccaaaca

SEQ ID NO: 420093 - RNA, 24 nt, Human
cagcuguccaugcuuaauacuuag

SEQ ID NO: 420094 - RNA, 18 nt, Human
ccuauaggcaagcaaaau

SEQ ID NO: 420095 - RNA, 24 nt, Human
cuccaacacuagucuagcugggga

SEQ ID NO: 420096 - RNA, 26 nt, Human
gagaauucaacacuacaagcuaaaug

SEQ ID NO: 420097 - RNA, 19 nt, Human
gcccucaagauuucaauuu

SEQ ID NO: 420098 - RNA, 23 nt, Human
gggaaggggauacugcuaaacau

SEQ ID NO: 420099 - RNA, 18 nt, Human
guauguuuaagucagagu

SEQ ID NO: 420100 - RNA, 25 nt, Human
uauaaaaacaauaaaacaauaauga

SEQ ID NO: 420101 - RNA, 22 nt, Human
uauaaggaaaagaaagcaaaac

SEQ ID NO: 420102 - RNA, 25 nt, Human
uauaaggaaaagaaagcaaaacacu

SEQ ID NO: 420103 - RNA, 18 nt, Human
ucaaggaacaagcaccac

SEQ ID NO: 420104 - RNA, 22 nt, Human
ugcagccauagcuuccacugca

SEQ ID NO: 420105 - RNA, 19 nt, Human
ugcuuaauacuuagugguu

SEQ ID NO: 420106 - RNA, 19 nt, Human
uucagggggaaaaaaaaga

SEQ ID NO: 420107 - RNA, 23 nt, Human
uucaucguuauuccaguucauca

SEQ ID NO: 420108 - RNA, 22 nt, Human
aaaaaaacaaaaggaaaaacca

SEQ ID NO: 420109 - RNA, 25 nt, Human
aaaaaaacaaaaggaaaaaccaaag

SEQ ID NO: 420110 - RNA, 23 nt, Human
aaaaaaacaaagaagcauuacca

SEQ ID NO: 420111 - RNA, 26 nt, Human
aaaaaaacaaagaagcauuaccaaag

SEQ ID NO: 420112 - RNA, 21 nt, Human
aaaaaagagagagagagagaa

SEQ ID NO: 420113 - RNA, 23 nt, Human
aaaagacccagaauuuuuggaug

SEQ ID NO: 420114 - RNA, 19 nt, Human
aaacaaaaggaaaaaccaa

SEQ ID NO: 420115 - RNA, 21 nt, Human
aaacaaaaggaaaaaccaaag

SEQ ID NO: 420116 - RNA, 21 nt, Human
aaacacaaaguuuggagaaau

SEQ ID NO: 420117 - RNA, 25 nt, Human
aaacugaaaauucaaaucuucucuu

SEQ ID NO: 420118 - RNA, 23 nt, Human
aaacugaaagcagaaacacugga

SEQ ID NO: 420119 - RNA, 19 nt, Human
aaagagagagagagagaaa

SEQ ID NO: 420120 - RNA, 18 nt, Human
aacagguagccacucgag

SEQ ID NO: 420121 - RNA, 19 nt, Human
aaccaaagcggugaaacaa

SEQ ID NO: 420122 - RNA, 24 nt, Human
aacucacuugccuugugcuccgcc

SEQ ID NO: 420123 - RNA, 21 nt, Human
aagaaacugaaagcagaaaca

SEQ ID NO: 420124 - RNA, 18 nt, Human
aagcagaaacacuggauu

SEQ ID NO: 420125 - RNA, 22 nt, Human
aagcagaugcuguuuucaggac

SEQ ID NO: 420126 - RNA, 18 nt, Human
aagcagccuuggaaaggg

SEQ ID NO: 420127 - RNA, 25 nt, Human
aagcccaacagguagccacucgaga

SEQ ID NO: 420128 - RNA, 24 nt, Human
aaguagcaucaccacuuuggcuca

SEQ ID NO: 420129 - RNA, 25 nt, Human
aauacaaaagcaacaagaaagacaa

SEQ ID NO: 420130 - RNA, 23 nt, Human
acaaaagcaacaagaaagacaag

SEQ ID NO: 420131 - RNA, 21 nt, Human
acagguagccacucgagacac

SEQ ID NO: 420132 - RNA, 22 nt, Human
acauccuuuaaaaaaacaaaag

SEQ ID NO: 420133 - RNA, 20 nt, Human
acccagccugaaaagggccc

SEQ ID NO: 420134 - RNA, 21 nt, Human
acccccaucaccauccugcuc

SEQ ID NO: 420135 - RNA, 25 nt, Human
agaaacacauccuuuaaaaaaacaa

SEQ ID NO: 420136 - RNA, 24 nt, Human
agaaauuccccucaaguagcauca

SEQ ID NO: 420137 - RNA, 23 nt, Human
agaauuacaaaauauagaagcug

SEQ ID NO: 420138 - RNA, 22 nt, Human
agacaacuaacaauuaacaggc

SEQ ID NO: 420139 - RNA, 21 nt, Human
agagacuggcaaguaucuuga

SEQ ID NO: 420140 - RNA, 21 nt, Human
agagagagagaaauuagaaau

SEQ ID NO: 420141 - RNA, 18 nt, Human
agcaccgugaaaggugaa

SEQ ID NO: 420142 - RNA, 19 nt, Human
agcgguguagcucccagag

SEQ ID NO: 420143 - RNA, 20 nt, Human
agcuacaggaagacaacuaa

SEQ ID NO: 420144 - RNA, 21 nt, Human
aggaaaagacgcugaagagga

SEQ ID NO: 420145 - RNA, 20 nt, Human
aggaaggguggaggugaggg

SEQ ID NO: 420146 - RNA, 21 nt, Human
agggcccuuccaauuucauau

SEQ ID NO: 420147 - RNA, 24 nt, Human
auccugcucacauuccuaccguca

SEQ ID NO: 420148 - RNA, 20 nt, Human
augcauuuuaacaaaaaccc

SEQ ID NO: 420149 - RNA, 22 nt, Human
auggguugcagaaauuccccuc

SEQ ID NO: 420150 - RNA, 20 nt, Human
caaaugcccacagggaaccc

SEQ ID NO: 420151 - RNA, 21 nt, Human
caagccaagaaacugaaagca

SEQ ID NO: 420152 - RNA, 22 nt, Human
cacaaaguuuggagaaaugaaa

SEQ ID NO: 420153 - RNA, 19 nt, Human
cacacgcggccucuccgcc

SEQ ID NO: 420154 - RNA, 24 nt, Human
caccaggcagcuucacaaacacac

SEQ ID NO: 420155 - RNA, 19 nt, Human
cacugcccacaagcccaac

SEQ ID NO: 420156 - RNA, 22 nt, Human
cacuguacuacagcugcagggc

SEQ ID NO: 420157 - RNA, 18 nt, Human
cagcaaucaaaacuaaaa

SEQ ID NO: 420158 - RNA, 26 nt, Human
cagcaaucaaaacuaaaacgguccgc

SEQ ID NO: 420159 - RNA, 21 nt, Human
cagccaucggggacugggcaa

SEQ ID NO: 420160 - RNA, 21 nt, Human
cagcuacaggaagacaacuaa

SEQ ID NO: 420161 - RNA, 25 nt, Human
caggugucaggaaacuaaaggagca

SEQ ID NO: 420162 - RNA, 22 nt, Human
caguuaucuuucauccagaauu

SEQ ID NO: 420163 - RNA, 28 nt, Human
cauaaaaaaacaaagaagcauuaccaaa

SEQ ID NO: 420164 - RNA, 21 nt, Human
cauccugcucacauuccuacc

SEQ ID NO: 420165 - RNA, 22 nt, Human
cauuccuaccgucaccucaaac

SEQ ID NO: 420166 - RNA, 21 nt, Human
ccaagccaagaaacugaaagc

SEQ ID NO: 420167 - RNA, 20 nt, Human
ccauggucccgccgcgccgc

SEQ ID NO: 420168 - RNA, 22 nt, Human
cccacaagcccaacagguagcc

SEQ ID NO: 420169 - RNA, 18 nt, Human
cccugugccgcagcucug

SEQ ID NO: 420170 - RNA, 21 nt, Human
cccugugccgcagcucugccc

SEQ ID NO: 420171 - RNA, 18 nt, Human
cccuguuuguugaaccuu

SEQ ID NO: 420172 - RNA, 22 nt, Human
cccuuuuuaacaacaacaaaaa

SEQ ID NO: 420173 - RNA, 24 nt, Human
ccgcagcucugcccagcucagcgg

SEQ ID NO: 420174 - RNA, 20 nt, Human
ccgccgccuccugugugcgc

SEQ ID NO: 420175 - RNA, 18 nt, Human
ccgccgcgccgcggccgc

SEQ ID NO: 420176 - RNA, 20 nt, Human
ccuuugcagcccaggcccug

SEQ ID NO: 420177 - RNA, 19 nt, Human
cgagacacacacacugagg

SEQ ID NO: 420178 - RNA, 19 nt, Human
cgccggcgccggggcugcg

SEQ ID NO: 420179 - RNA, 21 nt, Human
cgcggucccgccgccggcgcc

SEQ ID NO: 420180 - RNA, 18 nt, Human
cuaaaggagcagggcucc

SEQ ID NO: 420181 - RNA, 22 nt, Human
cucaugugcagcacaauuugcu

SEQ ID NO: 420182 - RNA, 20 nt, Human
cuccauggucccgccgcgcc

SEQ ID NO: 420183 - RNA, 18 nt, Human
cucugcuuuuagcuccag

SEQ ID NO: 420184 - RNA, 21 nt, Human
cugaauucucuugcaaaaacc

SEQ ID NO: 420185 - RNA, 20 nt, Human
cugcccacaagcccaacagg

SEQ ID NO: 420186 - RNA, 19 nt, Human
cuggccccagcaccgugaa

SEQ ID NO: 420187 - RNA, 20 nt, Human
cugggacagaggagagaaca

SEQ ID NO: 420188 - RNA, 23 nt, Human
cuuaaaaucuucaacacgcuccc

SEQ ID NO: 420189 - RNA, 27 nt, Human
cuuuaaaaaaacaaaaggaaaaaccaa

SEQ ID NO: 420190 - RNA, 21 nt, Human
cuuucauuacuguugagcugc

SEQ ID NO: 420191 - RNA, 22 nt, Human
gaaaagggcccuuccaauuuca

SEQ ID NO: 420192 - RNA, 18 nt, Human
gaacagggugaaggcccu

SEQ ID NO: 420193 - RNA, 19 nt, Human
gaaggguggaggugagggc

SEQ ID NO: 420194 - RNA, 21 nt, Human
gaccaaguggugaaaggugcc

SEQ ID NO: 420195 - RNA, 24 nt, Human
gacugcacccaauggacaggcucu

SEQ ID NO: 420196 - RNA, 19 nt, Human
gagaccacuuaaaaucuuc

SEQ ID NO: 420197 - RNA, 20 nt, Human
gaggugagggcacagcacug

SEQ ID NO: 420198 - RNA, 23 nt, Human
gcccacagggaacccagccugaa

SEQ ID NO: 420199 - RNA, 20 nt, Human
ggaggacaaccaugugcuuc

SEQ ID NO: 420200 - RNA, 23 nt, Human
ggaggacaaccaugugcuucuag

SEQ ID NO: 420201 - RNA, 22 nt, Human
gggaacaacaggaaggguggag

SEQ ID NO: 420202 - RNA, 21 nt, Human
gggacagaggagagaacagac

SEQ ID NO: 420203 - RNA, 25 nt, Human
uaaaaaaacaaaaggaaaaaccaaa

SEQ ID NO: 420204 - RNA, 19 nt, Human
uaaaaccaacuuauucaga

SEQ ID NO: 420205 - RNA, 24 nt, Human
uaaacccaaacugcacuaaauacu

SEQ ID NO: 420206 - RNA, 22 nt, Human
uaacaccaggcagcuucacaaa

SEQ ID NO: 420207 - RNA, 19 nt, Human
uaacuaaccacaauggaua

SEQ ID NO: 420208 - RNA, 21 nt, Human
uacaaaagcaacaagaaagac

SEQ ID NO: 420209 - RNA, 23 nt, Human
uaccaagccaagaaacugaaagc

SEQ ID NO: 420210 - RNA, 24 nt, Human
uacgagggacaauuuaaaauuacc

SEQ ID NO: 420211 - RNA, 20 nt, Human
uagcaucaccacuuuggcuc

SEQ ID NO: 420212 - RNA, 22 nt, Human
uagcuucuguguucucuccauc

SEQ ID NO: 420213 - RNA, 22 nt, Human
uaguagcuucuguguucucucc

SEQ ID NO: 420214 - RNA, 22 nt, Human
uauaaucaaagccuggagcacc

SEQ ID NO: 420215 - RNA, 18 nt, Human
ucaagggaaucucaugag

SEQ ID NO: 420216 - RNA, 22 nt, Human
ucacauuccuaccgucaccuca

SEQ ID NO: 420217 - RNA, 23 nt, Human
ucacauuguuuauacaaaaggug

SEQ ID NO: 420218 - RNA, 23 nt, Human
ucagaaaacauuuugauguucua

SEQ ID NO: 420219 - RNA, 18 nt, Human
ucccagagucauggacug

SEQ ID NO: 420220 - RNA, 18 nt, Human
uccugcggcucacucagg

SEQ ID NO: 420221 - RNA, 21 nt, Human
ucgcugaggagcuaagaacuc

SEQ ID NO: 420222 - RNA, 21 nt, Human
ucuauaaucaaagccuggagc

SEQ ID NO: 420223 - RNA, 18 nt, Human
ugaaacaauaucacuuac

SEQ ID NO: 420224 - RNA, 26 nt, Human
ugaaacugaaaauucaaaucuucucu

SEQ ID NO: 420225 - RNA, 22 nt, Human
ugaaaggugccaucuaaagugc

SEQ ID NO: 420226 - RNA, 20 nt, Human
ugacagccuauuuccucaug

SEQ ID NO: 420227 - RNA, 20 nt, Human
ugaggggacuucggggcugg

SEQ ID NO: 420228 - RNA, 23 nt, Human
ugaguugaaaauaacuuguugau

SEQ ID NO: 420229 - RNA, 25 nt, Human
ugaguugaaaauaacuuguugauuc

SEQ ID NO: 420230 - RNA, 23 nt, Human
ugcccacaagcccaacagguagc

SEQ ID NO: 420231 - RNA, 20 nt, Human
ugcccacgugggaacaacag

SEQ ID NO: 420232 - RNA, 18 nt, Human
uggagaaauaauacgagg

SEQ ID NO: 420233 - RNA, 23 nt, Human
uggcucaguuaucaguaguaguu

SEQ ID NO: 420234 - RNA, 18 nt, Human
ugugcagagguaaugaaa

SEQ ID NO: 420235 - RNA, 19 nt, Human
ugugcagagguaaugaaau

SEQ ID NO: 420236 - RNA, 20 nt, Human
ugugcagagguaaugaaauu

SEQ ID NO: 420237 - RNA, 20 nt, Human
uguuuguugaaccuuucccu

SEQ ID NO: 420238 - RNA, 21 nt, Human
uucauuguaauaccauauuag

SEQ ID NO: 420239 - RNA, 24 nt, Human
uuggauguuucuucuccauuuguu

SEQ ID NO: 420240 - RNA, 26 nt, Human
uuggauguuucuucuccauuuguuuu

SEQ ID NO: 420241 - RNA, 23 nt, Human
uuuagaaguucauuaauaacugu

SEQ ID NO: 420242 - RNA, 19 nt, Human
uuuccucaugugcagcaca

SEQ ID NO: 420243 - RNA, 19 nt, Human
uuugcuauguuuaguggca

SEQ ID NO: 420244 - RNA, 20 nt, Human
uuuuggaugugcagaagcaa

SEQ ID NO: 420245 - RNA, 27 nt, Human
aaacaggaacaggggaugcuccgugcu

SEQ ID NO: 420246 - RNA, 20 nt, Human
aagcaggcuggggggcuggu

SEQ ID NO: 420247 - RNA, 19 nt, Human
aagcuuaaggggaagaagc

SEQ ID NO: 420248 - RNA, 22 nt, Human
aaggcgcccccuccccucccca

SEQ ID NO: 420249 - RNA, 21 nt, Human
acaugcauucucugguuccag

SEQ ID NO: 420250 - RNA, 22 nt, Human
accaaguggacagacaugcauu

SEQ ID NO: 420251 - RNA, 19 nt, Human
aggcagggaggcaggaggg

SEQ ID NO: 420252 - RNA, 23 nt, Human
aggcgcccccuccccuccccaag

SEQ ID NO: 420253 - RNA, 22 nt, Human
aggggcacaaagcuuaagggga

SEQ ID NO: 420254 - RNA, 21 nt, Human
caaagcuuaaggggaagaagc

SEQ ID NO: 420255 - RNA, 23 nt, Human
cacuucauggccaguccagggac

SEQ ID NO: 420256 - RNA, 24 nt, Human
cagccaccaaguggacagacaugc

SEQ ID NO: 420257 - RNA, 24 nt, Human
caggaagcuccuucuggcuggucu

SEQ ID NO: 420258 - RNA, 23 nt, Human
cauggccaguccagggacaaaca

SEQ ID NO: 420259 - RNA, 19 nt, Human
ccagacugagggagcugga

SEQ ID NO: 420260 - RNA, 18 nt, Human
ccaguccagggacaaaca

SEQ ID NO: 420261 - RNA, 19 nt, Human
ccccaagccccagcacagc

SEQ ID NO: 420262 - RNA, 21 nt, Human
ccccaagccccagcacagccc

SEQ ID NO: 420263 - RNA, 22 nt, Human
ccccaagccccagcacagcccc

SEQ ID NO: 420264 - RNA, 23 nt, Human
ccccacccagcagccaccaagug

SEQ ID NO: 420265 - RNA, 18 nt, Human
cccccuccccuccccaag

SEQ ID NO: 420266 - RNA, 21 nt, Human
ccccuccccaagccccagcac

SEQ ID NO: 420267 - RNA, 19 nt, Human
cgguggaggagguggccag

SEQ ID NO: 420268 - RNA, 21 nt, Human
cuccccuccccaagccccagc

SEQ ID NO: 420269 - RNA, 20 nt, Human
cucccgaggccgggggcccu

SEQ ID NO: 420270 - RNA, 25 nt, Human
gagaacaaggcgcccccuccccucc

SEQ ID NO: 420271 - RNA, 21 nt, Human
gaggcagggaggcaggagggc

SEQ ID NO: 420272 - RNA, 20 nt, Human
gccccgaugggagggguagg

SEQ ID NO: 420273 - RNA, 19 nt, Human
gcuuaaggggaagaagcag

SEQ ID NO: 420274 - RNA, 22 nt, Human
gggcugguggcaggucccggcc

SEQ ID NO: 420275 - RNA, 18 nt, Human
ggggagaagcugagagug

SEQ ID NO: 420276 - RNA, 24 nt, Human
gggugggaggcagggaggcaggag

SEQ ID NO: 420277 - RNA, 25 nt, Human
uagcagugggugccagacugaggga

SEQ ID NO: 420278 - RNA, 21 nt, Human
uccgugcucccagaagagccc

SEQ ID NO: 420279 - RNA, 20 nt, Human
uccuucuggcuggucugaag

SEQ ID NO: 420280 - RNA, 24 nt, Human
ugagggagcuggacugcgguggag

SEQ ID NO: 420281 - RNA, 19 nt, Human
ugcuaguuccugguaauug

SEQ ID NO: 420282 - RNA, 26 nt, Human
ugcuccgugcucccagaagagcccca

SEQ ID NO: 420283 - RNA, 19 nt, Human
uggcucaugaggcugagug

SEQ ID NO: 420284 - RNA, 22 nt, Human
ugggaggcagggaggcaggagg

SEQ ID NO: 420285 - RNA, 21 nt, Human
uggggggcugguggcaggucc

SEQ ID NO: 420286 - RNA, 21 nt, Human
ugugggcuccgggcuggcaug

SEQ ID NO: 420287 - RNA, 19 nt, Human
uguucccggccccacccag

SEQ ID NO: 420288 - RNA, 25 nt, Human
uucccggccccacccagcagccacc

SEQ ID NO: 420289 - RNA, 18 nt, Human
aaaaaaacgcacaaacag

SEQ ID NO: 420290 - RNA, 23 nt, Human
aaaaaaacgcacaaacaggcacu

SEQ ID NO: 420291 - RNA, 18 nt, Human
aaaaaacgcacaaacagg

SEQ ID NO: 420292 - RNA, 19 nt, Human
aaaagaaacccgcuggcca

SEQ ID NO: 420293 - RNA, 24 nt, Human
aaaagcccaggaugacggcuggug

SEQ ID NO: 420294 - RNA, 24 nt, Human
aaaagccuaaccccuagcacuccc

SEQ ID NO: 420295 - RNA, 26 nt, Human
aaaagccuaaccccuagcacucccac

SEQ ID NO: 420296 - RNA, 18 nt, Human
aaaauaccauauccauag

SEQ ID NO: 420297 - RNA, 23 nt, Human
aaagaaaaaaacgcacaaacagg

SEQ ID NO: 420298 - RNA, 23 nt, Human
aaagaucauucacaaaauaccau

SEQ ID NO: 420299 - RNA, 18 nt, Human
aacugcuccccauaggac

SEQ ID NO: 420300 - RNA, 22 nt, Human
aagcucaaaagccuaaccccua

SEQ ID NO: 420301 - RNA, 19 nt, Human
aaggacccugcagauauuu

SEQ ID NO: 420302 - RNA, 20 nt, Human
aaggacccugcagauauuuu

SEQ ID NO: 420303 - RNA, 20 nt, Human
aaugaaaggaaacgccugga

SEQ ID NO: 420304 - RNA, 21 nt, Human
aaugguucuuaucucagaaga

SEQ ID NO: 420305 - RNA, 19 nt, Human
acacacacacgugugaaug

SEQ ID NO: 420306 - RNA, 18 nt, Human
accacccccuccaccccc

SEQ ID NO: 420307 - RNA, 18 nt, Human
acccccaaagcgccuugg

SEQ ID NO: 420308 - RNA, 18 nt, Human
accgcucuuccauagccc

SEQ ID NO: 420309 - RNA, 21 nt, Human
agaaagaaaaaaacgcacaaa

SEQ ID NO: 420310 - RNA, 25 nt, Human
agcaccagcaccacccccuccaccc

SEQ ID NO: 420311 - RNA, 22 nt, Human
agcacugagggaaugaaaggaa

SEQ ID NO: 420312 - RNA, 21 nt, Human
agcagaaaagaaacccgcugg

SEQ ID NO: 420313 - RNA, 18 nt, Human
agcccagugcagcaccag

SEQ ID NO: 420314 - RNA, 22 nt, Human
agccuaaccccuagcacuccca

SEQ ID NO: 420315 - RNA, 19 nt, Human
aggaacagauccacacaac

SEQ ID NO: 420316 - RNA, 21 nt, Human
aggacagacugggacuugggu

SEQ ID NO: 420317 - RNA, 18 nt, Human
aggacggcugcccgggga

SEQ ID NO: 420318 - RNA, 18 nt, Human
aggcguucaagcucaaaa

SEQ ID NO: 420319 - RNA, 24 nt, Human
aguaaagagaaagcaaaggaaaaa

SEQ ID NO: 420320 - RNA, 21 nt, Human
agugcagcaccagcaccaccc

SEQ ID NO: 420321 - RNA, 24 nt, Human
aucuucuccguggacucccuaccg

SEQ ID NO: 420322 - RNA, 20 nt, Human
auggcaggcgcaggaguggc

SEQ ID NO: 420323 - RNA, 21 nt, Human
augggaacaguccaguguguc

SEQ ID NO: 420324 - RNA, 22 nt, Human
augggaacaguccagugugucc

SEQ ID NO: 420325 - RNA, 25 nt, Human
caaaagccuaaccccuagcacuccc

SEQ ID NO: 420326 - RNA, 22 nt, Human
caaagcgccuuggcccagcaga

SEQ ID NO: 420327 - RNA, 21 nt, Human
caaaggaaaaaugacgcagca

SEQ ID NO: 420328 - RNA, 22 nt, Human
caaauacuaagcacauuccgcu

SEQ ID NO: 420329 - RNA, 23 nt, Human
caagcucaaaagccuaaccccua

SEQ ID NO: 420330 - RNA, 25 nt, Human
caagcucaaaagccuaaccccuagc

SEQ ID NO: 420331 - RNA, 19 nt, Human
cacaaacaggcacuagaua

SEQ ID NO: 420332 - RNA, 18 nt, Human
cacaacacacaggcaaca

SEQ ID NO: 420333 - RNA, 19 nt, Human
cacaacacacaggcaacag

SEQ ID NO: 420334 - RNA, 20 nt, Human
cacaacacacaggcaacagg

SEQ ID NO: 420335 - RNA, 21 nt, Human
cacacgcaggcguucaagcuc

SEQ ID NO: 420336 - RNA, 21 nt, Human
caccacccccuccacccccaa

SEQ ID NO: 420337 - RNA, 25 nt, Human
caccagcaccacccccuccaccccc

SEQ ID NO: 420338 - RNA, 19 nt, Human
caccaggcugugguccugc

SEQ ID NO: 420339 - RNA, 19 nt, Human
cacccccuccacccccaaa

SEQ ID NO: 420340 - RNA, 27 nt, Human
cacccccuccacccccaaagcgccuug

SEQ ID NO: 420341 - RNA, 19 nt, Human
cacccuggcccugccauca

SEQ ID NO: 420342 - RNA, 24 nt, Human
caccgcagcccaaacgccccccca

SEQ ID NO: 420343 - RNA, 19 nt, Human
caccucugcuccuccgagg

SEQ ID NO: 420344 - RNA, 18 nt, Human
cacgcacggcgaaaggag

SEQ ID NO: 420345 - RNA, 18 nt, Human
cacugcacccagccagag

SEQ ID NO: 420346 - RNA, 18 nt, Human
cagaagcagagaagcuga

SEQ ID NO: 420347 - RNA, 18 nt, Human
cagagaagcugacaggug

SEQ ID NO: 420348 - RNA, 22 nt, Human
cagagaggccagccuccaccac

SEQ ID NO: 420349 - RNA, 19 nt, Human
cagcaaagcccagaaugua

SEQ ID NO: 420350 - RNA, 18 nt, Human
cagcaccacccccuccac

SEQ ID NO: 420351 - RNA, 26 nt, Human
cagcaccagcaccacccccuccaccc

SEQ ID NO: 420352 - RNA, 24 nt, Human
cagcagaaaagaaacccgcuggcc

SEQ ID NO: 420353 - RNA, 26 nt, Human
cagcccaaacgcccccccacggcggg

SEQ ID NO: 420354 - RNA, 19 nt, Human
cagcccagugcagcaccag

SEQ ID NO: 420355 - RNA, 24 nt, Human
cagcggaagaaagaaaaaaacgca

SEQ ID NO: 420356 - RNA, 20 nt, Human
caggacggcugcccggggaa

SEQ ID NO: 420357 - RNA, 19 nt, Human
caggucagaagagaagcac

SEQ ID NO: 420358 - RNA, 24 nt, Human
cagguggaaggaaggagagagagu

SEQ ID NO: 420359 - RNA, 19 nt, Human
caguccacucgggaggggg

SEQ ID NO: 420360 - RNA, 22 nt, Human
caugcaagcauucacugcaucu

SEQ ID NO: 420361 - RNA, 27 nt, Human
cauucuuacauuuaaaagucaacugga

SEQ ID NO: 420362 - RNA, 25 nt, Human
cauuuaaaagucaacuggauugccc

SEQ ID NO: 420363 - RNA, 22 nt, Human
cauuuuggcucugaacugaagg

SEQ ID NO: 420364 - RNA, 21 nt, Human
ccaaagcgccuuggcccagca

SEQ ID NO: 420365 - RNA, 23 nt, Human
ccaaauacuaagcacauuccgcu

SEQ ID NO: 420366 - RNA, 19 nt, Human
ccacccccuccacccccaa

SEQ ID NO: 420367 - RNA, 20 nt, Human
ccacccccuccacccccaaa

SEQ ID NO: 420368 - RNA, 22 nt, Human
ccacgccccauucccucccaac

SEQ ID NO: 420369 - RNA, 18 nt, Human
ccagagaggccagccucc

SEQ ID NO: 420370 - RNA, 19 nt, Human
ccagcaccacccccuccac

SEQ ID NO: 420371 - RNA, 21 nt, Human
ccagcaccacccccuccaccc

SEQ ID NO: 420372 - RNA, 23 nt, Human
ccagcaccacccccuccaccccc

SEQ ID NO: 420373 - RNA, 22 nt, Human
ccagcaguuuagaugcaugugu

SEQ ID NO: 420374 - RNA, 24 nt, Human
ccaggaugacggcuggugaccaaa

SEQ ID NO: 420375 - RNA, 18 nt, Human
ccaggcuccugcugccgg

SEQ ID NO: 420376 - RNA, 23 nt, Human
cccacgccccauucccucccaac

SEQ ID NO: 420377 - RNA, 21 nt, Human
ccccacgccccauucccuccc

SEQ ID NO: 420378 - RNA, 22 nt, Human
ccccaggccacccuggcccugc

SEQ ID NO: 420379 - RNA, 21 nt, Human
cccccacggcggccaccucug

SEQ ID NO: 420380 - RNA, 24 nt, Human
cccccacggcggccaccucugcuc

SEQ ID NO: 420381 - RNA, 19 nt, Human
cccccccuuucagccucac

SEQ ID NO: 420382 - RNA, 27 nt, Human
cccuccacccccaaagcgccuuggccc

SEQ ID NO: 420383 - RNA, 19 nt, Human
ccgcucuuccauagccccc

SEQ ID NO: 420384 - RNA, 19 nt, Human
ccggccgcccccaaacugc

SEQ ID NO: 420385 - RNA, 21 nt, Human
ccuaaccccuagcacucccac

SEQ ID NO: 420386 - RNA, 26 nt, Human
ccuccacccccaaagcgccuuggccc

SEQ ID NO: 420387 - RNA, 19 nt, Human
ccucuuucccaggcuccug

SEQ ID NO: 420388 - RNA, 23 nt, Human
ccugcugccggccgcccccaaac

SEQ ID NO: 420389 - RNA, 22 nt, Human
ccuggcccugccaucaccuggc

SEQ ID NO: 420390 - RNA, 18 nt, Human
cgcuggccauucacugca

SEQ ID NO: 420391 - RNA, 19 nt, Human
cggcugcaggacggcugcc

SEQ ID NO: 420392 - RNA, 20 nt, Human
cgugugaaugcaugcaagca

SEQ ID NO: 420393 - RNA, 21 nt, Human
cuaaccccuagcacucccaca

SEQ ID NO: 420394 - RNA, 25 nt, Human
cuagcugggacacacacacgugugg

SEQ ID NO: 420395 - RNA, 23 nt, Human
cuccugcugccggccgcccccaa

SEQ ID NO: 420396 - RNA, 24 nt, Human
cugaauaccaacaaggucucugcu

SEQ ID NO: 420397 - RNA, 20 nt, Human
cugcaguccucuacugcuau

SEQ ID NO: 420398 - RNA, 23 nt, Human
cugcugggaaaacaaggagcagg

SEQ ID NO: 420399 - RNA, 21 nt, Human
gaaaacaaggagcaggagaaa

SEQ ID NO: 420400 - RNA, 23 nt, Human
gaaaagaaacccgcuggccauuc

SEQ ID NO: 420401 - RNA, 25 nt, Human
gaaaauggggaagcagcggaagaaa

SEQ ID NO: 420402 - RNA, 27 nt, Human
gacagacugggacuugggucggacccc

SEQ ID NO: 420403 - RNA, 22 nt, Human
gagaaagcaaaggaaaaaugac

SEQ ID NO: 420404 - RNA, 20 nt, Human
gcagcaccagcaccaccccc

SEQ ID NO: 420405 - RNA, 19 nt, Human
gcaggcguucaagcucaaa

SEQ ID NO: 420406 - RNA, 19 nt, Human
gccaauggcaggcgcagga

SEQ ID NO: 420407 - RNA, 20 nt, Human
gccagauucuagacccauuu

SEQ ID NO: 420408 - RNA, 24 nt, Human
gcccagugcagcaccagcaccacc

SEQ ID NO: 420409 - RNA, 19 nt, Human
gccggccgcccccaaacug

SEQ ID NO: 420410 - RNA, 21 nt, Human
gcucugaacugaaggggaggu

SEQ ID NO: 420411 - RNA, 24 nt, Human
gcucuuccauagcccccccuuuca

SEQ ID NO: 420412 - RNA, 21 nt, Human
gcugggacacacacacgugug

SEQ ID NO: 420413 - RNA, 22 nt, Human
ggaacaguccagugugucccca

SEQ ID NO: 420414 - RNA, 23 nt, Human
ggaagaaagaaaaaaacgcacaa

SEQ ID NO: 420415 - RNA, 21 nt, Human
ggacagacugggacuugggua

SEQ ID NO: 420416 - RNA, 28 nt, Human
ggacagacugggacuugggucggacccc

SEQ ID NO: 420417 - RNA, 24 nt, Human
ggaugacggcuggugaccaaauac

SEQ ID NO: 420418 - RNA, 19 nt, Human
gggaagcagcggaagaaag

SEQ ID NO: 420419 - RNA, 18 nt, Human
gggugccccaggccaccc

SEQ ID NO: 420420 - RNA, 20 nt, Human
gggugccccaggccacccug

SEQ ID NO: 420421 - RNA, 23 nt, Human
gugcagcaccagcaccacccccu

SEQ ID NO: 420422 - RNA, 18 nt, Human
uaacaagacacaguagga

SEQ ID NO: 420423 - RNA, 21 nt, Human
uaaguaggucaucugaaagca

SEQ ID NO: 420424 - RNA, 19 nt, Human
uacagaacucaacaugcag

SEQ ID NO: 420425 - RNA, 18 nt, Human
uacagcaaagcccagaau

SEQ ID NO: 420426 - RNA, 21 nt, Human
uaggaaaagcccaggaugacg

SEQ ID NO: 420427 - RNA, 23 nt, Human
uaggacagacugggacuugggua

SEQ ID NO: 420428 - RNA, 20 nt, Human
ucacaagcuguguuuccgcu

SEQ ID NO: 420429 - RNA, 21 nt, Human
ucacaagcuguguuuccgcug

SEQ ID NO: 420430 - RNA, 23 nt, Human
ucacugcacccagccagagaggc

SEQ ID NO: 420431 - RNA, 18 nt, Human
ucacugcaucuucuccgg

SEQ ID NO: 420432 - RNA, 19 nt, Human
ucacugcaucuucuccgug

SEQ ID NO: 420433 - RNA, 27 nt, Human
ucagcccagugcagcaccagcaccacc

SEQ ID NO: 420434 - RNA, 19 nt, Human
ucauauagcugaauguguu

SEQ ID NO: 420435 - RNA, 24 nt, Human
ucaucugaaagcaucggguuugau

SEQ ID NO: 420436 - RNA, 26 nt, Human
uccacacaacacacaggcaacaggga

SEQ ID NO: 420437 - RNA, 22 nt, Human
uccaccacgcacggcgaaagga

SEQ ID NO: 420438 - RNA, 18 nt, Human
uccacccccaaagcgccu

SEQ ID NO: 420439 - RNA, 24 nt, Human
ucccacauaacugcugaacccugc

SEQ ID NO: 420440 - RNA, 22 nt, Human
uccccaagauguggccgcagac

SEQ ID NO: 420441 - RNA, 24 nt, Human
ucucauuauguugccuauacuagg

SEQ ID NO: 420442 - RNA, 23 nt, Human
ucuccguggacucccuaccgcuc

SEQ ID NO: 420443 - RNA, 21 nt, Human
ucugaagguuccugacagcuc

SEQ ID NO: 420444 - RNA, 20 nt, Human
ucuguggauugcugaggccu

SEQ ID NO: 420445 - RNA, 22 nt, Human
ucuguggauugcugaggccuug

SEQ ID NO: 420446 - RNA, 23 nt, Human
ucuuccauagcccccccuuucag

SEQ ID NO: 420447 - RNA, 23 nt, Human
ugaccaaauacuaagcacauucc

SEQ ID NO: 420448 - RNA, 22 nt, Human
ugaguaaagugccagauucuag

SEQ ID NO: 420449 - RNA, 21 nt, Human
ugcaggucagaagagaagcac

SEQ ID NO: 420450 - RNA, 21 nt, Human
ugcaugcaagcauucacugca

SEQ ID NO: 420451 - RNA, 24 nt, Human
ugccccaggccacccuggcccugc

SEQ ID NO: 420452 - RNA, 20 nt, Human
ugcccggggacucaccaggc

SEQ ID NO: 420453 - RNA, 19 nt, Human
ugcuaucugaagguuccug

SEQ ID NO: 420454 - RNA, 20 nt, Human
ugcugcugggaaaacaagga

SEQ ID NO: 420455 - RNA, 21 nt, Human
ugcugcugggaaaacaaggag

SEQ ID NO: 420456 - RNA, 22 nt, Human
ugcugcugggaaaacaaggagc

SEQ ID NO: 420457 - RNA, 21 nt, Human
uggaaaggacccugcagauau

SEQ ID NO: 420458 - RNA, 19 nt, Human
uggaaggaaggagagagaa

SEQ ID NO: 420459 - RNA, 21 nt, Human
uggcgagggccucuuucccag

SEQ ID NO: 420460 - RNA, 25 nt, Human
ugggacuuggguacugaaggauuuu

SEQ ID NO: 420461 - RNA, 22 nt, Human
ugugaaaacaaggugccucuga

SEQ ID NO: 420462 - RNA, 19 nt, Human
uguggccgcagaccuagac

SEQ ID NO: 420463 - RNA, 19 nt, Human
uucacaaaauaccauaucc

SEQ ID NO: 420464 - RNA, 21 nt, Human
uucacaaaauaccauauccau

SEQ ID NO: 420465 - RNA, 19 nt, Human
uucccaggcuccugcugcc

SEQ ID NO: 420466 - RNA, 21 nt, Human
uuuggcucugaacugaagggg

SEQ ID NO: 420467 - RNA, 19 nt, Human
aacacagcgguccaaagac

SEQ ID NO: 420468 - RNA, 22 nt, Human
aagcagcccccagggcagcuga

SEQ ID NO: 420469 - RNA, 18 nt, Human
aagugugaaaccuggacc

SEQ ID NO: 420470 - RNA, 24 nt, Human
acacacacacauccacacacacac

SEQ ID NO: 420471 - RNA, 25 nt, Human
acacacacacauccacacacacaca

SEQ ID NO: 420472 - RNA, 25 nt, Human
acacacauccacacacacacacaca

SEQ ID NO: 420473 - RNA, 24 nt, Human
acacacauccacacacacacacag

SEQ ID NO: 420474 - RNA, 25 nt, Human
acacauccacacacacacacacaca

SEQ ID NO: 420475 - RNA, 27 nt, Human
acccacacacacacauccacacacaca

SEQ ID NO: 420476 - RNA, 19 nt, Human
agaauucuuuacaaaaccc

SEQ ID NO: 420477 - RNA, 20 nt, Human
agaauucuuuacaaaacccu

SEQ ID NO: 420478 - RNA, 22 nt, Human
agacaguuuuugcuuuuauugg

SEQ ID NO: 420479 - RNA, 23 nt, Human
agggcagagccagggccuggggc

SEQ ID NO: 420480 - RNA, 18 nt, Human
agggccuggggcaggaag

SEQ ID NO: 420481 - RNA, 22 nt, Human
agugaaggagcagagagaggga

SEQ ID NO: 420482 - RNA, 21 nt, Human
auccacacacacacacacaca

SEQ ID NO: 420483 - RNA, 21 nt, Human
auccccauuuugcagauugaa

SEQ ID NO: 420484 - RNA, 22 nt, Human
augucacagcugccaaggccug

SEQ ID NO: 420485 - RNA, 19 nt, Human
caaccgccuggucccugcu

SEQ ID NO: 420486 - RNA, 27 nt, Human
cacacacacacacacacaugaugccug

SEQ ID NO: 420487 - RNA, 28 nt, Human
cacacacacacacacaugaugccugccc

SEQ ID NO: 420488 - RNA, 30 nt, Human
cacacacacacauccacacacacacacaca

SEQ ID NO: 420489 - RNA, 31 nt, Human
cacacacacauccacacacacacacacacag

SEQ ID NO: 420490 - RNA, 25 nt, Human
cacacacauccacacacacacacac

SEQ ID NO: 420491 - RNA, 31 nt, Human
cacacacauccacacacacacacacacaugg

SEQ ID NO: 420492 - RNA, 18 nt, Human
cacagcugccaaggccug

SEQ ID NO: 420493 - RNA, 24 nt, Human
cagcagugaaggagcagagagagg

SEQ ID NO: 420494 - RNA, 20 nt, Human
cagcgguccaaagacagcgg

SEQ ID NO: 420495 - RNA, 18 nt, Human
cagcugagugagcagcag

SEQ ID NO: 420496 - RNA, 19 nt, Human
ccacacacacacacacaca

SEQ ID NO: 420497 - RNA, 24 nt, Human
ccacacacacacauccacacacac

SEQ ID NO: 420498 - RNA, 30 nt, Human
ccacacacacacauccacacacacacacag

SEQ ID NO: 420499 - RNA, 22 nt, Human
cccacacacacacauccacaca

SEQ ID NO: 420500 - RNA, 23 nt, Human
cccacacacacacauccacacac

SEQ ID NO: 420501 - RNA, 28 nt, Human
cccacacacacacauccacacacacaca

SEQ ID NO: 420502 - RNA, 19 nt, Human
cccagagaugaucccugga

SEQ ID NO: 420503 - RNA, 20 nt, Human
cccucugggucagcagugaa

SEQ ID NO: 420504 - RNA, 22 nt, Human
ccuggacccugcuccacccccc

SEQ ID NO: 420505 - RNA, 25 nt, Human
ccuggacccugcuccaccccccagg

SEQ ID NO: 420506 - RNA, 20 nt, Human
ccugggaucaggcccuccug

SEQ ID NO: 420507 - RNA, 24 nt, Human
cgagucacccaaggucacggugcu

SEQ ID NO: 420508 - RNA, 23 nt, Human
cuccucuuuccaccguugagccc

SEQ ID NO: 420509 - RNA, 23 nt, Human
cuuuucugcuucucugcucagga

SEQ ID NO: 420510 - RNA, 22 nt, Human
gaaacacagcgguccaaagaca

SEQ ID NO: 420511 - RNA, 18 nt, Human
gaaagcagcccccagggc

SEQ ID NO: 420512 - RNA, 19 nt, Human
gacagcggacgagucaccc

SEQ ID NO: 420513 - RNA, 23 nt, Human
gagcagggacggggacucugcuc

SEQ ID NO: 420514 - RNA, 26 nt, Human
gagccagggccuggggcaggaaggga

SEQ ID NO: 420515 - RNA, 21 nt, Human
gcagcugagugagcagcaggg

SEQ ID NO: 420516 - RNA, 19 nt, Human
gcccagggaaagcagcccc

SEQ ID NO: 420517 - RNA, 19 nt, Human
gcugucgccgccgcaaccg

SEQ ID NO: 420518 - RNA, 19 nt, Human
ggcaggaagggagugcccg

SEQ ID NO: 420519 - RNA, 20 nt, Human
gugacagauaaacagcaucc

SEQ ID NO: 420520 - RNA, 21 nt, Human
ucaggaacagaggucugugcc

SEQ ID NO: 420521 - RNA, 24 nt, Human
uccaaagacagcggacgagucacc

SEQ ID NO: 420522 - RNA, 20 nt, Human
uccacacacacacacacaca

SEQ ID NO: 420523 - RNA, 21 nt, Human
uccacacacacacacacacau

SEQ ID NO: 420524 - RNA, 25 nt, Human
uccacacacacacacacacaugaug

SEQ ID NO: 420525 - RNA, 23 nt, Human
ucccuggagcccgugcccaggga

SEQ ID NO: 420526 - RNA, 21 nt, Human
uccugggaucaggcccuccug

SEQ ID NO: 420527 - RNA, 21 nt, Human
ucucugcucaggaacagaggu

SEQ ID NO: 420528 - RNA, 19 nt, Human
ucugcucuucuugaccucc

SEQ ID NO: 420529 - RNA, 21 nt, Human
ugacagauaaacagcauccuc

SEQ ID NO: 420530 - RNA, 23 nt, Human
ugacagauaaacagcauccuccu

SEQ ID NO: 420531 - RNA, 20 nt, Human
ugagcccccggaguugccag

SEQ ID NO: 420532 - RNA, 23 nt, Human
ugagcccccggaguugccagccu

SEQ ID NO: 420533 - RNA, 19 nt, Human
ugccaaggccuggggguca

SEQ ID NO: 420534 - RNA, 20 nt, Human
ugccugcccugcugugguca

SEQ ID NO: 420535 - RNA, 19 nt, Human
uggacccugcuccaccccc

SEQ ID NO: 420536 - RNA, 19 nt, Human
uggcagagcagggacgggg

SEQ ID NO: 420537 - RNA, 22 nt, Human
ugucacagcugccaaggccugg

SEQ ID NO: 420538 - RNA, 21 nt, Human
ugucggggagcaaguggaggu

SEQ ID NO: 420539 - RNA, 19 nt, Human
uugaccuccaggagguggc

SEQ ID NO: 420540 - RNA, 23 nt, Human
aacacagauaccaguguuggaca

SEQ ID NO: 420541 - RNA, 18 nt, Human
aacacggccgccccaucc

SEQ ID NO: 420542 - RNA, 19 nt, Human
aacacggugaaauuccauc

SEQ ID NO: 420543 - RNA, 20 nt, Human
aacacggugaaauuccaucu

SEQ ID NO: 420544 - RNA, 21 nt, Human
aacacggugaaauuccaucuc

SEQ ID NO: 420545 - RNA, 22 nt, Human
aagaacacagauaccaguguug

SEQ ID NO: 420546 - RNA, 18 nt, Human
aaggucccucugggcccc

SEQ ID NO: 420547 - RNA, 24 nt, Human
aagugacauuuccacuggaagcac

SEQ ID NO: 420548 - RNA, 21 nt, Human
acaccacugacacuggcgggc

SEQ ID NO: 420549 - RNA, 19 nt, Human
acacggugaaauuccaucu

SEQ ID NO: 420550 - RNA, 20 nt, Human
accacggccgccccauccug

SEQ ID NO: 420551 - RNA, 19 nt, Human
accaguguuggacaguggu

SEQ ID NO: 420552 - RNA, 23 nt, Human
accaguguuggacagugguuuug

SEQ ID NO: 420553 - RNA, 21 nt, Human
agaacacagauaccaguguug

SEQ ID NO: 420554 - RNA, 18 nt, Human
agagggcuuggugacggg

SEQ ID NO: 420555 - RNA, 18 nt, Human
agcaaccaacaauagcaa

SEQ ID NO: 420556 - RNA, 18 nt, Human
agcucugcagaggccagc

SEQ ID NO: 420557 - RNA, 21 nt, Human
aggagcgguggcucacgccua

SEQ ID NO: 420558 - RNA, 24 nt, Human
aggaucgcuugagaucaagagcuc

SEQ ID NO: 420559 - RNA, 22 nt, Human
aggcagggaggaucgcuugaga

SEQ ID NO: 420560 - RNA, 24 nt, Human
aggcagggaggaucgcuugagauc

SEQ ID NO: 420561 - RNA, 21 nt, Human
aggccgaggcagggaggaucg

SEQ ID NO: 420562 - RNA, 25 nt, Human
aggccgaggcagggaggaucgcuug

SEQ ID NO: 420563 - RNA, 19 nt, Human
aggggaagagagccagggc

SEQ ID NO: 420564 - RNA, 19 nt, Human
aggugccugccccacaaag

SEQ ID NO: 420565 - RNA, 18 nt, Human
aguagcucugggaaaugg

SEQ ID NO: 420566 - RNA, 23 nt, Human
auagcacaaaagaacacagauac

SEQ ID NO: 420567 - RNA, 18 nt, Human
auggggacugggugacag

SEQ ID NO: 420568 - RNA, 19 nt, Human
caaaagaacacagauacca

SEQ ID NO: 420569 - RNA, 23 nt, Human
caacaauagcaauuaggaaucca

SEQ ID NO: 420570 - RNA, 18 nt, Human
caagcugaugccaacacc

SEQ ID NO: 420571 - RNA, 21 nt, Human
cacaacacuguuuaaucagcu

SEQ ID NO: 420572 - RNA, 18 nt, Human
cacagauaccaguguugg

SEQ ID NO: 420573 - RNA, 18 nt, Human
cacgcauggccagguggu

SEQ ID NO: 420574 - RNA, 24 nt, Human
cacgccuauaaucccagcacguug

SEQ ID NO: 420575 - RNA, 18 nt, Human
cacggccgccccauccug

SEQ ID NO: 420576 - RNA, 21 nt, Human
cacugaaucauccguacaucc

SEQ ID NO: 420577 - RNA, 20 nt, Human
cacuggcgggcgggcagggc

SEQ ID NO: 420578 - RNA, 23 nt, Human
cagaaaucucuacucugaaaucc

SEQ ID NO: 420579 - RNA, 24 nt, Human
cagcacguugggaggccgaggcag

SEQ ID NO: 420580 - RNA, 25 nt, Human
cagcacguugggaggccgaggcagg

SEQ ID NO: 420581 - RNA, 25 nt, Human
caguggucccucuuugccuuggcuc

SEQ ID NO: 420582 - RNA, 23 nt, Human
cauuuaaaaccccagcaaccaac

SEQ ID NO: 420583 - RNA, 20 nt, Human
ccaggagcaaccauggcagg

SEQ ID NO: 420584 - RNA, 18 nt, Human
ccaggguuccucaccacg

SEQ ID NO: 420585 - RNA, 18 nt, Human
cccacaaagccugggucg

SEQ ID NO: 420586 - RNA, 20 nt, Human
cccagcacguugggaggccg

SEQ ID NO: 420587 - RNA, 25 nt, Human
cccagcucuucccaugagacaguca

SEQ ID NO: 420588 - RNA, 21 nt, Human
ccccacaaagccugggucggg

SEQ ID NO: 420589 - RNA, 24 nt, Human
ccccauccugagcccgcacaccug

SEQ ID NO: 420590 - RNA, 24 nt, Human
ccccucuauaaguuaacuguacaa

SEQ ID NO: 420591 - RNA, 18 nt, Human
cccgcacaccugcccaag

SEQ ID NO: 420592 - RNA, 23 nt, Human
cccucuauaaguuaacuguacaa

SEQ ID NO: 420593 - RNA, 21 nt, Human
ccguccauaccaggagccggg

SEQ ID NO: 420594 - RNA, 19 nt, Human
ccucuugugaugcugagag

SEQ ID NO: 420595 - RNA, 26 nt, Human
ccugcagcucccgugaguaacugucu

SEQ ID NO: 420596 - RNA, 27 nt, Human
ccugcagcucccgugaguaacugucuu

SEQ ID NO: 420597 - RNA, 19 nt, Human
ccugccccacaaagccugg

SEQ ID NO: 420598 - RNA, 19 nt, Human
ccugggucgggagagggcu

SEQ ID NO: 420599 - RNA, 23 nt, Human
cgccuauaaucccagcacguugg

SEQ ID NO: 420600 - RNA, 24 nt, Human
cgccuauaaucccagcacguuggg

SEQ ID NO: 420601 - RNA, 21 nt, Human
cuaggagacaacacagaaauc

SEQ ID NO: 420602 - RNA, 20 nt, Human
cucaaggucccucugggccc

SEQ ID NO: 420603 - RNA, 22 nt, Human
cucacgccuauaaucccagcac

SEQ ID NO: 420604 - RNA, 22 nt, Human
cucacgccuauaaucccagcac

SEQ ID NO: 420605 - RNA, 22 nt, Human
cuccagaccagccuaggcaaca

SEQ ID NO: 420606 - RNA, 19 nt, Human
cucugggccccagcucuuc

SEQ ID NO: 420607 - RNA, 21 nt, Human
cugaugccaacaccacugaca

SEQ ID NO: 420608 - RNA, 19 nt, Human
cugcagaggccagcccugg

SEQ ID NO: 420609 - RNA, 22 nt, Human
cugggccccagcucuucccaug

SEQ ID NO: 420610 - RNA, 20 nt, Human
cuuccaggagcaaccauggc

SEQ ID NO: 420611 - RNA, 24 nt, Human
cuuccugagugaacugaagcccaa

SEQ ID NO: 420612 - RNA, 19 nt, Human
cuuggcuccuuucuucuug

SEQ ID NO: 420613 - RNA, 27 nt, Human
cuuugccuuggcuccuuucuucuuggu

SEQ ID NO: 420614 - RNA, 19 nt, Human
gagagggcuuggugacggg

SEQ ID NO: 420615 - RNA, 19 nt, Human
gagcagaggaggauucagg

SEQ ID NO: 420616 - RNA, 19 nt, Human
gagccagggccccacccaa

SEQ ID NO: 420617 - RNA, 23 nt, Human
gaggggaccuacucugcccuguu

SEQ ID NO: 420618 - RNA, 18 nt, Human
gaucgcuugagaucaaga

SEQ ID NO: 420619 - RNA, 22 nt, Human
gcagcgauggguccaugagcac

SEQ ID NO: 420620 - RNA, 20 nt, Human
gccagggccccacccaacaa

SEQ ID NO: 420621 - RNA, 27 nt, Human
gccccagcucuucccaugagacaguca

SEQ ID NO: 420622 - RNA, 20 nt, Human
gcccuguucuggucacuacu

SEQ ID NO: 420623 - RNA, 19 nt, Human
gcguggccuggugaaugga

SEQ ID NO: 420624 - RNA, 23 nt, Human
ggaucgcuugagaucaagagcuc

SEQ ID NO: 420625 - RNA, 21 nt, Human
ggccaggagcgguggcucacg

SEQ ID NO: 420626 - RNA, 18 nt, Human
ggcgacagccucauuucu

SEQ ID NO: 420627 - RNA, 21 nt, Human
ggcucacgccuauaaucccag

SEQ ID NO: 420628 - RNA, 24 nt, Human
gguggcucacgccuauaaucccag

SEQ ID NO: 420629 - RNA, 19 nt, Human
gugcacgcauggccaggug

SEQ ID NO: 420630 - RNA, 20 nt, Human
gugcacgcauggccaggugg

SEQ ID NO: 420631 - RNA, 23 nt, Human
guggcucacgccuauaaucccag

SEQ ID NO: 420632 - RNA, 20 nt, Human
guggucccucuuugccuugg

SEQ ID NO: 420633 - RNA, 19 nt, Human
uagcacaaaagaacacaga

SEQ ID NO: 420634 - RNA, 21 nt, Human
uagcacaaaagaacacagaua

SEQ ID NO: 420635 - RNA, 22 nt, Human
uagcacaaaagaacacagauac

SEQ ID NO: 420636 - RNA, 18 nt, Human
uagcucugggaaaugguc

SEQ ID NO: 420637 - RNA, 21 nt, Human
ucauagcacaaaagaacacag

SEQ ID NO: 420638 - RNA, 23 nt, Human
ucccaggcugugcacgcauggcc

SEQ ID NO: 420639 - RNA, 19 nt, Human
uccguccauaccaggagcc

SEQ ID NO: 420640 - RNA, 22 nt, Human
uccugagcccgcacaccugccc

SEQ ID NO: 420641 - RNA, 19 nt, Human
uccuuggaaggcagcgaug

SEQ ID NO: 420642 - RNA, 21 nt, Human
ucuauaaguuaacuguacaag

SEQ ID NO: 420643 - RNA, 26 nt, Human
ucugcagaggccagcccuggagcagg

SEQ ID NO: 420644 - RNA, 21 nt, Human
ugaaauaaacuacauguaaug

SEQ ID NO: 420645 - RNA, 18 nt, Human
ugaagcccaaagaaaggg

SEQ ID NO: 420646 - RNA, 21 nt, Human
ugagcccgcacaccugcccaa

SEQ ID NO: 420647 - RNA, 23 nt, Human
ugcccuguucuggucacuacuuc

SEQ ID NO: 420648 - RNA, 24 nt, Human
uggccaggagcgguggcucacgcc

SEQ ID NO: 420649 - RNA, 21 nt, Human
uggcucacgccuauaauccca

SEQ ID NO: 420650 - RNA, 22 nt, Human
uggcucacgccuauaaucccag

SEQ ID NO: 420651 - RNA, 24 nt, Human
uggcucacgccuauaaucccagca

SEQ ID NO: 420652 - RNA, 19 nt, Human
uggcuccugguguugccuu

SEQ ID NO: 420653 - RNA, 19 nt, Human
uggcuccugguguugccuu

SEQ ID NO: 420654 - RNA, 18 nt, Human
ugggaggccgaggcaggg

SEQ ID NO: 420655 - RNA, 24 nt, Human
ugggaggccgaggcagggaggauc

SEQ ID NO: 420656 - RNA, 22 nt, Human
ugguuggaggagauacuuuuuc

SEQ ID NO: 420657 - RNA, 19 nt, Human
uuaaaaccccagcaaccaa

SEQ ID NO: 420658 - RNA, 19 nt, Human
uugagauguuuugguugga

SEQ ID NO: 420659 - RNA, 25 nt, Human
uugggaggccgaggcagggaggauc

SEQ ID NO: 420660 - RNA, 20 nt, Human
uuuucuggcaacauuucuga

SEQ ID NO: 420661 - RNA, 20 nt, Human
uuuuuuuuuucaacuaaaau

SEQ ID NO: 420662 - RNA, 23 nt, Human
uuuuuuuuuuuucaacuaaaaug

SEQ ID NO: 420663 - RNA, 19 nt, Human
aaaaaggaaagauacccac

SEQ ID NO: 420664 - RNA, 18 nt, Human
aaaaggaaagauacccac

SEQ ID NO: 420665 - RNA, 20 nt, Human
aaacucuagugccugauucg

SEQ ID NO: 420666 - RNA, 24 nt, Human
aagcacaaaaucugacaaugaaac

SEQ ID NO: 420667 - RNA, 24 nt, Human
aagcacaaaaucugacaaugaaac

SEQ ID NO: 420668 - RNA, 26 nt, Human
aagcacaaaaucugacaaugaaacau

SEQ ID NO: 420669 - RNA, 26 nt, Human
aagcacaaaaucugacaaugaaacau

SEQ ID NO: 420670 - RNA, 24 nt, Human
aagcaugauggugaaacggugacc

SEQ ID NO: 420671 - RNA, 24 nt, Human
aagcaugauggugaaacggugacc

SEQ ID NO: 420672 - RNA, 24 nt, Human
acaaggguucuaaaaacuuggaca

SEQ ID NO: 420673 - RNA, 24 nt, Human
acaaggguucuaaaaacuuggaca

SEQ ID NO: 420674 - RNA, 24 nt, Human
acacgcaaaaacacucccaaucac

SEQ ID NO: 420675 - RNA, 19 nt, Human
agagcagaagagggaaaga

SEQ ID NO: 420676 - RNA, 19 nt, Human
agagcagaagagggaaaga

SEQ ID NO: 420677 - RNA, 24 nt, Human
agagggaaagacaggggaacauca

SEQ ID NO: 420678 - RNA, 24 nt, Human
agagggaaagacaggggaacauca

SEQ ID NO: 420679 - RNA, 23 nt, Human
agcagaagagggaaagacagggg

SEQ ID NO: 420680 - RNA, 23 nt, Human
agcagaagagggaaagacagggg

SEQ ID NO: 420681 - RNA, 29 nt, Human
agccaacauuuaccagugauuccgacacc

SEQ ID NO: 420682 - RNA, 21 nt, Human
agccgcggcggggccaggggc

SEQ ID NO: 420683 - RNA, 21 nt, Human
agccgcggcggggccaggggc

SEQ ID NO: 420684 - RNA, 24 nt, Human
agccuccggggccggcccgcgcug

SEQ ID NO: 420685 - RNA, 23 nt, Human
augauggugaaacggugaccagg

SEQ ID NO: 420686 - RNA, 23 nt, Human
augauggugaaacggugaccagg

SEQ ID NO: 420687 - RNA, 20 nt, Human
cacagaaauagagaaaugac

SEQ ID NO: 420688 - RNA, 23 nt, Human
caccuguacaaccuccccugaca

SEQ ID NO: 420689 - RNA, 23 nt, Human
caccuguacaaccuccccugaca

SEQ ID NO: 420690 - RNA, 30 nt, Human
cagccaacauuuaccagugauuccgacacc

SEQ ID NO: 420691 - RNA, 24 nt, Human
caggaacaugagccccccggcuca

SEQ ID NO: 420692 - RNA, 24 nt, Human
caggaacaugagccccccggcuca

SEQ ID NO: 420693 - RNA, 21 nt, Human
ccauccagaggcggggguggg

SEQ ID NO: 420694 - RNA, 19 nt, Human
cccacaauuccauucuuaa

SEQ ID NO: 420695 - RNA, 19 nt, Human
cccacaauuccauucuuaa

SEQ ID NO: 420696 - RNA, 22 nt, Human
cccccggcucauucaccuguac

SEQ ID NO: 420697 - RNA, 22 nt, Human
cccccggcucauucaccuguac

SEQ ID NO: 420698 - RNA, 18 nt, Human
ccgcgcugcgaauuacac

SEQ ID NO: 420699 - RNA, 24 nt, Human
ccuccccugacagauagugagagc

SEQ ID NO: 420700 - RNA, 24 nt, Human
ccuccccugacagauagugagagc

SEQ ID NO: 420701 - RNA, 20 nt, Human
ccuuugcucuugagagcaga

SEQ ID NO: 420702 - RNA, 20 nt, Human
ccuuugcucuugagagcaga

SEQ ID NO: 420703 - RNA, 21 nt, Human
cgacacacgcaaaaacacucc

SEQ ID NO: 420704 - RNA, 21 nt, Human
cgacacacgcaaaaacacucc

SEQ ID NO: 420705 - RNA, 22 nt, Human
cgaggccgagcccggggacugg

SEQ ID NO: 420706 - RNA, 23 nt, Human
cgaggccggggcucagaggccag

SEQ ID NO: 420707 - RNA, 21 nt, Human
cgcaaaaacacucccaaucac

SEQ ID NO: 420708 - RNA, 25 nt, Human
cugcacugaaaaagaaaaggaaggg

SEQ ID NO: 420709 - RNA, 21 nt, Human
cugcacugaaaaagaaaaggc

SEQ ID NO: 420710 - RNA, 21 nt, Human
cugcacugaaaaagaaaaggc

SEQ ID NO: 420711 - RNA, 18 nt, Human
cuguggguuuuaguuaug

SEQ ID NO: 420712 - RNA, 18 nt, Human
cuguggguuuuaguuaug

SEQ ID NO: 420713 - RNA, 22 nt, Human
gagacagacaucuguucaacac

SEQ ID NO: 420714 - RNA, 22 nt, Human
gagacagacaucuguucaacac

SEQ ID NO: 420715 - RNA, 18 nt, Human
gagagccuccggggccgg

SEQ ID NO: 420716 - RNA, 21 nt, Human
gagcccggggacuggagccgg

SEQ ID NO: 420717 - RNA, 23 nt, Human
gagccgcggcggggccaggggcu

SEQ ID NO: 420718 - RNA, 21 nt, Human
gagguggcgcucugaaggcag

SEQ ID NO: 420719 - RNA, 21 nt, Human
gagguggcgcucugaaggcag

SEQ ID NO: 420720 - RNA, 24 nt, Human
gccggcccgcgcugcgaauuacac

SEQ ID NO: 420721 - RNA, 23 nt, Human
gccucuugugguggggugggggc

SEQ ID NO: 420722 - RNA, 24 nt, Human
gccucuugugguggggugggggca

SEQ ID NO: 420723 - RNA, 18 nt, Human
gcucugugugcuuuggag

SEQ ID NO: 420724 - RNA, 20 nt, Human
ggccaggggcucugugugcu

SEQ ID NO: 420725 - RNA, 20 nt, Human
ggccaggggcucugugugcu

SEQ ID NO: 420726 - RNA, 25 nt, Human
ggccggcccgcgcugcgaauuacac

SEQ ID NO: 420727 - RNA, 20 nt, Human
ggcggggccaggggcucugu

SEQ ID NO: 420728 - RNA, 20 nt, Human
ggcggggccaggggcucugu

SEQ ID NO: 420729 - RNA, 23 nt, Human
ggcggggccaggggcucugugug

SEQ ID NO: 420730 - RNA, 23 nt, Human
ggcggggccaggggcucugugug

SEQ ID NO: 420731 - RNA, 24 nt, Human
gggaaagacaggggaacaucaaag

SEQ ID NO: 420732 - RNA, 24 nt, Human
gggaaagacaggggaacaucaaag

SEQ ID NO: 420733 - RNA, 23 nt, Human
gggcucugugugcuuuggaggcu

SEQ ID NO: 420734 - RNA, 23 nt, Human
gggcucugugugcuuuggaggcu

SEQ ID NO: 420735 - RNA, 21 nt, Human
ggggccggcccgcgcugcgaa

SEQ ID NO: 420736 - RNA, 21 nt, Human
ggggcucugugugcuuuggag

SEQ ID NO: 420737 - RNA, 18 nt, Human
gguccauccagaggcggg

SEQ ID NO: 420738 - RNA, 20 nt, Human
gguggggugggggcaugggg

SEQ ID NO: 420739 - RNA, 20 nt, Human
gugguggggugggggcaugg

SEQ ID NO: 420740 - RNA, 18 nt, Human
gugugagucacacacuag

SEQ ID NO: 420741 - RNA, 18 nt, Human
gugugagucacacacuag

SEQ ID NO: 420742 - RNA, 18 nt, Human
uacagugacuucaucuuu

SEQ ID NO: 420743 - RNA, 18 nt, Human
uacagugacuucaucuuu

SEQ ID NO: 420744 - RNA, 25 nt, Human
uacauuaaaaaaaaaggaaagauac

SEQ ID NO: 420745 - RNA, 25 nt, Human
uacauuaaaaaaaaaggaaagauac

SEQ ID NO: 420746 - RNA, 18 nt, Human
uacccacaauuccauucu

SEQ ID NO: 420747 - RNA, 18 nt, Human
uacccacaauuccauucu

SEQ ID NO: 420748 - RNA, 24 nt, Human
ucacagaaauagagaaaugacaug

SEQ ID NO: 420749 - RNA, 18 nt, Human
ucagaggccagcucgcgc

SEQ ID NO: 420750 - RNA, 22 nt, Human
ucagaggccagcucgcgccugc

SEQ ID NO: 420751 - RNA, 22 nt, Human
uccgaggccggggcucagaggc

SEQ ID NO: 420752 - RNA, 20 nt, Human
ucgccgagagccuccggggc

SEQ ID NO: 420753 - RNA, 20 nt, Human
ucuaaaaacuuggacacggu

SEQ ID NO: 420754 - RNA, 20 nt, Human
ucuaaaaacuuggacacggu

SEQ ID NO: 420755 - RNA, 18 nt, Human
ucugcacugaaaaagaaa

SEQ ID NO: 420756 - RNA, 18 nt, Human
ucugcacugaaaaagaaa

SEQ ID NO: 420757 - RNA, 19 nt, Human
ugaaaaagaaaaggaaggg

SEQ ID NO: 420758 - RNA, 23 nt, Human
ugagagcagaagagggaaagaca

SEQ ID NO: 420759 - RNA, 23 nt, Human
ugagagcagaagagggaaagaca

SEQ ID NO: 420760 - RNA, 19 nt, Human
ugagagccgcggcggggcc

SEQ ID NO: 420761 - RNA, 19 nt, Human
ugagagccgcggcggggcc

SEQ ID NO: 420762 - RNA, 20 nt, Human
ugagagccgcggcggggcca

SEQ ID NO: 420763 - RNA, 20 nt, Human
ugagagccgcggcggggcca

SEQ ID NO: 420764 - RNA, 18 nt, Human
ugaucuggagguggcgcu

SEQ ID NO: 420765 - RNA, 18 nt, Human
ugaucuggagguggcgcu

SEQ ID NO: 420766 - RNA, 22 nt, Human
ugccucuugugguggggugggg

SEQ ID NO: 420767 - RNA, 23 nt, Human
uggagguggcgcucugaaggcag

SEQ ID NO: 420768 - RNA, 21 nt, Human
uggagugggcgguccgaggcc

SEQ ID NO: 420769 - RNA, 18 nt, Human
uggggugggggcaugggg

SEQ ID NO: 420770 - RNA, 20 nt, Human
uggggugggggcaugggggc

SEQ ID NO: 420771 - RNA, 23 nt, Human
ugguggggugggggcaugggggg

SEQ ID NO: 420772 - RNA, 25 nt, Human
ugugguggggugggggcaugggggc

SEQ ID NO: 420773 - RNA, 24 nt, Human
uguguccccaucugaucuggaggu

SEQ ID NO: 420774 - RNA, 24 nt, Human
uguguccccaucugaucuggaggu

SEQ ID NO: 420775 - RNA, 19 nt, Human
uuuaauuauuucucaggcu

SEQ ID NO: 420776 - RNA, 19 nt, Human
uuuaauuauuucucaggcu

SEQ ID NO: 420777 - RNA, 20 nt, Human
uuuuuuuuuuuuuuuuuugg

SEQ ID NO: 420778 - RNA, 20 nt, Human
uuuuuuuuuuuuuuuuuugg

SEQ ID NO: 420779 - RNA, 30 nt, Human
aaccgccucacuaacggucgccacuccacu

SEQ ID NO: 420780 - RNA, 20 nt, Human
cacagcccagcagaccccuu

SEQ ID NO: 420781 - RNA, 19 nt, Human
cagaccccaaggcgggcag

SEQ ID NO: 420782 - RNA, 20 nt, Human
cagcgucugucucagcaacc

SEQ ID NO: 420783 - RNA, 20 nt, Human
ccaaggcgggcagagggugg

SEQ ID NO: 420784 - RNA, 20 nt, Human
ccagaaaagcagcaaaagca

SEQ ID NO: 420785 - RNA, 23 nt, Human
ccuuacggcucgggcuccuccua

SEQ ID NO: 420786 - RNA, 24 nt, Human
cgccucagcgucugucucagcaac

SEQ ID NO: 420787 - RNA, 20 nt, Human
cuaacggucgccacuccaca

SEQ ID NO: 420788 - RNA, 18 nt, Human
gggcuccuccuacccgcc

SEQ ID NO: 420789 - RNA, 23 nt, Human
uaccccuggcaacguacaugcgc

SEQ ID NO: 420790 - RNA, 23 nt, Human
ucagcgucugucucagcaaccgc

SEQ ID NO: 420791 - RNA, 18 nt, Human
uguccgaaagggaaagcc

SEQ ID NO: 420792 - RNA, 20 nt, Human
ugucucagcaaccgccucac

SEQ ID NO: 420793 - RNA, 18 nt, Human
uuuuuuuuuuuuuuuuug

SEQ ID NO: 420794 - RNA, 22 nt, Human
uuuuuuuuuuuuuuuuugacag

SEQ ID NO: 420795 - RNA, 19 nt, Human
aaggaaaaaguugaaaaaa

SEQ ID NO: 420796 - RNA, 22 nt, Human
acaaauaccuaauuaaaacaau

SEQ ID NO: 420797 - RNA, 23 nt, Human
acacacacacacacacacacaca

SEQ ID NO: 420798 - RNA, 23 nt, Human
acacacacacacacacacacaca

SEQ ID NO: 420799 - RNA, 23 nt, Human
acacacacacacacacacacaca

SEQ ID NO: 420800 - RNA, 23 nt, Human
acacacacacacacacacacaca

SEQ ID NO: 420801 - RNA, 23 nt, Human
acacacacacacacacacacaca

SEQ ID NO: 420802 - RNA, 23 nt, Human
acacacacacacacacacacaca

SEQ ID NO: 420803 - RNA, 31 nt, Human
acacacacacacacacacacacgaaguguag

SEQ ID NO: 420804 - RNA, 21 nt, Human
acacauacacacacacacaca

SEQ ID NO: 420805 - RNA, 21 nt, Human
agaaauggagcccagcccaua

SEQ ID NO: 420806 - RNA, 27 nt, Human
agugucaacuauauauauguaugugua

SEQ ID NO: 420807 - RNA, 24 nt, Human
auacacauacacacacacacacac

SEQ ID NO: 420808 - RNA, 24 nt, Human
auauacagacauaacuugcagaag

SEQ ID NO: 420809 - RNA, 18 nt, Human
auguauguguacauacac

SEQ ID NO: 420810 - RNA, 20 nt, Human
cacacacacacacacacaca

SEQ ID NO: 420811 - RNA, 20 nt, Human
cacacacacacacacacaca

SEQ ID NO: 420812 - RNA, 20 nt, Human
cacacacacacacacacaca

SEQ ID NO: 420813 - RNA, 20 nt, Human
cacacacacacacacacaca

SEQ ID NO: 420814 - RNA, 20 nt, Human
cacacacacacacacacaca

SEQ ID NO: 420815 - RNA, 20 nt, Human
cacacacacacacacacaca

SEQ ID NO: 420816 - RNA, 20 nt, Human
cacacacacacacacacaca

SEQ ID NO: 420817 - RNA, 20 nt, Human
cacacacacacacacacaca

SEQ ID NO: 420818 - RNA, 22 nt, Human
cacacacacacacacacacaca

SEQ ID NO: 420819 - RNA, 26 nt, Human
cacacacacacacacacacacacaca

SEQ ID NO: 420820 - RNA, 26 nt, Human
cacacacacacacacacacacacaca

SEQ ID NO: 420821 - RNA, 26 nt, Human
cacacacacacacacacacacacaca

SEQ ID NO: 420822 - RNA, 26 nt, Human
cacacacacacacacacacacacaca

SEQ ID NO: 420823 - RNA, 26 nt, Human
cacacacacacacacacacacacaca

SEQ ID NO: 420824 - RNA, 26 nt, Human
cacacacacacacacacacacacacg

SEQ ID NO: 420825 - RNA, 30 nt, Human
cacacacacacacacacacacacgaagugg

SEQ ID NO: 420826 - RNA, 26 nt, Human
cacauacacacacacacacacacaca

SEQ ID NO: 420827 - RNA, 21 nt, Human
caccugguugucucaauaggc

SEQ ID NO: 420828 - RNA, 25 nt, Human
cauacacacacacacacacacacac

SEQ ID NO: 420829 - RNA, 21 nt, Human
caucugccauaaaaaaauacg

SEQ ID NO: 420830 - RNA, 19 nt, Human
ccaucaggcaaagcuggaa

SEQ ID NO: 420831 - RNA, 21 nt, Human
cuaaguaacauuuucuuuucu

SEQ ID NO: 420832 - RNA, 26 nt, Human
cuuuaaaggaaaaaguugaaaaaaaa

SEQ ID NO: 420833 - RNA, 22 nt, Human
gcggggcguaggggugggucag

SEQ ID NO: 420834 - RNA, 21 nt, Human
gcguaggggugggucagugcc

SEQ ID NO: 420835 - RNA, 30 nt, Human
guauguguacauacacauacacacacacag

SEQ ID NO: 420836 - RNA, 23 nt, Human
gugucaacuauauauauguaugu

SEQ ID NO: 420837 - RNA, 22 nt, Human
uaacuugcagaagguuaagucu

SEQ ID NO: 420838 - RNA, 20 nt, Human
uaagaugacgccaacucuuc

SEQ ID NO: 420839 - RNA, 21 nt, Human
uaagucugaggacgcuguucu

SEQ ID NO: 420840 - RNA, 19 nt, Human
uacaauauauauaauacau

SEQ ID NO: 420841 - RNA, 20 nt, Human
uacacacacacacacacaca

SEQ ID NO: 420842 - RNA, 25 nt, Human
uacacacacacacacacacacacac

SEQ ID NO: 420843 - RNA, 22 nt, Human
uaccacaggugaagcaaucuca

SEQ ID NO: 420844 - RNA, 21 nt, Human
uauauacagacauaacuugca

SEQ ID NO: 420845 - RNA, 22 nt, Human
uauguauguguacauacacaua

SEQ ID NO: 420846 - RNA, 21 nt, Human
ucaauaggcaguaaaaccuaa

SEQ ID NO: 420847 - RNA, 18 nt, Human
ucagaagcccagccaggc

SEQ ID NO: 420848 - RNA, 21 nt, Human
ugaaaaaaaaaagauaccaca

SEQ ID NO: 420849 - RNA, 20 nt, Human
ugacugugcggggcguaggg

SEQ ID NO: 420850 - RNA, 24 nt, Human
ugagagcacagaaaguuuuuaaac

SEQ ID NO: 420851 - RNA, 18 nt, Human
ugcauuuuuauggccaaa

SEQ ID NO: 420852 - RNA, 23 nt, Human
ugccauaaaaaaauacgaaaaac

SEQ ID NO: 420853 - RNA, 22 nt, Human
uggaaaccacauccugauauca

SEQ ID NO: 420854 - RNA, 22 nt, Human
uggaauuccaucaggcaaagcu

SEQ ID NO: 420855 - RNA, 19 nt, Human
uggggaaucaaaaguuaua

SEQ ID NO: 420856 - RNA, 19 nt, Human
ugguugucucaauaggcag

SEQ ID NO: 420857 - RNA, 20 nt, Human
uguauguguacauacacaua

SEQ ID NO: 420858 - RNA, 28 nt, Human
uguguacauacacauacacacacacaca

SEQ ID NO: 420859 - RNA, 23 nt, Human
uuggggaaucaaaaguuauaugc

SEQ ID NO: 420860 - RNA, 23 nt, Human
uuuaaaggaaaaaguugaaaaaa

SEQ ID NO: 420861 - RNA, 18 nt, Human
uuuaagaugacgccaacu

SEQ ID NO: 420862 - RNA, 24 nt, Human
uuucucuagcuuacuuuaagaaua

SEQ ID NO: 420863 - RNA, 26 nt, Human
uuuuuagcucuaagauccaugacacu

SEQ ID NO: 420864 - RNA, 23 nt, Human
aaacauccaccaugccagaaacg

SEQ ID NO: 420865 - RNA, 21 nt, Human
aacaugaaaacauccaccaug

SEQ ID NO: 420866 - RNA, 27 nt, Human
aaccagaaagggggcacaggcacccag

SEQ ID NO: 420867 - RNA, 22 nt, Human
aagaccuucuccuccgaggcac

SEQ ID NO: 420868 - RNA, 19 nt, Human
aagcagaggacaaaucaca

SEQ ID NO: 420869 - RNA, 24 nt, Human
acaacaugaaaacauccaccaugc

SEQ ID NO: 420870 - RNA, 19 nt, Human
accaagaccuucuccuccg

SEQ ID NO: 420871 - RNA, 19 nt, Human
accagaaagggggcacagg

SEQ ID NO: 420872 - RNA, 18 nt, Human
acccgcccgccucaccgc

SEQ ID NO: 420873 - RNA, 24 nt, Human
acuuggagaagguggacgccagaa

SEQ ID NO: 420874 - RNA, 26 nt, Human
agaaacacagacagcugccgccacca

SEQ ID NO: 420875 - RNA, 19 nt, Human
agccaggcccgugcucaca

SEQ ID NO: 420876 - RNA, 19 nt, Human
agccugugcuggugacaca

SEQ ID NO: 420877 - RNA, 23 nt, Human
agcggaaaaacauaucccauaag

SEQ ID NO: 420878 - RNA, 23 nt, Human
aggcacccagcaagagccugugc

SEQ ID NO: 420879 - RNA, 21 nt, Human
agggagccacucuccaggagc

SEQ ID NO: 420880 - RNA, 19 nt, Human
aguuaaaaagcuuuuccua

SEQ ID NO: 420881 - RNA, 22 nt, Human
auccgaacaagcucaucgucgg

SEQ ID NO: 420882 - RNA, 22 nt, Human
augccagaaacgucagcccaca

SEQ ID NO: 420883 - RNA, 21 nt, Human
augccaggaugcaggggaaca

SEQ ID NO: 420884 - RNA, 18 nt, Human
caaaauagcugccagacu

SEQ ID NO: 420885 - RNA, 22 nt, Human
caacaugaaaacauccaccaug

SEQ ID NO: 420886 - RNA, 19 nt, Human
cacaggcacccagcaagag

SEQ ID NO: 420887 - RNA, 22 nt, Human
caccaccggcucacacgcagcc

SEQ ID NO: 420888 - RNA, 22 nt, Human
caccaucugugccaccgaugcc

SEQ ID NO: 420889 - RNA, 19 nt, Human
caccgaugccagacagagc

SEQ ID NO: 420890 - RNA, 19 nt, Human
caccuuuuccuucuugaag

SEQ ID NO: 420891 - RNA, 19 nt, Human
cagagcucccugcgacucc

SEQ ID NO: 420892 - RNA, 21 nt, Human
cagcaacaucccuguggcucu

SEQ ID NO: 420893 - RNA, 22 nt, Human
cagcaacaucccuguggcucug

SEQ ID NO: 420894 - RNA, 19 nt, Human
caggcacccagcaagagcc

SEQ ID NO: 420895 - RNA, 20 nt, Human
caggggacagccccauccuc

SEQ ID NO: 420896 - RNA, 21 nt, Human
ccaccaagaccuucuccuccg

SEQ ID NO: 420897 - RNA, 18 nt, Human
ccagaaagggggcacagg

SEQ ID NO: 420898 - RNA, 21 nt, Human
ccagccaggcccgugcucaca

SEQ ID NO: 420899 - RNA, 24 nt, Human
ccaugccagaaacgucagcccaca

SEQ ID NO: 420900 - RNA, 20 nt, Human
ccccuuuauuuucuugugac

SEQ ID NO: 420901 - RNA, 20 nt, Human
cccgccucaccgccauacac

SEQ ID NO: 420902 - RNA, 21 nt, Human
cccgugcucacacuuccugaa

SEQ ID NO: 420903 - RNA, 22 nt, Human
cccuguaaaccgggugccagcc

SEQ ID NO: 420904 - RNA, 23 nt, Human
ccucaaucaccucccuguaaacc

SEQ ID NO: 420905 - RNA, 27 nt, Human
ccucaccgccauacacaugugccagcc

SEQ ID NO: 420906 - RNA, 25 nt, Human
cgaaaaggaguagacgucuccagac

SEQ ID NO: 420907 - RNA, 20 nt, Human
cgcaccgcuccccuggucca

SEQ ID NO: 420908 - RNA, 19 nt, Human
cgccaccaccggcucacac

SEQ ID NO: 420909 - RNA, 21 nt, Human
cggcggaacaacaugaaaaag

SEQ ID NO: 420910 - RNA, 21 nt, Human
cgggugccagccaggcccgug

SEQ ID NO: 420911 - RNA, 22 nt, Human
cucccuguaaaccgggugccag

SEQ ID NO: 420912 - RNA, 24 nt, Human
cucccuguaaaccgggugccagcc

SEQ ID NO: 420913 - RNA, 27 nt, Human
cucuagacggccacacccguguggcuc

SEQ ID NO: 420914 - RNA, 19 nt, Human
cugagcuggucacaacuga

SEQ ID NO: 420915 - RNA, 19 nt, Human
cuucaagagcuuccacucc

SEQ ID NO: 420916 - RNA, 21 nt, Human
gaacaacaugaaaacauccac

SEQ ID NO: 420917 - RNA, 20 nt, Human
gacaaaucacagaugcuccu

SEQ ID NO: 420918 - RNA, 24 nt, Human
gagaacaggagaaacacagacagc

SEQ ID NO: 420919 - RNA, 21 nt, Human
gagaagguucauccuugcuga

SEQ ID NO: 420920 - RNA, 18 nt, Human
gauggagcuacauccgaa

SEQ ID NO: 420921 - RNA, 18 nt, Human
gcaaaauagcugccagac

SEQ ID NO: 420922 - RNA, 25 nt, Human
gcccagagccucuuccuguccgcac

SEQ ID NO: 420923 - RNA, 26 nt, Human
gcccagagccucuuccuguccgcacc

SEQ ID NO: 420924 - RNA, 21 nt, Human
ggcacaggcacccagcaagag

SEQ ID NO: 420925 - RNA, 22 nt, Human
ggcaggcucaagcauucgugcu

SEQ ID NO: 420926 - RNA, 18 nt, Human
ggcggaacaacaugaaaa

SEQ ID NO: 420927 - RNA, 26 nt, Human
gggcacaggcacccagcaagagccug

SEQ ID NO: 420928 - RNA, 24 nt, Human
gggcuggggcaggcucaagcauuc

SEQ ID NO: 420929 - RNA, 23 nt, Human
gucacaacugaugucaccuuuuc

SEQ ID NO: 420930 - RNA, 23 nt, Human
uaaaccgggugccagccaggccc

SEQ ID NO: 420931 - RNA, 22 nt, Human
uacacaugugccagcccagagc

SEQ ID NO: 420932 - RNA, 23 nt, Human
uaucccauaagcagaggacaaau

SEQ ID NO: 420933 - RNA, 23 nt, Human
ucaagagcuuccacuccacuggu

SEQ ID NO: 420934 - RNA, 21 nt, Human
ucaccuuuuccuucuugaagg

SEQ ID NO: 420935 - RNA, 24 nt, Human
uccagacuugucggccaccaagac

SEQ ID NO: 420936 - RNA, 18 nt, Human
uccccugguccaagggcg

SEQ ID NO: 420937 - RNA, 23 nt, Human
ucggccgacagaucgcacgcaag

SEQ ID NO: 420938 - RNA, 22 nt, Human
ucuccuccgaggcuaugaaagu

SEQ ID NO: 420939 - RNA, 19 nt, Human
ucugucaucgguuaaagca

SEQ ID NO: 420940 - RNA, 25 nt, Human
ucugugccaccgaugccagacagag

SEQ ID NO: 420941 - RNA, 26 nt, Human
ucugugccaccgaugccagacagagc

SEQ ID NO: 420942 - RNA, 25 nt, Human
ugaaaacauccaccaugccagaaac

SEQ ID NO: 420943 - RNA, 23 nt, Human
ugaaaagaaagugcuucaagagc

SEQ ID NO: 420944 - RNA, 19 nt, Human
ugagaacaggagaaacaca

SEQ ID NO: 420945 - RNA, 23 nt, Human
ugagagacaccacugaccgccac

SEQ ID NO: 420946 - RNA, 21 nt, Human
ugagcuggucacaacugaugu

SEQ ID NO: 420947 - RNA, 20 nt, Human
ugccacggucugucaucggu

SEQ ID NO: 420948 - RNA, 19 nt, Human
ugccagacagagcucccug

SEQ ID NO: 420949 - RNA, 21 nt, Human
ugccaggaugcaggggaacaa

SEQ ID NO: 420950 - RNA, 22 nt, Human
ugccaggaugcaggggaacaag

SEQ ID NO: 420951 - RNA, 20 nt, Human
ugccccagcucuagacggcc

SEQ ID NO: 420952 - RNA, 22 nt, Human
ugcugaguuucaacagccugug

SEQ ID NO: 420953 - RNA, 23 nt, Human
uguaaaccgggugccagccaggc

SEQ ID NO: 420954 - RNA, 23 nt, Human
ugugacuucuuuucugcagcacu

SEQ ID NO: 420955 - RNA, 24 nt, Human
ugugccaccgaugccagacagagc

SEQ ID NO: 420956 - RNA, 25 nt, Human
uucaagagcuuccacuccacugguc

SEQ ID NO: 420957 - RNA, 21 nt, Human
uuccuagucaaaaauuuacua

SEQ ID NO: 420958 - RNA, 19 nt, Human
uugaaauucagcaacaucc

SEQ ID NO: 420959 - RNA, 20 nt, Human
uuucuugugacuucuuuucu

SEQ ID NO: 420960 - RNA, 24 nt, Human
uuuuuuuuuuugaguuuugccugg

SEQ ID NO: 420961 - RNA, 18 nt, Human
uuuuuuuuuuuuuuuuug

SEQ ID NO: 420962 - RNA, 24 nt, Human
uuuuuuuuuuuuuuuuuugaguuu

SEQ ID NO: 420963 - RNA, 20 nt, Human
uuuuuuuuuuuuuuuuuugg

SEQ ID NO: 420964 - RNA, 21 nt, Human
aaucacugaauccagaccacc

SEQ ID NO: 420965 - RNA, 19 nt, Human
acaguggagaaccuccugg

SEQ ID NO: 420966 - RNA, 21 nt, Human
cagaccaccacaguggagaac

SEQ ID NO: 420967 - RNA, 21 nt, Human
ccacacuggaaacacagagua

SEQ ID NO: 420968 - RNA, 23 nt, Human
ccacccugcgcccgaaaacccgc

SEQ ID NO: 420969 - RNA, 21 nt, Human
cccacacuggaaacacagagu

SEQ ID NO: 420970 - RNA, 19 nt, Human
ccccugggcgcgcagcagg

SEQ ID NO: 420971 - RNA, 22 nt, Human
ccccugggcgcgcagcaggcug

SEQ ID NO: 420972 - RNA, 18 nt, Human
cccugcgcccgaaaaccc

SEQ ID NO: 420973 - RNA, 21 nt, Human
ccgcgggcgccacccugcgcc

SEQ ID NO: 420974 - RNA, 19 nt, Human
ccuccuggugaagcugugu

SEQ ID NO: 420975 - RNA, 22 nt, Human
ccugcgcccgaaaacccgcggg

SEQ ID NO: 420976 - RNA, 22 nt, Human
cgccacccugcgcccgaaaacc

SEQ ID NO: 420977 - RNA, 28 nt, Human
cugcgcccgaaaacccgcgggaccccaa

SEQ ID NO: 420978 - RNA, 22 nt, Human
cuggugaagcuguguuuuuucc

SEQ ID NO: 420979 - RNA, 18 nt, Human
gcacacguuagugcaccg

SEQ ID NO: 420980 - RNA, 22 nt, Human
gggcgccacccugcgcccgaaa

SEQ ID NO: 420981 - RNA, 21 nt, Human
uaccauacauauuuacaaaaa

SEQ ID NO: 420982 - RNA, 21 nt, Human
uagaaucaaucacugaaucca

SEQ ID NO: 420983 - RNA, 23 nt, Human
ucaaucacugaauccagaccacc

SEQ ID NO: 420984 - RNA, 22 nt, Human
ucacugaauccagaccaccaca

SEQ ID NO: 420985 - RNA, 21 nt, Human
ugcuauagaaaaauagaauca

SEQ ID NO: 420986 - RNA, 18 nt, Human
uggaaacacagaguagcc

SEQ ID NO: 420987 - RNA, 21 nt, Human
uucccacacuggaaacacaga

SEQ ID NO: 420988 - RNA, 22 nt, Human
uuugcuauagaaaaauagaauc

SEQ ID NO: 420989 - RNA, 23 nt, Human
uuuuuuuuuuaaaucagcaagua

SEQ ID NO: 420990 - RNA, 24 nt, Human
aaaaaaaaaagaaauauaagaugg

SEQ ID NO: 420991 - RNA, 21 nt, Human
aaaaaagaaauauaagaugga

SEQ ID NO: 420992 - RNA, 19 nt, Human
aaaaggagggcgcgacgua

SEQ ID NO: 420993 - RNA, 24 nt, Human
aaaauuaaugagaaaacaaacaga

SEQ ID NO: 420994 - RNA, 20 nt, Human
aaacagacuaauaauacaau

SEQ ID NO: 420995 - RNA, 25 nt, Human
aaacagcagcacaguugcccaccac

SEQ ID NO: 420996 - RNA, 19 nt, Human
aaacauguuuuagaccaaa

SEQ ID NO: 420997 - RNA, 18 nt, Human
aaagacaagugcaaacau

SEQ ID NO: 420998 - RNA, 22 nt, Human
aaauauugaagagaaaaaccgg

SEQ ID NO: 420999 - RNA, 19 nt, Human
aacccgcuggcuccacccc

SEQ ID NO: 421000 - RNA, 21 nt, Human
aacuauaagcagcacaccacc

SEQ ID NO: 421001 - RNA, 18 nt, Human
aagagccagggaccgaau

SEQ ID NO: 421002 - RNA, 23 nt, Human
aaggcaauaccuccacagaauca

SEQ ID NO: 421003 - RNA, 26 nt, Human
acaagucaaagacaagugcaaacaug

SEQ ID NO: 421004 - RNA, 27 nt, Human
acgaagaucgguuuauauacacaaaua

SEQ ID NO: 421005 - RNA, 18 nt, Human
acuauaagcagcacacca

SEQ ID NO: 421006 - RNA, 18 nt, Human
acuggggcguagugggcg

SEQ ID NO: 421007 - RNA, 24 nt, Human
agaccaaaauuaaugagaaaacaa

SEQ ID NO: 421008 - RNA, 27 nt, Human
agagcucucccaagcagggguccaccu

SEQ ID NO: 421009 - RNA, 18 nt, Human
agcagcacaccaccacag

SEQ ID NO: 421010 - RNA, 24 nt, Human
agccccauuauuuccccggggugg

SEQ ID NO: 421011 - RNA, 20 nt, Human
agccgacccgaaagccggcc

SEQ ID NO: 421012 - RNA, 21 nt, Human
agccggccuggacgcagcccc

SEQ ID NO: 421013 - RNA, 19 nt, Human
aggagggcgcgacguagcc

SEQ ID NO: 421014 - RNA, 22 nt, Human
aggcggccgggcagcgcuuccg

SEQ ID NO: 421015 - RNA, 25 nt, Human
aggggcaggcggccgggcagcgcuu

SEQ ID NO: 421016 - RNA, 18 nt, Human
aucugaagaggggcaggc

SEQ ID NO: 421017 - RNA, 23 nt, Human
caaaaagaagaccuauuaacaac

SEQ ID NO: 421018 - RNA, 21 nt, Human
caaaagaaacagcagcacagu

SEQ ID NO: 421019 - RNA, 23 nt, Human
caaaagagagcuggauucgccua

SEQ ID NO: 421020 - RNA, 26 nt, Human
caaaauuaaugagaaaacaaacagac

SEQ ID NO: 421021 - RNA, 18 nt, Human
caaacuauaagcagcaca

SEQ ID NO: 421022 - RNA, 24 nt, Human
caacagcaaacuauaagcagcaca

SEQ ID NO: 421023 - RNA, 27 nt, Human
cacaauuaaaaaaaaaaaagaaauaua

SEQ ID NO: 421024 - RNA, 24 nt, Human
caccacagugguuaacccuggaaa

SEQ ID NO: 421025 - RNA, 20 nt, Human
caccacgaaaccaagugccc

SEQ ID NO: 421026 - RNA, 27 nt, Human
caccacgaaaccaagugcccggcacac

SEQ ID NO: 421027 - RNA, 19 nt, Human
caccgaggcugaggucucc

SEQ ID NO: 421028 - RNA, 23 nt, Human
cagcaaacuauaagcagcacacc

SEQ ID NO: 421029 - RNA, 22 nt, Human
cagcuuucaacuguaauucaca

SEQ ID NO: 421030 - RNA, 19 nt, Human
caggcggccgggcagcgcu

SEQ ID NO: 421031 - RNA, 19 nt, Human
cauagcaaucaucaaaaua

SEQ ID NO: 421032 - RNA, 19 nt, Human
ccaaaagaaacagcagcac

SEQ ID NO: 421033 - RNA, 18 nt, Human
ccagggaccgaauggccu

SEQ ID NO: 421034 - RNA, 22 nt, Human
cccuggggcgagccacuggggc

SEQ ID NO: 421035 - RNA, 20 nt, Human
ccgcuggcuccacccccggc

SEQ ID NO: 421036 - RNA, 19 nt, Human
ccggaaauggugacucggg

SEQ ID NO: 421037 - RNA, 18 nt, Human
ccggccuggacgcagccc

SEQ ID NO: 421038 - RNA, 19 nt, Human
ccggcgccgcccgaacacc

SEQ ID NO: 421039 - RNA, 24 nt, Human
ccggggugggugacuguuaggggc

SEQ ID NO: 421040 - RNA, 19 nt, Human
ccuaugagcgagccugggg

SEQ ID NO: 421041 - RNA, 24 nt, Human
ccucggaggccgcuucuugccccu

SEQ ID NO: 421042 - RNA, 21 nt, Human
cgaaagccggccuggacgcag

SEQ ID NO: 421043 - RNA, 21 nt, Human
cgagccuggggcggcgggggg

SEQ ID NO: 421044 - RNA, 21 nt, Human
cgagcugggaagagccaggga

SEQ ID NO: 421045 - RNA, 18 nt, Human
cgcccggacggggcuggg

SEQ ID NO: 421046 - RNA, 22 nt, Human
cgccuaagccgacccgaaagcc

SEQ ID NO: 421047 - RNA, 19 nt, Human
cggccaaaagaaacagcag

SEQ ID NO: 421048 - RNA, 24 nt, Human
cuaaucaguaaaacuacugacacc

SEQ ID NO: 421049 - RNA, 18 nt, Human
cuccggugcugggggauc

SEQ ID NO: 421050 - RNA, 23 nt, Human
gaaagccggccuggacgcagccc

SEQ ID NO: 421051 - RNA, 18 nt, Human
gaacaaguuacaaaacca

SEQ ID NO: 421052 - RNA, 21 nt, Human
gaacccgcuggcuccaccccc

SEQ ID NO: 421053 - RNA, 19 nt, Human
gaaugucagaagucauucu

SEQ ID NO: 421054 - RNA, 25 nt, Human
gaccaaaauuaaugagaaaacaaac

SEQ ID NO: 421055 - RNA, 21 nt, Human
gagaaaaaccgggcaaaacau

SEQ ID NO: 421056 - RNA, 18 nt, Human
gagccagggaccgaaugg

SEQ ID NO: 421057 - RNA, 21 nt, Human
gagcgagccuggggcggcggg

SEQ ID NO: 421058 - RNA, 22 nt, Human
gccagggaccgaauggccuucg

SEQ ID NO: 421059 - RNA, 18 nt, Human
gcgcgacguagcccgcgg

SEQ ID NO: 421060 - RNA, 18 nt, Human
gcggacgguggcggcagc

SEQ ID NO: 421061 - RNA, 19 nt, Human
gcggacuuuccggcagagg

SEQ ID NO: 421062 - RNA, 20 nt, Human
ggcaugcguuggcaaaaccg

SEQ ID NO: 421063 - RNA, 22 nt, Human
ggcccgagcaccgaggcugagg

SEQ ID NO: 421064 - RNA, 24 nt, Human
ggccuccgagccccauuauuuccc

SEQ ID NO: 421065 - RNA, 24 nt, Human
ggcggcgcggacuuuccggcagag

SEQ ID NO: 421066 - RNA, 18 nt, Human
ggcggcggggggcccggc

SEQ ID NO: 421067 - RNA, 18 nt, Human
gggcaaaagagagcugga

SEQ ID NO: 421068 - RNA, 18 nt, Human
gggcggguccgccacgug

SEQ ID NO: 421069 - RNA, 18 nt, Human
gggcguggcagugggcag

SEQ ID NO: 421070 - RNA, 19 nt, Human
gggcguggcagugggcagc

SEQ ID NO: 421071 - RNA, 22 nt, Human
ggggugggugacuguuaggggc

SEQ ID NO: 421072 - RNA, 20 nt, Human
guaauaaagcccuugaguac

SEQ ID NO: 421073 - RNA, 20 nt, Human
guccccuggggcgagccacu

SEQ ID NO: 421074 - RNA, 19 nt, Human
gugaaaaacuuggaauguc

SEQ ID NO: 421075 - RNA, 24 nt, Human
uaaaaaaaaaaaagaaauauaaga

SEQ ID NO: 421076 - RNA, 19 nt, Human
uaaaacacaagucaaagac

SEQ ID NO: 421077 - RNA, 26 nt, Human
uaaaauagcagcaaauucacaaggca

SEQ ID NO: 421078 - RNA, 19 nt, Human
uaagccgacccgaaagccg

SEQ ID NO: 421079 - RNA, 18 nt, Human
uacaaugcaacagcaaac

SEQ ID NO: 421080 - RNA, 21 nt, Human
uacagaagacagacugguaag

SEQ ID NO: 421081 - RNA, 18 nt, Human
uacagcaaagacaaaacu

SEQ ID NO: 421082 - RNA, 22 nt, Human
uagcccgcgggggaaggaccag

SEQ ID NO: 421083 - RNA, 22 nt, Human
uauaagauggacacacagguac

SEQ ID NO: 421084 - RNA, 19 nt, Human
ucaaaauacagcuuucaac

SEQ ID NO: 421085 - RNA, 22 nt, Human
ucaaagacaagugcaaacaugu

SEQ ID NO: 421086 - RNA, 26 nt, Human
ucaaaggaaaaaaaaaaaaggcaaau

SEQ ID NO: 421087 - RNA, 20 nt, Human
ucaaauggcuaaucacagau

SEQ ID NO: 421088 - RNA, 23 nt, Human
ucacaguguucagggggaggugg

SEQ ID NO: 421089 - RNA, 21 nt, Human
ucagggggaggugggaaagga

SEQ ID NO: 421090 - RNA, 24 nt, Human
ucagugauuucaaccuagcuuccu

SEQ ID NO: 421091 - RNA, 21 nt, Human
uccaaaggagggaaagggugc

SEQ ID NO: 421092 - RNA, 23 nt, Human
uccaaugcacuagcuucaaaguu

SEQ ID NO: 421093 - RNA, 21 nt, Human
uccacagaaucaucaucccau

SEQ ID NO: 421094 - RNA, 21 nt, Human
ucccaugguucaugcaaugcc

SEQ ID NO: 421095 - RNA, 24 nt, Human
uccgcggccaaaagaaaccggggc

SEQ ID NO: 421096 - RNA, 20 nt, Human
uccgcggcuucccgcgaccg

SEQ ID NO: 421097 - RNA, 21 nt, Human
uccgggucucugcgagcuggg

SEQ ID NO: 421098 - RNA, 22 nt, Human
ucgccuaagccgacccgaaagc

SEQ ID NO: 421099 - RNA, 21 nt, Human
ucggcgccagccaagucuggg

SEQ ID NO: 421100 - RNA, 18 nt, Human
ucugaacugcgggagccg

SEQ ID NO: 421101 - RNA, 19 nt, Human
ugaaaaacuuggaauguca

SEQ ID NO: 421102 - RNA, 18 nt, Human
ugaaagccugacauagca

SEQ ID NO: 421103 - RNA, 20 nt, Human
ugacaccaaucgagaaaguu

SEQ ID NO: 421104 - RNA, 22 nt, Human
ugagcgagccuggggcggcggg

SEQ ID NO: 421105 - RNA, 26 nt, Human
ugcugggggaucugaagaggggcagg

SEQ ID NO: 421106 - RNA, 20 nt, Human
ugcuuaggcuggacacuggc

SEQ ID NO: 421107 - RNA, 18 nt, Human
uggaaugucagaagucau

SEQ ID NO: 421108 - RNA, 23 nt, Human
uggaaugucagaagucauucugg

SEQ ID NO: 421109 - RNA, 19 nt, Human
uggauucuaucagugauuu

SEQ ID NO: 421110 - RNA, 19 nt, Human
uggcagugggcagccacgu

SEQ ID NO: 421111 - RNA, 26 nt, Human
ugggaagagccagggaccgaauggug

SEQ ID NO: 421112 - RNA, 23 nt, Human
ugggaggaggccuccgagcccca

SEQ ID NO: 421113 - RNA, 20 nt, Human
ugggaggggcaaaagagagc

SEQ ID NO: 421114 - RNA, 21 nt, Human
uggggcggcggggggcccggc

SEQ ID NO: 421115 - RNA, 24 nt, Human
ugguguaacauccaacagugacac

SEQ ID NO: 421116 - RNA, 25 nt, Human
uguaacauccaacagugacacaucc

SEQ ID NO: 421117 - RNA, 21 nt, Human
uguaauucacaauaaaagucc

SEQ ID NO: 421118 - RNA, 22 nt, Human
ugugcuuaggcuggacacuggc

SEQ ID NO: 421119 - RNA, 21 nt, Human
uguuuacauuuguucgccagc

SEQ ID NO: 421120 - RNA, 23 nt, Human
uuaauacagcauuccaaaggagg

SEQ ID NO: 421121 - RNA, 26 nt, Human
uucaaaggaaaaaaaaaaaaggcaaa

SEQ ID NO: 421122 - RNA, 19 nt, Human
uucaaagggaggguauguc

SEQ ID NO: 421123 - RNA, 20 nt, Human
uucacaauuaaaaaaaaaaa

SEQ ID NO: 421124 - RNA, 24 nt, Human
uucacaauuaaaaaaaaaaaagaa

SEQ ID NO: 421125 - RNA, 20 nt, Human
uucagggggaggugggaaag

SEQ ID NO: 421126 - RNA, 20 nt, Human
uuccaaaggagggaaagggu

SEQ ID NO: 421127 - RNA, 18 nt, Human
uugaaaaaaaaaggaggg

SEQ ID NO: 421128 - RNA, 23 nt, Human
acaaagucacccaaccaggcugg

SEQ ID NO: 421129 - RNA, 19 nt, Human
agcaugcacagucugcugg

SEQ ID NO: 421130 - RNA, 18 nt, Human
ccagacgcacacagaaga

SEQ ID NO: 421131 - RNA, 20 nt, Human
ccaggaugguaaaacaggga

SEQ ID NO: 421132 - RNA, 20 nt, Human
ccaggcugggccaaacuggg

SEQ ID NO: 421133 - RNA, 20 nt, Human
cccaaccaggcugggccaaa

SEQ ID NO: 421134 - RNA, 20 nt, Human
cucguggagcugcagggccu

SEQ ID NO: 421135 - RNA, 19 nt, Human
gagccuugucuuagaaagg

SEQ ID NO: 421136 - RNA, 19 nt, Human
ggagcugcagggccuugcu

SEQ ID NO: 421137 - RNA, 24 nt, Human
gguuugagggccagguguccuguc

SEQ ID NO: 421138 - RNA, 19 nt, Human
uaaaacagggacccagagc

SEQ ID NO: 421139 - RNA, 23 nt, Human
uaaaacagggacccagagcuguu

SEQ ID NO: 421140 - RNA, 21 nt, Human
uaaaggucucguggagcugca

SEQ ID NO: 421141 - RNA, 25 nt, Human
uaaguggcucccacaaagucaccca

SEQ ID NO: 421142 - RNA, 22 nt, Human
uagaggaauguucuugcaaccu

SEQ ID NO: 421143 - RNA, 23 nt, Human
uagcagaaaguagaggaauguuu

SEQ ID NO: 421144 - RNA, 21 nt, Human
uaguaagcaaguucauuucca

SEQ ID NO: 421145 - RNA, 20 nt, Human
ucccaacuguuuccaaggcu

SEQ ID NO: 421146 - RNA, 19 nt, Human
ucccacaaagucacccaac

SEQ ID NO: 421147 - RNA, 19 nt, Human
ucccucggaucaugugucc

SEQ ID NO: 421148 - RNA, 21 nt, Human
ucccugggcagcgaccuucca

SEQ ID NO: 421149 - RNA, 21 nt, Human
uccgcguccagcacaugcccc

SEQ ID NO: 421150 - RNA, 23 nt, Human
ucucguggagcugcagggccuug

SEQ ID NO: 421151 - RNA, 19 nt, Human
ucuugcucugcugagcuga

SEQ ID NO: 421152 - RNA, 21 nt, Human
ugggcggcggcuucuucccgg

SEQ ID NO: 421153 - RNA, 23 nt, Human
uggggacaggagcaugcacaguc

SEQ ID NO: 421154 - RNA, 18 nt, Human
uggguacauaccucccag

SEQ ID NO: 421155 - RNA, 22 nt, Human
uuaaguggcucccacaaaguca

SEQ ID NO: 421156 - RNA, 22 nt, Human
uucaugggcggcggcuucuucc

SEQ ID NO: 421157 - RNA, 24 nt, Human
uucuuaguuccacccagcaggguc

SEQ ID NO: 421158 - RNA, 24 nt, Human
uuuuuuuuuuuucuuauuugguug

SEQ ID NO: 421159 - RNA, 21 nt, Human
uuuuuuuuuuuuuucuuauuu

SEQ ID NO: 421160 - RNA, 23 nt, Human
uuuuuuuuuuuuuucuuauuugg

SEQ ID NO: 421161 - RNA, 20 nt, Human
aaagugcuuuuccagacacc

SEQ ID NO: 421162 - RNA, 19 nt, Human
aagugcuuuuccagacacc

SEQ ID NO: 421163 - RNA, 18 nt, Human
acccuggcuuucugcucc

SEQ ID NO: 421164 - RNA, 19 nt, Human
acccuggcuuucugcucca

SEQ ID NO: 421165 - RNA, 19 nt, Human
agccgcccccacaggguuc

SEQ ID NO: 421166 - RNA, 22 nt, Human
cacacugccaaugugccgccuc

SEQ ID NO: 421167 - RNA, 21 nt, Human
cagaaaaguuguucgggagca

SEQ ID NO: 421168 - RNA, 26 nt, Human
cagcagccuucccuuugucggggucc

SEQ ID NO: 421169 - RNA, 18 nt, Human
caugcaauucccaacaca

SEQ ID NO: 421170 - RNA, 24 nt, Human
ccacgcaaucuacacauggucgca

SEQ ID NO: 421171 - RNA, 19 nt, Human
ccagaggcuuuuauuucag

SEQ ID NO: 421172 - RNA, 22 nt, Human
cccaacacacuugguauucaga

SEQ ID NO: 421173 - RNA, 25 nt, Human
ccccagccucugauggggccgggcc

SEQ ID NO: 421174 - RNA, 21 nt, Human
ccucauggcaacaugcacuuc

SEQ ID NO: 421175 - RNA, 22 nt, Human
ccugccggcccgugagugggcc

SEQ ID NO: 421176 - RNA, 22 nt, Human
cuccaaggcacugaacacaguc

SEQ ID NO: 421177 - RNA, 18 nt, Human
cucccccacagccgcccc

SEQ ID NO: 421178 - RNA, 20 nt, Human
cuucacacauucacccacua

SEQ ID NO: 421179 - RNA, 19 nt, Human
cuugaaggugggggaggag

SEQ ID NO: 421180 - RNA, 20 nt, Human
gaaggugggggaggagaggg

SEQ ID NO: 421181 - RNA, 20 nt, Human
gaaggugggggaggagaggg

SEQ ID NO: 421182 - RNA, 23 nt, Human
gagcagcugaacgcggcgcaaac

SEQ ID NO: 421183 - RNA, 19 nt, Human
gagugggccgcacgcggcg

SEQ ID NO: 421184 - RNA, 18 nt, Human
gcaugccugucgggcugg

SEQ ID NO: 421185 - RNA, 18 nt, Human
gcccuggggccucugggc

SEQ ID NO: 421186 - RNA, 19 nt, Human
gcccuggggccucugggcc

SEQ ID NO: 421187 - RNA, 20 nt, Human
gccgccucccccagccucuu

SEQ ID NO: 421188 - RNA, 22 nt, Human
ggaccucccccacagccgcccu

SEQ ID NO: 421189 - RNA, 20 nt, Human
ggcccgugagugggccgcac

SEQ ID NO: 421190 - RNA, 21 nt, Human
ggcgcugcgacgcccuggggc

SEQ ID NO: 421191 - RNA, 28 nt, Human
gggaccucccccacagccgcccccacag

SEQ ID NO: 421192 - RNA, 20 nt, Human
gggaggagagggaaucucau

SEQ ID NO: 421193 - RNA, 19 nt, Human
ggggaaaggccucauggca

SEQ ID NO: 421194 - RNA, 22 nt, Human
ggggaagagcugcuaaggugua

SEQ ID NO: 421195 - RNA, 25 nt, Human
ggugcaugccugucgggcuggggcc

SEQ ID NO: 421196 - RNA, 23 nt, Human
guaaagugcuuuuccagacaccg

SEQ ID NO: 421197 - RNA, 24 nt, Human
gugcaugccugucgggcuggggcc

SEQ ID NO: 421198 - RNA, 28 nt, Human
uaaacaaauccaacacaaaagaaagaaa

SEQ ID NO: 421199 - RNA, 20 nt, Human
uagcagugaccaaacaaaua

SEQ ID NO: 421200 - RNA, 21 nt, Human
uccaacacaaaagaaagaaag

SEQ ID NO: 421201 - RNA, 22 nt, Human
uccaacacaaaagaaagaaaga

SEQ ID NO: 421202 - RNA, 19 nt, Human
ucccccacagccgccccca

SEQ ID NO: 421203 - RNA, 22 nt, Human
ucgggagcagcugaacgcggcg

SEQ ID NO: 421204 - RNA, 20 nt, Human
ucuacacauggucgcaaggu

SEQ ID NO: 421205 - RNA, 24 nt, Human
ugaagagccggcuagcgcggccuu

SEQ ID NO: 421206 - RNA, 24 nt, Human
ugccggcccgugagugggccgcac

SEQ ID NO: 421207 - RNA, 23 nt, Human
ugcuggacaggagggucaugagg

SEQ ID NO: 421208 - RNA, 19 nt, Human
uggacagagcuacacagca

SEQ ID NO: 421209 - RNA, 23 nt, Human
uggcaacaugcacuggaagcucc

SEQ ID NO: 421210 - RNA, 21 nt, Human
ugggggaggagagggaaucuc

SEQ ID NO: 421211 - RNA, 22 nt, Human
ugggggaggagagggaaucuca

SEQ ID NO: 421212 - RNA, 25 nt, Human
uguagcagugaccaaacaaauaaga

SEQ ID NO: 421213 - RNA, 19 nt, Human
uuaaacaaauccaacacaa

SEQ ID NO: 421214 - RNA, 21 nt, Human
uuucugcuccaaggcacugaa

SEQ ID NO: 421215 - RNA, 21 nt, Human
uuuuaaacaaauccaacacaa

SEQ ID NO: 421216 - RNA, 22 nt, Human
aaacgcuggagcugacgaagcu

SEQ ID NO: 421217 - RNA, 19 nt, Human
aaggauggguagagaaugg

SEQ ID NO: 421218 - RNA, 21 nt, Human
acagacaacccagggaggagc

SEQ ID NO: 421219 - RNA, 20 nt, Human
accaggcaaacgcuggagcu

SEQ ID NO: 421220 - RNA, 19 nt, Human
acgcuugcucuuugggggc

SEQ ID NO: 421221 - RNA, 23 nt, Human
agugugagcuagggacagggcau

SEQ ID NO: 421222 - RNA, 21 nt, Human
augucagaaugggggucuggg

SEQ ID NO: 421223 - RNA, 22 nt, Human
cagacaacccagggaggagcuc

SEQ ID NO: 421224 - RNA, 21 nt, Human
caggugauguccucugcgccc

SEQ ID NO: 421225 - RNA, 18 nt, Human
ccagaccaggcaaacgcu

SEQ ID NO: 421226 - RNA, 19 nt, Human
ccagaccaggcaaacgcug

SEQ ID NO: 421227 - RNA, 24 nt, Human
cccaguccuggccucaaagaaagc

SEQ ID NO: 421228 - RNA, 24 nt, Human
ccccagaaacgaagucgggcuucg

SEQ ID NO: 421229 - RNA, 19 nt, Human
cgagggggccaggacugca

SEQ ID NO: 421230 - RNA, 22 nt, Human
cgcucagcucucaguugcccca

SEQ ID NO: 421231 - RNA, 22 nt, Human
cgcuucugggaaagaaaaugac

SEQ ID NO: 421232 - RNA, 23 nt, Human
gaaaaugacgagggggccaggac

SEQ ID NO: 421233 - RNA, 22 nt, Human
gagcauguggaugucagaaugg

SEQ ID NO: 421234 - RNA, 25 nt, Human
gcaccccaggugauguccucugcgc

SEQ ID NO: 421235 - RNA, 23 nt, Human
gcucucagugauggagugcuggu

SEQ ID NO: 421236 - RNA, 18 nt, Human
gcuugcucuuugggggcc

SEQ ID NO: 421237 - RNA, 21 nt, Human
ggguagagaauggcugagugg

SEQ ID NO: 421238 - RNA, 22 nt, Human
uaugucacccuggggaaagcug

SEQ ID NO: 421239 - RNA, 20 nt, Human
ucacccuggggaaagcugga

SEQ ID NO: 421240 - RNA, 23 nt, Human
uccagaccaggcaaacgcuggag

SEQ ID NO: 421241 - RNA, 25 nt, Human
ucucugucuccuccuucuugcuggg

SEQ ID NO: 421242 - RNA, 20 nt, Human
ucugucuccuccuucuugcu

SEQ ID NO: 421243 - RNA, 23 nt, Human
ugaagaugggggaauaaauacag

SEQ ID NO: 421244 - RNA, 24 nt, Human
ugcucuuugggggcccugggugag

SEQ ID NO: 421245 - RNA, 22 nt, Human
uggagcugacgaagcugggccg

SEQ ID NO: 421246 - RNA, 19 nt, Human
uggagugcugguuccucug

SEQ ID NO: 421247 - RNA, 19 nt, Human
ugggggaauaaauacaggg

SEQ ID NO: 421248 - RNA, 20 nt, Human
uggggggaucuuuggccugg

SEQ ID NO: 421249 - RNA, 19 nt, Human
ugggggucuggggggaucu

SEQ ID NO: 421250 - RNA, 25 nt, Human
ugggugaggagcugggccaccacgu

SEQ ID NO: 421251 - RNA, 22 nt, Human
ugucacccuggggaaagcugga

SEQ ID NO: 421252 - RNA, 23 nt, Human
ugugagaggcagcaccccaggug

SEQ ID NO: 421253 - RNA, 23 nt, Human
ugugcacgagggcuuaagugugg

SEQ ID NO: 421254 - RNA, 24 nt, Human
uuccucuggcuguaagauaugugg

SEQ ID NO: 421255 - RNA, 19 nt, Human
uugcugggcuguugggaug

SEQ ID NO: 421256 - RNA, 24 nt, Human
aaaaaaauauacaaaguuaucccc

SEQ ID NO: 421257 - RNA, 24 nt, Human
aaaaaaauauacaaaguuaucccc

SEQ ID NO: 421258 - RNA, 24 nt, Human
aaaaaaauauacaaaguuaucccc

SEQ ID NO: 421259 - RNA, 24 nt, Human
aaaaaaauauacaaaguuaucccc

SEQ ID NO: 421260 - RNA, 21 nt, Human
aaaaagaaccaagucuuaaaa

SEQ ID NO: 421261 - RNA, 21 nt, Human
aaaaagaaccaagucuuaaaa

SEQ ID NO: 421262 - RNA, 21 nt, Human
aaaaagaaccaagucuuaaaa

SEQ ID NO: 421263 - RNA, 24 nt, Human
aaaaagaaccaagucuuaaaacau

SEQ ID NO: 421264 - RNA, 24 nt, Human
aaaaagaaccaagucuuaaaacau

SEQ ID NO: 421265 - RNA, 24 nt, Human
aaaaagaaccaagucuuaaaacau

SEQ ID NO: 421266 - RNA, 20 nt, Human
aaaaaugcggacaccugggg

SEQ ID NO: 421267 - RNA, 19 nt, Human
aaaacauuccauaugccaa

SEQ ID NO: 421268 - RNA, 19 nt, Human
aaaacauuccauaugccaa

SEQ ID NO: 421269 - RNA, 19 nt, Human
aaaacauuccauaugccaa

SEQ ID NO: 421270 - RNA, 19 nt, Human
aaaacauuccauaugccaa

SEQ ID NO: 421271 - RNA, 19 nt, Human
aaaacucuuccugccucuu

SEQ ID NO: 421272 - RNA, 22 nt, Human
aaaagccuuucaagauagaguc

SEQ ID NO: 421273 - RNA, 22 nt, Human
aaaaggccaacaacuauaggua

SEQ ID NO: 421274 - RNA, 24 nt, Human
aaaaggccauaaaaaagcaccugc

SEQ ID NO: 421275 - RNA, 24 nt, Human
aaaaggccauaaaaaagcaccugc

SEQ ID NO: 421276 - RNA, 24 nt, Human
aaaaggccauaaaaaagcaccugc

SEQ ID NO: 421277 - RNA, 23 nt, Human
aaacaaaagcagacaaacuguac

SEQ ID NO: 421278 - RNA, 25 nt, Human
aaacaaaagcagacaaacuguacaa

SEQ ID NO: 421279 - RNA, 22 nt, Human
aaacaaaauucaccucaacaac

SEQ ID NO: 421280 - RNA, 26 nt, Human
aaacaaaugugaugaaagggaggaaa

SEQ ID NO: 421281 - RNA, 18 nt, Human
aaacagcaauucucaugg

SEQ ID NO: 421282 - RNA, 24 nt, Human
aaacaggcccacacgagugucccc

SEQ ID NO: 421283 - RNA, 24 nt, Human
aaacaggcccacacgagugucccc

SEQ ID NO: 421284 - RNA, 24 nt, Human
aaacaggcccacacgagugucccc

SEQ ID NO: 421285 - RNA, 25 nt, Human
aaacaggcccacacgagugucccca

SEQ ID NO: 421286 - RNA, 25 nt, Human
aaacaggcccacacgagugucccca

SEQ ID NO: 421287 - RNA, 25 nt, Human
aaacaggcccacacgagugucccca

SEQ ID NO: 421288 - RNA, 21 nt, Human
aaacauauguaguacucagau

SEQ ID NO: 421289 - RNA, 21 nt, Human
aaacauauguaguacucagau

SEQ ID NO: 421290 - RNA, 21 nt, Human
aaacauauguaguacucagau

SEQ ID NO: 421291 - RNA, 18 nt, Human
aaacaucacaaaaugcuu

SEQ ID NO: 421292 - RNA, 20 nt, Human
aaacaugaggcaagggccgg

SEQ ID NO: 421293 - RNA, 29 nt, Human
aaaccaaaacuaccuccgaacaaaaaaag

SEQ ID NO: 421294 - RNA, 18 nt, Human
aaacccugcaagcucagg

SEQ ID NO: 421295 - RNA, 19 nt, Human
aaacccugcaagcucaggg

SEQ ID NO: 421296 - RNA, 19 nt, Human
aaacccugcaagcucaggg

SEQ ID NO: 421297 - RNA, 22 nt, Human
aaacugguaaagaaaagccaaa

SEQ ID NO: 421298 - RNA, 22 nt, Human
aaacugguaaagaaaagccaaa

SEQ ID NO: 421299 - RNA, 22 nt, Human
aaacugguaaagaaaagccaaa

SEQ ID NO: 421300 - RNA, 22 nt, Human
aaacugguaaagaaaagccaaa

SEQ ID NO: 421301 - RNA, 23 nt, Human
aaagaaaagccaaaugaaaaaaa

SEQ ID NO: 421302 - RNA, 23 nt, Human
aaagaaaagccaaaugaaaaaaa

SEQ ID NO: 421303 - RNA, 23 nt, Human
aaagaaaagccaaaugaaaaaaa

SEQ ID NO: 421304 - RNA, 23 nt, Human
aaagaaaagccaaaugaaaaaaa

SEQ ID NO: 421305 - RNA, 21 nt, Human
aaagaaaugaagcaaguugcc

SEQ ID NO: 421306 - RNA, 21 nt, Human
aaagagcagaguaaugaucac

SEQ ID NO: 421307 - RNA, 21 nt, Human
aaagagcagaguaaugaucac

SEQ ID NO: 421308 - RNA, 21 nt, Human
aaagagcagaguaaugaucac

SEQ ID NO: 421309 - RNA, 21 nt, Human
aaagagcagaguaaugaucac

SEQ ID NO: 421310 - RNA, 21 nt, Human
aaagaugaggcugucgggcug

SEQ ID NO: 421311 - RNA, 19 nt, Human
aaagccaugaaaugcauga

SEQ ID NO: 421312 - RNA, 18 nt, Human
aaagcgccacacacacaa

SEQ ID NO: 421313 - RNA, 23 nt, Human
aaagcucuuuaaagcaaaaaucu

SEQ ID NO: 421314 - RNA, 19 nt, Human
aaaggaccaaagccaugaa

SEQ ID NO: 421315 - RNA, 20 nt, Human
aaagugcacugcaaagccga

SEQ ID NO: 421316 - RNA, 19 nt, Human
aaaucuuuggcuuccucca

SEQ ID NO: 421317 - RNA, 23 nt, Human
aaaugaaaaagaaaugaagcaag

SEQ ID NO: 421318 - RNA, 23 nt, Human
aaaugcccaucuccccaccccac

SEQ ID NO: 421319 - RNA, 24 nt, Human
aacaaaagcagacaaacuguacaa

SEQ ID NO: 421320 - RNA, 18 nt, Human
aacaaaauucaccucaac

SEQ ID NO: 421321 - RNA, 19 nt, Human
aacaaagcugggcagggcc

SEQ ID NO: 421322 - RNA, 19 nt, Human
aacaaagcugggcagggcc

SEQ ID NO: 421323 - RNA, 20 nt, Human
aacacaaaaucagaucuccc

SEQ ID NO: 421324 - RNA, 23 nt, Human
aacacacguacgaggcacgcaca

SEQ ID NO: 421325 - RNA, 18 nt, Human
aacaggguauggugaggc

SEQ ID NO: 421326 - RNA, 18 nt, Human
aacaggguauggugaggc

SEQ ID NO: 421327 - RNA, 18 nt, Human
aacaggguauggugaggc

SEQ ID NO: 421328 - RNA, 25 nt, Human
aacagggugagacucugucucuaaa

SEQ ID NO: 421329 - RNA, 19 nt, Human
aacaguauaagcaacaacu

SEQ ID NO: 421330 - RNA, 20 nt, Human
aacauggcgaaaucuugucu

SEQ ID NO: 421331 - RNA, 19 nt, Human
aaccaaaacuaccuccgaa

SEQ ID NO: 421332 - RNA, 24 nt, Human
aacccugcaagcucagggccgcua

SEQ ID NO: 421333 - RNA, 24 nt, Human
aacccugcaagcucagggccgcua

SEQ ID NO: 421334 - RNA, 24 nt, Human
aacccugcaagcucagggccgcua

SEQ ID NO: 421335 - RNA, 20 nt, Human
aacccuugccucacuacccu

SEQ ID NO: 421336 - RNA, 25 nt, Human
aaccgcacaccucagcaauuacccu

SEQ ID NO: 421337 - RNA, 20 nt, Human
aaccuggggccagcguggcu

SEQ ID NO: 421338 - RNA, 18 nt, Human
aacgaugucaccccaccc

SEQ ID NO: 421339 - RNA, 20 nt, Human
aacugaggcacaccccaucc

SEQ ID NO: 421340 - RNA, 18 nt, Human
aacugcccacaauacacc

SEQ ID NO: 421341 - RNA, 23 nt, Human
aacuggaccuuuuaaaaacuaaa

SEQ ID NO: 421342 - RNA, 28 nt, Human
aacuuuugcuaaacccaagagcugaaga

SEQ ID NO: 421343 - RNA, 20 nt, Human
aagaaagaaaggaaaaagga

SEQ ID NO: 421344 - RNA, 22 nt, Human
aagaagcagcagugggacagag

SEQ ID NO: 421345 - RNA, 27 nt, Human
aagaagccaauaacagcuuugugagua

SEQ ID NO: 421346 - RNA, 23 nt, Human
aagaauugcuggaaccaaggagg

SEQ ID NO: 421347 - RNA, 21 nt, Human
aagacagacaaacacugcgaa

SEQ ID NO: 421348 - RNA, 21 nt, Human
aagacagacaaacacugcgaa

SEQ ID NO: 421349 - RNA, 21 nt, Human
aagacagacaaacacugcgaa

SEQ ID NO: 421350 - RNA, 22 nt, Human
aagacucuuccgaucccucuga

SEQ ID NO: 421351 - RNA, 22 nt, Human
aagacucuuccgaucccucuga

SEQ ID NO: 421352 - RNA, 22 nt, Human
aagacucuuccgaucccucuga

SEQ ID NO: 421353 - RNA, 19 nt, Human
aagagcugaagaugcugcc

SEQ ID NO: 421354 - RNA, 21 nt, Human
aagaggcccuaaaacaucugc

SEQ ID NO: 421355 - RNA, 21 nt, Human
aagcaaaucccagacauauca

SEQ ID NO: 421356 - RNA, 20 nt, Human
aagcaacucuaacagggcca

SEQ ID NO: 421357 - RNA, 24 nt, Human
aagcacagacauaguguguggaag

SEQ ID NO: 421358 - RNA, 20 nt, Human
aagcacugguucuggcagaa

SEQ ID NO: 421359 - RNA, 20 nt, Human
aagcacugguucuggcagaa

SEQ ID NO: 421360 - RNA, 20 nt, Human
aagcacugguucuggcagaa

SEQ ID NO: 421361 - RNA, 22 nt, Human
aagccuacgcuacacauuucag

SEQ ID NO: 421362 - RNA, 22 nt, Human
aagccuacgcuacacauuucag

SEQ ID NO: 421363 - RNA, 21 nt, Human
aagccuacgcuacacauuucg

SEQ ID NO: 421364 - RNA, 21 nt, Human
aagccuacgcuacacauuucg

SEQ ID NO: 421365 - RNA, 22 nt, Human
aagcguuucugaggaacaauuc

SEQ ID NO: 421366 - RNA, 22 nt, Human
aagcguuucugaggaacaauuc

SEQ ID NO: 421367 - RNA, 22 nt, Human
aagcguuucugaggaacaauuc

SEQ ID NO: 421368 - RNA, 22 nt, Human
aagcguuucugaggaacaauuc

SEQ ID NO: 421369 - RNA, 25 nt, Human
aaggaucccucaaaaaaagaaccaa

SEQ ID NO: 421370 - RNA, 25 nt, Human
aaggaucccucaaaaaaagaaccaa

SEQ ID NO: 421371 - RNA, 25 nt, Human
aaggaucccucaaaaaaagaaccaa

SEQ ID NO: 421372 - RNA, 24 nt, Human
aagggccgggugcaguggcucaca

SEQ ID NO: 421373 - RNA, 18 nt, Human
aaguaacuaaaaaugugc

SEQ ID NO: 421374 - RNA, 23 nt, Human
aaguaguuuaauggaaaagaccc

SEQ ID NO: 421375 - RNA, 21 nt, Human
aagucaccacguccucagaac

SEQ ID NO: 421376 - RNA, 21 nt, Human
aagucaccacguccucagaac

SEQ ID NO: 421377 - RNA, 21 nt, Human
aagucaccacguccucagaac

SEQ ID NO: 421378 - RNA, 21 nt, Human
aagugaauaaccggaccaaaa

SEQ ID NO: 421379 - RNA, 24 nt, Human
aagugacagcggggcccuggggcc

SEQ ID NO: 421380 - RNA, 24 nt, Human
aagugacagcggggcccuggggcc

SEQ ID NO: 421381 - RNA, 24 nt, Human
aagugacagcggggcccuggggcc

SEQ ID NO: 421382 - RNA, 20 nt, Human
aauaaucuuuagacccaaag

SEQ ID NO: 421383 - RNA, 20 nt, Human
aauaaucuuuagacccaaag

SEQ ID NO: 421384 - RNA, 20 nt, Human
aauaaucuuuagacccaaag

SEQ ID NO: 421385 - RNA, 18 nt, Human
aauagaggaacccaacca

SEQ ID NO: 421386 - RNA, 20 nt, Human
aauauggcgaaacccugucu

SEQ ID NO: 421387 - RNA, 21 nt, Human
aaugcccaucuccccacccca

SEQ ID NO: 421388 - RNA, 18 nt, Human
aauuugacaucacugcca

SEQ ID NO: 421389 - RNA, 18 nt, Human
acaaaaccacggaguagc

SEQ ID NO: 421390 - RNA, 22 nt, Human
acaaaaugcuuaauuaucuaca

SEQ ID NO: 421391 - RNA, 21 nt, Human
acaagaaauuaaaacuccaaa

SEQ ID NO: 421392 - RNA, 20 nt, Human
acacaacauucuucagacag

SEQ ID NO: 421393 - RNA, 23 nt, Human
acacacaccucuggacacacaca

SEQ ID NO: 421394 - RNA, 23 nt, Human
acacagcauccucccuccuuucc

SEQ ID NO: 421395 - RNA, 24 nt, Human
acacagcauuuuacucuacugacu

SEQ ID NO: 421396 - RNA, 24 nt, Human
acacagcauuuuacucuacugacu

SEQ ID NO: 421397 - RNA, 24 nt, Human
acacagcauuuuacucuacugacu

SEQ ID NO: 421398 - RNA, 19 nt, Human
acaccauuuggucauuugc

SEQ ID NO: 421399 - RNA, 18 nt, Human
acaccgcaucauuuuacc

SEQ ID NO: 421400 - RNA, 18 nt, Human
acaccgcaucauuuuacc

SEQ ID NO: 421401 - RNA, 18 nt, Human
acaccgcaucauuuuacc

SEQ ID NO: 421402 - RNA, 18 nt, Human
acacucacaucaggcuuc

SEQ ID NO: 421403 - RNA, 20 nt, Human
acacugaguuaccacacagc

SEQ ID NO: 421404 - RNA, 20 nt, Human
acacugaguuaccacacagc

SEQ ID NO: 421405 - RNA, 20 nt, Human
acacugaguuaccacacagc

SEQ ID NO: 421406 - RNA, 20 nt, Human
acacugaguuaccacacagc

SEQ ID NO: 421407 - RNA, 18 nt, Human
acacugcagcgugggcag

SEQ ID NO: 421408 - RNA, 21 nt, Human
acagcaguaggaccgcccguc

SEQ ID NO: 421409 - RNA, 21 nt, Human
acagcaguaggaccgcccguc

SEQ ID NO: 421410 - RNA, 21 nt, Human
acagcaguaggaccgcccguc

SEQ ID NO: 421411 - RNA, 20 nt, Human
acagcauggcucucacacag

SEQ ID NO: 421412 - RNA, 24 nt, Human
acagggugagacucugucucuaaa

SEQ ID NO: 421413 - RNA, 19 nt, Human
acagguauaagagauaaaa

SEQ ID NO: 421414 - RNA, 19 nt, Human
acauaguguguggaagaug

SEQ ID NO: 421415 - RNA, 21 nt, Human
acauuccagccaacugcuaaa

SEQ ID NO: 421416 - RNA, 22 nt, Human
accacccgcaaggagagcaaag

SEQ ID NO: 421417 - RNA, 23 nt, Human
acccaccuccuucaggaaaccag

SEQ ID NO: 421418 - RNA, 24 nt, Human
accccaccccgucuuguuccccag

SEQ ID NO: 421419 - RNA, 23 nt, Human
accccacgcuuacaggucacaaa

SEQ ID NO: 421420 - RNA, 23 nt, Human
accccacgcuuacaggucacaaa

SEQ ID NO: 421421 - RNA, 23 nt, Human
accccacgcuuacaggucacaaa

SEQ ID NO: 421422 - RNA, 19 nt, Human
acccuaaagcgccacacac

SEQ ID NO: 421423 - RNA, 24 nt, Human
acccugucucuacuaaaaauacaa

SEQ ID NO: 421424 - RNA, 22 nt, Human
accugguuccacgucccccugc

SEQ ID NO: 421425 - RNA, 23 nt, Human
acgccaccugcagcagcauccug

SEQ ID NO: 421426 - RNA, 23 nt, Human
acgccaccugcagcagcauccug

SEQ ID NO: 421427 - RNA, 18 nt, Human
acgccuguaaucccagca

SEQ ID NO: 421428 - RNA, 23 nt, Human
acgccuguaaucccagcauuuug

SEQ ID NO: 421429 - RNA, 20 nt, Human
acucacacugcagcgugggc

SEQ ID NO: 421430 - RNA, 24 nt, Human
acuccagccuggccaacaggguga

SEQ ID NO: 421431 - RNA, 19 nt, Human
acuccucuucagaggcagc

SEQ ID NO: 421432 - RNA, 18 nt, Human
acugcacuccagccuggc

SEQ ID NO: 421433 - RNA, 24 nt, Human
acugcacuccagccuggccaacag

SEQ ID NO: 421434 - RNA, 24 nt, Human
acugcacuccagccuggccaacag

SEQ ID NO: 421435 - RNA, 20 nt, Human
acugugaauagcacaccuuc

SEQ ID NO: 421436 - RNA, 24 nt, Human
acuuuucaugccaaagcaaaauuu

SEQ ID NO: 421437 - RNA, 22 nt, Human
agaaacugguaaagaaaagcca

SEQ ID NO: 421438 - RNA, 22 nt, Human
agaaacugguaaagaaaagcca

SEQ ID NO: 421439 - RNA, 22 nt, Human
agaaacugguaaagaaaagcca

SEQ ID NO: 421440 - RNA, 22 nt, Human
agaaacugguaaagaaaagcca

SEQ ID NO: 421441 - RNA, 21 nt, Human
agaaauacauuccuucagggc

SEQ ID NO: 421442 - RNA, 22 nt, Human
agaaaugaagcaaguugccaaa

SEQ ID NO: 421443 - RNA, 22 nt, Human
agaacgaauuggggcagaggug

SEQ ID NO: 421444 - RNA, 22 nt, Human
agaaggaagcugauggcgagaa

SEQ ID NO: 421445 - RNA, 19 nt, Human
agaaguuaagaagccaaua

SEQ ID NO: 421446 - RNA, 23 nt, Human
agaaguucgagaccagccugggc

SEQ ID NO: 421447 - RNA, 23 nt, Human
agacaaacuguacaaugaacccc

SEQ ID NO: 421448 - RNA, 21 nt, Human
agacagacaaacacugcgaag

SEQ ID NO: 421449 - RNA, 22 nt, Human
agacagacaaacacugcgaagg

SEQ ID NO: 421450 - RNA, 22 nt, Human
agacagacaaacacugcgaagg

SEQ ID NO: 421451 - RNA, 23 nt, Human
agacagauacuucaguuuguguu

SEQ ID NO: 421452 - RNA, 23 nt, Human
agacagauacuucaguuuguguu

SEQ ID NO: 421453 - RNA, 23 nt, Human
agacagauacuucaguuuguguu

SEQ ID NO: 421454 - RNA, 21 nt, Human
agagcucuaugagccccgccc

SEQ ID NO: 421455 - RNA, 26 nt, Human
agaguuucccccacaggugaccacau

SEQ ID NO: 421456 - RNA, 26 nt, Human
agaguuucccccacaggugaccacau

SEQ ID NO: 421457 - RNA, 26 nt, Human
agaguuucccccacaggugaccacau

SEQ ID NO: 421458 - RNA, 18 nt, Human
agaugccaccuucuguga

SEQ ID NO: 421459 - RNA, 22 nt, Human
agcaaggccagggccagggcag

SEQ ID NO: 421460 - RNA, 21 nt, Human
agcaauuacccuauuuauaga

SEQ ID NO: 421461 - RNA, 20 nt, Human
agcacuuugggaggcugagg

SEQ ID NO: 421462 - RNA, 20 nt, Human
agcauuuugggagggugagg

SEQ ID NO: 421463 - RNA, 18 nt, Human
agccaaagaaucugccgg

SEQ ID NO: 421464 - RNA, 20 nt, Human
agccacauagccccaagcag

SEQ ID NO: 421465 - RNA, 22 nt, Human
agccagaaagggggcaacgcga

SEQ ID NO: 421466 - RNA, 22 nt, Human
agccagaaagggggcaacgcga

SEQ ID NO: 421467 - RNA, 22 nt, Human
agccagaaagggggcaacgcga

SEQ ID NO: 421468 - RNA, 22 nt, Human
agccagaaagggggcaacgcga

SEQ ID NO: 421469 - RNA, 21 nt, Human
agccauacaguccagcacccu

SEQ ID NO: 421470 - RNA, 18 nt, Human
agccaugaaaugcaugag

SEQ ID NO: 421471 - RNA, 21 nt, Human
agccccaguggcgagaaaccc

SEQ ID NO: 421472 - RNA, 21 nt, Human
agccccaguggcgagaaaccc

SEQ ID NO: 421473 - RNA, 21 nt, Human
agccccaguggcgagaaaccc

SEQ ID NO: 421474 - RNA, 22 nt, Human
agccuggccaacagggugagac

SEQ ID NO: 421475 - RNA, 24 nt, Human
agccuggccaacagggugagacuc

SEQ ID NO: 421476 - RNA, 24 nt, Human
agccuggccaauauggcgaaaccc

SEQ ID NO: 421477 - RNA, 18 nt, Human
agccuggcuggggaggcc

SEQ ID NO: 421478 - RNA, 21 nt, Human
agccugggcaacauggcgaaa

SEQ ID NO: 421479 - RNA, 24 nt, Human
agccugggcaacauggcgaaaucu

SEQ ID NO: 421480 - RNA, 26 nt, Human
agcgcucaccuacucuucagaguggc

SEQ ID NO: 421481 - RNA, 23 nt, Human
agcggaucacaaggucaggaguu

SEQ ID NO: 421482 - RNA, 20 nt, Human
agcggcugccccgguccccc

SEQ ID NO: 421483 - RNA, 20 nt, Human
agcggcugccccgguccccc

SEQ ID NO: 421484 - RNA, 26 nt, Human
agcggcugccccggucccccuccaug

SEQ ID NO: 421485 - RNA, 26 nt, Human
agcggcugccccggucccccuccaug

SEQ ID NO: 421486 - RNA, 26 nt, Human
agcggcugccccggucccccuccaug

SEQ ID NO: 421487 - RNA, 24 nt, Human
agcucguuuccccuggguccucug

SEQ ID NO: 421488 - RNA, 24 nt, Human
agcucguuuccccuggguccucug

SEQ ID NO: 421489 - RNA, 23 nt, Human
aggaacccaaccagcccucagcc

SEQ ID NO: 421490 - RNA, 19 nt, Human
aggaacccaaccagcccuu

SEQ ID NO: 421491 - RNA, 26 nt, Human
aggaagucuccacucccagagcaccc

SEQ ID NO: 421492 - RNA, 22 nt, Human
aggacaggcacgguggcucaug

SEQ ID NO: 421493 - RNA, 18 nt, Human
aggacccccaccccuacc

SEQ ID NO: 421494 - RNA, 21 nt, Human
aggagcauaaaucuaugagcc

SEQ ID NO: 421495 - RNA, 21 nt, Human
aggagcauaaaucuaugagcc

SEQ ID NO: 421496 - RNA, 21 nt, Human
aggagcauaaaucuaugagcc

SEQ ID NO: 421497 - RNA, 28 nt, Human
aggauggaaaagaagcguuucugaggaa

SEQ ID NO: 421498 - RNA, 23 nt, Human
aggcacaccccauccuuccuggg

SEQ ID NO: 421499 - RNA, 24 nt, Human
aggcacgguggcucaugccuguaa

SEQ ID NO: 421500 - RNA, 21 nt, Human
aggcagcagccccaaauggcu

SEQ ID NO: 421501 - RNA, 21 nt, Human
aggcagccacgcugcuaaagc

SEQ ID NO: 421502 - RNA, 21 nt, Human
aggcaggcgagguggaaagcu

SEQ ID NO: 421503 - RNA, 21 nt, Human
aggcaggcgagguggaaagcu

SEQ ID NO: 421504 - RNA, 21 nt, Human
aggcaggcgagguggaaagcu

SEQ ID NO: 421505 - RNA, 26 nt, Human
aggcaggcgagguggaaagcuccgca

SEQ ID NO: 421506 - RNA, 26 nt, Human
aggcaggcgagguggaaagcuccgca

SEQ ID NO: 421507 - RNA, 26 nt, Human
aggcaggcgagguggaaagcuccgca

SEQ ID NO: 421508 - RNA, 19 nt, Human
aggcagggccggccgcccu

SEQ ID NO: 421509 - RNA, 19 nt, Human
aggcagggccggccgcccu

SEQ ID NO: 421510 - RNA, 19 nt, Human
aggcagggccggccgcccu

SEQ ID NO: 421511 - RNA, 19 nt, Human
aggcagggccggccgcccu

SEQ ID NO: 421512 - RNA, 21 nt, Human
aggcccaacccggccaggccu

SEQ ID NO: 421513 - RNA, 21 nt, Human
aggcccaacccggccaggccu

SEQ ID NO: 421514 - RNA, 21 nt, Human
aggcccaacccggccaggccu

SEQ ID NO: 421515 - RNA, 21 nt, Human
aggcccaacccggccaggccu

SEQ ID NO: 421516 - RNA, 24 nt, Human
aggcgagcggaucacaaggucagg

SEQ ID NO: 421517 - RNA, 24 nt, Human
aggcggagguugcagugagccgag

SEQ ID NO: 421518 - RNA, 24 nt, Human
aggcggguggaucacgaggucagg

SEQ ID NO: 421519 - RNA, 25 nt, Human
aggcuagaaaaaaacacaaaugugg

SEQ ID NO: 421520 - RNA, 20 nt, Human
aggcugaggcagaagaauug

SEQ ID NO: 421521 - RNA, 21 nt, Human
aggcugaggcgagcggaucac

SEQ ID NO: 421522 - RNA, 21 nt, Human
agggcaucauaaggagcauaa

SEQ ID NO: 421523 - RNA, 21 nt, Human
agggcaucauaaggagcauaa

SEQ ID NO: 421524 - RNA, 21 nt, Human
agggcaucauaaggagcauaa

SEQ ID NO: 421525 - RNA, 21 nt, Human
agggugaggcggguggaucac

SEQ ID NO: 421526 - RNA, 24 nt, Human
aggugcaguggcuuacgccuguaa

SEQ ID NO: 421527 - RNA, 19 nt, Human
aguaaauaauucuuacugc

SEQ ID NO: 421528 - RNA, 18 nt, Human
aguccagaacacaggagu

SEQ ID NO: 421529 - RNA, 24 nt, Human
agucccaaaucucagucuacaacc

SEQ ID NO: 421530 - RNA, 18 nt, Human
aguggacguguuauuggc

SEQ ID NO: 421531 - RNA, 18 nt, Human
aguggacguguuauuggc

SEQ ID NO: 421532 - RNA, 18 nt, Human
aguggacguguuauuggc

SEQ ID NO: 421533 - RNA, 18 nt, Human
aguggacguguuauuggc

SEQ ID NO: 421534 - RNA, 19 nt, Human
aguggacguguuauuggca

SEQ ID NO: 421535 - RNA, 19 nt, Human
aguggacguguuauuggca

SEQ ID NO: 421536 - RNA, 19 nt, Human
aguggacguguuauuggca

SEQ ID NO: 421537 - RNA, 19 nt, Human
aguggacguguuauuggca

SEQ ID NO: 421538 - RNA, 23 nt, Human
aguggcucacaccugcaauucca

SEQ ID NO: 421539 - RNA, 24 nt, Human
aguggcuuacgccuguaaucccag

SEQ ID NO: 421540 - RNA, 18 nt, Human
agugggagggaaccuuga

SEQ ID NO: 421541 - RNA, 18 nt, Human
agugggagggaaccuuga

SEQ ID NO: 421542 - RNA, 18 nt, Human
agugggagggaaccuuga

SEQ ID NO: 421543 - RNA, 18 nt, Human
agugggagggaaccuuga

SEQ ID NO: 421544 - RNA, 20 nt, Human
agugguucuaggacaggcac

SEQ ID NO: 421545 - RNA, 18 nt, Human
agugugaaaucaagacua

SEQ ID NO: 421546 - RNA, 21 nt, Human
aguucacuugccccugcccac

SEQ ID NO: 421547 - RNA, 24 nt, Human
aguuuucaaggggaguucuguaaa

SEQ ID NO: 421548 - RNA, 24 nt, Human
aguuuucaaggggaguucuguaaa

SEQ ID NO: 421549 - RNA, 24 nt, Human
aguuuucaaggggaguucuguaaa

SEQ ID NO: 421550 - RNA, 24 nt, Human
auaaaacaauaaaaaugguaccca

SEQ ID NO: 421551 - RNA, 23 nt, Human
auacaccugcuuccacuggcaca

SEQ ID NO: 421552 - RNA, 24 nt, Human
auacagccauuuccaaagagcaga

SEQ ID NO: 421553 - RNA, 24 nt, Human
auacagccauuuccaaagagcaga

SEQ ID NO: 421554 - RNA, 19 nt, Human
auagggggcugcugguguc

SEQ ID NO: 421555 - RNA, 21 nt, Human
auagguaggcuagaaaaaaac

SEQ ID NO: 421556 - RNA, 22 nt, Human
aucacaaggucaggaguucaag

SEQ ID NO: 421557 - RNA, 21 nt, Human
aucacgaggucaggaguucaa

SEQ ID NO: 421558 - RNA, 21 nt, Human
aucaucuccucauaaacauga

SEQ ID NO: 421559 - RNA, 22 nt, Human
auccugcugccagacaagcauc

SEQ ID NO: 421560 - RNA, 22 nt, Human
auccugcugccagacaagcauc

SEQ ID NO: 421561 - RNA, 22 nt, Human
auccugcugccagacaagcauc

SEQ ID NO: 421562 - RNA, 22 nt, Human
augaagcaaguugccaaaguca

SEQ ID NO: 421563 - RNA, 21 nt, Human
augagccccgcccagguugcc

SEQ ID NO: 421564 - RNA, 19 nt, Human
augccuguaaucccagcac

SEQ ID NO: 421565 - RNA, 20 nt, Human
augguacccaaagggaucaa

SEQ ID NO: 421566 - RNA, 20 nt, Human
auguacacagacacugugug

SEQ ID NO: 421567 - RNA, 23 nt, Human
auuaaaacuccaaagcucuauga

SEQ ID NO: 421568 - RNA, 18 nt, Human
auucccauccacguuccc

SEQ ID NO: 421569 - RNA, 20 nt, Human
auucucuuaaaaacacugga

SEQ ID NO: 421570 - RNA, 22 nt, Human
auuuaucacauauaccuuuuuc

SEQ ID NO: 421571 - RNA, 24 nt, Human
auuuauucucuuccucagggugau

SEQ ID NO: 421572 - RNA, 27 nt, Human
auuucauccauaagaaguuuagcacaa

SEQ ID NO: 421573 - RNA, 25 nt, Human
caaaaaaagaaccaagucuuaaaac

SEQ ID NO: 421574 - RNA, 25 nt, Human
caaaaaaagaaccaagucuuaaaac

SEQ ID NO: 421575 - RNA, 25 nt, Human
caaaaaaagaaccaagucuuaaaac

SEQ ID NO: 421576 - RNA, 22 nt, Human
caaaagcagacaaacuguacaa

SEQ ID NO: 421577 - RNA, 25 nt, Human
caaaagccuuucaagauagagucuu

SEQ ID NO: 421578 - RNA, 23 nt, Human
caaaauauuacccgagaguuaua

SEQ ID NO: 421579 - RNA, 18 nt, Human
caaaaucagaucucccua

SEQ ID NO: 421580 - RNA, 23 nt, Human
caaaaugaagucgaagguuugcc

SEQ ID NO: 421581 - RNA, 23 nt, Human
caaaaugaagucgaagguuugcc

SEQ ID NO: 421582 - RNA, 23 nt, Human
caaaaugaagucgaagguuugcc

SEQ ID NO: 421583 - RNA, 23 nt, Human
caaaauuuauacuuuuggauaaa

SEQ ID NO: 421584 - RNA, 21 nt, Human
caaacaugaggcaagggccgg

SEQ ID NO: 421585 - RNA, 26 nt, Human
caaagaaaaacacagggaauucucca

SEQ ID NO: 421586 - RNA, 26 nt, Human
caaagaaaaacacagggaauucucca

SEQ ID NO: 421587 - RNA, 26 nt, Human
caaagaaaaacacagggaauucucca

SEQ ID NO: 421588 - RNA, 20 nt, Human
caaagcccugcugcagcucu

SEQ ID NO: 421589 - RNA, 21 nt, Human
caaagcgcucaccuacucuuc

SEQ ID NO: 421590 - RNA, 19 nt, Human
caaagguauccaaccaaaa

SEQ ID NO: 421591 - RNA, 21 nt, Human
caaagugcacugcaaagccga

SEQ ID NO: 421592 - RNA, 21 nt, Human
caaagugcacugcaaagccga

SEQ ID NO: 421593 - RNA, 21 nt, Human
caaagugcacugcaaagccga

SEQ ID NO: 421594 - RNA, 23 nt, Human
caaaguuuucuucagucugaaaa

SEQ ID NO: 421595 - RNA, 24 nt, Human
caaaucucagucuacaacaucuac

SEQ ID NO: 421596 - RNA, 21 nt, Human
caaaugcccaucuccccaccc

SEQ ID NO: 421597 - RNA, 24 nt, Human
caaauguggaccuaacacguaacc

SEQ ID NO: 421598 - RNA, 24 nt, Human
caacacuuugggaggacgaggcag

SEQ ID NO: 421599 - RNA, 21 nt, Human
caacaggaaaccacggagucc

SEQ ID NO: 421600 - RNA, 22 nt, Human
caacauggcgaaaucuugucuc

SEQ ID NO: 421601 - RNA, 21 nt, Human
caacauuugagcagagccaau

SEQ ID NO: 421602 - RNA, 19 nt, Human
caacucaagugaauaaccg

SEQ ID NO: 421603 - RNA, 20 nt, Human
caacuggcaagucucaacuc

SEQ ID NO: 421604 - RNA, 20 nt, Human
caacuggcaagucucaacuc

SEQ ID NO: 421605 - RNA, 20 nt, Human
caacuggcaagucucaacuc

SEQ ID NO: 421606 - RNA, 22 nt, Human
caagaaauuaaaacuccaaagc

SEQ ID NO: 421607 - RNA, 23 nt, Human
caagaauuaaauugcaguucuga

SEQ ID NO: 421608 - RNA, 20 nt, Human
caagagccuucucaggagcc

SEQ ID NO: 421609 - RNA, 18 nt, Human
caagcagccccucaggac

SEQ ID NO: 421610 - RNA, 18 nt, Human
caagcagccccucaggac

SEQ ID NO: 421611 - RNA, 18 nt, Human
caagcagccccucaggac

SEQ ID NO: 421612 - RNA, 18 nt, Human
caauaaaaaugguaccca

SEQ ID NO: 421613 - RNA, 18 nt, Human
caauacaccugcuuccac

SEQ ID NO: 421614 - RNA, 24 nt, Human
caauauggcgaaacccugucucua

SEQ ID NO: 421615 - RNA, 19 nt, Human
cacacacaccucuggacac

SEQ ID NO: 421616 - RNA, 21 nt, Human
cacacaccaugggcaagcaag

SEQ ID NO: 421617 - RNA, 18 nt, Human
cacacaccccugaacccc

SEQ ID NO: 421618 - RNA, 19 nt, Human
cacacaccccugaacccca

SEQ ID NO: 421619 - RNA, 19 nt, Human
cacacaccccugaacccca

SEQ ID NO: 421620 - RNA, 19 nt, Human
cacacaccccugaacccca

SEQ ID NO: 421621 - RNA, 24 nt, Human
cacacacgucacaaugaugccaag

SEQ ID NO: 421622 - RNA, 24 nt, Human
cacacacgucacaaugaugccaag

SEQ ID NO: 421623 - RNA, 24 nt, Human
cacacacgucacaaugaugccaag

SEQ ID NO: 421624 - RNA, 18 nt, Human
cacacaucuuccauaaaa

SEQ ID NO: 421625 - RNA, 18 nt, Human
cacacaucuuccauaaaa

SEQ ID NO: 421626 - RNA, 21 nt, Human
cacacaucuuccauaaaauga

SEQ ID NO: 421627 - RNA, 21 nt, Human
cacacaucuuccauaaaauga

SEQ ID NO: 421628 - RNA, 19 nt, Human
cacacccccucccagccac

SEQ ID NO: 421629 - RNA, 21 nt, Human
cacacccccucccagccaccg

SEQ ID NO: 421630 - RNA, 20 nt, Human
cacaccgcaucauuuuaccu

SEQ ID NO: 421631 - RNA, 20 nt, Human
cacaccgcaucauuuuaccu

SEQ ID NO: 421632 - RNA, 20 nt, Human
cacaccgcaucauuuuaccu

SEQ ID NO: 421633 - RNA, 19 nt, Human
cacaccucuggacacacac

SEQ ID NO: 421634 - RNA, 24 nt, Human
cacaccugcaauuccaacacuuug

SEQ ID NO: 421635 - RNA, 21 nt, Human
cacacguacgaggcacgcaca

SEQ ID NO: 421636 - RNA, 21 nt, Human
cacacguacgaggcacgcaca

SEQ ID NO: 421637 - RNA, 18 nt, Human
cacagagugcugagaugg

SEQ ID NO: 421638 - RNA, 18 nt, Human
cacagagugcugagaugg

SEQ ID NO: 421639 - RNA, 18 nt, Human
cacagagugcugagaugg

SEQ ID NO: 421640 - RNA, 18 nt, Human
cacagcaccagcugcccg

SEQ ID NO: 421641 - RNA, 18 nt, Human
cacagcaccagcugcccg

SEQ ID NO: 421642 - RNA, 18 nt, Human
cacagcaccagcugcccg

SEQ ID NO: 421643 - RNA, 21 nt, Human
cacagugcugagcaaaccccc

SEQ ID NO: 421644 - RNA, 18 nt, Human
caccacacccccucccag

SEQ ID NO: 421645 - RNA, 19 nt, Human
caccacacccccucccagc

SEQ ID NO: 421646 - RNA, 18 nt, Human
caccacagccaugcugcg

SEQ ID NO: 421647 - RNA, 25 nt, Human
caccacagccaugcugcggcacuga

SEQ ID NO: 421648 - RNA, 23 nt, Human
caccacagucgucuucuaaccug

SEQ ID NO: 421649 - RNA, 19 nt, Human
caccagcugcccgccauca

SEQ ID NO: 421650 - RNA, 19 nt, Human
caccagcugcccgccauca

SEQ ID NO: 421651 - RNA, 20 nt, Human
caccaggugacgugacucac

SEQ ID NO: 421652 - RNA, 22 nt, Human
cacccaccuccuucaggaaacc

SEQ ID NO: 421653 - RNA, 23 nt, Human
cacccaccuccuucaggaaacca

SEQ ID NO: 421654 - RNA, 22 nt, Human
cacccaugcaaaauucaucaug

SEQ ID NO: 421655 - RNA, 21 nt, Human
caccccacccaguauauguca

SEQ ID NO: 421656 - RNA, 20 nt, Human
caccccccgcugagauacac

SEQ ID NO: 421657 - RNA, 19 nt, Human
cacccccucccagccaccg

SEQ ID NO: 421658 - RNA, 19 nt, Human
caccgccccuggauccggc

SEQ ID NO: 421659 - RNA, 19 nt, Human
caccgccccuggauccggc

SEQ ID NO: 421660 - RNA, 19 nt, Human
caccgccccuggauccggc

SEQ ID NO: 421661 - RNA, 19 nt, Human
caccgccccuggauccggc

SEQ ID NO: 421662 - RNA, 23 nt, Human
caccucaacacucaaguaacuaa

SEQ ID NO: 421663 - RNA, 24 nt, Human
caccucagcaauuacccuauuuau

SEQ ID NO: 421664 - RNA, 20 nt, Human
caccuccccucuccaagcac

SEQ ID NO: 421665 - RNA, 25 nt, Human
caccuccccucuccaagcacagaca

SEQ ID NO: 421666 - RNA, 19 nt, Human
caccugcaauuccaacacu

SEQ ID NO: 421667 - RNA, 23 nt, Human
caccugcaauuccaacacuuugg

SEQ ID NO: 421668 - RNA, 24 nt, Human
caccugcaauuccaacacuuuggg

SEQ ID NO: 421669 - RNA, 18 nt, Human
caccugcuuccacuggca

SEQ ID NO: 421670 - RNA, 18 nt, Human
caccuggagucaguaugc

SEQ ID NO: 421671 - RNA, 19 nt, Human
caccuuuuauuucagauuu

SEQ ID NO: 421672 - RNA, 18 nt, Human
cacgcaccaggugacgug

SEQ ID NO: 421673 - RNA, 18 nt, Human
cacggagaaccaaauaac

SEQ ID NO: 421674 - RNA, 19 nt, Human
cacuaaggcaaaagggcuc

SEQ ID NO: 421675 - RNA, 19 nt, Human
cacuacucccacccugucu

SEQ ID NO: 421676 - RNA, 19 nt, Human
cacuacucccacccugucu

SEQ ID NO: 421677 - RNA, 19 nt, Human
cacuacucccacccugucu

SEQ ID NO: 421678 - RNA, 21 nt, Human
cacuacuguccaacacaaaaa

SEQ ID NO: 421679 - RNA, 21 nt, Human
cacuacuguccaacacaaaaa

SEQ ID NO: 421680 - RNA, 21 nt, Human
cacuacuguccaacacaaaaa

SEQ ID NO: 421681 - RNA, 20 nt, Human
cacuccagccuggccaacag

SEQ ID NO: 421682 - RNA, 23 nt, Human
cacuccagccuggccaacagggu

SEQ ID NO: 421683 - RNA, 24 nt, Human
cacuccagccuggccaacagggug

SEQ ID NO: 421684 - RNA, 23 nt, Human
cacucucagguccaaagacacug

SEQ ID NO: 421685 - RNA, 23 nt, Human
cacucucagguccaaagacacug

SEQ ID NO: 421686 - RNA, 23 nt, Human
cacucucagguccaaagacacug

SEQ ID NO: 421687 - RNA, 19 nt, Human
cacucuguagaacuggacc

SEQ ID NO: 421688 - RNA, 24 nt, Human
cacugcaauuggaggcuccacacc

SEQ ID NO: 421689 - RNA, 24 nt, Human
cacugcaauuggaggcuccacacc

SEQ ID NO: 421690 - RNA, 24 nt, Human
cacugcaauuggaggcuccacacc

SEQ ID NO: 421691 - RNA, 23 nt, Human
cacugcacaccacagucgucuuc

SEQ ID NO: 421692 - RNA, 19 nt, Human
cacugugcccuuucagaac

SEQ ID NO: 421693 - RNA, 18 nt, Human
cacuguguccugagcagc

SEQ ID NO: 421694 - RNA, 23 nt, Human
cagaacgaauuggggcagaggug

SEQ ID NO: 421695 - RNA, 23 nt, Human
cagaacgaauuggggcagaggug

SEQ ID NO: 421696 - RNA, 21 nt, Human
cagacaagcagccccucagga

SEQ ID NO: 421697 - RNA, 21 nt, Human
cagacaagcagccccucagga

SEQ ID NO: 421698 - RNA, 21 nt, Human
cagacaagcagccccucagga

SEQ ID NO: 421699 - RNA, 23 nt, Human
cagagugaggccagguggcugcu

SEQ ID NO: 421700 - RNA, 19 nt, Human
cagauugcagagauuccga

SEQ ID NO: 421701 - RNA, 21 nt, Human
cagcacugagauguaacuaca

SEQ ID NO: 421702 - RNA, 22 nt, Human
cagcacuuugggaggcugaggc

SEQ ID NO: 421703 - RNA, 23 nt, Human
cagcacuuugggaggcugaggcg

SEQ ID NO: 421704 - RNA, 19 nt, Human
cagcagugggacagaggag

SEQ ID NO: 421705 - RNA, 24 nt, Human
cagcauuuugggagggugaggcgg

SEQ ID NO: 421706 - RNA, 21 nt, Human
cagccaccggacagacaacua

SEQ ID NO: 421707 - RNA, 18 nt, Human
cagccauacaguccagca

SEQ ID NO: 421708 - RNA, 24 nt, Human
cagcggaaaccucggcucucaaau

SEQ ID NO: 421709 - RNA, 22 nt, Human
cagcuaaauggccuucauacca

SEQ ID NO: 421710 - RNA, 24 nt, Human
cagcuacucgggaggcugaggcag

SEQ ID NO: 421711 - RNA, 18 nt, Human
cagcucuggacagccccc

SEQ ID NO: 421712 - RNA, 31 nt, Human
caggacaacugccuaggccagggagacugaa

SEQ ID NO: 421713 - RNA, 19 nt, Human
caggacaccaggcugcucc

SEQ ID NO: 421714 - RNA, 21 nt, Human
caggacccccaccccuaccuc

SEQ ID NO: 421715 - RNA, 19 nt, Human
caggcaggccuccaccccc

SEQ ID NO: 421716 - RNA, 19 nt, Human
caggcaggccuccaccccc

SEQ ID NO: 421717 - RNA, 19 nt, Human
caggcaggccuccaccccc

SEQ ID NO: 421718 - RNA, 22 nt, Human
cagggucugggacccacauaca

SEQ ID NO: 421719 - RNA, 19 nt, Human
caggugccacacacucaca

SEQ ID NO: 421720 - RNA, 21 nt, Human
caguaaaaacagauuaucaca

SEQ ID NO: 421721 - RNA, 21 nt, Human
caguaaaaacagauuaucaca

SEQ ID NO: 421722 - RNA, 22 nt, Human
caguauaagcaacaacucaagu

SEQ ID NO: 421723 - RNA, 24 nt, Human
caguauaucccuccccccaaaaag

SEQ ID NO: 421724 - RNA, 24 nt, Human
caguauaucccuccccccaaaaag

SEQ ID NO: 421725 - RNA, 24 nt, Human
caguauaucccuccccccaaaaag

SEQ ID NO: 421726 - RNA, 22 nt, Human
cagugcccauaacacacguacg

SEQ ID NO: 421727 - RNA, 22 nt, Human
cagugcccauaacacacguacg

SEQ ID NO: 421728 - RNA, 22 nt, Human
cagugcccauaacacacguacg

SEQ ID NO: 421729 - RNA, 22 nt, Human
cagugguggggaggcgcucccu

SEQ ID NO: 421730 - RNA, 22 nt, Human
cagugguggggaggcgcucccu

SEQ ID NO: 421731 - RNA, 22 nt, Human
cagugguggggaggcgcucccu

SEQ ID NO: 421732 - RNA, 22 nt, Human
cagugguggggaggcgcucccu

SEQ ID NO: 421733 - RNA, 22 nt, Human
caguguggaccucaaacagcaa

SEQ ID NO: 421734 - RNA, 19 nt, Human
caguuaagaguuaccagug

SEQ ID NO: 421735 - RNA, 21 nt, Human
caguuaugggcuagcuggcug

SEQ ID NO: 421736 - RNA, 24 nt, Human
cauaagaaguuuagcacaaaucuc

SEQ ID NO: 421737 - RNA, 23 nt, Human
cauagccccaagcagguggcagc

SEQ ID NO: 421738 - RNA, 22 nt, Human
caucacggagaaccaaauaaca

SEQ ID NO: 421739 - RNA, 24 nt, Human
cauccugcugccagacaagcaucc

SEQ ID NO: 421740 - RNA, 24 nt, Human
cauccugcugccagacaagcaucc

SEQ ID NO: 421741 - RNA, 24 nt, Human
cauccugcugccagacaagcaucc

SEQ ID NO: 421742 - RNA, 20 nt, Human
caucuccccaccccaccccg

SEQ ID NO: 421743 - RNA, 20 nt, Human
caugaccuaaaguguucuga

SEQ ID NO: 421744 - RNA, 24 nt, Human
caugcaucagacagauuuuucguu

SEQ ID NO: 421745 - RNA, 20 nt, Human
caugccuguaaucccagcac

SEQ ID NO: 421746 - RNA, 24 nt, Human
caugccuguaaucccagcacuuug

SEQ ID NO: 421747 - RNA, 19 nt, Human
caugcucgcccucucccgc

SEQ ID NO: 421748 - RNA, 21 nt, Human
caugcucgcccucucccgcag

SEQ ID NO: 421749 - RNA, 21 nt, Human
caugcucgcccucucccgcag

SEQ ID NO: 421750 - RNA, 21 nt, Human
caugcucgcccucucccgcag

SEQ ID NO: 421751 - RNA, 21 nt, Human
caugcucgcccucucccgcag

SEQ ID NO: 421752 - RNA, 21 nt, Human
caugugaucagcagagacugc

SEQ ID NO: 421753 - RNA, 21 nt, Human
caugugaucagcagagacugc

SEQ ID NO: 421754 - RNA, 21 nt, Human
caugugaucagcagagacugc

SEQ ID NO: 421755 - RNA, 23 nt, Human
cauuuggaaaggaaaagugcagg

SEQ ID NO: 421756 - RNA, 19 nt, Human
ccaaagaaaaacacaggga

SEQ ID NO: 421757 - RNA, 19 nt, Human
ccaaagaaaaacacaggga

SEQ ID NO: 421758 - RNA, 19 nt, Human
ccaaagaaaaacacaggga

SEQ ID NO: 421759 - RNA, 24 nt, Human
ccaaauaacaagaaauuaaaacuc

SEQ ID NO: 421760 - RNA, 18 nt, Human
ccaaaugcccaucucccc

SEQ ID NO: 421761 - RNA, 20 nt, Human
ccaacccuugccucacuacu

SEQ ID NO: 421762 - RNA, 18 nt, Human
ccaagcacagacauagug

SEQ ID NO: 421763 - RNA, 22 nt, Human
ccaaugguccucccuaaguucu

SEQ ID NO: 421764 - RNA, 19 nt, Human
ccacacaccccugaacccc

SEQ ID NO: 421765 - RNA, 19 nt, Human
ccacacaccccugaacccc

SEQ ID NO: 421766 - RNA, 20 nt, Human
ccacagaaaagcagacagcu

SEQ ID NO: 421767 - RNA, 25 nt, Human
ccacagcaagccuuacuccagccgc

SEQ ID NO: 421768 - RNA, 18 nt, Human
ccaccacacccccuccca

SEQ ID NO: 421769 - RNA, 19 nt, Human
ccaccacacccccucccag

SEQ ID NO: 421770 - RNA, 24 nt, Human
ccaccacacccccucccagccacc

SEQ ID NO: 421771 - RNA, 18 nt, Human
ccaccccaccccgucuug

SEQ ID NO: 421772 - RNA, 23 nt, Human
ccacgcuuacaggucacaaaacc

SEQ ID NO: 421773 - RNA, 23 nt, Human
ccacgcuuacaggucacaaaacc

SEQ ID NO: 421774 - RNA, 23 nt, Human
ccacgcuuacaggucacaaaacc

SEQ ID NO: 421775 - RNA, 18 nt, Human
ccacgucccccugccaga

SEQ ID NO: 421776 - RNA, 22 nt, Human
ccagagcaccacugcacaccac

SEQ ID NO: 421777 - RNA, 21 nt, Human
ccagaggaagcuuugaaauua

SEQ ID NO: 421778 - RNA, 18 nt, Human
ccaggccucgaaagugcu

SEQ ID NO: 421779 - RNA, 18 nt, Human
ccaggccucgaaagugcu

SEQ ID NO: 421780 - RNA, 18 nt, Human
ccaggccucgaaagugcu

SEQ ID NO: 421781 - RNA, 18 nt, Human
ccaggccucgaaagugcu

SEQ ID NO: 421782 - RNA, 19 nt, Human
ccauaauauagagggagca

SEQ ID NO: 421783 - RNA, 27 nt, Human
ccauaugccaauuaacuuuaaccuaaa

SEQ ID NO: 421784 - RNA, 27 nt, Human
ccauaugccaauuaacuuuaaccuaaa

SEQ ID NO: 421785 - RNA, 27 nt, Human
ccauaugccaauuaacuuuaaccuaaa

SEQ ID NO: 421786 - RNA, 27 nt, Human
ccauaugccaauuaacuuuaaccuaaa

SEQ ID NO: 421787 - RNA, 19 nt, Human
cccacacgaguguccccau

SEQ ID NO: 421788 - RNA, 19 nt, Human
cccacacgaguguccccau

SEQ ID NO: 421789 - RNA, 19 nt, Human
cccacacgaguguccccau

SEQ ID NO: 421790 - RNA, 22 nt, Human
cccacagcaagccuuacuccag

SEQ ID NO: 421791 - RNA, 22 nt, Human
cccacauacagaauauagaccu

SEQ ID NO: 421792 - RNA, 24 nt, Human
cccacauacagaauauagaccuua

SEQ ID NO: 421793 - RNA, 20 nt, Human
cccaccccgucuuguucccc

SEQ ID NO: 421794 - RNA, 21 nt, Human
cccaccuucccaaugucccca

SEQ ID NO: 421795 - RNA, 21 nt, Human
cccacggucacagcugggggc

SEQ ID NO: 421796 - RNA, 21 nt, Human
cccacggucacagcugggggc

SEQ ID NO: 421797 - RNA, 21 nt, Human
cccacggucacagcugggggc

SEQ ID NO: 421798 - RNA, 24 nt, Human
cccacgugcugggguccccggggc

SEQ ID NO: 421799 - RNA, 24 nt, Human
cccacgugcugggguccccggggc

SEQ ID NO: 421800 - RNA, 24 nt, Human
cccacgugcugggguccccggggc

SEQ ID NO: 421801 - RNA, 26 nt, Human
ccccaaaaacaucaaccuggggccag

SEQ ID NO: 421802 - RNA, 18 nt, Human
ccccauguccucgcuacu

SEQ ID NO: 421803 - RNA, 20 nt, Human
cccccaaaaacaucaaccug

SEQ ID NO: 421804 - RNA, 22 nt, Human
cccccaaaaacaucaaccuggg

SEQ ID NO: 421805 - RNA, 24 nt, Human
cccccaacuggcaagucucaacuc

SEQ ID NO: 421806 - RNA, 24 nt, Human
cccccaacuggcaagucucaacuc

SEQ ID NO: 421807 - RNA, 24 nt, Human
cccccaacuggcaagucucaacuc

SEQ ID NO: 421808 - RNA, 18 nt, Human
cccccaggaccgcaccuc

SEQ ID NO: 421809 - RNA, 18 nt, Human
cccccaggaccgcaccuc

SEQ ID NO: 421810 - RNA, 18 nt, Human
cccccaggaccgcaccuc

SEQ ID NO: 421811 - RNA, 22 nt, Human
ccccccaaaaagugaauuucaa

SEQ ID NO: 421812 - RNA, 22 nt, Human
ccccccaaaaagugaauuucaa

SEQ ID NO: 421813 - RNA, 22 nt, Human
ccccccaaaaagugaauuucaa

SEQ ID NO: 421814 - RNA, 21 nt, Human
ccccucccagccaccggacag

SEQ ID NO: 421815 - RNA, 18 nt, Human
ccccugacucaugggcag

SEQ ID NO: 421816 - RNA, 20 nt, Human
ccccugguagcggcugcccc

SEQ ID NO: 421817 - RNA, 20 nt, Human
ccccugguagcggcugcccc

SEQ ID NO: 421818 - RNA, 20 nt, Human
ccccugguagcggcugcccc

SEQ ID NO: 421819 - RNA, 21 nt, Human
cccgcaggcagggccggccgc

SEQ ID NO: 421820 - RNA, 21 nt, Human
cccgcaggcagggccggccgc

SEQ ID NO: 421821 - RNA, 21 nt, Human
cccgcaggcagggccggccgc

SEQ ID NO: 421822 - RNA, 21 nt, Human
cccgcaggcagggccggccgc

SEQ ID NO: 421823 - RNA, 24 nt, Human
cccgggcuguccgagaccuugguc

SEQ ID NO: 421824 - RNA, 19 nt, Human
cccuaaaaaucaggaaacc

SEQ ID NO: 421825 - RNA, 22 nt, Human
cccuaaaacaucugcacuggca

SEQ ID NO: 421826 - RNA, 25 nt, Human
cccuccaugcacgucucaggcccag

SEQ ID NO: 421827 - RNA, 18 nt, Human
cccucccucccagacaag

SEQ ID NO: 421828 - RNA, 20 nt, Human
cccuccgccgccgccucuuc

SEQ ID NO: 421829 - RNA, 20 nt, Human
cccuccgccgccgccucuuc

SEQ ID NO: 421830 - RNA, 20 nt, Human
cccuccgccgccgccucuuc

SEQ ID NO: 421831 - RNA, 23 nt, Human
cccugaccuuccugcacuggaag

SEQ ID NO: 421832 - RNA, 18 nt, Human
cccugcaaagucacuccu

SEQ ID NO: 421833 - RNA, 18 nt, Human
cccugcaaagucacuccu

SEQ ID NO: 421834 - RNA, 18 nt, Human
cccugcaaagucacuccu

SEQ ID NO: 421835 - RNA, 24 nt, Human
cccugcaaagucacuccuuucgcc

SEQ ID NO: 421836 - RNA, 24 nt, Human
cccugcaaagucacuccuuucgcc

SEQ ID NO: 421837 - RNA, 24 nt, Human
cccugcaaagucacuccuuucgcc

SEQ ID NO: 421838 - RNA, 19 nt, Human
cccugcagggccacacacc

SEQ ID NO: 421839 - RNA, 19 nt, Human
cccugcagggccacacacc

SEQ ID NO: 421840 - RNA, 19 nt, Human
cccugcagggccacacacc

SEQ ID NO: 421841 - RNA, 20 nt, Human
cccuugggaaaagccuacgc

SEQ ID NO: 421842 - RNA, 21 nt, Human
cccuugggaaaagccuacgcu

SEQ ID NO: 421843 - RNA, 21 nt, Human
cccuugggaaaagccuacgcu

SEQ ID NO: 421844 - RNA, 21 nt, Human
cccuugggaaaagccuacgcu

SEQ ID NO: 421845 - RNA, 19 nt, Human
ccgcaaggagagcaaagua

SEQ ID NO: 421846 - RNA, 21 nt, Human
ccgcagagcucuaugagcccc

SEQ ID NO: 421847 - RNA, 19 nt, Human
ccgcaggcuccaccuccac

SEQ ID NO: 421848 - RNA, 23 nt, Human
ccgccagccccuccgccgccgcc

SEQ ID NO: 421849 - RNA, 23 nt, Human
ccgccagccccuccgccgccgcc

SEQ ID NO: 421850 - RNA, 23 nt, Human
ccgccagccccuccgccgccgcc

SEQ ID NO: 421851 - RNA, 18 nt, Human
ccgccaucaccgcagcgg

SEQ ID NO: 421852 - RNA, 18 nt, Human
ccgccaucaccgcagcgg

SEQ ID NO: 421853 - RNA, 20 nt, Human
ccgccaucaccgcagcggaa

SEQ ID NO: 421854 - RNA, 18 nt, Human
ccgccccuaagucaugcu

SEQ ID NO: 421855 - RNA, 18 nt, Human
ccgccccuaagucaugcu

SEQ ID NO: 421856 - RNA, 18 nt, Human
ccgccccuaagucaugcu

SEQ ID NO: 421857 - RNA, 23 nt, Human
ccgccucuuccccuucggcuucc

SEQ ID NO: 421858 - RNA, 23 nt, Human
ccgccucuuccccuucggcuucc

SEQ ID NO: 421859 - RNA, 23 nt, Human
ccgccucuuccccuucggcuucc

SEQ ID NO: 421860 - RNA, 20 nt, Human
ccgggacacagaggaggaca

SEQ ID NO: 421861 - RNA, 22 nt, Human
ccuacgcuacacauuucagagg

SEQ ID NO: 421862 - RNA, 22 nt, Human
ccuacgcuacacauuucagagg

SEQ ID NO: 421863 - RNA, 22 nt, Human
ccuacgcuacacauuucagagg

SEQ ID NO: 421864 - RNA, 22 nt, Human
ccuacgcuacacauuucagagg

SEQ ID NO: 421865 - RNA, 18 nt, Human
ccuagagcugcggggacc

SEQ ID NO: 421866 - RNA, 19 nt, Human
ccucacacgggccucaccc

SEQ ID NO: 421867 - RNA, 19 nt, Human
ccucacacgggccucaccc

SEQ ID NO: 421868 - RNA, 19 nt, Human
ccucacacgggccucaccc

SEQ ID NO: 421869 - RNA, 19 nt, Human
ccucacacgggccucaccc

SEQ ID NO: 421870 - RNA, 22 nt, Human
ccucacuacccuguuccaaaag

SEQ ID NO: 421871 - RNA, 24 nt, Human
ccuccacccccaggaccgcaccuc

SEQ ID NO: 421872 - RNA, 24 nt, Human
ccuccacccccaggaccgcaccuc

SEQ ID NO: 421873 - RNA, 19 nt, Human
ccuccgggccaguucaugc

SEQ ID NO: 421874 - RNA, 19 nt, Human
ccuccgggccaguucaugc

SEQ ID NO: 421875 - RNA, 19 nt, Human
ccuccgggccaguucaugc

SEQ ID NO: 421876 - RNA, 19 nt, Human
ccuccgggccaguucaugc

SEQ ID NO: 421877 - RNA, 19 nt, Human
ccucuuggcgaccaggccc

SEQ ID NO: 421878 - RNA, 19 nt, Human
ccucuuggcgaccaggccc

SEQ ID NO: 421879 - RNA, 19 nt, Human
ccucuuggcgaccaggccc

SEQ ID NO: 421880 - RNA, 24 nt, Human
ccugacucaugggcaggccucgac

SEQ ID NO: 421881 - RNA, 28 nt, Human
ccugcaagcucagggccgcuaccccaaa

SEQ ID NO: 421882 - RNA, 28 nt, Human
ccugcaagcucagggccgcuaccccaaa

SEQ ID NO: 421883 - RNA, 28 nt, Human
ccugcaagcucagggccgcuaccccaaa

SEQ ID NO: 421884 - RNA, 22 nt, Human
ccugccaggcaggccuccaccc

SEQ ID NO: 421885 - RNA, 22 nt, Human
ccugccaggcaggccuccaccc

SEQ ID NO: 421886 - RNA, 22 nt, Human
ccugccaggcaggccuccaccc

SEQ ID NO: 421887 - RNA, 22 nt, Human
ccugcugccagacaagcauccc

SEQ ID NO: 421888 - RNA, 22 nt, Human
ccugcugccagacaagcauccc

SEQ ID NO: 421889 - RNA, 22 nt, Human
ccugcugccagacaagcauccc

SEQ ID NO: 421890 - RNA, 20 nt, Human
ccuggccaacagggugagac

SEQ ID NO: 421891 - RNA, 24 nt, Human
ccuggccaacagggugagacucug

SEQ ID NO: 421892 - RNA, 22 nt, Human
ccuggccaauauggcgaaaccc

SEQ ID NO: 421893 - RNA, 24 nt, Human
ccuggccaauauggcgaaacccug

SEQ ID NO: 421894 - RNA, 19 nt, Human
ccugggcaacauggcgaaa

SEQ ID NO: 421895 - RNA, 24 nt, Human
ccugggcaacauggcgaaaucuug

SEQ ID NO: 421896 - RNA, 20 nt, Human
ccuguaaucccagcacuuug

SEQ ID NO: 421897 - RNA, 18 nt, Human
ccuguggccagagugagg

SEQ ID NO: 421898 - RNA, 22 nt, Human
ccuuggguuugaaggguuggaa

SEQ ID NO: 421899 - RNA, 23 nt, Human
ccuuggguuugaaggguuggaag

SEQ ID NO: 421900 - RNA, 23 nt, Human
ccuuggguuugaaggguuggaag

SEQ ID NO: 421901 - RNA, 23 nt, Human
ccuuggguuugaaggguuggaag

SEQ ID NO: 421902 - RNA, 19 nt, Human
ccuuugccaucugucuuga

SEQ ID NO: 421903 - RNA, 19 nt, Human
ccuuugccaucugucuuga

SEQ ID NO: 421904 - RNA, 19 nt, Human
ccuuugccaucugucuuga

SEQ ID NO: 421905 - RNA, 22 nt, Human
cgaccaggccccacccuuugcc

SEQ ID NO: 421906 - RNA, 22 nt, Human
cgaccaggccccacccuuugcc

SEQ ID NO: 421907 - RNA, 19 nt, Human
cgacuuuuucccaccacac

SEQ ID NO: 421908 - RNA, 19 nt, Human
cgagaugcauuuggaaagg

SEQ ID NO: 421909 - RNA, 22 nt, Human
cgaguguccccauucacugucc

SEQ ID NO: 421910 - RNA, 22 nt, Human
cgaguguccccauucacugucc

SEQ ID NO: 421911 - RNA, 19 nt, Human
cgcaugcauaaugcaguca

SEQ ID NO: 421912 - RNA, 24 nt, Human
cgccuguaaucccagcauuuuggg

SEQ ID NO: 421913 - RNA, 25 nt, Human
cgcgcaacagggcuaugcggcccga

SEQ ID NO: 421914 - RNA, 23 nt, Human
cgcuuguagucccagcuacucgg

SEQ ID NO: 421915 - RNA, 24 nt, Human
cgcuuguagucccagcuacucggg

SEQ ID NO: 421916 - RNA, 23 nt, Human
cggacagacaacuagccacaguc

SEQ ID NO: 421917 - RNA, 22 nt, Human
cggaucacaaggucaggaguuc

SEQ ID NO: 421918 - RNA, 19 nt, Human
cggccgcccugcaccgccc

SEQ ID NO: 421919 - RNA, 19 nt, Human
cggccgcccugcaccgccc

SEQ ID NO: 421920 - RNA, 21 nt, Human
cggcucggcaaccacccgcaa

SEQ ID NO: 421921 - RNA, 27 nt, Human
cgggaggcugaggcagaagaauugcug

SEQ ID NO: 421922 - RNA, 22 nt, Human
cguuaaauuagcagcauaauga

SEQ ID NO: 421923 - RNA, 21 nt, Human
cuaaugaguggaaacaacuga

SEQ ID NO: 421924 - RNA, 24 nt, Human
cuaggacaggcacgguggcucaug

SEQ ID NO: 421925 - RNA, 25 nt, Human
cuagggucagggcugggggugaguc

SEQ ID NO: 421926 - RNA, 21 nt, Human
cucaaagauaaaccgcacacc

SEQ ID NO: 421927 - RNA, 22 nt, Human
cucaagugaauaaccggaccaa

SEQ ID NO: 421928 - RNA, 24 nt, Human
cucacacagcuguggagggggcag

SEQ ID NO: 421929 - RNA, 24 nt, Human
cucacacagcuguggagggggcag

SEQ ID NO: 421930 - RNA, 20 nt, Human
cucacacugcagcgugggca

SEQ ID NO: 421931 - RNA, 22 nt, Human
cucaccucaacacucaaguaac

SEQ ID NO: 421932 - RNA, 21 nt, Human
cucacucuguagaacuggacc

SEQ ID NO: 421933 - RNA, 21 nt, Human
cucacucuguagaacuggacc

SEQ ID NO: 421934 - RNA, 21 nt, Human
cucacucuguagaacuggacc

SEQ ID NO: 421935 - RNA, 24 nt, Human
cucacuggcaaugagaacagcuga

SEQ ID NO: 421936 - RNA, 23 nt, Human
cucaugccuguaaucccagcacu

SEQ ID NO: 421937 - RNA, 24 nt, Human
cucaugccuguaaucccagcacuu

SEQ ID NO: 421938 - RNA, 21 nt, Human
cucauggucaccuaacucaua

SEQ ID NO: 421939 - RNA, 21 nt, Human
cuccaaaugcccaucucccca

SEQ ID NO: 421940 - RNA, 22 nt, Human
cuccacagaaaagcagacagcu

SEQ ID NO: 421941 - RNA, 23 nt, Human
cuccacccccaggaccgcaccuc

SEQ ID NO: 421942 - RNA, 20 nt, Human
cucccucccucccagacaag

SEQ ID NO: 421943 - RNA, 20 nt, Human
cucccucccucccagacaag

SEQ ID NO: 421944 - RNA, 26 nt, Human
cuccgccagccccuccgccgccgccu

SEQ ID NO: 421945 - RNA, 26 nt, Human
cuccgccagccccuccgccgccgccu

SEQ ID NO: 421946 - RNA, 22 nt, Human
cucguuuccccuggguccucug

SEQ ID NO: 421947 - RNA, 22 nt, Human
cucuacugacuaacaaacaguc

SEQ ID NO: 421948 - RNA, 22 nt, Human
cucuacugacuaacaaacaguc

SEQ ID NO: 421949 - RNA, 22 nt, Human
cucuacugacuaacaaacaguc

SEQ ID NO: 421950 - RNA, 18 nt, Human
cucuauccauaccugguu

SEQ ID NO: 421951 - RNA, 18 nt, Human
cucuccgccagccccucc

SEQ ID NO: 421952 - RNA, 19 nt, Human
cucuccgccagccccuccg

SEQ ID NO: 421953 - RNA, 19 nt, Human
cucuccgccagccccuccg

SEQ ID NO: 421954 - RNA, 19 nt, Human
cucuccgccagccccuccg

SEQ ID NO: 421955 - RNA, 24 nt, Human
cucugacugccucuucccuucccc

SEQ ID NO: 421956 - RNA, 24 nt, Human
cucugacugccucuucccuucccc

SEQ ID NO: 421957 - RNA, 19 nt, Human
cucuggguggcaggagagc

SEQ ID NO: 421958 - RNA, 19 nt, Human
cucuggguggcaggagagc

SEQ ID NO: 421959 - RNA, 19 nt, Human
cucuggguggcaggagagc

SEQ ID NO: 421960 - RNA, 18 nt, Human
cucugugacagacccagc

SEQ ID NO: 421961 - RNA, 24 nt, Human
cugaagaugccacccuauuacaau

SEQ ID NO: 421962 - RNA, 22 nt, Human
cugacucaugggcaggccucga

SEQ ID NO: 421963 - RNA, 22 nt, Human
cugacugccucuucccuucccc

SEQ ID NO: 421964 - RNA, 18 nt, Human
cugcaagcucagggccgc

SEQ ID NO: 421965 - RNA, 18 nt, Human
cugcaagcucagggccgc

SEQ ID NO: 421966 - RNA, 18 nt, Human
cugcaagcucagggccgc

SEQ ID NO: 421967 - RNA, 21 nt, Human
cugcagacagcaggcugugca

SEQ ID NO: 421968 - RNA, 21 nt, Human
cugccacacaugggacugucc

SEQ ID NO: 421969 - RNA, 21 nt, Human
cugcccaccuucccaaugucc

SEQ ID NO: 421970 - RNA, 22 nt, Human
cugcccaccuucccaauguccc

SEQ ID NO: 421971 - RNA, 24 nt, Human
cugcgaucugagcuccagcuucac

SEQ ID NO: 421972 - RNA, 26 nt, Human
cugcggguggcacucaaacaucagca

SEQ ID NO: 421973 - RNA, 26 nt, Human
cugcggguggcacucaaacaucagca

SEQ ID NO: 421974 - RNA, 26 nt, Human
cugcggguggcacucaaacaucagca

SEQ ID NO: 421975 - RNA, 18 nt, Human
cugcugcugaauguucuc

SEQ ID NO: 421976 - RNA, 18 nt, Human
cugcugcugaauguucuc

SEQ ID NO: 421977 - RNA, 18 nt, Human
cugcugcugaauguucuc

SEQ ID NO: 421978 - RNA, 19 nt, Human
cuggacagcccccaacuaa

SEQ ID NO: 421979 - RNA, 21 nt, Human
cuggcccuguuuccaaccuug

SEQ ID NO: 421980 - RNA, 19 nt, Human
cuggggcaggacaccaggc

SEQ ID NO: 421981 - RNA, 24 nt, Human
cuguccgagaccugcagcagcauc

SEQ ID NO: 421982 - RNA, 27 nt, Human
cugucuugcucucuuuacacacgaaac

SEQ ID NO: 421983 - RNA, 18 nt, Human
cugugggcuugcaguugc

SEQ ID NO: 421984 - RNA, 18 nt, Human
cugugggcuugcaguugc

SEQ ID NO: 421985 - RNA, 18 nt, Human
cugugggcuugcaguugc

SEQ ID NO: 421986 - RNA, 18 nt, Human
cuguuuccaaccuugcuc

SEQ ID NO: 421987 - RNA, 21 nt, Human
cuuacgccuguaaucccagca

SEQ ID NO: 421988 - RNA, 18 nt, Human
cuucagaggcagccacgc

SEQ ID NO: 421989 - RNA, 26 nt, Human
cuucagggcagggaaugcagucuccu

SEQ ID NO: 421990 - RNA, 23 nt, Human
cuuccgugcaaagcccugcugca

SEQ ID NO: 421991 - RNA, 25 nt, Human
cuuccuggcuaucccuaaauucuag

SEQ ID NO: 421992 - RNA, 19 nt, Human
cuucugccggccaccaucu

SEQ ID NO: 421993 - RNA, 19 nt, Human
cuucugccggccaccaucu

SEQ ID NO: 421994 - RNA, 19 nt, Human
cuucugccggccaccaucu

SEQ ID NO: 421995 - RNA, 20 nt, Human
cuugcucauuaguuuaacag

SEQ ID NO: 421996 - RNA, 20 nt, Human
cuugcucauuaguuuaacag

SEQ ID NO: 421997 - RNA, 20 nt, Human
cuugcucauuaguuuaacag

SEQ ID NO: 421998 - RNA, 21 nt, Human
cuuguagucccagcuacucgg

SEQ ID NO: 421999 - RNA, 21 nt, Human
cuuuugcuaaacccaagagcc

SEQ ID NO: 422000 - RNA, 19 nt, Human
gaaacccugucucuacuaa

SEQ ID NO: 422001 - RNA, 21 nt, Human
gaacaaagcugggcagggccg

SEQ ID NO: 422002 - RNA, 18 nt, Human
gaaccaacgcagacuuac

SEQ ID NO: 422003 - RNA, 24 nt, Human
gaacuggaccuuuuaaaaacuaaa

SEQ ID NO: 422004 - RNA, 24 nt, Human
gaacuggaccuuuuaaaaacuaaa

SEQ ID NO: 422005 - RNA, 21 nt, Human
gaagaauugcuggaaccaagg

SEQ ID NO: 422006 - RNA, 22 nt, Human
gaagaugcugccguggaagccc

SEQ ID NO: 422007 - RNA, 21 nt, Human
gaagugcagcuucuucccagc

SEQ ID NO: 422008 - RNA, 21 nt, Human
gaagugcagcuucuucccagc

SEQ ID NO: 422009 - RNA, 21 nt, Human
gaagugcagcuucuucccagc

SEQ ID NO: 422010 - RNA, 18 nt, Human
gaagugggcagugcagau

SEQ ID NO: 422011 - RNA, 18 nt, Human
gaagugggcagugcagau

SEQ ID NO: 422012 - RNA, 18 nt, Human
gaagugggcagugcagau

SEQ ID NO: 422013 - RNA, 18 nt, Human
gaauuauaaaacagguuu

SEQ ID NO: 422014 - RNA, 18 nt, Human
gaauuauaaaacagguuu

SEQ ID NO: 422015 - RNA, 18 nt, Human
gaauuauaaaacagguuu

SEQ ID NO: 422016 - RNA, 21 nt, Human
gacagaagcccagcucacagc

SEQ ID NO: 422017 - RNA, 20 nt, Human
gacaggagccucuccagcga

SEQ ID NO: 422018 - RNA, 21 nt, Human
gaccaggccccacccuuugcc

SEQ ID NO: 422019 - RNA, 18 nt, Human
gaccauggcagagaccug

SEQ ID NO: 422020 - RNA, 21 nt, Human
gacccagcacuuguucuggca

SEQ ID NO: 422021 - RNA, 24 nt, Human
gacuccgucucucuuuagacccac

SEQ ID NO: 422022 - RNA, 24 nt, Human
gacuccgucucucuuuagacccac

SEQ ID NO: 422023 - RNA, 24 nt, Human
gacuccgucucucuuuagacccac

SEQ ID NO: 422024 - RNA, 20 nt, Human
gacucuccgccagccccucc

SEQ ID NO: 422025 - RNA, 20 nt, Human
gacucuccgccagccccucc

SEQ ID NO: 422026 - RNA, 20 nt, Human
gacucuccgccagccccucc

SEQ ID NO: 422027 - RNA, 25 nt, Human
gacugccuuucaacuugaaaucuac

SEQ ID NO: 422028 - RNA, 21 nt, Human
gagaaacccugcaagcucagg

SEQ ID NO: 422029 - RNA, 21 nt, Human
gagaaacccugcaagcucagg

SEQ ID NO: 422030 - RNA, 19 nt, Human
gagcaaacccccaucagcc

SEQ ID NO: 422031 - RNA, 24 nt, Human
gagcaccaaugcugcgcuuaugaa

SEQ ID NO: 422032 - RNA, 19 nt, Human
gagcucagggccgcaucag

SEQ ID NO: 422033 - RNA, 19 nt, Human
gagcucagggccgcaucag

SEQ ID NO: 422034 - RNA, 19 nt, Human
gagcucagggccgcaucag

SEQ ID NO: 422035 - RNA, 21 nt, Human
gagcugaagggcaaguaagcc

SEQ ID NO: 422036 - RNA, 21 nt, Human
gagcuucagcuucuugcagug

SEQ ID NO: 422037 - RNA, 21 nt, Human
gagcuucagcuucuugcagug

SEQ ID NO: 422038 - RNA, 21 nt, Human
gagcuucagcuucuugcagug

SEQ ID NO: 422039 - RNA, 21 nt, Human
gaggagaagcaacucuaacag

SEQ ID NO: 422040 - RNA, 23 nt, Human
gagguugcagugagccgagauug

SEQ ID NO: 422041 - RNA, 22 nt, Human
gagucucugagaacagaggaag

SEQ ID NO: 422042 - RNA, 21 nt, Human
gaguguccccauucacugucc

SEQ ID NO: 422043 - RNA, 22 nt, Human
gagugugcuggggaggagccug

SEQ ID NO: 422044 - RNA, 22 nt, Human
gaucacaaggucaggaguucaa

SEQ ID NO: 422045 - RNA, 24 nt, Human
gaucacaaggucaggaguucaaga

SEQ ID NO: 422046 - RNA, 24 nt, Human
gaucacgaggucaggaguucaaga

SEQ ID NO: 422047 - RNA, 21 nt, Human
gaucucagcaggcuccauguu

SEQ ID NO: 422048 - RNA, 19 nt, Human
gauggcucaguggugggga

SEQ ID NO: 422049 - RNA, 19 nt, Human
gauggcucaguggugggga

SEQ ID NO: 422050 - RNA, 19 nt, Human
gauggcucaguggugggga

SEQ ID NO: 422051 - RNA, 20 nt, Human
gauggcucagugguggggag

SEQ ID NO: 422052 - RNA, 19 nt, Human
gcaaagaacaagaauuaaa

SEQ ID NO: 422053 - RNA, 19 nt, Human
gcaauucucauggucaccu

SEQ ID NO: 422054 - RNA, 19 nt, Human
gcacaccccauccuuccug

SEQ ID NO: 422055 - RNA, 24 nt, Human
gcacuccagccuggccaacagggu

SEQ ID NO: 422056 - RNA, 18 nt, Human
gcagacugcggucucacg

SEQ ID NO: 422057 - RNA, 18 nt, Human
gcagacugcggucucacg

SEQ ID NO: 422058 - RNA, 18 nt, Human
gcagacugcggucucacg

SEQ ID NO: 422059 - RNA, 22 nt, Human
gcaggccuccacccccaggacc

SEQ ID NO: 422060 - RNA, 21 nt, Human
gcagucaggguggaaggccgc

SEQ ID NO: 422061 - RNA, 21 nt, Human
gcagucaggguggaaggccgc

SEQ ID NO: 422062 - RNA, 21 nt, Human
gcagucaggguggaaggccgc

SEQ ID NO: 422063 - RNA, 18 nt, Human
gcaguggcuuacgccugu

SEQ ID NO: 422064 - RNA, 24 nt, Human
gccaauauggcgaaacccugucuc

SEQ ID NO: 422065 - RNA, 18 nt, Human
gccacacccacggucaca

SEQ ID NO: 422066 - RNA, 18 nt, Human
gccacacccacggucaca

SEQ ID NO: 422067 - RNA, 18 nt, Human
gccacacccacggucaca

SEQ ID NO: 422068 - RNA, 23 nt, Human
gccacuuacugcacuccagccug

SEQ ID NO: 422069 - RNA, 24 nt, Human
gccagggcagcacaggagcagcaa

SEQ ID NO: 422070 - RNA, 18 nt, Human
gccaucugucuugaugau

SEQ ID NO: 422071 - RNA, 18 nt, Human
gccaucugucuugaugau

SEQ ID NO: 422072 - RNA, 20 nt, Human
gcccaucuccccaccccacc

SEQ ID NO: 422073 - RNA, 18 nt, Human
gcccuggggccuucgacu

SEQ ID NO: 422074 - RNA, 18 nt, Human
gcccuucagggugaccug

SEQ ID NO: 422075 - RNA, 22 nt, Human
gccuaggucccugaccuuccug

SEQ ID NO: 422076 - RNA, 26 nt, Human
gccugcagcgcccuacggggcucccu

SEQ ID NO: 422077 - RNA, 26 nt, Human
gccugcagcgcccuacggggcucccu

SEQ ID NO: 422078 - RNA, 26 nt, Human
gccugcagcgcccuacggggcucccu

SEQ ID NO: 422079 - RNA, 23 nt, Human
gcgagaaacccugcaagcucagg

SEQ ID NO: 422080 - RNA, 24 nt, Human
gcgcaacagggcuaugcggcccga

SEQ ID NO: 422081 - RNA, 18 nt, Human
gcuaaaagcacguggccc

SEQ ID NO: 422082 - RNA, 22 nt, Human
gcuccauguucucucuacugua

SEQ ID NO: 422083 - RNA, 21 nt, Human
gcucuggggggggcuucucag

SEQ ID NO: 422084 - RNA, 21 nt, Human
gcucuggggggggcuucucag

SEQ ID NO: 422085 - RNA, 21 nt, Human
gcucuggggggggcuucucag

SEQ ID NO: 422086 - RNA, 24 nt, Human
gcugaggauggcucaguggugggg

SEQ ID NO: 422087 - RNA, 19 nt, Human
gcugcugcaucuccugcaa

SEQ ID NO: 422088 - RNA, 20 nt, Human
gcuggggaggagccuggucu

SEQ ID NO: 422089 - RNA, 21 nt, Human
gcuucuucagugguuuacaug

SEQ ID NO: 422090 - RNA, 23 nt, Human
gcuuguagucccagcuacucggg

SEQ ID NO: 422091 - RNA, 21 nt, Human
ggaaaaaucugaacauaaaca

SEQ ID NO: 422092 - RNA, 18 nt, Human
ggaacauuuuugggaugg

SEQ ID NO: 422093 - RNA, 18 nt, Human
ggaacauuuuugggaugg

SEQ ID NO: 422094 - RNA, 18 nt, Human
ggaacauuuuugggaugg

SEQ ID NO: 422095 - RNA, 19 nt, Human
ggaagcauggcagcucaca

SEQ ID NO: 422096 - RNA, 19 nt, Human
ggaagcauggcagcucaca

SEQ ID NO: 422097 - RNA, 18 nt, Human
ggacaccaggcugcuccc

SEQ ID NO: 422098 - RNA, 23 nt, Human
ggagaagggacagccaccagcca

SEQ ID NO: 422099 - RNA, 23 nt, Human
ggagaagggacagccaccagcca

SEQ ID NO: 422100 - RNA, 23 nt, Human
ggagaagggacagccaccagcca

SEQ ID NO: 422101 - RNA, 21 nt, Human
ggagaaguuagagucugaacu

SEQ ID NO: 422102 - RNA, 21 nt, Human
ggagaaguuagagucugaacu

SEQ ID NO: 422103 - RNA, 21 nt, Human
ggagaaguuagagucugaacu

SEQ ID NO: 422104 - RNA, 20 nt, Human
ggagagugggugucauaccu

SEQ ID NO: 422105 - RNA, 20 nt, Human
ggagagugggugucauaccu

SEQ ID NO: 422106 - RNA, 20 nt, Human
ggagagugggugucauaccu

SEQ ID NO: 422107 - RNA, 25 nt, Human
ggagcacacgaagcaccagcucacg

SEQ ID NO: 422108 - RNA, 25 nt, Human
ggagcacacgaagcaccagcucacg

SEQ ID NO: 422109 - RNA, 25 nt, Human
ggagcacacgaagcaccagcucacg

SEQ ID NO: 422110 - RNA, 18 nt, Human
ggagcagcaagcuugcuc

SEQ ID NO: 422111 - RNA, 22 nt, Human
ggaggcggagguugcagugagc

SEQ ID NO: 422112 - RNA, 22 nt, Human
ggagguugcagugagccgagau

SEQ ID NO: 422113 - RNA, 24 nt, Human
ggagguugcagugagccgagauug

SEQ ID NO: 422114 - RNA, 19 nt, Human
ggaucaggaauaacagaga

SEQ ID NO: 422115 - RNA, 22 nt, Human
ggcagcacaggagcagcaagcu

SEQ ID NO: 422116 - RNA, 23 nt, Human
ggcaggccuccacccccaggacc

SEQ ID NO: 422117 - RNA, 23 nt, Human
ggcaggccuccacccccaggacc

SEQ ID NO: 422118 - RNA, 20 nt, Human
ggccagggccagggcagcac

SEQ ID NO: 422119 - RNA, 19 nt, Human
ggcccagcagucaacaggc

SEQ ID NO: 422120 - RNA, 21 nt, Human
ggcccuguuuccaaccuugcu

SEQ ID NO: 422121 - RNA, 18 nt, Human
ggccgggugcaguggcuc

SEQ ID NO: 422122 - RNA, 21 nt, Human
ggccgggugcaguggcucaca

SEQ ID NO: 422123 - RNA, 19 nt, Human
ggccuccgggaaagcccaa

SEQ ID NO: 422124 - RNA, 19 nt, Human
ggccuccgggaaagcccaa

SEQ ID NO: 422125 - RNA, 19 nt, Human
ggccuccgggaaagcccaa

SEQ ID NO: 422126 - RNA, 21 nt, Human
ggcucaugccuguaaucccag

SEQ ID NO: 422127 - RNA, 22 nt, Human
ggcugaugcucuauagaagcaa

SEQ ID NO: 422128 - RNA, 20 nt, Human
ggcuucucagucuuggugcu

SEQ ID NO: 422129 - RNA, 18 nt, Human
gggaaugcagucuccuug

SEQ ID NO: 422130 - RNA, 20 nt, Human
gggcaggccucgaccccgcu

SEQ ID NO: 422131 - RNA, 21 nt, Human
gggcagugcagaugaugcugu

SEQ ID NO: 422132 - RNA, 21 nt, Human
gggcagugcagaugaugcugu

SEQ ID NO: 422133 - RNA, 21 nt, Human
gggcagugcagaugaugcugu

SEQ ID NO: 422134 - RNA, 22 nt, Human
gggccgagagccagccacaccc

SEQ ID NO: 422135 - RNA, 22 nt, Human
gggccgagagccagccacaccc

SEQ ID NO: 422136 - RNA, 22 nt, Human
gggccgagagccagccacaccc

SEQ ID NO: 422137 - RNA, 18 nt, Human
gggcugggggugagucuc

SEQ ID NO: 422138 - RNA, 25 nt, Human
gggcuucucagucuuggugcuucug

SEQ ID NO: 422139 - RNA, 25 nt, Human
gggcuucucagucuuggugcuucug

SEQ ID NO: 422140 - RNA, 22 nt, Human
ggggcccuggggccuucgacuc

SEQ ID NO: 422141 - RNA, 22 nt, Human
ggggcccuggggccuucgacuc

SEQ ID NO: 422142 - RNA, 24 nt, Human
gggugcaguggcucacaccugcaa

SEQ ID NO: 422143 - RNA, 24 nt, Human
ggguuuaggugcagaugcugguuu

SEQ ID NO: 422144 - RNA, 24 nt, Human
ggguuuaggugcagaugcugguuu

SEQ ID NO: 422145 - RNA, 24 nt, Human
ggguuuaggugcagaugcugguuu

SEQ ID NO: 422146 - RNA, 23 nt, Human
gguauuuuuucacacaagccuca

SEQ ID NO: 422147 - RNA, 23 nt, Human
gguauuuuuucacacaagccuca

SEQ ID NO: 422148 - RNA, 23 nt, Human
gguauuuuuucacacaagccuca

SEQ ID NO: 422149 - RNA, 23 nt, Human
gguauuuuuucacacaagccuca

SEQ ID NO: 422150 - RNA, 21 nt, Human
gguccuucacagagcaggagg

SEQ ID NO: 422151 - RNA, 21 nt, Human
gguccuucacagagcaggagg

SEQ ID NO: 422152 - RNA, 21 nt, Human
gguccuucacagagcaggagg

SEQ ID NO: 422153 - RNA, 23 nt, Human
ggugcaguggcucacaccugcaa

SEQ ID NO: 422154 - RNA, 18 nt, Human
ggugcaguggcuuacgcc

SEQ ID NO: 422155 - RNA, 23 nt, Human
gguggaucacgaggucaggaguu

SEQ ID NO: 422156 - RNA, 23 nt, Human
gguggcucaugccuguaauccca

SEQ ID NO: 422157 - RNA, 24 nt, Human
gguggcucaugccuguaaucccag

SEQ ID NO: 422158 - RNA, 20 nt, Human
ggugggggcuugcgcucgcu

SEQ ID NO: 422159 - RNA, 20 nt, Human
ggugggggcuugcgcucgcu

SEQ ID NO: 422160 - RNA, 20 nt, Human
ggugggggcuugcgcucgcu

SEQ ID NO: 422161 - RNA, 20 nt, Human
guaaacacacacuucagucg

SEQ ID NO: 422162 - RNA, 20 nt, Human
guaaacacacacuucagucg

SEQ ID NO: 422163 - RNA, 20 nt, Human
guaaacacacacuucagucg

SEQ ID NO: 422164 - RNA, 22 nt, Human
guaauaaucuuuagacccaaag

SEQ ID NO: 422165 - RNA, 22 nt, Human
guaauaaucuuuagacccaaag

SEQ ID NO: 422166 - RNA, 22 nt, Human
guaauaaucuuuagacccaaag

SEQ ID NO: 422167 - RNA, 21 nt, Human
guagaagugggugaugucguu

SEQ ID NO: 422168 - RNA, 21 nt, Human
guagaagugggugaugucguu

SEQ ID NO: 422169 - RNA, 21 nt, Human
guagaagugggugaugucguu

SEQ ID NO: 422170 - RNA, 22 nt, Human
guauaucuguacauguacacaa

SEQ ID NO: 422171 - RNA, 20 nt, Human
guccagaacacaggagucau

SEQ ID NO: 422172 - RNA, 20 nt, Human
guccagcacccuaaagcgcc

SEQ ID NO: 422173 - RNA, 19 nt, Human
gucccugaccuuccugcac

SEQ ID NO: 422174 - RNA, 19 nt, Human
gucccuuaccugccggaag

SEQ ID NO: 422175 - RNA, 19 nt, Human
gucccuuaccugccggaag

SEQ ID NO: 422176 - RNA, 19 nt, Human
gucccuuaccugccggaag

SEQ ID NO: 422177 - RNA, 18 nt, Human
guccucacacgggccuca

SEQ ID NO: 422178 - RNA, 18 nt, Human
guccucacacgggccuca

SEQ ID NO: 422179 - RNA, 18 nt, Human
guccucacacgggccuca

SEQ ID NO: 422180 - RNA, 18 nt, Human
gucuuuuugcccuuuucc

SEQ ID NO: 422181 - RNA, 18 nt, Human
gucuuuuugcccuuuucc

SEQ ID NO: 422182 - RNA, 18 nt, Human
gugcaguggcucacaccu

SEQ ID NO: 422183 - RNA, 19 nt, Human
gugcugggguccccggggc

SEQ ID NO: 422184 - RNA, 19 nt, Human
gugcugggguccccggggc

SEQ ID NO: 422185 - RNA, 19 nt, Human
gugcugggguccccggggc

SEQ ID NO: 422186 - RNA, 20 nt, Human
guggaaacaacugaggcaca

SEQ ID NO: 422187 - RNA, 23 nt, Human
guggaucacgaggucaggaguuc

SEQ ID NO: 422188 - RNA, 26 nt, Human
guggcaggagagcuagguggauuacc

SEQ ID NO: 422189 - RNA, 26 nt, Human
guggcaggagagcuagguggauuacc

SEQ ID NO: 422190 - RNA, 26 nt, Human
guggcaggagagcuagguggauuacc

SEQ ID NO: 422191 - RNA, 20 nt, Human
guggccagagugaggccagg

SEQ ID NO: 422192 - RNA, 20 nt, Human
guggccagagugaggccagg

SEQ ID NO: 422193 - RNA, 23 nt, Human
guggcucaugccuguaaucccag

SEQ ID NO: 422194 - RNA, 20 nt, Human
gugggacagaggagcccccg

SEQ ID NO: 422195 - RNA, 21 nt, Human
guguagaucuggacuuucccg

SEQ ID NO: 422196 - RNA, 21 nt, Human
guguagaucuggacuuucccg

SEQ ID NO: 422197 - RNA, 21 nt, Human
guguagaucuggacuuucccg

SEQ ID NO: 422198 - RNA, 18 nt, Human
gugugagucgccuuccac

SEQ ID NO: 422199 - RNA, 24 nt, Human
guugcagugagccgagauugugcc

SEQ ID NO: 422200 - RNA, 22 nt, Human
guuggaagcauggcagcucaca

SEQ ID NO: 422201 - RNA, 22 nt, Human
guuggaagcauggcagcucaca

SEQ ID NO: 422202 - RNA, 20 nt, Human
guuuccacccaccuccuuca

SEQ ID NO: 422203 - RNA, 20 nt, Human
guuugagucccugcagaaaa

SEQ ID NO: 422204 - RNA, 19 nt, Human
guuuuuguguuuugcuuca

SEQ ID NO: 422205 - RNA, 19 nt, Human
guuuuuguguuuugcuuca

SEQ ID NO: 422206 - RNA, 19 nt, Human
guuuuuguguuuugcuuca

SEQ ID NO: 422207 - RNA, 21 nt, Human
uaaaaaaggauagaaucaaaa

SEQ ID NO: 422208 - RNA, 23 nt, Human
uaaaaaugaacacuaauggaaga

SEQ ID NO: 422209 - RNA, 28 nt, Human
uaaaacaauaaaaaugguacccaaaggg

SEQ ID NO: 422210 - RNA, 24 nt, Human
uaaaacacagccaaagaaucugcc

SEQ ID NO: 422211 - RNA, 25 nt, Human
uaaaacacagccaaagaaucugccg

SEQ ID NO: 422212 - RNA, 24 nt, Human
uaaaacauuccauaugccaauuaa

SEQ ID NO: 422213 - RNA, 24 nt, Human
uaaaacauuccauaugccaauuaa

SEQ ID NO: 422214 - RNA, 24 nt, Human
uaaaacauuccauaugccaauuaa

SEQ ID NO: 422215 - RNA, 24 nt, Human
uaaaacauuccauaugccaauuaa

SEQ ID NO: 422216 - RNA, 18 nt, Human
uaaaagaugccacagaaa

SEQ ID NO: 422217 - RNA, 18 nt, Human
uaaaagaugccacagaaa

SEQ ID NO: 422218 - RNA, 20 nt, Human
uaaaagaugccacagaaaau

SEQ ID NO: 422219 - RNA, 22 nt, Human
uaaaauaagcaagaccccgcca

SEQ ID NO: 422220 - RNA, 21 nt, Human
uaaaauauccuaucaacccuc

SEQ ID NO: 422221 - RNA, 23 nt, Human
uaaacaaaaaacacaaaaucaga

SEQ ID NO: 422222 - RNA, 22 nt, Human
uaaacacugaauacauauuuug

SEQ ID NO: 422223 - RNA, 21 nt, Human
uaaagcagccccagucccacc

SEQ ID NO: 422224 - RNA, 25 nt, Human
uaaaguguucugaaauaccaacccu

SEQ ID NO: 422225 - RNA, 27 nt, Human
uaaauaauucuuacugccuuuucucca

SEQ ID NO: 422226 - RNA, 25 nt, Human
uaaaugaccuuucauuuaauuuucu

SEQ ID NO: 422227 - RNA, 24 nt, Human
uaaauggccuucauaccaaugcca

SEQ ID NO: 422228 - RNA, 18 nt, Human
uaaaugguucacaauaau

SEQ ID NO: 422229 - RNA, 21 nt, Human
uaacaaccuaucaacuucuga

SEQ ID NO: 422230 - RNA, 23 nt, Human
uaacagcacaguaaaauguuaaa

SEQ ID NO: 422231 - RNA, 22 nt, Human
uaacauagugcacuguuugucc

SEQ ID NO: 422232 - RNA, 20 nt, Human
uaaccggaccaaaauuauga

SEQ ID NO: 422233 - RNA, 22 nt, Human
uaagaaacauucucuuaaaaac

SEQ ID NO: 422234 - RNA, 19 nt, Human
uaaggugaugaaucuauug

SEQ ID NO: 422235 - RNA, 19 nt, Human
uaaucccuaaaaaucagga

SEQ ID NO: 422236 - RNA, 26 nt, Human
uaauuucacgaaaacgagcuucagcu

SEQ ID NO: 422237 - RNA, 26 nt, Human
uaauuucacgaaaacgagcuucagcu

SEQ ID NO: 422238 - RNA, 26 nt, Human
uaauuucacgaaaacgagcuucagcu

SEQ ID NO: 422239 - RNA, 24 nt, Human
uacaaaaguaguuuaauggaaaag

SEQ ID NO: 422240 - RNA, 22 nt, Human
uacaaaagucuaccuggccaga

SEQ ID NO: 422241 - RNA, 21 nt, Human
uacaaauaauuuucuaccugc

SEQ ID NO: 422242 - RNA, 23 nt, Human
uacacacgaaacaugagugaauc

SEQ ID NO: 422243 - RNA, 23 nt, Human
uacacacgaaacaugagugaauc

SEQ ID NO: 422244 - RNA, 23 nt, Human
uacacacgaaacaugagugaauc

SEQ ID NO: 422245 - RNA, 26 nt, Human
uacacacgaaacaugagugaaucccu

SEQ ID NO: 422246 - RNA, 20 nt, Human
uacacagcucguuuccccug

SEQ ID NO: 422247 - RNA, 22 nt, Human
uacacagcucguuuccccuggg

SEQ ID NO: 422248 - RNA, 22 nt, Human
uacacagcucguuuccccuggg

SEQ ID NO: 422249 - RNA, 23 nt, Human
uacacguaucaaacuguaaagca

SEQ ID NO: 422250 - RNA, 19 nt, Human
uacagaacgaauuggggca

SEQ ID NO: 422251 - RNA, 19 nt, Human
uacagaacgaauuggggca

SEQ ID NO: 422252 - RNA, 19 nt, Human
uacagaacgaauuggggca

SEQ ID NO: 422253 - RNA, 28 nt, Human
uacagaccuugaacaauaaaggacauac

SEQ ID NO: 422254 - RNA, 23 nt, Human
uacagccauuuccaaagagcaga

SEQ ID NO: 422255 - RNA, 23 nt, Human
uacagccauuuccaaagagcaga

SEQ ID NO: 422256 - RNA, 24 nt, Human
uacaguccagcacccuaaagcgcc

SEQ ID NO: 422257 - RNA, 24 nt, Human
uacauaaaacaauaaaaaugguac

SEQ ID NO: 422258 - RNA, 21 nt, Human
uaccaacccuauaaaaguacc

SEQ ID NO: 422259 - RNA, 21 nt, Human
uaccagugguucuaggacagg

SEQ ID NO: 422260 - RNA, 20 nt, Human
uaccccaaagccuggcucca

SEQ ID NO: 422261 - RNA, 20 nt, Human
uaccccaaagccuggcucca

SEQ ID NO: 422262 - RNA, 20 nt, Human
uaccccaaagccuggcucca

SEQ ID NO: 422263 - RNA, 21 nt, Human
uacccuguuccaaaagggccc

SEQ ID NO: 422264 - RNA, 18 nt, Human
uaccuggccagaggaagc

SEQ ID NO: 422265 - RNA, 20 nt, Human
uaccuggccuagaccagugc

SEQ ID NO: 422266 - RNA, 20 nt, Human
uaccuggccuagaccagugc

SEQ ID NO: 422267 - RNA, 20 nt, Human
uaccuggccuagaccagugc

SEQ ID NO: 422268 - RNA, 22 nt, Human
uaccugguuccacgucccccug

SEQ ID NO: 422269 - RNA, 26 nt, Human
uaccuugcugcgaucugagcuccagc

SEQ ID NO: 422270 - RNA, 18 nt, Human
uacgggaacacucgcgcc

SEQ ID NO: 422271 - RNA, 18 nt, Human
uacgggaacacucgcgcc

SEQ ID NO: 422272 - RNA, 18 nt, Human
uacgggaacacucgcgcc

SEQ ID NO: 422273 - RNA, 18 nt, Human
uacugcacuccagccugg

SEQ ID NO: 422274 - RNA, 20 nt, Human
uacugcacuccagccuggcc

SEQ ID NO: 422275 - RNA, 21 nt, Human
uacugcacuccagccuggcca

SEQ ID NO: 422276 - RNA, 24 nt, Human
uacugcacuccagccuggccaaca

SEQ ID NO: 422277 - RNA, 22 nt, Human
uagaaaaaaacacaaaugugga

SEQ ID NO: 422278 - RNA, 24 nt, Human
uagaaaaaaacacaaauguggacc

SEQ ID NO: 422279 - RNA, 24 nt, Human
uagaucgcuugagcucagaaguuc

SEQ ID NO: 422280 - RNA, 18 nt, Human
uagcagcauaaugaauuu

SEQ ID NO: 422281 - RNA, 18 nt, Human
uagccaagaggcccuaaa

SEQ ID NO: 422282 - RNA, 23 nt, Human
uagccacauagccccaagcaggu

SEQ ID NO: 422283 - RNA, 21 nt, Human
uagcggcugccccgguccccc

SEQ ID NO: 422284 - RNA, 23 nt, Human
uagggcaucauaaggagcauaaa

SEQ ID NO: 422285 - RNA, 23 nt, Human
uagggcaucauaaggagcauaaa

SEQ ID NO: 422286 - RNA, 23 nt, Human
uagggcaucauaaggagcauaaa

SEQ ID NO: 422287 - RNA, 18 nt, Human
uaggucuggaagcaacag

SEQ ID NO: 422288 - RNA, 20 nt, Human
uaggugcagaugcugguuuc

SEQ ID NO: 422289 - RNA, 20 nt, Human
uaggugcagaugcugguuuc

SEQ ID NO: 422290 - RNA, 20 nt, Human
uaggugcagaugcugguuuc

SEQ ID NO: 422291 - RNA, 20 nt, Human
uagugagcauguagaagugg

SEQ ID NO: 422292 - RNA, 20 nt, Human
uagugagcauguagaagugg

SEQ ID NO: 422293 - RNA, 20 nt, Human
uagugagcauguagaagugg

SEQ ID NO: 422294 - RNA, 24 nt, Human
uagugagcauguagaaguggguga

SEQ ID NO: 422295 - RNA, 24 nt, Human
uagugagcauguagaaguggguga

SEQ ID NO: 422296 - RNA, 24 nt, Human
uagugagcauguagaaguggguga

SEQ ID NO: 422297 - RNA, 19 nt, Human
uaguucccaaguuucaccc

SEQ ID NO: 422298 - RNA, 19 nt, Human
uaguucccaaguuucaccc

SEQ ID NO: 422299 - RNA, 19 nt, Human
uaguucccaaguuucaccc

SEQ ID NO: 422300 - RNA, 24 nt, Human
uauaaaauuugccuuuucauauuu

SEQ ID NO: 422301 - RNA, 24 nt, Human
uauaauacaaauaauuuucuaccu

SEQ ID NO: 422302 - RNA, 21 nt, Human
uaucccuaaauucuaggguca

SEQ ID NO: 422303 - RNA, 19 nt, Human
uaucuguacauguacacag

SEQ ID NO: 422304 - RNA, 21 nt, Human
uaugucagcucaacugacacu

SEQ ID NO: 422305 - RNA, 19 nt, Human
uauuuugcuaucauguacu

SEQ ID NO: 422306 - RNA, 25 nt, Human
ucaaacaucagcauccuguucagac

SEQ ID NO: 422307 - RNA, 25 nt, Human
ucaaacaucagcauccuguucagac

SEQ ID NO: 422308 - RNA, 25 nt, Human
ucaaacaucagcauccuguucagac

SEQ ID NO: 422309 - RNA, 24 nt, Human
ucaaaguuuucuucagucugaaaa

SEQ ID NO: 422310 - RNA, 23 nt, Human
ucaaggccugcccuugucaaagg

SEQ ID NO: 422311 - RNA, 20 nt, Human
ucacaaaaccacggaguagc

SEQ ID NO: 422312 - RNA, 20 nt, Human
ucacaaaaccacggaguagc

SEQ ID NO: 422313 - RNA, 21 nt, Human
ucacaaggucaggaguucaag

SEQ ID NO: 422314 - RNA, 24 nt, Human
ucacaaggucaggaguucaagacc

SEQ ID NO: 422315 - RNA, 29 nt, Human
ucacacagcauccucccuccuuuccuguu

SEQ ID NO: 422316 - RNA, 22 nt, Human
ucacacagcuguggagggggca

SEQ ID NO: 422317 - RNA, 22 nt, Human
ucacacagcuguggagggggca

SEQ ID NO: 422318 - RNA, 18 nt, Human
ucacacugcagcgugggc

SEQ ID NO: 422319 - RNA, 21 nt, Human
ucacagacggcaaacaggccc

SEQ ID NO: 422320 - RNA, 21 nt, Human
ucacagacggcaaacaggccc

SEQ ID NO: 422321 - RNA, 21 nt, Human
ucacagacggcaaacaggccc

SEQ ID NO: 422322 - RNA, 22 nt, Human
ucacagacggcaaacaggccca

SEQ ID NO: 422323 - RNA, 22 nt, Human
ucacagacggcaaacaggccca

SEQ ID NO: 422324 - RNA, 22 nt, Human
ucacagacggcaaacaggccca

SEQ ID NO: 422325 - RNA, 23 nt, Human
ucacagacggcaaacaggcccac

SEQ ID NO: 422326 - RNA, 23 nt, Human
ucacagacggcaaacaggcccac

SEQ ID NO: 422327 - RNA, 23 nt, Human
ucacagacggcaaacaggcccac

SEQ ID NO: 422328 - RNA, 21 nt, Human
ucacgaggucaggaguucaag

SEQ ID NO: 422329 - RNA, 24 nt, Human
ucacgaggucaggaguucaagacc

SEQ ID NO: 422330 - RNA, 19 nt, Human
ucagaauaagauaguacca

SEQ ID NO: 422331 - RNA, 21 nt, Human
ucagcaggcuccauguucucu

SEQ ID NO: 422332 - RNA, 21 nt, Human
ucagccggaccaggaccccca

SEQ ID NO: 422333 - RNA, 24 nt, Human
ucagggaggcgugggacccugcag

SEQ ID NO: 422334 - RNA, 24 nt, Human
ucagggaggcgugggacccugcag

SEQ ID NO: 422335 - RNA, 24 nt, Human
ucagggaggcgugggacccugcag

SEQ ID NO: 422336 - RNA, 19 nt, Human
ucaguauaucccucccccc

SEQ ID NO: 422337 - RNA, 19 nt, Human
ucaguauaucccucccccc

SEQ ID NO: 422338 - RNA, 19 nt, Human
ucaguauaucccucccccc

SEQ ID NO: 422339 - RNA, 22 nt, Human
ucaugccuguaaucccagcacu

SEQ ID NO: 422340 - RNA, 18 nt, Human
ucauggucaccuaacuca

SEQ ID NO: 422341 - RNA, 18 nt, Human
ucauuuccugaucagggu

SEQ ID NO: 422342 - RNA, 20 nt, Human
ucauuuucugaauauuuggg

SEQ ID NO: 422343 - RNA, 20 nt, Human
ucauuuucugaauauuuggg

SEQ ID NO: 422344 - RNA, 20 nt, Human
ucauuuucugaauauuuggg

SEQ ID NO: 422345 - RNA, 24 nt, Human
uccaaagagcagaguaaugaucac

SEQ ID NO: 422346 - RNA, 24 nt, Human
uccaaagagcagaguaaugaucac

SEQ ID NO: 422347 - RNA, 24 nt, Human
uccaaagagcagaguaaugaucac

SEQ ID NO: 422348 - RNA, 24 nt, Human
uccaaagagcagaguaaugaucac

SEQ ID NO: 422349 - RNA, 19 nt, Human
uccaaaugcccaucucccc

SEQ ID NO: 422350 - RNA, 20 nt, Human
uccaaaugcccaucucccca

SEQ ID NO: 422351 - RNA, 24 nt, Human
uccaaaugcccaucuccccacccc

SEQ ID NO: 422352 - RNA, 18 nt, Human
uccaacacaaaaauaagu

SEQ ID NO: 422353 - RNA, 18 nt, Human
uccaacacaaaaauaagu

SEQ ID NO: 422354 - RNA, 18 nt, Human
uccaacacaaaaauaagu

SEQ ID NO: 422355 - RNA, 25 nt, Human
uccaaguuagggcaucauaaggagc

SEQ ID NO: 422356 - RNA, 25 nt, Human
uccaaguuagggcaucauaaggagc

SEQ ID NO: 422357 - RNA, 25 nt, Human
uccaaguuagggcaucauaaggagc

SEQ ID NO: 422358 - RNA, 20 nt, Human
uccacagaaaagcagacagc

SEQ ID NO: 422359 - RNA, 24 nt, Human
uccacaguguuugcguuuacaaau

SEQ ID NO: 422360 - RNA, 21 nt, Human
uccaccccacccaguauaugu

SEQ ID NO: 422361 - RNA, 20 nt, Human
uccacucccagagcaccacu

SEQ ID NO: 422362 - RNA, 24 nt, Human
uccagccgcaggcuccaccuccac

SEQ ID NO: 422363 - RNA, 23 nt, Human
uccagccuggccaacagggugag

SEQ ID NO: 422364 - RNA, 24 nt, Human
uccagccuggccaacagggugaga

SEQ ID NO: 422365 - RNA, 23 nt, Human
uccaguguucugccacuucuagg

SEQ ID NO: 422366 - RNA, 19 nt, Human
uccaugcacgucucaggcc

SEQ ID NO: 422367 - RNA, 20 nt, Human
uccaugccgggacacagagg

SEQ ID NO: 422368 - RNA, 23 nt, Human
uccaugccgggacacagaggagg

SEQ ID NO: 422369 - RNA, 19 nt, Human
uccauuuuaaaugcuauuu

SEQ ID NO: 422370 - RNA, 19 nt, Human
uccauuuuaaaugcuauuu

SEQ ID NO: 422371 - RNA, 19 nt, Human
uccauuuuaaaugcuauuu

SEQ ID NO: 422372 - RNA, 18 nt, Human
ucccaaguuucacccaaa

SEQ ID NO: 422373 - RNA, 18 nt, Human
ucccaaguuucacccaaa

SEQ ID NO: 422374 - RNA, 18 nt, Human
ucccaaguuucacccaaa

SEQ ID NO: 422375 - RNA, 21 nt, Human
ucccacaaaagcuguuaccag

SEQ ID NO: 422376 - RNA, 18 nt, Human
ucccaccacacccccucc

SEQ ID NO: 422377 - RNA, 19 nt, Human
ucccaccacacccccuccc

SEQ ID NO: 422378 - RNA, 22 nt, Human
ucccagagcaccacugcacacc

SEQ ID NO: 422379 - RNA, 18 nt, Human
ucccauccacguuccccc

SEQ ID NO: 422380 - RNA, 25 nt, Human
uccccaccccaccccgucuuguucc

SEQ ID NO: 422381 - RNA, 19 nt, Human
uccccagggaacgauguca

SEQ ID NO: 422382 - RNA, 20 nt, Human
ucccgcguccaccacagcca

SEQ ID NO: 422383 - RNA, 22 nt, Human
ucccgcguccaccacagccaug

SEQ ID NO: 422384 - RNA, 21 nt, Human
ucccgggcuguccgagaccuc

SEQ ID NO: 422385 - RNA, 21 nt, Human
ucccgggcuguccgagaccuu

SEQ ID NO: 422386 - RNA, 18 nt, Human
ucccuaaaaaucaggaaa

SEQ ID NO: 422387 - RNA, 19 nt, Human
ucccuaacaaaaaguuaaa

SEQ ID NO: 422388 - RNA, 24 nt, Human
ucccugcagaaaaucccacucgga

SEQ ID NO: 422389 - RNA, 21 nt, Human
ucccuucuggccuccgggaaa

SEQ ID NO: 422390 - RNA, 21 nt, Human
ucccuucuggccuccgggaaa

SEQ ID NO: 422391 - RNA, 21 nt, Human
ucccuucuggccuccgggaaa

SEQ ID NO: 422392 - RNA, 21 nt, Human
uccgaacaaaaaagugucaca

SEQ ID NO: 422393 - RNA, 20 nt, Human
uccgagggcucgucucccgg

SEQ ID NO: 422394 - RNA, 20 nt, Human
uccgagggcucgucucccgg

SEQ ID NO: 422395 - RNA, 20 nt, Human
uccgagggcucgucucccgg

SEQ ID NO: 422396 - RNA, 20 nt, Human
uccggccaagcggccgccug

SEQ ID NO: 422397 - RNA, 20 nt, Human
uccggccaagcggccgccug

SEQ ID NO: 422398 - RNA, 20 nt, Human
uccggccaagcggccgccug

SEQ ID NO: 422399 - RNA, 20 nt, Human
uccggccaagcggccgccug

SEQ ID NO: 422400 - RNA, 19 nt, Human
uccugaucagggucuggga

SEQ ID NO: 422401 - RNA, 26 nt, Human
uccuuuguccuucuggcuuaacuuuc

SEQ ID NO: 422402 - RNA, 19 nt, Human
ucgaccccgcuacacuggc

SEQ ID NO: 422403 - RNA, 26 nt, Human
ucgaccccgcuacacuggccucaugc

SEQ ID NO: 422404 - RNA, 23 nt, Human
ucgggaggcugaggcagaagaau

SEQ ID NO: 422405 - RNA, 22 nt, Human
ucuauagugagcauguagaagu

SEQ ID NO: 422406 - RNA, 22 nt, Human
ucuauagugagcauguagaagu

SEQ ID NO: 422407 - RNA, 22 nt, Human
ucuauagugagcauguagaagu

SEQ ID NO: 422408 - RNA, 22 nt, Human
ucucaaagauaaaccgcacacc

SEQ ID NO: 422409 - RNA, 21 nt, Human
ucucacuaggauggaaaagaa

SEQ ID NO: 422410 - RNA, 18 nt, Human
ucucacucuguagaacug

SEQ ID NO: 422411 - RNA, 18 nt, Human
ucucacucuguagaacug

SEQ ID NO: 422412 - RNA, 18 nt, Human
ucucacucuguagaacug

SEQ ID NO: 422413 - RNA, 19 nt, Human
ucucacucuguagaacugg

SEQ ID NO: 422414 - RNA, 19 nt, Human
ucucacucuguagaacugg

SEQ ID NO: 422415 - RNA, 19 nt, Human
ucucacucuguagaacugg

SEQ ID NO: 422416 - RNA, 18 nt, Human
ucuccaaaugcccaucuc

SEQ ID NO: 422417 - RNA, 20 nt, Human
ucucccgcaggcagggccgg

SEQ ID NO: 422418 - RNA, 24 nt, Human
ucucccgcaggcagggccggccgc

SEQ ID NO: 422419 - RNA, 21 nt, Human
ucucuaaacauaaagucuuac

SEQ ID NO: 422420 - RNA, 18 nt, Human
ucucuaaauaaauaaaua

SEQ ID NO: 422421 - RNA, 22 nt, Human
ucucuacuaaaaauacaaaaaa

SEQ ID NO: 422422 - RNA, 18 nt, Human
ucugcaaguccagaacac

SEQ ID NO: 422423 - RNA, 20 nt, Human
ucugcaaguccagaacacag

SEQ ID NO: 422424 - RNA, 20 nt, Human
ucugcaaguccagaacacag

SEQ ID NO: 422425 - RNA, 24 nt, Human
ucugcugccaaggcaacccuuuca

SEQ ID NO: 422426 - RNA, 21 nt, Human
ucuggcaagagccuucucagg

SEQ ID NO: 422427 - RNA, 21 nt, Human
ucuggccgacugcagacagca

SEQ ID NO: 422428 - RNA, 21 nt, Human
ucuguaaacuucucugcaaga

SEQ ID NO: 422429 - RNA, 21 nt, Human
ucuguaaacuucucugcaaga

SEQ ID NO: 422430 - RNA, 21 nt, Human
ucuguaaacuucucugcaaga

SEQ ID NO: 422431 - RNA, 23 nt, Human
ucugugacagacccagcacuugu

SEQ ID NO: 422432 - RNA, 21 nt, Human
ucuucccuuccccuuuugcuc

SEQ ID NO: 422433 - RNA, 21 nt, Human
ucuucccuuccccuuuugcuc

SEQ ID NO: 422434 - RNA, 19 nt, Human
ucuuccucagggugaugga

SEQ ID NO: 422435 - RNA, 18 nt, Human
ucuucuuggucuuuuugc

SEQ ID NO: 422436 - RNA, 18 nt, Human
ucuucuuggucuuuuugc

SEQ ID NO: 422437 - RNA, 18 nt, Human
ucuucuuggucuuuuugc

SEQ ID NO: 422438 - RNA, 19 nt, Human
ugaaaaagaaaugaagcaa

SEQ ID NO: 422439 - RNA, 19 nt, Human
ugaaauaccaacccuauaa

SEQ ID NO: 422440 - RNA, 24 nt, Human
ugaaggguuggaagcauggcagcu

SEQ ID NO: 422441 - RNA, 24 nt, Human
ugaaggguuggaagcauggcagcu

SEQ ID NO: 422442 - RNA, 24 nt, Human
ugaaggguuggaagcauggcagcu

SEQ ID NO: 422443 - RNA, 24 nt, Human
ugaaggguuggaagcauggcagcu

SEQ ID NO: 422444 - RNA, 20 nt, Human
ugaagugggcagugcagaug

SEQ ID NO: 422445 - RNA, 20 nt, Human
ugaagugggcagugcagaug

SEQ ID NO: 422446 - RNA, 20 nt, Human
ugaagugggcagugcagaug

SEQ ID NO: 422447 - RNA, 20 nt, Human
ugaaucccugaggcacacuc

SEQ ID NO: 422448 - RNA, 20 nt, Human
ugaaucccugaggcacacuc

SEQ ID NO: 422449 - RNA, 20 nt, Human
ugaaucccugaggcacacuc

SEQ ID NO: 422450 - RNA, 22 nt, Human
ugacaaaaacaggacccauguc

SEQ ID NO: 422451 - RNA, 22 nt, Human
ugacaaacaaaauucaccucaa

SEQ ID NO: 422452 - RNA, 22 nt, Human
ugacaacagcccugugcucagc

SEQ ID NO: 422453 - RNA, 22 nt, Human
ugacaacaguauaagcaacaac

SEQ ID NO: 422454 - RNA, 25 nt, Human
ugacaguuaccucaguuucucuggc

SEQ ID NO: 422455 - RNA, 22 nt, Human
ugacauucugaagaauuaaaau

SEQ ID NO: 422456 - RNA, 21 nt, Human
ugacucuccgccagccccucc

SEQ ID NO: 422457 - RNA, 21 nt, Human
ugacucuccgccagccccucc

SEQ ID NO: 422458 - RNA, 21 nt, Human
ugagaaaaacagcaucacgga

SEQ ID NO: 422459 - RNA, 23 nt, Human
ugagaaaaacagcaucacggaga

SEQ ID NO: 422460 - RNA, 19 nt, Human
ugagaacaaagaaaucuuu

SEQ ID NO: 422461 - RNA, 20 nt, Human
ugagacagauacuucaguuu

SEQ ID NO: 422462 - RNA, 20 nt, Human
ugagacagauacuucaguuu

SEQ ID NO: 422463 - RNA, 20 nt, Human
ugagacagauacuucaguuu

SEQ ID NO: 422464 - RNA, 18 nt, Human
ugagagccagaaaggggc

SEQ ID NO: 422465 - RNA, 18 nt, Human
ugagagccagaaaggggc

SEQ ID NO: 422466 - RNA, 19 nt, Human
ugagagccagaaagggggc

SEQ ID NO: 422467 - RNA, 19 nt, Human
ugagagccagaaagggggc

SEQ ID NO: 422468 - RNA, 24 nt, Human
ugagcauguagaagugggugaugu

SEQ ID NO: 422469 - RNA, 24 nt, Human
ugagcauguagaagugggugaugu

SEQ ID NO: 422470 - RNA, 24 nt, Human
ugagcauguagaagugggugaugu

SEQ ID NO: 422471 - RNA, 19 nt, Human
ugagccgagauugugccac

SEQ ID NO: 422472 - RNA, 18 nt, Human
ugaggaaaggcccaaaga

SEQ ID NO: 422473 - RNA, 21 nt, Human
ugaggaaaggcccaaagaucc

SEQ ID NO: 422474 - RNA, 24 nt, Human
ugaggaaaggcccaaagauccauc

SEQ ID NO: 422475 - RNA, 30 nt, Human
ugaggaacaauucacauuaguacaaaaaaa

SEQ ID NO: 422476 - RNA, 30 nt, Human; identical to SEQ ID NO: 422475

SEQ ID NO: 422477 - RNA, 30 nt, Human; identical to SEQ ID NO: 422475

SEQ ID NO: 422478 - RNA, 30 nt, Human; identical to SEQ ID NO: 422475

SEQ ID NO: 422479 - RNA, 19 nt, Human
ugaggacaaugacaaaacu

SEQ ID NO: 422480 - RNA, 19 nt, Human
ugaggagaaaaaacuacgg

SEQ ID NO: 422481 - RNA, 19 nt, Human
ugaggagaaaaaacuacgg

SEQ ID NO: 422482 - RNA, 19 nt, Human
ugaggagaaaaaacuacgg

SEQ ID NO: 422483 - RNA, 19 nt, Human
ugaggagaaaaaacuacgg

SEQ ID NO: 422484 - RNA, 19 nt, Human
ugaggcagaagaauugcug

SEQ ID NO: 422485 - RNA, 24 nt, Human
ugaggcagaagaauugcuggaacc

SEQ ID NO: 422486 - RNA, 25 nt, Human
ugaggcgagcggaucacaaggucag

SEQ ID NO: 422487 - RNA, 26 nt, Human
ugaggcgagcggaucacaaggucagg

SEQ ID NO: 422488 - RNA, 24 nt, Human
ugaggcggguggaucacgagguca

SEQ ID NO: 422489 - RNA, 20 nt, Human
ugagugaaucccuaacaaaa

SEQ ID NO: 422490 - RNA, 19 nt, Human
ugagugaaucccugaggca

SEQ ID NO: 422491 - RNA, 19 nt, Human
ugagugaaucccugaggca

SEQ ID NO: 422492 - RNA, 19 nt, Human
ugagugaaucccugaggca

SEQ ID NO: 422493 - RNA, 21 nt, Human
ugaguggaaacaacugaggca

SEQ ID NO: 422494 - RNA, 18 nt, Human
ugagugugaaaucaagac

SEQ ID NO: 422495 - RNA, 18 nt, Human
ugauacagccauuuccaa

SEQ ID NO: 422496 - RNA, 18 nt, Human
ugauacagccauuuccaa

SEQ ID NO: 422497 - RNA, 18 nt, Human
ugauacagccauuuccaa

SEQ ID NO: 422498 - RNA, 18 nt, Human
ugauacagccauuuccaa

SEQ ID NO: 422499 - RNA, 21 nt, Human
ugaugccaaggacauucccaa

SEQ ID NO: 422500 - RNA, 21 nt, Human
ugaugccaaggacauucccaa

SEQ ID NO: 422501 - RNA, 21 nt, Human
ugaugccaaggacauucccaa

SEQ ID NO: 422502 - RNA, 21 nt, Human
ugcaaagcgcucaccuacucu

SEQ ID NO: 422503 - RNA, 20 nt, Human
ugcacacuaugggaucuaug

SEQ ID NO: 422504 - RNA, 22 nt, Human
ugcacacuaugggaucuaugca

SEQ ID NO: 422505 - RNA, 22 nt, Human
ugcacaucacacacagucaccc

SEQ ID NO: 422506 - RNA, 27 nt, Human
ugcacuaccugaagaugccacccuauu

SEQ ID NO: 422507 - RNA, 23 nt, Human
ugcagcgcccuacggggcucccu

SEQ ID NO: 422508 - RNA, 23 nt, Human
ugcagcgcccuacggggcucccu

SEQ ID NO: 422509 - RNA, 23 nt, Human
ugcagcgcccuacggggcucccu

SEQ ID NO: 422510 - RNA, 21 nt, Human
ugcauuacucuaaaucaaagc

SEQ ID NO: 422511 - RNA, 22 nt, Human
ugcauuuggaaaggaaaagugc

SEQ ID NO: 422512 - RNA, 18 nt, Human
ugccaaggaauccugagg

SEQ ID NO: 422513 - RNA, 18 nt, Human
ugccaaggaauccugagg

SEQ ID NO: 422514 - RNA, 18 nt, Human
ugccaaggaauccugagg

SEQ ID NO: 422515 - RNA, 18 nt, Human
ugccaaggaauccugagg

SEQ ID NO: 422516 - RNA, 18 nt, Human
ugccaaggaauccugagg

SEQ ID NO: 422517 - RNA, 18 nt, Human
ugccaaggaauccugagg

SEQ ID NO: 422518 - RNA, 19 nt, Human
ugccacagaaaauuuaaca

SEQ ID NO: 422519 - RNA, 19 nt, Human
ugccacagaaaauuuaaca

SEQ ID NO: 422520 - RNA, 19 nt, Human
ugccacagaaaauuuaaca

SEQ ID NO: 422521 - RNA, 19 nt, Human
ugccacccuauuacaaugg

SEQ ID NO: 422522 - RNA, 22 nt, Human
ugcccccuucucagggugcucc

SEQ ID NO: 422523 - RNA, 22 nt, Human
ugcccccuucucagggugcucc

SEQ ID NO: 422524 - RNA, 22 nt, Human
ugcccccuucucagggugcucc

SEQ ID NO: 422525 - RNA, 23 nt, Human
ugccccggucccccuccauguac

SEQ ID NO: 422526 - RNA, 23 nt, Human
ugccccggucccccuccauguac

SEQ ID NO: 422527 - RNA, 23 nt, Human
ugccccggucccccuccauguac

SEQ ID NO: 422528 - RNA, 23 nt, Human
ugccuaggccagggagacugagc

SEQ ID NO: 422529 - RNA, 18 nt, Human
ugccucacuacccuguuc

SEQ ID NO: 422530 - RNA, 19 nt, Human
ugccugaagaguuuccccc

SEQ ID NO: 422531 - RNA, 19 nt, Human
ugccugaagaguuuccccc

SEQ ID NO: 422532 - RNA, 19 nt, Human
ugccugaagaguuuccccc

SEQ ID NO: 422533 - RNA, 23 nt, Human
ugccuguaaucccagcacuuugg

SEQ ID NO: 422534 - RNA, 23 nt, Human
ugccuguaaucccagcacuuugg

SEQ ID NO: 422535 - RNA, 24 nt, Human
ugccuguaaucccagcacuuuggg

SEQ ID NO: 422536 - RNA, 23 nt, Human
ugcgaaggggacccagccagcca

SEQ ID NO: 422537 - RNA, 23 nt, Human
ugcgaaggggacccagccagcca

SEQ ID NO: 422538 - RNA, 23 nt, Human
ugcgaaggggacccagccagcca

SEQ ID NO: 422539 - RNA, 29 nt, Human
ugcuccugacagcauggcucucacacugc

SEQ ID NO: 422540 - RNA, 25 nt, Human
ugcugaggauggcucaguggugggg

SEQ ID NO: 422541 - RNA, 25 nt, Human
ugcugaggauggcucaguggugggg

SEQ ID NO: 422542 - RNA, 25 nt, Human
ugcugaggauggcucaguggugggg

SEQ ID NO: 422543 - RNA, 19 nt, Human
ugcugggguccccggggcc

SEQ ID NO: 422544 - RNA, 19 nt, Human
ugcugggguccccggggcc

SEQ ID NO: 422545 - RNA, 19 nt, Human
ugcugggguccccggggcc

SEQ ID NO: 422546 - RNA, 21 nt, Human
ugcuguaauuucaaaugaaau

SEQ ID NO: 422547 - RNA, 20 nt, Human
ugcuucaucuaugucuucuc

SEQ ID NO: 422548 - RNA, 21 nt, Human
uggaaaaaucugaacauaaac

SEQ ID NO: 422549 - RNA, 24 nt, Human
uggaaaagacccaguaauuuaaac

SEQ ID NO: 422550 - RNA, 24 nt, Human
uggaaccaaggaggcggagguugc

SEQ ID NO: 422551 - RNA, 21 nt, Human
uggaauuaaaauaagucacuc

SEQ ID NO: 422552 - RNA, 22 nt, Human
uggaucacgaggucaggaguuc

SEQ ID NO: 422553 - RNA, 18 nt, Human
uggcaaaagacuauaauu

SEQ ID NO: 422554 - RNA, 22 nt, Human
uggcaacggcaaaaaauuuagg

SEQ ID NO: 422555 - RNA, 22 nt, Human
uggcaagaagcuugaaagaagg

SEQ ID NO: 422556 - RNA, 20 nt, Human
uggcaagucucaacucucua

SEQ ID NO: 422557 - RNA, 20 nt, Human
uggcaagucucaacucucua

SEQ ID NO: 422558 - RNA, 20 nt, Human
uggcaagucucaacucucua

SEQ ID NO: 422559 - RNA, 18 nt, Human
uggcagagggcacaugug

SEQ ID NO: 422560 - RNA, 18 nt, Human
uggcagagggcacaugug

SEQ ID NO: 422561 - RNA, 18 nt, Human
uggcagagggcacaugug

SEQ ID NO: 422562 - RNA, 23 nt, Human
uggcagugagcaccaaugcugcc

SEQ ID NO: 422563 - RNA, 24 nt, Human
uggccaauauggcgaaacccuguc

SEQ ID NO: 422564 - RNA, 25 nt, Human
uggccagagugaggccagguggcug

SEQ ID NO: 422565 - RNA, 18 nt, Human
uggcccuguuuccaaccu

SEQ ID NO: 422566 - RNA, 21 nt, Human
uggcggcucgagcuggguccu

SEQ ID NO: 422567 - RNA, 21 nt, Human
uggcggcucgagcuggguccu

SEQ ID NO: 422568 - RNA, 21 nt, Human
uggcggcucgagcuggguccu

SEQ ID NO: 422569 - RNA, 21 nt, Human
uggcggcucgagcuggguccu

SEQ ID NO: 422570 - RNA, 23 nt, Human
uggcggcucgagcuggguccucc

SEQ ID NO: 422571 - RNA, 23 nt, Human
uggcggcucgagcuggguccucc

SEQ ID NO: 422572 - RNA, 23 nt, Human
uggcggcucgagcuggguccucc

SEQ ID NO: 422573 - RNA, 23 nt, Human
uggcggcucgagcuggguccucc

SEQ ID NO: 422574 - RNA, 21 nt, Human
uggcucacaccugcaauucca

SEQ ID NO: 422575 - RNA, 22 nt, Human
uggcucaugccuguaaucccag

SEQ ID NO: 422576 - RNA, 24 nt, Human
uggcucaugccuguaaucccagca

SEQ ID NO: 422577 - RNA, 19 nt, Human
uggcugacuucuaaugcau

SEQ ID NO: 422578 - RNA, 24 nt, Human
uggcuuacgccuguaaucccagca

SEQ ID NO: 422579 - RNA, 20 nt, Human
ugggaaaagccuacgcuaca

SEQ ID NO: 422580 - RNA, 25 nt, Human
ugggagaaguuagagucugaacugg

SEQ ID NO: 422581 - RNA, 25 nt, Human
ugggagaaguuagagucugaacugg

SEQ ID NO: 422582 - RNA, 25 nt, Human
ugggagaaguuagagucugaacugg

SEQ ID NO: 422583 - RNA, 24 nt, Human
ugggaggcugaggcgagcggauca

SEQ ID NO: 422584 - RNA, 19 nt, Human
ugggaucuaugcaucaccu

SEQ ID NO: 422585 - RNA, 21 nt, Human
ugggcaagugacagcggggcc

SEQ ID NO: 422586 - RNA, 21 nt, Human
ugggcaagugacagcggggcc

SEQ ID NO: 422587 - RNA, 21 nt, Human
ugggcaagugacagcggggcc

SEQ ID NO: 422588 - RNA, 20 nt, Human
uggggacccugaugggagaa

SEQ ID NO: 422589 - RNA, 20 nt, Human
uggggacccugaugggagaa

SEQ ID NO: 422590 - RNA, 20 nt, Human
uggggacccugaugggagaa

SEQ ID NO: 422591 - RNA, 23 nt, Human
uggugcccccuucucagggugcu

SEQ ID NO: 422592 - RNA, 23 nt, Human
uggugcccccuucucagggugcu

SEQ ID NO: 422593 - RNA, 23 nt, Human
uggugcccccuucucagggugcu

SEQ ID NO: 422594 - RNA, 24 nt, Human
ugguggcagccgcuuguaguccca

SEQ ID NO: 422595 - RNA, 18 nt, Human
uguaaagaaggaagcuga

SEQ ID NO: 422596 - RNA, 19 nt, Human
uguagaacuggaccuuuua

SEQ ID NO: 422597 - RNA, 19 nt, Human
uguagaacuggaccuuuua

SEQ ID NO: 422598 - RNA, 19 nt, Human
uguagaacuggaccuuuua

SEQ ID NO: 422599 - RNA, 22 nt, Human
uguauuuaauuucugacggggc

SEQ ID NO: 422600 - RNA, 22 nt, Human
uguauuuaauuucugacggggc

SEQ ID NO: 422601 - RNA, 22 nt, Human
uguauuuaauuucugacggggc

SEQ ID NO: 422602 - RNA, 19 nt, Human
uguccaaacaucacaaaau

SEQ ID NO: 422603 - RNA, 21 nt, Human
uguccgagaccugcagcagca

SEQ ID NO: 422604 - RNA, 23 nt, Human
uguccuggcggcucgagcugggu

SEQ ID NO: 422605 - RNA, 23 nt, Human
uguccuggcggcucgagcugggu

SEQ ID NO: 422606 - RNA, 23 nt, Human
uguccuggcggcucgagcugggu

SEQ ID NO: 422607 - RNA, 23 nt, Human
uguccuggcggcucgagcugggu

SEQ ID NO: 422608 - RNA, 20 nt, Human
ugucuacaaugagaaaaaca

SEQ ID NO: 422609 - RNA, 21 nt, Human
uguggaagauggucugaagug

SEQ ID NO: 422610 - RNA, 22 nt, Human
uguggaccucaaacagcaauuc

SEQ ID NO: 422611 - RNA, 19 nt, Human
uguggcgguaacgcugagg

SEQ ID NO: 422612 - RNA, 19 nt, Human
uguggcgguaacgcugagg

SEQ ID NO: 422613 - RNA, 19 nt, Human
uguggcgguaacgcugagg

SEQ ID NO: 422614 - RNA, 19 nt, Human
uguggcgguaacgcugagg

SEQ ID NO: 422615 - RNA, 19 nt, Human
uguguggaagauggucuga

SEQ ID NO: 422616 - RNA, 20 nt, Human
uguucucucccucccuccca

SEQ ID NO: 422617 - RNA, 20 nt, Human
uguucucucccucccuccca

SEQ ID NO: 422618 - RNA, 20 nt, Human
uguucucucccucccuccca

SEQ ID NO: 422619 - RNA, 19 nt, Human
uguuuuuaauacaaaaaua

SEQ ID NO: 422620 - RNA, 19 nt, Human
uguuuuuaauacaaaaaua

SEQ ID NO: 422621 - RNA, 19 nt, Human
uguuuuuaauacaaaaaua

SEQ ID NO: 422622 - RNA, 22 nt, Human
uuaaaauaagcaagaccccgcc

SEQ ID NO: 422623 - RNA, 24 nt, Human
uuaaacaaaaaacacaaaaucaga

SEQ ID NO: 422624 - RNA, 18 nt, Human
uuaacaaauucucccuuu

SEQ ID NO: 422625 - RNA, 18 nt, Human
uuaacaaauucucccuuu

SEQ ID NO: 422626 - RNA, 18 nt, Human
uuaacaaauucucccuuu

SEQ ID NO: 422627 - RNA, 21 nt, Human
uuacaggucacaaaaccacgg

SEQ ID NO: 422628 - RNA, 21 nt, Human
uuacaggucacaaaaccacgg

SEQ ID NO: 422629 - RNA, 21 nt, Human
uuacaggucacaaaaccacgg

SEQ ID NO: 422630 - RNA, 21 nt, Human
uuacgccuguaaucccagcau

SEQ ID NO: 422631 - RNA, 23 nt, Human
uuacucuacugacuaacaaacag

SEQ ID NO: 422632 - RNA, 23 nt, Human
uuacucuacugacuaacaaacag

SEQ ID NO: 422633 - RNA, 23 nt, Human
uuacucuacugacuaacaaacag

SEQ ID NO: 422634 - RNA, 19 nt, Human
uuacugcacuccagccugg

SEQ ID NO: 422635 - RNA, 20 nt, Human
uuacugcacuccagccuggc

SEQ ID NO: 422636 - RNA, 21 nt, Human
uuagagucugaacuggaaagc

SEQ ID NO: 422637 - RNA, 21 nt, Human
uuagagucugaacuggaaagc

SEQ ID NO: 422638 - RNA, 22 nt, Human
uuagagucugaacuggaaagca

SEQ ID NO: 422639 - RNA, 23 nt, Human
uuagcacaaaucucuaaacauaa

SEQ ID NO: 422640 - RNA, 19 nt, Human
uuaucaucuccucauaaac

SEQ ID NO: 422641 - RNA, 22 nt, Human
uucagaguggcaagccgcagag

SEQ ID NO: 422642 - RNA, 24 nt, Human
uucaggaaaccaggagaugguccu

SEQ ID NO: 422643 - RNA, 19 nt, Human
uucauuuucugaauauuug

SEQ ID NO: 422644 - RNA, 19 nt, Human
uucauuuucugaauauuug

SEQ ID NO: 422645 - RNA, 19 nt, Human
uucauuuucugaauauuug

SEQ ID NO: 422646 - RNA, 24 nt, Human
uucccagcccugcagucauugcag

SEQ ID NO: 422647 - RNA, 24 nt, Human
uucccagcccugcagucauugcag

SEQ ID NO: 422648 - RNA, 24 nt, Human
uucccagcccugcagucauugcag

SEQ ID NO: 422649 - RNA, 22 nt, Human
uuccccagucccugagcacccc

SEQ ID NO: 422650 - RNA, 26 nt, Human
uuccuucacaggccuuugucaugcaa

SEQ ID NO: 422651 - RNA, 19 nt, Human
uucucccuuucugaugucc

SEQ ID NO: 422652 - RNA, 19 nt, Human
uucucccuuucugaugucc

SEQ ID NO: 422653 - RNA, 19 nt, Human
uucucccuuucugaugucc

SEQ ID NO: 422654 - RNA, 21 nt, Human
uucuggccuccgggaaagccc

SEQ ID NO: 422655 - RNA, 21 nt, Human
uucuggccuccgggaaagccc

SEQ ID NO: 422656 - RNA, 21 nt, Human
uucuggccuccgggaaagccc

SEQ ID NO: 422657 - RNA, 25 nt, Human
uugagaauaaaaaucagaaacuggu

SEQ ID NO: 422658 - RNA, 29 nt, Human
uugauucucgccaugcacuccuccucguc

SEQ ID NO: 422659 - RNA, 29 nt, Human
uugauucucgccaugcacuccuccucguc

SEQ ID NO: 422660 - RNA, 29 nt, Human
uugauucucgccaugcacuccuccucguc

SEQ ID NO: 422661 - RNA, 18 nt, Human
uugcagugagccgagauu

SEQ ID NO: 422662 - RNA, 19 nt, Human
uugcagugagccgagauug

SEQ ID NO: 422663 - RNA, 22 nt, Human
uugcagugagccgagauugugc

SEQ ID NO: 422664 - RNA, 24 nt, Human
uugcuccuagaccaucuuuggggc

SEQ ID NO: 422665 - RNA, 18 nt, Human
uugcucugcgccgccucg

SEQ ID NO: 422666 - RNA, 24 nt, Human
uugcuggaaccaaggaggcggagg

SEQ ID NO: 422667 - RNA, 19 nt, Human
uugcuggggacccugaugg

SEQ ID NO: 422668 - RNA, 19 nt, Human
uugcuggggacccugaugg

SEQ ID NO: 422669 - RNA, 19 nt, Human
uugcuggggacccugaugg

SEQ ID NO: 422670 - RNA, 21 nt, Human
uuggacaccauuuggucauuu

SEQ ID NO: 422671 - RNA, 25 nt, Human
uugggaggcugaggcgagcggauca

SEQ ID NO: 422672 - RNA, 19 nt, Human
uugggauggcaaacuucug

SEQ ID NO: 422673 - RNA, 19 nt, Human
uugggauggcaaacuucug

SEQ ID NO: 422674 - RNA, 19 nt, Human
uugggauggcaaacuucug

SEQ ID NO: 422675 - RNA, 23 nt, Human
uuguccauuucaugaaucugagu

SEQ ID NO: 422676 - RNA, 18 nt, Human
uuuaaaggaccaaagcca

SEQ ID NO: 422677 - RNA, 20 nt, Human
uuuaagaacuaugaaacugc

SEQ ID NO: 422678 - RNA, 21 nt, Human
uuuagcaaaaauauauugaga

SEQ ID NO: 422679 - RNA, 21 nt, Human
uuucaaggggaguucuguaaa

SEQ ID NO: 422680 - RNA, 21 nt, Human
uuucaaggggaguucuguaaa

SEQ ID NO: 422681 - RNA, 21 nt, Human
uuucaaggggaguucuguaaa

SEQ ID NO: 422682 - RNA, 20 nt, Human
uuucaugccaaagcaaaauu

SEQ ID NO: 422683 - RNA, 26 nt, Human
uuucuaccugcuaauuacagucaauu

SEQ ID NO: 422684 - RNA, 23 nt, Human
uuucuuaggacacuuugggagaa

SEQ ID NO: 422685 - RNA, 23 nt, Human
uuucuuaggacacuuugggagaa

SEQ ID NO: 422686 - RNA, 23 nt, Human
uuucuuaggacacuuugggagaa

SEQ ID NO: 422687 - RNA, 21 nt, Human
uuuguguuuugcuucacauua

SEQ ID NO: 422688 - RNA, 21 nt, Human
uuuguguuuugcuucacauua

SEQ ID NO: 422689 - RNA, 21 nt, Human
uuuguguuuugcuucacauua

SEQ ID NO: 422690 - RNA, 19 nt, Human
uuuuaaaugcuauuuuccc

SEQ ID NO: 422691 - RNA, 19 nt, Human
uuuuaaaugcuauuuuccc

SEQ ID NO: 422692 - RNA, 19 nt, Human
uuuuaaaugcuauuuuccc

SEQ ID NO: 422693 - RNA, 23 nt, Human
uuuuacacuggagagccaccucc

SEQ ID NO: 422694 - RNA, 23 nt, Human
uuuucaccaaaagccuuucaaga

SEQ ID NO: 422695 - RNA, 20 nt, Human
uuuuccacacugaguuacca

SEQ ID NO: 422696 - RNA, 20 nt, Human
uuuuccacacugaguuacca

SEQ ID NO: 422697 - RNA, 20 nt, Human
uuuuccacacugaguuacca

SEQ ID NO: 422698 - RNA, 20 nt, Human
uuuuccacacugaguuacca

SEQ ID NO: 422699 - RNA, 20 nt, Human
uuuugaggaaauaaacacug

SEQ ID NO: 422700 - RNA, 22 nt, Human
uuuugcucugcgccgccucguc

SEQ ID NO: 422701 - RNA, 22 nt, Human
uuuugcucugcgccgccucguc

SEQ ID NO: 422702 - RNA, 23 nt, Human
uuuugggagggugaggcgggugg

SEQ ID NO: 422703 - RNA, 19 nt, Human
uuuuuuuuuuuuuuuuuug

SEQ ID NO: 422704 - RNA, 20 nt, Human
uuuuuuuuuuuuuuuuuugg

SEQ ID NO: 422705 - RNA, 20 nt, Human
aaaaaaccaaaaacagucca

SEQ ID NO: 422706 - RNA, 20 nt, Human
aaaaaaggcagagaauagug

SEQ ID NO: 422707 - RNA, 21 nt, Human
aaaaaccaaaaacaguccaug

SEQ ID NO: 422708 - RNA, 22 nt, Human
aaaaaugaaaauaaauaaagga

SEQ ID NO: 422709 - RNA, 21 nt, Human
aaacaaaaaaccaaaaacagu

SEQ ID NO: 422710 - RNA, 24 nt, Human
aaacaaaaaaccaaaaacagucca

SEQ ID NO: 422711 - RNA, 24 nt, Human
aaacaaaaaccagacaccaccaac

SEQ ID NO: 422712 - RNA, 21 nt, Human
aaacacaaguacacaaaucua

SEQ ID NO: 422713 - RNA, 21 nt, Human
aaaccaaaaacaguccauguu

SEQ ID NO: 422714 - RNA, 22 nt, Human
aaagaccaagggaauuuaaccc

SEQ ID NO: 422715 - RNA, 24 nt, Human
aaagaccaagggaauuuaacccuc

SEQ ID NO: 422716 - RNA, 23 nt, Human
aacaaaaaaccaaaaacagucca

SEQ ID NO: 422717 - RNA, 26 nt, Human
aacacaaguacacaaaucuaucuccu

SEQ ID NO: 422718 - RNA, 21 nt, Human
aaccaaaucaaacaaaaacca

SEQ ID NO: 422719 - RNA, 20 nt, Human
aaccaaggaacacaucuuag

SEQ ID NO: 422720 - RNA, 22 nt, Human
aaccgagcuaggccgcaugaaa

SEQ ID NO: 422721 - RNA, 19 nt, Human
aaccucguuaucacauccc

SEQ ID NO: 422722 - RNA, 22 nt, Human
aagaagaaaccaggcaggaaaa

SEQ ID NO: 422723 - RNA, 23 nt, Human
aagaaucccaaaccaaccaaauc

SEQ ID NO: 422724 - RNA, 24 nt, Human
aagaggaaggcucgggagguggga

SEQ ID NO: 422725 - RNA, 19 nt, Human
aagcacaauaaaaggcaag

SEQ ID NO: 422726 - RNA, 18 nt, Human
aaggcaagaaaagaccaa

SEQ ID NO: 422727 - RNA, 23 nt, Human
aauccagccaaaacaauagugca

SEQ ID NO: 422728 - RNA, 24 nt, Human
acaaaagaaucccaaaccaaccaa

SEQ ID NO: 422729 - RNA, 24 nt, Human
acaaaauauuuccuuggccuaaaa

SEQ ID NO: 422730 - RNA, 20 nt, Human
acaacaaacagacaucuaga

SEQ ID NO: 422731 - RNA, 23 nt, Human
acaaguacacaaaucuaucuccu

SEQ ID NO: 422732 - RNA, 25 nt, Human
acacaaguacacaaaucuaucuccu

SEQ ID NO: 422733 - RNA, 23 nt, Human
acagcaaaaacauuucuuuuuca

SEQ ID NO: 422734 - RNA, 22 nt, Human
acagcccccucggccuccgccu

SEQ ID NO: 422735 - RNA, 19 nt, Human
acccagaacaccaucacaa

SEQ ID NO: 422736 - RNA, 19 nt, Human
accgaaaaaaaaaaaucau

SEQ ID NO: 422737 - RNA, 20 nt, Human
acggccgggccgggccgggc

SEQ ID NO: 422738 - RNA, 20 nt, Human
acugccaaagacagcuguca

SEQ ID NO: 422739 - RNA, 19 nt, Human
acuggauuaacaaggaguu

SEQ ID NO: 422740 - RNA, 24 nt, Human
acuuuugcuuuauacaaccaagga

SEQ ID NO: 422741 - RNA, 24 nt, Human
agaaauaaauaggaaaaaaaaggc

SEQ ID NO: 422742 - RNA, 19 nt, Human
agaaaucuugcauggagac

SEQ ID NO: 422743 - RNA, 24 nt, Human
agaacaccaucacaaaauauuucc

SEQ ID NO: 422744 - RNA, 18 nt, Human
agaagaaaccaggcagga

SEQ ID NO: 422745 - RNA, 21 nt, Human
agaagugagccuaccuacugc

SEQ ID NO: 422746 - RNA, 19 nt, Human
agaaucccaaaccaaccaa

SEQ ID NO: 422747 - RNA, 25 nt, Human
agaggaacaggagugcuguacugag

SEQ ID NO: 422748 - RNA, 19 nt, Human
agaggaaggcucgggaggu

SEQ ID NO: 422749 - RNA, 22 nt, Human
agcccauggagaaacaagucuc

SEQ ID NO: 422750 - RNA, 19 nt, Human
agcuaugguggaagugugc

SEQ ID NO: 422751 - RNA, 19 nt, Human
aggaaaaaaaaggcagaga

SEQ ID NO: 422752 - RNA, 22 nt, Human
aggaaaaaaaaggcagagaaua

SEQ ID NO: 422753 - RNA, 21 nt, Human
aggaaggcucgggagguggga

SEQ ID NO: 422754 - RNA, 18 nt, Human
aggaggaggcggaaccga

SEQ ID NO: 422755 - RNA, 19 nt, Human
aggaggaggcggaaccgag

SEQ ID NO: 422756 - RNA, 22 nt, Human
aggaggaggcggaaccgagcua

SEQ ID NO: 422757 - RNA, 20 nt, Human
aggcacggugaauaccaagg

SEQ ID NO: 422758 - RNA, 20 nt, Human
aggcacggugaauaccaagg

SEQ ID NO: 422759 - RNA, 20 nt, Human
aggcccggaguggggcuggg

SEQ ID NO: 422760 - RNA, 24 nt, Human
aguguaaguuaaauggugguuuuu

SEQ ID NO: 422761 - RNA, 26 nt, Human
auagagcccuucucuaagccuaugaa

SEQ ID NO: 422762 - RNA, 23 nt, Human
auagugcaaaaaguuacaaagca

SEQ ID NO: 422763 - RNA, 20 nt, Human
auagugccauuuucccccaa

SEQ ID NO: 422764 - RNA, 18 nt, Human
augaacugguuucccauu

SEQ ID NO: 422765 - RNA, 20 nt, Human
auggagacuacaagucugga

SEQ ID NO: 422766 - RNA, 22 nt, Human
auuuggauguucauaauuguuc

SEQ ID NO: 422767 - RNA, 23 nt, Human
caaaauauuuccuuggccuaaaa

SEQ ID NO: 422768 - RNA, 20 nt, Human
caaacaaaaaccagacacca

SEQ ID NO: 422769 - RNA, 24 nt, Human
caaacagacaucuagaucaaccca

SEQ ID NO: 422770 - RNA, 21 nt, Human
caaagcaacaaucucuugggc

SEQ ID NO: 422771 - RNA, 20 nt, Human
cacaaaagaaucccaaacca

SEQ ID NO: 422772 - RNA, 26 nt, Human
cacaaaagaaucccaaaccaaccaaa

SEQ ID NO: 422773 - RNA, 24 nt, Human
cacaaguacacaaaucuaucuccu

SEQ ID NO: 422774 - RNA, 22 nt, Human
caccaccaacugcuucugccug

SEQ ID NO: 422775 - RNA, 23 nt, Human
caccaccaacugcuucugccugc

SEQ ID NO: 422776 - RNA, 19 nt, Human
cacuuggaacauagccacg

SEQ ID NO: 422777 - RNA, 23 nt, Human
cacuuggaacauagccacguucu

SEQ ID NO: 422778 - RNA, 23 nt, Human
cagacaucuagaucaacccagca

SEQ ID NO: 422779 - RNA, 20 nt, Human
cagacugccaaagacagcug

SEQ ID NO: 422780 - RNA, 20 nt, Human
cagccaaaacaauagugcaa

SEQ ID NO: 422781 - RNA, 22 nt, Human
caggaaaaugccaauaaugaug

SEQ ID NO: 422782 - RNA, 26 nt, Human
cauacaacaaacagacaucuagauca

SEQ ID NO: 422783 - RNA, 20 nt, Human
cauccuuaacuuucccuuuc

SEQ ID NO: 422784 - RNA, 26 nt, Human
caucuccaucuuguuuuuauuaggga

SEQ ID NO: 422785 - RNA, 23 nt, Human
cauguuaaugcugauuaaaaaac

SEQ ID NO: 422786 - RNA, 19 nt, Human
cauucuaaccccccggccg

SEQ ID NO: 422787 - RNA, 24 nt, Human
cauucuaaccccccggccguguca

SEQ ID NO: 422788 - RNA, 22 nt, Human
cauuuuugcuuuaauaaggcag

SEQ ID NO: 422789 - RNA, 24 nt, Human
ccaaccaaaucaaacaaaaaccag

SEQ ID NO: 422790 - RNA, 21 nt, Human
ccaauaaugaugauuggcgaa

SEQ ID NO: 422791 - RNA, 19 nt, Human
ccacaaaagaaucccaaac

SEQ ID NO: 422792 - RNA, 22 nt, Human
ccagaacaccaucacaaaauau

SEQ ID NO: 422793 - RNA, 21 nt, Human
ccagccaaaacaauagugcaa

SEQ ID NO: 422794 - RNA, 24 nt, Human
ccagcucaaaccgaaaaaaaaaaa

SEQ ID NO: 422795 - RNA, 23 nt, Human
cccccaaaauuuccauacaacaa

SEQ ID NO: 422796 - RNA, 18 nt, Human
ccccgcgccggacgccuc

SEQ ID NO: 422797 - RNA, 21 nt, Human
cccuccacaaaagaaucccaa

SEQ ID NO: 422798 - RNA, 19 nt, Human
ccgagggacgggggucgcc

SEQ ID NO: 422799 - RNA, 23 nt, Human
ccgccauuuccgaugaguuucug

SEQ ID NO: 422800 - RNA, 31 nt, Human
ccgccgccgccgccucucccgccgccgccgg

SEQ ID NO: 422801 - RNA, 28 nt, Human
ccgccgccgccgccucucccgccgccgg

SEQ ID NO: 422802 - RNA, 19 nt, Human
ccgccgccgccucucccgc

SEQ ID NO: 422803 - RNA, 19 nt, Human
ccgccgccgccucucccgc

SEQ ID NO: 422804 - RNA, 18 nt, Human
ccgcgccgccgcugcugc

SEQ ID NO: 422805 - RNA, 24 nt, Human
ccgcugcugccagagaggagccug

SEQ ID NO: 422806 - RNA, 22 nt, Human
ccggaguggggcuggggugcgg

SEQ ID NO: 422807 - RNA, 18 nt, Human
ccgggccgggcgugcugc

SEQ ID NO: 422808 - RNA, 27 nt, Human
ccuccgugcuggccgccgccgccgccu

SEQ ID NO: 422809 - RNA, 23 nt, Human
ccucucccgccgccgccgcgcac

SEQ ID NO: 422810 - RNA, 24 nt, Human
ccugcaugaacugguuucccauuu

SEQ ID NO: 422811 - RNA, 20 nt, Human
cgccgccgccgccucucccg

SEQ ID NO: 422812 - RNA, 22 nt, Human
cgccgccgcgcacaaagccccc

SEQ ID NO: 422813 - RNA, 19 nt, Human
cgccucuccgcggcgaccu

SEQ ID NO: 422814 - RNA, 18 nt, Human
cgcgaggaggaggcggaa

SEQ ID NO: 422815 - RNA, 18 nt, Human
cgcgccggacgccucugc

SEQ ID NO: 422816 - RNA, 26 nt, Human
cggcuggcagcccggccuggguagca

SEQ ID NO: 422817 - RNA, 20 nt, Human
cgggggucgccgcgccgccg

SEQ ID NO: 422818 - RNA, 22 nt, Human
cgugucagugcgaucacaggag

SEQ ID NO: 422819 - RNA, 22 nt, Human
cucagauuccuacuuaaaacac

SEQ ID NO: 422820 - RNA, 24 nt, Human
cucggccuccgccuccgugcuggc

SEQ ID NO: 422821 - RNA, 22 nt, Human
cugaggccaugaagauccgcaa

SEQ ID NO: 422822 - RNA, 23 nt, Human
cuggcagcccggccuggguagca

SEQ ID NO: 422823 - RNA, 26 nt, Human
cuguaugcacuguagcagucucuucu

SEQ ID NO: 422824 - RNA, 25 nt, Human
cuuuauuuaaaaacaaaaaaccaaa

SEQ ID NO: 422825 - RNA, 24 nt, Human
gaaaauaaauaaaggaaugauggc

SEQ ID NO: 422826 - RNA, 23 nt, Human
gaaacagccacgaugaaaugugc

SEQ ID NO: 422827 - RNA, 22 nt, Human
gaauaccaaggaaccaaggaga

SEQ ID NO: 422828 - RNA, 22 nt, Human
gacccagaacaccaucacaaaa

SEQ ID NO: 422829 - RNA, 20 nt, Human
gaccugugcacagcccccuc

SEQ ID NO: 422830 - RNA, 20 nt, Human
gagccugcggcuggcagccc

SEQ ID NO: 422831 - RNA, 22 nt, Human
gagccugcggcuggcagcccgg

SEQ ID NO: 422832 - RNA, 28 nt, Human
gauggcaaaggcuguaugccacagaggu

SEQ ID NO: 422833 - RNA, 18 nt, Human
gcaagaaaagaccaaggg

SEQ ID NO: 422834 - RNA, 19 nt, Human
gcaugaucuauuugcuuuu

SEQ ID NO: 422835 - RNA, 20 nt, Human
gccgagggacgggggucgcc

SEQ ID NO: 422836 - RNA, 21 nt, Human
gccgagggacgggggucgccg

SEQ ID NO: 422837 - RNA, 20 nt, Human
gcgcgaggaggaggcggaac

SEQ ID NO: 422838 - RNA, 21 nt, Human
gcggcgaccugugcacagccc

SEQ ID NO: 422839 - RNA, 23 nt, Human
gcgugcugcgggaagaggaaggc

SEQ ID NO: 422840 - RNA, 23 nt, Human
gcucaaaccgaaaaaaaaaaauc

SEQ ID NO: 422841 - RNA, 21 nt, Human
ggacccagaacaccaucacaa

SEQ ID NO: 422842 - RNA, 21 nt, Human
ggagagacacggaggcccgga

SEQ ID NO: 422843 - RNA, 23 nt, Human
ggcccggaguggggcuggggugc

SEQ ID NO: 422844 - RNA, 21 nt, Human
ggccggcacugaggagggcca

SEQ ID NO: 422845 - RNA, 25 nt, Human
ggcuggggugcgggcagccgcuggg

SEQ ID NO: 422846 - RNA, 18 nt, Human
gggaaggggaggccgagg

SEQ ID NO: 422847 - RNA, 26 nt, Human
gggaggccgagggacgggggucgccg

SEQ ID NO: 422848 - RNA, 26 nt, Human
gggccgggccgggcgugcugcgggaa

SEQ ID NO: 422849 - RNA, 18 nt, Human
gggcuggggugcgggcag

SEQ ID NO: 422850 - RNA, 23 nt, Human
gggcuggggugcgggcagccgcu

SEQ ID NO: 422851 - RNA, 26 nt, Human
gggcuggggugcgggcagccgcuggg

SEQ ID NO: 422852 - RNA, 23 nt, Human
guaauacaaauccagccaaaaca

SEQ ID NO: 422853 - RNA, 21 nt, Human
gugucagugcgaucacaggag

SEQ ID NO: 422854 - RNA, 23 nt, Human
guucagagucuugaagaagaaac

SEQ ID NO: 422855 - RNA, 23 nt, Human
uaaaaacaaaaaaccaaaaacag

SEQ ID NO: 422856 - RNA, 18 nt, Human
uaaaaggcaagaaaagac

SEQ ID NO: 422857 - RNA, 18 nt, Human
uaaagcaauuguucagag

SEQ ID NO: 422858 - RNA, 26 nt, Human
uaaagcuuaucauacccuuuccuaga

SEQ ID NO: 422859 - RNA, 20 nt, Human
uaaccccccggccgugucag

SEQ ID NO: 422860 - RNA, 21 nt, Human
uaacuuucccuuucucucauc

SEQ ID NO: 422861 - RNA, 22 nt, Human
uacagaaacagccacgaugaaa

SEQ ID NO: 422862 - RNA, 19 nt, Human
uagagggcuuucucagauu

SEQ ID NO: 422863 - RNA, 19 nt, Human
uaugaaaagcauuuugaag

SEQ ID NO: 422864 - RNA, 19 nt, Human
uauugccccccaauaaaau

SEQ ID NO: 422865 - RNA, 19 nt, Human
uauuucaacccacaguuug

SEQ ID NO: 422866 - RNA, 19 nt, Human
ucacuggauuaacaaggag

SEQ ID NO: 422867 - RNA, 21 nt, Human
ucaguguaaguuaaauggugg

SEQ ID NO: 422868 - RNA, 23 nt, Human
uccauagagcccuucucuaagcc

SEQ ID NO: 422869 - RNA, 21 nt, Human
ucccaaaccaaccaaaucaaa

SEQ ID NO: 422870 - RNA, 23 nt, Human
ucccauucuacaaguuuuucacu

SEQ ID NO: 422871 - RNA, 22 nt, Human
uccccgggcuagauuuuccccg

SEQ ID NO: 422872 - RNA, 30 nt, Human
uccuaaaaaugaaaauaaauaaaggaaugg

SEQ ID NO: 422873 - RNA, 22 nt, Human
uccuacuuaaaacacacacaca

SEQ ID NO: 422874 - RNA, 18 nt, Human
ucgccgcgccgccgcugc

SEQ ID NO: 422875 - RNA, 18 nt, Human
ucgccgcgccgccgcugc

SEQ ID NO: 422876 - RNA, 21 nt, Human
ucgccgcgccgccgcugcugc

SEQ ID NO: 422877 - RNA, 19 nt, Human
ucuccugaggccaugaaga

SEQ ID NO: 422878 - RNA, 18 nt, Human
ucugaaaaugcuagaaaa

SEQ ID NO: 422879 - RNA, 22 nt, Human
ucugagacuuccuuggugaagu

SEQ ID NO: 422880 - RNA, 20 nt, Human
ucuuugauuuguauucgauu

SEQ ID NO: 422881 - RNA, 21 nt, Human
ugaaaagcauuuugaagggaa

SEQ ID NO: 422882 - RNA, 19 nt, Human
ugaaaugugcagaucaggc

SEQ ID NO: 422883 - RNA, 21 nt, Human
ugaagaagaaaccaggcagga

SEQ ID NO: 422884 - RNA, 22 nt, Human
ugacaaaucuuugauuuguauu

SEQ ID NO: 422885 - RNA, 18 nt, Human
ugagccuaccuacugcuc

SEQ ID NO: 422886 - RNA, 21 nt, Human
ugcagagacaucuccaucuug

SEQ ID NO: 422887 - RNA, 19 nt, Human
ugcagcacaucuacauaug

SEQ ID NO: 422888 - RNA, 18 nt, Human
ugcaguccagaagagccc

SEQ ID NO: 422889 - RNA, 19 nt, Human
ugcaguccagaagagccca

SEQ ID NO: 422890 - RNA, 20 nt, Human
ugccaauaaugaugauuggc

SEQ ID NO: 422891 - RNA, 22 nt, Human
ugcgggaagaaauaaauaggaa

SEQ ID NO: 422892 - RNA, 21 nt, Human
uggaagugugcaguccagaag

SEQ ID NO: 422893 - RNA, 22 nt, Human
uggaauuugugcgggaagaaau

SEQ ID NO: 422894 - RNA, 21 nt, Human
uggagacuacaagucuggagu

SEQ ID NO: 422895 - RNA, 19 nt, Human
uggauguucauaauuguuc

SEQ ID NO: 422896 - RNA, 21 nt, Human
uggcagcccggccuggguagc

SEQ ID NO: 422897 - RNA, 19 nt, Human
ugggaaggggaggccgagg

SEQ ID NO: 422898 - RNA, 24 nt, Human
ugggaaggggaggccgagggacgg

SEQ ID NO: 422899 - RNA, 18 nt, Human
ugggaugggaaggggagg

SEQ ID NO: 422900 - RNA, 20 nt, Human
ugggaugggaaggggaggcc

SEQ ID NO: 422901 - RNA, 22 nt, Human
ugggaugggaaggggaggccga

SEQ ID NO: 422902 - RNA, 19 nt, Human
uggggugcgggcagccgcu

SEQ ID NO: 422903 - RNA, 22 nt, Human
uguaaguuaaauggugguuuuu

SEQ ID NO: 422904 - RNA, 20 nt, Human
uuaagcuguacccauccagc

SEQ ID NO: 422905 - RNA, 21 nt, Human
uucauugcugguguauggacc

SEQ ID NO: 422906 - RNA, 23 nt, Human
uuccauacaacaaacagacaucu

SEQ ID NO: 422907 - RNA, 23 nt, Human
uugaacuacacuucuugaaauuc

SEQ ID NO: 422908 - RNA, 18 nt, Human
uuguaauguauacaguuu

SEQ ID NO: 422909 - RNA, 26 nt, Human
uuuaacccuccacaaaagaaucccaa

SEQ ID NO: 422910 - RNA, 21 nt, Human
uuuaagcuguacccauccagc

SEQ ID NO: 422911 - RNA, 24 nt, Human
uuuccauacaacaaacagacaucu

SEQ ID NO: 422912 - RNA, 18 nt, Human
uuugaagggaaagagaag

SEQ ID NO: 422913 - RNA, 22 nt, Human
uuugcaauucaguugauuauug

SEQ ID NO: 422914 - RNA, 22 nt, Human
uuuguguuuuggauuuuuuccc

SEQ ID NO: 422915 - RNA, 22 nt, Human
aacacaugaaagguuaacaaag

SEQ ID NO: 422916 - RNA, 24 nt, Human
aagaaaaucuauaccaucaugcua

SEQ ID NO: 422917 - RNA, 21 nt, Human
aagcaggugguugagcaguuu

SEQ ID NO: 422918 - RNA, 24 nt, Human
aauaaugguaaggucaaaauauau

SEQ ID NO: 422919 - RNA, 22 nt, Human
acacugcucucccucuaguccu

SEQ ID NO: 422920 - RNA, 20 nt, Human
auacauacaaacaguauaaa

SEQ ID NO: 422921 - RNA, 22 nt, Human
caugaaagguuaacaaaggcua

SEQ ID NO: 422922 - RNA, 21 nt, Human
cccccagacaccauaaaugca

SEQ ID NO: 422923 - RNA, 20 nt, Human
cugauuucacacugcucucc

SEQ ID NO: 422924 - RNA, 22 nt, Human
cugcccccagacaccauaaaug

SEQ ID NO: 422925 - RNA, 24 nt, Human
cugucccaaagcacugaaacaaga

SEQ ID NO: 422926 - RNA, 18 nt, Human
cuugguguaacuuaaaac

SEQ ID NO: 422927 - RNA, 21 nt, Human
gcgugugcugccugagcuggg

SEQ ID NO: 422928 - RNA, 18 nt, Human
uaaagcaggugguugagc

SEQ ID NO: 422929 - RNA, 23 nt, Human
uaacaaaggcuaugaacuuggug

SEQ ID NO: 422930 - RNA, 23 nt, Human
uaacuuaaaacguuucagauguc

SEQ ID NO: 422931 - RNA, 20 nt, Human
uaguccuggagggcaaauac

SEQ ID NO: 422932 - RNA, 23 nt, Human
ucaacauuaacugcaccauccaa

SEQ ID NO: 422933 - RNA, 18 nt, Human
ucugacaauaaaaucuga

SEQ ID NO: 422934 - RNA, 20 nt, Human
ugaaaauaucugccaacuac

SEQ ID NO: 422935 - RNA, 21 nt, Human
ugaaacaagaaaaucuauacc

SEQ ID NO: 422936 - RNA, 21 nt, Human
ugauuucacacugcucucccu

SEQ ID NO: 422937 - RNA, 23 nt, Human
ugcaaaaaguucauacauuauau

SEQ ID NO: 422938 - RNA, 24 nt, Human
uucauacauuauauucccuauuuc

SEQ ID NO: 422939 - RNA, 22 nt, Human
uuccaggguagaaacagguccc

SEQ ID NO: 422940 - RNA, 23 nt, Human
aaaaauguccugggaaagacccu

SEQ ID NO: 422941 - RNA, 20 nt, Human
aaaagaccacaaagcagggc

SEQ ID NO: 422942 - RNA, 18 nt, Human
aaagacccuaacaguuuc

SEQ ID NO: 422943 - RNA, 24 nt, Human
aaagugcugggauuacaggcguga

SEQ ID NO: 422944 - RNA, 26 nt, Human
aaaucggaacccccgggacgcgccgg

SEQ ID NO: 422945 - RNA, 26 nt, Human
aagcagggcaaguugacaaaaggcaa

SEQ ID NO: 422946 - RNA, 19 nt, Human
aagugcugggauuacaggc

SEQ ID NO: 422947 - RNA, 19 nt, Human
aagugcugggauuacaggc

SEQ ID NO: 422948 - RNA, 26 nt, Human
aagugcugggauuacaggcgugagcc

SEQ ID NO: 422949 - RNA, 24 nt, Human
aauguuuuguauuuuuaguagaga

SEQ ID NO: 422950 - RNA, 21 nt, Human
acacccaccuccccccgcccc

SEQ ID NO: 422951 - RNA, 21 nt, Human
acagaaaaaaaaauguccugg

SEQ ID NO: 422952 - RNA, 23 nt, Human
acaggcacccaccaccacgcccg

SEQ ID NO: 422953 - RNA, 19 nt, Human
acccaccuccccccgcccc

SEQ ID NO: 422954 - RNA, 22 nt, Human
acccaccuccccccgccccgcc

SEQ ID NO: 422955 - RNA, 19 nt, Human
acccaggcuggagugcagu

SEQ ID NO: 422956 - RNA, 23 nt, Human
acuaggggggaaaaaagaggagg

SEQ ID NO: 422957 - RNA, 21 nt, Human
acugaaaucucugccaaccua

SEQ ID NO: 422958 - RNA, 18 nt, Human
acugcaagcuccgccucc

SEQ ID NO: 422959 - RNA, 18 nt, Human
agccuccagaguagcugg

SEQ ID NO: 422960 - RNA, 25 nt, Human
aggcuggagugcaguggcgcgaucu

SEQ ID NO: 422961 - RNA, 24 nt, Human
agggaagccuggggcauaauccag

SEQ ID NO: 422962 - RNA, 19 nt, Human
aguagagaugggguuucac

SEQ ID NO: 422963 - RNA, 18 nt, Human
aguagcugggacuacagg

SEQ ID NO: 422964 - RNA, 19 nt, Human
aguagcugggacuacaggc

SEQ ID NO: 422965 - RNA, 20 nt, Human
agugcaguggcgcgaucucg

SEQ ID NO: 422966 - RNA, 23 nt, Human
agugcaguggcgcgaucucggcu

SEQ ID NO: 422967 - RNA, 24 nt, Human
agugcaguggcgcgaucucggcuc

SEQ ID NO: 422968 - RNA, 18 nt, Human
agugcugggauuacaggc

SEQ ID NO: 422969 - RNA, 22 nt, Human
auaucaaaaagaccacaaagca

SEQ ID NO: 422970 - RNA, 23 nt, Human
augaggcuuggaaaacccacagc

SEQ ID NO: 422971 - RNA, 24 nt, Human
augggguuucacuguguuagccag

SEQ ID NO: 422972 - RNA, 23 nt, Human
caaaaagaccacaaagcagggca

SEQ ID NO: 422973 - RNA, 18 nt, Human
caaaaggcaaacaacagg

SEQ ID NO: 422974 - RNA, 24 nt, Human
caaagugcugggauuacaggcgug

SEQ ID NO: 422975 - RNA, 23 nt, Human
caacuaggggggaaaaaagagga

SEQ ID NO: 422976 - RNA, 19 nt, Human
caaguugacaaaaggcaaa

SEQ ID NO: 422977 - RNA, 26 nt, Human
caaguugacaaaaggcaaacaacagg

SEQ ID NO: 422978 - RNA, 18 nt, Human
cacccaccaccacgcccg

SEQ ID NO: 422979 - RNA, 21 nt, Human
cacccaccuccccccgccccg

SEQ ID NO: 422980 - RNA, 24 nt, Human
cacccaggcuggagugcaguggcg

SEQ ID NO: 422981 - RNA, 18 nt, Human
caccuccccccgccccgc

SEQ ID NO: 422982 - RNA, 22 nt, Human
cacgccauucuccugccucagc

SEQ ID NO: 422983 - RNA, 18 nt, Human
cacuguguuagccaggau

SEQ ID NO: 422984 - RNA, 19 nt, Human
cacuguguuagccaggaug

SEQ ID NO: 422985 - RNA, 24 nt, Human
cacuguguuagccaggaugaucuc

SEQ ID NO: 422986 - RNA, 24 nt, Human
cagaaaaaaaaauguccugggaaa

SEQ ID NO: 422987 - RNA, 24 nt, Human
cagaguagcugggacuacaggcac

SEQ ID NO: 422988 - RNA, 20 nt, Human
cagccucuucucggagcaac

SEQ ID NO: 422989 - RNA, 22 nt, Human
caggaaaagcugcucuaucuua

SEQ ID NO: 422990 - RNA, 21 nt, Human
caggcacccaccaccacgccc

SEQ ID NO: 422991 - RNA, 21 nt, Human
cagugggugaugagaagcaag

SEQ ID NO: 422992 - RNA, 22 nt, Human
ccaaagugcugggauuacaggc

SEQ ID NO: 422993 - RNA, 22 nt, Human
ccaaagugcugggauuacaggc

SEQ ID NO: 422994 - RNA, 24 nt, Human
ccaaagugcugggauuacaggcgu

SEQ ID NO: 422995 - RNA, 23 nt, Human
ccaacccgacccacagggaaaca

SEQ ID NO: 422996 - RNA, 24 nt, Human
ccagaguagcugggacuacaggca

SEQ ID NO: 422997 - RNA, 24 nt, Human
cccccgccccgcccccgggccccc

SEQ ID NO: 422998 - RNA, 22 nt, Human
cccccgggacgcgccggcaguc

SEQ ID NO: 422999 - RNA, 23 nt, Human
ccccgcccccgggcccccagguu

SEQ ID NO: 423000 - RNA, 23 nt, Human
ccccgccccgcccccgggccccc

SEQ ID NO: 423001 - RNA, 22 nt, Human
ccccgggcccccagguuuugac

SEQ ID NO: 423002 - RNA, 20 nt, Human
cccgcccccgggcccccagg

SEQ ID NO: 423003 - RNA, 18 nt, Human
cccgccccgcccccgggc

SEQ ID NO: 423004 - RNA, 18 nt, Human
ccgccccgcccccgggcc

SEQ ID NO: 423005 - RNA, 19 nt, Human
ccgcccgggacgcccgcga

SEQ ID NO: 423006 - RNA, 23 nt, Human
ccgcgcccggcccuauuuuuuga

SEQ ID NO: 423007 - RNA, 20 nt, Human
ccuauuuuuacuuugaucua

SEQ ID NO: 423008 - RNA, 21 nt, Human
ccugaccucgugauccgccug

SEQ ID NO: 423009 - RNA, 18 nt, Human
cgacccacagggaaacag

SEQ ID NO: 423010 - RNA, 23 nt, Human
cgcccgggacgcccgcgacgccc

SEQ ID NO: 423011 - RNA, 22 nt, Human
cgccggccgccgccgagccccc

SEQ ID NO: 423012 - RNA, 19 nt, Human
cgccucccggguucacgcc

SEQ ID NO: 423013 - RNA, 24 nt, Human
cgcucugucacccaggcuggagug

SEQ ID NO: 423014 - RNA, 22 nt, Human
cggccgccgccgagcccccucc

SEQ ID NO: 423015 - RNA, 24 nt, Human
cucagccuccagaguagcugggac

SEQ ID NO: 423016 - RNA, 25 nt, Human
cuccccccgccccgcccccgggccc

SEQ ID NO: 423017 - RNA, 21 nt, Human
cucccggguucacgccauucu

SEQ ID NO: 423018 - RNA, 24 nt, Human
cuccugaccucgugauccgccugc

SEQ ID NO: 423019 - RNA, 24 nt, Human
cucgcucugucacccaggcuggag

SEQ ID NO: 423020 - RNA, 23 nt, Human
cugccucagccuccagaguagcu

SEQ ID NO: 423021 - RNA, 23 nt, Human
cugcuucggccucccaaagugcu

SEQ ID NO: 423022 - RNA, 19 nt, Human
cugucacccaggcuggagu

SEQ ID NO: 423023 - RNA, 24 nt, Human
cuuggaaaacccacagcacagcug

SEQ ID NO: 423024 - RNA, 26 nt, Human
gaaaaaagaggagggaagaaggcggc

SEQ ID NO: 423025 - RNA, 18 nt, Human
gacccacagggaaacagc

SEQ ID NO: 423026 - RNA, 22 nt, Human
gaccucgugauccgccugcuuc

SEQ ID NO: 423027 - RNA, 22 nt, Human
gaccucgugauccgccugcuuc

SEQ ID NO: 423028 - RNA, 24 nt, Human
gaccucgugauccgccugcuucgg

SEQ ID NO: 423029 - RNA, 21 nt, Human
gagacggagucucgcucuguc

SEQ ID NO: 423030 - RNA, 19 nt, Human
gagggaagaaggcggcaau

SEQ ID NO: 423031 - RNA, 25 nt, Human
gaguagcugggacuacaggcaccca

SEQ ID NO: 423032 - RNA, 18 nt, Human
gauuacaggcgugagcca

SEQ ID NO: 423033 - RNA, 22 nt, Human
gauuacaggcgugagccaccgc

SEQ ID NO: 423034 - RNA, 22 nt, Human
gauuacaggcgugagccaccgc

SEQ ID NO: 423035 - RNA, 20 nt, Human
gcccccgggcccccagguuu

SEQ ID NO: 423036 - RNA, 19 nt, Human
gcccggcucggcccagcuc

SEQ ID NO: 423037 - RNA, 26 nt, Human
gcccugcgcgcccggcucggcccagc

SEQ ID NO: 423038 - RNA, 25 nt, Human
gccucccggguucacgccauucucc

SEQ ID NO: 423039 - RNA, 25 nt, Human
gcucugucacccaggcuggagugca

SEQ ID NO: 423040 - RNA, 19 nt, Human
gcuggagugcaguggcgcg

SEQ ID NO: 423041 - RNA, 20 nt, Human
ggcagaaaaaaaugucccgg

SEQ ID NO: 423042 - RNA, 20 nt, Human
gggcaugaaaaugggcuugu

SEQ ID NO: 423043 - RNA, 18 nt, Human
gggguuucacuguguuag

SEQ ID NO: 423044 - RNA, 21 nt, Human
gugggugaugagaagcaaggu

SEQ ID NO: 423045 - RNA, 18 nt, Human
uaaaacuacaauugcaaa

SEQ ID NO: 423046 - RNA, 22 nt, Human
uaauguauucuacugacaaugc

SEQ ID NO: 423047 - RNA, 24 nt, Human
uaauguuuuguauuuuuaguagag

SEQ ID NO: 423048 - RNA, 23 nt, Human
uacaggcgugagccaccgcgccc

SEQ ID NO: 423049 - RNA, 23 nt, Human
uaggggggaaaaaagaggaggga

SEQ ID NO: 423050 - RNA, 20 nt, Human
uaguagagaugggguuucac

SEQ ID NO: 423051 - RNA, 24 nt, Human
uaguagagaugggguuucacugug

SEQ ID NO: 423052 - RNA, 19 nt, Human
uauacaagcucauugggag

SEQ ID NO: 423053 - RNA, 24 nt, Human
ucacccaggcuggagugcaguggc

SEQ ID NO: 423054 - RNA, 18 nt, Human
ucacugcaagcuccgccu

SEQ ID NO: 423055 - RNA, 19 nt, Human
ucacugcaagcuccgccuc

SEQ ID NO: 423056 - RNA, 24 nt, Human
ucacugcaagcuccgccucccggg

SEQ ID NO: 423057 - RNA, 24 nt, Human
ucacuguguuagccaggaugaucu

SEQ ID NO: 423058 - RNA, 19 nt, Human
ucaguccaacccgacccac

SEQ ID NO: 423059 - RNA, 23 nt, Human
uccaacccgacccacagggaaac

SEQ ID NO: 423060 - RNA, 24 nt, Human
uccagaguagcugggacuacaggc

SEQ ID NO: 423061 - RNA, 24 nt, Human
ucccaaagugcugggauuacaggc

SEQ ID NO: 423062 - RNA, 21 nt, Human
ucccggguucacgccauucuc

SEQ ID NO: 423063 - RNA, 24 nt, Human
ucccggguucacgccauucuccug

SEQ ID NO: 423064 - RNA, 23 nt, Human
uccgcgccgcguccgcccgggac

SEQ ID NO: 423065 - RNA, 24 nt, Human
ucuccugccucagccuccagagua

SEQ ID NO: 423066 - RNA, 19 nt, Human
ucucgcucugucacccagg

SEQ ID NO: 423067 - RNA, 22 nt, Human
ucucgcucugucacccaggcug

SEQ ID NO: 423068 - RNA, 23 nt, Human
ucucgcucugucacccaggcugg

SEQ ID NO: 423069 - RNA, 24 nt, Human
ucucgcucugucacccaggcugga

SEQ ID NO: 423070 - RNA, 26 nt, Human
ucucgcucugucacccaggcuggagu

SEQ ID NO: 423071 - RNA, 27 nt, Human
ucucgcucugucacccaggcuggagug

SEQ ID NO: 423072 - RNA, 24 nt, Human
ucugucacccaggcuggagugcag

SEQ ID NO: 423073 - RNA, 21 nt, Human
ugauacagaaaaaaaaauguc

SEQ ID NO: 423074 - RNA, 26 nt, Human
ugauucaacuaggggggaaaaaagag

SEQ ID NO: 423075 - RNA, 24 nt, Human
ugccucagccuccagaguagcugg

SEQ ID NO: 423076 - RNA, 24 nt, Human
ugcugggauuacaggcgugagcca

SEQ ID NO: 423077 - RNA, 22 nt, Human
uggaaaacccacagcacagcug

SEQ ID NO: 423078 - RNA, 23 nt, Human
uggagugcaguggcgcgaucucg

SEQ ID NO: 423079 - RNA, 24 nt, Human
uggagugcaguggcgcgaucucgg

SEQ ID NO: 423080 - RNA, 19 nt, Human
ugggacuacaggcacccac

SEQ ID NO: 423081 - RNA, 21 nt, Human
ugggacuacaggcacccacca

SEQ ID NO: 423082 - RNA, 24 nt, Human
ugggacuacaggcacccaccacca

SEQ ID NO: 423083 - RNA, 18 nt, Human
ugggauuacaggcgugag
